United States Patent 11,866,728 (ENGINEERED RETRONS AND METHODS OF USE) - sequence listing, part 3

SEQ ID NO: 7031 - protein, 574 aa, unidentified
  source 1..574: note = Related to NZ_CP049872.1; note = Thermomonas sp.
MTTVSMQPCAHFRLADVRTVDQLARALGVPLQVFHEVIACQDPGLIYAMHSIPKRSQRNPDGFRVVWESRTEAVARSHKAAARRLDDFARRQEIGYPNPAVHGYVRGGSTRSNALPHCGARVVVRADIEDFFQTITLERVESAFRAIGIAPETAHSLALFSTINGKLPLGLPESPVVSNLVCLDLDRDLKALADRHGVKYTRYADDMTFSGNENLPSREEIRTVLLRHGFRLSDRKFKKSKRGQAHFVTGLSVSERDYPHVPRKLKRMLRLELHFCEKYGLATHAENRRESERKTYLRIDGMVNYVSFIERRKSAAIKGQWDRIRKKHLGSTLYARLAGKEIGDRFVVADETEFEVDGIGYLAICFVRLSNLEDVEKSLDLLLGDYLTKPGAKGNLDVLKKVGIHYADAHFDLRTMTLDLMTEYLQWSASICFSRLRTSDDYKEAYLRMFAELVKQEFVTSDGLRVEMLVENNDKIKLPALTQVCEAEYRRSESEDGRRPISLPSIRSVKKSEIRSLTLADFVLAAFRAYVLRAHDDRVLDFERIRDRVRYVRDSDSDNFYTRKKPFLGIGDVT

SEQ ID NO: 7032 - protein, 422 aa, unidentified
  source 1..422: note = Related to CP089414.1; note = Dyella terrae
MLPARLLAKFVTINGLLPLGLPESPIISNLVCLDMDRELQAMADERDLRYTRYADDITFSGYANLPSKEDIRHLLTGQGFRLSDRKFRISKRGQAHFVTGLSVSERDYPHVPREMKRKLRQELYFCERFGLDVHAIEQGETSQKTFNRLYGLVNYVSYVERRQADRLHQKWGRIVRRELGEAAYATVQGREYRDIHLIVDESEFKIGEQKYLAICVVRLSELDRKQRVVRKLLLDYVTTLGAKGEIDALKDVGVHFTEVHYDLRTKTLDLMLEMLWSASVHFAKYESGEDYEFTWLKLFKEAMHQELVTADGIGLEVLVEENDKVSSSALKSIVDAQYQHMELAGSRRPRVKPDVKRVGKSDTPILTLPDFVLAAFRHNVLQVADERVLDFERIRDKVRYIHDHDLDAFYTRKKPFVEVGSA

SEQ ID NO: 7033 - protein, 589 aa, unidentified
  source 1..589: note = Related to CAADFF010000009.1; note = Candidatus Kentron sp. LFY
MARDPVAPFIVDFRKAKDTNHLATLIGCHAEMLDRIRNSATHQEFYREHRIPKRNRRRRGEYRVVWQAVSELAQIQKALLRKFENFARDTVDDYPHSAVHGYVTGRSTLTNARCHAGAKIIARADIKDFFPSISRARLEALLTELGIYQSVAEVIGGLATIDDGLGQGIHTSPFFANLVCIPLDQELSDLAGKYQAIYTRYADDLTFSSDTRVPDRIAIETVLQTHGFPLAKDKFRTTKIGQAHFVTGLSVSELDRPRIPYKFKHKLRQELYYSDRFGIMNHAERAGYRFPHHCINSIDGRISYLQGIEPELGVEMRQLWKSLLKRDGLFSTYLPTYKEGMRQIFKEVEGVSYFIDETETHFRGDVYLGLALVAVATGDVSTIEEAIAQTLDRFLHDPYASGRKEKLQKKGLHFTDDSEEIRTDFIKTIARFPIRAFVAYRKLSGITRKDAYLSLLRILVTDRLSDPLLTLNSTIIYEQLSEVPHKYFELTIHEVMGKIKERGGKFYQEPRIVCCGKRDQPCIAIADYLLGVFSHYATSEPPNETPRKRFERLRDKIRLIVDADEKRRFWRNNPFPGFSAMDGTENNLA

SEQ ID NO: 7034 - protein, 325 aa, unidentified
  source 1..325: note = Related to NZ_LPLT01000066.1; note = Burkholderia stagnalis
MTTAKLRDLKSIDDVARACGVEADFIAEYAQSEYQSHFYNFLKLPKRGKRRKGEFRVVFAAKEERLRALHRSISMVVTNSAKFGNHVQGFMKKRSTRTNAEQHLGAKVLLHADIKGFFDSITTKHVRDAFISDGTDVSVAELLASACTIDGLLRQGTRCSPTIANLVCHDMDQAFLRLARAHDCVYTRYADDITFSGESVPSDDAVQQILESRGFELRDGKCYRQYRGRSQFVTGLTIADKSAPRLPKALKRRLRMIMHYIEKFGIADHFKHAGVFDPYREEAWLRGILIYARSIEPELVEKWQEILDRSIYDRSDYDEPIDDDY

SEQ ID NO: 7035 - protein, 316 aa, unidentified
  source 1..316: note = Related to NZ_JAIZQK010000007.1; note = Burkholderia vietnamiensis
MKSIDDVARACGVEADFISEYAQSKYQKDYYNALKLAKRGKRRKGEFRIVFAAKEKRLRALHRSISMIVTNSTEFGNHVQGFMKKRSTRTNAKQHLAAKILLHADIKGFFDAITTQHVREALISEGAAVPVAELLANVCTIDGLLRQGTRCSPTIANLVGHDMDQALLRLARAFDCVYTRYADDITFSGASVPSDDSVREVLESRGFELRDAKCFRQYRGRTQFVTGLTVVDETAPRLPKGLKRRLRLIMHYIEKFGIVDHFKRVGVSDPYREEAWLKGILMYARSIEPQLVEKWQKVLDDAISEHPPYDDLIDDD

SEQ ID NO: 7036 - protein, 330 aa, unidentified
  source 1..330: note = Related to NZ_CAKKNB010000001.1; note = Aquabacterium sp.
MTISKLRELKTIDDVARACGVEADFITEYAESPEQSTYYEALKLSKKGKRRSNEFRIVFAAHEQRLKQLHRGLSMVVANSANFGWHVQGFVKGRSTLSNAKQHLGAKVLLHADIKSFFDAITVDQVQAAFVEHGVLAPMAEVLAKLCTIDGLLRQGTRCSPMIANLVCFDMDQAFLRLAGATNSNYTRYADDITFSGDSVPSDDSVRTILKNRSFELRDGRCFRQHRGRVQFVTGLSVADTTAPRLPKRLKHQLRLVMYFIKKHGLDDHNNWVKQGYKSHPEITWLWGILNYAKSIEPTLVNQWQQVYQTAWEEQQAKRKERIKVKDWNP

SEQ ID NO: 7037 - protein, 346 aa, unidentified
  source 1..346: note = Candidatus Nitrotoga sp. BS; note = Related to NZ_CAKMLL010000115.1
MSSNPYIKTLLYPSRRCRPYMTIAKLKELKSLDDVARACGVEFDFIEAYSSSQNQKSFFNVLKLPKHGRRRKGEYRIVFEAREQRLAAFHRSISMIVTNSAVFGEHVQGFMKKRSTRTNAEKHLAAKVLLHADIKGFFDAITTEQVRNAFVTEGAAVRMADVLAKACTIDGLLRQGTRCSPTIANLICFDMDQSFLRLAHSHNCVYTRYADDLTFSGDQVPSDDSVKEILESRGFKLRDDQCYRQYRGRSQYVTGLTIADPNQPRLPTRLKRRLRLMMYYIDKHGLADHWRKVGVNDVIQEEAWLRGMLKYAGSIEPKLVNQWWQIFGEAWSNRTSYEPIPGNEEH

SEQ ID NO: 7038 - protein, 328 aa, unidentified
  source 1..328: note = Related to JADKBR010000003.1; note = Dechloromonas sp.
MTTAILKNLKSLDDVARACGIERDFIEAYSNSLDQKSFYNVLKIRKRGRRRKGEFRIVFEAREGRLASFHRALSMIVTNSTVFGDHVQGFLKKRSTRTNAEKHLAANVLLHADIKGFFDAITTEQVRNALVAEGTALPMADVLSKACTIDGLLRQGTRCSPTIANLVCFGMDQAFLRLSRSHNCAYTRYADDLSFSGDEVPSDDSVREILESCGFKLRHDQCYRQYKGRSQYVTGLTVADPNRPRLPKRLKHRLRLVMYHIEKHGLTDHWNKVGVDEALRAEAWLSGMLRYAGSIEPHLVRQWQQIFDKARSNRDPYKPLPDCDEGQG

SEQ ID NO: 7039 - protein, 327 aa, unidentified
  source 1..327: note = Related to PDZJ01000001.1; note = Janthinobacterium sp.
MTKAKLKDLTTLDDVARACGIEPDFILGFVKNTIQKDYFYVVKMAKRGRRRKGEYRVVFQAREKRLSDFHRSISMIVSNSACFGDHVQGFRKKHSARTNAEHHLGAAILLHADIKGFFDAITTAQVKTALISEGSPPPVAELIAKACTIDGFLRQGTRCSPVLANLVCVAMDQSFLRLARSHTCNYTRYADDLTFSGERVPCDEAVREILAADGFALRDGKCYRQFRGKTQYVTGLTVADPNRPRLPKQLKHDLRTTMYFIERHGLADHWERIGEEHPMKKEAWLQGMLRYAWSIEPNLVRRWQYILDRAFTERAPYIIDITDEDYG

SEQ ID NO: 7040 - protein, 367 aa, unidentified
  source 1..367: note = Related to NZ_LPJO01000032.1; note = Burkholderia pseudomultivorans
MIQSALATVVDFSGYVRGRDSAVRSLENFLYPSTVATDMTQSRLSEIRDIGDLARATGIPKDFIAAYANSQAQSDAYSVVLIPKKGRKRRGHFRATFSANQEWLSQLHRGVAMIVLNSVDFGEHVQGFIKKRSIRTNAEHHLGAKQLLHADISNFFDSITTNQITQNLITVGAAPEAASLIAKSCTIDGLLRQGTRCSPILANLVCRSLDADMISLAQSIGAKYTRYADDLTFSGDQTPSSDSVDAIITQHGFTLRDGRCYLQQKGHRQYVTGLTVADTAQPHLPKRLKSRLRLVMHYIERNGVRAHFAHDCKRPIARNANELWGMLRFAKSIEPDLASTWLDQWKAGERIDSSKERRRLKKLARWL

SEQ ID NO: 7041 - protein, 323 aa, unidentified
  source 1..323: note = Related to JAIZRF010000030.1; note = Burkholderia cepacia
MTQSRLSELHDIVDLARATGVPAEYIDSYANEATQADAYHVLRIPKKGRGRRGQFRVAFSAKEEWLAQLHRGIAMIVVNSVEFGEHVQGFLKKRSIKTNAAQHLGAKQILHADISNFFDAITTELVSESLVTVGVPPKMAVLIAKSCTIDGLLRQGTRCGPALANLVCRPLDADMLSLAAATGAKFTRYADDITFSGALLPTGDSVRAILNKHGFALRDDRCYIQRKGRSQYVTGLTVVDTVQPHLPKRLKARLRLVMHYVAKNGLQALFAQHHDRPIAQSESELWGMLRFANSVEPALAAKWFAQWEAGELVDAQRGPKQAA

SEQ ID NO: 7042 - protein, 332 aa, unidentified
  source 1..332: note = Related to JAKZHX010000030.1; note = Undibacterium sp.
MTKTKLVDLKTLEHVAQACGVSAEFIVQYANDQRQRDYYFRIKIPKRGKNRNRQFRIVFQAKEYQLASLHRSVAMIIANSVQFGEQVQGFRKKRSSRSNAQQHLAKAVILHADIKSFFDSITTEQVHVAFVSQGVSNEIAQLLAKACTIEGLLRQGTRCSPILANLVCAGLDNKLLALAHSCHSVFTRYADDLTFSGDQVPSSAAVKTIVESEGFTLRDDKCKLQRQGRCQYVTGLTVSDGNMPRLPRRLKSRLRLIFHYIEKNGLTEHWQKTGQKNGRRKEQWLDGMLQYAASIEPDLANKWQDILTTAKVQKAATARQKYFVDCGIDDID

SEQ ID NO: 7043 - protein, 308 aa, Pseudomonas sp.
  source 1..308: note = Related to NZ_JAJSLV010000001.1; note = Pseudomonas shirazica
MTTTKLLDIHDLAELSYAVGVRAELIEEYLTAPRQVDYYEVIRIAKRGRNRKGEYRQVYKAKSNWLSQLHRSISMIVTNSVEFGEHVQGFLNGRSTVSNAKLHMRKDIVVHADIKDFFNAITEAQVCQSIMSLGCAQFIASIIARACTIDGRLLQGTRCSPVISNVVCRNLDLDMLELARATKSTFSRYADNITFSGKAPPNKENIEAVVNARGFILQPKGCYVQYRGSRQFVTGLSVVDGVMPRLPKQVKKKLRLIAYYVKKYGDGHFEFSSGNHSIAPTRTQLEGFIAYAHSVEPEFAKKLWSMVS

SEQ ID NO: 7044 - protein, 308 aa, Pseudomonas sp.
  source 1..308: note = Related to NZ_CP027729.1
MTTTRIEDVHDLAELSFAVGVKAELIESYLNAPWQAHHYQIIKIAKRGRNRQGEYRQVYKAKNKWLAQLHRSIAMIISNSVEFGEHVQGFLAGRSTVSNAKLHMKKDVIVHADIKDFFNAITEVQVCQSILALGGNLLIAQILARACTIDGYLLQGTRCSPVLSNIVCRRLDSDMLELARTTKSTFSRYADNITFSGITPPAPENIEAVINGNGFQLQAKGCYVQYRGARQFVTGLSVVDHERPRLPKKMKKKLRLIAYYIKKHGDGHFEFPSRSHSIAPTRAQFEGFIAYAHSVEPQFAKKLWSMLN

SEQ ID NO: 7045 - protein, 308 aa, Pseudomonas sp.
  source 1..308: note = Related to FMUZ01000023.1
MTATKIDDIHTLDDLSLVVGVKAQLIQQYVHAPCQADYYQIIRIAKRGKGRRGEYREVYKAKEFWLAQLHRSIAMIIANSVQHGQHVQGFVYGRSTLTNAQYHLLKKIIVHADIKNFFNAITESQVEQAFLTIGGHSSVAHILARVSTIDGRLLQGTRCSPAVSNIVCRNLDLQMLEVARVTSSVYTRYADNITFSGDKPPSSSNIEAVVKGCGFELQGKGCYTQHRGARQFVTGLSVVDDERPRLPKQMKKKLRLIAHFVKKYGDEHFEFSADSSSIAPTRTQLEGLVAYAYSIEPQFAKKIWSMIN

SEQ ID NO: 7046 - protein, 308 aa, Pseudomonas sp.
  source 1..308: note = Related to FOTU01000012.1; note = Pseudomonas syringae
MTTTKINQIHSLEELGCAVGVPVSDIKTYLNSNRQVSFYRKLRIPKRGKARKGEYREVYKASEAWVAQLHRLMALIIRNSVEFGLHVQGFVDGRSTISNARQHMKKEVIMHADLKDFFNTITEVQVAEYFLAIGAHPEMAPVFARLCTIDGYLLQGTRCSPAVSNIVCDRLDSDMLRLARSTSSVFTRYADNLTFSGDNPPSAKQIEGLVEANGFKIRGTGCYSQHRGSRLFVTGLSVVDQERPRLPKQMKKRLRLIAYYVGKYGEDHFEHSEHARSIAPSLTQLEGLLAYAYSVEPQFARKIWAMLN

SEQ ID NO: 7047 - protein, 309 aa, Pseudomonas sp.
  source 1..309: note = Related to PPYB02000023.1
MTSVKIADIQTIDELCLAIGANREEVLQYLQSPRQVDYYELICIPKRGKRRRGEYREVYKAKYQWIAQVHRSVAMIIKNSASFQECVQGFLDGRSTLSNALLHMGQEVIVHADIKDFFNAITELQVKDAFSVMGASLIIADILARMCTIDGFLRQGTRCSPGISNLVCRRLDLDMLGLANSKSSVYSRYADNITFSGCSPPSYNLIKAVVENNGFELRGSGCYTQYRGARQFVTGLSVVDDKMPRLPKKMKKKLRLIVYYVSKYGEEHFEASAGAHTITPTMTQLLGMIAYAYSVEPVFAKKLWAKLAP

SEQ ID NO: 7048 - protein, 311 aa, Pseudomonas sp.
  source 1..311: note = Related to NZ_LR134308.1; note = Pseudomonas aeruginosa
MTTRRLKDIHSAHELAQAVGVSESKILDYAVSDCQEGFYEKLEIPKRGRNRKGEFREVYKANHKWVTQLHRSVSMLVANSASFGTHVQGFLKGRSTLTNAELHLRKSLILHADIRNFFNVITEPQVAKAFLTIGATPEISKLLARISTIDGFLRQGTRCSPIISNLVCKGLDQAMLDLASTHDCMYSRYADNMTISGAEIPDISAISTIVTNNGFELRGSGCYIQRRGSRQFVTGLSVVDRERPRLPKKLKSRLRLAVYYASKYGKEHFERSRHVDTVTPSWAQMKGMIAYAHSIEPDFAEKLWKLLRHSR

SEQ ID NO: 7049 - protein, 311 aa, Pseudomonas sp.
  source 1..311: note = Related to NZ_RAFS01000009.1; note = Pseudomonas aeruginosa
MTTRRLKDIHSVEELAQAVGVSVAKILEYAVSGSQEGFYEKLEIPKRGRNRKGEFREVYKASYKWIAQLHRSVSMLVTNSVSFEGHVQGFLKGRSTLTNAELHLRKSIILHADIRNFFNVITECQVAKAFLTIGVKSEVAQLLARVCTIDGFLRQGTRCSPIISNLVCKSLDQAMLDLASTHDCIYSRYADNMTISGEQMPDIRVVAQIVKDNGFELRDTGCYTQLRGARQFVTGLSVVDREKPRLPKQLKRRLRLIVYYASKYGREHFDRSRQVDTIAPSWTQMEGMIAYAHSIEPEFANKLWKILRKSR

SEQ ID NO: 7050 - protein, 334 aa, unidentified
  source 1..334: note = Related to NZ_JPMI01000298.1; note = Archangium violaceum
MALTPFSRIRHVGDLALHLGCSPEELLHFANTQPQRQFYDLLRIPKRRGRDKVRIVYRANEESLARMHKTLAGELAPQEGEDFDECVQGFVRDRSIVTNARKHLGCKVLLHADIQNFFESITLAQVMSVFETLGCNSGVAALLGRLCTLDGFLPQGAHASPALANRVCLHLDTDLKQLAARHGCVYTRYADDIAFSGDEVPEPQRVEAILNKHGFKLRAEKCRIQRRGHSQFVTGLSVADTQGPRYSRQAKRWLRLVLHYASRYGLENHLKRTGRGSANPKLAYAELEGMVRFLRSVEPRTTERMNPLLAEIGFRLHADAREEAHEGEDENGEP

SEQ ID NO: 7051 - protein, 328 aa, unidentified
  source 1..328: note = Related to NZ_CP071091.1; note = Myxococcus sp.
MTGVEFPFKTIRDERDLAQHLECEANTLLFLADPSRQHEFYAELRIPKRKRGGFRLVYRSREDVLSRIHKALAVAVADAARFRPCVQGFVKKRSIVTNARQHLGKQLLLHADIEHFFESIRLPSVISCFQSLGCRPQVAELLGRLCTRKEVLPQGAHASPVLANIACRHLDQDFEQLAEVHGCTYTRYADDLTFSGDEVPEEGNIQSILAGYGFKLRDGKCRRQQRGRGQFVTGLSVGDPVGPRIPKKMKRQLRRDLHYATRYGLEDHLRHVGRPTVDPWEEYSVLEGRTRYLASVEPKIASAMWKQLVRIRAQLDKSADTGSEEAPS

SEQ ID NO: 7052 - protein, 325 aa, unidentified
  source 1..325: note = Related to SSMQ01000014.1; note = Polyangium fumosum
MWMSLRNFAFVRNIQDLSRELGCERAQLEEYISSRQREFYKEMRIPKKGRRRREFRTVYKPCRELAVLQKNIATLLQRNPLPEYVQGFVSDRSIYKNAKIHIGQKILLHADIHEFFESITLERVRDAFETCGSNREVATLLAKLCTLDGFLPQGSSASPVLANLVCRHLDTDINALAISYGCRYSRYADDITLSGDRVPPAESVENLLKRHAFELRPGSCRTQRRGHGQYVTGLSVEDAVPRIPRRMKRRLRLVLRLARSAMQHADLLLSETKIDGWLAFFHSVEPNLASKLSAEWDPIRARLNNRHTGSPDDPSEEVTEEEPSD

SEQ ID NO: 7053 - protein, 307 aa, unidentified
  source 1..307: note = Related to SECP01000091.1; note = Myxococcales bacterium
MLPLRFSDLRSVQLVCAHLQTTPRALQSFLREPERYYTPIDLPQAPGRRPRRVFEVGAPLRRIHRVLAVALAPHVDAQPSYIQGFRSGRSIRSNAAMHVDAEVVVTADIRGFFDEIDVERVTSLFQSLGATFQAATLLARLTTFQGHLPQGGRASPAISNLAVPDLDKALVRLGGRCAYTRYADDLTFSGSAAACPTEEQIRRVLESSGFQLRPRSFRRQLKGSGQIVTGLSVVSGSPTLTRRTRREIERALYFGARFGLSYHASRAGSERSPQREFARLCGHIAAAGGVDKTLHAKWVKLLESVNL

SEQ ID NO: 7054 - protein, 322 aa, unidentified
  source 1..322: note = Deltaproteobacteria bacterium; note = Related to VBKH01000045.1
MEHVKFDQIRNDEDLARNFGCKVNDLRRLTEGDQRLLYLTIRIPKRGAARRGQYRIVYKALDQTLRLLQKNLASSIAARVTFADHVQGFVARRSIVTNARRHLARKYVLTADIENFFESITIERVAAAFRGLGCHEGVAQTLATLATLNGHLVQGSSASPVLANLVCEGMDADLLALGGSYDCTFTRYADDITLSGDERVPSGEEIADVLARHAFVLRDGRVRVLRRGRRQYVTGLSVFDAERPRIPRVHKRRLRLLLHYASKHGLEKHFERIGIEPENRYRELRRMEGWIQFMRSVEPRRAAEFAAQLDDARAADARGLPK

SEQ ID NO: 7055 - protein, 334 aa, Nostoc sp.
  source 1..334: note = Related to JAIVFX010000002.1
MIELNFKALENIDHIARAVNCFPSFINIVLERPSLFYTLKKIPKRGKRQKGQYRIIYEVESELNIIQKNISTAVTSKQQFPEYVQGFVSKRSIATNASLHLSQKYVLNLDVKNFFNSITQKQVSDVFKELGCTEKSAEIFTKLCTFNGHLVQGASTSPVLANLVCKELDQDFAGLAQQYNCSYSRYADDITFSGDLTPRKKDIEKCLNKYKFELNPAKWKHQRRGRSQYVTGLTVFDNTKPRIPKFIKKQLRQILYYASKYGWDNHQYKVNSHNHKNMYYDIKRIDGLIAFMYSVEPDRAFEFDLQWQKILKEEGIVDEQERDPYAIFARHSPV

SEQ ID NO: 7056 - protein, 340 aa, unidentified
  source 1..340: note = Related to AP018314.1; note = Sphaerospermopsis kisseleviana
MIQLDFQSLEDIDTVAMVLGCFPSFINTVIDTPSRFYTLKKIPKKGKGQKGQYRLVYEVDSELNVIQKNIATAIASKIQFPEYVQGFVNKRSIATNAALHLSQKYVLNLDIKNFFDSINQKQIIEVFKEIGCTETIAEIFARLCTFNGHLVQGASTSPILANLVCKELDQNFVELAKKYNCSYSRYADDITFSGDITPRKKEIEKCLKKYGFELNPVKWKGQPRGKSQYVTGLTVFDNTKPRIPRVIKKQLRQILYYASKYGWSNHKYKVSICIQKNMYYDIKQIDGMIAFMYSVEPEQALKFDLQWQKILKEQDIDYVKGRDPNVIFARRSQVQTDISE

SEQ ID NO: 7057 - protein, 340 aa, Nostoc sp.
  source 1..340: note = Related to VJOX01000264.1
MINIDFTTIEEISQIEIAFGCSIGFIQTVLDKPSLFYDQLQIPKKGRGQKGKYRIVYKVEDELNLLQKNIATVINSKISFPEYVQGFVSKRSIATNASLHLSKKYVLNIDIKDFFDTIHQQQVCEVFKNLGCVDKIADVFAQLCTFNQHLVQGSSTSPVLANLVCQELDEAFVDLAKQYNCSYSRYADDITFSGEKTPGKKEIKRCLKNYGFELNSNKWKSQSRGRSQYVTGLTVFDTTMPRISKSLKRILRQILYYASKYGLENHLNRVHDFNHKNMRYDIKTIDGLIAFMYSVEPNRALQLDMEWQRILNAQEAEQAESSSRKGKRNPEVIFARRSKL

SEQ ID NO: 7058 - protein, 330 aa, unidentified
  source 1..330: note = Related to SCQE01000079.1; note = Nitrospirae bacterium
MRRIEFSEIRNIDDLAKCLSCTNEDLRRLAFDATSAKHCRKMLIPKKNKSGHRIVYKSFDKSLSLIQKNLETTINHNEIFPECVQGFVRKGCIAKNAGKHLAKRYVLNADIEDFFESIGMLQIVNAFKRIGCNDDIAIMLSRLCTLDEQLVQGFSTSPVISNLVCHGMDEDFVTLSKQYNCTYTRYADDMSFSGNAVPTQGDIEDILSNHGFKLNKKKFFLQKRGDKQYVTGLTVFDDKYPRIPKRIKKKLRLTLYYADKYGLLNHFEKIGIDWSFVDWEINKIDGWIAFMFSVEPALAKNFKAKWNIILDEHKKSMSSESGAYNVFPEN

SEQ ID NO: 7059 - protein, 318 aa, unidentified
  source 1..318: note = Nitrospirae bacterium; note = Related to JADLDG010000084.1
MKKIKFSKIRDVNDLARSFGCSKDDFKIIESPSEAVSHYSRMLIPKKNRKNAGSYRVVYKVLNPKLRLLQKNISTALEYACFFPEYVQGFVRGRSIATNARHHLAKKCILNLDIKDFFESISQDRVIRVFEHIGCNSEIASILAKVCTINGYLPQGTSSSPIIANLVCKDMDEELNSLAMSYSINYSRYADDITFSGDACPQREEIEVILGRNNFRMNNEKFVMMKRGQNQYVTGLTVFDAESPRVPRKIKKQLRLILYYSKKYGIEDHLERIFADKVGCPYKKEFEKRKIEGWIGFLCSVEPPLGYKLKEQWLEIVK

SEQ ID NO: 7060 - protein, 366 aa, unidentified
  source 1..366: note = Related to NZ_LT545989.1; note = Chryseobacterium sp.
MKHTELSTKKDLANYLRCDLLFLEKAIEDDYFIRNIDTFNQEDVLLASLTSLNNNIISVDQFKLRKKGHNGGFRTVHKIWTLQLKNSLKILNNHLIQIFTPLDIVHGFVKGKNIRSNAECHLAKKLVLSVDIKDYFETITEKMVEEALISIGYNENIALWIAKIVTIDNHLVQGFCTSPTLANIVTNQLDKELKKLCGKKITYTRYADDLYFSSNTEEIPLESIKLTIEKHNFLLNDKKTKFMKRGQKQYVTGLTIFDSYIPRISKKRKKNIRLEINYIERVGYRSHTVHKLIKEGEDPDSLDFYSKLGEEIKLTRNRLYGWLHFIQSIEPQFAKKYYKKLNDIDQKYILMAKLNALKKNARNSDI

SEQ ID NO: 7061 - protein, 361 aa, unidentified
  source 1..361: note = Related to CP016378.1; note = Elizabethkingia meningoseptica
MKHTELSTKQDLANYLRCDVAFLEKAIEEDYFIRNMDTFDPEEILLSSLKSNISVYRFKLKKKGQNGGYRTVHRIWTAQLNNSLKILNAYLTQIFQPLEIVHGFVKGKNIKSNAQSHLAKKIILSVDIKDYFETITEEMVKNGLMSLGYREDISLWIAKITTINNQLVQGFCTSPTLANIVTHKLDKDLKKLCAKDVTYTRYADDLYFSSDTKEIPLENIASLIEKHSFVLNNKKTKFMKRGQKQYVTGLTTFDSNIPRISKQRKKNIRLEINYIKKFGYTAHAKHRLIKRGEDPNGLDFFNKVGDEITLTRNRLYGWLHFIQSIEPQFTKKYYRKLNDVDKNSVLNSSLKEILKQFRQNM

SEQ ID NO: 7062 - protein, 365 aa, unidentified
  source 1..365: note = Related to CP033929.1; note = Chryseobacterium indoltheticum
MKHSELITKQDLANYLRCDLEFIEKIIEDDYFIRNLDRRNIEELRSALTSNKILVDRFNLRKKGQNGGFRTVHRVWTAKLNNTLKILNHYLVKIHQPSEMVHGFVKGKNIRSNAECHLEKKIVLSVDIKDYFETITESMVTNSLKKLGFKDNVALWIAKITTIENQLVQGFCTSPTLANIVTHSLDEELKSLCGSNIRYSRYADDLYFSSNTDILPLDDIQLAVEKYGFLLNEKKTKFMKRGQKQFVTGLTIFDSHSPRISKNRKKNIRLEINCITKFGYTAHAKHRLIARGEDPKDLGFLSKLGDEVTNTRNRLYGWLHFIQSIEPQFAKKYYKKLNDVGENSVLRSTQALEILLQIRAGQKES

SEQ ID NO: 7063 - protein, 342 aa, Flavobacterium sp.
  source 1..342: note = Related to JAJQXA010000019.1
MKHTEIETRQQLANYLRCNIHFLEKAINNEFFIRDTKISEDVIPTISIPPSEITVSKYYIKKKGKNGGFRIVHHIWTYQLENSLKILNNYLNEIFIPFDFIHGFVKGKNIKTNADTHLAKKIILSVDIENYFESISKEMIILGLCKIGFKEEIAESIASIVTINGFLPQGFCTSPTIANIVTHDLDQQLKKICGTNIQYTRYADDLYFSSDIENIPLLEITKIIEIYGFILNENKTKWMKRGQLQYVTGLTTFDSNTSRISKKRKKNIRLEIYYLTKFGFRKHIKNKLIKSGENINAEDFEYKLIDEIDKTRNNLFGWLHFIKSIEPEFSAKYYSRLKKAKR

SEQ ID NO: 7064 - protein, 336 aa, Flavobacterium sp.
  source 1..336: note = Related to SEBM01000517.1
MEHNEIDTLKDLANYLRCDIEFLESAVSYEYYVKDAGVDFKDSISKIIVSKFNIAKKGKTGGFRTVYQCWSHFLSSSLKILNTNLNEIFIPNQFSHGFVKGKNIQTNASCHLGKKLLLSVDIKNYFESISKDRICKSLEKLGFKKHVAEWISNITTLNNHLPQGFATSPTLANIVTQELDNELSLLCGDLITYSRYADDLYFSTNLDEISLAEITSIIENYGFNLNSKKTKFMSRGKKQYVTGLTVFDVKYPRISKRRKKNIRLEIYYLSKFGYKRHIRKKLIKSGMNPKDPDFKSHVSVEADITRDKLYGWLHFINAIEPDFAKKYYPKLKKAKQ

SEQ ID NO: 7065 - protein, 345 aa, Flavobacterium sp.
  source 1..345: note = Related to PRDM01000001.1
MKHSDLRTINDLANYLRCDVAFLERATSNEFDVLDLANGDKLKLSPSGVTVTIARIKKKGKKTGFRKVHKIWTDEFKNSLKILNNYLREIYIPKDCVQGFIKNRSIKTNANLHLGKRLVLSVDIKNFFESIKIKMIVSGLTELGFQKSIAEFISEFVTIEGSLVQGFSTSPVLANIVSSKLDLELIKFCGNSLIYSRYADDLYFSTDDNEIELDAIEKIISSHGFSLNHDKTKLMKRGQLQYVTGLTVFDSDRARISKQIKRNLRLEIYYITKFGYRRHIRVKLKKEGFDSSLEHFRLFVNEEIEATISRIFGWLNFIHSVEPDFTAKYYKTLIKIKPNYYRKLN

SEQ ID NO: 7066 - protein, 361 aa, unidentified
  source 1..361: note = Related to UGQP01000001.1; note = Myroides odoratimimus
MSSYPIIRINYYLPYPNAHLYIFDMNLLEINTKKQFLYLLRCRESFLNLINSREYVIIDYTKNENVDVEISEGTIVIERFYIEKRNPTLGYRTIFKSLNFELDSCQKILNSLLLDVYTPLDCVQGFVQKKNIKTNASVHLAKKQILRLDIKDFFETITKEQIIESLIKLGVNIQISEWISNIACVEERLVQGFSSSPILANIVAREMDLDILKNIDSTINYTRYADDLYFSSNLSKPNLELIVDSVIKFGFKINYAKTKVMKRGQKQYVTGLTVFDGLFPRIPKKIKRELRLEAYYIGKYGYEEHIIHKLKIKKHQLKDKETQRLVVNEIDITRHRIYGWLHFINSIEPEFSKKILTELKK

SEQ ID NO: 7067 - protein, 342 aa, Flavobacterium sp.
  source 1..342: note = Related to NZ_FNRD01000015.1; note = Flavobacterium gillisiae
MDLLQIETKKEFLYFLRCRESFLDSVNLREYVIIDNKKNKNVDFEILENTIAIERFYIEKRNPTLGYRTIHNSLNHELEHCQKTLNTGLSNIYKPLGCVQGFVLKKNIKTNAFVHLAKKQILTLDIKDFFETITQKQIIESLTKLGINIQVSEWISNIACVNGYLVQGFSTSPILANIVAIEMDLEIFKNIDETINYTRYADDLYFSSDSTQMSLELITKIITKYGFEINNSKTKLMKRGQKQYVTGLSVFDHNYPRIPKKIKRELRLEAYYIGKYGYEEHIMRKLKIKKHQLKHQEIKGLIINEIDKTRDRIFGWLHFINSIEPNYSKKITQELKKTSANR

SEQ ID NO: 7068 - protein, 328 aa, Flavobacterium sp.
  source 1..328: note = Related to NZ_LIYD01000005.1; note = Flavobacterium akiainvivens
MENRDYYIFEEYSEAVVSTAINIKRFHIPKKNPALGHRTIHKPFTGNLEFCLKLLNSEISKLFVPGIAVHGFVAKRNIRSNAYSHLSRKYLLSVDIKNFFESISSPQIVESLVKIGVNRDIAESVTSVVTINGLLVQGFSTSPTLANLVAKEFDDDIQMFVGADITYTRYADDLYFSSDTSLPEVDKIEAILTQYGFSLNHSKTKYMPRGKAQYVTGLSVFDKAYPRIPKKIKRNVRLEIHYIKKDGFKVHIIKKHKIDEDQVPKDILDAIIEFETYNIKQNLFGWLRFINSIEPAYAQKYLAELSEIERANSLDKVELNEINPNITL

SEQ ID NO: 7069 - protein, 359 aa, unidentified
  source 1..359: note = Related to NZ_CP094326.1; note = Zhouia spongiae
MEKHKLVTLVTASFYMKVSDINNLNLLANYLKLDKNLLKTICENDYIGLSAREILKYRADNSDLTLVIKKIKIYKKNGGIRTVYSPVSDSVINCLKVLNKKLSKIYVPSKNVFGFIKGRSVQSNASQHLGKKYVYKVDLKDYFECINSDMLEKAFMRLGFNKAVLDCLCKIVTINNTLAQGFHTSPTLANIVFIDLDNVFSNISKNITYTRYADDLYFSSDEEFEIHDFIVENLKKFGFEVNESKTRMMKRGSKQYVTGLTVFDPDYPRIAKRIKKKIRQEIYYIKKYGYKGHVMHKLKVKNKDYKTNEDVKNKVDLAISELQSKINGWLLYINSIEPKFSKKYSEFLYKKSFKPISNN

SEQ ID NO: 7070 - protein, 336 aa, unidentified
  source 1..336: note = Related to NZTP01000094.1; note = Proposed Altibacter sp.
MKPTEINTTKRLVNYLKLDEMSFKLMTNNDYVVINDVENEIEIPDALKIRKLNISKKNGGKRVVYSCQSDVLSNTLKILNSNLNSLYKPPTSVHGYVKGRNIKTNATKHLTKKYVLVLDIENYFDTVKSSLVEQSFKDLGFTTDTAAYLTKLVTFQSALVQGFNTSPTIANIVFYPLDKKMEKLDKNITYSRYADDLYFSSDKEFNIEAKVQEIISEFGFRINKPKSKLMKRGWHQYVTGLTVFDKESPRISKKTKRKLRQQIYYINKFGYRSYVLYDLEKTPQDYFSSSSLRDEVDSKIEYLQRKLNGWLLFINSIEPRFAKKYSDLLTHRKIEP

SEQ ID NO: 7071 - protein, 344 aa, unidentified
  source 1..344: note = Bacteroidales bacterium; note = Related to DNSL01000055.1
MKQINSSYLNHCYFIMSHKKIDTVKKLSNFLNIEKEILSELSKNDYIIIERNNSSTDILNNVLTVEKIEIPKKSGGFRVVYSPSSDNLTNCLKVLNSKLRKIYVPSSCVHGYIKGRGIKTNASEHLGKQYILKVDIENYFEKITKERIIKSLNNLGFQNEISSLIAKITTHNNVLVQGFHTSPTLANIIFHELDLIFSKFTNASYTRYADDLYFSSKEEIDILSKVEEQLLKFGFTINKSKIKLMKRGQKQYVTGLTVFDNKKPRISKNKKKEIRQQMHYINRYGYKGHIMHEFGISNEEYLNNDEIKENVDYKIHELKTKIKGWLLFINSIEPEFSKKYITLK

SEQ ID NO: 7072 - protein, 334 aa, unidentified
  source 1..334: note = Related to NZ_JQNQ01000001.1; note = Salegentibacter sp.
MKLEEIVNIQLLANHLKIEKESLQFIVDNDYITEITSKKDFKKGCLINEIKIKKRSNGYRYVYSPVSDILVNTLKILSGKIKELYKPTEYVHGFVPGRNTKTNAQEHLAKRVVYCVDIDKYFENIDIEKVKSAILSIGYNEYCSDKISKIVTHKNQLVQGFHTSPVIANIVFHEIDLKLSRLGDENVSYTRYADDLYFSTSGRINFEKDIEDILNSYGFKVNSKKTKFMIRGRSQFVTGLTVFDEMYPRIPKKIKRSIRQKIHFISLFGYRGHVLHKLNIEKQLYDQNEEIQKHVDSKIYLEKLNIEGWLNYINSIEPDFSKKCYSKLSKKDNP

SEQ ID NO: 7073 - protein, 341 aa, unidentified
  source 1..341: note = Related to NZ_FTOL01000001.1; note = Chryseobacterium ureilyticum
MNPQIITDTKQLSNALRINEESLNELSQNEYLIDDTCAKTFNLHPDSILNLKKFCIPKRNKKFGEREVYEPIAETLKNLLKVTNSGLNKVYVAPTSVHGFVKGKNIRTNATPHLEKKYLLSIDIENFFESINKEMVINCFKEYEFIESIAKVLANITTVDNKLIQGFHTSPTIANMYFKKIDLIFETVFPNLTYSRYADDLSFSSNEEITVTQVTDIIKIINDFGFSINHDKTKIMKRGRNQYVTGLTIFDGTLPRVPKRIKRKLRLQIFYINKYGYRNHILKKLGRKPHEYFKNSRVKESVDSYEDYLHNNIVGWLMYIKSIEPQFAALHLELLNNRRRD

SEQ ID NO: 7074 - protein, 324 aa, Flavobacterium sp.
  source 1..324: note = Related to NZ_CP089096.1
MDLKLLNTLIDNEYIINDYCSGEVTLKFDFTILDVDRFCIPKRNKELGHRVIYKPMSESLKNCLKILNINLNGIYSPPISATGFIKGRGIKSNAEKHLKKKYILSIDINNFFETINKEMVIEVLKDYGFIEEIALKISKIVTINDKLVQGFHTSPTLANMIFKKIDLIFEKLDENIEYSRYADDLTFSSDSEITYLSKITEIIESFGFEINNKKTKIMKRGQNQYVTGLTVFDEQYPRIPKRIKKKLRLEVYYINKYGLRNHTLKKMKVNWKDFFGDELIKKKVENMEGLVHDYIYGWLVFINGIEPVFSEKCFELMRTRKIDV

SEQ ID NO: 7075 - protein, 362 aa, unidentified
  source 1..362: note = Related to DPHQ01000053.1; note = Butyricimonas sp.
MYIPSEINNVNKLAGVLRCEISQIDNLVNKVVPRSEFGELFEKVHFDGLPFHFEVSMPEDFILEIKLPKRKVHLGYRTVYSVLPHFASSALKVLKFYLNDLYVPNDCVHGFIKKRNIVTNARMHLNKKLILNVDIKNFFESINLDMVRGVYEKLGFQKDIAEILSNITTLNGRLVAGFSTSPVIANLYCNEMDEELMHVCSQNNITYTRYADDITFSGDKIDILSDVGEILRRYGFEINKSKTRYYYRGNGQYVTGLSVEDTVKPRVPKYVKKRLRAEIYSICKYGLKSNVARILGIDEGGVDETMLKKRAAKIIGWLSFISSIEYKFAKDCFDHLLRIDNARDSYYIMNALEHVSSKIKRF

SEQ ID NO: 7076 - protein, 337 aa, unidentified
  source 1..337: note = Related to JAFWXU010000033.1; note = Alistipes sp.
MYKPQDISSPLLFSGFLRCAEKAIPILKSKSEGVLEMNIPKHNPKYGYRKVYKATSQLLSYTLKQLHFELSNLYKPQSCIGGFTRGRGILYNASPHINKKVVLNIDIKDFFESIPFELIVSTFVRYGFTSEFANDLAEIVTYNKVLVAGFNTSPIVANMCCEDMDAKLLALCSAHQISYTRYADDLSFSGESIECVEDIKAIIVQYGFIINDKKTRIYRKGGPQYVTGLTVVDEKCPRIPRRIKRELRSDIYYIVKYGLESHIRYKYHLDIHIFDRYYMGDLCLNEARKIVGWIHFINSVEPMVAKRLNEMLFNKRHEDLGYFINAYGYIENLTDLK

SEQ ID NO: 7077 - protein, 363 aa, Flavobacterium sp.
  source 1..363: note = Related to NZ_QWDM01000016.1; note = Flavobacterium cupreum
MYSPSAIENFEMLSSYLRTTPDQLSKLAHGQRLIFDFKSESLLVNPPEIIIRENVTVFRKFYIPKKNKKLGYRVVYKAHKQFVKDIHKTLKFNLTNIYTPHTCVHGFIPGKNIRSNALVHLEKKHLLSLDIKNFFESIDKKSVSAAFISLGFNKSIASDLSVICTLEDKLVQGFPTSPIIANIVCTKMDEEIQNLCWVYGATYSRYADDLSISSNFDMPPVEEIELILKSFNFELNAIKTKRFLRGQNQYVTGLSISDSAYPRIPKAIKKRIRQQLYYIRKYGYHSHICKIKGLDKETDLSITKQYVREIENKLKGWISYIHSIEPLLAEKYFDIFNEIQSIEYAEVIKLLKRDPQIRRFKSK

SEQ ID NO: 7078 - protein, 355 aa, unidentified
  source 1..355: note = Bacteroidales bacterium; note = Related to JAIPBW010000053.1
MYQPKEIANLDLLSGYLRTHKHDLNNFVSGVRAVYQQKSGKICVYNHIKSWKDIDVQYDKYHIPKKNPKLGYRIVYEIRTLSALNILKVLKFNLSTLYKPHVSVHGFVLGRGVFSNAKQHLANYYLLRTDIKNFFESINIDMVYEVFIDLGFIPEIAEVLSKITTLDNHLVQGLPTSPIIANLVLKNMDTELKSLCKKYNAVYTRYADDISISSNSDLPPLKEIENIVNKSKFKLNTKKTKTFKRGQNQFVTGLSICDNLYPRIPKKIKRKIRQELYYIKKFGYESHICKKFDFDEENYNEDFVSEEKRKLEYRIKGWVDYIHSIEPKVAENFYNDLKVIQDNEIKKMDEYGDAF

SEQ ID NO: 7079 - protein, 579 aa, unidentified
  source 1..579: note = Related to JAIZPA010000026.1; note = Sulfurovum sp.
MNLNQLNSLDIISKSFNIPLKFLQSISKNEKNIKYIELFDIPKKNPKRTKKYREVIKINSPYNLFYKELLHIIEQEIEQNKAFFISNIAHGFIKERGVLTNAKQHLNKKYLFKIDIKNYFKSITKASIKSVFLKLRFSENGAEIFSDLCTFEDVLYEGFNTSPILANLYCLNLDLELKSLADEYKVGISRYSDDITFSSNNNNFPPLKAIQDIFDKYNFKINEEKTISFKYGQPQYVTGLSISNNKYPRVPKRMKRKIRQELYYLNKYPENYFNIEDGYARLRAIYGKIVYIIGIEKILGKRYQSDFINILENNNIYLENLYMDAPQKKSGMCTYHYIDESETPDKKTLILSLVSINGNFLKNTIFNKLTLLQNDLVSDLRNGLTDNQKSKLFHYCEDNITVKERYISILRELNIEAQIMFKSEQESMDKLGKEVYQNNYYALFNSLMKNILRRYKNNTNMITVEENSKISLEKLKEIVLSKGSFFPNTIIEKSGKDDILLSIPDYILGIVRDCMENNFSEKLNKLKTGQTLKENIKLNEISDKIRLIADLTNNQFFTQQNNNKMDCLKLNDYIHNKTE

SEQ ID NO: 7080 - protein, 582 aa, unidentified
  source 1..582: note = Related to JAHJEY010000048.1; note = unidentified bacterium
MNLYYLNSLDIISKSFNTPLEFLNSIFNSEVNSTYIELFNIPKKNPKHSKKYREVINIKSSYNLFYKELLCVIEQIIGQNEKNFVSDIAHGFIKNRGVFTNAKQHLNKKYLFKIDIKDFFKSIPQDGISNTFLKLGCSQDGANLLSTLSTFNGILYEGFNTSPILANLYCYNLDLELIKLADSYDVIVTRYSDDITFSSDTNSFPSIDEIEKILKQYFFNINHEKTLYLKYGQPQYVTGLSISNDKYPRVPKRLKKKIRQNLYYMNKYPENYFYKEDNYAVLRAIYGHIVYLLGIEKSLGKKYQSEFINIIENYLNLEDIYINSPQKKSTLSTYHYIDESEFIDSKTNKYYLILSLISINGEFQKNMISDKINALKNDLASDFRNGLNDEQRSKLFHYCEDNISVKEKYISILRELNIEAHIIFKYEDKPMKKQDYQDNYYALFNSLMKNILRRYKNNTNVIVVEENSKISINTLEKSILNRRFFFPNIEIAKASKDDVLLSIPDYILGIVRDCLKKDFLETLEKLKAGQRLKEDIKFDEISNKIRLIANLNNSNFFTRQNNSQLTCIKLNQYIHHKRILGS

SEQ ID NO: 7081 - protein, 572 aa, unidentified
  source 1..572: note = Related to NZ_LIWS01000003.1; note = Campylobacter sp.
MDIRKLNSLEAIAKSFNTDIGFLEFMKEPENTKTQSDYFKLLKLKKKNKKFSTSFREVLKINEPFNVFYKELLNELEKIIYSDYNKYISEYAHGFLRGKNIVSNSKEHLNKYYLCKFDIEDFFVSIKKESIEKVFIKIGCEKQAAELFSNLCTYDNALKEGLNTSPLLANLFCHKLDADIRSSIAKNIVYTRYGDDITFSSDKNNFIKTDDLQKILNKYNLKLNKQKTLFAKQGQPQYVTGLSISNREYPRVPKKLKRKVRQKLYYMNKFFESNSEEELLKRLYGEIAYIIGIEKDLGEKYKKTFLEILKNNNCTIDNASAKTFKVTTAKRIFHYIDESEIIISTDADKQYLAICVVSIISDSDKQKNIQKLGELKNSFLIDARDEFIKKEGLFHYTSDNPEVKIKVQDLLRELEYEAFIIFGKFNKKITKEEYQELYYGLFSKIFNNILLNRFGDANNYICYEENSKISTNKLSSYLCNKKHSTKFKIEKISKKDILSTLPDYVLGTFCSLAKEEKLLEKIENQKYPFALRNLNKISSKIRLIVDNNNKIYYSRQNKNKNDFLEINKNIMN

SEQ ID NO: 7082 - protein, 303 aa, Leptospira sp.
  source 1..303: note = Related to JAIZBM010000014.1; note = Leptospira mtsangambouensis
MESLNFNKIRNIDDLALYFQCTIDTLKNIIENKENYSSRRQIPKKNGGKRRIIIINNFDWSRFLKQIHFSIEKQYPYLDCIEGFLKSKSIKTNASKHINNQYLLTLDIKDFYFSIKYEDIINSFKALGANDTVSEILGQICTYNNLLYPGFNTSPLISNIAFESLDRKICDLCKEKGINYSRYADDLSFSSTNPIEILPIIKQYLSEKAFEINEYKLRFSKHGQAQYVTGLSISDKTMPRLPRKFKRNIRLLLHYAKMNGIENYHKHPKSRHLLTIYGQIMYSYSIEPHFAFKCLKIFNDIKK

SEQ ID NO: 7083 - protein, 302 aa, Leptospira sp.
  source 1..302: note = Related to NZ_NPDN01000013.1; note = Leptospira hartskeerlii
MLLLDFPNIRHKGDLIKYFQTNTETFDSVLVSKNKFAHVINIPKKKGGNREVIKLTNEDWKRFLKQINFSLHQLYTFPNCVQGFIPGRGIKSNSYFHLKNRQLLVCDIKDFYYSIKESDISNIFKYFKASDEIANLLAKLCTFEGILFPGLNTSPTLANLYCEKMDEKLSILMTSHQGVYTRYADDLTFSSNQTLPNLKDISELLENYNFKLQERKTRYSSPGQRQYVTGLSISDKRVPRLPRNFKRNIRLLVHLAEKLGVKEYHENLNSRNLFTLKGQLVFAMHIEPIFAKKYLVRLNRLI

SEQ ID NO: 7084 - protein, 312 aa, unidentified
  source 1..312: note = Related to JAKKPI010000005.1; note = Aliarcobacter butzleri
MIKLDFSKFQDETTISTNFHILKKNLDDLLTGNQEDFYEVLHIPKANKSLGYRKVYKPNWKIDGLHKYILEQINFKSKPLIHDCAHGFIKGKSILTNAQQHLNKKYLLQVDIKSFFSSISQDEVKRVFIKLGCNDYVAELFSILCTINNSLAEGLNTSPTIANIYFFELDEILNEISRRYSCTYTRYADDLTFSSNNYFDYTELLKEIEDALEKKNLTLNNKKTRFSKYGQAQYVTGLSISNEVRPRIPKKIKKRLRQEFYFIKKYGFNAHFSRCNQNIKNGHNRLNGWLLYALNVEPDYFRKLYAEYKGLK

SEQ ID NO: 7085 - protein, 555 aa, unidentified
  source 1..555: note = Related to JAGDMU010000005.1; note = Proteobacteria bacterium
MNQVVDFSGLSNLRSIASTFNTKLEFLESILKSPTRSEFYQKMFILKKNGKGYRLVYKAINKSLSLFHKNLSTSLQKLEKEFVHDCAYGFVKGKSTFDNAKIHLNRQILVQFDIENFFKSINYENIKKIFFQLCKNDDIASILTSLTTVNTSLVEGLHTSPVLANLFFYDLDIQLFELAQKHDCLYTRYADDITFSTNFKDINVKKLEKEVSAILKESNLSLNNEKTRISKKGQPQYVTGLSVSNPEFPRIPRLMKKKIRQELYYIKKYGAEDHFMNKKEKLYDGMQRLNGWIIYCHAIEKELAKKFQDQILMTDAYTDIHEYNKRLRKKEKRKEELHLYFDETLYENYFGMSCVLIQDENHQDISNDLNTFYDQLSGDQLIPKKGRIFHYCEDSHDVRGQIVDRLRKCDFQAYIVFSKLETNSYTKDDYLKIFYKVLFDRIHKNYDCTVHIYYEENNKIKTADIDDLVEDIKDKLNNQTSMVISINIQKITKQNHLSVIPDYVLGLFKDAYLKKERKDFEIRYCQKLSNKIRLVIDLDTNKYYSRHQTLSLSNE

SEQ ID NO: 7086 - protein, 327 aa, unidentified
  source 1..327: note = Related to MVRP01000128.1; note = Syntrophorhabdaceae bacterium PtaU1.Bin034
MLIKFSEIENLTMLSQFLYIKEDNLLTLLKEGAVSSCCEKMAIPKKNRALGYRVVYKVNSHLLKNVHKVLCGHLNAVYDAPAFVHGFVLGGCTRRNAAQHLNKKKILGLDIDRFFDSISENAIKEVFCGLGCRMNIAANLSKLTTINGRLPQGFNTSPVLANIMFGHLDAQLNSICNDYGCIYTRYADDITISTDDQLPPVARINDVLFTGGFRLNSSKERVMFRGKKQYVTGLTVFDPEYPRVPKRFKRRIRLQLYYLVKFGAKSYVMRELGLSEEDVRNDYEKLQLVSGRKVQLQYQIKGWIDYVNSIEPLLSEKYYESYNAIAW

SEQ ID NO: 7087 - protein, 323 aa, unidentified
  source 1..323: note = Related to JAKEIP010000017.1; note = Streptomyces muensis
MSFSVDQLAEQVGTSVENLEFLSEHLPAGEGLLYVQRRHRKKHGGIREVFEPKPPFNAVSKNLHRSFTSQFSYEAPDHVHGFVRGRSTISNASQHLAKKCVLRMDLEDFFPSIGAATIRASLREQGFDEKAAELAVSLVTIGGKLPIGLSTSPLLSNLAFLDTDRSLAAYARSEGLSFTRYVDDLTFSGDVTDRHSTDIARILDDAGWSVNTRKTAFMRRGGPQYVTGLYVGESDGPHIPRALKRKMRWILHVISKFGYEAYMTDFGGENEGMYRCRLLGWACYIAAVERDVGFSLLREFDRLVPEGSDEELHGYDEDLYDLL

SEQ ID NO: 7088 - protein, 320 aa, unidentified
  source 1..320: note = Related to JAELVG010000016.1; note = Streptomyces poriferorum
MAFSVDHLAEQAFLSVKDLEWLSAHLPAGEGTFYVQRRHRKKHGGIREVFELKPPFDTVSKNLHRSFTSRFSYEAPAHVHGFVRGRSTISNASQHLAKRCVLRMDLEDFFPSIGAAAIHDLLREQGYEEKAAELAVNLVTIGGKLPIGLSTSPLLSNLAFLSTDRSLAEYARSEGLSFTRYVDDLTFSGDVTDRHSMDIARILDDAGWSVNTRKTVFMRRGGPQYVTGLYVGESSGPRIPRKVKRKMRWILHVISKFGYAAYMTDFGGEGDEMFRRRLLGWACYIAAVEPDVGYPLLRAFDELVDEEDLEGDEEGLYDLP

SEQ ID NO: 7089 - protein, 307 aa, unidentified
  source 1..307: note = Related to NZ_JOBP01000002.1; note = Streptomyces rimosus
MPYSVHDLAQQAGVSVEVLERLSSMLPAGAGQLYVQRIYRKKHGGIREIFKPKPPFDAIGKNLHRSFTSLFSYEAPDHVHGFVRGRSTISNASQHLAKGCVLRMDLEDFFPSIDAATIKASLQERGYEEKAADFAVNLVTIGGKLPIGLSTSPLLSNLIFLSTDRSLAEYAQSEGLSFTRYVDDLAFSGDVTDRHSADIARILDDAGWSVNTRKTAFMRRGGPQYVTGLYVGESDGPRIPRKVKRKMRWILHAISKFGYETYMTEFGGEDEGMRRRRLLGWACYIAEVEPDVGYPLLRGCVGWPWAG

SEQ ID NO: 7090 - protein, 336 aa, unidentified
  source 1..336: note = Related to CP043956.1; note = Streptomyces sp.
MIALTWECDPISRRPAAEGPVEFSVNNLAEQAGVSVRNLEWLCSNLPTGAGRLYVRRTNRKKHGGVREVFEPQFPFDVVSKNLNRSFTSLFSYEAPSHVHGFVRERSTISNASQHLAKKCVLRMDLEDFFPSIDAATLKASLRGQGYEEKAAEFAVKLVTIGGKLPVGLSTSPLLSNLVFLGTDRSLAEYAQSESLSFTRYVDDLIFSGDVTDRHSADIARILDDAGWSVNTRKTVFMRRGGPQYVTGLYVGESDGPRIPRKVKRKMRWILHVISEFGYDVYMEEFGGEDEGMHRRRLLGWACYIAAVEPGVGFPLLQAFDELVPERAEEDLYDLP

SEQ ID NO: 7091 - protein, 312 aa, unidentified
  source 1..312: note = Related to NZ_CP029192.1; note = Streptomyces venezuelae
MVDDLAEQAGVSVEILEALSSALPAGAGRLYDQRIYRKKHGGIREVFNPRQPLATISKNLHRSFLHLFSYDPPNHVHGFVRGRSTVSNAGQHLAKPCVLRMDLEDFFPSIGAATIKATLGEQGYEEKAADIAVNLVTIGGKLPIGLSTSPLLSNLAFLSTDRSLAEYAQSEGLSFTRYVDDLTFSGDVTDRHSVDIAQILDDAGWSVNTRKTAFMRRGGPQYVTGLYVGESGGPRIPRQVKRKMRWILHVISKFGYYTYMSEFGGANEVMLRRRLLGWACYIAAVEPDVGYPLLRAFDELVPEPDEDIYDLL

SEQ ID NO: 7092 - protein, 319 aa, unidentified
  source 1..319: note = Related to NZ_LIPG01000002.1; note = Streptomyces sp.
MPYSIDNLAEQAGVSVELLEHLSSSLPAGAGRLYVQRVHRKRHGGVREIFKPRMDFQFVNKNLHRSFIGLLPYEAPDHVHGFVRERSAVSNARQHLAKACVLRMDLEDFFPSIRAETVKVSLMEQGYEDKAAGVAVNLVTIGGKLPIGLSTSPFLSNLAFLDTDRSLAEYAKSEGLSFTRYVDDLAFSGDVTDRHAVDVARILDDAGWSVNTRKTAFMRRGGPQYVTGLYVGESDGPRIPRRVKRKMRWVLHVISKFGYDAYMMEFGGSGEGMTRRRLMGWACYIAAVEPEVGFPLLRELDALVPDEDEEDLDYLEITT

SEQ ID NO: 7093 - protein, 316 aa, unidentified
  source 1..316: note = Related to NZ_CP094918.1; note = Streptomyces sp.
MPYSVEDLAQQADVSTEILEWLSSEIPTGFGRLYEQRIYRKRHGGVREVFKPKRPFDTVSKNLYRSFTRLFSYTAPDHVHGFVRERSTITNASQHLAKKCVLRMDLEDFFPSIGAATVQTILREQGYEGKVADLTTSLVTIGGKLPIGLSTSPLMSNLAFLTTDHSLAEYAQSEGLSFTRYVDDLTFSGDVTDRHATDIARILDEAGWSVNTRKTVFMRRGGPQYVTGLYVGESDGPRIPRKLKRKMRWILHVISTFGYDTYMAEFGGREEGMRRRRLLGWACYIAAVEPDVGFPLLRKFDELVSEGDAEYWDEEY

SEQ ID NO: 7094 - protein, 320 aa, unidentified
  source 1..320: note = Related to JAJNOJ010000002.1; note = Streptomyces sp.
MPYSVDDLAEQAGVSVEMLERLSSTLPAGAGRLYFQRRFRKKHGGVREVFKPMSPFDAVSKNLHRSFTGLFSYKAPDHVHGFVRGRSVISNASQHLAKGCVLRMDLEDFFPSIGAAAVKSALCEEGYEEKAADLAVNLVTIGGKLPIGLSTSPLLSNLAFLATDRSLAEYARSEGLSFTRYVDDLTFSGDDVTDHHAVNIARILDDAGWSVNTRKTAFMRRGGPQYVTGLYVGESDGPRIPRNLKRKMRWILHVVSNFGYDVYMAEFGGRREGMRRRRLLGWACYIAAVEPDVGYPLLRAFDELVPEDEEEEEEGLYGLQ

SEQ ID NO: 7095 - protein, 317 aa, unidentified
  source 1..317: note = Related to NZ_BBXC01000017.1; note = Herbidospora sakaeratensis
MPFSVDDLAEHAGVSAEALQKLSSSLPTGAGRLYFQRTFRKKHGGIREVIKPASPFDAISKNLNRSFTTLLPYKAPEHVHGFVRGRSVVSNASQHLAKECVLRMDLEDFFPSISATTVKALLQDQGYEEKAADIAVSLVTIGGRLPIGLSTSPFLSNLAFLSTDRSLSDYARSEDLSFTRYVDDLTFSGEITDRHSENIGRILDDTGWSVNTRKTAFMRRGGPQYVTGLYVGESGRPRIPRKIKRRMRWILHMISKFGYDTYMSDFGGENEEMYRNRLMGWACYIAAVEPDLGYPLLRAFDELVPEGYYETAVWDLG

SEQ ID NO: 7096 - protein, 330 aa, unidentified
  source 1..330: note = Related to NZ_PYAC01000003.1; note = Micromonospora noduli
MPFSVEDLAQHAGVSAEVLEVLSSALPLGEGPLYRAWTSRKKHGGIREVFKPLSPFDAITKNLHRSFTDLLPYKAPDHVHGFVRGRSTITNASQHLGKACVLRVDLEDFYPSIRAAMVKASLQAQGYGEKAADVAVGIVTIAGKLPVGISTSPFLSNLVFWDTDRSLAEYAQREGLSFTRYVDDLTFSGMVVDRHLAEITRILDDAGWSVNTRKTAFMRRGGPQYVTGLYVGEADGPRIPRKAKRRMRWILHKISKFGYETYMEDFGGEDQVMYRNRLLGWACYIAAVEPDLGFDLLRKFDDLIPEGYYSNGYADMAGLLHVINDIDDLP

SEQ ID NO: 7097 - protein, 342 aa, unidentified
  source 1..342: note = Related to NZ_LOJP01000002.1; note = Actinoplanes sp.
MTLVLTADILIGAIGYPTRVLEELALMLRGGGLQVFSLQSHRKRRGGVREIVKPRPLLDSVSKNLYRSLLELLPYRPPDHVHGFVRGRSTLTNARAHLGKPCVLRVDLEDFFPSISSTTLQGALDQQGCDEKAAELVVSLATVFQRLPIGLSTSPFLSNVVFLSTDYALSEYARANNLSFTRYVDDLAFSGDVNDQHFEAISEILNNSGWSINVDKTAFMRRGGRQYVTGLYVGMADRPRVPRSLRREMRRTFHLIEKFGYECYMEDFGGEAAAMFPQRLRGWARYIASIEPDLGYPLLRRIDELVPDQYVSARDLEAYYDYGEYQVIESAEDLYGSEGPDY

SEQ ID NO: 7098 - protein, 319 aa, unidentified
  source 1..319: note = Related to NZ_JNXY01000031.1; note = Catenuloplanes japonicus
MATFSVDDLAQHAGTDVERLEELSRGVLLGNGLLFESRSHRKRRGGIREIVKPNPWLDSITKSLNRSFLQVLPYLPPDHVHGFVRSRSTITNATAHLGKKCVLRVDLEDFFPSIGSRWVNSLLQQQGYDEKAASLCVGLTTIAGKLPIGLSTSPFLSNLAFQETDSALAEFSATEGLSFTRYVDDLVFSGDVTDEHLSAIEGIISNDGWLINLRKTAFMRRGGPQYVTGLYVGGSDMPRIPREMKRYMRWTLHIIRKFGYESYMADFGGEASDMRPQRLLGWARYITAVEPEFGRPLLGAFFELIPLDYCGPDDCEDIY

SEQ ID NO: 7099 - protein, 322 aa, unidentified
  source 1..322: note = Related to NZ_BLPG01000001.1; note = Phytohabitans rumicis
MSFSVEDLGQHSGVSVRILESLSEDLPAGAGKLFRAQSFRKKRGGLREIIKPNPWLDLITKNLRRSFLAVLPYRPPDHVHGFVNGRSTVTNASAHLGRACVLRVDLEDFFPSIGSAQLKAALQEQGYDDKAASLAVSIVTIGGKLPIGLSTSPFLSNLAFQHTDHILAEYAEAAGLSFTRYVDDLVFSGEVSDQHLAAIERILNDSGWSINQHKTAFMRRGGPQYVTGLYVGATDHPRIPRKTKRHMRWVLHIITKFGYDEYMAEFGGENADMLPQRLLGWACYIAAAEPDVGYPLLRALNEQLPPAYVPPNGWLIGIEDLD

SEQ ID NO: 7100 - protein, 332 aa, unidentified
  source 1..332: note = Related to CP061913.1; note = Dactylosporangium vinaceum
MAIFSVEDLAQHAGVSTQTLEELAESLPSGAGTLYSRLTFPKKRGGFREVVSPRKTLDVVTKNLHRSFLDVFRYRPPEHVHGFVKGRSTISNASEHLGRTCVLRVDLKSFFPSIDSTRLKAAFLERVYDEKAAELCVRVVTISDKLPVGVSTSPFLSNLVFRATDYALLDYARAEGLGLTRYVDDLSFSGEVEDRHLSDITRILEDLGWRVNTRKTAFMRRGGPQYVTGLYVGAPDRPRIPRKTKRRMRWILHVISRFGYETYMTEFGGLEAGMIPQRLLGWSCYVASVEPDVGFPLFRAFREILPESYTPPSYYAGEIAGIRIIHELDDLR

SEQ ID NO: 7101 - protein, 332 aa, unidentified
  source 1..332: note = Related to QHBZ01000345.1; note = Pseudonocardiales bacterium
MVTIEDLSEYAGTSVAKLEKLADRLRERVDFSTHVYTTYNRGRREIVAPATALDTVTKNLHRSFVAELPYNPPLHVHGFVKGRSPLTNAAQHLDKACVLRVDLREFFPSINSDRVGTALQTQGFQTDALELCTRIVTINGRLPIGLSTSPLISNIVFEPTDYTLASYCEYEGLEFTRYVDDMIFSGDVADRNLGDIKEILLADGWLVNDRKTVFMRRGGPQYVTGLFVGCADRPRIPRRIKRQMRRVCYLIEQFGYQSYMEDFGGDDARMIPNRLYGWARYIASIEPSVGYPMLRLLSEHVPEKNAHSLDQTRFDHIGITVPRIVESLDDLL

SEQ ID NO: 7102 - protein, 337 aa, unidentified
  source 1..337: note = Related to nan
MLVSLKRIASVAGSSESELRQLADEVEEGQHFHVYRARLRRRDRSIYWPDTPYDTALKQIRPALERLLSYEAPQHVYGFVKRRSTRQNAANHLDADCVLTIDLADFFASIKREAVIGALGDSGADKDASEVIGRLTTPRGVLGMGLSTSPYLSNLVFLRTDDELASLATSLDIRFTRYVDDLTFSGAIDDKKAEHIKAVLISNGWTVNDRKTRFMRRGRAQYVTGLSVSDAVAPRAPRRLKRRMRWRLNMIERYGFYTYVTRFSGGSVDSMLHEAERLRGLAQYIASVEPNLRSGWLERWYRAVPTTSHRFDNEGDTTRLIKLDEDDIRRLLEDEAQ

SEQ ID NO: 7103 - protein, 320 aa, unidentified
  source 1..320: note = Related to PBTR01000101.1; note = Leifsonia sp.
MIPVTPTVLAKRLGHSVPTLENLAQIVQSGPSDDSYRLVRGDRELRVPTPQLKVELLPVAEYLRASLPRPAEHVHGFVKKKSILTNAKEHLGAPVVLRLDLRNFFASIQSDMVHAALTKHASFTDDAAHLLVAVCVPEGRLPLGFSTSPALSNLVFDETDRALETWASANHVALTRYVDDIAVSGHVDDRHLEDLTGILNEHHWVLNETKTLFMRRGRSQYVTGLSVSDPLQARVPRALKRRMRAKLFLMEKHGFDAYMKSFGGDDRGECPQQLLGHARYIAMVEPKLGGMLLRRFSLAIEESAYAGDPEEGWEAWALDL

SEQ ID NO: 7104 - protein, 324 aa, unidentified
  source 1..324: note = Related to NZ_JAFMTA010000001.1; note = Naasia sp.
MNISRRALAARLLVSNRYLDEAASRVTVGDAYILLSLHRRRGETPRQIFVPDAATAFLVKKFHEWITSVGPRPPDHVYGFVRGRSPLENARQHLAKQAVLRIDLRDFFPSISAQKVREALLSVGLDASAAEVATRILTVNDQLPTGFASSPALSNLVFRDSDIAISSWAKDHGLTFTRYVDDLVFSGEIGTEAVSAAVAMVEKTGWRVNTDKTRLMKRGGKQYVTGLAVSDPVRPRIPPSRKRSMRMKLHLIERFGYERYMREFQGEERGDTPGHLRGTARYMAGIEQPFGSNLLARLNAVLPEYWSMEDRSDPDWLEWLGDFH

SEQ ID NO: 7105 - protein, 587 aa, unidentified
  source 1..587: note = Related to JAAMSM010000030.1; note = Cellulosimicrobium cellulans
MVGAVAFESSFERTENLIADLYEGLVSESYLDGLDSYERFKTEGFHAWNDTAEVSTAFVRFLSRNRGYKSYIYFTDRTTRPDLGADQMHAILYRDLLRNLFQEYGSRRLRLIFEQNHKLDFELIATEAAEISAVRPPYSIEVGQKRAPHSLSIVDYAMAIFSRWRDTAYSTSPTTNKFRSWCAIRRWVAIVRSVEQGALYRRGHPVVSEERGVETLTSELNARDSRTQDGTLSSQPPSVAGPSPALEPLGRTEFVRSLGVDSQILESVGAAVREGQLYRVQQIRKRRGGLRKIYSPSIELKLIQKLIREELESALVYEDHPNVFGYISGRSIIDNARVHVGASVVLRVDLRDFFASITSDRVARALIDHGATQDLVSLLVPVLTADGILPAGFPTSPFISNLAFRHMDEALLELSNSHGLAYSRYGDDLNFSGEIDRDDAFLKLVERTLELDGWTVNQKKTRFMRRGGSQYVTGLYVGDSVPRAPRRTKRAIRAQSHFVSKHGFDDIAQARGHRVNTPARLAGWLGYLQRFEPDFVDNILGVGVLTLEDDRAGSRAAVDSSARGWDEYLSRGVLRHGKGSLHRADPS

SEQ ID NO: 7106 - protein, 326 aa, unidentified
  source 1..326: note = Related to CP072596.1; note = Tessaracoccus sp.
MDIRAFLRPIGLTEPQLRSLGDEIRAGARYSKRRVRKRHGGYRDIAVPDVELKAALKLLRIRLECVLPYEAPDMVFGYVAGRSIVDNASQHLGQACVVCVDLVDFFGAINGRRLESALLSQGLAEDLVQLLLPILVVDDSTPPGFSTSPMLSNVVFEATDRALEELAGEQRVRYSRYADDLTFSGQHVDDSLVARVDAVLLRQGWVLNPRKTRFMRRGGPQYVTGLYVGDAARPHVPRRIKRRLRAWFHYIGEFGYSDCEARVALPSGRQLEGWLRHVNQVNPEVVRSIVNDLGHSDLHVAFGAMGLELKGPPRDDWDELLGELGL

SEQ ID NO: 7107 - protein, 326 aa, unidentified
  source 1..326: note = Related to NZ_RJSF01000003.1; note = Marmoricola pocheonensis
MIDLADLGSASALDADEFIRWSNLIAAGSGYSRMSIPQRRRRPRVVLRPEVALDRFLKQLTIGLSRISGYMPPAAVHGFVTGRDIATNAAVHLDQDVVLRVDLKDFFGTINEQRLVRALGDYEFDEDAADAVAGVALVNDALAQGFSTSPFLSNIVFTESDAELTSFAARAGVSYTRYVDDLTFSGPYESVNDELLEAASALLADLGWSVNTGKTRFMRRGKPQYVTGLYVGDSAGPHIPRSMKRLLRREVYFASKYGLRDARLSSPTPMLHDRLNGWVHYAAHVDPVFGKKLLVAWNDVASRRYADRESAEWDAILEDINFPEDW

SEQ ID NO: 7108 - protein, 325 aa, unidentified
  source 1..325: note = Related to VDFS01000037.1; note = Georgenia sp.
MVSIRAVAHASALDVGELLHWQQLISSGAGYTRITIPQRRRRPREVLRPSVGLDRVLKQLNIGLARVSNYSPPHAVHGFIRGRDIRTNAAQHLDKDIVLRVDLRDFFGSIDAYRLTDTLTGFGFDQNAASAVLGVTIVNGSLAQGFSTSPLLSNMTFADADLALMKLAADVGVSYSRYVDDLTFSGSFGEVDDRLLLRITDVLESAGWIVNSNKTRFMRRGKAQYVTGLYVGDAVGPHIPRSMKRLLRREVYFASKFGIDNARLRSPTPMEHDRLNGWVHYAAHADPHFGQNLRDAWATVDSRRPASRSSAHRVQILDEIDFPES

SEQ ID NO: 7109 - protein, 329 aa, unidentified
  source 1..329: note = Related to NZ_SDPU01000011.1; note = Nocardioides iriomotensis
MFEVDVETLASASYMKSADVLVRWGEMLLIEGLGYTRIAVPQKRRRPREVLRPNIGLDRVLKHLRLGLASTSGYEAPDEVHGFVQGRGTVTNAACHLAQDVVLKVDIKDFFDSIGSEEVCSALTRFGFTDECAELVASVTLVDGKLAQGFSTSPLLSNIAFHATDEALAGFAHTRGVTFTRYVDDLAFSGTKDAIDDEFLESLDVQLGNVGWRINPAKTRFMRRGGPQFVTGLYVGDHAGAHIPRPMKERLRRELYFAERFGVSDARQRSPRPMSIERLAGWVHYAAHADPAFGLPLRDRWQRIAPALDSYVPGPDWDLLDDIEFPDDW

SEQ ID NO: 7110 - protein, 325 aa, unidentified
  source 1..325: note = Related to JADCLI010000002.1; note = Pimelobacter simplex
MIDADSLAQASGMTAGYLAHLGDLVQNGTGYSHVVIPQKRRRPREVLIPSVALDRALKQLRIGLEGRSSYEPHDAVHGFVAGRDIVTNASQHLGQDVVLRVDLADFFGSIDRDRLKSSLGSAGFAPSSAEMIANVALVNGALAQGFSTSPLLSNMSFQNTDKMISDLANQKSVTYTRYVDDLVFSGDMYAVTDDLSNAIETLLQEEGWKVNIRKTRFMRRGKSQYVTGLYVGDADRPHIPRGMKKRLRREVYFASRYGLTDARQHSPTPMDPKRLGGWVHFAAYADPVFGLPLRETWRAAVRSDPPPESRTWDSVLADIGFPEDW

SEQ ID NO: 7111 - protein, 326 aa, unidentified
  source 1..326: note = Related to NZ_WJWW01000001.1; note = Aeromicrobium yanjiei
MTTTRDLATHGGPSPQQYPFWAAVLAAGHGYSTLAISKRKRREPRVVLRPNVGLDRFLKQVSTALVAGLDFAPHDAVHGFVAGRGIVSNAAQHLSQDVVLKLDLRDFFGSVRREPLTTALVQAGLDEPTASEVAAVVTVNGSLPQGFSTSPLLSNVAFDPTDDAIQAIAASRGATYSRYADDLTFSGTNGAVDDTLLSDVVSALEHQGWIVNPGKTRFMRRGRAQYVTGLSVDTADGPHVPRVFKQNLRREIYFATRYGISDARVRSPQPLRESQLHGWVEFLAHVEPHRRAELREAWKIIAPRPSARRVELWDELLDDIDFPANW

SEQ ID NO: 7112 - protein, 328 aa, unidentified
  source 1..328: note = Related to QEHL01000037.1; note = Pseudarthrobacter sp.
MTVVQQKLVWRSLKWQLQVVGSMNGRLPTTSESSEWRQWAMEHARPVRFRGRDGWRSVGPLDSLLKRMTAALQSLYVAPDSVFGFVSGKSTYSAAQVHVGAPSALVVDLKDFFGQISEQRVRDALNPLLDEEALDVFVGCCLRSNTLPLGFRTSPLISNLVFRETDRDIERLCAARAVKYTRWVDDLVFSGSAVDDSFLHDLLAVLDSHAWLPNEKKTRFMSTRRVVLGLNVAQSLTRPHVPRGMKKELRKQVYYLSKFGMAHFSHAGAWPLPRILGMIAYVKSVDPNLAALLEQQLHALPKSSRLVAYSSAVGGGRWQMAMLEEVGL

SEQ ID NO: 7113 - protein, 303 aa, unidentified
  source 1..303: note = Related to RBIR01000012.1; note = Arthrobacter oryzae
MLPASASLSEWDNWAGENSRPVRFRGRDGWRSVGPLDSLLKRMAGTLQSEYSAPDSVFGFVPGRSTFSAAQVHIGAESALTVDLKDFFGQITEQRVRAGLGHVLDAEAMDVFLGCCLRSSTLPLGFRTSPVISNLVFAETDYKIEELCARLSVKYTRWVDDLVFSGPSVDDAFLAEVLDILTSFGWVCNEKKTRFMSTRRFVLGLNIAKGLDRPHVPRGIKRELRKQVYYLRKFGVAHFSNDRAWPLPRILGMIAYVKSVDPNLALRLEQQLVQLPKDPLLAAYSSAVGGGKWQLAMLSDIGM

SEQ ID NO: 7114 - protein, 308 aa, unidentified
  source 1..308: note = Related to VFNL01000001.1; note = Microbacterium sp.
MVYMLPRRALLISWEIFSVRIQLADLPPRSAPEWDAWARKNERVVSFRTKHRWRQARRATGRLDSAHKQARALLAAGWAPSAAVHGFVRTKSTKSAAMVHSGARAALTLDLADFFGQVTFNRVVDNLRMRFDDRSCDWIEGACFRDGAIPLGYRTSPALSNLAFSLTDDEIADVARRHGVAYTRWVDDLTFSGAGVSDQLLADVQRTLAGQGWAVNDRKTRFMRRSPYVLGLYVGHDVDRPRLPRRMKQRLLVETYHFSRLGFEHFSHEGVMSPSRLFGRVAYASVIEPELAELLNERVDAGHRVGRS

SEQ ID NO: 7115 - protein, 301 aa, unidentified
  source 1..301: note = Related to CAKKLT010000065.1; note = Microbacterium oxydans
MITWLHFSARLGLYDLEPRSASDWATWASRYRVPVSFPVRGGRRVTVRSVGRLDLSLRAFKSLIAEVSFPHASAHGYVRGRSTVSAATPHVGSSLVLSVDLKNFFGQIDFARVSPVLEASFDAQVCQWIEGVCFVSGSLPLGYRSSPALSNIAFASADLEIFNFAAKAGVEYTRWVDDLSFSGEGVGDGFLEGLQALLADEGWLVNARKTRFMRRAPYVLGLYVGRDATEPRLPRRIKQRLLLESYYFAKYGMSHFDRPYVLPPLTLFGYMSYAYSVEPRLATVLGERIVKGIGKSGGRLR

SEQ ID NO: 7116 - protein, 323 aa, unidentified
  source 1..323: note = Related to AP012204.1; note = Microlunatus phosphovorus
MTLSRVRELELKMGYAPGSLDRLARIFDAGAGHSVIRISSGKSKTRHVVRPTVALDGMLKSLRRVLEAELGFEPMDCVHGCVRGRSILTNASMHLARPVVLRVDLKDFFDSISTSDISDAFKVLDVDDETAELLARCTTIHGRMRAGLSTSPLLANLVFNSTDRDLQEIAARLDLTYTRYVDDLVFSGETITDDTLATIAEQIVARGWTINARKTRFMRSGGAQYVTGLSVDVESGPHLPRRMKRFLRLEVHYATLHGFGSGSTGKRRLIGLINYAKCVEPWLGAELHDSIREAGLLVGRSESEDAFEDAEDFWDELGLRDEY

SEQ ID NO: 7117 - protein, 320 aa, unidentified
  source 1..320: note = Related to NZ_JACCBU010000001.1; note = Microlunatus parietis
MAVTVDQIERMMGVPPGTLDKTARILEAETGFTILRIPSRRGRFRRVVRLTTTLDSIIKGIRRSLEAQLSFVPRDCVHGCVKQRGILTNARAHVGKKVVLRIDIRRFFESISVSQVEDALRTSEADPESSALVARCTTLGGFLPVGFSTSPLLANMIFDGTDALLGDCAKSYSLSYTRYVDDLSFSGEHLDDQIRLEIEGVLRSQGWEIQDRKTRFMRAGHAQYVTGLSVNDPNGPHIPRNMKRFLRLEVHHVVRSGFGASVLGKRKLLGHINHVKHVDYDLGLELHDAIRSAGLLVGRPDDESPEDGLELFWEDIGIDF

SEQ ID NO: 7118 - protein, 325 aa, unidentified
  source 1..325: note = Related to JAFBCF010000001.1; note = Microlunatus panaciterrae
MRSAARLGFVAGVRASALQQMALTFDRGLGYSTLEVPKRGGGSRTVLRPVSELDHNLKLLRRGIDTLSSYSPPEWVHGFVPKRSIVTNAQAHLSKEIVLRLDLSAFFESIKKSAVREAMLRFGFSDDASTLISDCCCIHGSLPAGFSTSPTLSNMVFLPTDDALHEWAGSRTLTYTRYADDLTFSGTDITDDDCAEIARMLSSAGYAVNARKTRFMRRGGPQYVTGLYVGESDQPHVPRRMKRLLRQQAYYIAQYGYSEAQTRSSRQFTPYQLRGWINYMGTLHPELAARLRCAIFARLPQAPERPDPSDYWDDLLDELHIPDDF

SEQ ID NO: 7119 - protein, 330 aa, unidentified
  source 1..330: note = Related to WRPM01000031.1; note = Nesterenkonia alkaliphila
MRESAPRTFSHREEAPMTILSDTLTLDDLVIAATLPDTARDLMEEPVRPWQLNTITVRKSPGKFRRVVEPRDNSLARVQKKLKEFLDRDVLEPHPCVHGFTRDRGPYTNALAHLNARAALTIDISDFFSSVSSDDVQSTLVSFGASTAVARGITNVSVFENVLATGFSTSPVLSNMYFRDTDDVLATFAEEFNLTYTRYADDLTFSGEDVDDTHLAEITRVLESKGLRVNQKKVRFQRSGHPQFVTGYVIAHRDHPRVGRYFKRQLRLDLHYVMKHGLVHQAQLRGLSPQVLAKQLAGRINYLMCSERDLAVHLRQKYGHLLDDVDENPY

SEQ ID NO: 7120 - protein, 306 aa, unidentified
  source 1..306: note = Related to NZ_CP071516.1; note = Arthrobacter sp.
MTVLSRIRNLEELTVAASLPRTAIDWLAKPIAPSEVTVHTTRKSNGGYRVVCQANDEKLVRLQKRFKEFIDRQVLVAHPSVHGFTRRRGTVTNASAHLGAAALLTVDISNXFPSISRQQVEFALQEHGASETIAAAIANIATFDSALATGFPASPVLSNLVFRPLDDEFEHFANVNGLTYTRYADDLTXSGESVNDAHLEAISATLSLHGFRTNTKXVRFQRRGHRQIVTGFTVAHADHVRLPKPKKKILRQDLYYSSKIGLAAQASFRNLDEEDFRNQILGRINYFMSVEPKLARVLRHEFDLLD

SEQ ID NO: 7121 - protein, 335 aa, unidentified
  source 1..335: note = Related to NZ_CP018135.1; note = Neomicrococcus aestuarii
MRFARVSYLVGIVVIGDFRAPHPRKEEVSILKDLRTAEELQIAAALPDSALLWLCRPLSAEDIYVHEIRKSKGRFRRVYEPRDNSLARLLKQLKEFLDRQVFQPHANVHGFIRDRSIFTNATAHLGARAILAVDISDFFSSISRDQITGALISLGASDQVAVSIANVCTFRNELVTGLSTSPVLSNLVFLPLDKNFESLAVERGLTYSRYADDLTFSGDAVDDQLLAVVAERLSEHGFKINLKKVRFMRKGHRQVVTGVSVACGDKLRLPRNFKKRIRQDLYFSEKNGISLQALHRGFSNDEDFRESLKGKINHLNSVDSSAAKLFMSQLNNISS

SEQ ID NO: 7122 - protein, 328 aa, unidentified
  source 1..328: note = Candidatus Zambryskibacteria bacterium; note = Related to JACOVQ010000014.1
MHPVGINIERIKTLIELASLFDVSEEMLQGFIDNHDELVARVLMLKNRSGEYRKIVFTKSDPYRIFLRTLSAFLYEWYSHRIPDSVHGFVKRRSIITNAQQHTQKKSVTNIDIKHFFESITFKEVHGIFIKVGFQDKIAGKLTELVTVDGVLAAGFATSPVLSNIACLDLDEDFKNLANEHGLIYTRYADDITLSSNKEIPSKEEIKNILIKYGFEINENKYRIYRRGGPQYVTGLSVVDKRPRLSKKFKRRLRLELYYIKKYGFMDHWAKAIKRAIDKNTYPSRFSQVAYGGWGLEGFAAFIHSVEPKLGSKIFKTLLKRGEDEMYW

SEQ ID NO: 7123 - protein, 326 aa, unidentified
  source 1..326: note = Related to MHXK01000022.1; note = Parcubacteria group bacterium RIFOXYD2_FULL_52_8
MFPTNIDIGKIKTLSELAPILSVSESQLRYFLESKESLIKRGLILKRSGTFRRIMMAKDDSFRHFLLKLSSLFYSKYELHIPAAVHGFVRGRSIVTNAQQHTQKKIVLNVDIENFFDSISFEQVVALLISFGFQENIAKVLAELTTVNGILATGFSTSPVLSNMACIVMDGVFKSWSKKRNFTYTRYADDLTFSSEQYVPAQKEIAEILGHFGFKINLDKYRVYRRGGPQYVTGLTVVDKRPRLGRKRKRSMRLELYYIKKHGFLNHFYHALDRATKRHELPSKFTRTVFFGYGVDGFRAFMHSIEPRLACNMQQVLKKEAPKARN

SEQ ID NO: 7124 - protein, 442 aa, unidentified
  source 1..442: note = Related to SJJY01000010.1; note = Kribbella speibonae
MPGGDGLRSWRHASAPFRRCLRLPRGALRRIGQKLRLPHRLRRRPTPRRQKAPYTVDAGGAAALGTSRPRDHVMCENPAMAPPVPLFEFTCHQSVASLEVPLGKPTHALEHLATTCDSGGAYQLNYFWIRNKLRSVSAPNHQLDLVHRRINSLIFPVDLAMRREVNGFIARRSTITNARPHAGARYLQKFDIKDFFINIRTLQVRAALRNIGFGPGAATMLSRLVSCNDRIPLGARTSPRISNLVLMSFDDAMIALADERDLAYTRYADDLSFSAQAMFDVSSEVRAALTSSGFELNASKTKSFKHGQPMFVTGLAISDASRPRLRKRLKSRLRREFYFVERFGLAGHANKIGAHPERTASRLLGQFHYARSVEPEFATRLEAKYPTAFGELIPQRTDDRVERAQRSRREFLTDVENAPQQTLPFYTPTASLPFVPAHRAVE

SEQ ID NO: 7125 - protein, 357 aa, unidentified
  source 1..357: note = Related to WAAQ01000003.1; note = Microbacterium maritypicum
MAPLTRQLEFTFHETAASLESVLGKPSSAIEALASSCDAGTAYEVGVLSIRRKLRVIRVPERELDAVHRRINMFLFPVDLSMNPHAHGYVARRSTLSNASPHVGATFLQKFDVKDFFSSVSREQIAGALTRIGLGQDAAQLLSRLVTCQGELPLGARTSPRISNLVLADFDESIGAVASDAGLTYTRYADDLTFSSQSAFDVSHEVRTQLELRGFELNLAKSKSFRYGQPMFVTGLSISDKTRARVRKRFKSRLRKEFYFVEKFGIEGHAEAIDEDEHHASARIMGQFHYVRAIEPDFAAKLAATYPTAFQTLIPERYDDRIARVQRKRDEFLTDVARQPGLHLPVYLPTTPLTVGR

SEQ ID NO: 7126 - protein, 356 aa, unidentified
  source 1..356: note = Related to VYRZ01000003.1; note = Microbacterium radiodurans
MAPLDPLFEYRVHPTRASLEAPLGRDSMTLEGLAARCDEGDAYVTGFMTIRGKSRFIAAPRPELDAVQRRINLLLYPIDLSLGASPHGYVARRSTLTNARPHVGARFLQKFDVKDYFASITASRIATALTELGFGSEAATLISRLTSHRLRLPLGARTSPRISNILLIDFDDQMENLAREQGLRYTRYADDLAFSSQIAFDVSDRVEQAIRAAGFELNPMKTKQFKHGQPMFVTGLSIQDATRPRVRRRLKARLRQEFYYIEKFGIEDHAAAVGESWRGVLHRLTGQFHYCRTIEPQFTAQLTLDFPAASSSVAPVHEDSRVERAQRHRREFVAEVMRQLPTAIPFYVPQADLFEN

SEQ ID NO: 7127 - protein, 360 aa, unidentified
  source 1..360: note = Propionibacteriaceae bacterium; note = Related to JADLEH010000111.1
MSTPAGPFDYILSEQHLARALGVPVALFEYVGNLAEMGKAYEYRRKSIHGKIRELGVPVDSVMSLQRRITDFLWPLSLELHPACHGYTPGRSATTNAAPHCGARWVQRLDIKDFFPRTTPNIVTKALVERGAHQTVAELLTKLTTDRGSLPLGAPCSPLLSNLILTPVDNRVADQAASIGVSYTRYADDLTFSADAEFDMTGVVQSALQPLGYTLNLEKSRLRRRGQSIAVTGLRVAEMDHPRLPKRFKRELRQEFYFIEKFGFADHCNTRYFWHWIDEEDDEKQLDHSTRHLQGKVRYALGVEPDWMRALLDAHPVAASELTPPKRHQADQRLAALTALAAEIVGRRHVSLSREPTRLG

SEQ ID NO: 7128 - protein, 366 aa, unidentified
  source 1..366: note = Related to JAAYZP010000360.1; note = Propionibacterium sp.
TGPFQFRGTNALFATALGLTAEQLEEAIKLAGERSSYQFRTVRKRGKERTFISPRAPLLNLAQRRVADFLRPFNELLHPGCVGYVPGRRTLDAATPHSGKPWVQKLDITDFYSSAQDTIIHDTFVSLGATQEVSETLTSLVTWEGVLPTGTRTSPVVSNLVLADFDFECAAEAERRNLAYTRYADDLIFSGDDPFDMSGWVDHHLQAIGFKLNPRKSVLCRRGQPIRVAGLTIFEKDRPRLPKALKRRLRLEIYLVSKDLAAGHFESPGDEDDYPPEVEEARARFFHAQGMLRYSAGIEPAFVQSALDKHGEELRDLLLPARRRHRDELELRRLLAKILGTRAPGLGRTPSPIPSAPPISRVSSVG

SEQ ID NO: 7129 - protein, 355 aa, unidentified
  source 1..355: note = Related to NZ_RKHL01000001.1; note = Plantibacter flavus
MTPRTSPASTLRSPRHLELYLGAPLSALEAIAADLAAGVGVEVVTLRSKGKAREITCPTDETVRNVHRRILSMMTPVQMDLPDMVTGYVRGRSSVSNAQAHAGGAFLQKFDLRDFFHHISSDAVATGLRDVGFQAEVAALLAGLTTCRGLLPAGFSTSPAMANLACRALDEDIAALADSLGLIVTRYADDLTFSGAQFFDVRSDIGVMVKAHSHVLNEEKTRTLKRGQPMYVTGLSVSENDRPRLPRPFKRKLRQELHYISVFGLAEHADRHGVKVEGLRFRLGGQLAYASAVEPDLVKYFEAHFPAAYRDVARARSPISDDKRRTRLAQLAARVAARSDPLAEMYEPTVTIAAL

SEQ ID NO: 7130 - protein, 353 aa, unidentified
  source 1..353: note = Related to NZ_JACCBH010000001.1; note = Microbacterium pseudoresistens
MTPRTSSVSILRTPRHLEVYLGAPLAALESIARNLDVGIGVEVVTLRSKGKARVIACPTDEAVRNVHRRILSLLTPVQMDLPDMVTGYVRGRSSVTNAIVHAGAAHLQKFDLRDFFPHIGVDAVDEGLHAAGFQEEVARLLSRLTTCRGYLPAGFSTSPAIANLACQSMDAELAALAEQEMLNLTRYADDIAFSGMEPFDVLDEVRQIAIAHGHALNDEKTRTLKRGQPMYVTGLSVSEQERPRLPRPFKRGLRQELYYVQTRGLAEHASWRGAKAEAVRYRLGGQLAYASAVEPGWVEALTTAFPTAFQEVARRRSSQSDAKRGERLAQLAARVIARNDAAAELYEPSATIS

SEQ ID NO: 7131 - protein, 358 aa, unidentified
  source 1..358: note = Related to NZ_JAGXJI010000001.1; note = Microbacterium sp.
MEIDRRVPSFADWLNEADVANAVGMQLESLAQTARRLAEDEGVVHSRILTIRGKQRLVHTPRDEGVRQALIALMASIELPIATVLRRDEIAHGYIAGRSAYSNASSHAGAFWLQQFDIKDFFPSISATRLESALLEAGMGARAAQFVTSLTTYGGSLPLGFVPSPLLSNLVATGIDVGLNDLAQQHGLTATRYADDITLSGPHEFDCTEEIEAIAQASGFALNPAKTKAGEARHGARVTGFVVSTGSPRLPQHVKRQTRQDLFSIQRIGIEGQASMRGRTPQSLVRRLLARLGTLRKCEPVVYERLKRDYPHAFVDLESYRTDALAARARRADALEQQLLLSSSPAPAYYIPTHPAGR

SEQ ID NO: 7132 - protein, 334 aa, unidentified
  source 1..334: note = Related to FOYR01000002.1; note = Microbacterium azadirachtae
MRLSALQEIAQRLRAHPAAVHSRHLLIRGKKRLVHTPRDEGLRQALVALVGCIELPIATTMRRDEIAHGYIPGRSAYTNARCHVGATWVQRLDIKNFFPSISAAHVEAALTEAGMGEDAARFIVAFTTFGGSLPLGFIPSPLLSNLVATNIDIGLLRLARERGLCVTRYADDITLSGEELFDCHDDVATIVGESGFALNLAKMSAGTPRNGFRVTGYVLSTGDPRLPRHVKRETRQDLYSVERIGITQQAKHRGRTPQSFGRRLLARLGSIRQSEPLVYERMRSDFPLAFERLDALRESARVTREQKSAMLERELLSMPSAAPAYYTPLHPAGR

SEQ ID NO: 7133 - protein, 361 aa, unidentified
  source 1..361: note = Related to JAHJKW010000011.1; note = Actinomycetia bacterium
MTPPTHLEYSVVDSVGVLAGQLGRTAEDLFQMAEEIASNVRYETQAVRIRGKVRILTVPDDRLKYLQRDICEFLIPANDRLSPEVHGFARGRSNRSNAISHAGRIYIQRFDLKDFFGSVTSAQVLAAFRELGLSDPAAHLLTELTTYRRALPQGAPTSPILSNLVMREVDDRMRELAHSRSLSFSRYADDMAFGGNERFDLSSEVEDIIDAYGFRLNDSKTAFAGPGQPRFVTGLYIDEDRVRLRKSFKRKLTQTLHYVEKFGIDDHADRVGKAPSKAQEQLRGRIHYARQVEPAWLDKQRSSFPRTLNELVPMNYEATRGEYLLARRQGFLSGMAGMTAASALRYVPAVSYAEVKSPVVV

SEQ ID NO: 7134 - protein, 554 aa, unidentified
  source 1..554: note = Related to SDNX01000008.1; note = Candidatus Lokiarchaeota archaeon
MEDYWYIVIGMVALLVIFCLCIGFSGGKWNYAAYIKEKNERVQRKRWNKYVKFLDPVKETELLNIIKLSSDADFEAFLKEIQPLLTKKYNPYNLNEQTLLKRTIYNVINRYTTQFKYDRVKKIEAILPMLKRVFLGPRLTNQVYSKKTLKRRFKFPLKSGVEIPKLDTIIDVAFFFNISVNKILGLCYMQEKNPGAYYVKREIIYDQMGEKGIILHQKDPAMVQLDSSYAIAEPNILKKKKSNQNEGKNSEDIQEKLEEIKPSFKEYSSPFYKRKMLTKPDGRKRLIACPVSYLKKYQRKILGDILEKVALPTNCTGFVKNRSIISNAANHVGSQTLVKIDLKNFFNSMKFYHTFEVFRGFGYNRPVSGILACICTDWYTKGGRYVPQGAPSSPMIGNLYALHLDKRLEGLWTKAGFVYSRYADDLAFSSSDPKVRVRGLIFASYQFIKDEKLSPNPAKTKVLRKQHKKKVTGITVNEKINIDRRWMNAFRGELHRYSKFGLPSDGVQRSKIFSQLKGKMSFLQMIDQNKAQKYDLYFEKIRTEYAKLLGNSSQ

SEQ ID NO: 7135 - protein, 538 aa, unidentified
  source 1..538: note = Related to JAFGBS010000004.1; note = Candidatus Lokiarchaeota archaeon
MDAFRYSLYISVGFGLLVFICCLLSSKKRADYEDYRREKWNKYVSFQDPELRKSLEHDIIVSTDEEFEAFLVSLRSSVKYRRDKNGLRIRKNICMFINNIWMNSYSEKGRKIYKRLKKLEEIVPLLKRVYFGPKYTPIIYRERKYEKSYQRRKFNFPLQPDSTAPKLDTIIDVAYHLQTSIRLILAIIYTQSHSRDRNYVKITQIDKALHQKGNSYLRVVGSPIARHVDIDQSFILKDKRGKVPKNAKTTDPQDAYLEYKELDSNFYTRKTLVKPNGRKRLIAVPNEKLRSFQRIILKTILEKAALPDVCTGFTKTRSTVTNAEFHVGAQTLVKVDLHNFFNNLSLDHVFEVFRGFGYNRPVSGILANLCTDYYRSRRYLPQGASTSPMIANLYALHLDRRLEGLANKYDLIYSRYADDLTFSSKDPKIRVRTFIQAVYKIIKSEKLYPNYQKTKVYRKQHKKSVTGITVNEKVNIDRKWVNAFRGELYRYSKFGVPEEDRFRIVHQMHGKFAFLKMVNPEVAKKYETQISKFIAENS

SEQ ID NO: 7136 - protein, 524 aa, unidentified
  source 1..524: note = Candidatus Prometheoarchaeum syntrophicum; note = Related to NZ_CP042905.1
MLLEGLSGEAAGLIIIAFMIFVFCLCLAKLLGYSGYLHGDYRWNKYIKSNEPSIEKEIYYNIQSLSDEYFKTYLQSIRKTINYKFRTGDKSLKNTILKRSMLNIINKHTNELPNERIKQIEEIFPLLRRVYFGPGLNKEVYDKKHFKKKFHFKLKPEHTIPQFNSIIDLALYFKIRVNALLGYSYNQKTKRTAYYIKRKKMFENFGQNTIPDDYRYIKKSYSELKEEKKKKSKKQPEIEIPSFKELESPFYTHKFIEFPNKKRRLISNPNYWLKQLQLKILRDILEKVEIPDYCYGFVPGKSTVDNARIHLKANTLIKIDLLNFFPSLKFWHVLHVFRGIGYNRPVSGVLACLCTDWYHSKRFVPQGAPTSPMIGNLYASRMDVRINGLANKYGLKYTRYADDLTFSSINEKIQVRKFIASVYHIIRDEKLYPNLKKTKVFRKGNRKAVTGIIVNEKLNVDRKWVNSLRGELYRYQKFGLPQGEEGDIIYNQLQGKIAYLHMVNPEKANKFSLLFQKLRELNRK

SEQ ID NO: 7137 - protein, 487 aa, unidentified
  source 1..487: note = Related to WJKO01000714.1; note = Candidatus Lokiarchaeota archaeon
MASELTLILVFVGLVYFLIFVCAAAASKRMRSRYPKPKPGHRYRKLKRVRDPKIQAKVRERLTKWEGAQYEEWYKDTIKKINYKYRTNQRQKKWTVLKRAVLDIINKYTYEIPEERLKKFSQDFPLLRRVYFGPKLNKQVYNKKNLARKFKFKIKDGTEIPHLDNIVDIALFFNTSVNVLLGYAYTQDLSNKSYYIKKNYTKKRKRKDYYEQKSRFYNRTTLIKPDGRKRLISSPKYNLKNLQLKILHDILEKAELPDCCTGFKPGNSIVDNAKPHIGKSTMVQIDLYNFFPSLKFDHVFEVFRGFGYSRPVSGVLAGICTDFCNSPRFVPQGAPTSPMISNLYASHLDKRLKGLWTKRGFTYTRYADDLTFSSDADDIKVGNLIHATYEIIKDENLKPNYKKTKVYRKGHRHEVTGIVVNDKLSVNRDWIRELRAELHNYNKNGLPDGIEGQQILNKLQGKISFLNMVDPEKAARYRAQFAVLTKD

SEQ ID NO: 7138 - protein, 349 aa, unidentified
  source 1..349: note = Related to SDNE01000165.1; note = Candidatus Lokiarchaeota archaeon
MLESQEKLDLNMHDSNRSKLKIKELPLVLNLRDLINFLEISHSLLENYFTFKSSLLIYKTFFIAKKSGGHREIFIPVPKLKSIQSKILVEILEKINISKFAHGFIKKRSIVSNAQEHLESQVIYKIDLVDFFPSIKFDKVHEVFKKIGYSEYISYLFGLLCTHLRGYNEMSQEKSSLNLNKLRFLPQGAITSPIISNLVCSKLDKDLNKIARIYGFRYTRYADDIAFSSQYRKDITNKFRKKIHSIIKKHGFSINRKKECLSYNRNFQRVTGINVQNSELSLPRKWIKNLRSALHHLENDYNQIDEECIEIMKNIEGRCAYALMVNKKKYNHYYQDFISIKNNISKRSE

SEQ ID NO: 7139 - protein, 358 aa, unidentified
  source 1..358: note = Proteobacteria bacterium; note = Related to SEDY01000002.1
MFKLCLCGVIIMLKPLGSPATLLRRRELSHRELNRHLGSQPGLISSIIEKGVARHYHKKTILSGNRFMRRSHDLQKMREILEPQDDLKEIQRAISRVLSRYFVPHEIAHAYVKNRGIVTNATRHIGARSMLHIDLADFFGSITQEAVLNGLYHVLEDFYASDIETIAELCCYDGFLPQGSPASPILSNLVCFPLDMELSELARSFGCALTRYSDDIVFSTATRSLPSKLARVSDREAAYTVKLGQPLRSLFELHGFELNMKKLRFQRWPGPLKVTGVLVGERLHVPREFRHNIGAALSQWKRHGIVVAARNHPKGSAEAFAGSLKGCIDHVGHVEGRDSTHYRRLLIDLETLIARDLN

SEQ ID NO: 7140 - protein, 360 aa, unidentified
  source 1..360: note = Related to CP012199.1; note = Sphingopyxis granuli
MQYKSLERRLGLATGAVSTVMNADAGTRYTRFPVSPKRGIIRKPGWTPKKRMILAPSKDLKAIQRAIARHISSKFTAHPIAHAYENGRSIFANARQHVGARSILKIDLVNFFGSIGRQSIIDALRLLLDDFGDRDIEVIADLCCCDGYLPQGSPASPVLSNLVCYPLDVELDRLARRHGCKVTRFSDDITFSTSAEVFPPVLARTWRSGLAHGVALERPICSLLQQRGFEINIGKLMFRTRPMPLKITGLIVTDSLSVPRAFWHNLRASLHNWDRRGLDTCARTHANGCVVAFVNSLRSSIEYIGQVQGRDCKRYQRALAAFEELRSRDKEPLSAAIQRIAAARKAKKAKDENVIIPGTG

SEQ ID NO: 7141 - protein, 356 aa, unidentified
  source 1..356: note = Candidatus Shapirobacteria bacterium; note = Related to QMND01000158.1
MFKAGVSNFDLKQVLGAGLETVDEIIANKENHIERISIPKKNGGKRNIIAPDPQLKYIQKSIYWRVFRRYKADPSAHGFVLKRGIVTNADCHVGAKCLGKIDIKDFFDSISIDHLKNCLFGNKHICRYCKYYERMLDGRCNPSLYHNKTHNFDFKCEEIKAVHIPAYCEETGYISLFNRIIELCTFEGFTAQGFPTSPMLANIVMRGFDKSMKEFCATEGIAYTRYADDLAFSSKNLTKFELKKKIKQKAYQLLWAYGFAPNKKKTIWKSSAGRLKICGVVVNVKKSVQRKDVHKFRAEVHHATVKNADKTTKGDLRKLKGWASFLMSIDPVKGKKYMNQLLKFEADKFSIKSKGI

SEQ ID NO: 7142 - protein, 305 aa, unidentified
  source 1..305: note = unidentified bacterium; note = Related to JACNHT010000021.1
MNIYELLNTTSKEVSSIILELDQHYLSYPIAKRNRKTMRWIDAPQGKLKELQETFLHRYLYRFSAHPSCVGFVKGKSVRTGAERHIGTEQLLNMDLKNFFSTIKIYKVAKLLTFLTSRHSTITGKQVTFVNTDDKEKLARLLTYKNTLPQGAPSSPAIANLCAYQMDVQLTALAKNNGCIYTRYADDLTFSTKKTKDKFNIIGMIPQIRETIEKNMFSVNYKKTRVQKQNNRMTVTGVVVNKKLSTPKWYWRNFRAKLHNLEKSGVPITEEEYQEIRGTAEWIKSLHPVRGEKFLETLGKLNLTI

SEQ ID NO: 7143 - protein, 304 aa, unidentified
  source 1..304: note = Related to JACNIW010000301.1; note = Rhodobacteraceae bacterium
MNIYDMLATDKQTLKTLQTDIDNQYLSYPIAKKKGKAIRWIDAPQPELKTFQEAFLNSFLYKFTVHPCCVGFVRGKNVASGAKQHLGSKQLLNMDFQNFFGAIHIGKVRQLVKFLFSRYKKITDNVFTFTSYDVELFAALLTFKSRLPQGAPTSPAISNLCTLPLDKELAALAAQSDCIYTRYADDLSFSTKQEKAVFDVKDLIKPVSKKITRAQLTVNYKKTRVQRPHNRMTVTGVVVNEKLSTPKWYWRNFRAKLHNLQMSQVPVTPEEYQEIRGTAEWIKMLHPIRGQQFLNTIGKLNLML

SEQ ID NO: 7144 - protein, 327 aa, unidentified
  source 1..327: note = Anaerolineae bacterium; note = Related to WVYK01000372.1
MFLPLTTDEFLDRILVVKNQWKRSTIYYHAKVQHYKKHVREKKPVKNILVMGDAPVPKLREINEPCPALKWIQGYILRMVLDPATDQLMKCAHGCVPGRSTVTNAAPHVKSRWKIHMDLKDFFPTVTVQRVYGLFHKVFKYGPDLSWLLANLTQYEGKLPQGAPTSPAIANHVATPMDRHLVKLISKMGGYYTRYVDDLTFSFPRQMSDKNKTRFIKTVREIVERNGFVVNEDKTSIIGRGSKMTVTGIVVNAKTSTPRWFRRNIRAALHQRALGVPSADNDHVIGGKIAYVNMVCPEQANAFHLKTCQVDDCKKCYGLAMKSKNAS

SEQ ID NO: 7145 - protein, 517 aa, unidentified
  source 1..517: note = Candidatus Falkowbacteria bacterium; note = Related to JABHAL010000007.1
MPTEKKKKVNPLDEYTDFGTILVLSERLAQYLRLLFKLDKASWNFALDKIRQGKAYREWRKFKGRGKGYRYFAAPCAELKTVQRSIKAQFLDQIPIHFSRYGCQGGTGIVEHAAAHMGNKVAFGVDIINAYPTVLRSRIRKCLQKPFRFMLRQFGDVTWLEDDVKNMLEAVVDLLCLHDRLPQGPPTSPRILGIVCYKMDTAIFSYLHESSSPLQGFNMTSWFDDITVSSDKEIPEEMRAKILALIKEHGFIPHTRPDKTKYYSPETGEVPIVTGIVICPDGRLTMAPRKVNQLRAAFNNWLKIEVWDEHILGKVNGTLGAVRQLYPEKLPSKLRVLVGKIEDRLHAGKVAKSLQYLDNALLPSGLQDLAKQLSMVVIDGQGDVSSQLLGDNLLFVDGAARKSYQAGIGAVLIKDRTEVSTISQLIGKATSNQAEYQAIIVGLTAAKELGIAELDCFTDSMLVVNQLNGKFAVSKPHLRTLVAQVKALVKEIGTVRFHHVPRELNTSAHSLAHMALK

SEQ ID NO: 7146 - protein, 374 aa, unidentified
  source 1..374: note = Candidatus Falkowbacteria bacterium RIFOXYC2_FULL_48_21; note = Related to MFGM01000084.1
MAKRGKRKNKKPFVFKDFETVLALPERLAEFLRLLLKLDKATWSFALDKIRQGAAYREWSKSKGPGKGRRDFAAPCAELKAVQRAIKQQMLDVIPIHFTRYGCSTGVGIKENAAAHVVPGVSVCVKEFDIMNAFPTVLRSRIRKVLQKPFRFLLDQFAGMEFGDDDVKLMLESIVDLVCLHDRLPQGPPTSPRLFGIVAYRLDCALFRFLHENSTEFQSYKMTSWFDDVSISSRDEIPEEVGVKAAKIIEEHGFTAHHRKDKSKYYSPATGTVPVITGLVLCADGHLTMTPNKVNQLRAALHKWSGEKSWDEATLGQINGTLGCIKQVYGDKPPSKLRKSVREIEARLAMMKIEKLQADVARARVMPKKKSKKK

SEQ ID NO: 7147 - protein, 454 aa, unidentified
  source 1..454: note = Candidatus Taylorbacteria bacterium; note = Related to SICH01000034.1
MMGTSRFMVSLPCIMASSFKREMGKMAKTKRRKKRKRAEWTWVDFRVILDLPERLSRYLRELLHLDKPSWDFALERIRRYKQWQNEKKEKPDLGRLPRTQVAYFEWSKSKGRGKGRRYFAAPCAELKLVQKAVLNRLLASIPVHFCRHGNQPGSSILSNAARHMGFAKSVFSIDIVNAFPTVFRSRVFANLKKPFKFVLRQFAGVEFSEDDIKQMLEVLCDLICLHDRLPQGPPTSPRILDIVCAKMDQELYALLEKNSTPFQSYRITAWADDITISCDGEIPEELREQCLKVIKDNGFIPHTREDKTKYYSPETGEVPVVTGLVLTSDGRMTMAPRKVNQFRATLHQALKRSEWDAQIRGQIAGTMGYIRQIYPDKLPSALRELVPQTEARMQEECKKALQLNGEATPTVPPNSLPKKKGKAKTKPAKTPKSRTSDEAEESSATETVLCEMQS

SEQ ID NO: 7148 - protein, 437 aa, unidentified
  source 1..437: note = Candidatus Yanofskybacteria bacterium RIFCSPLOWO2_12_FULL_44_13b; note = Related to MGKZ01000009.1
MAKKAKKPRGTAPEEQKKRRRRRKEWTFTNFQNVLALPERLATYLRLLLHLDKTSWDFCLDKLRQHVKWEAEVEDKRPKVQINVKGRERTSRSGPAYLAWSKSKGRGKGRRYFAAPCDELGRVQKSILHRFISQVFVHFARYGGQVGSSIMANAGHHAGFAKSVFSLDIVNAYPTVYRSRVRATLRKPFEFALRQFKGVTFSEEDVLKMLDSITDLIVFKDRLPQGPPTSPRVFDIVCGKMDQEIFQWLESNATPFQGYRYSAWTDNLTISSDGEIPLEVRQKVIEIVRENGFFPHMREDKMKYFSPETGERPIVTGLVVLPDGRITMAPRKVNQLRARLHQLMLRKAWDKEAMMLIDGTIGFVREIYPKNLPSKLRDVVLAVEARRASMRVPVVHDESIEDEDAIMLDEDPETKVPSPSKKKDEGPTETVSEVVLM

SEQ ID NO: 7149 - protein, 436 aa, unidentified
  source 1..436: note = Related to MHXB01000023.1; note = Parcubacteria group bacterium RIFCSPHIGHO2_01_FULL_45_26
MAEKPEKRRQRRRKEWKYDNFAAVLALPERLAHFLRLWLHLDKSTWDFCLDKLRQHRAWDEQVAQFRAQEGKKRKKGEAEVPKPPRCGPAYLEWSKSKGRGKGRRYFAAPCEELKVVQKAINNRILAHITVHFARHGGQIGSSILTNAGHHAGFAKTVFSLDIVNAFPSVYRSRVKAVLGKPIRFGLQQFAGVAFSPEDEEAICASIADLLVFKERLPQGPPTSPRVFDICCGKLDQEIFALLQGHSTPFQSYRYTAWTDNLTFSSDGEIPEPVREQLVELVRKNGFFPHTRPDKMRYYSRETGEVPIVTGLVLGAEGMLTMAPRKVNQLRARLHRFERLANWDDQIQGEVAGTLGYIRQVYPKRLPSKLRDVVAAIDSRLAANKAVTTEVATAPTPAPSTRPKTSKAPGKSKGKARAKSAGKPKVKEELLAEAVS

SEQ ID NO: 7150 - protein, 412 aa, unidentified
  source 1..412: note = Related to JACRNX010000027.1; note = Candidatus Falkowbacteria bacterium
MAKGKKVKKQKLQKTDVKDFEAILQIPERLAQLLRLLFHLSKPEWDFCVAKIRQKEAYREWRESKGPGKGFRQFGAPCAELKLVQKRILQNFLANVTAHFIRHGNQPGSSMMTNVQHHAGFAKAVFGIDLVNAFPSVFRSRIRGNLRVPLERKISEFGEEVNKSLSDEDKKIMLEAVVDFLCLHDRLPQGPPTSPRVLDIVCFALDRSLAGIAAKHSTPFQQYRLTAYADNFTLSSNDEIPEEVKTEVLEEIKKHGFIAHTRPDKTEYYSPFTGKVPVVTGIVLPTTADGHMTMAPRKVNQLRARLHQYAEKSTCTDEERGVVMGTIGYIRQVYPKKVPSKLRALVEQIETRARIERLPAPAVPIEAVPKKVGTDIDLSVIPSADTAKPKRKKPTPKKSKLTKDYCGESLPF

SEQ ID NO: 7151 - protein, 426 aa, unidentified
  source 1..426: note = Related to MGFG01000027.1; note = Candidatus Uhrbacteria bacterium RIFOXYC2_FULL_47_19
MKIAKLCRWLWLVNGLQLNKKRRPGVAKKGKNKRGKRQKIVGDDFRVVLDVPERLVLLLLQFLHLTRANWSFLMDRIRQYKTDGTPVYTEWSKSKGRNKGRRYFAAPCDELKLVQKAILNRFLLSVPVHFIRHGGQRGSSILTNAETHAGFAKSMFVVDIINAFPTVFRSRIKANLRRAWLDHCRMFEGVELSEADKEMMLEAIVDLVAWRDRLPQGPPTSPRVLDIVCLRMDEQLYELFYSHSTPFQSYRSTAYVDDLTFSCNADSIPEELRSEALEIVRQNGFLPHTREDKTVYYSPETGRVPVALGLVIGRDGRITMAPYKVNQLRSRIYTLLTKKGELDDVSRGQLQGTIGFIRQVYPRKLPAKLRQIVEQAEWRLSAEKSGATVTIVVEALPELETPTSESSSEGVTSSPTQVKEAMELSA

SEQ ID NO: 7152 - protein, 407 aa, unidentified
  source 1..407: note = Parcubacteria group bacterium CG1_02_58_44; note = Related to MNWN01000009.1
MAKKGKNRRGKRQKIVGNDFRVVLDLPERLVLLLLQFLHVSRADWTFLMDRIRQHKTDGTPIYTEWSESKGRGRGRRYFAAPCEELKLVQRAILHRFLSTVQVHFVRHGNQPGSSILTSAETHAGAKSMFAVDIVNAFPSVFRSRIEANLKGPWEHACRMFQGVELSEADKEMMLETIVDLVAWRDRLPQGPPTSPRILDIVCLRMDKQLYELFISNGTVQSYRSTAYVDDLTFSCNTDSIPEELREKALEIIRKNGFIPHKRADKTVYYSPETGRVPIVLGLVICHGGRITMTPRKVNQLRARLHTLLTKEGELDDVSRGQLQGTIGFIRQVYPKKLPAKLCQIVEQVERRLTAEKSGATVTIVIEALPELETSNADPELKDAAVPQQDVGESMVSPASVQEVAAP

SEQ ID NO: 7153 - protein, 414 aa, unidentified
  source 1..414: note = Candidatus Uhrbacteria bacterium; note = Related to JACPMJ010000005.1
MATSTRRRRRHTPKEWVYKDFESVLELPERLARILRLLLHLSTQEWDFCLDKLRQKAAYREWAESKGPGRGVRRYAAPCDELKSVQRKILNRFLISIPVHFCRHGNQRGCSVKTNAEHHAGNERAFSIDIVNAFPSVYRSRIRANLRKPFTFALKQFSGQTFEAEEIKQMLESLVDLVCLHDRLPQGPPTSPRILDIVCCKMDQDIWKLISENSTPLQEYRITVWCDDLTISFEEEIPGELRKRILAVMKKNGFFPHERKDKTKYFTPKTGAVPVITGIVLAPDGRITLAPNKLNQFRARINKLLAVIKAEPTKQVYGEIAGTIGYLRHIYSDKLPSKVRAITEKAETELKTIKFNELAGELGKKPRRRKKTTAVTPEPQTSETSAETQIATEEPPRRRSRKKKDTADESIPFK

SEQ ID NO: 7154 - protein, 456 aa, unidentified
  source 1..456: note = Candidatus Magasanikbacteria bacterium; note = Related to JABJNH010000022.1
MPRKKTRKKSRNIARGNNFVTVLSMNDDRLAKTIRQIISFQKGDWDLLMDVLQNSFVYRVERISKGIGKPPRIVHAPNGLLKKVQRKILNRFLSEIPTHSARHGGGQKGTSNKTNALEHQDNAYAFSTDIMNAFPSILRSRVRACLKPHLKRVLYQFRPLVFEFEEKRDPREKPTCDGDIVLEGLIDLLVFDDRLPQGPPSSPRLLDIVSYKMDCDLWRLAQESSNLGDEYVYTAYVDDLSFSSAVPIPEEVQQKMLTIVRDNGFHPHHSPEKTKYHGPDTGSHPVITGILIRDGMMHLPTRKQNQLRARLHNLNVAKEAWSDNERGEAAGLLGFIRQIYPLDSHRKLPSKLKDQVLFSENRLQQRKVVVSETPFGIPVAEEDVITKVCQNNPSISDFNALAVSTRVGWTSHSGIPFTGTITERFPDKPHLAQVTYLSKGGKRCGTRLKCQRLAVL

SEQ ID NO: 7155 - protein, 420 aa, unidentified
  source 1..420: note = Candidatus Uhrbacteria bacterium; note = Related to JACQSL010000039.1
MAKRKRGGAASAGDAPTATLVADDDVAQTFQKIFAALSEPAMTFLSQWLGIPRNATDRGVGLARPYTLADAAAILENGTPYRRYFRPKSGGGVRRISEPAASVKHVQRRLLHVVFPSIPVHHASFAGLRTRSAIEAIEWHAAQGKPFFKVDLKNAYPSVSRTRLTKVLRGPLQEYLARAAPHLVAEEYEALINFVISICLDAGGLAQGAPTSLHLMNAARFELDCALAAYLRSLPGSYTYTAYVDDLIISRGDATEIPEYVRERIVRIVLAHGFLVNRSRRKRKVDYWPAGTGARRPVVLGLVPHRDGRVTISAKNRKRFRAALHHALSSPESSDAHRAQVAGVMGYLHMVYGDDRLPSELRVLYAQCRERFGRPKTPGGAYPDIDCLLAEQHPGEGKAADPHSEVDDARASGKPPTDSA

SEQ ID NO: 7156 - protein, 403 aa, unidentified
  source 1..403: note = Related to JACPHT010000008.1; note = Candidatus Uhrbacteria bacterium
MAEQSRLPISFLLDARLEEVLCQILKIDPAEWRATTALWASGNAWTIHKIPKKKGHRTIHAPSDPLKKVLRALLTQFIQGIPVHLAVHGAHPGTSIVTNARAHVGGKAFYLLDLKDAFPTVNRKRCSAIFGPTFTGYITVVTGLPEQDGKRLAETFVDLLIVDDVLPQGFPTSPAVLNVLLGQVDRNISQLLRSASATEGVVYKYTRFVDDLTISSSDEVIPKKLRQKIRQAVRSDGWTIQGTKVSYFGDGAEGDEERTTKYPEVTGIIPNQDGRLTIPRPRLNKFRAILHNLLEVADKRQSGDEEALKAVKAQMEKDVVAFRKRGISLDSNLSPDKFYAREWPLTTREHRLLVGIVGFVSMVYDQKLPSSIRELYIKAKTQFRIGTRDISQGHAYSFVKETE

SEQ ID NO: 7157 - protein, 397 aa, unidentified
  source 1..397: note = Related to JACQXU010000004.1; note = Candidatus Uhrbacteria bacterium
MPSSFLLDASLEETLCRVLKIDPAEWRATKALWESGTAWTIHHIPKKNGVRIIHAPSDPLKLVLRSVLKLFLQCIPVHMAVHGAHPGTSIVTNARAHVGDKAFYFLDLKDAFPSTNRKRCASVLGPRLATHLADATDLSEKDSKRLAETLIDLLIVDDVLPQGFPTSPAVLNVVLGAVDRVLSQLLRAESEKEGVVYRYTRFVDDLTISTDAPEISKKLRQSIRRAITHDGWTIQGTKVHYFGDAEEGDEERTTRNPEVTGIIPNPDGRLTIPRPRLNKFRAILHDLLTASTQRLEGDAEALGKLQAQFDLFRELCKKRKVWIQPNLTLQEWCGNDWPLSPRERQIIVGIVGFVGMVYDQQLPSIIRKPYNEAKVRFGIGLRDMAGINGYNLDTEIC

SEQ ID NO: 7158 - protein, 341 aa, unidentified
  source 1..341: note = Candidatus Uhrbacteria bacterium CG_4_9_14_3_um_filter_50_9; note = Related to PFWU01000005.1
MCVNSSTAARFAQQEVFMTDPSAAPASFHKLTPMIERTFVELIRETEAVWSWCHQLYTDGVPWEMRRIPKKKGFRTIHAPKDPLMAISRGILHHVLRRLPVHRSVHGSEPRSSVITNARVHAGFAKSVYNLDLENAFPSTNRKRLVANLSPKMLALLLDSTDLSEEEASVLVELLIDLMLVDDILPQGFPTSPAVLNIVLLPVDREISRYLRQVGEELGCELRYTRYVDDITISSDGDRIPKPVRNQIRKIIRHNGWKINQTKLMYHGDAEPGDDERSTKMPMVTGLVIHDDGRLTVPRWKLRKWRALMHELLQAEDVSQDQRDTLVGVVSFLTMVYDGDL

SEQ ID NO: 7159 - protein, 395 aa, unidentified
  source 1..395: note = Candidatus Brocadiae bacterium; note = Related to JABWCH010000247.1
MALKITCPQCTAEFFVVEAFSGSKIVCPQCTSAIILALKTQHPSTHISGPKAILPSQMLNIKEEAIRHLEIWLDVPSVSIKNALSMIEQDKAYEVWKIPKGESNTFREIAAPADVLKHIQRRILDRLLYRIPVSNASHGFIQGRSIVTNASFHLKTAGAVLNFDLKDAFPSVDAQRIKHLLVRYLKIPLKHLGGNIPHEALDQAIEMLVKFTTYKGALPQGGPASGYLLNIACISLDKTIYSLLQSYGNSYRYTRYADDITISSPMPFPQGLQEAIETAIHNSGFQINPKKVRYAVRSQGQRLEVTGLILEKDKVRIPSQKIEIFRAIIHQAGSLETQNLQPEKRLEIQSIIAFIKMVYGKIPYRIWGPYKAYMEKHGIFMPRKTSKAYLSLYPH

SEQ ID NO: 7160 - protein, 403 aa, unidentified
  source 1..403: note = Candidatus Uabimicrobium amorphum; note = Related to NZ_AP019860.1
MAVEIRCPECGAAFQAEDVFPGSRVSCPSCEAILILDVEKQRLSRKSIVPPVPGPKIYKPEDQDSLKRAAINHLSNWLDIPATQINEALASLQKGEGYNDWKIPKGNEYSFREISAPIQILKDIQRRVLDRLLYRIPVSNAAHGFINGRSIVTNASYHLETAQSILNIDLKDAFPSVKKERVKHLFVRYIKIPLKHLGEQIDHGVLNKVVDILVELTTHNGGLPQGGPCSGYLLNVACITLDKSIYRLLQTHSTQYIQYRYTRYADDITISANAPISNMLKSEIQKAILNNGYQINPKKIHYAERKRGQKLEVTGLIIEKNKVRIPASRLDNFRANIHQASLMNTADLTPEKKLEVQSIIAFAKMVYGKVPHRLWGPYNTYLEKHGLTHPFGRKGLQWDQYPS

SEQ ID NO: 7161 - protein, 398 aa, unidentified
  source 1..398: note = Planctomycetes bacterium; note = Related to JAGOMP010000071.1
MSIKVQCPQCNSGWNVTEAFPGSMVHCANCGCAVLLAITPTYTSQRFLTPAPQVTGPSQQEVLKEQAVGHLEAWLDVSAEQIQQALESIRLGTAYDIWKIPKGDSGFFREITSPCDVLKMIQRRILDRLLYRIPSSNAAHGFIPSRSIVTNASYHLKTAGAVLNLDIKDAFPSITSQRVKHLYVRYLKMPLQHLGVAVPHAVLDYAIALLVELTTYNNQLPQGGPCSGYLLNLACLRLDKEIFRLLSTYGASYKYTRYADDITISAPMPFPEDLSSNLMKVILHAGFQVNNKKVHYAIRDKGQRLEVTGLILEKNKVRIPNEKLEKFRTIIYQASLLDTENLTCEKRLEIQSIIAFVKMVYDSVPFRLWKPYQIYLDKHNIPLSKGSQHLSLDLYPHY

SEQ ID NO: 7162 - protein, 429 aa, unidentified
  source 1..429: note = Related to JACQVV010000429.1; note = Planctomycetes bacterium
MATTVNCPGCAREISIGRAFTGERLECPDCQTILLLKVTAAPSLDRPQTILPPPPRFAHPPAPKDEAEIDRLARAHLASWLDLSARELGAALSLVENGQGYDTWQIPKAGPSFRTISAPKEELKRVQRRILDRILYRIPVSNASHGFVPGRSIVTGARVHLEDAKEVYNLDLKDAFPSVDATRVKHVFVRWAKIPLKHLGPHVEHAVVDRVVELLVRLVTHEGKLPQGGPTSGCLLNLACLKLDKYVYRFLGRYPGDLRFTRYADDLTVSSRDTIPEEVRQGLQAVIRDCGFRVNPQKIRYLSKARNQNLEVTGLILEKGQVRIPPATLDRYRAILHQAATAHELPDEKRLEVQSILAFVKMVYPALPGAIRKPFEAYAAKHVGRPPGPRKAFGLDLYRGARPPAPEPAAPEPGALPAPAPEPPAPPTG

SEQ ID NO: 7163 - protein, 420 aa, unidentified
  source 1..420: note = Related to RFJW01000804.1; note = Planctomycetes bacterium
MERSSMEFEIHCPSCQKEYLVYHPFTGAILPCQSCGTNIVLAIPKELEKEGDLKQFRYTIKRGRKREKPHTPHLVSPEKQLLLREEALFALSRWLDLDKSTLEEALDLLKEGKGYNEFSISKGPGRGYRKISAPSPVLKKVQRQILDRLLYRIPVSNACHGFMPRRSIVTNAKFHLPTAKVVYNVDLKDAFPSVSSLRVKHLLVRYIKIPLKHLGEQIEHETLDEIIHLLVQFLTYQNSLPQGSPASGYLLNIACIKLDKYLYKLLREEGLAKEIRYTRYADDLTFSSQDSIPETLRRKIISTIRDCGFQANTSKTKYLDRGKNQVLEITGLILEKGAIRIPRDTLERYRATIHRAYLTDTSELTEEMKVEVQSIVAFVKMVYPLLPYRISKPYKMFIQKHNINPIGSSSQFPLSHYPKG

SEQ ID NO: 7164 - protein, 423 aa, unidentified
  source 1..423: note = Related to RFKQ01000043.1; note = Planctomycetes bacterium
MRAQIQCPNCSQKHHIQNPYPGSLLLCPHCQTALLLELSPELEKEFHLHPPKQYRFTIHSGRKKQPLTPTILPPETLQQLQEKALFALSRWLDLNKEHLSNVLQLLEQNQAYDEFKIPKTQPHTFRQISAPKEELKLVQRRILDRLLYRIPTSNACHGFTQGRSIVTNAKFHLPTAYEIYNLDLKDAFPTVNTLWVKHLLVRYLKIPLKHLGEHVEHEVLDEIILILTKMLTHKNGLPQGSPASGCLLNIACIKMDKYLYKLIADKYQNTIRYSRYADDLTFSSPTTIPQSFRQEVQQIIRNCGFSINPSKIKYLSKKRQQLLEVTGLILEKGQIRIPKTNLERYRATIHNAYLLPHEELTEQKRLEVHSIVAFVSMVYSHLPNRIQKPYQKFLEKHGGKPIGKLTKLGWKTYPPDPPNPKLT

SEQ ID NO: 7165 - protein, 721 aa, unidentified
  source 1..721: note = Related to JACKEL010000003.1; note = Myxococcales bacterium
MGQDTPKRKRNTAHLTIRAYQPLASYSDAAHQLLAQWLDVDVALLREVHQAIRQGDAYYHYRIPKPGRLEWRDIFEPYGALKEIQRRILDRLLYPIRVSNAAHGAVPSRSVVTNAMHHLPNAQQLLMMDIRNAFPSVRLPRVHGIFRRYVKPLFRKFGPLPNAKDAQQGPSPVDEALHFLAALTTMKQTVDTPQGPRETYALPQGAPTSGYLLNLACLEMDQKIFKIIDQNKDLGLRYSRYIDDITISTPSAIPPEVQNELELAVIKNDFRLHRGKTRLVETHNENAVICGVTLRFGRLEADPLLLERCQEVLERSVEVADPRTEIKRRSKIRGIVSFFKQVYGDQLPSGLKDVYQRYRKARDLPEEPEVAAPTLAPAEPRTAEAQDAVSLLAQWLDLSPSLVGLAGELASSGLGYEEWEIPKGNGKTRKICSPKNELKETQERILDRLLYHMPVSVASHGFVPGRSIVTNAQAHLDAQHLINLDLKDAFPSVSKHRVKLVMQIGLGNLLKKFGLRCPRSLRDDVIELIASLTTHKDELPQGAPTSGYLLNLACLTLDKRIFACLQEHKVSIAYSRYADDLTFSTQEPLPDELLGQIKKLIENAGFRWHPHKVHVASVAKGQALEICGLRLDGNQIRIPREKLKTYRSVLRRAAIKIPTGQLDADTKNHVQGIVGFVKMVYGDLPHSLAQPYQAFLQTHPEARPTGSAREKFALYPNVLPA

SEQ ID NO: 7166 - protein, 717 aa, unidentified
  source 1..717: note = Related to PCBK01000030.1; note = Deltaproteobacteria bacterium
MSDNSTVRKRNTSHLTIRKRSPLSSYSDSAYRILSQWLDVDTSLLYEVLEALKAGEAYYTYKIPKHGTYEWREINDPYGGLKEIQRRILDRLLYTVPVSNAAHGAVQARSVVTNALEHLPDAKEVLSLDIRNAFPSVRFSRVHRIFRKYIKPILRKHGPLPSPNTGGNPPLDEAIHLLAALTTYPRSIKQKGQTQKVWCLPQGAPTSGYLLNLACRALDRKIFKIFDKHPNLNLRYSRYLDDMTISSSVELPADVQRELELAVKKNDFRLNRDKTKKYGPTDTPVICGVMLRQGHVEAEPELIQRCNDLLKRSVHVDDPRVELQNRRKIRGILSFFKMVYGDQMPTEISEPYSEYRSARNLPPEPSIPAPAHPTVSARAVEHQSAMSLLAQWLDISMDTLNTAHQKSLSEDGYEHWSIDKKNGSKRQICSPCLEVKDIQDKLLSRLLYHIPVSVAAHGFVPGRSIVTNALAHANARYLLNLDLKDAFPSVSRKRVEHCLNVGLGGLIKRFGLRCPTALRQDVIGLIADFVTYKDALPQGAPTSGYLLNLACHTQDKRIFELLERTAPNVTYTRYADDLTFTSTEPLPEGFLEAIQNEINRSGFRWHPQKTHFAAVHKGQNMEICGLRLDGSTLRIPRKKLKHYRSVLRRATNKLETGGLDTETRHKIQGIVGFVQMVYGELPRSLSQPYAAFLQKHPEARPTGSAHEKISFYPNIQT

SEQ ID NO: 7167 - protein, 719 aa, unidentified
  source 1..719: note = Related to SBHC01000053.1; note = Deltaproteobacteria bacterium
MSETNTPRPRNRSHLTIQARRPLASYSDAAYRLLGQWLDVDTGLLQEALEAILAGQAYESFRIPKPGRDEWRVILDPYGGLKEVQRRILDRLLYPIPVSNAAHGAVPGRSVVTNARQHLPDAQEILSIDLRHAFPSVRFSRVHSIFRKQVRPLLRKLGPLPTAHSGTLDPVDEVIHLLAGLTTYKQTVRQQGRTTQVYCLPQGAPTSGYLLNLACLPLDGKIYKIIEKNPELNLRYSRYLDDLVVSSPNQLNDEVQKEVELAVVKSDFHLNHQKIARTQAPAPLVVCGVQLSGEQLTAEGGLIERCADMLRNAEAVRNPTAEQKLRRKIRGVMVFFRQVYGQDLPPNIAEPYQQYRTNRQLPEEPETVAQAVAPVTLATEPSNAVELLAQWLDLTPETIAEARAKIQAGEGYESWSIDKGNGSKRIITSPVDQLKDIQTRILSQLIYHIPVSNACHGFVPGRSIVTNAMTHQGATSLINLDLKDAFPSVSKHRVELGLRIGLGRVIKKFGLRFPRPMRDELIALLGELLTVDDQLPQGAPTSGYLLNIAAMSLDKRLFELIQEHDQEVTYTRYADDLTFTCKDGELTTDFLNKLKRVIRRSGFRWNPRKTHRAEVDKGQQIEICGIYVDDDGLRLPRDKMKAYRSILRRAATQIPTGQLDDATKRQIQGVVGFVEMVYGELPRRISEPYQAYLQQHPDARPKRLYRDKISFYPNIMPNP

SEQ ID NO: 7168 - protein, 345 aa, unidentified
  source 1..345: note = Planctomycetaceae bacterium; note = Related to PBSL01000014.1
MELNRPADTAFAMLARLLSTDNEVVRAGHEALSGGDAYRSWEVPKGNGKTRRIDAPVEELKQVQSLLLTRLFCHAPTSPFAHGFVPGRSIATNAAVHQQTGRSLVSLDLEDAYPSVSRQRVVKTLEWGLGYFLKHVAPCSSRESRDELYELIADLCCFRQCLPQGAPTSGLLLNMACCSLDRRCARLLRRCRDQFPELRYTRYADDLSFTSSEELSHEFLEQAIGCVVQAGFRVNRRKVKRYSVRNADLVICGIRLHEGQLTLPRRVLRRYRALLFQSLAYGPDEISEENRQFLLGHIGFLTMASSVCPPQLERLLEEVLQQHGSWLRSGVASHILPSYGEVGRS

SEQ ID NO: 7169 - protein, 344 aa, unidentified
  source 1..344: note = Planctomycetaceae bacterium; note = Related to DLVH01000085.1
MGMNAYADSTLSLLSRLLMTDRETVNSGFEALSGVAYDSWTVPKGNGRERQIDAPVPELKRLQSLLLKRLLNFAPISPFAHGFVRGRSIVTNAAVHRETARCMVSLDLKDAYPSVSRDRVVKALQWGVGSFLKHTSPETTRGEREAVFEAVADVCTHRDALPQGAPTSGQLLNMTCCSLDRHCSRLMRASREEFPGLRYSRYADDLAFTATGELSHEFLERAIGCVLRAGFEVNRRKVKRYTVANADLVICGIRLHDGQLTLPRRVLRKYRALLFQTLAREPEDMSDGARQHVHGAIGFLTMATTVCPPQLEDLLQAVLQQHGTWLRPGTVPAHFPFYSSFSQK

SEQ ID NO: 7170 - protein, 977 aa, unidentified
  source 1..977: note = Myxococcota bacterium; note = Related to JAHJCH010000159.1
MTEPTQRAARLARLMSRGAATGASEARATPHEAARRATQVLIGALLPGDVELQAALGGDLSALEHAQRPGPAQALLDALLDALEGPLSAPLAGWVELAEGGASDGALWRAVDTHLARPECLALRRALTSRWAALPSTRARLSALIDARPSLRGARGPLTGLLSAALSASESLRGSRLSEALRVEVYVSYRRFQRALLSDDLRSAGAALDDLFGYTPNRPALLISDAALCVLEGRPGEARRALSEALAFIHDHAALEAAYAALAAPPRLEKTAAAPRHSPRDLRPRLGIEGRAVRAEGRVYKPRLDRWSPRPSYARWVIEAVAAALGRAPEAIDAALTTLHRGEAYRAFTITAPSGKPRRIQAPQGALIEIQAAILEGLLYRLPVSNAAHGATPGRSLITQAVAHLPQPRQALSLDLKDAYPSVSFQRVYRVFYEGLARLLPVARLPGLEGLRPLVARDHLAHLLATLTCAPLQGARPKPKTAWALPQGAPTSAALLNLACADLDRGVYKLLRAHPGVDLRYTRYIDDLTITATGGALPEGLTRQLERLIERVGFSSQPLKRRAWRVGEGPLIICGLSLESGGVAFGPDLIARAATLSALGAPGAAELRGLAAFARQIYAQTPPFLQSWAEAAPARAWSSPRAPYLRYLQGDPTAAAPGVAQLARWLDAPMAQVERALALLEAGAAYATWRLSKGGGGEREIESPAAPLKGLQTRILHRLISRAPLSAAAHGFAEGRSIATNARAHLGAAALLNVDIEDAFPSVSAQRVRHALDRALGPRLASLGPSAEAASEALGLLTRLLTYRGRLPQGAPTSGALFNLCLTPLDRLLEDACGPRGITYTRYADDLTFSSPRVEAIDAAFGDQIKQIIHRAGFRWSARKWARMAAPRLEVCGVRLDGAHLRLSRAQLQRYRATLHRLAHAPTLDAEGRDKAAGILGFVHMIYGELPAPLRGPAQALRQRHRLEPKPKSKLDLYGRG

SEQ ID NO: 7171 - protein, 352 aa, unidentified
  source 1..352: note = Deltaproteobacteria bacterium; note = Related to JADZES010000076.1
MPGRSATTLLAKLIDLPAREVEEALALVTGGEAYDRFEIPKVGTRAPRVIQAPVERLKRVQRALIGLLEPLALHSAVHGFRRGRSIVTGAEKHLQARAILNIDLKDFFHSVDRDRVRRALQRSLLPRLVEETGELTKAEGDAVVALVTELTTYAVPGRDLPVLPQGAPTSPFLANLAARKLDQEISELLAGLPGELVYTRYADDLTISAPHEIDRRLIGEIIKRVQRAGFAANPQKVRLASTLKGSPHYRQKLEVTGLVIDPRDKVLRIPRDRLELYRLKIHQAAHLRELDPGTRQEIEGFVSFAFMVYRTLPPSLATAYERFTAAHRLAPLQAGKSRRAARRRATQKELYP

SEQ ID NO: 7172 - protein, 351 aa, unidentified
  source 1..351: note = Planctomycetaceae bacterium; note = Related to DLVH01000085.1
MCDPCGLDPQGSWPPVAIETPTVLSADCKMALADLLQLPSGQIISAWDAVRGNAAYDWHLFGAREVAVPVPLLADVQRRVLDRVLRTGPVSPAAYAGVPGRSYVAAAWRHLGGTGAETVVMDIAGAFGSTTYGHVRSALSRRLKHELWVLGLDSDDAKAVVQVIAHLVTVDMDGRSRQLPLGAPTSVALFNLVLLSLDGDLARWCVPRGIRYTRYVDDMVFSCSEGVPNQLEEFVEHNVERFRFRLNQNKTVRSAAGMGTVHGLVRTADGIVPGEGARRRFADNIQWHTRQAEDEATSEAHREKSRGFLKGLNTFLRQFYERQDLARPEMLKIHVPEGSTAASPLVDLLWE

SEQ ID NO: 7173 - protein, 301 aa, unidentified
  source 1..301: note = Planctomycetaceae bacterium; note = Related to BPBW01000218.1
MWRWWLRLAPAGRSEVAVPVPVLSDLQRQILERILRTGPVSPAAYAGVPGRSYVAAAWRHLGGSGAETAVLDIADAFPATTYGHVRAALFRRLKSELWVLGLDPADSKVLVQVLSHLVTVDKGGRSRQLPLGSPTSVAMFNLVLLPLDGELARWCKPGKITYTRYVDDMVFSQADGLPVGLETTVHRAVVRHGFRLNPAKTVRRPAGQGTVHGLVRVAAGIVPSERARERFASNIRWHSDRTADTTIPAPQRQRSRGFLKGMDTYLQQFYERQEISRPGSLEIQIPEGAAVPPPAVDLLWD

SEQ ID NO: 7174 - protein, 337 aa, unidentified
  source 1..337: note = Planctomycetaceae bacterium; note = Related to PBSL01000014.1
MTVITIPDPLSDDCRVALSDLLRLPVEQVMAAWKVSQTDRGYDWNLYGDRVIHVPQPLLSEVQRQILDRVLRTGPISPAAFSGVSGRSYVLAATRHLSGPPAETAALDIADAFGSTTYGHVRGALWKRLKQELWILGLSGSESTAIVKVLSHLATVADRARTRRLPLGSPSSVAMFNLILLPLDGEMLRWCSEYGITYTRYVDDMVFSCPDGLPPDLESRVEAVVRRHRYRLNHGKTIRHAAGSARVHGLERTTEGVVPGADAVERFAARARWHQGKAVDETSSRSQRERSYGFLRGLDVFLRQFYEAQDLQRPDSLRIVVPEGAERPVPPIDLLWN

SEQ ID NO: 7175 - protein, 332 aa, unidentified
  source 1..332: note = Related to PFNL01000093.1; note = candidate division WWE3 bacterium CG_4_10_14_0_2_um_filter_41_14
MKMLPPEWEQLWECTRSGNEVTDEVTFHALEWLYDNRTKKGTWFHNPFRVEKKNKQGQFRLISWAGPQLSIVHLAISRWLKHEYVRKSMDASTPGAGGVMVALRAHGDNKFVTLVDVANAFSSVSERSLSAALRCLMDDVTEEFLDVLLELTTVDGHVWQGWSVSKDLFNLVMLNLDPVVFDQLPFLGVEIYTRYVDNLIFSSSKPYSPITLERFLRHVFKQCGFLLGPFQHSDQGRYSYLGVMVEEGNYRPQDVKRYVVEIEKALQHPCPHLYYWTILGYFSWTLSVSRDNIPKELFEVFERYFKLVGMIPPALQRLMIMRYQMSFADLQN

SEQ ID NO: 7176 - protein, 345 aa, unidentified
  source 1..345: note = Related to JAKLSD010000282.1; note = Candidatus Portnoybacteria bacterium
MTEKKYKLQPLEKVSLDVQFSWTMGIIAKLLKITKKNLRKAKKIVSAPKYDDEILINGMPTQITFHYGFYGFIKKIKRKQRKILAPHPKLQIVFRAIKDTLVEMEPTHENAFGFVKKRNVQMAVRSLLGNAHFISFDIADAFPSITAKMVENSLKKLKLQEELIQPLTHLVTCDYDQERRLPQGSSCSPAILNLVYKPMCQEIDRVCGTHNISWFVYADDFNFAALVIPPQAKNELLAIPPKYGFSTKASKTKDNLGKTIPHMLGLTIVDEKVHIRRRTKKKFRRILYMAWKYEAYSPQQIRGVAVAIRQTYGNEKNWPGWLKEYWIKYQTKRQAEGGRYEKSAQ

SEQ ID NO: 7177 - protein, 344 aa, unidentified
  source 1..344: note = Candidatus Aminicenantes bacterium; note = Related to JADHWO010000107.1
MVREKHELQPMKNVSLDVQFSWTMGIMAKFLKTTKKELRKVKKIIDVKNLKDQIPIKGSFVKMTFTHGFYSFTKKIKRKQRKILAPHPKVQIVLKAIKDTLVELSPAHENAFGFVKKRDIQMATRSLLGNTHFISFDITDAFPSITAKMVEKALRKLKIGEELIKPLIWLTTYYYNQDRRLPQGSSCSPALLNLVYVPMCQEIDEVCKAHGIKWCVYVDDFHFAALKIVPDVKKKLLTIPSKYGFSIKAKKIKDNFDRTIPHILGLTIVNGKIHIRRCTKKKFRRIFYMAWKHGAYSPQQVEGTVAAIRQTYGKEKNWPGWLREYWTKYQTKYQTEGGRNGKHG

SEQ ID NO: 7178 - protein, 332 aa, unidentified
  source 1..332: note = Candidatus Moranbacteria bacterium GW2011_GWF1_34_10; note = Related to LBPM01000015.1
MAISNEMCPLSVASIQVQLQWTLGGLSELISVPKKQLKKAFKIVSTPKLEATIMKRGGLVRKTFLYGFASYIIKNKNKERKILEPHPEVQKVYKKIKEWLEKVDPPHERTFGFVKDRNCKKATETLSALFRGGHHVAFDIADAFPNITEEMIKEALLRLEIEVDMAEVLAWFVTYNYQGKRRLPQGSSSSPSILNLVYKPMCKEIDRFCQANGIEWSVYVDDFNFAAPSISSELKDALLSIPSQFGFSIKPKKNKDNLGKTIPHLLGLTVADGKLHFSRTQKKKFRGIFYLAVKYQEYPPEVVHGIMRYVHHIYGPKENWPGWLIKMGGTQS

SEQ ID NO: 7179 - protein, 307 aa, unidentified
  source 1..307: note = Candidatus Nealsonbacteria bacterium CG23_combo_of_CG06-09_8_20_14_all_38_19; note = Related to PCRP01000057.1
MLENKSGYRVWSIPKKSGGKRQIQAALWPLREIQARIAALIYPYSISEINHGFIPGRSHQTAVLPHLLANAMFCWDIKDAFSSTTKKQVLLKFRVIGFNNPLADLMADLVCYSATGKSEDGFLPQGYCSSPIIFNLVLKDIDRLLFLFAQQRDYQISRYVDNFAISTPKKEIPRQDRELVVRIVMNLSNGSYKVPEEKTSYFKVEEDKVCFEFLGLVIKGPKKGKREIRVTDEKLADYRWTIHDALEKGDFSDRKVREIRGKINYLKSVYQRQSLPLPIRIMELYFQYQQMAEVAKTGQLPLNLSGP

SEQ ID NO: 7180 - protein, 305 aa, unidentified
  source 1..305: note = Related to JAHJOV010000010.1; note = Patescibacteria group bacterium
MLETKKAYHVWFIPKKPAGKRQIQAARWPLNEIQVRIAGKIYPYSISEISHSFVPGRSHRTAVFPHLRANAFFTFDIKDAFPSTRKKQVAANFRWIGFKKAVADLMADLICYSPTEKSEDGFLPQGYASSPTVFNLILNTTDRVLFGFSQKRGYQVTRYVDNFAISATQKTIPEEERKLAIKIVKSLSLGNFKIPEEKTSYREAGEKEVHFEFLGLVIEGPRDGERKIGVADEKLADYRWVIQEALDKEDFSEGKFREIRGKINYLKSIYQGRALPNQVAELYNQYRLLREIINTTKRGQLSLPI

SEQ ID NO: 7181 - protein, 338 aa, unidentified
  source 1..338: note = Related to JAHIGO010000018.1; note = Patescibacteria group bacterium
MITPGRKEAISELAVALEISPNLINRALQMITDKTAYNVWSTPKKSGGERQIQAANWPLNEIQSKIAAEIYPYSVSEINHAFVAGRSHRTAVLPHLRANAFFSFDIKDAFPSVSRRQVLLKLRLLSVQLGLKDRVAELITDLVCYSPTGKSEHGFLPQGYRSSPHIFNLVLKDIDRILAGFAQKRGYQITRFVDDFLISTTEKAIPREDRRLVIKLVENLGGFKISPEKISYLESEGNDVHFEFLGLAIKGPREGERTMGVAEKKLNECRWIILGAMEQKDFSKKTFRRIKGKVNYIKGIYKSQGKPLPAKIADVFAQYRSLRAIADADKNQQVLFKI

SEQ ID NO: 7182 - protein, 328 aa, unidentified
  source 1..328: note = Candidatus Portnoybacteria bacterium RIFCSPHIGHO2_12_FULL_38_9; note = Related to MHNB01000007.1
MNNEKLKKGINEICNFLEYNPGIMDLEKAFEGRNSYQRIFIRKRGGKKKGKRVIHVPPPKLKNVQSVIHRRVLEMVEWPASVHGFVKNRSHLTAALKHSRSIPPPVALLLIDFKDAFSNVGVKKVERALDKRLQPNLLCPLSPGAIKLLAKLITYRGRLPQGAPSSPTIFNLVALDLDEVLSVYAEERGYTYTRYVDNIAVSSPKPIPKNERAEIIGLCRQFGFQVVSEKARYQEAKWGVLEMTKVLLQPYGGQKWYASYGLGLSNRKFVDKVRAMVHRAQKDPSISLASIWGKIDYVRLVDPYKLSSRLSKPMRQLRSIQSNLERRK

SEQ ID NO: 7183 - protein, 326 aa, unidentified
  source 1..326: note = Parcubacteria group bacterium GW2011_GWB1_52_7; note = Related to LCRC01000006.1
MLTPLGCRFQELVSRAAQLLAVEPALIEQALQEKGQYQRRTRKKPGKDAEGRPRIRVLHVPPPVVKEVQRAIHRHLLNLGNSWFRKLGSDFAWPIAMHGFLPRRSNLTAARDHIGNTALFTLDFADAFPSVRRERVATALRWHAKLGRQEANFIARLATYRGRLCQGSPSSPLLFNLVVLNLLKSLERLAAERGYRVTIYCDEVAITADKPIPAEERRAILQLVIQAGFAVHPKKIRYQEARWGALEVTKVLVRPDRLGLSTRHTIDRVRAFIDHLARRGTADTKELAKAKGYIGWVELVDPEKLKTRLRKSLAQLAKLEQSGGHS

SEQ ID NO: 7184 - protein, 338 aa, unidentified
  source 1..338: note = Candidatus Parcubacteria bacterium; note = Related to JACPLK010000008.1
MQQAELPLSPNNAPWPDDFRTALGLDEAALAEAWMHRADYRPHRVPKRKARRIGPKREPRVAKKKRRPIDEPHPALRVVQEAIRRKLLEQIPLSACAHGFRKGRSAKTALLPHRKSTSFFTVDFRNAFHKVTGAMLAEALRACTPIIKPRWVAPLVAFTTHRGRLPQGAPTSNDLFNIACRELDANLAAFAQTRGFVYTRYADAVIISAKAPLPTDLQREIEAKIRAYGFPLAAEKTGYTEPRYAHPVIMGIAVVDGRLRVPRRQLDRARAFLHRAKLDPTIPMEIVEGVLGNVRGLIGGLPPRLLKPYKALLMSRHLWVRYRRRRGIPYVAHSPMQP

SEQ ID NO: 7185 - protein, 329 aa, unidentified
  source 1..329: note = Candidatus Parcubacteria bacterium; note = Related to JACPXH010000004.1
MPAPWPDDFRTALGLDEAALADAWLHRADYQPHRVPKRKPRRIGPKRQPKAIKKKRRPIDEPHPALRVVQEAIRKKLLKRIPLSSAAHGFRKGRSATTALIPHRKSAAFFTVDFRNAFHKVTTAMLADALRECAPIIKPDWVPPLVAFTTHRGRLPQGAPTSNGLFNIACRGLDANLAAFAQTRGFAYTRYADAVIISAKVPLPTSLQREIEAKIRTHGFPLAAEKTGYTEPRYAHPVIMGIAVVAGRLRVPRRQLDRARAFLHRARYDPAIPMKVVEGVLGNVRGLLGGLPQRLLKPYRELLTSRNLWVHPRRRRLAPPLTPSTSSPP

SEQ ID NO: 7186 - protein, 407 aa, unidentified
  source 1..407: note = Parcubacteria group bacterium GW2011_GWB1_52_7; note = Related to LCRC01000018.1
MRDKRQLGIFIPGFLDDSMLKLAVPQTARMIGYEEKHLPFFSRTLRRVLSDPNAYRSVQIPKRLGGYRTLDIPNHDLMQVQRRIHSCILVRRYVPSPICHSFVGKLYDRSGAAEERWQAGRSIFTNAFAHLAPGPRARRDVRIPSSILTVDLKEAYPSIAADRVFRVYQELTGDPWTAQILTHLSVWRGCLPQGAPTSPMLQNLVYRELDVALATEFNKGPFRLTRYADDFTLTSLRGYIDPKIVIHLIEVVEAHGFPVNRQKVLRWRRKDRRLRVTGINIRRTAERPFSLPRKKLEQLRAALFYAVKTLQSTARYEAERRAAGTLDTTTAKALDQLQKQTWGRIHGLVGFAVQVYGDELPPTIYKWFGFLREETEVTGEELLQQIRESFPVSEVQRSGRELLGDSP

SEQ ID NO: 7187 - protein, 366 aa, unidentified
  source 1..366: note = Related to JACOZA010000081.1; note = Candidatus Sungbacteria bacterium
MQQRLSDPYCYRAKQIPKRLGGLRTIDVPCPRLKKLQRRIHDFLLRRHYRPSRICHSFVGKFYDVARPARKRWIPGRSLFTNAWVHLGVPPGVSPRSKSRRIHWRIPRSLFSVDLKDAYPSIGVDHVFRIYQELTGDPWTAQILSTLSTWNGSLPQGAPTSPLLLNFACRELDGALAHEFTRGPYRLTRYVDDFVLTSTDPEISEATRERFVAIIEQHGFKINQAKTCYWRDTDRALRVTGINLFPQERHIGLPNVVQRQFRAALYYALKSLESIHAYALQRGVLDETTAMSLRGAEKQAWGLIYGVIGFTYQVYGAKIPRPIYAWIPELTARTGVTSDTLVAKIKKYPPIAAIQQIGEEIIGSSP

SEQ ID NO: 7188 - protein, 382 aa, unidentified
  source 1..382: note = Related to LCDF01000016.1; note = Candidatus Giovannonibacteria bacterium GW2011_GWF2_42_19
MKEFENIGSILKAIVQKSMYNVIGLSNAIDLERALELARDPKTGYRRFIMEKKSGGKRPIDAPHDDLKFVQRMIYKKILLKDFTPSKICHSTLERSIVSNAYAHLGVPADVVPNPSYITIPWREPQSIHLIDLQGAFPSIKTGRIKEIYQDILHDENAAEILTELSQLRGSLPQGAPTSPLLFNLACRELDRDLEEEFADPRLPLTRYVDDISVTSLDSRVPQKKQKMLRMIVEKHGFKIKEEKVANWDVRDKPLNVTGIALNPAKRAIFLPYKTREIFRLLMFKSYKTLCEANSEWFEQERDISLMKFITQGRRRYKRAFGTICGVASLAFMVYGKDEAPKRTFSWFEGYDGDVSSATFQAILDDIRNGDLVGEIWGYNQF

SEQ ID NO: 7189 - protein, 404 aa, unidentified
  source 1..404: note = Related to JACQJT010000015.1; note = Candidatus Giovannonibacteria bacterium
MAKNPESIGSLLANLSAKEPRGSLLTNLLAKISLHETAKLIGTDERSLLRALRLAKRPDGYKRKYIPKKRGGFRPVDAPHDDLKWVQRCLHRNFLRRRHHPSSICHSFVGKCYDPQAEFGEKWRAGRSIVSGAYEHICPGEWRHPRSLFSVDMKDAFPSVTEKRVSAIYKELSGNELVAKVLTNLSVLNNSLPQGAPTSPTLFNLACRELDANLAEEFGLDGRFVITRYADDVTITSVEREIKTADRERLVKVVEGHGFKVNREKDCYWQDWRHVLRVTGINLDPEKRRLFLPRSELDRLRLLAFHSLRVLENESAAWLESKSRFDVPDFLRSLDKRATMAFGRLGGIVGFCSMVYDEQEWPSRLFGWHPALAEWSKDDFHTLLQIIKEGELANPDSDLFDFSP

SEQ ID NO: 7190 - protein, 421 aa, unidentified
  source 1..421: note = Candidatus Giovannonibacteria bacterium; note = Related to JACPKW010000005.1
MNIKKLRKEDTNLQQPSLGIQSLVEKTLGKLALEETARLIGVDVSDLVKALEIAKSSDGYRHKKILKKRGKGYRRIDVPHKDLKWVQRACHINLLLRHFKPTPICHSFVGRRFEKDSLHWIFGRSVISGAWAHLGVPPDEEPDPKSNSINWRKPRSQLAIDFKDAFPSVSRTRIKEILQKLLEQTGKYQAGADIIAEILVDLTTWNGVLPQGAPTSPVLFNLACRDLDEILIGEFSDEEQKSRIKITRFCDDISVTRLSKKIGLKTRGKIERLIHKNGFQINEEKTVHWQDSHHVLRINSINLDPINRRVFLPRETIERFRYLLYRSWQELEESFSWWLVLGRDSDNTIKYFLNQAAYGRIAGIVGYCRMIYKEDSEMPLRLFSWNPDLSGYWDQERFEQIFADISKGSLIQDLEDHLHYF

SEQ ID NO: 7191 - protein, 403 aa, unidentified
  source 1..403: note = Candidatus Sungbacteria bacterium; note = Related to JACPYH010000043.1
MLHQAIGHVADLIGLRKRDVPFLKTVYERALKDPYAYEPILIRKKRGGYRRIDIPNKGLKYVQRCIHHQLLVRRYEPTHICHSHIRKTYDVAQEYGDRWLPGRTIVSNAFAHLGVPPDVDPHDQYDDERIRWRTPCSLFAIDLKDAYPSVSEDMVFDVYGELAGDPWSAEILTRLSVWHGCLPQGAPTSPLLLNFVLRDLDAAIKKEFRPQHFCVTRYVDDVVLTSRHKRISLRIQKRLIDLVEAYGFKVNLEKNCYWQADRHVLRVTSVNLYPEERRVALSKTVVEQFRSLLYGLFTGLRANGFLLHSNLVADAFSRALDCEDPRVAEIHGMRSKQFHKMMGIIGFCHLVYGNELPKRLSAWGDRGGGDAMDVEWAIEMIKDGYFDTDVIDASYDASGYRVR

SEQ ID NO: 7192 - protein, 388 aa, unidentified
  source 1..388: note = Related to nan
MRKEVRQMFPKRIGAIVPGVMREAVLPYLAQQLAIKADMLREALEIRARPMVQGDLESPYRRYPKKKKTGGVRWITAPHETLKKVQAAIYKRLLRPRYKPTPIAHGFIRGRGIVTNAAVHIQGGREPQSALNIDLQDAFPSVRAERVVKLFRKLTGSEELALTLGYLTTWKNEQGQGAIPQGAPSSPILLNSVLQEFDAELLELAGKFGLVVTRYVDDITLSGPDARIPDKVFTYVARLAKKHGFLPNMTKLRWQHANRNPIEITGLHLIKPWVGDLEVRLPAATRRRWRGILHNLAEVPTDAFGKPEVGLGVGIIGVARHVQAVSSNAATRGHILPYELRAPACELALLDRVPSIETLRDPRAWRKFQQKHQESIRRFELAYADRQS

SEQ ID NO: 7193 - protein, 373 aa, unidentified
  source 1..373: note = Candidatus Wildermuthbacteria bacterium RIFCSPHIGHO2_01_FULL_49_22b; note = Related to MHTT01000006.1
METVVPYVEQLEFDFPGVPRRGPGRVFVVPDNIKQKIECARDFLVGRLRLPYQEMAFALTLPNACWYEITKKVGDKQRTFYVSRRPLAEMQRRIATYLEDSSKWERWSMRKRGSLHRSETDLASAFRRGTSIITNAWPHRVNRSSLTLDLRDAFESITRRHVERYLTRIFANNITHPVQSPEVTAWVLSRLVTCRGKLRQGPPSSPAVFNCMLERLDDALAEATGAPKRDVIMPAMYLGMRFQRYRELDASDRRSGASYVAPRGVLYTRYADDLCFSHPDETFPIALEEMIRKVVASHGFRINGAKTRHGRYGILEFPGVVVANGHLRPKTRLVQEILEGVSIMTAQERAGYRAFLHQFGPSGRLECLRVFDN

SEQ ID NO: 7194 - protein, 350 aa, unidentified
  source 1..350: note = unidentified bacterium; note = Related to NZCO01000055.1
MDTSRGIAARGHVDACLAGLKMYSLDPDVVLDVLLRPNAHWQRVVKEKRGKQRVCYSPSDDLRTLQWRLIRILDRSIKFHRGYCRIWDQRYAFTISKPRFPQTGWWKGSSIVANARVHRHSNSALVCDLRHAFQSITTRHIQSFLNRTQPFRIRRRRDASWTYFPESLMWVASRLLTYYGRLRYGAPASPIMFNFMIDRLAVDLATAVNAPLHVNEAALRSTQRILMTVYGDDICFSCKRGAVPESVLWRTETLVRQHGFRMNHAKTLRSGNGALLLPGVVISAHEVRPRDTYLDPLATAIQGGELTQDQANGHLGFLKPFKRPGRRALKRWGPTLYAQLQERAGVTINE

SEQ ID NO: 7195 - protein, 334 aa, unidentified
  source 1..334: note = Related to LCBS01000001.1; note = candidate division WWE3 bacterium GW2011_GWB1_41_6
MFVESIIWSMAENTTPSFDKELVRYRNTISRLVSLAERERYLKPFYVKKKSGGKRRIVPATKDLVYVQSILASWFVKTFGGSADYCYTGKGIIPAIKPHQGAKTALVVDLKDAFDHVTKEKIYKLLERRFRKMSKEVRLLIATLLTYEGTTPQGCVSTPYVFNAVVDPMDKDLLAILGNFPLRAYTRYADNMCFSFDKPVNLWAVDRAVAKIISMHDFQVSWSAGFEHMPISYLGTHVYEDRLELDPDKLDAYVLLLNEALSSPTPEVYRKQILGILTWVSQVYKTTNPEKLSPEDRAKLAYFIGLFQQYFGKVRGTPELLERLVTSFHNSRMF

SEQ ID NO: 7196 - protein, 410 aa, unidentified
  source 1..410: note = Related to JABHMO010000007.1; note = Candidatus Falkowbacteria bacterium
MTKILQSACNPLQTKGGLAAAYYLRNFLGYKDSEHKINFLELLRRAIYRNSNLYSTARIPKRNGKYRILNIPCHELKIVQRLINKTILQKTRVLKCTFGFYGGSGLEALKKVVKPEQAIFSVDIVDAFSNTTARAVYHVFRRLKFGHFASYYLTCLTTWLHPTRSFSQTKRQSDHDFAHDRSDELHAFLSFGGFNFAGKEAKLQQNSFVLPQGAPTSPRLFDLCFWQLDYNLVVRAIHVKGYYVRFADNLYFSAPEFWRDGQIDITKNNKGALLFHSPLISSIYDIMRAGYRIWIEPFQNMPRYTQKWYQIYKLHKARLLMPDDKDCLPALGYNVFPDGTIRNKRRFVLRIRMSVFNLRKALESGNYEDTWRIYQKLQGQMQFAIHDQLPPRLLKQATDLLSQINSQQAI

SEQ ID NO: 7197 - protein, 376 aa, unidentified
  source 1..376: note = Candidatus Falkowbacteria bacterium; note = Related to JAFGMD010000036.1
MLKSRTHIKNPLLKISGRKAAWYLFSTLDYPFDDFERFRKILWAAIVRSPWLYSNIAIPKRDGSKRILAIPHPDLMTIQRAINKNFLELYRHPNVYGFSGGNAREALTALARSNQAIFASDIKDAFPSTTGRAVFNFFRTEKFGYYTSYYLTCLTTWFNQQKKFNLPQVGLPQGAPTSPRLFDLCFIRFDRRFARLTKNANGVYFRYADNIFLTAEEFWPERINIQTMRDGGVRWQSPIISAIYRILKRGYEFEHSPDNEIWHNQEYGLHKSYFARQGQILHALGLNIKDDQLHNTREFKLRVRMTIFNLKKALEQKDDFETKIWPLYHKLDGMQKFLVKETSSKLWEEAEQALFQVALIRYSGQGGRYVKNISEY

SEQ ID NO: 7198 - protein, 417 aa, unidentified
  source 1..417: note = Related to JACRDY010000022.1; note = Candidatus Falkowbacteria bacterium
MAHQPIYNPLGNPWGKAAAHWLHWQLALEEDDIPWDMFASILWLAIERDPGLYYRKRKQKKSGGTRTLCVPNGDLKRIQTKIDQIVLAAEPRLPYVYGFGGGSVAQALQPHLERGYPIFTADIRDAFPNTHDMAVYNVFRRLGYRKNTAYLLTRLCTWPINSQWRAALPQGAPSSPRLFDLCCRPLDVKLHQLAANVDGSYTRYADNLFFSARSFSARQYRPDEKKRYRGSAWPEPQPLWQTAPGDDAAVISWHATLISAIYRRCTDGYELPELPRKVYRHHWSWLRKCWIHVNPSNTISDRLEYQLHKTYLWHPKQGHAFKALGLQIIDGRLCNSRRYKQRLRLLTHHVSWLLDHHRDFETEVDPVYLQLNGLLQFAVRETLPAPLLTAAAALCQRVEDIRYSGPSHTRVRHINAY

SEQ ID NO: 7199 - protein, 388 aa, unidentified
  source 1..388: note = Candidatus Buchananbacteria bacterium RBG_13_36_9; note = Related to MHHZ01000002.1
MNDKKSPLERQSGQIAAKYLFKKLKYPFKDWQKFWDLIRLAVERDKNLYRQISLSKRGGGKRVILIPCEELKYLQRLISQRLLADISGHPNASGFSEGSIREALLPIVRAKQPIFCADVKDAFPETTFGAVFSAFQRCKYGYNSSYFLTYLTTWRTYQSLFYNSALPQGAPTSPRLFDLCFEPIDNALAKFAAKIGGVYTRYADNIFFTAPTFWPARKSCRKVEGETIVKDKHGFETYYPYKRKISTIPEGKADIDKSDSGALNWHSPVISAIYQIVHTKGKGTYYQLHKSYLCDKGQLLHALGLNLINGQLHNTREFKRHLRLTIFNLQKSLSAQDDFGNKIWPLYQKLNGMMQFAIKETLPVSLVQQWEELDLAIYQIRYPRTIGT

SEQ ID NO: 7200 - protein, 366 aa, unidentified
  source 1..366: note = unidentified bacterium; note = Related to JAAXXB010000144.1
MWENKQTGSIRHEYYEPEENVAALVWLSKELGYKIVGEDVIYSLLVQLRVDKPEQNPLYHTILKRKNDGTIRKLYSPLDELKEVQYRIKRRILSSYQVSDNAFGYSGGSVFDTLQPHLPTDGEQRIMFQADIKNAFPSVSGENVFLALYGLPSSESYEHYREKGYLSWHVAAMLTELLTIYDGWSGFLPQGAPTSPKLFDLVFLGIDRNLSHLACNVGGVYTRFADNIYFSMKGEFFPEVISRAIIRTIQECRSRDDYLFDARRFYCKKVKVRPLNVESLRALGLNIINGEIHNTREFKLSIRKSIHHINWLLANSDTPEYSAKLEHAINVLKGQMSFAVEETLPEALLQDYYSLSTTLDGSVSTI

SEQ ID NO: 7201 - protein, 371 aa, unidentified
  source 1..371: note = candidate division CPR2 bacterium GW2011_GWC2_39_10; note = Related to LBVV01000019.1
MVSRIFSPCPDIVSDNEIPAIIWLSKTLGKPQDDGSVLEILKRIRQGETLYEEGFVLKRNGKLRKILKPVPELKKIQREINRRVLSDLIVHPNVSGFSGGQLHDAIRPHLNAKSIFCTDIKDAFPSVTYNDVFRCLTKGREYELTYDISDSYYVYDEEWDDFFPCIIGRKRFKILNHGFLSWYAAQIVTEIATAKDAYGRLRLAQGFPTSPRLFDAQMEPIDIKLTHLAQNVEGVYTRFADNIHFSMQEEEFPGEVARAILKTIEGRGRNLWSNKYECHKTRSFKTDGQAVRILGLNIIDGKIHNTRAFKRAVRLSIHHVKWFLERGIIDTEEFEHAYRKLNGQMGFAVPETFPVKLLDDYSQIKKTYKDL

SEQ ID NO: 7202 - protein, 408 aa, unidentified
  source 1..408: note = unidentified bacterium; note = Related to JAIOSA010000118.1
MGIYKEIVKDLVIDYKKRNPDWTEYDFSEHLVLLTYRAGNNAVLPDPLADSEEAWQATLNSEVPVKNDPVETFLSSFRLNQDGDERIIKIVERSTFYWLGKIFRMHFLDLMNLVEKIRVKGWSNFYRLEWQDKKGGGFRQLQIPNRQLMGIQTKINEKLLRDLPRYPQAFCFSGGRVIDALRPHLKFGSLLKLDIKKAFPSITAYDVRRGLTFGRKIKPVEKLQNIEDYGHFSWYLAKIICDLCVTSSLPQGAPTSGRLFDLAFYPLDVELSKLLKAAGGNYTRFADNLFFSVSERFFPSELKNSIKIIITGEKRNFLKLRYHKLWITNKRYVALRALGLNTLNGRLRNTKAFKSRLRKAMHHKQRLSELGLDTEAAQQKIGGLMGFAVKETLPNKLLKKTEQIKKDR

SEQ ID NO: 7203 - protein, 362 aa, unidentified
  source 1..362: note = Related to JAAXUE010000002.1; note = Candidatus Moranbacteria bacterium
MDRIPWSESDIEFALSLGRDTEEREANIEQYTSEWMNERTERIRGRETAAFLWLAARIGMKPNRFLFAVAGFRSGSFGYTTHFVTKRDGKGKRKITAPHKVLKAVQRKIAQELFWDHPRSPHSFGFLGGSSAEALLPHAKNASLLMVDVTNAFPSIERDVIFRWFRKRDYSWRVSGILADLATFEGRLTQGSPLSPRIFELMFEWIDERLSRLARRVGGTYTRYADNVFFSIPGAHMDKKLVWTVLKKIWRMDLICQVPRDKRYHPTFDTHKLRVRTLPGNAVHTLGLVLRDGEVHNTRDFKRTLRKRIHHVRYLLENSRETGVILSAWTMLCGTYSYARKETLPPKLIQEVEELRGRIHQL

SEQ ID NO: 7204 - protein, 365 aa, unidentified
  source 1..365: note = Candidatus Moranbacteria bacterium; note = Related to JAAXVB010000009.1
MINNQEFGYDPEFMLAFVRELEEKRIERGDQLRFELEEEKRYIRKKQLYALLWLARRIEVKPEKIIELFLAIQEKKKIHNVYFKNKSGGGKRKIIAPIKELKYLQKRISTEILKRYSRGSESCSFGFIGGSTAQALQPHLESGCLLMFDIRDAFPSVKHRHILDLFRGLGFSWYVASFLADVATYEGCLAQGSPMSPRIFELICANYIDRPLEKIARKNEGIYTRYADNIFFSVLGDGFDERLKREIFRNICPPRSSNLKSPYCPKFQTHEFRVKKLAGNAIHALGLVIHDENVHNKREFKRRFRKAIHHAKWCLKNNYDLLPEAWGKLRGLFSYAQKDTLPAKLRSDYELLKDEILNLGIDLTI

SEQ ID NO: 7205 - protein, 393 aa, unidentified
  source 1..393: note = Candidatus Nealsonbacteria bacterium CG_4_10_14_0_2_um_filter_38_17; note = Related to PFPB01000062.1
MEDCEGFSDEELDDVEYSVQLAAENEEFEWRLQREIQRKRKEIPALVWLAHQMKIAPDNLDTVLNMVRNDQSPYRMITLDKPDGGKRRIFIPIDPLKRIQRKIVKCILSDFQTGPNCYGFSGGSIVEAIEPHLQAGTILYVDIRDAFSSSSAEMVMSYLTEGRVPTFRYDYNGKSWPYCYDEDGERGLHYGSTRRLVFEGMLREGRMSWSAARIIVDLTTYPVIGSTCVLPQGAPTSPWLFDMVCKKLDEKLTAFAQKVGGKYTRYADNIFFSMDQDEFPNPVKNAVLRMIRMYGRFRPHKIRVRRMTKGAVKLLGLNVIEGQIHNTREFKRRLRLAIHHVEWFLNNRLKDTPEFDTAWHKLQGLMAFARIDTLPPKLLESYYELEDRIFKIN

SEQ ID NO: 7206 - protein, 362 aa, unidentified
  source 1..362: note = Candidatus Pacebacteria bacterium; note = Related to JAGOSO010000002.1
MNWEDELSDRFLSNGHQLTMKELEEHRLQDRIKKSRRRIDYRKKSFFWLGHKLELPHWLNLSEMLQRIDVEGSAYLYKEPQIIPKPEGGTRIILSPQADLKLVQTRINRLLLKTFPRRPETFGYMGGSCLELAQRHLGMASTLKFDIKDAFFQVPWTNVRKSVKGFRGIAPGFSGSVSHWIAKLCTYSPTPEHIRNQFGLWRGATSFLPQGAPTSPICFHLACGPLDDEMTKLAKRFGGVWSRYADNYYFSMPTPQISNKLEEIVVCEARTKGFKIHKVRRVKQGELCRILGYNLLDGRIANTRDFNRNFRGALYVLRTKLDRGLDYRDAYSRVKGFMGMAINVPENLRLEYDYCKNKIETI

SEQ ID NO: 7207 - protein, 327 aa, unidentified
  source 1..327: note = Related to MHCP01000015.1; note = Candidatus Woykebacteria bacterium RBG_13_40_15
MRSIEPVIFSSGEGRFPAEGLEVDYNRFGFNPLVYLGFLIGIPTRWIDYVIKIGADNFYTEVRIPKKGGGVRVLQVPLDPLMGIQRRILRKVLSQLEPKSSCHGFVTGRSIITNAQVHVGSTHMLVLDLESAFDQGLSSRIFRELWGERVGERRLGFLVASLITQLCTVYSGDIGERYGFRHLPQGAPTSPALFNLACRPLDGRLDHFVWRIGGVYTRYADNLAFSVPRQLTPKEEHIIRKIVDGSGFRVNDAKTRLMRQSGHSILRLPGVAINNGRIILPKRKRKQLRAAIYLAALHGETDRLRGLIGFVEQVYGPEVPRQIIGSH

SEQ ID NO: 7208 - protein, 338 aa, unidentified
  source 1..338: note = Related to MEZX01000002.1; note = Candidatus Berkelbacteria bacterium RIFCSPLOWO2_01_FULL_50_28
MPTLTGRQYAAGRKLARRLDLPPDQLFLVLEYGAAAFYGSYAQPKSGGGTRIIHVPHEPLVTIQQAILKRYFSCLPVSPIAHGCVAGRGIESNAFPHRKARSMVGFDLKDAYNQASFTRSFIQTYHHHYTTSNGEVIERWCSQRKQPWDILPMELAVLEIVSDLVDIYSDYKEVLPHYKLVLPQGAPTSPALFNFACQRMDARLEHLASNVGGVVTRFVDNIVFSWENDEVDRPVYSAIRRIIEKSGFKVNERKTVAIRNGNRNGVPLRFPGVHIIDGDLYIPRKKLRHLRMALHCAGKAHNDALYQGIKGYALQVEAQMPPQLRGVYGKARADNPRI

SEQ ID NO: 7209 - protein, 321 aa, unidentified
  source 1..321: note = Related to JACPCE010000006.1; note = Candidatus Woesearchaeota archaeon
MSLTLEIGLQDNKPAIKSYKTELSQYLSDLTHPLEVLEISHRRKELTDILLDLTETTQLSLLCDESETLDHLFDGLLQLRKEKRPLYKRFQKEINGKTRDLAVPQKPLDLFLRNYAGPIINQAECHAQAHGGENNWSLTESIKTHLPIGIALSFDLSQAFKNTHLQYVFDFYYSLIYKKTRDKKTSTDLAGFLATVSTVYYRDGGYALPQGSNIATKLFNRLLYPIDESLSNYAKNRNLTYTRWIDDFILASKDRDKTNKELIEATNIVQPYFPLSEKKTFLQRDKPVYLLGQKIVDCWITKATTKEIQSKNPMKSTTHYL

SEQ ID NO: 7210 - protein, 317 aa, unidentified
  source 1..317: note = Candidatus Woesearchaeota archaeon; note = Related to JAGVZG010000002.1
MDLAVCDQYKKVKLQVQIHTKELTDYLHSIEHSLQLLEDTNKRKDVTSILLEFTKTSQLSLLGDEAKTLDVVLENLLDLRRAKRPLYKRFKIKVGEKIRDISVPQKSLELFLKYYVSPLIDHAKCHAQSHGGEVGCTPKYSIKSILPVEFVLSFDLKDAYKNIDLQYIFDFYYDLIFEKTKDVEKSKQTAGFLAGVSTVYYADRGYALPQGSPICSKLFNRVLLPIDNLLYKYSLEIGLDYVRWVDDFIFSSSDCGLTLDKFVKTLDIVRNYFPISENKTYFQRKHPVYLLGHKIVGTDISEATTEELETRRQINLS

SEQ ID NO: 7211 - protein, 362 aa, unidentified
  source 1..362: note = Related to MFWN01000063.1; note = Candidatus Pacearchaeota archaeon RBG_13_36_9
MPAVLEEVPINDSPLVLGVPGHYYSFFGGPLFLGIHDDKLREHYEKIKIPLNILRDDEKRRNLAELLSSLNPKPGLFSGESDLEELFPLILEQKHLYQIWKQKVNGKERSFYVPQKAFKTLLTNYVLPFVKAVPAHPSCHGGEKGWTVKKSLESHLPVVSSLTFDMSAAYHQATMNYVFEFFYDSLEGRCKTEEQRRDAAVFLSAVCTIRKDYDERREECFEASLPEGSAVSSAVFNRMLLPIDEEFSRFAEKKGIKYSRWIDDFVFTSPKKRKFNHFEYVMRKAQESFTLAPRKVFFTYEGVSYLLGHKIAYNEIEKISREEFEKQRGEPYTGGMLSDTHPWDCMYEGYEEPTCDGNDIPF

SEQ ID NO: 7212 - protein, 405 aa, unidentified
  source 1..405: note = Related to JACOZR010000022.1; note = Candidatus Woesearchaeota archaeon
MEDRMYAPSGRRFRIFVDCMSMGSRLDVIPSENPDLEIDTDGTPTIFLSSVPLVPGAYFTGPWLPMSYADELVKYFSETRNPLEVLESKKEIILKTLLELLPLDNQLSMLDNKQERLEVLLDDLLALKGERKHLYQRWSQRINGKVRDISIPQDSLEHLLIEYVKPIIMEAPCHSQCHGGEQGFSPKKSLSRHLPLGTVLSFDLANAFKNTHIQYVFDFYYTLFENKIENREIRRDIAGFLTSISTVYYSDTQISALPVGSPISICLFNRLFYPIDEVLHICALKKGLRYTRWVDDITISAKETNRNPEKICGAISMVRREFPIAVNKVFFQQNVPEFYLLGHKIIGNRITKMNKEKSKDKLVPLDPECIATEREIEWIHEVYMGEIPPNQGECSLEGLEEDLPF

SEQ ID NO: 7213 - protein, 387 aa, unidentified
  source 1..387: note = Candidatus Woesearchaeota archaeon; note = Related to JAHWIP010000076.1
MSIEAEIKSCNDVFVEGSFYKHKYEDETSAILLKERLGIPVAYFRGPWLPMFYINECMEYSFSLDYPSQILEIPKRRKQIVDAMLELRSAQQQASLFNIDEKQDLESLLDRLLILKNNNRPLYKRWTQNIDGKKRELSVPQKALDVLLKNYVHDIIMLAPCHPQCHGGEKGWSVKKSLATHTPLGTVLSFDLANAFKNVDIQYVFDFYYRLFESKISDPENRRDTAGFLTTLSTVYYKDKDSFALPQGSPVSIPLFNRLFYPIDKLMQESATKRNLRYTRWIDDLIISAKESNRNRKKFFGSLSIVREDFPVNLNKTFFQQNLPEYFLLGHKIIGNLVIKVSKDEEKNRGEQIDPDCFATHYEREHLWIEDYYDGDEPGDFGEIKDF

SEQ ID NO: 7214 - protein, 310 aa, unidentified
  source 1..310: note = Related to JACQNJ010000008.1; note = Candidatus Woesearchaeota archaeon
MPVYEREFFDYVESNLHPTGSVLANPCRRGSLRRLLSPGTQEDLFGDPLEVILERLSGDIVNRKGGYMRWREKIGEKERMLSVPSKTLWKFLEDYLEPFIEKQRVHGSCHGGIKGWSPKSSLESHLPIVTALSFDMESAFQNMPARKVFDFFYCSLKGIDNYEERRDIAGFLTFISTVRYDQQRGLPQGSPISQAIFNRLMLEVDETMFWAATERGMTYSRWVDDFTVSSPDRRDVREFLGAVNLLAERFPVARDKVYFQEGEPVYLLGHKLVGGRVLKNSREERLRNKTPPLDYYKWLSNRRAFEPWIN

SEQ ID NO: 7215 - protein, 307 aa, unidentified
  source 1..307: note = Candidatus Pacearchaeota archaeon; note = Related to WJLU01000050.1
MNPKVDRLNEYCRRFGPGFRVLDDVRNVLVDFLAGLDRQLDLFESPEQRALSSLEALRVHDGSLYNRWSFSDNRKRRELSVPCEPLKVFIDDYLIPLIKRTKVHECCHGAEPGWSPRRSLEDHLPCYSVLSFDLKSAFNNFTIAEVFDFYYSLDLEGLEEDEKIAVAGFLSMISSSLVDGRRVLPTGASHSPLLFNRGLLELDDELYEGCSRKGFNYTRWLDDITISSQGKVCIEELLGAVELTERYFPVAPNKIFFQKADEPIYLLGHVIYLGRVCKNSRTERDAHKVKPLDYDEWFGDRGYEGWE

SEQ ID NO: 7216 - protein, 317 aa, unidentified
  source 1..317: note = Candidatus Pacearchaeota archaeon; note = Related to JAGVWS010000026.1
MLNEVVVNLRDESLIEAAGAVIDAAITPRNRISTLFPEVDEAYRPANLWRDVLEMLDQGRSLYSRFQKADSNGRVRDISVPQAAFLEFVNRCLIPLVKSVPSHPASHGIEKGWSAERSVKTHVPIRTAFSMDISDAIPGVGIDKVYDFYYALLEDSKFGLTERERAGVAGNLAYLSTVHYASRGTRGLAVGSGLSNTLFNKLFMGIDVAIQEGCNRRGFRYSRYLDDVTVTSEGDESNEAFLGIHPVVAAHGFRISPRKTFVQKASEGDIYLLGQVVVNGRAVMKNSREIREANKKGRLEPEYIERVLSSGDYSRWI

SEQ ID NO: 7217 - protein, 312 aa, unidentified
  source 1..312: note = Related to NZ_FQVL01000001.1; note = Seinonella peptonophila
MIIEQQSSIHITQYLNRIMEEDHTPSYQRIWIDKYHGTTIFNPQQIAELTVKQKEEPRRADQRYVRTLGPDPKTKQWCQTLNDLLLQSREPHPNSHGLEKGRNTSTYIEPHRTQKKVLSVSLYNAFSSVGKKRVTSIARHLLGIEGNAATFFGEIATKHGKLNLGNPLAPQLLNIQAYKMDRYLTDFVRKYGLEYSRFLDELTFSSAYFIQTETIAKIKRIISRCGWMIDNETVNIQSGNHFIIAGHVVVPREGVVREKKEHRKEATNTIPSINQSHTNQANKALKTLTNPSDRLSREKGLIRNLKGLLNRK

SEQ ID NO: 7218 - protein, 425 aa, unidentified
  source 1..425: note = uncultured prokaryote; note = Related to LN854281.1
MSRKQNKVSNSHNKSWSNYRQVSYIKTSVVRQIGVEELKRINKRIFVLMKRSEGFFKEEKARMLVVKQANGYFRGQKVISQADQRALKATGGKYREVTFLKDKATRKMLRKVAKLIDIPHADQVGFTRKRSIWDAAARLGDAKSIVNIDLENAFNAIPEQAVYLILRRVFDLNKKHARQLTNAITDGGYLYQGSPLAPLIFNLWTRPIMDSVRGAGFDIVAYADDLTIGSDYGAISHKMVRVFIKWIRQFNMNVNMAKVKFYNIKKAYKETVGLKSIRSGGGILTTPVKFRKGLRKLRYLTHLYTVNGVTHTRRVNKEGEPNELGFVILGSWIWLSEAERRGVARVDTALYKKLKKSVPAIIEDWKIKRRSYNVDHQSCFTTDSIPHIPQDTRGKWKVIYTSHQGRLREGVYRKRLSARVRRPFR

SEQ ID NO: 7219 - protein, 364 aa, Streptococcus sp.
  source 1..364: note = Related to NZ_POJC01000071.1; note = Streptococcus suis
MEFKDTLAKGMSYTKQSIARYNPNVNLHKLGAKIVAWHNANKGLSYSMKTMYVVKNDPLGRFKKGAKHFEKVDGITYRNIRFYKRETREKLVEILDCLDLEHPNQIGFSRGKGIKDMLKLDNIGERTKIKLDLSNAFDNITKEQLKALLVIVFEIRPKIAEEIASAWTVNGHMVQGHPLTPAVFNLLTRQAVDFVIKYVKNCGIIQYADDILIWHDTHDYVSWKTIRMVCKAFKRAGFPMNTEKEGFYHKGAEIQFVGLRYRRDTDGKYKWFPKEMRKNKARLRAYKHLKALGHLGLDHKEKGYTEWLLFRKRNKQNNKQIQTLKGEWVDFDKAVETMLKLFPTKEEPQWAEFNRLPIREFLLI

SEQ ID NO: 7220 - protein, 394 aa, unidentified
  source 1..394: note = Related to HG796529.1; note = bacterium
MYYKRENLATLRQELIRHVGIEEFNKISATVRTKLENFEYYRIGYSSFWINKRTKAKVFSKSEILKSNDEHRPIKSPKKDLKVLTKEINELFSSFTSNRYYIKGFVKDEGVQTNAEYFRKYGGIKFGLNMDLENAFNQIDYGNLKDFGKIVMGWNAKVSEKFAKLLTIKGQMVQGNPLSPTMLNLFAIPMDLTIIEFSKSQTAPLLYTRYADDMLIGSRTKIDFKTFINLLKIIKQFGFKVKKKKTKFMKNNIEITGIILYNGKRWKTKRGRKRRLVKKIRLMKHLQSLGLKHTKRLNKEGKLIEISCVISGILAWLYPASSKKKKSRKNRKTKQNSKLNRKFSKTKHDKSLAKQNKKFSKDKRQKVAKNVEEEYRIFCMTNHHILRRNSPTTT

SEQ ID NO: 7221 - protein, 343 aa, unidentified
  source 1..343: note = Related to nan
MGHKPCRSCGEGGYAERQNQFNFQLLSFSHVKLNPNSCLSATPVRVLGILTMFTRKTVYDVNRMSGQKKAREVCNPGRHLRTIHGALRRSLAPLVSALAYSAGCRKGDSPRRRLLRHLGDVHFYLIDLKSAYRAVQLAPMARILARISPSCLLPSADQSGQYNLPYLTEQESERWLLQYAFDDKFGGLMVGAPASPDLFNLYAGEMIDAPLSKLAARYGLRYSRYLDDLLFSAPADNPIGQKKRRAIRRILTEVGFAVSDHKSRLWDIRKGPIVVNGVGLDVSGRFFVPGAFMRRLNGIAHLVRRRMLPISNLGGLLGAVKNILSTQHLNRSQGKVLAAAAST

SEQ ID NO: 7222 - protein, 328 aa, unidentified
  source 1..328: note = Related to PCXO01000005.1; note = Candidatus Yanofskybacteria bacterium CG10_big_fil_rev_8_21_14_0_10_46_23
MYKISDFLAELERSAYTKPGELSLRPTFSEPPKWERWAIRDINPLSGQKKVRMLTVPNEALRFLHKGLIYLLRVSKKASSALHYARGARPGFSHQRLVSEHRGNRFFYVVDLKDAYSQVDHSLMIKIVIEFLRAIPHFEAFSEEDEAGVTIFLERYFLLPEIPGLPVGLPASPDLFNAYIGTLVNWRISKMISAGHYTHYLDDLVFSFRSRPSRKKRREIRETLKQWRLPINHGKCQFKDLKKGPIVITGIGLEYGGRMFIPRNYTRKIAGLVHRALETRDPHEIARARGMVGLVLHTLKVARQVPNQHEEKLLRSFRKLQDDPENNR

SEQ ID NO: 7223 - protein, 316 aa, unidentified
  source 1..316: note = Related to MHWW01000009.1; note = Candidatus Zambryskibacteria bacterium RIFOXYC1_FULL_39_10
MFIDIKEFLEIHDDPRFDKYTLRDVNPVSKHIKTREISNPNKSMREIHRRIIQAVKDVYLDSSNHFSSTHQNADRHNSSRFFYQTDLMHAYASVPLEGLVTILSSLKPTWGTKNVREILTTYCFDESGAGLIVGAPASPILFNIYAWQTLDIPLLEFWPYMNDEGQIFRKFYTRYLDDLTFSSPEPITDSIRRSIRRVVEQAGFQINHRKSTVRDLKKGPVVITGVGLEYRPRRSARLFLPRHYLKRMNGLLHLALKGDPRVSHSEIEGLMGVFYGVLGRKHRQSHQSTKLNATESRFLEMYGAYRAQYERATNRK

SEQ ID NO: 7224 - protein, 308 aa, unidentified
  source 1..308: note = Candidatus Parcubacteria bacterium; note = Related to QZJN01000010.1
MFILFSSFVKGLPGREAPGFKFFFLQDRNPLARRRKRRHVGAPNEAMWRLHWRLIQWLRSPGLNRGRRYSTGCGHLDSPRRNILRHRGNRFLYLLDIKDAYPNVNLDKLAKILYELAIHLVPEDKIKLFLKLFCFSPNGGLVVGGPASPELFNLYAESLLDHPLGVFCHKHGITFSRYLDDLTFSCSTPIGKRKRLEIRKIILKAGFNINHSKAKVVDLRKGPVVITGIGLNLNGKLFVPGHYRRRIDAVFHKAAKNPKDLKYLAIGMHGLFRSVIPRGELNSRSELRTINRFRSFLSANRNKEALTR

SEQ ID NO: 7225 - protein, 332 aa, unidentified
  source 1..332: note = Related to JAGQML010000021.1; note = Candidatus Nomurabacteria bacterium
MSEKQLSIDFPTDHFLLQNKSPLPGYKTEEIVTYSSSGKRKVRVICKPNETLRIMHDIMKEVLSPVYNKKNLPYAYQWIKGISTPPIAALQHHKENRKFYPRHWFVTDLKSAYHSMDLIEASIYVEIFCQINGINPVIDWTISMILYCTDPNMTLAEGLPVSPWLFNIYAHYKLDIYLALLAHKYNARYSRLGDDLIFSSPEPFGKRKRKAILGFVRNQGFTISERKTKVIDLTKNHGASINGIGIRNTVSKGELFLPRDYRAKIKGLLHVALYGLDENGRLNDPSNFPEINGMMAIFKKLVPKNVDSWTKDDDWIVENYEIFRESFHNKAG

SEQ ID NO: 7226 - protein, 321 aa, unidentified
  source 1..321: note = Related to NVSU01000009.1; note = Candidatus Wolfebacteria bacterium
MIPSLRGLLILDPEPSSQKGGGRKHNKNKLHYIPNDSLRVLHAYALRKIEEYIFEMPSATGWIKGRGSITKDHILSHTNGQGFFHEYWYITDIKDAFRSVNLQKMSWVLCNLFPYYDFTNWPDMKEYLKKYFFAPGGSGLAEGYSTSPKLFNIYAEKMIDQHFRELCTQYNISYTRFGDDLIFTSDTIIGKKKKKALLSILRVAEFTPNDNKTHSFNLNKLKEGKIINGVGIRNTSTQAEIFLPRSKRKKLEMLLYLFWYDEAKLNPRKIEGLMGWFNQVTDSSKKGKRTLNTSEEKILKYYNRASFGLKELIREMREETT

SEQ ID NO: 7227 - protein, 396 aa, unidentified
  source 1..396: note = Related to SCTI01000001.1; note = Patescibacteria group bacterium
MARRCVPVVASTPMCLDSCSLLTSGRSTQYSYSSGSPRLITGFYDLGANMPLHNTGQLELELEALMEEPLFHSFIHKDVNRLSGNVKFRRVSAPNKAMRKIHLQIRAALSRLDVEMPYVTAGLRKSKVVNHVKAHRGNQYLCCYDLKAAYDHVRPEAMADILRQHGLPESDIELVARYCFGNESGGLVTGGLVSVQLFNLYANEVIDQPLATLFAERGGITYTRYIDDLIISSGAPIGRRFRRSILQIIRAAGFEIKPAKTQLIDLAAEHSQMAVLNGIGLDLNGELHVRPHYRELLYRLIKRAQAGEIDPSVVHGCMGAFYVIKPRGQQMTPGERKLDRAYRWYVNQQRRADPGRPERRRRKQQQYRARRRLKPSYKRHGRRSGPVGTYRPRPTF

SEQ ID NO: 7228 - protein, 327 aa, unidentified
  source 1..327: note = Related to nan
MKTENNPAFTKRVYQDFNPVSRHRKTRIIYEPNRLMRQVHAKFLKEFGGFLPRGLPITACIPGASPKMNLEPHRRNRYFYLTDIHSAYSGVNIYRLASLLCSLRPDLKLFRGDKLPHEPLDLFRAEDGMVSFLRSYFFAEEGGLATGGPAAPFLFNIYCANFLDVPLMELCRKWELTYTRYLDDLTFSAADGNPIGDKKREAIRAVVISAGFEISHRKSQVLDLKKGTISITGIGLEYGGRLFMPRAYTNTLRGALYRVVRRRSDDDERVRVRGMYSAFLSLIDLRSANCTEKKIIELAGRAFPPKPKKPGYTPKTSSRRKRRRQLE

SEQ ID NO: 7229 - protein, 329 aa, unidentified
  source 1..329: note = Patescibacteria group bacterium; note = Related to SCTI01000001.1
MSKETRSITAPPATERRFINGRNGGKRREVFVPNAAMREVHAQVIRETRLQLGIPSHNFGGVRGGSAVRCAMQHWGNHYVYKLDLYNAYPSVRPEWLYPVLAEVKSELWVDQVGMEDFVRRYLATPRGRGLMTGTPAATDLFNQVAARKLDEALIELAERWSLTYTRYIDDLVFSSWEPIGRRKREAIRAVIKRSGFRLNYKKTGYYDVARRPVMITGLRLGAGPSAGEASDDINRAFAIYLPRKWLQGLEGSMYCLVNGKSNRVGKAIEPGVVEGRMGALREHLALGGFPFDRQAALVWRKYTYVKPITRPKVPLSPMEEWLQRLFRG

SEQ ID NO: 7230 - protein, 323 aa, unidentified
  source 1..323: note = Related to MEZX01000003.1; note = Candidatus Berkelbacteria bacterium RIFCSPLOWO2_01_FULL_50_28
MSNKPILAAPVEGAAFRHFFLKDVNPLGGRTKRRHISAPNAQMREVHSALISYLRSLPADLSAATGARKGHSSITNIFPHRNNRYFLLLDIKDAYGTVDEEKLVQVLLELDPTLPRDLFGSEVVTQFLQRYCLNNKGGLLTGAPASPDLYNLYVAVLLDSKLIELCKQYGLTYTRYLDDITLSSMTRIGKKKRQAIYGLMREAGLVIHESKTQILDLNRGPVKIAGFTLNQNRSIILPRSYLGKIRGAIHNAIEKGLCDKATQVQISGMMSQLLASLQDPSVRRKGGRRYRRRPNSTEKRVMDRYCAYRQLCAQTISPKLATS

SEQ ID NO: 7231 - protein, 316 aa, unidentified
  source 1..316: note = Candidatus Wildermuthbacteria bacterium RIFCSPHIGHO2_01_FULL_49_22b; note = Related to MHTT01000015.1
MSFENLVLGFELNPALLGGTPAFRIFAIRDKNPLSKREKGRRPLEAPNNAMRIIHGRLIKYLRSLKVEMPYATACRPGDSPLKNVERHRQSRFFCLLDLRRAYQSVQVGKLASVLHQADPRLKGQFWEVRAFLQRYCMSQTGGVPAGAPASPDLFNLYCAVLLDEKIGNLCRQHGLIYTRYVDDLTISGNITVSRRVRAQVRAIIASAGFKVNHLKSQTHDLQKSTLVINGIGLELGGRVFVPPFYLRHVRGLLHEGLKGDLSLAPKIQGAMSVVLGIVNQRKPTASEQRVLRQCKRFRRLIGQTKREQRKAPAPV

SEQ ID NO: 7232 - protein, 340 aa, unidentified
  source 1..340: note = Parcubacteria group bacterium; note = Related to JACOYQ010000025.1
MQLSLHDKIFGVGFDETLRTFPEPPAMRLYVRFCGHTMSGHGKMRKLEVPNKAMREVHIRLLRFLRTLPSESSYATGCKPGDSPAKNVKRHAGQCFFYLVDLRGAFHSVDIPVLAGILRKAAKLPSRQESQILALLERYCASHFGVGGLAEGVPASSDLFDLYCAVRIDKQLGPYCKWWGIRYTRYADDLVFSSERPLSRKIRQYIRRILEEAGFAISHHKCELRDLKKGPIKINGIGLQPDGRMFVPRPFTRRTQHLLHLVLEKGRWELLLQVQGRMALFRQLTDVRNPNRTEKHLLEQYAALQRILRKEKMRAREQKKRVRQSGRPEYLHVSRSPIAC

SEQ ID NO: 7233 - protein, 312 aa, unidentified
  source 1..312: note = Candidatus Saccharibacteria bacterium; note = Related to JACAFG010000002.1
MFDNLSDLLGDEPSFRVHRLRDENKVSGVTKWRTIHAPNDPMRKLHSRMIVDLRLLQTKVHGRSPYATAVLPGSSPRRNVERHRGKRYLYLLDLHSAYLYVKGGELAFILCTLAAQRDGYLVADPSELSSTHDFLKRYCLGTTGGLLTGAPASPDLFNIYAGELIDQRLAPRLKRWGLTYSRYIDDLTFSSNEPIGERKRRAIRDVIAAAGFDISYRKAKVYDLAKGPVQINGIGLDLTGRTYVPRKYLGKVNGILHLARYGMIKPAKVAGYMGVYWTATPRSHQGRNRAECHTLELFHDYQLHRNDWLIRS

SEQ ID NO: 7234 - protein, 329 aa, unidentified
  source 1..329: note = Related to JAIFWN010000002.1; note = Candidatus Parcubacteria bacterium
MIFDGIDLPRSGTKAEFKAWQKRDVNPLGRTSRMRTLHTPNEAMKYLHDRLVINLRRIKAVDLTSAASKPGGSALRNVLRHRHNRYFYLTDISSAFDSVDSHRLAAVLAGLDTQVRESEVYAFLRQFCMTEQGGLITGSPSSPDLFNIYCAVLMDGQMREYCLRHEVTYSRYLDDLTFSSKQVIGARKREKIRELISLSGLRIGHHKSRVLDLKKHRIEINGIGLEYGGRVYLPRWYLYKIRGLMHVAERSEDPKLLQRVHGMIGLLQASTDASRPRNRLETKVFSEYAQLRHQTRKKPFIPPPQGRAPIGIQTGDPWGSLDDDDDVPF

SEQ ID NO: 7235 - protein, 344 aa, unidentified
  source 1..344: note = Candidatus Kerfeldbacteria bacterium; note = Related to JACPSJ010000005.1
MILESFTTGLPGKPAWQPFRYRDVNPLGGTTKVRLLGAPNPAMRLLHHRLVRFLRGLNVPMPHAVGARPAGSPVVNVRRHLYIDNRGRPARYRPNRYFLLYDLRHAYCNVDPGLLAGIICQHCPELTVQDGAVLDFLLGYCFGPNPNKPYQLELPIGQRRRGGLVQGGPASPDLFNLYVAITLDQPLGELCQRYGLTYSRYLDDLTFSSRERSIGTKKRQVIRRKIRDAGFTVSDRKAKNLDIRKGPLTINGVCLNRQGTIFCPRWYLRRIRTLVHAARKGAAVDLAALHGMMGVFTATLPRRWELVDINGRRSERRVPVGRLRIEQKTLDEYRQLQARQRRQP

SEQ ID NO: 7236 - protein, 345 aa, unidentified
  source 1..345: note = Related to LBTF01000013.1; note = Candidatus Nomurabacteria bacterium GW2011_GWB1_37_5
MIDKLTFGIDIENATFKIVVINDKNNLSGTKKRRVIHMPSPEMRIIHKRLIRWIRGQKRLVPISASGSRPGDSVFKSVFIHKKTRKHSYVSNGYTHIDTIGWFPRHFFCLDIKDAFPSVSVSKMTEALLFAGLDPNDYSYNKVISILERYCFTKEDGLIVGANASPDLFNIYAEYFLDRNLRRYCHEHSLVYTRYLDDLIFSSNKTIGKRKRKSIYKFIDESGLKVNEKKTKIYDLRKGCAVINGIGVNEKGRMFIPRQYLDTLRGYMNLYLKGKIELKFNWLRGKMNPLFQCQEQSDLLPNRTEGKVFDLFEEVKVRLKFPINTSLDHDDLDDLAYENTDDLNF

SEQ ID NO: 7237 - protein, 327 aa, unidentified
  source 1..327: note = Related to JAGQMN010000021.1; note = Patescibacteria group bacterium
MDRILFTERMLCNIGLQILPHIKDEDFYSFREKFQEKHLHHFVVNDINSLSGQEKQREVVKLSTELDLFQKALLSRLKMHYGEVLRSEISNSHRSALNTILCHKKVDLYRGEKRIYFSRFYYSMDIQNAFGCMTTEKVLEVLKGDFQDESLEKILKLTCFDLHRGIITGASASSYLYFLYWQKKIDSKIYELCREEGIICTRYVDDFLFSSEHKITKSFSKKVLKVIRNANFEINFQKTQFYDLGRETFNVNGIVFRKKDNRGAIGIPKTRSRKLLGMLNQYEKGNIKIAQLAGAMSLLEKISQVHNGAFLSRTHQKILSRYRKLKR

SEQ ID NO: 7238 - protein, 314 aa, unidentified
  source 1..314: note = Candidatus Wolfebacteria bacterium; note = Related to NVTD01000044.1
MIFDRLCITEKPNAAFKPFINKKGRKLNRQNSDMREVHRAFLAFLKIQDIHMPSAYGTGGKARNLWHRFLQHRDKDTGKFQKEWYILDLADAYGHVNMEKLVGVILLTCDNELRRRSDDLLAFLMRHCSSTREKGLIQGATSSSFLFNLYLDELVDIPLERFCKAHGVTYTRYYDDFAFSGQKGTLLSHRRGKLIRKGIRKILIKAGFEINHLKSKCFDLTKKPTKVNGVLLDYYGRISLPRPVIKKMSGLLHRFVHGKHLSSFVVDGNLGRVQDIHDILEPTCCIEQRLLILYLEYYHHRFRGRVRTRQDDPF

SEQ ID NO: 7239 - protein, 365 aa, unidentified
  source 1..365: note = Candidatus Kaiserbacteria bacterium; note = Related to JACQKC010000011.1
MRRIVMIQQNHAVLRGSRTDAEDDPLRFVTMVGGCPRIDFHWKQDTNGKRRLIGNPNKPLRRLHRLFGQYLEEAISKMGKENYELIKFPSSTAFVRGTNPLKNAQKHQKGRFFYITDFANAYPSVDLVRLAVLIVYIKRHNVYGLEMSLRMLGQNRVLVRELQEDPLFLSILAFLESYCSGQYGRGLAVGGPRSPYLFNLYCEVYADAGLRKVCERYGITFTRYADDNVFSRDKPITSDIRRELRRRIESAGFQVNHRKSKVLCRDMGTVFVTKVGLRDQNLVAPRSESAKAAIVFPKKKRRRLHGIIGSYLHMQMDWPEKVSGRIAEFLHYYRHVERRTAADHKTFALCKEFEREWAKYRKRRK

SEQ ID NO: 7240 - protein, 352 aa, unidentified
  source 1..352: note = Related to JAGWZP010000006.1; note = Patescibacteria group bacterium
MRHVRSAAPQEPPVENWDPLHFATMVGGHPQIHFHWKEEGGKRRLIGNPNKPMRKLHEVFGQYLRKGIYAMGNDNYTLRRLPSSAAFVKGSNPLKNAQKHIEGRFFYITDVSNAYPSIDLERLAILIVYIKKYYEYGPNFSLSAFGQNASFRDQVRRDWLFPPVHAFLESFCSGMHGQGLAVGGPLSPFLFNLYCEVFMDAQVRKLCERYDITYTRYADDCVFSRHKPIIGDIRRNVRECIARAGFEVNHRKSKVLSREMGAVFVTKIGLRNRTGKEDGSETAKIVFSQKKRRRLHGIIGSYLTMQMDWPEKVSGLIAEFIHYYKNVDESTATDRKTFALCKLFEAEWAKHR

SEQ ID NO: 7241 - protein, 346 aa, unidentified
  source 1..346: note = Candidatus Moranbacteria bacterium; note = Related to JAGOUL010000013.1
MRDMIMRPELVGQACGGYPLINFEVRDVRGKSRLIGIPNRPMRSLHRQLGKFLRGIIMHTDGSGYGLRKLPSAYGCVEGSNPLRNASQHKENQYFYITDISNAYGTVSLERLALLLTYLIQYEAYEESGFSLAWFGQDERVWVLRQDEAYQPVLGLLVAHFGGLHGQGLAIGGPLSPYLMNLYCEVYIDAPLRKFCEPREITYTRYVDDLTFSAKHFIGEETRRRIRAVISRGGFTLNRQKSRAQMLSMGQVSITQIGLARDTPDGSTRLVFSQKKRRKLHGIIHSYLTRGMDWPEKVRGYAAEFLYYYKNVAVRTATDEKTFELCKRFEREWKLYGGPKHRTRSK

SEQ ID NO: 7242 - protein, 312 aa, unidentified
  source 1..312: note = Candidatus Liptonbacteria bacterium GWB1_49_6; note = Related to MHKU01000025.1
MIFLKKAHEKTCDELPLFFPRLIRRQNQKTGAWKIRRVYEPNDAMRAIHEELDEYLRSQPRFPKHAPPRPAENVAPHRGNRFFYLTDIENAFGSVKVDGLVKAFCLMNSFWIPRKRGLKNFLENYCIAPEGGLYQGAPSSPALFELYAWAFLERPIHTWYNLKKWCGWNDVTYTRYVDDLTFSSKKRIGRGTRRQIRRLLHNAEFTINNGKNFVIDLANPKTPRITITGIGLEYGGRMFVSRERLRELEKMLIAGIEGEDVNPHKIEGFMSVFWSPYGGKRRSAVLTRTQRRILSLSRAWRKLQKKNHTMTP

SEQ ID NO: 7243 - protein, 406 aa, unidentified
  source 1..406: note = Related to JAGOVW010000033.1; note = Candidatus Pacebacteria bacterium
MHLQLLVEQASATETPPAFSVVRKRVGKKVRAIAVPNASMRVLHRLLINELEAPGYLLESATAKKGSSIIQNVRPHLHARSVYLLDFAHAYRSVPVQKLAASLHFRFPTFGTEREIAHFLKQYCFVPRHGLAQGAPASPLLFELYAEWEVDTSIRQFLERVEDSIGGRINYTRYVDDLTFSALEPIPAWVRRGIRSICMSAGFSIQHRKSVVGSLGTKVVEVTGVHLLAPGRAMLSRDFCNTLERTLDTYLSQLFSEPDLRLEGMIVYYVGMMRALGDVRASNRRTVRIDKKIKAYRLRTGFAPSHKRKTFSNRTLDAIRAQLPVSQIVSRSVALKRAGKEYKGLSPFKVERTPSFFVNDQKGFYHCFASGSHGDIFTFVMFREQCGFVEAVEMLAKEAGVSLDYD

SEQ ID NO: 7244 - protein, 329 aa, unidentified
  source 1..329: note = Related to JAGQNG010000010.1; note = Candidatus Saccharibacteria bacterium
MQPALSFDIMPKRFHHNPNQPELFTLTRDGSTKVRDIYVPTDEVRMKHEAMLRRLHALEIPFPHAHGGLPGFGVIDNVRPHQQSNYFYKLDIKNAFPSVDHEWLQRTVHDMLVERRVRKSDIRDIDHFVEADALVDGCPGLPLGYPASPFLFNIYCRPTDLAIGAGLALRKDFGYQVVRYSRWLDDLTFSSLQPIDAGHRRILREWVHMTPGFEINHRKSQRHSLGQGPVTITGISLYPDRRMAPSPELLEKVRVQFGQMAELIAAGIELTPQEIGEFNGYHSVLHMAGDPLKSRSATVRLLAKWYNRLALQLPDMESAAPGEDGGSTD

SEQ ID NO: 7245 - protein, 308 aa, unidentified
  source 1..308: note = Related to JAGNKD010000006.1; note = Candidatus Saccharibacteria bacterium
MKRRTVFKPATPEDLRIHWRMLANLQSIQWEFPHSVGSLPGSHLIDNVTPHISAESEQFYLLDLKSAFPSVDTDFALRAVYDGIRTRRGRDEAAEAARFMVETSYMGRTQDEKPDKMMYGLLQGLPCSPLFFDIISQALDMRLRRHLQRVFGDDVVYTRYIDDLTFSSRRAAFTRRRRKDIVAQIETLPGYIVNHDKTRCQSLGRGTLTVTGLDMRRNRKWPTDRRVLVAPSGSQLASVEQEINEMTRKLREDLPITLSEKAHFYGMGSILHMAGDPSKSPMSSVRTLKRRFREVDKELKKLPSGRLF

SEQ ID NO: 7246 - protein, 427 aa, unidentified
  source 1..427: note = Candidatus Kaiserbacteria bacterium RIFCSPHIGHO2_02_FULL_49_11; note = Related to MFLC01000025.1
MIALKSLVPLPLFGGAPTFNPQNIFDGKKWRTVQAPNNVMRKLHKELIEVLLELPIDFTSATGSLPGKSNILNANVHAGNQFFYIFDMKDAFPSVPIDRLADTLHVCSHGHLGTRARIRSFLEDYCAGPRGLAVGAPASPLLFNIYCAVGVDPGIRKLLRSDTIYTRYVDDLVISSSRPIPRILRKRIRKVVTDAGFAIKDPKSKVLDKEKGPVTITGVVIDKKGRIAPTKECLAEVEDLLWIPPQELTPEQQKRIAGFASYLQSFREFGRQKLAEGNGTVSTAPLSPVLDTLAKRCRIRLRENKKPRTQKQQMHLVFPEVFIDEIRATASLRDVIEPYLRPGKRGLRLKKVGGEWAGLCPFHNEKTPSFTIAEEKGFFHCFGCGNHGSVIDFIMRVERLEFPDAVRFLAKKYDLPLPERKLERTKN

SEQ ID NO: 7247 - protein, 419 aa, unidentified
  source 1..419: note = Related to JAHIST010000097.1; note = Patescibacteria group bacterium
MAAPRLSCSLKKYGFNSKEVVVKVNGKKLLADLMNWPEKKIEQAITRRSRYYLVKKIDKDGSIRKTYAPDRELKKLQKRFLKYFLYRIPVGWKNLITGFRPGCSYVYNAKCHALADAKIVLRLDFANAFPTVETSYLKTILAKILSQEVEYHRKGDYPFHPLFPVKRVKWFRRAIKNYYQLDLFCDPDKIICEFLDLVLSFVTYQGRLPQGAPTSPYLFNIVLWYSGLIQKITAFLGEKRISVSVGNVFSGEVIFTAYADDLTISSSRSITKHEVNNLIDLIEQESPFRINREKICYFQADRIAPLVTGLRLVKLVKEGRELDVLMSKANLNSREKKNLKRKILNREGRWIVNSVSLPKKGIRKIRGLIHKATYAPPLIQRMLEQKIKGHLSCLKAIYGDKLPNQISKPYQKFQQSLRG

SEQ ID NO: 7248 - protein, 389 aa, unidentified
  source 1..389: note = Related to JABMPX010000007.1; note = Parcubacteria group bacterium
MISKDLLTSVLDWPEEKINKAVLFKDSYRLINRKKKDGSLRKIYAPHPDLKRFQRRFLKYFLYRIPLISSLPINGFRPKFSYIDNTKEHAQKNVRFVLRLDFRDAFPSVKIEYLRIILKKVLFLEVKGYMEKNYRQRPLFPNKRVQWFRKLLRDLPQLNLFSVDPLKILDEFVELILPLITYQGKLPQGASTSPCLLNIVLCYSGLLEKIYQFLWDNRILFSENDVSMVNSTIYADDLTISSSEPISRSSINQLIDLIEQESPFKINRQKISYFNRARIAPLVTGLRIVRLVKEEIELENFLSNKDLTYKQKKNILRRTLNKKGKWIITSVSLPKKQIRRIRGLIYRAISEKALAPIIDGHMANLKAIYGQNLPNQIMVPYKKYLITEG

SEQ ID NO: 7249 - protein, 403 aa, unidentified
  source 1..403: note = Related to JACRFM010000021.1; note = Candidatus Kerfeldbacteria bacterium
MSRIKIEGGDTLLAGVLGMPSADIRNAIVCRDNYKIKHIVKKSGGRRRLSIPCKSVKKFQKLFLKKFLYCLIERGVLDKNMTGFLPGVSVKDNALVHLNENLQYVVRLDFKNAFPSVSFRVVKEVLLHHVKNEIGTYRAVEIQRLLGKKINYPEPVLFSMRKVKWFRELVSSLSVDNSASYYLDYIVDGFIEMAAYLLTYKGKLPQGAPTSPFMLNLTVSYLKILDRIREFLKQNNIDSQVSIYADDIVISAKERINFGLIRGLIGVVEASRVFRINRAKILRFDINQTAPLITGFRLIRIRSVNRKLTESWLARLPRKIKATVEERLFYNPQSPFINITLPQKQIKKIRGIIHRAIYQPGLASKVNGYVAYLKDIYGEHLPRQIVEPYKKYLLVNQKDPEVV

SEQ ID NO: 7250 - protein, 347 aa, unidentified
  source 1..347: note = Candidatus Moranbacteria bacterium GW2011_GWE1_35_17; note = Related to LBQA01000005.1
MNTIQEKAIIVLSSLLSNKFSPEKIKEILTSGISYRYKPRKKKDGSIRDCYAPAEDLKALQQSILSEILHNIPVHKNLCGFVPGVAMKNGVEAHLRETREKKIVGRWIVKVDIKNCFPSVKIKVLKNMFEDIFTGTLYAYGVDNPAVFFEFCDILIKLTTHKGGLIQGAPTSPYLTNLVISWAGIVDDLEHYCNTRHGYDLIFSIYADDITVSPTITNKASVKKIIHAIEKSRIFRVNPKKTTQNDNRHRSHRITGMSIHQEFDQFGPSEAWTTLSRKKQKFYRGRIQKVIQFLQQGCEPSIKEHGVSINQARGYITWTRHVCGERIPSCLKKVIAVFEELVNKQAL

SEQ ID NO: 7251 - protein, 366 aa, unidentified
  source 1..366: note = Candidatus Moranbacteria bacterium; note = Related to DOKE01000013.1
MKNSKYYLSLFLKFLPILEKMKITSAMADGLIYTYYTKEPYYRTYEILEKNGKIRKIDEPCDALKLIQQELNRYFYRFPTHKSLKAYIENCEGAKETALTHQFTVWGAKPGDRQSKPPRWLLKMDLKDFFPSIKTRTVENVLFLNFLRDKDNQQLLIRLSEKLNKKFGLLFKQFIELLIWLTAGNGCLTQGAPTSPYLANLVWTESGVIEKILDYLHSRKKEFNLAIYADDISVSFLERKYPRGVIKNIAKIINDSEYFKINPKKTKLNRLKHGAHLVVGISIGKTSHFEPSFGIPQKFINTLRGELHKTITIIKTETRPIEQIHEVSIPMMRGKIGWVKSVYGDRRLPSKIKKLVEEFEILSRII

SEQ ID NO: 7252 - protein, 425 aa, unidentified
  source 1..425: note = Candidatus Buchananbacteria bacterium; note = Related to JAGONZ010000028.1
MARPTALDVLSALIGLDRQIIELALSETESYQKIEIPKRNNGRRIIHIPSEILALVQKYLLECLYSWEVHDYMHGCVIGRSPVSNAAKHLRLNKKENVRPGTGEQFLYMTVPRHVLKLDLSNAFHAVTKDAVHQMLTSALSSTWAANLHLKQGDTDVEKKRWDIINHVRSNGYFVEPLASLITQLTTTEGLLPQGAATSPYLLNMVICASGLMERVAKACKPRRGRFTVYVDDITISTKEPEIGEGFIAAMIEAVERGGRFTVNPKKTSLTDSRHRAPVITGVTLGTNADGTGRLSIEQSHLNTIRRILWCAANLLEQGIKPDFDEHGFSLDHALGHAAWVDNVYQDKAPHPLVAKPLARFRKAFLCRALGPLGTQLSLPFGEEQPKQGLRSSNRRQLLQELLDQLLDRPVEERIRAIDEFNTQH

SEQ ID NO: 7253 - protein, 343 aa, unidentified
  source 1..343: note = Related to JAHIRB010000007.1; note = Patescibacteria group bacterium
MQKSRKDAVEILANLMRLQSDFIFDALKNRNYQQILIPKRSGDVRKLHAPGEELKLVQEVILQFLYRWKVDARQFGFVLGGSPIRNAKYHIRNEFYVPHWVLKLDLENAFPSVTSTVLRKEYTRVFNPETFKELSGIDEKQFTAFIQLMLDLTTYRERLPQGSPCSPYLLNLVLVWTGVTKGVLEYCEKKGLRASLYGDDFTISAKTSNMWFSKTFFRKINSAVSRSGCLRLNHDKTHLICSRNSAPIITGVKITESHDNGAKLTLTQSTLNHWRGVIHRVTEILYWNNRLPRLEQDGVTFNQALGYVNWIEDVYRESEVPLSVRKPIKSFKVQSSRFDRRRG

SEQ ID NO: 7254 - protein, 399 aa, unidentified
  source 1..399: note = Related to SOKK01000088.1; note = Patescibacteria group bacterium
MSRKQDEVKIKNPFPAQPLLQPRTLTKIYKERRDEMDALDFLGHIVKDRQTIQEAWRIRREYKDVYVLKGNGEVRILSVPPIKVKKAQKMILEWLRDGNFISSHPRIHGLVGSSCFNFIKGHCGTSQYFYSFDIKHAYDSTPVPLIYENLLRILSNKESLLLRAYFESETGKGIQELAKTIIELTTYSQASPKRTENEKQLSFLKRGSNSILPQGAPTSPALFFVVLKTMMEKIERDVNLSEHKLSCYGDNFLISSPSPINPEVADHVLAIVKSFGFTPHKTFQHNIKQGALKICGYTIAPGNGGKDKTRIGIDKSTIRRIRALCCKAQYTTRYKDPRLYRRLQGCLAWITPVYGGNRHNLPNQIKKPLRKIGTPLKCQSKQSKRSFLLKKQRPKKRRA

SEQ ID NO: 7255 - protein, 348 aa, unidentified
  source 1..348: note = Patescibacteria group bacterium; note = Related to JAHJGP010000039.1
MRQTRIDEWFSETKQKKKLIAKIQKVSALTKTRPESFWEKLEKALPLRKDYREAKIPKRSGGYRTIYMPSPELKKVQKNILRYLQEIWQVHYGPVHGLSPGGSCVKHARIHSASRWIFQFDIKNAFPSTNIITLRKLLSQIIPVEVNLGENATKIAYTRAELIIKLTTFQEGLPQGAPTSPFLFYIVLTSRKIIPATTGGEIRLTGLFYKLWSACPRGYKISCYVDGFVISGPKPISPKTQEKIFKTIRKESFEINQKKTRIQDCRHGTVMICGLAVDGKGRISLPKKTIRKWRGIIGKARFDPENLELRQKIEGFVASLKPIYEKGTPPQITKPYNRYQRELVKTTS

SEQ ID NO: 7256 - protein, 366 aa, unidentified
  source 1..366: note = Candidatus Portnoybacteria bacterium; note = Related to JACQXN010000004.1
MKKFSSFDGLLSLLEDCRQCEIKYRIKKMPKKGGSKRIIHVPSKEVKEIQWEILDIVKAWQVDECQFGFSPGKSCVDNALFHIHGYDINASGRKIQIRGVPRWVLKTDIEDAFPSVKRKHLETLFRDLFLPLKSYPAFVSATSPDRVDKIYKKLVYQFARLATFKGRMPQGSPCSPYLFNLVLLQSGIVKKLKDKAGERAKKTKGCQVTAYKISFYGDDITVTSFKDRIPNRFIKEISAIVEEGGIFRLNNEKTQRSSKKYRSILINGITLNDKWKEGGPCFLGLSKKIRKTYRGKIHRVTVILDSGRLPELEIDGINLEKAMGIISRIKDVYRNESLPSDLERVLIKFQEARNNLIRRTINIVCI

SEQ ID NO: 7257 - protein, 416 aa, unidentified
  source 1..416: note = Related to DPTL01000176.1; note = Elusimicrobia bacterium
MWISQDLIEKTKEALYEKTKDERVLWASPLEIVCLAKQKKCKVDFNTLLRSFSANHCTAEDVANLFNYLNSHGEGNVEREMLLKVIAEPEERKVLQEVKCLIDRYYPKRKKNPLEGIPKIKQFVTRFRNKERHYRSFAIPKRNGGRRIIEAPTQELANIQRLILKKILYRNQIWNSNSSVHGFVPGRNILSNASLHKEATVIVRIDLKDAFRNTKEEMLVKHLKEYFTEKGAKILVRLCTYKGHLPQGAPSSGMLLNFVLGELDGKLKKIAGFMGWRYSRYADDLTFSCVEFNKHTVGIGKLIERVKSMIKDYSYRVNEEKIRVFKKNRAMRVTGLVLNSGKPTISRKFRRNVRAKVHNFVTKGIGNEKEVLGYISYINLANKKYAKKLLRMMEKLPSTHVPRQDAIGISSGVASE

SEQ ID NO: 7258 - RNA, 1461 nt, unidentified
  source 1..1461: mol_type = other RNA; note = synthetic construct
atggataagacggaaattgtgcagatcgcgtcacagatgagtacccgtgaagatctcctcgcattgctgaacaggattaagcaggatgagattcgcgaaagcggctttgacgccgacaagttctatcctttcacaatgaaacagctgctttactattgcaatcctaatcacgccttccaccggtataggcagtttaagatcaaaaagaaatcgggggggtttagactcattaccactccacgcaatagaagcttcatgatgctgttgcgatccgtgaatgaaattttgaaggcgatctacacacccagcgattatgccatgggctttacagaaaaacgctccgttgtgaccaatgctgccgtgcataggaatcagaactacgtcttcaatatagatctcaaagactttttcccctccgttgagcagggaagagtcatgaagagacttactctggaaccctttaatttttcaccccaaattgccctccttatcagcggtctgtgctctatgcgggtcaaacgagagcaacccctggaaacaaagagatatgatctagacaagcagtttatgtacgtactgccgcagggcgctcccacatctccagtcataacaaacacaatatgtgatacgctggaccgcaggctggctgggttggcaaaacgcttcggtttgcggtacacccggtatgccgatgacattactttcagctctatgcactacgtgtactccaagaacagtgagtttatcaaagagctaattaggatcatcaacactcaaggcttcatgatcaacgaggctaaaacccgactgcagaaactgggttcccggcaggaggtgactggaattattgtgtcggacaaacttaacgtcaccaagaagtacgtaagggaaatccggtcactcttatatatctgggacaagtatggctatagcgctgccatgtctagattctttccaaagtacaaagcagagaaggggcacatcaaaaaagggaatccggaactgactaacgtcctagacggaaagttactgtatcttaaaatggtaaagggggataccgactcagtgtatattaagctgtacaccaagtttcaggagctcgttaatcgcgatagcggccctgacaagaccaattcttacggaataagttacattgagtctttccctatcttagagttcgagaaggataagaacaccaacatcacaatctttcacaaggacggaaacaaaagatacgcaaccttcaggatgggcgagactcatcaggtggccagtattaacaaagacgtgacgccagacgacgaacaacagaaagagaagctggcaatatcctgttgcaagaattttcgtggcgagcaattctggcttatacatctcctggataaagttactgtgttcaaaccaaagcctgtggatatcgatgaattaaacaacgacttggacctgctcctgggaatctga

SEQ ID NO: 7259 - RNA, 1461 nt, unidentified
  source 1..1461: mol_type = other RNA; note = synthetic construct
atggacaagacacaaattgcacagatagcctcccagatgtcgacgagagaggacttgcttgcccttctcaacaggattaagcaggatgagatccgggatctgggctttgacaccgacaagttctatccttttacaatgaagcagctgttgtactactgcaatccgaaccacgccttccataggtaccggcagttcaagattaagaaaaagagcggcgggtacaggcaaatcacagcacccaggaatcaatccttcatgatcctcctgcagtctgtcaatgagatcctcaagagtatatacaccccaagtgaatatgccatgggctttaccgagaatcggtcggttgtgacaaacgcagcggttcacagagctcaaaattacgtgttcaacattgacctgaaggatttctttccaagtgtggagcagggacgagtgatgaaacgccttaccctcgctccattcaatttttcccctcagatcgctctggctgtgtccgggttgtgcagcatgcgagtaaagagagagcagcctttagagacaaaacagcacgacctagacaaacagtttatgtacgttttacctcaaggagcacctactagcccaattataactaacatgatctgcgataccctagatcgcagactcgcgggactggccaagagatttggtttatgttatactcgttacgctgacgacatcaccttttcctctatgcactatgtgtattctgaaaagggggaattcagaaatgaactggcgcggattataagcacccagggctttgtaatcaatgaggccaaaacccgactccaaaaactggggagtaggcaggaggtgactggcgtaatcgtcagcgaaaagctaaacgtaactaaaaagtacgtgcgcgaaattcgcagccttctctatatttgggataagtatggctactccgcagccatgtcaaagttttatcccaagtacaaggccgagaaaggtcacgtcaaaaaggggaatccagatcttacgaacgtgctcgatggtaaattgatgtatctgaagatggtcaaaggagatgacgatagcgtctatgtccgtctgtacaccaagtttcaggagctggtcaatcgcgacacaggctctgacaagacaaactcatacggaattacctatgtggaaacaatgccccttatgaaattcgagaaggacaagaacactaacatcataatctctcagaaagacgttaacaagcggtacgccaccttcgaactggggaaagtgcatcagatcgcttcaattaacaaggctgtgactcccgaggacgaacagcataaagaaaaactggcaatctcatactgtaggaatcccaaaggcgaactgttctggctgatccatttgctggataaagccacaactttcaaaggaaaaccggttgatgtggatgagctgaataacgacctcgatgccctgttgtctacgtga

SEQ ID NO: 7260 - RNA, 1461 nt, unidentified
  source 1..1461: mol_type = other RNA; note = synthetic construct
atggataaaactcagattgcgcagatagcaagtcagatgtccaccagagaggacctcctggccctgctcaaccgcatcaagcaggatgaaatccgcgagctggggctagatgctgataaattctacccttttacgatgaagcagttgctttattactgcaatcccaatcacgcattccaccgatatcgacagttcaaaatcaagaagaaaacaggaggatatcggcagatcgacgcccctcggaataagagctacatgatgctcctgaagacagttaacgaggtgctgaagtcaatctacatcccgagtacctatgcaatgggcttcacggaaaagcgtagcgtcgtaacaaacgccacagtgcacaaaggacagaactacgttttcaatatcgatttgaaggactttttcccttctgtggaacagggacgcgtaatgaaaaggctgaccctatccccattcctattttctccagaaattgccctgctcatttcggggctctgtagcatgagagtcaaacgggagatcttagtagaggacaagaaacacgatctggacaagcaattcctgtacgtacttccgcaaggcgctcccacctctcccatcatcacaaacatgatttgcgacactcttgatcggcggcttgccggcctcgcaaaaaggtttggtctgcattacacaaggtatgccgacgatatcacatttagtagcatgcatcatgtgtattcaaaagagggcgaattccgcaaggagctcgagagaattattgaatcccaagggttcactatgaacgataagaagactaggctgcagaagcttgggtctaggcaagaagtcacgggcatcatagtcagtgacaaacttaatgtgaccagaaaatacgtgcgcgaaattcggtcactgttatacatatgggaaaagtacggatacaccactgctatgtccagattttatcccaaatatatcgctgagaagggacatgtgaagaaggtcaaccctgacatgactaatgtgttggacggcaaactgatgtacctgaaaatggtcaaaggcgattcggattccgtgtacattaatctgtatacaaagtttcaggagctggtggcccgagattccggttcagaaaagaccaattcctatgggctgacctacattgaaagcgttccattgctgaagttcgagaaagataagaagaccaacgttacgatcagcaaaaaagacgggaataagcgttatgctacctttaaactaggtgaggtgcaccagattgcgactattaacaaggccgtgactcctgacgatgagctgcacaaggagaagttggttatcagctactgtaggaacccaaagggcgagacattttggctcatacatttactcgacaaagtcaccacctttaaaccctatccagtgaacatagacgagctgaataacgacctcgactctttgttatctacatga

SEQ ID NO: 7261 - RNA, 1461 nt, unidentified
  source 1..1461: mol_type = other RNA; note = synthetic construct
atggacaagacacagataacgcagatcgctagccagatgagcacgagggaggacttgctggcactgttgaacagaatcaaacaggatgagattcgggagcttggctatgatactgataaattctaccccttcaccatgaaacatctgctgtattactgtaatccaaaccacgtgtttcacagataccaccagttcaagattaagaaaaagagcggaggctttcgccagataaccgctccaaggaatcaatcctttatgatgctgctgcagacagtcaatgagatcctgaaggcaatgtattcgcctagtgattatgcaatgggcttcaccgaagaaaggagtgtagtgaccaacgcgtccgtccataagggacagaactacgtgtttaatatcgacctgaaggactttttcccgtctgttgaacaacgacgagtcctgaagagatttggggcaaaaccctttaactttaaccctgaaatcgctctccttctctctgggctctgctccatgagagtcaagcgcgagcaggccgacgagacacagactcatgatttggacaaagaattcgtgtatgttctgcctcagggagccccaacatcccctatcattacaaatatgatttgcgatacccttgatcggcgcttagccggactggcccgcagatttggccttcgctattcacgttacgctgatgacataacgttcagttcaatgcattatgtgtatgccgagaagggtgaatttcgaaaagagctggcaagaataatcgggtcacagggattcaccattaacgatacaaaaactcggctgcagaaacggggctcaaggcaggaggtgactggtatcattgttagtgataaactcaacgtgaccaagaagtacgtgagggagatccgttccctcttgtatatttgggaaaaatacggctactctgcgaccatggccaagtttctgccgaagtacaaggccgagaaaggtcacgtcaagaagggcaacccagacttgactaatgtgctggacggtaagctcatgtacttgaaaatggtaaagggggaatccgatattgtttacgctcggctgttcgagaagttccagcagctagtggcgcgtgacagcggaggggataagaagaacccctatgggatcacatacatggagacagtgcccctgctcaaattcgagcaagacaaaaataccgaggtagccatcttccacaaggaagaaggaaaacggtacgctactttcgaattcaatggcgtcaaacaggtggtatctatcaacaaggacgtttctcaaaatgacgaaatgcaaaaagagaaactagccattagcaattgtaggaaccctaagggcgagcaattttggcttattcacttagtgaacaaagtcactgtttataacctcaagcccgtggacatcgacgaacttaataatgatctagacagcttactcagcacctga

SEQ ID NO: 7262 - RNA, 1446 nt, unidentified
  source 1..1446: mol_type = other RNA; note = synthetic construct
atggataaggctcagatagtccaaatagcctcccagatgagcacgcgcgaggatctgctggccctgctgaactccattaagcaggacgaaatcagcaagtcctgttctgacggtgataagttctacccatttacgatgaagcacctgctctactattgcaatccgaatcacgtcttccacagatataggaagttccggatcaaaaagaagagtgggggattcagacagatcactagccccagaaatagatctttcatgatgctgttacagtcggtgaacgaaatcctgaaagcaatgtacaccccatccgattacgccatgggctttactgagaaaagatctgttgtgactaatgctcggattcatcagggacagaactacgtgtttaatatagatctcaaggactttttcccctctgttgagcagcctagaatctggaaacgcctgcaactggccccatttaacttccctatcagtattgcaaatgtcctagcaggcctgtgttccatgcgcgaggtccgaaaggatatcgacggcaaggacgtcttcgtgtatgtgctcccacaaggcgcacccacaagccctattattaccaacatgatctgcgatactttggatcgtaggcttgtcggccttgctaaaaggtttgggctgcactacagccggtatgctgacgacataacattctcatctatgcattacgtttacgccaagaatggagagttccgaaaagaactcattcgtatcatcaaatcgcagggctttaccattaacgaggagaagacaaggcttcagaaacaagggagtcgacaggaagtaaccgggattgtggtatcagaatcaaaactgaacgtgcctaaaaaatacgttagggagatccggtccttgttgtatatttgggagaagtacggttatagcgtagccatgagcaggtttctgccaaagtacaagttggaaaaaggacacgttaagaaaggtaatccggatcttatcaatgtgttggaaggaaagctcatgtatttaaagatggtgaagggcgatatggaccctgtgtatgttcggctgtattccaagttccaggaactggtggccaaggacttttcattgaataaaaccaacagctatggaataacctatatagagacaattcccctccttaaattcgaggaggataacaacacaaacgtgatcattcatctgaaagactgcaacaaacgctacgcggtatttaagctaggcgggatcaatcagttcgcgtctattaataaaaacgtgccctcagactacgaacagcaaaaagaaaagcttggtattagtaactgtcgcaactccaaggggaaacaattttggctcatccatctggtggataaggtgatcgtccagaacagtaacatggtcgacatcgacgagctgaataatgacctcaatctcttactagacatctga

SEQ ID NO: 7263 - RNA, 1449 nt, unidentified
  source 1..1449: mol_type = other RNA; note = synthetic construct
atggataagaaccagatcgcccaggtcgcgaaccaaatacaggaacgcgaggacctgttgagtctgctgaataaaatccgcaaagacatagttggagacaacggctctgagtccaaatttttccctttcaccatgaaacacctcctgtactactgcaaccctaatcacacttttcacagatatacgcagttcaagattaaaaagaagtcaggagggttccgccttatcacatctccaaggaacagctcctacatgtttctgctgcagtccttaaacgaattactcaagagcatgtatacaccggctcagtcggcaatgggctttacagagggaagatctgttgtgactaatgctaatgtccataagggccaaaactacgtgttcaatctggatctaaaggattttttcccatccattgagcagcctcgtatttggaagcgccttcaactcgccccctttaactttccttctagtatcgcgaatgtgattgctgggttgtgcagcatgaaggaaactcgaacggacactaccggaaacgacgtggttacttatgtcctgccacagggggctcccactagtcccattatcacaaacatgatatgtgataccctagatcggcggctgctgggcctgtcaaaacgcttcgggctgcgatatacaaggtatgccgacgatataacattctcttcaatgcactacgtctatgccaaggacggcgtgttcagaaaggagttaacaaggatcattgaatcgcagggcttcactattaatgaggctaagacccgactgcagaagttgggtagcaggcaggaggttacagggatcatcgtctcagacaagctcaatgtgagcaagaagtacatccggaatatcagaaatcttctgtacatttgggagcggtatgggtatagcgtcgccatgagtcgtttccttcccaaatatagagccgataaaggacacgtgaagaaaggaacccctaacctgatcaacgtgctggatggtaagcttatgtacttgaaaatggttaaaggtgagtttgactctgtgtacgtgcggctacatgacaagtttcaggagctcgtcaagagggattttggggcagagaagactaatagcctcggcattacgtacatcgacacaaagccgctgttagaattcgagaaagaaatgcaaaccaccatttcctttcagcacaagaagaacgaaaaaagggcagcatcatttttgatcgagggcattacccattgtgcctctgtgaataaaaatgtgacccccgattccgaacaacagaaagagaaactctccataagcaactgccagaacgaaaaaggcgaacaattctggcttatccatctcgtagataaaaagaccgtattcaaatccaagccagtagatatcgacgagctgaataaagacctcgacagtctgttgaacacctacaatggttga

SEQ ID NO: 7264 - RNA, 1464 nt, unidentified
  source 1..1464: mol_type = other RNA; note = synthetic construct
atggataaaaaacagatcgttaagcaagcatctcagcttaaatcgaaagaggatctgctgaatctgctgaatcgcataaaacgggatgaaatcgaggagatgggttttgatgccttcaaatttcatcccttcactatgcgccatctgaactattactgcaacccaaacaatgtctttcaccggtaccggcagtttcacattaagaaaaagtccggaggttccagggtcatcactgctcccagaaaccgtagttttatgatgatgctccaggcagtgaatgagatactcaaggccatatactccccttccgattacgccatgggatttaccgaggggagatcagtggtgactaatgctaccattcacaagggccaaaattatattttcaacatcgacctgaaggatttcttcccctctgtcgagcagagcagggtttggaaaagattacaactgaagccgttcaatttttccaagcagatggcgaatattatcgctggtttatgctctatgcggcaggtgaaggatgttattgacgaaacaaaggagcacaacaacgacaagaaattcaaatacgtgttgcctcagggcagtcctgtcagcccaataattacgaatatgatttgcgacacacttgatcgcaggcttgcaggactcgcccggaggtttggcctccactattcaagatatgcggatgatattacattctcttcaatgcactatgtgtacgccagcaacggaaagttcaggactgaactatgtcgcctgattaccgaacaaggcttcaccatcaacgaagacaaaacccgtttgcagaagctgggagcccggcaagaggtcaccgggattattgtaagccaaaaattgaatgtgacgaaggagtatgtaagagacatccgaagtatcctatacatctgggacagatacggctataccgctgcaatcgcacagtttctgccgaaatacacagcggctaaaggtcatgtgaagaaaggcaatccagaccttcagaacgtcatagacgggaaactgatgtacctcaagatggtaaaaggggacgaggatagcgtttatacccgattatattctaagttccagtctcttatccagcgagacactagcagtgaaaagaccaatagctacggaatatcatatgtggagacaacaactgtttccaagtttgagcagatcaacaaaaccacaatcaacttcgtgcaggacggcgacgggaaaaggcatgccgagttcaccctggggggcaagaaacagtacgccacgttcatgactatcgtgaagactgacgaaattaaggataacttggctatctcgaattgtcgcaatcccaagggcgaaatgttttggctgatccataaggtggataaggtcaccgtgccagccaagcccatcatcaatattgacgaactgaacaacgacttggatacactgctcaacctccctcacgggtga

SEQ ID NO: 7265 - RNA, 1461 nt, unidentified
  source 1..1461: mol_type = other RNA; note = synthetic construct
atggacaagaaacagatagtaaagcaggtgtcccagataaaaagtaaggaggatctgctcaatttactgaactgcatcaagagagacgaactggaagagatgggttttgatgcctccaagtttcatccattcaccatcaggcatctgaactactactgtaaccccaacaatgtgtttcacagatacagacagttccacatcaagaaaaagagcggtggcacaagggttatcactgctccgcgcaatcgcagcttcatgatgatgcttcaggctgtgaacgaaatccttaaggccctttactccccaagtgactacgccatgggcttcaccgaggggcgctctgtcgtaaccaatgccaccatccataaaggccagaattatgtcttcaacatagacctaaaggacttctttccttcagtggagcagttccgagtttggaaaaggattcagctcaaaccatttaactttccaaagcagattgcaaacattgtggccggactgtgtttcatgcggcaagtgcggaacgttattgacgaaactaaagaacatgataacgacaagaagttcaaatacgtcctgccgcagggtagccctgtctctcccatcataaccaatatggtgtgtgatactctggatcggagactggcaggactagctcggcggtttgggttgcattatagtcgatatgccgacgatattacctttagctccatgcactacgtatatgcgcccaatgggaagtttcacaccgagctctatagactcatcactgaacaggggtttattatcaacaaggataagaccagactccaaaaacttggcagccgtcaggaggttacagggatcattatttctcagaagctgaatgtcacaaagaaatacgtgcgagatatcaggaacatcctttacatttgggaccgctatggctatacaacggcaatttctaagttcctccctaagtataaagccgctaaaggacacgtgaaaaaagggaatcccgacttacaaaacgttatcgacggcaaattgatgtatctgaaaatggtcaagggcgacgaagattccgtgtatgtcaagctgtacactaagttccaggagctcgtgaatagggacagcagctcagataagacaaattcatacggtatcacgtacatagagtctttgccttttctcaagttcgagaaggataagaacactattattacgatccaccacaaagactgcaataagcgctacgcgacttttaaaattggagaaaccacacagatcgtaagtatcaataaatcggtgacccccgacgatgagcaacaaaaggaaaagctggcaatatcttattgcagggactccaaaggagagcgtttctggttaattcacttggtggacaaaatgacagagttcaagcctaaaccagtggacatagatgagctgaataacgatttggatctactgctgtcaatctga

SEQ ID NO: 7266 - RNA, 1455 nt, unidentified
  source 1..1455: mol_type = other RNA; note = synthetic construct
atggacaagaagcagatagttaagcaggctagccagctgaattccaaagaagacctcctgaatctgctaaaccggattaaacgggacgaaattgaggagatgggctttgatgcgagtaagtttcatccattcacgatgagacacataaactactactgcaatccaaacaatgtgttccacaggtatcgtcagtttcacattaagaagaaatcaggaggtacccggattatcactgcaccccgtaacaggtcattcatgatgattcttcaggccgttaacgaaattcttaaagccatctatacaccttctgattacgctatgggattcacagagggtagatctgtggtgagtaatgctactatccataagggacagaattacgtgtttaacatcgatctcaaggacttttttccctcggtggagcaattccgcgtgtggaaaaggctgcagttgaaacctttcaatttcccgaaacagatcgccaatatcattgccggcctctgctccatgcgacaaacccgcgagataattgatgagacaaaagagcacaaaaacgataaaaggtacaagtacgtcttgcctcagggaagcccagtgagccctataattacgaatatgatatgtgacaccctggatcgcagactcgcagggttagcgcacagattcgggctgtgctatagccggtatgccgatgatatcactttctcatcaatgcattatgtctacgcccccaacggcaaatttcgaactgagctgtgtaggatcatcagtgatcaaggttttaccctgaacgaagacaagactcggctgcaaaaggtaggggcacggcaagaggtaacgggcattatcgtctctaagaagttgaacgtaacaaaaaagtacgtccgcgacattcgaaacattctatacatctgggacagatatgggtataccgcagctatcgccaagttcctgcccaaatacaaagccgctaaaggccacgtcaaaaaaggaaatccggatctgcagaatgtgatagatggcaagctcatgtatcttaagatgatcaagggcgaagaagactccgtctatatcaagctgtacacaaagttccagagcctcgtaaatcgcgacacttccttggataagacaaatacctacggaatctcctatgttgaaaccactcctattcttaagtttgaacatacaaacggcaccatcgtggttttcgtgcacgacgagggcgggaaaaggcatgccgagtttatcttaggggaaaaaaagcagtacgctaccatcatgtctgtcgttaaaaccgaggaggtgaaggaaaacctggcaatttccaactgtagaaacagtaatggtgagatgttttggttgatacacagcctcgacaaggtgactacattcaagcccgaaccagtggatatcgacgagctaaacaatgaccttgacttactgctgtctacctga

SEQ ID NO: 7267 - RNA, 1440 nt, unidentified
  source 1..1440: mol_type = other RNA; note = synthetic construct
atggacaggactgaaattactaagatggccatgcagatgaaaactaaggaggatctgctatcactcctgaatctgattaagcgggcggaacttgaagaaattggactccaagatcagttccaccctttcaccatgaagcacatcaattactattgcaacccaaataacgcctttcatcgatatcgccaatttaaggtgaagaaaaaaagcggcggcttccgactgatcaccacccctagaaacagaagtttcatgatggtgttgtcagctataaacgagctgctgaaatctctgtatactccttctgactacgccatgggcttttctgagggtcgcagcgtggtaagcaacgcctcgatacacaaaggacagaattacgtattcaacatcgacctcaaggactttttcccttccatagagcagccaagagtttggaagagattacagttggcaccctttaattttcccgagaagattgctagtcttatcgccggcatgtgtagcatgaaggagattaggtctttcgaagacggccatcaggagacattctacgttctaccgcagggtgctcctactagtccaatcatcacgaacatgatttgcgacaccctcgaccgccggctagctggattagcaaagcgattcggcctgcattatagcaggtatgctgacgatatcaccttctcttccatgcattacgtgtaccaggaggatggggattttcgtaaagagttgaggcgtatcattgcagaccagcattttacgataaatgacgataagacacgccttcagaagaaaggagcacggcaagaagtgacaggaatcatagtgagtgataagctgaacgtcacacaaaaatatgtcagagacgtgcggaatattctttatatctggaatcggtatgggtatccgagcgccctggccaaatttattccaaagtacaaggaggagaaggggcacgtcaaaaaagggaatcccaacctggaaaatgttattgacggtaaactcatgtacctgaaaatggtcaagggtgaagaggattccgtgtaccaaaggctccacaacaaattcgtcacactggtggagaagatgaaggaaaagtcaatcaccactgagcagaaagtaacgtacatcgagacatgggctctgttggaatttgagaaaaaatactccactgaggtggtgatcaccacatcagaaaatagccacaggtacgcgcacttcatctttgggtccaagaaagcaaaggcctcggtcaataagaacataatccccgatgaggagaaagacaaaaagcagttagccatctccctgtgtatcgacggcaaaggggacaccttctggtttgtccaccgcattgataaggttatcgttcccaagaagaccgaagtggatattgatgaactcaacaacgatttgaacctcctgcttaatatttga

SEQ ID NO: 7268 - RNA, 1605 nt, unidentified
  source 1..1605: mol_type = other RNA; note = synthetic construct
atgttattccttttatgctacgacgtgtttatgctctacatcatttgctacatctacatcaagaagattgtgtctgggtgggatctcagtcggccactaatcaatatatttgaaaggagaaggcagatggacaaagaacagattcggcagaccgccctgcagatgaagacgcgcgaggacctgctgaccctgctgaacagaataaagagggatgagatggagaaactggatttcgctgataaatttcacccttttaccgcgaaacacatgaattactactgtaatcccaaaaatgccttccaccgctatcgtcagttcaagatcaaaaaaaagagtggtggctttcggcaaattatggccccgagaaatcgatccttcatgttcatgcttgactgtctcaatgaggtgctgaaagccgtttatactccaagccagtatgctatgggctttacagaaggcaggtctgtggtgctgaacgcttcgaaacacaagggtgctaactatgtcttcaacatcgatctcaaagactttttcccctctatcgagcagcctcgggtgtggaaaaggctgcaactccagccatttaactttcccgtaccggttgcctcagcaatcgcaggcttgtgttgtatgaaagagacaagagaaatgagtgatggaaccaagaaggacttctatgtgctgccacagggagcacctacgagccctattatcaccaacatgatctgcgataagttagatcaccggttgggtgggcttgcccgacgctttggtttgaactacactagatatgcggacgatatcacattctcttcaatgcataacgtctaccaggagaattccgagtttcggaaggaacttgccaggatcattgggaaccaaggattcaccatgaatgagcaaaagacacgactgctaaaacgcgggagccgccaggaggttactggcataactattagtgacagattgaatgtcagccagaaatatgtccgtgatatcagaaacattctgtacatttgggaaaagtatggctatgcagtggcatattccaagtttctgcccaaatataaggaagaaaagggacatgttaagaagggcaatcctgacctgatgaatgtgattgacgggaagctcatgtacctaaagatggtgaaggggaaagaggatagcgtatacaaacgaatgtatgccaaattccagatcctcgtcgaaaagtcctacgacatcaaaaagaccaacgaaaagaatatcacatacatagagacgactcccctgctcgaattcgagaaaaagattggctccccagtagagattgtgatcagcaaccaggagtcccaatcagaggctgagaaaaagaaaaacgacaaaggcaggtacgcatattacaaactcgcgaacggatctaagatcaaagctagcataagtaagtacctttcagacgccgaaattaagaccaaggataagctggccatatcgacatgccgtgatgctaagtctaaggagttcatgttcattcatcgcgccggaattgtcactgtgccaccccctaagcccatagacatcgacgagcttaacaatgaactggactccttgttgtcaagctga

SEQ ID NO: 7269 - RNA, 1479 nt, unidentified
  source 1..1479: mol_type = other RNA; note = synthetic construct
atggataaggagcagattaagcacattgctctgcagatggagtcccgtgaggacctgttgagtctgctgaacagaataaagcgcgacgagatggaagaattgggttacgctgacaaattccacccctttaccattcgtcacatgaattattattgcaaccccaaaaatgccttccatcgatacagacagttcaagattaagaagaaagccggtggcttcagacagatcaccgcacctcgaaatcgctccttcatgttcctgctcgattgcttaaatgaggtgctcaaggccgtgtataccccatcccagtacgctatggggttcactgagggccggtcggtggttacaaacgcgtgcaagcacaaaggggccaactacgtattcaatatcgaccttaaggactttttcccaagcatcgaacaacctcgcgtgtggaaacggctccagctgcagccatttaattttcctgtttcagtggctaacgctatcgccggcttgtgttgcatgagagaaacaaggatcacgagcgacggcatcaagaaagattactacatcctaccacagggggccccaaccagtccaataatcaccaacatgatttgtgataagcttgaccacaggcttggcggactagctcatcgcttcggtttaaactatacacggtatgccgacgatatcaccttttctagtatgcataatgtgttccaagagaactcagatttcagaaaagagcttctgaggataatcggagatcaggggtttgtaatgaatgagaagaagactcggttgcagaagcgtggttctagacaggaggttactggcatcatcatatctgataaactgaacgtcagccagaaatacgtgcggaatatacggaatattctgtacatgtgggaaaaatacggctatactgtagcctatgcgaagttctttcctaggtacatggaggagaaaggacacgtgaagaaaggaaaccccgacctggtcaacgttatcgacggcaaactcatgtatttaaagatggtcaagggcaaagatgactcggtgtatcagcgcctgtacgcgaagtttcaatctctcgtggcacaaatgagggatccgaaaaaaacaaacgataagcatattgcctacgtcgaaaccatgccgctcctggactttgagaaaaagataggaagttcagttgaaatcgtcatcccccccaaagaagaaaagaacagcgaaggagagatgagccaatctgggaaagggaggtttgcatattatctcctggtgggcacaaagcagctaatcagcatttctaagtacctttccgaaactgagattaaggcaaaggacaagttggcaatttcacagtgtcgcgatggaaaagggaaagagtttatgctcattcatcgaattaacatcgtcacggtccctccccccaagcctgtggacattgatgagctgaataatgaactggactccctgctgagctcctga

SEQ ID NO: 7270 - RNA, 1554 nt, unidentified
  source 1..1554: mol_type = other RNA; note = synthetic construct
atggacaaggaacagattgccaaacttgcccatcagatggaaacgaaggacgacttggtaaccttactgaatcggataaaaaaggaggaaatggcagagatgggctttgctgacaagtattatcccttctcccagaaattgatgaactattactgcaatcctaagaatagtttccacagatataagcagttcaagatcaagaagaaaagcgggggcttcagacaaattaccgctccgcgcaataggtcctttatgctgatgttgtcgtacgttaacgtgattctgaaagcactatacacaccatctaagtatacaatgggatttactgaagggcgctctgtcgtggacaacgctcaaaaacatctgggcatgaattacgtgctcaacctagatttaaaggacttctttcccagcatcgtgcagcccagagtctggaagcgactccagctgaaaccttttaatttccctgttccagtggcctctgccatcgccggactgtgttgcatgaaagaaattcgagaagataccgatggaaagaagactgagcactttgtactgccacaaggagcccccactagcccgattattaccaacatgatatgtgacaaactggaccacaggctggcggggcttgctaagagattcgggctaaactatacgagatatgcagatgatatcactttctccagcatgcacaatgtttatcaaaagcacggtgagtttttcgcagaactctaccggataatcgaaggtcagggctttaccgtgaatgaaaaaaagacacgtctccagaaaaacggctccaggcaggaggtcaccgggatcactgtcagtgaaaagctgaatgtgacccagaagtacgtgaacgacctgaggaatattatctacatttgggaccggtacggttattctgtcgcctattccaagtttttccccaaatacaaacaggagaaaggccatgtgaaaaaaggaaatccagatctggtaaatgtgatcgacggaaaattgatgtatctcaagatggtgaaaggcgatgaggactcagtgtacaaacgcctccacgggaaattcatcaagttgctttcaaacctgaacgatcccgcgaagaaaactgagcagaacatcacatatgtggacaccctgcctctactcgaatttgagaagcggaataacaccgaggtgctggtctgtttctcagaggagaaatacgagctgacctttgataatggcatcgtggtgcagatgagcgaggaacactacgagattctgaaagataaaacacctaaggaggagataaagagtacgaggttcgtgccttcccggcgctacgcctactttaagctgcataacaagaaggtctacgtttctatcaacaagagtgttaaaccagaggaagaacacaataaggagctgctggctatatctgtctgccgtgacagcaaaaacaaggagttctggttgctccataagttagataaggtaacagtcagcacacaagttgaacttgatcttgacgagctcaataacgaccttgattcattactcaactcgtga

SEQ ID NO: 7271 - RNA, 1053 nt, unidentified
  source 1..1053: mol_type = other RNA; note = synthetic construct
atggagcgcgagcagatagctaaaatggcagctgccatggcagataaggaagatctcttagacctgctgaacaaaatcaaacaggacgagatgatcgctacaggtttcggcgataagttctatccattttctatcaagcacatcaactactattgtaaccccaacaattcattccacaggtaccgccagttcaaaattaagaagaaaagcgggggagagagaattataacagccccacggaatcggtcgttcaaactgattttgtcctacatcaatgagattctgaagtccatgtataccccatctacatatgcgatggggtttgctgagggtcggagcatagccgacaacgcgaaaaagcatagaggcatgaattatgtgtttaacctggaccttaaggatttctttccgagcatcgaacaagctcgcgtgtggaagaggttgcagctcgccccctttaactttcctctgcctgtggctaacattattgccggtatgtgctgtatgaaagaagtcgtgcaagcagagggtgggtcacagacggcccgttatgtgctgcctcagggagccccaacttcccctatcatcacaaacatgatctgcgataacctcgatcgtagacttgccggagtggccaagcgatttggcctcaattacacccggtacgcagatgacatcactttctctagtatgcataatgtctaccaggaaaatggggagttcagaaaggaagttaggaggattattgaagagcagaagttcactataaacgataagaaaacccgcctgcaaaagaaaggcagtcgacaggaggtgaccgggatcattgtgtccgacaagatcaacgtaaccagggactacgtaagagatatccggaatattttgtacatgtgggagaagtatggatatggcgttgcctttgcaaaattctttcccaaatacaaagcggacaagggccacgttaagaaaggcaatcccgaccttataaatgtcctggacggaaagttacaatacctaaaaatggtcaagggggaagaagacagcgtctggtga

SEQ ID NO: 7272 - RNA, 1461 nt, unidentified
  source 1..1461: mol_type = other RNA; note = synthetic construct
atgaaacgtgagcaaatcgcacaactcgctcggaatatggagaatagatctgatctgctcgccctgctgaaccgaatcaagcacgacgatgtagtcgaagagggcgtgcagttctttccctttactatgaaacagattagattctactgcaatccaaaccacgcctttcataggtatcggcagtttaagattaagaagaagtcgggaggctttcggttgattaccacaccccgaaatcgcacctacaaaatgcttctgcagtacgtgaatatcatcctgaaagctttgtactccccttctgactacgcaatgggcttcacagaagggagatcagtggtgacaaacgcggagaaacacctgggacagaactacgtgctgaacttagatcttaaggacttcttcccctccatagatcaagcgcgagtatggaagaggcttcaactggcaccgttcaactttccagtggagatcgccagtattattgccggcctctgttgcatgaagtttaaagatgacgaagtcgaaaagacacgctatgtgttgccacagggcgcacccacgagcccaattatcaccaacatgatttgcgataagctggacaggagactggttggtttggccaaacggttcgggctccattacacccggtacgctgatgatattacattcagcagcatgcacaacgtgtaccagcctaatggcgacttttggactgaactcaggaggatcatcgccgaccagaacttcaccatcaatgaggacaagacgagattacagaaaagggggagtcggcaggaagtcaccggggttatggtcacagagaaactgaatgtttcccagaagtatgtacgcgacatacgcaacattctgtatatatgggagagacatggatttaacgtcgcctatagcagattcttccctaaatataaaagcgaaaagggccacgtgaagaagggaatgccagatctagtgaatgtgctcgacggaaagctgatgtacttgaagatggtaaagggagaaaatgatcctgtgtatcttcgcctgtatcgtaagtttaaggcactagccgaccaggctcgtgatatactcactgctaacaacggggggatcaattatatcgaaaccacacctatccttgaatttgagcagaagaataacacggaggtggttattctgtggactgaggacaaaaccgacggtgataaaatgatccccgcccggcgctacgcctacttcatgctggacggcaaaaggatcaaggcttcagtcaacaaggtgataactaaagaagaggagtcccagaaagagttactcgcgatctcatcttgtcgagatggtaacgataaacctttctggcttgtccataagaaagacaaagttactgttttcccgccagaacccgtgaatattgagcagctgaacaatgagctcgacgctctattgaataagcaagacggttga

SEQ ID NO: 7273 - RNA, 1491 nt, unidentified
  source 1..1491: mol_type = other RNA; note = synthetic construct
atggataaaaccgagattgcagctttggcccaccgtatggagagtaaggatgacattctggccttactcaatcatctcaagcaagacgagatggaagaaatgggtcagattgacaaattctatcccttcacaatgaagcacatcactttttactgtaaccccaaccacacgtttcacaggtataagcagttcaagatcaaaaagaagtccgacggctatagacagatcaccgcacccaggaaccaatcgtttatgcttctcttgagatacgtgaatgagatatttaaagctgtgtacagcccctcagactacgcgatgggctttaccgagcagcggagcgttgttaccaacgctaacgtgcataagggccagaattatatcttcaatatcgacctcaaggactttttcccttctatcgagcaacctcgtgtctggaagaggttgcagctggagcccttcaatttccccataccagtggctaacgttctagcaggaatctgcagcatgaaggaaacccgcactctagagaatggcacgaagaaggacttttatgtactgcctcagggcgcccccacaagcccaatcatcacaaatatgatatgcgacactctggatagacgactggccggactcgccaagagattcggtctgcggtacaccagatatgccgatgacatcaccttttcttctatgcacaacgtctaccaaaaggatggtgatttccggaaggaactggtgaggattattcaatcccagggctttaccatcaatgagaaaaagacacgcctgcagaagataggaggcaggcaggaggtcactgggattatcgtgtcagataaacttaacgtaacacagaaatacgtccgggacattcgaaatattttgtacatatgggaccgatatggatacggggtaacatactcaaaattcttcccgaagtataaggaggaaaaagggcatgtaaagaagggaaacccagacttagtgaacgtcctagatgggaaactgatgtacatgaagatggtgaaaggtgaaaatgattcagtgtacaaacgcttgcacgataaattcgaaaaactggtgagagaaactcgcgatcctttaaaaacgaccgctcacagcattacttacgtggagacaacaccactgctggattttgaaaagcaaaataccaccgaggttatcattactgaatccgagactagcgtcgaacagacaatgaccgattccggggagcaggcacgcccacatcggtatgcctatttcatgcttgatggcaagaagatttttgcgagtgtcaacaacggcattaaacctgagatggaaaaacggaaagaacagctctctattagtatctgtagggacaagaacgacaaacagttttggcttatccacctgtccaaaaaggtgacggtgcctccattcgagccgatagacgttgacgagcttaataaagagctggacgccctcctggatatcggacatgggtga

SEQ ID NO: 7274 - RNA, 1191 nt, unidentified
  source 1..1191: mol_type = other RNA; note = synthetic construct
tatgctatgggcttcgcagagggtcgatccgtcgttacaaacgccaacgtgcacaaaggacagaactacgtgttcaacatcgacctcaaagacttcttcttttccatagagcaaccaagagtgtggaaaaggctgcagctgaagccctttaatttccctcttcccgtggctaatgtcattgcagggttatgtagcatgaaggaagtgagagagctggaggatggtacgaaacaggaaatatttgttttgccacagggcgcgcccacctccccaatactgaccaatatgatctgtgataagctggaccaccgtctggccggactggccaagagatttggtcttcattacactagatacgccgatgacatcaccttttcttctatgcataatgtgtatcagcctaaaagcgaattcatgaaggagttacaacgcattattctggatcaggggtttcacattaacaacaaaaagacacggctgcagaagttgggaagccggcaagaagttacaggcatcattgtctcaaataaactcaacgtgacgcagaagttcatcagggatatccgcaacatcctctatatgtgggatcgctacggatatagcgtggcctatagcaattttttccccaagtacaagaatgagaagggccatgtaaaaaaggggaatccggacctcattaacgttatttgggggaaactgatgtacttgaaaatgatcaagggcgaagaggactcggtgtataaaaggctccacgacaaattcatttcactagtcgaaaaaaccttcgacgagaacaaaactaccgatcaacatatcacttatgtagagactacccctatatctgagtttgagaagaggaataatacacagatcttcatcgagatttctcagccatacgtggagctcgaaaaagatgagaataatcccgataagactaaggaagtggaaaagacaagtcaccgatacgcgtactttatgcttaacggcaaaaagatttacgcttccgtgaataagtgcatcaaaaccgaagaggagtcaaagaaggattatctggcaatctccacctgccgggacgccaaggggaaaccgttttggctggttcacaagatagacaaggtcacagtacctagtcagcttgctgtcgacatcgatgaactgaacaacgaattagacagtctattgaacatgtga

SEQ ID NO: 7275 - RNA, 1524 nt, unidentified
  source 1..1524: mol_type = other RNA; note = synthetic construct
atgaacaaagggaaaataataaagtatgccactgtgatgcagaccaaggtggacctccttaagttgctgaattccatcaagaaaatggaacttgaggattgtggcctgagcaaggaattccatccaatcactatgaagcagctgaattattactgcaacccaaaacacacctttcacaggtacaagcagtttgtcatacccaagaagacaggtggaaagaggattataacagccccgcagaaaggttcattcagattaatgttgagcgctctgaaccagcttttcaaatttttgtacacaccctcagattacgcaatgggctttaccgaaggcagaagtattgtgacaaatgccgatgttcacaaggggcaaaattacgttttcaacatcgacctgaaagacttctttccttcgatacgccagccgcgtgtctggaagaggatccagctccccccattcaatttcactaaagaggtggccaatgttatcgctggtctttgcagcatgcaaattaaaaaggaggatggaacgttggactatgtattacctcagggggctcctaccagtcccattatcacaaatatgatttgcgacaagctagaccgcagactggctggacttgctaagcgctttgggctgcattataccagatacgcggatgacatcactttttcttccctgcattacgtctatagcctcaatggggaattccgcaaggagctggagcgaatcatcgccgaccaaggattcaccattaacgataaaaaaacacgtctccagacgcgggccatgcggcaagaagtgactgggatcacggtcagtgataagttaaacgtaacacagaaatacgtacgagagattcggaatctcttatacatctgggaaaagtatggctatgttgatgcagtgagcaagtttctaccaaagtataaggtggaaaagcagcgaaaaggcaatcctgatctgattaacgtgctgtctggaaagctgctctatctgaaaatggtcaagggcgaggaagacagcgtctatatcagactctcacagaaattcaacaaactggtggcagacttcatggacgtgacccggagatcagccactggcctcatgtacattaagacatacactatcgacgagtttgagaagcggtttaacaccaaaatcaagatcgagactttcgagacaaacacaaaagagaaggagattaacgtgaaaaccgagaacgaaggccaggcaaaaaaaaagacccacaggtacgcatctttcattttgtccaacgaggagggcgaagatatcaagcagaacataagtattcggaggaatgttaagtggaacgacgaccccaagaccaaacgcaaactggccgtatctcaatgtcagaagggtaatgccaaacctttttggcttctacactacagggctgaaaaacaagcggtggaacagaaggatgtctccatcgaggacctgaacaatgtgctggacaatctcttgtccactctggatgatggaacgaccatttcttga

SEQ ID NO: 7276 - RNA, 1449 nt, unidentified
  source 1..1449: mol_type = other RNA; note = synthetic construct
atggataagactagaatcgcacggctggcccatctgatgaaaggcaaagatgatctgctctccctactgaatgacatcaagcgagatatgatggctcaggccggtgccggcggatcattttatccgttcaccatgaagcacataaactactattgtaatccagggaacacatggcatcggtacaaaagttttcagatctccaagaaaagcggaggtacgagacaaataacagcaccccggaatgaatcttttaagctcattctccgctgcctcaatgagcttctcaaagccgtgtactctcccagtgcgtatgcaatgggcttcaccgagggtaggagcgtagtgacaaacgctgaagtccacaagggcatgaattatgttttcaacatcgatctcaaggacttcttcccctctattgaacaggccagggtttggaaaagattacagatcgcgccatttaacttcccagtccctgtcgcaagcgttatcgcggggctgtgttctatgcaggacgcccggactatggacgatggcaccacagccgtgaggtatgtgttgcctcaaggagcccctactagccccataatcactaatatggtttgcgacaaactggacaggcgtctggcaggtctagccaaacgctttggggtgcgatacacacgatacgccgatgacataaccttctcctcaatgcacaacgtttaccaggtgggcggggaatttcgtcaagagctgcagagaattatcgctggccagggctttaccatgaatgaggctaaaactcgtcttcagaagcggggagccaggcaagaggtcacaggtattgtggtcaatgataagctgaacgtgacccaggcttacgtacgcagcattcgcaacatcttgtatatctgggacagacatggttacggcgtggcttatgccaagtttttgccagtgtataaggccgataaggggcatgttagaagagggaaccccgacctagtgaatgtgattgatggaaagcttatgtacctgaaaatggtcaagggagatgctgatagcacatacctgcgactccgcgccaaattcgataagttgtccggcgacgtgcatgaccccagtaagaccacggaccacgccattacatacgtggaaacgaccccactgcctgagttcgagaggcggaatgccactaccgtggtcatcgctactcccgaaccgtgtgacggcggagctgcagctcacaggtacgcatattttgagattggggggaagaaggtatatgcgtccgtcaacaaagctgtcaagcctgaagatgagggacggaaggatttactgtctatttcgtcctgccgcgacaaagatgacaaaccattctggttagtgcacctgtcatcaaaaactgtgacccctgcactcgtagacgttgacgcactgaacaccgagcttgacagtttgcttgactga

SEQ ID NO: 7277 - RNA, 1341 nt, unidentified
  source 1..1341: mol_type = other RNA; note = synthetic construct
atgaataaagaactattccttgaggagaaatacatcaagacgaagaagaagtacagaaagatagtaacatacgtggacggcgagaacttgcttagagagaagcacgaacggatcgtctcactgctcaagcaggaatgcagtgactcaatttttgcgaaagcttatattgagcacagcagcattgttaagaacgcaaaagcccacatgtataatgatatattcctcttcttcgacgtgaaggacttttttccatctatacaccaggcgcgggtctggaaaaggctgcagctaaagccactgttcttcaaacaacctatagccaatattctggctggactgtgttctatgaaagagaaagctgaagacgggagcatcaggtacgtactgccacaaggcgcccccactagtccagtcatcaccaacatgatttgcgacaatctggatcgccgtctggccggtttggccaagcgatttggtgttgtgtactcacgatacgccgatgatatcactttctcctccatgcataacgtgtataacacaagcggggaatttaggaaagaactgaaacgcatagtggaggggcagggcttcaccatgaatgaggcaaagacacgtctccagaaacttggcagtcggcaggaggtgactggcatcatcgtgtctgataaattaaacgtctcccagaagtatgtcagagacatccgaaatattctttatatctggcgcaaatatggatacgacactgccttcaacaagttttttcctaagtataaggaggccaaaggccatgttaagaaaggaaaccccgacatggtgaatgtgctcgatggtaagttgatgtacctgaaaatggttaaaggggaggacgattcagtatgtaaaaggttgagatcccaatttgatgaactctgtaactcgctgcacgacgatacgaaaactactcaacaaggaatcacctacgtggaaacactacctgtgctggaattcgagcgcaagcacaacacaaccattgccatcatgaccacgaaaccgaaggaatttttcattgtacagaagaatcaggaagctaccgaggatacccagaaatccatttctgaaaacttcatcccccatcggtacgcaagctttaagcttggagggagaatgcagaaagctagcgtcaataagagtctcaagaaggaggaggagacacagaaagatctcttatccatctctaactgccgggacgcaaagggcaagttgttttggctggtgcataggagcgacaaggttaccgtgccgcctgcaaagcccgtcgatattgacgagctgaatgatgacctggacaagctcttaaattga

SEQ ID NO: 7278 - RNA, 1500 nt, unidentified
  source 1..1500: mol_type = other RNA; note = synthetic construct
atggataagaatagcattagcaaggccacacaacagctggaaaccaaagaggatctgctccgactgcttaaccaaatcaagcaggatgagatgacagagtacggtatgtccgataagttctacccctttaccatgaagcacttgaactattactgcaatccgaataactccttccaccgttataagcagttcaagatcaagaaaaagtccggggggtttaggctgatcactgcccctcggaaccagtcatttatgctgttgctgcgctacgtcaatgaggtgtttaaagctgtgtacaccccatccgattacgcaatgggcttcactgaaggcagaagcgttgttaccaacgctaataaacataagggtcacaactacgtgttcaataccgatctgaaagatttctttccttccatacatcaggcacgcgtgtggaaacgacttcagctgaaaccactgctcttcaagcaatcaatcgcaaacatacttgccggactctgctccatgaaggagaagacagaagacggaaatataaagtttgtcttacctcagggcgcgcccacttctcctattattaccaatatgatctgtgacaacctcgatcgcagactggccggactagccaaaaggttttccgtggtgtattcgagatacgcagatgacatcactttctcatcaatgcacaacgtctaccagacttcgggggagtttagaaaagagttgaagcgaattatcgagagtcagggctttacgatgaacgaagccaagacccgcctccagaagtttggcagccggcaggaagtcacagggattattgtctccgataagctaaatgtgagtcagaagtatgttcgggacatcaggaacatcctgtacatatggcataagtacggctatgacacagcgttcaacaaatttttcccgaagtacaaagaggccaagggacacgtaaaaaaaggtaatcccgacatggtcaatgttctggacggcaagcttatgtatttgaaaatggtcaagggagaagacgatagtgtttataaacggctgcgctctcaattcgatgcactctgcaattctctacacgacgacactaaaacgactttgcagggcattacatatgtggagacgctccccgtgctcgagttcgaaaaaaagaataacaccactatcacaatcgtaacgaccaagcctaaagagttctatacagaacataccagccaagaagccaccgaggacacacaaaagtctatatctgagaatttcatcccccacaggtatgtatcattcaaactgggagggcggatgcagaaggctagcgtgaataaaagtttaaagaaagaggacgaggaccgtaaggaacttttaagtattagcaactgtagggacgctaaagggaaactcttttggctggtgcatagatctgacaaagtgaccgtgagcccagctcagccagtagatattgacgaactgaacgacgatcttgataagttgctgaactga

SEQ ID NO: 7279 - RNA, 1452 nt, unidentified
  source 1..1452: mol_type = other RNA; note = synthetic construct
atggataagaatgatatcgctaaagcagcccagttgctcgagacgaaggaggacctccttcacctgctgaacaaaatcaagcaggatgaaatggccgaatgtggcatgtctgacaagttctacccctttaccatgaaacatctcaattactattgcaatcccaataactcctttcacaggtacaagcagttcaaaataaagaagaagagcggcgggtttagactgatcaccgctccacggaaccagtcattcatgctactgctcaggtatgtgaatgagatctttaaagccgtgtacaccccttcagattatgcaatgggattcacggaaaatcggagtgttgtaacaaatgctaatcttcacaagggccgtaactacatcttcaacattgacctgaaagatttctttccctctattcatcaagcgcgcgtgtggaaaaggctgcaactgaagccactgtcgttcaagcagcctattgcaaatgtcgtggccgggctctgctctatgaaggaaaagatggaagacggtagtattcgctatgtgttaccgcagggggctcccaccagccctatcatcactaatatgatttgcgataacctggatcggcgactggctggactagccaagcgatttggagtcgtatactcccggtatgccgacgacattaccttttcaagcatgcataacgtctatcaccccatgggggagttccggaaagagttgaagagaattgtggaatctcaaggcttcgtgatcaacaaggataagacccgactgcagaaactcggctccagacaggaggtaactgggattatcgtgagtgacaaactgaacgtttcccagaaatacgtgagggacattaggaacatactttacatatggagaaagtacggctatgccaccgcatttaacaaatttttcccacgctacaaagacgcaaaaggacacgttaaaaaaggcaatcctgacatggtgaatgtgttagacggtaagttaatgtatctgaaaatggtgaaaggtgaggacgattcagtgtatatgcgcttgaagacacagttcgatgagcttcggcataagctgcataacacaagccaagcgactccacgcggaataacatacgtcgagacaacccccgttttggaatttgaaaagaagaatggtgccacgatcgagatcactcgctccaaaccgagtgagaaggccatcgaaccatttgtcagccacagatacgccactttccctcttggcggaaagagacagtgggcgtctgtcaacaaaacacttaagccagaggaagaaactcagaaggatctcttggcaatcagccactgtcgtgacgctaacgggaagctcttctggctgattcaccgtgctgataaaatgatggttaggcctcccgagtccgtcaacatagacgagctgaataaagagctcgacgatctactggcctga

SEQ ID NO: 7280 - RNA, 1431 nt, unidentified
  source 1..1431: mol_type = other RNA; note = synthetic construct
atggaaacaaaggaggatctacttgatctcttaaacaagatgaagaaagatgagatggccgaatccggcatgtctcacaaattttttcccttcactatgacctaccttaactattactgcaaccccaacaatacgtttcactgctacaagcagtttaaaatacgaaaaaagtccggtgggtttaggcagatcaccgcaccacgcaatcggggcttcatcctgctgctgcactatgttaatgagatattcaaagcggtgtactcaccttccgaccatgctatgggatttacggagggcagatccgttgtaacaaatgccgggatgcataagggacagaattacgtgtttaacattgacttgaaagacttcttcccctcaattcagcaggcgcgggtatggaaaaggatacaactgaaacccctttgtttcaagcaatctattgcaaacatgatcgctgggctgtgttctatgaaggaaatcctcgaggacgggagcaatcgctatgtattgccacaaggagcccccacatccccgattttgactaatatggtatgtgacaaactcgatagacgactggctggcctagccaaaaggttcggcttgaacttttcgaggtatgcagatgacattaccttctcgagcatgcacaatgtgtatcaggggaatggtgagttccgcaaggagctgaaaagaatcattgaagatcagggattcaccataaacgaggcaaagacacgtctgcagaaactaggcagtagacaggaagtcacagggatcatcgtgagtcataagttaaacgtgactcagaagtacgtcagagatatccgcaacattctctacatctggaaaaagtatggatatagcactgccttcaacctcttcttcagtaaatacaagcaggacaaaggccacgtgaagaagggcaaacctgatatggttaatgtgctcagcggcaaattaatgtacctgaagatggtgaagggtgctgaggattcagtgtacgttcggcttaggactcgcttcgatgagctgaccattgcccttaaggatgcgcacaacacaacaacccaaggtgtcacctatgtggaaaccatacctctgctggagtttgagaagaataaccacaccgatgtcgtgatcacgacatttaaagctcgggaggaggtgaacgccgaggacgaaaataaggtgatcgcacaccgttatgcctactttaccctggggggacataaagaactcgcttccgtgaacaagtctctgcggagcgaagaagaaaaagacaagagccctctgtcaatctcctcttgccgagacgccaagggaaagccattttggttgattcataggagcggcaaggtcgtcgttccgactctgtctccagtcaatattgacgaccttaacaatgacctcgacactctgctcagtatctga

SEQ ID NO: 7281 - RNA, 1449 nt, unidentified
  source 1..1449: mol_type = other RNA; note = synthetic construct
atggacaagacccatatcattaaacactcgttgcagctgcaacagaaggaagacctcctcaatcttttgaatcagctcaaattcgatgaaatgaatgcgatagggatcggcgacaaatatcatcctttcatccttaagcatatcgattattactgcaacccaaataacacgtttcaccgctacaggcaattcaaaatcaagaagaaaaccggaggcttcagggaaatcactgctccccggaaccgcagttacgttctactgctgcggtacgtcaacgagatcttaaaggccctgtacatgccttccaaatacgccatgggttttacagatgggagatctatcgctacaaacgcaggtaagcacattaacagtaactacatcttcaacattgacctcaaagatttctttccgtcaatcaatagggcaaggatcatcaaaaggctccagattcgcccttttaatttcagcccaaagattgccctcctgattgccggtttgtgttgtatgcgtaaagaactactctctgacgacgggaagatcttttacagttatatattgccccaaggagccccaacatcccctattattacaaatatgatctgcgacaagctcgaccatcagctggctgggttagcaaagcgattcggtttaacctacacccgatatgcagacgatattacctttagcagcaatcacaacgtgtatcacgataatagcatctttagaaaagagctggagcgaattataaagtcccagggctttaacatcaacgaaaagaaaacccgtttgcagaaactaggacatagacaggaggtgaccgggattattgtgtccgataaactgaatgtgtcacagcactatgtgcgggatattcgcaatatactgtacatatgggatagatacggctacaacatcgcttatgcaagattctttagcaagtataaagcggagaaaggccacataaaaaagggcaatccaaacctgattaatgtacttgacggaaagcttatgtatctgaagatgataaagggagagaaggactctgtctatcagcggctttattccaagttcaaaatgctgagcaattacatcgacaacaataacccgatctcaccccagtccgtcaagtatatagagacaatgacaattagcgatttcgaaacgaaaaacaacactgagattgtgttcaagatcgacgataataactcaactcccaagcggtccgcctactttactctgaatcgcactaagatctctatctccatcaagaagaacataagcaactcaaaactgaacaaagagcacctggccatctctacttgcatcgacgctaataacaggcaattttggctcattcatccaattaacgttgaaagaaccccttctcccattgatattgatgccctgaataatgacttggagagtctgcttaatctgcagtacggctga

SEQ ID NO: 7282 - RNA, 1446 nt, unidentified
  source 1..1446: mol_type = other RNA; note = synthetic construct
atggatcgtaagcagatcgcacagcaggcctcccaactcaaagacaaaggtgacctcttgaacctgcttaatttaataaagaaggcggaaatagaggatatgggcttcgattcttctatgtatcaccctttcactgagaagcagttgaacttctattgcaaccccaaccacacatttcatagatatcggcagtttaagatcaagaaaaagtcagggggaacccgccaaattacagctccccggactcagagtttcatgatgatgttgagtgcagtcaatgagctctttcgaagcatctataccccttcggaatatgcgatgggctttaccgacgggcgcagcgttgtgacaaatgcgagcgcacatctgggcatggattacatcctgaatattgacctaaaggatttctttccgtcaattcatcaagccagagtgtggaagagattacaagttccaccatttaacttcaaccagccagtggccaacttactggccggcttgtgttgtatgaaggaatcttgcgaggacgaaaatggaaacaaaaaggacgtgtttgtacttcctcagggggctcccacctctcccattatcacgaatatgatctgcgacaagctggattactacctctcccgactcgccaaaaggtttaacatgaattataccaggtacgctgacgacattacttttagcagtatgaggtacgtatattcaaagaaaggtaaattcgtgctggagctcgagaggattattaaggagcaaggattcacaatcaacgaggcaaagacaagactgcagaaaaggggtgatcgtcaggaagtgaccggcataatcgtcagtgataagctgaacgtcacgcagaagtacgttcgcgacgtaagaaatatactctacatgtgggaccgctacggatacaatgtcgcttatggaaaatttttccccaagtataaggaagagaaaggccacgtcaagaaagggaatcctgacctgattaacgtcatagacgggaagttgatgtacctgaagatggtgaaaggtgaaaacgattccgtgtacgagaagctgcatgccaaattccagaagcttgctaacaaggatgtgatttccgagaaaaccaatagcaaaggcgtaacctacctagaaactatcggcgtcaaagagttcgagaagaagaatttcaccacagttacatttgccatctccgagaaaggaaaacactatgcttacttcatgctgaacgataagaaaatgctggtgacggtgaataagactctgactatcgaagaagagcaggataaagacgttctcgcaatctctagctgccgggggaaagacgagaagcctttttggcttatccaccggaaagataaagtgatggtgccaccgccacccgccattgatgtggacgaactgaacgccgaactagactcacttctgaatacctgttga

SEQ ID NO: 7283 - RNA, 1464 nt, unidentified
  source 1..1464: mol_type = other RNA; note = synthetic construct
atggaccggaactacatcgcccagcaggcggctaagatggaaactaagcatgatctgttgagcctgcttaatagaatcaaaatctcttggtttgaggatatgggaatgacggtcaaattccatcctttcaccatgaaacagttgaactattacagcaaccccaaccataccttccacaggtactcccagtttaagatcaagaagaaaacagggggctttcgccagattacagccccccgctcgaaaacattcaagttaatgttgatgtgtctgaacgaaatgttcaagagcatttatagtccaagcgattttgctatgggctttacagaaggacggtccgtggtgtcaaatgcatcaatacacaaggggcagaattacatcttcaatatcgacctgaaagactttttccctagcatttatagagtcagagtgcgagcacgtctccaagcaaaaccattttgtttcaatgagaacatagctatgctcctcgctggtctttgcagtatgaagatctcttcaggccataacgatgggagggattacgtcctcccacaagggagccctactagtcccataatcactaacatgatttgcgataacctcgatcgcaggcttgccgggctggcaaagcggttcggtttacggtacagtcgatacgctgacgacatcacctttagcagcatgcataacgtgtatcagaccaatggtgagtttagaactgagctccggcgaataatcgaaggccaaggcttcactatcaatgaagcaaaaacccgcctgcagaaacagggctccaggcaagaagttaccgggctgattgtctctgacaaactgaacgtgacgcagcactatgttcgcgacatcaggaatattctgttcatttgggaacactacggttataatgcggccttcacaagatttttccccaggtataaggcggagaaaggccacgtaaaaaagggagtgcccgacctgattaatgtgcttgacggcaagctcatgtatttgaagatggtgaagggagcagaagactccgtttacatccgtctgttctctaaataccggaccttagccgataaggctcacagtatagataacaccacagaacacggagtaacttatgtggagactattcctctgcacgactttgaggtcaataactcaaccgaggtaattatcgattgggtcgtcccaacctccgatgacgagaatggccagccgaagccaaagaggagaacggcttcatttacactggacggaaagagagtttacgcctctgtaaataagaacgtgaagaaagaggacgaacagaaaaaagagctactggccatttccaattgccgcgatgccaagaacaagcaattctggttgattcattacgtgaataaagtgacagtgccgcctgccgaacccgttaacatcgaggagctatccaatgagctggacgcccttctaaactcttga

SEQ ID NO: 7284 - RNA, 1425 nt, unidentified
  source 1..1425: mol_type = other RNA; note = synthetic construct
atggaccgagagtttattataaattatcacggggactttctgaccctgcttaacaaggtgaaaaaggtgatgctggaggagaatgggatgggggacctatttcatccattcagtctcagacagatcacttactattccaaccccaaccacacgaagaatcggtatcagcagttcgagattaaaaaaaagaccggtgggatgaggcttattactgccccacgcaacaagacatttaagatgatcctgcagtgcctcaacgaaatattcaaagcaatctacaccccctcagactacgcaatggggttcacagaaggccgcagttcagttacaaacgcttcaatccataaaaaccagaattacgtgttgaatatcgaccttaaggatttctttcctagcattacgcagtcaagaatctgtaatcggcttcgtactaaacctttcgaattcccggataaaatagctctagtcatttccggcctgtgttgcatgaaaataacaaccaaggatgaaaatggcaatgatgtagtaaggtatgtgctgcctcaaggagccccaactagccctgtcatcaccaatatgatctgcgacaaactggatcggcgcttagccggggttgctaagaggtttggcctgaagtactctcgttatgccgacgacattacttttagctccatgcataacgtctaccaaaaggacggcgagttttggaatgagttgaatcgcgtgattaccgctcagggattctctatcaatgagaagaagacaagactgcagaccaaacgaatgagacaggaagtgactggcatcgtggtaaacaagaaactcaacgtgctgcagaaatacgtgcgcaacattcggaacatcttgtatatctggggcaagtacggattcattgctgcgcagtctaggtttctgcccaaatacaaagcagacaagggtcacgtcaagaagggcaatcctgatatgataaacgttctcgagggaaaattgctgtatctgaagatggtcaaaggagaggacgatagcgtttatcaaaggctccgggagaagttcgatagattgaagaatgacgcactgggaattttaaagaccaacaccttttccaacgtgacatatatcgaaactctcccactttcggattttgaaaacaagaacggtgaagttgtaatcacctacagcgaaaaaaagcacaaacgatacgcgtacttcaatctcgacggcaacaaaaagctcgtgtctgtgagcctagatattacggaggaggaagagaaagccaaggacaatttcgccatttccctgtgtcaagacgccaagggtaagaggttctggctgctgcacaaaaaaacaaaggtcacagtgccgacccccaagcccgtcgatcttgatgagctgaacaacgacctcgatagtttgttaaatatctga

SEQ ID NO: 7285 - RNA, 1452 nt, unidentified
  source 1..1452: mol_type = other RNA; note = synthetic construct
atggtgaagaacaccatcgccatgcaggcccggcagattacgtcaaaggaagacctgcttaatctgctaaaccggatgaagatggacgaaatggcagagagcggcatggccgactccttctgtccctttacgatgaaacacataaactattactgcaatcccaacaatgtcttccaccgctacaagcagttctgtatcaagaaaaagtctggaggcacccggcaaatcacggccccaaggaataaatcattccgactgatgctgcagtacgtgaacgagatattcaagtcgctgtacgaacctagtgactacgctatgggttttactgaagggaggagtgtggtgactaacgcgaatatacacaagggacaaaactacgtatttaatatcgacctcaaagacttcttcccttccattgaacaggcacgtgtttggaaacgtctccagctggagcccttgaatttacagaaacaggctgctaatctcctggctggaatgtgtttcatgaaagtgtcctccgaagatggggctgtcaagtttgttttgccgcagggagcccctactagtccaatcttaacaaacatgatttgcgataagcttgacagaaggctggggggcctcgcaaaacggtttggcctgcactatagtcgttacgccgatgatataacctttagcagcatgcacaatgtctacaaaatggatggagcgttccgcaaagagttggagcgcattattaacgaccagggctttaaaatgaacccggagaagactagactgcaaaagctcggggccagacaggaagtaacagggctcattgtctcagataaacttaacgttacccagaaatatgtgagggatattcgaaacatcctgtatatttggagcagatacgggtacgatactgctttcaacaagtttttccctaagtacaaggctgaaaagggtcatgtcaagaagggaaaccccgacatggccaatgtactggacggcaagctcatgtatttgaagatggtgaaaggcgaagatgacggcgtgtatctcagactgaaaaccaaattcgatattcttgccagaaggctgaacgacacatccaatgcgtctgcccgcggtgtgacatatgtcgagacaactgcactactggactttgagaagaaaaatggaacatctatcgaaatcactatgtctaagcgcccagagaatgccaccgagtcatttacaccccataggtatgcaatctttacccttgggggtaaaaaccatatggcttccgttaataagaccttgaaacctgaggaggagaagcgcaaagatatccttagcataagccactgccgggatgcaaagggcaaacaattctggctgatccatcgaaccgacaaggtgatggtgcggccagacgagctggtgaatatcgatgagctcaacaaggaattggacgatctattatcttga

SEQ ID NO: 7286 - RNA, 1227 nt, unidentified
  source 1..1227: mol_type = other RNA; note = synthetic construct
atggacagagaggagatagcgaacacaatccgtttgatcgaaacaaaaaacgattttctggagctgctgaaccgaattaaaagagagaacatcgatttcgcagacaaccaggatcagaagacctatccatttaccatgcggcaacttaacttctacataaaccccaaacataccacaggcagatacaaggagttctacatcaagaagaagtcaggaggcatgcgtcggataacggcaccacgcacaaaaacctttcaattaatgttaagcgccgtgaacgagatcctcaaagccgtctacgtgcctactcagttcgccacaggttttgtggaaggccgctctatcgttgacaacgctgtcccacaccagaatcagtattatgtgttcaacacagacctgaaggactttttcccgtctattgatcaggcccgcgtgtggaaacgcctccaagtgaagccttacatttttcccgaaaagatcgccaatctcatcgctggtctatgctctatgcaaatgatctccaaagaagatggagaagacactataaggtatgttctaccgcagggagcccctacgtcacccattttgaccaatatgatttgtgaaaggctggatcgacagctcgctggtcttgcaaagagatacgggctgcggtacacccggtacgcggatgacattaccttctcgagtcttcacaatatttatcaggagggaggcgagttcagaaaggaactggagcatatcatcaaagagcagaggtttactatcaacaatgagaaaactcgactgcagaaggccggcgagaggcaggaggttactgggctcgtcgtaaaccaacgggtcaatgtgccaaatcagtacgtgcgcaatattcgtaacttattgtacatttgggacaggtatgggtatgatgttgcttacaattgctttctgcctaagtatcagaaagaaaaaggacacgtaaagaaagagaagccaaatttgagcaatgtgatcgaaggtaagctgctgtatctcaaaatggtcaagggggagaacgatcccgtttacagaaggctgttcgacaagttcaattcccttaccactcccgaccatgcacaagagattgaaatgtccgaaggcgtaagcatagagcagcttgtggctctcatggaacctgacattagtgacatcgataagctgaacaatgatctggacgaactgttgatgcggagctatggcgggtga

SEQ ID NO: 7287 - RNA, 1200 nt, unidentified
  source 1..1200: mol_type = other RNA; note = synthetic construct
atggaaaagaaaattttggcaacaaaggtgcgaagtctggccacagtgggagattttttgaccttactcaaccagatgaaacgcgaagatcagggagttgaggaggacccccatcccttcactctcaagcatatcaactactacagaaatccctctcacgagggaagatataggtcatttaagatccctaagaaaagcggcggttgtagggtgatcagtgcccctaggaataagacctttaggttgatccttcgctacgtaaatgagatgctcaaagccctgtataccccaagcgaatacgctatgggtttcgcagaaggcagatctgttgtcactaacgctcagatccacctacggcagaactacgtgttcaataccgacctgaaagacttctttccctccgtggatcaagctcgcgtgtgggctagactacagattaagccgctctccctccagcgaccaattgcggggattattgccggactgtgctctgtcagactggagacagacgaaggaactgtgcgatatgtccttccgcaaggggcccctaccagcccaatcttgactaatatggtttgtgatactctggatcgccgtctgggtggcgttgcaaagcgctttggtctgcgctattcaagatacgccgatgacataaccttctccagtatgcacaacgtatacgaggtggggggcgatttcagatccgagttgcggaggattgtcgaagaccagcgatttgtcatcaacgagaagaaaacgcgcctccagaagcggggggctagacaagaagtgacagggctcacggtcggtgagcgtctgaacgtgccccaatcgtacgttcgggggattcggaacttgctgtatatctggaggaagtatggcgagggcgaggcgagggctcggtttgaagagagctatatggccgaaaaggggcatctacgtgagaaatgccctgacatgatactggtactggagggaaaactgtgctacctgcggatggtcaaaggccccaacgattcagtgtacaggcggctgtccaccgacttcgaccgacttctccacgcggatgagggcgctgtggagcctcttccatctggcggagaaaggctgttagccgaaggcttagcacttacagcaagcgccccagtggatctcgaagccttaaatttcgacctggaccagcttctgaataatgggtga

SEQ ID NO: 7288 - RNA, 1611 nt, unidentified
  source 1..1611: mol_type = other RNA; note = synthetic construct
atggacaagcagaccgtgattaataaagcacaggacctggaaacacggcatgatctgctgaacctcctgaacgagatcaaagcggatatgcttggaagtgccgcctaccccttcagcatgaaaaagttactgattctttgtaaccccaaaaacgacggggataagaagcaggagaggtacaggaccttcagtattccgaagaaaagcggaggtgagagaactatctccgctccctgtggaaaccttaaatggatgcaactctgcttgaacgagatattcaaagctttgtatacatccagtccatacgcaatgggattcgccgaggggcgctcaatcgttgataatgcacggatgcataccaaccagaattatgtgttcaatatcgatctcaaagacttttttccctcaattgaccagaccagggtatggaaacggttacagcttgccccgttcaatttcaatccaaagatcgcctccattatcgccggcttgtgcagcatgcgcactattagataccgtgagaacctaccttttgaggaagccttcgtgctcccccaaggtgctcccacatctcctctgctgacaaatgctatctgcgacactttggatcggagattacacggcttagcgaagcggtttggcctgcattacagtcgatacgccgacgatatcaccttttcaagcatgcacaatgtgtatcagcccggctcggacttcagaaaggagctggagaggataatttttgaccagcgctttacgatcaacgccaaaaagactaggctacagcactgttctgttcgacaagaagtgacgggaatcactgtcggccagaagctgaatgtgacccgcaagtacgtcaaagacgtccgagcgattttgcacatatgggagaagtatgggatcaatgcagcctacgctaccttttatccgcgctataaatccgagaagtgccagctccatcgaggcgaaccaaacctggaaaacgtcatcagcggtaagctttgctatcttaagatggtgaaaggggagacagatccagcatacgcaaggctaagtgcccagttttctcgtctcactagctccgcaaatcctacccagaagcctcgcgacattgactatctcttcacaatgccactgcttgcttttgaaaaaaagttgggatgtaagctggaatatagaacaaggacgcatgacaacaagccttacgcctgtttccacttccaagacagatttttcgtggtcgccgtttcaaaaaatttggatgtgaacaacctccctgaaaacgtcgaaatatccctcacccggatggcggttccaattccattctacctggctccaggtgagcctatccccgaggtgaaacctaccaaggctcaagttggctacctgctccacaagccctatactgggaagaagcgtaaagcagtagataatgatcaatccgcttcaacaggggtgcctgactctctgagagagtttgtgctcgatctggctaccaagtttcccaaactgcagctacaggacgaaatgggcataattgccggccagcaggaagacgatatgctgtctcggctggtagatagcaatttcgatctgtctatcctgccatga

SEQ ID NO: 7289 - RNA, 1617 nt, unidentified
  source 1..1617: mol_type = other RNA; note = synthetic construct
atggacaaacagactataaaggaaaaggcgaaggcgctggagactaggtttgatctccttaacttactaaatgaggtgaaagccgaccttttgggcagcacagcctatcctttcactatgaagaagctcctgatcttttgtaaccctaagaacgacggggagaaaaagcaggagaggtatcgatcttttagcatccctaaaaaaagtggaggtgagaggacaatctctgcaccttgtggcaatctgaagtggatgcagctgtgcattaatgaaattttccaggccctctactcccccagtccctacgcaatggggttcgctgagggtcggagcatagtcgataatgctcgaatgcacacaaaccagaactatgtctttaacattgatcttaaggacttcttcccctctatagacatcaaaagggtctggaatcggctgcagagagcaccctttaatttcaatgcaaaggtggcctatactatcgccggattatgtactatgcgtacaatccactatcgtgaggatctgccttttgaagaggcattcgtgcttccacagggagcccctaccagtccactgctcacaaatgccatttgcgatacattagatcgcaggctgcatggactggcaaagagatttggcctccattactctaggtatgctgacgatattacattcagctccatgcataacgtgtaccaaccggatggcgatttcagaaaagagctcgaacggataattaccacgcagaggttcatgattaatgctaagaaaaccagactccaacactgcagtgttcgccaggaggtgacagggatcaccgttggccagaaattgaacgtgtctcgaaagtacgtgaaggatgttcgagctatccttcatatctgggagaagtacggaatcaacgccgcctatgccaccttttaccccagatataagagcgaaaaatgccagctgcaccgtggtgagccaaacatcgtcaatgtcatctcaggcaagctgtgctacctaaagatggtaaaaggagaaagcgacagtgtctacacgaagctcttcgcgcaattcactcgcctaacctctaccgaaaaaccagttactaagcctaatgacatcgactacctgtttaccatgcccttgatagcgtttgagaaaaaacttgggtgtaagttagaatatcgcacgcggtcacatgacaacaagccttacgcctgttttaatttccaggatcggttcttcattgtcgccgtatcaaaaaacatcgacattaataacctgcccggaaatgtggaaatctcattgacccgcatggctgcaccattgcccttttatgtggctgaaggggacccgattccagagattaaaccaactaagattcaggtaggttacctgttgcacaaacactataccggcaaaaagcggaagaatgagatagtgacaattacctccgatgagtccaacgacgtttcggatggcctgcgcgaatttgtgctcgggctcgctgagcaataccccgaattccagtttagagacgacatgggcatcatcgaatcccaacaggagaacgatattctgagcagactggtggactccaacttcgacctgtccatcctgccgtga

SEQ ID NO: 7290 - RNA, 1617 nt, unidentified
  source 1..1617: mol_type = other RNA; note = synthetic construct
atggataaacagaccctgattgaaaaggcccaggcactcgaaactcggcgggatctcctgaaactcttaaacgaggtgaaagcagagctccttggctctagcgcctatcccttcaccatgaagaagcttctgatcctttgtaaccctaagaatgacggtgataagaaacaggaaaggtatcgctccttctcaatccctaaaaaatcgggtggcgagcggacaatctctgccccctgtggcaacctgaagtggatgcagctctgcctaaacgagatcttcaaggcactgtacaccgctagcccatatgccatggggtttgtcgaaggccgctccatagtagacaacgcacgcatgcacacaaatcaaaactacgtgttcaacattgacctcaaggacttctttcccagcatcgaccaagctagggtctggaagcgtttacagctcagtccgtttaattttaacgccaaggtcgctagcgtcattactgggttatgctgtatgagaacaatacggtaccgggtggatctgcccttcgaagaggcatttgttctccctcaaggagcgcccactagcccactgctgacaaatgcgatttgcgacactttggacagacgcttgcatggactggctaaacgctttggtttacactactctagatatgccgacgatatcaccttcagtagtatgcagaacgtgtatcagcccaatggcgatttccgtaaagaattggagaggatcatctctgatcagcactttaccatcaattctaagaaaaccaggctgcaacactgctcccagagacaagaggttactggaattactgtgggtcagaaactgaacgtggccagaaaatacgttaaggatgtacgagcccttctgcatatatgggagaagtatgggattaatgctgcgtatgctaccttttacccaaggtacaagagcgagaagtgtcagctgcatagaggggagcctaacatcgtgaatgtgatatctggcaagttgtgctacttgaaaatggtcaaaggggaaaccgatccagtgtatacgaagctcttcgcgcagtttacacggctcacaagcactgaaaatcccgtggcccaaactaaagatatcgactacctgttcacgattccgttaatcgccttcgaaaagaaactagggtgtaaactggagtaccgaaccaggattcacgataacaagccttatgcctgcttccagtttcaggacaggttctttattgttgctgtcagtaagaatctcgatattaacaatctgcccggcaacgtggagatatccctcgttcatacggcacactacaatacaaatttccatagtagcgaggacaccgatttgaactttaaaatctcccagcttaaagtgggatacctgcttcacaagcactatacaggaaagaagcgaattgacgaagcttcagcaccatccccaaatacaaccctggacgtccctgactcactgcgtgaattcgtgctgggactggccgaacagtttccagagcttcagctaagagacgacatgggcatcattgagtcccagcaagagacggacatactgtcacgcttggtagattcgaacttcgatctgtcaatcctaccttga

SEQ ID NO: 7291 - RNA, 1593 nt, unidentified
  source 1..1593: mol_type = other RNA; note = synthetic construct
atggataaggagacacttgtgtcaaaggctagggctctggagacacccaaggattttctgtacctcatgaatgaaattaaggccgacctactgggggataactcatatcctttcagtgtccgccagttgcatatactctgcaaccccaaaaatgataagaaaaggtacttcagcttcgagatcccaaaaaagagcggcgaatccaggcaaatctgtacccctagcggcaacctgaaatggtttcagatttgcctgaacgagttgtttaaagccctgtatactccatccccatacgccatgggatttgctgtagggaagtcgatcgtggacaacgccaggatgcacactaatcagaattatgtctttaacatcgacctgaaagacttcttcccttcaattgatcaggccagagtttggaagcgactgcagatcgcacctttcaatttcaatgcaaagatcgcaggaatcatggcagggctgtgttctatcaagtccttgcgttactccggagaagagccatttcaagagtgcttcgttttgccccaaggtgctccgacctctcccttgctgaccaacgccatttgcgatacactggaccgcagactccacggtctagcaaagcgctatggtctacattacagcagatatgcggatgatataactttctcatcgatgcacaatgtgtaccagtccgactctgtgtttcggaaggaactgcagagaataattacagagcagcgcttcactatcaatccaaaaaaaacacggcttaaccactgttctctgcgtcaggaggtgacgggccttaccgtgggtcttaaaatcaatgtctcaagaaagtacgtgaaggatatcagagccatcctacatatctgggagaagtacggctataacgccgcctatgctactttctatccgcggtacaagtccgaaaagtgtcagctccacagaggggagcctaacctggagaacgtgattagtgggaaactctgctatttaaagatggtgaagggcgaatccgaccccgtctattctaaactgtactcccaattcattcgactgaccgaagcaaccattatcgcacaagataagcacaacatagactacctttttactatgtcaaagtgcgacttcgaaaataaattaggcgtgagcattgaattccgggagcgcgccgacgacaaaaaaaaatacggctgtttctacttccaggacaggttttttgtggtagcggtcagtaagaacatcgacatcaataacctcccagagaacttacagatttctctgacccgcatgcagaagcccgtagaattttatttaaggccgggagaacctagggctgctgcgcttcccacaattacccggatcggatatctccttcataagcctctccggggctacaaacccgagcccaaagctgggaacattagcaatgatatatctaacgagctgaagagctttgttataaatctggccaatacgtacccagagctccagttgaaagacgatatgggaattattgaaagcagtaacgaggataatctcctcgcccgattggttcagagcaattttgacctgagtatcctgccttga

SEQ ID NO: 7292 - RNA, 1542 nt, unidentified
  source 1..1542: mol_type = other RNA; note = synthetic construct
atggagaaaagataccttaccgaaaaggcgcaggctctgaatactacagtggatctgttcaaccttctgaacgaaataaaatgtgacattcttggagacaactctttcccttttaagtggaatcggttcctggctctgtccactccgggtgactacctgcatcggtactattctttcaaaatccctaagaagagcggcggctttagatcaatatatgccccgctctacaatctgcggtggatccagatatgcctcaatgaaatctttaaagctatctacaccccatctccatatgctatggggtttgcagccgggagaagtattgtagataatgcacgaatgcataccaaccaaaattacgtgttcaatattgacttgcaggactttttccacagcatcgatcgacatcgtgtctacaagcgcttacagtttgccccctttaatttcaaccccgaaattgccaacgtgattgccggcttttgtacaatcaagtcttttgttcgctctggcgggagtagctcgatcgattgttatgtgctgcctcagggcgctccaaccagtcctctcctgacaaacgccatttgcgacactttggaccggcgtttgcagggactggctaaaagattcggactgcactactcacgctacgcagacgatattaccttttcctccatgcacaatgtttaccaggagcagagcgagtttaggcaggaattagagaggataattgcggatcagggttttactatcaatccaaagaagacgagactgagccattgttccaagcgccaagaagtcaccggactcgtggtgtcccaaaaagttaacgtgaaccccaaattcgtcaaagatatccgagcaatcctccacatctgggagaagtacgggtataatgcagcctacagctccttctatcctaagtatctcagcgaaaagtgccaacttaaccgcggctatatgaacctagccaacgtcatcagtgggaagctgtgctttctcaaaatggtaaagggagccaaagaccccatctacattaagttgaacgagcaatttgcatcgatcctgaagtcacagaaatcaacgaagggcgagagtgaacggatcaaatatcttatgacaatgaccaagagagacttcgagaaaaagatcggaaccaaaattcacttcaatcggtctaggtatgatgctaagatttacggctatttctactaccacggtaaatcatttctggtggccgtcagccagaatctcgatataacaaatctgccagacgagactcagatatctttgtgcgaattcgttaagtatctcgactgtgagtatgatagcgatcccaggaaactaaagtcctcccaaaggtattacggtgtggtataccttttacacaagccacattacggcttgaacatgaagaacaagaagattcccaaacaggtgaaagagatggtgatcaatttcgcgaataggttccctgaactggagctaaaagacgagttcgggattatcgatgagtataacaagacacagattgacaaaaactga

SEQ ID NO: 7293 - RNA, 1635 nt, unidentified
  source 1..1635: mol_type = other RNA; note = synthetic construct
atggacaaggaattactgataagcaagattcggaataccactacccgatggaagttactcgacctccttaacgagatcaaggcagaccttgctggcactgccgcctaccctttcactatgtctaagatgatgagactctgtaacccccgaattggactggatcgctaccactcattcgaaatccccaagaaatctggtggcgtcagactgatctttgcccccgaaggcaatctcaaatggatgcaactctgtttgaacgagatcttcaaagcactgtacaccccgtctccctacgctatgggcttcacccaggggcgaagtatcgtgagcaatgccgtgaggcacttgcatcagaactacgtttttaatatagacctctgcgacttctttcccagtatctcccaagctagggtgtggaaacgcctgcagttgcctccattcaatttcaccaaggatgttgcttcagtagtggcgggcctgtgtagcatccgcatgctagacatagttgatgggaatgtccggttagtgtcatacaaacttccacagggggcccctacgtcgccattgctgacaaacgccatctgcgatactctggataggcgactggccggactggccagaaggtttggactacactacactcggtacgctgacgacattacattttctagcatgcacaacgtctatcaagacggctctcccttcagacacgaactggaacgcattgtaagcggccagcattttaaaataaacgctaagaagaccagactaaaccatcgcggggagaggcaggaggtaactggactcacagtcggagaaaaagtcaatgtcgcccgtcggtacgtgaaagatgtgcgggccattctgcacatttgggaaaggtatgggatgaatgcagcagtcgcgaagttctacccccggtataaaacagagaaaggtagtctgcacaacggcgacccagatatggaaaacgttatcgccggaaagttatgttatttgaagatggtgaagggacagcatgaccctgtgtatgtgaaattacaggagcagttcgatagactgacgtcagcgaagcctgaggctcatgacttggaaatttcctgggagtacttgcaaacgctgcccacatccgattttgaggcgcagctgggggtgaaaattgactacggaattagcaatctcggcaagcagtacgcctcctttgttttcaacgggaaaaagatctatgcatctgtgagtaggaatatctccatctccaacctcccaaagagtctttacatcagcctctgcagacagatcgattataaggtcaagtatactggggaagccagccagaggcacgccgtgatcgacccaggcacaccttatggccgtatgatgctgggttgcccccttcctgaggacctggctgtccgctatatttacgttgtacaccgggcccttccgaaggacaaacccctcaagtatgtgcatacccctcaggtggcaccggagctgaaagatatagtggggaagctcaatgagctgatgccaggcgcactgacagctgatggtgctctgctggcaggtgatcgtcctaaagataccctaacccaattggtggagtccggatttgacctgtcaattcttccatga

SEQ ID NO: 7294 - RNA, 1635 nt, unidentified
  source 1..1635: mol_type = other RNA; note = synthetic construct
atggacaaggaactgctggtcagcaagatacggtcgactaccactagaatggagttgctggacttgctgaacgaaattaaagtcgacctcgccggcagtgccgcatacccattcacaatgcagaagatgatgagactgtgcaatcccaaactgggagaaaacagatatagaaggtttgaaatacccaagaaaagcggaggagtgcggacaatcttcgcccccaacggcaatctgaaatggatgcagctgtgcctcaatgaaatttttaagactctgtacaccccttcctcctatgcaatgggcttcactcagggcagatccattgtcgataacgctaaaaagcacctaaaccacaattacgtgttcaatattgacttatctgacttcttcccttctattgaccaagcgcgtgtgtggaagcggcttcagatgccaccattcagtttttccaaagagattgccaatgtgattgctgggctttgtgccatcgagatggtttatgatgaggacgacaaggatcccgtgaaaacctacaagttgccacagggcgcaccgaccagtcctttactcacaaatgcgatatgtgatacactagacaggagactggccgggctcgccaaacgattcggcctgcattatacaaggtatgctgatgatatcacgttctcatctctgcacaacgtataccaggagggttctgcatttcggaacgagctggaacgcattgttatcgggcaaaactttcgaatcaatccgaggaaaacaaggttgcaacataggagcaaacgtcaagaagtcaccggtctgtcagtgggagaaaagatcaatgtttgcagaatgtacgtgaaggatctgcgcgccctcttgcatatttgggaaaagtatggcatcaacgctgcaatcgctaagttttacccccgctacaaggctgagaagggatatatacataaaggggagcctaatattgagaacgtcctctccggtaagctttgttacctgaaaatggtaaaggggaagtttgatcctgtgtattgcaggctacaggagcagttcaataggttaacgttgaccagtacgaataaaaagaacgtcgaactgagttgggaataccttcagaccacacctgtaaatgattttgagacacagctgggggtcaagatcgagtacgcggtgagcaagcggggcaaaccctactcatattttatgctcaaaggtgagcgtattatgatctccgtgtctcagaacattagcatcgacaaactcccaaagaacctctacatatcgttatgccgccaggttgattacaagctccgctatactaaacaacagttctctgtgcccgaggtgatcgacaacactaccgcctacggccgaatgaaattgggatgtccacgcatggaggacctggcagttcggtatctttatgtgatacaccgacagctaccgaagaatcaccccagcaagtacatccggacccctgaggtgactcccgagctgaaagacgtcgttaacaaacttagcgaactgatcccaagcttattcgatgtagactgtgtgcaggccaccgacgtggagcctaaggatactctgaccagactggtcgaatccgggtttgatctctcaatcctttcatga

SEQ ID NO: 7295 - RNA, 1635 nt, unidentified
  source 1..1635: mol_type = other RNA; note = synthetic construct
atggataaagaactgctgattagcaagatccagaacaccaccactcggtgggagctgctcaatctgctcaatgaaattaaggctgatctagtgtcaagtaccgcgtaccccttcaccattcaaaaaatgatgcgtctttgcaatcccaagctgggaaataatcggtaccgaaaattcgaaatcccaaagaagtccggaggcgtaagaactattttcgcccctaacggcaacctcaagtggatgcagctgtgtctcaatgaaatctttaaagccctatacaccccatctccatatgcaatgggttttgtggagggtcgatcgatagttaacaatgcagaaaagcatctgaagcagaattacgtattcaacatcgatctcagcgattttttcccatctatcgaccaggcaagagtatggagacggctccagctgcccccgtttaactttagtaaagaggtcgcaaatatcatagccggtctatgttccattgagatgaaaaaagagggggacgagacaccgcccgttaagagctataagctgcctcaaggggcccccacatctccacttttgacaaatgctatctgtgacacattggataggagacttgctggtctggctaaaaggtttggattgcgttacactcggtatgccgatgacattactttctcatccatgcacaatgtgtatcaaaacgggtcacagttcaggatagaattagagaggattatctccggacaacatttcaagattaaccccaaaaagacccggctgcaccacagaggtcagagacaggaggtcactggactgacagttggcgaaaaaatcaacgtgtgtaggtcctacgtgaaagacattcgggctatcttacacatatgggggaaatatggcattaacgccgctgtcgcaaagttctatccacgctacaaagctgaaaagggctatctgaacaaaggggagccaaacatcgcgaacgtgatctctgggaaactctgctacctcaagatggtgaagggcgaaatggaccctgtgtatagtaggcttaatgatcagttttcaaggttagtggacaccaactccggcgcgaaagatatcgaaatatcctgggaatatttgcagacactttctacagatgactttgagaagcaattgggcgttaaaatcaagttctcagttagcaaacagtccaaacagtacgcctacttcattctgaaagatgagaagatcatggtcagcgtcagtcgcaacatatcgattgatcacttacctaagaatctttacatcagcctctgccgccagatagactacaagctgaaatacaccggggaactgtataccagaccagacgtgatcgacaatagcactgcctatggacgaatgaaactgggctgccctatcccgggcgatcttgccgtccgttacatttacgtgattcatcgcgccatcgcaaaggacaagcccacgaagtatattcatacacctgaggtggcccctgagatcaagaatgttatcaacaagttgaacgagtttatgcccggggctttcaccgtgggacgcgtagagagcacgtctgtcaagcctaaggacacgctgactcgcctcgtggagagtggatttgacctgtctattctgccctga

SEQ ID NO: 7296 - RNA, 1818 nt, unidentified
  source 1..1818: mol_type = other RNA; note = synthetic construct
atggaaaacaatgaaatcgtggcccgggtttcaaaaatatccgacgtcgagtctttatacaaattactcgatgacatccgtaagagtgatagagagacttacattcggaagatggactttaccctggcccacatcaaaaggtatgctaatcccaacctgacatacaaaaggttcagccttgtgaatattccaaagaaatctggaggaacaagacaaatttgcataccaaacgttcgcctcggcgttatactccattgcctaaatgaggtgttcaaagccttatatacgcctaacgaattcgccacagccttctgtgttggcagaagcatcgtcaacaacgcaaaggtccacatcggtcataactacgtctacagtatcgacctggaggatttctttgggagcatccagcaggcccgtgtgtggaagaggctgcaactgcctcccttcaacttccgacagcctctcgtcaatgcaatagcagggatgtgttgcgtgaagatgcagcctagtatcaaaaataaccgctcgaccgctgattatatcctgccacaaggtgctcccacctctccgctcctctctaatgctatatgcgacactctggatcggcggctgacagggctggccaagagattcggcctttgttattctaggtacgcggacgatattacattctcctccaatcacaacgtgtttcaggacaatagtgatttttgcaacgagcttaaccgaattatagccgaccagaagtttactatcaatgtcaaaaagacccggctccaaaagcgcggcagtaggcaggaggtgacagggcttattgtgtgtgagaaggttaatctgtgccgtaaatacgtgcgatctatcagacagatcctgtacatctggaaatggtatggagtccatgatgcgtactcctcatacagaaaaaacaacaacatctctgagtacaaaggcgaagaaggattcaaactgatcatactgggcaagctgaattacctcaaaatggtgaagggggaaaccgaccccgtatatatcaagttgcgcactgaatacgacaacattgtgaatggtacctaccaccatcagtcatctagcattcacttcaagttcgtgaatactcaaagcctagaggactttgagtcagagcacgggaggattggcattgccgtggggaaaagcggcaagaggtatgcatattggaagaaactgaatcggtacttgcgatttatctccatttccaacagcattaaggaatttaaccgcgaagatctgtgtatttctgagtgcgctaccgctggaggaggcaagttttatcttttacggaacaagagtaagcgcaaaaaatacactgacgtactggaggcagattttaaaaagtccttgatctgggaaacctgtagcaagctgagccagtcaaagccatatgaatttgacatcgttactatgtggaatagcggtatgtttgatgtaggtgaatactcccacgacgattcgtaccattatattaatatcgcggaaacgcagtataccggaacgtggacaaacctccagcaggaactcacaagagagctgaagaggatctgcttcgatatcaaattcattaatggacagacctcctttattgtgaaagggaagtcaattggccttagtctacaatggccatggaaccccccctatgaggaggagctgaataacaccgcagtattggtgcaggccaagatcccgaagaacaagtatcctgagatggaggcttttataaaatcctacttcgagttggtcgtgtcagaacagatgtattacgacagcttgaatattttctga

SEQ ID NO: 7297 - RNA, 1581 nt, unidentified
  source 1..1581: mol_type = other RNA; note = synthetic construct
atggaaaagaacgttatcatcaagagagccagcaatctggagacaaaagaggacctcttgcttctcctgaacgacattgtgaaggatgagctgggtaaagacgatgcctttagcttttctatgaagcagcttatgtactactgtaaccctaataacgtcagaggcagatactctcacttttctatcccaaaaaaatctggcgggtgcaggaacattgcagtgccttcccgaggactcggtaatctgctgcactacgtgaatatcatgctaaaggccatttatcagcccagcgattacgctatgggcttcgtcgagggcaggtgtgtagtcgataacgctatgcgccacgtgggccaaaactatatattcaacactgacctcgagaatttcttccccagcattgaacaacctcgagtgtggaagcgctttcaattatccccctttaatttcaagcgtccgatagccaacattctggcaggactgtgctgcattaaagagaagaatgacgacggatcctttatctacgttgtgcctcaaggcgctcccacctctccactgattactaacagtatctgtgacgtgttggaccggcggctgaatggccttgctaggaggttcaacttacattattctagatatgccgatgacataacattctcgtctatgcacaatgtgtataaggttggaggagatttcagaaccgaactcaagcgtatcgttgaggaccagcattttcggatgaaggaatcaaagacgaggttacaaaagatcggggagcgacaggaggtgacaggtttgatagtgtcctcgaaagtcaataccagtgcagcgtacgtggccgagattcgcaacctcttacatatctgggaaaaatacgggtacaatgaagtgtacaagcggttctaccctaagtataaggcagacaagggctatatcaaaaaaggtgaaccactgttggagaatgtgctgtacgggaagctccagtacctgaaaatggtaaaggggtacaaagatagtgtctatgccgctctccaggcaagatatgaccggctgaccagtcccattaatgcctcctcagagcagaaatatgattacttgcgctcctttacactcgccgaattcgaggagattgtcggcaaccagattcggtattccctgtccaaaaacggaaatctttacgggagggtgaacctaaatgacaatgacatcatcgtgagcatcacaaacgctgcgaaagttcagctggtcaaaaacaagatcatcaccgatgaatcaatgattgctagcgtcaaaactagcaagtcaactatcccagccaacagtcgccccgggctttacgtagtccttacggcgaagaatggcaaaagcctattttggatgatgacctattacgatccgactgtgaccgacatcgatctgtcatctgtatcagtgagcgagttggttgatatatgggagcaggaaggaatcaacgctgccattgaggcatatgaaaacggaatactgttcaaacaggataataagtcctttgaaaagctgaaaggtgggaagcagaagttctatcgtccaagtagcttttga

SEQ ID NO: 7298 - RNA, 1785 nt, unidentified
  source 1..1785: mol_type = other RNA; note = synthetic construct
atggaaaagtctgagatcagaaagcgggcaaccgagatcgaaagtaaagaggacctgcttctcctgttgaatgatattgtgaaggatgagttgggaaaggacgatgccttctcttttagtatgcagcagctgaactactactctaacccaaataacgtgaggggtagataccaccatttctccatacccaaaaagtccggcggaaagcggaatattgcggctccatcaaaagggctgggacacattctatattacgtcaacatcctgctcaaaagcatctatcagcccagtgatttcgccatgggctttgtggaaggccgctgcgttgtagacaatgctatgcgccatatcggccagaactacgtgtttaacactgacctcgagaacttttttccgagcattgaacaacctagggtatggaagcgatttcagctgaaaccgttcaacttcaaacaacccattgcaaatctgctggccggtttgtgttgcatcaaagaaaaacacgatgacggcacctttaaatacgtcgttccacaaggagcccctacgtccccactgatcactaatgcaatttgtgacaccctggaccggaggctcaatggtcttgcaagacgttttaaccttcattattcccgttatgccgatgatattacctttagctcgatgcgcaatgtctttaaggccggcggcgacttcaggatggagctgaaacggatcatcgagggccagaatttcaagatgaatgaggctaagacgagactgcaaaagaaaggcgaacggcaggaggtcacagggctgacagtctctaataaggttaacacttcatcagcctatgtggctgaaattagaaacattctgcacatctgggaaaagttcgggtataatgatgcctacaagcgattttacccaaaatacaaggaatccaaggggcacgttaagaagggagagccactgcttgagaatgtcctttatggcaagttacagtacttgaagatggtgaaaggggtgaaagaccctgtctatgtggctcttcaggcaaggtatgacaaactaacatcccctgtaaacgcggaagtcaagcagaaatatgattacttgcgaagtttcactctcgcagaatttgaggagatcgtggagtgccaaatctcatacgcgctcagtaaagaagacaacctgtacgggaaggtgatcttaaacggcaaggacatcattatctctatatcaaacgaggctaagacacagctcgtgaagaacaagattgtgactgacgaggccctcgtcgcatccgtcaagcctattaagaacgtaatttcggtgaatagcaaacctggactatacgttgtgctgaccgccaagaatggaaaggcccccttctggatgatgacctattatgatcccacagttactgatattgacctctctcaggtaagtgtggctgaactcgtgaatatctgggagaaaaacggtatcgacgccgcaataaaagcttacgaggacgggatactgttaacctcagaggacgccagcatggccaacaaaaacagcaaggacaaaaaaaacacccccatgcagaagcgcaaatctgctagcagcaaagacgagtccgtgtacatgggggacatcgatttcatagatgtggccgatattgcggcaatagaagaagaaatcaagagcggaaacctgggtgaggttaagctgtctttcagcaaaaatgacgaagctgataattcaggcaatgatgagttagatacaataatcgatgaggggtccttcgatgacttgtga

SEQ ID NO: 7299 - RNA, 1779 nt, unidentified
  source 1..1779: mol_type = other RNA; note = synthetic construct
atggagaagtctgtgataagaaaacgcgccgcagaactccagagcaaggaggacctgcttctccttctgaatgaaatcgtgaaggacgaattaggcaaggatgacgccttttcctttagtatgcagcagcttacctattacagcaatcctaataatgtacgaggtcgataccggcacttttccatcccgaagaagtctggcgggaagcgcaatatcgctgccccttcaaaggggttgggccatattctctactacgtgaacatcttactgaaggctatttaccagccttccgactatgcaatggggttcgtggaggggagatcggtggttgataacgcgatccgccacatcggccaaaattatgtcttcaacaccgacatcgaaaattttttcccctctattgagcagccacgggtctggaagcgctttcagctcaagccctttaactttaaaaaaccaatcgccaacatcttggctggcctgtgctgcattaaagaaaagaatgatgatggcaccgtgaagtacattctgcctcaaggagcacccactagtccgctaataacaaacgccatttgtgacacactggacaggaggctctctggtctggccaggcgtttcaacctgcattatagccggtacgccgacgatattaccttttccagtatgcacaacgtctataaagaggacggggacttccggaccgaattgaaaaggataatagagggccaaaatttcacgatgaacgaggctaaaacaagattacagaagatcggagaacggcaggaggtgactggtctaacaatttcgaacaaggtcaacgcatcaaccgcatatgtcgccgagatacgaaatctcttgcatatttgggagaaatacggatacaatgaggcgtataagcgcttctatcccatttataaggagtcaaaaggtcacgtgaagaaaggagagccacttcttgaaaacgtattatacggcaagctgcagtatctgaaaatggtgaagggttacaaagatcccgtctatgccgcactgcaggcacgttacgacaaactgacatcccctgttaacgccgaggtggaacagaaattcgactatcttagatccttcaccctcgctgagtttgaagagattgtagatggtcaaatcaattacgccttgtctaaggagggaaacctgtatgggaaagtggtcctgaacggcaaggatatcatcatcagtatcagcaacgatgctaaatctcaactcgtgaaaaataagatcgttaccgacgagacgctggttgcttcagtaaagcccacaaagagcgcaatacctgttaacagcaaaccaggactgtacgttgtcttgactgccaaaaatggaagagtaccattttggatgatgacttactacgaccccacggtcaccgacattgacctatcagaagtgcccgtgaccgaacttgttaatatctgggaaaagaatgggatagatgccgcgatcgaggcttacgagaacggaattctgctcaagggggaaggcgccaacaaagcggccaaggatgctaagggcaagaaaaaaactaaaaaacctcagaagggggtgttcctgccaagtatgtccgaaagcgtctccctggatgtggactatatcgatgtggctgacattgccgcagtggaggaggagattaggtcaggaaaaccaactaagctgtctagtagcttcacagacgagtacaatgatctcgattctgatgaattggacactatcgtggatgaaggcagcttcgatgacctgtga

SEQ ID NO: 7300 - RNA, 1689 nt, unidentified
  source 1..1689: mol_type = other RNA; note = synthetic construct
atggagaaacgagaaattgcccagcgggccagcatgttgcagaacaaagaggaccttctccagctattgaacgacattctgaaagatgaaatcagctccgatcactccttctcctttagtatgcgccaattgagttactactgtaatcccaataacgtgagaggtaggtatcgtcactttagcatacccaaaaaaagcgggggccagaggcacatatcagctccaagcagaggactctcacatattctgtactatgtgaacatcatgctcaaggcggtgtacctgccatccgactatgctatgggcttcgtggaagggcgttcagtagtcgataatgcttctcggcatattgggcagaattatgtgttcaacacagacctggaaaactttttcccatcaatcgcccaacccagagtctggaagaggttccaacttgcacctttcaactttaaccagcaaatagcttctattctggccgggctatgctgcatcagggaaaagcaggaggacggcaaatttaccttcatcttaccacagggcgctccgacttcgcctttaatcactaacgccatctgcgacaaacttgacagacggctgagtggactcgcacgcaggtttagactgcattacagtaggtatgccgatgatataaccttttcttcaatgtgtaacgtgtaccatgagaatggcgactttcgaactgaactgaagcgaattattgaagatcagggtttccatatgaatatcgcgaagacacgattgcagaaaagaggcgagcgccaggaggttaccggattaactgtctctaatcgcgtaaatacctctcgcgagtacgtcgccgaaatccggaacctgctccacatttgggagaagtatggttacaatgatgttttcaaacggttctatccgcagtataaagccaacaaaggccacgttaagaaaggggagccgatgcttgaaaacgtgctctacgggaaacttcagtatctgaaaatggttaagggttacaaggatcccgtctacgccgcactacaagcccggtatgacagactcacaagccctgtgaacgctgaagcaaagcaggggttggactacctccggagttttactattgccgaattcgaggagatcgtgggatcccctatctcgtactatctgtccaaagacaacaaaatttacggcaaatcaatgctgaatggcaaggagatagctatatccattacgagggctgcaaagcaccaactcgcgaagtcaaagatcatcaccgatgaaagcctgctggccagcataaagcctgttaaatataacgtgaccgctaattctaatcccggactcttcgtggtcttggccgcacgcaatggtcacacccccttctggctgatgacctactatgatccaactgtgacagatattgacatgtctaatgtgccccctacagagcttattaacatctgggaggagaagggaattgatgcagcgatcctggcatacacggagggaaaagaccagggaccaaataagaagcaggagaagtccaagaagaagggcaagcgtagtgagacaaagaagctggtaagcaatatcgacctgctggattttgacatcgatggggctctggacatcgatgatatctctagcttggtcgccgactttgatgaagcctccgcaatttcccttgacgacttatga

SEQ ID NO: 7301 - RNA, 1521 nt, unidentified
  source 1..1521: mol_type = other RNA; note = synthetic construct
atggaaaagcgcgagattgtccaccgggcttcccagctgcaaaataaagaggatctgctgcagctgctaaatgatatcgtgaaggatgaactctctaacgaacgggcattcagtttctctctgaaacaattgagctactattgcaatcccaacaacgttcgcggcaggtaccggcactttagcatcccgaaaaagtctggaggccaaagaaatatcgccgctccttcgaggggattgagccacctgttgtactatgtgaatattatgctgaaggctatatacaggccaagcgactatgcaatgggctttgtggaagggagaaacgtggtggataatgcctcacgacatattggccagaactgtgtctttaacactgacctggaaaattttttcccatccattgctcagccccgagtttggaagaggtttcagctcccacctttcaatttcaataagcaggttgcgagtatactagccggactttgctgtattagggagaagcatgtcgatggaaagctcacctatattctgccacagggtgcacccacgagccctctcattacgaacgcgatctgcgacaatcttgatcgtcgtctatcaggattggcgcacagatttgggttacattattcacggtacgccgacgacctgaccttctcgtctatgcataatgtctatcaggaaaacggcgagtttcagacagagctgaagagaatcatcgaaggtcaggggttccgcatgaacatcgggaaaacaagattgcagaagcttggggaacgccaggtggtgacaggactgaccgtgagtaacagagtcaacacctcaagcgaatatgtcgccgagattcgaaatctgctgcacatatgggagaaatacggatataatgacgcctttaagaacttctactcacactacaaagacaagaaagggcatatcaagaaaggggaacctatgttagagaatgtactctacggtaagctccagtatttaaaaatggtgaaaggctcaaacgaccctgtttatgccgctctgcaagcccgctacgataagttaacttctcctgtcaacgctgaaatcaaacagtccttggattacctccggtcttttactatagccgagttcgaggagatagtgggcagccccattaactaccggcttagtaaggataacaacctttacggtcaggcaatgctcaatggcaaagagatcgccatctctattacaggtgccgctaaacaccaactggctaagtccaagatcataacagacgagacacttctcagttccatcaagccaattaagtatagcgtgacctccaagagcaaacccggactcttcgtagtactgaccgcaaggaatggccacgccccgttttggatgatgacttactacgacccaaccgtaactgatatcgacatgtccaacgtgcccgcctccgagctggtggacatctgggaaaaagagggcattgacgctgcaatcaacgcattcgaggaggggtttctggaagatttcgtttga

SEQ ID NO: 7302 - RNA, 1662 nt, unidentified
  source 1..1662: mol_type = other RNA; note = synthetic construct
atggaaaaaagcgagcttctcaagaaaattctcgccctgcagacaaaggaggaccttctacagctgcttaacttaatcgtgaaggatgagttacgacaggagaacgcattcacgttttcaatggcccaactgatgtacttttgcaatccaaataacgtgcgcggcagatatacacacttctccataccgaaaaaactcgggggaaaacggcaaatcgcagcccccaccgctggactgcgcaacattctgtactacatcaacatcatgctgaaggctgtgtacactccaagcgactacgcaatgggattcgtggagggacgcaacgtcgtgagtaatgccaccctccacgtaggcaagaactatgtctttaataccgatcttgagaacttcttcagctctatcgaacagcctagagtttggaagcggctacaattgccaccctttaacttcagccggccaattgccaatataattgcaggcctgtgttgtattcgagaaaaacaggagaatggtcagttcatttatgttttgcctcaaggggcccctacttcgcccctgttgacaaatgccatatgcgactccctcgaccggaaactggcaggcttggcgcggaggtttggtttgcactacagcaggtatgccgatgatatcacattcagttccatgcataatgtatatcagaacaaccgtgaattcatcacagagctcaaacacatcatcattggccagaatttccatataaatgaggcgaaaacgcgtcttcaaaaacacagggagaggcaggaggtgactggcctgactgtaaactcgggcgtgaataccagtaagaagtataaagctgagattagaaacctactacacatttgggaaaagtacggatacaaagaagcctataaaagattctacccccattataaggagacgaaagggcatactaagaagggcgaacctatgttggagaacgtgctgtacgggaagctgcagtacctgaggatggtcaaaggagctaaacatcccgtgtatgttgcattacaggagagatacaataagctgactagccctataaacggccactctaaggaaagttttgactttctccgcgctttcagcctgtcagactttgaaataatgaccaataatcctgtgcaattcgctatctcttcaacccacaatctctatgcctacactatgcttgaggggaagaagatactgatctccctcactaatgcagtcaaggagattctgatcaagaagggagatatcacaaacaatacagctacctctcacgaagaaatcatcaagtcatacatcccctttaactccacaacacagctgtacgtggttctgactgccaagaaagggcatgctccgttctggctcatgaccgactatgatccaacaacgaccggtctgcacttctgctctatgccaatttcccagttaattgatatctgggaaacaaaggggattgacgaggccatcgcgacctatgaaaaaaactctacctttaccaaagtcaagaatatcgagagttccagcgagaaaaacgaatcagtctttgataaattccccattaaggaaaactccgacgaagacattcagtttttgcataagctctttgaggacggtacccagaagaacgataccctgtttaccctttga

SEQ ID NO: 7303 - RNA, 2373 nt, unidentified
  source 1..2373: mol_type = other RNA; note = synthetic construct
atggataagggcgagatagcgaagaaagccagaatcctccagaccaaaactgacctgctggctctgttgaatgagattaaagctgacgatttgggcgagaaaggctacccattcgtgctccgccagatcaactattactgtaaccctaagaacacaaaggggaggttcgtgaccttcgcgatcttaaaaaaaagtggtggaatacgcaacatcgccgcacccagcaacgggctcaaaatgctgcagacctatctgaacgttatcctgggcagcctgtatactcccagctcgcacgtaatgggcttcgtgaaagggcggtccgtaataactaacgcctcacgacatctgaatcagaactacgtgtttaacatcgacctgaaggacttcttctcttctatcccacaggcaagagtttggaagaggctgcagctgccccctttctcctttccccaggagattgctaatgttatagctgggctgtgttgcatcgaaatgattgtgcaggatgagcaaggacaggtgagaacaaagtatgtcctgccacaaggcgccccgacgtctcctgttattacaaacatgatttgcgacacgttggaccggaggctgtccggcttagctgccaggtttggcttgaacttttctcgatacgccgatgatatcactttttcaagtctgcactatgtgtattcagagaacggggcttttagaaaggagctgaaacggattgtggaagggcagaacttcactataaatgaagccaaaacacggctgcagaagaagggggatcgacacgaggttacaggactgatagtgagcgatcgcgtaaatgtctcaagaacctacgtacgcaacctacgttccctactatatatttgggaaaaatacgggtatgatgctgcgaacgaaaagttcgtctattattacctggacgacaaacccgcgagctctacttgcatgcctaatatggtgaacgtcattgagggaaagctccagtatttgaaaatggtcaagggtggcgataatcccgtttatctgaacctctactctaagttcgaactcctccagtacatttaccataataaggacaatggtgaagagcaaagcatgagcgatgtggagtccatgctccaccagagctcaatgagcgtggaaggtgttgtcgcccagtggaagaaccgggacatctttagtatcacaggtacgctgttgaatgagtgtaaacgctctgtttcgccgctcattgtcaagaaggtggccgccagcttgatggcatatctctcggcctctctggtgaacaatatcaaaaaacgagcagagctccagtggtacatgctgagggatataaatgatgctatgaatggccagcctcgcacaaggaaaatagacggtgaggaggagaagatccataggccgaagcttgtcgtggcattccttaagcaattcacaagcaccgaaaaccttaagtataccacccacacctgggaacgaatgattgacggcaagtacaagtggaccgactttgatcagttttttcactcctacgagtctgagctaaaggataagacggggtccgggattcctatcttcgacatctacaactgcaacattcacctttacaacctggtgcggaatttcttactcccaccatccaaggaggaatacccatggcagaccgattacgggctcaaattgagttactgtacacctgagggagtcatccagaattggatgaaagagaatcctgataaacaacccatggaaattccactttcagtgtttcccgaatcctatcgccctaagcagagggtgcaaggtcaaaccttagtggactttagagacgtgattgacattttcaagaacgctattgagtaccgggatgacaatttgtattgggacgtcagtgacatcttcaaactaacagactttagtctggacgattcagttcttgatactcttagtggcataaccttttacactgacactattcttgtacgggaagcactcaaaatcattgccgataatatcatcgttcgcccccagcatagacatttgaaagtacaggcaatcaggggaaaggacggagatcagaaatacgtctcattagaaatcctgcacgtcgaatcctttagtaataagagcctggacgatgacaagctgcaacttaaaggcaataagggccagctctccgcagtcaagcaaaagctggtgagcctttgcgatttttccgtggagtctagattccgtaaaggagacgagatgggagactatagaatcgattacttatactctgaagaggtgaatgccgaaccccgtgtgaccaaactggacgccccagctgagggattcaagtatatcctcaaattctacctgtga

SEQ ID NO: 7304 - RNA, 1431 nt, unidentified
  source 1..1431: mol_type = other RNA; note = synthetic construct
atggaccttccccagataaaaaagaaggccacagagcttgaaacaaaggaaaatttgctggatttgctgaatgagatcaagcaggaggacctccaggaacaggcttatccattcacaatcaagcagctgaactactactgtaatcctaacagaaccaagaataggtatatcacctttgaaatccccaaaaaggcgggggggactcgggtcatttcctcaccaagtaacggccttaaatccatcctccactaccttaattatatcttacagtcaatccacacaccgagcaagtttgcaatgggctttgtgaaaggcaagtcaattatagacaacgccagccaacacacaaatcagaactacgtgtttaatatcgacctgaaggacttctttccgtcaattcatcaggctcgagtttggaaaaggctgcaacttccccccttcaatttcaacaaggagatcgcctctatcgtagccggactgtgctgcatgaaggtagagccacaggaagaaaacgagaagcccctgtatgtgctgccccagggtgcaccaaccagcccaactatcaccaacataatttgtgataacctggataggcgattgggagggctggcaaagagattcggtttaagatacagtagatatgctgacgacatcactttcagctccatgcataatgtttatcaaaacgactctgacttccggaaggagctagagaggattattaccgatcagcacttcacaatcaatgagaaaaagacccgcttacaaaaactagggagtcgccaagaggtgacgggcctcattgtgtcccataaaattaacgtcactaagaagtacgtgcgcgagatacggagtctcctgtatatgtgggaaaagtatgggtacaatgtagcctattgcaaattcttccctaaatacacagaagagaaaggccgtatttacgaaggtattcctgatttgatctcggtcattgcgggtaaactcatgtacttgaaaatggtcaaaggagacggcgataccatgtacacacggctctttgccaagtttcagaaactggctaacaaagaaactattgccgagaaaaccaatctggcaggagtgacgtatcttggcacgataggcattctggagtttgaaaagtatatctccaccaccatcatttttgagataactgagaaatgcaacctgtacgcctacttcaagttcaacgagaaaaagataatggttagcgtgaacaagtctctcaagcactccctgactttggaagaagctatggataaaggggagcttgcaatctctctctgtcgtggaaaagaaggaaagcctttttggctgatccatcgcaaagataaggttttggtgcctcctctcccactagtggatgtcgacgagctgaatgtgaagttagattctctgctcctgtttagctga

SEQ ID NO: 7305 - RNA, 1521 nt, unidentified
  source 1..1521: mol_type = other RNA; note = synthetic construct
atggaacggagcgaaatccactaccaagcctctggagtcaaaactacactggatctggcccagctgctaagcgagattaaagaagacgcactcggcataataaaagctcgagcattccaggagaaacagattacgtactattgcaatccgaagagaaccgacaggaagaggtacatcaattttaccatccccaagaaatccggaggcgaacgcaccatctcagctccagtgaggggcttaaagagcatactcttcagtttgaacacacttctccaagcgttgtatgaaccttctaagtatgctatgggatttactcagggccgatccgtggttgacaatgccaagatccatatcgggcagaggtatatttacaatattgacctcaaggacttctttccctcgatagataagagccgcgtctggaaacgccttacactgcccccatttaactttaactcagatatcgcccacaccatcgccggtctatgcactatgcgcatagtcgaagatggcaaagagcggttcgttcttcctcagggtgcgcccacttccccaatcctgactaacgccatttgtgacaccctggatagaagattaggcgcagttgccaaacggttcggcttgaggtacagccgatacgccgatgacataacatttagtagtatgcactatgtctacggcaaggattcagaatttatcaaggagctgcatcgtgttatcaagtctcaaaatttcaccatcaacgaatcaaaaacacgcctccaatccctggggtatcgccaggaagtgacaggcgtgattatctccgataagatcaatgtcgctaaaagatatacgcgtgagattaaaaccttgctacacatctgggacagatacgggtatatggctgcctgcgagtcttacaccaaaagtcatcatgtgaagaacgataactttaagagagtaggttacccaaagctggagagcgtgatcgctgggaagctccagtacatgaagatggtgaaaggagcagaagacgccgtataccaaaccttgcagaccaaatttagcactcttgtaaaagggattaagaagatcgagtttacaattgggggtcgggatatcgcctaccttcagaccatgacccgggaacagttcaggaaagagaagctggcggacattacaatagacgcaacgaataaagtggcttattatgagttcggagatcagaaacacaatattgtcattagccggtctatttctgaggacattctgagtcagctcgctacttcacctgcaaatgacgaatgttggaataaataccgaatctccctgtgtgagaacaacaatgtgcagttttatctgctccacaagtgcttcaaggagagaaagttccgggtgaggacggatatcaagctggaggacatagacaacatcttcacttacttagattcccctaacaatcgcaacgagaacaacaagatcacagacaaaaagtcctcgaatattttcgagagggtgattggatggctgcgtagatga

SEQ ID NO: 7306 - RNA, 1494 nt, unidentified
  source 1..1494: mol_type = other RNA; note = synthetic construct
atgatttcgacggatgagatcaaacacgatttcgcagcgatcgaggcccctaaagacttgttaaacctgttaaacaaggtgaaaagaagtgtgctgggcggcaaataccacccattctcctttgatcagctgttctactattcaaatccaagacgcgaggacgtcgtgagataccatagctttaccatcccaaagagaagcggaggaaccaggaccatttcatcacccgttgctggcctaaaatcaatcctgacaacgttgaacgatatcttccaggctatttaccgtccctccaagcaggcaatgggctttgccgccaaacggagcgtcgtcaccaacgctcagatacatgttgggcaacgctatattttcaacaccgatctgaaggacttctttactagtattaacaggtctagggtgtggcgccggttaacactaaagcctttttctctgtccgatgacattgctgatattgtcgccggcctttgcaccatgcgcgacagagacgcgaacggtcgggtacgatatgtgttgccccagggggcacccacgtctcctatcattacaaatatgatctgcgaccgcctcgatgctaagctagccagattggccaaaaggtttggactgcgatatagcagatatgccgacgacatcaccttcagtagcatgcacttcgtttacggcaaaggtggacgattcatctccgaactgcacgacatcatcaccgccgagggcttcgaaatcaatgatactaagacacgtctgcagcatctgggcataagacaaaaggtcacaggactggtggtcagtgaacgggtgaatgtgtccaaggagtacgctagggaactcaagctcttgattcatatttggcttcggtatgggtatcttcacgctctggacagctacacacaaaagcaccaacacacaaagggggggattgccaatctggaggccatcattaaggggaaacttaattacatgcggatggtgaaaggtgcaaacgacgctatggtacagcgcctgcaggccgcctttaacgaactgaaacacgattcaatcaggctggaacaccgctttgacagctggcttccaactcttacatttaatgccacttatactcgatcggagatagaggccttagagggtatcagcctcaaactgagagttgataccactaaggtgtgtgcttacctcgcaattgatggaaatgagtacccggtaactatcagtcgtcatatatcatccgcgacgaggctggaactcatgcactctgagtctaactctgcagtgtggcgaaaccatcggatttccatatgtagcaatgaggcaggctcctttatcctgctccataagaggctgcggaggtataagccgaaagccgaagctgaaaccgagtcttacaaggtgatcgacatagacacctttatagcgatgctcaatgcaactgagcaggatttccatctcgaaacattgtgcctcaacgcacctttctga

SEQ ID NO: 7307 - RNA, 1512 nt, unidentified
  source 1..1512: mol_type = other RNA; note = synthetic construct
atgaataggcaggagatccagcaggcggtggcggcaataaaatccacagaggacttcgtgctactcctcaataaagtcaagagagaagcccttgggggtaaagcctatgacttcaagctgaaacagattacctactactgtgacccgaagcgagaaaacatcgagaggtaccggcatttcaccatccctaaaaagggcggtggcgagcgccaaatatctgcacccgtacctccactgaagagcatactattctccctcaacaccatcctgcaggcaatatatgagccttcgagccacgtaatggggtttgtgcagggacgcagtgttgtcgacaacgcaaaaatgcacattgggcaaacctatgtgtacaatatcgacctcaaagactttttcccctctatagataagtctagggtgtggaagcggttgacattgcccccgatgaacctttccagtgatcttgctcatctcgtggccgggctttgcacaatgcggctggaagaaggtgagaacgttcgttacgtcctgccccagggagctccaacaagcccagttatcaccaacatgatttgcgataacctggacagacagttgctgaagttagccaaacgctttggcctgaggtacagcagatacgctgatgatattacattcagctcaatgcattacgtgtataacgaaaatggtgcttttgtgaaggctctgcgtcggatcattgagaaacagcggttcacgatcaatcccagaaaaacaaggttgcagcagcctaaccagcggcgagaagtgactggcctggtggtttcagataaggtaaacgttacccgccaatacacccgagaactgaaaactcttctccacatctggcaaacttacggatatatggacgctcgcgagtcatacaggcgagccagaatcaagtcgatgactgtatttgacaaaaaagagggctttgaccttgcagccgtcgtgtccggaaagctcttatacatgaaaatggtgaagggggaggatgatcccgtctatcgccgtctgtataagcagtatcgggatgtctacgtgaataagcagagcgaaatctacgaagctcaggcaacatacattgagtatattcagactatgaccaaggccgagttcgaagaaaaaatgcagacgcgcatcagtattaatctggacaagtccctcaattgggctgccacctacggggagggcgagtcaagaggaaggctcagattaagctccaagattaccaaagaagtcctggccgagctagcggccgatactacaggcgaaggcgcttggtctaagtattgcatcagtttgtgtaataacggcgcctctcagttctatatggtccacagaccattggtgccaaaacaatatacgactgccgttaggtttctgatggaagagctccaagccgagctggaggaaatcggaattgacaacctgctggaggagctggacgatttaaaggcaaatcctgagaagctgaatgtggtgaagaccctttga

SEQ ID NO: 7308 - RNA, 1512 nt, unidentified
  source 1..1512: mol_type = other RNA; note = synthetic construct
atgaatacccaggagattcgccagaccgtgaaggctatgaaatccacagaggaccttctgcatctacttaaccaggtcaagcaggatgccctcggagataagtcacatcccttccacctgaaacagattacatattactgcaaccccaaacgggagaacgtggttaggtatcgacacttcacaatccccaaaaaagggggcggagagcggcagatttccgctccagtcaatgggctgaaaagcatcctgtttagcctgaacaccatcttacaggccatttacgaacccagttcctacgccatgggctttgttgcaggaagatctgttgtgaacaatgctaaaatgcacatcggtcagcgctacgtgtataacattgacctgaaggactttttccctagtatcgacaagtctagagtttggaagagactaactctcccaccgatgaacttgtcaagcgacctggcacacctggtggccggtttatgtaccatgcgtcttgaagagggtgaaaacgtcagatatgtgctccctcaaggcgcacccacgtctcctgtgattaccaatatgatttgtgatagcctcgaccgtcagttggcaaagttggccaaacgatttggactccggtactccaggtatgctgacgatataacgttcagcagcatgcattatgtctactcggagaacggcgccttcgtgcaggccctgaataaaatcatcgagaagcaacactttaccatcaatccaaggaagacaaggttgcagcaacccaaccaacgccgggaagtgaccgggctcgttgtatcgaacaaggtgaatgtcactcggcaatacactcgtgagctgaagactattttgcacatctgggagaagtacggctatatggcagcgagagagagttatcgaagggcacgcatcaaatccatgacgttcttcgataagaaggacgggtttgatctcgctccggtcgtgcttggcaagctactgtacatgaagatggtgaaaggggagaacgacagtgtgtacaagaggcttatgggacaatatcgggatctcacaaaggcggacaatggggtaacctatcaagcaaaacataccaagctgacttacctgcagacaatggctaaggcggagttcgagagacagctgctcacatctctgatgatagatgtcgaagccccaaagctgcgcaaggtgtacttcgcggaaggcgaatccaacaggtacttgcgcactagcggcaaaatcactgatgaagtgcttgctgagttagccgccgatgtagaaggcgtagggatatggtcaaaatacagaatctctttgtgcgacaatggacattcacagttttacatgctccacaaaaaactggtcgaggtgcagtatacagaagctgttctgcttcagctggaagagctgcaggccgaactcgaagagattggtatagacaatctgatggccgagtttgccaatttccaggctcaccctgaacagtatgaggtcctgttaaccctatga

SEQ ID NO: 7309 - RNA, 1611 nt, unidentified
  source 1..1611: mol_type = other RNA; note = synthetic construct
atgggcagagaacagattcgaactgccgctttggaaatcaagaatattaaggacttgcggcgcgttctgaacttggtgaagcgtgacgctcttggagataaagctcaccccttccaccttaagcagatcacatattattcaaatccgcgtcgagccgaagtggttagatacaaagactttactattcccaagaaatgtgggggcgtccggaatattagtgcgcctgtagcaggactgaagtcaatactcacctccctcaataccatcctccaggcaatctacgagcctagcaaatacgctatgggatttgtgccaggacggtccgtggtggataacgccaagatacaccttggtcagaactacatatacaacatcgacctacaggacttttttcccagcatcgataagagccgcgtgtggaaacgcctgacacttccgccattcaattttaccagtgagctggccgatgtgatagccgggttatgtgcaatgagaatggagatcgagggcaatggctctaggtgcgttctgcctcaaggcgcccccacatctcccactctcactaatataatctgcgaaaagctcgataggcagttgggagggctggcaaagaggttcggcgctcgctactctagatatgcggatgacatcacgttcagttcgatgcagtacatctacgccgccgatggggagttcatggcagaacttcatcacattatcgccacgaaccgctttactatcaacgaaaaaaagaccagactacagaagaaaggcgagagacaagaagtgaccggcctggttctgagcgacaaggtaaacgtgatgaggcgatatgctagagagctccgaacactgctgcatatttgggagaaatacggacatctggctgcttgtgagagttacatgaaggtcaggaaagccaacccagtgtatcgccacaaaggtggtatgcctactttagacgccgtcctcatgggcaaactgcagtaccttaagatggtgaaaggggaagaagataccacctacaaggccctctacgcaagattctgtaaactgacaaataaggcaccccaaggagtaaaatatccaactccctactcatcccatattgtctatctgcatacaatgtcacggtccgaattcgaagaggcgctcaggacgaccattaaatatcgggaagacaaggagccaaagctgtattttgtaataggggacgtggagcggcccatcacatggtcccactctgtgccgattggccagctgctagagaacagcgaggacgggtataagctgtggggtaagtaccaaatttctctgtgcgacaatggtaccacccaattctatatgttacacaagcggcttgtcgctccaccatatacaaacgatgggcgtaaactcaccgaaaggttgcagaaggagctagcagcgttagtcgacagcgatatcttcactcaggtcttgggcgttgatgaggaacctatgtgccctaaaatcgatccctccgagggagagcagctggctttgaaaaatgagaagtggaacgacgccctggatattatggccaggctggaggacatggacattcctgagcctccagaagtgaccctctga

SEQ ID NO: 7310 - RNA, 1377 nt, unidentified
  source 1..1377: mol_type = other RNA; note = synthetic construct
atgcgggacattagggatctgaggagtctgctcaatcgtgtcaaaagggatgccctgggcgacaacgctcacccattccatctgcggcagatcacatactactcagaccctcggagaactgacgtggtgcggtataagtcattcgccatacctaaaaagagtggaggggtgcgcgcaatctcagctcccgttgccggactaaagtctatactcacaagcctgaatactatcctgcaagccgcatacgagcccacccggtacgctatgggatttgtggaagggagatccgtagtggataatgccagagtccacctcggccagaactatgtatttaacatcgacctcgaggatttcttcccctctatcgacaagagtcgtgtttggaggaggctgactctgccgccatttaacttcagcgtcgaacttgcagacgttgtggcagggctctgcacaatgagagttgaggcagagtgtgaaggcgataagcctagatacgtcctccctcaaggggcgccaaccagtcccacgatctcaaatattatctgcgagtctctggaccgtcagttggccggcttggccaagcggtttggcgccaaatattcgcgctatgctgacgacatcacctttagcagcatgacatacatatattctgctgagggagaattcgtcgcggaacttcgaagaattatcgctgcaaaccgctttaccatcaatgaaaagaaaacccgactgcagaaggtgggtcagcaccaggaggtgacgggactggtgctttccgataaggtgaacgtggcccgcaattacacgagggagcttcgaaccctcttacatatttgggataagcatgggtttatgaatgctacagtatgtttgatgcgagctcgggacaagaaccccgtccaccgacacaaatggggaaaaccatcgctggaggcagttgtgggcggaaaacttaactatctgaaaatggtgaagggcgaaaaagattccacttataggaacttgtacgagatcttcgaaagatgctactctagagataaaaggtactttgcccgcgaggatactaaggtcggcggtctaaagttcctgataaccatggacgtgtttacatttatggcgaccatgaatattctgctggagtacaataaaggcgggtcccccgaggttttctttaggtggggcgactataagtgtccgatttccgtaagccgcatggtgcctgtcgccaaattatttgaaaatgccggggaaggtatttgtaagatgaacaacttcgaattgtccctgtgcgatgatggttctactcgcttcttcctcctacatagacggctcccaattagcagctggatgaaattcaagttagtggacgagttgtga

SEQ ID NO: 7311 - RNA, 1590 nt, unidentified
  source 1..1590: mol_type = other RNA; note = synthetic construct
atggaaagaacagaaatacggacgacagcattggcaatgaaaaacattaaagaccttcggagacttctaaatcaggtaaaacaggatgctttaggcgacaagtttagaccttttcaccttaatcagatcacttaccactgtaacccaaaacgcgctacccatcagcgttataagaatttcaccattcccaagaaatctggcggagaacgagtgattagcgctcccgtggcagggctcaagagcatcctcttcagcctgaatacaatcttgcaagctatctacgagccttctaaatacgccatgggattcgtgcagggaaggtcggtagtggataatgccaagctgcacctggggcagaactacatctacaatctggacctcaaggatttttttccctccatcgataaatccaggctgtggaaacgtttaaccttaccaccctttaacttcccaagtgagctctctgacgtgatcgctgggctgtgcaccatgagactggaagaggacggtaaggagacgcgatatgtgttgcctcagggggcacctacatctccaacaatcactaacattatctgcgaaaagctagaccgacagcttggtggtctggccaagagattcggcgccaaatactctcgatacgccgatgacattaccttctcctccatgaactacatatattcaaacgagggggaatttatcaaggagctgcatcgcattatagccgacaatcacttcactatcaacgaaaagaagacccgcctgcagaaagtgggcgaaaggcaggaagtaactggactcattctctcggacaaggttaatgtcgtccggacttacaccagagaggttcgcaccctgttgcacatctgggagaagttcggccacatggccgcctgcgaatcatacatgcgggccagaaagctgaacccgacacataggcataaaggaggaatgcctagtttggatgcggttctcatgggcaaactgcaatatctcaagatggtgaagggagctgaggacgccacttataaagctcttaacagccgttttgccaaactgcaaggccaggagttggccccgattaagtacgcaaaaaaaccactcgcttatgtccacactatgaatcgggaggagttcgaagagactctgtcttcccaaatagaatataaccccgagacaacccccgccctgttcttcaaggtgggcgatgacatcaggcctataacggtcagtcaaaccgtgcccgtgaaagaactatttgcgaaaggggacgaggcggccgaactctggaggaagtatcagattagcctttgtgataacggtatctcattgttttacatgctgcacaagaagctggttgccccgcagcatacaaaagctggcaagcgcaaaaccgttgagcttcaggaggaactatccgcactggtcgaatcagatatatttagccaggtcctgaatgaggataaggtagacgggaagaactataaggtggtcagtatggaggacattgcaagcgatcgcgtggagatcgctaatcgggagaggctcattgcgctgatggaggcagacattcctgagccagataatttatga

SEQ ID NO: 7312 - RNA, 1557 nt, unidentified
  source 1..1557: mol_type = other RNA; note = synthetic construct
atgcgagacgtcagggatcttcggttgctgctcaatcgcgctaaaagaggtgccctcggcgcaaaggcgtacccaattcacctgcgccagatcacttactatgccgatccgcgacgcgaagatgttctgaggtacagaaactttcccattccaaagaaatcagggggcgagagactcatttcactgcccgtcgacggactgaaatccatcctgcgcgcccttaatacactgctccaggcactttatcagccaactgcttatgcaatgggatttgtccaagggcgttcagtggtggacaacgcacgggtgcacctcgggcaaaactacgtctataacatcgacctcaaagactttttcacctctatcgataagtctcgcgtctggcgacgtcttactctgcccccctacaacttgcctagccagctagccgatatcgtggctgggctgtgcactatgcgactcgaggagggcgataaagtgagatatgtcctgccacaaggtgcacccacaagtcctaccctgacgaacatcatttgcgagaagttggaccggcagttagccggtttggctcggaggttcgggcttaggtacacaaggtacgcggacgatattacctttagttccatgcattacgtgtactctagtgacggcgaattcgtgacctccctaaggcagatcattgagcagaatcacttcgtgataaacgagacaaagagcagattacagtaccgcggcgagagacaagaggttacaggaatcgtattatccgacagactgaacgtcgctcggcagtatactcgcgaacttcgaaccctgctacacatatggcagaggtatggatacctcgctgctcgtgaatcctatctgaatcatcacgcagagggctctaaatgccgactatgtattcgggacacacgcttagaaagtagcatcatgggcaaactccagtatctgcggatggtaaaaggtgaaacggatgccctttatatgcggctgaagcagaggtttgacgaactgatgaaggagaagggatcagccgtaaaatacgccaagtatggagaattcagctacctctataccgtggatgtgcccttgttcgaatctacttttaacacccgtatttgttacaacgcggagtctgatgtgaagttgtactttgttgacgggggggtgatcaagccaatcgcgcttagcagtaggctggacgcaggaaagctgttcgcctcggacaatgatgagaataggtggcatggcttgcagattagcctgtgtgaaagccattctacgcaattttacatgctgcatagacggctggtgaatccgctcttcagtaagcctcgccacaaaaagaggtcgagccctatggatgagtatgttgagttgttcaactccaatgccaattccgctctgatcgacgagttcttctttagaaattacggtcggagaatgacaatcgatgatttaggcgacgttgtggcccagtcagacgagagcggcgcaatatccgaactggcccacatactggatgctgacattaccgtactcgcccctaaatga

SEQ ID NO: 7313 - RNA, 1422 nt, unidentified
  source 1..1422: mol_type = other RNA; note = synthetic construct
atggagcgtgaagtgctcataatgcgcgtggagagaatgaaggataaagaagatctgttggcgctcttaaatgacgttaaagctgacgagctgggcgataaatcataccctttcaccatgaagcagatcaatttctattgtaatcctacctctgtacccaactctaaacgctacaacgatttctttattgcgaaaaaaagcggtggtatgcggcatatcagtgcccccgtcaacgggcttaagagcatccagacttacctcaatataattttccaggccatttacgaaccaagtcagtgggctatgggctttgcccaacatcgatctgttgtgaataacgctcaaatgcacattgggcaaaattatgtcttcaatctcgatatcaaggacttttttccctccattccgcaggcacgcatttggggtaggctccaggtaaagccatttaattttaacaagcagctggctaacgtgatcgccggactatgttgtatgaaggtggtgactgaagagtcagagaggtatattcttcctcagggggcacctacttcacccttactaacaaacgcaatctgcgataagctggacttcaaattgtccaggctggcacagcggtacggcctcaattatagcagatatgccgatgacataacattctcttcaatgcataacgtgtaccagaaagaaagcagattcctgaggaccctgttccaaatcattcaggaacaggggttttgcatcaatgaggctaagactagactccagaagcgtggaagcagacaggaagtgaccggattaattgtctctaataaggtcaacgtgacgcgcaaatatacagaggacatccggaatatactgtacatctggcaacgatacggactgaccgtcgcctaccaaaagttttccaagtactataagaaggagaaaggccacgttaagcagggagaaccaacaatggaaaacgtgctggccggcaaacttgactacctgaaaatggttaagggagagagcgattcaacctatctaaaattgaaaggcacttacgacactttgatgaatcacattcttgaaggcgccgatgggagtattaaatatattgacacccactccatctccgattttgagaagaaccttaaaacgaagatcgagatcaaaaagtctaagaagggcaagcagttcgcaagtttcatcctcgacggcgatgagaaaattgtaagcatatccaaaaacgccgaggacatcacacgcgacaagctgtttatcagcctgtgcgaggataacgagaagaagcgattctattttatacaccggcagatgtggaaaagggggctcgaaacaaagcggaccgaggagaatagtttggacttggacgaaatccttgctcagctgtgcaactccaacttcgacctgtcgctgctgtga

SEQ ID NO: 7314 - RNA, 1422 nt, unidentified
  source 1..1422: mol_type = other RNA; note = synthetic construct
atggacagggagaagatcaaactgagagtcgagcatatgaaggacaagacagacctcctggccttacttaatgacattaaggccgacgagttgggcgatagggggttccccttcacaatgaagcagattaatttctattgcaaccccttttccataccgaactcaaaacgataccatgacttctttattgcgaagaagtctggtggggctcgccacatttcagctcccgttaacgggctgaaaagcattcagacttatctgaacatcatctttcaggctatttatgagccatcccggtgggccatggggttcgcacagaataggagcgtggtggataatgcacaaatgcatatcgcccaaaactacgtcttcaatatggatctgaaagatttcttccctagtatcccacaggcccgcgtgtggggaagattgaaagtcccaccttttaactttaaccccgaattagccagcgtaatagcaggattgtgttgtatgaagcttgtcaacgaggacagcgagaagtatatcctccctcaaggcgcaccaacatcccccctgctgacaaacgccatttgtgacaagctcgattacaaactcgctaagcttgccagtcactacggcctgatctactctcgctatgccgacgatatcaccttttccagcatgcataacgtctatcagaaggactctaggtttatgaagaccctcttcaaaataatccaagagcaaggcttccaagttaatgaggtaaaaacccggttgcagaaaaaaggttcaagacaggaggtcacaggactcatcgtgagtgacaaagttaatgtgacccgcaagtacgtagaagatatacgtaacatcctgtacatatggcagaagtatgggctgactactgcatatcagcggtttattgttcactaccagctggagaaaggccatattaagaaaggcgcaccgcacctggagaatgtgatcgcgggcaagctggattaccttaagatggtgaaaggtgaagacgactctacctacgtgaagctgagaaaactatacaatgtattgatgggcgtgcctctgtacggtaattcagaaacagctatcaagtatttggatacccagcgtattactgatttcgaaaagcgaattgggaccaaagtggagatgaagttatccaagaatggaaagaaatacgcgtccttcctaatcgatggagaaaaacaggtcgccaccatctcgaagaacagcgaaaagcttgaatttacgaacctcgtgataagtctgtgcgaaaatcagcagaaagagcggttttatttcgttcacagaccttttggaaaagacgtggatgtgaaaaagaagaagcactctagcatgacgctcgatgagattctcgctaaactatgcgaaactaacttcgacctttcgtatctgtga

SEQ ID NO: 7315 - RNA, 1149 nt, unidentified
  source 1..1149: mol_type = other RNA; note = synthetic construct
atggacaaggaacgtataatcgaaaccctgaatacccatgactgcaagacagcattgcttaccctgctgaacgacgcaaagcaggaatatttgggcgataaggcgtacccatttgagttacggcagattaccttctatagcaaccctgcaagcgatgtgaagaggtacaaagatttcgagattcctaaaaaaagcggtggcactaggaagatctcggctccagtcgaaggcctgaagatcatacttaagtgcatgaacatgattctccaggagatctatgagccatcaaagtacgccatgggatttgccaaaaataggtctgtcgtggacaatgctaagcggcacattaaccagaactatgttttcaacatcgacctaaaagatttcttcccttccattacaagagcacggatatgtgcgcgcctcaaggtcaagccctttgagtttagcgatgatatcgccagaatgatctctggtctatgtactatgaaagtgaccgacggcgagaatatcaagtacgttctgccccaaggagctccaacatccccgactctgactaacatcatttgtgacaaacttgaccataaactcgccgggcttgctaaacggtttggacttaactattcccgctacgccgatgatattaccttctcaagttctcataatgtgtatcaggaggaaagtgacttccgtaaagagctgcagagaataatcacggaggacggcttcgtgataaatgacaaaaaaacgaggctgcaaaaacgcggaggcagacaggaggtgacaggggttattgtatgcgaaaaggccaatgtcacaaaaaagtacgtcaaagagatccgaaatttgctgtacatttgggagagatacgggtacgatgaagccgtgaagcgctttcaccccaggtataaggccgaaaagggctacactaaaaaggggaaccccaacctcgatgctgtgctcggaggtaagttgctctatttgaaaatggtaaaaggggaaaacgacagcgtttacaagcgactgcagggtaagtatgatcacctcatggaggtgaagaatcctatcattaaccagacagacaatcaaaccaataatgaggcattaatctccgagctggaaaacctgttagacgaactgctgaagtga

SEQ ID NO: 7316 - RNA, 2370 nt, unidentified
  source 1..2370: mol_type = other RNA; note = synthetic construct
atgacacagagcgatattatatccttggtatcccagctggagacaaaagaagatttgcttgcccttttaaacaaacttaagttcgaggatctaggggagcgtagctttagtttcaacattaggcaactgaattactatgcaaacccaaaccataccaagggtagataccggtccttcgaggtgcccaaaaagaagaaaggagccatgcgcactatctccgctccctccaatggactgaagatgctactccgctatgtaaacgtcatcctgcaagctctgtaccggccgggggagaataccatgggcttcgtgcacggtaggtcggtgagggataacgcgtctcggcataatcaccaaaactacatcctgaacctggacctggctgacttcttcccttcaattagtcaggcaagagtctggaaacgattacaatgcccaccctacaatttggctaaaccaatcgcagacatcatcgctgggctgactgctgtgaaggaagtgaccacggatgagagtgggaatgagtgcgtgcggtatgtcctgcctcagggagcacccaccagtccagtgctgacaaatattatatgcgagaggctcgaccgcaggttacagggcgtgggcaaaagattcggcgccaattatacaaggtacgccgacgacatcactttttcttccatgcacaacatctatcagcaggacggagagttcatgcaggaagttatcagaatcattcaagatcaggggtttgctgtgaacaaggagaagaccaggttactcaaaaaaggaagtcgtcaggaagtgaccggtgtaatagtcggcgataaagtgaacgttggccgagattatatacgatctatcagatccctcctgcacatctgggaagcattcggctacacagccgcgtcagcaaaatttcgccagcagcacctcaaggataagaatggatacgttaaaggtgagcctgccatggaaagtgtgatcgcggggaaattgcagtatgtccgcatgctgaagggctatgatgaccctgtatatcagaggctgcggcagaaattagattggttgctcggaatgagcgaccctgaagcagcgattctgcagaacccggattacaaggttctggagactatgcctttgcccacctttgaagaacagaatgcctgtcaggtgcaattttctatgtcgcccaatgggaatagatatgcattttaccatcaacgggataaccggatgactgtctctgttagccatgatattacacagacagtgaaacccttcctagccatctcattatgtcagagaagggacggcagtaggtttcacttgatccataaaccaattccacaggtccccgtgcgacaagaacccgccgtaaaggaaattgagattaggcattggcaccaacccgctatggttacgggtttcctcagaagattcaccgagaaaggtgcactcaagtacaccacccatctttggactcctgccgaggatggcagctatcaatggcaggattttgaaacattctaccaaagctaccggaaggagctctatgagaagaaagacgatcagatcaacatcaacgatctgtatcactacgttcctaccctgaatgctctgatacgcaatttccttattgagtccaagtccccaagcctgtactggtctaaagaatacaagcttgcagtgtcctatggatctccaaaaggctttattgccgactggatgcgccagaccgggaagcagccgtttgagatgcccctcgccgaactccctaaggagtatgtgcctgccgcccccgttcaggggagaacacttgtctactttaacgacgtggtggggatctttaagaatgctattgagttccgcgatgaccagttctactacgccgtcaagggtattttcaagagcgtatatcatcacgtggaccagcagaaattgagcacactgcggggcctgtcattttacaccgacacgtttcaggtcaaaaaggctctgcgcctcattgccagcaatatggagagtagaacagagtatccggaagtggaaatctcagcccagtatatagatggagacgacaactcaccacgtcggctgcgagttactattctgcaacgtgactctttctcagataagtccatctacgatgacaagttgctgctccgacacggatctggccagatgggctctatcaagtcgctgctgcgcagcctatgcgacttttcagtcgagagcagatttagggctcacgacgatttccttcactaccggatagactacctgtacacgactgacgcggacgccccaccttgtcttgtgcagctcgacaagccaactgaagggttcaagtatatactcaccttcgcactatga

SEQ ID NO: 7317 - RNA, 1548 nt, unidentified
  source 1..1548: mol_type = other RNA; note = synthetic construct
atgacaaaggaggccatagtcaccgccgccagcaaagtgcagacaaccagggactttctcaacctgcttaacaagataaagatggacgacctgggtgataaaggccatccttttatcatgccacacttgaactactttatccatccagcccggaacaagaagtcatacaaggaattcagaattcctaagaagaccggtgggttccgcgtgattagcgcccctaaagctctgctgaagagctttttgacgtatacaaataaactgctccaggccttttacgacgctccagattatgtgacaggcttcgtccctgaaaaaagtgtagttgacaatgcagagaaacacattgggatgaattatgtctttaacactgacctccaggacttctttccgagcatctccaaatctcgtgtctgggctaccttaaaatttccaccgttcaatttcaatgacactgtcgccgatgcgatttccggcctttgctgtaccgaaatttatgtgaacggggaaacgcgtagagcactgccacagggcagtccttgttcccccatactgactaacattgtttgcaggaatttggatcggcgactacatcggctcgcaaaagagtataaccttaggttttctcgctatgctgatgatattacgttctcaagcaacagaaacgtgttccagaaagggtcagagttccggaataaactcgagggaattataacagagcagcactttatcttcaacgaaaagaagaccagattacagactaaatgtcagcgacaagaggtgacaggactaatcgtgtccgatcgcgtaaatgtcaccagggagtttgtacgcgaactagacaacctgctgttcatatgggaaaaatacggtgaggcagacgcttatgctaaatttctcctgcactacactcccaagcaaaacttccactcttacaagcccaatatgcaggctgtgatccaaggaaagctgctgtacatcaagatggtgaagggagccgataatgaagtttggaggcgtttacagagacgcttcaacaaactgtccggagcaaaaccctctacagtggaggccacactcaagtataagtacactattgcggacttcgagaagaagatcggccaggccctggattttgaactcaataaagacggcgtgatctactgcactttcagtttgaatgggaaaaagacttccgttgcactttctcattacgtccgaactcggatctcaaatattctggcaaagtctgataccgccgcccttgagaaatttaagacgagttacatgctcgtattctatgaacaagacaataccaacttctggagaatcgagcgcaaaaggacctgggtgaagaccaaccttgccgatctgatcgatacatcgtccttagcggaggcactgctgtcagcttctgctatctcggaaaagggcgacgagctgaccagcacacccatgaagagcaccgatgaggttctcgcggccctggtggatagcgactttgacttgaagatcttggatgaatgggacaaaattcggagttcctga

SEQ ID NO: 7318 - RNA, 1566 nt, unidentified
  source 1..1566: mol_type = other RNA; note = synthetic construct
atgaataaggaggccatcgtggaggaagcatctaagttggaatctactcatgatctcctaatactgctcaacaaaatcaagatggatgagctaggagataaggggtatccttttaccatgccacagctcaattattacataaaccccattaggaacaagaagagttatagaaacttccgaattccgaaaaaaagcgggggctatcgggaaatttctgcccctaaggccattcttaaaagcttgttgacctacactaacaagatcctgcaggcactgtacgaagctcccggtagtatcaccggatttgtgactggcaaatcagtcgtggataacgcggagaagcatataggccggaattacatttttaatatcgacctccaggacttctttccatccatttcaaagtcaagagtgtgggctactctgaaactgcccccctataaattcaacgatacaatcgctgatgccatcgccggcctgtgctgcaccgagatcgttatagatggggaaaccaggagggcactcccacagggaagcccatgcagcccgatactgactaatattgtgtgcaggaatttagaccggcagcttaacaaactggctaagaaatacaaccttacgtattcccgctacgccgatgatattactttcagttcaaaccacaacgtataccaaaaagacagcgagttccggcaggagttggatgatattatcaagaagcagaacttcagcatcaactccaaaaagactcgtctccagcaaaagaatcatagacaagaggtcactggccttgtggtttctgacagagtgaatgtgaccaaagactacgtccgcgacattgataatattctttatatctgggaccactacagtgaggacgatgcatatgcccgatttctgacacactatagtcccaaacacaatctcaagcaccggatcccaaatttgtcctcgataattcagggcaggttaaactatttgaaaatggtcaagggtgcagacaatgaagtctggagacgcctacaacgaaagttcaataaattaacgggtaccaacaagtcttccaatgacgaaaacgcgaacatcaagtacatctatagcattcctgacttcgaaaagaaagtggagacacagataatcgttacgctgggatcaaacgacaatgtctactgttacttcaccatcaacaattacaagacctccgtaaacctctctaagtacgtgaaaacacgcctgaaaaacatcgttagcgaaaacaatcaggacctgcttaagcgttttatggccaactgtatcctcatcttctatgagaaagaggggagctgttactggaaaatagagagaaggcgcaaacattccatgatttcagaccctaaagactttgatctgaatctgctgctcctgaagattgaggaggtgacactggaacctaagaagtcatccattgctcagacagacaatacctctacctccaagagcacaacagatgagatcctggatgaactggtagactctgggtttgacttaaatatcctggataagtgggacaaaatcaagagttcgtga

SEQ ID NO: 7319 - RNA, 1548 nt, unidentified
  source 1..1548: mol_type = other RNA; note = synthetic construct
atgacgaaggaagccattgtggctgcggccgctaaggtgaagtctacgcacgaccttctgattctcctaaacaagatcaagatggacgatctcggcggtaagggatatccctttatcatgccgcacttaaattatttcatccacccggcccgaaataagaagtcctataaagagttccggatcccaaagaaatctggaggcttccgagtaatttctgcccccaaaaacatgctgaaatcattcctgacctacactaacaagctcttgcaggccttttacgaggggccagaatacgtgacagggttcgtgcccgaaaagtcagtcgtcgataacgcggagcgccatgtgggcatgaattatgtcttcaataccgatctcaaagacttttttccttccatcactaagtccagagtttgggctacactgaagaggccaccctttaactttaatgatacagtagccgatgctatcgccgggatttgttgcacagaaatggttatagatggagaaacacgctgggtgttgcctcagggtagtccagccagccctatactgaccaacatcgtgtgccggaatttggatcggatgttgcacaagctagccaagaaatataaccttaggtacagcagatatgcagacgacataacctttagttccaaccgtaacgttttccacaaaaatggggacttccagaaagaactgataaagattatctcatcgcaaaacttcagcatcaatgagaaaaagacccgggtccagaataagaatcagagacacgaagtgactggcctggtggtgtcagatagggtcaatgtcactcgagagtacgtgcgtggtttagacaacctgctgtacatctgggaaaagcatggcgaagctgacgcttacgcaaaatttctggcacattatactccaaaacagaatctgcatccccataagcctaatatgcgcgtggtaatccaggggaagcttctctacctcaaaatggttaagggcgccgacaatgaggtttggagacggttgcaaagacggttcaacaaattaagcggagcgaaaccctctaccgtcgaggccactctgaaatataagtacaccatcgctgattttgaaaaaaagattggacagacacttgcttttgaacctaacatcgacggggtcattttctgtagctttaatctgaacggcaagaagacctctgtgacactgagtcaatatgtccgcactaggctctcaaacatattggtgaaaaacgacgccgctgcacttgagaaattcaagacgagctacatgctcgtgttctacgagcacgacaattccggcttctggaggatcgagagaaaaaggacctgggtgaaaacaaaccttgctgatctgattgataccagtagtctggttgaggcgccactaagcgcagcagccattcctgaggagcgcgaggagagcacaaacaccgcaggaaaatccacggatgaagtattagccgcactggtggagtctgactttgatctcaagactctggacgagtgggacaaaattaagtccaactga

SEQ ID NO: 7320 - RNA, 1365 nt, unidentified
  source 1..1365: mol_type = other RNA; note = synthetic construct
atgaccaaagaggctatcatcgcggctgcgaaagatatcaagactacacatgacctcttgaagctgttgaataacattaagatgtccgaactaggcgataaagggtaccctttcatcatgccgcatttaaattacttcattcacccagctcgtaataaaaactcgtacaagacctttagcattccaaagaaatctgggggcgaacgcacgatctctgcaccaacccgactcctgaagtcattcttaacattcaccaaccgactgctccaggccttttatgaagcacctgactatgtgaccggcttcgttcccgagaagtccgttgtggacaacgccgagcgccacattggtatgaactacgttttcaacactgatctaaaagacttctttcccagtataaccaaatctagagtgtgggccacgctgaagcatcaacctttcaactttaatgacacgatcgctgatgccattgctggactctgctgtacagaaatggaaataggaggtaagagccagtgggtgttgccccaagggagtccctgctcacccgtgctgaccaatatagtatgcaggactctggatcacaagctgcacaagttagccaaaaagtttaatctgcggtattcccggtacgccgacgacatcactttcagtggcaatcgcaacgtgttccataaagacggtgagttcattaaaaagctgaaccgggtcatcgcacagcagaactttactgtgaatgaaaagaaaacccgtatccagaataaaaatcagagacaggaggtgacaggcctagtggtgagcgatagagtgaatgtcaccagggagtatgtcagatccttggacaacctcctttatatatgggaaaagcatggagaatctgaggcatacactaaatttattgtccactacatccctaaacagaacccgtacaaagagcggccaaatatgagaagcgtcatcctcggcaaacttcaatacctgaaaatggtaaagggttccgataacgaggtctggaggcgccttcaatcacgctttaatcagctgtccggcgttacccctagcattgaatctgccgtgattaagtatctttacaaggtgtcagatttcgagaagaagattgggcagaagctgaaattcgaaatctttgacaagaaagtcgtacgttgtttttttcccttgaacaatcagcacacagatgtaatgctgagtcgatatgcccggacaaggtttagcaacctcatagtgcaggatgactttgttaagcttgagcaaatcaaaagtagctacatgctgatcttctatgagcagggagggtctggattctggaggattgagagaaagaggcggcagaagctgaagacatga

SEQ ID NO: 7321 - RNA, 1581 nt, unidentified
  source 1..1581: mol_type = other RNA; note = synthetic construct
atgacagacaaggcaatcgtggccgcagcctctaagctggaatccaccttcgatctcttgaccctgctgaataagattaaagaagatgagctgggtgataaggcttatccctttaagatggaccacttaaattacttcatcaaccctaaacgaaaccgtgccagttatcgaactttcaccattcccaagaagagcggaggcgtacgcacgatctcagctccggtgaaattacttaagtccttcctgacctacacaaatattctgttgcgagcattttacgaagcaccagactgcgtgactggcttcgtcccagcgaagtcagtcgtggataacgcagagaagcacgtgggtatgaattacgtgttcaataccgatctgaaagattttttccccagcatctctaaaagtcgggtctgggccactctgaaaacaaggcctttttgttttaacgacaccgtggccgatgctatcgccggtctatgctgtacctatgtgaacgagaagggagaagaggataacatcgctctgccccagggatctccttgctcacctattctgacgaacatcgtgtgtcataacctcgactggaagttgtccgggctagcccgccggtttgggctcaattattccaggtatgcggacgacattaccttctcctcaatgcataacgtgtatcaggaaggaggtgaatttatggcagagcttagacggatcattgagggccagcactttcgtataaacgaaaaaaagacaaggctacagaagaaaggagagagacaggaggtgactggccttgttgtctcagaccgggtgaatgtggcaagggagtacgtgcgcgatctcgacaatcttctgtacatatggaaaaagcatggaagagccgccgcgtttgccaaattcagtggccgatatattccgaaacaagatctcaaggcccccgcattcgacatggatcgggtcgttgccggaagactggcctacttaaggatggtgaaaggtgaagagtctcaagtatggcgccgcttgcagaagcgctataacactctgagcggcaaaaaggagaaaaccgttggaaccgacataaaatacctgaacttctacacgatcgaaaatttcagcgctgctactgggttagagctccacttggtcatggacacaataagtattccccgtgaaacacctgaagaggcgggggtcatgcgggttccagtagcctatttcatgtccggcgacaggagaatagacgtagagctcagccactatatgcagaccagacttagaaacatcctggagtcaggggacggcaaagctctggctgagttcaaacataagtacattatcgcatactgccacagttcgactgggtacttttggatgattatcaggtctatgccaaagatggggaacaatgctgacgtttcggaaaagggcgctggcttcatcctcagcgacttgttttgttccgagggggaaagcgttctgagcgacgataagtctacagatcagatcctttcccaactggtcgcctctaattttgatctgaagattctcgatcagtgggataaaatcaagaatagctga

SEQ ID NO: 7322 - RNA, 1464 nt, unidentified
  source 1..1464: mol_type = other RNA; note = synthetic construct
atgactgataccgcaatacggcaggccgcttccctgatggaatgccagagtgacttactgtcgcttctgaatcacatcaaagtggatgaactcggcggaaaagctttcccttttacacacgatcaactctaccacttctgctctccacgaagaaatcgaaagcattaccatacattcaccatccctaagaagtctgggggagttcgcacaatctccgcacccaccaaaatgctcaaaagtttgttgcgttgcaccaacacattactgaaggcattctatgatgctcccgaggatgtgacgggttttgtgcgcgaacgttcaattgtggataacgcaagggcgcacgccgggatgaactatgtctttaatacggacctgaaggacttctttccgagcatttccaaatcgcgcgtgtgggcaaccttgaagacctctccctttaactttaatgaccgcattgccgatgcagtcgccgggctgtgttgcacgtgtctcaacggggaagacgagcctgaacggattgcgcttcctcaaggctctcccgcttcccccgtgttaactaacatcgtctgccgcaacctcgatagaagattgcgcgggcttgcacgacggttcggccttcactatacccgctacgctgacgacataacattctcaagtatgcacaatgtctatcaggagggtggggagtttatggccgaactcagaaggattgtgctaggacagcactttgaactaaatgagaagaaaactcgcctccaggtaaggtccgcccgacaggaggtcacagggcttgtggtaaacgacaaggtgaatatcagccgggcttatatccgggatctggacaacctcctgtacatatggcagagacatgggcgatccgccgcctttctgaagtttgtgggccgctacgtaccaaagggagtttggttcggacaggcccacaatatggagcgggttgttgccggccgtctggcctacatcagaatggtcaaaggtgagtgtcgggcgtggagaagattgcaggaccggttcgacaggctgatagccaggggcaaccatccagtgggcagcggaggtaaggatttcatttacaccagtttctacactcttgacaatttcatgaagttttctggattagagctgcaattcatcctggaggacggccgtccaaaagtcttctttgttaaggatggcgtgaggactgacatcactctgagccattatgtaaggaccaggttgagaaatatccttcaatcaggtagcaaggaagaactgaggaaattcacagccaggtacataattgctcattgtgcttttacctatatgagcgatgctgagggactcttctggctgatcattagaagcgtgccgcggaagaaaatcgcgtcactgggcaacaaagacctggcagagctgattactgacctatctctggaaaaagtggaggatgaggccctctga

SEQ ID NO: 7323 - RNA, 1671 nt, unidentified
  source 1..1671: mol_type = other RNA; note = synthetic construct
atgaaccgggacgccatcatcaaagccgcttctcaaatggagacacttgaggacctgcgccgtctgctcaatgagatcaaagaggacgagttcggcgataaagcataccctttcagtgagcggcagttaaagtattacattaaccctaagcgcaataagcagtcctaccgccaatttaccatacctaagaaatctggaggagtcagggccatctctgcccctattcgtattctgaagtcactgcagctctgtacaaacaggattcttcaggctttttatgaagcacctgactatgtcaccgggtttgttcctgctcgatccgtcgtcgacaacgctgaaagacacctcggcatgaactatgtcttcaataccgatttgaaagactttttcccatccatctcaaaaagtcgagtttgggccacactgaagacgcggcccttctctttcaatgataccattgcagatgctatcgctggcctatgctgcaccgagttagaactagacggcgaaactcgcgtggcattgccccaaggttccccgtgctcaccagtccttaccaacatcgtttgccacaatctcgattggaaactgaacggactcgctaggcggttccacctccgatattccagatacgcggatgacatcacgttttcaagcaatcataatgtctaccagcccgagggggagttcatgattgaattgcgccgaatcgtaaacgaccagaggctcaccatcaatgaaaagaagatgcgggtacagaagaaggggcagagacaggaggtgacgggcctcgtggtgagcgatcgagtgaacgtcacacgggagtacgtgaggagtctggactctctgctctttatatgggaaaaacatggagaagatgtggccttttcgaatttcctgaagcactatgtgccaaagcataatcggagattccgctcccccgacatgagcaaggtaattctgggtaaattgatgtacctgaagatggtgaaaggagaggatagcccggtatggcaacggttgcaggtgtgttacgagaaccttgcccatagggagccagctgccagctcagacatacagtatctgcactcctttgcgatcgatgtcttcgagaaagggtccggagtgcagttaactttcagtatgaccgatggtaagctgaaatgtctaatggagtataagggcagagaaattagagtgtgcctgtctcagtatgtgcagaagaggttagcgccaatagtggaatcaaacaatctagaggccctcgaaaagctgaagaaacagctgcacattgggtactgtatggccagtcttcttgagacttctgtcgtaaaccatttttggctgctttacaggaaaagacccgttgtgaaggatctccccattactttgaccgaagaaaaagagattcaatcacacatcgaacgttacctgaaggagtctgcaggtgtgcgcaaagcatccgacagaaacattaatgcaggcgagagcatgaaagaatccgtgtcggttacaagcgagatcgggacagaagaaaaaaaagttaaagccgaaagcgaggccgacagcaagactggcaagactatcgacgaggtgttggacgttctggtgagcaagaactttcgcgatctgagtatactggataagtgggacaagatcaagacaaattga

SEQ ID NO: 7324 - RNA, 1554 nt, unidentified
  source 1..1554: mol_type = other RNA; note = synthetic construct
atgacgcgcgaagcgatagtgcacgctgcgtctaagttagaaactacccatgacctcttggtgttactgaatagaatcaagatggatgagctcggcgacaaagggcaccccttcaccatgccacagttgaattactttatcaatcctaagaggaacagcagtcactacaagaccttctatattccgaaaaagtccggcggacagcgagagatctctgcacctacccacatcctgaaaagcctgcagacctatatgaacaggatcctgcaagcattctacgaggctccagagtacgtgactgggtttgtaccaagtaagtctatcgtagacaatgctgagcgccacattggaatgcgttacattttcaattccgatctgaaggattttttcccttcaataccacaggctagggtgtggggaacgctacagacacgcccgttcagtttttcgaaggaaatagcttccgcgattgccggcctttgctgtgttgaggcgcgggatgaaaatggcaagctaatccatgtcttgcctcagggctctccctgtagcccaactctgaccaacatcgtctgccataacctggactggaaacttaacggcttggccaagaggtttcatctgaaatacagccgatacgcagatgacattacattttcctccgatcattatgtgtaccaggatgatggcgagttctttcgggaattccgcagaattgtggccgagcaacactttaagctcaatgaaaaaaagacccggacacagaaacgaggagagcgacaggaggttaccggtctggtcgtcagcgatcgcgctaatgtcgcaagagagtatgtgagagatcttgataacctgctgtacatctgggagaagcatggtcacaatgcagccttcgccaaattcatagccagatatactcccaagcaggacctcaagcaatcctcacccgacatgaagtcagttatcatgggacggctgatgtatttacggatggtgaaaggagaggactctttggtttggcgtcggcttcaaaaaaggtttaatcgtctggctgataagaaggaaagctgtggtgggactaacatccagtatctccatgcctacccaatagaggccttcgaaaaagctgtaggcactgacgtgtcctttacactcgaagacgacttcgtgagatgcagctttacgctcaacgggtcagcccacagcgcaagactgggcaagtatgccaagaccaggatccggagcattctggagagtgggaacgaagacgccatgctgaaattcaaggagaaatttcacattgggttctgccatatggatggtacacctgaggaagaccacttttggcttatcttcaggcgccctcccagggccaaagggcttgagatcaccgacgtggatgaaattctaagtctcactgactacgtcggattacccgagaacggcgaaacagattcagctgactccttgacaacagatgcaactctcgaagccctggtttcttctgacttcgacctgaacaccctggacaagtgggataaaattaaatcgaactga

SEQ ID NO: 7325 - RNA, 1083 nt, unidentified
  source 1..1083: mol_type = other RNA; note = synthetic construct
atgactaatctggagattgcacatgccgctagcagggttgccaaccttcccggcctgctggctttactcaatcggatcaaagaagacgagttcggcaatcgggtataccccttcaccttgcaggagctgaactactacatcaatcctaaacggagccggtcggggtaccggatattttctatcccgaaaaagaatggtggggatagaaccatcgcgagtccagtgaaaattctgaagagctttcagatctgtgtcaatagattactgcaggctctgtacgaggtgccagaatgcgtctgcggattcgtgcctggacgcagtgttgctgataacgcagccaggcatacaggaatgaggttcgtgtttaacgctgatctgcaggatttctttaccagcattccacaagcaagggtgtggggcgcccttaagacccgacccttttcattccctcccgtaattgcctccgcgttagccgggctctgctgtatggaagtcgatggagctgacggaccccgatatgtgctgccacaaggcggcccagcctctcctgtgatcacaaacatcgtgtgtcacaacctagattggaagttgtccggtttggcacggcgatttcatcttcactactcacgctacgctgacgacataacattttcaggggaccacttcgtgtatgaagaaggcggtgtttttctgaccgagtttcgtcgcattgtagccgagcagaattttaggctcaacgataaaaagactcgcctgaataggcgtggcgagcgacaggaagtcacaggcctggttgtcagtgatagagtcaacgtccctagggaatatgtgagagacttggacaacctcctcttcatttgggagcgctatgggagagacgccgcctatgcgaaattcctatctagatatactccgaaaaaggggcgcatggttaagaagcccgatatggaggccgtggtgcgtggtagaattagctatcttaagatggtgaagggcgcagactcccctgtatggaaaagactgaggaagcggttcgacatcctcataggacgcgcatacttctctacgactacatgctcctga

SEQ ID NO: 7326 - RNA, 1512 nt, unidentified
  source 1..1512: mol_type = other RNA; note = synthetic construct
atgaatcgacaggagatcattgctgctacggccaagttagagacacgctacgacctcctgatcctccttaacagaatcaaagtggacgagctgggcgagaaagcccacccatttacaattagacagctgaatcacttctgtcaccctcaccgcaacacttgctcttacaaagtgttcaccatcccaaaaaaatctggaggattcaggaccatttccgctcccggcagactcctgctgagtcttctgacatacactaatcgcattttccaagcagtgtatgaagctccatcctgtactgtagggttcgttcccggacgaagcgtggtcgacaacgcgaaaatgcatgtaggcagagattatgtctttaatacagacttacaggacttctttccatccatcacgcaggcccgcgtgtgggctacattgcagttaccccccttcagcttcaacaagaccatcgcaaacgccctggcgggtctgtgctgttccgagattttgatcaatggagaaatacgaaacgccctcccgcagggtgctcctactagtcccgtcttgaccaatattatatgccagaagctggatcgaagactgacaggattggccaagcgttttcatgtgcattactcgaggtacgcagatgatattaccttctcttctgatcacgatgtttatcaggagggcggcccgtttcttacggagcttaagaggatcatcggggagcagcattttaccataaatgagagcaaaacacgggtacagaagaaaggagcacggcaagaggttaccgggctagtggtgagcgacaaggtgaacgtcactcgcgagtacgttcgggggctcgattccttactctacatctgggaacggtatggccgtaaggaggcggtgtccagctttctccggcactataccgcaaagcataatcttaagaagcaggttcctagcatggaaagggtcctccgcggaagattgatgtatatgaggatggtgaaaggcgaagatgatccagtatggaggcggctgcaaagaaaattcaacggcctgtctgaaagggaaacctttcccggtaacgatgtgaagtatgaagccagttatcgcatcgaggaatttgagcaggcaattggtaccaaggtcgaatttctgagtagtggcacagagtcaagtacctctcggccttcaaatgcccaaccacaagctgttttttcactgcatgggatcatccgatctatatacctgagcaaatactgcaaaactcgtctagaaaaggtgctcgactccgggtcagaagaggaaatggacaagttccggaaacagtgcattatatcactgtgtcatagggccgacgatcctgactaccacttttggctaatccacagacctggcagagtcaggtccagcgtgactgtgctggagattctcggggcagacgaggtgttccactcggccgagagcgctgccaaggacattcttaacaagctgatcgattcaaacttcgacctgtccgtcttgtga

SEQ ID NO: 7327 - RNA, 1671 nt, unidentified
  source 1..1671: mol_type = other RNA; note = synthetic construct
atggtgcgcaacgatctcataatccaagaatgcagcaggctcgcctcactcaaggatctgctgtttctgttgaatagggtgaagcgtgaggagtacggctttggcgcgcaccccttcacaatggagcagatgcttcatttctccgaccctcgaaggaacagacgacattatgacactttcgcaatcccgaaacggtcaggaggacagagaaccattaccgccccccggggaatgctgaagagtttccagaaagttgcaaatcgcgtctttcaggccttttacaacgccccaccttgtgttcaagggtttgtaacagggcgttcggtcgtcggcaacgctggcatccacgtggggatgaattatgtgtttaatagcgacctgaaggatttcttcccaagcatcacccaagctagaatctggactgtacttcaagcccccccttttaattttcctaagcgtatcgcttcagtgctcgcaggtctttgctgtacggatctagagtacgtgatggccaggtgcgctgacggaggcacttctgtaaaaggtacctctaaagccaagagtgtgctgccacagggtagcccagcatcccctatcctttccaatgttgtgtgcaagaacttagaccgacgcctgtccgggctggctaagagattcggactgagatattccaggtatgccgacgacattacgtttagctctcagcacaatgtgtaccagaaggatggtccctttatgaaagaatttcagcggatcgtgcggaccgaagggttcacaataaacgaaaacaagactcgcttgtcgcgcaggggacagaggcaggctgtgacaggcctcaccgtaaatgatatggtcaacgttccacgaaagtatgtacgggacctggactgcctgattcacatttggaagcggtatggggcctcagatgcttatgcaaagttcctgtcaaggaacatggccaaagtctccggagctgggctcacatactttcccaagatggaggatgttctcaaaggtaggcttgcatacatcggcatggttaaaggccgtcactctccagtctaccaaagactactgggcaaaatggacaccgtgcgccatcggacatctctgggggcgtttcggtatgtccatagctggcgaatttctgagttcgaaagtcttactggtttttccctagatatggaaaaagatccgagcggaaagtggtactgcagattcggccctgagggccatcgcgtctttgtttgtatgtcccgatggtgcaggagccggttgaccgggattttagagacaaatgaccaggcagcgttgaacgaattcaagcgtatgaatagaatcgggttatgttttgacgccagaagcatgaatatggaggcccggtgtgagagccagatagtggacgaattgagcccatacctggatggcccatactctggacaccgcttcttctggatgattttcagaagggtcagtcctaactccggaccccacaagagttttttcgagctggtggataagcgggtgtctaaagaaggtagagagctcatgaaaactttgggcctgaaacccgtgtccatttcaaaaggccccctgctcactaacacggaccctgtgagtcccaccgactgtttcgatgacacctatgatttctacatacgcccgttctga

SEQ ID NO: 7328 - RNA, 1476 nt, unidentified
  source 1..1476: mol_type = other RNA; note = synthetic construct
atggaaaggcaggagatcagagaggccgcatcactgatgacaaacaggcactctttgctgacactacttaactccctcaagaaggatgatctgggtgataaagctcatccgtttaccatggcacagctgaactacttctgccatcccacacgcaacgcgaaacattacaaggtctttaccattcccaaaaaatccgggggcgtcagagaaatttctgcccctgtaaagatgctgaagtctttccagacatatacgaacatgctcttgcaagcactttatgaaccaaccagtgcggccatgggattcgtgcctggcagatccgtcgtggacaacgctatgaatcacgttggcatgaattacgtgctgaatcttgacctgaaagactttttcccaagcattccacaagctcgggtgtggggtgctctgaaatcgaaggcaattggattcaaccaagaagtggcttctgcggtcgccggcttgtgctgcaccgagattgatttctatgatggtaagcccgtactaaccacagttgacctgccaaagggggccaagacggagaagcgcaacgtgttgcctcagggcgcacccactagcccaattctgactaatatcgtgtccaggaacttagaccgccgtttaaaacatttagccgcccgattcggcctcaattatacccggtacgccgacgacattacatttagctctatgcacaatgtctaccaggaggagggtgagtttatgacagagctgagaaagatcgtggccgagcagaattttaccatcaatgaaaagaagactcgattccagaagaagggaagccgacaagaagtgactgggctaatagtttcagatcgggtcaacgtcacccgtgagtatgtgcggagcataggctcactgctctacatctgggaaaggtatggctatgacagtgcctttgcccggttctttcagcactacaccttgaaggtgaatagagtgagccccccctcaatggagagggtgctgcagggcaaactgatgtacctcaaaatggttaaaggagaagaaagtcttgtgtggcagagactgcaggatcggttcgataaagtttgttccaagaaacctgttaaggtgtctgatattaactacgtggctgcgtatactatgcccgcattcgagaaacagtttagcacggagatatcgttttttgctaaggagatcccgggtaagaaagagaagggaccagtcatcagttacggggcctcctttaagtcagggaacgaagggatcatcatctccgtatccgacagctgtaaagagctcattgcatctgctatcggggacgaaaaggccgttactgatcttaaaaagatgctctatgtggcttactgtaagcgcggagaattcccttattggctcgtcatgaaaagtcgccctcgtaatatatacgcaagcactgtaaggcgcaaagagggcgacctgttcttccacggatga

SEQ ID NO: 7329 - RNA, 1824 nt, unidentified
  source 1..1824: mol_type = other RNA; note = synthetic construct
atgaacatcatcctccataacatcatttactacttcaggctgaacggtaataaattgccggtgcacaaagaaaaaacaattcaggtctgcctagaaagatttatcaatgtatcaatgacccagaaacagatcattggaaaagtgcatggactcaaaactaagatggacctgctcaatttactgaatgctctgaaaaaagaagacctggggaaggattatcacagattcacccttgctcaactcaactactactgtaacccgaatagaactccacacaagcgttaccgaaattttacaatccccaaaaaaagcggcggcgtcagaaacatctccgcacctgtgagggggctgaagtccatgctcacttatctcaacattgtacttcaggccatgtaccagcccactgatgcagcaatgggttttgttcccggtcggagcatagcagacaatgctgccatgcatacctgtcggaattatgtcttcaatacggacctgaaggacttcttccctagcatccagcagccacgtatttggaagatcttacagcttaagcccttctcacttaacaaagagcttgcctcggttattgccggcctatgttgcatgcaggatgccaacggtaatggcgtgttgccacagggctctccctgcagtccaattctgaccaacattgtttgtcggaacctggatcgaaggctgacaggcctggccaaaaggtttaatctgaagtactctaggtatgcggacgacataaccttcagttcggactacaacgtgttccaggacgattcagagttcatgaatgaatttatgaggatcgtcgccgatcagaattttaccatcaacgaaaagaagacgcggttacaaaaatccggccaacggcaagaagttacagggttgatcgtgaacaaaaaggtcaatattgctaaggagtactatcgggacatacgcagtctgctgtatatctggagtcgatacggcaaagagcaggcatatgccaagttttgtgtgagatataaggcctctaaagcttataatgctaagaagaagggaatgcctagcatgcccgcagtgatttctggcaaactgctgtatctcaagatggtgatgggagaggacagtactgcttacgccaagctgagagataattttttgaagctgtgccctgagcaaaaaaacgtcctgaagaatacgaacctcacctatctcgccagctaccgcctggacgagttcgagagcgcttttgggactaacgtgaagtttgaatataaaccattcagcaacgtctccgggaaatccaagactatggggagcttcttactcgaagaagagatcgtatcagtatccgttaatgtgagatgcgattctatagtggataagtatctagccaacccggatgaaaaagagttggagaagatcaagcgcaggctgtacatttccctaagtgaaaggggaaacgatcgtttctggttaataacaatcgcgcgcatgaacaacgagcacaagaaatcctataaaggctcatacgtggctaaagtcaaggtgcgaccagaggaaataaagaaggaaggaatcgagctgaagcgcgaggtttacgccgaaattatacgccccaccgagattttggagaacaatgacctcgacccaacccatcctggacctcactactacaattctacataccggaaatgggtgcctgtcgacgatgagcagtttgaggatatccccgatagcgaagagatcgacgcgatgctggcatcattggtgagctctgggtttgatcttaacacacttaaggagtgggacaaaattaagaagaattga

SEQ ID NO: 7330 - RNA, 1653 nt, unidentified
  source 1..1653: mol_type = other RNA; note = synthetic construct
atgagccggaccttcatcagcgtgggtatgaacaagcaacagatcatcgagaaggtgaggggcttaaaaactaaggtggatctgctaaacctgctcaacgcgctcaaaagggatgacctaggaaaagattgctaccgctttacacttaatcagatcaacttttactgcaatcctaatcacaatccctcacgacggtacaaggatttcacaatccccaaaaagtcaggcggggtgagaacaatttcggcccctaagggaagtctgaagtctatccttacctatctgaacgtcatcttccaagccatgtacgaaccgagcgaagctgctatggggtttgtcccaggccgcagcatcgctgataacgccgcaatgcatgttgggagaaactatgtattcaataccgacttgaaggatttcttccctagcatccaccaggcacggatctggaagatgttgcagttgaagccattttcccttagcactgagttagcgagtgtaatagcagggctctgctgtatgcaggatccaaatggcacagtcgacaaaagtggtaagatcattggtgtgcttccccagggctccccctgttcaccaatactcacaaacatcatttgtcggaatttagatcggaagctgttaggtctggccaagaggtttaatatcagatacactaggtacgctgacgatattacgttttcgagcgattacaatgttttccaagaagggtccgagtttatgaaagagttcacgcgcatcgtaacagagcaaaggttcaaaatcaatggctccaaaaccagactgcagaagagtggacagcggcaagaggtcaccggcttggtggtgaataaaaaggtgaacgtcacccgcgattattacagggacctgcgttccctgctgtacatttggcagagatatgggaaggagcaggcctacgctaagttttgcataagatataaggagagcaaaacctataagcgaaaacagaacgaaatgcccgacatcgtggcagtagtttctggaaaactactctacatgaaaatggttatgggcgaggagtctacggcctacctgtcactgaaaaacaaattcatttccctgtgtccagaacagaagcagatcctggatactaacctgcactatcttgcgtcatatagactggacgaatttgaaagggcttttaacacccaggtcgtgttcgcctataagccccagaatcgcgtcgtggggaaatctaagactatgggaacatttgttctgggagaggagaagcatgttgtggcaattaacatacgatgcgactccattatagataagtatctcagtgcccctgacgacaagttgatgaaaggtctgcgtaaaagattgtacatcactctctctgagcgtggatctgaaaggttctggctcgtgactattgcccgcatgaataatgaacattctcgcagctttaacgagtcctataaggccaaagtgcgaaacgaaattgaaaccaattcaggcgaacctgtggatgtcattgactccatgtacgaaatggacgtgtacgactgtttcccggagaacatagacattgacggccttctcagcgagttcgtcaagtctgagtttgacttcaataccctgaacagttgggacaaaattcggaaaaactga

SEQ ID NO: 7331 - RNA, 1995 nt, unidentified
  source 1..1995: mol_type = other RNA; note = synthetic construct
atgaaggacataagtacactcaggtgcgaaattaaaaagatgagaactcatctggacctcttttatgtgctgaacgaggtcaagaagcattatgccgagactgaagggatctctttttaccccatcaaccgatcaaattttgaatactacatcagcagcaagaccaatcgcaatcagtactataaagagttcgacattcggaagaagtataatgacggcaagagacacattatcgctcctttcatgggtctgaaagatatccaaaaggcaatcagcctgatgctgcagctgatctacaccccgtacaacaatgtgaacggatttgttcagggtcgttgtattatgcagaatgcctaccctcacgtattccagaattacatcttcaacatcgacatcaaagatttctttccaagcatacaccaggccagagtctggaaaaaactccaactgcctccactgaattttcctgttgcgattgcaaacgctatagcaaacgtctgttgttatgaactgatcaatgacgacgatactaagattggagtcttaccgcagggggccccgtcttccccaattttgtctaatattgtgtgcgagagactagactggaagctgcgaaagcttgccagggagaacaatcttatttataccaggtacgcagatgatatgaccttcagcggtatgtataacgccttctcacccaagagcgaattcatcattaagctctatgcgacgatacacgaggaaaacttcgtcgtgaatgaaagcaaaacaagtcttatgaaacggggcgcccatcaggaggttactggtctagtcatctccgacaaggtaaatgtgccacgctcttatatccgggaaatccgatccctcctctatatctgggagcggttcggagaaaagacagcttcctaccgctttgcgttgcacaacagtaaccgaaaagacaaaaccctgtcagagattggaactttagagaatgttctgcttgggaagatcgaatatgtaaagatggtgaaaggcgccaatgattccacctatctggcactgaaaggcagactcgataagctgcttggagccgaactctcaaagaaagaaaaaaggcgggagagccgggagaagaagctacgtaaagtcgttccccacaatctggaagagacacaaaaatttttccacctgtttgattaccctgagggctttaagtatttgacccatgactttcccgaaggggaagagtggagtgtcgataagctgaaagagcagtgcataggtattctgaagaactactcaaattactcacagattcccacttcgctgtgggctctggtgaacgtgtttgtcatagggaagtactataagaagacagactggattgactacgaagggcatgaccagaggattacatactccgatttcgtgggaggagagggccaccctatcctcggagatcataaggaggtgatagagcgcttcaagaacactattagggtgaggatgaggtgtctgtacaatttgtgcgtaagttggaatgaccccaaatacggcctgaacatcacaatggataaaaacgagttgaacaaggcagatttctacaccaacgtgttcatccttaaaaaatccgtgcagcgtattttccaaatgttcgcttctcgcaatgacaaaaaggacgttaacattcactatcacaaggaggacattaagaatcggcgctgccatatcctcacgataacccaacaggacagctactccgagaagggggttgatgagttaagacccaaactacacggcgggggcggcgattttgctacgttgaaacacgacttgagtggctactgtaactggtctgtgttatctgtgtggaacgaaaaaccagccaagtggaacatacttagagaatcggatgtggatgagatcgaggaagtgaccgacaaaccagtaggctttacccatatcctcacattttatgggaacaaattagaggaggatatccatcactga

SEQ ID NO: 7332 - RNA, 1887 nt, unidentified
  source 1..1887: mol_type = other RNA; note = synthetic construct
atggccaaagaattcggggtggagtattatcccatcagctgggaggattactgctacttctcatccccaaaacgatctgttcgcaactatatctccttcgagatccctaaaaagagcgggggttaccgacatattagcgcccccgtgaggggactgaaagagatccagaagtgtctgaactaccttcttgagctcatgtactatccaaaggacaacgtaaccggatttgttagaggaaaatctatcgtggacaacgcatcaccccatatcggcaagaactatatcttcaatgtggacttgcaggacttcttcccctccattgaccaggcaagggtgtggaaaaagctgcagctgcggcccctctgcctcactaaagaggttgcctctgccattgccggactctgtagcatggagatagaggatgaaaaagggaataaacggtacgttttgccgcaaggagctcctacctcgccaatgctgagcaatatcgtgtgcgaacgattagactggaagttgagcggtgtcgcgcgcaggtttggactgacttatacgcgctatgctgacgacattactttttcttctatgcacaacgtgtaccagcatgatggcgacttttgcaaggaactgagacatatcatagaggatgaacacttcaccttaaacacctcgaaagtgaagctccagaagcgtgggggccaccaggaagtgactggcttagtcatcagtgataaagtgaacgtgcctaaggcttacgtcagggagatccgctcactactcttcatgtgggagtgctacagctatgctgtcgcctcccagaaatatgccctgtatcacaatgcctatgtcaaacaccggacctatggcgagttcgtatcactcgagaacgttctggacggaaagattgaatacctgaagatgattaaggggtgtaagaacccactgtacctgacccttcgtagtaggctcgataagctgataggcaagtccacgaagaaaaataaagattgcgaggtcatagaggtagtgaataacaaaaaagaggtgaaaaagcacgacatcgaagcgacatatgaggtgttgcatttatttgaagagcccaatggattgaaattccttactcatgacttcccagatgcttcttggagtatagataagctactaaaacagtgtcggacagtgtttaatgaagaagcaaagggacacccgaacataccccagtccctgtacagtctcgttcacacattcatgtccggcgtcagcaataatatcaagggctggctaggttatgatgaaaagctgcacacggaaacttggaacgactgggagaaaaagaaagagcaccctatcaagagatatggcgacatcatcgacattttccgcaatacaattaggattagatcaccaaagctgtttgaccttattaaagcccttgaagggcagaatacacaatttgtgtttgactacgatagcaaggaattgaaaaaggcagatttttacaccaacgtctacatgcttagatggtgtctggtccatgttctgctgatgttcggtcaataccctgagcacaaggaactgaatatttcctgtacccgtagtagcatgaacggctggattgtctacactatccagtttacacaagtagggagtttcccttccgcagatattaatgatgcgatcaagagagtgaacgagggggctggggacttgggcgtgattaaagagaaaatgcggtcttactgcaattggtctatcatatcaaagtggaacgataagaatctgcggtggaacatcctccgcagcgagggtgtaaaggaaattgaggaaatcgccgagcaaacaataggctttacccatgaattcgtgttttacaagattaagtccaactga

SEQ ID NO: 7333 - RNA, 1143 nt, unidentified
  source 1..1143: mol_type = other RNA; note = synthetic construct
atgaaccgcgagacaattgcagaaaaagcggaaaagatgaccgagaagcaggacctcctccacctgcttaatgaggtgaaggttgacatgctaggcgataaggcccacccatttagtttgaggcagctgtgttattactgcaaccctagagtgaaccgaaaaagatacactgatttcgagatccctaaaaagagcggcggaaagagacgaataagcgcccctgtcaatggtctgaagtcaatactcagctgtcttaacatcattttccaagcaatgtacgaacccagcgagaatgctatgggcttcgccgtcggaaaatctgtagtggataacgctaagatccatgtcggaaagaattacgtgtttaacacagacttgaaagacttttttccttctattcaccaggctcgagtgtggaaacgcctccagctgccaccctttaactttaatcagaacatcgcaaatgtgatggcagggctgtgttgcatgaaagtatccagcccagagggcgacaaatatgtccttccccaaggagccccgacttcccccattattactaatatgatctgcgacaaactcgatcgtaggctgaatgggctggctaacaggtttgggctcacatatacccgctatgctgacgacatcacgttctcctctatgcacaatgtctaccaggaagacggcgagttcataaaggagctgcggcgcatcatcgaagaccagaatttcaccattaacgattcaaaaacgaggctgcaaagaaagggtagtcggcaggaggttactggcctgacagtttgtgccgccccgaacgtgaccaagcagtacgtgcacaacatccggtccctgttggccatttgggaacatcacgggtacgatattgcctatagacggttcttaccaaggtatataggtgagaaggggcatgtgaaaaaaggttcacctaacctggatagtgttcttgctggaaagctgttatacctcaagatggtgaagggcgccgataaccccttgtacgcaaagctgcaatgccggttcgacaatcttatcggaaccatgaatggggaaatgacctctgatactgaactacgtttcttgtataccatgggcgcgaaggagtttgatttcacacattcgaaatga

SEQ ID NO: 7334 - RNA, 1572 nt, unidentified
  source 1..1572: mol_type = other RNA; note = synthetic construct
atggacaaatttgaaactagaaaaagagtctccagcctgcagactaaagcggatctgttgaaactgctgaacgatttgaaggtaaatgatcttcaggaaaacgcctatcctattcccatgaaggccatcaatttttactgcaaccccgctcatgagaagcgatacaagtcattctcaatccccaagaagtccggcggacaacgggtgataagcgccccatgccggggtctgatgtcaatcttaacctacctcaacgtgatgttcgaagccatgtatgagcctgccccctgtgtttgcggcttcgctatagggaagagtgtggttgataatgcgaataatcatgtgggaaaaaactatgtcttcaacttggacatgaaagacttctttccgtctatccagcaggctagggtgtgggccaggttacaagcagcaccatataacatgaaaaaggacgtcgctaatattattgccggactgtgttgcatgaaaactagcgacgggaaatttgttttgcctcagggagcacctacctcaccaattctgactaatatgatctgtgaacgccttgaccggagactaacagggttggcgcggcgcttcgggcttagctacagtcgttacgcagatgacatcacgttttcaagtatgcacttcgtgtattctggtgatggagatttcatgaaagagttaaacaggattgtctcggaagagcattttagcctcaacgataagaagaccaggctgcagaaaaataatgtaagacaggaagtgacgggcattaccgtgaacgagaaagccaatgtcacccgaaaatacgtgcgggagattaggcagctcctctacatttggaaaaagtacggatataatgacgcctactctaaattttatccaaagtataaggccgagaaaggccacgtgaagaagggcgaacctgtgcttgagaacgtattgagcggcaagctgctctacctgaagatggtcaagggtgaggaagattccacctacctgcgcctgcgaaagcagtttgataaactttctggcgataccattctgcacaagagcacttccgatgagttcaaatacatcctgacatatgaccttagtaacttcatagctgtgaactcgatcataccatttaagctgcatatcaaggacgaggacctccagaccacagcctccggcaactacaaaggaaagatggaactcaatggggagtacatgtccgtgtttatcagcaaaggagttctaaagcagatcagaactgccgagcagggtgattatacggacatgtggaagtgctacatctctctgtgtgagagtgcaaaggggcgtttctggctcatccatcgcggcaagcacgacgaagctacacacaatcccgctccccaaaagacaatatcccagattatcgacatatgggcaaaaaagggcctggagaaggcaaaggaggtcttcgaaaacgtgcactatccgacaggggactctattgacatcaaagccattctagatgtatgggaagagaaaggtgctgacgctgcggaacagctctatgagcaatacgttaaacaatga

SEQ ID NO: 7335 - RNA, 1668 nt, unidentified
  source 1..1668: mol_type = other RNA; note = synthetic construct
atgatcgccgagagggctgcccagatgaagaccagggcggatctgctcctgcttttgaatgacatccgccatgacgaactggccgaagctgggcgggaggaggattaccacccattcacgcaacctaagttcaacttctatataaaccccaatcatactcagggccgctatcgggagttctacatacccaaaagatcaggtggtcggagacggatcagtgctcccaggaccgggacctacaaatacatgctgcacgctctgaacctgttgctcggatctctgtacacacccagcttgagcgcaatgggattcgcacccggacgctccattgttaccggcgctgaaaagcacgtggggcagcattacgtttttaatacagatctgcgcgatttttttccatcagtacggagagcacgggtgaaagcccgactactcctcccgccctttgggtttacagaggaagtagccatcgccgtagcaggtctgtgtaccgtccgagtggaggcccctggtgatgacggccaacctgctcgtcctatctacgttctgccacaaggagctcctacttccccactgttaacaaatgccgtgtgcgaccgcctagacagacgccttaccggcctagcgaggaggtgtggcgcaaattacactagatatgccgatgatatcacgtttagctccccccacaacctatgcgttgaaggctccgccttccgcgctgagcttgccagaatattggctgtagagggattcgagatgaacgaagccaagaccagggtgcagagatccggacagaggcaagaggtgactggcctggtcgtgaatcgaagagtcaatgtgtgccgtcattatgtgcggagcctgagagccgtgctctatgtctggcgacgctacggctatgatgctgcccttgccgccctgttgcggcatgaccgagtggtgccagagaggcgtggaaggaggcgccttccagacctcaccagggtcattgaaggacgcctgttattcgtgagacaggtccgtggtacggcagacccactgtacgcccggttacaggccgcatttgacgcattggtggcttctatgagtgctcagaagtgtgaaaacggactcaccttcatttggacagttccactggaacagttcgagaagcagtatggtgcgactgtcaagattcactttttcccagcagaaccgaccagtcagcccacaagctcggactcagcagccgagacaaacgctccttctgccgatgcgcagtctgccccgactgcgatggcctcttgcaggtttactcttcctcggaaccgagctaaagggggggacacctatgatgctcaggtggagttgcctctcacggtgagtagacggctcacccctcagacacctcgtgaggggatggcagtttcattctgtagagcgacaaaaggcatcccgtttctgctcttacaccgacagggggctgtgaccgtggccattattactggctctgggatggcaggcggttcccaacccgctggaaacgccccaggcatctttgcaacactgcccgtctatgggaaacggcgcctcgccagcgccgttcaagcagatcagggcgaaccccccgtcgacgttgatgcgctgctggcagagctggaaaactaccttactgaccacaatggctga

SEQ ID NO: 7336 - RNA, 1407 nt, unidentified
  source 1..1407: mol_type = other RNA; note = synthetic construct
atgctgtaccttctcaatgacattatcacagacgcttatggttcgcaagccgccactattaacatgtggcaatttaactacttctcaaacccaaatcggtgtaagggccggtaccgtagctttcagattcctaagaaatctgggggtgctagaaccatctctgccccttgtaaaagcctgaagtatattcttcggatcgtgaacattctcctgcaggcaatacataaacctagcacagcggcaaaagggtttgtcccacggttatctatcgttgacaatgcggcaccccatgtgggcaagaattatgtgttgaatctggacctgaaagactttttcccctccataagtgaagccagggttcgcgcccgtttgatggctaagccttttaactttactgacgaagtcgcaaccacactggctggactgtgcagctacagaccctatagtaaagagacagcccatcaacgcatagccccctgtgtgttaccacagggcgctccaacttccccaacccttaccaatgccatttgcgaccgattggatatgctgctgtctggcgtcgctcgacgcttcaacctcacctataccaggtacgccgacgacattacattctcttccaaccattacgtattcagcagggatggtgaatttatgactgaggtgagaagaatcatagccgatcagggttttgaaatcaatgagaagaagacgcgcctacagcggcgtcacgaacaccaagaggtcactgggttgactgtgaatgaaaaggtgaatactgccaggcggtacgctagagatatcagaaacttgctatacatctggaactatcacgggatcgcagacgccgagaggtcattcctgtggaactacgataaaagacagagaagggtgcccgacatgatcaatgcgatatcaggcaagctagagtacctgaagatggtaaaaggcgctaatgatcccgtctatgttaggctcagtaaaaagtttgagtccctgcagaatgggaatacagtgctgggctacaagattcataagacctggacgatcaatcggtttcgattcacgcacggatatattagtgtaggatatgagcgcaacgagcttcttgataggctgaagtacgacgatatcccggatctgttcaaaaacgcagtttgcatcgatggacctcacccgtatttctacattgagaagcgaatcaagtaccagggccagctctatttgcaccgacagtttctccgcgtgctcagaaacattgaaacagagttcctcgaattcctgaacgggggcgagtgtcgcaggacctttttcgtgtcagaatgcacccgcaaaaacaaagatgggcggttatggaagggattcctggtccatcacgcaatcagccgggacggatcccacttcctctga

SEQ ID NO: 7337 - RNA, 1728 nt, unidentified
  source 1..1728: mol_type = other RNA; note = synthetic construct
atgaatgatctgaggactctaatctcaaagataaacaacttgtctgacctgaccaaggtgctcaattacttcaagcatcgggaaactaatagcgaggagaacctgttcactgaggatgtcctggaaagttacgccaatccttccaagaaagtagcacggaggtataagacattctacataccgaagaaaaacggcaaactccgtgagattagtgcaccaaaccggaacctcaaggaaatccttcactacttgaacatgatgctggccgaagtttaccaggccggtcccagcgctatgggctttgtgaaaggccggtctatcgtcgataatgccaatctacatgttggacagaactatgttctcaatctggatctttctgactttttcacctccatctcccagtctaggatttgtaagcgcctgcaattagccccctttaattttaatgaaaacgtcgcgaaagcaattagcggcctgtgttgcaagaaggtggtaaagggtgggaagaagggatatgcactgcctcaaggcagtcccacctcacccatcctcactaatgcagtctgcgattttcttgacaaaaaattgaggcacctgtcaacacgtaatggagtaaagtatagtcgctatgctgacgacatgacattctcatcaatgcacaatatataccaggagaatgataccttcatgaagaacctgttttccatcattaaagaagagagattcactgttaacccagataaaacacgattgcaaaaaaggggcgagcgacaggaagttacaggattaaccgtcaatgacaaggtgaatactgcccacaagtataccagagagttgagaaatgtgctgtatatgtgggagaaatatggctacaaggacacgtatacttccttctataagcactataaggcaaccaaagggcatattaagaaaggggaaccagtgctggagaacgtgatcatcggcaagttagacttccttaaaatggttaaaggggagaacgatgtggtgtacaccaagttacgatcacgctttgaggccctgaaccccaacatttacgattctaaaaacacgaatagccggtctaaagtcaattacatcgagctctatagcgtggtggaattcgagaaagcctttaagacaaagatcaagtttatcatgtccggcgaaggtaagttgagcgccgtgtacaaaaacgggaagaaagaaaactccatatacgtcagcaacgctgtgaaggacattgtcttcaccgaaaaggctaagcctcgcaaaaactgtagatttaccattagtagcatggagtctttttttgtggcactgtgccggtcgaactgcgtgaattactggatgatgctggctaatgagccagctagagagagacacatccatccaaaatacaacaatctaccgattaaccagctactgaaagagtgggaagaaaaaggactcgaggcggccgctgaccttctcagttccattctggtagatgagacgttcagctccaatggagacaggaaagagcctgctctccctaaactcggtaagaaaaagcgcaagaagaaaagctctatgggggtgcttgaagagctgatgatcgaagattacatggatgatatggagttgcaggcgtcgctgaccgacttcgaagacgaagagacaatagaatacaacacaaaggccatcatgaagctgcttaaaggagacaaggacgggaaggaggagtga

SEQ ID NO: 7338 - RNA, 1743 nt, unidentified
  source 1..1743: mol_type = other RNA; note = synthetic construct
atgatggaacgggacaagatttttgaactctcccaaaaaatgaagacagtgcgccatctggctttcattctcaacaagatgaagtgtgaggaatttggcacaatggaatttcctatcactgcaaagcagctgagacatttcagctccccaaaaattgctgacaagagatacaagacctttcagatcaagaaaaagtccggcgggatccgggagatcaatgccccatgctatcagctgaagattatcctgtattttctcaacaagatcctcaaagccgtattcacacccaatgattgtgtgaatggattcgctgaaggtcgctccgtagtgagcaacgcccaatgtcatgtgggccatcactatgtatttaatattgacctcaaggacttcttcccatctatccctcagccacgagtctgggccaggctccaactgcctcccttcaatttttctcaggaaatcgccaatgttgtggctggtctttgttgccaccccaatgctgatggcaccaacgtgctgccccagggtgcagcaacatcacccctgttaaccaacgccatctgcgataccttggatcgtaggatgaagggggttgccaaacgatttggactccactactctagatacgcagatgacatgacattttcatcaatgcacaacgtctatcatgaaggcagcgacttcaggctcgagataaaacggattatcgaggaacaggggtttaagatgaacgagaagaagactcggctactgagggatggtcagagacaggaggttactgggctgaccgtcaactctactgttaacgtgtcaagacactacgtcaagtatctgcgatggattctgcacatttgggaaacggagggctattcgaaagcttactccaaattctatccgaagtataagaaggagaagggatatatcaaaaagggtgagccagtgatggagaacgttatagggggaaaactgaattacctgcgcatggtccgggggagtaataatgccgcatacctaaaattgcaggcgcgctacgacaaattgcagcagctggtcttcattgacaatgagacggataaaggcgaatcctacatatacgtgcagccttataagatggcggaattctgccaagatttctctacgagtatagtgttggagatcagcgccaggaacaagcttgtcggaaggtgcgtactgtgtggtatggataaaaccatcgctatttctaagtccacccaaaagaaactctgtcctgatcttgagaaaaaaaagcccggcgacgtcattactagtgacctgctccccgagtgccatgtgaccttgtgcagaagcaaaggaaagaacttctggttaatcactgagtttaagccgctgcgttcgatttacctttcaatacagaacgcacaggtgaatatagacgagttactggacatctgggacaccctaggccttgatagtgccgtgagcgcgttcatgaacagcattaacgtcagcaactttaagaacaacaattctaaagagggctcaaatatcaacgagaacggggtgctgtccaaagaaaataatccaggcgttcttgagagttctcaggaaaaacacgaacagtatatcgtggggttgggagagaaattacctcagaatacaaaaaaggtgatcgatcaacaccgccaatacgatactggaacagactccagtataattgatgttgacgacgtggactgggatgtactggaatacagcatctga

SEQ ID NO: 7339 - RNA, 1722 nt, unidentified
  source 1..1722: mol_type = other RNA; note = synthetic construct
atgaaaactgtgaaacacctggcggtcctgctgaacaaaatgaagtgcgacgaattcggctcgcggaagcatcccattacagctaaacagctgctacattttagtacccctaagatcgcgctgaagcgatacaagaccttccagatcaggaagaagtctggcggggtacgagaaattaacgccccatgctatcagctgagcattatactgtatttcctgaaccagttgctcaaagccatcttcacgcccaacgaatgtgtgaacggcttcacagagggtagaagcgtggttactaacgcccagcgccacattggacaccactacgtgttcaatatagacctcaaggattttttcccaagtattcctcagccccgggtttgggctcgcttacaattgccaccgtttaatttctcgcaggagatcgccaacgttgtcgccggcctgtgctgtcatccaaacgccgacggcaccatgaatgttctgccccaaggagcagcaacatcaccccttctgaccaacgccatatgcgacaccctggatcgcagaatgcgcggtgtcgctaaacggtttgggttgcactattcccgttacgccgatgacatgacttttagcagcatgcataatgtgtaccaggacggttccgatttcaggttagagttgaaaaggatcatcgaggagcaaggattcaaaatgaacgaaaagaagacccggttgctgagagatgggcagcgccaagaggtgactggcctgactgttaactcttccgtgaatgtgtctaggaagtatattaaggaccttcggtggatactccacatctgggaaacagaagggtacgcaatggcttactcccgtttttaccctaagtacaaaaaggagaagggatatatcaagaaaggggagcccgtgatggagaatgtcatcggtgggaaactcaattatctgcggatggtgcgaggcgataacaacgcggcatacctaaaactgcaggcaagatacgacaagcttcaacagctcgtattcgtggataatgaaacagataagggcgaaagctatatctatgtgcagccttactcaattgctgacttttgcaatgatttcgccacaagtatttctctggaggtaagtaccaggaagaacttaatagggaaatgtgacctttttggaatcgaaaagattatcgccattagcaaatctacacagcgtaaactttgtcctaacctggacagcaaagagcccggggatatcatttcatccgagctccttaccaagtgccacgtcaccctgtgtagatcaaagggacgcaatttttggctcattactgagtttctcccccataggtctaagtgccttagcattcagaacgctcaggtggacatcgatgaactcctggaaatttgggacgagctcggcgtggaggctgccatcaaggcgtttaccgactccttcgtagctgattgtgttaatctaaaaacgactgtggagccaaaagacggtcctgcctcaaaaaatacgaatgcagtcgtccaggtcagtggaataaatccaaccgatatagagagactgttagcaatggctggacaagccgaacaggacccgatctcttttgccgagcctatctccgctgacgattgggatgaattgaatatgggcacagacgtggatgatgtcgacttcgacgatttgaacgacattgacaaggataatccaatcgcatccatctga

SEQ ID NO: 7340 - RNA, 1707 nt, unidentified
  source 1..1707: mol_type = other RNA; note = synthetic construct
atggaaaaggccgagattagagataaagccatggttatgaaaacgactaagaacctcgccagattgcttaacacaattaaacaggaagagtttggttccaagcggtataaaatcacccctagacaactttatcactttgcttacaccaatattgctccaaatcgttataagaccttccatatacacaaaaagagcggaggtttgagggagatcaatgccccttgttatcagctaggcatcatattgtacttcctcaacaaggtgtttaagagtctgtatacaccatcttcctctgtaaccgggttcaccgagggacgctcggtttatgacaatgctaaaatgcacgtgggccaccattacgtgttcaatatcgaccttaaggacttcttcccctccatcagccaagggcgggtttggacacgattgcagctgccgccgtttaactttacacaagaaatcgcaaatgtggtcgctgggctgtgttgccacaaaaatgcaggcagcactttaaatgtgcttccccagggagcagccacctcaccaatcctgactaatgcggtctgcgacaaactagaccgccgcatgagaggggtggcaaaacgatttggtttgcattatagtaggtatgccgatgacatgactttctcctctatgcacaacgtgtaccaggaaggctcggagttccggtgtgaagttaagaggattattgaggaacaaggctttcagatgaacgacgcaaaaacgcggctgcttcgcgatggagtgagacaggaggtaaccgggctgacagtgaacagcgtggtgaacgtgtccaggaaatatatcagcgatctccggtggattatacgtgtgtgggagaaggagggatatgctaaggcgtactccaagttttatcccaagtacaaaaaggagaaagggtacattaaaaagggcgaacccatcatggagaacgttatcggcgggaagctaaactacttgaaaatgattcgaggcgaaaacaatcctgcctacaagaagctgcaggagaggtacaatagactccagcaagtggtctacgtggacaacgaaactgataagggtacatcttacgtctacgtccagtcctataccatgaaggaattccagaagtatttcgcaactacagtaacgctggaagtgagtgccaaagggaagctggtcggcaaatgcttactggctggtatggagaagataatccctatctcactcagcacacagaaaaaactctgtcccgatcttgagtccaaaaagagcggcgagcaggtcataagtaagatgctcactaagtgccatgtcactctgtgtagggccaagggcaagaatttttggctgatcaccaaatacgagccaaaacgctctaaatgctttagcattcagaacacgaagattgatatcgacacactgctgaacatttgggagcaatacgggaccgagggagccgttgatgtattccagcagtcaatttacaatggccagcggatctcaaaggaaggaattgacggactgatcctgaatttcatcttagaaagcaagtacccaaaactcgacacaaacaaaactcagaagcctcagaagtctgaaagtgaaaccctctcagaagaggagatggctcaactgtcagagtttgcggatctgattgatagttctgacatagatgagttacccttcaccatccagctgaacccttga

SEQ ID NO: 7341 - RNA, 1710 nt, unidentified
  source 1..1710: mol_type = other RNA; note = synthetic construct
atggaaaaaaatgagatcaaataccggctgaagaacgtcaagaatcttgaggacttcgccaaactcctgaatgatgtgaaaatagacgagttcaagacagcaaaatacaaaattaccgagaaacaactgctgcacttctgtaaccctaagacagtcccgaaccgttacaaggccttctacatcaaaaaaaaatcaggaggactacgggaaatcaacgcaccttgctaccagctgggcaccatcctctacattctgaacatcgtgtttaaagctgtatacactccctctgaatccgccatgggattcactgaagagaggagtgttgtgaccaacgctacctttcacatcggacatcattatgtctttaacattgaccttgagaactttttcccctccattccacaggctcgcgtgtggaagcgaattcagcaccccccttttaacttcccgaaagaagtggcaaacgtcgtagccgggctgtgttgccatacaaacgcggataagacaaaaaatgttctgccacagggggcagccacttccccactattaactaacgcaatttgtgatacccttgaccgccgtatgaggggcgtcgccaagtattatggcttacattactctcgctacgccgacgacatgaccttctcttctatgcacaatgtgtttgaagagggcggggacttccgcctcgagattaaaagaatcatcgaagaccagggatttaagatcaatgacaagaagacacggctgcaaagagacaatgagaggcaggaagtgactggtctgaccgtcaaccagcgggtaaatgtgtcacgtaagtacgttcacgatattcggtggatcttgcactgctgggaaaaggacgggtatgggaaggcctacgctctcttctatgattattataagcggacgaaggggtatattaaaaaaggcgagcccgtcatggaaaacgttataggcggtaagctgaattacatgagaatggtgaagggtgagaataacgccacttacaggaagctgctggaacgattccttaaactgcaaggcctggtttatgtggatacagaaaccgataagggcatgtcctatatttacgtgtacagctaccccgtgtccgaattcaacgctctctttaagacagatctttctctagaagtgagcgcaaaaaataagttgatcggtaagttccagatcgagcagagagataaagtgcttgccatatccaagcgcactcaagattatctctgtaaagacatcgcccagaagcagccaggcgaggaagttaaaaccgagagactgacatcgtgctttgtcactttgtgtagggcgaaggggaagaatttttggctcctgaccaaaagcgagatgaaacgatcaaagtgcttgagcctcctgaacgctcacatagacatagacaagctacttgacatttgggagaaaagggatattaacgaggcaagtgaggctctcaattatgcgatcacggaaggaaagcctattttgaccttcgaggaaagaatgtttgagaacctgaatctcagcggcttcggtatcttggaaacggtgaagggaaaatctcatagcaagagtgtaagttttgagtcaatcgctgaccagctcagcaagtttgagtcattagagaatatcgaggagttgttaatggagaatgatctggatgactccctggatataggggaattcaaggattga

SEQ ID NO: 7342 - RNA, 1593 nt, unidentified
  source 1..1593: mol_type = other RNA; note = synthetic construct
atgaagctgctgaacgagatcaagttgcacgagtttggcaccaataagcaccctatcacagttaaacagcttatgcatttctctaatgccaaattgggcgataaacgctacactgttttctcgattaagaagaaaagcgggggcctgagagaaatctccaaaccatgttaccagcttaagtgcatcctgtatgtgctcaatatctttctgcggagcctgtacactcccagggaatgcgtgatgggctttaccaccgggcgaagtgttgtcggtaatgctgctgtgcatgcagctcaccattatgtatttaacatcgacttgaaggactttttccccagcatcccacaggccagagtttgggcccgtctgcagctgaagccgttctatttttcaaaagaggtcgcatcaatcattgccgggttatgctgcaataggaacagtgaaggcaaaaatgttctgcctcagggagctgcaacgagccccctactgacaaacgcaatctgtgacaagctcgaccgtcgcatgtgtggtgttgcaaaaaggtttgggctccactactcacgctacgcggatgacatgacattctctagtatgcacaatgtgtacaaggacgatagcgactttcgcaaggagattaaaaggattattgaggatcaagggttcacgatgaatgataaaaaaactcggctgcttcgggatggtaggagacaagaggtcaccggactcactgtcaacagcaaggtgaacgtatctagaaagtacatgcaggacctccggtggtacatctccatgtgggaaaaagaggggtacgcgaaagcttatagccgattctacataagctacaagaaagaaaaagggtatatcaagaagggcgagccagtgatggaaaacgtgattggcggaaagctcaattacctgcggatggtgcgcggcgctagtgatgctgcctaccagaaactccaacagaggttcgacaaactccaagagctggtgtttgtggataatcagactgataagggagcccagttcgtatatgtccagccgtatacatataaggagttcacttcgttgtttaataccgatatacagctggaggtgtcagccggaaataagctagtgggtaagtgcaccatcgacgggatagataagtttatttctattgtgaaggccgcccagcggcaactgtgtcccacactggacggcagaaaagccggagatatagtggaatcttctggactgagcaagtgctatattgctttatgtcgttcaaagggcaaaaacttctggttgatgagtctaaagcctcttagacgatccaaaaccctgtccatccagaacgcgaaggtcaacgtcgacgacttgttcgctctctggaacaatgagggtttcgaaaaagccgcagcggcatttgatgacttcgtcaacaagtctaaggccataccagaatgcaaagagaaacctaagaaggagtatttagacggaaataacacacttgacattcagtccgagaacaacatcgtagaacgctccacctccggttgtaacttctccgaagacgatcttttagccgccggcgcagatgtggacttttga

SEQ ID NO: 7343 - RNA, 2868 nt, unidentified
  source 1..2868: mol_type = other RNA; note = synthetic construct
atgaaaaaaggaaacgatatcctaatcccgcccgcttactttttgaatgattacaaggaggggttttatatcgaaagacctgagagagactggtcacaatgtgagctttggaaaaacttaccatttgtgttggaggtcggggataataccatcgccacaatcgtcaaaggcgccgacaagcgtagactaaaatacgtctatgtccacatctaccagtcaactaacgacggccgctggttcctgagccccacttggtccgataaaattctcacagagtacccttttcaggaggtaaagacacaagaggaaatcgagtcccggatagcaatcttgaaggagaaggttaagaaactgaatgaggagcaagaacaggagattaagcttccaatagacgagtttatcaagaaacacatctctgaaatcgatacaacccgtaaactcgcactctttatcacgaagcttatgaagacactgttcagtgagaagcatttcgtgaccgagaagcagctgctgtatttcagcacccccaaagccggcaagcggtacaagacctttaaaatacgcaagaaaaacggcgggctgagggagattaacgcccctgtgcatcatctggataaaatcctgttcgtgctcaacatcatctttaagagtctttacacccctaataacgcagtgatgggcttcacagaggggaagtctattgtggacaacgctgctcggcacaccggccaacactatgtgttcaatatcgatctcaaggactttttcaccagtatcccccaagccagggtctgggggaggatccagtgtgccccgttcaacttttcgagggctgtggctaacgtagtcgccggactttgctgtgccacaaattcggagacaggcaaaaacgttctcccacaaggcgcacccacgtctcccctgctgaccaacgcaatctgtgatcggttagaccgacagctcaccgctttgagcaaaaagtacggtctgcattactccagatatgccgatgacatcacttttagctccatgcataacgtgtaccaggaggactctgacttcaggaagaagttaaagacaattatcgaagaccagaacttctgcataaacgataaaaagacacgcctactccggactggtcagaggcaggaagtgaccggacttactgtaaattcaaaggtgaacgttacccgaaaatacgtcagggacattcggtacattctgcacctttgggaatcaaaggggtacgcctttgcctatagcaagttctataagttctataagaccgagaaagggtatattaagaagggtgaaccagtgatggagaatgttattgggggcaagttgaattacctgaggatgatcaagggggctggcaatgaatgctatcagaaactgctccagtgttacaacaagctgcagcagattatctatgtggataataacactgacaagggacataattacgtttacgtccagcagtatactctcacggactttgagaatgacttcaagactaaaatcacactgcagatttcagatgacgaaaagctcgttggcaaatgcaacctctttggcatggataagacgattagtataagtcacaaaacccaggaggaactgtgcccaattatatcacatctgaaagtgggagatactttcacctccgagttactgaaaaactgttttgtgaccctatgcaggcagaaggggaaaaacttctggcttattacccataaagaactggatcgttccagatgcctgtccattcaaaatgcacaaatcgaatcggagaaactcttaaaggaatgggagcaaaaaggattcgaattcgtagttaaacagtttcagacagaaatcctgaaaaaaagcgacgtcccggattacgtctccgagagggatattaaggaatttatatacttcgtcacccacagtaaaaactttgaccgtaaacagaaactgcaacgcgattctcttctcgctcgcgatatggctaagcgcaaagcccagcctcaggaattcaaacctatgagtgttagctatacagccaattttttggcgaatttcaatagacccgacggtttcaagtatttgactcacgactttgataccgaatccaatatgactcttcctgacctgcgggaacagagctacaagcttctcgagtcagaaaagggaaaaatcccagattctctatatgtgttgatatacgcctatctgtctggcaaaacatggcgagacgcgttcggagacaacaacaatatctccatcaatgacaagaagtggattcagtggtctaaagagaacgataatgcccacccaattactaacagtgacttcgaaagcgagatactgaagttcaagaaagcaatcagaattgtacctcccctgctgcagacgattgtggataagatctgtgaaaagtacgagttgcacgtcacgacgaaaaagctagacaaggctgacttttatacaaacacctacattctgtctaacgttttggatagaatcctgcagatgatgaaacggcggaatgaaaacgtggattatcaacgcgacgtggaagtgtcttacaagcgagagattaccaacgacgtggtgtacaagaagataattatactccagaaggacagcttccccgagaatacatttgaggacgtgagcactagaatgaataataacaccgaagccggagatctgggtgcgattcgcaagatcctgaatggatattgctattggagcattgagactaaatgggacgataagtccctccggtggaatatcttgtcagacgatgacgcacctgaaacagagccaattgaggatactttagcggtaggttttcgacacatactgaccttcatgtga

SEQ ID NO: 7344 - RNA, 3114 nt, unidentified
  source 1..3114: mol_type = other RNA; note = synthetic construct
atggataagaacaaatacataacgatcaagaacgctgtgttcgataattacaacgaggactgctttttctttgagatcccctccatggacctctcaaacgctaattcctggcatcaccccttccttctgtatgacgggactaacatttactccattcttcgaggcgccgataagtcaaaacttcgatttgcatactgttatatccaccagtcaaaaaaaagtggccagtttttcttcaacattagtctgactgacaagatcattcagaagtacaactgtaagaaaatctctacaaaggacgaatttgagactctgaaagaacagttgaagcagaaggtaaagctgttgaacaaggaatactctcaggatgtgctgccactcgatgagttcatcaagaaaaacatcaactcccttaacaataccagggacctcgccttttttctgactaagataatgaaggtgatcttttcggagaatcatttcgttactgaaaatcagttgaagtacttctgcagcccgaatatcccgaatagatataagacgttcaagatacagaagaaaagcggcggtctgcgggagattaacgcgcctacaaaccgccttaacaagatactgtgcgctctcaacatcgttttcaaaacaatctacacccctcacaatgcagtgtccgggtttacacagggaaagagtatcgcggataatgccattaaacatatcgggcaaaattacgtgtttaatatcgacctgaaggatttcttcacatcgataccccaaaaacggatctggggtcggctgcacgtgcatccatttaacctcagaggccaggttgcaaacgtggtggccgggctttgttgctgtaaaaattcagagacaggcgaaaatgttctgccccagggagctcctacttctccactgttaactaatgcagtatgtgacaaactggacaagcagctgttcaaactaagcaaaaaatacgggctgcattacagtcgctatgcagacgatatcacatttagctctatgcataatgtctatcaggaagattccgatttcaggagggaattgaagattattattgaggggcagaatttctgcattaacgacaaaaagacacggctgctcaggagcggacaacggcaggaggtgactggtctgattgtcaacagcaaaactaacgtcacccgtaagtatgtgagagacttgcggtacatcctgcatgtctgggaaaccaaggggtatgctgtcgcctactccatcttttaccgtttctataaaaaggagaagggctacatcaaaaaaggggagcctgtcatggaaaatgtcatcggagggaagctcaattacctcagaatgattaagggcacctctaacgaatgttatcagaagctcgctcagcaatttgatcgcctgcagcagatcatttatgtcgatgaggacacagacaactcaaaacaatacgtgtttgtccagtcatataccatcaatgagtttgagcacctgttcaacaccaagatcaccctacaaatttctgcacgcaagaagctggtgggaaagtgtgagttatatggaagcgagaagattataccaatttctcacctcactcaggacgagttatgtcccgaaataacaaaattccacgtgggtgacatcgtgaagaatgagaagttagactccttttacataaccttatgccggcaaaagggaaagaacttttggctaatcataaacaaggagctgattcgaagtcgttgcctctcaatcaacgatattattatcgacacggagaatttctttcacctgtgggaaaccgagggctttattatagtcgtgaagctcttccagttcgtgctgaacaagtatggcaactttgataccgagaaggtggtgaattttatcaatgacttatccaaacgcaacgaaatctctaagaaaaaaagactgaccaagaaaaggaagctgcagattgaggaggctctcaaggacgactcttttaagaaaatcaaagaaacggagatccaggaatttgtgtacttcatcactcactacaagcagttcacctacaaacagaaaatgtatgttaacaggttgctgacacgggatcttgccacaaaatacattgagaagacggagatagttattgacgacggaaaacatagatgtggggtgcgatgcgagtatatcagccccaagaagctccagaagtttctgtttgacttcaatcaggacgaagttcttaaatacacctgccatccaatcgattctgaagaggtaatcgaggaaatcaacaagcagtgtaaaaccgacatctatagcgttgaagcccacagtaaattgattctggaacgcttcgaaagcaagtttaagaatgtgaaatcgagtaggaatatgcaaggcctcattttcgcctatttgaaaggtcctaaagaatggagcagcaacagagtggtgattaattggagctccaatgaattgataagttggagcaatgagaataaaggaaaaattgccagtcccggtaaaaatatagcggccaaacagaaaaactacggatttaaattgccaaacccgttcgtatcttccataaatggccaacgcgttgccactttcacgaatcttgtaattttcttcaagacgctgttccacatcaggagagataacagtcttaagaacatcatcacttacaacaacaagtcaatcgagaatgtcaatataaccttcagctcaaactttaatgagaacatcgaactgttcacagatgtggataaactactgcaagcctacaagaacattatcaagatctgcaccgactgctcactcgaaggcgagcagcctgtattcgagatatccttctataaagaggaaaataacgtctacttctgtatccaccacatcaataccaagtatggcaaaacccttgatgattccctgaagcgaattggagagtctcagtccaacctgataaagaaccaaattaatgggctatgcgacttgtttattgaagctgattttggtaacaaggagtatgcaagaattaacctatgggatgaaagcgatgaactgaaagctcaaaatattgccgagatgcagggcgtcaaatatattctcaggttctga

SEQ ID NO: 7345 - RNA, 2679 nt, unidentified
  source 1..2679: mol_type = other RNA; note = synthetic construct
atgaatttctgctttcctgataaaatgatcaccaactgtgaaaacaacatcctcgagaatgagcggaacctgaagatttctctgaaagaacacttcgaaccgattgagaatattgaggaacaaggggtgtctaacaaagataacacaaagtctctgtcaatcgacaagcttataaaggaacatatcttcaagacagactcgcccaataagctggcatggctcatctctaagatcatgaaggaggtcattagtgaaaactacttcgtgacagagaagcagctaaaatacctgtccacacctaaagtgtccaacaggtacaagacatttaagatcaagaagaaaagcggcggtactcgagaaattaatgctcctacaaaccggctgaataacattctctactctctcaacttgatattcaaatccttatacagtccccatgaagccgtgtgcggttttactgaaggtaggtccatccgcgacaacgctctccgtcacgtggggcaccactatgtgttcaatatcgacctcaaagactttttcactagcatacctcaggcaagaatttgggctaggattcagtgtgcgccatttaatttctctcctagtgtggctaacgtggtcgccggactgtgttgtgtatacaacgaggaactgggcaaaaacgtgttgccccaaggggcccctacatcacccctgctcaccaacgccatctgtgacaaaatggaccgcaagctggcggcgttagccaagaagtacggactccactactccagatatgccgatgacatcacctttagctctatgcacaacgtttatcaagaggaatcagaattcagaaaggagatgaaaaacatcatagagggacaaggcttctgtctgaacgataagaaaactcgcctactgaagtccgggcagcgccaagaagttaccggcctcaccgtcaatagtaaggtcaatgtaacaagaaagtacgttaaggatcttagatgccttcttcatatttgggagacgaaaggttacaatacagcttactcgtacttttatcctctatacaagaaggagaagggccatatcaagaagggggaacccgtgatggagaacgtgattggcggaaaacttaattatctacggatgatcaaaggggagagcaatgcatgctatcaaaaactgcagcagagatacgacaaacttcagaaaatcatctacatcgacaacaatatcgacaaggacataaccttcgtgtatcagcaatttgtgctacaggactttgagaaaaatttcagtaccaagatcagcttacaaatatctccaaaggaaaagctcataggtaaatgcaatatctttgggatggagaagatgctgagtattaccctcaatacgcagaaagagctgtgcccaaatctcaacacgctgaatgtgggcgacacggtcaatagcccaatcctgaaagactgttatgtaagcctctgctgccagcggggccgaaatttctggcttattagccacaagcagctggaagggtccaagtacttgacaattccctacattaagattaaccccgatatcctgctgaaaaaatgggaggaaactaatctcgaatatgtggcctggaaattttactttgccattagcaacaagatcgacattagtaccttggagaattcgatccaggagtttgtctacttcgtgacacataataagcattttaacaacacccagaaactgcaggttgcaaaattactggctagagattatcaaaagtcctgcgaggaacagaacgacaagctgatctatagtcaggagaacaagaataacgaagggaagatcatagaacagcagaaaatttttgacccaattgatacggcccgttttctgtccttgttcaatgagcccactggtctgaaatatcttacccacgatttcgatccagataattgtccggaaaccatcaacgaactgatcgagcagactgagaatgtcttaaaaaccaaaaaacggataccggagtctctctatgcccttatagagaacttttcattcggcaaaaaagagtggttggacacctttggcaaatcccacagctcatctatcgacaaaactgattggatagagtggagcgaaaatttccattctcatcccatcaataatcctaatttccgcaacgaaatcgagatcttcaggggaactgtgcggattgacaagggcttattgtcaaagattattgatgttgccgcacagaacacggcactcaaaatcgagaaggagaagatcgataccgcggatttctacaccaacacatacctgttgtatctgtccattaagcgaatattcgagatgatgaaccacaggaccgagtttccaaacgtattcgtctcctataaaaggggccacgacgagaacggagcaatgctgcgcaagattatcataagccagaagggaagctttccccagaagactctgcaggaaagcattgatcgattgaacaatcataaagaagctggagattttggcgctatcaagaagtatctgaatggatactgcttttggtccgtcgagactcgttgggaagggaagtcatcaaggtggaatattctgcggaacgccaacacaccagagactgaagagctagatcttgagtcagatggattcacccacattcttacattctatttggtttga

SEQ ID NO: 7346 - RNA, 1950 nt, unidentified
  source 1..1950: mol_type = other RNA; note = synthetic construct
atgaacctcaaggatcagaatctgatcaattcggactctaaaaacaagacaaagaaacgtgtcctggcccaccagtttcaggggatttttttcaatatgggcaactctgacctgacagagaagcgaaagaagattagtactgcggaagagctggcagctgtcctggacgaaatcaagcagatcgagtttgcaagcgtaagatatagcatcagcgtgaagatgctacggcatttttccagcgataagatcacccctaaaagattcagaacgttccacataagaaaaaaaagcggcgggcttagggagatcaaagcgccctgcaaacagctcgatgtcatccttacctgtgtaaacatactgctcaagtccatctatgagccgagtgatgttgctatgggatttgctcccggaaggtctgtgctcaataacgcacaggtgcacgttggacacaactatgtgttcaacatcgatctcaaagatttcttcccaagtattccgcaggctagagtgtggaagcgtcttcagctcgcgccttttaacttttcccaagagatagccaatatactggcaggcctttgttgctcatacgatgccaacgtgaacgccaacgttctgccacaaggctcccctgctagcccactcttaaccaatacaatttgcgacaagctggaccggcggatgaaaggcgtggccaaacggttcggtttgcactatagtcggtacgcagacgatatgaccttctcgtcaatgcataacgtgtaccaggctgggtctgagtttagattggaaattcagaggattatctccgaacaaggttttaggatgaatgacagcaaaacacgacttcagaagcgcgggtttcggcaggaggtgactggcttaactgtgaatgatatagcaaatgtgtccaggaagtacatctctgaccttcgctggatgctgcatgtgtgggaaaaggagggatacgccaaagcatacgccctgttttatcctaagtacaagcacgagaaggagtacatcaaaaaaggagaacccgtgatggaaaacgtgatcggagggaaattgaactatctaagaattgttaggggcgagaacaatccagcctatcgaaaactgcaggctaggtataacgctctgcaggagctggtatttgttgacaatgaaactgacaagtccaagtcatacgtatacgtccagccttacgctctggcagacttccaggagctgtttaataccacaatctccttgacggttactagagaaaagaaattggtcgggaagtgtatcatcgacaatcgcgagaagaccttgtcaatttcaaagagcacccaaaaaacactgtgcccgaacctcgggaatttgaacacaggcgaactggtgaattctgaagagctggccgagtgctacgtcaccttgtgtcgccataagggcaaaaacttctggctgataacgaaattcgagccaaaacggtcccgttgtctctctatccagaatttaaagatcacccccgacgaaattctagattattgggaccgctatggtctggaaaagaccattgaggacctgactcaatttattcaatacgccgacccagaagattcttttaaagactggcgcctgctcgccgatttcgagcacaccattgacaggggaaagttcaaaatcagtaagaaggatctcattgtcttcttccttaagaacaagaatgtcactagtctgcatcgaaaaaaagccatgcaattaatgatagactccatccccataaatacagatagcgaaaacattgacatcgaaaagttactcgacatttgggaagagaaaggtctggatgaggcggtccttgcctggaaggagatgtcacgcaagaaaaagagcaagaagaaaaaccccgaccctgatcctattgtgaatgatgacgccccccagttcgatctagtgttcgattggtga

SEQ ID NO: 7347 - RNA, 1953 nt, unidentified
  source 1..1953: mol_type = other RNA; note = synthetic construct
atggagaaactggatctgactgagaagctcaaaaatatcaacacagcagagcagctcgctaccgtccttgacgaaatcaagcagatagagttcggctcggtgagatatagcataagcgttaagatgttaaggcatttcagctccgataccattgcgccaaaacggtttcgaaccttccatatccgcaagaaaagtcgagggctcagagagataaaagccccttgcaaacagcttgacgtaattctgacttgcgtgaatattctgttgaagtctatctatgagccatccgacgtcgtcatgggcttcacctcagggcggtctgtgttaaacaacgcccaggtgcacatcggtcacaactatgtgttcaacattgatttgaaggatttctttccttccatccctcaggcccgggtttggaaacgacttcagctagctccctttaactttagccaggagatcgccaacatcctggccggactatgttgctcatatgatgccaatgtgaaggccaatgtgctgccacaagggagccccgcaagtccacttttgactaatgcaatttgcgacaaactggataggcgtatgaagggtgtcgctaaacgcttcgggctccattatagccgctacgccgatgacatgacttttagctccatgcataacgtttatcaagagggctccgaatttagactggagatacagcggattgtgagtgatcagggatttcggatgaatgattcgaaaacacggctgcaaaaaacgggttcaaggcaggaagtcaccggcctgactgtcaacgctatcgcaaatgtctcccgaaaatacctttccgacctgaggtggatcctccatgtctgggagaaagaaggctatgcaaaggcgtatgctatattctatcccaaatacaaggacgagaaggggtacattaagaagggagagccagtgatggagaatgtgatctctggtaagttgaactatctccgcatggtgcgtggcgaaaataatccggcctacagaaagttgcaggccagatacgatagtttacaagagcttgttttcgttgacaatgagactgataagtctaagtcctatgtttacgtacagccttacaccgtggtggacttcgaggaactttttaagacaaagctgactctcacggtgacaagagataaaaagctagtgggcaaatgcgagattgacaatagggaaaagacactcgctattagcaagaccacccagaaactgttgtgtgacaacttggataacctgaacgctggcgacatcgtacactctgaagaattatcagaatgctacgtaaccctatgtcggcacaaaggaaagaatttctggcttatcacaaagttcgaacccaaaaggtctaggtgtctgtcaatccaaaacctccgtattgctcctgaagaaattctcgactactgggaaaaatacggaatcgaaaagacaacggagaagctggtactgtttgtccagttcgcgaatcctggggattcactgaaagattggaatccctcagaaaacagcgagcacacaatagaccgcggatcgtttaagatttctaaggatgacctgatcgtgtttttcctcaagaacaaaaacgtgaccagtctgcagagaaaaaaagcaatgcagttgatgatagactctattcccgttaaccgctacagcgaaaatatagacatcgaaaagctcttagacatctgggaggaagaggggctggatgctgcagtccttgcctggaaagagatgtccaaaattaacaagagcaagcccattagccacaagaagaaggccaacactaaaaatcaaagttcccaggacacctttctggaggagatcggcatctctgaggaagagctggcgtccatccaacaggagatggcaaagtgtggtgggaaaccgatcggaaagccaattgccggcagttactctctggtgtga

SEQ ID NO: 7348 - RNA, 1986 nt, unidentified
  source 1..1986: mol_type = other RNA; note = synthetic construct
atggagaactcaaacttgactgagaagctgaaatacatcagcacggcccaggagctggctgtggtattggacgaaattaagcagattgaattcgggtcagtaagatacagtatctcagtgaacatgctcaagcactttagctccgacacaatagcacccaaaagattccgaaccttccatatccgcaaaaagtcaggcggcttacgggagattaaggctccatgtaagcagctcgaagtgatcctgacctgtgtgaacattctgctgaagactatctataaaccttccgacgtcgccatgggctttaccagtggccgaagcgtgctgaacaatgcacaggtacatgtagggcacaactatgtgttcaatatcgacctgaaggacttcttcccaagcattcctcaagcaagggtgtggaaaaggttacagctcgcacccttcaacttttctcaagaaattgccaacattctggccggtctttgctgctcttacgaccccaatgtgaatgccaacgttctgccacaggggtccccagcaagcccccttttgactaacgcaatctgtgataaactggacaggcgaatgaaaggagtggccaaacgtttcggactgcactatagtcggtacgccgatgatatgacattttccagcatgcataatgtatatcaggagggctcaaaattccggattgaaatccaaaggatcatctctgagcaagggttctacatgaatgagagaaaaacaagactgcaaaagacaggatcccggcaggaagtgacagggctaacggtcaacgccatcgctaatgtctcccacaagtacatttctgatttaaggtggatcttacatgtgtgggaaaaggagggctacgcgaaagcttacgctatgttttatccgaagtacaaacacgagaagggttacatcaagaaaggggagccagtgatggaaaatgtgatcgggggtaagctaaactatctgcgtatggttaggggcgagaacaatcccgcttatagaaagctacagacccgctacgacgcgcttcaggagctcgtgttcgtcgacaacgagacagataagagtaaatcttacgtctatgtccagccctataccctggtcgacttccaggaactgttttcgactaccatcagtcttgccgtgacccgcgaaaagaaactcgttgggaaatgtgtcatagataatcgggaaaagacccttgccataagcaagtccactcagaagtcactctgccctaacctcgacaatctgaatgccggagatcttgttatcagtgaagagctcgcgaaatgctacgtgactctctgcagacataaaggcaaaaacttctggctaataaccaagtttgaacctaaacgctcttgttgcctctctattcagaatttgagaatcgcgcctgaggatatactcgattattgggagaagtatggtatcgagaaaacagtggaagagctgactctgtttgttcagtttgcaaattcgggcgactccttacagaattggaaccactctgaaaatttcgaacaaaccatagatcgggggggttttaatatctccaagaacgacattatcgactttttcctgaagaacaagaatgttaccagcttgcacaggaagaaggcaatgcagctgatgattgatagtatccctgtcaacacagacagcgaaaacattgatatagtcaagctgctggatatttgggaggaaaagggactggatgccgctgtgttggcctggaaggagatgagcaaaacaaaaaaacttaagcccaactctaccaaaaagaaggccacggagcgcgatcgcagctcgcagaatacgtttcttaaagagatcggcatttcagttgaggacttggctgccttgcaacaggagataggcgagggaggaggcactccgattgacctcgacatagattgggatgatattccatttgctgacgacgactccgagattatcggagaactgtga

SEQ ID NO: 7349 - RNA, 1974 nt, unidentified
  source 1..1974: mol_type = other RNA; note = synthetic construct
atgaataaaaccgacatcctggaacagctgaagactatgaaaaccgtggaggaccttgctgtgttgctagacgccattaaacaggacgagtttggctccgttcgctacagcatctcagcaccgatgctcaaacatttctccagcgataaaatcgcccccaagcgcttcagagtattccacatcaggaaaaagtccgggggggagcgggaaattaaggctccatgtcagcaactctacgtgattctgacgtgcttaaatgtgatgcttaaggcctgctacgaaccctcagatgccgcaatgggatttactagtggcaaatcggtccttaataacgctcaggttcatgtcggccacaattacgtgtttaacatagacctgaaggactttttcccgtctatacctcaggctcgtgtgtggaagcggctccaattatctcctttcaacctgtcgcaggatgttgcaaacgtgctcgctgggctttgctgcgccttcgatgccgaggctgggcataacgttctgccgcaaggttctccagcctctcccctcctgacaaacagcatctgtgacaagctcgatagaaggatgaagggcgttgccaaacggttcggcttgcattactctagatatgccgatgacatgacattcagttccatgcacaacgtctatcaggatggctccgagtttcgacaagagatcctacgtattattgaagagcagggattttgcatgaacgataaaaagacacgtctgcagaaaaagggagcgcgccaggaagtaacgggcctaacggtcaatgccgtggcaaacgtaagccataagtacatcagcgatcttcgctggatcttacacgtctgggagaaggacggatacgcaaaggcctatgctttgttctatccaaagtacaagcacgaaaagggttacataaagaagggggaacccgtgatggagaacgtgatcgggggcaaactcgactacctcagaatggtccggggtgaaaataatccagcttatcagaggctgcaggcccgatactatgctttgcaacagctcgtctttgtggacaatgaaacagacaagtccaacagctatgtgtatgttcaaccatattctatgcccgagttccacgagctgtttcacaccgaagtgaaactcgtcatcacaagagaaggcaagcttgttggtaagtgcgagattgacgggcgggagaaaaccctggccatctcaaaaagtacccagaaatccctgtgtcccgatatcgagagcatgcacactggagaaattatcacaagtgatgagctagcgaagtgttttgtcaccctgtgtcggaataaaggcaaaaatttctggctgatcacaaaattcgagcctaagaggtcaaggtgtttatcaattcagaatctgaacgtgtcacctgaagatatcttgactttgtgggaaaaagagggacttgccagtactgtggaagagttaacactgtacatacagtatgcaaatccaaccgactcaattctcagctggaaccctctggcggacagcaaaaacaccatagatcgcggtagctttaatttcaccaaggaggacattatcgcgtttttcctgaagaacaaaaacgtaaccgcctcccatcgcaaacgagctatgcagctgatgatggccaatatacacgagcagtctgatggggatgggattaacgtggtggagctgctgaatatttgggagaaggatggcttggatgcggcagtgaaagcatggaaggaatctaccaacaagcaagtccaacagaagacaaaggcaaagaaatccaagagcaatagtgctagtaagttcactagggaaactggattttccaaagaggcctttggcacgtttagacaggagatagcactggacggtggaactcccgtagaaatcgatatcgattgggacgacatccctttcgacattgacgactctggggtgattggaggcctgtga

SEQ ID NO: 7350 - RNA, 1467 nt, unidentified
  source 1..1467: mol_type = other RNA; note = synthetic construct
atggacaaattggtcgtaatcgaacagctgaagaagatgaagactgtgaaggatgtcgcagtgatactcgacacaattaaaagatacgagttcgggtctattagttacaatatatccgagaagatgctcaaacatttcagctcagacacaatcgcgcgaaaaaggttccgtaccttctacattcgcaaaaagtccggcggctttagggagatcaaagcgccttgtcagcagttgcaggtaattctgacctgcttgaacatcctctttaagagcatttatgaaccctcggatgtggcaatgggttttactagtggacggtcagtcctgaataacgctcagatccatgttggcttcaattatgtgttcaatatcgacctcaaagacttctttcctagcatttcgcaggcccgggtttggaaacgtttacagctgccaccctttaactttagcttggaaatcgccaacgtgctggccggcctgtgctgtacctacgacgagagcctaaagttgaacgtattaccgcaaggctcaccaacctctcctctgttgacgaatgccatctgcgataagctcgaccggagaatgaaaggagttgccaagaggttcggaatccactactcccgatacgccgatgacatgactttttcttctatgcataacgtctatcaagaagatggtgacttccgcgtggagatctccaggattattgatgaacaggggtttcacataaacgagagcaaaacccggctccaaaagaaggatacgcggcaagaggtgactgggctgacagttaatgccgttgctaacgtgtccaggaagtatataagcgaccttcggtggatccttgcaatatgggagaaggatggctacgataaggctcaggcactatttaatccaaagtatcagcaggagaaggggtacattaaaaagtgtgagcccgccttagtcaatgtgatcagtgggaaactcaattatctgcgaatgattcgcggtgagagtaacttcgcataccagaagctcgcaaaacgctttgaggtgctgcaggagatcatcttcattcaccacaagaacgacgtgaagaacttcaggatcaatacaaagttcgagctgaagtattctcgctgcctgagaaatcagaaccttaaagtctctctggacggactcttagatatatgggagaaaggagggatcgaatccgctgtcgaggagctggctgaatctggatatatgagcattacctcaagagactccatcgtgtccggcaatgaacacctgctcaactactttctaaacaatccaaagttgaccatgacacatagaaaacgtcttatcagactgcttctggcctacattccttcaaaaccccttaagactgacattgaacaactgcttagtatatgggaaaaagaaggcctggatgccgctgtgcgcgaatggaagaaactgaaggataataaagctaactga

SEQ ID NO: 7351 - RNA, 1572 nt, unidentified
  source 1..1572: mol_type = other RNA; note = synthetic construct
atgaaaaaattagagatccgaaatcggctcatagcaatcaagaccgtggaagacctggcggagctgctcaacgagatcaaaaaggacgagtttggcacgaaccggtatgaaattacggataagcagctcaagttttatagctccgataagtatacctccaaaagataccgcacctttcatatcaggaagaaatctggtggtctaagagaaattaaagctccatgctatcagctaaacatcatactcaggatcttgaacattgcactcggggctgtgttcgagcctgactcagtggctatgggctttgcgcccgggagatctgttgtgaacaacgctcagaagcatgtaggccacaattacgttttcaacattgacctgaaggatttctttccaagcatccctcaggcgagggtatggaagcggctgcagcttgccccgtttaacttttcacaagaaattgcgaatgtggtcgccggattgtgctgtagttataatgaggagagagggcagaacgtgctgccacagggagcacccaccagtccgctcctgacaaatgccatttgttgcaatctggaccggaagatgaaaggactcgcaaagagattcggactgcactactcacggtacgccgatgacatgactttttcttcgatgcataatgtctatcaagagggaggcgaatttcgcaaagagctgttaaagatcatcagtgagcaggggttcacaattaacgataagaagacccgccttctgaagaccggctgtcgccaggaagtaactggacttacagtaaatgctattgctaacgtttccaggaaatacattcaggaattgagatggatcctgaacgcctgggagaagtacggatatgccaaggcctacgccttgttctacccccgctataaaagcgagaaagggtacattaaaaagggtgagcccgtgatggagaatgttataggcggcaaacttgactatatgcgcatggttaggggggccaataacgtcgcatacaagcgactgcagacacgtttcgacaaactgcaacaagtcgtctttatcggttccgaagaagagcagacccaagccaagaagttcatgtacgtgcagccttatacaatggctgaattcaaggaatacttccatactgaggtgagcttgactgtgacaaagaatggcaagctagtgggcaagtgcactattgctgagatggagaaaaccctggccatcagccacgccacacaggactacctctgccctgatcttaaacagcacaaggagggcgattgcgtcgagtccaaaaagctcgaaaagtgtaatgtgatactgtgtagggctaagggaaaaaactactggatgataacgaacaaagaccacaagcgggacaagatcctgtctatccaaaacgtcaaaataaatccagatgacctcttggatctttgggaaaaagagggttataaagcagcagccgaagaaatcactattgataatcgtaaagggatgcctgtgctgttaaccttgcccgggctggagctggagcgttcattcgatatcaaacgaaaggacaatgaatga

SEQ ID NO: 7352 - RNA, 1401 nt, unidentified
  source 1..1401: mol_type = other RNA; note = synthetic construct
atggagaagctggagatccggaactcattaatcgcgatcaaatcagtggaggatctcgccgaattgctgaacaacatcaagaacgacaaattcaaaacctcccgtcacaagattactgataaacagctcaagtactacagcaataataaatacgcaccaaagaggtatcgcacattccatatacgcaagaaaaatggcggtctgagggaaattaaggccccatgctaccagctcaatatcattcttcgtatgctgaacattgcctttgagtcggtatttgaacccgacagcgtggctatgggctttgcccccggcagatctgttgtgaacaatgcccaaatgcacatacgacataattacgtgttcaacttagacctcaaggattttttcctgtccattcctcaggcaagggtgtggaagcgcctgcaattggcgcccttcaacttctcactggaaattgcaaacgtggtcgcgggtctttgttgtagctataacgaagaacgggaccaaaacgtgcttccgcaaggggctcctacaagtcccctgcttacaaacgcaatttgcgggaatctggatagaaagatgaaaggtctggccaagcgatttgggctacattactctcggtacgccgacgacatgaccttctcttccatgcataacgtctataaagagggaggggagttcagaacagagctcctgaaaattataagtgaacagggatttaccgtcaacgacaaaaaaacccgcctgcacaaagcagagcacaggcaggaggtcacgggcctgactgttaatactaaggccaatgtctctagaaagtacatacaggagcttcggtggattttgaatgtatgggacaaatatggctacgcaaaggcttacgctctcttctatccaaggtataaaagcgaaatgggacacatcaaaaagggcgagcccgtgatggaaaatgttatcggcgggaaactcgactatctgcgaatggtacgcggcgctaccaatccagcttataagaagttgcaggagaggtttgataagcttcagcaggtggtcttcctggaaactgaggaagagcaacctaaaacacagaaatttatgtacgtgcagccttacaccatgacagaattcaaggagtattttctaacggaggtcagcttaatcgtgactaagaagggcaagctagttggaaaatgtaccatcgccggtatggaaaagaatttgtccatctcccacgccgctcaggattttctctgcccgaaactgaatttatgcaaggagggggatagtgtggttaatgagaagctgaacaactgctacgtgatcttgtgtagagccaaagggaagaactattggatgatcggactgatcggacagaagcggaatattctcaagatgaaatga

SEQ ID NO: 7353 - RNA, 1590 nt, unidentified
  source 1..1590: mol_type = other RNA; note = synthetic construct
atggacaataataccattatcgaccgatacaaaaagatccacgatgccggcgcctttttgggactgctcaacgccatgaagatcgaagaatatggggaaaagactgaaaagtttagcaccagagacttaaaggtatttatttggccgaacaaccctgaaagatatagcacattcacgatccccaaaaagagtggaggagtgcgccacattagtaaaccatgcccaaaactgaagtacatgctgcgctacgtgaagcagttcctgcaagccttttataaccctatgccctgtgttcaggggttcacgaccgggcgatcagttgttggaaatgccggcatgcatctccaccagaattacgtctataatgttgacctttctgacttttttccgtccatctcccagggtagggtgtggaaaagactccagctccctccgtataatttccctgtcggtctgtgtaatatcatagccggcttggcatgcgcgccatacgagactcccgaaggcgtgaagtacaacgccttaccacaaggagctcccaccagccccattttgtccaacattgtgtgtgagcaacttgatcgacgcctgactgggcttgctaagcgattcggtttgcactacagccgttatgcggacgatatgacctttagctcaatgcataatgtgtatcaagataacagcgaattcatccgcgaactgcagcgcctgattacacaacagggcttcaggttcaatgagaagaaaacaagactgcagatccgtggatcgcggcaggaggtaacggggctaaccgtgggcacaaaggttaacgtgagcaggcgttacatcaaagagttacggtctgttctccatgtgtgggaaaaattcggctacagtgaggcatttgcgtggttctatagtagatataagcgggataagggctcactgaaaaagggcgaacccgtgctggagcaggtcattgaaggtaagcttaactatttgaagatggtgaaggggaattctgactccacttacaaaactctagccggtaggatcgaggcatgcatgacagctctcgacgaggagcggcctaaacacgggaagaggaatgtactggtgagctacgagttgaaggacttctcaaccagattttccaacgtctccatggattttagtacctcaccagatggcattgtctcagggtccctcaccgtggactctgtagccacccctatatactttgacaagattttccggaaactgtcgtccgcaaacaaggctaaggtgctgaaagccataagccaagatacatctgactggtttatctccgaaattgaggatctggacaagaggtaccgcaacaaatttaatcatttctggctgatctctcggtataggcctcatcagtctaccacagtcgataaaagcgagataactagattactgctggagctctgggagaaggatggacttgatgcagctgtggatgaatggaaaaaactaatcaagtacgacccaagtcagaaaagtgagtccatgcaggctacttctctgcagaacccccagaacgtcctcgactcattcttctacgagcaccttaataaatga

SEQ ID NO: 7354 - RNA, 1461 nt, unidentified
  source 1..1461: mol_type = other RNA; note = synthetic construct
atggaacgcactgagatcgcaaaccgcgttaaagccatgatttcacaggaggatttgctgcaacttataaacgaactgaaagctgaagacctcggtgataatgcctacccattctctatgcgacaattaagatacttctgtaaccctaacaacgaatccaggagatacatccactttgacattaagaagaagtctgggaaggagccacgacatatcactgctccccagaaaaccctaaagatgatactcacatacctgaaccagattctgcaggcagtgtatgaaccactcccttgcgtcatgggcttcgtgtcaaacaggtccgtggccgacaacgcctctaagcatatcggcaaactgtacgtctacaacattgacctaaaggattttttcccgagcatagaccaagcacggatctggaagaaaatgcaatgtcccccctttaatttctgtaatcaggaggatccgaatgcaccacagcggcgtgtgctcgctgatatgatcgccgggttttgttgcatgaagaaacctatggaggacggcgagatcaaacagaggtatgtgctcccacagggaagtccttgttcccccgtgctgaccaatataatttgcgagcgcatggacaggaggttgacgggccttgccatccgtttcggagcaacttacacacgctacgctgacgacatgaccttttcgagcatgcacaacatctatcaggacgattctgagtttatcaaagaactgcaccgaatcatctccgaccagaattttagaattaatcccgcgaaaactagactgtgcacaaccaagatgaggcaagaggttactggccttacagtaaatgagaaagcaaacgtcagccgcaagtatctcaaagaactgcggagaaacctgcataattgggagtattacggttataatgaagcgtataaacggttttacgctcggtataagatggaagtggggcacaaaaagcatggagagcccgtcatggaaaacgttttggggggaaagctgttataccttaaaatggtgaagggcgagagtgatcctacatatcagaaactgcagaagaggttcgatatccttgtagaggccaaggaaggacgaatgagccagtacgccgatagcaaattccggtatattgtcacgtacagaattgctgaatttgaggacatcatttccactaagattcagataggggttagtgacaatggttacaagtatgctttctatgagaatggctcaaagagaacctacataagtttgtcaaagaacatcgggaaggaaggaattcacaccctcttcatctctctgtgcgagaaccagaaaggcaagcgtttttacctaattcatcgcgccattgaggagaaagccaaagtggagacaaagcaaaccctccacttagatgcgatgctggataagctgttggaaaccaatttcgacatcgatagcatctga

SEQ ID NO: 7355 - RNA, 1590 nt, unidentified
  source 1..1590: mol_type = other RNA; note = synthetic construct
atgacccccaacgaaatcgcaaatgaagccaaaagcctccagacacctaccgacctgctggagttgatcaacaaaattaggctgtcagaagatgcccaaactcaccgggctttgtctcttaaggagctggccctgtactgtaatccggactccagtaaagtcaaaaggttccggaccttctttatccctaagaagtccggggggaaacgagagatctctgcaccagtcagcaagttggatgccttcctgtggcccctagatctaatcttaaagagcgtgtatgaacccaaatcttgcgtgatgggctttacatacggtcgctcaatagtggacaacgccaaagcgcacctgggccagaattacgtcctgaacctggacctggaaaatttcttcccttccattacccagggtagagtgtggaagaggctgcaggtcgccccttacaacttcgcaccaaaggtggcctccgtcatcgctggtctgtgcagcatcaagaaggtaaatgatgacggagagacacggtatgtgttgccacaaggagcccccacctcacccgtcttgaccaatataatatgtgaacgccttgatcgccggctcctcggagtggcaaagagattcaacttgcgttacacgcgttatgctgatgacattactttttcgtcgatgcacaatgctctgaaaatagggggcgaagcgtttcaagagatcaaacatgttattgaagagcagggcttcgctattaattcaaaaaaaactcgcctgcagaaagtaggggaaaggcaggaggttacggggttgattttatccgaaaaagtgaacactccaagatcctacgtgcgggatctggaccagattctatacgtgtgggataagtggggatatgagaaagcctacgccagaatgatgttagtgaaaggtgagaaggcttacaggaagaatggacttactacattagagcgagttatcggaggcaaactggactacctaaagatggtgaagggggaaaacgacaaggtgtatcttaagtatctcagtctctttaaccgacttaagaaacaaggcgcacatagtgacgactctctcaactatgtcgctacctacaccgttgcaagcttccaggagctctttaagacagacctgatatttaaggaagagggcgagcatattagagccagctttagactgaacgacgttttccaccctgtacgcattacgagcttcgcgtccaaagcaatcagtgacaaaggcaaagaaaaggagtctctctatatttcactgtgcgaggatgaaaatctcttttggcttatccatatccgtgaacccaaagctgccccatctaccgatctgatcctgcccatcaaaaagataattaagatctgggaggagaagggactcgcggccgccattaaggcagaggaggaagcccggaagaagcagagtagggccgaggagacaaagaaaccaactcttcgcgctatgatgatggctaagtattttccggagctggcagagatcgagggcgagttcaaggatctccctagcctgatggacatgattaaccacttagaagaagatggggagacaaattga

SEQ ID NO: 7356 - RNA, 1755 nt, unidentified
  source 1..1755: mol_type = other RNA; note = synthetic construct
atggacgagaatgagatcaaggaccgtgtgggaaagttgaggacaaaagaagacctgttagatctgctgaactcccttaaagtcgctgagtatggcgagggtgtgcatctgtttaccatgaaacagctgaacttctattgcaaccctaagtacggtaagcggtatcagtcttttcgcattccaaaaaagaaaaagggggagttccggacaatttccgccccagtggctgccctgaaatcaattcaacacttcattaacgtgatcctgtccgtgttatataagcccacggatgtcgtcacagggtttgtgaagaataagtcagtggtggacaacgctctgagacatgtcggaatgaactacgtgctgaatatcgacctcgagaatttctttccctctattccacaggtgcgaatctggtggcttctgcagcagaaaccttacggattctccaaggagatcgccaatgttatcgcaggcctctgtgccattaagcaaccaaaaaaagaagttgagtcccccaagaatgcaatcgaagattacgactacgtgttgccccaaggtagcccaacgagtcctatactgagtaacatttcgtgcgagcacctggaccacaagctgcagaaactggccaggtcttttggcatgaattattcaagatacgcagatgacatcaccttttcatccgaagaatacgtgtacagcaggaaggggaaattttggactcagctacgaaggatcatttcagagcacaaattctcaattaacgagaacaagacaagactgctccgcaaaggcgtccgccaggaggtaaccggccttaccgtgaataaaaccgcaaacgtgagcaaaaagtatattaaggagatccggagacacctcaacacttgggaaaagtacgggtacgctatagccttcaagaatttctaccctatctacaagctggaaaagggacatgttaagaaaggagaacccgacttaatgaatgtgctctccggtaaacttttatatttgaagatggtacgtggggagagtgatcctgtctattccaaacttaacacgcgcttcaagaatcttactactggggaggatagttctatagtgttcggctccatgagttaccacaatacccagaaagtcaccgaatttgagaagactatggatacagagataaaaatcaacagaacccaaggcaccctaaagagttatttcttcgagactaaaagcattgcgactaagaaaagacgcaagaaggaaaatagcccttctgagccgcaggtaacaaaagttgatgtgaggatcagtgaaaatgccaattttgagcacaagaaggatttgttcatatctctctgtcgcaacgaaaaaggagaaacattctatctcatgcacaaagagctgttttcgaccgatgagaaaaatgagcggaagctcgagctggacaagatgttgtctgccttggtgaggggcggaaaggtacatctcgaagtgctagaaaaggatattgttaacgaagaaaagcccatttatgaagacactatgagcgtcgtcgaatttgagaagaaacatcggtgcaaggtagagctgagcgaggataagaaatatgcggttgctaaatacaaagtcaagagggagaacataaaaatcagccccaaggttaacccagaggaataccgagaacacagcatcagcaagtataccaaaggctccgactcttcatactacctcatccatagaaagccgcggacagacaagaaatga

SEQ ID NO: 7357 - RNA, 1338 nt, unidentified
  source 1..1338: mol_type = other RNA; note = synthetic construct
atggaaatcgatattgtgtcatcggtgaaaaagcttaggaccaagtcagatctcctccgtctgataaatcggataaaggagattaagttcgtagaggtaggactgcagaaaaaattctccccagtaactattaagcagctggaatactatagtgaccctaacaatacgtacaggagatacaggaagttttccatcccaaaaaagagcggcgagttaagggagattcacgcaccccgcaacgcaaactacaaagtgattctgcgaactcttaatgaaatcttaaacaccgtgtacgagcctagcgagtacacaatgggatttgtcagaggcaagagcgtggtcacaaatgcgctgagccatgttggaaagaattacgtctacaatatcgacctaaaagacttttttccctcaattgactatctccggattgctaaaagattacagctgtctcccttttgcttcccaagacagatagcgatcataatcgctggactggcatctatacgtacagacgaaggggatgccgtcttgcctcaagggagcccgctgtctccgattctgaccaacataatctgcgataaattggaccgcaaactctcccggctcgccgagaagtttggtctttcctactccaggtacgctgatgacatcacttttagttcctaccataacgtgtatcaccaggatggcgaattttgtaagaagttgaaatccatcatcgaaaagcagggctttaagattaatgagaacaagactcggctacagaagcgcgggcaacgccagttggtgacaggtatcaaggtgaacaccgagactaacgtcgaccgatcgtatatcaatcaaatccggaatctgctgtacatttggaagagatacgggtacagtgtggccgaacagcgctattatgagtggagactcaaaaataagccactgagctataaacgcactagtctagcctcatatttgaacgggaagattcaatatctcagagccgttaaggctagcggctatagcacagcctacatccatttcctgttcgaatatgagtacctgtacaaggagacattcaaaaagaaaaagcgatacggaatcaactatatagaaaccacccccctcgagcaattcgagaaaaaacttggcgtgcagatcgacatcaataaaaaagtggatgcagatggtcagagccaccggttctctgtttttgaatataagttcatccccaccttcattagtgtttctaaggacatcacgcctgaggacgaaaccaacaaatccaagctgtctatttcaaggtgtattgatcagaggaaaaaagagttctggcttattcactattga

SEQ ID NO: 7358 - RNA, 966 nt, unidentified
  source 1..966: mol_type = other RNA; note = synthetic construct
atggatataaaagacaccaacaccctggtatctactattgaaactatcgctccttataacgttggctgggcgctgaccgatagggtcggggatatcaacaacctcgcaagcgcccgtcttcgtacattaagctacaaagagttcgacatccccaaaaaatcaggtggcacccggagaataaccgcccccgtgggtaaactgaaagacgtcctgaagtgtctgagcgtgattctaactccatactacgagcccggagggtgcgtccacggatttacaacccaacgcagcgttgctagtaatgctagtgtgcacatgggcaaaaattatgtccttaacattgacctcaaggacttctttccttcaatcaccgccacaagagtccaaaaggccttacagaagcatggtttgaattcagaagtggctcaccttattagtaggctgacgactctgccaatggcaattgaagatagccagacactgcgcaatgtgctccctcagggatcaccatgctctccgctcctctctaatatggtgtgttccgacctggatcgaaagcttatgggattggccaggcgctttcgggtggattacacgcgctatgcggacgacatgacattctcctctaatcaccatgtatacgcagcaggaggcgagtttttcgcagaattgcgatccataatagaggattgcgggtttaccatcaatgaacggaagacaagactacagaagcgggggtccaggcaggaggttactggggtgatcgtgaacgagaagacaaacgctcatagatcgtttcgaaaaaacttgagagccgccgtgttcgccgctgaaactttcggctgtaccaggaaagagtacaacagcatcatgggcaagattagttacctgtctatgctgctcaatgaggagcggggctgcatttataagtataaggccatcatgtccaaggttatgatcaagaaatga

SEQ ID NO: 7359 - RNA, 966 nt, unidentified
  source 1..966: mol_type = other RNA; note = synthetic construct
atggaactcaaagatactgacgccctcacacgggcgattgaggaaatagcgccctattgtgccggatgggctctgaccgagaaggtgggggacatcaatcgcctggcttcggccaggcaccgtattctagcatacaaggaattcaagattccaaagaaatctggaggcaccagaaaaatcacggcacccaccggcaaattgaagggcgtgctgaaatgtttgtcccaaattctgactacatactatgaaccccacgagagtgcacatgggttcatgccgggcagaagcgtcgccactaatgctgacgtccatgtggggaaaaactatgtattgaacatcgaccttaaggacttttttcaaagcatctcaagccagcgcataacacgcgccctgactaggcacggcttgtcacaggatgtagccgagctgatctcccgcctcgctaccataccaaccgtgaaagaaggctctgatatctccatacacgctttacctcaggggagcccttgctcaccaatcctcagtaatatggtgtgcgtggatcttgataaaaggctctccggtctggccaagcagtttagggttgattacaccaggtacgctgacgacatgaccttctcctctaatcataacgtttacagtgcggacggaagattctttgaagcactgagatcaattgtcgttgaatgcggattcgtccttaatgagaagaagacacgcctgcagaagagaggtagccgacaggaggtgaccggaatcttagtgaacacgaagcggaacagtcatcgaagcttcaggaaaaatctgcgtgccgctgtgttttctgcagagactaacgggtgcacacaccgggagtacatgcggattatgggcagaatttcttatctatccatgctgcgaggtaaggaggatccttgtgtgaagcggatgcaggccatcatgagcaaggttgccgtcacaaaatga

SEQ ID NO: 7360 - RNA, 1017 nt, unidentified
  source 1..1017: mol_type = other RNA; note = synthetic construct
atgagcttcacggtgccaatcacagtcccgttaccagagacattgccccagctgcacgaggaaatggctagaattgcagttagtacctcagggtgggctgtgcataatccaggcggaagggagttcctctccaaggcggagtctaggtcttttagacagcgattttatcgagagttctcaatccccaaaaaaagtggcggccgccggagaataaccgctcctacaggctatctgaaaggggctcaaaaggcaatcgccgtgctcttagaaagactgtatgaggcccctgacatggtgaatggtttcaccggcgacaggagtgtactgacaaatgcagaggcccatgtgggacgtaattatgtctttaatactgatctgagggactttttcccctcgatcactgccggtatggtccggaagactttggagaaagaaggcgtttcccctgaagttgccaggtacattagcgtggtttgtaccattacaacaggggatggggacctttccgaagatgttctgccccagggctctcctgcgtcaccaattctgagcaacatggtgtgcctccaaatggatagacaccttgattggctcgcccggcggtacgggctgacttatacccgttacgccgacgacattacttttagttcaatgcactctgtgtatggcaaaaacagcccattcctaaagggtttgaaagagattatagaagagtacggatttagcatcaacgaagaaaagacccggcttcagaagaagggttccaggcaggaggtcaccggactgatcgtgtccgacagagtgaacgtctgccgccgctacctcaagaacctgagggctgaagtgttcaggatggaaatgcagggctttacgatcgaggaataccgccgggtcatggggaaaatagcattcgtaggaatggtacgcgggcgagaggatcccctatacagaaagctgcacaaccgaattcgtagcatcaagcgccatcctgagggattccttgcccagccgcggtga

SEQ ID NO: 7361 - RNA, 1017 nt, unidentified
  source 1..1017: mol_type = other RNA; note = synthetic construct
atgaaagctatgaaaccctttaagaatatcccggacacactggagcagatgtgtgaacgcatcatgatacggctgcctctggtgtgtcgcaaaccccagctgttgggtatggacgacatactgccataccggcgccgcaaagtgcgtatgaatagctatcacgaattcggcattcctaagagatcgggggggatgcgtgtgatccaagcaccttgtgaagagctgaactacattcagaaggccgttaattctttactccgggagcaatggaccccagccgatgaggtctgcggattcgtgcagggcaggtcagttgggatgggtgctgctcagcacgttggaatgcactacgtctttaacacagacctccatgacttcttcccctcaatcaccgcccctaaggtgtttgaaatgcttatgcgagaactggggatgaagccagccgtggcgagactcatttgcgacctctgcacaatcccagtgaaagagggatatgatgtactccctcagggaagtccagcatcccccatattaagtaacattgcctgcgcgagaatggatcgtcgcctaaagggtctggcagaatgttttgggcttacttacacgaggtacgccgatgacatcacattcagcgccccctataacgcgtttaaagagggcggcactttcaggatttgcctggagagaattattcgagaagagggtttctccctaaacgaagctaagaccagactgcagaaaaggggggggagacaagaggtcaccggccttactgtcaatgaaaaggtgaatgtgcctcgcaagtggctgaaaggcttgagggcatgtatccatcggatggaggtagatggcttttctccggaggagatggatgctgcacggggaaaggtcgcctggttgaggcatgctcgaggcggcttagatcccctcagccagaaaatggtgatgcggctgaacgccttggaagttgccctttatttcgacgagctgccagatgaggacggatccaagatctga

SEQ ID NO: 7362 - RNA, 987 nt, unidentified
  source 1..987: mol_type = other RNA; note = synthetic construct
atgaacgcctttctttataacctgggaccagaatctcttccagttggtacacccgacgagctgtgcatgagcatcatgctcgcactcccggccgtttgtcggaggactctgctgcctgggacaggatctattcgtaaatttagacaccctgcccgacgcaccgcagcttatagacggttcgagattcctaagaaaagcgggggagtgcgaaccattatggctcccaccggcgacctgaaggacatcttaacaactgtgaatagtctcctttcgctctattgggagcccaagcacagctacgtccacgggttcacgagcggacgttccgttgtcagtggggccgagccacatgtgggcaaaaactacgtgttcaacctggatctcaaggatttcttccccagtataacaaaacagatggtggcacgggggttggaaagagccggttttgaccggaggactgcaaggtttctgtccgaaatttgtaccgtccccggggacgacggacgagagattttgcctcagggagcccctacttcacccttactgtcaaacatatcatgcatgatgctcgacttacgcctggctggcctcgcagctgaatttagcctggattacactcggtacgccgacgatatgaccttctctgctcaatataatgcgtttggtccacgcggcgatttcaggtcccttatggagacagtaatcagggaggagggcttccggatcaatgagaagaagacgagattgcagaagagaggttcccgtcaggaagtgacaggcctgaccgtgtgtaggaaagtcaatgtcgccagaaagtggatcaaggatctgcgagctcagatccatagaatggaaaccgtgggctttacccctgcagaataccggtctgtttgcgggaaagtgggctggatcaggcaagtgcgcggcgctgtaccaatgtaccgcaaactgcgcgcgaggttgagagccctaccgctaccagcctga

SEQ ID NO: 7363 - RNA, 1014 nt, unidentified
  source 1..1014: mol_type = other RNA; note = synthetic construct
atgaccgaagacctcagggattacctacggggctgtatttctaccgcatctattgctgatatgtgtgtctcaatcaacgaaatcggaccttttgtgagcggactgtcaatctccaatcccgtttccgtatctctgctcctttactacacagatgttagagtaagaagagcagcataccacgaatttcagatacccaagaagagcggcggttttcgcaatatcctgagcccatgcggcgaactgaaggagatcatgcatacattggctttcattctgaaagagctgtatgttgcaaccccaccagccatggcctatatcgccggcaaatcgatcgttgacaacgcttgctgtcaccttggacgaaattacgtgttcaacgtcgatctgtccgacttcttccctagcattacggccatgatggtggaacatcaccttgtgaaaataggagtgagtcccttggtggccactgtgattgctacattatgtacctatcctaccatcatcgaccaccatgtagtcaatatcgttccccaaggtgctccgactagtcctgtgatctccaacatttgtgcgacaaccctggaccaccggctttctgggctggcaaaacgattccatctaagctatactaggtacgccgacgatatcactttttcctcaaatcacaacgtgtatcaccccgatggggatttcatgattgagctgtgccgtattatcgacgagtgccactttaccataaacagaaataagacacacctgcagaagcgcggcgaccgccagatggtgacaggtttattggtctgcgaaaagccgaacgtgggaaggaagtttataaaggatctccgggcgcatattcataaaattaagttcgaggaggagccaactctgcatgacatcaacgtggtcaggggcaaactcaatttcctccggatggtcaaaggggccgaggacaccacgtacctcagtcacataaagaagttgaatatggccattaaagggaaacattttgtctga

SEQ ID NO: 7364 - RNA, 1029 nt, unidentified
  source 1..1029: mol_type = other RNA; note = synthetic construct
atgaacgctgagttaagggaggaactccggagtcatattaacgttgatactattgagggcttgtgcaaatctataaacgaaatagggccctacgtatcctttctgggcatggattcatccatttcagtcagtaccctcaagtattttacccaagtgagtgctcgcagagacgcttataggcagtttcatatccctaaaaaaacaggaggcgtaaggactattaccgcccccgatggacagctgaaagacatcatgttcaccctcgcctttattctgagcgaactttacatccctagcccagaggccatggcctttgtcccacagcggagcatcgtggacaatgcacagcagcacctgtgtaagaattatgtgctgaacctagacctgtgcgacttcttcactagtattacctcatacatggtggaacgcggcctttgtgaactgggtatctctcctgtcgtggcacagtgtttgagcactatctgtacgtaccctgagttcaaagagaatcgggtccagaatgtggttccccaaggagccccgaccagcccagtaatcagcaacatctgcgcacgacgtctggatcgaagattgtcaggtttagcgagatccttccacctgtcttatacaaggtacgctgatgatatcaccttttcttccaaccacaacgtctaccatcaggacggcgccttcatggcagagttgtatcgtataataactgactgccatttcgccgtgaatgaaaagaaaacaaggctgcagaagagaggggcccggcaagaggtgacaggcctgtctgtttccgagaagccaaacgtgtcgcgcaaacacgtcaagaatctaagagcccttattcacaaaatctcccttgaaggagcgcccgagatgcacgacatcaatgtggcccgcggtaagctcaactttctccgaatggtgaagggggaaacagatagcacgtacattcggctgattatcaagctcaataaagcggttgctgggaagcatttcgctgactctataaaggcatga

SEQ ID NO: 7365 - RNA, 1026 nt, unidentified
  source 1..1026: mol_type = other RNA; note = synthetic construct
atgagtctgcaggagtatcttatcgaccacatctgtcttgacacccgagagagcctatgtgagagcataaatgagattggcccatatgtgagcggactgtccattgacaacactattactgttaaacacctccggcgccatgcaaatgctagaataaggttaggttgttaccacgaatttaggattcctaagaagagtggcgggtttaggacaataaccgcgccggacggccagttaaagcacattatgactgcacttgcattcatactgacatatatctatcatcccaccccaacagccatggcttttgtcccttgcaggtctatcgtggataacgccagaatgcacgtaaaccacaattacgttttcaatatcgacttgtgcgactttttctcttcaatcaccgccgacatgatcgaatacagcctcatcaggcaaggaattaattctatggtggcaagagatatatccacgatctgctgctaccccgtctccgatggcacccatacacggaacatcctgccacaaggggcccctacatcgcctgtgctgagtaacatctgcgcccaaactctggatcagcgactgacaggtctggcacagcggttccatctcacgtataccagatacgctgacgatattaccttttcatccgatcacaacgtctatcatgataatggagcctttattcaggagttgcgtgccattattgctgagtgtcacttcgtgatcaacacgaaaaaaacccgcttgcagaagcgcggctcacgtcaggaggtgactgggctcacagtgaatgaaaggcccaacgtctctcgcagatacatcaaaaacctaagagccatgattcaccacatagaactcgacgagcatccatcatgtcatgcgatcaacgtggctcggggtaagctgaacttcttgcgaatggtaaagggggaaaatgatagcacctacattcggcttgtgatcaagctgaatctggctgtccgcggaaaacatttcgcctccgacactcccactgtttga

SEQ ID NO: 7366 - RNA, 1017 nt, unidentified
  source 1..1017: mol_type = other RNA; note = synthetic construct
atggatatcgacgtttcctctagagatgccctgtataactcgatctataaagtgatgccttatgtatccaacaccctgctggctagtccgtctgtgctgtacaagaaaattcgcttttataacaacgtcaagaacaggttgagcgcataccatgagttcctcattccccagaaaaccggtggaacccgtaagatattagcgcccaattccgacctcaaatctctgatgtcagcaattgcctttatcctgaacaccatgtatatgccttccgatagtgttatgggattcgtgaaacagaggagcgtgcttacaaacgctaaaaaacatgtcgggaacaactatgtgtttaacatcgatcttagcgactttttcccttcaataacagactctatgatcgaagcccagttactgaaaatgaatataccccctttggcaactcgcattatctctagcgtgtgtacatacccacagaaaatggagggcggcacatacaggcaagttctgccacaagggtcctccgcgtcacccattttatctaatatttgctgcatcagcttggataaggccctagagggcctcgccaagcggttccacctgacctatagtagatacgctgacgatattactttctcctcaaatcacagcgtctaccaagaagacggtgaatttatgactgagctccagaagatcatcgctacacaccactttttcattaatccaaagaagacaagactgcagaaacggggaaccaggcaggaagtgacgggggtaagcgtgaatgagaagaccaatgtcagtcgaaagtacgtcaaaaacctgagagccctcattcaccagatcgcccttgccaagaaactctcaacgaagaaggtgaatgtggcacgcggaaagttgaactacctacgaatgatcaaaggcgttaatgacaatacttacaagaccctgtgtataaagcttaatctggctctcaagggcaagcatttcactccaaaaaagaagcggagttacgtaaaatga

SEQ ID NO: 7367 - RNA, 1182 nt, unidentified
  source 1..1182: mol_type = other RNA; note = synthetic construct
atgcattcactagttcactcagcacactgcagaagtctcgatcacccggcacataccaaggtccgccctatgttctcccttctttcgcagattgacaaaataatgcgggatcagatcgtgaagtacctcaaagacatcactattgggaacccaaaggaacttttcgacgttctgaatttcatcgcaccactgatcgatggatggtctttaaccgagccgaagtctggccggcagataatgagattcgccagtgtgaaagcaagacagagcgcctatgtagattttacgattccaaagaagtcaggcggttatcggaagatctctgctcccgtgaagccactgaaggctatacagtctgccattaatatcctgctgcaggccatttttgtgccagatgagcatgccacagggtttgttctgaacaggagcgtcaaagaaaatgccttgattcacgtcggacagacttgtatcttcaacatggatctggagaactttttcccctctatcaccaaattaatggtcagacaggctctccaccgggaattgggcgatcgactccagtccaacgacgtgataaatattatttgtcggctttgcactgtctctgatagtgagggcgtcgaagtactgccccaaggcgcacctactagccctgtgctgtccaatatcgtgctgaagtcactagacaaagacatgagcaaattggcggagcgaatggagtgcaaatactcccgctatgccgacgatataaccttcagccatagcaaaagtataaggaggatgtcacccttctggcagtccagactctataacattatcgctaagtacgggctgaaagtgaatgaaaagaagaccaagacctttgtacccggtacaaggagggaggtgacaggagtggttgtgagcgacaagattaatgtgcctcgcagctacatcaaacagctccgtgtgttactgcacctgtgggagaaatacggatatgcccaagctcaaatcatctttacacgagacttttgtaaggggatggaaaagaacttggtcaacgttattgacggtaagatcaactacctcgaaatgattaaaggcaaagacgatcctacgtatcgtaagtttaagtcccgcttctcccatctgcaatggaaagagaagcagtacagtaaccagatccaaaatgcgatctga

SEQ ID NO: 7368 - RNA, 1080 nt, unidentified
  source 1..1080: mol_type = other RNA; note = synthetic construct
atgcgggagcaggtagccgaatacctgaagaacgtaaccatttcttctagaaagcaactgtttgatgccctgaatttcattgcccccctgattgatgtctggtccttggcagccccaaagtcaggacagcagttcttaagattcagctccgccaaatcacgcacgaccgggtatgtggatttcaccatcccaaagaaaacaggtggcgtgcgaaagatctctgcccccgtcaagcctcttaaagaggtgcagtcagctattaatacactgctccaactgatcttcattccagacgagcatgcgaccggattcgtgctgggcaaaagcgttaaggacaacgccctgattcacgtggggcaaacctgtatctttaacaccgacctcgagaactttttccccagcatcactaagaagatggtgagaagagcgcttcacactgagctaggtcatattctgaactcaaacgacgttatcaataccatctgcaggctctgcacagtgccgaactccgatgggattgaggtattgccccagggtgcacctacatccccaattctgagcaatattgtgctggccggattggaccgcgatatggctaagctggcagataggatggaatgtaaatacagtcgatatgcagatgacataacactcagccacagtaagcctgtcaggaaaatgtctagttacctgcagagtaaaatccaccgtataatcctaaagtacggcctcaaggtgaacgaaatcaagactaagacttatgtgcctggcagacggcaggaggttacgggggtcgttgtgtcgtccaaaatcaatgtggctcgtacttatgtcaagaatttgcgcatactgcttcatttatgggaaaagtatgggtacatacaggctcagctgatttttatcagggatttttgccacggcaaagaaaagaacttagagaatgtcatagacggaaaaatcaattacctcgagatgatcaagggcaaagacgacagcacttaccttaagtttaaacgcaggctcaagttgcttcagtacaaagaacggcaaaaaaccacatatacgaaacgggctatctga

SEQ ID NO: 7369 - RNA, 1080 nt, unidentified
  source 1..1080: mol_type = other RNA; note = synthetic construct
atgaggacacagattgccgattacctgaaggacctgactattggtaaccgtaaagaactgttcgaggtactcaatttcatcgccccccttgtggattgttggagtttggccgagcctaaatctggcaagcagatcatgaggtacgcttccgccaacgcccgcaagtccgcctatgtggaatttagcatcccaaaaaaatctggcggtcagcggaccataagcgctcccataaagcctctgaaagcaatccaatcagctattaacatcttactgcagtccatctttgtcccggataatcacgcgactgggtttgtcctggacagaagtgtgaaagacaacgcactcattcatgttggacagacatgcattttcaatacagacctggagaattttttcccctccatcaccaagattatgatacggaaggctttgcatagagagctgggtgacaaactccagtcaaaggaagtgattaacataatctgcagattatgcaccgtacccaactcatccggcatcgaggttctcccacagggggcacctacttctccagctttgtccaacatcgttcttaagtcttttgacaaagacatgagcaagctagccgaaagaatggggtgtaaatactcgagatacgcagatgatattaccttctctcattcaaagagcataaggcgaatgtcgctcttctggcagagtcgcatttataacatcatcgcgggatatggccttaaggtcaacgagaaaaaaaccaagacccttgtgcggggaacgaggcaggaggtgacaggagtcgttgtgggagacaaaattaatgtgcctaggagctgcgtgaaacacctgcgtgtattgctgcacctatggaagaagtatggctatacccaagcccagattatttttactcgagacttctgtaaggggaaggaaaagaatctggtgaacgtcatcgatgggaaaataaattacctcgaaatgatcaagggcaaggatgatagcacgtaccggaaactgaaaagttggttcaatcgcttacagtggaaggagaagcaacgcagcaatcagatgcaaaaggcaatctga

SEQ ID NO: 7370 - RNA, 1080 nt, unidentified
  source 1..1080: mol_type = other RNA; note = synthetic construct
atgctggatcaaatcgctgactattttaaggataagaccatcggcaacaggaaggacttcttcgatgccttaaatttcatctctcctcttatagatggatggggactttgtgagcccctcagcggcaggcgcattcttagattcgtaacaaaaaaatccaggcagaacgggtacgtcgactttactatccccaaaaaaagtggaggcgtcagaaaaatcagcgctcccgtgaagccactaaaagagatccagtccgccataaacatcctgctgcagtcgatctttattcccagtgatagcgctatgggcttcgtggcaggtaggaatgtgatggataatgcactgatacacgtcggccagacttgtatcttcaacactgacattgaaaacttcttcccatcaataaccaagattatggtgcgcaaagccctgcagcgagagttaagcaataaattaacctctcacgatgtgattaacattatatgctctctgtgtactgtgcctaacaatgtcggagttgaggtactcccacagggcgcgcctagttcccctattctgagtaatatagttctgaagtccttggacaacgaaatgagcaagttggctgggcgagccggttttcgttattctcggtatgccgatgacatgactttttctcatagcaagccaatcagacgtatgaatccgttttggaagtcccggattctaaatatcattgagcagcacggcctcaagattaatgactcaaagacgaagacatttgtgcggggaattcatcaggaagtgaccggggtgatcgtatcagacaaactcaacgtgagccggcagtacgttaagcagttgagggtcctgctccatctctgggaaaaatatgggtacgagcaggcccagaccatcttctcccgcgacttttgcaaggggggtacaaaaaatctgtgcaacgttatcgacggaaaaatcaactacttggaaatgatcaagggtaaggaggattctacatactgcagattcaaacaacgcctgaaaacacttatttggaagcaaaagcaactgtcaaccaacaagacggcatcggtgtga

SEQ ID NO: 7371 - RNA, 1020 nt, unidentified
  source 1..1020: mol_type = other RNA; note = synthetic construct
atgaccggtatctctggcaactacattcgccgctttctgtctaagaactcccgacgcaaagcttacaagagttttaagatccccaagaaatccggcggattccgaagcattagtagccctgtgaatgacttgaaggacattcagcgcgccatcaatgccctcttactgtcgatttttgagccctcaccctatgccatgggattttgcaggaaccggggagtggatacgaatgccaaaatccatatcgggcagacctgtatcttcaacactgacttggagaatttcttcccatccatcactaaacagatggtacggaaggcacttcatagagagctcggggacgttattagcagcaacgaggcaatcaactatatatgctccctctgtacagtacctaacgatgagggaatcgaggtccttccgcaggggtcacctgcctcaccagtcttgtctaatattgtgcttaaagccctggatcgtaaactggctctgtacgccgaactatgggagtgcaggtacaccaggtatgcggatgacatcacttttagtcataatagcacggtgagaaagttcagtcaatttaaacagttgcggattagaagcattattgaggagttcgggctgaagattaatgaaaagaaaaccaaggtcctggtccaaggcgaaagactagaagtcacaggcgtgaccgtttctagtaacaaagcgaacgtggctcggaaatacataaaacagctgcgcacactgatgcacctgtgggataagtatggttatgaacaagcacagcacatatacgttagggatttctgtggaggcatcgaaaagtctctgactagcgtgataaacggtaagatcaactatctctgcatgatcaagggcaaacaggactccacatatcgaagattcaagtcacgttacgaaaccgcagagaagaagagaaaggctctctccaaaacaaaagtggtgttataccggaggtctaggaattggaataagaaatcctcaccagctcacctttga

SEQ ID NO: 7372 - RNA, 966 nt, unidentified
  source 1..966: mol_type = other RNA; note = synthetic construct
atgaccgatcggcccgagaggacagtacggcattttctgccggctcgcgttcgggccgcctcttatgtggaattcactataccgaaaaaaacaggtggcactcgactaatctgtgctcctgtgcaacctctgaaggccgtgcagagagcgctcggaacaatgctgcagactctgtttcagccctccgacgctgccatgggctttgtcactgacagatcagtcgccaccaatgctagatgtcacctgcaccagaactgcgttcttaatcttgatctcgagaacttcttcccatcgataaccaaagcaagagtgaggcgtgcactcgaacgagaactggccgacagaataccttcctccgaggtgcgcagcctcatctgcagcttgtgcactatccccaatcagagtggaatcgaggttctgcctcagggggcacccacgagtccagtcctgtcaaatattgtgctgaaggggttagatcgacgcttagccgcttttgcaggcgcccacggctataactacaccaggtatgcggacgacatcacattctcccatgatcgccccatccggagattctcaccatttttcatggagcgcgtaaggacgatcatcgaagagtatggactcaagattaatgaccgcaagaccaaggtcagtgttaaaggcgaacggttggaggtaacagggctaacggttggggaaaaggtgaacgtcccaaaaaactacattaagagattgcgtacccttctgcatttgtgggagcactacggctatgaacaggcgcgactgatttactctagggatttcagccaaggaaccggaaagagccttaaaaccgtcatctacggtaaaattaactacctggcaatggtgaaggggcgggaggatcctactgtggtgggttaccgtaatcggtttaggagactcgtgaggattgctaaggccgaagagaggacatctatttcttga

SEQ ID NO: 7373 - RNA, 969 nt, unidentified
  source 1..969: mol_type = other RNA; note = synthetic construct
atgacagaacgtccagaacgcattgtgagacgctttctgcctgccagggtcagagcggactcatacgttgagtttaccattcccaaaaaagcagggggatctcgttccatttgtgccccaatccagcctcttaagaaagtgcagcgtgctctgggaacccttctccaggctctctttcagcccagcgaagaggctatgggctttgtggcaggacggaatatcgctgccaacgctcgatgccatctcaatcaaagttgcattctgaacttggaccttgaaaacttcttcccctccataacaaaaacattggttcgccaggctctgaagcgcgaactcgccgatagaatcccgagctctgaagtacggaacctgatatgtcgcctatgtacgattcctaaccagtctggcatagaagtgctcccccaaggcgcccccacttcaccagttctgagcaatattgtgctgaagggattagatagaagattatcggcctttgcagaggcccatggttataattacaccaggtatgccgatgatatcaccttcagtcataaccaccctataagacggttcagcccgttcttcatcgagaaaatccggtctattatcgaggagtacggcctgaaaatcaacgacgagaagactaaagtgtccatcaagggggagcggcaggaggtcactggtctaactgtcggcgagaaagtcaatgtgccacggaattatatcaagcaactgaggaccctcctgcacctgtgggagcactacgggtacgagcaagcccagttgatttacgatcaggacttctgccaggggaccggtaagtcactgaagactgtcatttatgggaagatcaattatttggcaatggtgaaaggcagggacgactccacagtgatcggatacaggaaccgatttaggaagcttgttcgagtaacgaaggcgaaggaacaggcaagtttcacaagctga

SEQ ID NO: 7374 - RNA, 1056 nt, unidentified
  source 1..1056: mol_type = other RNA; note = synthetic construct
atgaaggagtcacacattgcagaagctgcccgggaatatctgggcacagggaccgtcaagtctccacgagatcttgcagtcgcgatctgcagatgcggggagctattggacctgtggccactaggggagctgaccctcagccacttaaggcgccttagcactaaggcagtacggaaagagtgctatcggacatttagcatccccaaaagatcaggtggcgcgaggcaaattgcagcccctacgggccgcctcagagatattcagcgtgccattaacttgctgctccaggctcgcgttggcgtgatggaatgcgccacagggttcgtttgtggcaggagtgtaaccgacaacgccctcccacatattggaagtcacgtggtggtgaaccttgacatcgagaacttcttccctagcgttaccaaacgtatggtgcgcgaatccctgaaaagggagactcgcgaatggctcgaatctcacgaagccgtgaacatgctgtgtagcttagtgtctatgcccgacggcgagaaaggtgagatgttgcctcagggagcgccctcatcccccatgatttctaatatagtcctgggccggttggataggaggctggcaggattcgctcgagagcgtggctacgcctatactaggtatgccgatgatctgaccctgtccgggagagagatccgcaagatgagtgctgccgacatgaaactgatcgaaagaatagtggctgaggaaggatttaaattaaatcggcggaagatcaagcaacagggtgccgggcatagacagtccgtaaccggtctgacggtgaatgaacgcataaacgtctcgagagactttgtgaagaatcttcgggtctgtctgcatctgtgggagactaggggatacgaagaggcttcaggaatctaccgaagggactttagagggggtgaggacgtcgatttcgcccgcgcaatcaagggcaagatcaattacattgctatggttaagggacgtcgagatccggtgtttatggctttctcccggcgacttcggctcctcacaggcagaaaatga

SEQ ID NO: 7375 - RNA, 1326 nt, unidentified
  source 1..1326: mol_type = other RNA; note = synthetic construct
atggcaacacggaccataaacggacgtgagtacaccaaagccgatttcgagaatcagttgcgatacctgaatgacgctcaagagcttgccaacctacttaatgagctgaaagcgccatatatctatagcgattttcgcggaaagcaactatcatttttcgcagataccaataacatcagaaggagatgcaaaacgttcagactccgcaagaaacacgggggctacagggaaatcaccgcccctaaaggccgcttgcacgacgtgctgcacattcttaacatcgtgttgcagacctatgatgaacccacaccctgggcttatggctttgtgtgtgggagaagtgtcgtggacaatgctaggccacatgtcggtaagcgctacatcctgaatctggacctcaagaatttctttccgaccatcaccagacgccaggtggccgactgtcttatggcggagcctttcggcttcagctctttagctgccgagctggtgagcggcttagctaccgtcaggactgataatggcgaagaggtcttggcgcagggctttgccacttctccaactctctctaacttcatctgcagggaaatggataaggagatcgccggagttgcagctgcccagggagttacatttacccgatatgccgatgacctgacgttttcaagcgacgcagacattctgcggcctcaaggagaactcgcacagcaagtgaaaaccattgtcgagcgatacggtttcattcttaacgaagccaaaacacatctgcagcggaggggtaggcggcaggaagtgactggattaatggtcacagagaaggttaacgtgtcccggagatacgtaagggaaattcggagcctgctatacatctgggaacgttacgggtatgaggacgcatgtcaggctgcatggaagtcatacaagcagcaacatggtaagacaaaagggcaccagcaccatgtgcccctgaacaaggtgctgggaggcaagctgcactatatgaagatggttcgcgggtccgatgatcctctgtacctcaggttcgcctcacgatacacttcgcttcagcagagatccaaaggcgacataaaggaggtggagtataaggcctatatgggcaaatgcttgagtaagtctgggaaagaccgcgtaactagaacgactgtactgagcaatgacaacaccagtacacgacagcggggggttacatccagtaatccatacgatcccggtaagaaaaacaagcggattctcaacttcattgtcatggtgatcatctttgctgcgattatactgataaagctctttctcaaatcccgtctgtga

SEQ ID NO: 7376 - RNA, 1326 nt, unidentified
  source 1..1326: mol_type = other RNA; note = synthetic construct
atggctacacggataataaacggacgagagtatactaaagcagatttcgagaacaaattgtgccatcttagcgacgcgcaagagttggcagctatgctgaatgaactcaaactcccgtggtactactctgattttcgcgggaagcagctttccttcctcgcagatactaataacgtgcagaggcgctgtaagacattcagacttagaaaaaaacacggtggctatcgcgagattaccgcccccaagggcggccttcgaggcattttgaatgccttgaacatcctgctccaaacgtatgacgagcctacaccctgggcctatgggtttgtttgtgggagaagcgtggtggataacgctcgaccacacgtgggtaaaagatacatcctaaatctggacttgaaggacttctttcctacgattacccgtcagcaggtagcagactgcctcacagcggagccatttgggttctcaagcctggccgctaaactgatcagcggtcttgccacagttaggaccaagaacaacgaggaagtgctggctcagggatttgctacctcccctaccctgtcaaactttatttgccgggagatggacaaagagatcgcatctatcgccacagcccagggcatcactttcacacgctacgccgacgatctgacctttagtgcagacacggatatcctgcggccccaaggggaattagtgcagcaggtgaaagctatcgtcgaaaggtacggttttcggttaaatgaggaaaagacccatctccagcggcgtggacgacggcaagaagtcaccggacttatggtgaccgaaaaagttaatgtctccagaaggtatgtcagggaaatcagaagtctgctgtacatatgggaacgttatggctacgaggatgcttgccaggcggcatggaagtcatacaggcaacagcatgggaagactaagggccaccagcactgtgtgccactgaatgccgtgttgcgcggaaaactgaattacatgaagatggtcaggggcgctgatgacccgctgtaccaaagattcgttagtcggtacaccagcctgcagcagcgcagtaagggcgatattaaagaggtcgcctataaggcctatatgggaaaatacttatcaatttctgccaaggacaggacaactagcgcaaacgtgctgcccaatgataacacttcttccagacagctaggagcgacttcttccaatccatatgaccctcggaagaagtcgaagcgcatcctgaacttcattgtaatggtgatcattctagtagccataattctcatcaagctcttcctcaagtccctgttatga

SEQ ID NO: 7377 - RNA, 993 nt, unidentified
  source 1..993: mol_type = other RNA; note = synthetic construct
atggcaacacgaaccgtgaatggccgtgaatatactaaagcagactttgagaaccggttaaggtatctcaacgatgcccaggagctggcaaaattgctcaatgaactcaaggccccgtatatatacagcgattttcgaggaaaacagctctccttttttgctgacacgaataatattcggcggaggtgcaagacattccgactgagaaagaagcatggcggatacagagagattaccgccccaaaggggaggctgcacgacgtactccatatcttgaacattgtcctgcagacatacgacgaacctaccccttgggcttatggctttgtttgcggacgctcggtggtggacaacgctaggcctcacgtgggaaagcgatacatcctaaacttggacctgaagaacttcttccccaccatcacacgccgtcaggtggccgactgtcttatggcggagccctttggattctctagcctggcagccgagctggttagtggccttgctaccgtgaggacagataatggggaggaagtacttgcacagggcttcgccacgtcacccaccttatccaatttcatctgtcgcgagatggataaggagattgctggcgtggcagctgcccaaggcgtcactttcactagatacgccgatgacctaacattcagcagtgatgctgacatactcagaccacagggtgaacttgcccaacagatcaaaacgatcgtggaaaggtacggtttcatcctgaatgaggcgaaaactcacttacaacggagggggagacgccaagaagtcaccggtctgatggtcactgagaaagtgaacgtatctcgccgttacgtttgcgagattaggtctttgctgtatatttgggaacgctatggttacgaagatgcctgtcaggtccgggggagagctacctcatgcagcacagagagacagcgggggatacggactacctatctgctgatcaagttttgggtggtttcctga

SEQ ID NO: 7378 - RNA, 1323 nt, unidentified
  source 1..1323: mol_type = other RNA; note = synthetic construct
atggccactcgtaccgtgaacggaaacgaattcacaaagaccgactttgacagccgccttcgatggctcaatgaaccaaaggagctcagcgcccttctaaacgaggtgctagacgctttttgtttcaccaagtccaggcccgcccagctgaggttctttgcaaacacctacaacacccaacgccgatgtcgcactttcagacttcggaagaaacacggggggtaccgcgaaatcatcgctccgaagggcaagctgagagacattctgcatgccttgaatattgttctgcagacctttgacgatcccactccatgggcctacggctttgtctgcgggaggagcgtggtagacaatgccaggccacacgtggggaaacggtatgtgctgggcctggatctgaaggacttcttcccctcaatcactcggcggcaagtggcggattgtctcacgaccgagccgttaggattttcttcagtagccgccgaccttgtcgctggcttggcaagcgtgaggactgatgagggtcaggaagttctggctcagggcttcgccacctcccctacactgtctaatttcgtttgccaggagatggatcgtgagatagccgacgtcgctgccgctcagaatatcacatttacgcgctatgccgatgacttgacgttcagtagtgacgctgatatcctgaggcctcaaggcgcatttgttcagcaaatcaaaactatcgttgagagacacggatttcggctgaacgaagcgaaaacccacctgcagaggcgaggtagacgtcaggaagtcacagggctcatggtgacagagaaggtgaacgtcagccggaggtatgtgagagaggtccgttcgttgctctacatttgggagcgatatggatacgagaatgcatgcaaagctgcatggaaatcctacaagctgcagcacgggaaaaccaaagggcacctgcatcatgtgcccctcaatcgcgtactcgcaggcaagttaaactatatgaagatgataagaggcgcttcagatcctctttaccagagattggccggacgatatgcagccctgcgcgatgctaatcgggatggaattatgaacgtggaatacaatgcgtacatgggcgagtatgtccccaactctcatcggcgaaggcctgcgggtgatgacggactatacacagaaaatactgcaggtagacatagacgctctggtacacgcgacatttatagtccagaaagaaagggcaaccggattctgaagttcattttaaaagtggcaatgtgggccgctatcatactcgcctacctgtatttcaggtcccggtga

SEQ ID NO: 7379 - RNA, 1314 nt, unidentified
  source 1..1314: mol_type = other RNA; note = synthetic construct
atgacctccaaaacctttgcccgtaccgatttcgatcgccagctgcgtcagctcagctctccggcagaactggcagctctgctgaatggcgtgttgccagcgttcttctacgccatctgccgacccgctcaactgagattcttcgcaaacacggccaatatcgaaagaaggacacgcactttccgcttgaggaaaaaacacggaggctaccgggagattatcgcaccgaagggggccttcgccgacatatcaagagtgctgaatactgtcctgcagacctacgacgagcccactccatgggcgtgcggctttgtccgaggtcggagtgtggtagataatgcaaggccacatgtcggcaagaggtacgtcctgtcactggacctaaaagacttttttcctagcatcacccggcagcaggtggccgactgtctagctgccgagccttttggcttttctcctggagccgtggagttggtgagtgggctgtgcacagcccggctcgatggacaagacgttctggcacagggcttcgccaccagccccactttatccaattttgtatgtcgcaagatggacgagcagctggctgaactggctgggcagcaagcagtgacttacactcgttatgctgacgaccttacattcagctctgatgccgacgtcctgcgacccacaggagacttcgtgcagagagttgaggatatagtcaggagccacggcttcgaacttaacggctccaagacgcatctccagcggagaggtagaagacaagctgtgacagggctaatggtgaccgataaggtgaatgtagcccggagatatgtacgccaggttcgttcccaattgtacatctgggagaggtacgggtatgccgaagcctgtaacgcagcgtggaagcactatcggctccagcacgggaaaaccaagggtcaaggccattttgttaacttagatgccgttctgcgcggaaagctcaactatttgaagatggtcagaggagctgaggacgctctctaccagcgactgcagagcaggtatgataggctttgggcaaaagatcgctcggcaatcggccacgcggtgaggaaggcttacgccgaaaactatgaggcgaaacagggacagcacggaaggcagagttggcttacggtggggtcaaaacccacaagtgcaccagctgaggaccgatatcgcgccggttccattgataaccctcttcctgctgaagggtcacggtctggtgtgaagcggattttaaaaattgcattgtgggttgccgccctcgctgccgtggcttactttctcctgcattga

SEQ ID NO: 7380 - RNA, 1437 nt, unidentified
  source 1..1437: mol_type = other RNA; note = synthetic construct
atgatacgccaaaagcagaacctgaagttcgataaagagacggtcgaccgacaactgaagaacctggaatccgccaaacagctggcacagatcttgtatgacgccgtcaatgatgtgcggagagagccctattggctacgaaccaactccaaaaatggttacctgtatgactccatgcctcttgagtggcgatctgtttcccagctgaactattatgtagataccgccaaggatgactacaatcgattacggattttcaatatacccaaaaggaaaggtggtttcagggaaattgttgccccaaagcccgcatttagagtgagactcaaggcgattctgaagatcctgcagtcgtacgaagaagctacaccgtgggcctacgggttcgtgcaagggcgatccgtggcagacaatgccgccttacataccggcaagaattttgtgttaaacatcgacctcagcaattttttcccttccattactcgggagcaggtcaagcaggtcctcagtgctaagcctttcgaattttccccattcgccgtggacttcataagcggcttgtgcacgtaccgtaaagatggggtagacgttctcgctcagggatttcccacatcaccacttctctctaacttcgtgtgccgccaaatggatgaagatatcgctaaagtggctgcggagaataacgtgactttttcaagatacgcggatgacattaccttcagctctgatgtgaatgtgtttgactttaacggcgcattctacaacaagatcaaagaaatcatctcaagttacgggttcgtgatcaatcaaaagaaggtacgcctgcagagcaaaaccaggcaccaggaagttacaggcattgtcgtgaataaaaagcttaacgtctctagacgttatattcgggagatcaggacccttttgtttgtctggaaaaaatacggctatgaggctgcttgctgttgtgcctataggaataaccgcaaaaaggactaccataagtattaccactctattgaggttagtaagttcctcaggggaaaaatcaattatctgggaattgttcgcgggaaagacgacagcatatatctacggtttaaggcacagtttgacgaactgtacaaaaacgagagcgatgtgatgaaatcatacagcgacatgctcgagaaacaccggttgcgcagagaaaacaacagcgagtgtgaggaaatgtctgacaagtcgtgcggcgtgtccactaatgacgaggcaggcaacagtgtatctgcaaatagttcaacagatggaaacggataccagacacggatcgatagaaacagctacctgcgggatgctgatgataaggagagaaggaagaaggacaggcgtactatcatcctgatttgtttcgccttcctgattatctttcgcttgcttgtcttcatattttttaaggcctga

SEQ ID NO: 7381 - RNA, 1206 nt, unidentified
  source 1..1206: mol_type = other RNA; note = synthetic construct
atggcacaggtaaaccgcgacgtggatcttaaggcccttgtcggtaatcagctgcagtacatttactccgcggaagagctgactaacgttttaaacacactggcgagcaatgtgggggtcccgagcgacttccggcgaaaccagatgctgtgcttcgcagacaccaggaatgactaccgcagggtaaagcggtattttatgcacaagaagcacggtggaagacgccccatagtcgcccctcaccatagcctgatgcacatgctacaggggtttaatgtgctcctacaacagtataatccacccacaccttggtgctacggcttcgtgaggggccggtcagttgtgcaaaacgcccagctccacgtcggcaagagatacatcctgaatgtggacattaaagacttcttccctagcatcaccagacagatggtggaagatgtattgaccgctgctccactgagatgctctacagaggccgcccagttgctgtcagggctttgtaccgtgatagagccggtaggcgacgtgctgccacagggatttcccacttcgcctacgctctccaatatggtttgtcggaagatggacgaggagttagcagctgccgcccaacgtatcggggcaacgtatagtagatatgccgatgatatgactttctcatgtgataacgatgtgctgagaacaacaggctctttttacctccaggtgagtacgattgttgaaaaatacggctttcggttgaacgatcggaaaaccagactgcaaagacggggaaggcgccagcaggttaccggtattgtcgtctcccataaagtcaatgtcagtcgcgagtatgcacgccagatccgttccctgctgtacatgtgggaacgctacggatactgggagacagccaaagctgctctccacgcttatcgagagcaaaacgggaagactaggagacatggagaatatctcactttgtatactgtgttacgtggtcgactcaactacatgaagatggtgaaaggcgaaaccgaccccacctatctaaagctgtggaacaaatacaaccagctgatgttgcgagacaagcccaaacggaggcgcgtgctcactgcacttacaaggatcgatcaaaggctgcaggcgccaaccatcattctcgctaataggaatgagcgagtggcccgtgttctgtggcagtctttgtggcggcttcattga

SEQ ID NO: 7382 - RNA, 1239 nt, unidentified
  source 1..1239: mol_type = other RNA; note = synthetic construct
atggctcgcaatcatcgggatgtcaaccttaaagccctgatcggaaatcagttgcagtatatctactctgccgacgaactgacgaacgtgctgaacaccctggcatataacattggggagcactctggcttccgcaggaaccaaatgttatgttttgcagatacgacgaaagacaaccgtcgggctaagagatacaggatgcataagaaacacggtgggacacgggccatcgttgctccacatcagtcgctactgtacatgcttaaaggatttaacgctctactccagcagtattacgagccaacaacttggtgttacggcttcgttaagggcaggtccgtggttcagaatgcacaacagcacgtgggcaagcgttacatcctcaacattgacatcaaggactttttcccttctataacccggcagatggtggaagatgtccttctcgccgaaccactaaagtgttccacagaggcggctagactgctctcaggcctgtgtaccgcggctgagcctcaaggagatgtcctgcctcagggattccccacatcacccaccttaagtaacatggtgtgcaggaagatggatgaagagctggctgccgcagcccaacgcataggtgccacctatagccgctacgccgacgacatgtccttctcaagtgataaagacgtattgcgccctacaggatccttctatctccaggtaagcggtattgtcgagaaatacgggtttagactcaacgacagaaagaccaggcttcagcgacgagggaggcgacagcaggtcacaggtgtcgtggttagcaataaagtgaatgtggcccgtgagtacgcgagacagattcgaagccttttgtatatgtgggagcggtacgggtattgggaaactgctaaggccgcattaagaggttattgcgaacaatacggcaagacccgggggcacggcgaatatctgactctgtatgcagtgctgcggggccgcctcaactacatgaaaatggttaaagggggcactgacccgacctacttgaagctgtggaataagtacaatcagctcatgcagagggatactccaaaacgcaggcggggaacttatggcacaaatgctcacagaccggagccctctagtaccaatgattacctgggcgagccccaaagaaagggatgcgccggggtggtagcgctctttgtggtgcttactctggccggattgttggcatgcaatctgctggcctga

SEQ ID NO: 7383 - RNA, 1239 nt, unidentified
  source 1..1239: mol_type = other RNA; note = synthetic construct
atggcccgtagaaaccagaatataaacctgaaaaccactatcggcaatcagctgcagtatatctacagtgccgacgagctgactaatgtgctgaatgacgtggcaaaacagatcggcgtgcaggctggcttcagaaccaaccagctgcagtgttttgccgacaccggtaaggacgaccgcagaacaaccaggtataggatgagaaagaagcatggcggaactcgagccattgtggcgccgcactcttcgctcctgtttatgttgcaggccttcaatgcccttttgcaagatttctacgtccccacaccttggtgttacgggttcgtgcgtgataagagcgtggcgcagaacgcacagcagcacgttggcaagcggtacattcttaacatcgatctgaaggactttttcccttcaatcacacggcagatggtagaagatgtcctgctggcagaaccaattaaatgcagcactgaagctgctaaactgcttagcggcctttgcacagcaacggagcctcagggtgatgtcttaccacaggggttcccgacatctcccaccctatcaaacatggtatgccggaaaatggacgaagaactcgccgccgctgctcaacgaattggcgccacttatacccgatacgccgacgacatgacctttagtagtgataacgatgtcctacggacgactggatccttttacatgcaactgtctaccatcgtggagaagtatggctttaggttaaatgagcgcaaaacaagactccaaaggagggggagacgacagcaagtcaccggggtggttgtgagcgataaagtgaatgtaactagagagtacgcccgccaaatcagaacattgttgtacatgtgggagcgttacggctatgaggacgcctccgaaaaggctctctggaactaccgcaatcagcatggaaaaaccaagggtcattccaaacggataaacctgtccgctgtcctcaggggtcgcctctcatatatgaagatggttaagggcgaggcggaccccacctatctgaaactctggaacaaatactgtgcacttcacgctgccggatatccaaagagcaagacacggaagcgcggaatgaggcctgctaacgatgactctatgcacgttgggggatatttgggggatcccccaaggcggggatgcgctttggtgattgcattctttgcattactgacgttcgcggggctgctggcatggaatctctacgcctga

SEQ ID NO: 7384 - RNA, 3048 nt, unidentified
  source 1..3048: mol_type = other RNA; note = synthetic construct
atgatgacgtttatcgggttttggaccgctataaacggcctcgccgctgtgaacaatcaggctgcctttggcaaacttgagtgcttaagatacggagacactactctgccagacaggtacaaaatgtataacatcccaaagaagttccagaagaaaggtctgtccgtcagggctatatacgctcccaatgaccgccttaagtactttctcaagtttgctaacaacatactttctgaacagtacgtgcaaaacaattatgcttatgggtatgtgaagggccgaaacattgtatctaacgcaagattacacacaaacaagcactatgtgtgtaacctcgacctgaaagatttcttcccaagcatcagttacgatcgagcatatcttgcggccaagaagcacttcaaagatattgaaccgagcatcctcgagttgtgtattaaagcttcctgcgtgagcgtcgaccataaatgctttctggcgcagggttcccccctcagcccacttctgtcaaacgtcgtctgcattgacctcgacaaccgcctgtattcttactgctccgataatgggtttagttattcccgatatgcagatgacatgactttttcaaccaatcacacagataaatcagctattgagctacacatcaatacgatcaagcagataattaagcagagcagtttcaacattaacgaagagaaatgcaggatccagtccaatcaatacaatcagagcgtgacagggcttacagtgaacgagttccccaacgtgaaaaaggaatacatcaaagatctgcggaacatcctgtacatctgggagaggtacggatacattgacgctaataggcggtatcaaaggaaatataggatcgccaagcgcatcaagcccttaagtgacataatcctgcctaggatggaagacgtgattcgtggccggatccagtttcttaagaccgtcaagggctccaatgacaaccagtaccagcgtttcaataacaaatacacctcattgctcaaccgcgattgtaattttattcccacccacaagcccaataaatatattgaggggagcaatttcaagatatatcactccattctgaaggaccaagacggcaataattacatccaactcgacaagttcgaacgggcaatcgtgccagataactgtctatccctcctgaaattatgccaatctaatgcgtggagcaaaattataaagaccatcttcaacatccgcccgataaacaaagcaaattacaaatgggcccttcagctgaatagtaatacccgaaagaacgctgttaaatacggactgcgtgcctataataaacgcgagggcggttatgaagacgccgccaacctgttaagaattgcaatcgagctcggcaactacaattactttgaccagtacctgatctcttgcaagctcagtaatcagagccataacttgatacctgaaaatatcgagtacctcgaggccaacgagtacgggacgctgttgaaaaaatatgctggatattatagcgccaaaggtttcaagatctctcagatcatcggcaagagtaacggagacagcaccgtagatctatacaagacccctattcatcctatccgcgaagaacacaatgtcacagagaatatccagtggcataatacaactggagttggcatatacctgggagtcaacgaatatagatgtctagacatcgataatgtgaatggagatatcgaacgggttataatcatgatgctgcacctgctgcatctgcccctggactattcgtgggttattaagtcgggctcggggaaaggcttccatatcatcttcaaagcagaaaacatagaaggcttcaaggccgatatcgtcgcattttctaccaacaagaaaaaccacagagccttcgagagaattgagctgaggtggcaggagtgtttcctggtgctaccgccaagcctgcatagatctgggaatttctatggctttcggaacggtgatattcctacctataaccctatgcacgttaagcataacgacataaacactctcctggattacttttgtggttggacaaagttcattgagttgaagtacaacaacatcgactttgatttggtctacagatccaaatggggggccgactcctcatgtgggagtgtgtcaattaacctcccaatcgaatggctgagcgcatgcaacagccctgtgtgcgcaaatgaactggccattcggtacttaattggggagtcagtaagcccagataataacaaggcagtgcagttattcagaaaggccaataacacactgagtgcatataaccttgcttctttgatagcgattggatacatagatgacattggtgaattcaattccctcatttccaaatgcaaagatcatattgatgagatagacgtgcacttcaataactccaagcaccgcatcgaacgcgtgatccaaatcttcaatcagacccaccagaagaagctctatgtgtttttcgatacagagacgaccggcattcctctcgattacaatgcccctatttccgacattgacaattggccccggctggtacagcttagttggatgataaccgatgaggatgggaagctgattaaagaaaacgactacatcgtatacccaaaaggcttcgatatccccacttcatcaagcgccatccatggaattactaatgaatacgccaacaagaaaggtatcgacattgagactgttctggctgagttcattgaggacctcaagggagtttctctggtgatcggccacaatatcaattttgacatcaacattgtccaggcggagttgtttaggctggggatgactgacatctttaatgataagcggaaagtgtgtactatgaagtcttcagttgatttttgtgccatccccaacaagtatggatataagtggcccacattgcaggagcttcaccaaaaactatttggcgagatttttacagactctcataatgccctgtctgatatccgtgccaccaagcgatgctacttcgagttgaaagaaaagggaattttgtga

SEQ ID NO: 7385 - RNA, 1971 nt, unidentified
  source 1..1971: mol_type = other RNA; note = synthetic construct
atggacgaggtgatatatttttcagatagcgacataaccgagcggtacagactggccagcattcctaagcgcgattcgaacggccgattcactaagcgacggaaggtgtacatgccaaccccccgcctaaaattctttctccaacaggcgaacagcctgttgtccgccatctattctccgccaccctgtagctttgcatttatcaagggtagaaccattgtgggaaacgccactcctcatactaacaagaagtatattctgagcttggacatcaaagacttctttaattcgatttccatccagaaggctgtaaacgctattaaatcagcattcccatggcagttccggggggagtttatacaggcaatcgtaggggccagtagcttaaatggccaccttgtgcaaggtagccccctctcccccaccatatccaacattgtgtgtctaaacctggacaaaaggatctcttcttactgtgaaagccttaagatatcattcactaggtacgcggatgattttacgttctccagtaacgacttcgatttcaagcgggattcctctttcttagataacatcactaagctgatctctgaggaaggattcgctttgaataatgagaagacccacatccagttatataataacaagcaggtggtcaccggtttggtcgtgaactctaaagttaatgtggctcgccgttacattaaggagatcagaaacatcctctatatttggaagcgctttggctacgacgaggcactcgagtcctttcgatttcattacctgcacatctctaggaaaattggcagttccctaagaagtcggatctcatacgaagacgaaaagcggatcttacactctagaatggtcaagaaagccacaaattactcacctcgtttggaccagcatattctggggaggctaaatttcctgaagatggtcaggggtgagaacgattatcagtatcttcagctcacccaaaaattcaatgagctcagtaagaaactcccgtacaaaaaggataaagacggcagctattcctttaaaagcattcaacactttgagtgggcactggggtgtctcgtgctgactgatgatgtgaagaacgaaaatggcacacaatttttcaagatgaacaacggcggaaaagctattattagcacgaagttactcagcttcctttcctccgtagaaccagaatactatagtgttgcactttccctgattaagtccaaatgccgggtgaaagccatcaacctggaagccaatctgtttatcatctgggccacacctttggacctgaagaagtacagatgggcgattatcgacgccgtgtacagggctgctagagatcgttatgaaagtattcattgccttgccaaggttgaaaggtcagagatagaaagcctgcacaaagactttcagttcgccatgaataatggaaattacgccatgattcatgcatatcttgacatatgcaatttcctgaacctggatagcgggctgtaccctgaaaattttgaccttctcaacagtaacgataagagcattctgctgcagaaatggggttggaactactattcactgtacatcgacacagtgcccaccgataaggacggagtacctctaagtgaatctactttcgacaattaccgccgccagtgggggtctaactttgctcacctgagatggaagggagctgatggcatagccctcgttgcgggaacaaacaaatgggtgatagaagtcacagacaggaatctcgatgaggacgatgttatgcgcgagctgttgtccaataaagagattgaagtctgcatcatccgaaagccaaccttgctgctcgttgtgaataaagacgtcctgcaggagaaagagtatcagggcttcacgatccacaaatcagggtactattctatctatccatacaaaggcgagcccatggagatcaagacaatcgagctgtcgtga

SEQ ID NO: 7386 - RNA, 1470 nt, unidentified
  source 1..1470: mol_type = other RNA; note = synthetic construct
atgcctaattgcagtaactgttacaagaccctcgacgaaggcctcaacttctgtccatactgtggagcgagggtgtctcactccggcgataaactctgtccctcctgcaaccaaattttcaatgaatatgacggcagcttttgtggtcgttgcggctctagattgatcgtgtacgagagagaacagagcacgaacggacagcatgtaataaacagcgtcgacgatcttattgctaccatcaactctttcatccccaaaatcgattccaaagctgactctatttctaaggaggagctgttatcattcggaaatatcaacaatgaccgacgctacgagattttctatatccccaaaaagcgtcggaaataccggatgataagctctccaacccctagactgaagctgatcctgaggtgcttgaacgagattatataccagcatttcgctcccgcagggtatgtaactgggtttgtgaggaacctctccattgtggacaatggccggatccacgtgggccagcgatacgtatatactatcgacctggcaaactttttcgagagtgtgaccccggatatgatcatcccatatttgtgcaaagcaccttacaaccttaatccagaagtagcagacatagttgccaaaatctcatgtgttaagaacaggcgcaaaaactctatcggcctgagccagggtagtccactttcccctgtcctaagtaacatagtgtgcgcagacttagacaaaaaattgaatggattagcctccctgtaccgggccaagtatagccgatacgctgatgatattaccttttcttcctcaaacaacctgtatctccaggttaacgactttgagaagcggataattgaggccgtggaaagctcaaatttcaagatcaactacaacaagatccacctgtgtggccctcaatcaagacattatgtgactgggattgtgacaaattcgaaggttaatgttccgagagagtacatcagcaatatccggaatctactttatatttggagcagatatggggttaaggaggcgtacaaaaggtttgatgtgtggtacaagaaatacaggaagggcaaaccgactccattcattggtgattttctgcgcgggaagatagaatacctgggtgctgtccgagggaaaaacgaccctatttataagaagttcaagaattgcctggagtccctcagccagatcaattttaagacattttacgagcgccccaaacgtatgaaggtcagttttaatctttcggagcccctggtcaaatacggaagaacgtattatacagccgaaacaaggtatcgcggagaactggtgttgattagtcccaaactcaatgcctacattgaatccggggtcgattactcacctgcccgcgtgctagccacaaattgcgtggtctataagatcttcgataaggatggagtgaagctcctgatgaccactgaaaattga

SEQ ID NO: 7387 - RNA, 1146 nt, unidentified
  source 1..1146: mol_type = other RNA; note = synthetic construct
atggctacccacctgtccacgatatgctctgccgaggagttgaggcaggcaatcaatagatccatcacccaaagcgggtattcccctttgagccccgcccgttataagtttttgacaacctctgttaccatgccatatttataccggcactttacgataccaaaacgacatggtggcggccggaagattgatgcccctaagaaaatgatgcaagcgatccagtctgctctgctccctctgctggaaggctcctttgtaccttcgtcagccgtttgcgggtttgtcaagaatcgatcagtggtgaacaacgctctcccacacatcggatgtggagtgctgctcaacatcgacattaaggacttcttcccgtcaattactcaccagatggtcactgacgcgcttgtgtctgagcttaagatgggacaagaggccgcccacgctcttggctggttatgtaccatccccaaaaaagggcagcgtgtgctccctcaggggagttgcaccagccccatactcagcaatatcgtgtgttcgaggatggaccgggagctgctaacactgtgtgcagctcatggagtcacatatactagatacgccgatgatctgagcttcagcgcaaaggagaactgctttgaagccggtagtgaattccgccagcgcatggaagagattattaaggctacttccctaaagctgaataaccgcaaaactcatatcgcctatccggggaggcggatggaagttacaggcctcgtggtcgaacgccgagcgaatgtagccagggattacatactggagctcaggcagctgttgtacatctgggagaaatacggagaaaaggaggcagctatttcattctctaagcatcacggtgaacggacccatagaagtcccattagacagatcattcagggtaagttggccttcatgagtcaggtgagaggaaacgacgatcccatcgtgaagcggtactccagctggtttgagcgtctgaaaaagaggccgcgcaaacagcagagaaaagccacaccacctcctcaacccacccccgttacaccaccagcaaaaggcgggtacttaggcatggtggcactgcttgtcggcctgtctatgcttatggtggtggcggtagctgcagtcttctga

SEQ ID NO: 7388 - RNA, 1134 nt, unidentified
  source 1..1134: mol_type = other RNA; note = synthetic construct
atgaagtctgtcgacgatttcatcaaacttctgaacggcctgaggtactctcgctacggcgaaaaatgcaaacccataactagaaatttgctctattactacgcaagcaataaggtcccaatctcgaatctgtacacggatatttacattcctaagaaatcaggaggcaaacgtaagatccaaattccctgccgagggttaaaagagatccagggctatattgctgagatactaaacgcacttttcacaccacagagctgtgttacaggattcgtccgcggtaagaacatcatagacaatgcgaaacctcacgttgggcataaatatctgctatcctgggatatcaaggacttcttttctagcatatacgccaaactggtgaaatactgtctggtaaacgatccattcaattttccagatgacattgccaatctgatcacgaacatctgcggtgtcaggattgaggaggatagctgtaagagggtgctccctcaagggagtccctgctcccctatactcagcaacattgtgtttgccgtgttcgacaaatatattgttgatcactgcacctggaggggcgtcatctatacccggtttgctgatgacatgactttctcagctgatcacgacttctattacgactccagattttcttggggtcgcgtgctcccttccaacggccagttttatcataacaagcacttgagacagtttttctatctcgcaaagcggctgaatattaacaaaaagaagaccaggaagtgtaaacaggggcagcgaaagatcgtgactggaattgttgtcaacgacaagttaaacgtgaagcgggagtatgtaagagaaatccggaatctcctgtttatctgggaaaaatacggatataacgatgccaaggcccgtttcaataatcatgtgcacaagagtacacccaatgccaagccgagcgaattgctgaacgtattggtggggcggatctactttattaaacaggtgaagggcaaaaatgaccccatctttttacgcttcaagacaaagctcaagtacctgtgtagtatcatgaatacctccaaagctgtgagtatcagactgaagaccggtctgttcattaaaggaaaccttatatcacttgactga

SEQ ID NO: 7389 - RNA, 1275 nt, unidentified
  source 1..1275: mol_type = other RNA; note = synthetic construct
atggaagacatcgacactaaaccaaggtccgggccatctaccgtgtttcatttgctggggctcctcaataaggcaaaacggcaagagtttgggtatcgtgcctggccgtttactctggaacagctgttcttctttagtgatcctaaaaagaaccacatatactacctgcaccacttcattcccaaaaaaagtggcggcgtacgcgagatttcttcaccctcttggatgcttaaaatgttccaagcctccgccaagaggcttctacaagataaatacgtcgcgcctgacaacgttatgggattcgtctctggccgttccgtcgctgacaatgcagcccggcacatcgggaagaactatgtgtttaatgccgacctgaaagacttctttcccagcataacacgcgatcgcgtgatctcaagcctaatgaagccgccattctgctttgggaaggaggccgcccttcttctcagcgggatttgctgcgcccacgcagacctgactcagaagggcaaggatacgtattgggtggtgcggggcgaaggaaaacgcggcaagctgatggacgcttcaaactaccatccagccgtccctgcgacactaccacagggtgctccctctagccctgtgttaagcaacgctgtgtgtcttactctcgataagaggctcgatggtctggcgaagcgatacaaagtgacctacacgaggtacgcagacgacatcaccttcagtagtaatcataatgtgttccgagagggcgactccttcctcaaggagttcaggaatattatcaaatccgagggattcattctgaacgaagataagctgcgtctgcagaataaagggcagagacaggaagtaactggactgatcgtgaacaagaaaatctccgtttcgagacagtatatccggtccatcggcagcttgttatacatatgggaaaggtacggagtggacgctgcttacggtagatttttaaagtacaagaccgatttggaggttaccgctgataatagacagctgtgtacctatgtccatccccacctccttgagacaatgcagggcaggatagcatatgtgagaatggtacggggcgaggatgatcccgtttggaagagactgaacgaacggtttttgaagctgaaagcccaatatgaatctagaggagtcatcggtaaccctacacgcattctgcattcatggacaattaagcgatttgagcagctgagtggattccacctccgctatggtccattgtatagctttatgtcaccttga

SEQ ID NO: 7390 - RNA, 1566 nt, unidentified
  source 1..1566: mol_type = other RNA; note = synthetic construct
atgacttacgaggagaaggccctccgagaaaaggcctttgatatagagacgaaagaagatcttttgagcttgctgaatgatataaaagctgaccttactcacgagacaagttatccgttcaccatgcagaccatgatgcgctattctcggcccggagtgtactcatggagatacaaaaagatcttcgtgcctaaaaagacaggaggtgctagggaagtctacgcatcatggggcactctgaaatggctgcaggtgtgcgtcaacgaactgctccaggctctctacgatccttctgactacgcaatgggctttgttaaacggcgcagcgtggtcgataacgctaaagcccacgtttaccaaaactacgtgtttaacatagacctgaaggacttcttcccaagcatcacctactcccaagtgaaaaattcgcttcagcagctgccatttgggttcaatgaggagattgcgaaaataatcgctggcctgtgtaccattagtgatgacacccccgacctgatgcctaaaggaaagaaggaaaggaagagatactttttgcctcagggcgccccatctagcccagttctgtccaatgcagtatgtatttccctcgaccggaaattggcaggcctggctcgaaggttcggcttaacttttacaagatatgccgacgatatcacattctcgagtatgcacaatgtctatcaggaaggctcagcctttaggattgagttggaaaacatcatcttcaagcagggattccgcatcaacgcacaaaaggtgcggctgcatcatagaagtcggagacaagaagtgacagggctgattgttggtagaaaagtaaacgtgcctaagcagtatattaaggacctacgagccgtcctgcacatctggaaaaagtatggagaaggggcggctgctgcctcctattatcccaggtaccgcgccgggatcaagaaggagacacagttcaacttaaaggcagtgatgttaggcaagctttgctatctaaagatggtgagaggtgaggatgaccccgtttacaagcgcctgtccgatcagttcgatgaagtgacaagcaagcgaaaaaagaaatgccaacccggagttgaatacctcgggagctgcacgctcaaaacctttgagcgtcggttgaacgtggtaattgacattggagaggaggtctgtaagaataaatttacgcgtattcggctcaagaatggtactaccctgccaatctatatcagcaggctgatgccccctaattctaggaaggatagggtgtgggtgagcctttgccgccgtaccttcgaggcaggggggttctctgttttctacatgctccataactcctacgccattaaatcattcgtccccccactaaagtcagatatttttgacgagactgtctccaaagtcgtggaccttgtagtagcgtttcctattctccatgtggaagacgagtgtggcgtcatccagccaaagtatataccgcagaaaatcagtgaggtgatcgaccagtttctggccgaaaaaaatatctctcacaaggagaacatacccttttga

SEQ ID NO: 7391 - RNA, 1134 nt, unidentified
  source 1..1134: mol_type = other RNA; note = synthetic construct
atgaacagaacagcaatcctgccacctaagaaggcggtcgcaacagcggtgaccaccagaatctgtgatttatggggctgcttgcacaccaaaaaggacttgctcaagctagtgaacgtggccctcgaggggctctatggtgagcgcgtgtgctctgttagcatggctcaactgaataaggctgcgtattcaagcctgaatccagataggtactgcacatttaagatcccgaaaaagaagaagggggagttcaggacgattgacgcccctgaacatagtcttaaatacattcaacagggcctgaatatggttttacaaactatctatgcacctcatccggccgcaatggggtttgtgccacgccgtagcgtcgttaccggcgcaaggatgcatctcgggcagagactcgtgtacaacatagacctgaaggatttctttcacacaatcacttccggacgactgtactcaaggctgacctctaaacccttctgtttggatggaaaggtggccggcattattgccgacatctgttgttactcgggtcctgacggtcgaaacgtactgcccatgggagctcccacctctccaactatcactaatattatttgcgagcgaatggatacaaagttgactagacttgctaaagcatatggcatgcagtacagtcggtatgccgacgatataacttttagcggaatggctaatgtcttcggagaagattcccggttcattaaaagtctgaggaatatcatagagcgcgaggaggggtttaccataaaccccgacaaaacgcggctgtgccatcgcggcatgagacaggaagtgaccggcgtaacagtcaacgaaaaagagaatgtgccacggtggtatgtaggccagcttcggaccatgcttcacaactgggaaatggacggacacgatcgtgctcaggccgtgttcgaacgccactacgtgcccaagttcacaaggccctcctcaggtttacctcctatccatcacatcgaaaatgttatcgccgggaaactgctctacctaaagatggtcaaaggcgagacggacaccacctataaagccctgaaccggagatttgccgctctgatggactgtttcattcagacttcccagacaatttga

SEQ ID NO: 7392 - RNA, 1116 nt, unidentified
  source 1..1116: mol_type = other RNA; note = synthetic construct
atgagactcgacagaaacatcctggatagggaggcggccaagaacgctgtgaagtgtaggatttctgacctgtgcgggtgcctgcataccaagaaggaccttctcaaactgattaatgtggccctggaaggtttatacggtgagaaggcttctatggtgactatgtcccaactcgacaaaagtctgaaaagctctccaaacacagttcgatactatcgcttcctaatccctaagaagaaaaaaggagaactccgcactattgacgctcccgagcctaccctaaaatatattcaacagggactcaatctcgtactgcagaccatctacagcccacattcagcggccatgggctttgtgtcccacaggagcgtggtcacaggggcacggatgcatatcgggcaaaggttcgtctacaacattgaccttaaggatttttttcacacggtcacatcgggacgcctttataacagacttactacaaaacccttcaacctggatcgaaaggttgccggcatcataaccgacttgtgctgctacgcggggcctgaagggaaaaatgtgttaccgatgggcgcccctacatcccccaccattactaacatcatctgtgagcggatggacatcaagttgactcgcctggcaaaggcttacggactgaaatacaccagatacgcagatgatattacgtttagcggaatggccaatgttttcgatgagggaagtcatttcatccagtcaatgaggaatataatagagaacgaagagggttttaccataaatcccgagaagaccagactgtgtcaccgcggcatgcgtcaggaagtaactggcgtgactgtgaatgaaaaggagaatgtaccacgggagtatgctaaacagttgaggacaatgctgcataactgggaaatggacggctatgataaagcccaggccgtcttcgagcaccactatcaggctgacaacccgagatacgctgccacccactcagattttcgaccaaacttggaatccgtcgtggccggcaaactgttatacctgaagatggtgaagggtgagacagacgcaacgtataaggcacttaatcgtcggttcaatgcactccggtgtgatgtttga

SEQ ID NO: 7393 - RNA, 1143 nt, unidentified
  source 1..1143: mol_type = other RNA; note = synthetic construct
atgaagaaagttgccgagattacagataggagagctgaggtgaaggcagccgagactagaatacatgacctctggtcttgcctgcacactaaaagagacttactccgcctggtgaacgtcgccctggaaggtctatacggcatggatgccaggaccgtgactatgcgtcagctaaatctttcagcgtattcaagtcttaacgcccaccggtaccgaacctttcagatcccgaaaaagagaaaaggcgaatttcgcacgatcgatgcaccagaccccactctcaagtacattcaacaggggctcaatttcgtgctgcaaactgtacacacaccccatcctgcagctatggggtttgtcccacatcggtccaccgtgacaggggccaaggtccacctgggacagcgtttcgtgtataatatcgacttgaaggatttcttccataccgtgacctccggaagactctataaacgcttaactctggaacccttctgccttgacggagaggtagcgggtctgatcaccgatctctgttgttacatggggcctgatggacggaatgttttgccaatgggagcccccacatcccccgctgtgacaaacattatctgcgaaagaatggatggcaagttgagcagactggcccgcgtgtatggccttaaatacagccgttacgctgacgacattacgtttagcggcatggctgatgtcttcgctgaggacggaaggttcataatgtctatgaggaacatcatcgtcaacgaggaaggcttcacaatcaatccggagaagacaaggctgtgtcactggggtatgaggcaggaggtgaccggaattacagtgaacagtcgagaaaatgtgcctcgcaagtatgttaagcagctgcggaccatgattcacaattgggaaatggacggccacgacaaagcacaggccgtctttgagaagtattacatggaacagaattacacccacaaccctgatgtaaaacatcatatagagaacgttgtcgccggtaaactgctgtatctgaagatggttaagggggagacggatccaacctaccgagcgttggaccgacggtttcgcgcactcactgagacaggcgggagggacactcaaggcaccgggaaaaaccggttatga

SEQ ID NO: 7394 - RNA, 1374 nt, unidentified
  source 1..1374: mol_type = other RNA; note = synthetic construct
atgaaactggacgaacatatcaagcggcaggagctgcttgtccaaccggacgccaaaggcgcttcaaatggccagctaccagatgcccaggcagcggagagggggaatgtctttgagcgcctgccatattacgggaaatccagtcccgaggcccgacagaaagcagcagaaaggatgcctgatttgtggcgctgccttaatactaaaggcgatctactccacttattgaacgttgctctcggcgggctttatggagagtggcctcaaaagataacaattcagcagctcaacaagtttgcttacactagcctgggtgcaaagcggtacaccagcttcaaaattcccaaaaagcggcaaggggaatttcgcaccatagacgcaccagtacctatgttgaaatatatccagagaggactgaatttcgccctgcagtgtcactatacacctcacatgtcagcaatgggatttgtgcagcacaggtccgtggtggataatgccaaggttcacgtcggacagcgattagtctacaatatcgacttgaaggactttttccccagcattacggccgggcggctacataagagacttatggccaagccctttagcctgtctaaggagatggcgagtattatcacggatctgtgttgttacactaatgccgagggcaagcatgttctgcctcagggtgccccgacgagcccaacacttactaatattatttgcgagcggatggacagaaagctctccaggctggcgaaagcttacggactgaagtacacccgctatgctgacgatataactttttcaggtatggctaacgtgttccacgaaaattctcggttcttaaagtcaatgcgtaacatcatagagaatgaggaacacttcaccatcaacacagataaaaccaggctgtgccatcaaggcatgcgacaggaagttaccggcttgtctgtgaaccgtcaggagaacgtgtccagaaagtatgtgaagcagctgagaaccatgctccacaactgggagatgaatggctacgaaaaagcacaagaagtattcgccaaacactactccgagacaaagaagtctaacctgctcatgaagggaacacatcatattgaaaacatcatcgacgggaaactgatgtatctcaagatggtaaagggtggaaacgactgtacttataaaagtctcgatgctcgcttcagagctctcatggaccatctgcccgccacaaggattgacgggaataattcgccaaaagtgaccgtggaaatccctatggtccccaaagaggatgatgaatgctgggaaaccatctacaacctggagaagatccttaacaacgagaataacaacaatgacggccgtcaggtgtga

SEQ ID NO: 7395 - RNA, 1413 nt, unidentified
  source 1..1413: mol_type = other RNA; note = synthetic construct
atggagattgacgaacacataaaacagcaggagcagcaaacccacgccgattctttagaggtgacactgggggagccactggagttcactttcgtggaaaatgccaacgtcttcgctcaactgcctgttcacggcgttagtgccaatccgaacaagaatggcatttcagataccattgttcgggtgcaggacctctggcgctgtatgaaaaccaggaaggaccttcttcacctgttgaatgtggcactggccggcatgtacggcgagcagtcaactatcctgacgatgaaacagctctgtggctacgcttattctaccattgaggcaaagtcttataccacatttcagatccccaagaaaaagaaaggggaattccgcaccatcgacgctcccgtgccaatgctaaaatatatccagagagggttgaatttcatactgcagtgcgtttacactccacatactgcagctatgggctttgtgcaacacagaagcgttgtggataatgccaaggtgcatacaggacagcgcctggtctacaacattgacttaaaagactttttcccgagcattaccgccgggagactttaccatcggctcatgtcaaagccttttagcctcaatgagaaagtagcatccattatcaccgacttgtgctgctacactaacgccgatgggaagcacgtgttgccccagggagcacccacgagtccaaccatcacaaacatcatttgcgagaggctggataggaagctggctcgtctggctagagcctatggactgaagtatactaggtacgccgatgacatatccttctccggtatgggaaacgtgttcgccgaagattcacggtttgtcaaaagcatgcacaatatcatcgaacaggaggagcattttatcatcaataaggataagacccgactgtgtcaccgaggtatgcgccaagaagtaaccggtctaagtgtcaatcagcaagaaaacgtgagccggacgtatatcaaacaactccgtacgctgcttcacaattgggagatgaatggctacgataaggcgcaggaggtgtttgcaaagcattacgcggagacaaacacaagaaacctcaagaataaagggacacatcatgtcgagaatatcatagcgggcaagctcatgtacctgaaaatggtaaagggagaaacagactgtacctataagaacttatttgctaggttcaaactcctgttggagaaccacacagacactaaaatagacaaatcgaagttctctgacgatcaggcccagaacatccctgtggacgaaggacctaagcatgtcactaacaacgagacagtacagagtgtcgacattgaaaatagcgatgagattctttctaccttttcctccctagaggaattgctgaacaacgaaaacgaatga

SEQ ID NO: 7396 - RNA, 1149 nt, unidentified
  source 1..1149: mol_type = other RNA; note = synthetic construct
atgaacgtcgccaaacatggtcagtccaaatcactcgtccccaagccgctggaactgacccaggaaaaacgcagagcactggccgaccgagtcgcaatcctttggccccgcctgaagaccaaggccgatttgaagcagctgcttaacatcacgctgagcggccttttcggcccacactcgacgtttcttacaatgaatcaattgaactactccatctattccacaattgagtccaagcggtactcttcattcaggattccaaagaaaaataagggggagtttcgcaccatcgatgctcccatgccactgctcaagtacgtgcaacagggccttaatttcatcctgcagagtgtgtataccccacacattgccgccatggggtttgtccctcgtcggtctgttgtggacaatgcaaaagtgcacacaggccagcggcttgtgtataacatcgacctgcaggatttttttccctctataaccgcgggaagactcttcaaaagactaatggctaaaccgtttagcttgaataaagaggtggcctcactgatcacagacctgtgctgtcatacccatgagaacggtaaaaatgtattacctcaaggcgcacctaccagtcccactatcagcaatattatttgtgagcagctggataggaagctgtcccagctcgcaaaggcctatggcctaaagtacactcgctacgctgacgacataacattcagtgggatggccaatctgttcgccgagaactcaaagttttgcaagtctctgaaacacatcatagaagacgaggagggttttgttattaacccaaataagactaggctatgccatcagggaatgaggcaagaagtgactggcttgagcgttaacaggttcgaaaacgtgcctcggacctatgttaagcagttaagaacactcatacacaactgggaaatgaatggatacgataaagctcaggcggtgttcgctaaacactatactaaaaacgatcctcggcatctcttgagaaaatacgctggacgaatcgaaaacgtgattagcggtaagctcatgttcttaaagatggtaaagggggagaatgatgacacttataagagcctggtcgggcgttacaacgcgctcatgatggccgctggatgtctgtga

SEQ ID NO: 7397 - RNA, 3237 nt, unidentified
  source 1..3237: mol_type = other RNA; note = synthetic construct
atggaggacctgcatatcaagaatggaataaagacactctggcagaatatgtcttcaaaaaacgagctgctgagcatccttaacaaagctgccagtatactctacggcgatgatgctaaaaagattgaaatgagccacctgacatatcattcctactccacaaataacaagaaacggtacatctcattccagataccaaagaaaaagaaaggggagtaccggatcatagatgctccatgtaaagggctgaagctgattcaacagtgcctgaatgtcctatttcatgaaatttacgctcccaatgtggctgcagtgggcttcgtccaaaataagagtattgtggatggagctaaaatacacctgcagcagaagttcgtctataatatagacctgaaggactttttcccaagtatcacctccggcagattgtttaagcggctccagtctaagcccttttgcctaaacgaggaaatagctagcataatcacagatctgtgctgtaatacgaatgcggagggaaaaagcgtgctaccccaaggcgcacccacatctcctactatcactaattttatatgcgagagactggatcagaagctcactaatctggctcacgcctatggactcaagtatacaaggtacgctgatgacatcactttctcgggtatggccaatgtctttgctgaatccggcaaattttgcaagagcttgcggcatatcatagaggaggaggagaaattcaagattaacacgtccaagactcggttactgcatagaggcaatcggcaggaggttaccggtataaccgtaaatgagaggttaaacgtgagcagacgctatattaagcagctgcgaaccatgattcacaactgggaaacgaagggctacatcgaggcacagtacatctttcagaagaaatacaatgagacgaacattaagaactcgaacggcatccattacatcgaaaacatcatttgcggtaaactagattatctgaagatgataaagggggaaaaggataggacctatatcaaactgaaagagaggttcgataaacttctgtttgggaacacttactctccactcaacaaccacattgacaaaatttttgagacgttgattgcgtctagatttaatgagtacaaggataagaacgccagtgacgagaacgaaaataagaaagagggtaagaactatgtgaacaagtcaatcaatacactagtctcggagctggacagtccaatgacactggaggaagccaccgaaacactcgtggagggtattgacgtgattagtgtacgcaatgggttcactagtactgaaagccgcgttatcgtggaagtgtcaacaatcaaaaaggatactaagagcccttctattaaccttgcagtgctcactgtcccgatcggcgagacatccctcatcatcaatgatgagattcaagaaggaaaattgttcatcgatgagctcaagtccctcaatgacaatccggaggactctaacaacttgaatatcgccaagaacattatgggacaaaacagccggattaggtcagttcacgccattctgaacaatgtactgaataagctttccgaagaccctaataacttccgtatctacaataacgggagggtaggatttaccgaggacgcccaagctttcattcggaaagagttgaaccgcattagccgccatctgtatctgtccgacagcgcgactcctatgctcggactgaccaataataacgagatagtgttcaccatcttggatgacaacaccttcgaggacgtcctcgtgcctactggtatagttcttgggaatacgaacgtggccgacgccgccaatagcatcaaaggtgccgaaaatattttccataagaacgccacaaaactgaccgaatataccactgccagaattgtgagagacttgataacgaaggtcgagggcaacgagagggtggttcggaaaaacggcaagggatacgaagcagtaaagtggcagttacgctatgataggcttcagaaagaggctgatatctctaacaccagcaataagactgccaaggaacagattgatgcacacaacgaaagccgcgaggcctacatacgaactgcagtgaaagagggaatcattatcatcaacttcaacaaagactctctggaaagcaataactaccttaagcacaagtatctgaacagaaagaacatcgcaaaaatcctgttgaacaagatgggcaaatgttttgttaccgaggaacaggttctgaatatcgtgtcccaaaagaagtacgttacagaagaacgtgccatagaactgatcagaaagtatgggggccataataagaaagagattggaaagtccaacgtcgtggagtaccctgacccaaagcagacctatcaatttcttagctttttctcccagaatgacggggggttaaaaaacctgacccacgacttcaactatgggtacatcgattatgacgtgttcattgcgcagtgcaagaaagagttcgaggaaatcaaaaaacgattccctaatgtgcaggagtctgtggtacgtcgcatcgaagaatttgcctttaaagaatccccgaattggtacatcaggcttggcaatgacaagaaatatattagatacgggtggtcagagccctcattcgtggaatggtacaggacaaacaaaatccaccccgccaaagatacacactataacgccgagatgattgtacccttcaagaattctatccaggttcgcgcagacaacaaaaaccttattggactactcagttcattagtcacaatggccttcggtcagaatccttgttgtaacgtcgaaatcacacagaatgttggggaggctcagttttataccgatgtcgaccgtctgggccaggctatttatcagatcttcagtaccatcaaggattattcagagcagaacttttgtgacaaagtgatcgtggattactacacagaaaacgattttaagatcctcaccatcacccacattgatagtaaacccaccaaaaagtctgacgacaaagattacttaggcggaaatggcactaccattaaaaaggcactcttcggactgtgcaattatgaagtccaagcggagttcccagatggtgcatatcgaaagatcatcttgtccgataattacgaagactttaagaagggccgataccttattgacaaggactcaattgacgggtacaaacacattatgaaattttactga

SEQ ID NO: 7398 - RNA, 1443 nt, unidentified
  source 1..1443: mol_type = other RNA; note = synthetic construct
atgtcaaagaagaaagctaatagcaagagtgacctcaagaaagtgctggaccgaaaccggcataaagaggagaaagtggccgctaaggtcggtatgcagatggaggctgaggaagaagtcgcaatcatcgacttcgacgatgattcggcgagctcctccgaagacgtacagattgagactaccgggaaccccaagactgagcagaaggaggacggggtgaaacaagttactcatccactctctgaggaagagaagaaagagtgcttagaggagatccgcgaaagatggccgagaatcaaaaccaaagagagcctgctcagtattctcaatatcgctctgatactgctttatggaagggacgccaggaagttaactttgaggatgctcaattactacgcgtactcctcacacaacaaaaaacgttacatcacattccaagttcctaaaaagaagaaaggtgaatttcggacgattgatgcaccttgtgccggcctgaagatgatccaaagagccctcaacctgattttccagaccatctatacccctcacgaggccgctatgggatttgtgcctcaccgcagcgttgtgacaaacgcccgggtgcacgtaggccaaaagtacgtgtataacatagatctgaaggactttttcccatcaattacaagcggtagactttttaaaaggttgctggtcgctccattttcaatggataagaagatggcatctatcgttaccgatctctgctgctacaccaatgccgacggtaaaaatgtcctcccacagggggccccaacttctcccaccattaccaacttcatatctgagcatcttgatcgaaagctttctaaattggcaagagcctacggcatgaagtatacgagatacgcagatgacattactttctcctgtagttctaacatgtttgcagaggacggcaaattctgtaagtccctgaggaacattatagagaatgaagagcacttcaagattaacacagataagacacgcctgtgccatagcggggaacgccaggaggtgactggcctaaccgtcaatgaacagacaaacgtgacacggaaatatgtcaaacagatccgcctttttttgcatatatgggaagctaagggactgcccgaagcccagcggctcttcgaaaagcactacacacctaagactacgaggccgaatgtgggaattccccacatcgaaaacgtcatcgccggaaaactgctgtatctgaagatggtgataggcgaggaccgagatatgtataagcgtctagcttcacggctggacatcctggttggaaatacacaggagagcaatagtaccgatatctcccccaaagataagggggtgttgtccgtacctgaaaaaggcaaactgcccgcggagaaggaaattttgattgaactgaataccctaatcgagttacttgaatga

SEQ ID NO: 7399 - RNA, 1476 nt, unidentified
  source 1..1476: mol_type = other RNA; note = synthetic construct
atggcaaagaagaagaacatcactaagaagcaaaacctgaaaaagaagttgggccaaacctctgcgtcgaagaaaacagaagtctccgaactagttagcagcgggagcgagaaagctgaggaggtactttttgccatcgagccaattgaggatgaccttgtcagagtggctgccgctgtgactgagctggaggatatagacagtgccaaagtgagcgacgaagaaactattagtacccaagcagatgcactgagcaagattgatgaattgcctaaatatggaggttcacccctgacgggagaggatctgaagcagcaactggccaagatcgtcgagggctggcactctatgaatggcatagatgacctgtgtgtggttctgaacatggccctgcaggcactgcatggcatggacgccgtgaagaccactgtgggcagactgaagctgatggtgcgcaaagggcggtacgttacattcaaaatccctaaaaagaagaagggtgagtttagaaccattgatgcaccctgcagcgagctcaaaaacatccagcaggctctcaattttgtcttacaagaggtgtactcacccaacgccgcggcgatgggttttgtgaagggaaaatctgtcgtgacaaacgcccaggtccatctggggcagaattatgtgtacaacatagacctgaaagacttctttcccagcataacctccggccgggtatttaagcgacttctggtaaagccattctgcttaaatgagaaggttgcctcactgatttctgatttatgctgttatcagaagggggaaaacaaagtcctccctcagggcgccccgacttcaccaaccatcaccaacatcatctgtgaaaaactagacttcaagctcacccggctcgctaaggcatacggattgaagtatacacgctacgctgacgatattacattctctggcatgaagaatgtgttcgctgaggatggaaaattctgcacttccctgaggaatatcattgaaaatgaggaaggcctgaagatcaatagtgacaaaacacgtctttgccatagggggatgcgacaggaagttacgggtttaactgtgaactcaaaaaccaacgtgagtcggaaatacataaaacagcttaggccactcatccacaattgggaagttaagggctatgacgaggcacaggctatcttcgccaagcactatgccgaaactaacattcgcaacctgaggtttaaaggggaacaccacgtggagaatattatctccgggaaattgatgtatttgaagatggtcaaaggagagacagactccacgtacaaaagttacgccaatagatttgaaaagctctgtaacgatacattcggggccggatcccagaaatcccagaccttgctcacccctctcatggacgacggtaacgtgctttctgtactcaatgatctagctacactgattgagacgaataccagcgagtga

SEQ ID NO: 7400 - RNA, 1311 nt, unidentified
  source 1..1311: mol_type = other RNA; note = synthetic construct
atgaagaacagaatcaaaaacgatatggactacaataccgtcatcaatgagatttggagaaacctggaaagcaagaccgatatcgtggccctcatcaatgtgtctttgaaggatctttacggcgacaaggcctccaaaataagcttgcgtaagctcaactattacgcatatagcaaagtaaacgcaaaccgatacgtgagcttcgatattccaaagaaggacggttctatgaggcggatcgacgctccctgcagaggtctgagaactatacaacgcgcccttaatcacgtgtttcagattgtttacaccccgcacgaagccgctatgggttttgtcccagggaaatcagtggccaccaacgcaaagatgcatataggacagaggtacgtttacaatctggacttaaaggacttctttccctcaattagcagtggccgcgtgttcaagagattacaggctaaacccttcggactgaaggaagatatctccaggataatcacagatttgtgctgctacgagaatggcgaacaccggcacgttttacctcagggggcacccacttcaccaacgatcaccaacttcatttgcgagaggctggatgtgaaacttagtcgcctggcgaaagcctatggactcaactatactcgttatgcggacgatatcaccttttctggcatgaacgacctcttcgacatagacggaaaattctgtaagtccctacaccatattatcgaggacgaggaacatttcgttattaaccagaagaaaacacgccggtgtcacgctgggatgcgacaagaagtgacaggcgttaccgtaaatcagaatacatccgtcagtcgaaagtatgtcaaacaactcaggactctgattcacaactgggaggtgaaaggtcatgacgaggcccaggctatttttctgtctaactactccagtacgaagtatcataattttcggggagtgcatcacattgagaacgtcatcgaggggaagctgctgtatatgtcgatgattaacgggaatgaggatagcacctacagccagctcgtggtccggtttaagtctctgctggagacaatcgtctcaggcaaagccaatgcagaaaagggcctcggcaacgatacatcctctctagggaaggggggcaattgtatcactatatccgatatcctggatatctggggcaaaagcggaatggtagacgctttggaggtgtttaaagaaaatattgggatccttacgcagaaagacacctttcctacaggtttcaagactagtgacggagatcctttccttgactcaaatctgtga

SEQ ID NO: 7401 - RNA, 1161 nt, unidentified
  source 1..1161: mol_type = other RNA; note = synthetic construct
atgagattgacggactgtattggcctgcaggcgcaaccccagtctgtgagtcctgcaccaaaagatgttagtgtcaggctccgggacctttggcgatgtctagagtctaagcaagatctgctgcgattaattaatatagccctggaaggactgtacggagacatggcccagatgatcaccatgaagcagttgatcaacatggtgtacactgccaatggggagcaccgctatacttcattccagattccaaagaaaaagaaaggggagttccggacaattgacgctccaattccaacccttaagaatatccagcggggcctgaattccgtacttcaagctgtatataagccccaccaagctgccaaagggtttgttaagggcttttcagtggtggacaacgcccgagcccatattagccagagatacatctttaacatcgaccttaaggatttctttccttctattcattccggtcgtgtctacgctagactcctggcaaagcctttcagcttgcccccggagatcgcctccattatctgtgacctctgctgctttaccaactcagagggccacaaggcgctgcctcaaggtgcacccaccagtcccactttaacaaatataatctgcgaacggatggatcgcaagctcctgaaactggctaaagcctataatctgcagtacaccagatacgccgacgatattacctttagcggttccacgttcatgttcgctccggagggcaggttttgcactctcttgcagcacatcatagaggaggaagaacacttcacaatcaacaggaataaaacaaggatgggccatcgtggaacacggcaggaagtgacagggttgactgtgaataacaaaccaaacgtttctaggaactatgtgcgccagctaaggactctgctgcataattgggagatgaaaggatatcagaaggcacagacggagttcctcgcgcattatgccgaaattaacaccaagaacttacaatgggatgggacacacaagatcgaaaatatcatcgcaggtaagcttctgtacatgaaaatggtcaaaggagaaactgatagcacctacaaaggcctgaaaatacgcttcgaccagctaatgcagaacagacgcaagtatatcaagtcgctcaccaaccctatatga

SEQ ID NO: 7402 - RNA, 1194 nt, unidentified
  source 1..1194: mol_type = other RNA; note = synthetic construct
atgaccaagcaagagatcgatgaaaaaattaaggcccagtggtcagccatggaaaccaagcaggacttccttagacttttgaacttgagtaactgtgccctctacgctgagaaggcacagccgttcactttccgacagttgctctttcacgcccacacaacccggaataagaaacgttatgtctccttcaagattcccaagaagaaaaaaggggagtttcgcgttattgatgcacctaatcccacgctgaagagcatgcagcgcgccttaaactacgcactccaggtgatttatgaaccacacgcagccgctatgggattcgtaccaggacgctctatcgtgagtaatgcacagagccatactaacaagagatttgtgtacaatatcgacctgaaaaacttttttcccagcatcagtagcggcagagtgttcgcccgatttcaggctaagcccttttcctgtaataaagaggtggcttccctcatagctgacttatgttgctatcggaacgatttcggtactgttctgcctcaaggtgccccaacgtcgccgactatcaccaacattatttgcgaccggctggatgtgaaactgactagactggcgacggcgtacgggctacattataccaggtacgctgacgacattaccttttccgggatgtcaaatatgtttgcggaagacggccgattctgccagtctgtgaaacatatagttgaggacgaggaacacttcactatcaataaggataaaacacgcttgtgccatcggggcatcagacaagaggtcacaggtatcactgtcaacgagaaacctaacgtcacccgcgaatacgtaaagcaactgcggacaatgatacacaactgggaatctcaagggtatgagagggctcaggcaaggttcctggagatctacaataaaaccaatacaaggtatcacaaggccaagggcaatcatcacatcgaaaacatcatttccggcaagctactgtttcttaagatggtcaaaggagaaaacaatgcacagtacaaaaagctcgatgaaaggcttgtggccttagagtcaacccacacagatccaattccccagaatcgtagcaatgccgtgatacctcctgctatgggagacaacatcatttctaacgagaaggaaatcctcgaggagttcatgacactgaacaaactgctggagtga

SEQ ID NO: 7403 - RNA, 1014 nt, unidentified
  source 1..1014: mol_type = other RNA; note = synthetic construct
atggacaaagacaagctgtctctgctttcctccttgtcaaaggaggaactcttcaatctattcagcacctttgtcgagtcccaaaatgcagtgcaaaacactgattctgaaacagttgactttgccaatcaggctaaggaaatgtggcataagctcagtaatgaagccgatttgagagcactgattaacaccgtaagtgttaaggtgtttggtaagttccagtacaccgaagcacagttcggccactgtttcaacatcaaccacagtcggtatactactttcgagatcccaaagaaaaaacctggcgagtatcgaacaataaaagcgcctaatccgacccttatggggatgcagcagtgtctgaactatgtcttccagcagctttatcaaccaattgagtgcgcgacaggatttgtacccggacgcagcatagtggatggagcacgcgtccatttgtctcagaagtacgtgtacaacattgacctgaaggatttttttacgagcgttactgcacagaggctggtcaacaggctccagatcgagccctttggtctgagcgaagacatggcccagctggtggctaatctgtgctgtgacaagactaagtatgacaagtttgtactgccacaaggggcccctacctcacccacaattacgaatttcatatgtgactccctcgatcggaaattaattaaactcgccgctgcccacaatctgcgttactcacggtacgccgatgatatcaccttcagcggcatgcagaacgtgtttgcggccaacgggcgtttctgtaaatctttgaggcatatcattgaacgcgaagagagattcactatcaaccctgccaaaaatgcttcactaagttcccggaatgctgcacgctccaacagacacaactgcaaacccaaaaccgagtgctttgcctctctctaccaaacagtgacctgcgctgtgaagcagctgggcgagaagcgaatcagacacagcgcttcgaggatccttgagacattatga

SEQ ID NO: 7404 - RNA, 1218 nt, unidentified
  source 1..1218: mol_type = other RNA; note = synthetic construct
atgcccgaatcggagcagaagaccgaagagaaagaggccaaggtggaactgctgaggatactcaatgtgatgaagaagaaactttacggggacaactcctatccgataacaatgaaacaactcaactaccatgcctattcaaaaaacaacccaaaacgatatgtgcaattccagattcccaaaaagaaagcaggagaattccgcactattacggctccaaatgcagggctgaaggccatacagcggtgcattaacgccctgctgcttgaacagtttgaagcgcatcctgcagctaatggctttgtgcccgggaagagtattgtggacaatgctagagtccacctgggacagaagtacgtctacaacatcgatctcaaagacttctttcctagcgtgaccatcggcagggtatttgcgtgtctgcaacttccacccttctcatttgacaaacacacagcttccttgatcgctgatctgtgttgccacgagggagttctcccccagggagcacctaccagtcctacactaacaaatatcgtctgctctcgcctggattggcgtctctcaaagctggcaaggaggttcgatctgcgatacagtcgttacgccgatgatataactttctccgggatgtccaacatttttcacgaggacggtgccttcgttaaggatttacgccacttcgttgagaaggagggttttttgatcaacgaaactaaaactcggaccaattcctactatcagagacaggaggtcactggcttaacaatcaacgaaaagcctaacgtgactcagcgctatgttaagcagattcggaccatgttacataattgggaggcttctggatatgaggcggcccaatcagtgtttttcaagcattatcacccgacaaaaaatgtaaatgccgagcaccatatcgaaaacatcattggtgggaaactagactacttgaagatggtgaaaggagtcgacgacgccacgtacatcaagctgagagatcggtttggcgaccttctgagcggcagagagaagaccaacagcaccgccaggccaggcaatgttatcccagtggtggatattagcgtacttaacgagggcaatattatcgacatcgagctggtcaatgaggaagagcaaaagagcaaagatacccacggcctcttggacgaaaagctccagcagttgtgtgaatctgggttcgacctatctatactgtga

SEQ ID NO: 7405 - RNA, 1074 nt, unidentified
  source 1..1074: mol_type = other RNA; note = synthetic construct
atggagcaactaaataagttcaaaaaggagttgtacggggagaattgtcacgccataaccatgcagcagttgaatttccacgcctatagtgaacacaattcaaagcgttacatacagtttcagattccgaagaagaagaaaggcgagtttaggactattactgctcccaacaaaggcctgaagtgcatccagcgctgccttaacgccatgctcctgcggcagtttgcccctcatcctgctgccaacgggttcgttcccggcaaaagcatcgtcgacaacgcaagagtccacgtggggcagaaatacatttataacatcgacctcaaggactttttccctagtgtgactatcgggcgggttttcgcatgtctgcagcttcctccattcaaatatgatagagagacagcaagcctgattgcggacctgtgttgccatgagggggtgctgccacagggagctcccacttctcccactatcacaaatatcgtgtgccagaggcttgattggagattgtccagactcgcactgcggtacaatttgcattactccaggtacgcggacgatatcacattttcaggtatgaccaacctatttcacgaggatggagacttcgtgaaggctctccaccatttcgtggaaaaagagggtttcaccatcaacgaagccaaaacacgagtgaactcctattaccaacgacaagaagtaaccggactgaccatcaatgagaaaccaaatgtgacacagcggtacgtcaaacaaatcaggacaatgctgcataactgggaagttaatggctacaagtatgcccagtcggaattcttaaagcactatcataccacgaagtacatcaactttaagggagaacaccacattgagaacgttataagcggcaaactggacttcatgaaaatggtaaagggcgagaaggatcatacgtatctgaagttaaaggaacgctttgatcgccttaccattatagatgtctctggtattctcgacgtctgggaaaaggagggaattgacgctgccatggatctctttatgaatgtgaaaaaacacaacggcgacgagtga

SEQ ID NO: 7406 - RNA, 1299 nt, unidentified
  source 1..1299: mol_type = other RNA; note = synthetic construct
atggagaagtccttaaaagacgaaatcaatgccatcattgacgactgctgtgctaaatatagctctttcagtatcgaaacctttatagacatcgtaaatgagattcacagtaaggtcttccaggagagctatctgatcgagatcgaaacactaaaaaagatcgcgaattccgtcgataagtatgacaagttcgagattcccaagagaagcggaggtgtccgagaaatctacgctcctaaaaagaacctgaagaagatcctctattaccttaactttatcttccagaacatctacgtgcgcaatttcagcttgtacatttcaccgaatggttttataccaaatcgttccgtggttaccaatgccaaacgccacctctgcaagaactacgtctttaatattgatctggaagactttttcccatctatcaaacagtacaaagtaagcttcatgctgcagattgctccctttaatatgagcaagaatgatgccaacctcatggccaagcttatttgctatcaggatcagaacggcgagtcctttttaccccaaggagcccctactagccccattatctccaactttgcctgtcgatttctggatataaaactcgtgaacttggctaagcaattccgcctgacatacagtcggtatgcagatgatatcacattttcgtcaaactacaatgtgtacgacgataaattcatggacgccctgaccttggtgatagaggaggaggggttcaagataaataaaaataagacgcggctgcagaagcggaatatgaggcaggaagttacaggagttattgtgaactacaaactcaacgtgtatagaacctacatcaagaagctgagggtactgttacatatggtgaagaaatatggctacgagaaggcaaacgagatttacaatcaaaaggagcagagtgataaacaaaaagacctgaaatcaaccattgcggggaagctcaattatctgaagatgattaagggctctaacgatactacttatatgggcctcatgaattcttacgtcgaactattcgacataaaacagaagaacaagcctccaataccagatgacgaatctttgatcgtgtgtgaaactgcagagaagttgcttaaagaactgaccgcttctaacaacctgattctcaccaatatcaaaaacgagtcaaactatctgaaccttcctaagactcagaacgtttccaactccaaagtggccaatagcgaaaaagcaattacaacggagtcactagtggacagaatccttagtaaactgagggagatcctgtga

SEQ ID NO: 7407 - RNA, 1992 nt, unidentified
  source 1..1992: mol_type = other RNA; note = synthetic construct
atgaacatcaagtcgatcaacggaatcaagaacatcaatgacctcattgatattatctactactacaacgacgagcataacatcgaaaacaacctgcacatagaaaccagcactatcaatttcctcgcattctatgcgaagaagaaatacaagaagttcgaaatcccaaaaaacaatggggaattccgaacaatatatgcaccaactaaatacctcaagacgattctgaaatcactgaattacgcctttcaggccatctataagaataatcaagtggctcatggctttctgcctaataaaagtgtggccactaacgccaagaagcacatatctaagaactacgtctttaacatggacctaaaagactttttccagtctattcaccaggcacggatttggaagatgctccagattagcccctttaatctcccgaaagatatggctaatcttctagctggcctgctgtgttaccaatatccccgggaaagcaaggagaaatcctttctcccacaaggtgcccccactagtccaatcattagcaacttcatttgctacagactggataaatccctcctcgaacttgctaaaaaacacaacgctatctacacccgctatgccgacgacattacgttcagttcaaatatcaatctgtacaagaaggattctgagtttcttcagaagatttaccgtatcatcaataacgaagggttcagtattaatgagaacaagattagactgcaggggaaaggctatcgtcaggaggtgacagggattatcgtgaatgagaaaatcaatgtgtccaaaaagtacatcaagaacctgagagccttaatttacatgttagaaaagtacggcgaaaaagaagccaatgagttttactataccaaccatgcaaaatcgctaaatatggttatttccggcaagctgaactatttgaaaatgatcaaaggcgagagcgactccacctatctgaagttgaaagagaagttcgagaaacttgcgaagaacgacgttttaatcaaggaacctaacaaagaaagtgcccaaaagaccaaacgaaatcccaagcagaaccctaacgcaaaacacaatccaaaggcgttagtagacatccttcggaaattctcccagtcagactcccccttcaaggctactgttcataatgagagcaattacccctcctacaacggctatgacaacttcatgacatcacttaataaggagtggaatgagatacaaaaagatctgaacgcatatagctacaggctctataacaaattgttgggtttcctgtttaagtctaccgaggagctgaccaatgcagataattataaggggtggggagaatcaaacgtgaaaatagggtggtcaagtagcgagatctctgagtactgcaaggctaacgacaagaataatccgtttgagtataaactgcctgatcgctatattatagagcacaaaaacggatccattacaacattcggggatatttgcatgaagatctttaagtacgagattgagttccgcgatgagaaccagcagttttttaagctgattcaggacaatagaaagaagttgggatctggttttaatgtcaaaatcgatgagaagatccagggagtctctttttacagcgacacacacctggtatcagaagccataaacaagatctttaaccagttcatcgaacggaaaaagtatatcaatatcagggtgagtatggaaacgactgatgagtaccataaattcatcttcagccagctcgaaagcaaatgcaacaagggctctaaggaaatgctgaaggagattaaggacggcgatttcgaagatataaaaaaacgcctgttctccctgtgtgattggtctatagaagctaaatgttccgacggaaacttcaggataaactatcttaaaagcgacaatgagaaggacattgataagttgcctgatgcccctgagggttttacccacatattgaggttttataagtga

SEQ ID NO: 7408 - RNA, 1638 nt, unidentified
  source 1..1638: mol_type = other RNA; note = synthetic construct
atgtcaaaaactagagtatatgagcttgccaaaatcctgaaagtgacatccaaagagataatttccaaggcgaacgagctcaatatcgccgtgaagagccatagttccagcctggacgaagatgccttaaaactgattacagacgcattcgctaccaagccccaaatcaaaaacaatacatcagcaacgatcaagattaccctcaaagacaaagagcaaacctctctaaacgaacatatccagaaagccttcaatgagctgcggaacattgaggatctcgcaagcctgataaacaaggtgaataagactatctatgagcacacccataagatcaaggtgaaacacctcacttatcacgcctaccattccaaagataagtatcaggtctttaagattccgaagaagagcggtggcgagcgtgaaatttattctcccagcaagggcctcaaatacatcttaaagacactgaacatcatctttcaggcactatacaaaccccagagcgttgcacacggcttccttcctaatcgctcagtcgttactaatgccaaattgcacgtcaataagaattatgtgtacaatatcgacctcgagaacttcttcccaaatattcatcaggcgcggatttggaagcgcctgcagcaccctccctttaatctgaatggaaagcgtatcgaaatcgccaacttgctggctaaccttgtttgttttcagtacgagaaaagcagtaatgagaagaactttctccctcagggtgccccgacctctcctatgctcagtaatataatttgccacagactggacaagaagctgctcgaattggctaaggcctacaacgtgaaatacactagatacgctgatgacatgacgttcagttctgatcacaatgtgtaccaaaaaaacagcgagttccttcagaaactgttttctattatccaatcggagaacttcaagataaatccaaagaagatcagactgcagaagagggggtacaagcaggaggtgacgggcctgatcgtcaatgaaaaaattaacgtgagccggtcttatattaaaaatactagggcactgatccacctggtcgagaagtatggtgatgagaaagcccaaaagatctttgtggaaaaaaacggatccaagaacttggatctagtgatattcgggaaactgcagtatttaaagatggtaaaaggctctgaagactcaacctacaccactttgtatcagaaggccatgaacgcatacaaaatgatcgaagttgaggtgaccaaatcaaataacgatgaaaagaaacagaccgagattatcaaaaagaacaccattaacgagcaacacaacccaaaggagctggtaaagatattgcggaactttacaacatgtgaaaaacccccttgcgctcttaaggctgccgttcattccgaagaagaatattaccagtttaacgggtacgaagactatatacgaaatctgaagtccgcgtggaggaagattgataatccacttaggaatctctccaaacgattacatggcaagatttacgcttttctgttcgcttcggacctagggacccaggagcgcgtcgacaagagtaagagtaaaaactccggatggggagactcaggaatgacattcgggtga

SEQ ID NO: 7409 - RNA, 2007 nt, unidentified
  source 1..2007: mol_type = other RNA; note = synthetic construct
atgccgattaataaggtgacaccagatcagaagaataagatagagatcctgttcaacaagatttccaatattgacgactttctgtccttgatcaataaggtcaataagatccagtatcaggagtataagaaactcgagctgaaacagctgacctattatgcctttatcaacaagtcaaagtacactacctttgaaatcaagaagaaaagcggtggaaatagggaaatatactccccaaaaaccgggctgaaatatatcctctccgctatcaacatcattttacagtccgtctataagcccactatagcgacacatggctttatcaatcaccggtcaattgtgacaaacgccaaaaaccatacggataaaatttacgtctacaacattgacctggagaatttttttcccagtatccaccaggctcgcgtctggaagaaactgcagttacctcctttcaacctctgcgaaaataagatccaaatttctgagctgattgccaacctggtctgttatcaacatatagagaagacaacagagaagaatttcctgccccaaggggcaccaacttctccgataatatctaacatcatttgcgagcggctggatagacgcttattaggcctggccaagcgtttcaatctaaagtatacaaggtatgcagacgatatcaccttctcttctaatcacaatgtttaccagaagaacagtgattttatcaaggaactgaattccatcatcagtaaggagaacttcaagatcaactctaaaaaaacccggcttcagaagaaagagtacaaacaagaagtgacaggaattattgtgaataagaagactaacgtgtccaaaaagttcattaaggaactgcgcactcagatctatctactagagaaatacggcgttaagaaatcgaagagcatttacaaggagtactacaagaagatcaatggggatatagagctgatacctaatatgatgaatgtgatttacggtaagctcaaatatttgaagatggtaaaagggcaaaacgacagcacttatctgaaacttaataaccgattcgagaactgctttaagaataagaagcattttgcttcacagaactttaccagctacgagctcaaagaattttcgaaccaccagccgcaaaaaatggtggaactgttgaaaaagttcacatcagaagaacccttgaaaagctctacccatccaacgaaaaacaacgagtgttacctagattttatcaaagagttacgggtgacatggaaaatttacgaggaagagtataaagacttcatcaacgaaaagctcattagcaaaatctacaccttcctctgtaacccaaaccccaaaaatggttggggaatagataacatcaaacttggctggacaagctccaaacttaaaaagtggtgtgagaagaatcctaatttgatgcctaacaagtttcccattgagaatactatctacaccttccaagatatcatcaattacttcaagatggagattgagattacccctaacagaaataacctgtatagcttcctgtttgacatcatggacaatgaactgtgccagttcgagaagctcactgatgaagaaactgaggagatactggacgaagcaaaattcttcatcgacacccagtggattaaggaaggcctcgagcttatttttaacgagattaaccagagatccagtgtttcaaaacgaatcagaattcaggccaagaaaaataaggagttcattgagttgaagatcacccacatcaacagctttagtaaattctccccagaaaaactccttgagaggcttgaaaacggagtagggagttttccctacatccagcagaaatttacctctctctgcgacatcgccttgcagtcaaagtaccactcaagcatattcaagatcaacatactgaacaactacaatgatgaggaaaagctgattaaagacatcaatacggaagaagaaggctttacctatattttcaggttctatcgttga

SEQ ID NO: 7410 - RNA, 1710 nt, unidentified
  source 1..1710: mol_type = other RNA; note = synthetic construct
ttcgtattgaataagtccaatgtgaccaatgccaaagtgcatatcgacaagaactacatatacaccatcgacctaaaggatttcttttctagtattcaccaggcacggttctggaaacgcctgcaattccccccctataatctggatggaaccaaaatcgaactggcaaacctgattgccaacttggtcttcctccaaacagagaagcaagaggagaaaaactttctgccacagggtgcccctacgtcacctattgtcagcaatattatttgtgaacgtcttgatcggcgtctgctggggttagcgaagaggtttaatgtgaaatacactcgatatgctgatgacatcacattctctagcaaccataatgtttaccagaaagactcagagttgatcatcgaactcaacaggatcattgccaacgaaaactttgagataaacccaaagaaaactcggttgcagaaaaaaggatataggcaggaagtcaccggtatagttgtgaactccaaagctaatgtgaggcgcaagtacataaaggaggtccggacatacttctatcttattgaaaagtatggcctggaaaaagctgagcgcgtctttgtgcaacatcagtacaaaaataacccgaaccttaagaattacaagtacctgtccagcgtgttgttgggaaagttagagtatctcaagagcgtgaaggggaaagaagactctacgtatctgaagctcaagaacagatacgatatttgcttccccaaggaggaaactagtaaggagaagaaccttaaactgaaaaaggaaccaatccacaatcccaaagaggtggtcgccattctgaacctttttacccagaacaataacatcctgaaatacactacacacaattgggataaagaggagctggacagtctggacaactttttgaaggagatcaagatcgaatggaataaggttaacaatagactcaaagagctgactcctagattacacgccaagatcatttctttcctgttctctaaaaagctgggcaccctcaatctaactgataatcgaaataaggtgtggagatgggggatgagccagatccagttcggttggtcatccccgaaacttagagagtggacaaaagaaggcaatagtcctttctcgtacgtactcgatgaaaagtatcggaagaaaattgatggcaagtcgattgacaggttttccgacatcgtcgaagtatttaagaacgaaatcgagattcgctccgataataaccaactcaagaagctgttcattagcaagcagaagaaatacctagggtttgactttaacgtggagtttgttaatctggaaggggtggacttttacaccgatgttcagcatttagatttcggactgaatgagatcttcaaggaaataaaacagcgaaagctgtttccaaaaataaagatcgaagcgatcaagaacatcgaggcaggttttattgagctatgtatcacccacattgattcattccccaacaaaacaaaggaggagatgataaaagaagtggaggacggcgacttcagcaaaatcaaagagaagttcacaagtatttgcgactggtctatagctagcaaactttccgacggaaactataagattaattatctcggaggcgaagaatcattcgagaagctcaacgaggagcctatcggctttacgcacatcctcaaattttataagtga

SEQ ID NO: 7411 - RNA, 2073 nt, unidentified
  source 1..2073: mol_type = other RNA; note = synthetic construct
atggagctcgattccaaagacaaaatctacatctacaactctttctacaagatgaacaataagctcgatctgcttcagttgatcaacttctgcaagaaaaagatctatggtgaagaagctcaccccatttccctcaaacaattcaattaccatatcaatcccttgtacaataacttcagatacaacagctttatcgtgaagaaaaagtcagggggcgataggattattttttcccccaacaatgggctgaaagtcatacagaaatgcttaaacctcatactccaggtcgtgtataaaaacccatctaaatatgccacaggatttattagtggacgctccattgtggacaatgccaagatacatgtgaacaggaattacgttttcaacattgaccttaaggacttcttctattctatagatcaggctcgggtctggggtcgcctacaagtccaaccattcaatttttccaagaaggagaacaagctggaattagccaacatagtagcctccctgtgttgtcacagtatcgaggtggaacgttttgtggaggggacctggatcaaaaatcagaagaacgtgctgccacaaggcgcgcctacatctcctgtgatcagtaatatcatttgtgagcgacttgactattacctatccgcagttgcaaaacggttcgggctgaagtatactaggtatgtcgacgacatcacctttagttccgaccagaatgtgtatcaggttgacggggatttccggaaggaacttgaaaaaatcgtgcaacaggagggtttctatttcaatgttaacaagacgagactacagaaacgcggatttcggcaggaagtcactggggtaatcgtgaacgagaaggtcaatacaaacaaacattttgtcaagaggctgaaaaagtggatctacctgtgggagaactatggctatgaaagggcatcaatattctttaaaagcgagtatgaagcagataaactgaactttaagactacccctagcctggtttccgttttacgaggaaagctgaattacctgaagatgctcaaaggagacaaagattctctgtatctcaacctgaatagcaaatttgacaagctgctgaatggaagcattgatcagaagtccagcctgatcaagattaccaaaccagctatccctgtgatccaccaacctcagaagcttgtagcaattttgaagaaattcaccacgaacaatacagccttaaagtactcaacgcacacttgggacggcggtaaggacactgagatcttcgctaacatagaggatttccttattatggctgagagagaatacaagactatcagctatgatttgagcattctgtcgaagccgctgaacgccaaaatttggacctttctgttctctgacaacttttcaaagaatggctggggcatgtttaatgtgagattcgggtggaattcaatggagctgcataagtacctcaatggtaaccccaacaataaacctgaatcttatatcctgccagaggagttccagcagaacattaaaaagtatgggaaaagctttctgatccagagcttcaaaaatgtgatagacttgttcaagaacgagattgaaatccgtgatgagaattcaaccctcgaggacatagtaattagtttgcacaagacctaccttaatggctttaacatcctgaagattgaaaacctcgcgaataaaaacttttacacagacgtggattacttatacaaggccctcgagctcgtgtttcataatatccagaaacgcccccagtatcccaatgtgggatacattgggtacgattttgaggattatttctgcctcgaaatcatgcactttgagtctaacgccaaaggaaagagtttcaaggactcaaaatttacccttaaggaaggcgatttcggcacaataagcaactacctaaaaaatttgtgcgattggagcatcgagtcttcttttagcgagggcacataccaggtcaactttctgagttccaagaatatttcgccgtacaaattgaaatcatccagtgaaggcttcaagtacattttcaagttctacaagtga

SEQ ID NO: 7412 - RNA, 2073 nt, unidentified
  source 1..2073: mol_type = other RNA; note = synthetic construct
atggagctgaactcaaatgataaaaggtatattcaggcaaccttctttaagatgaaaaataaggcagacctgctctacctcatcaacttctgcaaaaagaagatatatggcgaggatgcctacgacatcagcatggttcagttcaactatcatattgtgcctagctacaacaattatcgatacataaccttcaaggtaaagaagaaatctggtggcgaccgcaccatattcagtccaaacaatggactgaaagtgattcagaagtgcctcaatctgatcttccagatcatttataacctgcctagcaaatcaacaactggttttgtgccgggcaggtctatcgtggacaacgcgaaggtgcatatcaacagaaattacgtattcaacgtggacctcaaagacttctttaatagtatcgatcaagcccgtatttggggccgacttcagattcagcccttctactttagtaaaaaggagaagagattggaacttgccaacattattgcttcactgtgttgccacccaatagaagtggagcggttcgtggacggttgttggattaagcaaataaagaatgtcctcccccaaggagcacccacaagtcccattatctcaaatattgtgtgtgagcgcctggatttctatctgaacgccgtagctcgtcgctttaacttaaagtatacccgctatgtcgacgatataacgttctccagcgatcataatgtgtaccagtctgacggcgaatttcggaaagaattagtacggatcataacgaaagaaggattctacttcaataccaataagaccagactgcagaaacgctactttagacaggaggttacgggcgtgatcgttaacgagaaggtgaacgcaaacaagagatttaccaaaaggctgaaaaagtggatctatctgtgggagaattacgggtacagaaaagctagcctattcttcatctccgagtacaaggacgataaaattaacctgactagcatcccagcacttgaggatgtgatcagagggaagattaattacctgaagatgctgaaaggagataaggattctctctatttgacccttaagtcccggttcgacaaactgctgaatggccctatcaaccacgagtctcaaatcatcaagataattaaaccccccattcctattatccatacaccgaaagaactcgttagtatcctaaagaagttcagttccaataacactgccctcaagtactccacacatacatgggacggcggtaaagacaatgaagtcttcgattcaatcgacgattttttaatcaaggctgagatggagtataaactgatatcctacgagctcagcatcctttcaaagtggttgcacgccaaaatttggactttcctctttagcactgacttctctaaaaagggttgggggatgtttaatgtccgttttggctggtctagcatagagctgagggattttttgaacgccaacccatataataggcccgaaaactacattttaccagaaaagtatcagcaaggaatcaagaggtacgggcggaatttcatcatcaacaacttcaagaacgtcatcgacctatttaagaacgaaatagagattcgggatgagaattcaatcctagaggatatcattatctcgctgcacaaaacacacttgaatgggtttaacatcgataagctggagaacctgtccaataagaacttttacacagatgtggactacctttataaggccctcgaattggtctttcacaatattcagaaaaggccacagtatcctaaagtcggatattatggatacgactttgaagactacttttgcctggagatcatccactacgaaagcaatgctaaagggaaatccttcaaggattccaaatttaagttgaaagagggggattttggcactatttccgtttacctccgaaacttatgtgactggagtatcgaaagcggatttcttgagggggactatcgcataaatttcctggcgtctgaatccattatgccttatgagaaaattgacttttcggaaggcttcaagtacattttcaagttctacaagtga

SEQ ID NO: 7413 - RNA, 1203 nt, unidentified
  source 1..1203: mol_type = other RNA; note = synthetic construct
atgacgatactacccgaccagaaagattacattcagaagcatttcgaggcaatgcagaataagatcgaattcctcagcctcctaaattatgccaaatcaatcctattcggggagaagggcgagccttttgttatccgacagctcaactactacattaacaccgcttcaaaagctgcgtcctaccaagcgttcgaaatcaagaagaaaaatggaggaacaagaaatatcctggccccaaaccaaggcttgaaggcaattcaatcctgtctgtctctcatcttgcaagagatctacatagtgaatgccgcggcaaaggggtttgtgaaagggcgatccattgtagacaatgccagcatccacattcagcaatactacgtctttaacatcgacttgaaggattttttctctagtattgatcaggccagagtgtgggctcggctcaagatggctcctataaacctgaattcctcaactaacaggcaggagctgtccaacattatcgctaagctgtgctgtcatgaactggaggtggaacgcctgaatatggagggtgaatgggagaagcagaaaaaaaatgtcttaccccagggagcacctacgtcacccgtactctctaacctgatttgcgagaagttagacaagagactgaccggtgtggcaaggcgcttcggactgcggtattcgcggtacgccgacgatattaccttcagcagtctgcaccacgtgtataacaatgaaggcgattttgtgcgcgaaatcactcgcataatcaacgaacagaactttcacataaaggaaacaaagactcgcatgcaggggcagggctacagacaggaagtcacaggacttatagttaacgagcgtgttaatgtgccaaagagatatacaaaggagttaaggaaatggctgtatttgtgggagaattatgggcacgatagggcttatctgttcttcaaacagagctacctgaacgacaagatccgggataaccgtttcaaaccggacatgattaagattctggccggcaaactcgactttcttaagatgatccggggtgcagaggatcatatgtacaaaaaactccagcaacgatttctggccttgatcccaaaaactagctctcttagtaaagtccttgacacctgggaggagcttggcattgaaaaggccatggaagagtattatgctcataggaccgcctga

SEQ ID NO: 7414 - RNA, 2106 nt, unidentified
  source 1..2106: mol_type = other RNA; note = synthetic construct
atggagctccaaaaaccacaagttgagtatattcgcaagtcattccgtaagatgcagagcaaaaaagacttcctgacgctgttaaactacgtgaagaacatcttgtacggggaaaagtttcaccccatagtgctaaaatctctgaactatcatagtaaccctgccaacaataacagacgctatatcaagttctctatcaaaaagaagagcggcgggagccgaataattcacgcgcctaataagggcctcaaagtcattcagcggtgcctaaatattattctccaagcactgtacgacgtagatgaacacgcctttgggttcgttcccgggagaagtatagccgataacgcacatctgcatatcggtaaggcatatgtctacaacatcgatcttaaagacttctttacgggtgtggatcaggctcgcatctgggcccggttgaaggtgaaaccatttcagctgaatggaagcgtggggcgtcacgaacttgcgaatctcatcgccggactgtgctgtcagtccatgattgtcgaaagaaaaggcgaagacggggcatggctgaaagaggtccggaatgtgttgccgcagggtgctccaacatctcccgtgctcaccaacattatctgtcagcaacttgattactatctgggaagggtagccctgcggttcggacttacatacagtcgatacgctgacgatataactttttcctcaagccactttgtttaccagaaagaaggcgagtttatcaatgagctggagcgccaaataactgaccacgggttttacatcaaatattcaaaaacccggctgcagaaaaggggctatagacaagaagtgacaggcctggtagtgaatagcaaattgaacgtccagaggaggtatatcaaggacctgcgcaaatggctatactattgggagaactacggatataaaaaggcatccgtgttttttgaatccgcctattccgccgacaaggggtatctaggagccaccaacccagtgatggcgaaggtcattcgcggcaagctcgattttttaaaaatggtcaaggggaaggacgacccgactttctttaagctcaatcagcggttcgagatcttgactgatattgtgaaggaagagctgcaaaatcaaaatacagcagagccgaattgcgtggccgttcctgtcatcgacggacttcctgtgttacacacccccctggaagtggtaaagatcctcaaaatgttctccatcaatgagtcagctctgaagtttgctacacacagttgggaggctggactggacgacaaaatattcaagaactacccagatttcatccgaaaggctaaaaaggagtttaacgtggtgtccagttctctcaacgaactgaatccccagttgagagcgaagatcctctctttcttgttcaacaaaagagttggcataaagtggggaatgcggagagtccgctttggctggagctcacccgagctgaaggaagccatggagaggacccccgagatgatgccagagaacatggtgctgcctgaacatgctcagtttcgggtaacttctcagaggggcggtacacagaccatccagaaattcaaacaggtgattgacatattcaagaacgagattgaaatccgaaatgacggtcccgtgctggaagaactcatctatgactaccattttaagcacctgcagagcttcgagatcatggagttcaccaatctcaacgacaaaaatttctacaccgatgtggattatcttcataaagcactggatttggttttcgggaatattgccaagtacccaggtaatgaaaagctagttggctacagattaattgatgacccttcgtactaccagctggctatcattaattacggttcccgacttaggggcgtttcaattgccagtgaaaagttcttgctgaccaagggcgattttggaacgattaagaaaaggctgaacaacctttgtgattggtcgatcgagacagagtttgccgaggggtcctatcgtttaaactttctcgcttctgatcctaacactgcaagcgtcgagcctattcagtacgccgtcggcttcacctaccttttcactttctataagtga

SEQ ID NO: 7415 - RNA, 1218 nt, unidentified
  source 1..1218: mol_type = other RNA; note = synthetic construct
atgaagctggccgaggaaaagtctcagcacattctcaccgccttttctaacttgaaaagtaaggaggatttcctggaactgctaaactacaccaagatcattatatatggagacaaggcgattccttttacgctcaaacaggttaactactactctaatccgagaatcaatatcgagaggtacgccgcatttaccatcaagaaaaaatcaggtgccacacgcgttatccacgcacctactaaaggcctgaaggctattcagaagtgcctcaatctgatcctccagattgtctatgaacaacatcagcataaagccgcaactgggttcattcccagtaagtcaatagtagacaatgcactcttacacgtcagatccatatatgtgtacaacattgatctgaaggactttttcccctccatcgaccaggccagaatttggggccggttgaaatttcctcccttcaaccttaatgataaaacaggccgcttggaaatagctaacataatagcttccctctgttgtcacgagatggaggttgagcgcatcaagccagatgggagctggcagaaagaaaagcgaaatgtgctcccacagggtgcgccaactagccctacactaacaaatatcatctgccaacagcttgatttctacttgacggcggtggccaaacgattcaacttaaaatacagtcgttacgccgacgacatcacctttagctctcaccataatgtgtatcaagagggcagcatcttccttcatgagcttcaccggattatcgctgcccagaacttccatatcaagccatcgaaaacacgtctgcaaaagcaggggtacaggcaggaggtgactggaattgtagtcaatgaggacgtcaatgtccccaaaaggttcgtgaaacaactgcgcatgtggctgtattactgggaacagtatggctatgagagagcctatacctactttctgcagcagtactccgctgacaaaggtcacaccaagaagggacggcccgatatggctaacgtgattctcgggaagctgaagtatctgaagatggtgagaggcgctgataaccacatgtaccagaagctggcatataggttcgaacagctgagcaaagaaaacttaaatcaagaagatcggccggcccatttgaacaaagtgctgtcaattctaatccacaagggacttgacgaggcaatggacttttataagaggtga

SEQ ID NO: 7416 - RNA, 2229 nt, unidentified
  source 1..2229: mol_type = other RNA; note = synthetic construct
atgagtattaaggaggaacagtcacagtacatactgtcttccttcagtagcatgaaatccaaagaggatttcgtgggacttttgaactatgcgaaggtcattatctatggggacaaagccgtgcccttcactcttaaacacctgaactaccactcaaacccgcaagtgtcaaaaaaccgctacacggcatttactatcaagaaaaagtctggagctaaccggacaattcacgctccttccaaggggctcaaggctatccagaaatgcctgaatctactgctgcagatcgtctacgcccagcaccagcataaggccgctacagggtttgtccccgggaaaagcatagtagataatgctaaactgcacactaacagcatctacgtgtacaatctggatctgaaggacttctttccctccatagaccaggcacgagtctgggggagactcaagttcccaccattcaatctgaatgagaaaagcggcaggcttgagttggccaatatgatcgctagcttgtgctgccaccagctagaggtagagcggctccaaccggatgggtcttggcaaaaagacgtgcgcaatgtgttgccgcagggcgcacccacctcaccaacactcacaaatatcatctgtcagcagttagacttctacctgagcgctgtggccaagcgtttcaacctgaaatacagtcgttacgccgacgacataacattctcatcacagcacaatgtctatcacgagggtggcgaatttcttaatgagctccaccgcatcattgccgcccaaaatttccatgtgaaaccatctaaaaccagattacagaagagaggctataggcaagaagtgaccggcatagtggtgaatgaacatgccagcgttccaaaaaggtatatcaagcagctgcggatgtggctatattattgggaacagtacggctatgacagggcgtactcttattttgtgcagcagtacaaggtagacaagggatacaccaaaaaaggaaaacctaatatggcaaatgtcatcaagggcaaactcgactatctgaaaatggttaagggctccgactctgcagtatatcaaaaacttaccgaacgctatgacctcctgaggaaggaagaaccagcaaagactaagctcaccatcttttccacgatctccgagactagcgagagcgactcctctttcatcaagattgttgttgaaaacagtgctagcccctctattcccgacaaactgacccgggaaatcaacattcctaaggataccgtgctcccccatgttcttcttattgataacaaactggtcattgaggggacgactcctacaaaaaagctgttgccacataaccccatgcacacagttagttttctcaagaaattcaagatcgcagatggctccggattcaaagagttggtgcacgatgtgattctgtcagatgagattgtggacgatataatcagcaaggtcaagtcccatccaaattttatttaccattacaagcaggagagggtttcgaacatcgaatacattaacgtgggcattcagagtgaggttattcaactgatcaacctgttcgagtcggagggtatccctttctacaaggagacaggaaaacaccctttcaacaatgatgagaagtatactgagtttgcgaagaagtttaaaaagaagtaccgatatggatctggttccgagtacagcaagttacatcaagatattctgaacattgccattgaccagaagataccgcaggactgtattgagttcctccccgatgaaagagcctttaacatacgcagcggctttttcacctggcagcctctgatctatcgaggcctacggcacatctttcagtgtatagccgatcacagcaacatccacggtgaatcgctgaagcatgtagatgacaaagaagtcttggtgaaggcggagaagggagatgcagatgggcataagtttatcgaagtcagtatcctggacaagaattcaaaggctaccatagatagtgacttgctgctacacttttacaaggagtccactgccttcaaacaagacttcagaaatctgtgcgactggttcatcgaatgtgattttaccgccgaacctcccaaaaggattaacctcttaattgctagaagacttgggtctgaatcagtcgagatcgagccattatctaaccctgtgggtggatttaaacatgtgctccggttttatgacgtgcgctga

SEQ ID NO: 7417 - RNA, 2175 nt, unidentified
  source 1..2175: mol_type = other RNA; note = synthetic construct
atgaagactaaaaaagacttcctcggcctgctgaattacactaagggcattctgcttggagataaagctgtgccttttgagctaaaacatttgaactaccactccaatcctaaggcaaaccctaaacgttatgtcgcctttgccgtgaagaagaaagccggtgggacaagaaccattcacagccctgccaaaggtctgaaggccatccagaaatgtctcaaccttatcttacaggtggtgtatgcaaaccaccagcataaggccgctaacggctttgtcccaaacaagtcgatcgttgacaatgctagagtccacgcgaatagcttgtatgtgtacaaccttgatctgaaagacttcttcccatctattgaccaagcgcgggtttgggggcgactgaaattcccgccgttcaacttgaacgagaagaccgggcggcttgatctcgcagggataattgcctcattgtgctgccattccatggaggtcgagcgtctggatgatgcgggcaactggaagaaagagattaggaatgtcctaccccagggagctccaacttctcctaccatcaccaatattatatgtcagcagctcgacttctacctgacagctgtggcacgcaggtttcaattgaagtactcccgatatgcagatgatataaccttcagttctcagcataatgtataccacaaggacggcgagtttctgcaagaactacataggctgattgcagctcagaactttcacattaaggagagtaaaacacgcttacaaaagcagggctaccgccaggaagttactggtctggtagtgaatgaagaaccaaacgtcccaaagagatacatcaaacaactccggatgtggttgtattattgggagcaatatggctacgatcgcgcttacagttacttcatgcagcagtacaaagccgataaaggccatcttatcaagggaaagcccgacatggccaacgtgattaaggggaagctcgactatctgaaaatggtgaaggggactgaatcgaccggttatcaaaagctagcggagcggtacatcctgttgacgaagcaggaacctgtggcagaagaattcacagtgtccaatgacatctccgggatgtccgaactcgttagcagtgttatcaaggttaccctcgaaaatagcggtttaccctcaaaccccaacaaattaattaaggccatcaacatccccaaagatacgatactcccgtctgtgttgctcatcgacaataaaattacaaccgaatccacatctagtaataaactgtttccacataacccactgcacaccgtgtccttcctcaaaaagtttaagattgccgacggcagtggatttaaagagctggtgcacgacatcattctgagcgacgaggtagtgaaggacatcattacgaaagttaagtcacaccctaactttatttaccactataagaaggaacgtgtactcagcatcgattatctcaatattggaatacggggagaggtcatccagctgatagatctgtttgaatctgaaggaatccccttctacaaggaaaccggcaagcatccattcaataatgacgaggtgtatactgtctttgccaaggagttcaagaaaaagtatagatacgggtcaggttcagagtactccaaacttcagcaggacattttaagcatcgcctcagatcagaagatcgccctggattgcatagaatttctgcccgatgagagagccttcaatatcaggagcggattcttcacatggcagcccctcatatataaaggacttcggcatatcttccagggcatcgctgatcacagcaacataaatggagaggacatcaagtgcattaacggcagggaagtgcaggtccgcgctgagaaaggggaagccaatttttgtaagttcattgagatctccatccttgataaaaactcaaaggctaagattgagtctgacctgctacttcactactacaaagagagtacagcatttaaacaagactttagaaacctgtgtgactggatcattgagtgcgatttcaccgtggagcctagcaaacgcatcaatctgctgactgcatctcacttcaactacaatattgatgagatcgagcccctggaccacctggtaggcgggtttaagcatatcttgcgattctatgacataaggtga

SEQ ID NO: 7418 - RNA, 2118 nt, unidentified
  source 1..2118: mol_type = other RNA; note = synthetic construct
atgaaattggaccaggccactattaaccacatcaacaccacattccacaagatgaagtcaaaaaacgatttcctgtcccttttgaacttcgtcaagggtaaaatttacggggagaagatacacgcgttcgagattaaaaacctgaactactacatcaacacgaagagtaagcagaatcgctacaccaaattcatcattaagaagaagagcggcgaggataggatcatccactctccagctcctgggctcaaggccatccaaaagtgcatcaatgttattttccagagtatttacgaggtgaaccccgctgcaacgggattcgtaatcggaaaaagtatagtcgataatggaatagtccatagcgggaagaactatgtgttcaatttggacttgaaagactttttcagcagtattgatcaagcccggatctggggcaggcttaaggtgccaccctttaatctaaatgaacagaatggcaacttggagattgccaacataatcgcaagcctctgttgtcacgaaatggaggtggaaaggtttgacgcaatcaacaacaagtgggaaaaagtaatcaagaatgtggtgccacagggtgctcctacatctcccaccctcattaacattatttgtcagaagcttgacttctatctttcggccgtcgcgaaacgctttagcctcaggtacacaagatatgccgacgacataactttttctagcgatcataatgtgtaccacaacaatggagaattcctgaccgagatcaaacgtatcattaagagcgaacgttttgacattaaggatagcaaaactcacctgcaaaaacgcggctatagacaggaagtcacaggcttggtggttaatgttaaacccaacgtccattccaagtatgtgaaacaaattagacactggctgtatatctgggaaaaacatggctacgaatatgcctccaagttctttattaacccttacctgaagaacaagattaatcctaaagacaacatccctgatctgtacatcatcctgcgcgggaaattaaattacctgaagatgatcaagggttctgacaattcgacatatattaaactgtccaatcggttcgatctcctcaattcctccgagaagaaagtgctgcaggagcagtctgaaagaataatcctgtcaaagattctgcccactactgagaatgacaaggtgtacatcctccccattattcataccccgaaagaggtagtaaaaatactcaacaagttcaccctaaacaacagcgcactcaaatactctacccataattgggattctggacaaaatgaggatatctttaaggatctggctgactttatcaaaaaagcgcggtcagaattttatcccgcatcagaacagttaaagatgcttaagaaagagttgcatgccaagatcttttcgtttctattcaatgagaaggtcgccgagaagggctggggaatccaccggatcaaatttggctggagcagtcctgagctcctgaaggagatggaaaacaatatcataaaaccggagaattgcattcttccaaagaacgctcagttcatcttaaaaaccaacacaggcaatcaaaccattcagaagttcaaacaggttatcgacatctttaagaatgaaatcgagatacgagatgagaatagtatactgttaaacctactcttagagaaacatgacatgcacctgaatggtttcgagataaaagaggctaaagacctggaaaacacgaatttttttaccgacgtggactacttctcaaaggcccttacccttgtgtttgaaaacattcagaaacgaccagaacacaagatcgtctcttatgttatcaaggagaagtcagattcttacattctggaaattatgcaccataactcaactgctaagggaaagtcctataaagacaagaagctgagtctgcagtccggggatttcggcactattaaaatgcacctcttgaacctgtgcgagtggagcgttgaatccgagttcaaagaggggcccacaaggatcaacttcctgcactccaatgaggatacactgccatatgaaaaaatagatgacgtgaaggggtttaagcatgtgttcaagttttacaagtga

SEQ ID NO: 7419 - RNA, 2070 nt, unidentified
  source 1..2070: mol_type = other RNA; note = synthetic construct
atgaaaagcaaaaatgacttcctgtccttgctaaacttcgttaaggggaagatttacgggggaaaaattcatgcatttgagctgaagaatctaaactactacataaacaccaagtctaaacagaacaggtacactaagttcacaattaagaagaagtctggcgaagaccgcattatccactcgcccgttcccggccttaaagctattcagaaatgtatcaacgtgatattccagagcatatatgaggtcaatagcgccgctaccggcttcgtgatcggaaaatctatagtggacaacggcatcgtgcactcaggcaaaaactacgtgtttaacctcgacttgaaagactttttttccagcattgatcaggcgagagtatggggcaggttgaaagttagcccatttaatctgaacgagcagaatggaaatttagagatcgcgaacatcattgccagtctttgctgccacgagatggatgtagagcgatatgatgccataaataaccggtggtataacgtgacaaagaatgtcgttcctcagggagcaccgacatcccctactttaataaacatcatttgccagaggctggattactatttaagcgcagtggcgaaacggttttctctgaactatacccggtacgcagatgatatcacattctcgtcgaaccataacgtttatcaaagtggtggggagtttattacagaaattgaacggatcatacgtagcgagaagtttgacatcaaagactctaagactaatctgcagaagagggggtatagacaggaggtcactggcttagtagtcaatattaaacctaacgttcactcaaagtacataaaacagattcgtcactggctctacgcatgggagaagcacggatatgaatacgcctcaaacttcttcatcaagcagtacctgaaagacaagattaatcccaagacgaatacacctgacctatacagcgtccttcgtggcaagctcaattacttgaagatggtgaagggtttcgagaactccacctatctgaagctcagtaatcgcttcaaccttctgatagacttttccgacaagaacgtaaccctgacgcagtccaatcaagtgacagtcagcgaggtgctgcccgaccttaagaataacaaaatttcaaagctgcccatcatccatacccccaaagaggtcgtgcgcatcttgaacaaatttaccctgaataactccgccctaaagtatagtacccatacttgggatgccggccagaatgaggacgtgttcaaagatctgccagatttcctgaagaaagctaatagagagttcaaccccgtgagcgaatctctcaaaactctgagaaaggaactgcacgctaagatcatctcctttctgttctatgataaagtggccgagaaaggatgggggatccatcgggtgaagtttggctggtccagtcctgaacttctcgccgagatgcagattacgaacatcaaaccagaaaactttacgatcccggagaaggcccagttttcattggaaaccacacgaggtatccagaccattcagaaattcaagcaagtcatcgacatttttaagaacgagatcgaaattagggatgaaaatagtgtccttcgcgagctcctgatcgaaaagcacaacactcatctcaatggtttcaatatccgggaaatgcgcaacctggagaataccaatttttttacagacgtggactattttagcaaagctctgaccctgatcttcgagaatattcaaaaaaggccacagcataaattcgtaagctacatacttaaggacgaggaagattcttacatcctcgagattattcaccacgattctaccgccaagggaaagtccatcaaagacaataagctctcactggaaagtggtgacttcgggactgttcgaatgcatttgctcaacttatgtgaatggtcagtggagtccgaatttagagaagggccaactagaatcaatttcctcgattctaatcaagatacaccaccttatgtgaaaatcgatcaagctgagggattcaagtacattttcaagttctacaagtga

SEQ ID NO: 7420 - RNA, 2121 nt, unidentified
  source 1..2121: mol_type = other RNA; note = synthetic construct
atgaaattagaccagactgtgattgactatatcaacactacatttcacgagatgaagagtaaggatgacttcctctctcttcttaatttcgtgaagaagaagatctatggagaattgactcacccgtttgagatcaaaaacatcaactactacatcagctctaaatctaaacaaaaccgctataccagatttgtgatcaaaaagaagtctgggggagatagaatcatccattcccccgttcctgggctaaaggccctccagaagtgcatcaacataatcttccaatgtacctacaaggtgaatcccgcagctacaggattcgtcataggcaagagtatcttcgataatgccattgtacacagcggaaaaaactacgtgttcaacttggacctgaaggattttttctccagcattgaccaggccaggctttggggtaggctgaaagcagcaccttttaatttaaatgagtcctccggtagactcgaactggctaatattatcgcatgtttgtgttgccatgaaatggaagtagaacggtatgacccaataaacaatcagtggtataaggccattaagaacgtcgtgccccaaggtgcgcctaccagtccaacactgatcaacataatctgccagcgtctggattactacctctcagctgtcgccaaaaggttttcggtgaattacacacgatacgcagatgacatcactttttctagcgatcacaacgtctaccagaaaaacggcgagtttattaccgaagtggagcgtatcataaaggtggagaacttcaacattaaggatagtaagacacatctccagaaacggggttatcggcaggaggtcaccgggttagtggttaatcacaatccgaacgtgcacaacaagtacattaaacagattcgccattggctgtacgcttgggagaaagatggctatgagtacgcttcaaatttcttcattgaagcctatctgaaagacaagatcaatcccaaagccaccacccctgatctgtcaaatgtgctaagcgggaaactcaattacctaaaaatgatcaagggatttgacaatcccacgtatattaaactcaatgctcgcttcgagtcactgttgattaagggcgacaaaaaaaacaaagagacaaccgccgaccaaagtcttaccatggacgggctgagcgagattgaatattccaaggtgtccaatttaccagtggaacacacacctaaggaggttgttcggatccttaataaattcacgctcaacaattctgcactgaagtatagtacacacaattgggacgcgggacaggatgacggcatattcaaggacctgccaagctttctgaagaaggccaattctgagttcaacccagtctccgagcatctcaaaatgctgagaaaggagctacacgctaagatcatctcattcttattctacgacaaggtcgccgaaaaggggtgggggacttacagaattaaattcggctggtccagtcctgaactactgttggagatgcagaacaacaacattaaacccgagaactttatactgccgcagtctgttcagtttttgctggaaacaaacactggcgtgcaaacgatacagaagtttaaacaggtgatcgacatcttcaaaaacgaaatcgaaattagggacgaaaactcgatgctcagggatctgttgctggaaaagcatgataaacatctcgaaggctttaacattcgagagatgaagaacctggagaataccaatttttttactgacgtcgattacttcggaaaagctctgaccctgatatttgagaatattcagaaacggccagagcaccgattcgttagctatgtactcattgatgagtctgacggttatatccttgagatcatacaccacggaagcaacgccaagggtaagagcattaaggataaaaaactgtcactggagtcaggcgattttgggacaatcaagactcatcttcttaatctgtgcgagtggtccgtcgagtccgaatttaaagaaggccccacgcgcatcaacttcttggatagcgacaagaatactctgccttatgtaaagctcgatcaagcggacggcttcaagtacattttcaagttttacacctga

SEQ ID NO: 7421 - RNA, 2118 nt, unidentified
  source 1..2118: mol_type = other RNA; note = synthetic construct
atgaagctcgaccagacactgatcgactatataaacactacattccacgagatgaaaagcaaggacgatttcctcagtctcttgaacttcgtgaagaaaaagatttacggcgaggacacccaccccttcgagatcaagaacatcaattactatatctcgagcaaatccaaacagaaccgttacaccaggtttgtcatcaagaaaaagagtggtggggatcgcaccatacactcacccgtgtctgggttgaaggctctgcagaagtgtatcaacctcatctttcagagtacatataaggtgaatccggccgcaaccggctttgtcattggaaagtccattgtagacaacgccattgttcattcagggaagaattacgtgttcaacctggatctgaaagatttcttctcctcaattgaccaggctcgcctgtggggacggttaaaagtggcgccatttaatttgaatgagcaaacaggccgactggaactggccaatataatcgcatgcctctgttgtcacgagatggaggttgagaggttcgatacaataaataaccagtggaacaaagtgatcaaaaacgtgattccccaaggcgctcccacaagccctacgcttattaatatagtctgccagagactggattattacctgctcgctgtagctaaacgcttttctctgaactataccagatacgccgatgatattaccttttctagtgatcacaacgtgtatcagaagaatggggagtttatagccgaggtccaacggatcatcgagaaagagaactttaacattaaggactccaaaaccagattacagaaaagaggataccggcaagaggtaacgggactggtggtcaatcataagccaaatgtccataacaactacattaagcagattcgccattggatatacgtatgggaaaagtttggatacgagtatgcaagcaacttcttcatcaaacagtatctaaaggacaaaatcaacccgaagactaacacccccgatctcagcaatgtgctgtccgggaaactgaattatttgaagatgatccgaggtttcgacaactctacttacatcaagctgaatgaccgttttgaactattgctcaacatcagcatccagaagaatgagaatatcgtggccgaccaatccacccttcttggaatgccagaagtggagaacaatgaaaactttaaactcccagtgttacacacaccgaaggagcttgttcggattctgaacaagttcacccttaataattcggcactaaagtactcaactcataattgggatgccgggcaggatgaagacatctttaaagatctacccgattttctcaagaaagcctcaaaagaattcaacccagtctctgagtatcttaaatcactgaaaaaggagctccacgcaaagataatgtccttccttttcaacgaaaaagttggcgagaaaggctgggggatttaccgagtgaaattcggctggtcctcacctgaactgttgaaagagatgcagattagtgacataaagccagaaaactttactctgcctcaaaatgctcagtttaggctcgagacaaatagaggtaatgagactatccagaagttcaagcaggttattgacattttcaagaacgagatcgaaatcagggacgagaacagtatcctgcaggatcttctgctggaaaagcacgacaaacacctgaatgggtttgagattaaagaaatgcagaacctggaaaatactaacttttttaccgacgttgactatttcagccgcgcgttgacactgatctttgaaaatatacagaagaggcctgaacatcggtttgtgagctatatattagtcgacgaacccgactccaatatcctagagattattcatcatggcagcaccgccaaaggtaagtctatcaaggacaaaaagctgtccttggagagcggagatttcggcactatcagcatgcacctgagaaatttatgcgaatggtctattgaaagtgagttcaaggaaggccctatcaggattaactttctcgactctgacaaagatacgcctccttacgtcaagatcgatcaagtggatggtttcaagtacattttcaagttctacaagtga

SEQ ID NO: 7422 - RNA, 2061 nt, unidentified
  source 1..2061: mol_type = other RNA; note = synthetic construct
atgatcttaaagaccgaaaacatcattttcatcaaggagacgtttcagaacatgaagtctaagcatgactttttggacctgctgaactatgtgaagccatttatttatggcgagaagacccagagctttgatcttaaccacctaaatttccatagcaattctaacaccaagaagtacaagtctttcatcgtaaagaaaaagtctggcgcagataggacaatcaattccccatcaaagggtctgaaggcaatacagaaatgtcttaacctgatctttcagacgatttacgacgtgcatccttctgtctatggatttgttaaaagcaagtccattgtgaacaatgctaatattcactcaggcaaccactatatctacaacatagacctgaaggatttctttagcagtatcgaccaagccagaatatgggggaggctgcagtatcccccatttaatctcaacaaagaacgggatctgcttgaagtggccaatatgatctcgtcattatgttgcttcaaaattgatgttgagaggctggatgagaataatgaatggcagattgtgaacagaaatgtccttccacaaggtgccccgacctcccccaccatcactaatatcatatgccaacagctggatttctatttgacagcagtggctaagagatttggcctccgatattcacgctatgccgacgatattactttcagtagcatgcacaatgtatacaacgaaaacagcgattttatcaaagagctgaatcgcgtcattagttctcagaacttccatattaagcagagtaaaacacgactgcagaaaaaaggctacagacaggaggtaaccggtctgatagtgaatgctaaacccaacgtcaactcccgttacattaaacagctccgtatgtggctattctactgggagaaccatgggtatgaaaaagccaatctgttctttggctcgcagtactttaaggacagaggatatgttaagaagcgagtgcccaatctagagttcgtgctcgatgggaaactcaactttctaaagatggttaaaggggcagaaaatggaacatacctgaaactttacgagagattcagggtcctctctgaaaagaaaatatcgtttcaggcggtgcagatatcaaatattaaagaggtgaaacacgaccctcaagagacagtgaaactcttgaagttcttcaagtacgacaacaagtacagttttaaacagttggttcacaagcccgtgaacgaaaacgacttcaattttatcgaaatcctcaaaactgcgaacaagcaatttatggatttcagcgtggataacaataacaaactgaacatcccaaaggaccttatatccggcgtccagaatctctttgagattctgcgcacttccggcatcgatttctacaatatcaacaatctccaccccctggaagacaagaacattggggcaaagattcagctgttcaaaggggattaccggtttggaaatgagaaaagcgaatctagcattctcagcgacctgatcatcaggaccgctctgaaaaaggagttctcagaccaaatcaacaacattgtctatagtttcggagaaaatgataacagcggactgttcgactacaaacagatcattttctatccggagttacagaaattccagtccaaggctaatttcttcacctgggtgcctaacgttaaaatagccttgtccatcatctttgagtcaatcttaaaacacagcaacgtgaatgggaaccgcaattttacacttgaagagaagggcattatcatcaatatcgagcggaaggccgtgaatgatctgattaagattgagttgtccatactggacaagaattctttgcttatgggttccattgacaacatcctgtccgacatgcgccgggacttcttccctgttttggtgggaatatgcgatttcaaggtccaatttaagagtatcatggaggaaaactatgaatgtcgggtcctcccttatgcctctaaagtaaagcctattgacgaggatccacaaggcttcaagtacatctttactttttacgactga

SEQ ID NO: 7423 - RNA, 2079 nt, unidentified
  source 1..2079: mol_type = other RNA; note = synthetic construct
atgaagcttacacagaccgatatcagctttattaaggagtcctttgagaaaatgagggataagagtgacttggtggccctgctgaattatatcaagcccattctttacggagagaagacctacttatttactgtgcacgacttaaactaccacataaacaacaagaatgacaaccgctatgagaagttcgagattcgaaaaaaatccggcaaaagccgcgtaatacactccccaaacaatgtgctaaagtcgttccagaagtgtctcaacctggtgttccagacagtgtacaaatttcacagcagcgcgactggttttattggcggaaagtcaatcgttgacaatgctaaaatccacgtggggagcaactacgtttacaatatcgacttgagagacttttttccatctatcgatcaagctagactgtggggacggctgcagtatcccccctttaacctgaacaaggaaaacgacaatatccagcttgctaatattatcgcctacctatgctgccataagtataaggtcaaacggctgatcgatggcaaatggaagattgtggagaaaagcgtcttgcctcagggagcccctacctctccagtagtctcaaatattatctgtcagaggttggacttctatctgagcgccgtggctaagagatttggggccaaatattccagatacgccgatgatattaccttcagttccgttcatcacatttacaaagagaaccatgcattcatcttagaagtccagaaaataattgccaacgagaatttcaccattaaccctcagaaaacccggttacaagaaggcgcatacaagcagatggtgacaggcctggtggtaaatcagaacgttaatgtctccaagaagtatatcaaagaactccgaatgtggctgttcttctgggagacatacggggttcagaaagcaaccgttaagtttaacctctaccgcgccggccaggacataggtagtagctctaacatgattaaggtgattaggggaaagttggatttcttaaaaatggtcaagggggcgaacaacctcgcttacctgaaactcctgaagcgattcactgaactcgtctctgcccaaaactctatgcaaaaaaaattggacaagcagaagcatatagagacgtttaagatatctgacttcaacctccaccagaagacaacgcatcacgaacctcaaaagctagtgtctctgctgaacaatttcacagccgggagtaacctgaaatatgctactcacgggtgggaggagcacgagacatatgatgagttcatcatcaagctgacaagagattggcagaagattgaagacgacctctttgatctgaagaagacctttgcgaccaaaatcagcgtattcctcgattctgaaaaagtggaagaaattggctggggggctaaaactgcaaatgaacgcatctattttggctggaaaagtaaaagtctggtcgagtggagtcacgcaaatcccaataaatccccgttctactttcctattccacaagataaaaaggttttcttcgacggaattcaaaccaattacttctatgacgtcacagagattttcaaacggcagattgaaatacgcgaggagaataatcatctgcataatcttttcatggacctgagaaagaactacctaggctatgatttcaagcttacgtcaataaacacgaaaggtatcactttctttaccgacgtgaatactctcaaaaacggaatcattaagatctttgagtccatcaagaagaggccacagtttccgaagataaagatcgtagtggaacacctcgaaaattccatcgagatcaaaatcatccatgtggattcaatctgcaacaggcccatcaatgataacaaaatacttctggccaatactggggactttgcagatcttaacaaatacttcaccaatctctgtgactggtcaattgagtcaaattttatcgacggtaagtcatacaggattaactatttggactcgcgtgtgggcatagataagatctccactatcagcaagcgtgaaggttttacatttattctgcggttctatctgtga

SEQ ID NO: 7424 - RNA, 1329 nt, unidentified
  source 1..1329: mol_type = other RNA; note = synthetic construct
atgatattgaccccggagtttaagttccaggtccaaactgccttcaaggagatgcagtctaaaagtgactttctggagctcctcaatatcgcaaaacagatgatgtatggggacaagacagtcccctttagtgagaagcaattgaactacttcatcaccaaggattctcaagttatcaagtcccgagtagactttcggatcgacctgagcaaatttgaacctttcattgaggagaacgtggttattgagaagaagaacattaatcgcaaagactgctatgtacccttcatcattaagaagaaatcaggtcaggacaggacaatccacgcccccgttaagggtttgaaggagttccagaaagcacttaacattatcttgcagtgcctgcacgaaccacacacagcggctacaggcttcgtaattgggaaaagcattgtcgataacgctaagaagcatatcggacaaacatatgtctacaacatcgacttaaaagacttctttccatcagtggatagatctcgagtatggggccgtttgctggtggcccctttcaatcttggcactacagtggaacggaaaaatatagccaactttatagccactctctgttgtactcccatggaagttgaacggttcaaggaagggaactggatcaagataacgaccagcgtcctacctcagggagcccccacatcccctacccttaccaatattatctgtgagaaactggacaaacgcctgaatggcgtggcgaagagatttgggctcaactattcccgctacgctgatgacatcactttcagctcaaagcacaatgcttacgaggtgtccccaaccaaggtggaaaaaatctttgcaagcggcacgacctttgattgcgaagttagaaagattatcactgagcagaacttccacataaaagagactaaggtgagactccaaaaaaggggatataggcaggaggtgaccgggcttgtcgtgaatgataagatcaacgtgacccgcctctacgtgaagcagcttcggcagtggctgtatttatgggaacgttacggatatgataagtcctacgccattttcctgaatatctacttagcagacaagggacatgtgaaatctgaacagccaaacatggccatggtgattgagggcaaactgctctatctaaagatggtgaaaggcgctgatgatgggacatacctcaaactgaagaaaaggtttgatctgctactgggtaccacgtcgaagaataacagtgaagcagttaatattctggatctgatatttgacgtcggtctggacgaggctatgacccattacaaaaaatga

SEQ ID NO: 7425 - RNA, 1278 nt, unidentified
  source 1..1278: mol_type = other RNA; note = synthetic construct
atgcagacgaaaagtgactttttatctctgctcaatctggctaaactggagatctacggagagaaaaccattcctttttccgagaagcagtttaattactatctcaccaaggactccagtacgttcaagagcaagattgacttccagatagatctgtcgggagatagtgtcgtcattaacgagaatgtaatcgtggagaaaaaaaatcagcaaaggaagtcctgttacacaagcttcgctatcaaaaaaaaaagcggaaaagaccgcactatccatgcaccaatcaaagggcttaaagaatttcagaaggccttgtgcctagtgttacagtgtctctatgagccccactctgcggcaaccggctttgttctgggtaaatccatcgttgacaatgccaagaagcatgtcgggcagacttatgtgtacaatatagaccttaaggacttcttcccctcgatcgacaaaagcagagtttggggtcggttgctggtggccccattcaatttgggcaactcaaacgagcggcgcacacttgccaacttcatcgctactatttgctgcacacccatggaagtagaacgtttccaagaaggcaagtggatcacagtgactacttcagttttgcctcaaggggcacctacgtccccagctattaccaacatcatatgtgaaaagctggacagacggctgacaggagtggctaaaagattcggactcaattacacccgctatgccgatgacatcacttttagctctaagcacaacacctatgaggtgtctgattcaaaggtggaaaagatctttgttgccggcagtagcttcgattgcgaggtgaggaaaattattagcgagcagaactttcacattaaggagtctaaggtgaggctgcaaaagagaggctatcgccaggaggtaactggcttagtcgtcaacgataagattaacgtgacccgacgttacgtcaaacagctgaggcagtggctttacttttgggagcgatatgggtatgataaagcatacgcatttttcctgaactactacctgtcagacaaggggcacataaagttcgagaagccgaatatggccatggtggtcgaagggaagctgctgtaccttaagatggtaaaaggcgccaacgatggtacctatctcaagttgaaggaacggttcgatctgctcgttggcacagcgtccaagaataataacgaaaaagctaccatcgtggatctaatttttgatgtgggactcgacgaagccatgacacattacaaaaagtga

SEQ ID NO: 7426 - RNA, 1359 nt, unidentified
  source 1..1359: mol_type = other RNA; note = synthetic construct
atgaaaataacattggaacaatcaaagacgatccaggaggcttttaagaagatggactccaagaatgatttcctggctctacttaatgaagcgaaaaagctgatgtatggcgacaaaaccattcctttcgaggagaagcagctcaactactatattagcaaggattcgatcaagaataagagcgtcaaaagcgagaagaatatcagcaccgtgcttctaaaggaggagacaagttttaaggcgtccgttcgcaaaccttcctacacatcattcacaatcaagaaaaagtccggaagcgacagaactatttacgccccggtgaaggggctgaaagagctgcagaaagcactgaacattattctccaggcaatccacgaaccacacatagcagcaacaggcttcgtactggggaagtcaatagtggacaacgccaaggttcatgtcggccagatctacgtgtataacctggatctcaaggattttttcccatccgtggataaggccagggtttggggccggttactggtggcccctttcaacctcaacacctccgatgaacggaagaaaattgctaacatgattgccggtctgagttgcacacccatggaggtcgaacgctttatcgacaataattgggtgaagataaccactgccgttctaccacagggagcccccacctctcctactcttaccaataccatttgtgaacggatggacaagcaattgtctggcgtcgctaagagatttgggctcaattatactcgatatgctgacgacataactttcagcagtaagcataactcttacgaagtctcaccgaataagttcgagaaaatttttgtgtctggctcaacctttgataaagaagtgagaaagatcatcgctaaccagaattttcacgtgaaggaaagtaaagtcagactgcagcaggaaggattcaggcaagaagtaactggactggtagtgaatgaaaaagtgaacgttacccgtcgatacatcaaacaattgaggctttggctgtattattgggagacttacggttacgacaaatcttactcctttttcctccagaagtattgccgcgagaaaggcaacgtgaaaaaagggcagccaaacatggccatggtcctggatggaaaactgttgtatctgaaaatggtgaagggtgagaaggatgagacgtacttgaagatgaaaaataggttcgacgttttagtgcttaacacgacccccagcaaatctctcgtgcccaataaactgctggaggtaaaggacacaaaggagaacattgggaagaacatcgtcgatttaatcctcgagatcgggcttgagggtgcaatgaaaaattacaaaagttga

SEQ ID NO: 7427 - RNA, 1359 nt, unidentified
  source 1..1359: mol_type = other RNA; note = synthetic construct
atgaaactggccctggagcagattaataacctgaaaaccgcttttgagaagatggacagcaaagaggacttcttggcactcctgaatctggctaagtctttcttgtacggcgagaacacagtcgtgtttgaaatgaagcagctgaattactacatcaacaaagaccagaaaacaaccaataagaaggtgaacttagagggattgctcaataccggggatgatcgcttcaagactgccgtcagaaagcccgcttacacaagtttctccataaaaaagaagtctagggaggaccggattctccatgcaccagtcaaggggctgaaagagttccagaaagccctgaaccttattttccagtgcgtttacgagccacacaaggccgccaccggcttcgttctcggaaagtctatcgtagataatgccaagctacatgtcaatcagaattacgtgtacaacttggacctaaaggatttttttccatccatagatcaggcaagagtctgggggcgcattaaagcagccccttttaatctggagacaactgtagagcggcaaaaaatagctaatatgatcgcagctttgtgttgcactcctatggaggtcgaaaggaacactaacggtgaatggaaaaaaatcacgcttcccgtgctgcctcaaggagcaccaacgtcccccaccttgaccaacgctatctgtgaacgtctcgacctgaggcttgcaggggtagccaagcggtttggtctgaattatagtcgatatgccgacgatattacgttttcaagcaaacacaactcattcgaaaagaccaagaatgtttttgagaacatctatctgaaggactccacttttgacaaggaagtgagaaaaatcattgctagccagaacttccacatcaaagaaagtaaggtgcggcttcaaaagcagggatataggcaggaggtgacaggcattgtggtgaacgacaaggtgaatatcaaccagaagtatatcaaacaactgcgtcagtggctcttctactgggaaacatttggctatgatcgagcctaccagtattttctccaaaaatatgtcgcgaacaaaggtcatgtgaaaaaaggccagcctaatatggccatggttctggatgggaagttactgtaccttaagatggtgaaaggcgaaacagatccggcgtacctgaagctcagagagcgcttcgaaaaactcattggctcgaagtctaacatctcagagatcctggatttatgggaaactaagggaatagatgaggctatgaaagccttttatttcgcgaagcagcaagacgtactgcccaaggtgagcacccgcctaaatgttgaagacattttctacctttga

SEQ ID NO: 7428 - RNA, 1281 nt, unidentified
  source 1..1281: mol_type = other RNA; note = synthetic construct
atgaagttcacccaagagcagaaatcacagatcaggtccctctttgacaaaatgaattctaaatcggacttcctctttctcctgaataaagccaagatgatagagtatgaggataagatgatagacttcgaagaaaagcagctgaacttttacatcaacaaagactcaaccaacaagaaagacgcggaatcccttaccaaaaacagcaagaactttttctacaactccttcagtattaagaagaaatctggaaaggagaggattatcaacgctccagttacaggactgaaaaacttccaaaagagcctcaatatcatcttacagtgtgtttttgactgtcacgacgctgccactggctttgttcccggcaagagcatcgtcgataatgctaagattcatgtggggcagacttatgtatacaacatcgatttgaaggacttcttttcttccattgataagagtcgaatatggggtcggctcctgtttcccccgtttaacctgaatacatcttcccaacggaaaaaaattgcaaatatgattgccggtctagcatgcactcctatggaagtggagcgctttatcgatggctattggtgcaacattgaaaattcagtgttacctcaggggagtccaatgtcaccaataatcaccaacatcatttgcgaaaggcttgacagacagttgaccggcgtgtccaaaagattcgggctgaactacagcaggtacgcagatgatattactttcagcggcaagcacaacacgtatctgaaaggactgggagtcgtggagaaaatcttcgagaaaaattctacgtttgaccttgaagtccggagaatcatcaacaacgagaagtttcacatccaagaggacaaagtgcggctgcagaaggagggttatcgccaagaggtgacaggcctggttgtgaataataaggtgaatgtctctaagcgctatattaagcagctcagacagtggatatattatctcgaaacatatgggtacgataagagctacagtttgttcttgagcaactacattgatggcaaaaaaaattcatccagccagacccctaatatgcttatggtaatacgtggtaagctgctgtacctaaagatggtaaaaggagataagaacgaaacctacttaaaactgaagaatcgattcgattcggtcattatgccccattccagtattagcttcatcatcgacatttggaagaatgacgggatcgaaaaagccatggagatctactacaaccagaaggtgaaaaatgagaagtga

SEQ ID NO: 7429 - RNA, 1329 nt, unidentified
  source 1..1329: mol_type = other RNA; note = synthetic construct
atgaaaacaaatgtggatcaacagaccgagataaaggaactattccaaaacatgaagaaggaggccgatttgtggcatctgatcaacgtggcgaaaaaacacattcacggcaccaaggcatctaatttcaagcccaaactgcttcagcatttgatcctgaaagacgctaaggagttcaacctcgaaaattcaacctcagtcttttatcaccagtttgagatcaagaagaaatccggcggtatcagaacaatccacgcgccacaccctaaactcaaggaagtccaggaggcccttaattacatcttccagtgcgtatatctgccccatccgaatgcaaccggatttgttgtaggtaagagcattgtggataacgctaagaagcacgttaatcagaaatacgtatacaatctggaccttaaagactttttccctagcatagacaaaagtcgagtctggggtaggcttctaatagccccattcaacctgaagaacagccctaagggtattaagatagccaatatgattgccagtatctgttgtacaaagttggacgtggaacgtattaaggacggcgtgtcccatactattttgacctccgttctgccacagggagctcctacctctcccactctcactaacgccatttgcgaaaaaatggacattcggttagccggagccgccaaacggtttgggctgcagtactctcgatacgctgatgatattacgttctcgagtaatcataatgcatgcgagtacgcgaaagggaagttcgagaagatctacaagaaaaacagcgtcttcgataaggaggtgcgcagaatcataacagatcagaatttccggatcaatgagtccaaggtgaggctccaagtcaaaaacgtgaaacaagaagttacaggaatcacggttaatgaaaaactcaacgtctctcgcgactatattaagcagcttagaaagtggctgtattactgggagagctatggctttgataaagcatcaaccttctttactcagaactacatggcagagaaagggcacctggtgtccaaaaagcccaatatgactcacgtgctggaaggcaagttactgtatctgaaaatggtcaagggagccgaggattctacttatattgggctgaagacaaggtttgagaagttaagcggccgcgtgaacaaaatagaccagctgttggacgtatgggaaaaagagggcgtggaagctgctatctccttttacaactttgggaaaaaagctaagaagattgcaaccatcgtggattttgagtcattcctcatcgacaacatcaacattgacaacaagatcctctga

SEQ ID NO: 7430 - RNA, 1383 nt, unidentified
  source 1..1383: mol_type = other RNA; note = synthetic construct
atgaaactggcgattgatcaggaaaaaaagattaaacagctgtttgccaagatgaatagtaaagaagagtttttgcagctgctcaatttctcgaagaagatcatatacaaagaggagactataccattcaccattacacagctcaacttctacatctcaaaggacagtaacaagttcaactccaagaagaaatactaccacacgtttgaaatcaaaaagaaaagtggggctcctagaacaatacacgcaccttgtaaggggttactagagttccagaagtccctgaacattattcttcaggcattgcataagccgcacgaagccgctacaggatttgtacccaacaagagtatcgttgagaatgctaaaaagcacatcaacaagaactatgtgtacaacatagaccttaaggatttttttcccagcgtcgacgctgcaagggtttggggccgtctcaaagtagccccttttaatctgggctcatctgacaataggaagcaaatcgcaaatatgattaagagcctctgttgccataagatgaaggtggagcgctttgtcgataataactggataaaactggagaagctggttctgcctcagggagctgccacctcacccacactcactaatgccatctgcgagcggatggatatcaaactcactgggttagccaatcgtttcaatctggactacactaggtacgccgatgacattaccttttctagcaatcacaacacatacaagatttccttagaaaaggaggaggccatcttcgagaaagatactacatttgatatcgagctgcgcaggatcattaaggagcaaaacttccatatcaaggaaaccaaagtgagactacagaaacggggttatcgacaagaagtgaccggcttagtggtcaacgacaagatcaacattaaacgcagctacattaagagcgtcagacacaatctctatttgtgggaacggttcggttatgataaggcatacgagctcttccttaacaattatctgaaggaaaaaggccataccaagaaagggaatccaaatatgctgatggtgttggagggaaaactgctgtatttgaagatggtgaaaggcgaatccgacagcacctatcttaagttgaaatcccgatttgataagctttctatcactccccagccagtggagaaaattaagaagagactcacgctgaaagagaaacggcttaaaaccgacaacgccaaaaacaagtctgatatttcctcaatcgaattcatgaaactggtcgctaaggccaaagccaagaaagaggcgaataagaagaagaacatcaacaagatactggacgtgctgttcgaaaaaggactggacgaagcgatgaaactatatgacaaatga

SEQ ID NO: 7431 - RNA, 1323 nt, unidentified
  source 1..1323: mol_type = other RNA; note = synthetic construct
atgaagcccacacctaaccagaaatatacaattaggcagctcttcgcagaaatgaaaactaaggaagattttctcagcctgctgaattacagtaaggaggtgctgtaccgtgagaaaatgattccattctccatgaagcaactcaacttttacggcagcccgaagtttaatatccacagattcgacaagaaattctatcacgaattcgaaatcccaaaaaagtccggtctgaagcggctcatacacgcgccaactaaaggcttaaaagagttccagaaggcactgaatcttattctccactgcgtgtatgagcctcattacgctgccaccgggtttgtgcccgacaagagcattgtggataattcgaagcctcacgttggcaaactgtacgtgtacaacattgaccttaaggacttttttccctcaatcgacgcttcaagggtatgggggcggctgctggttactccatttaaccttggaacaactaatgagagacgatacatagcaaacatgatcaaaatcctgtgctgtcattacctgccagctgagcggtttgtcgataacgtatgggtgactgagaaacgccatgttttaccccaaggcgcagccacaagcccgaccttgacaaacgccatttgtgagcggctcgatatcaggttgtccggggtcgccaaaagattcgggctcacttatacccgctatgccgacgatattaccttctctagtatgcacaactctttccccaacaaagaaggcgtcgcggaaaccatctttaagaagggatccacctttgatctagagctcaggaaagtcatcgagtcccagaacttccacataaaggagaataaagtgcgcctgcagaagaaaggctataagcaggaggtgacgggtctggtggttaatgataagatcaacgtgcctcggagctatatcaaggatttgagacactggatctacttctgggaacgatatggatacgacaaggcttacgagctgtttttgaagaagtacagtaacaatcgtggccatgtgaaaaaaggcaagcccaatatgggtatggtcattgaggggaagctactttatctaaagatggtaaaaggatcagaagactctacctatttgggacttagagaaaggttcaagacgatatgcgatgaaaattctaacgacaacaataagacggtcaatacacatatcgaagggctgctggaggaatttttccttaaaatggacaagcctattgagaataccaacacccagaaaattttagatctgatcttcgaggaaggactcgaccgcgccatggagctgtacaaaacatga

SEQ ID NO: 7432 - RNA, 1305 nt, unidentified
  source 1..1305: mol_type = other RNA; note = synthetic construct
atgaagctcaacacctatcaaacggagtatattagggatctttttgcgaatatgtcctcaaagaaggacttcctatttctgctgaacaaggtcaaagagttaatctacaaggaaaagacgatcgccttttcggaacaacagctgaactattacatcaacctcaaccccaacgtgaaaatggaaaaaaagtacttcagcttcagcattgaaaagaaaagcggaggcactagaacaatccacgctccctcagaaggcttgaaggaatttcagaaggcagtgtcgatcatcttatccgccatccatcagccccacgataatgcgaccggattcatccagaataggagcatcgttaataatgccagaaaacatatagggaagaattacgtctacaacatcgatttgaaggactttttccccagtattgatgccaatcgcgtttgggctaggctccttattgagccattcaatttgggaaccagtgtcgagcgcaaaaagatcgctaatatgataaaggccatttgttgcaccaacatggaggtgcagcgcctgatcgatgacaaatgggagagcgtgaacttgaacgtccttccacaaggcgcatccacctcacctgttctgactaatattatttgcgaccgactggacaaaaggctgactggcgtcgccaaacgctttggcctgaattatactaggtatgccgacgacatcacattctcttccaaccacaatgtgtaccgcctggattccggagatactgaaacaatctataccgctaattctagtttcgatagagaggtacggcggattattgtggggcagaagtttcatgttaaagagtccaaagtcagactccagaaacgaggttacagacaggaggtaaccggtcttacagtgaacgaaaaggtgaacgtgccaaagcggtacataaaggagattagacactggatttacttttgggaacgttacggctatgacaaagctacagagctgttccgtgtgaagtatcgaaaggacaaggggcacatcaaaaacgactcaccgaatctaataatggtgctggagggaaaactcttatatctgaaaatggttaagggtgagtacgatcctacctacgtgaaactgcggtctaggttccgggagctcttgaacccagacagtgcaattacaattaacctcagcgacgacaactacgaatctatcatactggacactatctttagcgacgggcttgatgaagcaatgaaggaatatgatcctgtctatatagagatcatgtctcctgagcagcggaataaagatgtatga

SEQ ID NO: 7433 - RNA, 1134 nt, unidentified
  source 1..1134: mol_type = other RNA; note = synthetic construct
atggaagacctcctatctctcattaagctggtgaatgaaatgttatacggggagacagctaaggcggtgaaactgaagtcacttacttactattcaaaccctagcttgaggggagatgtgtacgagaaattcaagattccgaagaaaagcggtggcgttcgagttattcacagtccagttagtggcctgaaaagcatccagaaggccatcgctcatatactgcaatcagtttttgagccccaccccaacgccactggatttgtgaccgataaaagcgtagtggacaacgctaagccacacaccggcaaaaacttcgtattcaatactgacctcaaggacttctttccctctatcgacaagcccaggttttggaaacggctgcagtatccaccatttaatcttaatcgcaataacggacggctggaactggcaaaccgcatctctgccatctgcttcactgaccttgaggtcgagcgtaaagttgagggacattggaaaaagcaagtgaaggacgtcctcccgcagggtgctcctacctctcctattattactaacatcatctgttaccgcctcgacgtgaaattaacgtccctggctgaacagtttggctgcgcctatacacggtacgcagacgatatcacgtttagttccaaccacaacatctacaataaggatggcgaattcagagcctccctcaagaaactgatcaaggaggagaatttccatgtcaagcaccagaaaacaagactgaataccaagaccgaaaggcaagaggtgacagggctgacagtcaatgagaaggtcaatgtaaacagacggtacataaagcagctgagacattggatatacttctgggaacagtatgggaaagagaaagccgaagaactaattctgaacaactacaaggcagataaggggcacgtgaaaaatggagagcccgatatcgagaatgtgattgatgggaagttacgatatttgaaaatggtcaaaggtgcaaacgatcattcctatcgcaagttgcagcacaggtttgaagtgcttaccggtatatcgattaacttcaatcctgatcgtttgttcgaagtctgggacagcgacggcattgtggccgcgatggagtattattacggctga

SEQ ID NO: 7434 - RNA, 1365 nt, unidentified
  source 1..1365: mol_type = other RNA; note = synthetic construct
atgcaattcagcgcagagcatataactcacattaggcaggaatttgccacaatggccaccaaagaagagttcgtcgctcttctgaactacgccaaagagatcctgattggtgacaaataccaaccctttgagttgaagcagattacctattacgccaatgctaaggtttcaggagtgaggtacaagaagtttgaaatcaagaaaaagagcggcggcgtaagggtcattcatagtccaatcaaaggtctgtctattatacaaaggtgcttaaacgctatcctgcagtgtgtttttactcctcacgatgctgctaagggattcgtgctgggacgctccatagtagacaatgccaagaagcacgtggggaggaactatgtctataacattgacctcaaggattttttccccagcgtggaccaggcacgggtgtggaagtgcctgcagttgccaccctttaatctggtcgattcagagaagtcccagatagtaacgcgcaagacaatcaagagtgaagttttggccttgatgaaagcgaatgggctgggagaagatcgacaaaccctgaatcgggcactcgataaagtgtccccacagatcaataaggggcgaatccatctggcccacattatagcctctctaagctgcactgagatgatcgtggagcgctgtatcgacggtgagtggcaggaagttaagaagaatgtactaccccagggcgctgctaccagtcctatactcaccaaccttgtgtgccagcgcctggattatcttctgactggcgtggcaaagcgtttcgggttacgatacacaagatatgctgatgacattaccttttcttctcagcacaacatttttaaggaggacggcgaatttatcaaagagcttcggagaatcatcgccgaacagggcttccatatcaaagaatcgaaggtgcgtctgcagcaggcagcattccgccaagaggtcacgggtcttatcgttaacaagactgtcaacgtgaatcagaactacattaaacagctcagaatgtggttgtataactgggaacggtacgggtacgacagagcgtataactatttcctgcctagctacttcgccagcaaaacaacacctgtcaaaggcaaaccggatatggcgaatgttattggcggaaagctcaactacctcaaaatggtgaaaggcgagaataatgaaatgtatctcaagcttaaggagagatttgacttcctgatctccaactgtttaccaatccggtcaatcctcgacatttgggagcacgagggaattgagaaagccatggggtcattctacaatgtgaaagcagatcaacaggtgctgtccatcattaaaggggacctactgtga

SEQ ID NO: 7435 - RNA, 1206 nt, unidentified
  source 1..1206: mol_type = other RNA; note = synthetic construct
atgaagatagagaagaagcacattaactacattagaaacgcatttgagaagatgcaaagctctaatgatttcctcaagctcttgaactacacaaaaccattagtctatggtgaaaactatgtgcctttcgaactgaagcagatcgtattttactcaaatccaaagaacacctccaaagcctacacggaatttcagatcaagaagaagagtggcggtatccggaccataaatgcgcccgataatcacttgaagattattcagaaggttctggcattcatccttcaatgtattttccagcctcatgaggctgcaaaggggtttgttaagggaaaaagcatcattgacaacgctcgggaacacacaggaaagaactacgtttacaacatcgatttcaaagacttcttctctagcatagataaggcccgtatcaaggggagtctcaagaatgagcccttcaatctgaataacaagcaggctctggctaatatcatctccgaaatctgttgcacggagatggacgtggagcataaaaatgagaagggcaactggattcggataaaaagtaacgttctaccccagggcgcccccacttcacctatcttttccaacattatttgcaaggaggtggatgtgaaactgaccggcgtggcgaagcggtttaatctcaagtataccagatatgccgacgacattactttctcttccatgcacaacatttatcaggaaaacggcgattttttgaaggagcttaacagggtcatcaaagtggagtcatttcatatcaaagagtcgaaaaccaggctgaaaaaaactggatacagacaagaggtcactggcttagtggtaaatgattcagtgaacgtccgaaagaggtatgtaaaacagataaggatgtggctatactattgggagaaatacgggtataataaggcaaaaacaatctttctccgcgactacatcaaagacaaaggactgctgaagagtatgaaaccgaacttcaaaaatgtgctttctggtaagttggaataccttaaaatggtcaaaggggccagcaacagcacatatattagcttaaatctgcgcttcgaaaaactctccaataagaacaaccacatagacagagtgctggaagagtgggaacgcaatgggatcaataaagccatcctggagtactatcgaaagccacaacagctgtttattcagtga

SEQ ID NO: 7436 - RNA, 1443 nt, unidentified
  source 1..1443: mol_type = other RNA; note = synthetic construct
atgaagattgagaaagagcatatcaagtacatccaggatgagtttgccacaatgcagtcacgggaagatttcctcgatctgctgaactatgcgaagcccttgatttacggggataactatatcccatttgagctcaaacagataacttattatgctaacccgaaaagaagtagaaaggcctacaaggaatttcaaatcaaaaagaagagcggtggcgtgagaacaatttacgcgcccgaaaacggcttaaagaccattcagaagaccatcgccctcatcctgcagtgtgtgtttgagccccatgaagctgcaaagggattcgtgatgggaaaatccatagtcgacaatgccaaggaccacgtcgggaaaaactatgtttacaacatcgacctcaaagactttttcccatcgatcgaccaggctcgggtatgggcctgcttaaagctggccccttttaacctgatcgatcagaagacaagtaaggagttcgatttcaaaaagcttgaaacgggaattcgccgctttacaaccgaatttgacgaggagattttctaccaactgaagggagggacttttctgcttgtgaacgacaaaaaaggcaattataaggcataccaaaagaggctgaaaaaattggataaggatgttttcaaggacgccgccaaatacattaccactgatgcaaatctcaaagaactggagaagcttacagtgcatagggagaaactggcaaatatgattgctagcctctcttgcacgaaaatgcaggttgagaggaaggacgagaacgggtcctgggtgaaggtcataaggaacgtgctgcctcagggtgcccctacaagcccagtgtttagcaacataatctgtcaacgactggataagaaactatccggtgtcgccaagcgcttccacttgaattatacccgctacgctgacgatatcacgttttcttcaatgcacaacgtctatcaagaaaacggcaagtttctgaaagagttgacaaaagtgattaagggacagaatttcgacatcaaggaatcaaagactcgacttcagaaaactggctatcgtcaggaagtgaccggcctaatcgttaacgacaaggtgaatgttcggaagcggtatgtgaaacaggtaagaatgtggctctactactgggaaaagtacggctacaacaaggcggagagtatcttcctgaaagattacttcattgacaaaggtcacgtaaagaatgcaaaacccaatttcggcaatgtcctgtctgggaaattggagtatctgaagatggtcaaaggcttcgaaaacaccacttacctgtctctaaataagaggttcgaaaagttacttggggtgatagatcctatcgagcgtattctcaatgagtgggagaataatggaattgactccgctatgaaaatctataaaaccgacatacacgagtga

SEQ ID NO: 7437 - RNA, 2259 nt, unidentified
  source 1..2259: mol_type = other RNA; note = synthetic construct
atgcaactggagcaggagcaggttgaaattattaggaccatgttccagcaaatcaagagtaaaaacgacctcctgaagttgataaacttcgcgaagaagctgctgttcggcgaagctgctcacgctgtgcccttaaagaccttaacatactacggaaacgcaaatctcgcaagcgacgcatatcggaccttttcaatcaggaagaaatctggcggaaaaaggccgattcatgctccggtcaaggggctcaagcctatacagaaggcccttaacctgatcctgcagtgtctgtttaccccacatcatgcggctaatgggttcgtgcccgaacgttcaatagtggataacgctaaggtccaccagggggcccactatgtgtacaacatagatctgaaggacttctttcccagcatcgatttgtctagagtcgccgcatgtctgcgcctgcctccttttaacctgatcgacactgccgaggaaccgctggcctttctggtggccaatttgtgctgcactcccatccttgtcgaacggcaaaatgagtccggcgagtggatcaacaagatactgaacgttcttccacagggcgcgcctacgtcccctacaatcacgaatatcgtggcccagagactcgacaaacgcttaacaggtctggcccggcgctttggagctaatttttctcggtatgccgatgacatcacattctcttccatgcacaatatttacaaacaggacgaggcattcaccattgaattgactagaatcatagagtcacaggggttctatatcaatccaagtaagacaagactgcaaaaaacagggttccgacaagaggttaccggcctcgttgtcaacgagaaggtgaatgtgcaccgccgatatgttaaacaaattcgtcactggctatacctttgggagcggtatggctacgctcaggctgaacaaatcttcaaaagggaatatgtgaaagacaagggatacgcaaagaaaggcaatcccaaacttgaaaatgtgcttgagggaaagttgctctttatgaagatggtaaagggcggagaggacggtacttttttaggactgtggcgccgcttcgatcatttgctaattgaactcaacgaggtgcgagataatacgtcaatccctgaggaggcattcaccgaaaaagagcagctgactagaacgatcaagatatcgctgctaccaatcgatgacggcaagttcattcagactctgcagcacgacaaattgatccccatgggtgtcgccctcccatacgaggagacatttgaaaacaacatcgaagagacttacgaaaagccatccctccagcacaatcccattaacacaatgaacttcctcaagaatttcaagtacgacaatgcaagtggctttaaagaattggtccatgcaccctttgacgtggacaacttcgatttcgaaaagattctggacaccgtaaagaatcacccaaactttattctcacctttaagaacaccagagccgaaaaatttaccggggagctgcccctgggcctttggaagaaggccaaagagctgattaatcatctcagcacagaggggctcgacctgttcaaactaactaaacagcaccctatagagagcgagaaattcctcacagaaatccaggacttcaagaagaactataggtttagttcagatgataccgagtcctcgatcctgaagaagctgattattcatgtggccaaaaaagctgagcacaagaacagcgataagaacattgtattttccttcgggaatacagatcagagtggtcagtttagtgatgaccaacttgtcttcctccctgatgagcgaatattcggtcttagatccggattttttacctgggtcccaaacgtgaggaataccctagcctggattttcaaagggattttgcagcatagcaatgttaacggttcccggacgtttgagaaaaaaagcaagaagattgttgtggagatcaataggtttagggataaagacattggactgactaaagtacagctgaccatctctgatgaattcagcgtgttgaaaaagtctccagatcagttcctggaggacctgttaaatagcgagccttgcaaacactatctccggaatatcgcggattgggccatcgaatgcgactgtgataacggcgaatcatacctgtttcagattttacccaagaacgactataaacgtcttgaaagaaaagtgaactctttcaagcatatcatcactttctacgactga

SEQ ID NO: 7438 - RNA, 1257 nt, unidentified
  source 1..1257: mol_type = other RNA; note = synthetic construct
atgcagatcaatcaggaacacattgacactatcaaagcacgctttcaacagatgaagacaaaagaggagcttttggaactcgttaacttcgcaaaaacgctggtgtatggcgagaaggccaaacctgtgcccctccgaactttaacctattatgggaacatccaggtcgcgggtagcgcctacaaggagttcagtatccgcaaaaaatcagggggagtgcggaagatccatagtccagttaaaggcttgaagcccatccagaaagctttaaacctgatcctgcagtgtgtcttcacacctcatcaagcagcgaccggattcgtgccagagaaatccattgtggacaatgctcgagtgcatcggggcatgaactacgtgtataacattgatctcaaggatttctttccgtctgttgatatgaacagggtcaaggcctgtttgcgtctgccccccttcaatgtaatatatacggatgaggctcctctggcctttctgattgccaacttgtgctgcacaccaatcgaggtggaacgcaagaacgataagggggaatgggagaaaaaggttatgaatgtcctgccacagggggctcctacctcaccgacagttactaatatcatttgccaaagactagaccgaaagctgaccgggctcgccagaaaatacggagcacagtacacaagatacgccgacgatataaccttcagcagcatgcacaacatctacgaagagtcctctgaatttataaagctgaatgagggctataggaatttcatccgggacatggtcaaaattattgagggccagcggttttctattaatcccaagaagactaggttgcagaagtccgcctacagacaggaggtgaccggactggtagtaaacgaaaaagtgaacgtgcggaggcggtacgtaaagcaaatacgcagatggctatatttatgggaaaggtacggatatgtccaggctgaggctattttcaggaacgactacagagcagataagggtcacgtgaagaagggagaaccttctctccaaaatgtgcttgatggcaagcttctgtttctcaaaatggtgaaaggtggcggcgacggtacttttagcaagcttctcgaacgttttacaaaactgaccgattcactggaacaggtccgctcggagaatgtcgacctagattccgtgctggacgttctgctgaacaaggggcttgacgacgccatgaatctgttcgacaagtttaaaagtctcggccagtga

SEQ ID NO: 7439 - RNA, 1290 nt, unidentified
  source 1..1290: mol_type = other RNA; note = synthetic construct
atgaaaattgagcagagtcacattctggaggtgcgcagcgtgtttgaaaagatgcattctagggaggattttctgaacctactgaatcaggtgaagcctttggtttatggagtgaagacagttcctatcgaattaaagcaactcacctggtacgccaaccccaatctcggtgggaaacgctatagtgacttctccatcaaaaagaagtctggggctgacaggttaatacacgcacccgttagcggaatgaaaagcatacagaaagccctctccttcatcttacagtgcgtgttcgaaccacacaaggccgcaaccggctttgtcatcgggagatccatagtcgacaatgcacgcatccatcagggctgtaactatgtgttcaacattgaccttaaagatttcttcccctccatcaatcagtcacgagtttgggcctgtctgcaaatggagccttttaacctgaacgagaaaaagagtatagcccctaccgaatcggcagacaagtactttatggtgcggtcccgtaccattgccggacgtaaacagattgccaacatgatcgccgccatttgttgcacagagatgactgtagagcggcaggacgaaaaaggggagtgggtgcaggtgaaacagaacgtgctgccgcaaggcgcgccaacatctccagtaattactaacatcgtctgcaaaaagctggatcacaggctaaccggtgtcgctaataggtttggccttagatattcacggtacgctgatgacatcactttctctagcatgcacaatgtgtatcagaaagatggagagtttctcaaggagttgcatagaatcattacggatcaagggttccacataaatgagaaaaagacccggctccaaaagactggccaccggcaggaagttacaggactggtggtgaatgagaaggtaaatgtgcagaaacgctacatcaagcagctgaggatgtggctgtactattgggaacgatatggctacgaaaaggctgagaggatttttctggaacagtacatggatgatagaggccatcttctggacggtggtaagccaaatatgatcaacgttcttgctggaaagctcgactacctgcgcatggtgaaaggcgctgataactcagcatacaagaagatgaaaaagcatttcgacaacctgatcattgaaaaccgaagcaatgtcatcacagaccccttgagagtcaaagaactcgacgatgtcttgaacacgtttttcgagtcagggttcgatgtagcgatgaataagtacagcatgaattga

SEQ ID NO: 7440 - RNA, 1149 nt, unidentified
  source 1..1149: mol_type = other RNA; note = synthetic construct
atgaccaatagagaggatctgcttaccctgctgaacctggctaacaagcacctgcactcaaacaaggcgttggatttcgagctgaagcaacttaattggtactctaatccagccataaacaagagacgatacaagacgttcagcatccagaaaaagtctggcgctgaacgcaaaatccacgctcctgtgaaaactttgaagtacatacaacaagcactctgctttgtgttagagtgtgtatttgaaccccataaggcggcctatggatttgtcaagaataagtcgatcgtggacaatgctcagaaccatgtcggtcagatatacgtatacaacatcgacctcaaagattttttcccttccatcgaagccgggcgactgtttagcaggctgcagtatccaccattcagcctgagcgacaaaagggacgttgcaaatgtgataacttggctctgtaccgaaaagctggaggttgaacggttcaataaagaaaacagtacatgggaggccaaagagctaaatgttcttccgcagggagcacctacgtcccccctgattacaaacattatatgctataagctcgactacgttctgtccgccgtggctaaacggtttgggttaaagtattctcggtatgccgatgatattaccttcagttcaatgcacaacgtgtatcagaagaactcagaattccttactgagttgaagagggtcattcaggaccagaatttccatatcaaggagtccaaaacaagactccaaaaagatgggtttagaaaggaggtaacaggcctgctcgtgcacgagagtgccaacgtgcataagcgttacattaagcagctgcggatgtggttgtattattgggagcgttacggctacgagaaggcatacggtttctttctaccccagtatgtgggcgatcgcggtaatgtcaaaaaaggcaatcctaatatggaaaacgtcatcggcggaaagctggaatacctgaaaatggtgaaaggggtggaaaacgagctttatctaaaactcaaagacaggttgtctatcctcattggatacaccgagcccatcaaccagattttagacgtctgggagatcgaggggattgaaaagctgtggaaattcatcattcgcatcaatgaaactaagtga

SEQ ID NO: 7441 - RNA, 2151 nt, unidentified
  source 1..2151: mol_type = other RNA; note = synthetic construct
atgaaactcgaagaggctcatatcaagtccatcaagtcatccttcgagaaaatgaaggacaaagaggacctgctacaattactgaatttcgtgaaacccctggtttacggtgaaaaaaccataccctttaagctcaaacagcttacctggtatgccaattcgactttgaagggaagaaggtacaaagagttcaacatcaagaagaagagcggagaacaccgtactattaatagccccgtgagcggccttaaagccattcagcgaatcctgaatttcattctccagtgtgtctacgaaccccataaagctgccatggggtttgtgaatggaaaatcgatcgtcgataatgctcggctccatactggcaatcactatgtgtataacatcgacctaaaggattttttcccctctattgaggccgggcgcatctggagtagatttcagcatcctccattcaacctcaatgatagaacaaataggaaggagctggctaacatcattacttggttatgctgctgcgagatggaggtcgaaagactggatgagaaaaatcagtggcacatcgttaagcgcaatgtactgccgcaaggcgcccctacgtcccctactattagtaacattgtctgtcatcagctcgatttttatttaagcgcggttgccaaaaggttcggcctgaagtactctcgctacgctgacgatattacctactcttcaatgcacaatgtctatcaaaaagggtcagaattcctaagcgaggtgcatcggataatcagtgcacagtcctttcacattaacgtgaataaaacgcggctgcaaaaagcagggtaccgacaagaagttacgggtctgctcgttaatgagaacgttaacctgcagacacgctacataaagcagttgaggatgtggctgtactattgggagcgatatggctatgaacgcgcctctggtttttttctgcagcaatacgtggcagataaaggacatgtgaagaatgggaaacccgatcttgccaatgtgattagtggaaaactagactacctaaagatggtgaaggggtccgagaacgatctgtacctgaagttgaagaataggttcaaccaattgactacaaaaacaatcgaccagatagacctttcaaaggtaaaaaagatctccaagccctcggaacgggaatctataatcgaggagaacattgacatcaacaacaataacagctatcctattctccacaacccgcagaaaaccattactcttctgaagtccttcagtgtgaatgagaaggacctgaagtactcaacccacagctgggaagagggaaagtacaacagttatgaggagtatatcgagaagatcagaatcgaatggaatgaaataaaggacgaacttaagaatcagtccccacggctcttcgcgaagatctccaacttcttgttcaacaacaaactgggccagaagaatgaggagggctactacatttcctggggggaaaaaagactgaaatttggatggtcaagcgcaaacctcaaggaccacatgtctgatccaggtaactcaccgtttagctgtccaattcctgatcagattagggaactggataagaggcatgatttgctgtactttaaagactatgctgacgtgttcaaaaatgaaatagaattccgggaggatagtaacaacttcaagaagatgatccttgaactttgggaaaaggagctcagctatgactttaacattaaaggagtggagcagtttgcaggtttctctttctttacagacgtgcacctggtcaaggaatctcttagaacagtctttagggacatgtacaaagtgaaaccacagtttcctaccataattatcgagaagatcagtagctttaacgagcgagggtaccacctgattaaggtaacccagaaagatagctttatcactcgtgatgtaaacgatccaaagttaacatcacctagcggcaacctcttctctataatccgcaatttaaagaatctctctgactactctatcgtctcccggttccgcgacggcagaaattatcgtctgaactatttgacatccaccaaaaccgacttcatcgagacattgacccaggacgagaacaccctgggcttcagccacgagttcaagttttatctgtga

SEQ ID NO: 7442 - RNA, 2268 nt, unidentified
  source 1..2268: mol_type = other RNA; note = synthetic construct
atgattaccgagaaagataaggaatacatcgacatcgcattccacaagatgaggaatagggaggatctgctctccctgctgaattacgccaagactattctgtttggccaagaagccagtcagattgcattgcaccagctgtcgtattacgccaatcccaaagccggcggcaagcggtatcacacgtttcgaatcgcaaagaaaacaggcggttctagaaaaattcatgcccccgtggaggggttgcgggtcatccaacagtgtctcaacctcattctgaaatgtgtgtacaaaacgcagcaacaagcacacggtttcgctcagggtaaatccatcaaaacaaatgccgctatgcatgttggatcctactacgttttcaacattgaccttaaggactttttcccttccatcgatcaggctagggtctggaaagtcttgcagctggaaccgtttaatttactaaaccgggaacccgcagaacaggaagggatagacaattacgaaatcgctaatctaactgccgcactgtgctgcacgagtatgatggtggagcgtatcgacgaggagggagagctgatcaaggtgcgccgaaatgttttaccacagggggccccaacatccccactgttgtcaaacgtgatatgccagcggctcgattttttgttagccggggtcgctaaacgcttcggattaaagtacagcagattcgctgatgacataacattctcatcccttcacaatgtatttcagtctcatagcccatttaccaaggaacttactcggatcatatacgaccagggtttccggatcaatgaacagaaagtccgcctgcaaaggagcgcctatagacaaatggttactggcatagttgtcaacgaaaagaccaacctgactaagaaatatctggtcagtttgcgcaagtggatatatctgtgggaaacatatggattcgcccgtactctggagatctatagacaggagtataaacttgaacagattaagcctctggatatcgacctggtggccatccttcgaggaaagattgcctttctcaaaaatgtgctgggggacacaaatccgagatataagcagtacaagtataggttcgacgcgttgaacgctcccactctcgccgagaatatgccagtgcaaggagatgctagggagatggcaaagaagttagatcggattgacgagctgctgaagtctaataaaattccttccgtggatgccagcatcgaagagttaagagaattcgtgtctcttgtgcatcttcgctctgagattcccctgatagataacccgagtaaagagacgaacttggaggacgacatccacgatcctcgcttcgtagtgagtctcctcagcaagtttaccgaagaaaccaaccttaagtacaccgtacacatgtgggacagcgagaacagatatggcagctttcaggatttctcaagtgcgattttcgcagacatcaggcagtacaaactaaggtccctgccccggtacaatagccgactctactggaagatcatataccccttcattattcaagaacacaccctcaagaagaaatctggcgagccattcgaatatgcttggggccggtataacttgaagcttggctatcactaccccagtaccctcgctcagtggatggactctaacccaaacaaatcgccttttatgatgcccattagcaaggacctgcgtcctgcagagcctatcaaggggcgaagcatctcatacttcgaggatgtggtagacatctttaagcaggccattgagttccgtggaaacgacctctattatctgttcaaagagctgacagggtcgttgctcttcgatttcaatatcgaactgctcaacctgaaaggcatatctttttttaccgatacccatcaggttgagaaagcgctgagaattatcttttcaagcattcgcaagtacaccgagtcacctcagatcagggtgtcaggtacatatatctctgaagctcactactttgatatcgagatcctgcagctaggatccttttgcgataagccaattgatgaccccaagataaccctcaaagggaacaagggcgactttaatactattcgcacactcctgcattctctatgtaactggtccgtcgagagtaggttcagagtgggcgacaagtacaaattctacagactgaactaccttaactcctcagcgagcgatgagatcgaagagatggacgccgcagaggggtttaaacatcgcctgcggttttatatttga

SEQ ID NO: 7443 - RNA, 2220 nt, unidentified
  source 1..2220: mol_type = other RNA; note = synthetic construct
atgaaaagccgcgaagacctgcttgatttgatcaactactccaagaaagcgctgtacggtgaagatgtggagcctattacaatttcacagcttacgttttacagtaatccctcagccggcggtaaaagatacagacagttcaacattgcaaaatccagcggtcagtatcgcgctatacatgccccggttcagggattgctcctgatacagaggtgcctgaacctcatactgtcctgtatctacaaaccaacccctcaggcacacggctttacccccggcaggtccgtgaagacaaacgcattcgtgcacgtgggcaactattatgtcttcaacgttgatctcaaggatttttttcctagcatcgaccaggccagaatttggaggatgttacagctaccacccttcaatctagttgccaagaacgactctagaatcagcccaaaaaaccggtacgaactcgctagtatgatctcagccatatgctgtacctcgatgttggtagatcggattgacaggaaggggaacttgacgcgagtggtaagaaatgtcttgccacagggggcacctacaagtccattcttcagtaatatgatttgtcagaggctcgaccagcgcttgatgggagtcgctaaacgtttcgggcttaagtacactagatatgccgacgatatcaccttctcatctctgcataatgtgttccatagccacaatccctttatcgtggagatgcgcagaatcattaccgagcagggattcacagtgaatgaagacaaagtgcgcttacagcggactggataccgacagatggttactgggctcgtagttaatgaaaaggtgaacgtgacacgggaattcataaaatctctgcgcaagagcttatatcttctggaacggtataacgaggagaaggcctcccaggcttacattaaggataataagcttgacgacgtcagcattaacgatattgacatccaggctattgtgacaggaaagatcgcgtacctcaaagatatcctcggaaaaaactcgcccaggtacctgagctataagacccgaatcgaccagctgtacccggggaaagggacaacggtgcccgtggagaaggtggatgccaagacacttgctcgcaatattgaccgggtgaagcacaacctgctgaataatgagctgccgactgaaaatgcaagtttcgaagaactgagagcattcgtgcggcttctaagggacgagaacagcgtctcagccttactcgtcgacaaagccggccaagccgaagaagatgaaatccatgatcctaactttgttgtgagtgtcctcgaaaaattcacttccgagacacatctgaaatacgctacgcactattgggacacccaagacaggtataagaactataatgttttccgcaagtccatcatggaggacgtccggctgtttaagctgaggctcctgcctagatacaattcccacctgtactggaaggtcatccacccattcctaatacgagataagcccgacgagaagaagtctggagagaaattcgagtatcagtggggtcgacataagttgaaggtgggcctgcaatatccaggcatcctggaggagtggatgcaggaaaatcccggaaaatctcctttcagcatgcctatacccaaagagttacggccccctttccgcatttctggtaagtcgctgacctactttgaggacttcgttgatgagtttaaaaacgaaatcgagtttcggcgtaatgatcttcactatctgatcaaggacattacctcctccatggaatttgattttgatatctcaatcaccaacctcaaaggcctgagcttttatactgatacttaccaagtagagcaagccctgcgcattatctttaacgctattcgtaagtaccctggcgcgccaaagatcattgtcaatggctcttatgacaccgaggcgaagtttatcgacatagacatattgcacattgactccttttgcgatagaccattaaatgataggaagctccagctaatggacaaacgaggggactttttcactatcaggaaactcctgaacagtctctgcgattggtctattcaatcaagatttcgggtaggtaacgagtatacttcttacaccatccactacctgaatagcacaggcgcccaaaacccggagaaatctgcagatgctctggggttccttcataaattgcgtttttacctgtga

SEQ ID NO: 7444 - RNA, 2286 nt, unidentified
  source 1..2286: mol_type = other RNA; note = synthetic construct
atgaagattgagaaagaccaaaaggactacgttgttaaagcttttcactcaatgcgcgatagggacgatttcgtcaaactgctcaactatgcaaagaagattatttacggggaaaaaaccgtattctttgacctgcgacaactcacctattactctaacccgaatgtgaacttcaaaagatacaagagcttcgagatcgctaagaaaaatggcaagtcccgcaaaattcatgccccagtgaaagggctgctggtgattcagaagtgcctaaacctcattcttaattgcattttccagcctaccgtcttcgccacaggatttgttatgggcaaatccattgttgacaacgctgcattccatgctggtaattactacgtttacaacatagacctcaaggactttttccactctgtagaccaggcacgggtctggaaatgtctgcagctaaagcccatcaacctgagcctgtttcagaatcccgaagacaacaaatataactcctccctagaaatcgtcaacatcatctcagctctgacttgtaccgagctccttgtcacgaggacagaccgaaatggcaaggagatcgaggtgaataagaatgtgctccctcagggagccccaacctctcccctgattaccaacctggtatgccagaaactggactatctgttaagcgccactgcaaaacggtttggcctcaagtactctaggtacgcggatgatatcactttttctagcttgcacaatgtatatcagcagaatagtgatttcttgatcgaactgaatagaatcatcaaagaccagggtttcgtcattaacgaagaaaaagtgagactgcagaaggacggattcaagcaaatggtaacgggattggtagtgaataagcatcctaacgtgtccaagtcgttcatcaataacattaaaatcgacctgtactactgggagcattatggctacgtgaaagccacgaaattctttctgagacgatataagcacactaaggaaagcactaaaaaggtgaacgtggatatgagcaatgtgatttgcggacgcctccagtatttaaagatgattaagggagccaacaacaaaacctatacctccctggccctcaaataccaaaagctgcttgcgaagaaacagaagagtgagctgaatcccgaggacgtgcactttaaatcagtcgagtcatcgggctatgacctgacagaaaacggcctgattaatccagacctaaagacatttatggtcagtattctgaactctgaccaaatagcactggccgagaaacaggagatcttcgcaaacgttaatctggagttatctcggttggtgaacaatgataatacagggaagaactcgcttgggtcttcctccagtataaactctagtagcgtcaccacagacgggtggaaatccgaacattcacctaaggatgtggcccgtttcatgagtttgtttaataagcgggatggattgaagtaccttactcacgacttcgacgaggagggtaagttcgaaatctcctttttcctggagaaatggaggtccatctttgaacagagcttacgggggaagaatggctttgaaatcccatcttccctttatcgcatagtgaatgagttcgctttttcaggcaaacctaattggacgagcgtcaacgatagattagtgaatgaaggatggagcaccgacaagtggataaagtggagctccaagaatatgctgcacccctttagaaacactgggttgaaagtgatcattgaagactttaggagactcatcagggttgagtcaccaaatctggagttcttagtgaacgaagcttttagcgatgctctcatcgatgagaacaataagtacagcttgaaactcgatcaagtctcaaaagccgatttttatacacacatccctagcttgaaacgcgcgctgtttgcaatcttcagtgccatgggtaagtatggtggggatcgcgatatatctgtgtcttaccagcggtcaacagaggatgatttcttcgtgcgtaagctcattatcagtcagacaaacagctatcccaccaaagagctagagcagatccttatcgagtggaacactgacaagggagccatgggcggtataaagcataatctttacgggtactgtgattggagtatagagactaagattgataacacaccgtacaggataaacattcttaaggacaaaaagaccccaaaattcgatgttattggcatggaagaaatcataggcttcaagcacatcctcaagttttactatatctga

SEQ ID NO: 7445 - RNA, 2298 nt, unidentified
  source 1..2298: mol_type = other RNA; note = synthetic construct
attcagcggatgaagcaacaggcttccaagaacatctacatcatgaagctcaccaagaatcagtgtgaatacattgttaagcgtttccgtgaaatgcgaacaagagaggactttttgcacctagccaattatgcaaagaagattatctatggcgagaaggcatatgatttcaagctgaaccagctgacctattactcaaatccccgcgtcaatcccaacaggtatagaacgttcactgtcaaaaagaaatccgggggcgtgcgcatgatacatgccccaactaaggggctcatggagattcagaaaagcctcaacctgattttgaattgcgtgttcaacgcccactcatctgcctttggctttgttccgggcaagtcaattagggacaacgccgccgtgcatgctggaaattactatgtgtacaacattgacctgaaggactttttttttagtatcgaccaggctcgagtgtggaaatgttttcagctggcacccttcctgttagggaagaaaacagatacccttaacgacgagaaaggtaaaaacctggaggtggtcaatatgatcagcgctctctgttgcgctgagatcgagactggtatgcagcaaaccgacggcactttaaacatcgtgaagaagaacgtggtacctcagggggcaccaaccagcccaatagtcaccaatatcgtgtgccagcgtctagattttctgctcgcagcggcagcaaaacggttcggcctcaaatactctagatacgctgatgacattaccttctccagcctgcataatgtgtaccaaaccgactctgatttcatcgctgaaataaaacgggttattaaggagcagggctttcagattaactctagtaaaacacggcttcaaaagatggacgaaagacaaactgtgacgggcctggtggttaataaaaatgtgaatgtgcctcgcaactatattaaaaaaatgcggagctggctctacctgtgggaacgatacggctatgagaagacgtattcattctttctgaacgattacatacgggataaaggacacctaaagaagcggactcctgatatggcaaatgtcttaagaggaaaactcgagttcctaaagattgttaaaggtactgatgataaggtttaccagcagctgaataacagatatactgtcctcatcgctaggaacagaaaggactcacttaatgaccgcctgttaaactattgggaattgcacgggttgcacgctgcttgggaacacttcaaggcggagacagggattatgaccattgacaaattccttgacaaactgcttaaggagacagtaacggatgacgagagaaagaacaaactgttgaagcttatccagtccagcttaaacacctccagccttctgaccaagtcaacatccaaattcaccattcccgacaatgagaagctcaatatgccaaagcgagtcgccgactttatgagtttgtttgatgatcccgccgggctgaaatatctaacacacgatttcgacgagagtgaccagatatttgacatcgaaagcttcctgccccaaaccaggaaggtcttcgaagataaaaccaaaccgggcaatctgacgatcccctcgtcgctgtggaagatcgtgtacgagttcgccttcagcgaaacaccagattggaataagggttgcaaagacgggtggtctttacctgataggataaaatggtccatcgatagtaaaaagcatctgaaacggaatgaaggatttgctgcgacaatcgaaagttttcgcaagctcactcgcatcgaggcccctgaactcaagaggctgattaaccagatcgtaaaagaaaagcttggagacaaataccctgagtgtacaattaagctgaaagactgcgaaaaggcagacttttacacacatgtcgcctacttctctgaagccataaagctgctgcttgatggattcaataaaaggatcggagagtgtaaggaaatagccattacctacacccggaaaaacgatgacccttataggttgaggatcattactctcgaacatgtaggatcctttccaatgaagcccctggacgatttcttccgcgacttgggcaacggtaagggagagctggcggatgcccgaaacaagttgacaggctattgcgattgggccatcgagactatctgggactctaaactcgtgagaatcactctgcttggggccggcaatgagatcgagtacctcccaaacacaaaagaggtgtccaaccgcataaccggttttacccacatcctgacattttatcagaagtga

SEQ ID NO: 7446 - RNA, 1386 nt, unidentified
  source 1..1386: mol_type = other RNA; note = synthetic construct
atgaagcccacaaaagagcagattgattctatcaagaccaagttttccgcaatgcagactactgaagacctcctcgatctgttaaacttctcgaagtccattatctacggtgagaaggttatccccttcaaacttaaggacatcacgttttattgcaatccgaaacgaaccattgatcacaagtggaagttctttcatcagtatcaagagttcactattgcaaaaaagtctggagggacaagaacaatatatgctcccaaaaagggccttaaagccgtccaaagatcaattgcgtttgtattccagtgtatattcgaaccccacaaaagcaccatgggcttcacgaaggagcggtccatcgtccacaatgcccagctccacattaactcatattacgtgctgaatatcgacttgaaggattttttccctagtgtggaccaggcccgcgtttggaagtgtctgcagcaagcaccctttaatctgaaccaagcaacctcaaaagtgttcgagacatttgccatagacgaatttaagatcaagtatccagagcagtctaaaaagatccatccgaacaagaagtttgtgattagcgatatcgatagcaattacttcaaggctaccaatcgaattcctaaagcagctagattggagctggccaacatgctggcggccatttgttgcaccgagatggaagttgagagtatactggctgacggctccgtggagaaaattaagaaaaatgttctgccacagggagcccctacctctccaatcctttcaaacgtggtgtgccagaaattagatctcagactggcaggggtagccaagaggttcgggctgttgtactctcgctacgcggacgacataactttcagcagcctccataatgtgtttcaggtagacagtgagttcaagaaagaactgtaccgtatcattctcgatcaaggatttaggatcaacgagaaaaaaactcggctgcagaaggacggatacaagaaagaggttaccgggctgcttgtgcacggtcaggtcaatgtccagaaaagctttatcaaggatttaaggatgtggctgaacctatgggaaaggtatggttacgaaaaggccaataacatcttcttgaacgagaatggacctctgctgaatacgactgccaaaatcaagaaagctgaactacgtaacacacttgaaggcaagcttaattatctctccatggtcaaaggcctcaacaacattacctacgtgaaattgaacaaccggtttcggactctgaaaccaacaattaagatccatacagaagaccgcagtgcccacatcgaaaagaccctggagttgctactcaataacggcataaatgatgctatggctttctaccagcctcaatga

SEQ ID NO: 7447 - RNA, 1209 nt, unidentified
  source 1..1209: mol_type = other RNA; note = synthetic construct
atggatacgaaggaaatcacgatagagcagaagaagaaaattgtggaattctttggggtcgtgaacacttctttcgggttttgtgtgctgctcaattactgtcagcggatcctctatcctaaaaccgtatatcagatttctcagtttgagctgaggaccttagcccaccctgatagtaagaaacgttacaagacttttaccatacggaagaagaatggcgggactcgaactattcatgcgcccaagcccgaactaaagatggtccttcgctgcatcaatctgatcctgcaatgtgtatacacagtccatgaaaatgccaatggctttgttgagggcaagagtgttgtggataatgcaaagctccactgcaataacaactacatcttcaacatcgacctgaaggattttttcccttcgattgaaatcggacgagtgcttaatcgcttatcctacccaccattcaatttcaaaaaagagaaaggaaccgaggaaattggaaattacatcgcttggctggcttgcgagaacactcttgtagaaagagagctcgacgggaacattatcaaaacggtgaagagagtactgccgcaaggctccccaacctctcccatactgtctaatattatctgcgagaggctggacagacggcttacaggtctagccaaccggttcggcttgcgctattcacgctacgctgacgatgtcacatttagttctatgcataacgtctaccagaaggacggtgaattccgtaaagagatggaaaggatcattagcgagcagtacttcacaatcaaccagtcaaaggttagactgcagaagtccatcatgaggcaggaagtgacaggtataactgttaacaaacaagtgaacgtcagccagaagtatatcaaacagctgagaatgtggctttactattgggagagctatgggaccgtcaaaggattgtccttgttcctgcaatcctacattaaggataagtcacacgtgaaaaaagtggtgcctacccccgaatttatggaagccgttatcggcggcaaactcaactatttgagtatggttaagggaacagagaacagcacctatctcaagctgaaagagaggtttgacaagttaagctccaattacgtggacattgataatattctcagcgtgtgggaggagaacggtattgacgaggcaataaacctgtattcaaaaacagtgtga

SEQ ID NO: 7448 - RNA, 1209 nt, unidentified
  source 1..1209: mol_type = other RNA; note = synthetic construct
atggtcacgaaagagattactatcgagcagaagaaaatcattagtgacacctttcggtgggtgaaaaatgtcagcgacttttgtttagtgctcaactactgccaatcgatcgtgtatccccaaacttacttcgacatctccgaatacctcctgaaaacactggcccatcctaactcaaagaataggtataagaccttcaagatcaaaaagaagaacggaggtacacgaacaatccactcccctaagcctgagctgaaaatacttctgaggtgtattaaccttatcttgcaatgcacttacaccgtgcaccagaatgcgtacggctttgtagaaggtaagtctgttgttgataacgctaaactccattgtaacaacaactatgtgttcaacattgatctgaaagatttctttccaagcattgaaattgggcgtgttttaaatcgcctctcctttccaccctttaatctgaaaaaggagaatgggaatgagaaaataggaaactacatcgcatggctggcatgcgaaaatatcctggtggagagagaactcaatggaaagattattaagaccgtcaagcgagtgctgccccagggcagtccgatcagtcctatcttgacaaatattatctgcgagcgccttgaccgtcgccttacaggcctggccaatagatttggcgtgcgctactctcggtacgccgacgatattacattctcttccatgcacaacgtatatcagaaggatggggagttcagaaaagagatggagaggataatatcagagcagtatttcaccatcaatcagagtaaagtacggttgcaaaaatcaaccgtcaggcaggaggttactggaataacagtgaacaaacaggtgaacgtctcccagaagtatataaagcagctgagaatgtggctctacttctgtgaaacttatgggaccaataagggcttgagcctattccttaagtcatacatcaaggacaagactcatgtgaagaaagcaattcccaccccagagtttatggaggccgtaatcgtcggtaaattgaactatctatctatggttaagggcgtggaaaactctacctatttaaagctgaaggaacggttcgacaatctgagcagcacgtacgtggatgtggaaaacattctggctgtttgggaagagaatgggattgacgaagctatggatctctacagcaaaatcgtctga

SEQ ID NO: 7449 - RNA, 1254 nt, unidentified
  source 1..1254: mol_type = other RNA; note = synthetic construct
atggtgaaaaatatatctatagagcaagccgagttcatcaagaagttcttcaagagcatgaaagacctccgtgacttttgcatgctgatcgacatttgtcaggacatcctgtacccagagttcaaagaccggactcgcattgatgagtatgttatcaaaacactggctcacccaaaaagcaagaatcgctaccatagttttgagataaagaagaagaacggaggcatgagaaccattcacgctcctcagccggagcttaaggtggtactccagtgcataaacttaatgtttcagaccgtcttcacaccccattccgcggcgtatggttttgtcaaggatgccagcgtggtagataacgccaacttacactgtgggaataactacgtgttcaatatcgacctgaaggactttttcccttcgatcgaaattggcagggtgctgaataggctgtccttccctccctttaactttaataaagagaacgggcgcgaggaactgggcaattatattgcctggttggcttgtgagaacacgatcgttgagcgactcgttgatggtaagatccaaaaggcagagaagagagtcctcccacaggggagccctttgtcacccatcttgaccaatattatttgcgaacgattagaccgtcggctgacaggccttgccaaaaggtttggcgtcaagtactctcgctatgcagatgatatcacgttcagctcaatgcagaacgtgtatcaggaggaaggggcattcagaaaagagctaggccggattgtgtcagaccagtatttcatcattaatcaggataaagtgcggttgcaaaaatccggaactcggcaggaagtgactggcattactgtcaacgagttctctaatgtaacacgcacctacgtgaaaagaatcaggctgtggctctctttctgggaaaagtttggtgcagaaaaagcctttaatctttttctcaacggatacatcaaggataaggggcatgtgaagaatctgggaaaaaccagtttctttatggaaaacgtcatcgagggaaaactgaattacctgaaaatggtcaaaggggagaacaattccacctacctcggcctgaaggaaagattcgaaaagctttccctgaggaacaagtcagttgatcagctactggatacctgggaaaagaacggaattgacgaagccatgagtaaattttatgccgatcccagcccacgagtggacaaggttgctgaccaaatagctttgctttga

SEQ ID NO: 7450 - RNA, 1206 nt, unidentified
  source 1..1206: mol_type = other RNA; note = synthetic construct
atggaggtcaaggacattagcgccgaagagaagagtttaattgcaagattcttccgtatctgtgacagcgagaaaatgttctgccacttattgacctactgtcagcgcttgttgtaccaacagaagattgtcaatatcatcccccaaacactgaaagcactgtcccacccaaattcctctagacgcttcaagacctttgagatcagcaagaagaatggagggaagcgaacgatacatgctccaaaggcagatcttaaagtcgtgctgaaatgcctaaatctcattatgcatagtctgtatgagccccataatgccgcctatggcttcgtgcatgggaaatccgttgtggataacgccaaactgcactctaattccctctatgtctttaacctggacctgaaggattttttccccagcattgaaatcggaagaatcctcaatcggctgaaccatcccccttttaatctgaaaggcgagggcaaagacaagatagccctttacattgcatggctgagctgcgagaacatgatagtggaacgagagatagagggtaaactgcagaagaccgtacggagggtcctcccacaggggtcacctgtatcccctatttttacaaacatcatttgtgagcgactggactacctgttgagtgcagtggcgaagaggtttggagctgtgtattccaggtacgccgatgacatcaccttctcgtcgaatcacaacatatatcagaaggatggcgctttcagacaggaagttgagcgcattatcgctgatcaacactttcagatcaaccggtcaaaagtgcggttacaaaagtctaacgtccgtcaggaagttactggcatcactgtaaacaaggagccaaacgtggcccggagatatattaaacagatccgcatgtggttgtacttttgggagacttacggtaccgacaaagccttcagccttttcctgaagtcataccttaaagggaagggccacgtgaaggtgccgggaaacacgcctctatttatggaagctgttatcaggggtaaacttgactatctcaagatggttaaaggagaaagcaattctacctactctcagctcctgtcaaggtttgagaaggtgtctagtactccgaaccacattgaccacatcctcgatgtgtgggaaaatgatgggatcgaaacagcgattataaagttcgaaacagacggctga

SEQ ID NO: 7451 - RNA, 1104 nt, unidentified
  source 1..1104: mol_type = other RNA; note = synthetic construct
atgtaccccttcgaactggtgaagatcgacgagtataaagtgagaaccctggcccagcaaaactccgttctgcgatacaagacttttgagatcaagaagaagaacggtggggtccggcacattcatgcgcctaagtccgagttgaaagtgctacttaagtgcatcaatctcattttccactgcatatatactccgcacgactctgcttacggattcgtcgacggccggtccgttgtcgataacgccaggcttcattgtagaaacaactacgtattcaatcttgacctgaaggatttctttcccagcatagaaattgggcgaatcctcaaacgcttcaattttcccccattcaatttaaacaaggaaaacggccgccaagaaatcggaaattatattgcatggctgtgttgcgagaatatgatggtcgaaagggagttaatgggcgagacaaaaaaagtgtttaagagagtgctgcctcagggcagcccagtgtctcccatcttgaccaacattatttgtgagaggctcgattacaagctgagcgcagttgctaaaaagttcggaatcaaatatacgcgttacgccgacgatatcactttctcaagtatgcacaacgtctaccataaagaaggcgattttcgcaaagaggtcgaaagaatcatcaaagagcagtacttcgtgatcaaccagtcgaaagttaggttgcagaaaaccaatgtgcggcaggaggtgactgggatcacagtaaattctgagacaaacgtgccaaggcggtatgttaagcagattcgtatgtggctctattactgggaaaactacggtgactccaaggcattgtctctgttcctgcagagctatatgaaggacaagagtcacattaaaaaggccgtacctacccttggttttatgacagccgtgataggaggaaaactcaattatctgtcaatggtgaaaagcgaagggaatagtacgtatctaaaactgaaagatcgctttgagataatagctgagaagcaaatcaagatttcaggcatttccgaaaataccaatgacgagaagctcaagaagtttgtctcaagcagttttaactacgattttctgtga

SEQ ID NO: 7452 - RNA, 1200 nt, unidentified
  source 1..1200: mol_type = other RNA; note = synthetic construct
atgaacaagtacatttcatcagaggataaagtgaagatcaaagagaagtttgagaaaatgagcgatctgaaagagttctgtaacttgttgaaccattgttatagcatcctgttcagtgatgagagcaactttatagatgaagagaagctgaaacgttttgcaaatcagaatagtcaaaaccggtatcactactttgagattaagaagaaggacggctctacccggattatccatgccccaagctctgagctgaaggttctcctcaagtgccttaatctgatcttccatagcatctttatacctcaccatgcctcctacggttttatatacgggcgctctattctcgacaatgcgaagatccactgcaaaaacaattacgtctttaaccttgacctgcaggacttcttttcttccatagagattggacgaatcctcaagagattcaattatccacccttctcactaaataaagacaacggccgagaaattattggtaattatatcgggtggatcgcctgcgaggaaattgatctagaggaagaagtgaacggcaaactgctcaagattaagaaaaaggtgcttccccagggctctcccttatcaccgattctgaccaacatcatctgtgagcgcctggattataaactgaccggcgtggctaaaaggttcaacgtaacttattcgcgttatgccgatgacattacgttttccagtatgcacaacgtctatcaggagaaatcgattttccggaatgaggtggaaaagatcataggggaacaatactttcgcatcaaggaaaaaaagaccaggctgcagaaacggaatgtgagacagaaagtcacaggtatagttgtgaacgaaaaggttaacgtaactaagaactacatcaaactgatcagattatggttgagcatgtgggagaaatatggcgcagaaaaggcttaccaccttttcattaactcctacataaaagagaaggggttcactaagtatatcggatctacacctgtgttcatggagaatgtcatcgacggaaagctcaattacctcaagatgattaagggagagagtaatagcacataccagtccctgagggaaagatttaataggctgtccatcaagaatgctaaaatgaacaagatcttggacttatgggaattcgagtccatcgaaaaagcaattgaatattactaccgctga

SEQ ID NO: 7453 - RNA, 1242 nt, unidentified
  source 1..1242: mol_type = other RNA; note = synthetic construct
atgaaaattaaacagtctcacatcgagcacattcggaaacaattcacagagctgcagagcaaggacgatttggtcaatctactgtccgacgcaaaaaacatactgtggggggaggaatcaactcccgtacagttaaagtcactgacatactacgcgaaccctgccctgtgcaaaaagcgctaccgaacattcacaatcaagaaaaagagcggtgctgacagaataattcacgcccccgtgaaaggtctgaagtcaattctgcgctccctcaatttcgttttccaatgcatgtacaagcctcacgaggctgccaccggtttcatccccgaaaaaagtatcgtcgataacgccaaaaaacatgtgggccatcactatgttctcaacatggacttgaaagattttttccataccttcgacctgtatagggttaagtatgggctcctgacagaagtctggggaatcaacagtataaagaagttcaaggagcataatgaggagcgatttctggagatcgataagatcgcctttttgattgcttctctgtgtactcacccatttaagatcgatggcgaagagaaaaccgttctcccgcagggatcgcccacatctcctacccttactaatatcctttgtaagaagctggactccagattgacgggcctcgcgaagagattcggggcaacttatacccgttacgccgatgatataactttttctagccctcacaatatctacaatgacgaggccttcaaccaagaactgaagcggattatcgaagaagaccagaaactcgtgattaatccaaagaaaacccgcttacagaaatccgtctataggcaggaagcaaccggactcatcgtcaacgataaggtgaacgtgaggcggaggtatgtgaaacagatacgcatgtggctatactattgggagaaatacggctatggaaaagcagaggaaaagtttaaacgggattacatcgctgacaagggccatgtgaagaacatcaatgcccacctggtaaacgtgctagacggcaaactggaatttcttaagatggtgaagggaaaggaggacgacacgtacaagaaacttaagaaaagattggacggcctcacagatagagaaagcccaattacgaagatccttaacatctgggaaaatgaggggatagaggctgctatggcaacccgtgatattaccgaggatgacttaagtactaatgggaggattattgtgattttttga

SEQ ID NO: 7454 - RNA, 1374 nt, unidentified
  source 1..1374: mol_type = other RNA; note = synthetic construct
atgaatttgctcattaaaaacatccagaggttcatctccatccagatcgagtatcaggccggagtcttcaaggtcctaaacatctttaagatgaagatcgagcaggttcacatcgaccaaattaggaagcagtttgccggcttgcaaaccaaagaagatctagccaaactgctgtctttcgcggatatcgtgttatatggtgaggctcgtaagcctgttcgcctgaaggctctcacatactatgcaaatccagccttgtgcaaaaaacgttaccagaccttcataataaagaaaaagtccggcgcagacaggacgattcatgcacctgtgaaagggttaaagtctctcctccaatcacttaaccttgtgctgcaatgcattcatgaaccccacgaggctgccaccggttttgttctggagaagtctatcgtggataacgcgaaaaaacacgtggggcatcactacgtattaaacatcgacttgaaggactttttccattcattcgatttgtacagagtgaaatttggccttttaaacgaggtctggggtataaaaacaatcagcaagtttaggaaggaaaacggcgcaagctttcaaaagatggacgaactggctttcctgatggcttccctgtgtacccacagcttcgagatcgacggagagctgaaaactgtcctgccacaggggagccccacaagtcctactatgacaaacattctgtgtaagaagctggaccgcagactcactggccttgcaaatagattcggcgctacttatactcggtacgccgacgacattaccttctcgtctccacacaatatatacgaagaagtggagaatcccgtactaaaccagaagggcgcgtacgacgattttttgagtgagcttaaacggctgattaaagaagagaaactcactatcaatccgaagaagaccagactgcagaaggccggttatcgacaggaagccacaggactcattgttaacgacaaggtcaatgtgcgccggcgctacgtgaaacagatacggatgtatcttaacttctgggagaaatatggatatgaaaaagccgagcagatctttaagcgagattacctccatgataggggaaatgtgaagctgcttaaagaggggaagctgaaagtgaattttccaaagatgaaggatgtgctgggagggaaactagagtttctcaaaatggtgaagggggtcgaagacaacacatacctgtcactgaaagatcggctcaataacctgaataccacgattgtacagaaccctattcccaagagtgttgatttgaattccgtactggaagtcttcaccagaaagggcctcatggaggccatggaactgttcaaaaagtgcaagtga

SEQ ID NO: 7455 - RNA, 1209 nt, unidentified
  source 1..1209: mol_type = other RNA; note = synthetic construct
atgaagatagaacagactcatatcgatcagattcggaaacagtttgcagaactacagtctaaggaggatttggtgaaattgctgtcaggagcgaagaatatcctgtacggcaaggagtgtaagcctgtgcagcttaagtccctgacatattacgccaatccgactctatgtaaaaagcgttaccagaccttcaccataaaaaagaagtctggtgcagacaggactatccacgcaccagtgaaaggtctgaaatccatccttcgaagcctgaactatgtgttacagtgcgtcaatgaaccccatgaagccgctaccggatttgttctggagaagagcattgtagacaacgccaagaaacatgtgggccaccattatgtccttaacatggacttgaaggatttcttccactccttcgatttataccgtgtcaaattcggactgctccacgaggcttggagtatcgggaatatttccaaatatcgggagacaaatgaacagcagtttcagcagaaggaagagctggcctttttactggcctgcctgtgcacgcaccccttcaagatcgatggggaggagaaaacagttctccctcagggctctccaacgtcacctaccctcactaacattttgtgtaaaaagcttgatcgaagattgactggtctggctaacagatttggcgctacttacaccagatacgccgacgatattacattttcgagcccccacaatatctacaccaatggagaattcaacaaagaactgaagaggattattgaagaggatcagaagctcgtgatcaatcccaagaaaacccggctgcaaaaagcgggctatcgccaagaggccacagggcttatagtcaacgacaaggtcaatgtgcaccggcgctatgtgaagcaaatcaggatgtggctctactactgggagaagtatggcaacgaaaaagcagagcagatctttaagagggattacattgccgataagggccatgtaaagaatatcaacgcacacctggttaacgtgctggatgggaaactcgagttcctgaaaatggttaaaggagtgaacgacagaacgtatattaaactaaagaaccgctacgacaaactcacagaaaaggacagcccaataaatcaactgcttgacatttgggacaccgacgggatcgaccaagctatgagtatctattacaaggacaaactcgagtga

SEQ ID NO: 7456 - RNA, 1191 nt, unidentified
  source 1..1191: mol_type = other RNA; note = synthetic construct
atgaagattgaacaggcacacattaatcagatacgacaacagttcgcagagctgcagtcgaaagaggatctggtgaaactcctgtcagaggccaaaaatctcctgtatggggaaaaatgtaagcccgtgcagttgaaaagcctcacctactacgctaatccagaattgtgcaagaagcggtaccagacatttacgatcaagaaaaagtctggcgcggatcggactattaactcccctgtgaaggggcttaaatcaatcctgaggagtctgaactttgtgctccaatgtgtgtacgaacctcatgaggctgccacaggttttgtcctggaaaagagcattgtggacaatgcgaaaaaacatgtcggccaccactatgtgctcaatatggatttaaaggacttcttccatacattcgatagaaatcgtgtgaagatgggattcatctatgaaccattcaatttaagtggggacaaggaacccctcgctttcctgctcgcaagcctgtgcacccacccgtttgaaatagatggtaaagagaagacggtgctgccccaaggcagccctacctctcccaccttgacaaacattctttgcaagaagttggacagacgcctaaccggcctcgccaatcggtttggtgcaacatacactagatacgccgacgacatcactttttcttcccagcataacatctataccgacgaggtatttaacaacgaactaaaacgaatcatcgaggaggaccagaagttaatcataaatccaaagaagactcgcctccagaaggccggctatagacaagaagccaccggtctgattgtgaacgacaaggttaacgtacacaggaggtatgttaagcagattcgtatgtggctatactattgggagaaatatggatacgagaaggccgaacagattttcaagcgggactacctggtagataaagggaatgtgaagaatttgaatgctaaactggagaacgtcttggacggaaaactggagttcctgaagatggtcaaagggatcgaggatgttacatacaagggcctgaaagagaggtttgatctgcttaacggcatcaaagtcaagaaagagaacgagaaaatcgatcttgagaacgttgtcaacactatcctgaataagggacttatagaaggaattaacctttacgatcgctataaaaagtcctga

SEQ ID NO: 7457 - RNA, 1191 nt, unidentified
  source 1..1191: mol_type = other RNA; note = synthetic construct
atgaaaatcgagcaggcccacatcgatcagatcaggaaacagtttgccgagttacagagcaaggaagagctagtgaagctgctgtcggatgccaagaatatgctttacggcgaggagtgcaagcctgtgcaactcaagtccctgacatactatgctaatcccaccctctgtaagaagagataccagacattcactataaagaagaagtcaggcgctgaccggattattcatgcaccagtgaaaggtctgaaatcaatactgagatccctcaactttgtgctgcagtgcgtatacgaatcccatgaagcagctactggatttgttttggagaagagtatcgtggacaacgccaagaaacacgttggacaccattacgtcttgaacatggacctgaaggacttctttcacacattcgaccgtaacagggttaagatgggctttatttacgaaccgttcaatttgaacggggacaaagagcccctcgcctttctgcttgcatctctctgcacccaccctttcgagatcgatggggaggtaaaaacggtgcttccccagggatcccctacgtcacccacactcacgaacatcctgtgtaagaaactcgatagacgtctgacaggcttggcaaatagatttggggcgacttatacccgatatgccgacgatatcacctttagcagcccacacaatatctataccgacgaggagttcaataaggaacttaaacgcattatcgaggaagaccagaaactcataattaacccaaagaagaccaggctgcaaaaagccggctaccggcaagaagcaactgggctcattgtgaatgacaaggtcaacgttcggcgccggtatctgaagcagattaggatgtggctatactattgggagaaatacggttacgaaaaagccgaacagatcttcaagcgagactatattgctgataagggacatgtcaaaaacataaatgcgcatctggtcaatgtgctggacgggaaacttgaattcttaaaaatggtcaagggtacagaggatggcacctacaagaggcttaaggaacgcttcgataacctgaccggcttcaaagagactaaagatcaaagcaaaatcgatttgagtagtgtgctgaatactttagtgaaccagggactaaacaaagctatgtctctgtattctcgctttaagaatcagtga

SEQ ID NO: 7458 - RNA, 1212 nt, unidentified
  source 1..1212: mol_type = other RNA; note = synthetic construct
atgaagatcgagcagattcacatcaaacaaattaggaaacagttcgcagagcttaagagcaaggaagatttagtcatcctgctgtccgacgcaaaaaatatattgcactcagaggagtgtaaacccttccagctcaagtctctgacttactatgctaatcccaagctgtgcaaaaaaaggtaccagacttttacgattaagaaaaagagtggagccgaccggaccataaatgcacctgttaagggacttaagagcatactcaggagcctcaacttcgtgctgcaatgtgtatacgagcctcatgaggctgccacaggtttcgtcctgcagaagagcattgtggacaatgctaagaaacatataggccatcattatgtccttaacatggatttgaaagacttctttcacacttttgaccggaatagagtgaagatgggatttatctatgccccattcaacttaaatggggataaggaacccctggcctttctgcttgcgtcactctgcacccacagttttggtattgagggggaagtgaagactatcttaccacaggggtcgccaacctctccgacattgacgaacatcctctgctccaagctggacagacgcctaaatggtctggcaaatcgattcggcgccacttatacaagatatgccgatgatatcacattttcttccccccacaacatctacaacaatgaggatttcaacaaggagctgaaacgcattattgaagaggatcagaagctggtgatcaatcctaagaaaacccggctgcaaaaagctgggtttcggcaggaagttaccggactcattgtaaacgacaaagttaatgttcagcgccgatatgtcaagcagatcagaatgtggctgtacctgtgggagaagtggggctatgaaattgcccagcaaaaatttttgaacgactacattgtggacaaaggccacgtgaagaatatcaacgcccatctagtcgatgtgttggacgggaaactcgaattccttaagatggtgaaaggcatagaggacggcacctacatgggtctgaaacaaaggttcgatcgtctggtgggagtaaccgatcctattaaccagctcctagatatctgggaaaaggctgggatcgaatccgcgatgaacaactactacaagaacgagacaacaagtcttgacaaaggctcttcaaatatcgaagacctcttcaagtga

SEQ ID NO: 7459 - RNA, 1191 nt, unidentified
  source 1..1191: mol_type = other RNA; note = synthetic construct
atgaaaatcgaacaggcccatatagagcaaatcaggaagcagttcattgagttacagtccaaggaggacctggtgaagctgctctctgatgccaaaaacatgatgtacggagaagtttgtaaaccgatccagctcaaatctctaacctattacgccaacccttcactatgtaagaagcgttgtcaaactttcactattaagaagaagagcggcgccgacaggaccatacatagccccgtgaaaggtctgaagtccatacttcgcagcctcaatttcgtcctgcagtgcgtgtacgagccccacgaagcagcaaccggattcgtccttgagaaatccattgttgacaacgcgaagaaacacgtgggtcaccattatgtgcttaacatggacctcaaagatttctttcataccttcgaccgaaacagagtaaagatgggctttatgtacgaaccttttgctctgaatggtgataaggaaccactggcgtttcttctcgcaagcttgtgcacgcaccccatcgaaatcgaaggggaaggcaagaccgtccttccacaggggagtcctacctcacccactgtgacaaacattctgtgcaaaaaactggatcgaaggctgaccgggttagccaatcgctttggcgcaacatacacaaggtatgctgacgacatcacctttagttctccgcataacatttatacggacgaggatttcatcaaagaattaaagcggatcattgaagaggaccaaaaactggtgattaaccccaagaagacgcggttgcagaaaacaggacacagacaagaggttacaggcttgatcgttaatgataaagtcaacgtgcacagatcgtacgtaaaacagatcagaatgtggctgtactattgggagaagtatggctacgagaaggccgatcagatattcaagcgcgattacattgctgacaaaggtcacgtgaaaaataagaatgcccacctggacaatgtgctggatggaaagctagagttcctcaagatggtcaagggcattgaggatcggacttttaaggggttgaagaaacggtttgacaaattgactgggatgaacgatcctatgaatcagctcctcgatctgtgggagaacaaaggaatcgaagacgctatgaagaattattacaagtccccaccagagatgactatcatattcacactgtga

SEQ ID NO: 7460 - RNA, 2157 nt, unidentified
  source 1..2157: mol_type = other RNA; note = synthetic construct
atgaagattgagcaggcgcacattgatcaaatacggaaggaatttgccgaactccagtcaaaggaagacctggtgaagctgctgagcgatgctaagaacatgctatacggcaaagaatgcaagcccgtgcagctcaaatcgctgacctattacgccaatcctaccctgtgtaaaaagagataccagacgtttaccataaaaaagaagagcggggcggaccggactatcaacgctccagttaaaggtctgaagtccatcttaaggtccctcaactttgtgcttcaatgcgtgtgcgatcctcacgaagcagctaccggcttcgtcttgggcaaatctatcgtagacaacgcaaaaaaacatgtcgagcaccattacgtgctgaatatggacctcaaagattttttccatacgtttgataggaacagagtgaaaatgggttttatgtacgagccatttaatctcaacggcgataaagaacctctggccttccttctggcctctttatgcactcaccccttcgaaatagatggcgaggtcaagactgttcttccccagggaagtcccaccagccctaccttgacaaatattctgtgtaagaaacttgacaggcggttgaccggactggccaaccgctttggcgcaacttatacacgttacgcagatgatataacattcagctcccctcacaacatatacaccaatgaagcctttaacaaagagctgaagcgcatcattgaggaagatcagaaactcgtcatcaatccagagaagacacgtctacagaaggccggatataggcaagaagctacagggctcattgtgaatgacaaggttaacgttagacgtaggtacgtcaagcagattcgcatgtggctttattactgggagaagtacggatatgaaaaagcgcagcaaatctttatcctggactatacaacagataagggacatgtgaagaaggggaagccaaatctggccaatgtgctcgatggaaagctggagtttctgaaaatggtgaaaggggagaatgacagcacctatgagacactgaaaaaaaggttcgacaagctctatgtgatcgagaactccttctcaaaggtacttgacatttgggagaacgaagggattttgaagaatactgacaagaatacaggtcagaagacatcagaacacattatacataacccgaaacacattactaagtttctgagacagttcaaagagaatactgacttgaagtggactacccatagctgggataacatcaaatatgccagtatagacgactttatcaacgcccttaacgaaaataagaaggagttcaatcggctctataaacataaccgggacttgtataatctcatccagtatttcatctaccagccgaagtcaaatccgatcgagaatggcattcctaaatatgggtgggtgaaccttcaagcaatgaagtttggttggcagttcccagacaataagtttctgttgtggtgtaaggagaactacgataataaaagttacgacgaacggaagaaacctttccagtacttgctacccaaggaacttcgaccctccaaaaccgtaaaaggaaaggagatcaaatacttccaggatgtggtcgagatctttaagacggaaattcagtttcgagaagagtacctgtataaagagatccgcaaacgcatacacagaatttctgacttcaattttagcggcttagatgagctgaagaaactggacttctatacctatacccccggcgttttatccgcaatcgaccacatcttcgagcaaattaagcgaaatgagactgctatcgacatcaacatttcatacatcattcacaaccagaagatcatcctcagtattacacagatcaattccttcccctcgaaagagctggatattaacaacacgaagtctttcttagggggacatctgaatgccatagctgaaagcctgttcagtctcgctgatttctctattgagagcaactttaagtacaacggtaagatcatcccaggcgaattgcaaatcacctacgaaaacatgataggcaagagagtcgcttccaacattaccctaacccaggagccaattttcatcgagtctaataacaaactgcctgggttcacttacaaactgacattctacatttga

SEQ ID NO: 7461 - RNA, 1170 nt, unidentified
  source 1..1170: mol_type = other RNA; note = synthetic construct
atgaagatcgaccagtcccatattgaccatataagaaaacagttcgcagacctccagagcaaagaggagctcgtcattttgctctctgaggctaagaacttgctgtatggcgaagaatgcaagccggtgcagctgaaaagtctgacttattacgccaatcctgaaatttgtaagaaaaggtaccagaccttcactataaagaaaaagagtggggccgacaggacaatcaacgcccccgtgaagggtttgaaatcaatcctgcgaagcctgaactttgtgctccaatgcatctacgagccacacaaggccgccaccggttttgtcagagataagtccatcgtagacaatgcaaaaaaacacgtcggacatcactacgtgttcaacctggatctgaaggacttttttcattcctttgataggaatcgggtgaaaatgggcttcatctatgaacctttcaaccttggaggtgacaaagagcccctggcctttctgctcgcatccctgtgtacacaccccttcgaggtggacggagaacttaaaaccgttcttccacagggcagccctacgagcccaacattaaccaacattctgtgcaaaaagctggaccgccggctcaatggcctagccaaccgcttcggtgcaacattcactcgctacgctgatgatatcaccttcagctcaccacataacatttataacgacgaagcattcaacaatgagctgaagcgtataatcgaggaagatcaggagctggctatcaatcctaagaagacgagactacagaaagaaggctacagacaggaggctactggcctcattgttaacgagaaagtcaatgtgaggcggaagtatgttaaacaaatccggatgtggttgtactactgggagaagtatgggtacgagaaagctgagcaaatttttaagcgtgactacatagccgataaggggcacgtaaagaataccaatgcccaccttatgaatgtgcttgatgggaagttggagtttttaaagatggtcaagggaggcaacgattcgacttatctaacactgaaaaatcgcttcgaaaagcagattggattagcggctcccatctcttctgtgctcaacatttggcaaaatgaagggatagaaaaggcgatgaaaatctttaaccagctgcagcgaaattga

SEQ ID NO: 7462 - RNA, 2154 nt, unidentified
  source 1..2154: mol_type = other RNA; note = synthetic construct
atgaaagtggagcaggaacatattgaccagattcgaaagcaatttgctgagttacacaataaggaggaactgatcaatttgctgtcctacgccaagaacatgttttatggagaggagtgtaagccagtccaattaaagtctcttacgtactatgccaaccctgaaatctgtaagaagaggtatcagactttcacaatcaagaagaagtcaggagccgatagaactattaatgctcccgtaaacggccttaaaagcatactcagatccctgaacttcgtgctgcagtgtatgtatgaacctcatgaagtggccaccgggttcgtaatggacaagagtatcgtggacaatgcgaaaaagcacctggggcatcactatgtgctcaatctggatctcaaggacttcttccacacttttgatagaaatcgcgtgaaaatgggtttcatatatgagccattcaatcttagcggtgataaggagcctctcgctttccttttggcttccttatgcacacacccatttgaaatagacgaggagctgaaaactgtactgccccaggggagtcctacctcccctacccttactaatatactctgcaagaagctagatcgccgacttaatggcctggccaatcgattcggcgctacatttacccgttacgccgacgatatcacgttcagcagccctcataacatttataacgacgaggcgttcaataatgagctcaaaagaattatcgaggaagaccaggagctcgcaatcaatccaaaaaagacacgcttgcagaaagccggctaccggcaggaggtcactggactgatcgtgaacgagaaggtaaacgtcggccgacgttacgttaaacaaattcgcatgtggctgtactactgggaaaagtacggatacgaaaaggccgaacagatttttaccagggattacattgcagacaaagggcatgtgaagaaaggaggcgccaacatggctaatgttttagacgggaagctagagtttttgaagatggtcaaaggcgcagctgacacgacatatctgggattaaagggaagactggataaactggtcattaatcaggacaccaacaaaactgagatcgccgaactgaccaacaagggtctgaggttctccaatgagaatgaggtgttacacgacccggacttcgtggtcaagcgtctaaagcagtttacgatagaccctattatgaaatggacaacccacttttgggatatccccacagaaacggataccgatgttcactcactaagggacattgctgatcacttcgccgcagtgaacagtcggttcgacgaatttgttgcacttcagaaatacaacaacaacctgtggtggaaagtgatctatcccttcatcttccagaaaaaaccaaaaaagaacgagaacaaagacaacccttatcggtggggggagtataacctccatattggctggcagtaccccaaatttgttgcagaatggtctaaagataactacgatatcccccctcccgcgctgaagaagactccctttgagatgcccttgccaagtgagctcataacagacctcgccaatcagaagtatcgggaactatttggaaaggagattcggtatttcggtgatgcgattcaaatgttcaagagagagattgaattccgcgaagacaccaaagatctctactacgaggtcaaagtgctggcaaggcaggagctgaccgaattttcagtgaatggcttggagtcgcttaaacagttgagcttttttacctacactgctccagttctgaaagccatcagacgcatctttcggatgatccaatctcgcaccgaacagagagaagtgatcattgagtgcaaaaagctcactgacctgaggctcatcgagctgaggataatccacaaaaactctctgtcgcacagggaaagcaccgatgataagataacaaaaccatctggtgacctgcttgaagtcatcaagaatctcattagcatctgcaatttcgagatcgaatcctcttttaacgacgggattttccggatcacatatctgcgaccgaacacaaacgtgataaagctcaatcatttgcggcccctgaagcaatccctggattcactgcatggcttcacctacgtcttgaagtttccgatctga

SEQ ID NO: 7463 - RNA, 2208 nt, unidentified
  source 1..2208: mol_type = other RNA; note = synthetic construct
atgaagatcgaccagacccacattaatcagattcagaaacagttcaatgagctggagtcaaaggaagacctggtgaaactcctaagtgatgctagaaatatgttatacggccaggaatgcaaaccctttcagttaaaggcccttacatattactctaacccgaaggtctgtaggaagcggtataagacctttaacattaagaagaagtccggagctgaccgcacaataaatgctcctgtgaaaggattaaaggccattttacgaagtttcaactttgtcctgcaatgcttgtataaacctcacgagaatgccattggattcgtgcttgacaaatctattgtggacaatgcccagaaacatgtaggccatcattacgtactcaacctagacctgaaagacttctttcattccttcgacaaaaaatgggttaagtatggcttgatgtctcccccatttaatctgcacggtgataaggagcccttagcgtttcttctggcttcactcgttacgcacccattcgaggtggaaggcgaggtaaaaaatgtcctgccacaggggtcgcccacttccccaacactgaccaatatcctgtgtcagaagttagaccgacgcctcaacggtctggcaaataggtttggggccaccttcacaaggtacgcagatgatattacgttttcaagcccccacactatttataacgacgaggcttttaacaacgagcttaagcggatcatcgaagaagaccagaagctggcaattaatcctaagaagactagattgcagaaagctgattataggcaagaagcaacaggcctcatagtgaacgataaagtgaatgttaggcgcagatacgtcaagcagattcggatgtggctgtactattgggaaaagtatggatatgaaaaggccgagcaaatatttaagcgtgattacatcgccgataaaggtcacgttaagaatatcaacgcacacctggttaacgtcctcgacgggaagctggagtttctcaaaatggtgaaaggcatagaagacggcacctataagggtctaaaggaacgttttgacaagctgactcagtcatacccttcccccaccatacttaagctgagcgatgacaatcagaatcgaatgttggagaatgaaaccgtgtccataagcaatggcacacccagtgagctgttgaacaacaacaagatcaacaacatcgaattgatcgtgcgccctctcggaaactccaccgtggaggaacttatggtcgacaaatacctcgtcaaggggctgaaattgcctcatattgaaattttcgagaaccctgacaaatacaagccatcactgccgcataacccggagcagactacgatcctgctcactgaattcaagaatgatgggagcggattcaaagaattggtgcacaagcctttcgatgagattaccccatacaaggtgctcgaggaggtgaaaaaccacccaaacttctcagagtacttcaaaaagggtaggaaatccggctttaagggtaatataaatagagaagtgcagaactcggtgattggccttatcaatagctttgaacggatcggaaatatgcattgggatcagttcaaagagtatcctttcggggagcacggctcctcagagtacaccacctatgccatgaacttcaaaaagaactaccgcttcggacccagacaagacggctacactagtctggaggaactgatccggtttaccttccttaaagagatcacacgcttcgacagtaaactgatcttccttccagatgataggcgatttaacctgagagggtctttttacacgtgggttcccagcgtgaaaaaaggactcgagttcatcgcccaaggtataaacgaacatagcaacatttgcggctctagctctttttccacgaaggaaatttactttgagctacgtcgggatacctttctgaacactatctccttgctaattaccgatagtgatagcgtcgcgaaaagacccgcggaggacatcctgaaagatctgcggctgagcgaggtcttcaagaagtatttcaggtctatatgtgactggactatctatctcaagaatgaggacggaaatttccaactccgcgtactgaagagaatccaggacacagggaaggaggatatcatctctatcgaagggacaaaggggtttacacacaaaattacattctacggcacttga

SEQ ID NO: 7464 - RNA, 1170 nt, unidentified
  source 1..1170: mol_type = other RNA; note = synthetic construct
atgaacatcgaaccattccagaaagagcagatcagaaagaactttgccgagctgcagaataaggaagatttggtcaatatactgagcgatgctcagcgaatgctgtatggcgaaaactgtaaggacgtgcagttaaagtcactcacctactacgccaatcctgagatctgcaagatgcggtatcaaactttcaccattaaaaagaagagcggcgccgacagaacaattcatgctccagtgaagggtctgaaatccatcctgcgctctctcaattttgtgttccaatgtattagcgagcctcatgaagccgccactgggttcgttctggacaagtcaattgttgacaatgcgaagaaacacgtcggaaatcactatgtcctcaatatggatctgaaggattttttccactcttttgatcggaatcgcgttaagatggggttaatgtacgagccgttctctttgggaggcgataaagagcctctcgctttccttctggcaagtttgtgcacacaccccttcgagattgacggggaggtgaagacagttctaccccaggggagcccaacttcgcccacgatcactaacatcctgtgcaagaagctggataggcggttgaatggccttgcaaacaggtttggggccacctttacaaggtacgcagacgacataacgtttagttcccctcataacatttacaacgatgaaaccttcatcaaggaactcaaaagaataatcgaggaggaccagaacctcgtcatcaaccccaaaaagacccgattacaaaaagcaggttatagacaagaagccaccgggctgatcgtaaacgataaagtcaatgtgagacgtcgctacgtgaagcagattcgtatgtggctttactactgggaaaagtatggctacgaaaaagccgaacagatattcaagcgcgactatatggctgataaaggccatgtgaagaacgtgaatgcgcacctggtgaatgtgctagacggaaaactggagtttcttaaaatggtaaagggatccgaggatggtacataccagaggctgaaagagcggtttgacttcttggtcggttttaccgaaccaattaacgacgtactcgacatctgggagaaatatggcattgacaaggctatggatgtgtattacaaaaacaaacttggatga

SEQ ID NO: 7465 - RNA, 1197 nt, unidentified
  source 1..1197: mol_type = other RNA; note = synthetic construct
atgaagattgaacaagctcatatcgatcagatcaggaagcagttcgcagagcttcagagcaaagatgacctggtgaaactgctgagtgacgctaagaacatgctgtactccgaagagtgtaaaccgattcagcttaagagtctgacttactacgctaatccagtgttgtgcaagaagcgataccagacctttattatcaagaagaaatctggagccgaccgtatcattcacgcgcccgccgagggccttacctccatactcagagcactgaatttcgtgttgcagtgcatgtatgtaccccacaaagctgtgaccggtttcgtcttggaaaaatccatagttgacaatgccaaaaaacatgttggccatcattacgtcctgaacatcgacttaaaggatttctttcacagcttcgataggaatagagtgaagatgggatttatgttcgaacctttcaatctgaacggagataaggaacctctggcctttctcctggcctcattgtgcacacacccatttgaaatcgacggagaagtgaaaactgtactgccacaaggttctcctacaagcccaaccattaccaatatcttgtgtaaaaagctggaccggcgtctaaccgggctcgccaatagatttggtgttacatacactaggtatgcggatgatatcactttttcgtctcctcacaacatttacaacgacgaagcattcaacaaggagctcaaaaggattatcgaggaggatcagaagctggtggtcaatcccaagaagacgcgactccagaagactgggtaccggcaagaggttacgggcctaattgtgaatgataaggtcaacgtgcggcggcgctatgtgaaacagatccgcatgtggctgtattattgggaaaaatatgggtatgccaaggcagaacagatatttaagcgcgattacgtggcagataagggccatgtcaaaaacatcaatgtccacctcgtgaacgtactggacgggaagttagagttcctcaaaatggttaagggcacaaaagacgagacatataaaaagctgaaggagagatacgagaaccttgctgaagaaataaaccccatttcacaacttctcaatgtctgggagaaggagggcatcgagaaagccatggaagtgtactatgacaaagaggagaacagcaacattttaatcgaggacctattctga

SEQ ID NO: 7466 - RNA, 2178 nt, unidentified
  source 1..2178: mol_type = other RNA; note = synthetic construct
atgaaggttgataaggtccacattgaacagctccgaaagcagttcgcggagatgcagtcaaaggatgatttgcttaaactcctgaacaacgcaaagaagatgctgtatggagagaactccatgccattccagaaaaagagcctgacatattacgccaatcccgacctatgcaagaagcgctaccagacctttaccatcaaaaagaagagcggagaggatagaataattcactcacccgtgagcggccttaagtccatcctcagggtgctgaacttcgtgttgcagtgcatttacgagccacataaagctgccactggctttgttctgaacaagtccattgtggacaatgctaagaagcatctgggacaaaactacgtctataatatcgatctgaaggacttctttcatagcttcgatcggaacagagtgaagattggttttatgtatgaaccgttcaatcttaagggggacaaagaatcactcgcatttctgttggcctgtctctgcacgcacccactagaggtggacggagagatcaaaacagtgctgcctcaggggagtccgactagtccgacactgacaaatatcctgtgtaagaagctggataggcgtcttacaggactagctaagcggtttggcgccacgtacacccggtacgctgacgatataaccttttcctccctgcacaacatctacaaagatgacgactttatcaaggagctcaagcgcattatcgaggaagaccagaagctcgtgattaatcctaataaaacgcggctccagaaggccgggtatagacaggaagctacgggtctgatcgttaacgagaaggtaaatgtgcataggcggtacattaaacaaattcgcatgtggctctattactgggaaaagtatggttatgagaaggccgaacagatcttcaaaagggactacatcgccgacaaaggtcatgttaagaatatgaatgcacacttggtgaatgtgcttgacggcaaattagaattcttgaaaatggttaagggcttcaaagactcaacatatcagggtctgaaaaagcgctttgacagattaactaaatctgagaaccccatagaaaataacgagataattgagcagaaccgtactcaggaacatctgaatgtcctttctgaggacaaaaaggccatattccatgaccctaaacttgtcatcaacaagctggagcaattcacatctgatccaattatgaaatggctgacccacttctgggatacaagccctgatatcaattctgagagtaactccagtaccgagaactattttaaagccgttaatagccgatacgaagaattcgtcttcttacagaaatacaacgccaatttatggtggaatgtaatctatccattcgtgttccaaaagaagatttcaaccaataaagaggggaaagaaatcccctttaaatgggggaaatatggcatcaaaattgggtggcaatatcccgactcagtgattaactggatagtagagaattacgataacaagcctcacgcattaaaaaaaaccccctttgagatgtccataagcgacgatctcgtctctgcggaagcgaaccagaagtaccggctgatgtacggcaaggaaattcgtttctttggcgacataattaaccttttcaagagggagatcgcatttcgcgaagaaaccagggatttttattacgagatcaacaacttggtactacaggaactgcgagaatttaaagtgtctggcctcgagacacttaagtacgagagctttactgtgtataccgtgccagtgttgaaagctatcagaaggatcttccgcatgattcagaccagaactgagaatagagaagtcgaaatctcttgtaaccgactgtcgaatcaaaacctcatactgttgaagataatccacattgggagtcatcccctcaagaatagcgagcacagtaaattcatgaaaccttcgggagatctggaggaagtaattaagccactgatttccatctgtgacttcgaggttgccgcacactttactgacggagatttcgtgctgaagtatctgtaccctaacgtcaaaattagccacgagaattcccaattccacatcgctgagatcaaaaaggaggattgcatcgtcaaaggctttacttacatcttgaagttttacctgccctga

SEQ ID NO: 7467 - RNA, 1191 nt, unidentified
  source 1..1191: mol_type = other RNA; note = synthetic construct
atgaagatcgaacagcagcacatcgatcacattcggcagaggttcgccgagatgcaaactaaggaggaactggtgagcttgctttctgacgctaagaatattatgtatggtaaggagtgcaaaccctttcatctcaaatctctgacctactacgccaaccccaaattatgcaagaaacgctacactaagttctccatcaaaaagaagagcggaaaagagagaattattaacgcaccagtgggaggcctgaagagcttactgcggagtctgaactttgtcctacagtgtatttacgagcctcaccacgcagccacaggctttgtcctggacaaatcaatcgtggataatgccaacctgcataccggcaaccataatgtgtataacctggacctgaaagactttttccactcattcgatcgcaatagagttaagatgggttacatctacgagcctttcaatctcgggggggatagggagcccctggcctttttgcttgctagtctctgtacacatcctttcgaaatcgagggggagatcaagacagtactcccgcagggaagccccactagccctacaatcacgaacatcctctgcaagaaactggacaggcgtttgactggtctggccaaccgctttggagctaagtactcccggtacgcggatgatataaccttctcctctccacataatatttataaggacgaagagttcctgcgcgaactgtcgcgaatcatagaggacgaccagaaactcgcaattaacccagataagaccagactgcagaaggccggctatcgacaggaagtgacagggttaatagtcaacgaaaaagctaatgtgaggaagagatatgttaagcaaatccgtatgtggttgtattactgggagaaatatgggtacgagaaagcacagcaaattttcaaacgggattatctgaccgacaaaggtcacgtaaagaaaggcgaaccaaacttcgcgaatgttcttgacggcaaactagagtttctgaaaatggtcaaagggctcgaagattcaacctataagacactaaagaagaggtttgacaagcttactgatgtgaaggaaaaaacgcagcaagaaaaagtggatctcgatgctgtcatagacaccatcattaataagggccttgaccagggaatatccttgtacgacaagtacaagagtacctga

SEQ ID NO: 7468 - RNA, 1230 nt, unidentified
  source 1..1230: mol_type = other RNA; note = synthetic construct
atgaaaattgaacagcagcatattgatcagatccggcaaaagtttgcttcaatgcaaaacaaggcagatttggtgtcactgctgagtgaagccaagaacatactgtatgggaaagaatgcaagccattcgaacttaagtccctgacctactatgctaacccagacttatgtaagaaacgttacgcaaagttcactatcaagaaaaagagcggcggcgaaaggacaatcaacgcacctgtgagcggactgaagagtattctacgctctctaaatttcatcttacagtgcgtctacgaacctcacaatgccgccacaggattcgtcctgggcaagtccatcgtggacaacgccaaagttcacgtgggcaatcatcacgtgtacaatctggacctcaaagacttctttcatagttttgataggaaccgcgtgaaactgggatttatttatgagcccttcaacctcaatggtgaaagagagcctttagcctttttgctggcgtcgctgtgtacacacccgttcgaagtgaacggtgagataaagaatgtgctacctcaaggcagccccacctctccgactatcacaaatatcttgtgcaaaaagctcgaccggcgactcactgggctcgctaacagatttggggcaaagtacacgcgctacgcggatgatatcacattctcctctccacacaatatctataatgaagaggagttccagaaagagttggaaaggataatagctgatgacaatcttctcaagattaacggaaagcagaaagagatcggaccccagttgaacattaacaccgacaaaacccgtttgcagaaatcagtttaccggcaggaggtaaccgggctgatcgtcaacgagaaggtgaatgttcggcagagatacattaagcaaatcagaatgtggctgtactactgggagaagtatggctatgagaaggctcagcagatttttaccagggactacattactgataagggacatgtaaagaaaggcaaacccaaccttataaacgtgctcgatggtaagctggagttcctcaaaatggtcaagggggccgaggattccacgtatctgactctgaaaaaccgatttgacaaacttccacaggtaaaggagaagattcaaagcgaaaaagtcgacctggacgccgtgcttaataccctgatcaataaagggcttaatcccgccatggttctctatgatcgctataaaaatggctga

SEQ ID NO: 7469 - RNA, 1209 nt, unidentified
  source 1..1209: mol_type = other RNA; note = synthetic construct
atgaagatcggccacgaacagactgaacgtataaggaaacagttcaagaatcttcagacacggcaggacttggtggatctcctgagtgaggcaaaggacatgatgtacgaagataagacgaaaccctttaagctaaaaacactgacctattacgcaaaccctgaaaactgtaaattccgatattccaccttcttcgtgaagaaaaaatctggcggccagcggacaatacacgccccaacaaaggggttgcgttccgtgcttcgcagcctaaactatgttctccagtgcatgcacgtcccgcatcaggctgctacaggtttcgtgcgcgatagaagcattgtggacaatgcgcaaaaacatgtcggccaccattacgtgcttaatctggacctgaaggacttctttcattcctacgatagaaacaaggtcaaactggcctttatgtactcaccatttaatttaagggggtgtaccgagaaggagaaattggccttcttcctggcttgcctctgtactcacccttttgagattgaaggagcaactaaaactctcctcccccaaggctcgcctacaagtccgactatcaccaacatactctgcgaacgcttagatagaaggctgacgggattagcgaacaggtttggggccacgtataccagatatgccgacgatattaccttcagctcaccccataatatctaccaggaggaaacaaatccctccctgaaccctaaggggagctacgagaactttcgagccgagcttgagcgactgattgaggaggagaagttgactattaacccaaagaagacccggctgcaaaaatctggctatcgccaagaagccaccggactcatagttaacgagaaggttaatgtgcggcgccggtatgtaaagcagattagaatgtggctttattactgggaaaagtatggttacgagagagctgagcagatctttaggtctgattacatgatcgacaaggggcacgtcaaaaaaggcaagcccgacctaatgaatgtcctggatggaaaactggagttcctgaagatggtgaaaggtaaggaagacggaacctacaaggggttgaaagaaaggttttacgaactcattggacacgaggacccaatcaaccgggtgctgaatgtatgggagactgaaggcatcgatcaggcaatcaatatctattacaaggacaaactggagtga

SEQ ID NO: 7470 - RNA, 1230 nt, unidentified
  source 1..1230: mol_type = other RNA; note = synthetic construct
atgaagatcgatcctcagcacatcgcccaagtcaggaaacagtttgagaatctccagagcaaagaggacttgctccagttactgaacgctgcgaaaaaaatgatgtatggcgaaaagttcaagccactggagcttagagcactcacatactacgctgatcctaaactttgtacacgaaggtacagtaagttcagcataaagaaaaagtctggcggtgtgcggacaattcacgcccccacgaatgggcttaagtccattttgcgctcccttaactttgtgcttcagtgcattcatgaaccacacagaaccgctactgggtttgttctggacaaatctatcgtcgataacgcaaagaatcacgttggcaaccactacgtgctgaatctggacttgaaagatttctttcattcgttcgacaggaacaaggtgaagttggcattcatgttcacaccttttaatctgggcgtttctaaggaaaaagagaagattgcattcctcctcgccagtctgtgtactcatcctctagaggtggacggtataacgaaactggtgttaccccaagggtcccccaccagtccgactatcaccaacatactctgcgagcggttggacaggagattaaacggactggcaaagcggtttggtgccaactacagccgttatgccgacgatatcacattcagctcaccacataacatttaccacattgaggataacccctccctgaatcagaaaggacgttttgataatttccgcgccgaatttgggcgcctaattgaagaggagaaattgagcatcaatccaaaaaagaccagactgcagcgatccggcttcaggcaggaggctactggactgattatcaacgacaaggtgaatgtccgccggcagtacgtgaaagagctacggatgtggctttattattgggagtcttatggctatgaaaaagcggaacaaatatttaagcaggattacatggccgacaaaggccatgtgaagaatatgaatgcccacctcgtaaatgtaatcaagggaaagctggagttcctgaaaatggtcaaaggaaatgaggacgggacctacaaggggctgaaggaaagattttcaaagctcgatctggctaagggcaagcaagattttgaaaagatcgacttagaaaccgttgtcactaccattctgaacaaaggactcgacgagggtatcaacctgtatgaacgattcaagaactcatga

SEQ ID NO: 7471 - RNA, 2157 nt, unidentified
  source 1..2157: mol_type = other RNA; note = synthetic construct
atgaagatagaatacaagtacatcaaacagatcaaggaacagtttgccaatatacagaacaagcaggaccttgctaacttactgtcgtttgccaataaaattctctacggaaataagagcaagccaattaagttaaacgccttaacctattacgccaatccctctatttgcaaaaaccggtactacagtttctcaatcaaaaagaagtccggtgataagcggattatccatgctccgtcaaaaggactcaagactatcctgcaaacactcaattttgtgttccagtgtctctattcaccaccaaaggtggctactggcttcgtaaccggcaaaagcattgtggataatgctaggaaacacgaaggacatcggtatatcctcaatttggacttgaaagacttcttctattcctttgacaggaatagggtgaaattggcgtttatgtatgagcctttcaatcttatcggcgagaaggagccactggcctttttactggcttccctgtgtacccatcctatcgaagttaacggtgaaacaaaggttgttttgccccaagggagccccgcatctcctattttaactaatatcctgtgcaagaagctggaccgacgtctaaacggattggctaaaaggtttggggcctcttactcccgttatgcggacgatatcacattcagctcgcagtacaacttctacaataacaaagagttcgtagacgagctgaatcggatcatcgagatcgaccagaaacttaacataaattccaagaagatccggattcagaagtccactttcagacaggaagtcactggactgattgtgaatgaaaaggtaaatgtgcgccgccgctatattaagctcattcgcatgtggctctattattgggagaagtacggctatgacaaagcagagcagatatttcaaaaagattacatcgcggacaagggacatgtcaaaaaaggcaatgccaagctaatcgacgtgctgaaaggcaaactggcattcgtcaaaatggtgaaggggtacgaggacactacctatcagaaattgaaaaagcgatttgacagcctcataaaaaacaagatcatccaaaacctgaacaagaataaagtcgtgggcatgaaattggagaacaacaagtcatcaaatagtatcctcagcgagagcctgctggaatatctggaaaagcatctcaaggagttcctaaataaaaagacctacccgattattcacacacctcagaaaacgattgagatcctgaagctgttcagctcaaacgacaaacacctgaaatataccacccactcttgggaagaggaaaaatacgagacgtataacaactttatgggcaagatcaaagatgaatgggaggatattgataagaaccttaaagggctgtcaaaccgccttcacgccaagataagtaacttcctgttcaacaagaagctcggccaaaagaaatctaagggcgattatataagctggggtgacaaaaggctgaagtttgggtggagttccaaagagctcatggagtttatgaaaaagaacccctctagctctccattcgattgtcccattccagagaacattaagaacctggataatgattacggaaagttcttcagagactatgtcgatgtgttcaagaatgaaattgagtttcgggaggacaccaaatacttcaaaaatatggtcatcagtctgtatgaagacatccttagacctaacggattttccattgagggtcttgaaaacctggacggctttagttgctataccgatacgcagcagatcaagaatgcaattaagagaatattcgagatgttcgtgaatggggaatacaagaactacaacaagatcatcatagaaaggagttccaatctgacagggcagtcctttcacttgataaagattactcaactgaactctttcatcaagagatctggggatgaccccaaaattaaagagcctacaggtgatttggggaatatcatcgaactgctcaaaaatcttgcagactactccattgttagcaagtttaataacaaggattgctaccgaattaactacctaagcgccgatcagaaagatcagatcgaaaagattgactgtaacgagataaatggctttacacacgagatcaagttttacctttga

SEQ ID NO: 7472 - RNA, 1203 nt, unidentified
  source 1..1203: mol_type = other RNA; note = synthetic construct
atgactttcgagaaaacatacatagaccagatcaaggaagattttgccaatatgcaagacgtttcggacctggccgtggtgctgtctaaagctcgaaatattctgtacgataaagagtgtaaaccattcaacagcgagacactgtattattttgcctacccccagaactgcaagcatcggttcaaagagttttcaatcaagaagaagagtggcgctattcgcacgatacactcacccactcgggaacttaagtctatcttacgcgccctcaattttgtgtttcaatgtatcttcaccccgcatagtgcagctactggcttcgtccctaagaaatctatcgtcgacaacgcaaaaaagcacacaggaaaacactacgtgctcaatatggacatgaaggattttttctactccttcgatcggaatagggttaagatggggttcctggcggagcccttcaacctcaagggaaccaaggagccaattgccttcctgattgcttgcctttgcactcatcctgtcgaaataggaagcgaaatcattcacgtgctcccacagggaagcccttgctcccctattgtgaccaacatcctctgtgcccgcctggatagaaggctaaagggattggcaaacaggcatggtgtggtctacagccgctatgcagacgacattacgttttcctcactgcacaacgcctttaacagagaagcggagcccgtgatcggcgagaagggtcactataataacttcatcgccgagttcgagcgtctgattgggcaggagaagttgaatattaaccacaagaaaactcgtcttcaaaagagtggctactgtcaggaagctaccggcttgatcgtgaatgagaaagtcaacgttagacgacggtatgtaaagcagttgaggatgtggttatattactgggagaaatatggctacgaaaaagcagaacagattttcaagagggattacataaccgacaaaggccacgtgaaaaatatcaacgcgcatctggtgaatgttctggatggtaaactagagtttctgaagatggtaaagggggccgaagacggtacatataaagggctgaaggaaagatttgacatcttagtagggtttacagatccaataaatcagatccttaacgcttggcaaaccgaggggattgatcaggccatgtccatctattacaaggacaaactcgaatga

SEQ ID NO: 7473 - RNA, 1203 nt, unidentified
  source 1..1203: mol_type = other RNA; note = synthetic construct
atgaagatcgaacaggccaacatcaatcaaatccgcaaacagttctcggagctccaaacaagagaggacttagccaaacttttgtccgacgccaagaatatgctgtacggggaaaaatgctctcctgttcagctgaaatcactcacatactacgctaacccgcttatatgcaacgatagatacactaccttttctatccggaaaaagagtggggcatcccgaacaattcacgccccagtcaaaggcctaaaatcaattctccgcgctctcaattttgtgctccagtgcatgaccgaaccccatgccgccgcaaccggatttgtacccgacaagagcattgtcgataacgctgctcgccacgtgggtcatagatacgtgtacaacttagacttgcgtgactttttccatagctttgaccggaaccgcgttaaactggcctttatgaatgagcctttcaatctacgggatggccgcgaacccctcgcattcttgctggcttctttgtgtacgcaccctatggagatagagggggaaatcaaaagtgtgctgcctcaaggatctcccactagcccaacactaactaacatcctgtgtaaaaagcttgaccgtagactgtccggtctggccaagaggttcggagcaacctatacccgatacgctgatgatatcaccttctccgctgatagaaacgtgttcaatgatgaggagttccttaatgagctgcgccgtatcatcgaggacgaccaaaagcttgctattaacccacagaagaccaggctgcagaaagccgattataggcaggaagcgacagggttggtagttaatgaaaaggtgaacgtgaggcgacggtacgtcaagcagattaggatgtggttgtattattgggaaaagtatggctatgagactgcatcacggcactttggcaagttttacagagcggacaagggccaccttaaaaagagtaatgcccagctcatcaacgtcctggatggaaagctggaattcctcaagatggtcaagggagcggacgatagcacttacaaagcactgaaaaagcggctggataagttaacaggcattaagcagaaaactgacgcagagaaggtggatctggacttagttgtggacacgatactgattaaaggtctggatgccgggatagagctgtatgagaggttcaagaataccctcaacgacggctga

SEQ ID NO: 7474 - RNA, 1170 nt, unidentified
  source 1..1170: mol_type = other RNA; note = synthetic construct
atgcagatcgagcagaagcatatcgacacacttcgggcccactttgcagagatgcagaacaaggaggagttggctctcttactgtcagccgccaagaatatcctctatgggaaagtgtgtaagcccatttccgttaagagcctcaattattacgctaaccccgaatattgcaaacagcgctacaaaaccttcgccataaaaaaaaagagtgggggaactcgcactatacacgcacctgttgaaggactcaagactaagttgagagctctaaactttgccctgcaatgtttgtatgatccccataaggctgcaaccggattcgtcagggaaaagagcattgtggacaacgctaagtgccacgtggggcacaattacgtgttcaacatcgacctgaaagatttcttccattctttcgaccgcaacagagttaaaattggctttatgtctgaacctttcaacctgaatggcgaaaaagagccacttgcgtttctcttggcctccctgtgtactcacccttttgagatcgacggtatccaacagatcgtgctgccccaaggttctccaacctcacctaccataacgaatattctgtgccggaagctggatcataggctgagcggactagccaaacggttcggtgcgacatatactaggtatgccgatgacatgaccttttcgtccgaccacaacatttatgggaatgaagacttccggaacgagcttgtgcgaataattgaggaggaccagaagctgaagattaatccagataaaacacgtctccagaagacaggctatcgccaggagacaacaggtttagtcgtcaatgataaggtgaatgtaacccgtcgatacgttaagcaaatcagaatgtacatctactactgggaaaaatacggatacgagaaggccgagcaggtctttaaaaaggattacaccttagacaaagggtcaactaaaaagaaaaccccaagccttatcaatgtgattgatggcaaactgaacttcctgaaaatggtcaagggaagtgaagatggcacgtataagggcttgagggggagattcgattccctcgcaggcgtatttgacccgattaacgaggtgcttgacgcgtgggaaaagaacggcatcgatgaagcagtgagtctgtactttaaactgaatgctgactga

SEQ ID NO: 7475 - RNA, 1275 nt, unidentified
  source 1..1275: mol_type = other RNA; note = synthetic construct
atgaaaatagaacaacagcacattgactttgtgaaagaggagttcgccaagatccagacgaaagaggatctgctgtgtctcctgaacaatgctaagaagatcatttataagggtaagtgcactcccatctccctgagacagctaacctacttcgctaatcctaacttttgcaaagaacggtataggagcttcacaattaaaaagaagagtggcgccgaccgtctcattcatgcgccagagaagggactaaagtccatcctgcggcctcttaacttcattttgcagtgtatagacgacccccacaagagcgcaacaggcttcgtgctggacaagtcaatcgttgataatgcaaaaaagcatatcgacaagccttacgtctacaacatcgacatcaaggactttttccattcgtttaccaaatcttgggttaaatatgggttcatgacggctccatttaacctgggtaaggaaaaagaagatctcgcctttttgctggcctctctgtgtacccacccatttgaaattgacggcaagatacagaacgtacttccgcaggggtcacccactagcccgacaatcactaacatattatgcaaaaggctggatcgccgcttgtccggattggctaaaaggtttggcgctacctacacaagatatgcggatgatatcacattctctgccatgtacaacatcttcaaggaggaggaaaatcctcaacttaatgaaaagggtcgttacgacaacttcattgcagaattagagaggctcattacccaggaaaatctcatcataaaggaagagaaggtcagactgcagaataaagacgcacggcaggaggtgactggactcgttgtcaacgataaagtcaatgtgagacgccggtacgtgaaacaattgcgaatgtggctgtactattgggagaagtacgggtataacaaggcaagtgaaatcttttcccgagactataaggccgacaaaggacacgtaaagaaagggaccccaaatttcgctaatgtcctggatggcaaactgcagtttttaaaaatggtgaaaggggagcaggatgcgacctataaaaaacttaaagagaggttcgatgtgcttaaggccgagattgaccctattaacgaggttctcgatatttgggaggaggaaggaatcgagaaggccatggatttttacagcaagcgcaaaaaaacacaacccaagaagaagaagaatcccgtggtgcggactatgaccatggaaaaactgatggccctattcggcaagtga

SEQ ID NO: 7476 - RNA, 1179 nt, unidentified
  source 1..1179: mol_type = other RNA; note = synthetic construct
atgaatattgagcaggccaaggtcgacgagatcaagaagctctttgccgagatgcagaccaaggaggacctcgtttccttgctgaactttgccaataacttgctgtacgacaatgagtgtctgctgataaatcccaagacgctttcttactacgcaaaccctctgatatccaaaaaccgttacagggagtttaccatcaagaagaaatcaggctctaataggactatacatgccccggtgaaggaacttaaacatattctgagaagcttgaacctcgtattacagtgcgtcagcgatcctcacccgagcgcaacagggttcgtactgaacaagagtattatcgacaacgccaaaaaacacgtgggtcaccgctatgtgtataatctggacctgaaggactttttctattcctttgatggaaattccctaaaactagctttcatgtacaagccttttaatctcaatggagaacgggagtacctcgctttcttgctggcctcactgtgcactcaccctatcgaaattgatggcgagatcaagttcgtgcttccccaggggagtccaacctcaccaacactcactaacattttatgccgaaggctggacaggcggctttccggtctggctaaaagattcggcgcagtgtacactagatatgcggatgatattacgttctcgagctatcacaacatttttaagaaggatgagaaccctcagctcaatgacagagggtgttacgataattttatcgcggaactggaaagactcctgcaggaggagggcctcaaaataaatccacaaaaaactcgcttgcagaagtctggctggcatcaagaagctacagggctagtggtcaacgaaaaggttaacgtcaaacggcgatatgtgaaacaattaaggatgtggttgtactattgggaaaagtatgggtacaaaaaggcagagcagatcttcatccaagactatatctctgatcgaggacatgtcaaaaaacgcaagcccaatcttgccaacgtgatcaagggtaagattgaattccttaaaatggtgaaaggctgtgaagacagtacataccagggactgcgcgagcggtttgataaactggttctgaaccagccacccaagaagaccgaaaaaaagaccatcacaaccaatgttttccgtcccagcaacgagtga

SEQ ID NO: 7477 - RNA, 1200 nt, unidentified
  source 1..1200: mol_type = other RNA; note = synthetic construct
atgaaaccggaaccgcaccaaaatcagcaaatcagagaggcctttgcagctttgcgaacgaaaaaggatctcgcagagttgctgaacctggctaatcaatttctctatggggaagaggccgctcccctttacctaaaaactctgacctattatgccgatccacgcaaggcaaaggaccggtatcagacgtttactatacaaaagaagtcaggtgctgaaaggctaatacacgctcccgtgaagggactgaagacaatccttcgcgccttaaatttcatcctgcagtgcattcactcccctcatcaagctgccacgggttttgtcactgataagagtatcgtcgacaacgcgaggcagcatattggatctccatacgtttacaatctcgacctcaaggacttttttcacagcttcgacagaaaccgggtgaagctggggctcatgtatgcccccttccatcttaacggccctcgggagccccttgccttccttctagcaagcttgtgcacccaccctctggactgtgacggagaggtgcgcacagtactgccacagggttctcctacctcgccaaccctcacaaatattctgtgccagaaactggaccatcgtctcaacggtctggcgaaaagattcggcctcgtgtacacaagatacgccgatgatattactttttcatccgggtacgattgtttccgaaatcccgagttccagtccgaactgcgtcggataatcgaggaggaccagcagctgcgcatccaccctgacaaaactcgtttgcagcgccttggctatcgacaggaagcaacaggcctgattgttaacgaaaaggttaacgtccgcagaaggtacgtgaagcagctgagaatgtggatttacttttgggagcggtacggatacgctaaagcccaacagatcttcctcagggattatttaagggacaaagggcatctgaaggatgtgagtaccagctctcttcagcaagtctgtagtgggaagctcgaattcttgaagatggtgaagggaccagaggatagcacataccagcagttagcttcccggtttcacgccctgaccaccaaagagaaagcgtctgcctcaggagcaactaatctggaaagggtagtggatacaatcttaggccagggcctggagcagggcctgagattgtatgacagcttcaaaaccaacaaaaggtga

SEQ ID NO: 7478 - RNA, 1173 nt, unidentified
  source 1..1173: mol_type = other RNA; note = synthetic construct
atgaacattacgcccgagcaagtcaagcagattacaacccagctggctgccgtggaaacaaagactgatcttgctgcccttttatccgaggctcagaatattttacatggtaagacatgcaagccgatcacagccacagctttcgcctaccacatgaatccctacatgaacaaaaatcgatataggaacttcaccatcaaaaagaagagcggaggagcaagagtgatatatgccccaactaacgacttgaaggcaatcttgagagccctaaacctgattctgcaatgcatgtatacgccagctcgcgtagttacgggtttcgttccagggcgctctatagtggacaatgccaaatgccacatcggacacaggtatgtgtacaatattgacgtcaaggacttctttcactcctttgacagaaatcgggtgaaattggccttcatgtatgctccctttaaccttagagacaaacgggaaccgttggcgttctttctagcaagtctctgtactcaggcgttccgctttcccggcgaggtggtaaaggccatcctggttcagggctctccaaccagccctaccctcactaacatcatctgtgctaccttggacaggcgcttaaccgggctcgctagaaggttcggggtcacctatagtagatacgcagatgatattacattcagctccgaacattgtccttacaaccgagaggacttccagcgggagcttctccgaatcattgaggggcagggcctgacactgaaccctgataaaacccgactgcaaaatcttgcacaccggcaggaagtgaccggcctgatcgtcaacgagaaggttaatgtgcggcggcgttacgtgaagcagctgcgcatgtatctgtattacctggaaaagtacgggttttacaaagccgaggccatttttctcagagattacctcgcagacaggaagcataacgtgaaaggcaatcctcaaatgctcaatgtactagggggcaagctggactttctgaggatggtcaaaggtcaggaggattcaacttacatatcgctcctgcagcgttttcagaggtttgatttccgccccactaaaatatcaaaaaccctggatgcgtgggaaatgggaggaatcaaggagggtatgaagatctactatggccaagataaggaaaaatga

SEQ ID NO: 7479 - RNA, 1332 nt, unidentified
  source 1..1332: mol_type = other RNA; note = synthetic construct
atgaaagcaacggaagcacagcgcgaggagatcaaatcactggtggcggagctgtcctctaaaaagggccttgttaaccttctgtctaaggccaggacgatgctatacgggcaggaaactaagccagtcaaactcaaactgctgacatactatgccaatccaactatttgtcctcgaagatacagaaagagtacaatccctaagaagtccggcggtgtccgcacaatacacgccccagtgaaagggctcaaagcgatcttacagcccctgaatttcgtactacagtgcatgcacacaccccactgtgctgctaccggtttcgtccaggggcgcagcatcgtcgataatgccaggaaacatgttggacaaaactacgtactcaatttggacctaaaagacttcttccactccttcaaccggaatcgagtgaagctggggtttatgtttggtcctttgcagctcaacggcagcaaggagccactggcctttctgctcgcatcgctgtgcacacagcctctgtacgaaaacggagatattaaggttggtcatcgccccccgagccggtttgtgggagagtcaatttttatgtccgaagacgatcctaattacgagcttatcatgcagattctgcaggagaacgaggtcataaactccaaacgtagagtgaagcttaggattgctagaggcgctgtgaagactgtcctgccacaaggaagtccgacctcaccaaccatcaccaatatgttgtgcgagaaattagatcgaagattaactggcctgggcaaccggtttggagcaacgtattctcgctatgctgacgacatcaccttcagttctctccataacatttataaccaggacgaattcaacgatgagttagtgaggatcatcgaagaggaccaggggttcaaaatcaatcccaaaaagacccggctgcagcgcaggggatactgtcaagaagtgaccgggttgagcgtcagtgagaaggtgaatgtgaggcggaggtatgttaagcaacttcgtatgtggctttattattgggagaaatacgggatcgagaaggcagaagatatatttgctcgggattatgtgggagacaaaggccatgttaagatgcacgtgcccgaaatgagcagagtgataggagggaagctggaattcttgcgtatggtaaagggcgaaacagatagcacctatctgggcctgaaggacagatacgaaaagttgatgctccccctcgaccctctcactaagattctcgatctgtgggaagagaaaggtattgacgccgccatgaatgcctactacggcgaggaggtaactgaggagtga

SEQ ID NO: 7480 - RNA, 1191 nt, unidentified
  source 1..1191: mol_type = other RNA; note = synthetic construct
atgccaatcaaccaggaggataaggcatacattcgagacaaattcgcggcgatgcagaccaaagaggaccttgttaatctcctgtcggaagccaaggatatgcgttatagagagaggaccaagcctttcaaactgaactactttacatactatgctaacccgaagctgtgcaagcaacggtacaagacttttacgatatcaaaaaagtccggcggacaaagggtcattcatgccccagtaatgggccttaattttctgcttcagagtgtcaatttcgtgctcaattgtatgtacgagccccacaaagctgccacaggttttgtgcctgaaaaatcaatcgtggataatgccagaggacatgccgagaaaccttttgtgtataacattgatctgcaggacttctttcacagctttggcaaaccacgggtgaagtacggcttcatgcgctccccgttcaacctcaacggcgacagggagtatctggcattcttgctcgccagcctatgcacacatcctttcgaagtgaacggggaggtgaagcgagtgctccctatgggatctcccacctctccaaccattacgaatattctctgtcacactctggacaggcgcttaaacgggctcgcaaagcgcttcggcgcaacatactcccggtatgctgatgatataaccttcagtagcatccacaacatctatcgcaaaaaggacttccaaaaggaactttacagaatcgtggaggctaaccaagggttgaagatcaaacccgaaaaaactcgtttgcagaaagagggttacagaaaggaagctaccggattggttgttaacgagaaagttaatgtgaaacggaggtacgtcaaggatttacgaaagtggctgtacctgtgggagaagtatgggaatgagaaggcccagcagctgtttaccaaagactacgtagccgataagggacacgtcaagaaaggagaacccaaccttgaaaatgtcttggacggcaaactggactttatgaagatggtgaagggcgtgcaagacgggacatatctaaagctgcgggaccgctttgataaactaactcagcagtcctcaacatctaatagtaagaaggtaagcttagacgatgtcctggatactatactcaatcagggtctgatccaggggattgacctgtatcagaagctgagaaaaccctga

SEQ ID NO: 7481 - RNA, 1176 nt, unidentified
  source 1..1176: mol_type = other RNA; note = synthetic construct
atgaagctggaaaagcagcatactgagcagctgattaaacaattccgcagcctcaaaacaaaggatgatctgctggttctgatcaacaaggtaaatcttctgttgtacggtgatgactttaaaagtcttacactgaagggcctcaactactacacaaatccaaactatagtgataagcgttactcgtcattctctatcaaaaagaagtctggcggtgagagaataatcaactctcctgtgaatggactgaagcatatactcaagcccctcaacgttattttaaattgcattgccaccccacacccaaaggctactggcttcgtcttaggcaagtctattgtggacaacgctaaacaacacgtgggcaaccattatgtgtacaacattgatctgaaagactttttccacagctttgaccgcaaccgggtcaagctgggcttcatgtaccccccttttaatctcagtggagacttggagcccctggcttttctgttggcctccctgtgcactcaccccttcgaagtagagggtaaattgaaaacagtacttcctcaaggagccccgacctcccctaccatcactaacatcttatgtgtcaaactagacagaagactcaatgggcttgctaaacggttcaaggtgaattatagcaggtatgcagacgatatcactttttccagccatgtgaatgttttcaagaatgaggtcttcctgaaagaactgaatcgaatcatcgtggaggaccagaatctaattctcaacgataagaagaccaggcttcagcagactggtacgaggcaggaggtcacaggcctgactgtcaatacgaaagttaacgtgaattccaagtacattaagcagctgcgcatgtggctttattattgggaaaaatacgggttcaacaaagcggagtcaatatttctgagggactacgcaaaggataaagggcacataaagacagggaaaccaaattttcagaacgtgctaatgggaaaactcgaatacctgaagatggtgaaggggcacggagactcaacctatgtgaagttaaatgcaagatttacccgattgacccggacagaaagcatgctcgaaaaaaccttgatggcctgggaagagaacggaatcgagaaagccatggagatctataagttcaacaacacgaccatgttttga

SEQ ID NO: 7482 - RNA, 1170 nt, unidentified
  source 1..1170: mol_type = other RNA; note = synthetic construct
atgaagctcgagaaacaacacacggagcagatcatcaaacagtttaaagcgctgcgcactaaggacgatttggttgtcctcattaataaagtcaacctaatcctgtatggcgataagtttatcagtcttacagtgaagggacttaattattacgccaaccccgaatattctgataagaggtactcatctttcagcataaagaaaaagagtgggggtgaaagaatcatcaacgccccagtgaatggacttaaacatatcttgcggccactgaatattattctcaactcaatagccatgcctcatgctaaggcaactgggttcgttctggggaaatctatagtcgacaacgcccaggcacatgtggggtataactacgtatataacatagacctcaaggacttcttccactcgttcgatcgcaaccgtgtgaagctcggctttatctgtgcaccctttaatttaaatggcttgctcgagccaattgctttccttctggcctccttgtgcacacacccgtttgaaattgatggcgtcattaataccgtcctccctcaaggagctcccacatcccctaccataactaatattctctgcgtgaagctggataggcggctgaatggcctagcaaaaagatttaaagccaactacacacggtatgcggacgatattaccttcagctgtaacgtgaacatctttaagaacgacgagtttttaaaggagctgaacagaattatcgctgaggaccagaatctgattctgaatgacaaaaagaccaggctgcaacagactggtaatcgacaggccgttactggactaaccgtaaacacgaaggtgaacgtgaatagcaagtacattaaacagctgcgcatgtggctgtactattgggagaagtacggttttaataaagcagaaagtatcttcctccgagattacgccgtggagaaggggcagttgaagaaaggaaagcccaacttcaagtcagttctgggtgggaaactggagtatctgaaaatggtgaagggcttcaatgactccacctacttaaagttgaacaccaggttcacaaaactgtccaaaacagaaagcaaacttgagcagaccctgaaagcttgggaaaacaacggcatcgaaaaggctatggaaatctacaagcttgccaagatcaattga

SEQ ID NO: 7483 - RNA, 1188 nt, unidentified
  source 1..1188: mol_type = other RNA; note = synthetic construct
atgggctttaagtcctttataaacctcatcatgaagacaaccaaagaggacatcgccctgatccgagaaaagtttaattccttgtctaccaaagaagacctggtgaatttgcttaatgtggccaatgtattgctgtatggtgaggacgcgttcactctgaaagagtcgacactggcctattatgctaatcccgctttctgcacggaacgatataccagcttcgaaataaataagaagtctggtggaacacgcacaataaacgctcccgtgaagggccttaaaagcattctcaaaactctgaactttgttctgcagtgtatcagcgaacctcatcacaaagcaacggggttcgtcatcaataagtccgtagtgacaaacgcaaagtttcatgtggggaaccattacgtctataatatcgacctaaaggattttttccacagcttcgatcgcaatagagttaaactcgggtttatgcaaaaaccttttaacctcaacaaggatagagagcctattgccttcctattgtcatgtctctgcactcacccgttcaaagtcgacgataatctcaagatagtgctaccccagggagcaccaactagccccaccatttccaacatcctgtgctctaccctggacaggcggttaaatggacttgccaaaaagtttaagatcaactacagtcgttacgccgatgacataacattcagctcacaggtgagtgtgtttaaacgtaaagattttcagaaggagcttctcagaattatcactgaggatcagggcctcgttctgaatgaaaaaaaaaccaggctgcaacagtctggctacaggcaggaggtaactggtttgatcgtcaacgagaaggtgaatgtgtcccggcgctacatcaagaaccttcggatgtggttatactactgggaaaaatatggcttcaagcgggcggagattattttcaagaagaattacatcctggacagaggacacattaaaaagtccgaaccaaacttcattaacgtcatcaccgggaaactggagtatctgaaaatggtgaagggcccattcgactcaaccttcattaagttaaacagtaggtttgaactgctgcttcagaatgagtcaatgctggagcagatcctcaaggtttgggagaaccaaggaattgaaaaggctatggagttgtacaacaagtga

SEQ ID NO: 7484 - RNA, 1395 nt, unidentified
  source 1..1395: mol_type = other RNA; note = synthetic construct
atgaataacgacaacaaggattaccaggttagtattctcaaagagttcataaagatcgacaaaatggagattcagcagaagcacatagagaaaatgaagtcactgttttctaagatggagaacaaacaagatttggttaacctgctgaacggcgtctataacctcctatataagaagaacgaaacgaccgacaattcctatgatcctttcaagattgtatctgacaccaagaccgtgtattttaatttgatgttctcagaggaggagttcaatctgaaatccaagaccaagaagaacacttatattcagctgtccagtcttagctactatgccaattatagcctgtgcaagaaaagatactcccagttcaaaattaagaagaaaagtggggcagagcggattatcaatgctcccgtggaagggcttaagatcatcttgaaactgctcaattttgttctgcagcacgtgtacaaaccgcataaatccgccaccggattcgtgctcaataaatcaatcgtcgacaacgccaaaaaacacatagactcgaattacgtttacaacatcgacctgaaagattttttccacagctttgatatcaagcgcgtaaagctcggtttcatggaagagctgttcaatagcaaaaccgacagagaacccctcgcctttctgttagcttgtctctgcacacatccattcgaggtcgctggagaaattaagaacgtgctaccacagggctctcctacatcccccactatcaccaacattctctgtaaaactctggataatcgactgactgggctggcaaatcgatttggcttgaggtacacacggtatgccgacgatataaccttttcttctcagcataatgtgtacaacaaggaagattttcagaaggaactcaagcgcatcatcgagaataaccaaaatcttctgatcaaccacaaaaaaacgagactgcagaagagggggtacaagcaggaggtaacaggattagtggtgaatgacaaagtcaatgtgaggaaacggtacgtgaaacaagtcgacaagtatctttacttgtgggagaaatatagtttcgagaaggccaaacagatcttcatccgtgaatatccacaggagaaagcgcatttaagaaactacaagcccaatctcacaaacgtcctgcgcggcaaattagactttcttaaaatggtgaagggagcggaagatagcacatacctaaagctgaagaagcggtttgataagcttactggtaagcagaaccctatcaacgagattctggacatctgggagaaagaaggcattgagcaagctattaaggcatttgaaattgccactgaagtgaatcaaaacagcatagatttgtcaaagttcttcaagaacgaaagggattga

SEQ ID NO: 7485 - RNA, 1554 nt, unidentified
  source 1..1554: mol_type = other RNA; note = synthetic construct
atgaaaattgaacagcagcatattgagttgattcgcacaactttctctacactgcagacgaaagaagatctgcttagcctgttgaacctggccaacacactgctctatccaaagaactcattcaaattcgagttgaaacagctcacctactttgcaaatcctaagctggttaaaaacaggtacgccgagttcaccataaaaaaaaaaagtggcgccaatcgaatcattaatgctcccacccaggggcttaaatccatcctaaagacattgaatttcgttttgcagtgcatgtgtgaaccgcacaaggccgctaccgggtttgtaagaggtaagtccattaccgataatgcgaaaaagcacatcgacagcaactatgtctacaacatcgatctgaaggactttttccattccttcgatcttaacagagtcaaactgggatttatgcagaccccctttaatttacgcaatgagtcgtttccaatagcatttattctggcctgcctgtctacttatacattcaagattgacggtgaaatcaagcaggtgctacctcagggatcccctacctcaccaacgataactaatattctttgtaggaggctggacaaacgcttaactggcctagccaatcggtttgggcttaggtacacacgttatgctgatgatatcaccttctcctcacagcacaacgtatacaacaaggaggatttccagaatgaactgcacaaaatcatagtgaccgacgagaagttcgcttttaatacaaagaagaccagactgcagaagcatggctaccagcaagaggttacgggcctcatcgtgaatgaaaaagtgaacgtgcggtcccgttacgtaaaacaagtgagaatgtggctctactattgggagaaatatggatacaacaaggcagaacaagtcttccggaaagattacatcaaggataaaggacatgtcaagaaaacccttcccaacctggacaatgtcttagaggggaaactcctctttttgaaaatggtgaaaggcgagtacgacggcacttacatgaaactccaaaacagattcgagaagctcaataggaagcaaaatcatattgacgagattctggcgttatgggactctaagggaatcgatctcgccaagaacaaattctataacaacgacgatgacgatgaaaatagccacaacactatagtgactgacacagagaagctgagtaagatcaacgaaacagataagcaatatgacattgccaatttttgctttcggaacattacagggttcaagaagctatacctgaagaaagtgattatcgaccacgatatcctgtataagtattgggagaactcatctcgcacgatgatcctggtttcggaagaagcttttaaggtgctcagtgaagcaagcaattttgacagcaaaaatatcgtccagagcatcgaaaagtacaacatcagtgagaataagaagaccaaaaagactgagaagggtgactacaaccagcgatctttctttgtgaaaaagaagagcatagagaagtataagctgatgttctga

SEQ ID NO: 7486 - RNA, 1212 nt, unidentified
  source 1..1212: mol_type = other RNA; note = synthetic construct
atgaagactaacccagatcagaaaacctacatacgaaagaagtttgctgccatgacctgtaagagggaccttctggttttacttaatgaggcccaggggatgatgtacggagagaaaggtaggcacttcaggctgaaagacctgacttactacgcgaaccccgatttgtgtaaaaaacgctattccacgttcattatagccaaaaagaacgggggagagcgtacaattaacgcacctgttaaaggactgagaattattcttcggagcctaaatttcattctgcaggctattagtgaaccccatgcagcagctactgggtttgtccctgatagatccatcgttgacaatgcgcgcgcccacgtggggaagcactatgtgtacaatctagatattaaggacttcttccactcttttgaccgcaatagggtgaaaatgggcttcatgagaaagccgtttaatttgaaggcaaatgagaataaggagaagctcgcattctttctttcgtgcctctgtacacacccttttgaggtcgaaggagaaatgaaaaccgtgctcccccaaggatctccaaccagcccaacgatcacaaatattctctgcaagaacttggatagaaggctcaacggcctggctaagaagtacaacctgtcctttacccgttatgccgatgatataactttctcatctagccataacatctttaaggatgaagagttccagaaagagttacaacggatcatcgaggaggaccagcaattagttatcaacccgacgaagactagattgcagaagacctgctaccgccaggaggccactggcctcatcgtgaacgaaaaagtcaatgtgaaacgggactatgtgaaacagctcaggatgtggctgtattattgggaaaagtacggtgaagtacgcgctgaacagatcttccagcggaactacaatctggacaagggtcatgtgaagccagagcatcccgggatggctaacgtaattgccggcaaactggagttcctgaaaatggtgaagggcgacgaggaccctacctacaagaaactccgggagcgatttttgaagctgcaccctggcagtccctttgtcgaaaaactgctgcaaacctgggaaacaagaggcatagatgaagccatcaagatccatacactacgaatcaaaacatcaaaggtcatccttaataccaacatgtatacactgtga

SEQ ID NO: 7487 - RNA, 1209 nt, unidentified
  source 1..1209: mol_type = other RNA; note = synthetic construct
atgaaggccagcccagatcagcagacatacataaggaaaaagttcgcactgctggaatccaaagaggatctgctggtgttactgaatgaagctaaacgaatgatgtatggagacgagtgtaaggtattcagacttaaggcactgaactattacgccaatcctgacttctgcaaaaaaaggtatacatccttcgacattccgaagaaaaatggagccaaacgcatcattaacgctcccgtcaaggggctccgtagcatcttgagagtcttgaactttatcctgcaggcggtctacgaggctcatccagccgccaccggattcgtgcaggagaagtcaatcgtcgataatgcacagcctcacgtggacaagcactatgtttacaatcttgacctgcaagactttttccactcctttgataggaatcgcgtgaaactgggattcatgaagaagccattcaatctcaggaaggaccggaacaaagaacaactggcattttttctaagttgcctgtgcacgcacccttttaagattgacggcaacattaagactgtcctgccccaaggctctcctaccagccccaccatctctaacatcctgtgtcgggacttggaccgacgcttgaaggggctggctaagcgttttaacctaaattttacacggtacgctgacgatataacttttagctcttcccataacgtgtataacaaaaacgagttccagtctgagctcactagaatcattgaggaagatcagctactcaaaattaatccgtcaaagacaagacttcagaagaccggctttagacaggaggccacggggttagtggtgaacgagaaaataaacgtgcccaagaattataccaagcagctccgcatgtggttatactactgggagaaatatggcaccaagaaggcggaacaaatcttcacccaggattaccttaaagataaaggtcatgttaagcccgatcacccagagatggaaaacgttttggcaggtaaactcgaattccttaagatggtaaagggtacagacgatcctacttataaaaaacttcagggcaggttcctgaagttgagtatggggtcgccattagtggatcgggtgctcaaggtttgggacgaagagggcctgaataaagccatggaactctactacgaaaaaaaggagagttcagaggccctgactacaaccattctgactctctga

SEQ ID NO: 7488 - RNA, 2010 nt, unidentified
  source 1..2010: mol_type = other RNA; note = synthetic construct
atgaagatcaaacaaacagagatcaatctgttaagggcacagtttgcagccattcaaagtaaggaggatcttgtgaaaatcctcacaaaggcaaaaaagcttctttacggagagaaggcaaccaaaatccatctcaagtccctgacctactatgccaatcccgccatatgtaaatcccgctataccccatttcacgttaagaagaagagtggggataacagagtcatccatgctccagttaggggcctgagaattgttctcagttccttaaatttcctgctgcagtgcctgcacgaacctcataagacggcgacaggcttcgtgccaggcaagtctatagtcgacaacgcacggatccacaccaattctaactacgtctacaacatcgacctcaaggacttttttcattcattcaaccggaacaaggtgaagatggcctttatgtaccaacctttcgggctgaaaaagtctcaggagcctcttgcctttttgctggctagcctctgcacacacccaatcgagattgacggaaaaacccagatgatcctgccacagggaagcccgacctctcccactctcagcaatatattgtgtatcaaattggatcgtcggctgaatggattagcaaaacgatttggtgctaaatatacacgctatgccgatgatatcactttcagcagctcagataatatttatacccaagccgactttcaggccgagctacaacgaattatcgtggacgatcagaaactgacaattaatgcgcagaaaacgcggttgcagactaaatatgaaaggcagcaagtgaccggcctggtcgtaaacgataagaacgtgaatgtacacagggcctatgtcaagcagattagaatgtggctttattattgggaaacgtacggcaaaattaaggctgagcgcctttttcagcaggactaccagaaatcggccgtgaacgctcagaaaaaggccccccccctgcagagaattctcgaaggcaaactaaacttcttgaagatggtgaagggtaagaagaataacacctacagacgactgaaacaacgctttgacgagttggcatctgttgcagggaataacgacactaagcccaaaaagcctaagaggaagtcatcaaaacccctgccaagacctcaggagacaaaagggttcctttccctgttcaacaactctaaggggctaaaataccttacccacaagttcaatgacatcacccctccagactacactgaatttatggccctctgcaaggaagaattcgaccagggacagaaaaagtatcccaatgtcccgactgctttactggagcgcattcagcagtacacctttgcctccgctcccgagtggtttactcggaagggcgaagaaaagaactaccaccatatgggttggagcgagcctaaattcgtggaatggtatcagaagtcaagtctccaccctgccagtaatgctaaatggaatcaggagatgattctccccttcaaacacactatagaggtgcgggccggctatctgccggcaatcatagatgaggcaattaccctggctctcggggactctcgttcctcatttgatattcagatctcgaatgacacaataaaggtggctgaattctacaccgatgtagataggttccaattagccctataccatatcttcagcactatcaagactcatggcgaggcgaacttttgttacggcctgacaattgatttcattaaggagaaaagcggaagcacacacatcaaaaagctgatcatcacccacgtggactccgaagcgactaagccagctaacgacgaaggattcataaaaggggacctgaacacaattaagacgctcttgtggggattgtgcaactataacatcgaggcgaaatttcccgatgggttccaaagtaagacaatcctggccgataagcagaatctgggtaaatcctccgaggaagaagagaagcatattaaaggtttcacccacatactgaaattttactga

SEQ ID NO: 7489 - RNA, 1281 nt, unidentified
  source 1..1281: mol_type = other RNA; note = synthetic construct
atgaaaaacaagatcaccgcactgcaaataagcgagatcaaggcggattttcttaaaattgaatctttggacgacctctgtaatgtcctcaaccttatcaacgagcttacccagttcaaaaacaagattgagataaaccagctagttaagctgtcaaatccctccctggccaagaatcgctacaaagagttcacaattaagaagaaatcggggacaaatagaacaattaacgccccaattagggagctgaataccatactcaagtctctgaataacctcttcaatctgatttacaatccgcacaccaatgcatttgggttcgtgaccgggaaatccatcgtggataacgctaaaatacacaccaacaaaaagtacgtgtacaatatagacttgaaggatttcttccatagctttgaccggaatcgggtcaaaatgggtatttggtatcagctgttcggcggagataagtccaaggaaaagattagcttcatcctcgcatgcttgactactcatccacttatgatcgacggcgtctcaggaatcgtgctcccccaagggagtcctacaagcccttttctcacaaacctgctatgctacaaactggatagacaactgaaaggactcgcgaaacggtttcgattgatgtactctcgctacgccgacgacattacattctcttcgaattacgacgtttattccaatcctacttttacactagagctgaacaggataattaccacgcagaatctggtgattaaccccactaaaacgcgtctgcaaggcaacgggtaccgaaaagaagtcaccggcgtgatcgtgaacgagcagattaacgtttctcagaactatatcaagcagctgagaatgtggatctattacatcgagaaatatggaattgagaaggccaccgaaatcttcaagaaagattatgccaaggaaaagggtcacatcaagagtatgcaggccagtatgcagaatgtgattgaaggtaagctgttgtatctcgagatggtaaggggcaaagacgacaagaagtttctgacgttgaaaagacggttttataagtccatcggaaaggtgtccaagatcgacaaagtattaattgcttgggatgagaaaggcataagcaaggccatggacatctactataactacaaccgcatctcattagctgccttcctggataatgatgcaactaatgtcatcttagatgaacttcgttttgaagctaaggatagtaataacaacaggaagaaaagcaacatcatctttactctttga

SEQ ID NO: 7490 - RNA, 1278 nt, unidentified
  source 1..1278: mol_type = other RNA; note = synthetic construct
atgaaaaattccctgactgtggcgcagattactgagattaaagagaacttcctgaagattgaaagcctcaacgatctgtgcatcgtgctcaaccagactaacgagctgactcagattaaacataccattgaggtggagcagcttgctaagctgagtaatcctgcactagccaaaaatcgatatagagagttcaccattaagaaaaagtctggtgccgataggaaaataaacgcacccatctcagagttgaacctgattctgaaatcactgaatcagctcttcaactttatttacactcctcacacaaatgcctttggatttgttagcggaaagtccatagtagacaatgctaagatgcacactaataagaagtacgtgtataacatcgaccttaaggatttctttcacagtttcgaccgcaatagagtgaagatgggcatatggtatcagttgtttgagggtgataaaagcaaagagaagatcagctttatcttagcttgccttacaacgcatcctctgatgatcgaaggcgagacaaagatcgtgctcccacaagggtcccccacctctccatcgttgaccaacctgctctgttacaagctggatcgacaattaaaagggttggccaagcggtttaagctgacctattcacggtatgccgacgatatcacgttttcttctaactatgatgtgtatagcaaccccatatttacactcgagctgaatcgcatcatcaccgctcaaaatctgatgataaacccggcaaagacccggcttcagggaaatggctataggaaagaagttacagggattacagtcaatgaatacgccaatgttagtcagaagtacgtcaaacagcttaggatgtggatcttctttattgagaaatacggcatagaaaaggccacagaaatcttcaaaaaagactactccaaggaaaaaggacatgtcaagtcgatgaatgcctctatgctgaacgtgatcgaaggcaaactgttgtacctaggaatggtcagagggaaggatgatgaaaaattcctcaccctcaaaaaccgtttctacaaatcaatcggcaaagtcagtaagatagacaaggtactgaacgcatgggaggaagcagggatttctaaggcgatggatatctactttaacaataagcgcatttccctagccgacttccttgacaacgatgctatcaattccattctcgacatcatgggtttcgacgctgacgacagcaataacaagaagaacagcaacattatcttcaccttatga

SEQ ID NO: 7491 - RNA, 1224 nt, unidentified
  source 1..1224: mol_type = other RNA; note = synthetic construct
atgaggacccgcttaacggaagaacaaaaggaggtgatcaaggatcaaaccgctcttctacaatcaaagtctgacttcgtcgccctcctgaacgatgtcgcggtaatgatctatggcgacgatgggaagaaagcctttcacctaaaacacctcacctactacggaaacccgaaaatcagctccaagagatatgcaacattcgaaatcaagaaaaagagcggcaaaacccgcattatacatagcccatccagtggcctgaaatccatcttgaaatgctttcgctacgtgctggaatctgtctatgagccccatcctgccgcaatgggattcgctcccggaaggtctgttgtggataatgcccagaagcacgtgcaaatgctgtacgtctacaacatagacttacaggatttctttcacaactttgacagaaatagggtcaaaatgggactgtggcggaacctgttcaatgttgagaagaacaaggaagaactgtcatttttcctcgccgccctgtgcacacatccaatagagattaatggggaggttaaaatcgtactgccgcaaggttcacctgtatctcctgtgttgaccaatatgctctgtgtgtcgctggatcgcagacttcagggtttggctaaaagatatcggatccgatattcacggtatgcagatgacatcacattcagttccaataggaatgtgtttgtggagactgagttccagcttgagcttcacaggataattgaggaagaccagaagctcaagattaacccagacaaaactagactccagaagcgtggctaccgccaggaggtcacgggagtgattgttaatgaaaagctaaatgtgcatcggaagtacgttaagcaggtgcgtatgtggctttactacatggagaagtacgggcccgaaaaggctgagcagttgtttcgagcggactacattagggagaaaagccacgtgaaaaacattaccaaccctatgctgagcgtactcattgggaaattgcagtatctgaagatggtgaaaggccagcatgatcccacttatctgtccctgctgaaccgattcacaaaattattggacaagagcaactttccactccggcagaaaagtactgacctcgctgacaagagtgccatgctgaagaacaagaacatcattgatctgatcatcgaactgggcgtcgagaaagcacttcagaattatgtgatcaatgaatga

SEQ ID NO: 7492 - RNA, 1272 nt, unidentified
  source 1..1272: mol_type = other RNA; note = synthetic construct
atggaacaacaggtgaaacaactgaaagaggggtttttgcagatgcagaccaagcaggagcttgctgacgttcttaatttggcaaagaaggtcctgtaccccaacgacgaccaaaagatagagctaaagaatatcacctatcatggcaacagtaagttcagcaagaatcgatacaaaactttcgtggtgaagaagaagtcgggaggtgagaggattatccaggcaccaaagaaagaattcaagtccattctgaagcctctgaatctggtattccaaaccgtgtttgagccccacaaaaacgcatttggctttgtcccacagaaatccatcgtggataatgccaaccgacacgttagcaagaatttcgtgtacaatctggacctgaaagacttttttcacagcttcgaccggaacgcagtgaaaatgggaatctggttctatggttttaagatggacaaaacgaaagagtctctggcatatttactggcgtgtctgtgcactcatgagacagaaataggaggaaaatctgaatttgtcctacctcagggcaatccctgtagtcctacgctcaccaacctcctttgcaccaaactggatcggaggcttaatgggctcgcccgccgcttcggagccgaatatagcagatatgctgacgacattacatttagcgccaataagaacgccttcaaaaacgaggacttccaaaaggagttgaaaaggataatcgaggatgatcagcagctcgaaatccagcccaagaaaactcgtctacaagggcggaactacagacaggacgctacaggcttaaccgtaaacgaaaaagtcaacgtgcagccaagatacactaagcagatcaggcactacctgtacctctggaagaagtacggctataacaaggctgccactattttcaccgccgggtattcagataatcgcggccatgttaaatctccgaatgcaaagttagaaaatgttctgtcaggtaagctggaatatctcaagatggtgaaaggcgaggacgattccacgtaccagacacttaagaaacggtttgatattctcgccaatagagatgtcgagatagagaagattgtggccatttgggagaaggaagggatcgaggcggctgccaaagctaacgagaagcgtaagcagtcaaaaactgcgaacaagctgaacaacaaaaagttcagtaccttcacagacatcaatgagttgtttgatttctccgatgatttggctgccgaaaaagtagaaacatacggtaaatga

SEQ ID NO: 7493 - RNA, 1188 nt, unidentified
  source 1..1188: mol_type = other RNA; note = synthetic construct
atgtctctggatcaagaacaaatcgaagagctcaaacaagagtttctcgccataaagagcaaggaggacctactgattatcctgaacaaaacgagcgctcttttggccaaggacaatccagattttaacccaagccctatcgaactaaagacgttaacctattatgccaatcccaaactgtgtaaacagcgctactctagtttcaagattaaaaagaaggctggcgacgaccgcacaatttatgcgccatgccctgggttaaaacgcattctgaggactctaaactaccttctgcaaatcaccttcgaaagtcacgatttcgcaatgggtttcgttcagggcaaatcaatcgtcgataatgcaatcctgcatgtaaacaagaactttgtgtataacgtggacctcgaggatttcttttactcattcgatttctacaaggtcaagttcgcattcgagggcgccccttttaattttaataaagagaaggagcccctggctttttttctggcgtgtctttgcacccatcccttggagctcgaaaaagggactaaagttacactcccccagggcgctcctacttcaccgtttatcacaaacatactctgctaccgaatggatcggaagttgcggggactcgccaaacgctttgacctggtctacagccgatatgcagacgatattacattttctggtcggttcaacttctctctgagcaaggacttcactaatgaactggagcgtataatcaccaaggaaaagttaaagctgaaaccgtccaagactagaatgcagtcaagcttttataggcagagtgtcaccggtattgtggtgaacgaaaaggtaaacaactataagtcctacatcaaggatcttaggatgtggattttctatcttgagcggcacggactggagaaaacccagaccatatacagacagcgtgtgcaggatgacaaaaataagggcagagacattctgaatgtcatttccggaaaactcctttacatgaagatggtgaaagggcagacaaatccagcttacatcaagctggtggacaggatggaggccttcttgatcgggtccggcaccaagaaagaagactccaagcctaaacccgataaatttgagagagttgtgaattcgctcttgaaagatggagacatcgaaaaggccatgaagctgttcaggtga

SEQ ID NO: 7494 - RNA, 1197 nt, unidentified
  source 1..1197: mol_type = other RNA; note = synthetic construct
atgaagctggaacaagaacaagtaatcgagcttcgccgactctttctgaaagccaatactaaggaggatttgctcaaggtcataaacaaatccatcaaataccagaacaacggtacaaaggagtttaagtatatttcgctcaaaacgctaacttattacgccaatgcgaacgtctgtaaggatcgctatacaagctttgaaatcctgaaaaagagtggcagtaagaggaccatccacagcccccatctgattcttaacaagattctgaaggctttgaatctcatactccaatgtagcttcgagccgcaccaggcagccatgggatttgttaagaataggtcgatcgttgataacgccaaataccatctgaaccactcatacgtgtacaacatcgatctgaaggattatttctactgcttcgatcttaaacgtgttaagtttgggttctttaatgtgccattcgatttctctaagaaccaggagtctctggcgtttttcattgcctgcttgtgcacgcatccactggacattaacggcgaacttaagaccgtactgcctcagggtgctgccacatcacccaccttaaccaatatcctttcttacagattggaccgcaaactgactggtttggctaaacggtttaacctgctgtactctagatatgccgatgacataaccttcagtggggacttcgacttcagcaaaaataaagacttcattgctgagctcgaccggattatcacaaaggaagggttcgagattaataaggataaaacacggatgcagtccaaggccttccgacagcagatcactgggctggtggtgaatgagaaggtgaacgtccacaaaggcttcataaagcaattaaggatgtggatccactacattgaaaagtatggcctagaaaaggcacagtccatttttgacaagtcagagatcaaacctctcaatgcaaagtacgaccttgcaaacgtgctcaagggaaaaatagaatttctgaaacatgtgaagggccaggaggatcccacctatatcaaactgaatcagagattgagggcttgtctgataaaagcaggacggattgaagagaacctcactgagaaaaagtcctccgaagacattaaatttgagaaggccatcagcctgttaatcaaacagggagacatcgagagcgctatgaatctatttttcaaatga

SEQ ID NO: 7495 - RNA, 1236 nt, unidentified
  source 1..1236: mol_type = other RNA; note = synthetic construct
atgaaaaagctgactaaggagcagaagctctatattaagaactctttcgagaatctgcagtccttagatgacctggtatcgatcatcaactacactttaacagaagtgttcagctttgtgggaatcacaaagaagaacatcctcttcaataccaacccctcaaatcagagataccggtctttcaccattaaaaaaaagaccgggggggagcgggtgattaatgcccccaagctcctgctggtgaggactcaaaaggctctgtctgtgatttttaccatatgcatggagatccaccctaaggcaatgggattcaccgaggggaagagcgttgttaccaatgcccagctgcatattggcaaaaattacgtgtacaacattgaccttaaggatttcttccacagcttcaaaaaatggcagattaagaggatcttcactcaaacatcttttcagtttagtgaggaaatcgccaactgcctgacaaacctgtgcgtctatgctcttgccattgatgacaaaaaagaatttgtcctaccccagggagcaccaacatccccgatactgaccaacattttgtgtagaaagatggatattgcccttgataagctggcaaaaaagtacaaagccacatacagcagatatgcggacgacatcaccttctcaagcaacaaagctgtgttcaataaccctaatttccttcaggaactcgaagctatcatccataagaataaactgcagatcaatcctaagaaaacgaggttacaaaaaaagtcagaacgccaggaggtcaccggtattactgtgaatgaaaaattgaacacgacacggaaatatgtgaagcaaatccgtatgtggctctatctgattgagaaatacggagtggaaaaggcggagacgatctttcgcaaggattatataaaggagaaaggccacatcaagtataatcagaacccaatgttttcagtaatcggcggcaaactgttgtacttgaaaatggtgaagtcccaggaagatagcacttaccagaaactagctcagcgattcgataaaatatgtggctttaacgtcgacaccatacttgacgtatgggagaaggaagggaaagaaaaggcaatggaggtctttgaggccactaagagtgaaaagtggaaaaagtcccaaaacattggtgtttccgtttttgagtttagtgacgatgacgagttgagtgagatgatcctcgacaaggacatactctga

SEQ ID NO: 7496 - RNA, 1320 nt, unidentified
  source 1..1320: mol_type = other RNA; note = synthetic construct
atgaagacgctgaccacggaggaaaagcaggaattgaagaaccggtttgaaaacattctcagtatcgatgacctggtcgaggtcattaactacgtgtatcaggagttattggccggcaatgagataagtaaggacgacgtgctctcaaatgcagacttgtctaataaacgataccacacctttagcatacgtaagaaaactggtggggaaagaatcatcaatgcccccgagagttcattggaaaaaatccaaaaggcgcttaacaccatcctgaatgagtgcgtgactgtacatccaaaggccatgggattcgccaaaggtaagtctgttgtgaccaacgcaaggctacatcttggcaagaactatgtttataacatagacctgaaggatttcttccactccttcaaaaagtggcaggtgaaaagagtcttcgcccagtccccgttccagtttcccgaagaagttgccaattgtctgacaaatctttgcgtgtacgatctggagatcgatgacaaaaaggcatttgtcctgcctcaaggagctcccactagcccaattttgactaacattctttgccgcaagatggacattgccctggataaactcgctaaaaaatacaaagccacatattctcggtacgccgatgatatttccttctctagcaatgtgtcagtgtttaacaattccgtctttctggaggagctggaggccataatttccaggaacaagctcgagattaaccctaagaagactcgcctccagaaaaaaaatacaaggcaggaggtgaccggcatcaccgtgaatgaaaagctcaacacaacacgcaaatatgtgaagcaaatccggatgtggctatacttaattgaaaagtacggggccaagaaagcagaaaccatctttagaaaggattatgctaaagagaaggggcacacaaaacccgaaaagaatcctatgctgtcagtaatcgggggtaaactgttatatctcaagatggtcaagggggccgaggacagcacgtacctgaagctcgcacagcgttttgacaaagtatgtggattcgatgctgacaagatcctggacacctggcaacaaaagggagaaaaagaagcgcagaagctattcgaggagactaagaataacaaatggaaaaacctggcggctggccgacctaaaccaaaacgccagaaacttggcaagcatctgatggagaagagcaggtcgatggaggagcaggctgagtacgttgctcagattcggaaaaacatcgcagaaaggcaggcgaagagaaaggctgcaatgaagaaaatcagaggcgaatga

SEQ ID NO: 7497 - RNA, 1182 nt, unidentified
  source 1..1182: mol_type = other RNA; note = synthetic construct
atgaaaacccttaccacagaagaaaaacaggagctgaagaacaggtttgagaatatactgagtatagatgacctggtcgaggtaataaactatgtctatcaggagctcttagctggtaatgagatctcaaaagatgacgtgctgagcaacgctgacttgtcaaacaagcggtaccatactttttctattcggaaaaagacagggggggagagagttattaaccgacccatgggagcactgggtatgatgcagaaggcactgtccgtaatcttcaccatttgcatgaaaattcaccctaaggcaatgggctttactgagggcaagagcgtggtcacaaacgctcaactacatatcgggaagaattacgtgtacaacatcgatctcaaagacttctttcactccttcaagaagtggcaaatcaagaggatattcacccagactccctttcagctgcctgaggaaatcgccaattatttagcctccctttgtgttcacacaatcgatattgacggtaaaaaagagcaggtccttccacaaggagcgccgacatccccaattctcaccaatatcctgtgtaagaagatggacatcgccttggataagctggccaagaagtacaaggctacctatagtcgttacgccgatgacatcaccttctcttcgaacaagagcgtgtttaataatcctatcttcctgcaagagcttgaggccattatccacaaaaacaagttgcagattaacccaaagaaaacacggctgcagaaaaagactaatagacaggaggtgacggggatcacagtgaatgagaaactcaatacgaccagaaaatatgtgaaacagattcgcatgtggttgtacctcattgaaaaatatggcgccaagaaagccgaaaccatatttcgaaaggactacataaaggagaaaggccatattaaatacaaccagaaccccatgttctctgttattggcggcaagttactatacctcaaaatggtgaagtctcaggaagactcaacttatcagaaactggctcaacgctttgataagatttgcggatttaacgtggatgcaatcctggacgtttgggaaaaggaaggaaaagagaaggcgatggaagtcttcgaagcaactaagagtgaaaaatggaaaaagatccagaatatcaggagcttctacttctga

SEQ ID NO: 7498 - RNA, 1302 nt, unidentified
  source 1..1302: mol_type = other RNA; note = synthetic construct
atgaccacatttaccaatgaagaactgaaggatattgccgaaaaaggcgacgagctcataatcgagaagtttgcatccttgaacagctacaaagatatactggaaatgttcaacatcgcccaagtcattttatatggtgagaaggctacacttttcaagctggaagatctgatcttctatgcgtcattgaatttttcagagaaagaccggtacttcaccttcaccattaaaaaaaaatccggtggagaacggatcataaacgcgccctgcgaagagcttaaagggctgctccagtgcttcaattacatcttgcaggtgctatttacaccccatatcaaggccatgggttttgttagagaaagaagtgtcgtcagcaatgcacaactgcatactaataagaactacgtgtacaacattgacctgaaggatttttttcactccttcggccggcagtgggttaaatgggtgctgatgcaggaaccattcaacctctctggcgaaagagaaccactggccttttggttggcatctctctgtacacattcacttgagattgagggcagcacaaagatcgttcttcctcagggggcaccgacttctcctaccttaacgaatatactctgttatcccctagacaagaaactgaatggactcgctaagaggtttggtgccacctactccaggtatgctgatgacattacgttcagctcgaataagtctatcttcaaaaacgaggtattcctcaaggagctcgaacgcattgtgaagagccagaagttaactatcaatgagaagaagacccggctgcagaaaaaggaatatcgtcaggaggtgaccggactaattgtgaacgagaaagtcaacacataccgacactatgtgaaacaactgcgtatgtggctgtattacatcgagaagtacggaatggagaaggcagaggcgttttttcgcagagactacattaaagagaaaggccacatcaaatggaaagagaacccaatgaagaacgtgctgcaggggaaattgctttatttgaagatggtcaagggcgccgaagatgctacttatctgaacctcgtgcagcgctttgatagggccttcggcttcgacgtagaggccatcctcaagatttgggaggaaaaagggattgctgccgctgaaggactgtactacaatagtaagcccaaccgattaatcaaatataagaaggctgacttccactacatactgagtgaggaagagatcgccgagcttaggactaattatcctgaactgtttatggaggaggggttcctgcaatga

SEQ ID NO: 7499 - RNA, 1374 nt, unidentified
  source 1..1374: mol_type = other RNA; note = synthetic construct
atgaagaccctgaccaccgagcagatctcatatattcaaactactttcgcatccctgaagaggaaagaaagctttctcgatctcttaaacgaggtaaagaagtttatggagggtgaaaatgccactcctttctcgctgagcttctttacacaatatgccaatcccaaattctgcgaatatgaccgctactacatcttcaagattaagaagaagtctggcggagagaggacgattatggctccatacgacacattcggagagttgctgcgatattttaacgtggtgctccagaccctttttacgccccataccaatgccatggggtttgtaccaggtaagagcatcgcaaccggtgctcagatgcacatcgggaagaattacgtctacaacatagacctgaaggatttcttccattcctttgaaagaaagagggtcaaatggatgttcacacaggcaccatttaatctatctggggagcgtgaaccgctggcattcttcctagctagtctctgtacacaccccatcgagatcgagggacagactagaataattcttcctcagggagcccctacctcacccaccctcacaaatattctgtgttacggcctggacaaaaaattatcaggtcttgctaaacggtttggcgcaacatacagtcgttacgccgatgatatcaccttctcctctaacaagagcatcttcaagaaagaggccttcctttccgaactccagagaatcataacatcccagggcctgacaataaacgagaagaagacaaggctgcaacagaaggagtatcgccaggaggtgaccggactaattgtcaatgagaaagttaacacgtacagacggtacgtgaagcagttgcggatgtggctgcactacatcgagacttatgggtataagaaggcggagatcttgttcaagaaagattacgtgaaagacaaaggccatataaaagaggccagttcgatgaagctggttttagagggcaagctcctgtacttgaaaatggtgaaaggcgagcaagatagcacctatctgaagttgcaggacaggtttaacaaagcttttgggctggacattgaaaagcttctgcaggtgtgggagacttatggcattgaaaaagccgaacaagtttatcgcgaaatgggaatcgagaactttaaaatctgcagtggcgccactgagaaggaggctgcgagctttataactttgcttgaggaaaacgggatgaaaaattctctgctgaacatccgaatttcacgcaatagaattgggaagctcctctctccatccgaaatgatcgaaattttcgataaggaagaccctaaagaaattatggaaagcatgaaaggacggatcattaaatga

SEQ ID NO: 7500 - RNA, 1230 nt, unidentified
  source 1..1230: mol_type = other RNA; note = synthetic construct
atggagattatccagcagcataaggactacatcaaggagaagtttaagctcataaagtccggcagcgacttagtgcagatcctgatattcgtctctaaggaagtgcttaagtctaaacaagacctcaacctggaccttttcaaaaaatgtctggatacagaagctaaagaccgctaccagacttttaagatcaaaaagaaatccggcggttttaggaccattaatgcccctaatatccacctcaagcatatcctatcttgcgtgaatatcgtgattcagtgcgttgacgagccccacagagcggctacaggatttgtccgggggaagtccgtgatagagaacgccaagatgcatattgggaagaactacgtgctgaacatcgatttgaaggattttttccattcattcgacaaagaaaaggttaaggaatgtttcatgaggaagcctttcaacttcaatggagaaaaggagatactggcaatctttttggccgagctgtgcactcatccctttgaaatcgattgcgtcaagaaagctgtacttccacaaggagctcctagctctcccacaattaccaacgtaatttgtaaatccatggactgggatctaacagaactcgccaaccgatatggcgccacttataccagatacgccgatgacatgaccttcagttcgaatcacgatctgtactcagacgcattctacgaggaacttttccagatcattaactcacacgagttaactgtaaacagtaagaaaactaggttgcagaagaaaggttacaaacaggaagtgaccggtctggtggtgaacgagaaggttaatgtcccccggagatatgttaaacaactgcgcatgtggatttatttgtgggagaaatatgggtatgagaaagcggaaagtctttttgctaaagactatcggaaagataagggccacgttaaaaaggacaagaatacgatgctcagcgtgattaagggcaagttaaattacctgaagatggtcaaaggagagacggatccaacctacaaaaagctgtacttgcgatatttccacctcaccaattacctattcattgatgaaatactcggggtgtgggagacagagggcctgaacgccgcaatcagcgtgtatgaaaaacacaaacgtaaggagatgaactacccagagccgatcgatgtcaataaactgctggaactgtttgccaaagcagggatcaagtttgagtga

SEQ ID NO: 7501 - RNA, 1197 nt, unidentified
  source 1..1197: mol_type = other RNA; note = synthetic construct
atggataagtttcgggaggaatttaatcccgaaatacatcccattcagaaaattaagggtaagagcgattttgtaaggctcatcaactacctgagactcaccaacatttccggcaatatcaaacccattcctcttaagcactttacattctatgccaatcacctgctatcaccaaaccgcttcgagtccttcgaaatcgtcaaaaaaaatggaggcaatcgaacaatccatgcccctaagcgaggtctaaagtctatcctcactgggctgaaccttttcttcaagcagcattacaaaacacacccaaacgtcacaggttttgccgagggcaagtcaatcgtggacaatgcgaagccacacatcgggaagaagtatgtgctgaacatcgatttgaaggacttcttccacgcttttgagaggaagcacgtaaaatgggccatgatgaacgcaccatttttcattaaagaggaaaaggaacccctggcgtttttcatcgctagtttatgtacgcatcccatagaaattaacggggagacgaaatttattctccctcaaggctctccgtgctcacctatcctgaccaatctgttgtgcaggagactggataaacagctcaaaaacctggcacaagaataccaggctaaatataccagatatgcagatgacatcaccttcagctccaatcaccacaagatatctgagaaggacttctacaacaagctggagtatgtcatctccaaccacaatcaccagataaatactaaaaaggtgcgtcttcagaaagagggatacaagcaggaggttaccggaattatcgttaacgaaaagcccaacctgcctaagcgctacataaagcaactaagaatgtggctggcatattgggaaaaatacggatacctgaaggccgacaagctgtttaaaaatgactacttaaaggagcgggggcataggattgagggaactcctcatctgttgagtgtgatggacggcaaactccagttcctgaaaatggtgaagggcgataaagacccgacctataagaaattagaatcgcggtttcataagctcaatggggataaaaaactcactcaggctcatcttgagcttatgaaaattaaccccttcaagccaagcctcaagaatcaacagagcttggaggaagtgctgattaaattggcccgcaagaaaatcttgtga

SEQ ID NO: 7502 - RNA, 1248 nt, unidentified
  source 1..1248: mol_type = other RNA; note = synthetic construct
atgaaggacaatgtcgacatccaagctatcatcagggatgagttcccaaagatggagacacaagaggacctcttagttcttatgaacaaagtcaaacgctacctagagaagggcagtaaggaggagtttattccgctcataatgcagtctttgaactactacaagaacattaaggtgtctggcgagcggcgatacaagacattctccattaagaagaagtccggggcatttcgaacaatcaacgctccatgcaccggattgaaagtgtttcagtattgtctgaactacatgctccagaccctgtatcagagcaaccccaatgcctgcggttttgtgcccggccgcagcatagctgacggtgcaaaaaaacacgtgggcaaaaacttcgtactgaatattgacctcaaggatttcttcgatacgatcgaattgcaccgtgttaaagctatcttcactctgcccccctttaaccttaaggatgacaaagagaacagcaacagtctgccatacatcttagccaatctgtgttgccatcctaaagaagttacgaggattgataaagatgggaatccttatcagtgtgttaggaatgtcactccacagggggcccctacatcccctattatcacaaatctaatctgtcgccaactggaccggaggctccttgggctggcaaaaagatttcgcgtgagttattcaaggtatgcagacgatattaccttttcatcgaacaacaaggatgtctttgaagaaggctctgcgttccgtgtcgagctgaagcggataatcgaagaggatcagaagttccgaatcaatgaggaaaagactagagtgcagtcaagagcctatcggcaagaagtgaccggtcttgtagtaaacaacaaagtgaacgtcactaaacggtatgtgaagcagataagaatgtggctgtacctctgggagaggtacggctataataaggcctccgaacacttccagaaagattataatcgctacaagggacaggccgaacatgggaccagaatggagaatgtgattggcggaaaactgaattacatgaagatgatcgtgggagctgacaatgccgcatacagaaaacttgcggagcggttcgaaaagttggtgctggacattatcggagaaaataagaccctaaacaccgacgttaagatcgagactagcatatgcaaagaagacttgaacgccattctgaatgagctgaaggagctcgataagttactgaaatga

SEQ ID NO: 7503 - RNA, 1239 nt, unidentified
  source 1..1239: mol_type = other RNA; note = synthetic construct
atggacaataacgcagacatcaagacaacgattcttgacgaattcccgaagatgaagacacaggaggatctgctcgcgcttttaaacaaagttaaacgcgtaatcgactcaaaccatcaacgggattttacccctattaatgagaagagcttcaactactacaaaaacatcaaggcctcaaagaataagcggtacaagacttttagcattaagaaaaagagcggtaaactacgaaccattaatgctccatgcgccggcttgaaaataatccaaacctgcctaaattacatcctgcaggtgttttatcagccgaacaattacgcttgcggcttcgtacccggccgctctatagccgatggcgctaaaaagcacgtgcataagcagtatgtgctgaatattgacctcaaggatttttttgacacaattgagcaccacagagtgaagagtctgttcaccctccctccctttaacctgaaggatgataaagaaaatcctaattcagtcccctacatcctcgctaacctctgttgtcacccaaaggacgtgacaaggtttgacaaagacggcaatacattcgtgtgcaaacgcaatgtcacccctcaaggggccccaactagtcccataattaccaacttgatttgtgcacagctggatagacgattagccgggctggcaaaacggttcaaactgtcgtattcccgttatgccgatgacataactttctcctccaactacaaaaatatcttcaaagagggttccgcctttcgcctggagcttacaaggattatcgaaagcgatcagaaattcaggatcaatgaggagaagacgaggatccagtctaatgcttttcggcaggaggtgactgggttgattgtgaacgaaaaggtcaacgtcacgcatagatatgtgaagcaaatcagaatgtggctctatctgtgggagcattatggatatgacaaggcatttaagtgtttctctaaggattactccctgagtaaaggtagcgccgcgcacggaaccaatatggataacgtcattgctggcaagctgaactacatgaaaatgatcgttggagcggaaaacccaacttataaaaaccttagcaagcgtttcaagaagctgatcaacattcaggagaacggaatcaacgttactgcaatcttggacgtttgggaaaatgaggggatagaatctgccttagaaacctacaagaggttcaaagactacaacaataaatga

SEQ ID NO: 7504 - RNA, 1260 nt, unidentified
  source 1..1260: mol_type = other RNA; note = synthetic construct
atgaataactctgccgaggacatacatcgtttgattctggacgaattccctagagttagaactcaagaagacctgctggcattactgaacaagatcaaacagctccttgtagggtgtgctgacgaggagacttgcaaatccctgaccatgtcgtcactgaattactacaaaaatgtcaaggtgtccctacggcaccgctaccatttgttcaatatcaagaagaagtccggaaaactccgtcaaatttgcgctccggtagagggcctgaaaatcctgcaatcctgtttgcgcgaaattttcaacgcattttatgagcccacaccaaacgtctgcggcttcgtgaatgctaggagcatcgctgacggggccaaacggcatatcggcaagaactacgttctgaacatagacttaaaagacttcttcgattccattgagtaccatcgggttaaggcgatgctctgctgtgccccctttaatctgcgagataaccgagactctacccagagtctcccattcgtcattgccaacctctgctgtacacctaaggaagtgatcagatttgacaaagacggaaaagaatatcgctgcaggagatctgtgctcccacagggtgcgcccacctcacctatcctcacaaatctgatttgtcggcagatggacaggaagctctatctgttggctaagaaataccattgtgcctatagtagatacgccgatgatattacctttagcgcaaataagaacatctttaaggtggatagcgatttctatagtgagctacgacacatcatcgaagtggagtgcaaactaaagatcaatgaggaaaaaaccaggattcagtctaggaaatataggcaggaagtcactgggctggtggtaaacaagaaggtcaatgtggcaaagcgctacatcaaacagattcgcatgtggctgtacctttgggagacatacggctataagaaggcccagaatctctttatccacgattatttgcacgataagggacacgtcaagcctgaaacggtgcaccttgaaaacgttcttcgggggaaattggattatctgaaaatgattgtgggcgaagaaaaccacacttacagtagcctgtgcgaaagatacgagaagctgatagagtgcgagaacaaaccaaatcccagcgttgtgaagcaagagaagacgggtaaaaagaataacttacaggagttaaccgaggactgttcaatcgtggagctgcttgagatgcttatagataagatatga

SEQ ID NO: 7505 - RNA, 1347 nt, unidentified
  source 1..1347: mol_type = other RNA; note = synthetic construct
atgaatcagcaaaaagccaatattcagcagatcatccgcaaagagtttcccaagattactactgaagccgacctgctccagctcttaaatcgaattaatagcgagctgcacaaggaatttttcgcagcaaaagataagaaggtacctcctatcaagctggctactctgaaatactacaagaactacaaggtgtccggcgctaaacggtataaaacgttcaccattaagaagaagagcggtaaagataggttcatcaatgctccggcgaaggggctcaagttgatccagcagtgtctgaatgagatcctgcagacttactaccagattaacgataacgcctgtggctttatccctgatcgcagtatcgtttatggcgcgaaacttcataccgacaagccatatgtgcttaacattgacctaaaagacttctttgacacaatcacatttcctagagtgaagaaagtgctcgctctgcccccttttaatcttacagggtcaaaggagcccgtcgcctatatcataacatccctgtgctgccatcccaaggcagtcgcaaaggtggacgagaacggagaaaagatcaccgagattaaacaagttctgccacaaggggccccaacctccccaatactaaccaacattgtatgccgtaacctggatcgccatcttgccgggctggctaagcgattcaaagccaactattctcgctatgccgacgacattactttcagtgctcataagaacatattccagcaggattccgtattcatgttagaactcaagaggatcattgaggacgagcagggtctgaccatcaacccagagaaaaccagggtgcagtccaagcgtcagcggcaggaagtcacaggcctagtggttaacaaaaaagttaatgtccctcagagatacgtgaagcagctcaggttgtggatccactactgggagaaattcgacatcgagaaggctcagcattttttccttcagcagtacattactcaacggggaaatgtgaaaagccacaaatcacacatagagaatgtgatcggaggcaaactggattatatgaggatggtcgtgggtgaatcgaacccggcctacaagaagttaagaagacggctggataatcttattcagatcgaggaacacaagaaaagcacaagcgcgccccagcagacgtctagctacaaacaaaagcaatgtgccaaaaccaacaaggaatatatagcagatgggaatggcatacaatctctgagttcagagcagctgccctttacccacaaagatgacttggaagtcttgttggatggactcattaatgacctctctaaggaaaaccaatcactgtga

SEQ ID NO: 7506 - RNA, 1425 nt, unidentified
  source 1..1425: mol_type = other RNA; note = synthetic construct
atgatccttacggtcgaacacataaaagctattcgcgatcaatttcagctcttgcggaccaaagaagatctcctagccttgcttaattttatcgcctatccacaactgtatgccaccggctatgtgcctgatgacattgattttagcaaaattgagctgcccgacgacgctaccaccgcggaaaagttgggcctggtgttcaacagtagctccaaaaagagaaggaagcagataactgctaaacagctgacttacttctctaccagtttctctgatgcagagaagaaaaggaaaagatactaccggttccatatcttgaaaaagtctgggaaaaagagggagattcatgcccccgtgtctaaactcaagcagatccagtcatgcatttaccacatgttacagtcggtctacgaaactcaacctcaggcatatggcttcgttgccggcaagtcgattgcagataacgcaagtcttcacaccggtaaggcattcgtgctgaacgtggacctgaaggactttttccctagtgtacattttagaagggttaaagctatgctggaaaagcctcccttttacctcagcggagaaaaagagcctcttgcctacctgatctctaacctgtgtactgagaatggtgtgcttccccaaggcgccccaaccagccctttctttaccaacgtgatttgccagcggttggatcagaaactggagcgattggccaaaaagttccagaccacatacagccggtatgctgatgacttaacattctccgctaatgcctacgttttcagcaagcgcttcatgctggagctcgaacagatcgtgaaaggggaacgctttcagatcaacgaggaaaaaacacgcgtgcaggggtcagcctacaggcaggaggttacggggctgactgttaatgagaaggtgaatgtcaacaagcattatctcagatcctatcgaaccctcctgcacctgtacaagaccaaaggaccgctagtcgcttatgagtatcattacaaacgtatgccagagtcagtgcgggtaataaaacagcaacgtacagtgacatccgcaacttcccacatacagaacgtcatttggggaaagtatctctttcttaaaatgatcaagggagactcagtccccatgccgccctttaccagaaataagtatgccaagatggtgatcgagaagtctatctccttaattaagccagaaccagaaaacatcacaggtgacgacgacactaagaccgagacaaagaagtaccaccaaccagtggtacagacaattctcctggaggcgagcgtacccaatgagcctgtcgaaccgaatacaaaaaaagagacggtggttgaacagctgttaactgcgtgggagaaggagggcctggagaaggccatcgaactactgaagacaaagacgacttga

SEQ ID NO: 7507 - RNA, 2016 nt, unidentified
  source 1..2016: mol_type = other RNA; note = synthetic construct
atgaataacccgttcaacgacttaaagccggagcaagttgagggaattaatgagcggtttcacgggttaaattcttccaaggatttttaccttctgttagtagacctcctagatatcctgaacgtcaaagacgaggaaaaggaaatatttaaggcctggataactcagttcatcaggctccgatttcctagacgctacacatatttcactatcagaaaagcctcaggaaaggacagaattatccactcacccaacgatattctgaagttcatccagcgcctttttaacctggtcctaaacacagtttttgtgccacatcccaactcatttggcttctcaaaaagtcaatccatccgagacaatgctgctgttcacgtcaattataactacgtgttcaacatcgacctcattgatttcttcactacgatcgatgctgagcgcataaaaagcgcgtttaaggagtccccctttaacctgtctggagagaagcgtgagttgataaaccacctggtgtatctcacctgtattccgattaaactgggccaggataaagagaatgatacatcaatcggaacactcaaagtcctgccacagggggcaccaacgagcccaattatctcgaatattgtgtgctatgcaatggatcatcagttggctgaactcgctgacaaattcaagattaactatacccggtacgcagacgacattaccttctcttctaataggaacctttatcaggaaggaagcaaattcaggcatatgctggagtctatcgtgataagccagggttttgctctcaatgggaacaaaacccgcttacaaaaaaaacactcccggcaggtggtaacaggtctggtggtcaacgagaggaccaatgtaaaccgggattatataagatccctgaggatgtaccttcactactgggagaaatatgggtaccaaaaagccgaacagctctataataaagacgttgacactgaactgttcttcggagagcccaaaagtctgttcgaccttctcaagggtagaatcgactttctgaagatggtcaagggcgcagacgataacgtgtacaagaacctgaagaagagatggcttcggcttacaaatcctgactcacggaccattgaatttcgggatgagtacttcaatacccataagccaaaggacgtggcgaatttcctgcgcctctttcaggatagtgcaggcttgaagtacttgacacacgattttgatacccctggcgccaaattttcctacgagaagattatggacactgccaatacggaattttcaactggctttacaaaatacgctatcacacgagccttgtatgcaagaataaagcagttcgccttcactgagcggccatcttggtggcgttgggtgaatggggaaaagtccacatacaacctagggtggaagagcaccaagctgaaaaactggatcaatgaaaaccccggcgtgcaccctattaggttcaagatcttccgcgacgagttaataactcccttcaaagactctattcaaatcagggcccctaagtttaaggagctgattgagaactccattaaggagaagtttcaggactacaagagtgagttcaatatcagcttcaagtatctggaaacggcggagttctacaccgatgtggatattataatgggtgggatccgccatcttttcgacggtatcatcgaaaggctaagtctgtcgaacgaaatcatcattagctttaaacgtaccgaaatcaatggccgattgatcaaagtggtcgaaatcacccacgttaattccagttgcttcaaggaagctaaaatcaatgatctgctcagtggcaactttattgaagccaagcgagcctttcagggactctgtaactggagcataaccgccagcttcgcagacgggaattataaactgaacatgctgaatgatagcgatccttacatcgagagagaacccattgcctctgacgagattctgggcttcactcattccttgtatttttactga

SEQ ID NO: 7508 - RNA, 2016 nt, unidentified
  source 1..2016: mol_type = other RNA; note = synthetic construct
atgaatagtccatttagcgatctcaaacctgagataattaccgatattcggggacgtttcgaagccttgcggactaaagatgacctgtatgacctgttccagtcggtcattagagagcttccagccggcgaaaccaaaagagaacactttgagcaggaaattgcttggttgtacaagaacggctacccccgcgactaccatttctttaaaatcaagaagacgagtgggaaggatcggcagatcgccagtccacaaggccccctaaaaacagtccagcgaataatagccgttatcctgagcagtgttttccagcctcacccacattcctttgggtttagaaaaggaagctcagttgtcgacaacgcaagaatgcatgtggggtttcactacgtgtttaacatagaccttgcagacttctttacatccatttccctcaaacgtgttaaaaggagcctggaaggatcaccctttggactggatctttccagagagcctatcgccgcccaactcgccagaatttgctgtatcgaacttatcgtgccgggcgctaattccaggcgggctttcctacctcagggtgccccatcctccccggttctgtctaacattgtgtgtcaaaagatggacgagcgacttaatggtctggccaagagattccacctgaacttctcgagatatgccgatgacatcacgttcagcgctaaccacaatgtgtttcgagaagggtcagaattccgattggagcttgccgatatagtgacagcctctggcttccaaatcaatccgataaaaaccaggctgcagcgccagaagaatcgccaggaggtcacaggactcacggtgaatcagaaggtgaatatctgcagaaaatacgtgaaggagctgaggaggtacctatattactgggagcgttatggccttactaaggcctatgagttatatctgaaggatcagcacgaattcctgctcagcggctctggtgttcctatggccgctataatcaaaggcaaattggacttcctgcacatggtgaaaggggacaccggcgactacttaaagcttctggcaaggtttcacaaaatggacaagggtggtccccggaaggtggtcaagggcgagaacgccacccaccatcaggaagctgagcagttccaacaacatcaaccacataacgtcgctattttcttgcgtctgtttcaggattccgctgggttgaaatacctgacacacgagttcgatatcggagatgaagtattcaacctcgaacagaccgtagaactggcaggcagggaatttcaggccgcctatcagaaacaccctatcactcgcgcgttgtacgcacggattaagcagttcgcgttcgaaaagaatcctaagtggtggaggtggcaggacggaaagatgcgggaaatcaacttggggtggtctgctccaagcgtccgcacctgggcacagaaatttcccggtactcatcccatgctgctgttaccctaccgagaggagatgatactaccctttaaagaatcaatccggatcagggcccccaagctcaaggagctgatcaacgctaacatcaaagccaaatttcgcgaggcagcggcagactgggatgtggaattgaatgacctggagcgcgcagacatctacaccgacgtggatatgctgctgggaggaattaggcatctgctcgacggcatcttagagcggggcgaggtgagcagaaagctcctcattacttatcggaagacagtagtgtcagggcgcgagatgaagatgatcgagattattcacactgctagtatctgctacaaggatgccgcgatttctgagctcctcaatgggaatttcttagaggctaagaacgcattttatggcctgtgtaactggtctgtcaccgcaattttcaacgatggagcttatcgccttaatattctgaaggatgacgtcgatatgcctgagcgagaggcggtaatggtgaaagtgctcgggtttacacatcacctgtacttctattga

SEQ ID NO: 7509 - RNA, 2010 nt, unidentified
  source 1..2010: mol_type = other RNA; note = synthetic construct
atggccgaagaacacagatccgaattaaaagccaaatttcaggaggtggctaccaaaaaagactttttcgacctcctgatgcgggccattgagtgtcttccaatcagcaattcagaaacacatcgatttaaggagcgtctgaagaatttccatatcacagacagccgggagaattatcacagttttacagtgcgcaagtcctcgggcaaagacaggttgatcaacgcccctgtggcacccctcaagttctttcagcgactagtaaatgtagtgctgtcatgcgtcttcgaagctcatccaaacgcttttggcttcagaaagaatggctcaattgtccagaacgccagcttgcacgttaatcagcactacgtgttcaacattgatctgaaggactttttcacaagcatagacgacgtaatgctgataagtgctcttgagaacgccccatttggtttcaaggggaaaaaatccctgctggggcaggaaatcgtgagactttgtaccatgaaaatggacttggcaatgccgggtcaaggaacccagagctctaaggaggttagagtgctcccccagggagccccaactagtcctctgctctccaacgtggtgtgcctgaacctggacatcaagctcaccggcctcgctaagcggtttggcatcacttacagccgctatgctgatgatattaccttcagctctaacagaatggtcttcggacagtcatcctcattccttcaagagctgaagaagattatcatcgagcagaaattttccatcaacgagagcaaaacccggctgcaacatatgtctcagaggcaggaagtcactggactggtcgtcaataagaagatcaatgtggaacagaagttcatcaaggcagtgcgcatgtacttatactactgggagaagtatggatatcctaacgcccaggggaagtattacgcagatcaagggattgattattactacccggagtcaaaatctttgctggatacgttggatggtaggctcaatttcctgaaaatggttaagggagaagacgattctacctacgtcaagctagcacaacggttcaagaaactgtctggcagtctgtctactaggaagcacgctaatctgaatcccacgtccagcgaggttttcgaagagcaccggccagtggacgtggcgacttttttacgtctgtttcagcatggggagggcctgaagtatttgactcacgattacgatctccccgggcgcgagttccagtatgacaaaattatggatcttgcgggcagggaatttaatggcgcgtttcggtcctattctatcacaaggtctttatacgcacgagccaaacatttttgcttcgaaaggcgtcctaagtggtggagatgggaaaacggaaagaaaatcgatatcaacgtgggctggggaagtcctgagctaaaggaatggatcgcagacaacccgggtgtccacccaattagaatgaaggtcttccgcgaccagtttattaggccctttaaagagagcatacaatttcgggcgcctatgctccatcaagccgttgtgcagacccttgaagagaaatttggcgaagagtttcagaacttcgagatagagcttatcaatttggagtcagccgaatttttcacagacgttgacattttcttagggggtgtacgacacatcctcgacggtattctggagagagtggatgtaagcaaacgcattaggattgaattcaaacggcagatcttcgggaatcacaacatgaagatactagagataacgcacattagatctaagtgccaccgcgatgctaacatagttgatcttatgaacggcaatttccgcgaggtggcccgagcttttaaaggactgtgtaactggagtatcacctcctccttctcggacggcaactatactctgaaagtcctcgatgacaatcccggaagtccctcgaagatgtccgtggacgaggatgccgtgtacgggttcacacataccctcagcttttactga

SEQ ID NO: 7510 - RNA, 2067 nt, unidentified
  source 1..2067: mol_type = other RNA; note = synthetic construct
atgacctactacatagagttcgccagcccacatccattcactaatttgaaagacccactgaaacagattacacaggaacagagacaggaagttgcatctaaatttcacgcatgcgcttcacaacaggagttctatcaaatcctggtgcaccttgtgagcctgttagacatcaatgatttgggccagacctattgctgccaaattcttagccagttcgaaataggtgaagatagtcccacttattctaacttctcgatcaagaagcgatctggtcgctataggcacatttctgccccgtccgaagagctgatgcttattcaccgcctcattaacttccttctgagctgcgtgtttcagggccatcagtgttcccacgggttcaagaaaggttctagtgtggttagcaacgcagtggtgcatgtaggtaagaagtacgtgttcaacatagatctaaaggactttttcccgtccatcgattctgaaatggtgaaagaggccttgatgaggccgcccttcaatctgtcaggtgaaaggaaatctatcgcggagcacctcagcggactctgtacaatgcgggcccccctgaagaaggggatccggaatagttcaaggaaatttattcttcctcagggcgctcctacatcccctctgctgtccaatgccgtgtgtcagaatctggacaacttgttggagagcctcgcgaaagcgaatcagttagtctatacgagatacgccgacgatattacctttagtggcaataacaacgttttcgaagaaggatccgccttcttgattgagctcgtcagaatcattagcgaacagggcttccagatcaatgagtcaaagacgcgcttgctgggcaagtccgctcgccaagaagtcacaggaatcgttgtgaacgaaaagactaacgtaaaacgggaatacctgaaaccattacggatgtacatctactattgggagaaatacggatatcacgaggcagagattaagttctttaacgacaggagtctgatttcggataaggagatggagtccacattacattctacccttgacgggcgcttgaattacatgaaaatggtcaccggcgaaaaccaccccacatatctcaagctctcaaaacgttttaagaaacttgctaacaagcggtttgcggaaaaaaagcagaaatcgtctagcacacacaaaggagactttagcgaacatcgtcctaaggacctggcccgatttctccgctttttccaggattccgacgggctaaaatatctgacccatgatttcgatatggtggacgccgtctttgactacgaccgaattatgatgtatgctgttcgagacttcttcagaggagtcaaggagaactacatcactaagcaactgtatgctcgcgtgtaccagtttgcattcgaagaggagcccaactggtggaaatacgaggatggcaaaaggattgagattaacataggatggagtagcaagcaaataaaagagtgggttcggctaaatcctggcactcaccctatcaggagcaagctgatcagagataacctgatcagaccctttaaagagtcaatacagtttcggccaccagcactcagaaacagaatcgagtccactgtgcgtgagaagttcggcgaagattatgatgagcttcagatcgactactccaatctagaggccgccgagttttacaccgatgtcgaactggtactgtctggggtgaggcatctgctcgacgggattctcgagagaattggaatcagtaaaaccatacatatcgctttctctaagcaagaggtcaatggcagccttatgaaggtgctcgagatcacgcacgtagggtcccggtgctacaaaaatgctctgcctaaggaactgctcaacgggaacttttcagatgctctaaagttattccatggcctgtgtaattgggccgtgcgggcctcatttgcagacggagacttcgaggtggacatgctgagtgataaggaaaagctgagccagaagaggcccgtcaataaggagttgatcagtgggtttacccacctcctgcgattttattga

SEQ ID NO: 7511 - RNA, 1281 nt, unidentified
  source 1..1281: mol_type = other RNA; note = synthetic construct
atggcaaagaaaatcgaaaacaccgacctgatcatccagcggtttgccgcgatgcagagtattaccgacctgctcgagttgctgaacctcgtgaaaaaggaactgtacggcgagaaggctaatccattttctctacgacagcttaactactattcattatcgaagctgcaggctcagcactacaggcaatggagcatccccaagaagaacggaggggagcgaactattcatgcccctgtgaacggcttaaagcatgtgcaggcttgcctaaatgccattttgcaagtgctgtttgagcctcattatgccgcaatgggtttcttacctggaaaaagcatagtggataacgctaaaaaacacgctagcaagggattcgtgtataacctcgatctaaaggacttctttcccagtatacccagggaaagagtatgggcctgtctgctgcttcccccatttaatctgggatccagtacggagcggagacaactggctaataggatatctttcctttgcacagcgagcatcgagattaccgatgcagagagggggaaaatactgaacacttttctgccgcagggagcaccaacatctcctacgataaccaacatcatcgctagaaagcttgataggcgtttgcagggcgtggccaataaatatcacctcacatattcccggtatgccgacgatattactttctccgggaatagtaatgtcttcaaaaagtctggcgaggtggttttagagatccgccggatcatcgaagaccagaaatttcaggtgaatgacaagaaagtccggctccagcaacagggatataggcaggaagtgactgggctgatcgttaacgagaaagtcaacgttcctagacgttactaccgtcagcttagaaactggctgtacctttgggaaacctatggtaaagagaaggcatccaaactgtttctcaaggattaccgggccgataaaggttacaagagagacggcctgccggacatggactgtgtaattggcggcaaactggattacttgaagatggtcaagggccaagatgacccactcttcgccaagctcaatgcccgctacctgcgcttgagcaatattgaaagccaacagggggagtcccgctcatatattaagacctctcaggagtcaagcaagaaggaaaagaagaaaaacgttgaggaagggaaggaaccccgcaaactcatcgagacagtcctggaaatgattaatcgagactccttcgagaaagcaatggaatacttcttgtcaaaaaagtga

SEQ ID NO: 7512 - RNA, 1272 nt, unidentified
  source 1..1272: mol_type = other RNA; note = synthetic construct
atgaaggctgacccagagaaaattcctgaaatcagagctagttttgcccgaatggaaaccaaggatgacttagtgaaagccttgaacctagccaaggagatcttgtatggtaaaggagtcaacgaattttctctaaagaacatcacctattacgcagacacgaggttccaacgtaaacgatacagtgaatttcagatcccaaaaaagcagggcgggactcgcactatacatgcccctgttccaggcctcaaagcaattctgcgatgcctcaaccttttacttctgtccgtgtacgaggacgggtatgagaacgaggccatgggatttatcccagggaagtctataaagaataacgctgagtggcacacagggaagtcgttcgtcttcaacattgacctgaaagatttcttcccctccatcgacctctatagggtgaagaccatctttcagctccctccctttaatttgaagggcgagaaagaacccctggcttatcttatggcccgcctgtgttgtgaaaaaatggaggtggtgcgcaaagacaatctgggagccgaaataaagaaagtagcgactgttttgccgcaaggggctcctacaagcccagcgatcaccaatttcattgcacggaaaatggatcggcggctgaaaggagtggctaagagattcggtgttgcatacacaagatacgccgatgacataaccttttcaagcaatcacaacgtctataagaagggtggcgatttcctgctggaggtggagaagattattagcgagcagggcttctgcattaatgaaagtaaggtaaggctgcagcaaagggagtacagacaggaagtgactggccttattgtgaacgaacaccctaatgtcccgcgcaaatttgtgaaacagatgaggcagtggatctatctgtgggagcattacggctatgaaaaggcaaatctctttttccggagagactactctcaaaaggccggaagggtcctggcctttatacctcccctcgacctggtgctggacgggaagctgaagtacatgaagatggtggttggtcccgaacacactacctggatgaaattgaattcccggtactcactgttaacacaggatcgcgtcatctccgaccccgacctccttgatattaataaggctctcgagagcctattcgtagagatgcgtaaaaacattgatgagttcatcgccgaggttaattaccatcaggagacaaaccaggcgatcaacatcgatgataacgaagcaacggattga

SEQ ID NO: 7513 - RNA, 1215 nt, unidentified
  source 1..1215: mol_type = other RNA; note = synthetic construct
atgaaggctgaccagaaacagattcaagagattcgagatcgcttcgctaaaatgcaaaataagacagatctgctggatctacttaactttgccaaaggtatcttgtttctacagaagtctaatagcaaatctctgagactgagcacactgaattggtatgccgacccgagacttagtgctggcaagcggtatatcgagttctcaatccctaagaagaacggtggacagagaaagatacattctcctgctcgttccttaaaaactatacagcggtgcctgaatctcatccttcagtgtatctatgatccccatccggctgccatggggtttaggcccgggttttcagttgtagataacgccactaaacacacaggaaagaacttcgtgtataatctggacctcaaagagtttttcccctctatagaacttcaccgcgttaaggcatgcttcaagaacccccctttcaacttaactggcgacagggagcctctggcctttttcctggcaaatctgtgttgtcacgagcaagaagtggagcgcgagggtaaaccattggtgctgtcggttctaccccagggagccccaacgtccccaacgattaccaatatagtagcaaacaagctggaccggaagctcagtgggctggcaaatcggttcggggcctgctactccagatatgctgatgatattaccttcagcagcattcattacatatacggacgtaacggcgactttatcaacgaacttaagaagatcattgcgaatcagaagttcaagattaacagcttgaagacacgactccagaccaaatcaaaaaggcaagaagtcactggcctcatcgtgaatgagcacgtgaatgtgaacaacatctacttgaagaacattaggcagacactgcacatttggaaaaaatttggcatcgataacgcctggaaatactacaccgaaaacgaagacaccagaactaccaataaagagaattcatccctgttggtccagatcatgaacggcaagctccagtacgcactcactgtgcgcggcaaagaagactttctcatcaataagtacttcaccattctcaaagaccttatggcggataaaaggtccattccagaccagaatctggaattaatcttgcaagtcctgctgaccgagggattagacgaggccatggagaagtatacaaacaatatcagtcagggtaacgggaagtga

SEQ ID NO: 7514 - RNA, 1206 nt, unidentified
  source 1..1206: mol_type = other RNA; note = synthetic construct
atgaagcttaccaaagaaaatatcgaggaaatcggcaaggacttctttgagatgaagtcccgtgaggatctcctgaatctactcaataagaccaagttttacctgtttggtgacaagtcaaagccaattcaactaaaaatcctcacatactatgcaaatcctaacattgctggaaaacggtacgtcgagtttaccatcccaaagaagtccgggtccattaggcgtataaacgcgccagtgaaaagcttaaaatacatccagatgtgcttgaatgtcatactgaacattgtcttcaaaccctctcctttcgccatgggatttgtgccgggccggagtatagttaccaatgcgatgattcatcaaaactgtcggtacgtatataatatcgacttaagcgatttcttccactccatcgagctccacagggtgaaagcagtattgaagctgaaaccctttaatctttgttcggaaagggaaccgctggccttcctgatcgccaacctgtgctgtacggagctcgacgtgaatcggcttgaaaacggcaatcagattgccgtggtgcggtctgtccttccccagggtgcacctactagccccgttttgaccaatattgttgctcaaagactggatcgccgactgtatggcttggccaagaggttcaacatcaactactctcgatatgcagacgatatcaccttttcagccagtatgaacattttcaagcagaaaggagaatttaaccatgagcttacaaggatcatcgccaacgaggggttctctatcaacaaagacaagatcagactgcaggatagatgctttcgccaggaggtaacagggctcatagtgaacgagaaggtcaatatacggagacgctatatcaagaacatcagattgtggctctactattgggagcgctatggttatgaaaaagctgctcagtactatgaacagtattaccgaaaggataagatgtacatcaaaattgtgcctagtctggaaaagagcattctggggaagctaactttcataaagatggttaaaggagacaaagacccagtgtttagaggcctgtggactcgctttgagacactggtgaagaggttcaaagagtccaaaagcgctatgttagattacaacattatcctggagattctcttcaatcagggcattactgccgcaatggaagcttactcaaaagtgaagtga

SEQ ID NO: 7515 - RNA, 2226 nt, unidentified
  source 1..2226: mol_type = other RNA; note = synthetic construct
atgacaacttacgaagaacagcacatacgcaaacaagtggccctcagcttttccgagatggagagcacaaacgacctggtgcggctaatcaacaaagtgtggtctttttttagcggagaaaactatcagcctattccagccaaggttatctatcacttcagtaaccatcagcattcacaagacgcatatagaagcttcgagatccctaagaaaaatggaaagatgcggacaatccagagcccatgtcacgcgctgaaacgaattcaattctgcctcaactttatcttgtcgtccgtttatgatgacccccatcccgctgctaaagggtttgtccggggacgtagcattttggacgccgccaggccccacgttaaaatgccatatatttaccacgtagacctcaaagatttcttcccttctattagtttcttccgcattaaggcatgtctagaaattccccccttcaatttatctgggtccaaaaagaatatcgcgttttgcattgccaatttgtgttgcttgtatgacggcgaacagtcccgactaccccaaggggcgcctacaagtcctatcctctctaatatcgtctgtcaacggctcgataaaaaactgacaggcctcgccaagaggtttaatgctcggtatacccgatatgcagacgatctgaccttctcgtcatatattaatcttgccggcgagaaagatttccaggaagagctcgcccggatcattgacgggcagcagttctgcgtgcaggaagataagacacatcaggaaaaccgccaataccgccagcgcgtcctagggctgaccgtcaacgagaaactgaacatttctaaggagtacgtaaagtcaataaagatgtacctgtacctctgggagtcgtacggttacggcagagcttgccggctgttcgaagctgactgggataagtccgctaaaaacacacggagtatcccgagtcttagaaattatctgtccgggaagctggagtacatgcgcctggttaagggcagcgatgacccaacttttcagagtctataccagaggttcaccgacgtatgtatggagaatgacatacccgattggaaacagttcaagaaggaaatggaactgttttgtcaaaaagcttacaacccaacatatgacgccaaggagctcctgagatggtaccaggagaggctcgtggacattgatgtccgtctgctgaaggagtccaacctgtacttttcaatcaccaaggcattcacgtacctgagtaagaagctttatgcaaatcagcctcttatgaccaaggtggcagttcacgacgcccgcagattgccgtttttcctgtatacacacttctcaaaacaagagccattaaagtttttgactcatacttgggaccagtatgcggaatctacctcttttactgactacgaggatttcatccaaaagactaacgaggccttcaaaagaatcacccctgagtttaaggagcttgatcgacagctgtacgcttgcttttacgccttcctcaacaatgacggtaatggcagaggatgggggcagtaccacttaaaaacctcctggaagagcgattggataaaagcatggtgcaataagcatacggacagctccccctgggactgccctatcccagaagcctacaagcagatcaatgataacttgcgagtgaactactttagcgacatcatcgagttatttaaagaggagtttcagatcaggaccgaaaatcagcagctgaaaaggatggtccggagactcgtgaataagcatcttaatcctggcttcaacgtgcgtattaacgtgccacccaccaaactgtataccaacgtgtcactgttgtctcacgcactggacactctgttatataatctgtcccagaggaaggaatttactgatatagagataaccacgattgaccagagcgattacatcgatttgtctgtgtgtcagattggttcaatctattacgctgatagggaacagctcctgcaggagacagagtctggagattttgaagagattagaaagaagcttacgaaccgctgtgattggatggtccagaccacttgcaaggacggaggcaactatcaaatcgcctacctgaattcccttgctccgaacggtagcaccaaagagcttgacaaagtgaagggcttcactcacatactcaggttctataagccccaagcctacgaaaaaaacacagattactga

SEQ ID NO: 7516 - RNA, 2076 nt, unidentified
  source 1..2076: mol_type = other RNA; note = synthetic construct
atgacgtacttttccaattataaactggccaaggatgcatattacaagttcctgatccccaagaagaacgggaaaacccgggagatacaggctccagtgaaagacctgaagagacttcagatttgcctgaacttcattctctcatccctgtatcatccgcacccagccgccaagggatttatcctgggtcagaatattagcgacgccgctaaacctcatgtaagaatgccctacgtcttccaccttgacttaaaggatttcttcactagcatttccctctatcgcgtcaaggcctgcctcagtctgccacctttcaaccttaatggtgataaagagcggatagcttactgcattgcgaacatttgttgtaccaatgacggatccagaacctttctgcctcagggcgctccgacaagtcctatcctgtctaacatcgtgtcacttagactggatcgtaaattaaccggcctagcgaagaggttttcagcaagatacacaagatacgccgacgacattactttctcttcttatcaggatatcgctagcgatactgagtttcagcaagaactggcacgaattatttcgggtcagaacttccaaatccagccttcaaagacacgagccgagggaagaggataccgccaaaccgtttgcggactcacaattaatgagaaggtgaacgttagcaagtcttatgtgaaggagatcaggctgtacctgtatctgtgggagcgatatggctatgaaagggctcagatgtacttggattcagatatcaaaaagaccaaggaaaaccacagtgacatccctcaattgtcccactacctcaacggtaaaatacaatacatgcggatgattaagggcaactccgatgacacatataagactctccgcaacaaatttatctacctgtacatccctcagtggaaggagtgggaaaaaaatattcttgacttctgtgatgccgtccaaaattccaaactaagtatagaggaactgaataagtggtacaagacgatatccaccaatatcaacatccatctcttgaaagacacaccactttacacttctctgaccaaagctctgtcctgcttgacactgaaagccagtgacattccgacccagacagtgtttaaagaacccatacataatgccacactgttgcctagcttcctctatgagaacttctcgaaaaatgacccacttaagtttatcacccatatatgggacgggaatgcagacaactgcaaattcgagggatatgaagacttcattcgaaaagaacagatggcattcaaagaaatcactgggagatttaagaccatcgacaagaatctcttttactgtttctatggctttctacacaaccccttgaataatcgtgggtggggacagtataagatcaaatctgggtggagctcatcttggcttaaagcatggtgcagtgagcaccctgagcgcagcccctttgattgccccatcccagaaaacaagcgtgagattgccaataatgtcaagctcaactatttcagcgacatcgtggagttatttaagagcgaattccaacttcgccccgagacgaggcaattaaagaaactcctgcgggaactggttcggcagtacctcaactttgattttcacgtgactttcgaactaactgacgtcaagctgtatacaaacgtatatatgatcaggaacatcttgagcgacatactgcacgacatggcccagcggaagcagtttcccgatattctagtgagggtggaggatctgggctcagattacgtggatatcatattatgtcagaaagacagtgactactatgctacccacctgcagttgatccaggaaactgaatccggcgatttttgtgagctgaaacgcaaaatggcaaatctctgcgactggtacgttgagacgcagtgtaaggatggcgctttcaggattaactatctggacagcattcagccagatcggacaatcgcggagcccttgctctctgatggcgtaaaggggttcacccatcggattcgcatctacaagcattacgcctacgagaatccaaactacaggtga

SEQ ID NO: 7517 - RNA, 1185 nt, unidentified
  source 1..1185: mol_type = other RNA; note = synthetic construct
atgttggttgatcaacctcagattgatcatcttcgccagcaatttgcttcacttcagtctaaagcagatttactggcgctgttaaatgaagcaaaagccatgctctttgaaaagggagatcagtacccgctgcagctcaccagtctcacctggtatgctaataccagcttaggtgtcaagagatacacagctttcgaaattcctaagaagaggggtggacaccgactcatattcgctcctaaagaccccctcaaagtcatacagcggtgtctaaacctggtcctccaatgcgtttttagtccacataaagccgcaactgggttcgtgcctgggaagagcatcacagacaacgcacggccccatgtgggaaagcactatgtttataatctcgacctgaaggacttcttcaccagcgtggatctgcaccgagtgaaggcttgtctgaaactgcctccattcaacctgacgggcgatcgggagcctcttgcctttctgattgctaacctgtgctgcattcgtcaggtcggagagccaagcagagcctttctaccacagggtgcaccaacctcccccctcttgaccaatgtggtgtgccagcagttagacagaaggctgacaggccttgcgaagcgcttcggcgcaacttacactaggtacgcggacgacatgactttttcctcgttcgtaaatatctatcagcccgattctgctttctgtgtagagctgaaccgcataatcaccgaccaaaggtttgtcatcaaccccgccaagacaagacttcaacgccccgggtataggcaggaagtgacgggcctggtggtcaatgagcgggtgaacgtgccgagacgattttggagggagatccgggctttgttgcacaattgggagacattggattacgacgaggccaatactcggttccagaagctgtatgccctgaacaaggcacgtccctctcaaaaagccccagccctagccaacgtactctccggcaaactcttgtttatgaaaatggtgcgtggcgccaatgacgaactttaccagcactacgcgcgccagctggatgccctgactaaccagacaaccgatgagatctcagtggacgttgaaagaattcttgacatctgggaaaaacaggggctggagaaggctatgacggccttcgagcagtacaaggatctgtga

SEQ ID NO: 7518 - RNA, 1185 nt, unidentified
  source 1..1185: mol_type = other RNA; note = synthetic construct
atgtccctggaccagcagcaaattgactctattcgccagcagtttgcctccatgcagaacaaggaagaactactcgtcctgctgaatcttgcgaaaagcctcctgttcgagaagggtacggagaagtctattaaattgcacagtttgacttggtactccaacacctctctcaacgcggtgaggtaccagtcttttacaatcaggaagaaatcaggaggcgagcgcacaatccatgcacctgtgggccccctaaagaccatccagcaatgccttaacttcgttctgcagtgtgtgtttgtcccacacccggctgccacagggtttgtaatagcaaaaagtatcgccgacaacgcaagaccccatgttgggcacccctatgtctacaatttggaccttaaagacttcttcccttcagtcaacttccaaagagtgaaggcctgtctgaagctgccaccatttaatctcaacgaaacccgagaaccgcttgcatttttgatagccaatctgtgttgcgtgcggaaccctattgaccctaaacaggcatttttgcctcagggcgcccccacaagtcctgtgttaaccaatattgtttgccaacagttagacaggcgactcaccgggctagctaagcgattcggggcttcctacactcggtatgccgatgatatgacattcagcagcttcacgaacgtttaccagcccggtagcgagttttgccaggagctgaatcggatcatctcggggcagcgcttcgtgattaatccatcaaagactcggctgcagaggaccggctatcggcaggaggtgactggcctggttgtgaacaacaaggtaaatgtcaacaggcgttatctgagaaccctccgcgccatgctgcataattgggaaacactgggatacgatgaagcagatcgtagattcaaacaggcctatgctcttgaccgcgcttatactggaaagaaggctccagctctcctgaatgtgctgatgggcaaattagagtttactaagatggtgaggggacaagaggatgtgctgtacagccactataagcaggtcttcgagacactccttgccgaaacgaccgatcagaaacccgtagaattggagcaaattttagatatctgggaggaacaaggtatcgagaaagcgatgatactgtttgagagatacaaagccctctga

SEQ ID NO: 7519 - RNA, 1188 nt, unidentified
  source 1..1188: mol_type = other RNA; note = synthetic construct
atgcagctcaccgaagaacagaaggagacgattaaaatttgtttctccactatggaaagcatcgacgatctcgtggttttactcaacttcgtcaatcccctgttatacccagaaaattacgaggggaagattaatgctatccagaaaaaatccgtgaccttctatgctaaccctaagctgagcggcgacaagcgctatgcagagttctctatcagaaaaaaatcagggggagacagaaagattgctgccccacacaaatcattaaaactgattcagagcgccctcaactttattttctccgtgatatacgagcccaaggagtatgtcactggatttgtaccagaaaagtcgatagttgacaatgccaaggtgcatgtcggccgcaactatgtatataacatcgatttggagaacttcttcccgtctatcgaactgaatcgggtgaaagctgtgctgaagctcccaccttttagtctggagggcacagaaagggagaagatagcctacctcatcgcctgcttggcgtgcaaagacggacgactaccccaggggtcccccacaagtcctgttctttccaacatcgtgtgccaaaagatggacagaaggctgcgtggcttcgcaaaggcatttcactgtcgatttacaagatacgccgacgatatcacattcagcgctaacaaagacgtcttcaaccagacttttaaaaccgaactgaagcggattattgaggatcaaaatttcaccatcaacgagaagaaagtgaggcttcagggtaggggctacaaacaggaagtcacgggactgatcgtcaatgaaaagctcaacgtgtctaagaagtatgttcgggaggtacgcgcaatgctgaataactgggataagttggggtacgagaaagcaagtgagaagtttaagaagcactactacgaggataaggggcatgttaaaaaaggagaagcgtctatgcagaatgtggtatggggcaaactacagtttcttaagatggtgaaaggcgaggaagatgccgtggtgctgaaatacgaagctcaatacaaaaagttgaacccgcaaccccttcaggtcaatctggataaccctaccttgtcagatatcctggccatctgggagaatgacattaatggtaagggtatagaggacgccatggagctgtattatagcaagtttaagtga

SEQ ID NO: 7520 - RNA, 1146 nt, unidentified
  source 1..1146: mol_type = other RNA; note = synthetic construct
atgattcggcttaagtttaacacattgaattcgattgaggacatagcgactctaatcaatgaagtttacgcccttcttttccccaacgccaagccacttcccaaaacgaaaaagccttttcacatctcactgacttccctcaattacctggcttacagcgagcacttccgtcaaaaaaggtataaaacattccggattcccaaaaagaagaagggcgaatttcgtgagatttcagcacccacttacaccttaaaagcagtgcagcggtgcttgaatgcagtctttttctgcttattcgaaccttacaaggctaacgaactgccagagaatcagcagcatctgaccggcaagaaaattttcccgcacaaggctgccaagggatttctgcctaaccgatctatcgtcgataatgccaagctgcatgtggggaagagattcgtgtataacatagacctggaagggttttttccaaacacctctttcgctagagttcgccaagtactgaagctcgcaccctttaacctgaaaaatgaacgcgatgacctgggaaaactcatcacagccctatgttgtcaggatgattgcctgccacagggtgcaccaacctcccctaccctaactaatatggtgtgtcaacgactggatcggaagttgtacaagctggccaaagaaaatcacgctaactacacgaggtatgccgatgacattacattcagcagcgacaaaacaattttcaatgagcaccttaaagaggctatcgagaaaactatcaacgaggaagggtacaagatcaacaaggcgaaagagagactccaggggaagggaatccatcaagaggtcacaggcatagtggtgaataagaagctcaacgtcaccagaaggtatatcagggacctgtacttttggttttcccattgggaaaaagacggatatgcctctaccaaagcctattttgacttgaaatatgtgaaccagaagggttacctgcgctataagggcaagatccccccgatggagaacgtcttatggggcaagatccagttcctcggcatggtgcgcggtaaaaatgatgagctctaccagaaattcttggagaagtggaaggtttgcagtcagagtaaagacgtacctataattgaaaactga

SEQ ID NO: 7521 - RNA, 1191 nt, unidentified
  source 1..1191: mol_type = other RNA; note = synthetic construct
atgagcaacgacaacctgttccaggaaaacatcaaaagcattttctatagcatcgactccattgaggatttttgcaatctgctgaatcagatttaccagcacatttttccttcccgtgacactaagctgaacgtggttattagcgtgaaggacctaaactattacgccttcgacagatctaggaacaagtacaagacatttgccataaggaaaaaagacggcggctctcgcatcatcaaagcaccgaattacaagttgaaaaccatcctgaagtgcctgaactggctttttaatacgctattcattccccataacaatgcatatgggtttgtgaggaacaaaaatgtggcaaacaatgcggtgccacatgtcgggaaattatttgtctacaatatcgatctcctcaatttttttccaagcaccagtttccggcgagtgaaatccgtattcgaactcccccccttttatctgaacggcgacaaatcaaagctggctaatagggagaaactggggttcttgatcgctaatctgtgttgcgatgccgggttcttgcctcagggagccccaacatcacctgtgctgacaaatatagtgtgtcgcagaatggataagaaactttacaagttcagcaaacagaacaattgtacttacactcgctatgccgatgatattacttttagttcctataagcaggtcttcgatgagtctttcaagaagggaattaagtccatcatagagaacgaggagaactataagataaatgacaaaaaggagcggcttcaatcttatggtgaaaggcaaatagtgacaggtttagttgtgaatcagaaactcaacgtcacccgcgattacaacaaggatatccgtttctggctttggagttggaagaagtggggctacgaacaaacgcaattacggtttgctgaagagttcgtatataagaaatcttaccagaagtacaacggaaaggctccctcctttgtgaattatctctcaggaaaaatcagatatctcagcatgatccgaggcagagatgacgaacgggtaaagagatacatcgacaacttcaacaagatggtcagtgataccgttaagacctttaccactgttgatttgctgcagatcttccggaaaattgacacacacggtaaagactcgatcgactactcattcaagaaaaatattgcctga

SEQ ID NO: 7522 - RNA, 1278 nt, unidentified
  source 1..1278: mol_type = other RNA; note = synthetic construct
atgcgtttaacaccggagaacatcgaagaaattaaagtcagattcgcgaaaacggagactgttgaggagctggctcagcttctgagctgggtctacgctctgaagttccctaagaggagcgagaaaacaactattattatcgaagccaagcacctcaattactatgcttttaaacccgtcaaccggtacaagcagttcacaatcaagaaaaaaagtggtggagagaggacaatatctgccccacgctacaaacttaaaactattcagaagtgcatccacgaaatcctcaacgcagtgttcacccctcatttcaccgccactgggtttgtgccccgcaaatccatcgttgataacgcaaaagtgcatattgggaaacagtttgtgtttaatacagacctcaaggactttttcccctctaccgagttcaggcgtattaaggccgtactgggactagctccttttaacctgaccgatgctaacgagatcaactcaaacaaggacaaaaagaagacctcagatgagaagggtaaaggatacctgggctatcttatcgccaatttgtgttgcgacaatgggtgtctgccgcaaggcgcacctaccagcccaaccttaacgaaccttatatgccagcgattagacaaaaaactctacaagtatgccaaatcgattaacgcaacatactcccgctacgcagacgatattactttcagtgccaataagcccgtctttgacgaaacctttaagaagatcctgattgacttgatcgaagtgcaggagaagttcaagatcaattttgaaaaggagcgattgcaagggggtggagagcggcaatccgtcaccggaatcattgtgaatagaaagtccaacgtggatagaaagtaccttaaagatgtgcggttctggctaatgtgttggaagaaatttggcaccaatgccactcaacagaaattcctggttcagtttccagagaaaaaagggttcctcagatataacggcacaactccacagttttataattacctcaacggcaagatcctgttcctgggtatggtaaggggcgcgaaggacgaaatcttcttgaagcagaaaatgaacttcgatgagttgtattctgaagttacagggaagaataataagacggaaattggcactgtgatacagcgggacagtaattatgagagctcagatctgtctaagggcatactggagatactgaatgaactggatcgcaatggatataccaatgctaacaacaagctcaaaacaatctttaagtga

SEQ ID NO: 7523 - RNA, 948 nt, unidentified
  source 1..948: mol_type = other RNA; note = synthetic construct
atgaagctgtcggagacaattcaacaggagatcaaccagaagtttcaaacgattaaatcagtggaggacttggtgatcctcatgacttttgtttacggacatctctatcctaacatccagactaagattgagattaacaagcgaaagctccacttcatcgccttttccaaaaaggagagatacaaatctttcaccatcccgaagaaaagtggcggggaaaggaaaatttttgcccccatctacacactaaaggtttatcagaagattctgaacgaaattctgcagatagtttttacaccccacaagagctcccatggattcctcccaggcaagtcaatagtgagtaatgctaaccttcactacggcaagcagcatgtgtacaacatagatctaaaagacttcttccctagtacttcttttcgtcgggtgaaaaccgtcctccaattgtccccatttaacctgaatcaggatagagagtcattaggattcctgatagcaaatctttgctgtaacgacaatgggttaccacagggagcacctacaagccccatccttaccaatatagtatgccaacggctggacaggaaactgttgcgattcgctgcgcagtacaagtcttcttataccaggtatgctgatgatattacgtatagcagcaaccagaataagttctccgccgagtttgaaagcaaattgcaggaaattatccatgaagagggttttgaaatcaactcaaataagactaggctgcaggacttcaaaagacgccaagaggtaaccgggctgatcgtgaatcgcaaagtcaatctgaacatcgaattcatcaaacaggtccggttctggctttacgtgtgggaaaagtttggctacgccagcttccacgagagactgtcctccgattatatcaagagtggcaatacctctaagcgcaaagggggtattcactga

SEQ ID NO: 7524 - RNA, 1773 nt, unidentified
  source 1..1773: mol_type = other RNA; note = synthetic construct
atgagtggcgtcttcttggataagctactgatcgaaaatacgaagaaacgttttgatcagatgaccaatctcacagacttcgtgagcctcctcaactacatcgagcagagagtgttcaaaaacaagaaaaaacccctcacagttccacacctctattatttgagcaagactaagaatacccgctacgaagaatttgaaatccccaagaagaacgggaagcctaggaagataaagagtccagagaacagactgaagcgggtccaatcccttatcaacatcctgcttcagatcattttcgaagatcattctcactactcagcaaatggctttctgttcggcaaggatattcgcagaaacgctctgccccacataaataagaactatctgctgaacattgacatcaagaacttctttccgtccatcccttttcgaagggtaaaagtggttctggagtttgccccattcaatctcattgatgatagagaacgcatagggtttcttatagccaacctaggaactttcaaaaatgcactgccacagggtgctcctactagtccgatcttgtccaatattgtgacccaaaatctggatcgcaacatcttaaagtactgcctgaacaagaaaattaagtatacgagatacgcagacgatttaagcttttcttccaattggaacatctttgaccagcaggtcatcaaagaaatagaggcgattattatcgccgaaaatttcatcctgaaccccaaaaagactagagtgaggaatttcatgcaacgacaggaagtaactggccttatcgtgaatacaaaattgaacgtcaagcgcgaatatctccagaaggtgcgggccatgattaataattgggagaaaggagggctaagttttgctatctcacagtttaggaagcatcagccccctgagaaggtcaattataactttaaggaagtactgctgggtcacatatctttcctcaagctgataaagggggacacaaatagcgtcgttcagaacctgcaaataaggtacaatttcctcgtaaatctgttggactattcgttcatcgaggaggacaatgtgaggctgaaattggaggaggatgatcagaaaatggaaaagattgcttttgagaatgaccaaacaaaaaaggagacgttcatttcattctgcacctccgccttccaccagattgagaacctgctcaattactacttttggaagaaattccctgaaattgacgacttaaaagactacatgtggcataataaccctctttttcaggatcggtggaagaaacttaagaagttagacaagaaagagcggctcaaccgattgaacaactttaagactgtgagggacttcgacattaacaccctggtttatctgttcgagaaggagttttatttcgatcaacatctctcatacggaaaaaagttaacccacctgcgtgagattcgtaacgacgaaagccatcggtgtaccgtgctcgataccaacgaacaggttattattaatcagttcgaggagatcaagaaagagcggaaagccaaaaaagagaaaggcaaacagttcatccttagccccaaacaaaaaaaggaggagatgaactacttgacactgaagtacatcgaagagaagaattataagaacgtgagaaacatcctgcgcgaagtgaaaaacaacatcaaaaacaccctaccaaatatcgaaccacttcagataaccggaaaagtggagcagaaagagattctggaaacatctgaggtctttaattga

SEQ ID NO: 7525 - RNA, 1632 nt, unidentified
  source 1..1632: mol_type = other RNA; note = synthetic construct
atgaagaacttgactgattttgtcgcattgctcaactacttagaattccggatttataagacaaacttgaaaccgctaaacatcaagtacctgtactatttgagcaaaacaaaagatgaccggtatgtggtattcgagatacccaaaaaaaatggcaagactcgaaagatcaaatctcccgataagttaatcaagcgcgctcagtctcttatcaatctcctgcttcagatcatctttgaaaatcattcccactatagtaccaatggcttcctgctcggcaaggacattcggaggaacgctgtccctcacattaacaagaactatctactgaacattgacattaagaactacttccccagtattaactttagaagggtgaaagtcgtgcttgaactggctccttttaacctccgtaatgagagggaaaccattgggtttctgattgcgaatctgtgtacgcacgggaacagtttgccacaaggagcacccaccagccctatcctgtctaatatagtcacacagaacctcgaccgtaaactgtcaaagttctcaaacgagaatcggattaaatacacccggtatgccgacgatctgtccttctcaagcaattggaatatttttaagccaaccttcatcaaagagattgagaagatagttaactccgaaaactttagcctgaattccaaaaaaaccagagttcgtagcttcatgcagaggcaggaggtaacaggcctcatagtgaacacaaagctcaatgttaaacgcgaatacctgcagaaagtgagggcaatgttaaataactgggagaaaggaggtctgtatttcgccacctcaaggtttaaggcccaccagaccaaatctaagaagaacctggattttaaagaggtgctcctgggccatctgtcttttttgaaactcattaagggagaagacaatcaactcattaagcgactgctcgagaagtacaacaacttgtacaatcagatagagtatgggtacatcgatatcgaaaatgtcgagaagaagctgatcgaagacaatctaaagatggagaaaatctttctggaccaggaattaccagataaagataagttcatctccttctgcactatcgcctttcaccagattgagaacttgcttaactattactactaccggaaatttgagaatttcgaggatctactgaatgagcttattatcaacaacccgaaattcaaaaagcgctatagaactactgagaaagctaaccaatccttcaagaaaattagcgatctgaacatcaatgttctggtgttcatctacgagaaggagttcttctttgacaagaagataagttatgacaagcacataacgatgctgagagaaatccgcaatgacgactctcatagatgctccgtgatagattttgacaaagaagagatcatcaaggaataccaaaaaatcgagaaggaaaggaaggggaaagaaagccgcggtaagaattttgaatattccaatcagcaggccagaatcaagctgaattacgatacactgaaattccttgacagaaagaactataagagcgtgcgctacaatcttaagaacattagctcaaacatccgaaatactctccataagaaagagctttcgtga

SEQ ID NO: 7526 - RNA, 1701 nt, unidentified
  source 1..1701: mol_type = other RNA; note = synthetic construct
atgtcctctatcttcctggacaaaaaaatcaaggacaacatcaagcagaaattctataaggtgaaagatctcgaagaattcgctacactgctaaactttgttgagcgtcagtttttcaagaattttaaggccgagaaacttattgatgtggactacttatactacctttcgaaaaccaagtcatccaggtacactcagttcgagatcccaaaaaaaaatggcagtgtgcgcgtgatcaatagccctgacaccacattgaagcggatccagaaactgataaacataatcctccaaatcatctttgaggattatagccattacaattccaacgggtttatcctgggtaaggatataagaagaaatgctattccgcacattaacaaaaactacgtgcttaatatcgacataaagaatttcttccccagcatcaattttaggagaattaaagttgtgctcgagttaagcccatttaagctgaacaataaccgagagaaaatcagctttttgattgcaaatctcgctacaaccgatgggactttgcctcaaggaagtccaatcagcccaattattagtaacattgtcacgcagaaactcgatagaaagttgtccaagttttgcctgaagtcaaagatcaaatactcgagatatgccgatgatctcactttttcttccaacaagaaggtttttaactcagagttcatcgagaagatcgaaggcatcttaaatcaggagaatttcctgatcaacaatcaaaagaccaggattaagtcttctatggaaagacaggaagtgaccggattagtagtcaacaagaagctcaatatcaagcgggagtttctgcagaaaacacgagccatgctgaataattgggaaaaaggtggactgaactatgcgaaaaaagagttcaagaagcaccagcctgagtcaaaaaagaattatgagttcaaggacgtactgctgggccaaattagcttcattcggctggtgaaaggcattgaatccccgatagtgaacaagatatctctaaagttcaactacctgaacaaccttattgactacaccttcattagtaacgaaaacgtcaagaaaaagctgattaacgacaacataaagatggagaaacttttgttcgataagaatgaaagcgaagaggatatctttattcccttttgcacgtccgcatttcaccagattgagaatctgctgaactactattactggaggaaatttcctgtatttctggatttactgaagacattgctggaaaataatcccaatttcaaacggcgttatcgcaacctaaagaatgccaataaccacttcaagaaaatcagtgacttgaacatcaatgtgctggtgtatctctacgaaaaagagtttttcttcgacaaaaacaggtattacgacaaaaggataactcatctccgcgaggtccgaaatgacgacagccatcgctgtcagatcattgacatcgataaggattcacttaagaaagactatgagctgctgcaggataaaattaaaatccaggacaagaaagggaaacagttcgactacaaaaaggaagataagaagctaatacggtcttatgagactctcaagttcattgaaaagaaggacttcaagaaggtccggaattccctccgcataatgtcttaccaaatcaaaaacacccttcccaacaacgttcacaagaaatga

SEQ ID NO: 7527 - RNA, 1689 nt, unidentified
  source 1..1689: mol_type = other RNA; note = synthetic construct
atggccggcgtattcttgaatgacctcttcaaaagtgaaattaaggttcgcttcgagcgcattcgaaacgtccgggagtttgtcagtctgttaaactatatcgaatcccagatctccacatccaccgaagaaatttttgaattgaccttcagtcacttgtactacctgtctaaaagtaaggatagccgctatacagaattcgcgatcttaaagaaaagcggcaaactgcggcagatcaactctcctgataaactcctaaagagagtccaaagcctcatcaacatcttgcttcaaataatcttcgagagtcagtcccattattgctcaaatgggttcctcctgggacgcgatattaagaggaacgctataccacatacaaataagaagttcgtgctgaatgtcgatatcgaagatttcttcccttctatcaacttccgcagggtgaaggtggtgcttggattatctcccttcaatcttatagatgagagagagaagatcgccttcattattgcaaatttgggtacttacaagaactatttaccccagggaagccctctgtcccccttgctatcgaacatcgtgactcaaaagctggaccggaagataagcaagttttgtctgactcaccggattaaatattcaaggtacgctgatgaccttagcttttcgactaacagaaatatactggacgaatcatttgtgaagtcaatcaagaatatcgttgaggatgagaattttaggataaacgacgagaaaactcggctgaggacatccagagaaagtcaggaggtgaccggcctcgtggtgaacgaaaaagttaacataaagagagagtacctgcagaaagtaagagcaatgctgaataactgggagaaggggggtctgaggtctgccgaagaaacatttaaaaagcaccagccgccaaataaactcaactacgactttcgaagcgtgctgctgggccatctgtcttttcttaaactcattaggggggatgacgatcagactgtaaagcgccttcgactgaaattcagcttcctcaataatcttatcgactactcctttattgacaacgaaaaagtgaaagtgagactggagaaagacaataagacgatggagaaaatcttttttgacattgacatgtccgaggacaagtttatctccttttgcaccagcgccttccaccagatcgaaaacctaatgaactacttctattggaagaagtttgagcatgatgagctgctaaatgagctcctgattaataatgctcgattcaaaaagcggtacaaaacactggagaaagcacaggaggaaatcaagaccattaggaacctcgatatcaacgttctggtctacctatatgaaaaggagttcttctttgacaagaaggtgtattacaataagcacattaccatgttgcgtgagatccggaatgatggatcacaccggtgttctatttttggcctcgacgttcaaaaactgaaagacgattatgtcctgattgaaaacgagcgtaacgataaaaagaaacgtgggaagaatttcgagttatcactcgaccaggctaaaaaggaactcaacttccttacctattcttttctggagcgccagaactacaaggaggtcagagagaatttgcgaaatataacgaagaccattaacggtgcccttaaactgaaaatcaagtga

SEQ ID NO: 7528 - RNA, 1698 nt, unidentified
  source 1..1698: mol_type = other RNA; note = synthetic construct
atgcctgggatctttctggatgatgtaagccgcgagaaggtcattcagaaattcaacaagatctccagcattaatgagtttgcttctctattgaacttcatcgaaaagaacaacacacacctattagacaagaaaaaattcacccccattaacagcaagtacttatatcatctgtctattaccaaggacaaacgatacaaggaattttccatttccaaaaagtcaggcaatctaaggaaaattgaaactcctgatgagttactcaaacgggtgcagaaactcataaatttcctgcttcaggtgatctttgaaccatactcacactattcatccaatggattcctgtttggaaaaggcattttgaggaacgcgaagccccacgttaataaaaattacgtactcaacctcgacatcaaggattttttcccaagcattaatttccggagagttaaagtggtgctggaattgaaccccttcaatctgaaagatgaaagagagcgaatatcctttctaattgccaatatttgcacctataagaaccatctgcctcagggcgtgccaacgagccccattcttagtaatatcgtaacacagagacttgatagaaaactgacaaaagagtgcctggacctaaacattaaatacactcggtatgccgatgatctgacgtttagttctaaccagaacatccttaatcctaacttcgtcaaaaaggtggaacaaataatccaatcagagaacttcgaactgaacaataacaaaactagactgcaaacaagcatgcagcgccagcaagtcaccgggttgatagtgaacgagaagctcaacataaaaagggaatacctgcaaaaagtccgcgcaatgctgaataactgggagaaaggcggactggactatgctgaacagatctttcggaatcatcagccaatagagaaaaaggagtatcctttcaagaatgtgttattgggttacataagcttcataaagcagattaagggctctgataatgggatctcactgaagctggtggagaagtatactcttctcaataacctcattgactactctttcataaagaattccgcagtgaaagagaagcttatctctgacaattataagatggaacagattccacttttcaacaaccagccggagaatgacaagttcatcagcttttgtacctccgcctttcatcagatcgagaacctgctgaattactattactggtcaaagttttcggactttatcaacctgctcgaacatctgctcctgcacaacccctcctttaagaagcgttataagaatttggacaaggccaaatctcactttaaaaaaatcagtgacctcaacatcaacctgatcgtgtacctctatgagaaggagtttttcttcgacaagaagatttactacaagcaggagattacaaaacttcgtgaaatccgcaacgacgatagtcacaggtgtagcgtcatcggggttaataaggatgagatcaacaatgagtacgctaaattggaagccaagaaaaatgacttcaaaaaaaggggtaagaacttaatctactcgaataaggagaagaagttcatcctgaagtacgaaacctttctcttcctcgaagataagaactataaagaggttcgacggatcctgaagcacatcactctgaatattaagaataccttgccgaaaacaagttga

SEQ ID NO: 7529 - RNA, 1266 nt, unidentified
  source 1..1266: mol_type = other RNA; note = synthetic construct
atgtctggaatcttccttgatgagaattctcgtgagaaggtgatcaagaagttcaacaagattaattccgtgaacgagtttgtttctctactcaatttcattgagaagaacaatgacaacctgaaagataagaatgcattcaagccaataaactccaaacagttataccacatcagtaaaaccaaagacaagagatacttggaattctcaatccctaagaaaaatggaggaaagcggaaaattaaaacgcctgatgagatactgaagcgggtgcagaaactcataaactatctgctccaactcgtcttcgaaccatatgcccactactcatccaatggttttttgtttgggaaaggcatcattcgcaatgccactccacatatcggcaaggagtatgtgctgaatctcgatatcaaggacttttttccctccattaatttcaggagagttaaggtcgtcctggaacttaatccgttcaatttgaagaacgagcgcgagcccattagtttcatcattgccaatctttgtacccacaaggaccagctgccacaaggggcccctactagccccatcctctcaaacatagttactcagaaacttgatcgaaaactgacaaagatctcactcagtaagaacatcaaatacacccggtacgctgatgatgtgacctttagcaagaagaacattctgaaacacatctttatcaacaaggtgtccaagataattcaggaagagaatttcatcgtaaacgaagacaagactcgattacaaaaaagtacggaaagacagcaggtcacaggcctgatcgtgaataagaaactcaatgtcaaaagggagtatcttcagaaggtgagggcgatgttgaacaattgggaaaagggcgggctagaatatgcaatcaacgtattcaaaaagcatcaacccaccgaaaaagtagattaccctttcaaggaagtcttgctgggccatatatctttcatccgtcagattaaaggtattgacaataacgtgagcattaagttaacagagaaatttagcctgctgaacaacttgatcgattacaacttcattaagaacgacattgtgaagaaacgcctgatagatgacaatcacaaaatggagaggtttctgctggtggagaatctgaccgacaacgacaaatttatttcgttttgcacaagcgcttttcatcagatcgagaaccttgttaactactattattggagcaaattcgacaacatcgaactgctgctcaattacctatga

SEQ ID NO: 7530 - RNA, 1686 nt, unidentified
  source 1..1686: mol_type = other RNA; note = synthetic construct
atgactcatgaggaaattaccattgagtttgagaagctcaaaacaacatcgcagctcgcaacactgcttaacaaggtggagaaaaatagggcgctgcagacagaaaaactccagaagctgaaagctaaagatctcaactttttggccatttctaaagactctcgctacagggagttcaagatttttaaaaagagcggcaaagaacgcatcatcgatgccccagacaattacctgaagagagttcaaaccttaataaacgacctcctgcagatcatttttgaacctaaggtgcataacgccacgaatggctttctgcttaatagggatatagtgcgtaatgctcgcgtccacgtgaataaacgttacctcctaaatctggacatagaagatttctttccgaccatcagttttagacgggtgaagtcagtcctcgaactggctccctttaacttaaacaccgaaaaggaaaatctggcttttatcatagccaacatctgcagcctgaaaggcaagctgccccagggtgcccccacttctccaattctgagcaatattgttacgcagcagctggatcggcggatcacaaagtattgtctgaagaagaacgtgaaatattccaggtatgcggatgacctttcatttagctctaacttggatgtattcgacaaggcctttatcaaggggttgactatcattgtgaagaaggaaggcttcaaaatcaacaaagagaagactagaatgaactctaatatggagaggcagcaagtaaccggaatcatcgttaacgagaaactgaacgtgaagagggactatatccaaaaagtccgcgccatgctgaacaattgggagaaaggaggactggactacgcaaaagcacagttcataaaacactacgggaagtcgaaatacaaacctgactttagaaaggccttgaaggggcacatcaattttataggacttgttcgaggtaaagaagatccactcttcagtagactgctcctaaagtacaattatctgaactaccagattgattgcaactatatctcaaataaggtcgtgcaggaggtcctagagcgtgacaataaagaaatggaatccattccccttaggagcgtacggattaacgaagacaatttcatcgctttctgtaccagtgccttccaccagatagagaatctcttgaactacttttactggagaaaattccctgaaatcgaagatctgcttcagtatattatggactataacgaagcattccactggaagagtatcgagaaatgcaagaaacgattcccgaagatctctaaaattcaaatctgggctaaagtctacatattcgagaaagagttctatttcgataagaaaatcccctacaataaggacatcactattttgcgagaaattcggaatgatgatagccatcgctgtgcagttatttcctataaccgcgacggtatcaaaatggactacaaggagttgaagattaagtgcatgcagtacaaggaggagcataagaagaatatggagaagtccagcggcgagaacattcttgagcaaaaatacaaggtgatcaagttcttagaggagagaaattataactccgtgcggcgaattctgaagggggtgtcagacaacataaagaactatccattcgtgaagcctgtcgagttagaggaatccaattga

SEQ ID NO: 7531 - RNA, 2538 nt, unidentified
  source 1..2538: mol_type = other RNA; note = synthetic construct
atgaaaatagagttcaaaaaggtgatcctcataaaacaatacttcgacactaccgaaaacatagatggcctcgccgatctgctgaatttcgtggggaatacactctacgaaaaaaccttttctaagaagcagctctcaaaaaagctgcttaccttttttgcctttaaaaaagaggacaagtaccagagattcaccatcaagaaaaaaagcggggaaaaccgcttcattctggcaccacatagatacttgaaactcatccaaaaatgccttaatgtggtattgaacgtggttttcgaacctcattgggctagtcatggcttcgtcctggataaaaacattgtcactaacgctagaaagcatatcgggaaaaattacgtactcaacgtcgatctcgaagatttcttcccttcaatttctttccggcgcgtgaaaacggtgctgcagctgccccctttcaacctaaacgatgaactcgcctttttaatcgccaatctgtgttgctatgaaaattcactcccgcagggagcaccaacttcccctactctaagcaacatcgtttgtcagaaactggataggaagctggccagatttgccaaagaaaatagggttagttatagccgctatgccgacgatatcacttttagcgctcggacggatctcttcgacgaggactttctgaaccgactgaaagagatcatactgtcggagaattttaaagtgaatgagaacaagacgcgtatccaatcatttgcccaaaggcagatagtgacaggacttaccgtcaaccaaaaggtaaatgttagtcagcagtacatcaaagagattcgtgcaatactgaataactgggagaagaaagggtttgaacaagcacagtatgtcttcatcaagaactatatcaaggacaaccccaacataaaaaacccatcgatgattgaagttcttcgcggcaagctgaatttcctagggatggtccgcaaaaaagataacctgtaccagaagtactttaaccaattcaataagctgctggattcctataatcagaaggaagagggcgacattatctacatcaaaaacgtgcttagcaagtataagaccgagactaacacatctaagacaaatagggatgtccgcaaatcttgcaaacataatccaattagggtgaccgaatttctgagagtatttagcgaagacagaaatttcggtttaaatatgctggtgcacgaggctgaagacattgatcttgaggaaaagctgaaagagatcaatttagaattcgcgaaatacggtaagcaatttgaagaggaaaagtatcagattcccatctggttatatacccacattaagaaggacctcatagacctctataatgggaaggggcttagtatttaccgtgagcttggcaaacacccgtttcagaatgaccgagagttcacaaagaccatctttgattttaagaagacctaccggtttggacaggacaagggcgaagagacatccctcagagatacaatcattaggtgtctgtccaaggtgcggtacggcgacagggatatcctttccaagtttcaaattgcagtgtttgagcctataaaccagctggatttcgatttaattgctgctattaagaccgatgttatccgcgtggaattggccatacgaatcattctgtcctcttacctgaagcacagcaacggttcaggaaggctgaaatttgagcttcaggagatccagaaccagattattctgaacattatagacctcgactctatatgcacaaagaactatgagaacctgcagggtggcgacttcaatgagattattcagaagctgtggtccctgtgtgatgtcaacgtgatcagtaagtttaaggacggtaaaactcggatcgtgccaatccttcccgagaataaagacagcaaattgtacgacaaagaagtcgagggattcactttccagttggtcttttataacctccctcgggtgctcctcctggacaataaaggccgggttaaagaggtgaataacgaatacaaaccatacatagccattgagagtgatattagcgagaacgacctgttaagatacaacgctctcattatccacaagagcattcccaattatgttaacttgttcaagcgagctataaaggagaatatccctgttgtgagtagcggaggtggctcaggcggagaggaagggatcgtggagaacgtcggaaacatttctatcgcattcgacttgatgcagaagaacctgcccttgttcctgaagaaaatcaaggaagattacgtcgtggacatcaatatcttcttgttcgcgaataagatcaactataaaaaggccgtgaagatcaaggaggagatcatcaacattattgagaatcacaacctgctattcccggagttgtcccttgaggtaatcaataagatcaaggtattagccaagtcaaatgacattccctccttcgagaataagaaatctttgtccaagtttctacaggaaaagctaaaactgatcgagtatgaaacagcgaattga

SEQ ID NO: 7532 - RNA, 1656 nt, unidentified
  source 1..1656: mol_type = other RNA; note = synthetic construct
atggagcctatagatatcaagtcggagaacattcttaagcaatttaacagcatctctgggatccacgacttcgtggaagtgttaaacgagatttacaagctgtattttcctgagggtgagaagaagctgtttagagtcggtagtattaattactatgcctttcacgctcagaaaaggtattacacttttgacataccgaagaagaatgggtcaacgagaagaattaacgcccccgtgtaccaactgaagctgctccagcaatgcatcaatcagctcctgcatttaatctttaagccccaccataccgctcatggctttttgctgggcaggaatgtcgtaacaaacgcggggattcatgcgggaaagcaggaagtcttgaacgtcgacctgcaggactttttcagtagcattaaattccgcagagtgaaagccgtcctggaactgcctccgtttaacctgaccggcaaaaaagagaaagtggccttcctgatatctaatctctgttgcaataacggcgtgcttccacaaggcgcccccacttcacccctactgactaacatcgtttgtcaacgacttgatcgaaagcttttccagcttgcaaaaacatccaaggctcgttactctcgctacgcagatgacatcaccttttcttccaacaatgcaatcttcaatgatgagttcatcaaggaactcaattaccagatcgagaatgaaggatttttgctcaacgaagccaagactaggatacaagaccggcgtcagcggcaggaagttaccgggctggtagttaacaagaaagtgaacattaatcgcgattttatccgcaaaattcgggccatattccataattatcaaaagggcggacagaaattcgcccagaagcagttcgccaaacactggagtaaaccaatcacaccacctgactttcggagcagcttgaaaggtcagattgaatacctgggcatggttagggggaaatccgatagcatctacctaaagtataagcagacttacctgcgcttattctcctccaactttatcgattactcattcattagccacaagggagtccgcgctcagctggagctggactacaaacgaatggaagctgcacggatcaggctaactatgagtgacgaggaaagattcaccgagtactgcctcacagcagcttttcagcttgaggagctggtgaattattatttggcacagaagatggactttgataaacttgtaaacgaactcgtcacccacacgtgggctacaaccagtgggttgaatggaaaaaataatgtgagcgagattccagccgtttataagtactttctgttcgagaagtacttctattacaaacccggagtgttctatgattcagtgattaccaaattgcgtaacataagaaatcagaagctgcaccgggccacagtggtgcagaggtccgaggagcagattttaatggaatataaggccctcatggcgaaagcatctaatcacaaaatcaactcagacggccgagtttaccaaatgagcaagtccgaagcaagactcaacaacgaagccaaggctgtctatttcttcagggagaaaaactataaggctgtattcgaggcggtgaaggatgtgtctgataagatccggatggacctcgccaactga

SEQ ID NO: 7533 - RNA, 1134 nt, unidentified
  source 1..1134: mol_type = other RNA; note = synthetic construct
atgtccattccgccctcctccagcaatactaatggtaacgagcagccagctagcgttcctgctactaaagtggaccttactgccagctttcaaaaggtgacagacgtccatcagctggctcgggtactcaacgtggctttgaccctcgagctagcggaaaacccagagcacaaagataaacctatctcagcaaagctgcttaattactatgcataccacaagaaggaaacccggtacagaactttcaggatccccaagcgaaccaggggcgaggtccgcataatcaaggcgcccgacagaggcctgctgaggctacagcggctgctgctcagttgtcttactgcaactttcaccaccagccatcctgccagtcacggattcgtcctgggccggtcggtgctgaccaatgctcaaccacacgcagggcatagatttgtgctcaacctggacttacgcgatttcttccccagcacgtctatcggaagagtggttgccgtgttgcagctcccacctttctctctgtctaaggagggcgcctatcttattgccaatttgtgctgtgatcaaggctgcttacctcaaggagcacccacctccccgctgcttacgaacgccgtatgccagcgtctggaccgtcgcttgcaacagctggccactcaccatcggtgcacctatacaagatatgccgatgacctgacatttagttgtaaccgcccagtgtttcgggataggtttcaccaggaactcaacaccattattacagcagaggggtatcagcagaatgaacagaaacagagactgcagaccccagaaatccggcaggaggttacggggatcgtcgtcaacgagaggcccaatgttccccgcgagtacgtgaggcagattagggcaatgttacataactgggagacaagaggttacgaagctgccacatccaccctgcagcaacattatgccacatctaaggctcacgctcgacacaggggcaatgttcctaaattggaacgcgtactcgccggaaaaatagcgtactggggtatggtgagagggtgggaggatgtgaactacatctcatcactccttaagctacgaaaactgactgacaagcagaaacgacacgaacgttacacatga

SEQ ID NO: 7534 - RNA, 1119 nt, unidentified
  source 1..1119: mol_type = other RNA; note = synthetic construct
atgttcgtgcatgtccccagctccaccaacaacggcgccgtacaaccagcttcgggtcctgtgacggaagccgtcttggcaacaaatttccgtctgatcaccgatgtccatcagctggcccaggtactcaatagcgccctgctgctcgatttggccgaaaaccccacgcaccaggacaaacctatctcagctaaacttctgaactactacgcataccacaagaaggaaacacgctatcgtaccttccagattcccaaacgaactcgcggggaggtgaggaccattaaagcacctgaccgcgggttgcttcgcctacaacggctgctccttagttgtttgacggctgccttcaccggcaatcaccccgcatctcacggatttgttcccggaagaagcattctgacaaatgcgcaacctcatgcgggacatagattcgtgctgaacctcgacctcagggatttcttcccaagtacttctattgggcgagtgatcgcagtcttacagcttcctccatttggtctggtcaaggaggtggcctatttgatagctaatctgtgttgcgatcagggctgtctgccacagggggcacccacaagccctctcctaaccaacgttgtctgccagcggcttgacagacgtctccagcaactggcgatccggcacaggtgcacctacactaggtacgccgatgatctcactttttcttccaatcggccggtttttagagacagattccaccaggagctgaacactataattgcagaagagggctaccagcaaaatcagcagaagcagagattacagactcccgaatttcgccaggaagttaccggcgtggtgatcaacgagaggccaaacgtgccgagagagtacgtgaggcaaatccgagctatgttacataattgggagacaaaaggatatgaaacagctgctgccaccctgcgcgagaagtatacaatttcaaaagcgaaggctaggcacaagggccaggtgccaaagatagagcgggtactagccgggaagatcgcctatctcggtatgatccggggaaaaaacgacgccctgtttcttgagctgtccatgaaattgatgcaagtgatgaaaaagcagaagctgtga

SEQ ID NO: 7535 - RNA, 1002 nt, unidentified
  source 1..1002: mol_type = other RNA; note = synthetic construct
atggctttcgctctgaacgccgcactgcaacaggatctcgacgagaatccgcagcacaagcccaaactgatcaccccaaagctcttgaactattacgcttatcacaaaaaggaaaccaggtaccggaccttccaaattgccaaacgcacgcgcggtgagttccggacaattaaagcacctgaccacggcctgcttcggctgcagagactcctgctccggtgtctgactgccgcgtttacaacatctcatccagcgtctcatgggttcgtgcctggaaggtcagtgctgactaatgctcttccgcacgttgggcacaggttcgtgctgaaccttgacctcaggaatttctttccctctactagcgttgggcgtgttatggcagtgttacaactgccacctttttcgttggccaaggagagcgcctacctagtggccaatctctgctgtgatcagggtagtctgccacagggcgcacccacctcacctctgttaaccaatgctgtgtgtcagcgtctagaccgaagactccagcagctggccactcgccaccgatgcacctatacacgctacgccgacgatttaactttttcctgcaataggcccgtctttagagcagccttccatcaggagcttaacgccaccttggcggctgaggggtatcagcagaacgagcaaaaacagcgcctacagacacctgaaacacggcaggaggtcacgggcatcgtcgtcaatgaccggcccaacgtaccaagggaatatgtcagacaaatcagagccatgttgcacaactgggaaaccaagggatacgaggctgctagtgcaacgctgagacagcactaccctactagcaaggcccatgcacgccataacggaaaagtgcccaagctggaaagggtgctcgccggtaagattgcgtacctgggcatggtaagaggccagaatgattccgcattcttgaacctgatcaagtcctttcttcgaataaaagatgctggacaatga

SEQ ID NO: 7536 - RNA, 1377 nt, unidentified
  source 1..1377: mol_type = other RNA; note = synthetic construct
atgtccgaacaggaccctccagaacagccgacagacgaacccggacctggccaggaggagtttgaaggggctttcgaggagtcacaaagggagcactccgaggaggaggcggagctcttggcagaaatcaaagccgagcttcaggcggaactgtatgctgatctggaagcagacctgaggagtgagatgcagaatgagctagccagcgaatcactgttcgggacatatagtgctaacaaatctctgagcgatgatgtgatcgaagaaatcaagcgatggggcgcatttatggccgtgttaactgccgcaacaacactcaacgatctcgccgagccctttaggcgtgcaaccaatgccaagtatctcgctgcggtactcaatgcggtgctcagactcaatttgctagagaaccccagccggaaggctaaaccagtctcatttaagctcctgaactactatgcatttcacaaaggtgagcggcggtaccgcacctttctgatttcgaagagaactcccggggaacagcgcgaaattaaggcacctgactacggacttatgcgactgcagagactcctactgggctgcttgaccgccgctttcagcacttgtgatgacgccgcacatgggttcgtctccgggaggtccgtgctgactaatgccttgccccacgccggtcgcaggtacgttctcaacctggacctagagaactttttcccaaatacacccgttcaacgcgtcgtaaaagtgctgcaactgcagccgtttggacttgtgaaacccgtggcccatttaatcgcttctttgtgctgcgaccaagggtctttgccacaaggcgctccaaccagtccgttgctgaccaatgccgtctgtcagcggttagatcgacggctgaggcagttagcctttcgtcatagatgtacgtataccaggtacgctgacgatctgacgttcagcagcaatagacctgcattccaagaactcttccacaaggagcttaacgccattctgacactggagggttataagcagaatcccaacaagcagcgcttgcagacccctaaccagaggcaagaagtaaccggagtggtggtgaaccagcgtcctaacgttacccgagagtacgctagacagatacgggccatgcttcataattgggagactaagggctatgctgtcgcctcaacaacgctgcgccagttctacccacagactaaggctcacgccagacatgagggcaaggttcctaagcttgaaaaggtcttagcgggtaaaatagcctacctgggcatgcttcggggaaaagcagatgtgatgttcctggacttcaaaagtaaactgtccactctctctgcagccgctctgccacacgacaactga

SEQ ID NO: 7537 - RNA, 1281 nt, unidentified
  source 1..1281: mol_type = other RNA; note = synthetic construct
atggctgagacaccagatcagcttcccacccccccgcacgataacgaaccagctgccggtgggcctgcagatcatcctggtaaccctctggctggcttcgtaattaaaaacgggtggttacagcaggttaagcccggctatcagcccgctttacctgccgccgaggagttggctgaactagccgagcactttagggccgtgactgatgcaatttccctggccagagtgcttaatgctgctctcgagctccaccgtaagcaacaccctaaggggtcaccaaagacggtgagcccagggctcctgttgtactatgcacaccacaagaaagagcgctaccaaaccttccaggtcccgaaaaggactcgaggccagtttagagacatcaaagcacccgagcacgggctcagaaggatccagcggcttctcctgctgtgtctgaccgctgcgttcacaacatgtgacgaggcagctcacgggtttgtgcccggtcgctccgtcctgaccaatgcgcagactcatgctggacggagattcgtattgaatttggacctgaaagacttttttcctagcacgcgggttggaagagttcttaaagtgctgcagctggaaccattcgatctcccgaaggaagcagcacatctcattgccaatctatgctgcgatcaaggaagtctgccacagggcgcacctacatcaccccttttgactaacgtcgtttgcgtatggctggacagaaagttacgagccctcgctaagcggcaccgctgtcattacacacgttacgctgatgacattactttctccagtcagcggcctgccttcacagcggccttccaagccgagctcaatgccgtcttggtggacgaaggctacgagcagaaccctgcgaaacagcgactgcaaaccccagaaaccaggcaggaagtgaccggtgtcgtcgtaaatgaaaggcccaatgtgccacgggagttcgtgcaagacatcaggtttttactacatgtttggcagaaacatggctatgcagccgcctctaaggcaatgggccagaactatggcggctctaaggcccatgcccgctaccgtggaaatatccccaagcttgaaaaagtgctggcaggtaagatcgcgtacctgggaatggtgcgcggcaaaaagggaattgtctatgccagcctgtatgagcaactccaggatctgaacggagtgactgccctgcacatacttgaggaactgaccataatcgggttgcaggtggagtttgacaagaaccagaacctgtga

SEQ ID NO: 7538 - RNA, 1236 nt, unidentified
  source 1..1236: mol_type = other RNA; note = synthetic construct
atggccgagacacctgatcagctgcctcccacacccaacgaaaatgaaccagccgctggagctcccgctgatcagcctggagagccactcgctggcttcatcgtcaccgatgacaaactgcagccggcattaccagccgccacagagttggccgaactcgcagagcactttcgcgcggtgaccgatgctacctctctggccctggtcctcaatagtgcccttgagctgcaccgcaagaggcaccctaagggcagaactaagacagtcgctcccgggctgcttttgtactatgcgcaccataaaaaggagcgttacagaacttttcaggtccctaagcgcaccagaggccagttcagggacatcaaggctccggaacatgggctgcttagaatccagcgcctcctgctgctgtgtctgacggcgacgttcaccacttgtgacgaggccgctcacggttttgtcccgggacggaatgtgctaactaacgcccagccacacgctggtaggcgattcgtgctgaacttggacttgaaggacttcttcagtagtacgagagttggacgtgtgcttaaggttcttcaactggccccctttaatttgcccaaagaagctgcacatttgatcgcaaatttatgctgcgatcaaggatcactgccacagggcgctccaacatcacctttactcaccaacgtggtatgcgtttggctggaccgaaagctacgcgccctcgccaaaaaacatagatgtcggtacactcggtatgcagatgacattaccttttcgtcccagcggccagcatttacccccgcgttccatgccgaattaaatgccgtgctggccgatgagggatacgagcagaaccctgcaaagcaacggctccagacccccgaaactaggcaggaggtgacaggtgtggttgtgaacgaacgccctaacgtgccaagggaatttgtgcaggacattcgttttctcctccacgtctggcaaaaacacggctatgtagaggcatctaaagcaatgactcggaagtatgggagcagcaaggcccacgctaggtacaaggggtccacacctaaactcgagaaagttctggcgggcaagatcgcatacctgggcatggtgagggggaaagaagacgtagccttcgagcaattcgcccattctctggtcaccctatccagccccgaatatcgagagattgagatgctgatttccatacttagcagaataggttga

SEQ ID NO: 7539 - RNA, 1299 nt, unidentified
  source 1..1299: mol_type = other RNA; note = synthetic construct
atgccccagccccccgatgatctttttccaccctctcccgatgcagcagctggcagagaagaggatgctgctgggataccaaaccaggggagtagcatgccagatgaacccgcctcgattccacaacctgaccggataagggatgcggcggatttgctagccatgctcgacgccctcgatgacattcagcctgatcccctgacagacaatctggcagcacagcccttcccactaccagtcccaactaaactagctgatcttgccgagccctttagagcagtaactagcgcggtgtcactggcgagagtgctcaatgccgcactgcacttacatcgattacgttacccacgatcccaagctaaacctgtgtccgccaaactcctccggtattatgcccaccacaaacaggcgcgatatcatacctttcagattccgaaacgcacaaggggacagtttagagacatcaaagctcccgaccatggactcagacgcgtgcagcggcttctgctgctgtgcctgactgccgcattcacaacatgtgacgaggcagcccatggtttcgtccccggcaggtccgttctcaccaacgctcagccacacaccaagcggcggtttttgctcaatctggacctgaaaaacttcttcccaagcacctccgtaggtagggtcctggccgttctgcagctggcccctttcaatctgaataaagaagccgctcacttggtcgcaaatctgtgttgtgatgctggagtgttgcctcagggagctcctacctcacctttactcactaacgccgtgtgccaacgtctggacaagaagctgcggcgcttggctgcaaggcatcactgccgatacacaaggtacgctgacgaccttaccttctctagtcagaggcctgccttcacgcctacctttcacgcagaactgaacgccgtgttgaccgaagagggctatgaacagaatccggccaagcaaaggctgcagacgcctgctactagacaagaggtcacaggcgttgtggttaacgagcgccccaacgtgccgcgcgaatacgttcgcgacatcagatttctgctacatgtctggcagaagcacggttacgcagtcgccacacaggccatgcgtgccaagtacgggagctctaaagcccacgctcggtaccagcagaagatcccgaaattagagaagttgctggccggcaagatcacgtatcttgggatggtgcggggcaaagaggaggtggtgtatcgcactctccttagaaagcttgagatcgtaaagaagaagcaaaagctctga

SEQ ID NO: 7540 - RNA, 1338 nt, unidentified
  source 1..1338: mol_type = other RNA; note = synthetic construct
atgcctgaagacctcccacctgatgccatctctgcgacacccgaccagccagatgccggaacagaggaggcagccggtcaggcattggaggccgttcagcacgccgagctgctgagagtcctgtcccctgaataccaggcggggttttgggcaatgctgaacgcccaaaaagggagacagccacgtcctgcccctttgctcgaaataatcgataccgccggcctcgccgtaccttttagggaggtaatggatgctgacaccttggctcgcgttttaaacgctgctcttgcactggacgtcgcagagaatccccagcacaaacccaaacccctaattgggaaggtgctgaactactatgcttttcataaaaagaccactcgctacagcacttttgagatcccaaaaagaaccaggggcgaaatgcgagtcataaaggcaccagatcacggcttgcggagaatccagcgcctattgctcttatgtcttacagccgcatttactacgtgtgacaaggctgcgcatggattcgtgcccggcaggtcagtactcactaacgcccagccccacgcaggcagacgattcgttctgaatctcgatctgaaggacttctttacaaatactcactatggtcgggtggaacgcgtccttcaactcccgccattcagtcttttgcccgccgtcgctcggcttgtggcaaatctttgctgcgatcaggggagcctgccacagggtgcaccgacatccccactgctgacaaatgccgtatgtcagcggctggatagacgtctgaggcaactcgccaagtgccatcgcgccacctatacccggtatgctgacgacctgacgttctcttcccagaggcccgcattccgagagcctttttatgccgaactaaaggtgattctggacgctgagggataccaggagaacgctcagaagcggaggttacagctgcctaatgcccgacaagaggtgaccgggatagtggtgaacgatcaacccaacgtgccgcgcgaatatgtcagacaaatcagggcgatgttgcataactgggagacaaaagggtacgaagcggccagcacgactctccgtgcccattacagggagtcgaaagccggagcacggcacaaaggcaccgctcctaaactggaacaggtcctggccggcaagattgcttacctcggcatggttagaggaagcgactcagttgaatacaccgtgttctcccagaagctgaaaagtcttggtttcgacaaggaaaatttagctattatgggaatcctgaaggtgattaaggagaaaggcgtgaaggaggcgatcgcttctaagcaggtgtga

SEQ ID NO: 7541 - RNA, 1299 nt, unidentified
  source 1..1299: mol_type = other RNA; note = synthetic construct
atgcccgaagacttgcctccagacgccgcttcagcgacccctgaccaacccgatgccggaatcggcgaagcagcagagcaagcaccagaggttgctcagcacgcggagctccttcgcatccttagcccagagtatcaggctggcttttgggcaatggttaacgctcagaaagatcagcagcagcgaccgctgccactgcctgaaatcatagatactgctgggctcgcagtgcctctgggggaagtgaaggacgctgataccttagcccaggttttaaatgcggccttgaagctggacgtggtggaaaaccctctccacaagccaaagcctctgacgggcaaggttctgaattattatgccttccacaaaaaggccaccagatacagtacttttcagatccccaagcggactaggggtgagatgagggtgattaaggcccctgatcacggactgaggcgcatccagcgtcttctgctgctctgtctgacggctgcgtttaccacttgcgatgaagctgcccatggcttcgtaccgggtcggagtgtcctgactaacgcccaacctcacgcaggacggcgcttcgtgcttaatctggacctgaaggacttctttacaaatacccattacggccgagtggagtctgtgttgcgaattgcgccctttggtctgcaacccgccgtggcacgtctcgtagctaacctgtgttgcgatcagggcagcttacctcagggggctccaacatcacccctgctcactaatgctgtctgccagagattggacaggcggctgcgacagttagcaacacgtcatcgcgccacatacacccggtatgccgacgacctcacattcagctcgcaaagaccggcatttagagagcagttccattccgagcttaaggaaatactcgatgctgaaggctaccaagagaacgccctcaaaaggagactccaactgcccaatacacgccaggaagtgaccgggatcgttgtgaatgaacagcccaacgtcccaagggagtacgtaagacagataagggccatgcttcataactgggagacaaaagggtacgaggtggcctccgcaaccttgcgctcccactaccgggaatctaaagctggagcccggcacaaaggcacagtccccaatctagagagggtcctggccggaaaaattgcctatctaggaatggtccgcgggatcgagaaccccgagttcattaacttcactagagtgctgcaggagttgacgattacccagaagtttagattctctttggatcttgtcatgccaaaactatga

SEQ ID NO: 7542 - RNA, 1065 nt, unidentified
  source 1..1065: mol_type = other RNA; note = synthetic construct
atggaatttacttcagatgaaatccagaccattaaaacagcccttcagtctgggaagaacctggccgacctgaccgacttgcttaaccttgttagcgattggattgcgcagaaactggtgttagaatataagccttttagcatcaagcaggtgtatcattattattacaacctggagagcaaatacaaggagcaccgtattagtaagaagtcgggaggggagcgagtgattcacgctccagaggagacattgaaacgaatacaacgcagactgaacgtcatcctcagccatctctataagcctacggaggccgctcacggctttgtgatgaaccggtctattgtctccaatgctcagccccacctagggaagaagaacgtgttcaatctggatttgcaagactttttcccaactatccatttcggcagaataaaggcagtactgcagctgcctgagtatggtttaactagtgagtttgctcatatagtcgcaaatttctgctgcttccagggtaaattgccccagggatcaccagtgtctcccatcttgaccaacatcgtatgtcggcggatggattacaggatttccggactcgccgcaaaacacgggttcacgtacacaaggtacgctgatgatatcacactatcctttgacgaactttcaaaagaagccaagcaaaaaatgggcctgggcctgggaaaaatcctcaaggaagagggcttcaaggtgaattccaagaagacccgcttactgaaacctaaccagcggcaggaggttaccggcgtggtagtcaatgagaagctcaacgttaacagagaatacgtccgcactatccgcgcgattctgcataattggcaaaaacacggactggaagtgacacaggcaaagttcctgaatcactaccccgaagaaaagggcttcaaaagaaataaaaccatcccggaccttaggaaggtgctactcggtaaaatacagtttctgaggatggttcgtgggggtagtgacgaggcctttaaagagtacctgatcattttcgacaagctcgccaagaacaatctcaaatga

SEQ ID NO: 7543 - RNA, 1065 nt, unidentified
  source 1..1065: mol_type = other RNA; note = synthetic construct
atggagtttacaccggatgaactccaaaccatcactaatacactccgaagcggtcgaaatctagcggacttgactacgctccttaacttgaccggcgaactcattgctaagaagctggagttagagcataaatcatttagtgtgagacaggtctaccattactactacaacctggagagcaagtataaggaacacagaatgccaaaaaaatccggcggcgagaggattatccatgcccccgaggaacgtctcaaacagatacagaggctcctgaatgtggtgttctcccatctgtatcagccctctgaagcagcccacggttttgttaggaacaggagtatcgtcactaacgcccggcctcacgttggtaagcagcatgtcttcaacatagacctgaaggacttcttccctactatccactttggccgggtcaaggccgtgctacaactgcccgattatggactaacccccgaattggctcacatcgtggcaaacttttgctgtttgcagggacggctcccacaaggatctcctgctagtccaatcattactaatctcgtgtgcaaaagacttgactatcgcatttcagggcttgccgcaaagcacgggcttacgtacacacgctacgccgacgatattagcctgtcgttcgatcagttatcccacgagtcccgcaaatctttctcatatgggttaggcaagatactggacgaggaggggttcatggtgaatggaaaaaaaaccagactgctgaggccaaatcagaggcaggaggtgacaggggtagtgatcaacgagaagataaacgtcaatcgcgactacatccgtaatctgcgggcgattctgcacaattggcagaaacagggagaagagacaacccaagtacgatttgaacaactgtaccctaagaccgctgtttttcagagaaagcgcaagattccgaaacttcagaacgttctgtatggcaaaattcagttcctgaagatggtacggggcggtgaagataaggatatccaaaacttcttgatccagatcaacctgctgagcaataacgtgagaaaatga

SEQ ID NO: 7544 - RNA, 1047 nt, unidentified
  source 1..1047: mol_type = other RNA; note = synthetic construct
atggaactcagtcagtactatatcgacgaaattaaggcgcgtgtggccaatggtaccaccttagaggatgtcacaagccttattaacttcataatcaacatccagaacgaaacactaggcaccacttaccggttcatttctactaagcgcctcgcctattattttgtgcatcgcgacgagaggtacctatccttcgaaatacctaaaaagtcaggtggcgtgagacagattacagctccagatcctttcctgaagaaggtacaacgcaggctgaatttcatcctggaggtcttgttccgaccaaaagcagccgcccacggatttgtcacagggcggagcatcgtgaccaatgctaaggtgcatgttggtaagaactacgtctataatgtagatctgaaagactttttccccacaatccactatggaaggataaaggcggtgcttcagctcaattcattccgtatgaagccagattttgcccacataattgcccacttatgctgttataaaggaatcctccctcaaggggcacccactagtcccatcattaccaatatcacgtgccaacaactcgataagaacctggtcgattatgctaagctgaactcctgctactatacgcgctacgctgacgacatcacatttagcgctgataaaaacgtgtttaaggacaagttccatgagaacctgaaattacacctggaagccgccggctttaagctgaatgacaagaaaactcgaaaacagaagagaactcagagacaggaggtgaccggcattatcgtgaatgagaaactgaacctccagcggacctacattaaaaaaattcgggcaatgctgtacaattgggaaagagacgggttgcccgcatgtcagagggagtttaacaaatattacccgctggagaaagggtttgttaagtcgaggatcttgccacctttcgagaacgttctgatgggcaaaatactttttcttggcatggttagaggaaaagaagacaagtacttcatggagttcacctctaagtaccagtccttgaagtcttga

SEQ ID NO: 7545 - RNA, 1047 nt, unidentified
  source 1..1047: mol_type = other RNA; note = synthetic construct
atggaactatcacataaacagacggagtacattaagtatttcgtctcaaatggcgaaaccttggaggatctgaagtctctcatcaattacatcattaagctccagaacgacacactgggcaccacgtataagccggtcagtatcaagcaactcactttctattttgccaatcgtgataagcagtattttaacttcgagatccccaaaaagacagggggggttagaaagatcaccgccccagacctcttcttaaaaaagattcagcgcaggatcaactttgcgctggatttgctgtttaagcccaaagcagcagctcatggatttgtgaccggtagatcgatagtgtctaatgcaaaagtgcacgtcgggaagaaatacgtatataacgtggacttaaaggatttctttcctaccattcacttcgggagaatcaaagccgtgctccagctgcatccttttaagatgaaaccaaaatttgcgcagctgattgcccacatttgttgctttgaaggaattttgccccagggtgcccccacatccccaatcataactaacattatttgccagcaactcgacaaaaacctggtgagcttcgctaagttctacaagtgctattatactcggtacgctgatgatctgacctttagttccgacaagaacagcttcaaagaaaaattctacgaagatctggtgcttcaccttaccaacgccggattcgctctgaatgagaagaaaacacgcaaacaaactaggacacagcggcaagaggtcactggcataatcgtgaatgagaagcttaacttacagaggtcctacataaaaaagatccgggccatgctttataattgggaaaaagacggcctgcacgcatgtcagaaaaatttcaaccaatactaccctctggagaagggcttttttaagaataagagcgtacctccattcgagaacgtcgttatgggcaaaatcctcttcttgggtatggttcgaggaaaggacgacaaatacttcctagagtttttcagcaagtaccagaatctgtctaagtga

SEQ ID NO: 7546 - RNA, 1065 nt, unidentified
  source 1..1065: mol_type = other RNA; note = synthetic construct
atggatttgactaacaaacacatcgagtacattaaactgttgttacacaagggcagcacccgggatgatctcgtgtccctgatcaactttgtaatcgagctgcagaacgaacagctccagactaactacaagacaatctctaacaatcaacttgggtattacctagctaagcgggatgaaaagtatattcatttcgagatacccaagaaatcgggaggcgtgagacgtatcagttccccttccaaagtgctgaaaaagatccagaggaggattgcttttgtgctagaggtcctgttcaccccaagattaagcacaaatggctttgtgaaacagaggtctattgtcacgaatgccaaggggcatatcggccggaaatacatttataacatcgacatcaaggacttctttccgagcacccactacggacgagttaaagccgttctccagatttttccattcaaagccagcgaggaaatggcacacctgattgcgcatctctcttgttacaagggaatccttcctcaggggagtccacttagtcccatacttactaacatcgtctgtcagtctttggattatcacctggtgaaactggcccaagaccataagtgcttttattcccgctatgcagacgacatcacgttctcatcaaataagaacatttacctcaacgagaagttcttaattaagcttaagaaggttgtgaacgaccagggtttcaatatcaatgaaaaaaagacccggctgagatcaaatgctcaacgccaagaggtgactggtgtcatagtaaataccaagcccaacctgaagagaacatacattaagaagctccgagcaatgctgtacaattgggaaaataaaggactcaagtattgccagaataaactgacaattcactacccttatgagaaaggcttcatacgtaacaaagtcgtgcccgactttgaaaatgttctgcagggaaaaatacagtttctggggatgatcaggggcaaggatgaccattactacaagaccttcaatcgcaagttcaacgagttgaaaaaagtgaagaacggttattga

SEQ ID NO: 7547 - RNA, 1062 nt, unidentified
  source 1..1062: mol_type = other RNA; note = synthetic construct
atggactttacacagacagaaattagtgaaattctgacccaactccagcagggacagaagatcgaggatctggtcgagctgttgaatcatgtaatcaagctccagaacgaaaaggataagaccacttacaaacctctgacaaacaagagagtgaagttctactacgcaaatatcaacaaaaggtacgtgaatttcgaaatccctaagaagaccggcggcaaacgcaccatcacggctccagataagtacctgaaaaaagtgcaacggcgcattgatttaattcttaggctcttgttcgtaccgaagcctgccgcccatggattcctagccaatcgttctattgtttctaacgccaaaatccacgtgggcaaaaagtatgtactgaacatagacctgaaagacttttttccttccgtccattttggcaggatccgagcggtgctgcagttgtatcccttcagacttaaacccgagtacgcacacgtggttgcgaatttctgctgtttcgaatcaaaattaccccagggtgctccaaccagcccaatcatcactaacatagtctgccagaagctcgattataagcttgtccagctggctaaggagcaccactgctattttactcggtacgcagatgatattactttttcgtgtgacaaggcacggttcgacgacgaattcctgaagaagcttgatgagattgtcaaagcagaaggtttcgtgatcaatgagaagaagactcggattcagaagcgagcttttcgccaagaggttacgggcgtcaccgtgaatgagaaactcaacctccaacccgactacatcagaaacgtgagagccatgctgcacaactgggagaagtatggatatgagatcgccaacgccaaatttgctaaattttacccgaaggagaaggggttcctacgtaataaaataataccacccctggaatccgtggtttcagggaagattatgtttctcgggatggtgaggggaaaagaggacgccttatacttgcgctatagcaaccagctgaaaaccctgacagacttgaaaaatacaaagtga

SEQ ID NO: 7548 - RNA, 993 nt, unidentified
  source 1..993: mol_type = other RNA; note = synthetic construct
atgtacaaaaagattagcgcaaagcggctcaaacactattacgccaacatcaacaagaagtacatcaacttcgagattccgaaaaagacaggaggcaaacgaaccatcacagctcccgataaattccttaaggccattcagagaaggatcaatctgctgctgacgctctttttcgaacctaaacccgccgcccatggtttcctggaaaacaggagcattgttaccaatgctaaaattcacgtcgggaagaagtatgtgctgaatatcgacctcaaggatttttttccatccatacatttcggtagaataaaggccgtgctgcagcttcctgtgtttggcattaaagctaatcagttcaaacagggggatagtatctcttttgaactccttgccaagttcggactgaaacctgagttcgcacagatcatcgcgaacttttgctgttttgagtcaaaactcccacaaggcgcccccacttctccaatagtcacaaacatcgtgagccagaggctggactataagctggtcaagctggcaaaagagtaccactgtttttatactcgctacgccgacgatatcactttcagttgcgataaaaaccgctttaaggaagaattcatgattaagttggacgagattatcaaatcggaggggtttgttatgaatgacaagaagacgcgtactcaaaagaaagcagtgcgccaagaggttacagggattacagtaaatgaaaagctaaacttgcagaggacctatgtaaagaaggtgagagctgctttatccaactgggagaaatatggatacgaaaaagccaatgcaaaattcgcgtcctcatacccacaggaaaagggttttttacggaataaaaccatccctcccatggaggctgtcttgagcggcaaggtgatgttccttggcatggtgcggggacaggatgacaccctctatttgaaatacaagaacaagctatctgagctgctgataaccaagtga

SEQ ID NO: 7549 - RNA, 1080 nt, unidentified
  source 1..1080: mol_type = other RNA; note = synthetic construct
atgaaggagcgcaaggaaatgatcatgcaactcgtaaaaaactgtgacaatcttaaggacttctgcgaactgattaactcatccaacttgctcgtgagcaagattcagtctcagaaaccactttacacctccggcaaacaatttggctacctcctggctaacaaggagcatttatataaacagttcgacatccctaagaaatccggcgggaggcgaaaaattaacgcacccttggataatctaaaggtggtacagtacatgatcaaaaacctgctgcaactcttctataataccccatttgagtggcaggaaaagttagaggagatcagcaagaataacgcaacagtcctcccctgcgtgcacggttttgttaatggccgggggatcgtgagtaatgcgtatctgcacctcaagcaggatttcgttcttaactttgacctgaaggactttttcccttcaataggaaatggcaaaataatcgaaacgctatgtttggcccccttcaacttcagcagatttacaagcaagataattgccaacctgtgcaccctggagaaccatctgccacagggagcatgcacctcacccttgctgtctaatatcgtctcgcagagaatggacaatagatttatgagcctcgccaacaagtaccctaccatgcagtttagccgttacgcggatgatattacattcagttgtatgtaccatgtctttgacgactctttcatggagattatagaagatatcgttcgcgctgagagttatgtgatcaatccgaaaaagactaggctgcagaggcagtcccagagacaagaagtcactggtctgatcgtgaacgaaaggcttaacattcctcgcaaaaaaattcggatgttacgagccgtcctgcacaattggaaagtgaacggctatgagtccgcccaggccaaatttaaggatgctttcgggatgaaaaaggatttgaaactctctattgggggattccttaattttctgaagatggtgcggggagatcaggacgctctatatcaaaagtactacgaggaattcaagatcctgacaaatgagatcactaattga

SEQ ID NO: 7550 - RNA, 987 nt, unidentified
  source 1..987: mol_type = other RNA; note = synthetic construct
atggaaattactaaagagaagatcaaggagctactcgaaaaaggcaaaactatggaagacttcttggaagcatataattgcttcctgctatatctgaacagtagggacgggaaagatagaaaattgtgggagaagaactcttttttgtatctctaccgaagtgttaacagacaatacatagagttttccatccccaagaagagcggagaggaacgcaaaatttgcgcccccaaaaaacagctgaaactggtgcagaagaagatcacacaaattctggagctctactacaaacctaatgctaactgccatggattcgtaaaacagaggtctatcgtgaccaacgccgagatccatacaaataagacatttgtgctgaacctggacttagaggattttttcccctccattaaaactaaccggattatcgactctctcattatcgaaccattcaatttctcaacagagatggctaagataatctcaaggattgcatgtaaagaaggcggactcccacaaggcagcccgatgtcccctatgatcagcaatgtgtgttgtgaaaagatggatcttgaccttaaagatttcagcaaaaagtacaagctcaattactcgagatacgctgatgaccttacgttctcaggttatcgcaagatcttcaacaataccttcttttccgaactggggcgtatcatcggtaaaaagcaccattttcgtattaagaagtctaagacccgcattcagaatcgcaacaaccggcaggaggtcaccggggtcgttgtgaatgacaagttaaacgtgaataggaagtatatacgggagctgagggccctgatacactatcacaagctgggaaaggccgaggagaatgcgctttatgtaataagtgggaagttggaatttctgaagatgatcaagggcaaagatcgggtctacagaaacctgttaattcagtttaagagccagaaaaatggccagcgaaacaactga

SEQ ID NO: 7551 - RNA, 1071 nt, unidentified
  source 1..1071: mol_type = other RNA; note = synthetic construct
atggagaagtatcggactgctaggtggcggttaacgatgtatagcgaacgtcacattattaccatcctgaatcgtattcgaagaaggcgcgacatcctgaactgtaagggttactttaaactttccacgttacagaagtatgcaagcggaaactactataagtttttcagcatacccaaaaagaacggggggaaacgcataatctccgctcccgaaagagagctcgccttcatccagctatgcatcgcggtgctgttcaatagcatctacaagcccaataaatgcgtcttcggatttgtggataagcgatcgattgtgcagaatgctcagcagcacattaacaaagagatccttttcaacattgacctgaaagattacttctcttcaatctcttacaacgatatcatcgagaaactgatcagacagccttactatttctcttacccagccgcaaagtttctgacagacattttggtcgtggagactcaagatggaaagcgggttctcccgcaaggcgcacctagctccccaattgtgacaaacatgatagccgaccaccttgacgtccgcttgtccaagttcgctgaaaaacacgacttgacctatactaggtatgccgatgatattaccttctcattttcaaggagcaaacttcgtggttggcgcagtcatggtctgaccaaagggatccgcgacataatttttgacattatcgagacagaggggtttctcatcaataagagaaagaccagaatctcctttataaatcaaagacatgaggttaccggcctggtcgtgaataagaaagtgaacgtaaagcgggaatacatcaaaaggctgaggacagaaattcacaattgggagcgagatggctatgtcattgccagttacaagttcctgaaacattacgaaaagactcatctgggaaaactcaagtctatggaaaacgttatagaaggcaagctaagttttatcaagatggtgaagggcgagaacgatactacatttatgaagttgtacaaccggttcatgctcctcatgcagcgggacaaagtattcatcaattcatga

SEQ ID NO: 7552 - RNA, 1743 nt, unidentified
  source 1..1743: mol_type = other RNA; note = synthetic construct
atgcccagaccagcgctgctgtcctcgtcattcggattgctgagcgtgcaagatctgtgccagtatctgaatagtatcccagtcagcgagcccctgctcaagcaagcctatacccccctttctctccaggccctcagtgaagtggcttccagctgctacaaagagttacacctgcccaaaaaaaacgggtccttacgaataatccacggccctaacccacacctgaaagctgtccagaaaggcctgtgcacactgttaaatgagtatcagaaggagttgaaatctccttccgcttacgggttcgtaccagggagaaacatagtggacaacgcagctcgacacaccggaaagaatgttgtgatcaacttagacctgctgaacttcttccccacaatcaactcaagcatggtggctgaggcacttgccaaaccaccggcaagcattcccctggtgtctcagctcaatcaagtcatgacaaacctgatgtgtcgcgaggacaggttaccgcaaggtgccccatcaagccctgccatggcaaacctcgtctgtcacagtctggatttgaaccttcgggccctagcacagaagcatagatttacgtacactcgctatgctgacgaccttacattttcgtcaaactaccctaaggttgcggaggaggtcttcatcaatattatttatcagcgttgtgagaagttgggtttcaaggtcaacaaggaaaagactaggatccaaaggagctccggcagacagtccgtgacagggttggtggtgaattccaaggtgtctgttaaaaagaaatactgccgtataactagggctatgcttcataactggaaaaaactggggtacgaggaggccgaggccctattcaaagccaattatcccaaaggccctctatataatctgtccaacgttctgcttggtcgaatcgagtttatcggcatggtcgacaatcacaagttgccgctcagacagcggaaaaatcaactgctctctgacacccggtatatgaaacttctggccgaatactgggaactcatgaatgggcagaactatagcttcattcagaatcagaagatctttcagaggttggtcaggtttaaccggctcgccgagaatgtagctatgattaagaacaaccagtttagttctcgcgatcgctttatccggtattgcacctacaccttcgtacagttggaggaactttataaggtatacttcctcatcaagttccaagaagactacagtaagataggccgccatttctttgacaacaacgatgcattcaaacgcatgctgctcggaaagaagaaagaagaccactcacccgaggatgtggagagagctcgtaaagaggccgagaataaaacttcatttgcggattacaagacgtacatgctggaatcccagtttctgaacgattgttactacgcgaagggtagaaatcctccaaagctccccaggctgctgaggcagctacggaatttttacgtgcatggatctgaatttactaaaagagatgaggcaagcctgaagcagaccttggaaggaattcctgcaaagaatgccgcatataaaaagaagcatcagaaggatcgagtgatgcctaaggacgaagtgaaagcccaggaagaatatcttgtgttcaagtggattgatggaggcgactacgatagtgtgcgcgccttcctgggcgacattgttgctctcgttcggtacgaatttgaagatcggaattga

SEQ ID NO: 7553 - RNA, 2040 nt, unidentified
  source 1..2040: mol_type = other RNA; note = synthetic construct
atgataagcacacagtacgatacaaacgttctgatctcgctactccgcgagggggagtctctggatgacttgctgaccctgctcaacggcgtcgtcgaatggcaaaacttcgtgcaccagtctaaacgacggctgttcaccaggaagcagctctcatttttctacaaaaacgtggacaagaagtaccattcatttcaggtgccaaagaagtccggggccctgagaacaatcaatgcgcccgacgggaccttgaaagccatccaacggtgcattacggacctcctccagattatctaccagccccctttctcggtaaacggctatgtaaaaggcaggagcgtcgtatctaatgccttgatgcatacgaataagaactttgtgctgaatatagacctgcaggatttcttccccaatatcaagttcggaagagtgagtgcagtgttaaaacttaagcctatcgctgttaaacccaaattcgcctaccttcttacaaaatactgttgctacaacggcgctttgcctcagggagcacctacttctccagtacttagtaatctcatatgccagcgactagactttcgactcactgagctgactcggtccgagcatcttagctatagtagatacgccgatgatttaactttctctagtgatcaaccgtttcagaacgggttcctgacccgcctggaggagattatccaagaggaaggattcctgattaatcccggcaaagtgagactgctaggcagagatgtgcggcaggaagttaccggtgtgactgtgaatgacaagactaacgtcagtaggaaatatatccgtaagatcagggctatgctgtacaactggactaacctcggctatgaaaaagcccaggacaggtttcttagtagctacaaaccaccagccaatgttgtcaagaacaaaaagtcagatcctcagctgtccaatgtggtcggcgggaaaatcgactacctgaagatggttcgcggagcagacgattcaatttacagacaatgtaaggaggcttttgagcaattacttaagggggagctgatttttcagatctctgagaaaatcctcagaacgcaaaccgtagagcaccagccacggcaagtggtgtccttcctgcgcaatttcaaagttattaaccagaccggattccgtgagctgttacatgaccctgatgtctccgattttgattttaagaccaacttggcgaaggtcaacgagcagatgcctgctctgagcgctgtcttgcccgcaagcctctacacgaaactggaatcctttgttgcagtgtacaacacagacggacaggcttaccacgaaaagtatggacttcttccgctgaagggccagaagaagacaaatccaaataatctcatcgacatcctgtctcgaaagaagaagaataaagtggtcgaggatatggtgctgacaacacgggttcaggccgaagacatattgcccgataataaggtaacccaggccgccaaggactttcggacacaaatccggatagggaacgactattttcacgactggatactaattaactcgctcaagcccattgtcaatgaactcaactctagggaactggtgtctatttcctatgaaccatccgaggaagaattcagcctgaactgtgagtttttcactgacactaaagaggtgtggaaagctattaggagcttgctgaaggacttagccgagaacccttattatgatgtgaaggacgagcgcattatattgcttcgcagcgccaccattaagcgcaatctgaatggtgagtcattctttgcgactattatctatctcaacctacaaaacgctttcatcgtgaatgaactgaaagcctttcagcagagccgtctgaccaaaaaccagcagaggctgcataaactagcagattggtccaccgtgtatcaggacgaaagtggtcagttatccgagcacttgtttctggcaagcccggaaacaagatcagataatcagctcaccgaaggtatcacccacaagctcacattctatcactcatga

SEQ ID NO: 7554 - RNA, 1998 nt, unidentified
  source 1..1998: mol_type = other RNA; note = synthetic construct
atggcgcctatccagtctgatatcgtaactcttcagaattctctacagaaggctgaggacttccacgattttctctccgtcctcaatgacgcgctagagtttcccttctctcagaagaaactgtacttccacctgaaaaacgtcgacaagctgtatcatagcttccaggtgcctaaaaagtcaggtggcctccgtaccattaatgctccaaacaaatctctgaagttcatacagcattgcttggcgtttatcctgcaaggagcatatcagccaacatattccgtaaacggatacgtgacggggcggtctgtggtgagtaatgcacatgtgcatgcaaacaaaaagttcgtgctcaacttggatctcgagaacttctttccttcaattacatttgggagggtgcatgccgtgctgcagctaaaacccattctggccaagcctaatgtggcacagatgattgctaagttatgttgttacgagggcgttcttccccaaggcgcaccaacatctcccgtcctctcaaacatgatctgtcagcggctagacagaagaatagagtcgctcgtgtccggctaccagattacatacactcgctatgccgacgatttgactttctcctccgacaagcctttcgaaaatggattcttaagcaggctcgatgagatcatcaaggccgaaggatttaccataaacctcgaaaaggttcgactgcagttgaagaatagcaggcaagaggttaccggcttaaccgtcaatgagaaagtaaatgtcacccagcggttcatccgggaaatcagggctatgctgcataactgggggacgctgggctatgactctgcccaggccaagtttttaacccactactcccctaaggttagcaagaagaagaagagcgaaccccaattacgcaacgttgtggcagggaagatcaattaccttaaaatggtgcgaggaaacgaggataccgtttaccagcaatttaaagccgagcttacacggctcgaaaagggagaggagatcccacaaaaaaagccgaaactgccagtgtggcagccgtccatcgaccacaaccctcgtagggtggtacaatttctgagaaatttccgggtggtcaacgacacaggctttcgcgaactgctgcacgaccccgatgtgagtgatttcgacttcatggctaatcttgccaaagtcaacactcagatggacggtctgaagtccgtgctcacgccaaaacttcaccagaagctgtccgtgttcgtgaacgcttacaataccgccggcgttacctatttccaagaacacggtttgttgccgctgaaagggcgacccaaacagactgtgagcctgttagctcgcctactcctgaagaaggcaaaaatgcccgtcctggaacagcagactacagagcaggtagccgtggctcctgatcgcgccgtcagtaaagcagccaaggtgtttagagagcagatcagagtcggctcagattacttccaggatctgatcctggtaaacgctttgaagccaatagtggagacacttaatgctagcgacagtgtgaacgttagctttcaacctggtgaaaatgagtttgggataaactgcagtttttttaccgatacgtgggagagtgtcaagacactgaggtcagttttgaaagacttggcccagaacacagactaccaaactccaactaatcagaggaacatttggcttagatctgctgttattcagcgagaagcggagaaagaagcattttttgccaccgtcatttacattcacctggaaggcgggaagattgagtcagagaatgccttcaaacatatccgtctccttaaaacacagcagagactctgcagcctggccgattggtcggtcctgtatcaagacgcgaacagccagactcaagaattcttcttcctgaattcagatgccaaccgctcccatcaggcacccaattatgaaggaattacccacaaactgaccttttatcacagttga

SEQ ID NO: 7555 - RNA, 1497 nt, unidentified
  source 1..1497: mol_type = other RNA; note = synthetic construct
atgtccgaggccgaaatgaaaaaaatttggtggtttcggaatcgcatgtacaatcagttcgtggtcacctcaaaacacggcaaagctcggaggatcaatgctcctgatctcaggttgaagatgctccaaagaagcattgcaaaactcctagatcagctgtatgccccccgtaatccagtgcacgggttcgtcaatgatcgatccgtgattaccaacgcatcctctcatctgcgatccaagttcatagtgaatttagacatcgagaacttcttcccaagtatcagcgaaaacagagtagagggcctcctccgagccataggaatcgacgataacgtgtctagcatcatcgctcgcatctgtacaagacagggggtgttgcctcaaggagccccgacaagccccgtgttatcaaacatgatatgtttcagacttgaccgcgaactgcttgccctgtccaaagcctcaagatgcatatacacacggtatgctgacgatattacattctcttcgtaccagaagcccgaactcctgtttggtgctggtgtacctcctactggccgcttttctcccgagctgctcgctacgaatctctcggcagcctttaccgacaacggctttactctgaacgcggataaaagtcagtatggtgacaagcatagcaggagaatcgtgacggggctaaaaataaacagtggcttgaacgtggaccgtaggtttgttcgaaatattcgcgccgcactgtactctgtggaagcaaggggccttgcagccgcgcaaaagaaatttaaggatcggcacaacggcaccactgaccttgagctgcacctgaaagggaaaatctcttggttaggctccgtgaaaggacagttcgaccctgtcttcagggcgattgcgtctcgcttcaacgcggcttttccggcacacatgataaagatcaacccaagtccagaggatatcagatcacgggctgtctgggttttggagcattttcatggtgatttcgcccaaggcactgccttctttctgaagggggtgggactggtcactgccgcccattgcgtctcagacgctcttggggaggagattgatgtgcaccaccacagcaagcctagcaatacatttaaggttaaggttaagcagcatcacgtgatccgggatctggcaatccttgaacataccattccatccaatgaatattacgagctcgagctgacaaagcaggctttgaatatcggtgattccgtcagggccattggttacccaggctatgcccccggcgacggactgaatattcgtccgggacagatcagcagcttcagtgtgaagagtaccgttcctctagtcgaggtcacccagaagctgacccagggcatgtcagggggacccattattgacgaccagaacggggtaatcggcattatccacaagggagggccccatgagggacgggactttgccgtgaacgtagaagctttggttgcatggctggacgaatga

SEQ ID NO: 7556 - RNA, 1593 nt, unidentified
  source 1..1593: mol_type = other RNA; note = synthetic construct
atgccaaagccgttcattatgttcgggtcgttgaacctccgcactagcatacctcctgagttggcggactattctacatttttaggttacctctgcctgtctcaggctgagcttaagaagatttggtggtttcgtaagaagatgtacaaggacttcaaaattacatccaagtacgggaagacacgtaggattaatgcaccagatagaagattaaagatgctacagcggaacattagcccactcctcgataaactgtatagcccccggaacccagtgcatggatttattcatgagcgaagtgtgatgactaatgcgagctcccacctttccaacaaattcgtcgttaaactggacatcgaaaatttctttcccagcatctcagagaatcgtgtcgcaggcctgcttcacgccctaggggtggatgagtcagtgtccgccataattgctcgcctgtgcaccaatcggggagttctccctcagggagcccccacatcacctgtcttgagtaatatgatttgtttccgcttggataaagaactgctcaaactggcgaagaccgctaggtgtatctatacccgatatgcagacgatgtgactttctcttcataccaaaagccggaactgctgtttgaagtaggcgcccctcaacccgggagattttcacccgagcttctggccagcaacatctctgccgcctttaccaataacgggttcaaactcaacgcaaataagtcccagtatgcagataagaacagtcgccgcgtcgtaaccggcttaaaaatcaattccggcctgaacgttgaccgcagattcgtgcggaacatcaggtcagcactctattcagtcgaaacacttggcttgagcgcggctcagaagaaatttgctgatcaatacggagggaagtgcgatctgacacagcacttgaaaggaaaaataagttggctgggttctgtgaaaggccattccgacccagtatttagagccactgtgctgaggttcaattccagctttccatctcagcccatcaaaatgaaccccagttctgacgaaatcagaaatcgaggcgtctgggtgctggagcacttccacggagactttgctcagggcacggccttcttcatgaagggcgtcggtctggtgacagcagcccattgtgttgccgatgctattggcgaagagatcgacgtgcaccatcacaccaaaccgagcaattctttcaaggttaaggtgaagcggcaccattttatcaaagacctggctatcctggagcacgccataccttccaacgaatactacgagctcgagctaaccgaccaagatctccaagtgggagacactgtgaccgccgtaggctaccccgcattcgctcctggggatggtcttaacgttaggtccggacagattagcagttttagtgtgaagtcgacggtgcctttagtcgaggtgactcagaaacttacgcagggcatgagcggaggtccaatcctggatgagaaaaatcgggtaatcgggataatccacaaggggggtcccaacgaaggcagggacttcgccgtccatgttaaggctttgatggaatggctgcaggagtga

SEQ ID NO: 7557 - RNA, 1377 nt, unidentified
  source 1..1377: mol_type = other RNA; note = synthetic construct
atgctccagcgtgctctggtaccactgctcggcgaaatatactctcctcgcaaaccagttcatggtttcgtgcgggatagatccgtcattactaatgcagcgtcccacttaaagagcaagtttgtgattaaccttgatatcgaacggttttttcctagtattagcgagaatagggtgataggactgttgaaagctctcggcgtggacgaggacgtttcttcaataatcgccaggctgtgtagtaaccagggaactcttccccaaggcgctccaacaagtcccgtcttgtctaacatgatttgctttcggcttgacaaggagatgcaggttatcgctaaggcagcacattgtatctacacgcggtacgcagatgacattactttctcctcctatcagcctctgagcgccctatttgccgctggtgtcccgtcaacgggcaacttcgcccctgatctgctggctcctcagcttctcgctgcatttatcaataacggcttcaaggtacatcctgataagacccactatggggatcgccactccaggcgaatagtgaccggactgaaagtgaactcaggcttgaatgtggaccggcgattcgtgcgaaacgtgagatcaaccctcttcagtatagaaactacagggttagccgcggcccagaaaaaatttgacgatcactatggcgggaggagggacattgcccgcttccttagagggcgcatctcgtggatcggcaatgtcaaagggcagtctgatcccgtttatcgctctattgccacgcgttttaatgcgtccttcccaatgcagccaattatggttctgccgaccaggaccgagatcagaagacgcgctgtctggattctggagcacgcacacggagagtgggcccaaggctctgccttcttcctgaaagatgtgggattagtgaccgcggctcattgcgtccaggatgcaattggcaaggaaatcgacgtctaccaccccacaaagccagccaacatctttaaggtgaaagtcaagaagcaccataaaatcagagacttggcccttctggagcatagtatccccagcaatgagttttacgaactggagatgaccaacacaacatacgtgatcggcgacgttctcactgcagctgggtatcctgggttcgcccccggagatgggctcaatgagcggctcggtcacatcagcagcttcagcgtgaagtcaggtgtacccttgatcgaagtgactcaaaaactaacacaaggaatgtccggtggacccgtcttcgatgacaacgacctggtagccggtgtgattcataagggagggccagacgaaggccgtgactttgcagtgcacattgacgccctgaccgcctggctggatgaatga

SEQ ID NO: 7558 - RNA, 1596 nt, unidentified
  source 1..1596: mol_type = other RNA; note = synthetic construct
atgccccatccactgagagtatttggcggggtgtcatttcgcgtccgcatccccagcgagatgacagacctgactacctttcttgaccacctgtgtctgtctgaggctgagctccggaagatctggtggttccgagggcgcatgtataaggatttccctctgctaagcaagtcaggcaaaccacgcataataagtgcgccagatcggcgtctgaagatgctacaacggacaattgcgcctttacttgaccagatctattccccaagaaaccccgttcacggattcgttcccgataggtcggtgaggaccaatgccacatctcatctcaaatccaagttcgtggtcaatctcgacgtagagaggtttttcccgagtatttccgagaaccgagtggctggcttgctcaaggccgtcggcatcgacgagagtgtggccgttgtcgtggcccggctgtgcacaaatcagggagtactgccgcagggtgcccccacttctcctgtgcttagcaacatggtctgttttaagctggacaaggagctgcaggccatcgctaaagcagctcattgcatttacaccagatacgcagacgacgtgaccttttcttcatatcagcctcctggcgggctgttcgctgaaggtgtgcctcccacgggcaatttcgtcccagacctgttatctccgcgactcatcggtgccttcacaaataacggcttcaagctcaacccaagcaaatcacactatggagacaagcatagcaggagaattgtgaccggactgaaaatcaacagcgggttaaatgttgatcgccgctttgtgaggaatatccggtcaaccttgtactctatagaaactttgggcgccgatactgcacagaagaagtttgaggtcgaatacggcggtaaatgtcgcctctcccaacacctgaaaggggagatttcttggctgggtagtgtgaaggggcagagcgatcccatcttccgtgccatcgcagcccgatttaactcctccttcccaacccagccaataaaagtgtcaccgactcgggcgcaaatcaggtccagggctgtgtgggtgatagagcactttgaaggaaagtttgcacagggaagcgcctttttcctgaaggatgttgggctcgtaacggctgcacactgcattgaggaggcccttggacaggaaatcgacgtctaccatccctccaagcctagtaacgtgttcaaggcccgtgtcaaacagcaccatacagtccgggacctggcgattctcgatcatgaaatccccgcacacgaattcttcgagttggaaatggcgaccagagcaccctctctgggggatgctttgacggcagtgggttaccctggatatgggcctggagacagtcttaatgtgagatcaggccatattagctcgtttgccgtaaaaagcgctgtgccactaattgaagttacacagaaattgacccaaggcatgtccggcggccctgttttggatgacgaggatagagttgccggggtgatccacaaagggggccccgaagaaggtagggacttcgctgtccacattgatgctctgactgcctggcttgatggaagatga

SEQ ID NO: 7559 - RNA, 1623 nt, unidentified
  source 1..1623: mol_type = other RNA; note = synthetic construct
atgccaactccccgtagcatgtttgggggaaatctaacacgctccagagtgcctctcgaactgacctccattgatgagctgctccgacacttgtgtgtgagcgaagctgaattacagaagatatggtggtaccggtctagaatgtatagcgagttcaacatcagcaagaaggccggcaaatcaaggcttatttccgcgcccgatcggaggttgaaaatgattcagcgtgcactcgcacagctgctcgacgggatgtatcagaggcggaatgccgttcatggctttgtcgccgacagaagcgtgatgacgaatgctaggtcccacatgcgctccaaatttgtgttaaacctggacatcgagaacttcttccccacaatttctgagaatagagtggtcggggttctgaaggccctcggggtgattgaggacgtggcacgaatcgtggcgcgcctctgttgcaataacggggtgttgccccagggagcacctacctctccagtgctgtccaacatgatctgttttcggctggataaggacttacacggcgtggccaaggcatcccattgcatctacacccgatatgcggacgacattactctctcaagctaccagccgccagtggctctatttgcaggaggggtgccaccaaccggtaatttcagcacagaactgctggctcctgtcctggtggaagcattcgctcacaacggtttcaagctgaacgcccataaagcccactatggtgatcgcaactccaggcgcattgttaccggcctgaagatcaacgagggcctcaacgtagaccgccgttttattagaaatgttaggtctgctctctacagcatcgagacattgggcatcgaaactgcccaagccaaatttaaatccgagtacggaggcaagtgcggcgtcgcgaatcatttgcggggtaagatatcttggatcaagtcggtaaaaggccagagtgaccctgtattccgcggcatagcagcccggtttaataagctgtttcctgccgagcccatcaaagtacagccaactcggactgaaatgagagacagggccgtctgggtgcttgagcatactcatggagattgggcccaagggagtgcattttttctagagggagtgggtctggtgaccgccgcacattgcatccaagatgctgtcggccaggaaatcgatctgtatcacccaagtaggcctagcaacatcttcaaggttaaggttcgagcccaccacgctgtgcgagatcttgcactgctggaccactctataccctcaacagaatacttcgaactgcaactctcggcccggacgcatgctgtcggtgactatctgatagccgtcgggtaccctgggttcgctgctggagataacattaatgtaagatcaggccagatcagcagtttcagtgttaaatctaccgttccgttaattgaggtcacgcagaaacttacacagggaatgtcaggagggcccgtgctggacatcgatggtagagtcgctggggtgattcacaaaggaggacccgatgagggcagggacttcgcggtcaataccgatgccttgatggcttggcttagtgagcttgttacagccgtaggcgccccggtgtcatga

SEQ ID NO: 7560 - RNA, 1458 nt, unidentified
  source 1..1458: mol_type = other RNA; note = synthetic construct
atgtattccgacttcgagattgccaaacctagcggaaagtccagggtgatcaacgcacctgacgacaggctgaagatgttgcagcgctacatagcaaacctgctggatcagatttacaagccacggaacccagtccacgggttcgttttggatagaagtgtgcgcactaatgcatcttctcacctgcgaagcaaattcgtggtcaatttagatattgagaacttctttgggtctatcagcgagaatagagtgattggcttattgaaggctcttggcgtggatgaaggcgccgccgaaatcgttgcccggatctgctgcaacaaaggtcatctaccgcagggagcgcctagtagtcccgtcctctccaatatgatttgttttcgtctcgataaggaccttcagcagattgcaaagaaggtgtattgtatttacacacgatatgccgatgacatcacattttcttcctaccagcccttgtccagtcttttcgaggccgccgtcccacctgcgggtaatttcgattttgacatgctcgtgccagaactgaagcagtcttttctcaacaatggatttaaggtaaacgcttccaaagtgcactacgcggacagaaacagccggcggattgtgaccggcctaaaaataaatgagggactcaacgtggatcgcaggttcatccgcgacatccgcagcgcattgttcagcgtcgagaaggacggtctggttgttgctcagcaaaagtacgctgagaaatatgggggaacgtgctctatcgacctgtatctgaaaggcaagattagttggattggctcagttaaaggaagatcagacccggtgtttcggggcctggcatcaagattcaacctatccttctcattcaatagggtaaagctgctggccacccaagccgagatcagagaacgtgccgtgtgggttctggagcactgggaggggaattgtgcccaaggatccgctttctttctggaagacgtcggcctggtcactgcttggcactgtgtggccgaagctgccaacaagggggaaatcgatgtgtatcaccccaccaagcgatcaaacatatttaaagtgaaagtcgctagccattgcgcagtaagggatctcgccatccttgagcattcaatccccgataatgagttttatgaactccaggctagcactcacgtggtcgggatcggtgattcggtcaccgcaataggttacccctcgtacgggcctggcgacggaataaatgtgaggtccgggcaggtgtctgctctgcctgtgaaaagcgccgttcagttagttgaagtaacacaaaagctcagccaggggatgagtggaggccccgtccttgatgacgaagacaaagtggccggcgtgatccataagggcggcccacatgaggcacgggactttgcagtatctatcaaggcgctgattgatcttgccgctggtaaatga

SEQ ID NO: 7561 - RNA, 1467 nt, unidentified
  source 1..1467: mol_type = other RNA; note = synthetic construct
atgtacaacgatttcgaagtggccaagcccagtggtaagaagcgggtgattaatgcccctgatgaaaggcttaagatgttgcaacggtacatcgcggagctcctagatcatatttaccggccccgagatccggtgcatggctttgtcttcgacaggtcagtgagaactaacgcaagctctcatctccgctctaaatttagcctgaacctggatattgagaacttcttcggctccattagtgagaatcgtatcatagggctcctgaaagctcttggcattgaggatgacgccgcagaaatcgtagctcgaatttgttgcaacaaaggtcagctcccacagggagctccgtcctcacctgtgctgtccaacatgatctgtttccgcttggacaaggagctccagaggatagccaagaaaacgcactgcatctacacaagatatgcagacgacattacgtttagctcctatcagcccctgtctggcttattcgacggcgtgcctcctcccgctggtaacttcgacgttgaactgttgacagccgaattaaagcaaagcttcgctaataacggatttaaagtcaatgctgccaaagtccactacgcagatagaaatagccgcaggatcgtaaccggtttgaagatcaacgaagggttgaatctcgacaggcgctttatacgtgatgtacgatccgcgctttattcagtggaaaaagacggtctagctgcagcacagaagaaatttgaggacgcttatgggggcaagtgtcctattgacttttatctcaaaggaaagattgcttggatcgggtctgttaaaggcagatccgacccagtgtttcgcggactggcgagtagattcaatgcatcctttctgaagaaccgcatcaagctgcaggctactcctagtgagatacgggagagagcagtatgggtcctcgaatactgggaggacaatggggatggcgcccaaggaaccgccttcttcctgaaagacgtgggcctagttacagcatggcactgcgttgcgaaggccgagactgtcgggcttgacatcgatgtctaccatccaaccaaacggagcaacgtgttcaaggtgaaagtggttaagcactgcgccgttagggatctggccatcttagagcactctattccagataatgagttttacgagctggaaccatcaactagaaattcggtcatcggggacggagtgaccgccatcggatatccgagcttcggacccggcgatggcatcaatatacggtctggccagattagcgcacttaccatgaagagtgctgtcccatatatagaggtgacacagaagctggcccaagggatgtcaggagggcccgtcaccgatattgaccacaaggttgtgggcgtgatccataaagggggtccccaggaagccagggattttgccgtggacgtaaaggccctgatgaacctggccgtgggaaaatga

SEQ ID NO: 7562 - RNA, 1539 nt, unidentified
  source 1..1539: mol_type = other RNA; note = synthetic construct
atgacaagcgaggccgccttgttggattatctcggggtgacaagcgccgagctcaagaaaatctggtggttcagagggcgaatgtaccagacatttgaaatcgctaaggcagtaggcaagtcaagaataatctcggcccctgaccgccgtctgaaaatgcttcaaagaaatatcgccaccctcctcgacgccatttacaaaccacgccaccccgtgcacggatttgtccctgataggagcgtgttaaccaacgcgtctagtcacctccggtcaaaattcgtggtcaatctggacatcgaaggctttttttctgctatctccgagaacagggtcgctgggctgctgaaagctcttggagtgcagtctcgggctgccgacatagtagcacgcatttgttgcaatcgtgggtgtctgccacaaggcgcaccctcctcaccggttattagtaacatgatttgtttcggaatggataaggaattgcagcggtttgctaagaccgcacattgcatttacacaaggtacgccgacgatattagcttctctagctaccagccccttactgccctgttcgacggggccgtccctagttctgggaattttgatcacgacactctggcgcctagactaagagcagccttcgtgaacaatggtttcaccataaacaaggccaaggcacattatgcggacaagcatagtcggcggatcgtcactggtctgaaaattaacgagggactaaatgtcgatcgaagattcatcagggatgtgcgctcaaccctgtattccatcgattctctcggactggccgatgcacagaagaaattcgaagataagtacggcggcacctgtgatctttccagctttttaaaaggcaagatttcctggattggaagtgtgaaagggcggtccgatccagttttcagaagtcttgccggccattttaatgtcaagtttcccacccgcgccttcaagttgcaacctactagggacgaagtgcgtaagcgagctgtgtgggttatagagcacttcgagggagagtttgcacaggggtccgccttttttctaaagggcgtgggtctggtgacggcatcccattgcgttgctgaagcggcggcagcaggtgctgagatcgacgtttatcacccgacaaagccatcaaacatcttcaaagccactgtaaaacagcactgcgagatccgagacttggctatcctggaccacaatattcccgaaaacgaattttatgagctcgaggtgtcaggcgagaagttcgcagtcggtgatccactgacggccctgggctaccctaaattcgcccccggcgacggcatgaacatcaggagcgggaacatatccgccttcagcgtgaagtcttcggtccccttaatcgaggtgacacagatgctgactcaggggatgtctggtggcccagtgatagatcgccatgacaagctggctggaattattcacaaaggaggcccggaagaaggaagggactttgctgttcatgtaaaagctctgatggactggctcaccagctga

SEQ ID NO: 7563 - RNA, 1497 nt, unidentified
  source 1..1497: mol_type = other RNA; note = synthetic construct
atgtcaaaatccgagcttaagaagatctggttctatcgcgagagaatgtaccacaatttcaatgtttcaggggctaaagaaaccaagagactgatatccgcccctgaccaccgcctgaaaatgcttcagcgcaaaattgccgcatctctagatacgctgtactgtccaagaaagtctgtgcacggctttgtcaggcatcgctctgtgaaaacaaacgcagccagtcatctgagcgccaagtatctgctcaacttagatcttagcgatttcttcggatcaatttccgagaaccgagtgaatggcctcttcgtcagcttgggcatagataaagaggtcgctctcatcttggcccggttgagctgctacaaaaaccacctgcctcaaggagcgccgacttctcctgtcatttcgaacatgatttgctttaggctcgacaaggaactgttgagtattgcaaagcagaataggtgtatctatactaggtacgctgacgacatcactttcagtagctataaacctctcaccgtcctcttcgacggagttacaccaaatacaggcaagtgcgacatcaaattactgggtggccgtctgcttaccacatttcagaacaatgggttaatcatcaaccctgagaagatgtattacgccgataaatccgctaggcaaacagtgaccggcttacgggtgaacgagctcgtaaatgtcgatcggaagtacgtgcgaaacgtgcggagcgcccttcacgtggtggaaaagagcggtgtgctggaagcccagagagttctcaaggataagtacctgcgcaattcaaccatagaggctcatctgcagggaaaaattgcttggctggggcacgtaaaagggaggagtgaccccgtgttcagaaagttggccgctaaatacaacaacttgttccccaagaaggcaatcaaactagaacccaccaaggaggaggtgcgtaatagagcggtgtggatcgttgaatactcagatcatgagaattactcacagggatctgctttttttctcaaaggcgtcgggctggtgacagcctggcattgcgtgaatggtcacgaaagttatgacctgtaccatccgagtaagccctccaataagtttactgtgacggtgtctcgatcttgtaaatcccgggatcttgcactgctcaaccacaatattccattcaccgagttctatgagcttagcctaccagacagaacctttcacgtgggcgaaagcctgtatgcagccgggtatcccggctttggtccaggagacaaactgaacgttcgcttgggggccatctcttcctttcccattaagtttggtattcagatggtcgaggtcactcaaaagctaccatcgggcatgagcggtggcccgctggtagactccgctaaccgggttgccggaatcatacataagggaggggaagatgaacctagggacttcgcggttcacatcgatgtactgaaggcatgggtatccctgccctga

SEQ ID NO: 7564 - RNA, 1491 nt, unidentified
  source 1..1491: mol_type = other RNA; note = synthetic construct
atgagcccagatgagctcaacaagattcggtggtttcggggcaggatgtatcggaagttcgatattagcaaggggaaaagcaaaaagcggactattaattcccccaactatagattgaagatgttgcagaagaagatcagtattcagcttgctaagatttataagccacgtaacagtgtacacggttttgtctcccaccgatccgtcaagacgaatgcccagagccacataaaacagaagtacatcctgaacatcgacattaaagacttcttcccctctatcactgagtctcgcgtccgtgggcttcttgaggcgataggcctagacgaaaatgtgtcagctgccattacctggatctgttgtaacgacggctgcttgccccaaggcgcaccttcatcaccactgatttccaacatgatatgctttcggctcgataaaaatttacaggccttcgccaaaaggacgcgctgcatttatacaaggtacgctgatgatataacctttagtagccaccagcctctgtcactactgttcgcagagtccgtgcctagagccggacatttcccagtcatccagctgtctgaaggcctgaggaatctgtttacttccaacggatttaccctaaacgacaataaagcccattatgccgataagcattctaggagaacagtaactggaatcagggtgaacgaggtactcaatatcgaccgcaaattcattaggaatgttcgcgcggccctctacaaaatcgaaacaatcgggttgaaggacgcccagaaggagctgatgagccgattcagttccaacgcctcaattgaagactacttgcgaggcaaaattgcttggctcgggcatatcaagggggtgtccgaccctatctttagaggtctggctgctaggttcaatcgctcttttgcaaaaagtgccatcaaaatacagccgacccaagccgaaatgcgcgatagagcagtgtgggtcatagagcatttcgatggcgagatgtgtcaagggagcgcctttttccttgaaagtgtgggactggtgaccgcagctcattgcgtggaaggcagcacagagatcgaactttaccaccctagcaagccatctaacaaattttcgggtaagatcaagtctatttgttcccacagagatttagcaatcattgagcacaacatcccgagcgttgaatacttcgagctgagacggtcactgaaggacgcacagataggcgaagagttaatcgcagccggataccccggctttggacctggggataaactgaatattcgtcccggtaccgtgtcttcacgacccgtgaagtccgcggtgaactacatcgaggtgacacagaagctcgctcaaggaatgtcggggggtccactgctcgacactgataacaatgttagtggagtcatccacaaaggcggggctctggagaatcgggacttcgcggttcacatcggcgaactgtatctgtggctcggaatttga

SEQ ID NO: 7565 - RNA, 1599 nt, unidentified
  source 1..1599: mol_type = other RNA; note = synthetic construct
atgcccagcttcgcgtcctttttcgttactccagtgcgagtgagtgtacccaatgaacttacttcagaggctgagcttttgaaatttttagctctgtctaccgccgaactgaagaaaatttggtggttccgcggtcggatgtatcaaaagttcgaaatctcaaagggtgagggcaagaaacgggttattagcgccccagaccatcgcctcaaaatgctgcagacaaaaatcgcttcatctctcacgcccatctgccggccgagaaacccagtgcacggctttgtggatggcagaagcgtcaagacaaacgctacagcccacagaaggtccaagttcgtgatgaatctcgacatcgaagggttcttttctgccatcacagagggacgcgtgtcaggcctcatgtccgcattgggcattgattctcgtgtggcagagattctggctcgaatatgctgtaacgagggcgttttgccacagggtgctcctagtagccctatcatctccaacatgatatgtttcaggatggataaggagctgcaaaccatagccaaagagtctcgctgcatttacacccggtatgccgacgatatcacattctcttcctaccagcctctgactttgctttttgaaggacccactccccctgctgggaagttttccccagaactgctcaaagacagactgcggggcgcattcaggagtaacggcttcgctattaatccacagaaggtccattatgccgataaatattcacgtaggactgtcacaggccttaagatcaatgaactggtaaatgtcgaccggaaatttgtgcggaacattagggcggcactgtttgtcaccgagaaacagggagccaccagtgcccagaaaatcctgaaagacaagtacgggagagaggctgcactggcgagtcacctccgaggacgcatcagctgggtgggacacattaaggggcctagcgaccctatctttagaggactagcactcaggtacaacaagcttttcccatcggaaaaattggagatcctaccgactatctttgagattcgtgagagagccgtctgggtagttgaacattggggcgatacaaccacagagggatctgtccaggggacagcctttttcttaaagagtgtgggtttagtgaccgcatcccactgtgtagaaggcgctaccgagatagagatttaccatccaagcaaacccagcaataagttcaaggtgaccgtggcgaaaaacgacactcaccgcgacctcgctgtgctaacccacgagattcctgccactgagtactatgaatttgatatatccaagcgaacactgaaggtgggggacatcaccacggcgctcggattcccttcgttcggcgcaggggataagataaatgtcaggagcgggcctattacgtcccttcccaccaagtcagcagtgccgatgattgaagttacgcaaaagctgtcacaggggatgagcggtgggcccttgctggatgaagacggcgccgttgccggcatcaatcacaaaggaggacccggtgaggccagggactttgccgtgcatgtcaaggcactgactgattggctgtctggtgcctga

SEQ ID NO: 7566 - RNA, 1596 nt, unidentified
  source 1..1596: mol_type = other RNA; note = synthetic construct
atgaccaaccctttcgccttcctcgatatcgcctacaggattgatctgccagacgagctgaaggatgaggagcgcctgcttctccatctaggggtgagccaggcagagcttaagaaaatttggtggtaccgctctcgaatgtaccaccactttgacgtggccaaaggcaaaagaaaaaagaggattatcagtgccccagaccccaggttaaagatgctgcagagaaccattgcggcctctctgaatgtcgtttataaaccgcggcgtcctgttcatggattcgtgatcgaccggagcgtcaagtccaatgctctcagtcacttgaattccaagttcgtgttgaacctggatctcaaggacttctttccatccattacggagaaccgggtgtcagggctcctcaatgccctgggcattgacgctcgagtgtctgaaatcatcgcccgtatctgctgtgacaagagccagctccctcaaggggcgccatcatcacccgtaatttcgaatatgatttgcttcaaactggataaagagcttcaggtcattgccaaagcggccaggtgcatctatactcgatacgctgacgacatcaccttcagcagctatcaacctctgacactgctatttgaaggtgtcgcaccccccgcgggtaacatttcccccgaactcttgagcaaacagttacgcgaggcattccagaacaatggattcacaataaactctgagaaggcccactacgccgatagacactcacggcgaacagtgaccggactcaaagtcaacgaaatcctgaacgtggacaggaagtacgtcagaaatgtgcgggctgccctttataccgtcgagaaagccggcgtcgaagcagctcaaaagcgcctggaggaaaaatataacaaaagaagctccatcgctagtcacttgcgcggccgcatcgcctggatcggaaatattaaaggctggaatgaccctacttttaggagcattgcactcaggtttaacaactgttttcccaaggatcagttgaagattgaaccggatcgtgaagaaatcataaatagatctgtgtggctggtagagcattcattaggttccgtcaagaagatggctcaggggacggcgttctttctgaaaggggtgggcctggtaactgctgcacattgtgtacagaacggaaaggggatcgtggtttaccatccttccaagccatctaataagttcccggttaatgtggctaactcatgcaagtatcgggatttggctatcttatcccacagcatatctgaccaagagttctatgagctgaatgcctctgagagaagttttaaagctaaggataaccttacagcatacggctaccctggttttggccccggagacaaactgaacgtgaggccaggctacgtgaatagcctgccagttaaatcgagtatacagctgatcgaggtaagtcagaagcttgcccaggggatgtccggcggtcccatactggatgatgacggtcatgtggcaggagttatacacaaggggggacctgaagaagcacgggactttggcgtgcacatcgaggttcttatgaagtggctaaaggaattgtga

SEQ ID NO: 7567 - RNA, 1614 nt, unidentified
  source 1..1614: mol_type = other RNA; note = synthetic construct
atgactaatggctggcttggttttggcataccaacatctatacacctccctatccctccagaacttagttccaaaactgccctgctcagctacctcggggtatcccccgccgagatgaagaagatttggtaccatagggaaaagatgtatcattgctttgacgttgcaaaaaaatctggaaagccgcgcctcatcaacgctccagataggcgcttgaagtttctgcaacgcaggatcgccaatctgttggaccagttgtatagagttcgtaaccctgtgcacggatacgtccagggcaagagcgtcaagtcaaacgctacctcacatctgaagcagagattcatcctcaatctcgacatacgcgatttctttgggtcaatcagcgagaggcgggtgttcggcgtgcttcacgccatcggcgtaccacgggatgctgctgaaacggtggcccgcatttgttgttattctggacatcttcctcaaggaggtcccgctagcccagtgctgagtaacatggtttgttttagactggaccgagcactactgaagctcgcgaaagacagtaagtgcatctacactcggtatgcagacgacatttctctctcatcgcttcggccgttgactgccttattcgatggaaccttacccaccaccggccgggtcgatcctgaactgctgtccgccgcgctgcaagctgcatttacatccaatggttttgcattgaaccccgagaagatccattacgctgatcgacattccaggcgagtcgtgacaggcctgaaagtcaatgaaggcctgaatgtggataggagattcgttcgaaatatccgcgcagccctgtatgaagtggagaaagacgctgtagcagcacaggcccgctacgctgccgatttcggcggtaaggcagatatctcgagccatcttaaaggcaagatcgcctggctgggtaacgtgaagggattagccgatcccgtgtatcgggctctggcgctgagatttaataccgctttcccgaaaagggccattaaagtgcagccaacccggcacgagagactagaccgttcagtgtgggtaattgagcaccacctgaatgacatagagaagtatgcccagggctcagttttctttctggctggggttgggctggtgacagcagcccactgcgtcgctggagtgaaagacgctattgtgcaccatcctagcaggcccagtaacaaatttaaagtcagtgtggcccactactctaagcacagagacttagcgatcctgacacactccattcccgccacagatttttacgagctaagcaaaagtgccgccgcagcagttacgggcgatcctattgtggccatcggctaccctgacttctctccagcggataaggtcaactttagagagggaactgtctccagcaccaccgtcaaaagcctcattaacctcttggaggttaacttcaagttcattcaggggatgtccgggggtcccgtcatcaactctaacgacgaggtggtaggaatcgtgcacaagggggggcccaaagaaaagcgtgacttcgccattgtgatagaagagttcgactcttggaatgccgcggggctaccatccgattactga

SEQ ID NO: 7568 - RNA, 1188 nt, unidentified
  source 1..1188: mol_type = other RNA; note = synthetic construct
atgcccaacggctggcaaagattcggcattcccgcgcctgtgcacgtgccaattccgcctgaactggtcagtaaggccgccctgctcgtgcacctgtcagtgagccctgccgaactgaagaaaatttggtaccatcgggagaagatgtacgaaaattttgacgtcgccaaaaagtccgggaaacctcggcccataaatgcgcccgacaggcgtcttaagtttcttcagcgccagattgctgagctgttggacaccctctacccagtacggaaacctgtacacgggtacgtgagcggcaagagtgtaaaatccaacgctaccagtcatctaaaacagaggtttatactgaatctggacatcaaggacttcttcgggtccattactgagaggagggtgtcgggtattctgaatgctatcggcgtcccttcagacgttgcagaaacggttgcccgaatatgctgttatggcggacacctgccacaaggcggtccagcttcccccgtgctgagcaatatggtctgttttagattggaccgtgccttgctgaaattagcaaaagacgcaaaatgcatctacaccaggtacgctgatgacatctctttgtcctcactgcgaccactcgcacccctgttcgacggtgcactccctcccacaggacaggtggctcccgagttactgtctgatgctttgcaggccgttttcgcaaacaacggattcactcttaatccagataagatccactatgctgacaaacactctcgccgggttgtaaccggccttaaggtgaacgagggcctgaacgtggataggagattcgttagaaacgtgcgggccgcgctatatgctgtggaaaaggatgtcgccgccgcgcaaactagatacgccgcagatttcgggggaaaggcagatgttggtacacacctaaagggcaagatcgcctggcttgggaacgtgaagggacttgcggaccccgtgtatcgggctctcgccttacgctttaataccgcctttccgaagcagtctatcaaagtgcagccgacacgccatgagcgcctcaacagaagcgtctgggtcgatctcctgcctattaatcatgctatcgggaaactcgcccgccagatggagacaagcgatgcagcccgaccaatctataggggatcagatcattggagagcagctcgtgcctga

SEQ ID NO: 7569 - RNA, 1608 nt, unidentified
  source 1..1608: mol_type = other RNA; note = synthetic construct
atgccttccgtgtggtccatgtttggaactgcagtgcagattcctctgcccccagagttcggcgacgaaggtactctccttgcatatctggggctgtcacaggctgaactgaagaagatctggtatcacagagagaaaatgtacaagaatttcaatgtcgctaagaagagcggtaaaccacgaccaatcaattctcccgatcgccgcctcaaattcctgcagaggcagatcgccacaaaattggacatgatttatccacggaggaatcctgtacatggctatgtcaaggaacggagtgtaaaaagcaacgccgctgcacatcaaaaccagcgcttcgttctgaacctggatatcaaggacttttttcttacgatcaccgaggggcgcattgtgggggtgctgacagccataggggttcccgatagagtatcagcgatcattgcccgtatatgctgctatggcgggcgattaccacagggagggccagcatctcctgtgttgagcaatatgatctgttttcggctggatcgagccctcttgaaagtcgctaaggagggccggtgcatttacacccgctacgctgatgatatcagcctgtcaggattgaggccactatcacccttatttgaaaacggcctacccccctctggaccgatcagtcccgagctgctgagttcggcactacaaagcgcttttgccaacaatgggtttgttctcaaccctgagaaaattcactacgcagacaagtttagtaggcgggtggtgaccggagtgaaggtgaacgaagggcttaacgtcgataggagattcgtgcgaaatattcgggccgccctcttcgaggtggagaaggaccaccttgccgcgcaggcaagatacctttccaaatttggcggatcgaccaccatctccgctcacctcaaaggcaagatcgcatggctgggttttattaaaggctccgctgatcctgtgtaccggtcactggccctgagatttaacaagagcttccaatctcaggccattacagttcaggcgactagggaggagcagatcgacaggtccgtctgggttatcgagcacggctctgtgttagatgacacctaccgtcaagggtctgtatttttcctggacggtgtgggactggtcactgccgctcattgtgttgccggggtgaaagaagcaacagtccaccatcctagcagaccttccaataagttcaaggtgcaggtattgcattatagcaaacaccgcgatctggcgatcttgtctcacgccataccacctaccgacttcttccaatttgccaagtcccttataccggctgccgcaggtgacgccgttacagctttcggatacccggacttcaatcctgcggataaaatcaatatacgttctggcactgtctccagcacaacggtcaagagcctgattccgcttgttgaagtgaacttcaagctctcacagggaatgagtggcggtcccctcatcaacagttcagacgctgtggtcggcatcattcataagggaggccccgagatgcccagagacttcgccattgtgatttccgaactcgacaaatggatagccgcaggctgtccagacgatttctga

SEQ ID NO: 7570 - RNA, 1587 nt, unidentified
  source 1..1587: mol_type = other RNA; note = synthetic construct
atgccatcacccgcaatgatgtttggaccgccacctagagttaccatcccaccagccttggaaacggaggccgccctcctagctcacctagggttatcaagtgcggaattgaagcgaatctggtggttcaggcatcgtatgtatagggactttaacatagccaaaggcgccggcaagctgcgtatcattacagctccccaagaccgcctgaaacatcttcagaggcgaatcgctgacctgttgacccctatgtacagggtgcggcaccccgtacacggatttgtggcagataagagtgtgaagactaacgcccgaagtcatgtgaagtctaaattcgtcctcaacctcgacatacgcgacttctttggggccattactgagaatcgcgttgagggcctgttccggtcgttaggcattgacagaagagtggcagagatcttggcccggctttgttgcaatcaaaaccggcttccgcagggagccccttctagtcctgtaatttccaacatggtctgcttccgcctggacaaagaactgctggcggtcgccaaagctacccgctgtatctacactcggtatgccgacgatatatctttctcctcctacaggcctctctcgggactgtttgaagcagcccttccccccacagggaatgtctcccctgatctcctgagcactgacttgagaagcgccttcgagacaaacggattcgctatcaacccagagaaagcgcattatgccgatcggcactcaaggagaattattaccggggtgcggatcaacgagggcttgaatctcgataggcggtttatacgaaatctgaggtccggcctgtatagcatcgaaaaactgggcgagacagctgccgaagcaaaatatcatgcaaaacacggaggtacagcctcccttgagagccacctccgcggcaagctgtcttggttaagcgacatcaaaggggcatctgacccggttttccgcaatctggctaaaagatttaacctactgttccccaaggctcccatcggtattgagccaaccccagcggaggttagagatagagctgtctgggtcattgaacactcaggccctaagggccgtcagggtacagccttttttcttaaggattacggcctggtgactgcggcacattgcgtgtccgaagcctctgagcccataattgtctaccatccatctcgattatcaaataagattcctgtcaccgtagccaagacgtgtccccaccgtgacctggccattatcgcacatgctgtcccgcctaacgaatactatgaactcgaggttactgagaagcctccagctgtggaggaccacgtgacctccgtgggctacccccagttcggattcggtgacagactgaatgtgcggaaggggacggtgagtagcctcccagtgaagcacgctgtgcagcagatagatgtaggtattcgcattaccgaagggatgagcggcggtcccctccttgcagaggatgggaaggttatcggaatcaatcacaaaggagggatcgatgaagatagggatctggctatccacatccaacagctggtgaagtttgcaagcgagtga

SEQ ID NO: 7571 - RNA, 1305 nt, unidentified
  source 1..1305: mol_type = other RNA; note = synthetic construct
atgcacattgtgatcgcccggattatctgcctcacttggcgggactggaagggcgatccagtacctcgctctgcctctattttcggccgcgcgattagggtgaaactgcctccagagctgctgacagaagtcaatctactgactcacctgggaatgtcccgcggagaactcaatgtcataaattggtacgcgagacggatgtatcactcctttgacatcaagaagaaaagcggcaagcctagggttatcaacgctccagagcgcagattaaaactcttacagaggaaaatagccgatcttcttatgcccctgtatcggcgtcggaaccccgttcacgggttcgtggcagacaggtcagtgaagaccaacgcccagtcacacctgaacagtaagtttgtggtcaatctggatctcaaggatttcttcccctctatctcccaaaagagaattgtaggagtgctgcgatccctgggtatcgacaggggtgtggccgatgccatttcgacaatctgctgcctcaatggatgtctcccacaaggcgcaccaagctcccctgtccttagcaatatgatatgctttaggctcgacaaggagcttttggaattcgccaaacaggcgaagtgtatttacacccgctacgcagacgacctgagtttcagtagctaccagcccttgggatcactgttccagacgagcccaccttcccccggccattttagccctgacctactgggcgagaaattgcgccacatctttactgccaacggtttcatcttgaatccggacaaagctcattatgcagatcgacatagcagaagaacagtgaccggaattcgaatcaacgagctactgaatgtggaccgtcgatttgttcggaacttgagggccgctctgtacagtgttgaagcacagggcatcgccacagcagaagctaagttccacgcctcatacaacgggaaatctgatatagggaaacatctgcaggggaagattgcttggcttgggtatatcaaaggtgcttccgatcccgtgttcagaggcattgcgtctcggtttaacaaggccttcccctcgctcaagttggagattcagccgaccccacaagaaatccgcgagagagcagtgtggctcatcgaacattgggagagaaccggcgatcagggaaccgctttttttctggagggcgtggggcttgtaactgctgagcattgtgtcagccccagtgggatagtcgaactgtatcacccgtccaaaccttctacgcggaagtcacataggcgtgtcgtgcacagggttcgattatga

SEQ ID NO: 7572 - RNA, 1542 nt, unidentified
  source 1..1542: mol_type = other RNA; note = synthetic construct
atgaagctgcccccggagctgatgagtgaagcgtccctgctggcacacctaggcgtcggtagggcagagctgaatgtgatctcgtggtacgctggccggatgtaccataagtttgacatcaagaagaaaagcgggaaagctagggttatcaacgcccccgaccgccggcttaaaatgctgcagcgaaaaatcgccgacctgctgactcctctatatcgcagacggaacccagtgcatggttttgtgatcggtcgatcagtgaagactaacgcacagtcacacctggggtctaagttcattgttaatctcgatctcaaggattttttcccctcaatctcttacggccgcgtcaccggcgtccttaggtcgttagggatgaaaagagaagtcgctgaagccattgcgacaatatgttgcctgaacggaaccttgccccaaggggcaccatcctcccctattctgagcaatatggtgtgtttccgcctcgaccggaggctgagagaactcgccaaagatgctaggtgtatttatacccggtacgccgatgacttgtccttttctagttaccagcccttgatgggactattcgagactacacctcctgcctccggacacttcagcccagacctcctctcagagaagttgaagcagattttttctggcaatgggtttgtgctcaacccagacaaagcccattatgccgataagcacagcagaaggaccgtgacaggcattcgtataaacgaggcactaaatgtggaccgccgtttcgtcaggaacctcagagcagccttgtacagcgtcgaaacgctggggttagctgcggctcaagctaagttcaaatccctgcatggaggtaaagccgacgtgggccaacatcttcagggtaaagtgtcttggctgggatatatcaaaggggctagtgacccagtgttccgctctgtggcctcccggttcaatgcagcttttcccccattagcgcttgatatcctgccaagtccacaggaaatccgggagcgtagcgtttggctgatagaacactgggagacaggaggcgatcagggcaccgcatttttcatgaagggagtgggactcgtgaccgctgagcactgcatttcccccagcggcattgtagagttgtaccaccccactaagccatctaataagttcgccgcatcagtcaagcaccgatgccctgatagagacttggctgttttagatcatgcaattccgaacaacgagttttacgaacttgagacagccggcaaagccgccgccacaggagatgctactaccgcgatcgggtatcctgggtatggacccggggacagactgaatatccgacctggcgccgtaaccagccttcccacgaaatcagccgttaagatggtcgaggttcaacagatgctcactcctggcatgagtggcggccctctccttgacgtggacgatagggtcgtaggtgtagtgcataagggtgggcacgatcacggaagacagctggccatagcaatcagcgaactgcatgcttggctgccgtga

SEQ ID NO: 7573 - RNA, 1581 nt, unidentified
  source 1..1581: mol_type = other RNA; note = synthetic construct
atgcctagaccagcgcgtgcatttggcccaccgatacgcgtgaagctgccagtggaagttgcttccgagggtgcgatcctcgcccatttagcagtgagccctgccgaagccaagaaaattcgatactaccgagccaggatgtaccgcaccttcagcatccaaaagaagtccggaaaggctcgcatcataactgctccagacagacggctgaaaatgctccagaggcggatctgtgatctgctcactcctgtataccgcagacggaatcccgtacatggcttcgtggccgatagatcggtcaggaccaatgcggaggcacacctgggcagcaagtatgtagtgaatattgatctgaaggatttctttccaagtatctccgaaaggcgagtaacaggtgttctgatgagcctcggcatcgggcgagatgtagcagagatcctctcctctatatgctgtgttaatggatgtcttccccagggcgccccctcttcacctctgctttctaacatgatttgcttcaggcttgataaggagctgatggccttcgccaaacggacaaggtgcatctacacccggtatgccgatgacatcacattttcttcataccagcccttggctggactcttcgaggcagtgcccccttcaccaggccgattcgccccagacttgctctccgccgaggtagctgccatttttgctgccaacggctttgtcattaaccccgagaaagctcactatgcagaccgtcactcgaggcggactgtcacaggattaagagttaatgaggctatcaacgttgaccgtagatttgtccggaatttgcgcgccgcactcttctctgtggagaaactcggcgcagctgccgcgcaagctaagtttcacgctactcacgggggtagagtcgcactaggcaatcatttgcagggaaaactgtcttggctgggatacgtcaaggggcagtcagatccggtctttcggtccatggccagccgtttcaataggagtttcccagatagggcactgaccatccagccgactcgcgacgaaattcgcgacagagctgtgtggttggttgaacattgggagaacggcggcgaccaaggcacggcattctttctgcggggggtgggacttgttaccgccagtcattgcgtctcccctagtggcgctgtcgaggtgtatcacccctctaaacctagcaacaaatttaccgccaacgtgaagcatagatgtgaacaccgcgacctggcagtgcttgaccatgctattgccgcgacagaattcttcgagctagaagcagccgccacagctgtggtgacaggggatgcgaccgtggccgttgggtatcccggttttgggcctggtgacaaactgaacgtgcgcacggggaacgtgacttcacttccaatcaagagtggagtccaaatggtggaagtgcagcagatgctgacccagggtatgagcggaggtcccctaacggaccccgacgatggagtcattgggataattcacaagggggggcctgaacacggcaggcagttaagcgtggctatagaggtgctgagagattggctggcctga

SEQ ID NO: 7574 - RNA, 1503 nt, unidentified
  source 1..1503: mol_type = other RNA; note = synthetic construct
atgaagcacctcgggctgggagcagcggaagcgaaaaagattcgatactatcgtagcaagatgtaccggaccttcgacatccggaaaaagagcggtaaagccagggttatcaatgcccccgacagacggctgaaaattctccagcgcaaaatttgcgacctgatcactccattatatcgccgcagaaatcccgtccatgggttcgtagctgatcggtcagtcaaaactaacgcgcaatcacacctgggggggaagtttatcgtgaaccttgacttgaaggacttctttccttcaataagtgagcggcgcatagtcggcgtgcttatggcactcggcctgaagcgagacgtcgccgaaagactctcctccatctgctgtgtagacaatggacttccacagggagcgccgagcagccctatcctttcaaacatgatctgctttaggatggataagcagttgatggccttcgctaagtcggctaggtgtatttataccaggtacgccgatgatattactttcagctcttaccgtcccctaactggcctgttcgaatccgtgccaccacctagcggatcctttccacctgaactgctgagttcggagttgctagggatctttgggtctaatgggtttaccatccatcctgacaaggcccactacgcagatcgcaatagtaggcgtacagtgaccggcctgagggtcaacgagaacctaaatgtggatagaagattcgtgcggaacctgcgagctgctctctattccgtggagaagctgggcgagaagccggcagagacaaagttccatgctgaccacggaggacgggcaccaataggccgccatctgcagggaaaactcgcctggcttgggcatatcaaagggccagccgacccagtgtttcggtccatcgcctctcgattcaatgctgcttttcccagtctggccctcaagatcttacccacccagctcgaaattcgagaaagaacagtttggctgatcgagcattgggagggaactggcgcccaaggcacagccttcttcctgacaggggtcggcttggtgactgctgatcactgtgtttccccttccggcgcagtggagatgtaccaccctagcaaaccctccaacagatttgcagctatggcaaaacaccgcagctctgatagggacctcgctgtattggaccacgccattccgcccaacgagttctatgagctggatgcgtcaaacgttgggtctgtgaccggtgatgccacggtggccataggctaccccggctttggtcccggcgacaaagttaatgtgaggagtggtaatgtgacctctttacctaccaagtctggtattcaaaagattgaagtgcaacagacgctgacaccaggtatgtcaggcggccctcttttgaacagcattggacaggttattggagtcatccacaagggtggagcagaggaagaaagacagttagccatagatatcagtgtactgcagaaatgggtcccctga

SEQ ID NO: 7575 - RNA, 1581 nt, unidentified
  source 1..1581: mol_type = other RNA; note = synthetic construct
atgccctctgcattttacctgttcggcggcaccagtcggaccatcatccctgccgaactgtccacaaagagcgagcttctgaaacatctgggagtttcacctgccgagctgaaaaagatctggtggttccgcgggaggatgtattcccacttcaatatttctaagcgctctggtaaagtgagattgatctccgcacctgactacagactgaaaatgttacagcaaaagattgctaggtctttatctggcttgtataatcctaggaaccctgtccatgggttcgtcccagacaggagcgtgaggtcaaacgccgaggctcatctcagacggcgattcatcctcaatgtggacataaagaactttttccccgccattaccgaggctcgcgtccaaggcttacttgaaagcatcggagttgatactgatgttgccgagacgataacaagaatctgtacaaacaatggttgtctgccacagggagccccctctagccctgtcatctccaatatgatatgtttccgactcgataaatcactcatgaatttctccaaggaacacaggttgctctacacacgttatgctgacgacattacattgtcctcatttcagcccccaaccgcactgtttgaaggcgataggcccgacagcggtagactgccaccagagaagctgtctggtgagctcttgagcatactgggaaacaacggctttgagctgaacccagaaaagattcactatgctgataagaatagccggaggatggtgaccggcatcaaaattaatgagggcctgaacgtagatcgacggtacgtgcggaagattcgcagtgccctgtttaaggttgagtcggcttcagtggcagccgcagaagctgaactgaagaccagattcggaaaatcatgcaagatacaggcccaccttcaggggaaaatttcctgggtggggttcgtgaaaggacaatccgatcctgttttccgggggttagcagaacgttacaatgcctgcttcccagccagtccgatcaaggtacatcctactcaggcggagcttctcgacagatcagtgtgggttctcgagacagagaaaaacaccgggactgcctttttcctgcggggtgtagggcttgtgaccgctgcccattgcgtgaacggcgcgagttcgatcgaggtcttccacccagggaaaccggctaacacttttatggtgggggtgcagcatatctgcacacaccgtgatctggccctacttagccacagcattccctccactgactactttgaactggaagagtttggcggctttcccgccacgggggcaaatacgattgcagcgggattcccgagctatggacccggcgatcgactcaacatccgcccaggaactatctcttccctaaccattaagcatgccgtgaatctcattgaggtcacccagaagctaagccagggaatgagtggcggtcccttgatgacccaagaccacgctgtcatgggggtgatccacaaaggcggtcccgacgaacctcgcgactttgcagtaacactgagtgaaatgaagagttggatagcgactctgccgtga

SEQ ID NO: 7576 - RNA, 1644 nt, unidentified
  source 1..1644: mol_type = other RNA; note = synthetic construct
atgtgcacctggggcgactggcgaggaaatcttgtgccctctccgttcaacctattcgggggggcctcacggacaaagattccgccagaactgacttctaaagacgaactgctcaaacatctcggcgtgtcacctgctgaactgaagaaaatttggtggttcagaggtagaatgtactcccacttcaatattagtaaacgctctgggaagacgcgtctgataagcgcacccgactaccggctgaagatgctgcagcaaaagatcgccagaagtttggccaaactatataacccaaggaagcccgttcacggcttcgtgccagaccggagcgttcgctccaatgcggagtctcatctcaggcgtagattcatcctcaacgttgacttaaagaacttctttcccaccatcacagagcccagggtgcagggactgctggagtcaatcggcataaacaaagacgtcgctgaaacagtcgccagaatctgtgctaataacgactgcttacctcagggagccccaagtagcccagtaatcagtaacatgatctgttttagactggacaaagctctcatgaagttttccaaagaacatcggcttctgtatacccgatacgccgatgacattaccctgagcagtttccagcctcctaccgccctgttcgaaggcgatagacccgaccctggcaaggtggcggaggagaagctgagcgacgagcttagatccattattcgcaataatgggtttgagctgaaccctgaaaaaatccactatgcagataaaaactcgcgacggatcgtgacggggataaagataaatgaggggatgaacgtcgataggcgctatgtacgcaatgttaggactgccctttttaaagtagaaaagcacggccctgcagctgctcaagccgagttagaggctcgctttggtaagacatgtaagatccaggcgcacttacaagggaaaatttcatgggtggggttcgtgaagggtcaatccgatccagtgttccggggactggctaagcggtataatgcttgctttccggcctgcccgattaaagtgcatcctacccaggccgagattgtcgatcgagctatatgggtcgtcgaaactgaggatgatactgggacagccttttttctgaagggagtggggttggtgacagctgcgcattgtgtaaactcagcgagcgaaattgaggtgttccaccccttgaagactgcaaacaggtttaaggttactatcaaacacatctgcgcacacagggatctggccatcttggagcacagcatttcctccaccgagtactttgaactagagtctttcactggaagcccagtcgtgggcaccaatacccttgccgccggatttccaacgtacggccctggtgaccagctcaacatacgtcagggctctatctcgtcacttaccacaaaatccgccgttcccctgattgaagtgtctcagatgctcggtcagggaatgagcggaggccccctgatgaataagaataacgaaattctcggaatcatccataagggtggcccagtggcatacgttgccaaagatggctccgtctctccccagaggcagctcgcagtggcaatcagcgagttgaaggcatgggtcagtgcattgccttga

SEQ ID NO: 7577 - RNA, 1104 nt, unidentified
  source 1..1104: mol_type = other RNA; note = synthetic construct
atgatctgtttccggctcgacaaaacactaatcaatttttccaaggaacaccgcctgctgtacaccagatacgcagatgatattactctcagcagctttcaacctccaacagcgcttttcgaaggggacaggccagatcccgggcgtctagcattagaaaaattgagcgacgacctgagaatgattttcaagaataacgggttcgagttgaacccagagaaggtgcactatgctgataagaactccagacgcatggtcaccggtattaagatcaatgagggtctgaatgtcgaccggcgctatgttcgaaacgtccggagtgcgctctttcgagtagagactacaggcctggccgccgcacaagctgaactcaaaaccaggttcggtaagtcctgtaaagttcaagctcatttgcagggaaaaatctcttggattggctttgtgaaagggcagagtgaccccgtcttccgcggcttggctaaaaggtataatgcctcatttcccgctagcccaataaaagttcatcctacaaaggacgagatctttgacagagcggtctgggtggtggagactgacgacgacaccggaacggctttcttccttgatggcgtgggccttgtaactgcagcccactgcgtgaacggggcatctgagattgaagtgtttcatcccctgcggacctccaataagttcaaggtcaccataaagcatatatgcgcccacagggatctggccatcctggaacacctgatcccttcgacagagttcttcggcctcgaagcctttgagggtagtgtgacggtagggaccaacaccctggccgcagggtttccgacgtacggacctggcgatagacttaacgtgcgtcagggttcaataagctcactgacaacaaagtctgcagtgccattgattgaagtcagtcagatgctgggccagggaatgtctggaggccctctcatggatgaggatcacgccgtttttggaatcattcataaaggcggacccgtggcttacgtaactaaggatggatcagtgagcccgcagaggcagttagccgtggccatctccgagctgaaggcctgggttgctactttcccctga

SEQ ID NO: 7578 - RNA, 1602 nt, unidentified
  source 1..1602: mol_type = other RNA; note = synthetic construct
atgttctacctgtttggtggaaccagcagagccaagattcctggagagttgagctcccgctccgaactccttaaatacctgggcgtgagcccagaggagctgaagaagatctggtggttcagagggcggatgtactctcacttcgacatcagtaaaaggtcagggaagtcccgcacaattagcgctcctgactacaggctcaaaatgctgcagcaaaagttggctcgttcattaagcggcctgtacagcccccgtaatcctgtccacggttttgttcccgacagatcagtgcggacaaatgcagaaactcatctgaggaggcggtttatactgaacatcgacattcagaatttcttcccgtctattacagaggctagagtgcaaggactgctgacctctataggcgtcgacactaatgtggcggaaatagtcgccaggatttgctctaacaatggctgtttacctcagggtgcaccatcatcccccgtgctctcgaacatgatctgctttcgactggacaagagcctgatgcggttcagcaaggagcacaggcttctgtacactcgatacgctgacgatatcacgctttcttccttccaaccccccaccagcctctttgagggagagcgaccagcgcctggtcgcctttctcctgaaaaattgcacgctgagctgcggatgatctttcagaataacggcttcgagttaaacccagaaaaaatccattttgctgatcgcaattcccgcagaatcgtgactggcataaaagtgaacgaaggtctgaacgtggacagaagatatgtacggaacgtgagatcagctctgtttaaggtggaacgcagtgggctcgcagctgcccagacagagctgaagtcccggtttggaaaatcgtgtaagattcagagtcacctgcagggcaagatttcatgggtggggtttgtaaaaggccagtctgatccagtgttccgagggatggccaaacgttataatgcctgtttcccggccaaccctataaaggtgcatccaaccagagcagaaatcgtcgaccgcgctatctgggtcgtcgaaacagaattcgacaacggcactgccttctttctcgatggagttggtctagttaccgccgcacattgcgtcgatggagccagtaaaattgatatctttcaccctctacgcactagcaataggttcaaggtaaccattaagaacatttgcacacacagggatctcgcaatcctggaacacagcgtggccagtacggagtatttcgagctaggatctttcactgggtcccccaccatcggcgcaaatacacgggccgccggttttcccacatatgggccgggcgatcagcttaacgtgcgacaggggtccatttcttctttgacgaccaagtcagctgtacctttgatcgaggtcagtcaaatgttggggcaaggaatgagcgggggccccttaatgaccgaggatgatagtgtgctcggcattatacataaaggaggaccagttgcctatgtggcaaaagacggctccgttagtccccagaggcagctggcggttgcgatctccgagctttcagcctgggtcgccaccctcccatga

SEQ ID NO: 7579 - RNA, 1641 nt, unidentified
  source 1..1641: mol_type = other RNA; note = synthetic construct
atgccagaggacgtcaggcagtcctggagggattggaaggagggccttgttagttaccgcggggccctgttcggcaagcctatacgtataacaatccctgccgagctggctgatgaggcagccctcctggcatatttaggtttgggcgcagcagaacttaagaaaatatggcactttcgcggtcggatgtaccagcattttagtatcgccaaggggcccaacaaagtgagattaattagcgcgccagatcagcgtctgaaattcctacaacgccgactggcagataaattcaccgaactctacagaccaaggcacccggtacatggatttgtggtggggagaagtgtgaagaccaacgcccttgcccatctccatcggcggttcgtggtgaatatcgatctcaaagactttttccctacaatcgcccagaacagagtcgagggcatgctgttttcccttggcatcgacgccagggtggccgagattattgctcggatctgctgtaatcggggacacctccctcaaggggcacctagcagccccgtcctctctaatatgatttgcttcagactggataagcagctgttggacgtggctaaggaaactaggtgtatttatacacggtatgcagacgatataacattttcgggtcaccgtccccctactgcactgtttgacgccgccttgccacccgccggaagattttcaccggacctgctggcaccaaaactccttgacatcttccagcagaacgggttctctattaatcccgacaaagctcattacgcggataggcactcgcgccggactgtaacggggctgaaagtgaatcagttgctcaacgtagaccgacgctatgtccgaaatatcagggctgcacttcattccattgctactctaggcttgaaggaggccgagaaaaaattccacgagaagcacggcggaaactcagggctggctgcccacctgaggggaaaaatcagcttcttaagccacataaagggccagtctgattccgtggttcggtcccttacgctacggtttaacaagtgctttcccgcccagcctattaaggtgatgccgacctcaacagaaattcgagacagagcggtgtgggtcgttgagcacaacctggacagggaccatggaaaacaagggactgcgttcttcctgaaaggcgttggactggtgaccgcagcgcactgtgtagagggcgtgtctgagatcgaagtttttcacccctctaagcatgccaacgccttcaaggcaactgttagaaagcgagacgaacatcgcgacttagccatcctagatcattccattccagctaccgagtacttcgagttggaccccgtgtcacatgccatcgtgaccggtgatagtatgacagctgtggggtatcccgcttgggctcctggagatccactgaatatcagacccggcttcgtcagcacactcaccgttcgctctgctgtgcagtacatcgaagtaacgcaaaagctgaccccaggcatgagcggcggaccattgctggatgctaatgacgccgtcgccgggatcattcacaagggaggccctgaagaaggtcgcgattttgctgtccacattgaggtcctggaagcgtggctcaaggaaggttga

SEQ ID NO: 7580 - RNA, 1584 nt, unidentified
  source 1..1584: mol_type = other RNA; note = synthetic construct
atgacatactggggggcacttttcgggaaacctattcggattaccattcctcccgagtttgccaatgaagccgccctgttagcctacctcgggctcggtcccaatgagctcaagaaaatatggtattttcgggcgagaatgtatagacacttctccatagccaaggcgcaaaataaagtccgactgatatccgctccagatgagcgcctgaagttcctccagcataaaatcgccgagaagctgaccgatctttataggccacggaaacaggtgcacggcttcgtggccgggaagtccgtgaagaccaacgctctggcacatctaggacggcgattcgtagtcaatatcgatctcaaagactttttccctaccatcacccaaaaaagagtcgctggtttgctcctgagccttggtcttgacaaccaggtcacaactctgattgcccatatctgctgtaatgacggcaatttaccccaaggcgctcccagtagcccagtcatctcaaatatgatctgcttcaggttggacaaaaagctcctggggatcgccaaggaggctcgctgtgtctacactagatacgctgacgacattactttttcatcacaccagcccccgacagccctgttcgaggttgccctccctcccgcagggaggttttctcccgatctgtttacccccaaactgctggaggtgttccagcagaatggagtggccatcaaccctaacaaaacgcattacgcagacaggaactctcgtcggatcgtcactgggctcaagatcaacgaacttgtaaacgttgacaggcggtttgtgcgcaatattagagctgctttgcacgctgttgaggcacagggaattgtcgaagcacagaagacattccaggagaaatatggcggcagctccttggtagcacacctccaaggcaagatcagctttctgagtcacatacgagggcagtcggatccagtggttcgctcggttactctgaggttcaataagtgttttccgaaacatctgatcaaggtgacacccaccccatctgaaatccgcgataggtctgcctgggtgatagaagataagaacggcgacgtcgtgcagggtaccgcattcttcctgaaggatattggcttagtgaccgctgcccattgtgtggaacctaacacagaatttcagatctatcacccaagcaagcctgccaacaaatttgccgtcagagtaaagaaaaagtgcacacaccgcgaccttgctctgctggagcatgaaattcccgccactgagttttttgaactggcgcgtagtttgaacgcagcgagccagggcgaccagttgacagccgtggggtacccatgcttcggacctggagacggtgttaataccagactgggtactgtatccagcttaccagtgaagcgtgatgtgaaactaattgaggtgacccagacgctaacgcaaggcatgtccggcggacctctgcttgatgcgaacaacggagtggttggagtgatccacaagggcggaccggaggaaggacgaaatttcgcaattgctatagaagtgttgtcagagtggattgagtctagttga

SEQ ID NO: 7581 - RNA, 1578 nt, unidentified
  source 1..1578: mol_type = other RNA; note = synthetic construct
atgccccgatggggggctctgtttggtcagccagcaagggtcgccattccagcagaactggcggacgaggcagccttactggcttaccttggtctgggggcgggcgagctgaaaaagatttggtattacagaggacgcatgtatcagcattttagtattgctaagggaccaaataaggttaggacgatcagtgcccctgacgggcgcctcaagtttctgcaaagaaagctcgccgacaaactaacagaactgtatcggccacgcaatcccgtgcacggcttcgtggccgagagatccgtcaagacgaatgccctggcccacatgcacagacgtttcgtagttaatatcgaccttaaagactttttcccgacaatttctcagaacagaatagaaggcatgctcgcctcactgggcatcgatgctagagttgctgagatattagcccgaatctgctgtaacaatggccacctccctcaaggggcaccctcatcccctgtgctcagcaacatgatctgtttccgtttggataaaaaattgatgggcattgctaaggaggcaaggtgcatttacactagatacgcagatgacattaccttgtcctctcatcagccccccaccgccctatttgaggccaccatcccacaggctgggcggttctcacctgacctccttgcgcccgaactgcggaacgcagttcaccagaatggtttcgccatcaatcccaataaggcccattatgcagaccgccactcccgcaggacagtaactggccttaagataaacgaactcctgaacgtggatcggaggtacgtacgcaacatacgagctgcactgcactccattgaaacattgggaatcaaagacgccgaaaagaagtttcacgaaaaacatagcggtagggcatcgcttgctgctcacctgcatggaaagatctccttcttgacgcatattaaaggccactctgacccagtcgtgcgatcggtcactctgcggttcaataagtgcttccctacccggaccatcatggtggcccctaccccgtctgagatgcgagatcgtgccgtttgggtggtggaacatagcgagaatcacgggactgctttttttctgaagggggtgggtctagtgacagctgctcactgtgtcgagggcgtggatgaagtggagattttccacccctctaaacatgccaacaaatttaaggccaccgtgaggaagagtgacgaacatcgggatctggcaatcttggatcaccaaattcctgccactgagtatttcgagctggattcaatcagcagaaccatcgccattagtgatcctatgactgcgcttggatacccaagctggggcccaggagataggctcaacatcaggcccggcgtagttagcacagtcacagtgaagagcgcagtccagttaatcgaggtgacccagaaactcactcaaggaatgtctggaggaccgctactggacgggaacggtgctgtggcgggcataatacataaagggggacctaacgaggggcgggactttgccgtccatatcgagatgctgcaggattggttacgcgagggctga

SEQ ID NO: 7582 - RNA, 1281 nt, unidentified
  source 1..1281: mol_type = other RNA; note = synthetic construct
atgggcgccatctttgggcagccgattaggatcatcgtgcctgctgaactcgccaatgaggccgcattgttggcctacctgggggttagcgcggatgaactgagaaagatttggtactacagaaagcgtatgtataggcacttctctatatcgaaaaaacctaacaagaaccgactcatttcagcacccaacgacagattgaagtttctgcaacgggcactggcagtgaagctgaatgagctgtatagccggaggaatcccgtgcatgggtttgtcccagacagatcaatccgaactaatgctcttgcccatctacggcgcaggttcatcgtgaacctcgatctgaaagacttctttccaacaattggtcagaagcgcatcgagggcgtgctggtgagtctcaatattgatgctagagtcgccgaaattatatcttgtatttgctgcgttaacggacacctgccacagggtgcgcccacttcacccgtgctaagcaacatgatctgtttcagactagacaagaagctgatggacttcgcgaaagaggcgaggtgcatctataccagatacgccgacgacattacgttctcctctcatcagcccccgaccgctctcttcgagacgaccatcccggcagctggaagagtagcccccgatcgcttagcccctcgattacgggatttgttccagcagaatggatttgttatcaaccccactaaggtccattacgctgacagccacagtaggcgcatcgtcacaggcataaaggtgaacgaaatgcttaacgtggataggcgctttgtccgtaatatccgagccgcactgcactccattgagacattaggaattgaggccgctgaggaaaaatttcacgataagcacggcggccggagcaatcttgtcgctcatctcaggggtaaaatctccttcctgaattatatcaaggggcaaagtgaccctgtggtgcggtccatagcactccgtttcaactcccgctttcctgcaattccaattaagaccgcacctaccccatctgaaatacgggaccgcgccatctggatagtggagcagtcaaaaagccaaggaactgcgttctttctgaatggtgtagggctggttacagccgcccactgtgttgaggggtttgccgaagtggatgtcttccatccaagtaaactcgctaacaagtttaaagccagggtaggcaaattggatcgacaccgggatcttgctattctggaccacggcatccctgctaccgaatacttcgagcttcagtga

SEQ ID NO: 7583 - RNA, 1281 nt, unidentified
  source 1..1281: mol_type = other RNA; note = synthetic construct
atgtttggaaagacagttcacattagcatccctccagaactggcggacgaagcaagtcttttaacctacctgggactgggcgccgacgagctgaaaaagataaggtattatagggcgtcaatgtatcataatttccccatcgggacggatggcagaaagcggagaattatcaacgctcctgacgcccgactgaaattccttcagaggcgcattagtgataagctagccgatatttataggagaaggaacccagtacacggatttgtggccgagcgctctgtcaagaccaacgcgctggcccatatgcggagaaagtacgttgtcaacatagacctcgctaattttttcccaaccatctctcagaaccgggtggagggtatgctcctctcgctgaaccttgatgccagcgtagctcagatcattggtatcatttgctgcaacaaaggcatactcccacagggcgccccctcttcacccttactgtcgaatatgatctgctttaagttagacaagggcctgatgaacttcagcaaagaagctaggtgtatctacactcgctacgctgatgacctcaccttctccagttttcaccctccagcagccctattcgaaacagcccctcctccggcaggtcgcttgagctctgagcagctggcaagccagcttcgaaggctcattatccaaaatgggttcagcattaatgagcgtaagctgcactacgcagaccgcgactcccggagattggtgactggtttgaaaatcaatcagatcctgaacgtcgatagacgatatgttcgcaacatccgcgcagcacttttctcagtggagcggaatgggatcaaaggggccgagaagacataccataaagagcatggagggagagggtccctagctgagcatctgcgtggcaagatttctttcttgtctcatatcaaaggccaacacgaccccgtggtgcggggattggctattcggtttaatcaatgtttccctcactggcccataaccgtgactccgaccaaaaacgaggtgcgtgatagagccgtgtgggtcgtcgaaaatgaaacttcctcacagggcacggctttctttctccgaggagttgggctggttacagccgcacactgtgtggaaggcgtaaacgaagtcgacattttccacccatccaaaccctccaataaatttaaggcgaagatctttaagagggagccccacctggatttggccgtgctcagtcatgctatacccgagaatgaatactttgagctgagcaagtcctga

SEQ ID NO: 7584 - RNA, 1584 nt, unidentified
  source 1..1584: mol_type = other RNA; note = synthetic construct
atgcctttgttcggcgcctttttcggggctcctgtcagagtgacaatccccgaagccttggccgacgaaacaagcctgctgacttacctcaatttgtccgggcccgagcttaagaaaatatggttttatagggccagaatgtataggcacttctcaatcgccaagagtagtacaaaggtccgcctgattagcgcacccgatcaacggctcaaatttttacagagacaactcgccgacaagttggatgagttatacagaccaaggaacccagtccacgggtttgtagctgataggtccgtaaagaccaatgctctgtcacaccttcacaggcgcttcctgctcaatatcgacctagctgaattctttccgactatcaccgaaaacagggtgcagggactgttgatcagcctggggatcgactcaagggtcgctgacattattgcccgcatttgttgcaatgacggccagcttccacagggcgctccttcttcacctgttctgtccaatatgatctgctttcgtcttgacaagcagctgatgacgatagcgaaggatacgcggtgcatctatacacgatacgccgacgacatcactttctcatcctaccagcctcccgtgggcctatttgaggcgaccctccctccctctggacggttcctacctgatctgctaactccagccctccggggggtcatccagcaaaacggcttcgtgatcaacccagaaaaagctcattacgctgaccgccactcgcgtagaattgtaacaggattaaaggtgaacgagctgctcaacgttgatcggcgttatgttcgcaatattagagccaccctgtactccgtcgaaaagcttggagcgaaagaggcagagcaaaagtttcatgacagccacgggggacgaagttctttggcagcccatcttcaaggcaaaattgcatttttgactcacataaagggacgatgggacccagtggttcgcggtatcaccctccggttcaacaaatgtttccccgagcgcgcccttaaagtgcgacccacaccacaggaaattagagggcggtccgtgtgggttgtggaaaacgatccagcccagcagcagggaagtgcattcttcctcaaagatgttggcttagtgaccgccgctcactgcgtggagaatacggatgaggtagaggtctaccatcccaccaaaccggccaataaattcgtcgcaagagtgtcgaagaagtgtgagcatcgcgatctcgctctgctggagcatagcattagcagtaccgaatttctggagctcatacggtctgagagggcggtgtcccagggagatcccctgacagctgttggttatccccgatttcacgtcggtgatcggctgaatgcaaggcctggcaacgtgatttctctggtggccagaagcggcgtggaaatgatcgaggtgaaccagaccctgactcaggggatgtctggaggcccggtgctgaatggcgacgacggtgtcgtgggtataatccataaggggggtcctggcgaaggcagggactttgcagtaagcattgcaatgctgaacaaatggctggaagagaagtga

SEQ ID NO: 7585 - RNA, 1581 nt, unidentified
  source 1..1581: mol_type = other RNA; note = synthetic construct
atgccatccgccgctcgaatctttggcaaacactttccaattccaattccaccccagttagcagatgaggccactctattagctcatctgggtttgtccacaaaggaactcaaaaaaatctggtggtaccgtgggcggatgtatcatcaattttctattgcgaaaggagctggtaaggtacggttgatcacagcacctgatcgtcgactgaagatcctgcagagcaaattggcgccgctgctggaccagttgtattctgttagacaccctgtacatggcttcgtgcctgccagaagtgtgaaaactaatgcagaggcgcatggacggcggagattcgtcgtgaacctcgatctccaggacttctttcccaccatcaccgagaatagagtccgcggactgctgaccagcctgaacgtcgatgctagggtgaccgaaattatcgcccgactgtgctgctttaataaccacttgccccagggcgccccaacttcacctgtcatatcaaacatgatctgttaccgcctggacaccgagctcctgaggattgggaagggcgcccgagccatctatacgcggtatgctgacgacattactttcagttcatatcaaccccctgctttactgtttgagggagccctgcccccagtcggacggttttcaagagacttgcttgcacttcctctcagaggcacttttcaatctaatgggttcacgattaaccctgataagtcccactatgcagatcgcaactctcgcaggattgttacaggagtgaagattaatgccggcctcaacgtggatcgcagatacgtgaggcatatcagggcactactccactctatcgagacactggggctagccgacgctaacgccaaattcgttgccgcaggcggcaaaggttccattgcagcccacctgcgaggaaagataagctacatcgcgcatctgaaggggaggactgacccagtagttcgtacactcgccctgaggtacaatacatccttttcacatcagccgattaagctcgtgcccaccgttgaagagcgcagagataggagtgtgtggatagtagagcactctgccaatgggggcgaacagggaacagccttcttcctgaaagacgtgggacttgttactgcagctcattgtgtcgagggcgtgagcgacttcattgtgtaccaccccaccaagccctcgaaccaggcctccgtcaccgtgcttaagcggtgcgagcaccgggacctggccatcttgggacacgctatccacgacaccgaatacttcgaacttggggccgcgagccgcgctatagcagttgatgatgtggtcaaggcttacgggtatcctggttacggaccaggcgataagataaatgtgaggagtggcgctgtgtccagcctccccatcaaaagcgctgtccagatgatcgaagtgacgcaggaacttgcacaaggcatgagtgggggcccaatccttgacgcccacggtgaggtcattggggtgatccacaagggtggtccgaacgaagggagacagctggctatacatattggcgtattacagaaatgggcacaagagtga

SEQ ID NO: 7586 - RNA, 1581 nt, unidentified
  source 1..1581: mol_type = other RNA; note = synthetic construct
atgccgagtgtcatgcgcatcttcggtaatctgattcccatcgcaatcccccctgaactggccgcagaaccccctctgctgacccatctgggcctcagcgcaaaggaactaaagaaaatatggtggtaccgcgggcgcatgtataaacagttctctatcgccaagaacagtgggaaggtgaggctgattacagctcctgacagacgcctaaaaatcctgcaaaggaagctggcccctctgctcgaccagctgtacctggtgcggaatccggtgcatgggtttgtcccggcaagatctgtcaagacaaacgctgaggcacatgggcgacggcgttacgtggtcaacctcgacctgcaggatttttttgctacaattacggaaaatcgcatacggggactgcttatctcactcgatatcgatacccgggtggccgatatcgtcgcgcgcttgagctgtgtgcacggccatttaccccaaggcgcccctacatctcccgtgctgtcaaatatgatttgctaccgtttggacacagaacttttgagagtggccaagggggcaagagctatctacacccggtacgccgacgatattactttttcaagctaccaaccacctgctcctttgttcgagggcgctctgcctgccgttggaagattcagtccagaggtgcttgcaccacgagtgcgccagacatttgacaccaatggtttcactattaaccccgacaaggctcactacgccgatcggaactcccgtaggatcgtaactggcgttaaaattaatgccggcctaaacgtggaccggaggtacgtcagacatatcagggcgctcctgcattccatcgaaaccatgggtctggctgatgcgcaggctaagtataccgcaactggaggtaaaggcagcctagcagcccatctccgtggaaagatttcttacattacgcaccttaaagggcttaccgatcccgtggtcagagccctggccttaagatataatcggtcgcttgggcacaggccaatcaagttggccccaacaatcgaggagaggcgagaacgctcaatatggattgtagaaaactccgccaaggcgggcaaacagggtacagccttcttcctcaaagacgtgggcctcgttactgctgcgcactgcgtggagggcgatagtgacatcactgtatatcacccaactaaacccactaaccacgccaaagtcaccgtgttgaagaggtgtaagcatagagacttagctatactgggccataccatccacgaaaccgactattttgagctggagccgaccgaccacgttgtggtcgttggggatttcgtgattgcttatggatatccagggtatgggcccggtgataagattaatgtacgaggcggatccgtgacaagcctcccaatgaaatccgccgtccacatcatcgaggtggatcaagagcttgcacctggtatgagcggaggccccattttggatgcccgaggagacgttatagggatagttcacaaaggaggaccagacgagggcaggcagctggcagttcacctcgacgagttacagacgtgggtacaggagtga

SEQ ID NO: 7587 - RNA, 1524 nt, unidentified
  source 1..1524: mol_type = other RNA; note = synthetic construct
atggcggatgaagcttcacttctgagacacctcggtttgtcgccacgcgaactgaagaaaatctggtggtatcgcggtagaatgtaccaacagttttcaatcgccaagggaggcgggaaggtccggcttattatggccccagatcgtaggctgaagattcttcagtctaagctagcccccctgctggaccagctgtatcgcgtgagaaatcctgtgcacggattcgtacagcttcgcagtgttaagacaaacgcagaggcacacggcaggaggagattcgtgataaaccttgatctccaggacttttttcctactattacagaaaaccgcgtgaaaggcttgctgaaatccatcctgatcgaccccagagtggccgaaattgttgccaggctgtgttgcgtggagagccacttaccacagggggcgtcaacatctccggtgctcagcaatatgatatgcttcaggctcgacacgcagctgttgcagatcgcaaaatcagccagagccatctacacccggtacgctgacgacatcactttctcttcttatcagccccccgcccctttatttgagggagccctacccgctgtcgggcgattctccccagacatgctggctgcgcctctgcgtggagccttcgaatccaacggcttcattataaaccccgtcaaggctcattatgcagacaggaatagtcggcgtattgtaactggtgtgaaaataaacggggggttgaatgtcgatcgacggtacgtgagacggatcagagctctgctccattccattgagctgctaggcctggacgatgcacaacagaaatacggttctggagggggcaagggagctatcgcggaccaccttcgcgggacaattagctacattacccacttgaaagggagcgtagacccagtagttaggtcgttagcaacgcggtacaatcgaagtttccctgcacgccctattatgctcgctcccaccgtggaagagcggagagatagggcagtctggatcgttgagcatagcgctgacggtggtcaacaaggcaccgccttcttcctcaagaatgtgggtctggttaccgcgtcacattgcgtggagggggatagcgattttgtggtctatcacccatccaaaccgtccaacaggagtaaagtgaccgtgctcaagcggtgtgcccatcgggatctggccctcttagggcatgctgcccatagcactgattactttgacctggatgtggccgcacgatctgccgctgtcggcgatgacgtcgtggcatttggctatccaggctttgggcccggcgacaagatcaatgtccgaggcggatctgttacaagcctgcctatcaagagtggagttcctatgatcgaagtttcccaggaacttgcccagggaatgtccggcggcccgatattggatgctcacggcgccgtagtgggaattgtgcacaaaggaggacccgaggaggcacgccaactcgctattgagatcggcgtcctgttgaagtggctggccgagtga

SEQ ID NO: 7588 - RNA, 1575 nt, unidentified
  source 1..1575: mol_type = other RNA; note = synthetic construct
atgagcagcgcagcaaggatatttggaaaacgcattcccattccaatccctcctgagtttgccgacgaatccacactactcgcatttctggggctttcaccaagagagctaaaacggatttggtggttccgcgggcgcatgtaccaccaatttgagatcgccaagggggggggcaaatccaggctgattaccgctcctgaccagcggctttccatcctgcagagcaagctccgtcccctgttgaataccttatatcgagtgagaaaccctgtgcacggcttcgtcccagccaggagtgtgaaatctaacgccgaagcccacggcagacggcggttcatcgtaaatcttgatttgcagcacttctttcctactatcactgaaaaccgcgttagaggggtactggaagccctcggggtcgaccaaagggttgccgagatcattgcccgactgtgctgttttgagagccatctgccacagggtgcgagtacaagcccagtcttaagcaatatgatatgttacaggctggacacagatctcctgcgccttgctaaaactggtcgggccatatacacccggtacgccgacgatatcaccttctcttccaaccaaccgcctgctccactcttcgatggtgctcttcccaccgtgggccgtttctctcctgagctgctggcttcagccttgagagatgctttccaaaccaacggctttatcctgcatccagacaaggcccattatgccgatagaaattcaaggcgaatggtcactggagtcaaaatcaacgacggcctcaacgtggatagacgttatatccggcgtatcagagcgctcttacattctatagagacactgggcctggcagacgctcagtctaagtttgctggcttgggcggacgaggggctttagcggctcatttgcgcggaaagatcgcgtatattagtcacctgaaaggggccacagaccctgtagttcgcgctctggcgcagaggtacaataaaagtttcggcgctacccccataaccttggtgcccacgccccaggaaagaagagacaggtccgtttgggtggtagatcacatcgaccagtacgggagtgccttcttcttgaagggagtggggctggtgactgctgcccactgcgtgaagggactatcagaggtggagattcttcatccctctaagcacacaacaactttttcagcaaaggtgctcaagaggcacgatcaccgggacctggcactgctcgacaccagcaccattcctgcaactgagtattttgagctagacctggcaactacgcctcccctcgtcggtgatcccgtgacagcagttggctacccgaactgggcccccggtgataggctgaatcaccgcccgggagttgtcagccttattacgccacaggcaggagtgcgaaagatcgaagtgtcccagatgctgacccaaggaatgtcggggggtccgattctcgatgccaatgccggcgtcgtcggcattattcataaaggtggaccaggagaaggccggcagttagcaatccatctctccgtgctgcaggaatggttgaaggagtga

SEQ ID NO: 7589 - RNA, 1611 nt, unidentified
  source 1..1611: mol_type = other RNA; note = synthetic construct
atgggggactggcgcgactggaagggcgacttagtgtccgtcgcaaggatttttggaaagcactttccgttgcagatcccgcaggagctggcagacgaggcctctctgctggctcacctcggtctggggcctaaagagctgaagaaaatttggtggtacagaggccgtatgtacgagagattcgatattgcgaaaggtggcggaaagatccggcagataactgccccagacaagcggctaaagatcctgcaaagtaagctcacgcctctccttgatcaattgtatcgcgtgcggaatccagtgcatgggtttgtgcctgagcgatccgtcaaaaccaatgccgaagcgcatggccgtcggaggttcgtcgtgaacctggacctgaaggacttcttccccacaataaccgagtcgcgcgtcaagggccttcttggcgcgcttgctgtcgacgacagagtggcagaaattatcgcacgtttatgttgtgtcaacgaccacttacctcagggcgctccgaccagcccagtgcttagtaatatgatctgcttcagactcgatactgaactgctgagagttgcaaaagctgccaggagcatctatacacgctatgccgatgatattaccttctcttcttatcaacctcccgcccctttgttcgagggagccttacccgcagtgggaaggtttagcccagatacgctggctcccacactgcgcaatgtattcgccggcaatggcttcgtggtcaaccccgataaagcccattatgctgaccgaaactcccgacggatcgtgactggagtgaaaatcaacgcatccctgaacgttgacaggcgatacgtccggcacattagagccctcctgcattcagttgagactttgggtctgggggatgcccagcagaagtataccgatgccggtgggaaaggagttattgcagagcacctgaggggcaaaattgcctacgtgacacacctgaaaggactcaccgaccctgtcgtgcgcagccttgccatgagatttaacaagtctttcaccgcccgcccaatccggctagcacctacagtagaggagcagagggatagagctgtgtggatcgtggaacatagcgccaacggagggaagcagggaactgcttttttcctcaaggacatcgggcttgtgacagcttcacattgcgtggagggcgagtccgattttactgtgtaccatccctctaagccctcaaatcagtttaaggtttcagtggccaaaagatgcgaacaccgagacttggccttgctcggccacgccatcccaactacggattacttcgaactcgtggtggccacacaccctgtagcagtcggtgcggttgtgaccgcatttggttaccccggttttggcccaggagataagctgaatgtacggggggggagtgttaccagcctgcccataaaggggggcgtccagagggtcgaagtgtctcaagagctcgcacaaggaatgagtggagggcccgttgtagatgctcaggactgtgttgtgggcatagtccacaaagggggcccagaagaagctaggcagttggccgtagctatttccgctctgcaggacctagctgcggaatga

SEQ ID NO: 7590 - RNA, 1581 nt, unidentified
  source 1..1581: mol_type = other RNA; note = synthetic construct
atgccttctgctgctaggatctttggcaagcactttcctctgccaatccccccggaattggccgatgagtcctccctgctggcacatctcggacttagcccgcaggagcttaaaaagatctggtggtatcgcggaaggatgtacgcacagttctcaatcgcaaagggtggcggaaaggtacgacagattaccgcaccagacaagcgcctaaaaatccttcagaataaactggctccactgctgaatcaattgtatagagtgcggaaccccgttcatgggttcgttccggcgcggagcgttaaaaccaacgccgaggcacatggacagagaaggtttgtggtgaacctggaccttaaagacttttttcccaccatcacagagaatagaataacggggcttctccgctccctgggtgtggatgatcgcgttgctgaaatcattgctcgcctgtgttgcttcaatagtcacctcccccagggagcccctacttcaccagtgctcagcaacatgatttgcttcaggttggacactgaactcctacgggcggccaagggagctagatcaatctacactaggtatgctgatgacataactttctcttcctaccagccccctgccccactattcgaaggcgccctcccagctgtcgggagattctcccctgatactttggccccttcactgagagacacatttacccgtaatggcttcgccgtgaaccccgataaggcccattacgccgatcggaatagtcgaagggtggtcacaggcgtgaagatcaatgccggcctgaatgtcgatagaagatacgttcgtcggattcgagcacttctgcactctgtcgaaaaactgggattacgcgatgcccagcagaagtatgctgacgccggcggtaaaggtgtgattgcggagcacctgcgggggaagatatcttatattacccacttaaaaggggccacagaccccgtagtgaggagcctggcaatccggtttaacaagaactttcgagcacgaccaatcaagctggccccaaccattgaggaacaacgggatcgcgcagtatggctcgtggaacattccgctaactgcgggcaacagggcaccgcgtttttcctgaaagacatcggattagtgaccgcgagtcactgtgtggaaggcgtgagcgattttactgtctaccatccgtcgaaaccttccaacaggttcgaagtgacagtcgccaagcgctgtccacacagagacttggccgtcctcgaccacgcaatacctgcttctgactatttcgagctcgaggctgctgcccagtcagtagcggtgggcgacgcagtgacagcctttggataccccggtttcggccccggcgataagatgaacgttcgtggggggagtgtgacgagtctgcccgtcaaaagcggcgtgcacttagtggaggtcagccaggagttggcccaagggatgtctggcggacctattgtagacggccacgacggtgttgtcggtattgttcataagggggggcctgaggaggcaaggcaattggctattgccatcggagtcctgcagaaatgggtggctgagtga

SEQ ID NO: 7591 - RNA, 1506 nt, unidentified
  source 1..1506: mol_type = other RNA; note = synthetic construct
atgacgtcagcccggaggatgtttgggaaacagatccggatccccctgccacctgagctggctaatccggacgccctgcttgcttacctggaagtgtcccccgctgaacttaaaaagatttggtggttccggggcaggatgtatagtgaatttaacattgcgaagagaagcggaaaggtccgcaccattacagcacctgatcgtaggttaaagatcattcagtccaagttggcgcccctgcttgatcagctctaccgaccccggcacccggttcatggattcgtcccaaatcgctctgtgaaaaccaacgcagaagcccacgggagacgcaggtttgtggtaaacctcgatctcaaagacttctttccgacaataactgaaaaacgcgtggttggcctgctgagggccttgggtgtcgagaagggtgttgccgagatcgtagctcgcctctgctgtcatatgggacaactgccacagggcgcaccaacttctcctgtactgagcaatatgatctgctaccgactggacaccgacttgcagcaagtcgccaagtctgcgcgggcaatctataccaggtacgcagatgatatcacattttcctcttaccagcctcccacaactctcttcgagactgcagtggctggggcaggaagattttcccctgaggtgttagccccacagctaaggggtgctattgcctccaatggcttccttataaaccctgataaggctcactacgcggatcgtaacagccgacggatggtgacaggagttaaaataaacgctgggttaaacgtcgaccgccgttacataagaagaatccgggccatgatgcactcatttgaacgtgtagggcttgcggaggcccaggccaaatatgcctcaggaggtggcaaaggcagcttggcggcccatctacgcggcaagattgcctatgtggcccatctgaagggccagaccgaccctgtggttaggtccctggctcaaagatacaataagagcctccccgcaaagccaattaggttgaccccaacggtggaagagcggcgagatcgcgctgtttgggtaattgaggtgccactcaaacacaatggcacggccttcttcctcgctggagtcggcttggtgactgccgcacattgtgtggaggggctcagcgaagtggaggtcctgcacccctccagacacaccaccacttttacagttaaggtcagacactatgacaaacatcgggacgtggccgtgcttgaccacgggactatccccgcaacagagttctatgaactggagcctgctaccaaaccagccgccgtcggtgatgcagtcgttgccttaggatatcccctgtgggggctaggcgagggcctgaatatcaggccgggggaagtgtcgtcgctgaccgtgagaagtacaagtgctggtttctcagccagacgccccagcaagcgaagtgagaggggacctagcctgtctggcgtggactgcgcttctgcatcacggagttga

SEQ ID NO: 7592 - RNA, 1083 nt, unidentified
  source 1..1083: mol_type = other RNA; note = synthetic construct
atgtccaatatgatttgctacagactggacaccgagctcttgcgggtggctaagtctgcgcgggccatctacacgagatacgccgacgacatcacatttagcgggtatcagcctcccgccccgttatttgaggctgggcctccacccgtgggacgtttctcttccgacctcttgagcactgcgctgcgtgtcgccatagaaggcaatggcttcacaattaatccccagaaagcccattatgctgataggaattcaagacgcatagttacaggcgtaaagatcaacagtggcctcaacgttgaccgccggtacgtgcgtgatatccgcgctaagctgaacagcgttgaaaaacacggcctaaaggcatctcaggccaggcattcagcaaagaacggcaaaggggatatctgtagccacattagaggaaaaattgcttatgtcgtgcaccttaagggtctggcagaccctgtggtgcggagtttggccctgaggtataatagaagtttcgcagatcaacccatgaaggtgacccctactgactcagaaaggagggatcggtccgtgtggatcgtcgagcactcggggaacgagggagagcagggaaccgccttctttctcagcggcgttgggcttgtcacagctgcccattgcgtagagaatcccgaggatctgcttttgtatcacccgtccaccccttccaaccagacccgggttagcgtcagaaagcgatgtgaacaccatgacttagcaatacttgaccacgcaatacatccaaacgagttctttgaaatggaagcggccacagtcgctgcagcggtaggcgatgacgtgacggcttgcggttaccctgggtacggaccaggggaccgactgaatatccgcaatggaactgtcacctctctgcccaggaaatccgccattgatcgcgtggaagtgagtcaagagctgtctcagggtatgagcggtggtccagtactcgatgccggcggacgcgtggtgggtattattcacaaaggagggccaaacgagggccgacagatcgctactgccatccatgaactgaaaaagtgggccgcatcatga

SEQ ID NO: 7593 - RNA, 1581 nt, unidentified
  source 1..1581: mol_type = other RNA; note = synthetic construct
atgccatccgcagcgagggtgtttgggaaactctacccaattaacatccccgcggcccttggggatgaggctacactgctggctcatcttggtatgtctccaccggaactgaagaagatctggtggtacagaggcaaaatgtaccggcggttcagcatcaccaaaggcagcggcaaaacacggaccatctgcgcacccgactccagattaaagattctgcagcgtaaactggcaccgctgttaggccagatttaccgggtccggaaccccgtgcacggatttgtcctcgatcgctctgtcaagaccaatgccgaagcccacggggcaagaaggttcgttgtcaatctagatcttcaggatttcttccctaccatcacggaaaatcgaatcgtggggctcctgacttctgtaggccttgagaggagggtggcagaaatcgtagccagagttgcttgctatgacggccacctacctcaaggggctcctactagtcccgtgttgagcaatatgatttgttatagattggacaaggccctcttgcgtattgccaaatccgctaggactatttacacacggtatgccgacgatattaccttcagcggctatcaacccccagtggccctgtttgaggccggaccacccagcgtcggtaacttctcccctgaactcttgtcagccgcactacgaactgctgtgcagggcaacgggttcataatcaatccccataagctccattatgccgacagaaattcaaggcgcatcgtcaccggtgtgaaaataaacagtggtttgaacgttgatcgcaggtacgtacgcgatatcagggccaagctgtcctcaattgaacgccacggactgaaggcctcccaagccacgtatttttctaagggagggaaaggtgatattggtactcacatacgaggaaagattgcttacgtgggccacttgaagggtctggcagaccctgtcgttcgttccctcgccctccgatacaatcgcagcttcgcagatcatccggtgaaaataacccccactgagagtgagcgtcgcgacagaagtgtgtggattgtggagcactcaggaaatggcggggagcagggtacagctttttttctgtcaggggttgggcttgtaaccgctgcacactgtgtggaggaccccgaggacctgctggtctatcaccctagcacaccatccaatcaggctaacgtgtctgtcaggcgccgatgccagcatagagatttagcgatactggaccatgctatcagctcgaacgaatttttcgagatggaggcggcaacgaccgctgttgcagtgggcgacgacgtcatcgcctacggctaccctggatacggcccaggagatagactgaacattcggtctggcaaggtgacatcgctcccacggaagcacgcgatcgatcgggtagaggtgagtcaggaactgagccaaggaatgtcagggggccctgtgcttgacgcttctgggaaagtggtgggagttatatataagggaggccccaacgaaggaaggcagatcgccacagccatccatgagctgaagaaatggactgccgtttga

SEQ ID NO: 7594 - RNA, 1575 nt, unidentified
  source 1..1575: mol_type = other RNA; note = synthetic construct
atgccgcgcaatccgtttggaccaccaatcagagctgccgtccctgcggaacttgcgtcggaggcagccctcttggctcatctgggcatgacagtcggtgaattaaataaaatccgttggtatagggaccaaatgtaccagacgttcgagatcgcgaagtccggaggcaagagtcggttaatctcggcacccaacaaacgcttaaaacacattcagcgacagctgctccccctcctctatcagctctaccagacacggagtcccgttcatggcttcgtctttaacaggagcgtgaagactaatgctcaatcacacctgcgtagacggttcgtgctaaaccttgacctgcaggatttttttcctaccataactgagaaccgggtggtgggaatgctgaaagccataggcatcggagctactgtggccgtagccattggctatctgtgctgcattcatggccacctgccacagggtgcaccaacctcccccgtgctgagcaatatgatatgtttcaggctagatcgagagcttcttgcctttgcaaaggcaagcagatgcatctatacccgctacgcagatgacatcactctaagttcccatcagccaatgagcgccctgtttgaaggctctcccccacccgctggcaattttgctaatgatctgctggtttctgctctgacagccatagtggtgggcaacggcttcaccattaaccctatgaaagcgcactacgctaataggcatagccgccgaatggttacgggcctgaaaattaacgatcttctcaacgtagataggagatatataaggaacattcgtgctgtactgcactctgtcgagacattggggttcgtgggggcacaaactaagtacgccacctcaggaggaaccggttcccttgctgcccaccttcgcgggaagattgcatggatctcccacattaagggtccctctgatcccgtcgtcagatctattgccctgcgatttaacacctgtttcgccgatcgcaaaatcatggttactcccacccccattgagagacgggagagatctgtttggattgtagaacatgatgacggtcaggggacggggttcttcctcagtggagttggattggtgacagcagcccactgtgtcaccgggaagcgggaggtcgaggtgtttcacccgtcaaaacatgctaacactttcaaagcgacagtgctgcaaagggacgaccatctcgacttagctatcctgggacatgagatcccagccaccgaatactatgaattgaatagagccgccctgccagtggtaacaggggatcctatgacagccgtggggtacccaaagtgggcccctggtgaccctctgaatgtgaggcctggtgtcgtgagcaccgtgaccatcaagagcgccgtccgcctcatcgaggtgacacagaagctgactcaggggatgtccggcggacctctcttggacgcaaatggcgacgttgctggggtcgtgcacaaggggggacctgaagaaggccgggacttcgcgatccacgttgaggtgttgaactcctggttggcacacctggcctcatga

SEQ ID NO: 7595 - RNA, 1488 nt, unidentified
  source 1..1488: mol_type = other RNA; note = synthetic construct
atgactgctaaggagctcaacaaaatccgctggcatcgagggggaatgtatcagagtttcgagatcgctaagaataaagacaaaggcaggcttatttccgctcctgacgatagacttaaacatttacagaggcagctccttcggttgctggaccccctttacacagtacgcaacccagtccatggcttcgtgttacagagaagtgtcaaaacaaatgccctgagtcacctgcgcagatcatttgtcctcaatctggatctgcaggatttcttccccactatcactgagaaccgcattgtcgggatgttggaagcgctgggaatcggatccagcgtagccgccgccatcggatacctctgttgcattaacggacacctgcctcagggagctccaacatcacccctcttatctaacatgatctgttttcggctggatcgggaactgcttaacttcgccaaggtcaccaggtgcatttatacaagatacgcagatgacataacctttagttctcaccgtccgatgacagcgctgtttgagggtccactgcctctcgccggacactttgcccccaatctgctggttccgagcctcgtggccctgtttgctggtaatgggttcacaattaacccctccaaggcccactacgcagaccgccatagtcgtcgaatggtgacgggcctcaaggtcaacgaactgctaaatgtcgacaggaggtacattcggaatattcgggctgcgttacacagcgttgaaactctgggcactgtgggtgcccaagccaagtacgaggcatccgggggctcagcttcattggctagccacctcttgggcaagatagcgtggatcagctatatcaaggggtcttctgatcccgtggtgaggagcatcgccttgcgcttcaactggtgttttccagactgcaaaatcgaagtgctgccgacccctatcgaaagacgggatagggccgtgtgggtggtggagcacgatgatggacaaggtaccggcttctttcttaatggcgtcggattcatcactgcggcccattgcgtggccggcaaaaaggaagtggagatattccatccttcaaaacacagcaactccttcaaggcaatcgtgctaaagtccgatgacgacatggacctcgcagttctgtcgcatgagataccagctaccgagtattacaagctggaccaagctgcactaccaattgcaaccggggcactcatgattgcagttggttatcccaagtgggcccccggcgaccctttgaatgttagacccggcgtggtatctacgataacggtgaaaagcgctgtgagactgattgaagtgacccagaagctgacccagggaatgtctggggggcctctgctagatgccgatggggctgttgccggggtcattcataaaggtggccctgaggagggccgagactttgcaatccacatcgacgtattgaactcctggcttgccgctgccgcaccatga

SEQ ID NO: 7596 - RNA, 1683 nt, unidentified
  source 1..1683: mol_type = other RNA; note = synthetic construct
atgtcacgggaggacgttcgcgccattaggctgctgagagagtggcgtgactggcggggggatttggtaccccagaaccccttcggccccccagtaaggattgacatccccgctgagttggctagcgaagctgcactactgtctcatctcggactgagcgtgatggaactcaagaaaatccggtggtgtcgcgggagaatgtatcagtctttcgatattgctaaggtgaagaataagatacgcgagattaatgcccctgacagtagacttaagcatcttcaacgccagcttttgcctctgctggaccagttgtatcgcgtgcgaaaaccagtgcacggattcgtggccgacagatccgttaagacaaatgccctcgcccacctaaggaaacactttgtgttgaatttggacctgaaggactttttccctagtatcaccgagaacagagtcgtgggcgtcctgaaggctctgggaattgacggcagcgtggctgctgtgatcggatacctgtgttgcgtgaatgggcagctgcctcagggtgcacccacctcaccagttctcagcaacatcatctgcttcagattagataggaagttactggcttttgcgaaggacgcgaggtgtatctacactcggtacgccgatgatattacattcagcagttaccagcccatgactaccctgttcgagggcccgttaccaccggcagggcactttgtgccagatctgcttgctgcagcatttgcctccatatttgtagtgaatgggttcgccataaacccagccaaggctcattatgctgatcgacactccagacggatggtcacaggactcaagattaatgagctgttaaacgtcgatagaaactacgtacggaacataagggccgccctacactccattgagacaatcggcggtatcgccgcacaacgcaaatttgaagcacgaggcggcactggatctctggctgcgcacctcctgggcaaactgtcatggctgcgacacatcagggggcaaactgacccagtttttcggagtgtcgcagtgcggtttaacaatgccttccccacccacaaaatcgacgtaacgcccactcctgcggaagtgcgtgacagggccgtttgggttatcgaacattacgaaggagatatagaccaatggtatcagggttccgccttctttctacgtggagtgggactggtcacggctgcccattgcgttacaggcgcctccgaagcggaggtgtatcatcccgggaaaccggccaacaaattcaaagtgaccgtgcttaagatcgacgatcacagggatttagccattcttgcgcatatgatcccagaaacagagtatctcgagttggagcgctcgacccaggtcattaccgtgggcatgctcctgaccgcagtgggctacccttcttttgggtctggtgatcgccttaatgtacgagacgggaacgtctcatcgctcccggttaaacatggggtccagtatattgaagtgcagcagaaactctcaccaggcatgagcggcggccctctgttggatgcatacaatgctgtcacaggtgtggtccacaagggaggtccttctgagcctagagacttcgccattcacatcgatgttctgaacgcctggctcgcaagtgcaagcgctagcttcgggcccaacggttccgcctga

SEQ ID NO: 7597 - RNA, 1260 nt, unidentified
  source 1..1260: mol_type = other RNA; note = synthetic construct
atggtggcctatttgtcattaactgaagcagagcttaaaaagattcgctggtttcgccggggaatgtatcactacttcgaactggcaaaaggtaacggcaaacgtaggcggattatggcacccgacgcaagactgaagcatctacaaagggccctcctgccactgatggaaaatctgtaccgagttcgaaacccagtccatggttttgtaagggataaaagcgtcaaaaccaacgccgctgcccaccttagacgccggaatctcctcaatattgacctaaaggatttcttcggcgccatcactgaaaaccgtgtggtgggcgtactcgaagcaattggtgtccccggagatgtggctgctgccattggctatctgtgttgctgtgagggcagtttgcctcagggggcgccgtctagtcccttgctgagcaatatggtgtgtttcagacttgacagggagctgatgcgctacgctaaggagcataggtgcatatatacccggtacgcagatgacataactttgtcctcccaccaacccatggcctctgctttcgacgggcctattccacccgctggtacagttcagagtgagcttttggaccctgagctgagagggatcatcggaagcaatggcttcgagctgaaccctgataagattcactacgcagataggaattcccggcggatggtgacaggactcaaggttaacgagctgctgaatgtcgaccgtcgcttcgtccggaacttacgagctatgcttcatagcatcgagataaaggggcacgccgatgccaaagctaggttcgcgtccctcgggcactcaggatcaatgtctgctcatattcgcggcaagatcgaatggctcgcctctatcaagggaacatccgatcctgtggtgcggggaatcatattgcgctataacgcttgctttcccgggaaggcaatcgcggtgagcccaaccgacgaagaaagacaggaccgagctacctggatcaccgagaacaaaaatgggcagggttcgctgttctttctgaagggggtcggactggttactgccgcacactgtgtggccgatctactgaaccttgagatttttcacccatcaaagcatgccaatagatttggcgcgacggtaacgaaatacgacaaagacaggagacgactcagattaggcttaaagagggtgctggatccaatcgaggccgaaatgtgcgcctgcctcacagcccctctgtttggcaccggcccgagaatcctgtga

SEQ ID NO: 7598 - RNA, 1638 nt, unidentified
  source 1..1638: mol_type = other RNA; note = synthetic construct
atgcataacccctttgggccatcaacccccccgcggatctccattcctcaggagttggagaataaggaatcaatcctcgcttatctggatgttaatccagaggagctaaagaagatatggtggtttcgcgaaaagatgtatcaggccttcgaaatccagaaacggggaggcaaagccagggtgatctcagcccctgatgatcgcctgaagtacctgcagcataagattttgctcctgctaaacagactgtaccgtgttaggaaccccgtgcacggcttcgtccctcaaaaatccgttaagactaatgccaccgcccacctgagaaaaaggttcatcttgaacatagacctaaaggacttcttccccagtatcactgagaaccgaattattggtgtcctcaagtcgatcggtatcgatgaccaggtggctcaaattatcagccgaatatgctgctcaaacggttgtctgcctcaaggcgcaccaacatcaccagtcctctccaatatcatatgcttcaggctggacaagaatttaatgagcctcgctaaggacacaagatgtatctacacccgctacgctgatgatctgactttcagcagtcaccagcccatgatcaaactgttcgagggcgtcatcactccagccggccatgtgtccccggagctgttatctctccatttgcgcaatattttcctggccaacgggtttattattaatcccgataaggtgcactatgcagataggaattccagacgcatggtcacaggcctcaaggtaaacgaatttgttaatttggaccggaggtatatacgcaacattagagcaattcttcactctattaaggtaagtgacgttaaagccgtggagacaaaatataagcaggattatggaggtaaggtcgatctgggaaaatacctgagaggtaaaattacatggctcgggtttatacggggacagagcgaccctatttttcgagcgatcgccataaggtttaatgaagaattccctgatcttaagatcgaaacaactccaacctttattgagatccgggacagagccgtgtgggtgatagaatactgcgtggatactctcgcagggctgaaagcatttcagggtagctgcttcttccttaaagatgtgggattggtgacggcagctcactgtgtgctggacgagaatgagccaatgaaggagttggagcttgaattacaccatcccagtaagcccgccaacaagttcaaggcgaaaatctgtatgttcgacaaacatcgggacctggctatccttagtcacaagattcctgctaccgagtactatgagctcgagctcagcacaaaaaccatcagcgttgacgatgaacttaccgctgtggggtacccttcgtttggcccaggcgaccagaccaacattaagaagggaacggtatccagcctgcccaaaaaatctgatgtccagttaatcgaagtgacgcagaaactggcacaagggatgtctgggggccccctacacgactccaactttgccgtagtcggagtgattcataaaggcggaccgtctgaggggcgtgactttgcggtgcacttcgacgaacttaacaagtggctgtctaccccacctatctccaaaatcctgggctga

SEQ ID NO: 7599 - RNA, 1503 nt, unidentified
  source 1..1503: mol_type = other RNA; note = synthetic construct
atgagcggaaaagagttaaagaagatctggtggtttagagggcgcatgtaccaccagttcgagatcgccaagagggagggcaagacacgcattatcaacgctcctgataagcggctcaaacacttgcaaagacagattgcccctctccttgatcaactctactcagtgcgcaatcctgtccacggcttcgtgaccggaaagagcgtcaaaaccaacgcactggcccacctaagaaatagatttgtgctgaacatcgacctgaaagatttttttccaagcataaccgaaaacaggatcaacggcgtgctggaaagtctcggtgtagacagcggggtttcccgtataattgcacgcctgtgttgccataatgcccagctgccacagggcgctcccacatcacccgtcctatccaatatgatttgcttccgactcgacaaggagctgcttgcattcgccaagagcatgcggtgtatttacactaggtatgccgacgatatcaccttttcctctcatcagccgatggtggcactttttgaaggtagcgctcagcccagcggtgctttcgcactggacctcttgtcgtccacgctgcggaatattgtgaatggaaacggctttgcgatcaatcccgaaaaggcccactatgctgatcggcattcacggaggacagtgaccggcatcaaaataaacgagttcttaaatgtggaccgccgatatgtgaggaacatacgcgccgctcttcactctgtggagcaggtcggaaaaaaagcagctcaggaaaagttcgagaaagaccacaaggggaagtgtgatctgggagcccatctggggggcaagctctcctggctgagatacatccggggtcagtccgacccagtttttagggcaattgcaattcgtttcaacgccaacttccccgaccgaaagattgatgtgacgccaacatctcatgaggtgagagatcgggccgtctgggtcgtagaatattgcgagggggagggggaaaaccttaaaatgttgcagggaacttgttttttcctaaaggacgtcggcttagtgaccgctgcacactgcgttgagggagttgaggaagtcgaggtttaccacccatcaaagagaagtaacgtgttcaccgccactgtcgttaagcgtgataaggatagagatttggcgatcttggagcattcgatccctaccactgaatattttgagattgagaggtctgcccaagcggttgccatgggcgacgagctgacagccgtaggttaccctagtttcggccctggagacggactcaatgtaagggatgggaaagtgtcaagcctgccggtcaaaagttctctcaaactgatcgaagtgactcaaaaattgagtcagggcatgtccgggggtccccttctgaacggggacaatacagtagtgggcgtgatacacaaaggaggcccaggggaagcgcgagactttgctatccatatcgaaatgctgaatgcttggctgtcttga

SEQ ID NO: 7600 - RNA, 1629 nt, unidentified
  source 1..1629: mol_type = other RNA; note = synthetic construct
atgagagcatggcgtgattggaaaggggatctggtcactttgcctctgtttaattctagtatccgcacaagtatacctgctgaactggctgatgaaacggccttctttctatacctacagatgtctccgagggagatgatcaaaatctggtggttcaggcgacgtatgtaccaccagttcgaaattgcaaagggcaaaggcaaaacccgcatcatagaggcaccagacgaccggctgaaacatcttcaacgcaagctgttacctcttttagaccagctatattgtgttaggcaccccgttcatggcttcgtcgccgggaagagcgtgaagacaaatgcccaggctcacctgcgaaagagattcgtactgaatattgacctgaaggattttttcccttccataaccgaaaaccgggtggctggtgtgctggaggctctgaacatcgacggacgagtttcgagattgatcgctaggctctgctgtcacaacggccatttgccccaaggcgccccaacctcccctatcctgtccaatatgatttgtttccgcctggacaaagaattgctggtgtttgccaagagcatgcggtgcatctatacacgctacgccgatgatattacgttcagttcccaccaacctatggctgccatgtttgaaggagccgcggccccactcggacggtttaactctgacttgctcatccagccttttaggaatattatcgccagtaatggtttcagcctcaatgcagacaaagcccattacgccgatcgcaactccaggcggatggtgacaggaataaaagtgaacgaactcctgaatgtcgacaggcgttacgtgcgaaatatcagagccgctctgtattctgtggagaaacttgggaagaagggtgcccaagacaagtttgaaagcgagcatggcgggaccagcaagctcgcagctcaccttgcgggtaaaatcgcatggcttgcacatatccggggccaaagcgaccccgttttcagagccatagcggtgagatttaacaagaacttcccagaggctcgcattgcggtgacacccacttctgaggaaatccgtgatcgagccgtatgggtagtcgagcatgaggaagcccagggaactgcttttttcctgaagggagtggggctgattactgccgcacactgtgtcgaaggagtgaaggaggctcagctgtatcatcccagtaaaagggcaaacgaatttactgtgagagtggtcaaccgggacaaggacagagacttagccctccttgagcacaccattccttcaaccgagtattttgagctcgacagatcaaaccagccggttgctgtcggccaggagctcactgccgttgggtacccatcattcggcccgggtgatcgcttgaatgtccgggatggaaaggtgtcatcacttaccgtacagcacggggtgaggttgattgaggttacccagaagctgccccaggggatgtctggtggacccttactgagctcccagtgcgcggtggtcgggatcattcacaaaggcggcccagatgagggacgggacttcgcaattcacatggatgtactggcagcttggctcgcagagaaaccacccggcgatggctgcacatcctga

SEQ ID NO: 7601 - RNA, 1578 nt, unidentified
  source 1..1578: mol_type = other RNA; note = synthetic construct
atgccccccagtttttttgggatccccgtggttcgggtcgcgattccacctgagctggcctcagaagctgctttgttggcctacttaggtgtttccgccaaggagctgaagaagatttggtggtttaggggccgaatgtaccaccagtttgaaattgcaaaaggaaacggcaaatcgcgcattattaatgcccccgataaacggttgaagtatctgcagcgcaagatagccgcgttgctttatcatctctaccgtgtgagaaacccagtgcacgggttcgtcgccggaaaatctgtgaagaccaatgcgctggcccatctccgcaagcggtttgtgctcaacatcgacctcaaggactttttcccatccattaccgagaacagagtgactggagtcttagaatccttaggcatcgattctagagtcgcatccattatcgggcggctgtgctgtcataattcacatctccctcagggagctcctaccagccctgtgctgtcaaacatgatatgtttccgtctcgacaaggagctacttgcatttgctaaagcatccaggtgcatctacaccagatatgccgatgatattactctgagtagccatcagccgatgactgcccttttcgaggctgttcctccctctgggcattttgcccctgaccaactgaagccagcgttcagaaatatcatcgtaacaaatggcttcgccatcaaccacgataaggctcactacgccgatcagcactcgcggcggacggttactggacttaaaatcaacgagctgctaaacgtggatcgaaggtatgtgcgaaatattagagctgccatatactccgtggaaaatctgggcaaaaagaccgctcagaaaaaatttgagagctcacacggaggcacgagcgatctggggaagcaccttgaagggaaaatcacatggctgaggcacataagagggcagtctgatccagtctttcggagcatcgcagtgaggtttaatactagtttcccggaaaggaaaatcgaagtcacacctaccgctgcagaagtgcgtgatcgcgcagtctgggtagttgagcatttcgagggcgacatggctcaaggctcagcattcttcctcaaagacgtgggtcttgtcacagcagcccactgcgttgcgggggttgaagaggtggaggtctatcaccccagcaagccatctaacgcatttaaggccaaggtgctcaaacgcgacgagcccagggacttagcaattctcgaacacgccattccgcccacagagtacttcgaactggagcaatccaaccatagtgtggtggtgggcgagggactggttgccgtaggatatcccagcttcggccctggtgaccgactgaatgtacgcgacggtaaggtcagttctctgccagtgaagcacggcgtcaaactgatcgaagtgacccagaagttgagccagggcatgtccggtgggcctctactggaccacaatgacgccgtagctggtattatccataaaggagggccaggagaaggcagggacttcgccatactgatcgagatgttgaacgattggctcgctgagtga

SEQ ID NO: 7602 - RNA, 1542 nt, unidentified
  source 1..1542: mol_type = other RNA; note = synthetic construct
atggacaatgagactgccctcttgaagtatctaggcgtgtctgccgacgagttaaagaaaatttggtggtttcgagtccgcatgtaccatcaattcgagattgccaagggcaaggataagacacgcactattacagcccctgatgaacgattgaaatatcttcagcgccaaatcgcacccctgctggaccagctgtacagggtacgcaacccagtacatggcttcgtcgatggaaaaagtgttaagacaaatgccctcactcacctgaggaagagatttgtcctaaatattgatctcaagtcctttttcccatcaatcaccgagaaccgggtgattggactgcttgaagctctcggcattgataattgtgtggcctctatcaccgcgagattgtgttgctacaattctcacctgcctcagggcgccccgacatctcctgttctctccaacatgatctgtttccgactggacagagagctgctagcatttgcgaagggaaccaggtgcatatacaccaggtacgccgacgacatcacattcagcagccatcagcccatggctgccctctttgagggttccgcgccacccagcgggcattttagtcctgacttgctgatacccgccctgcgtaatacattcgcatctaacggttttacgatcaacccccacaaggctcattacgcagacagacactcgaggaggatggtcaccgggctgaaggtcaacgagctgctcaacgtggacagacggtatgtacggaacatccgggccgcattgtattcagtggaaaccctgggcaaggccgctgcccagaccaaattcgcaagcaaccacggagggacgagtgacctgggtgcttaccttcagggcaagattacctggcttaggtttatccggggccagtcagaccctgtattccgtgccatagctgttagattcaatgcttccttcccggatcggaaaattgaagttaccccaacagcagacgaggttcgcgacagggcagtgtgggtggtggagtactgcgaaggggaaggagagaagttaaagaccctgcaggggagcggatttttcctcaaagatgtcggccttgtgaccgccgcgcattgcgtggagggagttgacgaggtggaagtgcaccacccttccaaaccagctaataaatttaaggctacggtggtgaaacgcgacaaagaccgagatctggcaatcttggaacatactatacctgcaactgaatatttccaactcaacggagcaactcaagctgtcgctgtgggcgatgaattaactgcggtcggttatcccgggttcggaccaggagatcgggtaaatgtgagagaggggaaggtgagctccctggctactaaacacgccgttgagctgattgaagtcacacagaaactgtcacagggtatgagcggtggccccctgttaaatagtgataacgccgtcgttggcgtgatccacaaagggggcccggatgaagggcgtgattttgccgtgagaatcgagatgctcaacacatggcttgccgagtga

SEQ ID NO: 7603 - RNA, 1584 nt, unidentified
  source 1..1584: mol_type = other RNA; note = synthetic construct
atgcctaaccttccccctccgtttggcgcctcaataaggttagctctccccagggagctcgccgacgaaaacgctctgctggtgtacctggggctctctcctaaggagctgaggaaaatttggtggtgccgggcaagaatgtatcaacatttcgatatcgccaaagggcgggataaagtccgcaccatcagcgcccccgataaacggctgaagtacttacagcgaaaactggctgctttgctgacacagatctacagaccacgccacccagtgcatggatttgttgtggggcgatcagtcaagacaaatgccgtggcacacctacagaagagatacattctgaacatcgatgttaaggatttcttcccctctattaccgaaaatagagtggagggactcctccattccctcggtgtggacatgcgggtagccgcaataattaccaggatcgtgtgcaatgagggctgccttccacagggcgctccgactagcccaattctgtctaacatgatctgtttcaccctcgatcgccggctcatggcgttggccagagataacagatgtatttatacccgatatgccgacgatattactttttccagtcaccagcctctcgcgtctctgttcgaaggcgctagcccgtcagccgggcagattacacctgacctgttgagcccagctttgcgcgacaccttcgtccacaatggctttgccctaaatcccgacaaggcccattacgcggaccgccattcccgacgcacagtgactggactgaaggtgaatgaactgctaaacgtagacaggaggtttgtgcgtaatctgagggcagctttacacagtgtcgagactcttgggatcgccgcggcacagcaagtgtatcaggatcgctatggaggcagcgcgtcgcttggcgcacacctagagggcaaaatcggatggctgaggcatatacggggtcagtctgatcctgtgttccgagccctggcattgcgtttcaacgcctgttttcccgatagagaacttcgtttaacacccaccgtgtccgagataagagatagagccgtttggcttgtggagaatgacgagacaatcgagcagggcactgctttttttctggcaggcgccggattggtgactgccgcacactgcgtcgagaaggccacggaactgacgctctaccacccaagtaagcctgctaacaagttcgtcgccaccgttctcaagtgcgacgcacatcgtgaccttgctttattgggtcacgacatcccccctactgagtacttcgaactagaacggtccaccgccgctgtactggtcgggcaagaactcacggcagccggatatccaggcttcggacccggggatcggctcaacgttcggcttggcacagtcaccagcttgcccatcaaaaggggtgttcatatgatagaggtgagtcaaaaactgggacaggggatgtcaggggggcctgttctggacgaaatgctgggtctggtgggcgtaattcaccgcggaggtccaggcgaagctagggactttgctatccacctggacgtcctgaactgttggctggcagaggagtga

SEQ ID NO: 7604 - RNA, 1434 nt, unidentified
  source 1..1434: mol_type = other RNA; note = synthetic construct
atgtatcagcaattcgatatcgccaaaagcggcaaaaaggtgagaagcatcagcgctccggacaagcggctgaaacaccttcagcgtcagattgcaccactcctcgactctctgtaccgggtaagacacccggtgcatggcttcgtggctaacaagtcggtcaaaactaacgcccaggcacatttacgcaagcggtttatccttaacctcgaccttaaagatttcttcccctctatcactgagggaaggattggaggtctgctgcaatcgattggtatcgacagtagagttgcggacattattgcccggttatgcaccaatgacggacgcctcccacaaggggcacccacatctcccgtcctgtctaatatgatctgttttaggcaggataagcagttgatgtccttcgctaaggagaataggtgcatatacaccagatatgctgacgacattacattttcaagtgaccagccaatggcagccctgttcgaaagtgcggtgcccagtcctggccgattccctcctgatctcttggtcacccggttgagggcgatttttatggctaacggctttgagatcaacgctgataaaacgcattatgccgataggcatagcaggagaatggtcaccggactgaaggttaacgaactgattaatgtggatcgccggtacgtgcgcaatattagggctgccctatactccgtacgtacactcggggccgaagaggctcagaaaaagtttgaaactaaactgggcgggaagtccaatattggatcccatctggaggggaaaatcgcatggctgagatttatccgcgggcaatctgaccccgttgttcgagccatggccctgcgctttaacgccgccttcccagatcggaagatagatgtggtgccgacgcgagacgaggtgcgagatagggcagtgtgggttgtcgataatgacaccgacatatcacagggctcagcgttcttcttgaagggcgtgggactggtgacagccgcacactgtgctaagggggctaaggaggtagaagtataccaccccagcaaacgttcaaacaagttcaaagccactgtagtcaaacgggacgaacagtttgacctcgccatactgaatcacgagataccaaccaccgagtactatgagcttgagagatctctaacagcagtggccgtgggcgatgaccttactgcaatcgggtatcctgacttcggtcctggtgatggcttgaacgtgagagggggcaaggtcagctccttacctgtgaagaatggagtctccatgatcgaggtgacacagaagctgtcccaggggatgagcggtggtcccctcctagatgacaacgatgccgtcgttggagttacccacaagggcggcccagatgaaggacgagactttgtggtccgcatcgaaatgatcgataaactgtga

SEQ ID NO: 7605 - RNA, 1638 nt, unidentified
  source 1..1638: mol_type = other RNA; note = synthetic construct
atgccctctagtagtgcctttggattccctatcgtgtcggttgccattccatgtgaactaaagagtgaggagaagctactggaatacctggctatcagcacgaaagagcttaaatttgtctggtggtatagggagcggatgtatcgcaaatttgagctggggtccaagaaggggaaggtgcgggctattgccgcgcctaataaccggttgaaatatatacagcgcagaatcgccgtgctcctgaatcagatttaccgggtgagaaatcctgtccacgggttcgttaaggaaaagtctgtgaagactaatgccctctctcaccttaagaagaaatacattgtgaacatcgatctcaaggatttctttccttcaattacggaaaaccgagtgatcggagttctgaattccctcggtatcgagcggtccgtgtcccaaatcattgcaaagttttgctgctgtaacggacatttgccgcagggagcacccacttcgcccgtcatatccaatatgatttgctttaagatggacaagagcttaatgagtatggcgaaggaaatgaggttgatctacactagatacgccgatgatattacattctcaggttaccgtcccatgactgtcttgtttgagggggctgccccattccctggcaggttcgaccccaaccagcttgccagcgagttacgacagataatcagtggtaacggctttgtattgaacgccaacaaagcacattatgctgacccaaatatgcgacggatggtgactggcctgaagatcaacgagatcattaacgtggaccgtagatacataaggaacattcgctctgcactgtactcagttcagacaatcggggagacagcagcgcaggataagtatcagattaaatacgggggcagatcatctctcggagcccacctggaaggaaaaataacatggctacgatatatccggggacagtcagacccagtctttagggcgatcgctgtaaggtataacctgtgttttcccaaccggcgaaaaattgaagttattccaacaccggaagaagtcagggaccgcgccgtctgggtcgttgagcactctgagggcgatatggctcaaggctctgcttttttcctgaaaggcgtgggcctcgtcaccgcagctcattgcgtggaagaagccaccggcctccagcaaatcagcctctaccacccaagcaagccgaataatctgttcgccgcaaccgtagtgggtatcgataagcacagagacatagccattctggagcatagtatcccacttaccgagttcttcgagctggaaagctcattcagggtggtgcaggtgggagacaatatgaccgccgtaggattccccggtttcgctaaaggcgacagacttaacgtgagggagggcaagatatccagcctgcctgcaaagagcggtgtccgcctggtggaggtgacacaaaaactgacccagggtatgagcggcgggcccttgttagattccgacaataaagttgtggggatcatccatcgcgggggacctggcgaagggagagactttgctacccacatcggggtactgaatgattggctccgtgagcgccctgaaggcgtttccaaaaaaattgaggaggtcagaggatga

SEQ ID NO: 7606 - RNA, 1368 nt, unidentified
  source 1..1368: mol_type = other RNA; note = synthetic construct
atgcccaattttttcggcgactttcatacgcccagagtcaaactgcctgaggagtttagcagcaaggaggcctttcatcagtatcttggactgagtacagctgagctgaagaaaatctggtggtacagagaacgtatgtacaaacagttcccgctcgctaaaaagaacggcaaaaacagactgatttccgcacctgacaagagactcaagttcctccagggcagattacttttactcctaaaccaaatctaccgtgcaaggaatccggtccacggtttcgtcttcgaccggagcgtgaagacgaatgcagaggcccatctgaggaaaaggtacgtgttaaatattgacctgaaggactattttctgtctatcaccgaaaagcgtattgtcggactgctggaaagccttggcattgacactgaggttgcctgcatcgccgcacgactctgttgcttgaatagtaggttgcctcagggggccccaacttctcctatactgtcaaacatgatctgcttccgcctagataagaggctccaaaagttttccaaggaaaacagattcatctatacccggtacgcggacgacataaccctatcctctcagcagcccatgacctcaatgttcaagagtggtactatcgtgtccggatcaattagtcccgacgaccttaatgctactttcgttgatatcatcagcggcaatgggtttcaaataaacccacagaaagtgcactacgctgacaggaattctcgccggattgtgacagggattaagatcaacgagcttctgaacctcgatagacgatacgtgagaaatattagggccgctctgtacagcgtcaacaccctgggccagatcgaagcacagcgcaaatttgaggatgtgcacggaggagattgtgacctctcccggcatttgcgcgggaagataacctggctgggctatgttcgaggacgctccgatccagtatttcggtcaatcgctcgacggttcaatggatgctatcctgatatgaagatagagacagtacccacagccaaggaagtgcgcaatagggctgtctgggtgattgagcacttcgaaggcgattgggcgcaagggaccgcttttttccttaaaggtgtaggtttggtgactgccgcacactgtgtgaaaggggccgagaaaatcaaaatctatcacccagaaaagcggtctaacgaattcgacgtgcatgttgttaaaatcaacgaggacctggatttggccgtactgcaccactcgattcctacaactgaattttacgagtttgatcagacaaccaaggatgtggccgtcggcgatgagctgattgcgctcgggtatccaggcaacccacccgaaaaatga

SEQ ID NO: 7607 - RNA, 1440 nt, unidentified
  source 1..1440: mol_type = other RNA; note = synthetic construct
atgtatcataattttaatattgggcaccacggcagaaaattgcgagtgattaacgccccaaacgaccgacttaagtatattcagcgacgcctccttaaggtcatctccggtatttattccgtgcgtgacccagtgcatgcctacgtcgaaggccggagcataaagactaatgccgcaagccacctcaagagcaagtacatcgttaacctcgatttgagtgatttctttccatccattacagaagataggatagttggactaatgaacagtctctgtatcaccccaagagtatcagccatcataggacgcctgtgttgcatggggggatatctgccacagggggctcccaccagccctatgctgtccaatatgatctgctttaggatggatagggatttcctgagcattgctaagagatacaggtacatatatactcggtacgccgacgacattaccatctcctcccggtcaccccttaccaatctgtttgcgtctggcgcacctcccgtaggacacttcgatgcaaacatactttcaaaggatgtcatctccatcatttatactaacggcttcaacataaactctcagaaatgtcattacgctgacaggcatagcagacggatggtgacaggcctcaaagtcaatgagtttgtgaacctggatcgcaaattcattcggaatatccggtctacgctgtactcaatagaaaagtttggtatcgctaaagcgactgatgagttcatcagcaagcacgccgggaaaggaacacttcatgcccacttacgcggtgagattgagtggcacggccacattagggggagaagtgaccccgtgttccgtaaaaatgccgatcgctttaacttgctcttcaaacctaagatcctggtggagcctacatacgaggagatccgtaagttcgccgtctggatcgttgataacaatactgcatgtgatcaggggacatgttttttcgtacatgacatcggcctaatcaccgccgctcactgcgtggaaggagctaccgacatagacgtctacaatccgctgaaccctacgcagaagtacaaggctaatgttcaaaaaatcgacaaacacctggacttagcaattctgtctcactccattcccacatcacagtacaggaacattaaaatcagcaaggtcagagccagtgtgggacaaagtatcattgctgcagggtatcctgattatggcccgggggacagtctgtcgatcagaactggcaccgtgtgctctctgtcaatgaaatccggtgtaggccgagtggaagtgacacagaagttgtcgagcggaatgtctggaggccccctcattgaccgcgacaattgcgtgtttggggtgatccataagggcggttctaccgaggagaaagacatcgcggttgaaatttctgaattaacgaagctggttcatgcatga

SEQ ID NO: 7608 - RNA, 1692 nt, unidentified
  source 1..1692: mol_type = other RNA; note = synthetic construct
atgaacggtggggaacacctcgtaccgagtgggtcctatatctttgggagcgggaagccacgaatagggatccccgatgagctgaccaccctgtctaaaatgttggattacctgggcatttccgacaaggaattgctgaaaatccgtttatctaggtcattcatgtactccgagtttacaataccatcccccaagaaagcccgcctgatttcagccccagacgctcggctgaagtttctacagggaaggcttaagagctctttcgaaaagttttaccgcccccgccttagtactcacggtttcgtgtccggacgtagtattattaccaatgcggccattcacgctcgaaagagacatgtgctcagcctcgatctgaaagccttctttccctccataaccgagaatagagtcagaggactgtttcggaacctaggcttcgcaacggacgtgtgtgatgcaattactactatatgttgtcatgctggatatcttccacaaggagctcctacttctccgattatttcaaacctgatctgtttcagcctagatcgcgacttgcattcgtttgcaaaaaagcaaaatctggtgttcactaggtacgccgatgacatttcaatctcaacaaacgggacaccagccggacttttttccgcaacagtcccctctccaggaaagctggacattagtgccttgtcggtcgatttgatcgacgtcgtagttaagaatggattcttcctcaacgaagagaagatcagattcagcagcggctctcaccgaaaaatcgttaccgggctgatcgtcaacgaattccccaatgtgcctcgcacatacatctccaatattagggctattctctttagcatcatgaaagatggctatgcagtcgcagaagccaaatttcgacagaagcggccctctgcgaaacgctccctggagcagtatctccggggcaaattaaaccatctggctaatgttcggggcaaaggtgaccctatctacagatcactcgcagacaagttcaataaagagtttctacctagtctggcaacagaaccaaccccaagggaacggcagagcagcggtatctggattattgaatggcagtataatgaccgtaagatcgataagttgtacggggaggcggaggccaacggacaaggcataatgtccgtcactgaaggtgctcaggggacggcctttttcctggacggtgtgggccttgtatccgctgagcattgcgctccccctgaggagatcgatttagagtttttccgggtatttcaccccagcgcacctaacctcaaattcgaggtgaaggtggcgaagaggtgcaaagtgcgcgacatctgcatcctgaagcacgatgtgcctgagaataaatttgagggcttaaagccgtgccgagtccctgctagaggaggcgacgtggttagagccttcgggttcacggactatcaggtgggcgacgccgtaaccacaagcaggggagaagtgagtcacgtggccacccggtctggggtgaaactgcttaacctgagcttcaagatcggccagggcatgagtggcggtcccataatggataggatggaaagggttgttggcgtcgttcacaagggcgggcctctcgagttgagagattacgccgtgacccttaacgccgtgctctcactgcatgaggaagcctctctgtga

SEQ ID NO: 7609 - RNA, 1608 nt, unidentified
  source 1..1608: mol_type = other RNA; note = synthetic construct
atgctctgcataggtcgggaaggagggggagcaccattcacaatgcctaccttgcccaaggccctcggtagcgccaatgacttttatgcttatctaggtgtcggcgctggcgaacgaaaatttttggaaaagcacgccttccataggtataagcgcgtgattgtgccgaaacggagaggaggcacgcgagtacttatggtccctgatcggcggttaaagttcctccagaggaaggcccaccaactgttaaatcagctttaccgcccgaggaccccagtccatggcttcgtgaaacagaagggagctatctccaacgcaaatgaacaccagagaaggccttatctgttcaacatcgacctccgcaactttttcggtgtgatttctagacgacgggtgctgggcatgctgatctccatggggcttcctgatgatgctgccgaggccgtgtgtagcgtctgcttgacagccaatcagctgccccagggggcaccaacttcaccgatcttgtctaacctggtcgcctaccgtctcgaccgagacttaatgaagttcgccaagacttacaggctgaaatacacaagatacgccgacgatattagctttagctcttacgctcctccgctcgctttatttaatgcaggactcccaatcccaggcagagtgaaaagcgatcaacttagtgtcgagctgtccacggtgctcgctaccaatgggtttgagatagcacctgacaaagtttggttcgccggaccaaagtcgcgcaaggaagtgaccgggcttgttgtaaatgagtttacgaacctaaaacggtcattcgtgcggaacgtgcgcgcagctctgtacaagaccgaaaaattgggccttgctgcggcccagtctgcataccagaaaaagtatactactaacgccaccttggagcaggtactgcgcggaagactagagtggatagcgcaagttcgcggtcgcagctttgatccctataggactcttgcaaagagatttaacaacctctttcccaactccccactccctatcctgcccacccatgaggagacagccgaacgtgccgtgtgggttgtcgagttcttcgcggatgaggataactgcgcacagggcactgccttctttctggcgggggttgggctggttactgcccaccacgtgcttgagaagctgccccctggcgcgcatgctgacttgtatcgtccctccggaggcggaaataagttcaaagcaacccccagcaagagatcttgtcctattagagatctgatgatcctcgagcacgatgtgcccaccacagactacctgtccctgccagtggtcacaagtcccgaacagcgagatgacaaaatcgtcgcactgggctttccagactatgggcccggggaccaactaagtaggaggggcggacaaatttacggccgggctacaaaacacggcgttaagttactcgaggtgagtgctattctgtcagatggaatctcgggtgggcctgtggtgaatgaccagcatcaggtaattggcatcgctaaaaaagggggtatagaagaaaggaagcagctggccgtagaggtttcagaactgctgaagctggccgacgagtga

SEQ ID NO: 7610 - RNA, 1455 nt, unidentified
  source 1..1455: mol_type = other RNA; note = synthetic construct
atgctgtctgacactgcctattttacctatctgggtgtaggagcaaaggagcggcagttcctggagaagcacgctttctaccgatattcagaagccaccataccaaagcgacgggggggaaccagaacactcctcgtgcccgaacgacggctaaagttcctccagcgccgtactcatttgctgctgacacagttatattccccccgcgctccagttcacgggttcgttgcccacagaggagcaattacaaacgctaacgcccatcaatcacgtccataccttttgaacattgacctccggaactattttggcaccataactcggaggcgagtgctgggcatgcttcagagcatgggtctggacgaggccgtcgcccttgcagtctgttctatttgtatgactcggaatcagctgccacaaggtgcgcctactagcccagtgctgtctaatcttatcgcgtacagtctggatagagatctgatgaaattcgccaaagactataggttcagatacacgaggtacgctgacgacatctctctgtcatcctatgctccgccggtcgccctcttcgagcaaggagtgccaccccccggaaaaatgacagttgaacagctgtccgcttcactgaggagcgtgattacttcaaacgggtttgagattgcgccagaaaaaatctggttcgccggccctaaaagccgcaaggaggtgaccgggctcgtggtgaacgagttcaccaatctgaaacgcacgttcgtgcgcgatctgagggccgcacttcataaggtcgagacgatgggcggtgcagcagcagagaaggacttccaggccagatacaaaacaaccgcttctcttgaaaagattctccgcggcaggttggaatggatcgcccaggtaagaggacgcagcttctcggcctacaggaccttggcgaagagatttaatcaacagtttcccgctagcgcggtgaccatcttacctacttatgctgaaatcgccgagcatgcagtatgggtgattgacttttttaatggcacagtttgcgagcaggggactgccttttttctggagggggtgggcctagtgacagctgatcatgtcttgcagaacctccccgtaggagtcagcgccgaaatctaccgcccatccgggggaggcaagaaatttaaggccacacccagttcccgtaggtgcccttacagagatctggcaattgttgatcacgatataccgaccggcggttacctatccagacctgtgacatccagtcctgagcggcgggacgatgatattatcgccatgggctttcctaattacggccccggggaccagttaagcaaacggcgaggtcacatcattggaagtgctaccaagcacggcgttaagttcatcgaagtcagtgcaatgttgcccgggggaatctctgggggccctatcctcatgatcgctataaggtga

SEQ ID NO: 7611 - RNA, 1581 nt, unidentified
  source 1..1581: mol_type = other RNA; note = synthetic construct
atgccaaccgtgcccgctgaactcaaaacggctaacgccctcttcgcacacttaggggttgggtccgccgaacggaagttcctggaacaccacgctttttacagatacactgaggtggccatcccgaagagaagaaaaggcgagcgcaaactgctggttccagagaggaggctcaagttcttgcagcgcgagatgcttaagctgctgtctcagctgtacgtaccccgggaccctgtccatggattcgttgtgggcaggggtgcgctgacgaatgcttccgcccacgaaaaaagaccttatctcctgaacatcgatctgaagaatttttttggagtcatcgcccggagacgggttcgtggaatgcttttgtcattccatcttgaggaggaaatagctgaggcaatatgtgacatttgtactaccaggaatcagctgccacaaggcgcccctacatctcctatgttgagtaatatgatcgcataccgattggaccgggatcttatcaacttctctaagacccacaggctgcggtatactcggtacgcagatgacatctccctgtttagttatacccccccaatggggttattcaatgccgggttacccaactcaggaagggtggccgaagagcagctcagcacaggtctgcgttcagtcttctcgaccaatgggttcgagacagcgcctgaaaaaatttggtatagcggaccagacttccgtaaggaagtaacaggtctgattgtaaatgagttcccgaatgtgaaacgcacattcgtcagaaacctgagaagctcactatacaaggctgagactatgggcatctccgctgccgagaaagattatcaaaagcgatacgggacaacagcctctctgcagcaggtactccgcggcagactagaatggattgcacaggtccgaggccggagttttggcgcctataggactctcgcaaagcgatttaacgcaatatttccagcgagtcccattgctgtgcttccgacctatgatgaggtggcggaacaggctatctgggtcatcgacttttgcgaggacgtggcaggcaagcctgagcccacttgcgcacagggcactgcattttttatagcgaacattggtctggtgaccgcccaccatgtgctcgctgatctccccccaggctacagcgccgtccttcacaggcctagcttaccaggcaagaaattcaaagccacgccaaccaagcgccagtgcccttaccgcgacctgatgattctggaacataacgtgcccgccaccgactacttgtctttatcagccgccacctctcccgagagaaggaacgctcccatcgtggccctagggtttccgagttttaacgctggagatgaactagggacacgcagcggactggtggtggggaatgccacccgacacggggtgaaaatgctcgaggtgtccgcactcttgttgagcggcatctccggaggtcctattgtcaacgatcgcgcccaagttgttgccgtggcacataaaggtggatatgaagaaaataagcaactgggcgtcatcgtttccgagctgattgctcttgctaacgagtga

SEQ ID NO: 7612 - RNA, 1557 nt, unidentified
  source 1..1557: mol_type = other RNA; note = synthetic construct
atggcggctcttcctccccaactaacctcagttgcagcccttcatgcgtatcttggagtgggagccggggaagcacgattcctttctcgttatgcgcaccaccggtatcgggcagtgaatatcccaaagcggaggggcggcttccgaaacctgctggtacctgaggataggctgaaattcctccagcgtaagatgctggagctcctcgaaccccggtataagcctcggcctgccgctcatggttttgtagttggccggagtgcaatcacaaatgccaattctcaccaagccagaccgtacctgctcaatctggacctggagaactactttggaaacattacccgcaaccgggttcatggcatgctgcaggctattggattcgccccggaagtggcaagagccatctgccatatctgtatagtgaacaatcagctgccacagggtgctcccaccagccctctattggctaacatggtcagcttcaggctggataaggacttgactcagttcagcaaggctaatagaattagatatacacggtatgccgacgacataacattttcctcgtacgtgcgaccagtggcactgtttagcgagcccttacaggaggcaggcgctctctccgttgaggggctcagtaaggagctgcgactgataatctcaagcaacaactttacaatcaacccagtcaagactcgctacgcggaccgcaaaagcaggaaagaggttactgggctgattgtcaacgagtttaccaacgtgcggagaactttcatcagggatctccgcgcttcactgtacaaaatcgataaattgggactaagtgccgcccaaacttcttacaatgagaagtatggatccgacgccttgctaaaggatgtgcttagagggcgcctggaatggttagcccaggtaagatctaggtctttctatacgtatcgtaccttggcccagaggtacaacaagcattttcctgataatccagcccccattgatccaacaaatgaggaagtcgccaaatccgccatctttgtgatcgaacacttcgatggggacggcgcccaaggcacagctttcttactcgacggggtcggacttgtgaccgccttccacaccctcgacggaatggtaagcgagtgggctgatttgtaccgacctcacgagcccacgaagaagtttagggcgaaagtggggggtaagttctgcaaacacagagacatcgcactgcttgaacacgatattccggcagaagaccaggcttcattgcgccccgcaacaggcgccgagcatgtcaagtcttccatcattgcactcggctacccagaatttgcttcaggtgacggactgagtgaaagaactggtaagatagtggggcgctccacgaaaagtgccgtcaggtacgtcgaggtcgatgccattctgggtgacggcttatccggcggccccatcgtgaatgatcgctacgaggtgattgctctgacccacaaaggggggctcctggaaagcaaacagctgggcgtggacatagtggagattaccaaagttgctgaagcatga

SEQ ID NO: 7613 - RNA, 1554 nt, unidentified
  source 1..1554: mol_type = other RNA; note = synthetic construct
atgccaaccctgcccccagaactgatgaccgttcctgctctgtacgcaaagttgggcatcgggggcgcagaggcaaagtttttggctcactatgtcagacatcgctacagggctagccagatccccaaacgtagggggggctatcggacattactggctcctgataatagactgaagtttcatcagcgggagctgctggatttgttgacacccctgtaccgccctaagcctgccgtccacggtttcgtcgcagagcgctccccaatcaccaatgcgaacgcccatcagggaagaccctacctcctgaacctggacatttccaattacttcggcgtaataacaaggaacagagtgcgcggggtgctgattgcagtaggtatgcccgcagctgtggctgacgccgtgtgtaacctcaccgtggtggacaaccagcttccacagggtgcacctacctccccgctcctggcaaacatggtgacgtttaggcttgatcgtgaccttactagctttgccaagacacacagactgcggtacacaaggtacgcggacgacctgacctttagcagctacgttcgacccactgcacttttcgctgaggccgaaccagcaccgggactcattgatatcgccgaactagcccccgtgctatctggcttgattacgggaaataacttcaatcttaacccagtgaaagcccgctactgcgtcagtaaaacccggaaacaagtgaccgggctcgtggttaacgagttcactaatataagacgggattttctgaggaacgtaagatcaagtctctatcgtatggagacactcggcgtggccgatgcagaggcagaataccagtccaagtacgatcccaaagccaaactgcacagcgtggtccgcggcaggctggaatggattgcccaggttcggggcaggtcgttcgagccttatagaatcctggctgggcgattcaatgccttgtatcctgccgccactccattaccaattaaccccactaacgacgagcttttggctaaggccgtatttgtgatcgactatggcaaaggcaagaatatggctcaggggaccgctttctttttagagggagcgggactcgtcacagcgcaccatgtcctggctaaaatgcagtctggatctgccactctataccgagccgatgagcctacaaaaaagtataaggcgcggttctctgcccgcgtttgctctcatcgagatttagccatactggaccacgacgttccagtgtcagagcagacgtttctcaagcaagcggccggaatcgaccggattaagagcaccgtaaccgtcgtcggctatccggaattcggcccgggagatagtcttgttcaaatggaaggaaggatcgtaggtcgcaatactaagtcagctgtgcgatatgtgcaggtggatatgcaggttggtgatgggctatccggggcccccatcatcaatgacagatatgaagtggtggctgtcggccacaaagggggtccttcagagagtaagcaactgggaatagacgtggccgaagtccacgggctctga

SEQ ID NO: 7614 - RNA, 1704 nt, unidentified
  source 1..1704: mol_type = other RNA; note = synthetic construct
atgacacgtagggtgaatgccacatttgaccgaatgctgccacaggatgtggccgtagcattcggcgggttgcccgcaattagaaggcgtcgccgccttagtttcatgagacatattcctcagcagctcgcctccgaatctgaactgttggtacatcttggcgtgggtgctgaagagctcgccttcctgaggcgctggacaggatttaaataccggactgtcaagatctcgaaaaggagcggcggagaaaggacgctgctgatccccgacgatcgactgaaatttctccagaagaagatcctagggatactgctgaatctgtacagaccccgcgctccggttcatggattcaccaaagatcgcagtgcgttgacgaacgctaaagcacacgaggggcggcgctttctgttgaacctcgatcttaaggactactttgcttctgtgtccagaaacagagtagtgggacttcttgagaagctgggtattgacgctgccgtggctgacgtcattgcagcattttgcatcttccgcgaccaattaccacagggcgctccaacatcacccatcctcgcaaacatggtgacattccgaatggatcgagagctcatggagtttggccagaagcatcatctcaagtacactcggtacgccgacgatctaacgttcagtagctatcggccgcccaccctgctgttcaaagacggcctacccaaagagggcaagatcacagagaaagctttaagcgatgagatcaggctgataattaattctaacgggttcgacctaaattctgacaaaatttggttctccgcgacccgttcccggaaagaggtcactgggattatcgtaaaccagttccctaatgtgaagaggagcttcattcgagagttgagggttcttctccacaaggccgagactctgggcctgccccagacagaaaaggactatcaaagttttagcggaaaaaacgctcctctggaacaggttctgagaggacgtctcgagtggattagccaaattagaggtagagatttcccgtgttaccagatactcgccacccggttcaatgcgctctatgccaagaagcctttaaggcttccaccaagccaggaggacgtcttgcagaagtcgatatgggtgatcgaatatcacccaaaagaatctgaaaaacgggaatgtctgatcgatatacagggcacctgcttttttctgaagcaggtgggtctagtgaccgctcaccacgtcgtttcagagctgccaaagggaacccggttttccgtgtttaggcctactcacagctggcaaaagtatgaggcttggtcatccgagatcacctgccagtaccgggatctggccatcctgcaccacaatatcccacctcacgccttcctcgagcttgaagcggccaatagtcaagcggtcgatcagactcggatcaaagccctgggatttcccaactttgggcccggggacactttggcacgcatccctggcgaagtgattagaactctgaccaaatctgcagtgaagcaaattgaggtgaccgccgccttaccttctggcatctccggcggacctattatcgatgcagcacagctccgcgttctggcagttgccgtcaaggggggtgccaccgaagacagacaagtcgctgtggccatatcagaattacagacattgttcaaggagcatcccgggtcatga

SEQ ID NO: 7615 - RNA, 1581 nt, unidentified
  source 1..1581: mol_type = other RNA; note = synthetic construct
atgccttataatccgtttgtggtgcatagaaagcccaaggtgcctgaagggcttagaaccttgcctgttttcctatccgacctgggcgtctcagagtctgagcttcgtctgatctccgctaaaaaagtggagcagtaccatctcgtttccgtgcggaagaggtctggaggcatgcgcaccctcagtgtccctaacgaaagattaaagtacatccagaagcacacagcaagccttctagccccgttgtaccagccaaggtggtgtgtgcagggcttcgtgaaaggaaggtctgccttgcagaatgcccagaggcatcttggcagaaaacacctggtgaaggtggatctgaaggattatttcaaccaggtaaccgtctcgagggcaaagggggttctgaggtattttgagctcgacgccggtgttattgacgctatcctgaccttttgcacgctgttcggtaaactgccgcaaggagcgccctccagccccttactggccaacatggtaacttttagcttggatcaggaactggttcggtacgctaggacgaatcggcttaagtacacacggtatgcagacgacatagtgttaagctctttctccaagcccagactgctcagaccctccgtgactgccgattattgcaaattaacaatagaggacgtgcaggaggactttgcgaaaattttcagcaaccaggggttcgaactgaacgaggaaaagatgcgatattgcggccaacgcgcatctcgaaccgtcaccggttacactatcaacgagtttgctaatgtccctagggagcacattcgcagaatcagaagtattctaaacgacatcgagaagcgcggttacccactagctcaacggcggttttcggaaacaacacactcaataaaaagcctgaaggctagtttaaaagggcgtctgaattgggtcagttcaacgaaaggcgtgtcagatccagtataccgacgtctggccctgcgcttcaatggcctgtttcctgacgactgtcttgagattgggccagactattccaagctcgcccagctgagcacttgggtgatcgaggcagaacgaaagactaatggcgttccagaagcccagggcaccgctttctttctcaaaggggtgggactggtgtccgcagcgcactgtttgcccggagggtgcaattactcagtcttcaacatcgataatccctctaagacttaccccgcaactatcgctaagacccataaccatattgatctcgccattcttgatcattccatacctgccgaatcttacctcgcgctggagctgagtgatcggcaagccaacctcggcgaagaggtgttctcctggggatatcccgaacacggacctggaaaacgcattacacaaaaaagcggccgcgtcagcagtaaaccacgggtatctggagttgacatgtacgcagtagatatgaagctgtatcagggcacaagtggcgggccaattttgaactcaagctcagccgtgatcggtgtcacccacaagggaggtcacggggaggcccatgatctcgctatcctcatcaaacacctgaaggacttgtga

SEQ ID NO: 7616 - RNA, 936 nt, unidentified
  source 1..936: mol_type = other RNA; note = synthetic construct
atgcctacggctatctcggtggcctttgggaaaacccccacaccccccgtcgaatttagtagcatggcagccctgaaaactcatctcaaaatttccgacaaggagcttttggtgatacgcaagcatagatccaagatgtatagccacttcataattcccaagaaaagtggcggcgtcagattcatcgacgctccgaagccccgtctgctatacctgcagagacgcctacttgaagtgcttgtgaagatgcataaaccgaggaacccagtgcacggtttcgttaggaagcgctcggcaatcaccaacgcagaagagcacctgaatcggaaacatgtaatgaacatcgatctgaaggactttttcccaactataacccaggaccgtgtttcttcactgctcagaatcttggggattccatccgatgttcgagcggctatcctcagcatttgctgcgcgaacggaaggcttccacaaggcgccccaactagtccagtatttagcaacatgatttgtcttaggatggacaggcagctgatgggattttgtaaaacccggcgaatcaagtactctcgatatgccgatgatctcactttctcactgtacacagcacctcaccagttattcagtgaatcagttccttctcctggcaagctggccagcagccaaatatcaagggagctcaagagcatcatcctggataatggtttcgtcctcaatgaagacaaattacgctattttgggccctcctccagaaaagaggtgacggggctgattgtctctgacttcgtgaatgtgccccggaaattcgtccggaatattcgcgccacaatttttgatatcgagaagaatggcttccctgccgctcagatcaaattttccaccctgtaccggaagacaaaccctttgtctgagcacttgagaggaaagattgtgtga

SEQ ID NO: 7617 - RNA, 1650 nt, unidentified
  source 1..1650: mol_type = other RNA; note = synthetic construct
atggacataggatccctgagatgcgcctatgactacgataagctgggtaccctcttcggggtacctggagccgcactcaaaaagaatctctatagcagccgggggtacactgatttcacaatccctaaaaagtcaggcggagtccgccttatctcagcaccagggagactgcgcaaacagctgcagagaaagctgctccccgtactggatgacgtgtacaaaatgggccccgccgttcatgggttcgccaaaggccggtccgtgcgcactaacgccttaccgcatgagagcaagggcctggtgatcaattttgatctgaaggacttctttccttctattagtttccagaggattaggggcgtctttctagggcacccttttcgactggactggacagtggctaatatcctcgcacagatgtgttcccttgacggcgtaatgcccgccggagctcccacttcaccagttctgagtaacatcatatgcgcgaagctggataaacgtcttagtgccctcgctgcaagactagggggtacgtacaccagatatgctgatgacctgaccttctcgtttgacagacccctggccaaattgtctagcattgctatgatcgatgaggaaggtaagcccgccgtgggggcttcggtaagcgaaatcgtgacctccgaagggttcgccatcaatgtggagaaattcaggatagctgccaaagggtcacgtaaagccgtcaccggactggtggtaaatgagcgggtgaacgtgaagaggtcctggtatttaaaactagagtcagccatttatgctgtcgaaaagttcggtctgaaccctgttgccgccaagatgttcccacaagaagaggtgccaggagtcgcacctgccaggttgttgcgccagctgcacggcaagatttcctacctccggatgatccgcggaaagggtgattggctggccgcagagatggcccatcgattcaatacactgcacgggaacgtgaggttgagggtgcctagcgtggagatgatatctaacccaaaccgacaggtgcggggcgtccatatcgtcgttgcatatgccgccgcagttccagttttcgaccccactgaagaacaaggcaccgcttttacgaccccatccgggctgttagtgactgcagctcacgtgctcgagcatgaagacacaaagacccttctaccatttgtttacgtaatgaacgagcgcaaactttctcttgtcgcttgtgatgtgttagcggtggattgggatcgggacattgcaatcttgcgcgtgcgtgacgacaaaaatagagtctctgcagaacgaagtagatatggcttgggccaggaccctcaccagggtgagactttgattagcatcggctaccccgactacgcaaggggacagcacggctctgcgtttgagacacccgtcacaaaactgtttaagattaaggttcctggtggccaggagattctcaaggctcgagtgggcggaccaatccaaggaggaatgagtggcgggccggctattgattccaactttgatgtgcggggggtgatccttaagggagtcgcgaatcccggaggtgtgccggagattatagcgatcagcgaagtcaggcgggttgctcaagccaatggcctgaacctctga

SEQ ID NO: 7618 - RNA, 1653 nt, unidentified
  source 1..1653: mol_type = other RNA; note = synthetic construct
atggacatcgagagcctacgttgcgtgcactcctatgactcacttggagccctcttcggcgttcccggtagtaccttgaagaacaatttgtacaaatcccgcggttacacggatttcacaattccaaaaaaaagtggcggcgtgaggcttatcagcgccccaggaagactgcggaaaaagctgcaacacaagctgctcccagtattgtattcggcttacaaaatgggccctaacgtgcacgggttcgccaaaggaagaaacgtacgaactaacgctctcccccatgcgactaggaaggttgtgataaatttcgacctgaaagatttcttcagcagcatctcttttcaacgtatacgtggcgtgtttcttggtacccccctcagacttgactggtccgtcgccaatatcctggcacagatttgttccctcgatggagtgatgcccgctggagctcctacgtctccggttctttcaaacattatttgcgcaaagcttgacaagcggttgtctgccttagcagcccgcttgggagggtcttacactcggtacgcggacgatcttaccttctccttcgaccgcccgttaacccaactgcggagcgtcgccatcctggatgacgaaggtaaacccctggtgggcgcctcgatctcagagattgtgacatcagaaggcttttccattaatatggagaagctgcgcattgccacgaaaggatctcggaagaccgtcacaggtcttgtggtcaacgagaaggttaacgtgaagaggccatggtattttgcactcgagagcacaatctatgccatggagaaattcggagtcgatgaagtagcagctcagaagttccccgaagagaagacccctggagtggcacctgctcgcctcctaagacagattcatgggaaagtttcttacctgtccatggtgcgcgggaaaggggattggttggcctcagatatagcccataggtttaataagctgcacgaaacactgcagttacgcgtccctagcgttgagctgatctcacagctggttcgaagagcacggggggtgcatatcgtgaacgccagtactgaccctctgtttgtcttcgacctcggccagagtcagggtacagcatttactacctcaagcggaattatggtgacagccgcgcacgttgtggagcgagatgacaccaagacaatcttgccctttgtgtatgtaatgaacgagcgaaggctggccctcgtcatatgtgacgtcatagccatcgactggaatcgagacatcgctctgctgagggtgaggaatgacaagcacagactcgacctggaacggtctaggtaccgtctaggcagagatcctaatcaaggcgataacctggtcactgtaggctatccggattacacccggggggagcatgctaccgctgtcaatagccccgtaaccagagtctttaagaataaggctactagtggagcgcacgacatcagaaaggctagggtggatgggccaattcagtctgggatgagcgggggcccagcactggattccaaatttgaagttcgcggcgtcgtgcacaaaggcgtgttaaacccaggcggggtggcggagattatcgctatctccgaagtgctccgggttgcacaggccaacggtctgagtgtgtga

SEQ ID NO: 7619 - RNA, 1557 nt, unidentified
  source 1..1557: mol_type = other RNA; note = synthetic construct
atggggatcagggcattgcgtttcccaaggaatcccggtggagtgagagccatttcggcccctggcagattgagaaaaacgctgcagagacaactgctccccgtactctatgacgcgtataagatgggacccaacgtacatggattcgcacgtgggcgctctgtcaggactaacgcacaaccccacgccgctcgcaacgtcgtgatcaacttcgacctgaaggactttttcccttccatttcattccagcggatccgcggggtgtttttagccaacccgatgcggttagattggtccgtggccaacattttggcacagatgtgcagcctcgacggtgtaatgcccgcaggagctcccacatctccggtgctatcaaacatcatatgcgccaagctcgataagaggcttagcgctttggctgcacggctgggaggctcctacacaaggtacgctgatgacttgacttttagtttcgaccgacctttagcacagctgcgctccattgccatgctcgatgaagagggaaaagctgtcgtaggcgcttcgattagtgagattgtcaaatccgaaggcttctctatcaatatggacaagtttcggatcagcgttaaaggttctagaaagaccgtgaccggtctagtcgtcaatgagaaggttaacgtgaaacgaagctggtacctgaagttggagagcaccatctatgccatggataaattcggcatcccagctgtcgccgcccaggtgtttccagatgagaaaatcccagctgttgcatcagccaagctgctgagacagatccacgggaaagtttcctatctgtcaatgatacgcggcaaaggtgactggcttgccgccgatattgctcaccggtttaatggcctgcacggcgaggcccagcttagggttccaagcgttgaactgatctctcaagctggcaggagagccaggggggtgcatattgtgaacgcctctaccgaggaactgctggtgttcgaccttgcagcgagtcagggaacggcatttacaatccctagcggcctgatggtgactgcggctcacgtagtagagaaggatgacactaaaaccgtgctgccgcacgtctacatcatgaatgagcggcgaaaagccctggcggcctgtgatgtgctggcagtggactgggacagagatatcgcaatacttcgagttaatgatgaaaagcaccgcctcgacctggagagatcacggtataagcttggcttagaccctgctcagggtgatcatctggtcacagtcggctaccctgattacaccctaggtgagagggccacagcggtgaattcccccgtgagtcgaatttttaagtccaaggccgcaactcatggggccccagacgtgaataaagcccgcgttgacgggcccatacaaggagggatgtctggcgggcctgcgctcgatagcaagttcgaagtgcggggggtgatacacaagggagtcctcaacccaggaggcgtggctgaaattattgctgtgagtgaagtgcgccgtgttgccctcacccatgggctcaaggtctga

SEQ ID NO: 7620 - RNA, 1623 nt, unidentified
  source 1..1623: mol_type = other RNA; note = synthetic construct
atgctaactatcaagaacttacagggcgttcattcttatggggcactggctcctttattcagtgtcacacctgcggccttgaaggcccagctgtattcagctaaaggatacagttcattcaacatccccaagaaatctggggggttccggcttattcacgctcccacgaaaattcgcaagcagcttcagcgggccctgcttcctgtgctgaacgaggcatataaagccccttccttcgtgcatggcttcgtcgacaagcggagcgtcaggagcaatgcccagccccatgtacaggctcgcaccgtggtgaatgtcgatctggccgacttcttccagtctatctctttcaaaagaattcgaggggtatttctggcgccaccattccgatttgattggactatttctaacatcctagcccagatatgctgttatggcggtgctctgccagccggtggtgtgacaagtcctaccttgtccaacatgatctgtgcacgtatggacaagaaattagtcaggctgtcaagaaggttggggggcgagtactcaaggtatgctgatgacctgacatttagctttcggaggcctttggcccaactttcctcaattgtggctgtcgacgcatcggggaattacctcccaggagctgccctgttggagatcttcaatgccgaaggcttttcgctcaatccggtgaagtttagagttgcaactggcgccgctcggaagctcgtgactggagtagtcgtgaaccataggacaaacgttccccgtaaatggctcagagccctggagtccaaaatctacgctattacccgatttggtgtcggggctatcgccgcccaggaattcccagatgttgcccccgaaagcgcaagatatcggcttctaaggcagttgcacgggcgaatatcctacctgcgtatgatcaggggagcaggggactgggttgcaagcgacctggcctacaggtttaacaaggcccacggcgagaatcaactcagagtgccctgcacagagctgatatctaacccccagcgggttccgagaggagtgtgggtcctcggctgtagtgcatccactatgcatttctttgatcctcaaaatcaggggacggcctttgtgacctccagcggcctcttagttaccgcggcccacgtactgctgctggacagtggcgatgtggcgggctacatttatatcatcaatgagcgcgcaaagaaactgcgccgctgtgaactgcttgccattgacgtggaggccgacgtggccatcctgaaagctagcgagcacaatctcgaagtagaacgatctcgcttttctttgggcaacgatccgcagtcccaagatagcgttgtagcggtgggatacagtgattacggatctggtgacaccgctaccatgctccaggctagcgtgcagaaggtgttcaagttcaactccatcaagaaagctcaagtgggcgcatttattagcggtggtatgagcggagggccagttgtcgatagtgcgtgcagagtgcggggactcgtgcacaagggagtgtcctccgctgcaggcgtctcggaaatcatatgcgtcgaggcaataattcgcgtggccgtgtcaaatagcctgtcactttga

SEQ ID NO: 7621 - RNA, 1605 nt, unidentified
  source 1..1605: mol_type = other RNA; note = synthetic construct
tccgcccacacccatgagtctctcgcagcagctctgggtttagcgcctgcgggaatgttgaaagccctctataagagaaaggggtacacggtgtggctgatcccaaaaaaaaacggccagcaccgtaccattgctagcccatcgaggcttcggaggcacatacaaattcagctcaaggccgtgctggagcaggtttacaaacccgacgctagtgttcacggctttctgcagggccactctatcgtgacaaatgccaaacctcatgtccgccgccgcacaatcataaacttggacattaaggactgtttcgggtctatctccttttttcgtgtgaggggcttgctcctcaaagcgcctttcaatctgccctgggtgaccgccaatatactggctcaagccaccacattcgaaaatgcattgccacctggaggcatcacgagccccattcttgcgaatattgtgatggccggacttgataagcgcctgagccggatgatgattagatatggaggccgatacaccagatatgccgatgatcttacattttcttttccggcaccccctggacgcttgggcgaatttgtggaaaagtccgccgtcgggaattaccaaatcgcgccaaaactgagcgctgtactgaaagaggaaggattcgaatcaaaccagctgaagttccgatgcctgactggcgcctcttcaaagcgagtgactggcctcaaagtcagcgataaggtcaatttacccaggcggtggattagagagctggactgtaaaatctatgcaatggagaaattcggggtgaacgcagtggctgctgctgatcacccagattccccagttgaggctgcaaaggccaggctactccgccacatacatggtaagattgctttcgccagcatggtgcgaggacgggccgattttatcactgcagccatggcaaaccggctcaatcagctgcatgaacggagtgacctgtatctaagtgacatcgaaatcatttcgaggggtgaccgagcctcaagagccgtttgggtggtaactgctgcccccgagggggaagaccactacttcgcccctgagggaaacgggactgccttttgcataagggggggccttttagtcaccgccgctcatgttattgaagatcatgaggggaagaccaaggctccataccctgtagtgtgtgtgaggagagccgaccaacccggtacctatctgggttgcaatgtaatcgcattcgaccgggaccgggacttggcagtcctccagcttcttgtcccgcgcccagatctgaccagattccagtttgcgttaggcaaggtacctgtcacagatgagtccatgacttcaattggatttcccaactacgttgtgggcaaccgctccgctacagaagtgcacgtggttcaggatgtcagaccgcggtacggggtcctcaggatcagagctacgggtaacattatggggggagcaagtggcgggcccttgctgaataaaaagttcgaggtggccggcatcacacataagggactgctaatgaagtgggaggcaaacgagttcatcagcgtgggtgagctgcgtactgttctgaacgaaatcaaatga

SEQ ID NO: 7622 - RNA, 1629 nt, unidentified
  source 1..1629: mol_type = other RNA; note = synthetic construct
atggttgacattactttagtaccgcctaggcagagcttgcgggatattactacgacccgcgagttagctgccttgatgggggtgagttactctcgggaattcgcttacattctgtataggtttcccccaactggaagataccgcagctttaacattgcaaaaaaatccggcggagacagacagattaatgctccaattcgcctcctgaagaagctgcagaggaggctggtaccgctgctggcagagatctatgatgccccaccctgcgttagaggattccaggggggtcagtcaatcctgactaatgcgagcgaccacgtgggacagcgatacgtcctgaacttagatcttaatgatttcttccccagcatccacttcaaaagagtttccggcattctgcagaccaggagatacagcctgagtcgggatgtggctgtcgctatcgcccaaatcgcttgtcatggggggcaactccccataggcgctcctacatccggcatcctggctaacatggtctgcggacccctggactcaagcctcctgcgcttggccaaagcccataaactccgctatacacgctatgccgatgacattaccttctccacgagtaacagccggcacttaaatgaggccacagggatacatgtcggtgatagatttgtgatacgaggcacagaggaactgtccgactcgtttcacgccctgttcacacagaatggcttctcgctgaatccgaataaggcagtcttgatgtcaaggagagtgagacaatccgtcaccgggctcactgttaatagaaagaccaacgtgagtaaggagttttatcggaatctcaaaagcagtattaacgctatcgagaactacggctacgaggcagcgcagtcagtatatatcgatcgtttccgaaagcccaatgagtctctccagcttagggaaaacttgcttggccgcctggcctttctgggacacgtgctaaactactccgagcgctacaacaaacttgcccggaggacagcgcggctttttgaggagcggtctatcccacgccctcgagatgaccgggaaaaggccatatacgtgttgactaatgagcaggacctgatgatgggcaccgcctttcacaccggaggcggaaagttcttgacagctgcacacattttcgcagatcggcctggggtgctacgctgtgaactcgcctgcccacctcattatcctgaacagatcaccgcggtggtttctcatatcgatcgtgaaagggacatcgccctggttagagctacgggaacttttgatctttcccgtcactctattcctacggacggtaagtccgtgaggattggggacgatgtatttgcgtgtggctttccacaatatgaagacggtaacagcatctcaaccatctctactcgaattaccgccgaacgatacatctcagggaaccaacgtctcgaggtcgacaggccactcagtcacggctctagtggagggcccgtgttctccagggacggtttccttgtgggtcagataaacaccggccccagaataggcgaagactactctcccatgagctatacaatcacaccatttcggcctcatgcagacctagtggccacctggctggcagcatga

SEQ ID NO: 7623 - RNA, 1584 nt, unidentified
  source 1..1584: mol_type = other RNA; note = synthetic construct
atgcgacagctggctctgctccttaatgtcgactacgggaaaacactaagtttcgccctctatcgcgcaaatcagaccagcgcttaccgcgcattttctatacctaagagggatggctcagagcgcataattacagcccccaagcgcgcgcgtaaatcattgcaacagtcactcctcccactgcttgagcagttatacgaccccgccccctgtgtccatggagcagtgaagggacgttctgtgaaaaccaatgccgcaccccacgtggcaagaagatacatcctaaacgtcgatatcgatgacttttttcctactatccatttcaaacgagtggtgggcatactgtccagctcacgatacggtgtacatccaaccgtggccactgccgtggctcagatatgctgtcatcaaggtcggctgcctacaggagcgccaactagtcccatcttagccaacatggtgtgcggcaagctggactccgcccttcttaggttggcaaagaagaataagttgcggtatacccggtactatgacgacattactctgagtagtagcacatctggacatctgaccgcggccactggaattgacctcagctccgaccatattgctcatggagctgatcggctgtctgatgagttcaaggatatcttcacaaataatgggttctccatcaacagcaaaaaggtatggggcaccacacggaaggtacgacaacaggtgacaggtctggtggtcaataagaaacacaacgtacccatcgccttcgtgagaagcaccagggcgatgattcactctatcgaaaaaatgggcatcaagagtgcacaggaaaagtttctgcgctcccgtaaagacaacgattcacttgatttggaatcccacatttccggaaggctggcttatattggctacattactgactacggccttagatacacaacgctcgccaagagatttatggctgtttctcagggcactaagctccctctgccattattggagagggagcggtctgtgtacgtggcagtttctaaaccgggtaacgaacaggcaactgctttccacgtcggccacgggttctttgtcaccgcagcccacctcgtggatcctaataagaagccgattttcatcctggtccacagccctgactattatgagagcccaattgctaccaaaatcgttcacatcaactatgccaccgacgttgctctcctaaagaacgtgggcgccgttgccgttaacgataggccggccataaaattgacctcccgccagagttcgagaggcgaccaagtagaggcgtacgggttcgaaaattatatccccgggaacaaactgggcgtggtcaaaacagagatttcgagcgtgaggcagctggatggccagacgagacactcagtcagcgctccttggccccatgggatgtccggaggtcccgtttttgatacgcagggagtgtttctcggtatcgttttttcagggcctctgtacggggaaaaaatcagtccatatgggaccgcctttacgccaagcaacttattcgcagctgaactggagcagtggctgattgaccaagcctcctga

SEQ ID NO: 7624 - RNA, 1710 nt, unidentified
  source 1..1710: mol_type = other RNA; note = synthetic construct
atgcagaccaaagacgacctcgcaaacgctctgggcatttccaagtcaaaactgacatatttcgcctatgccgtgtctgacaaaaggaagtacgtgtctttttacgtgaagaagcgcagtggcggcaaaagggtaatccatgctccaaaccgcggattaaaagccattcagcgatctctcgccatattactgtccgagatttatcagccttccaatccgcactgtaaccatggctttggtcgcaatagggacataattacaaacgcccagagtcatattggtcgaagatacctttttaagtgcgacctgaaggacttttacccaagtataaacggagcacgtattttcggggtcctaaccgctgctccattcaattttagcgacgaggtggcgcacctgattgctatgctgtcgaccaaggacggagcactgcctcagggagccccaactagccctgtcctttccaatatcatcatcagaaaactcgacaggaagatgatgaacttcgccaaaagctcagggggcctttatactagatacgccgacgacattactatctcgtatcggaccatttctatgactaggtcagcaatcgattctgatggcaatatctcagaccgtctccggcatataatcgagcacgaggatttcacattgaatgagagcaaaacacggcttctgaccaaacggaatagacaaatcgttacaggcgtcgttattaacgaaaaattgaacgtgaagcgagggtacataagagatctgcgcaatctgatctatatcctagtaaggtacggagaaagcgacgctgtaaatgcatataacaaacaccacctgtttgataaatctgccaaagacatcaagagagtcattgaaggtcgcattaagtttctggagcgggtgagagggagagaggacgccgtggttctcaagttgatcggaatgtatcagcaacacgataaggggtttcgaacagataaggcccctccctacgatgacaataaaatcgagacgtttaaggttaggctgcttgccgagggtaaaaccgactataagcacctccagatagcattcgagtttttcgcggagtcaaacctgtacccctccctcgacctcaacctcgaacctcacccggacattgaaggtatcaaacatctggaagctcatgtgaaagtgctggaaaaggtgactctggagcacctgcatatagcgatctacgacagcgatgacaagacaataaatgaaaggtacgcaaacgggcccaaacagctcggcagcgatttatacggattcaccttgccccgcccagggcatttaccagccgatcaacccttttgcatcgagatgctatatacccccaaagaccttaccacgccggatgaaaacgggcggcggattttcttgatcgatgagttcgacagaaatactaaccaccacaaacaggataagcgtattacaaccaataacaaatcctgggacaagttgatcatcgatgataaagtcttccggctggatgaaaatcacaacattgagagcatcaacttgagtaaggctgccttcgctagttttattgaaaagcgaaagaccgcgggcgatccccctgatctgcatgctttcaaggcaatcttcgacatgattgataagattgcccgcacttactatggcaagaatacttccgagcttggagaaaagatagatatcatcaagacgtga

SEQ ID NO: 7625 - RNA, 1668 nt, unidentified
  source 1..1668: mol_type = other RNA; note = synthetic construct
atgaagactacaaaagagctggcgcaacacttagggatagagttgaaaaccctgatgttctacgcttttgcattacctgatacgaagaagtactaccattttgagatcaaaaagcggaacggcgactctagacgaatcgatgctcctataattaccatcaagaacattcaatcctccttgagcctgcttctccagaatgagtatgaaaagagcgcccctaagtccgtctatggctttaggcctggtcgaggcatcataaagaacgctagtgctcatcttaataaacgtgtgacaatcaaagtggatctcaaggattactttaactcaattaccggaggcatgattgtcgagacactgaccagtagaccattcgggatggataaacaggtggccagggtaatagccggcctgtgtactatcggcggacggctacctcagggagcaccaaccagcccagtgctggccaacatcattactagaacactcgacatcaaactgatttcgtttgctcataaaacacgaggtacctacacaaggtatgccgatgacctcacattctcatactcccacgagaatactgcacgtcagtgcgccatctactctgaggacgggatcgtgctgaacgcggagattatcaaacatatagaaagcaaagggttcaccgttaacagcaacaagctccggtataaaaagtcaacatctagacagatggttaccgggatcattaccaataacaaaatcccgggacttccacgcgaatacatcagggaaactaaacttctgattcacatcctgctgaagtacggtgaaaaggaagcagccgaagcatatcggcggaaatacgctcaaaatcgctatgggcaccgcaataatctggatatttctgctatcgtcaggggccgcttggagtacataaagtccgttaaaggtgtcaaaagctcggcgtattgtaaactggccctcagatataaggcattcaacccccagtataaattcgaggaagaggagcaagccgtgtttaatccggaagagatcattattctatgtgagggaaagacggactacaagcatttgagcgccgcactagctcacttccagcgcaatggacaatttaacagtctgaagttggatctgaccgacaaagaacgggggggctacgacggccttcagaaacagatagatgccctgctgaaggtgaaactgaggcagaagcacattgccattttcgacgctgatgttccttctatcagcaagaaatattatgaccccaatgacctctataaggtccatgagaacctgtttgtaattataacccccagaccagatcatgtggaatccggagagaacttttgcatcgaaatgctctacaaggacaaggatttaaagcgcgtctccagtgaggggagaaggatcttcctcagcaatgaattcgacgcgaagacttcaaagcacaaaaaggagccctactatgtgcaggaccgaattaaggataagcttattgtggaaagtccagtgtaccggttcacggatgagggtgagtcactcaattattgccgttccaaagacgacttcgccaaagagatcgaagcatgccacatgactcagcccatcgacttttctggctttttgcccttattcaagaagatctacgaagtacactcttcatga

SEQ ID NO: 7626 - RNA, 1230 nt, unidentified
  source 1..1230: mol_type = other RNA; note = synthetic construct
atggttttttcaccctcccgacccgcagagggatccaatagctttatgagtccatgtattacagtgtatcacgacgggattggttctgagtcacctcggcgtttcggcaagttttacccaaaagttgtcgaagccgtcgcacgcactcttcacgtgatgcccaaagtggctccatgtctccgacctcaatgggccgatattcctaatcagagattctcccaaacaattaagagcctcagctccgtgcaggacttggcccggttttgggatctgcctgttaagcagctgaattatcatgcgtatcacgcaaccgatgcttctgagtaccacaacttcagcattacacgccggaatggcaggaaaagaaaaatcagtgctcctaatcggtcgctaaagtacatccaacgtattatccatgagacactgtcaaagctatattggcccgataccacggtacacggattcgtttcgcagagatccaccatcaccaacgccaagacccacctggcacgtaaatacgtcctgaacgctgacttgaaagattttttccagactatcaccaggcctagaataattgcgcggttaaaggtggctccttacgaacttcagcccccggtggccgtgctcataggcttcctggctactgatggagacggtcaactgccgcagggctctccctgtagtccagtcatagctaacatcatggccgcgagcatggacactcagcttaaggaactgtgcaaaaaacttcgctgcacatacacaagatacgccgatgacctgactatttctacggactgcgaaccgttcccacctgagatcgcccggtacccatctgcagccggaaccgtccaggtagtgttgggcgatagcttcctggacatcattgagaataacggatttcagataaaccacatgaagagccggctgcagaaccattggacccgccaaatctgcactggtttagtagtgaacagggagaaactctccctgccccgcagttacaaacgaaggctgagggctttgatccacaattggaagtcattagggtgggaaaaggccgcaaaaagaatgcacgagaaggaatatcgccccctcttccataatcgagatagatttgtccatcatgtgtatggcaggattaactacatgaggatgatctatggggtggactatatcggggcaaagaagctcctctctgccctggaggaaatcccaaaggaccagtga

SEQ ID NO: 7627 - RNA, 1068 nt, unidentified
  source 1..1068: mol_type = other RNA; note = synthetic construct
atgacaactgggtcttcaagtatatttacgcccaacatcttcagcgtgaattcttgtgcaaaactcgcttcgctcctgaacacaaccgagagcaggttagaaagtctcgtggaccaggcaggaaactatcggagtttccgtatacctaagaaagacggcaccacccggcttattcaggctccccaaaacgaattgaagaagattcaatcccagctcagcgaaatgctgctgtgcgcctgggagccatcccctttctcctatgggtttcttcacagtagaagtatcgtctccaacgcgagagagcatttaggtaaacgctgggtgttgaatgttgaccttaaagacttctttccatcaatcacttcgcagcagattaaaaaagctctggttagtgccccatgtgatatgaagccagaggtcgccgatctgatcgcgaggatcgcatgcaacaataacaccctgcctcagggctcaccatctagccccatactgtctgatatagtggcctcccctctagatgactccctggctagcctcgcccagtctagagactgcacttactcacggtacgccgatgatatcacaatctctacctcccagaatttgttccctgtggaaatcgcccgccccattggccgccagatcgtactgggagccccgatcaaggaccccattattcgccatggctttaaaatcaacatgaggaaggtcagccttaattccaattcacaccatcaagaggtaacgggggtagtggtgaatgagaagaccaacgtgcgacggcagtatatctctcagctacggagcattttgtataattgtctggaatcaggtgtgtaccctcaagctctgcgttacattaagagaaataggcacaaaacacccgcagcagttatcgaaagaatggatgacattgcttatattgagcactggttcagcatggttctcaaaggaaaggtcgagtacatccgaatggtcaagggcaatgattcccccactttttttatgatggccgacaggtacaacagcgtgttcggaagcacattcaacataccgccaaagtcttga

SEQ ID NO: 7628 - RNA, 1101 nt, unidentified
  source 1..1101: mol_type = other RNA; note = synthetic construct
atggaagaacacttgtctacccatctgcgaacgggacaggatgtgcagaccctgaccaggttcctcaacgccatgctgcttcggcgcgccgagaaagatggctggacaccgtggagatggcaggaacgccagattgacgcaatgctcacggaccctagctggttctatcgttcgttcacaatacccaagaaatccgggggcctgaggcacatcgatgctccgaaacggacactgaagctggtccaatgggcactggtccctctcttctctgaaatgtttactcctagctctcaagtgtacggattcgttaagggacgtggaatcgtggataacgcgtccgtccacttaggccagtctgcagtacttaatgtggatattcaggggttcttcccctcagtgagcagggcaaggattgaggccatcctcaaggacggtccagtgcttagactcagtgagtacatggcgcgttcaattgcccgactctgcactttacatggcggtcttccccagggcagtcctgcttccgcagttctcactaatctggtcaccgtgcgcttagatgcccggttggctggcctagctgagcagttcgggtgtcgctactccagatacgtggacgatataaccctgagcgcaagcagtagagccgctctggaccgagctctccccaagctagaaatgatactgctatcagagggctttgccttgaacacaaacaagactaggatccaaaccctgtccatgcgcagagaagtgaccgggcttgtcctttccggtgaaagaatcggggtgccagcggtaaatgtgcctcggccatataggcgccaggttcgcgccatgctgcaccactggcggaaacacggtatctctgaggcggccgctagaaatggctttgatggcgaccatggagttcgaccagacttggcctttgtgaggcaattgcaggggaggattgcccatctgcggcatgttaaccccacaccagaagtcgagagattttataccgacctgagcgacctgctggtaagtgagggatttcggacaagccccgacactgacttggagtgttgcgcagatctcgagtcagctaaagccatctga

SEQ ID NO: 7629 - RNA, 966 nt, unidentified
  source 1..966: mol_type = other RNA; note = synthetic construct
atgactccatttgaagaggtgacgcagtttatcaatgatgggttaagtgtcctcaaagaagccgccccaaagaagcaccgggaagtgttcgaagtttctctcgatcaggtattcggggtcttcaaaaatctcgacacctcatacatcgcattcgagatccccaaaaaatcgggcgagatgcggcaaatagaggcacctaaccggaagttgaaatggatgcagaagggtctgaaggcccagctggagacacttttcgaggctgagccaggagctcacggctttgtgcctgaacggtcaatccagagcaacgcgggggtgcatgtgggccaacgttacgtccttaatctcgatatcgcagggtttttcccttccgttaaaagaggacgggtgcagacagtactgcagttggagcctataggcctcagcaagccggctgcgcgaatcctcgcacagttctgtaccaggaatagagctttaccgcagggcgccccaacatctcccaccttaacaaacctggtctgcatgcgtctggaccgcaagctggagaaactagcccgccattaccgctgcagatatagtaggtacgcggacgatattaccatctcaggtcccagcaaggaccttatgtatcacctgctgaaaaggataactctgattctgaagactgagggttttgaagtgcaagagtccaagactaggattctgcccacgagccagcggcaggaagttacaggattgtctgtgcatgcctttgttaactccccccgcacctataggcgccacttgcgagctaccctgcacacgtggcagtccagaggaatggaaaccgctatggaagcactgcagattactgacaaggcacagtttattgctgtcattagaggccgactacaacatgcccagcatactaacaatacagccgaggtgcaaagaatgagggccaccttccaccaacttatcgcctga

SEQ ID NO: 7630 - RNA, 1665 nt, unidentified
  source 1..1665: mol_type = other RNA; note = synthetic construct
atgtcactaaataaatgcaacacccttagcgacctggccctccatctgggcatcagcaccagtcgccttagatggttgttataccataagcagtctgatctgtatgacagcttccagatacctaaacacaacggcgtgagtaggaccatcgatgctccatgtatgtccctgaaggatgtccagaatcgcatcctcaacagtcttgcaacttactacaaacccccaagatgtgcccatggcttcatagactctaagtccattatcaccaatgcaaaattacacgttcggaagaagctgatacttcggatcgacttggaggattactttccatcaattcacattgggaggattcagggactgctgaaaaagggactggggtgtaacccaacaatcagctgggcaatttccaggctgtgcactctcgactccgttctaccccagggtgctcctacaagtcccctgatcgctaacatgataaccaagcgactcgaccatcagctcgccagctttgcctcgtcctactcctgccgctacacgaggtacgccgacgacattacgatttctacaaccaaaaaggcatttccgcgtagaatcctgaagcggagcgaactgtcccggttggatatagaagacctggccgacgaaatgatcgcaatcattacagagaatggattccacatcaacgagtctaaactccggctctatcactgcaaccagaggcagaccgtgacaggcctcaccgtgaatcagaaagttaatttgcctaggaagcgcgagaagcaagttagagcgatgatccatgattgggagactaatggcctgtctaatgccgctaagaaatacatcagccgctacgattataagaaacgacctgataacactagcagcggactcttgtttaaaaaagtggtacttgggagactgtcatatatcagaatgatcaagggccccgacgattggatcgtgcaaaagtacgcgcacaggctctctttgcttgacagtgaattctttgaacaatatgagagcaaatggaaggtcatagtgcgtgctttccaggccattgagtgtattcgacttatcgaggtggaatatagtaagaatggcgtggaatactattctcaagggacgggtgtatatatcaagaacataggcctgctgacatgttatcacgtgctggatcccgatttcaccggaacgacttcatcgaatattgacgtctcacttgtgcaagaaaaattaatctctgggaagctcatttactctaagaaagagctgggggccggggtcttactaaaggccgataaggactgcgacctggcgttgctcaaagtggacaacgaccgtcctaactccattaccctgtcaagtaatgatccaatcttaggagagagcattattactctgggctacccgaattatacacctggtagatctgctcacgtacagaatacttcaattgggagtcagaaaatgtacatgggaaagacacacttcactatcagcgatgatattttcaagggtatgtcaggcggacccgtcctgaactccaactatcagctggtgggtctgatgatcgtcggcaacgagatcacatgcaccaaatacaaacggtccgaatcctcctttatagttctaagccatattgtcgagtttttgcgcaagtga

SEQ ID NO: 7631 - RNA, 1641 nt, unidentified
  source 1..1641: mol_type = other RNA; note = synthetic construct
atgggctgggtggtttccttacatgacaaacttcttatcctagggttaaccaataccatcaaaggagtaaaggatccaatacctgatctgccaaggatggagccggagccgtataaggcaggaaagaaacttaaatgggacaacaagaaactggagaaccacagtcaggcctcgaaagaagagattattgacatctgtgagaagatcatcaacaaggatatcgtgattacgtctgctaacgatgtcgcaaatatactggaggttcccgtgggtcagctgctctacattctgtatcataagaaagggaattaccgccagttcgacatagagaagaaggggggcggttctcgtacaattagtgcacctcagggcggaatggctattttgcaagaaaaactgaagcccattatagaatacttctaccgacctaagaaaagtgcgcacggcttcattattggcaaaagcatctataccaatgctgcaaaccatactaagaaacgatatgtcgtcaatattgatctggaagggtatttcgattcggtgacatttgcaagggtgtacgggatctttaagtcaaagcccttcaacttttctcacccagccgctagtgtgttggcccagctgtgcaccagagacggaatattgcctcaaggtgcgtgtacgtccccagccctggcgaacctggctagtacaagccttgataaacagttgacccagctggccagacgcaaaaatataacttatacccgctatgctgacgacatcaccttctctttcaatcaggagcagatcaaggatatcataactctgggagacgaggatgagttcgaactgtccgagactgtcatctcaatcattgaaagatgcgggttcaaggtgaatctccgcaagtttcgggtgcaagagaaaaacgtttgccagaaagtcactggattggtggtgaatgagaaggtgaatatcgatcggaagtacctgcgagtcacaaggtcaatgattcacaagtggagggaggacaagttaaaggcatctctgatctttttcgcggccaaaggcctcgaaacaataaacaacgaacacgccattagcatatttaggaaccacatttatggcagactgagcttcattaagatgatccggggtgacgattttcccctctacctcaagctgatggcccagatgtcccataatgacccacggaagactaaagaaggcctgcgggctatgagagttacggagaattacgacgtatttatttgtcacgcaagcgaagataaagataccatcgccatccccatctacgacgctctcgtagctttgaacatcagcgcatttatcgatcatgtggagattaaatggggcgactcccttatcgagaagatcaactcagccctggtgaagagcaaatacgtcatggccattctctccgcttcatctgtgaataaagactggccccgcaaagaacttaacagcgttctcgcccgtgaaatctccgaaggaaaggtgaaactactgacactagtcaagaaggaagatgaggagatcgtggcctccgttttgcctcttctccaggacaagttatatatgtcttacgagaacaaccctcaagacgtagccgagaatattaaaagcctgctcgaatga

SEQ ID NO: 7632 - RNA, 1608 nt, unidentified
  source 1..1608: mol_type = other RNA; note = synthetic construct
atgctgcgacttgccacagccaacaagcaggctactgatcaagtgccggatctccctaaaatggagcccgaaccgtataaaacaggcggcaggatcaagtggaacaacaagaagctcaaaaacaatagtcagacccctaacgaggacatcatcaaaatctgccagaaaatcgagaacaaaagcatcatcatcacaagcgccaatgatatcgcaaacgtcctcgaggtgccagtgggtcaattactgtacatcctttacgacaaaaaggataactaccggcaatttgagatagagaagaagaatgggaagtccaggattatcaatgcgccccaaggtggcctggctatactccaggagaagctgaagccaattatagagcatttttacaggcccaagaagcccgctcacggcttcatcaaagggaaatccatttacacaaatgcactgaaccacaccaagaaaaagtacgtggtgaatattgacctggaagactattttggaagtgtgacctttgcccgcgtctatggaatctttaaatcgaagcctttcaatttcagtcatccagccgcttcaattgcagctcagatctgtacaaaggaagggaagttgccccagggcgcgtgcacttctcctgttcttgctaatctcgcctccgccgccctggacaaacaacttacgcagttggcccggcgaaagaacattacttataccagatatgcggatgacatcaccttctccttcaaccagagacaggtgaaagaaataatcaccttggatgaggagaataatttcgaattgggggaaactattatctcagtgattgagaagaatggcttcaagattaatacgcagaagttcagggtccagaagcgtaacgagtctcagaaggtcaccggactggtcgtgaacgacaaggtaaacgttgaaagaaaatacctacgggtgacccgaagcatgattcataaatggcgcgaggataagctcaaggcatccctgctgttcgctagcaagaaaggtatcaaaacgaatagcaacgagcacgcaatttctgtgttccgcaaccacatatatggacgtctgtcctttattaggatgattcgggggggtgattttcctctgtatcttaagctcatggccgagatgagccataatgaccccgtaaaaaccaaagaagggctaagaactatgaaggtgaccgaaacatacgacgtctttatctgtcacgcttcagaggacaaggccactattgcgatccctatatacgatgagctgaataaactcaacatctctgcctttattgaccacgtagaaataaaatggggagactcgctaattgaaaaaattaacagcgctctggtgaaatcaaaatacgtgatcgccatcctgtctgccaattccgtggacaaggagtggccaaaaaaggaactcaacgcggttcttgcaagagaaattgccgaaggcgatgttaagctcttgactctggtaaaagaggaggatgaaaagatagtcgcagaaagtttaccactgttacgggacaagttgtatatggcttacacagataatgcctctgaggttgctgcaagggttcatgcactgctggaccgctga

SEQ ID NO: 7633 - RNA, 1608 nt, unidentified
  source 1..1608: mol_type = other RNA; note = synthetic construct
atgctcagcctctctagtgccaacaaagaggaaaatgaaacaattcctgaactgcccaagttggagcctcagccctaccaagcagggaagaatctgaagtggggcaataaggagctgaagaaccacccgatcacctctaagatcgacattaacgtaatctgcaagaagattgagaacaaatccattgtaatcacttcagccaacgacgtcgcgaatctacttgaagtgccagtgggacaattgttgttcatcctatacaacaagaaggacaattacaggacgttcgagataaagaaaaagaatggcaagtccagaataattaacgccccacagggaggcctgagcatcctccaggagaaactgaaaccagttatcgagtacttttataggccaaagaaacccgcccacggcttcattaagaacaaaagtatcctaaccaacgctgagaagcacaccaaaaagaagtatgttgtaaacgtggatctagaaaactactttggaagcgtgaccttcgcccgcgtctatggaatctttaaatccaagccctttaatttcagccatcctgccgcatccattcttgctcagctgtgtacaaaagacggtaagctgcctcaaggtgcctgcacatcaccgattctggcaaacctcgccagtgctagcctggataagcacttaacccagcttgctcggcgcaaaaacataacttacacacggtacgcagacgatattaccttttcatttaatcagcagcaggtccgagagatcatcaccctcgacaatgagaacaatttcgaactcggggaagcagtcatcagcgtgattgaaaaatccgggtttagcatcaacacttcaaagttcagggtgcagaaaaggaatgaacgtcaaaaagtgacaggccttgtggtgaatgagaaggcgaacgttgaaagaaaatacctccgcgtgactcgtagcctggttcacaagtggagggaagacaaactgacttccgccctgttgttcgtgactaaaaaaggcttcaaggctaccaacaatgagcatgccatatctattttcagaaatcacatctatggccggctgtctttcattaaaatgattcgaggggacgactttcccttatatttgaagttaatggctgagatgtcccatcacgatccactgaaaacgaaggaaggtcttagagcgatgcgcgaaacagagacatatgatgtgtttatctgtcatgcgtcggaggacaaaatctcgatcgccatacccatttacgaggagctgactgagctgaatatcagtacctttattgaccatgtcgaaataaactggggagatagccttatccagaagatcaactctgcactcgtgaagtctaaatatgtgatcgccatcttgtcagctaattctgttgataagcattggccaaaaaaagaactgcactcagtactcgcacgggagattgccgagggggaggtcaagctgcttacgctggtgaaggaagctgatgaggctatagttgctgcaagtctccctctgctctccgataagctgtatataacctacaaagataaccctgccgaggtcgccgacaaggtcagagcattgttaaataaatga

SEQ ID NO: 7634 - RNA, 1608 nt, unidentified
  source 1..1608: mol_type = other RNA; note = synthetic construct
atgttgaacctgacaactactaataaggaagcaaaaggtctggccccacagctaccaaacgtggaacccaatccaaacactatcgggaagtccgtgacatgggaaaacaaaaaactgaagaactaccctatagcttccgagtccgacatcagaactatctgttctaagattgaaaacggctccatcagtattacttcaaccacagacgtcgctaatttactggaagtgcctattgggcagctgctctatatcttataccagaagaaggacaactacaagagcttcaagataacaaaaaagaacgggggcgtgagaatcatcgacgccccttgcggtagcctcagcattctgcaagagaaactcaagcctataatcgagtatttttaccgaccaaagaagtctgcccacggcttcatcaaaaataagagcatccttactaacgcagaaaaacacattaagaagaagtacgtcatcaacattgatctggaagattattttggcagcgttacattcgctcgggtgtatggaatctttaaatccaagccttttaacttcagccacagtgccgcatctatactggcgcagctttgcaccaaggatggaaaactgccccaaggcgcctgtacatcaccggtgttggctaatctggccagtgctagtctggataagcatctcactcagctggcacagaagaaacagattacgtatacccggtatgccgatgatatcacgtttagcttcaaacaaaagcaggtgagagacatcatcatcaaaaacaaggagaatgatttcgagctgagcaaaaccatcgtcgacatcgtagaacgcaatgggttcaagatcaatttcaacaagtttcgcgttcaaaaaaagtcagaaaggcagaaagtgacaggactggtggtgaacaagaaggtcaatatcgaaaggtcttaccttcgcgtcacgaggtccatgatccacaaatggcgtaccaatcgctcagagtccgcgtcactgtttagtattcagaagggctacacctctaaaaataaggacgaggagatctccatttttcggaatcatatctacgggagattatcatttatcaggatgattcgaggaaatgatttccccgcatatcttaaattgatggcagagatgtcccaccatgacaccgttaaaacccgggagggtttgcgagccatgaaggagactgagacatatgacgtgttcatttgtcacgccagtgaagataaagagtccatagcgacccccatttacaatgagcttgtcaagctaaacattgctaccttcatagaccatattgaaattaagtggggtgattcgctagtagataagattaactcgtctttggtgaaatcaaaatacgtgatagctattctcagtacgaattctattcggaagcattggccaaggaaagagcttcacagcgtactgtctcgtgagattaacgataacaaggtcaaactcttgcccctgataaagaaagacgacacaggaatagttctgagcgagctgccgctcctctgcgacaaattatacgttacctatgacaacaatcccgaggaaatcgccaatatgattcagagcagactcggcaaatga

SEQ ID NO: 7635 - RNA, 1644 nt, unidentified
  source 1..1644: mol_type = other RNA; note = synthetic construct
atgagtctccacataaagatcctcctaaacaatctcacatccactaatcacgccgacttgctgccaaatctgccccaggtggagccgcagcccaatttgagcccttctaagacggagtgggataacaagaagctgagtaataggtccttgctgaccgacgatgagcgcaataagattttaagcggtatagagaactccaaaatcattatctcatcgcctaccgacgtcgctaatcttctagaggttccaaccggacagctgctgtatatactgtacaagcgcaaaaacaactaccgctctttcattgtcaaaaagaagaacggaaagaaccgcatcattaattccccttacagtggcttggccatcctccagcagcgttttaagttgatccttgactacttctatagaccaaagaagtcagcccatggcttcatcaaggacaagagcattatttcaaacgccgagaaacatatcaaaaagaagtacgtcgtgaatctggatctggaagattattttgggaccatcacatttccccgaatctacggaatatttaaatctaggcccttcaacttctcccatccagctgccaccgtactggcacagctgtgcacacacgagggtaagcttcctcaaggcgcttgtacttctcctgtgcttgccaatcttgtatcggcatcactggacaaacagctgacgcaactggctaaacgtaagaatataacctatacacgctatgccgacgacattactttttccttcaagcaaaacggaattaacgaagtgataaaactgtccgaggatgaaaagtacgagatcggggatcagctgataagcattatcgagaagaacggctttaagatcaatcaggataaattccgagtccagaagcggaataataaacaagtggtgacagggcttactgttaatgacaaggtgaacatcaacaagaaatacatcagactgaccaggagcatgattcataaatggagtcaagataagaccacagccgcccttatgtacacggctactcacggaatcaaaacccgggacaatgatcacgccattagtattttcaggaatcatatctatggcaggctgtcctttatccggatgatccggggcaaaaacttcagcacctacttaaagctcatgtctcgaatgtctcattcagaccccaagaaaactaatgaggggagaagggcaatgagtgagacagaaacttacgacattttcatatgtcacgctagcgaagacaaagaattgattgcaattccgctgtataaggccttatgcgataagaatatccccacctttattgaccacgtagaaattgcgtggggggactctctcatcgataaaataaacaacgcactcgcaaaagctaaatatgtggttgctatcttaagcgagaactcagtggagaaaaagtggcctaaaaaagagctcaacagcgtgctcgccagagaaatttccaacggtaaggtcaagctgttgacactggttaagaaggaagatgaagaggctatcgccgacaaaatcccactcactcacgacaaaagatatatggtgtacgatgataatgcggactttatcgcggatgaagtccggaaaatgctagataaccaggcatctattaaccagtga

SEQ ID NO: 7636 - RNA, 1605 nt, unidentified
  source 1..1605: mol_type = other RNA; note = synthetic construct
atgcacaatttcgccctcgctaataagaaaagccccgactttataagcgaactccctcaaatcgagcctaagccctacagtaatggacacaagatcaagtggatcaatcatactctgactagtaccgaggtcactccaccggacaatctgatcaagatttgtatactgatcgaatccggagagattgccattacctcagtgagcgatattgccaatctgctaggcgttcccgcgggtcagctgctgtacattctgtaccggaagaaagataactacagaacctttgagatcgagaagaagaatggaaaaaagcgcgtaataaatgcgccatgcggtgggctctctatcctgcagacaagactgaagcctgtgctggagtatttttatcgcccaaaaaagagcgcccacggcttcattaaaggcaaatctattatcaccaacgctggcatgcacattaagaaaaaattcgttgtgaacatcgacctcgaaaattattttgagtccatttctttcgctcgcgtctacggcatctttaaatctaaacccttcaatttcagccatccagccgccaccgtgttggcacagctctgtacgcataatggcaagctgccacagggggcttgcacaagtcctatattggctaatattgcatccgcctccctggataagcagctgacacagtttgcagggagaaagaagatttcttattcacgttatgcagatgacatcacatttagcttcaatcagcgtaacatcgacattatcaagaagaacgatgacggcagttattctctctcggagacaattgacaacataatttccaaaaacgggttcaaaatcaactacgacaagtttcgagtgcaaacacgaaataccaggcagagcgtgactggacttgtggttaacgataaagtgaacattaacagaaggtacattcggattacccggagcatgatccacaggtggacagatgacaaattaaaatacgctctgcttttcgccaccgagaagggttatcaagcaaaggataataaccatgcgattcagatctttcggaaccacatctatggaaggcttagcttcatcaaaatggtgcgggggaaggactatcctggttacctcaaattgatgtcatacatgagtcacaacgacccgctgaagactcaggaagggctcagggccatgaaggagactgaaaatttcgacgtttttatctgccacgcctcagaagacaagaaagacatagccattccaatatacgatgaattgacgaagttgaagatctcagcttttatagatcatgtcgagattaaatggggagattcccttatcgaaaaaatcaacgcagccctggtaaaatccaaatacgtcatcgcgatcctctctgcaaattctgtcaacaaggaatggccccaaaaagagcttcgcgctgtgcttgcctccgaaatcagctcaggcgatgtaaaactgttaacgttactgaagaaggaggacaaggaagtcgtgaacttgagtctccccttactatcggacaaattctatatggtctacgataacaaccctgaggtggttgctaataacataaagtccctactgcagagatga

SEQ ID NO: 7637 - RNA, 1632 nt, unidentified
  source 1..1632: mol_type = other RNA; note = synthetic construct
atgtccctccatgataagctccttatgcacaacctggcattagcaaacaaggaaaacgccgatgtcattagtgaactcccgcaggttgaacccacaccatataaaaacggaaataaggttaagtggcgtaacaaaaagctgaataacaaggcggctattgaacctgactctttgatgaagatctgtatgctaatagagtctggcaaacttctgattacatcagtatcagacgtagctaaccttctggagatccctgttgggcaactgctgtacatactttatcggaaaaaagacaactacaggacctttgagatcgaaaaaaaatccggcaagaaacggatcatcaatgcaccagtgggtggactgagcatcttgcaaactaaactgaagcccgttatcgagtatttttatcgccccaaaaaatccgcacatggattcatcaaggggaaatccattataactaacgctaacatgcacataaagaagaaatacgtggtcaatgttgacctggagaactattttgagagtatcacgttcgccagagtgtacgggatctttaagagcaaaccattcaattttggtcaccccgctgcaaccgttctggcccaactgtgcactcataatggtaagctgcctcaaggcgcctgcaccagccctattttggctaaccttgcttcgacatcactagacaagcagctgactcagctggccggcaggaagaaaatttcatacagtagatacgccgatgatattacgttctcttttaatcaggagaaggtcattgacattatcgagcgaagtgaagacggatcttatatcatcggggaaacgatcgacaatatcatctctaagaacgggttcaagattaatcacgagaaatttagagtgcagacaaagaatactcggcagtcagtcaccggcttggtggtgaatgagaaagtcaacatagatcgcaaattcatccggattacccgctcgatgatacacaggtggaaagaagacaaagtgaaatacgcgttactcttcactaccgagaagggatatcagaccgaggacaacaaccaggccatcgagatatttcgtaatcatatttatggcaggctgagctttatcaagatggtcaggggcggtgattatcccggatacctcaagctcatgtcttatatgagctacaatgatccgtccaagacaaaggaaggggtgagagcaatgaaggaaacagaaaacttcgatgtgttcatttgtcacgcttcagaagataaggaggatatcgccatgccaatctacgaggagctaagtaaaatgaagattagcgccttcatagatcacgtggagattcattggggcgactcccttatagagaagattaacagcgcattggtgaagtctaaatacgtgatcgccattctgagcgcggacagtgtgaataaggagtggcctcagaaagaactccgagctgtattggcctccgagatttccgaaggcaagaccaagctcttaaccctggtcaagaaaaacgatgaggaaatcgtgacaaaggcgctgcccctgctccaggacaagctctacatggtgtacgacaataatccagacatggtagccgaaagcatcaaaaaacgcttacagtcctga

SEQ ID NO: 7638 - RNA, 1608 nt, unidentified
  source 1..1608: mol_type = other RNA; note = synthetic construct
atgtacaacctagtgagcgtgaataagaaaaatcaagatatcgtacctgagctgccgcaggttgagcctgtgccctataaaaacgggaacaagatcaagtggcgaaacaaaaagcttaaaaacaagaccatcaccaactgcgaaaacttaatcaagatctgcaaactgatcgagtccaacgagatactcattacatcgtccaatgacattgcaaatttgctagagatccctattggccagttgctctacatattgtaccacaagaaagacaattacaggacttttgagatcgagaagaagtccgggaagaagcggatcataaatgccccaaatggaggcgtggcgattcttcagggcaggctgaagcctattatcgaatacttttatcgccccaaaaaatctgcacacggtttcattaaagggaagagcattatcacaaacgccagcatgcatacaaaaaagaagttcgtggtcaacatcgacctcgaaaattactttgaatcaatcaccttcgctagagtatatgggattttcaagaagaaaccgtttaactttgcgcatcccgctgcaactatactcgcccagttgtgcactcacaacgggaagctgccccaaggcgcttgtacaagtccaatactggccaatctcgcaagcaccagtctggataaacagctgacgcagctggcttctagaaaaaatatcagctatagccgctacgcggatgacatcactttctcattcaatcaatccaacgtcttcaacatcatcgtcaagaacaataagggtaattacgaggtttctgagaatattgactccatcataagcaaaaacggcttcaagataaatcacgaaaaattccgcattcaaactaagaataccagacagtccgtgacaggtttggtcgttaatgagaaagtgaacattgatcggaaatacatccgtatcactcgttctatgattcatcggtggaaggtcgacaaagtgaagtatgctctgctcttcacaattgaaaaggagtatcagaccaaagacaacaatcaggcaatcgagatctttaggaatcacatttatggacggctctcatttattaagatggtgaggggagaaaactatcccggatatcttaagctgatgtcctacatgagtcataatgatcccctcaagaccaaggagggcttgcgggccatgaaagagacggagaattttgatgtattcatttgtcacgcctcggaggataagaatgacattgccattccagtctttaaccagcttgatagaatcaacatttctgcctttattgaccacgtgcagataaagtggggagatagtctggttgaaaaaatcaacagtgccctggttaagtcaaaatatgtgattgctatcctgtctgccaacagcgtcaacaaagaatggcctcagaaggaactacgagccgtgctggcttcagaaatatccgacggcaacatcaagcttctgaccctgattaaaaaagacgatgaggaaatcgtgaaaaccgctttaccactgcttagggataaatactacatggtatacaatgagaacccagaagtgatcgcagacaagataagagagctcttacatcgctga

SEQ ID NO: 7639 - RNA, 1608 nt, unidentified
  source 1..1608: mol_type = other RNA; note = synthetic construct
atgcacagcctcacatttgccaataaggagaatccggacagcattcccgaaatccctcaggttgagccagagccctacaaagacggtaaaaacgttaagtggcgcaacaagaagctgaagaataaaagtaccattgaccatgaatccctgatcaatctatgcaaacttattgagtcaggaagtattgttatcacctcggcgtcagatatcgccaatttactggaaattccagtaggccagctgctgtacattttgtatcacaagaaagacaactaccggacttttgaaatcgagaagaaaaacggcaaaaagaggatcataaatgcaccaaatggcggcgtgtctatcctgcaagagaaagtgaagccaatcattgagtatttctatagacccaagaaatccgcgcatggattcataaaagagcgctcaatcattaccaatgctttcatgcatacaaaaaagaagttcgtggtgaacatcgacatcgaaaactactttgactcaattacattcgctagggtgtacgggatttttaaatccaaaccattcaacttcgctcaccctgctgccactgtattagcccaactctgtacgcacaacggaaaacttccccagggcgcttgcacttctccaattttagccaacttggccagtacgagccttgataaacaattgacccagctggccggtcgcaagtcaatatcatattctcgctacgcagatgacattaccttcagtttcaatcagaagaaagtacctgatatcattgaacagaacgacgatggcagctatgaaatctccgaagccctggagggtattatcctaagaaatggctttcgagtgaattctgacaagtttcgtgtccagactaagaacacaaggcaatccgtcactgggctcgtcgttaacgataaagtgaacgttgatcgcaaatacatccgaataaccagatctatgatacacagatggaagtacgataaggtgaagtacagcctattgtttacaactgagaagggttacaagaccaaggataacaagcaggcaatggatatctttcgtaaccacatctatggaaggctctccttcattaagatggtcagggggaaggactatcctgggtatttgaaactcatgagttacatgtcgcataatgaccctctcaaaacaaaggaagggctgcgggctatgaaggaaaccgagaattttgacgtcttcatctgtcacgcatccgaggataaggaggacatcgccacaccggtctatgacgagcttacgaagatcaatatcagtgcatttatcgatcacgtggaaataaagtggggggattccctcattgaaaagataaactctgccctcgtaaagtccaaatacgtgattgctatactcagcgcctctagcgtgaacaaagaatggcctcagaaagaacttcgggcagtgctggcgagcgagattagcgacggagatgtcaagcttctgaccctggttaaaaaagacgatgaggagatcgtgaagaccgcactgcccttgctgagagacaaactgtatatggtctacgaggagaatcccgaggtggtggctgaccgggtgcgaactctgctgcatcggtga

SEQ ID NO: 7640 - RNA, 1653 nt, unidentified
  source 1..1653: mol_type = other RNA; note = synthetic construct
atgcagctgaggaaacaaataattgcgttcaacgagaaatgccgggccgagggcctggatgaagataggctcatcccactgcttaaagacacagagccatccagcgtaaaagtgggaaatactgtcatttggaacaactcctttaaaggaaacgtgtttagtttaacggaacaggaagtgtcaaaggtatgtgctgctatttcaaggggggacgtgaatattgaaagtgtgcaggatgttgccaatctgctagaggtaccagtgggaaatctcatccatctcctgtacagatcctccagtattaagtacaagtcatttaccatcccaaagaagaatggcggtgagcgaatcatccttagcccccagggcggcatcaaaattctgcaagagagagcaaggaaatatctggatgcattctatcgccccaagatttcggcccacggatttatcctaaataagggcatcttcaccaacgccgagaaacacgttaagaaaaagtatgtcctgaacattgacctgaaggacttctttgagagtatcacgttccctagaatttacggcgtgctgaagaagcatccgttcaatatgggccgccccgcagcagctgttttggcacagttatgcgtgcataacgggaagatgccgcagggagcccctacaagtcctgtgctttctaatatcattgctagcgccctagacaagacactagtgagactggccgggaagtataggatgagatacacacggtacgctgatgacatcactttctcctttaaccagtctccaccactggatatcgcaaagaagatcgaggacaccgggggatacgaactcggcgatagcctgcgccatgctatagagaacaacggcttcaagataaatgaagagaagtttcgattgcaactcaagactgaacgacaggttgtcactggtctgaccgtcaacgagaaagtgaatctggatcgtaagtatattcggcttaccagagcaatgatagacgggtggggaaaagacaaagtccaggccgccaataaataccataaaatccggtatgggaaatgtgataaaaacgacgaattcgcggttgaatccttccgcaaccacatctacggcaggttatctttcatacggatgattcgcggtgccgaatggcctctctatctcaagctgtccgcctggatgtcctctaatgacgataaccccacaattgaagggcgccgggctatgaaggcgatggagatgtttgatgtcttcctgtgtcacgcatctgaggacaaggaatcaatcgtgatgcctatctacgacgagttgtgcaaactgcacatacacgcatttgtagataccaaatacatcgagtggggagatagccttacagagaaaataaacggagctcttgccagaagcaaatttgtggtggcggtcctctcttcgaattcagttgaaaaaaggtggcccctgaaggagctgcacagcgtgttagcccgtgagatcgctgaaggcgacaaaaagttgctcaccttagtgaaagacggcgacgaggaacttattaaggctaagctgcccttgctcgccgataagctgtatgccgtctacaagggtgaccctattgagatcgctcacggtttgagctctttgctcactgggaagaaatga

SEQ ID NO: 7641 - RNA, 1632 nt, unidentified
  source 1..1632: mol_type = other RNA; note = synthetic construct
atggccttcaattcaaaatgcaagaaagagggcttggacgaagagcagttcctgcccctgctgaacgacaacgagccaagctctgtaaaagtcggcaattctttcctgtgggataatagggccaaccggaatgctttctctctgactgaacgagacatctccaagctctgtgttgcaattagcaagggtgacatcaatatcactgaggtccaagacgtggctaacctgttggaagtccctgttgggaatctcatttacctcctgtaccgcacctccagcgtcaagtacaaagagtttaccattccaaagaaaaacggagatgaaagaaagatcctgtcacctcaggggggcgtaaaaatactgcaggaacgcgcgaagaagtattttgatgccttctaccggcccaagattagtgctcacggctttattctgaacaaggggattcttaccaacgccgagaagcacgtaaagaagaagtacgtgttgaatgttgatctgaaagatttcttcgaaagcataacattcccgagaatttatggtgtgctgaagaaacatccatttaatatgggacaccccgccgccactgttttggctcagctctgcgtacataatggaaaaatgccacagggtgcccctacctcccccgttctttccaacattatcgcctctgccttagacaaaaccctggtgcggctggccggcaaataccgtatgcggtatacaaggtacgcagacgatatcaccttttcgtttaaccaatcacctcccagtgagatcgctaagaaaattgagaacactgatggatatgagctgggagactcacttcgccatgctatagaaaacaacgggtttaagatcaatgaagacaagtttcgccttcagtccaagactgaaaggcaggtggtgacaggcctcacagtcaatgaaaaggtgaatctggagcgtaagtacatcagactaaccagagctatgattcacggttggggaaaagacaaagtgactgccgccaagaaatatcataaaacacggtacggcaactttgataaggatgacaactatttggtcgcgaacttcagagatcacatctacggtcgactgtcattcatacgcatgatcagaggggctgagtggcctctctaccttaaactgagtgcttggatggcaagcaatgacgacaaccctacgacagaggggcgacgtgccatgagggcaatggaaatgtttgatgtgttcctctgtcacgctagtgaggataagaacgacatagtgatccccatttacgacgagctctgcaaactggatgtgcatgcgttcgtcgataataaatatattaggtggggcgattctctgaccgagaaaatcaacagtgccctagcaaggagcaagtttgtggtggcagtgctgagccgcaattctgtggaaaaggagtggccattaaaggagctcaattccgtcttagcacgggagatcgccgatggggacaagaaacttctaacgttattaaaggaaggcgacgaggagctcatccaagcaaaattgccattgctggccgataagctctatgcagtgtatacgggcgacccgataaaggttgctcaggacctgaaagcgctactttccgacggagaatga

SEQ ID NO: 7642 - RNA, 1653 nt, unidentified
  source 1..1653: mol_type = other RNA; note = synthetic construct
atgggcctgcgcgagaagattgcgtcatttaacaacgaacttaattacggggtcgactataaagatagcctaattccactcctgaagaacaatgagcctctggccatacatatgggtaataaggtgctttggaataacttcttcaagaagaatgagttctcgctgaccgacatcgacgtgtacaaaattactacggccatctccaagaaaaacatctacattattagccctcaggatgtcgcagctcttctggaggtcccagttggaaacctgctgtacctgctctacaaatccaactctaataagtaccgggagttcacgataccgaaaaagaatggagataaaaggactattctctctccccaagggggagttaagattttgcaggagcgcgctaaaaagtacttggacgctttttatcgcccaaaggcaagcgctcacggtttcatcctgaacaagtccatcttcactaacgcggagaagcacgttaagaagaagtacgtgctgaacgtggacatcaaagacttctttgagtccataacctttccccgaatatatggcgtgcttaagaagcaccccttcaatatgggcaacagcgcagctgctgtcttcgcccagctttgtgtgcacgaaggcaggttacctcaaggggcgccgacttcaccagtagtatcaaacattatcgcctcgagcttggacaagaccctcgtgcgactcgcaaggaaatataaaatgtcctacacacgctatgctgatgacataactttttcctttaaccagtatccccctgtggggattgccagaaaaatcgatggaacaaatgactttgaactgggggattctttgagaaacgccatcgaatccaacggattcaaaatcaacaatagcaaattccggctccagtcacgggccgaaaagcaggtggtcaccggtttgaccgttaatgagaaagttaacatcaatagggactatatcaggacaaccagagcaatgattgacgggtggggtaaagacaggttccaagccgctaagaaataccacaagattcggtatggcaaatgcgataagtctaatcagtcagctattatcagcctaagaaaccatatctatggccggttgtcttttattcgtatgatcagaggcgccgaatggcctctatacctgaaactgatcagtcgtatggcgaataatgatgattcccccacagttgaaggaaagcgcgccatgaaaatcatggaaatgttcgatgtattcctttgccatgctagtgaagataaggatgacattgtggagcccctgtacgaggagttagtgaatctacgagtgaacgcatttctcgataccaaatatatcaagtggggtgacagtctgatagagaagatcaatggcgcactggcaaaaagtaagtttgtgatcgccgtactcagccggaattctgtggaaaaaaagtggcctcttaaagagctgaacagtgtcctcgccagagaaattacaggagaagacaaaaaactgctcatacttgtcaaggatggggatgaggaattaattaaggacaagtttccactgctggtggacaagctgtacttggtctataagaacaatccagagataatcgccggcgagttactgtctctcctggccggcaaacagtga

SEQ ID NO: 7643 - RNA, 1641 nt, unidentified
  source 1..1641: mol_type = other RNA; note = synthetic construct
atgcttctgaaacagcagatcattgccgctaattttatccgtggcgagtctggaaaagcgttcctccccactttgctgtatgttgagcctaaaagtattaaaacaggctcgaagtacaagtggatgaatccacgatctataagggcctactcactctccgaaaatgacattcactccttgttgtcggcggtgctcacaggcgaaatcgaaatcaagactgccaatcacgttgcggagatcttagagatccccgtgggtcagctgatatacatcctctacaaaaagaccacagaaaactacgtagagttcgaagtgaagaaaaaaatgggtggagtgagaaaaatctactccccccaaggttccgtgaagatcatacagaatagggtcaagaagattctcgacttcttttaccgccctaaagccgccgctcatggattcatcaaggagaagtccataaaaaccaacgcaaagaagcatatagggaagaagtatgtgttgaacattgacctgagcaacttctttgagtccattactttcgctcgcatctatggggtattcaaagcccggccgtttaatttcggccacgatgcagcaagtatccttgcccatgcttgtacatacaacggggttctcccacaaggggccccaacctcacctaccctctctaacatagtagctgctagcctggataagaagctggtaaccctagcccggagattcaaaatccagtacacacgatatgccgatgacatcacttttagctttaatcaaaagccacctgaagatcttgtcaaggtgctggatggggaaggactctgcgaagtgggcgacctgctgaacgaggtgatcgagtcctgcggatttaaagtgaatagtaagaagacgcgcttgcagagtaaaacccagcgccaggaagtaactggccttgtcgttaataacaaggtgaacgtgaacagggactatattcggatcactcgaagtatgattcatgggtggtgcaaagatagagcttttagcgctagaaaacacttcaacattacagatgagtgttcagttgagaaagagaagaacatcattgagtcttttcggaaccacatttacggcaggctgtctttcattcgtatgatacggggcgtggactttccctgttatcttaaactcatggcctatatgagccataatgatcctaaacagacaaaggaaggcaagagggccatgaaggaaacggaaacctatgacatttttatctgccacgcaagcgaggataaggatgagatagctgtccccgtctacgacgagctgaacaatctgtcaatcgtgaccttcattgaccacctgtcaatcaaatggggtgacagcttagttgacaagatcaataatgccttagcaaaatctaagtacgtgatcgcaattcttagcaagaacagcgtcgagaaaaactggccaattcgcgagctgaattcagtcttggccagagaaatcaaaggagggaaggtcaaactactaaccctcattaaggcgtctgatgaagagtatgtgcaagataaactgcccctgctggccgacaagctgtatatggtttacaatggaaacccggcagaggtggcatccagggtcagagacttactgggccacccttga

SEQ ID NO: 7644 - RNA, 1635 nt, unidentified
  source 1..1635: mol_type = other RNA; note = synthetic construct
atgcttctgaaacagcagattattaccgagaacttcattagggacgaaaacgggaaatccttgctgcctgccccaagttacgtggagccaaagagtatcaagtctggcaacaagtatcggtggatcaaccctaagagcatccgaaagtactccctgagtgagagcgagatccactccctccttagtgcaattttaaccggcgaactcaagattaatacggtgaatcacgttgcagagatactggagattcccgtcggccatctcatctacatcctctacaaaaaaatctcgagcaattacgtggaattcgaaatccctaagaagatgggaggggtccggaaaattaaagccccgcatggaagtataaaaattattcagggacgggtaaagacaatactcgactttttctacagaccaaaaaccgcagcccatggcttcattaaggggaagtctatcaagagcaacgccaaaaaacacatagggaagaagtatgtactgaacatcgacctgtcaaactttttcgaaaccatcacatttgcacgggtctatggtgttttcaagagccgcccttttaatttcggccacgacgctgcgtcagtgcttgcccaggcctgtacttataacggtgtgctgccacaaggagctccaacctcacctgcgttgtccaacatcatagctgcttctctagacaagaaactggtgaccctcgcaagaaaatttaagatccagtacaccaggtatgccgatgatataactttttccttcaatcagaagccccctgaggatttggtaaaggtgatagatgggggtgctctgtgcgagatcggcgacctcctgaatgagattattgaatcctgcggctttaaggtaaacttaaaaaaactgcgcttgcaatcccggacacagcgacaagaggtgacgggacttatcgtgaacaataaggttaatgtcagccgtgactacatccgtatcacacgcgccatgatccacgggtggtgcagagacagcacgcttgccgctaggaagcacttcaacatcactgatggccagggtgaggacaaaagcctggtgaacagctttaggaaccatatatatggtcgcctatcgtttatcaagatgattagaggcgccgagttcccgtgttatctcaaactgatggcatatatgtctcacaatgatcccaaacagacaaaggaaggaaaacgcgcaatgcaggagacagagacttacgacgttttcatctgtcatgcgtctgaagataaaactgaaattgctatccccgtctacgaagagctgtcaaaattagggatcgtgacctttatcgatcacttgtctatcaagtggggagactccttggtcgagaagattaataatgccctggttaagtctaagttcgtcattgccattctctccgaaaattctgtcgagaagaaatggcccattaaggagcttaatagtgtgctgtcaagggaggtcaaaggagggaaggtgaaactactgactttgattagagactccgatgaagagtatgtgcaagaaaaactgccactcttaagcgataaactttacatggtttacaagggcaatcccgtggatatagcttcaaaggtggaagacctgctgcgaaactcatga

SEQ ID NO: 7645 - RNA, 1587 nt, unidentified
  source 1..1587: mol_type = other RNA; note = synthetic construct
atgctgacgtttaacaaactgcagtttaggttgcaggctaccgagcctacacggctttataataactactgggtcaaatggctcaatccttctcttagccccacgctttcccgaaacattgaaaccagccgtgagttaatcctggggctgcagagcagcaacgatgtcgccaacctgctggagattcccgtaggccagctcctgtacattctctatacgctggagccaaagtacaagagcttcacagtgaccaaaaagagcggtaagaaacgcctcattgattctccaaatgagtccattaaaatcttgcaggacaaagtgcgacctcttatcgaggcgcactacagggtaaagaagcccgtgcacggatttgtgggtggaggcaagggaatcgtgactaacgccatgcaacacaagaaaaaaaactacgtgcttaacatcgatttgtcagatttcttccattcagttaacttcggacgcgtgcaaggaatatttagaaacgccccctttaacatgggcagcgccgctgcaacagttttggcccagctgtgtactcataataagtgcctgccccagggggcttccacttctcctgttctgagtaacctggcagcaagcacattggatcgcaagctcgtgcagctggctaagaaattccacctgacctacaccagatacgcagacgacataacattttcatccaataagccattcagtggcaagatcgttgaaaatcgaaaggaggaaagtggactagaaactcatagggtaggcaaactattagagcagattattaccgattccgggttccaggtcaatcacacaaaaactcggctacaatataagtcgcagcgccaggaggtcactggattggtggtaaatgagggtgtgaatgttaatcgtaagttcatcaggaagacccgggccatgattcacgagtggtcaaatgatctgatctctgcagaggcaagatttatcatgcagaggtataacgtgagtgacagtgaagttgggaatgaccgggatggctcaatcttcaaacgggctgtgtatggtaaccttagcttcatcaaaatggtcaagggggaagaacatagtccctatctgaatctgtgtaggaaggtgctggaactggacaatgaaccaccatcctttatatccaagttaaaagacgtcctcgacatgtacgatgtctttatatgccatgcgagagagaacaaaaatgaggtcgccatcccgctctatgaagccttaaaatcgaaaggcatcaataccttcatcgactccagtgccattaactggggggactcactggtgtcaaaaatcaacacagcgttacaaaaggctaaatacgtgatcgccatcatatctgacgattccctcaacaagtcttggcctatgcacgaactgcggtctgtgctgtccaccgagatacgcagcggcgagatcaagctccttccgctcatggtgggcgacgctgacgctttgatttctcaaattcctctgctcgccgataagagatttattcacttcgaggacaacattgatgacgtcgttgaagaaattcagaagctacttaaggattga

SEQ ID NO: 7646 - RNA, 993 nt, unidentified
  source 1..993: mol_type = other RNA; note = synthetic construct
atgtctaatctggcagccacatccctagataagaaactcgtccagatcgctaagaaatttcacctgacctacactaggtatgccgacgatttaaccttcagcagtaacaaaccctttcctagcatcttggtcgaacgcaaaacccaggataacgggcaggataagcaccgagtggggaagttgctcgaacaagtcatcaaagatgccggctttgagatctcccatgacaagacacggctgcagcataaatcacagaggcaagaggtgacaggactggtcgtgaacgagggggtaaatgtgaacagaaagttcgtgcggaaaactagagcaatgatcaacgaatggggaaaagatttgcgagcagccgagatccggtttattaagcatagatatcacgtgaccgactccgaaatcaatatggagaatctcgatggctcaatatataagagggcaatctacggaaacttgtctttcattaagatggtgaaaggcgaagagcactctccataccttaacctctgcaaaaaggttcttgaactggaatccaaccctcccgagttcataaaaaagttaaaaggggtgttcgatatgtatgacatctttatatgtcacgcctcggaaaataagagtgatgtagcgctgccccttcatgctgctttggcggagcgcggcataaacgccttcgtggattgcttcgagattaaatggggagacagcctggttgccaagattaatactgctctgcaaaagagtaagtacgtcattgccgttatttcagaagagtctgtgaaaaagagttggcctatgaaggaactgaatgcagtcctttcaagcgagattggtagcgaacagacgaagctcttaccactcatggtaggtgacgacgagtccctcctgaaacagctgccgcttctgggcgacaagctgttcgtgaactttgacgacaatatcgaggagattgctggtaaggttgacagcctactgcgtggctga

SEQ ID NO: 7647 - RNA, 1596 nt, unidentified
  source 1..1596: mol_type = other RNA; note = synthetic construct
atgtccacccccctgggctcacttttatttaacctcgaaagctttgagcctgagaaaattccgaacaagaagacctattcctggaaaaatcctaaactcagtcccacgttaacgagagatctagaggtggctaaaactcacttcgtaggactccagactgacaacgacgttgccaatattctggaaatcccggtcgggcaactgctccacatcctgtactatcagaaacagaactacaattcctttaccattaagaagaagtcaggcaaaactaggcttatcgatagtccaaaagcctcaatcaagatactccaagacaaggtgaaaccgttgatcgaggcccattacagagtcaagaaacccgtacatggcttcgtcggggatggtaagggtatcataaccaacgctttccaacaccgtaagaagaactatgtgctgaacattgacctgcaggatttttttcacagcgtcaattttggccgcgtccaggggatcttccggaacactccttttaatatgggaatcccagccgcaacagttctggcacaactctgtacccataatgggagactccctcagggggcttcgacatctccagtgatcagtaatctggcttctacatcactagacaaaaaattggtccagatagccaagaaattccatctcacatataccaggtatgccgacgatctaacattctcttccaacaaaccattccccaccatactggtagagagagagatcgacgaaaatggtaaagaaatccataaagtcggaagactgctggagcaggcaatcaaggatagcggctttgaagtgtctcatcacaagactcgccttcaacataaaagccagaggcaggaggtgaccggcttggtagtgaacgagggcgtgaacgttaatcgcaagttcatccgtaagacacgagctatgattaatgactggtccaaaggcctggcgcaggccgagataaggtttcttaagcagcggtaccaccttaccgattccgagattaagaccgacgggctggatgggtccattttcaagcgagcagtctacggacacttgagtttcatacggatggtgaagggagaagagcacagcccctacctgaagctttgcgagcaggttctggcactggactccaagcctccagagttcattcggaagctgaagggcgtgttcgatatgtacgatgtttttatttgtcacgcgtcggaggataaggctgaagtggcactgcccctatatgacgccttagccaagagggagatcaaagccttcattgattgctttgctattgactggggagacagtctcgtgtctaagatcaacactgcgctgaaaaagtctaaatacgtcattgcagttgtgagcgatgaaagcgtgaaaaagagctggcccatgaaagaattaaatacggtgctggccgctgaaatttcttcagaagagacaaagttactgcctctcatggtgggagacggcgaagaattgctgaaagaaatcccattgctgggtgacaaattgtttgtgaacttcaacgacaatatcgacgagatcgccgataaggttgagaagcttctccagcgcagctga

SEQ ID NO: 7648 - RNA, 1311 nt, unidentified
  source 1..1311: mol_type = other RNA; note = synthetic construct
atgcaagagaaaatcaagcccctgattgaagctcactaccgcgtcaaaaaacccgtccacggcttcgtcggaggcggcaaaggtatcgtttctaacgctgaacagcacaaaaagaaggattatgtactgaatatcgacctccaggactttttccatagtattaactttggtcgcgtgcagggtatcttcaagaataccccgttcaatatggccacccccgccgcttcagttctggctcagctctgcacgcataacgggcggctgccacagggagcatgtacatccccagtgatctcgaacctggcagcaacttctctggacaagaaactcgtgcaaatcgccaagaaattccacctaacttatacaaggtacgctgatgatttgacatttagctccaataagccgctaccctcaattcttgtggagaagattgcggaagacaatgggcaatacaaatacaaagtgggacgaataatcgagcaggccattattgactccggatttaacatcaatcacaataaaaccaggcttcagcataagagccagcgtcaagaggtcaccgggttagttgtgaatgaaggcgtgaacattgaccgcaggtttatacgaaagacgagagctatgataaatgaatggagaaagaacctgctggaggccgaaatccgtttcatcaaaaagagatacaatctgagcgactcggagataaagaataggaagcttaatgggtctatctataagcgggctatttatggcaacctcagcttcatcaaaatgatcaaaggcgaagagcattcaccatatcttacactgtgtaagcaggtgttggagctggacaacaatcctccttatttcgtgcggaaactgaaagggatttttgatatgtacgacatctttatctgccacgcctctgaggacaaagataaggttgccatacctctctacgacgagctaattaaacgggacatcaacaccttcattgattgctttgcaattaagtggggtgattccttggtcagtaaaatcaacactgcgctgaagaagtctaagttcgtaatcgcagtgatatccgatagcagtgtaaagaagagctggcccatgaaagagctgcatgccgtcttatcaagcgagattggctccgaagaaaccaagttgcttccactcatggttggggatggagaggccttgctgaaggaactccctctgctcgcagataaactgtttgtggctttcgataacaacatagaggaaattgccgacaaagtggagactcttttaaagaagtacaacctctatgacatcagtcagagatga

SEQ ID NO: 7649 - RNA, 1596 nt, unidentified
  source 1..1596: mol_type = other RNA; note = synthetic construct
atgaccaaactcatggacttcctgtcttttcactccaatgcttttgagcctactaagtcctccaagaacgccggctatacctggatcaatccgtccttgaccccacatttgactagagaattagacttcgtgcagcgccagtttctggggctccagtcagacaatgacgtcgccaatattctggaaatacccgtcggccagctgctgtatatcctttactctcagaaggacacttatgttaactttacggtgaaaaagaagtctggcgagaaccggaacatagaaagcccctgctcgagcatcaagattcttcaggataaggtgcgccccttgatcgaggcccactacagagtgaagaaacctgtccatggattcgtggggaacggcaaaggcatcatttctaatgctgagcagcacaagaagaagacatatgttctcaacatagatctcaaggacttctttcacagtgtgaatttcggcagggtccaggggatcttcaaaaacattccctttaatatgggtacaccagctgctactgtgctagcacagctgtgcacgcacaaacgaagactgccgcagggggcctcgacatcacctgtcttgtcaaacctggcctccactaccctagataaaaagttgacaaagatcgcaaagaagttttacctgacctacacacgttatgctgatgacatcacctttagcagcaatgagccttttagtcaagcacttctggaaaaagacaaactggatgacggacaatatatctacagggttggaaatgtgctcgaggcagccgtgatctcttcagggttttccataaaccataagaaaacacggcttcagcacaagtctcaaagacaagaagtgacggggctcgtggtcaacaagggcgtgaacattaacaggaagttcatccggaagactcgcgccatgattaatgagtgggataagaacttgatcgaagctgaaaaacggttcatcaaagtgagatatcacgctcaggagacagagatcgacatgagtaaactcgatggttcaatctacaaacgggctgtatacggtaatctgtcttttattaggatggttcgaggcgaagatcatagcccatacctcaccctttgcaagaaagtgctcgagctggaccataaccctcccgccttcattaacaagcttaagggaatcttcgagatgtatgatgtgttcatttgtcacgccagtgaagataaagagagcgttgcgctgccactgtacgaaagtctggagaaacgcaatattaacgcatttattgactgtttcgcgataaattggggtgatagcttagtcgcgaagattaacactgcactacagaagtccaagtacgttatagcaattattagtgaggacagcgtcaaaaaatcctggcctatgaaggagctgaatgccgtactgagcgccgaaatcgccgccgataaaaccaggctcttgcccttaatggtgggagatggagaggctctcgtacgtcaactgccacttctggcggacaagttattcgtaggctacaaagacaatatcgaggaaataaccgacatgatcgaatcactactgaccgagaaatga

SEQ ID NO: 7650 - RNA, 1590 nt, unidentified
  source 1..1590: mol_type = other RNA; note = synthetic construct
atggccactacattctcatcattgagtttctacctggtgtcttttgaaccaaagaaggtaccctataagaaatctattgtctggaaaaaccctaatctgtcttcaacgctgactcgggacgcaaacgtggccaaagaaaaatttattggcttgaagaccgacaatgacgtcgctaacattctggaagttccagtgggtcagctcctgcatatcctttacagccaaaaacaaaactacgatagcttcgtcatcaaaaagaagagtggcaaatctaggatcattgagtcgccaaaaacctccgtgcgcatactacagaacaaggtgcgacctctcatcgaggcgcattacagggtgaagaagccagttcacggtttcgtgggtgggggcaaatctatcgtgagtaacgccgagcagcacaagaagaaaaattacgtgctcaacattgacctggtcgatttcttccactcagtgaactttgggcgagtgcagggcatctttcgcaatactcccttcaatatgggaatacccgctgctactgtgctggctcagctgtgtacccacaatggccggttgccccagggggcttctacctctccggtgttaagtaacctggcctcgaccacactcgataagaagcttgttcagatcgccaagaagtttcacttaaaatacacgcgatatgcagatgatcttaccttcagttccaacaaacccttttccagcattctggtagataaggagatacaagaggacggacagtataaatacaaggcaggcagagtaatcgaacaggccatcaaagagtccggttttagcattaatcacaataagacacggttgcaacataaatcccagagacaggaagttactggcctggtcgtgaatgacggcgtgaacattaaccgcaagtttatcaggaaaacccgtgccatgatcaatggctggcgtcaggatttactagaagcggagcgcagattcataaaaatcaggtatcatgccgcagagtctgacatcgacgcgagcaaattggatggatcaatcttcaagagggccgtttacggaaacctgagctttattaaaatggttaagggggaggagcatagcccttacctaaccctgtgcaagcaggtgcttgccctcgataataaccctccagagtttgtcaagaagctgaagggggtcttcgacatgtatgatattttcatctgtcacgcttccgaggataaagccgaagtcgctatccccctgtataattccctcaaggaaagagacatcaacacattcattgactgctatggacttatgtggggggacagcctcgtggccaagataaacacagcccttcagaagtccaagtatgtcattgctatcataagcgaggacagtgtcaagaaaacatggccgatgaaagaactgaatgcagttctgtcagcagaaattggcagcgaagagactaaactgctccctcttatggtgggagacggggaagctctgttagagcaactgcccctcctccgggataagctgtttgtatcctacgacgataatatagaggaaattgtaggaaaagtggaggcattgttgatctga

SEQ ID NO: 7651 - RNA, 1584 nt, unidentified
  source 1..1584: mol_type = other RNA; note = synthetic construct
atgaatcaagccaactttgtgtttagggatttcgaaccaaaaaagttcagctattcaggcaaccagtattgggtgaatccatccctgtctcacgagctggccggagacattgacaacgcgatacagcaatttatcggcttgaaaactagtgccgatctggcttcaattctcgaagtccccgttgggcagctgctgcatattttgtatgcccagaacaaccagtatacgagctttgaggtgaagaaaaagagtggtaaaagcaggcttattgagtccccccggaacagcatccgcatactccagaataaggtccgccccctgatagaagctcattatcgggtaaaaaagcctgtgcacggttttgtgggcggagggaagggtattgtgtcaaatgcagagcaacacaagaaaaagaactacctccttaacatagacctgcaagacttctttcacagtgtgaactttgggagggttcagggcatcttccgcaatacacctttcaatatgggcaagagcgccgctacagtccttgcccaactctgcacttacaatcaaagactccctcagggagcctccacctccccagtcctgagtaatttagctgcagcatctctggataaaaagctggtgaaaatagctaagcgtcatcacctaacttacacccgctacgccgacgatattaccttctcttcgaataaaccgtttagcacaatgctggtggaccgagaaattttggaagatgggacatataagtacagggcggggaaactgatcgatcaggcggttgaggactctggattcaaaatcaaccattccaaaacacgagtacagcacaagagccagcggcaggaagtcacaggactagtcgttaatgacggcgtgaacgtcaatcgaaagttcattagaaagactcgggccatgatcaatgaatggagaaaagacatcctagcagcagagatccgtttcatcaaagagagatatcatgccgatgaagcagaaatagacgtgtcaaaactggatggctccattttaaaacgggctgtatacggtcacctgtccttcattcgcatggtgaagggcgaggagcactccccctacctgaccttatgtaaacaggtccttgagctggacggcaatccacctgattttgtcaaaaagctcaaagggatctttaatatgtacgacgttttcatctgccatgcttccgaagacaaggaagccgtggccaccccactgtacgaaagcctcaccaaattgggtatcaacactttcatcgatagtgaggcaatcaagtggggggattcactggtgtctaagattaacaccgctctgaagaagtctaagtacgtggtggccgttatctcggaggagagtattaataaatcttggcctatgaaggagattaacgctgtactttcactcgagatcggagaggaaaacacgaagttgttgccccttatggtgggggacggcgacgcgttgctcaagcagctgccgctcctaggagataagctttttgagagcttcaataacaacgccgaggagatcgctaggaaactggcagaaagattacagaagagctga

SEQ ID NO: 7652 - RNA, 1473 nt, unidentified
  source 1..1473: mol_type = other RNA; note = synthetic construct
atgactcagacaaactttttcttcggcgattttgagcccaaaaagtattcataccgcggcaatcagtactgggtcaatccttcgctatcgcatgagctcacaggcgatctggacaatgctatccagcagttcattggactgaagaccagtgctgatctggcttccgtccttgagatacctgtgggccagttgttgcacattctttacgctcagaacaatcaatacacctcttttgaggtgaaaaaaaagagtggcaagtgccgcctgatcgaatcccctagaaattctattcgcattttgcagaacaaggtgaggcctttgatcgaggcccattatcgggtaaagaagcccgtccacggctttgtaggaggaggaaaggggatcgtttccaacgccgaacagcacaagaagaagaactacttactcaacatagatctccaggacttcttccacagcgttaacttcgggagggtgcaaggtatcttccggaatactccattcaatatgggcaagtccgcagccacagtgctggcccaactctgtacatacaatcagcgtttgccgcagggggcctcaacgtctccagtgctgtcaaatctcgcagcagcttctttagacaagaagttagtcaaaattgccaagaggcatcacttaacctatacccgttatgcagacgatataacgttttcaagcaataagccgtttagcaccatgctggtggatagagagattctcgaagatggcacttataagtatcgcgccggtaaactaatcgaccaagccgttgaggacagtggcttcaaaataaaccactccaaaactagggtgcagcataagtcccagagacaggaagtgacaggtcttgtggtcaacgacggggtgaacgtgaataggaaatttattcgaaagactcgggccatgataaacgagtggagaaaggatattcttgcagcggagattcgattcattaaagaacggtaccatgtagacgaggcagaaattgatgttctgaaattggacgggaatccccccgacttcatcaagaagctgaaaggaatcttcaacatgtatgacgtctttatctgccacgctagcgaagataaagaagctgttgctacaccactgtacgagtctctgaccaaactcggcatcaacacctttatagacagtgaggcgatcaaatggggggatagtctggtcagcaagattaacaccgctctgaaaaaatccaagtacgttgtggccgtgatcagcgaagagtctatcaataaaagctggcctatgaaagagatcaatgccgtgctttcactggaaatcggagaggaaaatactaagctcctgcccctgatggtaggggacggagatgccctacttaaacaactcccactgctcggtgacaaactgtttgagagctttaataacaacgccgaggaaatcgcactgaagttggcggaaagactgcagaagaactga

SEQ ID NO: 7653 - RNA, 1479 nt, unidentified
  source 1..1479: mol_type = other RNA; note = synthetic construct
atgaataccgacacctcatcagacataagtgtcacaacttcatttgagcccaagcgtataattgcctacaatggccaccaatggatcaaccctaaactctcccctaccattctcagtgatcagcttaaggctgctgaaaagatcatcggtctgaaggaggcttctgacgtcgccaacatcctcgagataccagttggtcagctgctctacatcctataccagcagaataagaagtatacctcattcaccatcaaaaagaaatccggaaaggagagactaatcgaaaaaccaaacaactccctgcaaattttgcagtccaagatcaaaccccttatagaggcccactatcgggtgaaaaaaccggtgcacggcttcgtttctggagggaaaggcattgttagcaacgctgaacaacataaaaagaagaacttcatcctgaacatcgacctgctcgacttttttcactctgtgaacttcgggcgggtgcaggggatctttcgaaacatcccttttaatatggatgtgccggccgccacaatactcgcgcagctgtgcacttataatggaaggttacctcaaggggcctctacttcccccatcatttccaatctggctgccgccacactggacaagaagctggtacagatcgccaagcgcttccatttgacttatacccgttatgcagatgacattacatttagtagcaaccgagaatttcccgcggtaatcgtccaacgggacgtgaatacccaagacaaattgaagtacatcgtgggccctcttctggagagagcaattacagacagcggattccatgtgaatcacaataaaacacgcgttcagcataaatgtcagaggcaggaagtgaccggtcttgtcgtgaacaatggggttaacattaatcgccagctcatacggaacactagggcaatgattaatgaatggaggaaggatctgcagtcagctgagattagattcatcaaacacagataccacgtcaacgagaatgatattgagatcaacaagctagatggcagtatctataaacgggcgatatacggcaagctcagcttcattaagatggtgaggggagaggatcacagtccttacctgaaactgtgcaagcaggtactggagttagactcgaatccaccaccctttatcaaaaagctcaagggcgtgttcgatatgtatgacgtctttatttgtcatgcatgtgaggataaaaacagagtagccattccattgtaccatgcattagaaaagaaaggcatcaagacgttcattgattgctttgctattgggtggggtgacagcttggtcggaaagattaacacagccctgcagaagagcaaattcgtgatatccatcatttctgaagcatctatagataagagctggccaatgaaggagattcacaccgttcttagcatggaaatccgcaatactaaaacgaaactgcttcccctgatcgtgtga

SEQ ID NO: 7654 - RNA, 1578 nt, unidentified
  source 1..1578: mol_type = other RNA; note = synthetic construct
atgcagcaacctttggagttctcggagtttgaaccaattaagttcggcaacggcgacgaaaccatctgggggaatcctacgctgtcacctaggcttacccgggatcacaaggtggcagagacactgcttctgaatctcgagtccgacaacgacgtcgccaatttgctggaaatccccaccggccagctgctctacatactgtacgagaaaccaaagcgatataccatattctccattaagaagaagagtggcaagccgcgtctcatcgagagcccaaacagttctatccgcatattacagaacaagcttcgtccacttttggaggcccagtataaaataaagaagcctgtgcatggcttcgtaggcaacgggaagtccattatcagcaatgctgagcaacacaagaaaaagaactacctcctcaacattgacttactggacttttttcattccgtcaatttcggacgggtgcagggcatttttaggaatactcctttcaatatggggtacaaggccgccactgttctagcgcacctctgtactcacaacaaacgactcccacaaggggctcccacaagccccgtgcttagtaatctcgcatctaccactctcgacaaaaagctagttcagctggccaaaagatttcagctgacctacaccagatatgccgacgatattactttttcatccaataggccttttccacccctcctggtagaaacaatccacttagaagacggtacaagccatcaccgagtgggaaaggcactgaaacaagccgtcgaggacagtggtttcgctgttaaccccaataagaccagagtgcagcacaggagtcagcgccaggaagtgacaggcctgatcgtgaatgagggtgtaaacgtgaacaggaagttcattagaaacacaagagccatgctgcacagctggcggaaagatctgattgaggcggagttgacctatctgaagaaccgctatcacgctgttgatgtcaacaagtcgaacctgactggcgatatcttcaagcgggcaatctacggccgcctgtcattcattaaaatggtcaaagggcaggaacatggaccctatttgaatctatgccggcaggcactcgaacttgacaataatccaccgaagtccattgctaaactgaaaggggtcttcgaaatgtttgatgtgttcatttgtcatgcgtctgaggataaagaagctatcgcactccccctttatgatgaactgaatacgctgggtgtgaaaacttttatcgataaggttgagattcagtggggggactctatagtgggaaagatcaactctgccttacaaaaaagcaagtttgtggtcgcaatcatctcagagagctctattggaaaagcttggcccctgaaagagctccatgccgtgcttgggatggagatcggtagcggagataccaaattgttgccgctgatagtaggaaacgaggaagagctgttaatgcagctgcctctgatcaaagacaaggcttacctgccttacacgaacaactgctcagaaatcgccaaaatcctaaaggataaattggacacatccaattga

SEQ ID NO: 7655 - RNA, 1572 nt, unidentified
  source 1..1572: mol_type = other RNA; note = synthetic construct
atgcaactgactcttgaatttctcgatatctctgaattcgagccaaaaaggattgaggctagctggagtaatcccaggttatctcctacgctaaaacgggagcgcgatgccgtggcgcagcgtttaatcggaattcaaaccgataacgagctggccaacctgttggaaatcccagtaggtcagctcctgcacattttatacgaggaaaagaagcgctaccatgagttctacatcaaaaagaagtcaggacagcttagagttatagagagccctaacaagagtctaaaaattctgcagcacaaggtcaaacccctcatcgaataccattatagagtgaagaagagttgtcacggatttgtcggcaacgggaaaggaatcgtgagcaacgcagaaaagcacaaaaagaagcagtacgtcctgaacattgatttgaaagacttcttccatagcgtgcacttcggtcgggtgcggggcatattcatgaatgtgccctttaatatggggaactcagccgcatccgtgctcgcacagctgtgtactaaccattctaggttacctcagggggctcccacatccccggtgctatccaatttggcggcctccagtctagacactgctttgacaaaaattgccaagcggtaccacctgacttataccagatatgctgatgacattaccttttcatctaacaggaagttccccctggccattgtcgaccgttttgaaaccgacctgggaaaggtagaatggcgggtggggtcattacttcgtcagagcatcgaggaatcagggttcaccgtaaacgattccaaaacacgagtccagcacaggtcccaaaggcaggaggtaaccggtctggttgtgaatgacggcgttaatgtctcacgcaagtttattcggaacacgagagctatgcttaactcctggtccaaagatctggtggaagccgaacgaagatttctgatgacacgctatcatatgagcgaatctgaaatcgacagtaagaagctggacggtagatatttcaagaatgctatctatgggcgcctctcttttatcaagatgattcgaggcgaggataacagcagctacctcacactctgcaaaaaaatcctggagctggagcccagtccacctaaaagtatcgccaagcttaaggagaggtttgagatgtatgacgtcttcgtgtgccacgcctcggaggacaaagatgacgttgcgatcccgttgcatagagcgctcgaagataaaggcatcaaagcattcatagactgctttgagattaagtggggcgactccctggtggctaagattaataccgccctgcagaagagcaaatacgtcgttgcaatcatatctcaacactcggtgaataaggcttggccaatgaaggaactcaatgccgttttgtccagcgagatagactcaaagcaaactaaactcttgcctctgatagtgggcgaccagaatgcccttattgaggagctgccactgcttgcagataaactctttaaggtgttcgatgatgacatcgatcagatcgcatctgagctggagatgcgcctgaaatga

SEQ ID NO: 7656 - RNA, 1566 nt, unidentified
  source 1..1566: mol_type = other RNA; note = synthetic construct
atgatgacacttttcagggacgactttcaaccaagaaaaacccgtaaccaatttggtgaatcgagctggttaaatcccaaactgaatccatatctaacggccggccaagaagaggtgaatcagaagctgaagaatttaaatgacgtcagcgatgttgctaacctgctggaactgcctactggccagctcacctatatactgtacaacaagaagccggcttacaaaactttcggcattaaaaagaagagcggtaaagtcagaataatcgacagtccaaacaattccattctgatcctacagaacaaaatcaaacccgtgatcgagagctattaccgggtcaaaaagcctgtccacgggttcgtcagcggacgatcaataatcagtaatgcagagcagcacaagaaaagcaagtacattttgaacctcgatctaaaggatttcttccatgccgtcaactttggacgggtgaaagggattttcaagagtaccccatttaactttggagacaaggcagcaaccgtcctcgctcagctctgcacctatcagggacggttgccgcagggagcacccacatcccctcttttatctaatctggccgccacctcgttagaccgcgagcttgtacacctcgcgaaaaggtttcatatgacgtacacgcgctatgccgacgatattactttctcctccaataaaaagttcgacgagcagatcgtgaccttcctgatcgagaaggagtgttttgaggtgggggttctgctgaggaaaaagatcgaggagtccggtttcgaaatttctgaaagcaagactagagttagccatcgctctcagcgtcaggaggtgacagggctgaccgtcaacgataaggtgaacgttcctcgcaaatacattagagaaactcgggccatgctacactcttggggccttgggctcctggaagcggagaggaagtatctgtctttgaaaaaaggatggacttccgaaaagcttaactctacaaaactcgatggctcctactttaaaagagccatctacggcaggctcggtttcatcaagtccatccaaggggaggactcaagtccttatttgtcactctgcaagaaggccattacactggacagtaaccctcccaaatttattcaggttgctaaggaaaagttggacatgtacgacgtgtttatatgtcacgccagtgaggataaagaagctatagtgtttccactggaaaaggccttagtggcaaaaggcgtgaaggtattcgtggattcatctgtgatcaaatggggagatagtctggtggataaaatcaatcatgggcttcgagtatcaaaattcgtcattgcggttctgtcccccgctagcgtaaataaagcttggcccaagaaagagattaacgcaatcatgtcaatggagataaaggccgagaagaagaagcttctgccactgctcgctggctctgacgacctcatcaatgaatttcccttgatgagcgataagctgtacaagaagttcgataataacgtggacgaaattgtggatggcttgtgcgagatgctgcaggagacatga

SEQ ID NO: 7657 - RNA, 1407 nt, unidentified
  source 1..1407: mol_type = other RNA; note = synthetic construct
atgaaagatatcgacgatctggcacgtgtcctggaggtccccaagggaaatctggtgtatattgcgtatacaagaggactgtcagcgcagtacaagacgtttgaaatcagaaagaagtcaggagggactaggattattcacatgcctaaaggggggttgcgagtgctgcagcagaagctcaaaaagatcttcgatttccttgatcgtaaacccaaatgctcccacgcttaccataaaggcaagtccttccttaccaacgccgtggagcacaagaaaaagcgctttgtctttaatatggatctagaggaattctttcctagtattcattttggaagagttcaaggggtactccgcgccgcctataaaatgccaccttctgttgccaccttcatcgcacacttatgttgctacaacggttctatcccacaaggcgcacccaccagcccaagtattagcaacctggtgagtaacaacctggacaaaaagatattagccttggccatcaagcatcacgtgtcctatacacgctacgctgatgacattaccttcagctatcgatacaggaatttcccacctgccatcggacacttcgcggcaacaggccaacttttcggccccgccgctgttggagccacattagagcagctcatcaaagatcagggtttccaagtgaaccataagaaaactcggctgcagtacaaccactaccagcagtccgttaccggggtgattgtgaatcagttcccgaatgtccgaagaagaaaggttctagaggtccggaagctgatttatctctggaggacgtttggcctggagaaagcagagacttttcgcttcgagaaggctgagggtggagattactttagggccgtgctcttcggcaatctggcatacctcaaaggggttaggggcgagaatgacaaaattgtccggagcttttgtagggacatcctgcggatcaccacaaaggtgccaaactgggtacgcgtggcagcggaagaatttcaggtgaaggacgtgttcctttcacatgcctccgaggacaaggtggctgtagctaagccccttttcgatgcctgccaggctgtcggcatctcagtgttttacgacgctgaagatataaagtggggcgactctgttatcgaaaaaattaatcacggtctgggggaggccaagattatagtaccggtcatctcggagacttttttggaaaagaaatggcctgtgcgggagctgaatgtcgctctcagccggttcatgaaggacaaagcaagaatcttgcccattatatataacatcgaccacctcgacgattaccctttgctgagcgactttcattataaaaagtgggaagataacccagctgaactggtggcccttctaaaggaacgtctgaactctatatga

SEQ ID NO: 7658 - RNA, 1509 nt, unidentified
  source 1..1509: mol_type = other RNA; note = synthetic construct
atgaacgtcttcatctccagcctggaggacccgattgtgtctcttcgcttcgctcacagtgtgcaggacgtcgcatctgttctcggcctggatccagcccgctttttctacgtggtccagaatgcagataacgggtcttactacaaacagttccagatccctaaaaaaaaagggggaaagagggatattagcaaacccgtgcgtggactggcccttgctcaggatcgactcgccgcgattctggctcagaagtactcgcccaagcaatacgtgaaaggatacgtgaagggagagagtttcctgaccaatgcccaatatcacgaaagacaacgctggatcctgaatatcgacatcaaggattttttcccttccattaacttcgctagggtaagggggttattcatgtcaagctatttcgggtttaacgaccgagtggcaacaatactagctcggataaccacttttaatgacggattgcctcagggcgcgactacgtccccaatcatagcgaacctcatcgcccataatctcgataagaaacttctctctattgctatttctgagaggctgcgctattcacgctatgccgatgacatcacgttcagctctaaccagaagacagttcctgcatcagttattcgcagctgggaaccactacatggcgagcggagcgtggaactgggtaacgcaattagggaagcttttcggagtgcccggtttgaagtgaacgaagaaaagactagaattctgttctcgtctgagagacaggaagtaacaggtctgatcgtgaatagaaaggctaacgtttggaggggggatgtggccttactccgtatgaaactgcacagtgccagagtccacggcgcccagaacgcagcaaaactgtggctgaaaaccacagacaaccctgaccatttttggcgacacattgagggctggctggcttacatctctcaggtcaggggtcgagacgacccggtaactgcaaaattatgcaagatggctgtactaagtgggctgaagggagccgagtggatcgaaaagtacgctgatatggtgagagagttcgatgtgtttttgagccatgccaccgaggacaagccaaccgtcgtgaagcttaagagaaagttggagagcctgggtataaaggttttttttgacgtcgattccatacagtggggcgacagcatcgtggagaagattaaccacggccttttgaaatcctcattttttgtgccatttctgtccgacacattctccgcaaaaggctggaccaataaggaactcaactccgcaattgccatgaatatcaaccggaaaggccgtatcctccccatctgtgaggccaatttctcaattgccgataattatccccttctcaatgagactctgtatcaacggtggcctgaggatcccgcgttggaagcggccttcgtcaccagtgtcgccgatcagatattgaagatcgttcaacaggagaaatccaagcccaatgacctgtcagactga

SEQ ID NO: 7659 - RNA, 1533 nt, unidentified
  source 1..1533: mol_type = other RNA; note = synthetic construct
atggtcaagagcgaaggccaggcgctagagactagagagactcccattaataatgccctactccagctcaggatggcccattcagtgaccgatgtagcatttagtctgggactggaaccaagtaagtttttctacgtggtgcagaacgctgacaacggacgttattacaaggaattccagatacctaagaagaaggggggcatgcgacacatagcaaaaccagtccgcggcctcgctttagcacaagaccgcctggccgcaatcttgcgcgataaatatgaaccaaagcccttcgtgaaaggctacgtaaaaggccagagtttcctcacaaatgccagatatcatgagcgtcagaagtgggtacttaatatcgacattaaggacttcttccccagtattggctttgcgcgggttagaggactgtttatgagttcttacttcggcttcaacgatagggttgcgaccatccttgctaggatcaccaccttcaaggacggcctgccacagggggcaaccacttcaccagttattgctaatatagtcgcccacaatctggacaaaaaactcctggctatcgccgtgaaagagcggctgcgctatagccggtacgccgatgatataacgttttcttctagccagaaagcagtacctccttcagtggttaggggttgggagccgatgcatggtcctcggacagtggatctaggtggggccgtcttggaggcctttcggtcagcccggttcgagataaatgacgagaagacgcgaatccttttggcctctgagaggcaagaagtgaccggcctgattgtgaacagaggcgcgaatgtctggcgccgtgacatcagcttattaagaatgaaattgcactctgctcgcgtgcatgggcctgagaaagcagccaaactctggctgaagacaactgaatcgcccgttcatttttggcaacacattgaaggatggctttcctatatctcccaggttcggggaggtgatgaccctgttacggctaagctgtgtaagatggcagtgcttagcgggttcaagggaaccacatggattgaggcatacgctgagatggtgagggaatttgacgtgtttctgtcccacgcctccgaagacaagcccaaggtgcgaatcctgaagaacaaactggaatactacggcattaaggtgttctttgacgctgatagcatcgagtggggggacacaatcgtcgagaagattaatcacgggctcctgaaatcatcctattttgtccccttcctgtccaaaacattctcgagcaagggatggaccaacaaagaattgaactctgccatcgccatgaatgtcaaccgaagaggaaggattctgccgatctgcgacggtgacttctctattgaggaaaactacccgcttctgaacgagacattgtataaaacttggcccagcgatccaaccgaagaggatcagtttgtcacttccgtggctgatgagatcctcaaaagagtgcaggataagcaatcccagcaaaacgatctcagcgggtga

SEQ ID NO: 7660 - RNA, 1506 nt, unidentified
  source 1..1506: mol_type = other RNA; note = synthetic construct
atgaccataacactggggctggacgatccactcctgctcctgagactggctcactcaatccaggatgtagccttcgctttaggcctcgagccggccaagtttttctacgtggttaagaattccgacaacggccgctattacaaacaatttcagatccccaagaaaaagggaggcatgcgcgatattgctaaacctgtcagaggcctcgcactggcgcaggacaagtttgcagcaatcctcgcccagaagtatgaacccaagcagtttgtaaaaggctacgtgaaaggtcaaagtttcctgactaatgctcagtatcatgaacggcaaaagtggattctaaacatagacatcaaggacttcttcccatcaatctcttttgctagggtgcgaggccttttcatgtcctcctacttcggattcaatgaccgagtggctactatccttgccagaataactaccttcaacgacggactcccccagggagcctccactagtccaatcatcgccaacatcattgcacataacctggacaagaaattagtcgagatcgccattagggagaggttgcggtacacacgctatgccgatgatataacattctcaagcagtcagaaggcggttccgtcatccgtcgttaaaagctgggaacctctgaatggagctcgtacaattgcattgggaaatgacgttatcgatgcctttagatctgcccggttcgagattaacgatgagaaaacacgtatcctgttcccctcagagcgtcaagaggtgaccggccttatcgtaaatcgaaaggccaatgtgtggcggagagatatatcgctgctgaggatgaagctacattctgcgcgcgtgcatgggcctagtaaggctgcaaaactctggctgaaaacgacagaaaatccagttcacttctggcaacacgtagaggggtggttgagctacgtgggacagattaggggccctaacgatgcagtcgtggcaaagctgtgcaaaatggcggtgttaagcgggcttaaagggtctgaatgggtggagcgctacgccgacatggtcagagagtttgacgtgtttctgtcgcacgccagcgaagacaaaccaaaaatccggaagttgaaggacaaattggagagctatgggttaaaggtgttctttgatgaaacctctatctcttggggcgacagcattgtggaaaaaattaaccacgggctccttaagtcttcctttttcgtcccctttctatccgaaaccttttccaccaagggttggactaataaggagcttaacagcgccattagcttgaacataaataggaagggtcggattctgcccatttgtgacggcaacttttcagtggagaataattaccctctgctgaacgaaaccctgtataaaaagtggcctacggatgctgctcaggaggaggaattcctggtcagtgtcagtgatgccatcctcaagaaagttcaggacgcccaggcaacctccaacgatctctctggttga

SEQ ID NO: 7661 - RNA, 1518 nt, unidentified
  source 1..1518: mol_type = other RNA; note = synthetic construct
atgagcgatccccaggcaaaagtcgatctgattgatctgactgccgacccaatgtttcgcctgttaaccgcccacagtgtggtggatgtggcccacgcacttcaccttgaccccgcgaggttcttctacgtggttcagcatgctcaggacggcacctattataagagtttttctatcgccaagaagaaaggcggtgttaggcacatctccgccccgaagaaaggcctgagactcgcccaagcgcgacttgctgcggtgttgctgaaagcctataagccaaagcctttcgttcatggatacgttaagggccagtctttcttgacaaacgctaaactgcatcaacggcaacgatgggtgctcaatctcgatatcaaagacttctacccaagcattacctttccccgtgtccggggtctattcatgagcagtgccttcgggtttaacgatcgggtggcgacgatcctagcacgcattaccacaacctcaaatgggttacctcagggggcccggactagtcccgttatcgcaaacatgatagcatatactctggacagaaagctgatcgagctggctacgcgccaccgtctcacatacaccaggtacgcagacgacgtcacattgagttcttccagaaaagaagtgcctgccgatgtcgtcaaatcctggtcccccccttttggggaaaggcagttggacctgggaggcgtcttgagcgccgccttccagacagctgggttccagatcaatgatgccaagacccgcctgtcatttcagtatgaacgccaggaggttacaggcgtagtggtaaatcaaaaggctaatgtctggcgcaaggatatctccaggatgcggatgattttacattccgctcgaaagcacggagctgctcaagccgcaacggtctgggtgggcaaagacgcaaacgccgacagattttggagattcgtggcgggctggctctcttttttcgcacaggtgcggggaagggatgaccctgtagtggccaagctgtgtaagctggctgtgttcgctggtcttaaagggatcgagtggattgagaagggggctgatatggtaagagagtttgacgtgtttctgtctcacgcttcagaggataaggagagagtacgtaaactcaacgatcggctggttgacctgggtgtcactgtgttttttgatgaaagcagcataggatggggagattccatagtggaaaaaatcaaccatggccttctgaaatcatctttcttcgtgcccttcctgagcgattcgttcgcaagaaaaggttggacaaataaagagttgaactcagcaattgcaatgaacatcaacaggaagggccgaattctcccaatcaaggacattgggttttcgcttgaggacaattacccgctcttaaatgagactctctaccgcacttggccagccggaggcgaagacgaagctgcctgcagcctggccgacgagattctcctgaaggtccagaccgcccacgaaataaggtccgacctaggatga

SEQ ID NO: 7662 - RNA, 1446 nt, unidentified
  source 1..1446: mol_type = other RNA; note = synthetic construct
atgcaggacgttgctttcgcactcaatctggacccagctaaattcttttacgtggtccagcatgcggatgacggcagctattatcgcgagttcgttatccctaagaagcgtggtggtgtgaggtcgattagcgcaccacagaaggggttggccttggctcagaccagattctacgagctgcttcttgagaaatacaaacccaagccattcgtgaagggatacgtcaagggggagagcttcttgaccaacgcgaagtatcacgaaaaacagaagtggatcctgaacatcgatatcaaggacttttatccatccatcacctttgctcgggtatacggcctttttctgtccccgtatttcggattcaatcgccgcgtttcagcaatcctcgccaggattacgacttaccggaatgagctccctcaaggcgcgcgcactagcccaattatagccaacattatagcatccaatctggataagaaactggtaagtctagccgccgatttaaagctgaaatacagtcgatatgccgacgatattactttcagctcttcccaacgaagaattcctgcaggattagttaaggggtgggaaccatcttttggagatagagaaattaagcttggcgctgctctcttggaagcctttaacggcgctggcttcagagtcaatgatgctaagacacggctgttgtttagctacgagaggcaggaagtgacgggcttggtggtaaatcagcaggccaacgtgtggcggaaagacataagccgcctgaggatgatcattcacagtgcacgaaaacatggaccccgcgaggccgcctcaatatgggtgggaaaaaacgcctctgaggaagaattctggcaatttctctgcggctggttggcttacgtagcacaggttcgtgggcagtccgatcccgtggtcgccaaactgtgtaaactggccgtcattgccggtctaaaggggcctaagtggatagaccgttctgcagatatggtgagggaatttgatgttttcctgagccacgcgagtgaggacaaacctagagtcagacttctctatgagaaactggtggaagtgggggtgaccgtctttttcgacgaagactcaattgcctggggtgatagtatccccgagaaaatcaatcacggcctactcaagtctaactttttcatcccgtttttatctaagcggttttcagaaaaaggatggacaaataaagagctgaactccgctatctcaatgaacatctccaggaaggggcggatcctgcccataattgacggccatttctcggtggaggagaattaccccctccttaacgagacactgtataagaagtggcctatcgaggtggaactgcaagccaaattcatctccaccacagcagacgagattctgaaaaaggtcgtggctgaaaagctcaagaagcacgacctgggatga

SEQ ID NO: 7663 - RNA, 1431 nt, unidentified
  source 1..1431: mol_type = other RNA; note = synthetic construct
atggcatttgctctggggctcgacccagaaaaattcttctatgttgtgcaacacgccgctgacggcacctactaccgcgaatttcaggtgcccaaaaagcggggcggggtgagaaacatatccgctcccaggaaaggtcttgctctggcgcagaatcgtcttgccgaggtgattcgcagtcattatgtccctaagaaatttgtgaagggctatgttcgaggagaatctttcttgagcaacgcacggtaccacgaaaagcagaagtggattttaacagtggacatccaagacttctaccccagtataggtttcgccagggtcagggggctgttcctgtctcggtactttggctttaatgagcgtgtggctaccattttggccaggatcactacatacagagacggtctgccacagggagcaagcacgagccctctgatcgctaacatcatcgcgcacaacctcgataaaaaactcgttgccatcgccgtaaaaggacagctaaagtatacacgatacgccgatgacataaccttcagctcatctcggagagctgtcagttccgacgttgtgcaatcatgggagcctgcattcggccggcgcgaagtacatctcgggcagtctataaccgaggcgtttaaacactcgggctttgaaatcaatcataccaaatcacggatcttgttcccatttgagagacaggaggtgaccgggctagtggttaaccgtaaagccaacgtgtggagacgcgatattgctcggctgagaatgaagctgcacagcataaaacgcttcggggcaaccgaagcagcgaaagtgtggctgggaccaggtggcgacaagcagaagatgtggtcacatgtcgccggcaacctggcctttattcgccaagtccgagggatgacagatcctgtgctcgccaagttatgtaaggatgccgtaattgccggtatgactggcccgtcctgggtgcttcagatggccgagatggtcagggagtttgatgtgttcctcagtcatgctagtgaagacaaagaaaagattaggcgattgaaggacaagctagaagagtgcggagtaaaggtctttttcgacgagacgagcattaagtggggagattctatcgttgagaagatcaacaacggactgttgaaatcctcctatttcatcccgtttctttctaaaacattcagcgagaaagggtggactaataaggaactcaattctgctatctccatgaatgtttccagaaagggaaggattctgcctattatcgactcgaattttagcgtggaggaaaattatcccctgctgggcgaaacattatacaagaagtggcccgccgatgagtcaagcgaggatgcattcattggcgaggtcgccgatgcaatcctgcaccttatcgagaagaaagtcacttccgtggcaacttga

SEQ ID NO: 7664 - RNA, 1533 nt, unidentified
  source 1..1533: mol_type = other RNA; note = synthetic construct
atgaagggaaaggatcggggctcatctattctgttgccagagaatccattcagtgaccctatattccgtctgaaaattgctcacagcgtccaagacgtggcatcagccctcggtctagactctgcgaagttattttacgtgatcagacactgcgacgatggccgctattacaaaaagttcaagatccccaagaaaagtggtggcttcagggatatctctcgcccaatcagaggactggccatggcccaagatcgattggctacgatcctcaccgcccactataagcccaaaagcttcgtgaagggttacgtaaaaggggagagctttctgtctaatgctcagtaccatgagagacaaaaatgggtgatgaacatcgacattgaagactttttcccaagcattgggtttgcaagagttcgcggactctttcttagctcctactttggattcaattcgaacgtgagcactatcctggcaaggattactacatttaacaatcagctgccgcagggggcctctacttctcctatcctggctaatatcctcgctaacaatctcgacaaaggcatcctctcaaccgccattcgcggtcggctgcgttattcccgctatgccgacgatatcaccatctcaagttcacagagacacgtgccctcccttattgttaaaaactgggagcccgataagggtaagagagagattagagtcgggaacgacatcgttgacgcctttaagaaggcccatttcaagatcaatgaaaaaaaaacccggatccagtttacctatgaaaggcaggaggtcacagggttggtggtcaacaaaaaggcaaatgtgtggcgaaaagacgtgtctaagatccggatgaaactacattccgcaaagaaatacggagcggaaaacgctgctaagctgtggctgggcaaggacaagtcaggcaaagatttctggatccatatagaaggctggttagcgtacattaggcaggtcaggggcgttgatgatcctgttctggccaagctctgtaaacaggccattctttccggactgaaggctagtaagtggatccagaggtgcagcgatatggtgcgggaattcgacgtatttttaagccacgcatccgaagataaagaaaaggtccgaattttgaagaatgcccttgaaattaggggcattaaagtattcttcgatgaagactccatagagtggggggactccattgtggagaagataaatcacggcctactgaaatcatcgttctttatccccattttgagcgataagttctctaagaagggatggacaaacaaggaacttaatagtgcgattcacatcaacataaaccggaaaggccgcattctcccgatagcaatcaacggattttccatagctgagaactatcctctgctgaatgagacactgtacaaggtgtggcccaacaacgagattgagcagaatatattcatcgaggaggtcagtgaccaattgctgctcaaaatccagaaaacccatagcgagtccgccgggcttgggtga

SEQ ID NO: 7665 - RNA, 1494 nt, unidentified
  source 1..1494: mol_type = other RNA; note = synthetic construct
atgagcgtgtttgatgatcctatcactaaactgcgcctggcacattccgtgcaggacgttgcatttgctctgaacctggacccagccaaattcttctatgtgattcagaattctgagaacggaagttactacaagaagttcgagatcccaaagaagagcggcggggtgaggcagattagccgaccactgcggggtttggctttggcccaggatcggctgtcagctgttcttactgctcattataaaccaaaaagcttcgtcaaaggatacataaaaggggagagctttttcacaaatgctaagtaccacgagaggcaaaaatgggtcctgaaccttgacatcaaggatttctttccttcaatccatttcggcagagtcagaggcctgttcatttcccagatgttcggctttaatgagcaggtttccaccgtcttagcccgcatcgtaacctttgagaatggtctgcctcagggagcatctacatcccctatcatagcgaatatcattgccaacaacttggataaacagcttatagccattgcggccaaagagcgtttgcgatacacgcgttacgcggacgatatcaccttcagtagctctcagaaaactgtaccctcggccctgattaaactttgggagccagacaaggggaaccggcagataaccctcagctctgccgtgcatgacgccttccgccaatccaatttcgcaataaacgaggataaggtacgcatccaatttccgtatgagcgccaagaagtgacaggcctaattgtcaacaagaaggccaatgtctggcgccgtgatgtgtcgaaactccgaatgaaaatccatgctgcacggaagcacggggctgaatcagccgcgaagatttttatcggagaaagcgcagacggcgaaaaattctggcaacacatcaccggttggctcgcatatgtgaggcagattcggggtaacgatgaccccgtggtggccaagctgtgcaagcaggccattctggccggcctcaatggagctgaatggatcagacggtacgcagatatggtcagggaatttgacatttttctgtctcacgcctccgaggacaaggagaaggtgaggaaacttaaagacaagcttgaaggcaaggacgttagagtgttctttgacgaatcatcaatttcatggggggatagtatcgtagagaaaatcaaccacggcttgctgaagagtctctatttcgttcccgtgctctccgagacatttgccaagaagggatggaccaataaggaactcaacagtgcaattcagagcaatattgggagaaaaggaagaatcctacccatcgtgatgcctgggttctctgttgctgaaaactatccgctattaaatgagacgctgtacaggtcctggcccgctcaagagcagaaggagggcgagtttctggaagaaatatctgaccagatactcctgaagatccagaagagtcaccacgaaaaaactgatttaggttga

SEQ ID NO: 7666 - RNA, 1497 nt, unidentified
  source 1..1497: mol_type = other RNA; note = synthetic construct
atggcactaccagagaatttcgatcctgaacaggcccacttgttccttggatttgcttactccatccaggacatcgccagcgcactgcacatgaggccggatggcattttccatatcactaagacaagcgaagatggaggctactatcgttcttttcgcattccaaagaaaaatggaggcgagaggagcatcgaccaacctctacgcggaatggccatggcacaggagcgattggccgccatcttacgggcgacctacgtgccaaagtcgcatgtgcatgggtatgtttgcgacaggagcttcctgaccaacgcccagtaccatgtcggtcaaaagtggattctgaacgtagacatcgaggactttttcgggtctattaccttccccagagtgcggggcttgtttcagacctacttcgggtactctgaccgggtggccaccacacttgcccgcatttgcacataccagggtaagctcccacagggcgccaaaacatcccctgttctggctaacctcattgcgcacaacctggataaatctttgctagctatcgcgactaagcactcattaagattttcccgatatgcagatgacattactttcagtacgagtcagagaaggttccccccttccctggtaaccgcctgggaacccctgtatggtgatagggagatccagctcggtgggcccctgaaggacgcattcatgaaagctggtttccgcatcaatcaaacaaaaacacgcatccaaaggtacgatgagagacaggtggtgactgggctggtggtgaataagaaagccaacgtttggcgatcagacataaaaagacttcggatgaagttacactctgcccataagtttagcgcagacgaggcggctaagatatggataggaccgtccgccacgcaggaagacttcgttgcgcacgttgaagggtggctggcttttatacgtcaggtcagaggaaagaacgatgccgtgctcagtaaattatgtcaacaggctgtagtcgctggcgtcacccagcaggcatgggtcaaagagctggctaagaccgtgcatgagtttgacgtgttcctgtctcacgcatcagaagataaacccaaagtacggttgcttagagacgccctggaacacctgggcgtgaatgtttttttcgacgaagatagcattacatggggagactccatcgtggaaaagatcaatgaggggctcctgcgctcaagttttttcgtgccctttctgtcagagacttttgcagccaaggggtggactaacaaggagcttaacagtgccataaccaataacgtccaaaggaagggccggattttgccaattacggatgctggctttgaggtcgaggataattatccacttctcaacgacatcctctataaaagctggcctgctgaaggccctgagcaatccgcccagattgaagaactggcagatcagctcctggctgtgatcgagaaaaataagctcaaagcacagtga

SEQ ID NO: 7667 - RNA, 1497 nt, unidentified
  source 1..1497: mol_type = other RNA; note = synthetic construct
atggggctgcccaaccatttcgatccggccacagctcacctccttattggtgttgctcatagtgtgcaggatgtcgctggtgcccttatgatgcgtcctgggggattgctccgtattcttaaaaacaccgagactggtgagtactataaaacgtttgagatccctaagaaacggggcggcacacgaactatcgataagccattgcgcgggctggcaatggcccaggaacgatttgcagccgtgttgctcgaggtttacaacccaaagccatttgtgcacggatatgtcagcgggagatctttcctgagcaacgcccagtatcaccagaggcagagatggattctgaatatcgacatcgaggacttctttgggtccatcggattcgcacgcattagagggatcttcatgtcaaaacttttcggctacaatgacagggtcgccacaatcctcgcgcgaatctgtacctaccaagatagattgcctcaaggggcaaagacatcacccgccttggccaatctcatcgcccacaacctggacaaggagttaattgctctggccgcgaaagaaaatctccgtttttccaggtatgcggatgacataaccttctctagcagcagcaaacgcataccaaggaccctgatcaaagcttgggaacctgaatatggcgacagggtggtagagctcggcgaacggctggaagaggcattcagaggaagcagtttccagataaatcgggacaagacccgcgtgcagctgtttggcgaaagacaggttgtcactggcctgattgtgaatcaatgccccaacgtttggcggaaggacgtcaaaagattaaggatgaagctgtactctgctaagaagtacggattagagcaggcagcttctctttggattgggctcgatgccaagcctgaagccttttggtcacacgttgaaggatggctcggctacattaaacaggtgcggggagagggtgatcccgtgctatccaaactgtgcaaacaagctatggaggcaaatccaaaaagtagtgactggatccaggagcacgcccatatgattcatcagtttgacctgttcctatcacacgcaagtgaggacaagccccgcgtgaagaagctacacgacaagctggtggtactgggagtgaaagtcttcttcgaccaatcctctattagctggggcgactctatcgtggagcagattaacatcgggctcatgaaatcgaacttttttgtcccgttcctttccaacacgtttgctgaaaagggctggactaatcgggagttgaattccgccatatccataaacatcaaccgaaagggcaggattctgcccatatgtgaccatgattttcacgtaggccgcaactatcccctactggccgatatcctgtacgaatcatggccaggtcctgatgccgatgaagaggctaagctgaatgagatcgccgataagttactggcagctgcggaaaaggcaaaacatagccagtga

SEQ ID NO: 7668 - RNA, 1461 nt, unidentified
  source 1..1461: mol_type = other RNA; note = synthetic construct
atgctccttggcgtcgcgcacagcgtacaggacgtggctcatgcactgtcgatgccggcgggaggcttgttttacgtgctccaaaacgcagacaacggcaaatattaccagtcttttgagataccgaagaaaagggaaggtacccgccctattgacaagcccgttagagggctggctctggcccaggaacgactggctgccgtgcttaaacagtcctacaggcctaagtcatttatccatggttatgtaaccgagcggtccttcctcactaatgcccggtaccatgagaagcaaaaatgggtgctgaatattgacatcgaagacttcttcggaagcattggattcgctcgaatccgcggcttgttcatgagccaattcttcggcttcaaccacagggtggctaccatcttagcccggctaacaacgtacaaggatgcactcccccagggggctaggacaagtccaattctgtcaaatatcattgcccacaacctggataaacatcttgtcgagatcgctgtgaaagaacgactgaagtattcacggtacgctgatgacatcactttttcttctagccgcaggaagattccaccatcattggtcagaacctgggagcctgagtatggggaccgggaagttatcttgggggaaaaaattactgatgcatttaagaccgcgcattttaggatcaaccccgataaaacacgtattcagctcttccgagagagacaggtggtgacagggctgatcgtgaacgaaggcgtaaatgtctttagaaaggacatttcccgcctacgcatgaaactccattccgggaaaaagtttggactggaacaggccgcaaaagtgtggatcggtcccactgccacagtgaaggattactgggcacatatagagggatggttaggccacataaagcaggtccggggtgacgacgatccagtgctcagcaagctgtgcaagcaagccgccgacatcaaccctgcagctcctgagtggataatacggcacgccgaaatggtgagagagtttgacatttttctgtctcacgcaagcgaggataagccacgtgttagaaaactaaagaaaaaactggaggccgtaggaattaaggtgttcttcgacgaagaaagtatcacctggggagattctatagttcagaggatcaaccacggcctcttaaagtccacgttcttcgttcccttcttgaccaatacctttgccgccaagggctggactaatagagaacttaatagtgcgatcagtgccaacgttaatcgccagaaacgtatcctgcctatttgtgaccacgattttcacgtcgggaaaaattatcccatgctcgaggatgtcctttataaaacgtggccaaaggctggccccaaggaggacgagtggctgaacgccattacagatgagttgcttgcactggtcgaaaaggtgaagctggagacttcctga

SEQ ID NO: 7669 - RNA, 1524 nt, unidentified
  source 1..1524: mol_type = other RNA; note = synthetic construct
atggccaataggggggcgcgcatagaagtgaagaatgaagaacaggctcttctacttccctccgaggaggagaaagccttattttcgctgcagtatgcccactctatacaggacgtggcatttgccctggggctagaccctgccaagttcttttatgtggtaaagaattgtgactcaggtgaatactacaagagtttcaccattcctaagaagaatggcggggagcggaagattagcaagccactcagagggttagcccttgcgcaggtgcggttgctgatcatccttaagcacgtttataagccaaagggttacgtgaaatcttacgtggagggagagagcttcctgacaaatgcaaactaccactccaatcagaagtgggtgctcaacttcgatattgaagattttttcggaacaatcacctttccacgtgttaggggactgttcatgtccaaatttttcggttttaatcccagggtatctactatcttagcaagaatttgcacacacgagggctcattgcctcaaggggcacctacgtctccgatcctgtccaacattataggcaatgctctggacaagaatctggtcgctctcgcccgggaatacaagctgaaatacacccgctacgccgatgacataaccttcagcagttctcagaaactgccaccaggagccgtaattagtttgtgggagcctaaattcgggaagagagaaattaccctcggcaaagatattcgggaggccgtcaaaaatgccggattcaggatcaaccccgagaagacaagaatacaatttccatatgagaggcaagtcgttactggcctagtcgtcaacaaaaaagcgaacatccgtcgggctgatatagcccgactgcgtatgaagatccatagcgcacagcgctttggcgcggaatccgcagccaaggtttggctcggtcccaacgctactgcttcatctcttcaaagccacatcgaaggacatctgtcctacgtgcgccaggtgcgcgggaaagacgacgtcgtgctggccaagctgtgtaaatctgcaataatcgccggacttgctaacgccacgtggatgaaagctcaggcagacatggttcgagaatttgatgtgttcctgagtcatgcatccgaggataaagagaaatatggcaagctcaacaaagctctcaaggctgtgggcgtgaagacttttttcgatgtcgacgtgattcagtggggggactcgattcccgagaaggtgaattttggtttgctgaaaagcgactacttcattcccttcctgagcaacaacttcacccgaaagggctggactaacaaagagctcaattcagcaattagtatcaacatcaaccggaagggcaggatcttgcctattatcgattccgacttttcagttgatgataattatccgatcctcgctgaaaacttgtataagaagtggcccgagaaagagagcgaggaagatgacttcattgaggaaatctgcgccgaaatcacaaaaagaatcgtaagatga

SEQ ID NO: 7670 - RNA, 1521 nt, unidentified
  source 1..1521: mol_type = other RNA; note = synthetic construct
atgaagtcaaaggagcgcggcagctcccaggtgaaagcaagcattgtctttcacaccgatttccgattgattcaacttcgcgcagcacattcagtccgagatgtggccctcgctctcggattagatccgaaaaaatttttccacgtcctgaaacataccgacgatggacggtattatcgcgattttgagattcctaagaagactggcggttaccggcagatctccaagccggtgaagggactggcactggcacaggaccgcctgtcaactatcctcgatcacgtgtacaatcccggctcttacgtaaaagcgtttgtaaagaaaacctccttcgttgagaacgcccggtatcacaaggcacagaggtggattctaaatattgacctcaaagacttcttcccatctatatcctttcctcgggttcgggggctgttcctcagcacactttttgggttcaatgagagagtggccaccatattagcccgtatctgtacctacaaaggatctctgccacagggggcctccacatctccaaggctggcgaatattatagcgaagtcgctcgacaaaaagatcctggagattgctaaaagtcatcagctgaagtatactcggtacagcgatgacatctctctgtccagcagtaagaaagtgatccccacgctggtggtgaagaactttcacgacaaccctgacggacgagatgtgattctgggcgacggattgaagaacgctgttcggtcaagtgggttcttcataaacgcgtcaaaaactaggctaatgatgccaaataaccgtcaagaagtcactggtttagtcgtgaataaaagggtgaatgtccgccgaacagatattgccaagcttagaatgaaaatccattccgtgaagaaagtaggcttcagtgaggctgctaaagtttgggtggatggtaacgaagctcaactgaagaaccacctcgtagggtggctcgcccacattaggcaagtcagaggtccgtccgaccccgtcttggctaaactttgcctgcaggcccatgaggcagggcttacagaaatcaagtggatcgaggagctggccgacatgtcaaaggagttcgacgtgtttctgagtcatgcttccgaggataaagaaagagtaagaaggctacaggccgagctggaggaacgtaaggttagcgtgttttttgatgagtcaaccataaaatggggcgacagcattgtggaaaaggtcaaccacggcctccttaagagcacattcttcatccctttcttgacggaaacgtttagcaagaaaggctggaccaacagggagctgaattctgccatccagatgaacatgactagaaagcgcaggatcttacccatcaagagtccagattttgacgttgactcgaaatatcccttgctgaatgacacactgtacaagacctggcctagagatcccgcagacgaggccgctttcatctctgaaatttccgatgaactcgtggccttgatcgaaatggaaaagagctctgtttga

SEQ ID NO: 7671 - RNA, 1482 nt, unidentified
  source 1..1482: mol_type = other RNA; note = synthetic construct
atgaatgaactcgatttatgtctgttccaacttaagatcgcgcactccgtgaaggatgtatccttcgcactgaaactggacccagaaaagttcttttacgtgcttcagcatactgacgacggcagatactaccacacgtttgagattccaaaaaagaatggaggaaagcgcgctatcgccaagcccttgcgtggtcttgctcttgcacaagacaggctggcccccctgctgcaccacgtttataatccgggcccccacgtgaaagctttcgtgacaggttcatcttttgtcagcaatgcctcttatcacaagggccagcggtggatcttaaacattgatctctccgacttttttcctagcataacctttcctcgcataagagggttatttcttagcaagctgtttggcttcaatcccaacgtgtctacaattctggctcgaatttgcacgttccagggcagtctgcctcagggagcaagtacaagccccgtgctcgcaaatattattgctaattcgctggatcgcaagttcttggaaatagccaggagtgaaaaaatcaaatacagtcgctattcagacgatattactttttcaagctcgaagaagtccattcctaaatgcctggtgaagagcttccatgaccacgaggatggcagagagataatcctcggcaacgacttgcaggatgccgttagggccgctggcttctctctcaacgatcagaaaacccggctgatgaccccaaataatcggcaggaggtcactgggctcaccgtcaacgagagagtgaacgtcaggagatcagacatcaaccgactgcgtatggtgattcacagcgcaaagaaggttgggttcgaggaggcgtccaaggtgtggcttccagacggaaagaacaatttacgggagcacattctagggtggcttgcccatatccgccaggtaaggggtgcctcagacccagtattggccaagctctgtctacaggcacatggcgcgggactgacaaaggtcgggtggattgaggagctggccgatatgtccaaggactttgacgtgttcctcagccatgcctcagaggataaagaccgagtgaggaaattgtctgatgcgctgaccgccggcggtgttaaggttttcttcgatgagagcagcatcaaatggggggacagcatcgtcgaaaaggtaaaccatgggctcctgaaaagtcgtttttttatcccgttcctgacaaccactttttcaaagaagggatggacaaacaaagaactcaattcctctatatccatgaacatcagtcggaaaggaagaatattgccaatcaaatccgaggatttcgaaatcggtgatcggtaccccatcctgaacgaaactctatataaaacctggcctaaaagttccgttgatgaaaccgcattcatccaagaagtcgtggactctattatcaaactgattgaggaagacaaagctgctccttctgtgtga

SEQ ID NO: 7672 - RNA, 1518 nt, unidentified
  source 1..1518: mol_type = other RNA; note = synthetic construct
atgcgagtagataaggtgaagtccgagggaagggctgacacagtcaagtctgaggcggaggttctgtttagcctgcagacagcacactccgtcaaggacgtggcctacgctttgggccttgaccccgaaaagtttttttacgtggtgcagcgggccgacgatggccactattacgacactttcaaaatccccaagaaaagcggcggcgaacgggacattgcgaaacctaagaaaggattagccctcgcacaggctcgtctggttcccatccttagcttcgtgtatagccctggtgaatgcgtcaaaggatttgtaaagggcagcagttttttagacaacgcccattatcaccatgcacagagatgggttcttaatattgatctgttggactttttcccatcggttacgtttgcccgagtgagaggcctctttatgtcgtcactattctcctttaatccccgggtagctacaattctggcaaggatatgtacctttcagggagggttaccacagggcgccaccacttcccctattctggcaaacttaatcgctaaatctcttgataaacgcttgacaggactagccagaactcaccgcttgaagtactccagatattcagacgatatcacactctcttgctccaaagcatacgtccctaagagtatcgtctctgagattatcgaaatcgacagtgcttgggaagtgcagctggggagtgaacttaaagatatcattaggcattccggcttccgggtgaatgacaagaaaacccggctaatgaggcgcaataatcggcaggaggtgaccggcctcgttgtgaatgaaaaggctaacatccgcagggcggatatccaacgcctgcgaatgaaaatatattccacacgtaagtacgggcaagctgaggcctcactgctctggctcggggacagcagcaagtctataagtatgcacctggtcggctggctggcctatatacgccaagttagagggcaatcagatccggttctggccaagctgtgtcagcaggtcgtggccgccggaatcagcgacatcgagtggatagtccggctcgctgatatgacgaaggagttcgatgtgttcctgtcccatgcgagcgatgataaatctaaagtgcgtccattgtacgagtccctcaactccgccggggtcaaggtattcttcgacgagagctcaatcaaatggggggattcaatcgtggaaagggtgaaccacggtttgctcaaaagtaggttctttgtgcctgtgctgagcagtaccttttcacgaaagggttggactaacaaagagtctaactcggccattgcaatgaatatttctcgcaagggtagaattctgcccattaagttcagcgagttcgacctggacgggaggtatccaaccctgaacgacaccctctacaagacctggccggaagattctggtaaagaggacgatttcatcagagaagtgactgacgatctgattgcacttgtagagcaggataagcagcttggatga

SEQ ID NO: 7673 - RNA, 1479 nt, unidentified
  source 1..1479: mol_type = other RNA; note = synthetic construct
atgaagctccttaatccttccagccggagcattgcaaagcttaactcactcgatgagttatgtaatctgctggggattaataaaggccatctgctcttcatttgttataagcgtcctgacgaactaaaatacaaatctttcgagatgcgcaaaaagcgagggggcttccgcaaaatcgatagcccccagaaaggactgagggttattcaaggcaaactcgcagagttactcgaagaaaatgtcgagtttaaaacctgcgtgcaagggtttgtgaaggagagaggggtcttggagaacgcgaccctgcacaaaaagagtaactgggtcctcaacgttgacatcaagaacttcttcggctctattaactttggtcgcgtgcgcgccgtgtttgtcgctaagccttttgagattcaccccgacgtagctacggttatagcccagatctgctgctttaagaattacctgccacagggggctgctactagcccaatagtgtcaaatatagtggcatccacactcgataaccagatcatcagaagaatcagaaaccaccggttgctgtatagtagatacgctgacgacattacaatctctgctaagcgggtgtttcctcgagaattggcctacatatccgagggcaggactatcgtgggggaggatctggttaacatcttcagcagagcctccttcgaaatcaatcagaaaaagtcacggctccaatccaaatattctaggcaggaagtcaccggtctgattgtgaataggaaagtcaacgtgcccgccgaatataaaaataaactgcgggctgccatacaccattgggtcgacgatcccagggaggcggagaggaagtactatgtggacattcttggccttacaccggaggaggccgaactgactgatgatggctcaaaacttcgacgcaatatttatggtcgtctgagttttctgaacatggttaagggaggagatgacccaacatacatcaagctgattttgaaaatggcagagcatgatcctctgccaccaaaatttgtgaagaacatcaaggcagagtacaagatgtatgatgtattcctgtgtcacgccagcgaggataaagccgacatcgtagaacccctttaccaagaattaagtaagatcggagtccatgctttctacgataagaaagaaatcggttggggcgactccctggtcggcaccatcaataaggcgttgttaaagtctaagtatgtaattgcagtgatgaccgacaactcggttggaaagtcttggccccagcaggagatcaactccgtgctcaatggcgacattagcggaggaacgaagcggttgctcccgctaatattcggggacaaggagaagattctgaataacaacttcctgatgaatgacaaactatacgtggaatggaaggacaaccctactgaaatcgcccagaaagtgcaggaattgctggcccagaagtcgaatgagtga

SEQ ID NO: 7674 - RNA, 1476 nt, unidentified
  source 1..1476: mol_type = other RNA; note = synthetic construct
atgaagttgttatctccattgaaccgctctatagccaaactatccagtctggatgaactctgcgggttgcttggggtgcagaaggggcacctgttgtatatttgctacaaaaggagcgacaatgcgaagtataaaagctttgaaatgcggaaaaagcgcggtggctttagaaagattgactctccacagaaaggactccgggttattcagaaccagctggctggacttctacaggaaaatattgagttcaagagctgcgtcaagggattcattaaggaacgtgggattctcgacaacgcagcacttcataagaaatctgactgggtgctgaacgttgatattaaagacttcttcggaagcattaacttcggcagggtgagagccgtgttcattgccaagccgttcgagatccaccccgatgttgctaccgtgatcgctcagatttgttgtttcaataattacttgccacagggtgcagcaacttcccctatagtcgccaatattgtagcttcaacactggataacaggatcataaaacacatccggaaccaccgcctgctgtattcacgatacgcagatgatattacaatctccgctaaaagaatctttcccagacaaattgcctacataaatgatggccagaccatcgtgggtgaagacctggccagcattttcgcgcgcagcggatttgagattaatgagaaaaagagccgtcttcaggccaagtttagtagacaggaggtgacaggcctgatcgtaaataagaagctgaacgtcccagctgagtataagaataaattacgaacggccatacatcactgggtggacaacccggtagaagcggaacggaagtactatatcgacatcctcggcctgagccctgaggaagccgagttaactgaggacggatccaaactcaagcggaatatctacggtaggctgtcttttctggccctggtgaaaggggctgacgatcccacgtacgtgaagctcatcctgaaaatggccgagcatgactccacacctcctaaattcattaagtccataaaggctgagtataaaatgtatgacgtctttctgtgtcatgccagtgaagataaggaagagatcgtgaagcctctgtacgacgagctggaaaaattgggcgtccacgcattttacgacgcaaaagagatctcatggggcgattcactcgtcgggaccatcaacaaggcccttcttaaatccaagtttgttatcgctgtcatgactgacaactcagttggcaaggcctggccccaacaggagatcaattccgtactcaatggtgatatcagtggcgggaccaagaggctcttgcccctgatatacggcgacaaggattcgatcctgaacaacaacttcctaatgtctgataaactctatgtggaatggaaaggaaatccagaggagatcgcacagaaggtgaaggatttacttacccaaaaagcgcaatga

SEQ ID NO: 7675 - RNA, 1488 nt, unidentified
  source 1..1488: mol_type = other RNA; note = synthetic construct
atgaaattgcttaatcccccatcgcgcagtattttaaagctgaactccatcgacgaactgtgctctatcctaggggtccagaagggacacttgctgtatatctgttataaacgctctgacgatcttaagtaccagtctttcgagatgcggaaaaagaggggcggcttcagaaagatagatagtccacaaaaaggtttacgcgtgatccagaaaaagctggctgagatctttgaggaaaatatcgagttcaagtcatgcgtgcaaggcttcatcaaaagcagaggaattctagaaaacgcagccctacacaagaagtcaaattggatcctgaatgtcgacatcaaggatttctttggttcgatcaactttggacgggtgcgtgcagctttcattgccaagccattcgaatttcatcctaacgttgccaccgttgtggctcaaatctgttgcttcaagaattaccttcctcagggcgctgctacaagccccattgttgcaaatattgtggcctcaactctggataaccggatcctcaagtacattagatctcagcgtctgatttacagcaggtacgccgatgatataacaatctcagccaagcgagtcttccccaatgaggtggcccacatcaacgacgggaaaaccatcataggagaggatcttgcaaacatcttctcaagggcaagctttgaaatcaatgaaaagaaaagccggctccaaagcaaatattcccgccaggaggtcactggactgatcgttaataaaaaggtgaatgttcctgccgagtataaaaataaactgaggaccgccattcatcactggatagacgacccagtggatgccgagcgaaagtactatattgatgtcctgggtctgagtcccgaggacgcagaactgacaaaagacggctccaagctgaagcagaacatttatggtaggttgagttttctctccatggtaaaagggaaggacgatccgacctacatcaaattagtgttgaaaatggctgagcatgaccctagcccacccaagtttattaagtccattaaggcggaatacaagatgtacgacgtctttctgtgtcacgcttccgaggacaaggagaagatcgtggagcctttgtatcaggagctcagtaaaatagggatccacgccttttatgacaccaaagagatagggtggggcgacagcctcgtgggagtgattaacaaagctctcctcaaatccaaatatgtaatcgcggtaatgacggattcaagcgtcgggaaagcgtggccccagcaggaaataaattctgtgctgaacggagacatatccggcgggactaagagactgcttccgctgatttacggcaacaaggataacattctgggcaacaatttcctcatgaatgacaagctctacgtagaatggaagaataaccctgatgaaattgcaaaaaaggtgcaggagttgctgacacataacgaatctcttaactctagatga

SEQ ID NO: 7676 - RNA, 1476 nt, unidentified
  source 1..1476: mol_type = other RNA; note = synthetic construct
atgaagctgctgaaccccccctcacgctcaatcctgaaattatctagccttgactctttatgtgagctcctagaggtgcaaaaaggtcacctcctgtacatctgttacaagcgggccgatgatctaaagtaccagagttttgagatgccgaaaaagagggggggcttccgcaaaattgacgtgccgcagaaaggccttcgagtgattcagcaatccctcgccaaactgctcgaggaaaacgtcgaattcaaaccttgcgttcagggttttattaagaagaggggcattctagagaatgctaacctccaccgaaagagtaattgggttctcaatgtcgacatcaaggatttctttggttccatcaacttcggccgggttagagccgtgttcattgctaaaccttttgaaatgcatcccgacgtcgccacagtcatagcccagatttgctgctttaataattatctccctcagggggcagcgacatcccctattatatcgaatatcgtggcatctaccctggacaatagaatcattaagcacatacgctcacaccgcctgatctattctagatatgccgacgatattagtatctccgcgaaacgtgtatttcctcgtgagatcgcccacatatccgagggcaaaactattataggtgaggacttgtcaaacatcttttctagggccaggttcgagataaacgagaaaaagtcccggttgcaatcaaagtacagcaggcaagaagtgaccggcctgatcactaataaaaaggtgaatgtgccagccgagtataaacataaactacggaccgctattcatcattggattgacaatccagtcgaagccgagagaaagtactatatcgatattttgggcctgaaagtggaagatgctggactgaccggagacggcagtaagctgaaacggaatatatacgggagactcagctttcttgcaatggtcaaggggagcgatgaccccacttacgtgaaactgatcttgaaaatggcaaagcacgaccctagcccaccaaagttcatcaaacccctgaaagagcagtaccagatgtacgatgtattcctgtgtcacgccagcgaggataaggcagagattgttgaacccctttataacgaactcaataagcttaacatccatgctttctatgacgcgaaagagatcgggtggggagatagcctgatcggcacgattaacaaggcactgcttaagtcccgctatgtgatcgctgtcatgacagataagagcgtaggaaaggcttggccacaacaggaaatcaattctgtgttaaacggagacataagtggagggacaaagcgattgctgcccctgatccacggagacaaggaaaccattttggggaacaacttcctgatgaacgataagctctacgttgagtggaacaacaatccagctgaaatcgcacagaaggtgcaggccttactggcccagaaggctgaatga

SEQ ID NO: 7677 - RNA, 1467 nt, unidentified
  source 1..1467: mol_type = other RNA; note = synthetic construct
atgaaactcctgaatccgccatcaagatcgatccacaaactggactccctggacctcctctgcaatctgctgggggtgaaaaagggacaccttttgtttatttgctacaaacgagccgacgagaagaagtataaaagctttgagatccccaagaaacgtggtggactgaggaaaatcgactcaccacagaaaggacttcgtgtgattcagcaaaaactggctgaattgttgactgaaaacctggagttcaaaccctgtgtccagggctttatcaaggggcgggggatcctacagaatgccatactgcacaagaagagtaactgggtgttgaacgtggatattaaggactttttcgggtccatcaattttggcagggtgcgcgctgtttttattgcgaagccctttgagattcatccagacgtggccacagtgatcgcccagatatgttgtttcaataactaccttccccagggcgcagcaaccagcccagtagtttctaatatcgtggcgtccatcttagataatcggatcattaagcacgtccgatcgcacaggctcatctattctcgctatgctgatgatattacattgagcgccaagagaaatttccctagggagatagctcacgtgtcagatggtagaacaatcataggagaggacctggccaatatattctcaagagcaagttttgagatcaacgagaaaaagagtcggctgcaaagcaagtatgatcggcaggaggtgacggggctaataaccaacaaaaaggtcaatatcccagctgagtacaaaaacaaggtccgggccgcaatttaccattggatccaagatccgaaggaagccgaaaggaagtacttcatcgatattctaaagctcaatcctgacgaggtcgaacttacggaagacggcagaaaactgaaacataacatctacgggcgcctgtcttttatcgcgatggtcaagggtaaggacgaccctacctatgttaaattaatactcaagatggcagagcatgataaaactccccctaagttcctgaagagcatcaaagaggaatacaaaatgtatgacgttttcctttgccatgcttctgaggataaggcggcaatcgtagagcccctctacgaagccctgactaagattggagtgcacgctttctacgatagcaaggaaattgcttggggagattcccttattgaaaccattaacaaagccctgatcaagagccagtacgtcattgccgtaatgaccgataactctgtggttaaagcttggccacagaaggagattaatgcagtactgaacggcgacatttccggcggcacaaaacgcctcctgcctctgatccacggcgacaaggaaaagatcctcaacaataacttcctcatgtccgacaaattatatgtggtgtggcaagagaaccctgacgaaatagcccagaagattaaagccttattggcaagttga

SEQ ID NO: 7678 - RNA, 1467 nt, unidentified
  source 1..1467: mol_type = other RNA; note = synthetic construct
atgaagctgttaacccctccgaaccgtagcatctataagcttgcttccctcgaccggttgtgcgaactgctgggggtaaagaagggcaacctattgttcatttgctataagagggcagatgctctgaaatacaagagcttcgagatcccaaagaaacgagggggccttaggaagatcgacgcaccccaaaaaggcctgagagtggtacaaaataagctggccgaactgctaaacgaaaacctcgagtttaagaactgtgtacaggggttcgttaagaaacggggaattctgcaaaacgccatgctccacaaaaaatcaagttgggtgctgaacgtggatatcaaggatttcttcggtagcatcaactttggccgggtccgcgctgtctttatcgcaaagccttttgagatacacccggatgtggccactgttattgcccagatctgttgctttaataactatttgccccagggcgcagcgacctcacccatagtttccaatatcgtggcttctaccctggacaataggatcattaagcatgttaggagtcaccatctaacctattccagatacgctgatgacgtgaccattagctcacgacgggccttcccccgcgaaatcgcacacattattgacggacagacaattgtgggagaggagttatcgtcaatattcgctcgcgcgcgctttgagattaatgagaagaagagtagattgcagtccaagtacgatagacaggaggtgaccgggctggtaactaataaaaaagtgaatgtccccgccgagtacaagaacaatgtgcgtgccgccatttaccagtgggtcaaggatccaaaagaagctgaaaagcactattacatcgacgtcttgggcctgaaacccgaggatatttcattaacggacgatggttctagactgaaacataatctctacggaaggctttccttcatcgctatggttaagggcaaagacgaccccacttacgtcaagctcattctgaagatggctgaacacgacaagtctcctccaaaattcttgaatgcgatcaaggaagaatatgagatgtacgatgtgtttctgtgtcacgcctccgaggacaaagagacgatcgtggagcctctgtacaatgagcttaaaaaactcggagtccatgcgttttacgatacaaaggtgatagcctggggagatagcctgatagaaacaataaacaagggcctcatcaagtctaaatatgtcgtggccatcatgacagaaaactctgtgattaaggcctggccacagaaagaaattaacgccgtgttaaacggggacattagcgggggtactaagcggcttctgcctcttatccatggtgacaaagagaagatactctcttccaattatctcatgagtgacaaactgtatgttgagtggaaagaaaatccagaggagatcgcaaaaaaaatcaaagacctcctggcaagctga

SEQ ID NO: 7679 - RNA, 1491 nt, unidentified
  source 1..1491: mol_type = other RNA; note = synthetic construct
atggccctcaagctgctgaatccaaccgccaaccccctgttcagactcaatagtttggacgctctctccggactactagaggtgaaaaaaggccatctgctgtacatctgttataagagagccgatgtccacaagtataagagtttcgaaatcccgaaaaaaaacggcgggattcgcaaaatcgatgccccccttaaagggcttcggctgatccagaaccggctggcagcgattttgacggagaatattgaattcaagtcatgcgtgaaggcattcgtcaagggagaaggcatcttcaataatgccgtgctgcataagaagagcgactgggtgctcaatgtggacgtgaaagatttcttcggctccatcaatttcggcagagtgagggctgtctttatcgccaaaccttttgagatgcatcctgatgtggcgagcgttgtggcccagatttgtatttttcaaaactctctgccacagggggctgccacctcacctgtagtagcaaacatcgttgctagtatgctggacaacaagatcattaaacacatcaatggggtgaaatctgggcgcctcgtgtactctagatacgccgatgatatcacaataagtgcaaaacgattctttccttctgagatcgcccacttaagcgaaggtaaaaccatcgttggagaatctctggtgaacttattttcccgctccggctttgtgataaacgactccaagagcaggctccagcccaaaatcaaccggcaggaggtcactggactggtggtaaataagaaggtcaacattcccagcgagtacaagaacaaactccgatccgcaatcagccagtggatactgaacccaaaggaagcagaacggaaatattttgtcgacatcctcgggttgaatgaatccgaatttgaagcatctgctactggtgagaatttgaagcgcaacatctacggtagattatcattcatgtcaatggtgaagggaaaagatgaccctacatatctcaaactgatcctgaagatggccgagcatgatgacagccccccgaagttcgtgcgtcttataagggctcaacacaatatgtatgacgttttcatttgccatgcctctgaggacaaagcagagattgctgagccattgtaccacgcactgactgccctgggtctgaatgtcttttatgacgccgagagtattgagtggggggattcgcttatagagacaatcaacaaaggcctgtacaagtccaagtatgttatagctattatgaccgacaattcagtagttaagaagtggccacaaaaggagataaacgctgttctgaactcggatattagcggcggacagaacaggttactacccttgatccacggcgatgcggagaatattctctccgccaattttcttatgagcgacaagctttacgaagtctggaaaggtaacgccgaagagattgctggaaaagtgaaggtcaagattgaaggcagggcgcgttga

SEQ ID NO: 7680 - RNA, 1473 nt, unidentified
  source 1..1473: mol_type = other RNA; note = synthetic construct
atgaaattagtcgagcctgataaaaatccactcctaaagctcgccacacttgacgagctctgttcccttctgaatgtgaaaaagggtcaattgctgcatatatgttacgaccggagcggacccgccaagtacagcagtttcgacatgaagaagaaacgtggcggagtccgcaaaattgaggtcccattgaaggggctgggcctggtgcagaagaggctgtctattctcttgtctgatttcatcgcctttaaaccctgcgtcaaaggctttgtcgagggcgaaagcatttgcactaatgcatcactccacaagaaatccaagtggatcctgaatgtggacatccaggacttcttcgggtctataaattttggccgcgtgcgagccacgttcctggcaaagccatttgagatgtcaaacgaggtggcgacagttatagctcagatttgtaccttcgaaaaccacttaccccagggtgcacccacgtcaccggtagttgccaatataatcgccagcatgttggataacaaaatgctccgcctcgcacagaagtatcggctgaggtacagcagatacgctgatgatatcacactcagtagccctagaggttttcctggcgaggttgccaccgctaccgaaggcagaactatcctaggcgaggagctgaaattgatctttgacaaagcccgttttactatcaatcccaataaaagccggctgcaggcaaaaaattcgaggcaagaagtcaccggactaattgtgaacaaaaagctgaatattcctgctgagtataagcataagttacgaactgccatcaagcactggaccagtgatcctgaggaggctgaaagaaacttttacctgaacataaagggcgaggaccccgctacatttgccgtttctaaggggggagaacggttgaaggggaacatttatgggaggctcagtttcatctccatggtcaaaggctcagatgaccctacatatatcaagctcgtgctgaaaatggcggagcacgacacccaaccgccaaaattcatccagaaaatcaagtctgaacataacatgtacgatgtgttcttatgccatgcctctgaggacaaggatgctatcgtgaaaccactttatgacgaacttaaggaactgggactgtccgtattcctagacggagaagagattggatggggtgacagtctgattgatataatcaataaggcgctgcacaagtccaagtatgtgattgccgtaatgactgagaactccgtggataagaagtggccgcagaaggagattaatgccgttttgtccaacgagattaagcacgacaagaacaaactgcttccactgatccatggggacgctgaagaaattctgggtaaaaacttccttatgtcagataagctctacaaaaaatgggaaggggaccccaagaaaatcgcacaagatgtgctggctcttctgcagaaaaacgcatga

SEQ ID NO: 7681 - RNA, 1470 nt, unidentified
  source 1..1470: mol_type = other RNA; note = synthetic construct
atgaaattggtgaaatcagacaaaaatccacttttaaagctgagtaccctggatgacctttgtagcctgctgtccgtcaaaaagggccaactgctctttatatgttataaacgttccgacaaggcgaagtattccagctttgacatgaagaagaaaagcggcggggtgaggaaaatcgaggtcccaattaaaggcctcggattgatacagaagcgactgtccgtccttctgtctgagttgatcacattcaagccatgtgttaagggctttgtgaagggggaaagcatctgctctaatgcaagtcttcacaagaaatctaagctggtgctaaatatcgatgtgcaggattttttcgggtcaatcaacttcggaagagtccgcgcaacctttatggccaagccattcgagatgagtaacgaggtcgccaccgtagttgcccaaatctgcacattcgaaaatcatctaccccaaggtgcgccgacctctcccgttgtggccaacattattgcttctatgcttgataaccgggtgctccgcctcgcccagaagtacaggctgaagtactcgcgctatgccgatgacattactctcagttctcctcggaaatttccgcccgaagttgctgcaacagtagagggtagaacggttctaggggaggagttgaaaacgatttttgagaaagccagattcgtgatcaatcctaacaaaacaagattacaggccgctaacagccggcaagaggtgactggcctgattgtgaataaaaaactgaacatccctaaggagtataagcacaaactccgtgctgccatcaaacactggataagcgatcccgtggaagctgaacgcaaattctacgttgacattaagggagaactgtccgaggagtttgtaagtcaggggggcgagcgactgaagaataatatttatggacggctgtccttcatgtcaatggtgaaaggtatcgatgacccaacctacattaagttagccctgaaaatggcagagaatgataatcagcctcctaagttcatcaagactatcaagtcggaacacaacatgtatgatgtgtttctgtgccacgccgctgaagataaagaaactatcgtcaggcccctgtacgatgaattgaagaagctcaacctgaacgtcttcctggactccgaagagatacattggggggactccctcatagacattatcaacagggccttgcacaagtcaaagtacgtgatcgcagtgatgtcagagaattctgtagaaaaaaagtggccacagaaggagattaatgcagtgctcagcaacgaaataaagcatgacaaaagcaaactcctacctctgattcatggaaacgctgaggaaatcttgggcaccaatttccttatgagcgacaagctctacaaggagtgggagaacaaccccgaggaaattgcacaggcggtcttaaagcttctgcagaaagctggttga

SEQ ID NO: 7682 - RNA, 1473 nt, unidentified
  source 1..1473: mol_type = other RNA; note = synthetic construct
atgcgtttggtagaatctgataagaacccacttgttaaacttagctctctcgacgcgctctgtgcccttctgaatgtgaagaaaggccagctactctacatatgctatcagcggtcaaataaggcaaagtacgactcattcgaggtgaagaagaagagaggtggtgttcggaaaattgaggtcccacaaaaagggttggctgtggtgcagaagcggctctgcaaactgctaagtgagtggattgagtttaagccttgtgttaagggctttgtgacaggcgaatctatttgctccaacgccctggtgcacaagaaatcaaaatgggtcctgaatgtcgacatccaagactttttcggaagcattaacttcggaagggtgcgcgcagcattccttgccaaaccctttgagatgtcttcagaagtggctagcgtagtcgcacagatctgtacattcgagaatcatttaccacagggggctcctactagccccgtagttgccaacatcattgccagtatgctcgacaacaaaattctaaggctcgcacagaaacaccgactgcgttactcccggtacgcagatgatataaccttatcctccctgagatccttccctggggaagtggccaagctgcttgacgggcgcacttttgttggagaggagctcaggctggtgttcgaaaggtcacgctttagtatcaacccgcagaagagccgattgcaagctaaaaatagcagacaggagatcaccggcatcatagtgaacaaaaagctcaatgtgcctatagaatacaagcagaaattgcgcgctgccatcaaacagtgggctctggatcccgaggccgctgaacgcaacttctacattgatattaaaggcgaggatcctgaaacctttaaagtcatcgaaggcggcaggagactacgggataatatctacggcaggttatccttcgtgtcgatggtgaagggctgtgatgatcccacatatattaatttggcgctcaaaatggccagacacgacacccacccacccaagtttatcaaaaaaatcgaaggggagcacaacatgtatgacgtcttcctgtgccacgcttcggaagacaaggatgccatcgtcaaaccactgtatgatgagctgaaacggttggggcttaacgtgtttcttgatgacgaggagattggatggggtgacagcctggtcgatattatcaataaggcattacatcgaagcaagtatgtaatagcggtgatgactgagaactctgtcgacaagaagtggccgcaaaaggagataaatgctgttctgtcttccgagatcaagcatgacaagagtaaactgctccctttgattcatggagacgccgagattatcctgggaaagaatttcctgatgagtgacaagctgtataagaagtgggaaggtaaccccgaaaagatcgcccaggacgtgctggccctgctgagaaaaaagacgtga

SEQ ID NO: 7683 - RNA, 1467 nt, unidentified
  source 1..1467: mol_type = other RNA; note = synthetic construct
atgaaactaatcgaaaaggaagagaaccccctgcgcgatatcaagtccatcgatgatctgcttagcgttctgaacattgagaaaggcaaactgttttacgtactctacgaggtgggcgtggacaagaggtataagaagttcagcatccctaagaagcgtggtggagagaggcccatttcagccccaacaaaaggcctgaggctcgcccaatacaggcttttcaagcttctgacggacaatattgagttcaaacagtgcgcaacagggtttgtctcgaagcgcgggatcattaaaaacgcaaaagtgcacaagggtaccaaatggatcttaaacgtggacatagaggacttttttgggaccattaattttggacgcgtgagaggagtgttcatgtcaagcccatttgatatgcctaaacaggtcgccaccctgatcgccaagatttgcacttttaataatgccctgccacagggagcccctaccagtcctgtgatcagcaatataatcgctagttccctcgacaataagctcttacggttaagcaagcagtacagactgaggtatacaagatatgccgatgacattacactgtccggcttcgggcagcctccgcaagacatagcgaagatcgtggagcagaagaccgtactatctgagaaattggtcgctgccttcacaaagtcagggttcaaggttaatgaaagcaaaactcggctgcaaaaaaaggtggtccgacaggaagttaccggactcgtgatcaactccaaagtgaacgtgccagtcgagtttaaaaaaagtttgcgggcagctattcatcaatggtgtgataaccccgaggaagccgaacggaagttcttggcctctactggcaaaattaaagaaggcgaggaagttactcaggggggtcagatcctgaaaaggaacatctatggccgcttgtcatacctcgctcaggccaagggcaacgaggacccgacctacatcaagttggccatgaagatggggagagcggaccccgaaccccctaagttcctgagacgaatcatggagaagtatcacgagtaccaggtgtttatatgtcacgcaagcgaggacaagactaagattgcctctccactttatgaagcactggaggagcgagagatttctacgttcatcgacaataaagtcattgaatggggcgattccctagtcgatacaattaaccatgcgctttataaggctaaactcgtcgttgcagtggtaagtgagaactctctgggtaagtcctggccccaaaaggaaatcaatgctgtgctcgcatcggaaattcagggtgaatctaagctcttagttctggtagatggagatggacaagagctgctgggccggttgttcctgctgcaggataaactctaccgccagtgggaagataatccagacgagcttgctgacgaaatcgctcgtatagctatgaaaatacagtga

SEQ ID NO: 7684 - RNA, 1695 nt, unidentified
  source 1..1695: mol_type = other RNA; note = synthetic construct
atgccccccctgcctgattacgcctctactgagctcctgctgggactgaagaccagaaaagatctagcctcctggctgggagtgagcgatcgggcattaaggtatatgctctatcggctgggcgatggcgacaaatacagcactttcagtatcagaaaacgaaacggggggttgagagagattcacgccccaaaaaaggcccttaagtacctacaaaataaggtcgcgcatgcgcttgccggtgtggttcccgtgcgacagatcgccaagggatatgtcccaggcaggagcatctacgatcacgctaagatgcacagatcaaaaaagtgggtcgtgctcgtggacttgaaatcctttttcccttccattaacttcggccgcgtcttgggtctattacgagctccccccttctctcttgaaaacgaggttgcagtagctgtcgctcagctgtgtacaagggctggtgaactgccacagggtgcaccctcatccccagttatctcaaatctcatctgtcgaaaactggatagacagctgcttgagctcgcaaagcaggcagggtgtggggtaagccgctacgccgacgacatttgcttctctacaaatcggaagagggtgagtgtggaaatatgcgactttgttaacgaacatggatgggtgcctggggccggattgaaacaactgatatgctcaaacggcttcgaaattaacttcagtaagttccgcgtgcatgaaggtcgggatcgcaaactggtgaccggactggtggtcaataaaggcgtatccactcccagcaggtggcgcgatcagctgaggagttcacttcacgtgattgataaatacggagaggccgcaggagtagaaatcatatccggctggacctccggcttttttcgcaaggagcctggggacgtcctgagaacaattagggggaagctgggctatttaaaatggatcgacaaggtggcaaatcaccttgctaccgatgccctgaggcgcaattttccctctttggccagtttaatgcctatcagcaacgacggagtctcatttcgtatcatggctgagggcccaacggacttgctgcatctggaggccgcgctcgactatctgcgcaagtcggggggcttcctggatgtaagaccacggttccagaacttcttaggcgacgttggcgattctgagctttgggagactcttctccggatagctaaggccgatgtgaatgaactgaccattggagtgtttgattgcgattcacctgcttttatgaagaaaacgtctctggttccgggcggtaacatccagctagggccgagggtttacgcgttttgcctcgcaccgcctggaacatctatcagcaacaatttctgtatagagtccctctattctcgtagcgacgcgaccctcgtcgacggaagtggcagacggctctttttcggggacgagttcgactccgcctccggcttcagccacgatggcttgtacaagtgtctgcatccaaaaaagaaggctattgtggttagcgaccaagtggcacgagtccacgatggggccagcgtgctcctctcgaaagctggttttgcatctcaggtgaaggacaaagccccaccttttgacgtggtcagtttcgacggttttagacccacatggttggggatccgtgcactggccattgctgccgtgcggaagtga

SEQ ID NO: 7685 - RNA, 1689 nt, unidentified
  source 1..1689: mol_type = other RNA; note = synthetic construct
atgccacctcctagcagtacagttgaagtgttcctgtcactgaagacgagggctgatttggcctcttggcttggcgtgagtgatcgggccctcagatacatcctgtatcggctcgaagaggctgagaaatataagaccttcttggtgcgcaagcgtgacgggggatttagagagattgacgcaccaaaacccgccctaaagtatctccaggagaaaattgcgtccgcactgatcgaagtgatgcctgtacgtcaaatagccaagggttatgttccaggcaggagcatttacgaccacgccaaggtccatcgcacaaaaaggtgggtggtgctagtggatctgaagcagtttttcccgtcgatcaacttcgggagagtgttagggcttttaagatctgcccccttcaacttggagcaggaagtagccgtcgcagttgcgcaactttgtacaaaagcaggtgctctgccccagggcgctccatcttctccggtcatctccaatctgatctgccgaaaattagatcggcaactgctggagctggcgaaaaatgccggctgttccgtctctcgctacgccgatgatatatgcttgagcaccaatcgcagacaggtgagtaagagtatctgcgagatccttcccgaacacggttgggtccctggggtcggtttgaagcaggtgatttcctccaacggcttcgaaatcaacatctcaaaatttcgggtggcatctggcagggagaggaaactggtcaccggactggtggtaaatcggggcgtcagtgtgccaagacgatggcgagatgagcttcgcagctcactgcacgtcgttagcaagtacggcgagttgcggggcgccgagatcatttctcagtggaattcgggcttcttcagaggggacggatcaaatgctctgcggaccattaagggaaagcttaactacctggactggatcgatcgcgtcgcgaggcgttctgctatcggggctctgagacgacagttcccttctctcggaacactaatgcctcggcccaggggcggcataccatttcgagtgatggccgaagggcccaccgacctcctccacttaaaagcggcttttgaccggtttcgggatgacggacacctctttgacatcctgccccggttccagaatttcagcggggacgtaggggacagtgagctgtgggagactctgcgacgcatagccaaagccgacgtgcatgagctcactgtgggcatctttgactgcgattccccagcttttcttaggaaatcttccctcgcacccggaggacacgtgcaagtgggagagaaggtttatgcattctgtctggccgctcctaactcctcactctcaggtgagttttgtattgaaagtttgtacagccgcgaagacgctaccatgttggacggcagtggcagaaggctcttttttggagatgaattcgacgcaactaacggactgtcacatgatggtgagttccgcaggttacatcctcagaagaagtccatagtggtgagcgatcaggtgacgcgcgttagcgggggaggtagcgttctcctgtcaaaggccaattttgcctccctgattagcgaaaaggttccgccattcgatagagtaagctttgaaggcttcaaggaaacttggcgtgggattagagagctagtcattgcaaactccaggaaatga

SEQ ID NO: 7686 - RNA, 984 nt, unidentified
  source 1..984: mol_type = other RNA; note = synthetic construct
atgtccgttaagagtcggtctgacttagctggctggttgggggtttccgagagggccttgcgctatattctgtacaagcttcccgacgagcggaagtattcaacattcgaaattaaaaagcgcaacggcaatgcccgggtgatagatgcaccgtccccagcattgaagtttctgcagagcaagctggcagaaaccctttctgagatcgccccgccccgtcagctcgctaaaggttacgtgagggaaagatccatcttcgatcatgcgaaagtgcaccggtctaagagatggctagtgctcgcagacatcaaagatttttttcccagcatcaacttcggcagggtgggagtatttcgggctgccccattttcgttcggtcacgaggtcgcggtttgcctcgctcagctgtgcaccaaaggtggacagctgcctcaaggcgcccctacatcccctgtcatatctaatatcgtgtgcagacgcctagatagagaattactggagttgagtaagcgaagccgttgttcagttagcaggtatgccgatgacgtctgtttcagtactaacactagggacatctccgctcgcgtggctgacttcgttggggaagcaggatgggtgccaggcctggaactgaaaagcgtgtttcagcgcaatggattccaaattaatcctaacaagttcatggtccggtgtggccgagagaggaagctcgtaacggggcttagcgtgaactcaggggtcagtatcccccgttcatggagacgacagctccgctctgcccttcatgtgatcagaaaatatggcgaggtccccggggactccattgtcctgtcatggaggccagcctttcaacgcgggagtgctgtgaatattggccaggtaattcggggtaaagtgagatacgcccattggatagataggctggccgggagaggctctgttgaggcactgcaccggaactaccgagcgggaagcatgggatga

SEQ ID NO: 7687 - RNA, 1695 nt, unidentified
  source 1..1695: mol_type = other RNA; note = synthetic construct
atgggcccgctgtcactgagccctgaagccattgccttttctggcctaaaaactcgggccgagctcgctggatggttaggccttacagacaagaagctctgttaccttctctacgtgctacccgcaacacagaaatacattactttccaggttgccaaacgggatggatctagccgaaccatcgatgctccccaccctgccctgaagcagattcagagaaagctcctgagtgttttccgcgaactggctccggctacaggggttgccaaaggatatgtcaacggagtgggggtcatcgaccatgcacggctgcaccggagacagcgacacgtcgtattggtggatcttgaaaacttcttcccatcaattacctttccacgagtgagaggtgctttgctgggcaagcctttcctgtttcccccgaaagtggccacgtgcatcgctcagttgtgttgcaaggacggagttttgccacagggagcgcctacctcacctgtgctgtccaacttaatttgcaggtctttggatcataagctgcttgcactggccaaagcaaaccgttgccgggtgtccagatatgctgatgatatctgcttctcgacgtccctggttgaggtcccctccatcatcgccactctttatgacggtaattacctggtagggccagccttgatcgcagccattcacgccagtggctttaccatcaatcagaagaagttcaaagccaagtcccagcgaacccaacagctcgttacagggctggtcgtcaatcgcggggtgtccctgccaaggagatggaggcgtcagctgcgcgtgctgcttcatctcgcagacaagaagggtgctgcacgggcaaccgagatcgccagtgcctggaccaagccagtagcgtttagacgtggctcggggagtatagaacagttagtgcgcgggaaaaccaattacgctcaacatgtggacttgaggtgtgacaaatctttcagtgagtctatttataggaactatggcggtgtgcggaagctcatgcccagaccactgagaggcatagctttcagggtcatgacagaagggaagactgacctgttgcacctggaatctgcgttaaagtggttccaggagagagctgagtttgcagagttcaaaccccggtttctcaatttccctggcgacattggcgacgtagagctgctcaaaactttacagcgtatagcaaaaagcgacgttcccgaactaaccgtcggcgtgtttgattacgacaatatcaaggacatgaacaaaattgggctcgcccccggagcgcatctgcaactagggagccgcgtctatgccatgtgtctgggtgagcctgctggtttcacgggaacaaggttctgtatagagaacctttaccaaaaaaaccagctcgtagctatgacatctgaggcgaggagggtgtttcttccagaggatttcgaccaagatggtatcagcctagacggcctgtttaagcgagcccaacctcgcgctactgccgcgatcgtctcagataaagtggtgaggctcagcgatggctttagcgcctcactgagcaaggccgaatttgcagagatgatattccgctccgtgcacccttttgatcagatcgatttttccggcttcggacccacttttaatgcactgcgccggattgtggaagaagtgagcctcgccggatga

SEQ ID NO: 7688 - RNA, 1692 nt, unidentified
  source 1..1692: mol_type = other RNA; note = synthetic construct
atgggaccgcacagctatagtccaggcgcacttgcttttttaaaccttaagacacgagctgatttggccgggtggttgggactgaccgataggaagctctgctacctgctctacgcactcgatgcctccaaaaagtacacttcctttcagattgccaagaagaaaggaggggtccgcactattgatgctccccacccggccctgaaatacattcagcgtaaactgatgcacgtgctagtggaactagccccaccaacaggcatcgctaaagggtacgttgcgggtgtgtccaccatcgatcacgcatggctccaccgacgccaacggcatatcatcctggcggatctggactccttcttcccaagcattacgttccagcgcgtgcgtggtgcactgttggccaagcccctgagcctgaccgcaaaagtggctacctgtattgctcagttatgttgcaaagatggagctcttccccagggggcccccacatcacctgtattctccaacctgatttgtagatctctcgaccacaaattattagcccttgctaaagctcatagatgtaaagtttccaggtatgccgacgacatttgcttctctactgaccttaaagttatccctaccacaatcgccagctgggtgggtgataggtatctagccggaccctcccttatcagcgcagtgtcttcgtccgggttttctctcaacccaagtaagttcaaggtgcggtccaaagagtctcagcaactggtaactggactggtcgtcaatgacggcgttagcctgcctaggcattggcggaggcaattgcgggtcatcctgcatttatcatcgaagaggggcctggtgcgcgcaaaggagattaccgacggctgggcacgacctgctgcttcaaggtgtgaggcagattcactcgaacactttatccgaggaaagacttattttgcgcagtacgtcgattttcggtgccggagaaagtttagtgagagcatataccgaaattatagtggaatgagaaagcttatgcctagacctctgtctggggctagctttagggttatggcagagggtaagactgatctgctgcacctggaggtggccctgaagtggttccagagtaatggggaatttacagattttcggccacgtttcgtcaattttcatggcgagacaggcgacgtcgaactcatgaagacactcgaacgcatagccaaatctgacatacccgagctcacgattggcatcttcgactgtgacaactcaaagttcatgctgaagaacggcctcagcccagccacccatcagtctctgggcgggaaggtctatgccatgtgcttgggcgcacctctggcgctgaccaagtcaaccttctgcatcgagctactgtaccccaggagccaactcctcacaatgaccagcggagggagacgcatctttttgcccgacgaattcgaccttaacagtggcctgacccctgacggtctatacaaaaataaattccccaaagccacggccccgatagtatcagaccacgtggaacgcgtggtggatggtttctccgccttgttgtctaaggctgattttgcagatatggtccaccaggccgtgcatccattcgatgctatggactttagtggcttccgggccactttcgacgcggtaagaagagtggtggacgaggtttattcgtga

SEQ ID NO: 7689 - RNA, 1656 nt, unidentified
  source 1..1656: mol_type = other RNA; note = synthetic construct
atggctctgtctagcaggcaggatcttgctaagtggctggggctgactgaccgcgaactacggtatgtgctttatgcgctgtcctctgacaaaaagtacaccacctttactatcaagaaacgcacaggtgcagaccgggttattgaagcaccccacccagcgctcaaaaatctgcagaggaagctccttaccgcgatctccgaaattgccccggcgagtggcctggccaaaggctatgtcctaggacgctctacgattgaccatgcatggctccataggagaaagaggtttgtaatcctcgcagatctgaaggaattcttcccaacgatcacctttcggagagtgcgaggcgcccttcttgcaaagccgttccaattgccgtcggctgtggccacttgtgttgcccaactctgttgtaaggatggcgtcttacctcagggtgcccctaccagcccagtgttgtcaaacctgatctgccggagcttagaccacaaattgctgcagttggccaagaaacacagactggccgtttctcgctacgttgacgacatctgttttagtacatctcggcctaccattccaggtaatattgctgtcccacatggtgccgagtgggaagctggccctgagctcactgaggccattcgtgtctccggattcgagttgaaccacagcaagtttaaagttcgatctcgcgagactacccaactcgtaaccgggctagtcgtgaaccacggtgtgtcgctcccacgtagatggcgtagacaacttcgggtgctgctacacctggtgaaaaagcatggagaaaagaaagcaggggagatagccgctagctgggtcaggccaactgcctccaggagaggctttgcgagtatagagcaggtaatacgagggaagtcacattttgcccagtacgtggatcgccgatgtaaccgcgcttattccgacgcactgttccgaagctacccaggacaacggagactgcttcccaggcctcttaggggagtgcagctgaggttaatggccgaggggaagacagacttattgcacctcgaggctgcccatcgggcctttaatactgccggcgaatatgcccacattagacctaggttcgtcaactttccctcagacacaggcgatgtcgagctgttaaagacactgaatcgcattgccaaatctgacatcccggagctcaccatcggcgtgtttgattgcgacaatcccaaattcatgaaggacgctggactccagcccgctggatacgtgcagctggggtccaacgttttctgcatgtgcctggcacctcccccatcccttgctggagtgcccttctgcatcgagctgctgtatgaaagagatgaactgtgcgcaatgacgacagatgccagacgggtgttcctccctgatgaatttgaccaggcaaccggtttgtcacacgacgggttgtaccggagaacaaatcccaaaaaatcagcactggtagtaagcgatcaggtggttcgcgtcagtgacgggtacagttccctgctggggaaggctgatctcgctacactagtgagccagcaggtgcctcccttcgaggagatgaacttcggaggctttcagcccaccttcgatctgatcggcagcatcatagatatggtgcatggccgttga

SEQ ID NO: 7690 - RNA, 1734 nt, unidentified
  source 1..1734: mol_type = other RNA; note = synthetic construct
atgtcagcatcacctccacctattaaaaaaacttcgctgctgagtcctaacgcaattgccttcagatctatcaaatcaagaagcgagctggccaattggattggtatcaaggagtccacgttgatttacatcctatatcgtctgcccacttctaaaaagtacacagacttcctgatccctaagcggaacggtggcaccagaatgatttctgcccccagaaaggctctcaaatacgcacaaaaacgaatctcctcggtgttatacgacatatcaccaccccggaacctgagcaagggctacattccgggacgagggattttcgaccatgcctataggcaccgtcgccgctccacagttgtcaccgccgatatcaaaggcttttttcccagtatcaattttggcagagttagagggatgtttgccgcagctccttttggcctgccactggacgtggcaactatgctggcacagctgtgctgcaaggatggagagttgccccaagggagtccaagcagcccagctatcagcaacatcatatgcaggtccctcgatctggatctagccggcttcagcaggaaacacaggataacagtcacgaggtatgcggatgacgtgtgctttagcactaatatgaggaagaatctctttcccctggtggaacggaatgacctactgggcgaagtgccaggaggagaggtcagtcgtattttcgagaaaaacggattcgagcttaacctgaagaagtttaacttgtccaagtctaactcccggcagatgatcaccggactgatcgtgaattcccacgtaaatgtgccgaggcagtggaagcggcagttacgcacgctgttgcatttaaggtcacgcatggaggatgcgcaggctactgaaatagccaacacatgggctaggcctcaggctagccggaaaggtgtcaccgagtctattgatcatcttatccgagggaaggcctctttcgctgcgtatatagactctaggtccggcactcggcacattgctagcttgcacagggggtatccaaaactgcgtcaaatgctcccccgaatgaatccttcattccctgtgcgcattatggcagaaggacccaccgacctcttacacctagaggcggcgctgcggcactgtagtgacagaatcgatttctctaatgttgctttgagacttcacaactaccagggcgatgttggggacaccgatatgatcaagacactccatcgcatcaataaggtcgatgtggaagaactgaccatcggaatttttgaccacgacaaccccagcttcctgaaagagataagcctcaacgaggggagtcatgtccggcttgggcgcatggtgtttgccgcttgtctttccagaccgaaattcgtgaccggtaattactgtatcgaaagtctctatcggcgaattgactcctccagagtcacttcggaaggccgacggctgtatttctccgatgagttcgatgctgagggcctccattcacagggtgttctgagacgccagtacccgaagaaaaccgccctggtgctctctgaacgcgtgtttgacccaaaggatcccaacgtatcacttacattaagtaagacagactttgcagccatggtaaacgccggagccgccccattctctgatatggacttctctgggttcttgcctacccttgcacatctccgcaagatgatcgacgaagccatgtactttagcggcaatagctga

SEQ ID NO: 7691 - RNA, 1737 nt, unidentified
  source 1..1737: mol_type = other RNA; note = synthetic construct
atgccttcctctccccccgtgaaaaaaaacagtcagcagttgtctgacagagcactagagttcaaggccatggctagtcggtccgacctggcacagtggattggcataaaggaaaagactctactgtatatcctctacaagcttagtgattcggagaagtacaaagactttacgatctcgaaacgtgatggaggtacccgtctgatcagtgccccattgaaagcgctgaaattcagccaaaagaggatctcagcgatcctgcaggagatctccccacccaggcacctggcaaaagggtacgttcctggaaaaggcatattcgaccacgccttcttgcacaagcaccggaagaccgtggtaacagcggacataaccaacttcttcccttccataaattttggaagagtgagggggatgtttctctcccccccgttctcacttccaacctctttagccactatgttagctcaactttgttgtaaagatgggcagctgcctcaaggttccccctcttctcccgccatctccaatatcatttgccgctccctggatttagaacttctggaattctccaaaagacaccggatttctgtgagccgctatgccgacgacatctgttttagtactaacatgaggaaacccattttcgggctgtatgaaattaactcacagtttggcaactttccgggaacagagctctccgatatcttcactcgcaacggcttcaccctgaacatcaagaagttcaaggtgtcgaaatccaatagtaggcagatggtgacggggctgattgtgaatgacagagtcaacattcctcgggcctggcgaagacaattacgggtcctcctgcatctgcgtagccgcatggaggatgcagcaactaccaaggttgttaattcatggagctcccctttaccctcacgcaagggcgagacaagtagcattgacaatctaatacagggaaaggccagctttgcagcttatattgacaggaggtctggtacgaatcatataggcggcctctaccgaagctatcctaagctgcgcggcatgttgccacgggtcacgcagacatttcccgtgcggattatttctgaaggcccaactgatcttctgcacctccaggctgccctggagcattacggttcaaagctcgacctgagcaacattagcattaagttccataattaccagagcgaccagggggatgctgatacccttcaaacactgaggaggatcgctaaggtagatgtcgaggagctgactatcggaatcttcgattacgataatcctaagctcctccgagatctttccctggacgccgggggctatgtaagattggggcgaatggtcttcgccgcatgcttggctcgaccggctcaaactaacggcatgtactactgcatcgagagcctgtatagaagagatcaggcctcacggaccacaaccgaaggaagaagactatttttcgctgacgaatttaaggaggatggatcaagtcaggacggctcactgcgccgggagcatccaaagaaaagtgccctcgtgctttctgaacgagtctttgatccagcgaaacctgaggtgtctctcaccttgagcaaaaccgactttgcctctatggttttcacaaaggctgcaccatttagcgacatggactttagcggttttctgcccacactcacactgttgaggcgtatggtggacgaagccatgcgctaccagggaatcaaatga

SEQ ID NO: 7692 - RNA, 1725 nt, unidentified
  source 1..1725: mol_type = other RNA; note = synthetic construct
atgcccgtcaaaccaccaagcttgtcgaacagaagcctccagttcttggccattagaacaagggcagacctggctaactggatcggcctgtcagagaaggcgctgctatatatcctctacaaattgagtccagagcgcaagtataccacctttctcatcaagaagcgcaacgggcagtttcgccggattagtgcgccccagaaggccctcaaattctcccagcaccagatttctctagcaatccaagaaattactcccccacgacacattgctaaagggtatgtgaagggcaagagtataagcgatcatgcacgccagcatgttcgcaaaaaaatcgtggtgataagcgacctgaagaacttctttccatccattaacttcggccgagtgagggggttattcctgagcccgccttacagttttcctacagacatcgccactattcttgcccaaatttcatgtaaggacggagaactgccccagggatcaccgtctagtcccgcaatcagcaacgcaatctgtcggaaacttgacaggcagatcttgcagctcgcctctagaaatcgggtgtccgtgagccggtacgctgatgacatttgcttctctagcaataagaagatcagcctttcaatctgcgacacctcactgataaccggagatgtcgctggtcaggccctgaggggaatcatccaaaataacggcttccaggtgaatgatgccaagttccacagaatcccctataatcaacgacagatggtgaccggtctggtggtaaacgaaggtataagcataccacgtaagtggcggcgccaactgcgggcaattttacacttgcgaagcaaatttgatgaccctaggtccactgagattgtgaattcctggtcatcacctcaggccagtcgcagtggcaaaattacgtctgttgaccatctgataaaaggtaaagccagcttcgctaagcatattgataggacaagtggtagacgtgtcgtcgagtcattacacagaggctacccaagcctgtccgaactgtttcccagggtgtcccccgaattcccagttcggataatgaccgaaggctctaccgatctcatccacctggacgcagctctccaacgatatgaaaagcagcttgaactgttcaatatctctataaagctgcacaattacatcggggacacgggagatgtggacgtgttgagcactctccgaagaatcgcgaaagtcgacgtcgacgagcttacaattgggctgtttgattgtgataaccctcggctcatgaaagagatctccctcgaggccggctcctacgtacggcttggaaggatggtattcgcagccgctctggctcctcccaactcttccaccgtgcctcctttctgcatcgagtccttgtatccgcgcgagcagtctactcgtaggacaaaagaaggacggcgtctttttttcggcgatgaatttgataagtccgggaagttcattggggaggacatcaatagagagtttcctcagaagaccgccgtagctctctccgagaaggtctactcaagttccgacccctctacatcgctaacgctgtcgaaagttgactttgccaacatggttagctctggggcccacccattcgaggacatcgatttttctggatttctgccgacattaaatctgcttagggcaatgattgatgatgcgactaggcatcgctacagaggcaaggagagatga

SEQ ID NO: 7693 - RNA, 1584 nt, unidentified
  source 1..1584: mol_type = other RNA; note = synthetic construct
atgagtccagaaaaaaagtacaaaagcttccggatttcgaaaagaaatggaggcgaacgggagattagtgcccctacaagcgtcctcaaaaagatacagaaacgtattgctttcggagtcgacggcgtccgcaagaaaagcctgatcagcaacgggttcgaaaaggggcgatccatttttgaccacgcacagccacacaaacggaagtccctggtgattacagcggatgtaaaggacttctttccgtccatcaatttcggcagagtgagaggcgttttcctgagccccccctttggcttcaataataaagtggcaacgttgctggctcaactatgtacagacggtgccagtcttccccagggagcacccagttcaccatcaatcgccaacgttgtttgcgtccaattcgaccgattacttgttaccctcgcaggaaagtgcaggtgtagcgtaactaggtacgcagatgatatctgcttttctacgggaatggctgacgtgcctaagtacattgcagtgcgaaaagacggaaactatgtgccaagccaggccctgatcaagacctttaaagatggtgggttcgagataaacttggataaattccgggtggtagatgggaaggacgccctcgtcacagggttgaagtatcggggaggaatcggcctgcccagaaagtggcgccgcagacttcggactgagctgaatctgctacgcaagtatggcgacggcgccgagaaaatcatagcgtcatggggtggcgttactgaggttgctggcttgcccgagtcccaagggagccctaggatcctcggaaagattggcttcctccgctggcttgatggcaaagctggatcctctaacgccctccgaatggccaggtcttacccccagctcaggaaagaatttcgggcggtaatcccatacgaaaatattgacttactcgtcgagggtgtcaccgataaggtgctgctgctagctgccctgtccgccttgcaggcaaagggcagcttcagtgatctgaagctgaacttccctgagtcagctatgaagggcggcccagacctggaaaaaacagtgcgtctggtagcatctaccggtgcccgccgcaatttgactatcgccctttttgattccgacgattcagaggtgttagctagggcagggctggcgccccaaagtggagtctactatagggccatcgccagcggggtgtatgtgatggccttaaagcctcctccttggatgctggtggaatccttttgtatagagaacctgctcagaaacgacactttttctgtggaagatagccacggtagacggatgtttctcgcgaatgaattctctgagaacggtctgcatcagtctaaggagttctttagaacccgtccgaataagaaagctatcgttgtggactccgacgtgtattccgtcaaatcagggaagtcgatggctttggctaaatatgccttctcagagcttgtggcaaacgggcaggctccagaggaagattactacggctttcatgggacctttagtctgattcaggaagtctcttacgattttgcccttgacaaggtgaggtga

SEQ ID NO: 7694 - RNA, 1584 nt, unidentified
  source 1..1584: mol_type = other RNA; note = synthetic construct
atgtcagcagaaaagaaataccgatcattccaaatccgaaaaaagaatgggggtcagagggctataaccgctccaaccgacgtgctgaagaggatacagaagagaattgcatttggcgtagatggagtcagaaaacgcagcttaatttcacacggatttgaaaaaggcaggtctatcttcgatcacgcgcggccccacaaaagcaaatccttcgttattacggccgacattaaggacttttttcctagcatcaactttgggagagtgcgcggcgtcttcttgtctgcgcctttcggctttaataataaagtcgccaccctgctggcccagctttgtacagaaggaaattgcctcccccaaggagctcccagctctccctccatcgctaacgtggtgtgcgtacagctggaccgccttctggtcctcctggcagggaaatgccgttgttctgtcagcagatatgctgatgacgtctgcttctcaactggaagttcgactgttcccaagtatttaagcgtgcgtaaggacggaaaatacgtcccatcccaggccctcctgaagacattcaaggattgtggcttcgaagtgaacttggagaagttcagagtcgttgatggcaaggacgcgctggtgaccggtctgaaatacaggggtggcatcggactcccaaggaagtggcgcaggcgcctgcgtactgagctaaacctcctgcggaagcatgggtctggggcgaacaaaataatctctggttggagtggggttcaagagatcgccggcattaccgaaaaaagcgactgccctgggatcagcggcaagattgggttctcccactggctcgacgtgaaagccgggagtagcagaacgctgcgaatggcaagaagttatccgcagctgcggaaagaattcaaggctgtgattcctcaccagaagatcgatttgcttgtggagggagtgactgacaaagtgctcctgcttgcagccttggccgcccttcaggtgcgaggaggtttttccgacctcagtttcaattttcccgactcggctatgaaaggcggcccggatctagagaagacaatcaggctcattgcctccacaggcgcaaggcggaacttaacaattgctttgttcgactcagacgattcagaggtcctggccaaggtagggctgagccctcaaaccggaatttactaccgggcggtggccgagggtgtgtatgtaatggcactgaaaccacctgattgggtaatctccgaaatcttctgtatcgagaacctacttcgcaaggacacatttgcagtccaggatgctaacggacggcgaatatttctcgcctctgaatttagcgagaacggcctgcatcagagtaaaaatttctatcggattcggccaaataagaaggcaatagtggttgattcagatgtttactctgtgactaccggcgaatctatggccttggctaagcatgcctttagtgagttagttgccgccggggaggctgctggtgaagattacaatggcttccgctatactttttccctgatccaggaggtgtcctacgagtttgcactggagaagtccagatga

SEQ ID NO: 7695 - RNA, 1725 nt, unidentified
  source 1..1725: mol_type = other RNA; note = synthetic construct
atggccagcctgtcacctaactcctttggcctgactgacgctgaccttatcaggttcctgtcaatggcttcaagaaacgaactcgccgcttggctcggcgtctccgagagacagttaaaatatgtggtgtacgccatgccgttgcacaagaagtacaaggtgttcaggattaagaagaagaacggaggcgagagggaaattagctctcctaccgacattctgaagcggattcagaggcggatagctagtgcagttgacagcgccagaaccagatccctgatctcaaatgggtttgagaagggtcgttctatcttcgatcacgccaggccacacaagggaagggtcttcgtcattacagcggacataaaggattttttcccaagtatcaacttcgggcgagtgaggggagtattcctcgcccctccctttcggtttaataatgtggtggccactctgctggctcagctctgtactgacggagaatccctgcctcagggtgcaccgtcctctcccagcatagcaaacatcgtgtgtgtccagctggaccgcctcctaatggagctggccaaaaaaagcaagtgttctgtcacgcgatacgcagacgatatctgctttagtaccggtattgcccaggtgcctaaatatcttgccgttaagaacggggatgactacatcccatcccaggccctgtgcaagatactcaacaacaacgggttcgagatcaatctggagaaatttagggtttgtcgtggtaaggatgccctcgttacagggctcaaatatcggggaggcatcggtctaccgagaaaatggcggagaagactgcgaagtgagcttcaagtgagccggaagtacggagctgcagcggccaatattatagcggcttgggacggctcggatgaacccaagcttacaggcgagaacaacgagcttctctgcgtatccggaaaaattgggtttagtaaatggctggatgggaaggtgggcgcccaacgtaccttggccttggcacgatcatatccacaacttcgcggagtttttaaagccgtcatcccacaccgcgaaatcgatctgctggtcgagggcgtgaccgacagaatcctcctcatcgccgccctgttggctctgcaaaaacgcggcctgttcttgagcctgaaattcaatttcctctcttctgcaatgaaaggtggcgctgatctggagaagacagtgaagttactagcagcaacgggcgctaggcggaatctgaccattgcacttttcgactccgacgatggagaaatcttagccaaggtgggcctggtccctgcaagtggggtgtactatcgcgccattgcggagggagtttacgctgtggctctgaaacccccctcttggttaaccgcggaaactttctgcattgaaaatctactccatccagataccttcagcattgaagatgacttagggcggagaatattcttggcaacagaattctcagagcgaaatggatttcatcagtccggcaaattctttcgcgtcaaacccaataagaaggctatcgtagttgactcggatgtgtattccacaacgagcggcgagcccgtggcattggctaaacatgccttttcagagttggtagcccagggggctgcccctagcgaagacttttatggctttcacgagactttttctctgatccaggagattgcttacgaattcgggcttgccgcgggtcgcacttga

SEQ ID NO: 7696 - RNA, 1698 nt, unidentified
  source 1..1698: mol_type = other RNA; note = synthetic construct
atggctccgccactttctaaaaaagagatcgtcaatttcctagccatcagcaatagatctgagctggccacatggttatctgtttcagagcgccagctcaagtttgttgtgtacgctctcccaatcgactgcagatatcggaagttcaagattgctaagaagaacggcggaacaagggagatctctgcccctgtggaggtgctcgctactatgcagagaaagatagggtcagcaatcgacagtatacgcaagagaagcctgatctcaaatggctttgaacgaggccggagtatctacgatcatgctaaagcacacaaaggcaagtccaagattatcacggtggacatcgaagattatttcaatagcatcaacttcggacgggtgagaggtatctttctgagcagcccattcttattcagccccacagtggcaaccctactggcccagatctgtactgacggaaagtcattaccccaaggggcccctagctctccctctattgctaacctggcgtgcgtgcgcctggataggatgttggtggagattgcctctaaagcccgttgctccgtttcacgttacgcagacgacatctgtttttccaccgggttgtctgaagtgcctaaattcctggcatacgaagacgatggatcatatctccccagtaacgtactcgctgacatttttaaatccaatggcttcagcattaacaaagacaagttcgccgtcaggagtcgaaataaagcgatggtcaccggtctgaaatttcatggtggaattggcatgccgcggaaatggagacgcaggctccgtagcgaattacaagtatgccggaagtacggagatgaagccgcttctattatatcctcctggacatttggccctaatcgggtgcagctcaaaagtcatggaataagctccgtagcggggaaggttggctatcttcactggctagatggaaagagcggcgctgacaaagtcaggagattggctgagagttatggccaactggcgggtatttttggaccattgatgtccttcggtgaaattgacctgctggtcgagggcatgtcagatgagatcttgctgaacgctgccctccgaaacctccagaaaaaggggatgttcgagggtctgaagtttaacttcctggaactaggcaagaaagggggccctgagctggagaaatctgtgcgccttttggtcactaccggagcccggcggaacctgacaattgccctttttgactgcgacgataacgatgttctgactaaggtcgggctggaacccgccaatgggatcaactttcgaaggctgagcgacggtatctatgtggccgcacttagacccgcaggctggactcagtcggatcagtattgtatagagtcactcttaaggcgagataccttcgagttgtccgatatttccggcaggaaactgttcctttccagtgaattcagtgataacggactccatcactctatgaatttctacaggaccactccaaagaagaagacactggtggtggacagcgaggtctactgtgttcgcaccggggcatcgatggcactttccaagatagtctttgcccagattgtggcatcggggaccggagtggccgaagacttttacgggtttgtagagacgttcaagatgctgtacgaaatccacctgaatcaccgcgttgtggccgtaaaatga

SEQ ID NO: 7697 - RNA, 1686 nt, unidentified
  source 1..1686: mol_type = other RNA; note = synthetic construct
atgccgctggaagagcgagaggccgaattcctggcactaaggaccagggaggcacttgcctgctggctgggtatcacagataagcagctgcgatttttgctctacaagaaactcgatcagtcttatcgaactttcgtgattccgaaggcccgtggcggatctagggaaatcactgccccctcaaaatttcttgcccgtctccagcggaagatcgccctggtcgtagctgccatatcacccccccgcggattggcgaaaggattcgttaagggcctgtcagtcctcgatcacgccgcactgcacgctaataagcgctgggtcgtgtgcctcgacctgaagaacttttttccctccatcaattacggtcgcgtgctgggggtgttccgttcgaggccattcgaattccctgatgctgtggccattcccttgtcccagatatgttgctatttagggctgttaccacagggcgcgccctcctctccagctatttctaacgtcgtggccaggcaattggaccggaggctggccgaatttgcccgaaagaacaagctttctgtatcccggtacgccgatgacatctcctttagcacaaacgctagaattgtgcctgtaggccttatgttagaggacagatcaccaggcaatgaaatccttgaactgttggttcaaagcggcttcgtgattaatggcgagaagtttcgggtcaggcatgctagtgagagacagcaagtcaccggactcattgttaacgacagacctcgaatgcctcgtttctggcgcaggcagaccagagtcctcatgcaccttaggagagtgcatggggatgaaaacgccttgagcatcgctaaagactttagatccaaacggaagctgagcgacgtgaaatccatcgaggccttagttcgcgggagagccacatttgcgagccacctggatgatcggttccaaactgacttcgtggaatcccttgcccgtgccttcccagaacagcgcagcgttctggagagccgccggaaggtggcacatattcgcgtggttgctgaggggaaaacggacaaaaaatatattgcacaggcattttcggcattgtctggtcatgacagcaggtataggagagttaagatcgagttctcagatctgccagataagagtgagggatttggggacgtggcgctccggaagcatgtccaggagattagtactgtgcaactaccagtgttcaccatagctctgtttgactgcgacaattcaaaactaatggcagacctaaacctcacagctgctagttacgtcccgttaagtcccacactcgcgatcgcatgtctgccccagcctgcacacgtgtcagatgcagctttctgcatcgaacactttataccagcccacatacgcgctctgagggacagtaagggtcggagaatctttacagtcgatgagtttgattctaccaatggacggcaccgcaccgaatccctgtacagaatccatcctaaacaggcgactctgatcgtggacagcgacgtatttagcatgaccagtgccgagagcgtggcactctctaaatcgcagttctgtgacctggtctgtgagcgggcccctcccttcgaagatttcgattgggaggtgttccggcctgtaattgatttcctgctctccgtttacgagggcgctacgtctcgaagatga

SEQ ID NO: 7698 - RNA, 1692 nt, unidentified
  source 1..1692: mol_type = other RNA; note = synthetic construct
atggcaccgcccgacttatccctgcaggctgcctccctgctggcagtgagcaatcgggccgagcttgcggaatggttgggcacgactgataaaagacttcggtacatgctctatggtcgcggaaatattggtctgtataaggtgttcgaggttgctaagagatcaggcggaactcggaaaattgccgcaccgaagccttttttaaaggcgctccaacgtcggctggccgctgtcttcccccttatcagcgctgcccgaggcatcagcatggcctacaccgcagggcgcggcatcatcgagaatgctaaggttcaccgtagaaaaaggtgggtggtggccacagacctggaggagttttttccatcaatcaacctgggccgaattagaggcctgtttctgagcgagcccttcaatttcccaaaggaagtagctaccgtgttggcccaggtttgctgttatcagggggcacttccgcagggagccccaacatctcccgctctctctaacattatttgccggtccctggataggaagctggtcgagtttgcccgccggagtgggatcgccgtgactagatatgccgatgacatagtgttttcgttcaatttcaaagagtgccccgactctctggtaaataaggtggatggcagatggatagtgtctgatattctcagcgaaatcatcgaatcctccggtttcaaagtcaaccataagaaaacacgagtgacacctcggagccagaggcaattagtcaccggcctggtggtcaaccaaagacccgcaatgccaagagaatggaggagacggaacagggtaatcctgaggctgttgcagacctacgggaaagagcgcgccagtcagatcatatccgaatggaaaggacttcgtcgccctggcgcagacgcagaagcaatcatcaggggggccaccgccttcgccagtaacctagacaagaattttaacggtacatacacttcatccctgcgaaggaactaccctctcctctcgcaggttatttcctactctcccgatctagtccccgtggaggtcttgaccgagggaaaaaccgatagactcttgctggaatttgcctatgctcagctcagactccttccagagtttcaggatctgcggctgaagttctcccgactgtccgatactgcgggagacggagcactcgccaagcgactagacgagttagcagctcgcggcgtacggaccttgacgattggtctgttcgacgctgataacgaccaatacttatctaagtacaggatagccgcaggggagttttcagctgtgtcaaagaccagcgactacgtgtactctgggatcatccctaagcccactgacgatgcgccaagtagattttgtattgagcattacttccctcgtgactttatatctaggaccgacgaatttgagaggcggttgtatttccttgatgaattcgacaaaaggaatggacgccacaaaagcctgcctctatataagattagcgagaaatcaacgctcattgttgatgacaaggttttctcaatcatgactgacgatgatcgcaactacgccatgacaaaggcggacttcgctgaaaaagtcgtgagtcgcacaccaccttatgaagacgctgatgtgaattggtttagtccagtcttcaaaatgctgaagaacttcagcctccgctatagttga

SEQ ID NO: 7699 - RNA, 1626 nt, unidentified
  source 1..1626: mol_type = other RNA; note = synthetic construct
atgaaggatataaagacctatgaagatctatgcatggtcctcgagataaatcaaggctatttctactccgttctgaacaagatcaagaacaagaagggttatacgaaattctccatccctaagaaaaacggcggtgctagggaaattctggccccgtcacccattataaagagcctccagttgaagatcaaggcctacatcgaaggaaaatatttcccacacacgtgcgcaaaaggctttaaaaagggttgctgcaatgtcgacaacgcgaagatgcacgtcaaacggaattggtgtcttaatctcgatctcaaagactttttcccaagcatcaattttggcagagtgtacgggctgctcatgtcagagccctttaatgccaacaagaaaattgcagtggcactcgcgcatatcctgtgttatgacaatgaacttccccaaggagctccttcttcaccactaattagtaacttaatcgcttacagtctggacaataagctgttggcccttgccaaggagtatcattgcaactatagccgttatgctgatgacatatccttttcctcaaatagcactcatatgcctaagcagctggtggtgtttgacgacctgatccatgaatggattattggtgatgatttacagaacaccattgaatcctgtggcttctcaattaatcacgggaaaacaagactgctgaaaaaaaatcagcgccaggaggttacagggatcatcgtaaacagtaagctcaatttaaacaggaagtattaccgggagatccgatccatattccacaagataaaggttaacgggatcaaagaggtcgccaaacagaaccacgaaaggtacgggaaatgtaaagataacagcgaattcggcctaatcagcttcattaacggcaagcttgcctactataagagcgtggtcggagaggataatccatgctacaacaagctgtgcaaactttacaacaacaccattgagtacaaatacaagaactgtaagtcttcgaaacaggagttgattgataacgctatgttcatcattgagacatcagaaggccaaggaacagcctttttgctcaaagatttgggactggtgacctgtaagcactgtttgggattcaagcacgacgacttctgcactgaggaggagctaatcatcttcaataagcagaatgaagacatcatatacgcataccgagtgtctaaccccgagaatagatttaagctcaagctgaagaagatctttaaagagagcgaccttgctatactggaattgctgactgacgaaattcttcagtactatttctatccgtctaaagagcggctggatattcattctaagaattgcaccctgctgggttttcctaaccactctaaaggttcctcgatttccgagatcaataacatccaagtgagtagcaaaaaagcctactttgggcgcgactactactgtctcgacaaacccatcattacaggaaactctgggggcccactgctcaatgaacagaatgaagtactggggattgcttgcaaaggcgcaggagatatcactagtgcgagtgagactgacttcaatggcgtgatccctattgagttactgtataccgagaaggatgcctga

SEQ ID NO: 7700 - RNA, 2073 nt, unidentified
  source 1..2073: mol_type = other RNA; note = synthetic construct
atgacgaagctgccctccatggatcagatcatcgaagccttggtgcgttcatcgccgtctttttttagtaggcgggtgttgggcatgagttatgaccacctgaaggccatagtgtaccctaggccctcataccagagtttcaccataaaaaaacgggacggcaccgacagaactattcatgagccccggaagccattgaagatcattcaggtgaaggtcctggcttttctgaaagagcggtcctcacctctgaaacccgccgtccacgggtttgtggccaaaagatcaatcctcacaaacgcattagttcactgttcaccaaaaaccaagcacgtcttcaacgtcgatctggaggatttcttcccctctattactttttacagagttaggggtgttcttctgcatcacccatttaatttcagccatcaggtggccacggttatcgcccatatctgcactctggataacgtacttccgcagggtgcccctacctctccctttctttctaacttagtttgccgtactatggaccgggatctcacagatctggctcggagatccatggctcggtattcgagatacgcggatgacattacgttcagctttcgcgtgtcaaagaccctgaaacttcctgctgcggtgtgctccgtgaatggcgatggcgatctagccataggaacagagctgcacgacatcatcgttaacaaacaccatttcaagataaacagtgcaaaaactaggctgagtgatagaacaagacgtatggaggtgacaggattgaccattaaccgcttccccaatgtgcctcgggtgttcatcgatcgtatcaggggggcgctgaacgcatgggaaaagcatggttatgaccaggccgacaaggcatggcaggcgaggataacagccgctgccactggcgcgtatgagaagaaaccgtggaaacgccagatcaggactggcaaagctcctgccctgaagaacgtactgtggggcaagttgttatacctgcgcatggtgcgcgggaaggacgatctaatctatactagactggctgaaaggtacaatgcagcagcagcagctaccacagccgccggaagcttctccgcgcctaccttaccggtggagccagtggtgcgagacaaagagactgccctagacgcctgttttgtcgtagactggtatggcgactacaagcaccctgcccttggggatgagatgcccatggcccaggggaccgccttcgtttaccgggaactcgggctcattataacgtgcaatcatgtgttcgaatgggaagggcaggtaggaaaagtcgacaccgtcatcgattacgaaagcccatacctcacaaacaaaattctccaactcattcaacccggtaccaagaagtcctggcccgctaaggtcttgtttagggacaagccaatggacttcgccatactcgctttcgctgaggagcctccccagcacagatatttttccgcaatggacacacccattgagcccggggcacaaggcgttctgatcgggtaccctgcctggaaacagtggaccctgcctgattttaatgatcagaaggtgctcaaccgcacatctccgcatgccggcatgaattccttcaccatcaccggcgccggttccatccgaccaggtaattctgggggaccctttaccgacgacaggtttcgcgtggccggcatggctcaaaggggagcatacatgggaagcggccacgatgaaagcctgtgcttcgaaattatcgatgacctcatcgctaagtataaggcctctcttgtccctccacccgcagccatttctgtgccacctgccgctcccgtcattggtagcggagccccaccagcaactcccccagcaagcattccagtgcttcctgctccaccagctccggcacctcctaatgcgggctgtactcgaacatgtcgctccgccgatgctacaggacccaccgcaagggtacgacgcatgaatcgaactaccgcgcaagctgactatgctattacgagacgacgcttgagccggtcaagtgaccggctgagaagcggaacagcagtctga

SEQ ID NO: 7701 - RNA, 1917 nt, unidentified
  source 1..1917: mol_type = other RNA; note = synthetic construct
atggctatactactgggcaccgatcagattacagaagcgttggtgcgtagcaacccgtccttcttttcgcgacgcgttctgggcatgccgtatgatcggctcaaagccatagtatacccacagcctccatataaatcttttatcctcaaaaagcgcgatggcaccgataggaccatacatgagccccgcaaggctctgaagatcatccagaataaggttctcgcctttcttgaggagcggtcaccagcacttaagccaacagtccacgggttcgtcgctaagagaagtattttaaccaacgctatggtgcattgcagtcataaaacccagcacgtctttaatatcgacctggaagacttctttccttccatcacattttacagagtgaggggcgtgctgcttcaccacccattcaaactttcacaccaactcgccactgtgattgcacacatctgtacgctggaaaatgttctgcctcagggagctcccacgtctcctttcctgtctaacctcgtgtgccggtctatggacagagatttggccgatttagccagaagatcattggcccgctatagccggtatgccgatgacattaccttttctttccgcgtgagcaagacattgaaactccccgccgcagtctgctcggtggacatcagtgggaacctgaccattgggaccgagctccacgatatcatcgtcaacaagcaccacttcaaaattaattcagccaagacccgaatcagcgacagggcaaggaggatggaagtgactgggttaactataaaccgatttccgaacgtaccacgcgtgtttatcgacaggatccgcggggccttgaatgcctgggagaagtatggttacgaccaggctaacaaaacctggcaagctagagttacagagggtgctaccggaacgtacgaaaagaaaccgtggaagcggcagacacgagggggccaagtacctgcccttaagaatgtgctgtggggcaagctgctgtacctgcggatggtgcgtggtaaggacgacctgatctacacccgactggcagaaaggtacaatgccatggttgcgacttccaccgccgccggacagttctccgcatccacactgcccgtcgaaccagtggtgcgtgacaaagagactgcactcgacgcctgtttcgtggtagagtggtatggggactataaggatccgacgcttggggaggagatgcccatcgctcagggcacagcgttcgtgtacagggaactcggcctaatagtgacctgtaatcacgtgtttgagtgggcgggacacgtaggcactgtcgaaactgtcattgattacgagtccccctacctgaccaacaaagttctccggctgattcaacccggaaccaaggctagctggcccgctaaaattgtgttcaggcataaacctatggacttcgccatcctcgctttcgtcggagaaccacctcagcaccggtacttctccgctatggacgctccaatcgagcccagtgcacagggagttctgattgggtatcccgcctggaaacagtggacaccacccgatttcaacgacctgaaggtcttgaatagaacatttcctcatgcaggtatgaacagtttcactataagcggagctggctccattcgcccaggtaatagcggcgggccttttacggacgatcggctgagagtggccggaatggcacagagaggcgcctacatgggaacaggccatgatgagagcctatgctttcagatcattgacgaacttatcgcaacatataaggcaagtttactgccacctctagccgccagcacattgggtgctgcagcgcctcccactacttcacctgcgcctatttctcatcccccatctcatcccgcccctccagttcaagatgcccccgcatcagatacttga

SEQ ID NO: 7702 - RNA, 3675 nt, unidentified
  source 1..3675: mol_type = other RNA; note = synthetic construct
atgaccacgttgtccgagctaaatcgttgcgacgtggcaactttcatcgacagactgcgtggtatctatgaacacagtccatggattcctgagcgcgctgccactcatcgcccgttcgcaaatgagacagccctcaagcttgcattacaggccgttgtcacacacgctactgagggcgaacagctgggcctcatccgggaacacccagagttggccggcaaagccgctgttgccggagagctcaccatggagtcgacatccgagcaagctgcatccggcctgcacctgtgctccgcagatgaatacgcgaccctgcaccaattaaacgcagactacaacgctaaatttggatttcccttcatccttgccgtcaaggggcccaccggaaaaggccttacccgcagacaggtgatagcagcctttaccagacgactgaagaatcagcgggctgacgaaatcgccgagtgtctgaggcaaataaaaagaatcgccgagatccgactgaacgacctgctgggggtgtctctcgagtttgggcccgctattatgcagtgggcggaaactattgcggcttggtcggatgccgataatgcggcagacgctgattttgatttgacctgtgcttatatgacaccagctcaccgcaggacggctgaccaattgcgcgactggatgaccgatgcagggatggatgctcatatcgacgccgtcggcaatgtagtgggggtttatcgctctcctgtgcccggagcaaagaccctgatgaccggttcacattatgatactgttcgaaacggcggaaaatacgacggtcgactcggaatattgcttcccattgcgattgtcaggcacctgtacttgcggggtgaaacgctgccctttcacttagaagtcgttggctttgctgaggaggaaggagtgaggttcaagtctactttcctggggagtaatgccattactggacatttcgatctgtcactgctagatcaggtggacgctgacggcgtgtctatgcgggatgccttgaccgccgccggacatgacgtcgctagaatacccgccctggccagacagcctgaggacattttggccttcgtcgaggtgcatattgaacagggccctgttctgctgcaaagagatctggccctgggagtggttaccgccattgccgggagtagtcggtacctggttcagctcacaggattggcttctcacgctggcacgacacctatgtccatgaggaaggacgctgccgcggcagcagctgaaatcgtacttttggtggagcaacggtgcgcccaaggccagtcccttgtcggaactgtggggcagcttgaagtacccggcggaagcgtgaacgtgatccccggagcctgtaaactgtcattagacatacgagccgcagatgatgctgtccgcctcgccgcagtacaggatgtgctggacgggatcgccagcatctgcgcagagcgacaggtggcctttgccctcgaaaggattgtggatgcttcagcagccccatgcgcaccccaccttatgcagcagcttggagcagcaattgaacgggcgggcctcccgaggtttgagttgctgtccggtgctggccacgacgctatggccatggccgctatcactgacgtggccatgttattcacacgctgtggtaacggtggaatcagccataacccactggagacaatgaccgccgacgatgccgacattgcagcaagggcctctcacgaagtgaccccaagggcaaccgataggcgactgtataactgggctattatccaggtgcaggaaaaggatactggtggtagattactattcagcattcgcgcatatatggctatccttcccaatatggaccagataattgaaacactagtccggagttccccctctttttttagtcagaatatcctcgggataaactataacgaactgcgcgccattatctatcccagaccaagctaccagagctttacaattccaaaacgtaacggcactgtgcgcacaatccacgagccttcaaagacactcaagattatacagctgaaggtattgaatttcctgcttgagcgctccagtcctctcaagccagcggtgcatgggtttgtagccaatcggagcatactgaccaatgccctggtacattgtagctctaaaacacagcacgttttcaacatcgacctgaaagatttcttcccaagcatcaccttctacagggtgcggggggtcctgactcatcatccatataatttctcacacgaagttgccacagtcattgcccacacctgcactctgaacaattcactcccccagggcgcacccacatctccgtatctcagcaacctggtgtgtcgcacaatggatagagacttaacggagctagcacgtaggagcctggctaggtactctcgttacgccgatgatatcacgttttcctttcgggtcagcaagacctcaaaactgccggcagcggtgtgttcggtggatagtgacggagatctcgtcatcgggtccgagcttcatgacataatcgtcaacaaacaccacttcaatatcaacagtgcaaaaacgagactgtctaatagaacacgccggatggaggtgactgggctcactatcaatcgattcccgaatgttcctagggtcttcatcgaccgaattagaggtgccctcaacgcatgggagaaatatggttacatcgatgctgagaaaaagtggcaagagcgggtgacatctgctgcaaccttggcctacgagaagaaaccctggaaaaggaagacccgagctggccgggttcctgctctgaaaaacatcctgtggggaaaactcctctaccttcgcatggtgcggggaaaagacgacctcgtatacacaagactagccgaacgttataacgctgccgtcttaaccgcgacttcagccgggcctttttccgcaccaaagttaccagtcgagcctgtggtaagagataaggagactgccctggacgcatgctacgtggtcgagtggtatgcggacttcaacgatccgaccattggcgaggagatgccactggggcagggcactgcctttgtgtacagagagctggggctgatcgtgacctgcaatcacgtgctcgaatggaacggcgaaatcaataacatcggcatcacaatcgactatgagaacaagtacctaaccaataaggttctgaagcttatccagccaggcaccaagaagagctgggcagctaaggtgattttcagaaacaagcagatggatttcgccatcctcgcgttcgctgatgagccacctcctcatcggtacttcgccgctatggatgcccccatagagcctgaagctaacggcatgttggttggatacccagcttggaagcagtgggctctgcctgactttaatgaacaaaaggtgcttaataggacaacaccccacgccgggatgaacagcttcaccattacgggcgccggcagcataaggcctggtaattcaggtggcccctttaccgatgacaggtttcgtattgccgggatggcccaacggggagcatacatgggggaagggcatgacgaaaacctatgctttcagattatggacgacttgatttccaaatatagagcgactctccgcattcatgtagcgatacctcccgcctccggcgcgtga

SEQ ID NO: 7703 - RNA, 1944 nt, unidentified
  source 1..1944: mol_type = other RNA; note = synthetic construct
atggaccagatcatcgaggccctggttagaaaacacactagcagcttttcccagcgggtgctgggcatgccatacgacgccctgaaggccttgatctacccacgtccctcttaccggtcttttacaatcaaaaagcgcgacggctccgataggaccatccatgaacctcgcaaagcactgaagaacgttcaactgaaagtacttgcttttctccaggaaagaagctctccattcaagcccgctgtgcatgggttcgtcgcggatcactctatcttcaccaacgctctagttcactgttcgcccaaaacccagcacgtctttaacctagacctggaggatttttttccctctattacattctaccgggttagaggcgtgcttctgaaccaccccttcaaattctcgcaccaggtcgcgactgtcatagctcatatatgcacacttgataatatgctcccacagggcgctcctactagcccgttcctgagtaatttggtgtgtcgaaccatggacagggatttgacagagctcgctaggcatggccttgcacgctatacacgctacgctgatgacattaccttctcctttcatgtgagtaagaccagtaagctgcctgcctccatatgcagcgtcgacgatgacggtgccctggtcgtgggaagcgagttaagggccatcatagtcgacaagcatcactttaagattaatgccgccaaaacccggctgtccgatcgcacccggagaatggaggtgacaggcctgacgatcaaccgattccccaacgtcccaaggatttttattgaccgagttagaggtgctttgcgggcctgggaaacttacggctacgaaaacgccgagaaggtatggcatgcgcgagttgctgctgctgccactgggccttacgaaaagaaaccctggaaaagacaaaccagagcaggaggccctcccgctctgaagaacgtgctctggggtaagctgttgtatctccgcatggtgagaggtaaggacgatctcatctacaccagattagccgaacggtataatgccgctgtgcttaatgagcaggctgccggtgccttcgtagccgcaactctgccggtggaaccagtggtcagggacaaatctaatgtgttagatgcctgcttcgtgctggaatggtatggcgactattcatctcctactctgggggaggagatggttggtgggcagggcactgcttttgtgtatcgagagctcaatctgctcgtcacctgttcacacgtgtttgaatggagcgggaagattggaaaagtggatgcagagatcgatatcaatgatccatgcattgcaaccaaaacactccaacttgttcagcccgggacaaaaaaagcctggcccgccaagattctgtttagggataagcccatggacttcgcaatcgtggcctttgaagacccacctccccatcgctacttcagtgcaatggataatcccattgaaccgtccgcccaggggttcctcatcggataccctgactggaagcagtggaacttgccggatatcaacggcctaacggtactgaataggaccatgccacacgccggaatgaatagcttcactatcactggagcagggagtattaggcctggcaacagcggagggcctttcacggatgaccgctttcgtgtagcaggaatggcccaacggggcgcttatattgggcgtggccacgacgagaacctgtgtttcaagattatagacgcgcttatcgccaagtataaagctaccttgccatcacctcctcccttagcgccagcggtgatggctgcatcagcacccgcatcagccgcaccgatcgtggtcccaacgtccacagacgccctaagtgctacaccatccgcagcgggagccacacccatagtgcctccatccgagggagagtcacctcctccggacgcaatttga

SEQ ID NO: 7704 - RNA, 1920 nt, unidentified
  source 1..1920: mol_type = other RNA; note = synthetic construct
atggcaattttgctgtccttggatcagatcgtggaagcactggtgagatctgagccggccagcttctcgcgcgatgtgctaggaatgccttacgacagtctgaaggccattatttatccacgccccccatacaaaagctttaccataaagaaacgcgacggctccgaccggaccatctttgaacctcggaagcgactgaaagtgatacagcttaaggtgctggactttctgcaaaagagaagcacacctcttaaacctgccgtccatggctttgtcgccaagaggagcatactgactaacgctcaagtccattgctccccaaagaatcaccacatcttcaatattgacctggaagacttcttcccctcaattaccttttacagggttcgaggcgtgctcctgcaccacccgtttaagttctcccacgaagtcgcaaccgtgatcgcgcacatctgcactttagataaaaccttacctcagggggctccgacatcaccctttctgagtaacctagtttgtcgtaccttggatcgcgatctgaccgagctggcccggagatgcttggctagatattcccggtacgctgacgacatcacattttctttccgaacccggaaaacaattaaactccccgcagccatctgtagtgttgattcggatggtgataccgtgatcggtacggagctacatgatataattgtgaatcagcaccacttcaaaattaattccgctaagacccggctctgcgaccgcaaccgaaggatggaggtgactggccttacaattaatcagttccccaacgtccccagggtgttcatcgacagaatccgcggcgctctcattgcttgggagtctcatggctatgcagccgcgaacaaggtgtggaacgaaagggttactgccgctcgttccggcgcctatgagaagaagccatggaagcgccagacccggcgaggtcaagtgcctgatctcaaaaacgttctctggggcaagctgttatacttgagaatggtaagaggcaaggacgaccttatctatacacggctggcggagagatataatagcgctgtgttaataacagcagccactggaactttcaccgccccaaaactgcccgtagagcctgtagtgagggataaggaaacagccagggacgcctgtttcgtcgtggagtggatgggggattacgatgagcctggggttgggactgaggtgcccatctctcaggggacagcatttgtctaccgggaactcaatttgctcgtaacttgcaatcatgtgctggagtggcagaacggcgaggaagggaaatttctggctcagatcgactatgaaagcccctttctcagcgataaggcccttaagcttatccagcctggaacaaaaaaaagctgggatgctaagattctgtaccgtaacgagcaaatggactttgctctgctcgcgttcgaagaccccccacagcataggtacttttctgcaatggacaatcctattgaaccgggcgccaaggggttcctgatcggttacccagcctggaaacagtggaacttggctgacgttaactcacagacggtcctgaaccgtacttcaccccacgcggggatgaatagtttcaccataaccggggcgggctctatcaggcccggaaattctggaggacccttcacggacgaccgcttcagagtagccggaatggcccaaaggggagcatatatgggtgatggacatgacgaaaacctgtgtatcgagattatcgatgagctcattgccgcctacaaggccagcctagtcgctcccgccgtgcttgttcccgctgcatcagccgcagcccctgctagtccagctacggcagcaccgtccgccaaacctactgcgccaccaccagcaccaacaccacctcctccagtcatgccctga

SEQ ID NO: 7705 - RNA, 1995 nt, unidentified
  source 1..1995: mol_type = other RNA; note = synthetic construct
atggccatcgtagccagcatagacgaaattatcgagagcttagtgcgtaacaatcccgcctggttcagtcggagaatcttgggcatcccctactccacactgaaggaaattgtctatccacgtccaccctacaagcgctttaccatcaagaaacgagatggcaccgatcgggtcatcttcgaacccagaaaccggctgaaaatcatccagcagcgcactctcaaatttctgcttgaccgcagtggccctttgaaacccgcagtccatggttttgtgtctaagagaagcatactcacaaacgcgcaggtacattgttctcctaaggtgcatcacgtgtttaacattgatctagaagacttcttcccgaacataagtttttaccgggttcggggtgtcttggagaagcacccgtttaattgttcccaccaggtagccaccgtgatagcccacatttgtactctcgacaaagtgctaccgcagggtgcccctacgagcccactattgtcgaacttagtgtgcagatcgttggacagggacttaaccgacctcgcacggcggagctttgccaggtactcccgatatgcagatgatatcactttctccttcccagtacgcaaaaccagtaggctgcctgccgcgatatgtcacgttgatgaggatggcgatcttctcatcgggaccgaactgcatggcgtcatcaccaaacacaattttaaaatcaaccccgcaaagacaaggctgagagatcggagccgaaggatggaggtgaccggccttacaattaatcgcttccccaatgtccctcgtcggttcattgacagaatcaggggtgctttgcacgcgtgggagaagtacggctacgatgctgcagagaaggcctggtctgagcgcgtggaaaaagccacaacgggaccttatgagaagaagccctggaaacgtcaaatgaggcgcgggagattacctaaactgaaaaacattctgtgggggaaactactgtatctgagaatggttaggggaaaggacgacctcatctatacccgcctggctgagagatacaatgatgctgttctggcagctcacgcagccggaccattcactgcccctcgattgccggtccaaccgctggtcagggacaaggaaacagcgcgagacgcttgcttcgtggtggagtggcttggggactaccaaagtgctgccggcgtgacggatgatataccaatggggcagggaaccgccttcgtgtaccgcgaactgaatctcctcattacctgcgatcatgtttttgaaggcaaggccaatgtcgggcacttcgaggtggagatggactacgaggacgttgagctggtgaacaagactctcaatctggttaaacctgatacacaccagaagtggccagcgaagatcctttaccggaatgcccagatggatctggccttacttgccttcgaccacccccctcagcataggtacttttctgcaatggataacccaatagagagcggagcccaagggattctgattggatatccagcttggaaacaatggaacctgcctgattttaacgaccagaaggtgctgaacagaacaaccccccatgctggtatgaattcatttacaatctccggggccggatccattagacccgggaattcaggcgggcccttcactgacggcaggtttcgcgtcgctggtatggctcagcggggagcttatatgggcgacggccatgacgagtgcctgtgcttcgaaatcattgatgacctcatcgacaagtatcgagccagcctcgttccccccgcaccagtaccagctccaactcccgccgtgggagctgctgctggacttgctgcagcaatgtccgcagcgccgccagcacctattcctattcctgccgccgtggcctcttatacggaagccccctcagtctccgcgtctgcaatcggctcagtggcaactcccgtgcagccacctccatcagacgaacctctgatgtga

SEQ ID NO: 7706 - RNA, 1983 nt, unidentified
  source 1..1983: mol_type = other RNA; note = synthetic construct
atggcaattctggcatcactggatcagataatcgaaggactcgtaagaaaccataccgcttggttcagcagccggattcttggaatcccatattcaactctgaagggcataatttaccctagacccccttataagaggtttacgattaaaaagcgcgatggtaccgacagggttatctttgagcccaggaaccggcttaaaatcatccaggagagaacactgaaattcctccaggagagatgtgggccatttaagcctgccgtgcatggcttcgtcagtaagagatcaatcctcaccaatgcgcaggttcactgtagtcagaagatccaccacgtgtttaatatcgatctagaggacttcttcccctccataagcttctacagagtacggggcgttcttgagaagcatccctttaactgcagccaccaggtggctactgtgattgcacacatctgcactctggacaaaatgttgccacaaggggctccgacttctcccttcctatccaatttagtatgtcgctcgatggatagggatttaactgacctcgccagaaaatccctggcccgctacagccgatatgcagacgacattacattctcattcccggtgaggaagacctcaaggctgccagcatctatctgtcacgtggatgaagacggagagctgctgatcgggaccgaattacacgacatcgtaaccaaacactcattcaagattaacgctgctaaaacgcgcttgtccgatcggacacgtagaatggaagtgacaggactgaccatcaaccggttcccaaatgtcccccgggtcttcatagatcgtattcgaggtgcgttgcatgcgtgggagaagtatggatatgacgcagcggaaaaggcctggtctaagcgcgttgttaaagcagctctgatgggggccccctacgagaaaaagccctggaaacgacaggtacgccgcggacgcatgcctaagctgaaaaatgtgctgtgggggaaactgctctaccttaagatggtacgcggcaaggacgacctgatatatacgcggctggccgagcggtacaatgaagctgttctccgggcacaggctgccggaccatttactgccccgaggttgccagtgcagccagtggtgagggacaaagagacagccctcgaagcctgctttgtggtggaatggttgggagattaccagtccaccgctggagtcaccgatgacatcttaatgggtcaagggaccgcctttgtttatagggagttgaacctccttgtcacctgtcaccatgtgctggagggcaaagcgaacgtggggcattttcaggttgagatggattatgaggatgccgagctcgtgaacaagacacttaacttagtcaagccggacacaaaacaaaagtggcctgcaaagatcctgtacaggaatgcccaaatggatctggccctgcttgcctttgactaccctccccagcatagatatttttccgcaatggacaatcctattgaacccggcgcacagggcgtgctgatcggttacccagcatggaagcagtggaacctccctgatttcaatgaccagaaagtgctaaaccgtacgacacccaacgtcggtatggattctttcactattagcggggccggttccatccgaccgggcaattctggcgggccctacacagacgatcgattcagagtggccggcatggcacaacgtggggcgtacatgggcgatggccacgacgaatgcctgtgctttgaaattattgacgacttgatagctgagtatcgggctagtctcgctcctgctcccgtcccagccgtcagtactgccgcaacaagcgccactgtgactgccggaaccaccccagctgctgtcagtgcccctgctgcagctgccatgtcggcttctgccgccattgtccctagctccgcgatgagctctctgggcaccctagtgcaaccacctccccgagccgacgatacatga

SEQ ID NO: 7707 - RNA, 1932 nt, unidentified
  source 1..1932: mol_type = other RNA; note = synthetic construct
atgaggactcaccttagcatagaggccattctggaagaactggcgagacagaaggtcttttggttttccacccatgtgctgggcatcgcctacagtgagctgaaggctatcatttatccgcagcccccctataagcatttcactatcaagaagaggaatggtacagacagggttattctggagccccgcaagcgcctcaaaatcattcaggagaaagtgctcgcttacctgcaaaatcgcgccggctcgattaaacctgctgttcatggattcgtgcggaagagaagtatcctgacaaatgcccaggcacactgcagcccaaaaaaccaccatgtgttcaacatcgaccttgaagacttctttccatccataaccttctacagagtgcgtggagtattggagaaacaacctttcaacttttcccatgaggtggccactgtgatcgctcacatctgtacactcgataaaaagctccctcaaggggcccccacatctccattcctttccaatatggtgtgtcgcaccatggatcgagacttggctgacttggcccggcgaaaccttgctcgctataccaggtacgccgatgacataaccttttcatttccagtcagaaaaactagcagactgcccgccgcaatttgtcgggtggacgacgacggcgacgtcctaatcggcaccgagctgcatgacctcattgcgaacaagcaccacttcaaagtaaacagcgctaaaactcgactctctgaccggacccggcggatggaagttacagggctcaccatcaaccgctttccgaatgttccccgcattttcattgatagagtccgcggggccttacacgcgtgggagaagtacgactatgccgccgcatcaaaagtgtggtccgacagggtcgtagccgcttccacaggcccttacgaaaagaagccttggaagcgacagacaaggtcagggaaagtgcccgaactaaagaacgtcttatgggggaagctgctgtacgtgaggatggtccgggggaaggatgacttaatttacacccggctggcagagcggtataacgcagccgtgttgaagacccgtgccgcaggaccctttgttgcacccaggttgccggtggagcccgtggttagagataaaactactgccagagaggcatgctttgtggtcgaatggtggggcgattaccagtcagcacccggacataccgatgatattcccatgggacaaggtacggccttcgtttatcgggaactgaatctgctcgtgacttgcaatcatgtattcgagggagtcgccaccgtgaataagcacagtttcaacactgattttgacgcccccgagatggtcaataagacactgaccctggtgcagccatcgactaaacagtcctggcccgctaagattctctatcgcaatcctcagatggactttgccctactggcattcgaagacccaccttctcacagatatttctctgcaatggattgtgccatcgagtcaggagcgcaaggcatccttatcggctttcctgcctatcagcagtggaacctgccggattttaacgaacagaaagtgcttaacaggacgctgccgaacgcgggtatgatcagttttacactgtctaattccggcagtgtcagaccaggtaatagcggcgggccattcaccgacgatcgattccgagtggcaggcatggctcagcgtggagcttacatggggacaggacacgatgagtgcctctgcatggaggtaatcgacgcccttataagcgaatacaaagctacgttagctagctctgcccctgtaacgccagcgtctgctttggatgcagctccaatagtggctcctagcggcgccgttatagctcctcgtacagctgccccagcacctgcagatccagaaggtcctaggcccccagccgatgcgtga

SEQ ID NO: 7708 - RNA, 1953 nt, unidentified
  source 1..1953: mol_type = other RNA; note = synthetic construct
atggcctccattccaaacttcgacgctatcactgagagcgccgtgagaagcaacataggcttcttcagtagacgcgttctgggcatctcatacgatcggctcaaagccatcatttacccccgggctccctaccgctcttttattatcaagaagcgggatggaactgctaggttgattcacgaaccccgcaagcgtctgaaaattctgcaggaaaaggtgcttgcatttctggacgagagatccggccccgtcaagccaagtgttcacggtttcgttaggaaacgaagcattctcaccaatgctagagtgcattgtagtcccaaaacccagcacctccttaatatcgacttagaggacttttttcctagcatcacgttttacagagtgagaggggttctgagaaaacacccattcaatttctctcatgaggtggccacagtgatagcccatctgtgcacgcttgacaggactctgcctcagggagcccccacaagcccttttttctcaaacctgatatgccggtcgatggaccgcgatctgaccgaactcgcccgccattccctagcgcgatatacacgttatgcggacgacatcaccttctctttccacgtgcgaaacgcagccaggctgccagcagccatttgtagtgtggatgctgagggcgccgtccagatcggccaagagcttcatgacgtgttagtaaacaaacaccacttcaacttgaactctagcaagactcgtctgtccgatcgcagtcgccggctggaagtaacaggattaacaatcaacaggtttcccaacgtgcccagaattttcattgatagaatcaggggcgcccttaatgcgtgggagaaacatgggtacgatgccgctgagaagacttggcaggcaagggtggtggcacagtcaaatggggcgtatgaaaagaagccttggaagcggcagactcgtagcggaaaagtccccgagcttaaaaacgtcctctggggtaaactcttgtacttaagaatggtacgagggaaggacgatctcatatacaccaaactagccgaaagatacaatgccgcagtgggtgcggcacaagcaaccggtgtattccacgcaccaaagctgcctgtgcagccggtggtcagggacaaagttaccgctcaggaggcatgctttgtcgtcgaatggtatggcgattataacgaacccggaatcggcgccgaaatgccctatgtacaggggacagcattcgtttatcgggagcttaatgtcctgattacctgcaatcacgccctggtctgggagaatgaagaagggaagtttcctgccgtgattgattacgagtccgcccatttgagcggcaaagttttgagcctggtgcgacccggcacaaaagagaagtggccggccaaggtaatctacaggaataagccaatggactttgccctcctagcttttgacggcgctccgccactccaccggtatttctccgctatggacaaccccatcgaacccggggcccaaggattcctcattggataccccgcgtggaagcggtggaacctgcctgatatcaatcagcagaccgtcctgaaccgcacttcccctcacataggcatgaattcttttaccgtgacaggggctggatcaatccgcccaggcaattcaggtggtccctttaccgacgacaggttcagggtggccgggatggctcaacgaggagcacacatgggcgtgggacatgatgagaacctgtgtatcgagataatcgacgatctgattgccaagtatcgggcgtcgatggtgcctccacctccagctgctccagcaccagccgatccagctgctagtgtttctgctccggtgttgggggtcccaccacctgcaccttctgcacctgccgcccctgcttcctcacagaatgctgcaccggttgccttgccgcctccccaaacggatacttga

SEQ ID NO: 7709 - RNA, 1908 nt, unidentified
  source 1..1908: mol_type = other RNA; note = synthetic construct
atggccattgtaaaaatgaacgagatgcacgaagccttaagtaggaacttcgtgacttggttttcgaataatgctcttgggattccatactccagtttaaagggaatcatctaccccagacctccctataagcagttcgtgataaaaaagagggacgggtccgccagggtgattgcggaaccacgcaatagactgaaagtgatccaacagaaggtgctgacgttcctaactgaacgcgccggacccttcaagccagtggtgcatggttttgttcccaagaggtccattttgactaatgcccagatccactgtacccctaaaaatcaccatgtcctcaacattgacctgaaggactttttcccatctatcaccttctttagagtccggggcgtgctgaggaaacatccgtttaatttttcccatgaggtcgcgactgtcatcgcccacatctgcaccttggacggtacacttccacagggcgcgccgaccagcccatttctgagcaatttggtgtgtcgctctatggatcgggatctgacagacctggctaggcgtaatctggctcggtacagcagatacgcagatgatataacgttctcctttcctgtgcgcaaaaccagtcgacttcccgcagctgtgtgtattgttgacgacgacggacacctccaagtcggcgctgaactacaggacctcataaccaataagcaccatttcacaataaaccccgcaaagtctcgactcagagatcgcggacggcggatggaggtcacaggtctgaccatcaatcaatttcccaatgtaccccgtgtctttattgatcgcatccgcggagcactgcatgcatgggaaaagtatggatacgaggcagcagataagcagtggaacgacctcgtcaagaacgctgtgactggggcattcgagaagaaaccttggaagcgacagacccgaagaggcaaaacccctgaactgaagaatgtcctttggggaaagctactttatctccggatggttcgaggcaaagatgacatgatctatacccgccttgccgaacggtttaacaacgcagtccttgcaactcacgtggccgggcctttcagcgctccaaaactgcccgttcagccggtagttcgggatatcactacagcccgtgatgcgtgctttgtggtggagtgggttggggagttccattctactcctggcacgtgtgatgacgtgatgtgtaaacagggcacagccttcgtatatagggagctgaacctactggttacttgcaatcacctgttcgaacacattgctaccatcaacaaacatgagtttccaacagattacgaggcccctgaaatattcaacaaaactctcaacctggtacacccgggcactaagcagcattggcccgccaagatattatatagaaacgcacctatggacctcgccttactcgcctttgagggtccagtgccacctcaccgttacttccccgctattgactctccaatcgagccgggcaagcagggcattctgatcgggtaccccgcctggaaacaatggaatctccctgattttaacgatcagagggtgctgaatcggaccagtcctcacgcgggtatgaacagcttcaccatcaccggcgcgggatcaattagacccgggaactcaggggggcccttcacagatgaccacttcagggtggccggcatggctcaaagaggtgcatatatgggcgacggacatgacgaatgcctgtgcatccagattattgacgacttgatcttgaaatacaaggccagcttgacgctcctgacagtacccgctttggctgctgtttcccctgatgaggccgccgtggctgccacatcaacaccagccctgacatcacctgccccaacgaccccagctgtgaccgtctga

SEQ ID NO: 7710 - RNA, 1785 nt, unidentified
  source 1..1785: mol_type = other RNA; note = synthetic construct
atgctgcggaatcatgtcacttggttcagccggaacgccctgggggtcgactacgaaaagctcaagcggatgatctatccgcgtccgaagtacaagcatttcactattacaaagcgcaatggttcaccacgcgtaatcagcgaacctagaaagagactcaagatcatacaagagcgagtcctggccttcctcgagccacgaagtggcccactgaagcccgcagtgcatgggtttgtgccaaagaggtcaattttaacaaatgcgagggtgcactgcagccccaagaaccaccacattttgaacctcgatctacaggactttttcccctccatcaccttttatcgggtgcgtggggttcttcggaagcatccttttaacttgtcacatcacgtcgccaccgtaattgctcatatctgcactctcgatggcacactcccacagggtgcacccacatctcccttcctgtctaatctggtgtgcaggtctatggacagagatcttactgatctggcacgcagaaaccttgcaaggtatacaagatacgctgatgacctgaccttttccttcccattgaaaaaaacctccaatctacctgctgcggtctgtgttgtcgacgaagatggagggatcaccttaggcgcagagttacacgacctgatcaccaacaagcaccatttcgccattaaccccgctaaaacccgattgagtgatcggggccgcaggatggaagtgactggccttacgattaacaaattccctaacgtgccacgcatatttattgatcggatcaggggcgcactgaatgcctgggaacggaatggatatgacgccgccgaaaaaggatgggaagagcgcatcggtaaggctgctacagggccatacgagaaaaaaccctggaaaagacagactagaggtggcgcggcccctaaacttaaaaatgtgctctggggaaagctgctatacctgaaaatgatcagaggaaacgatgacttgatttatacgaggctcgccgaacgctataacgcggccatcctgaaagaaatggcagccggccctttcagcgcccccaaactgcctgttcagcctgtggtgcgagattacaagactgcacgagaggccgtttttgtggtggagtggctggccgattaccactcatcccctggccaccacgagtgtcccattgaggcacagggaacagcctttgcttaccgtgagttaaatttgctcgtcacctgtgatcacgtgctggtaggcaaggccgagttcgccgggatggaagtgccagctgactttgacgcgcctgaagtggtgaacaagatgcttactgtggtgcgccccgaaacccaagagagctgggcagcacgcgtggtttacaggaacaagcagttcgatttcgccatccttcagttcgaggagcagcctccccaccatcggttcttctccgcaatggacacgccgattgcccctcatgccgacggagtactgataggctttccggcttaccaaaactggaacctcccagacattaatccccaaaaagtcctgaataggaccttgccgaatgccggtatggtttcgtttacaatagccaataccggaagcatcaggcccgggaattctggcgggccattcacagatgacagactgcgtgtagccggaatggcacagagaggagcgtatatgggtgtcgggcacgacgagtgtctgtgctttgaggtcatggacaaatttataggcgagtggaaggctaagagtgctgctgctgctcccccagctgttccttga

SEQ ID NO: 7711 - RNA, 1911 nt, unidentified
  source 1..1911: mol_type = other RNA; note = synthetic construct
atggtagcaatacccagtgcagacgcactgtttgagtccttagcgaggaacaacgtgaattggttctcacaccacatactggggattagctatgcccacctgaagcgcatgatctatcctcgcccaccttataaacattttagcatcaccaagcgcaatggatcccccagagtgatcagtgaacctcgccgtaggcttaaggtcgtccaggagcgagtcctggcgttcttagaggcccgcaggggtcctctcaaaccagccgttcatggctttgtgtccaaacggtccatagtgacgaatgctagagcacactgtagcccaaaaaaccaccatatcctcaacctggatttacaggacttttttccatctatcacattttaccgggtccggggcgtgttacgaaagcaccccttcaacttctcacatcacgtcgccacggtgatcgcccatatttgtaccctcgatgggacactccctcaaggagctccaacatctccactgctgtcgaacctcgtgtgcagatccatggatagggatctgaccgaccttgctagacggaacctggccagatacactaggtatgccgatgatatcactttcagtttccccgtgaagaaaacttctagactgcccgcagctatatgcgtggtggacgacgatggcggtgtcaccattggggccgagcttcatgatctaatcgctacaaagcatcacttcactattaatgcagcgaaaacacggttgagcgataggttccggcggatggaggtgaccggcctgaccatcaataagtttcccaatgtgcggcggatcttcatcgaccgcattcgtggggctcttaatgcctgggaacgtaatgattatgccgctgccgagaaggggtggcaagaccgagtacagaaggcctccgctggagcttacgaaaagaaaccctggaaacgacagacgcgcggctcagcagtgcctaaactgaagaatgtactgtgggggaagctcctttatctcagaatggtgaggggaaaagacgatttgatttacacacgtttggctgaaagatacaatgccgccgtcgacaaagagatggctgccggacccttcgcagccccaaagttgccggtagagccggtagttcgcgaccacgacacggccgaggaggctgtttttgtcctcgaatggtttggcgactaccagtctcaacccggtcataccgacgatatggtgatggcccaggggacagccttcgtgtacggcgaactcaatctgcttgtgacctgttcacacgtgttcgaggcagaagcaaaggtgggcaagatgatggttcccactgatttccaggcggtcgaaatggcgaacaaaactctgcagctggttagacctgggactcagcaagcctggcctgcgcatatcctgtacaggaacaagcagatggactttgcgttggtggcgttcgacgatccagttccccagcaccgctactttagcgtcatggacaatccgatccaggcccgagccgatggaatcctgatcggattccccgcctatcagaactggaacctgcccgattttaacgaccagaaggtgctaaacaggacaataccgaatgccgggatgaacagttttaccattgccaatgccggttctattaggcccggaaacagcggaggtccttttaccgatgaccggttccgagttgctggcgtagcccaaagaggcgcttacatgggcactggccacgacgagtgcctctgcttcgaaattgccgacgctctaattgcagcatggaaagctaccttggtgccacctgcaccaccaccagcacctgcagctgtcgttcccccacctgcacctcctccgattgctccagcaggtcacgccccgacagctcctccaacacccccaaccactccctga

SEQ ID NO: 7712 - RNA, 1830 nt, unidentified
  source 1..1830: mol_type = other RNA; note = synthetic construct
atggtagctatcactagcgcaatggcgctgaacgaaagtatgctcagaacttcagtcacctggttctcttctcacgtattaggcgtgccatatagccagctcatgagaatgatatatcctcgacccccttataaacggtttactatcacaaagcgaaatggctctccacgagccattgccgaaccccggcagaggctcagaatagttcaggagcaagtgctggcatttctaaaagagcggagtggaacggtgaggcccgctgttcatgggtttgtcgttgaccgctcaatcgtcacaaacgccaaggtgcattgtctccccaaaacacagcacatcttgaacctggacctacaggacttcttccccagcatcacattttatagagtcaggggggtgctgagaaagcaccccttcaatttttctcaccacgtcgccaccgtggtggcccatatatgtacattggacggcaagctgccacagggagcccctactagtccgtttctttctaacctcatctgcaggagtatggatcgcgaccttaccgagctggcccgacgcaatagagctacctacactcggtatgcagacgatattacgttctcttttaatgtgcggactgcatccagattgcctgtagccatttgcgtcgtcgacgacgatgggcatgtgacactggggaccgagttacatgacctgattactgccaaacaccatttcgcgatcaacgccgccaaaacaaggttatcggacaggcatcgacgtatggaagttaccggtctgacaataaacaagtttcccaatgtgagaaggatctttattgatcgtattcggggagcactgaacgcctgggaacgcaacggatacgaggcagccgaacaaggttggcaggatcgggtcatcatcgggggcaaggtgccttacgaaaaggtgctgtggaaaaggcagacaagatcgcgagttgtgccaaagctgaagaacgtgctctggggtaagctgctgtacctacggatggtccgtggcaaagatgatgtgctctataccagacttgcaggtcgtttcaacgctcttgtggacttcgaacaatccttcggatccttcgctgcacccaaacttccaatcgagccagtagtgcgggatcatgatacggctcaagagggcgttttcgtggtggagtgggccggcgattaccactcaagccctggccgccacgaggacacactgcaagcccagggcaccgcctttgcttatcgcgaattaaacctcctggtaacctgcgatcacgtgtttgaagtcgatgctaccgtcggaagccttaaggcaccgactgactacgaggcccccgagattgttaataagtccttgcgcctcgttaggccaggaacgaaagactcctggcctgccagaattgtctaccgcaatcggcagttcgacttcgcgatcttgcagttcgagggccctgtgcctcctcacagatacttctctgctatggataccccgattaaaccccgggccgatggactgttgatcgggtttccagcataccagaattggaatctgcctgaccagaacgagcagaaggtgctcaataggacagagcccaatcggtccatgttcagctttaccatctccggtgcgggctccatacgcccagggaacagtggggggccgtttactgacgaccgttttcgcgtagctggcatggctcagaggggagcgtacatgggcgacggtcacgatgagtgtctgtgcttcgaagtgatggatactttcgttaccgcatggaggagcagcacaaagtcaacgccaaccacctcagaaattcccgcttga

SEQ ID NO: 7713 - RNA, 1806 nt, unidentified
  source 1..1806: mol_type = other RNA; note = synthetic construct
atgccaaacccttttttgtttccagctttgaccgactcactgattagaaatgacgtggcacagttctctcgcaggatcctgggcctgccctactctcagcttcagaagcttatctatccccaacctaactatagggtctttactctcacaaagaggaatgggaagctgcgtagcattgcagagccattcgctaacataaaggcgttccagctgctaatcctggagtacctgacaaagaagagtagccccttcaaacctagcgtgcacggattcgttccccacagatccattctgacaaacgccaacgcccactgttcacctagaacacagcatgttctcaacattgacttacaggactttttcccgtccatttcgttttaccggattagaggcgtgttgcagaagaggcctttcaacttttctcacgccgtagcatcagtggttgcccatatctgcacgtttgatgggtcactcagccagggggccccaacctctccctttttctctaatttagtgtgccgatccatggaccgcgacctgcaagacctcgctcgcaggcataaagcagcctacactcggtacgccgacgatataaccttttcctttactacgcgaaattctctcagcctgccaaagaatatctgtatggaggcacctgatgggcgcgttgtgataggagccgaactaaatgaccttattaccgtgaaacatagtttcgctatcaacgctgacaaaactagactgtccaatcgagctcggaggatggaagtgacgggactgaccataaacgagaacccaaacgtgcggcgaattttcatcgataggatacgtggcgcactcagagcctgggaaacacatggatataacgccgctcaatctgtgtggcaggccaaagtcgcaaagtctatcctggctccccacgagaataaaatttggaagcggcagaccagaactggctccaccccacaattgaggaactcaatatggggtaaactactgtaccttaagatggtgcggggcggaaccgatcccctctacaaccacctggcggagaggtataatgcggttgtggaaatcgaaaaatcactcggtacctttgtggcaccacggctgcctgtcgatcccgtcgtgagagatgaacgcggggcccgaaaagcagtcttcgtagtggagtggtttggggacttcgagctatccgctactgccgccgacgttgtcagtggacaaggaacagcttttgcttaccgcgagtccaacttgctgattacatgcgaccacttattcgaagcaacagctaccattaaagataagagttaccccgccgatattaatgcgcctgagatcaagaatctcgctttgttcgcaatcctgcctgacattcctaaaaaaacttggcccgtacggatcctgtatagaaatgcctacgatgatattgccatcctttgctttgaaggcgagccgccgccacacaagtatttcaacccgatgagcgctcccatcaccagaaatactaacgggatcctgatgggctatcctgcgtataagcagtggaatctccccgacttcaataggcagtccgtcttgaaccggttcttaccagcagccggtatgagcagttttaccatcacgggtgccggcagcatacgtcccggtaatagcggcgggccattcactgatcttgagtaccgcgtagctggtatggcccagcgcggaagttatgagggccgtggccacgacgcgtgtctttgttttgaaatcatcgataagcatctgcagaagtggaaagcctcgacaacactcaactga

SEQ ID NO: 7714 - RNA, 1872 nt, unidentified
  source 1..1872: mol_type = other RNA; note = synthetic construct
atgggccttactatcgagcaaattaccaagatactcatacgcagccgcgtgtcggacttttgtgacgaaattttgggagtgccctactccgagatcaagaaactgctgtaccctagggcaccctatctgttcttcgagttaaagaaaaggagtggcggagtgcggcgcattgcgaagccaacaaaacgtctgaaagagatccagcttcgcgtcctggaattcctggaaaagaacagagggccttataaagcaagtgtccacgggttcatctcaagaaggtccatagtgaccaatgcccggacccattgtagccccaagactcatcagattttgaacttggatctcgaggacttctttccatctatcactttttaccgcgtaagaggtgcgcttcagtcccacccctatcactgttcacacgctgtggctacggtgatagcgcaggtatgtacagtagacggagttctgccgcagggagcccctacaagccctttcctctcgaatttgatttgtcgctcactggatgctgacctcaacaacctagcccggagaaaccgagctaaatacacccggtacgctgatgacattacgttcagttttgccactcggtccagtactgggctccctgccgccatctgcagcgtaggtgcagatggcagggtcaccctcggcgctgagctgaatgacctgattaccacgaagcacaacttcaagatcaaggaatcaaagaccagagtctctaacagagccacaagaatggaggtgactggcataacaataaacaagcatccgaatgtgccacgaattttcatcgacagagtgagaggggcccttaatgcatggaagaagtacggctatgcagccgccgaatctgcatggcagaagcgtgtgcgggaatccggcaccgttgcctacgaaaaaaagccgtggaaacgacagacaaggctgggagtgccaccattactgaagaacgtgctttggggtaagctactgtacttaaggatggttagggggtccgaggatctgctgtacacccgcctcgccgaacgttataatgcactagtagaatttgaacagagcattggtcccttttcagctccaaaactccccgtcgtgcctgtggtgcgagatcataagacagcaatggacgctaccttcgtggttgagtggtccgccgactatcgtatctctaaagaggatgtggattctatcatcggccagggtaccgctttttcatataggcaacagaacttcctagtgacctgcagccacgtttttgaggggaaagccacagttgggtctatggaggttcccgtcgatatcgacactgcagagctcgagaatttgtctattcacgtcgtgcacccccatctgaaggaacgatggcctgccaaagtcctttataggaaccgccagttcgactttgccatcatgtgcttcgatggagagatcccaccacatcgcttttaccctgctcttgaaagccctatcgaagtccgggatgagggtatgctgattggctttccggcttataagaattggaacctgccagatatgaatgaattggcggttctgaatagatccgagccccaccgaggaatgaggagtttcaccattactggcgccggcacgattcggcccggcaatagtgggggaccttttacagacatgaggtttcgggtcgcgggaatggctcaaagaggagcttacctggggaacggccatgacgaatgcttgtgcttcgaggtcatggacgatttaatcgccaaatggcgggagaaaatcgcagctgagtgcgcgaacgccactacaaaagccgcaatggccgagaataaggtggacgcaagcgggagcctcgaacaactgccctga

SEQ ID NO: 7715 - RNA, 2022 nt, unidentified
  source 1..2022: mol_type = other RNA; note = synthetic construct
atggccgctgctgtcatggagaaggatggtaggggccgccatcctgatttgagcgaggcccgcattcagtctctggaggaggttgccgagaggatcacccggaccgacgtgcctatcttttgccggagtgtgctgggaatcgaataccgacagctcgccccaataatatacccaacgcccccctacaaacatttcgctatcaccaagcgcgatggctccccccggtatattgccgagcctaggaagcgccttaaaattctccagtacaagcttctggagtttctgactgaacgaatgacacccttgaagcccgctgtgcacgggtttgtacctaataagtcaatagtgaccaacgcgctggcacacgctcacagacgaaaccatttcatccttaacctggatctcgacgacttcttccccacaatcagctttaagagggtaaggggcgtgatgatgaacagaccattcaacttctcttttgaggtggccaccgtgattgcacagatgtgctgtctgaatctgaagttaccacaaggcgctcctacaagccccttcctgtctaatctggtgtgtagaactatggacagagatctcacggacttagccaggagaaatagggcgacttatactaggtacgccgatgatatcacctttagctttattgtccggagtcgaaaatcactcccggcggccatttgtaccgccgacgacgaaggccatttggctctcggggcagagctgcaggagcttatcacaacaaaacaccacttcactataaatgaagcaaaaacccggctatccgacagaaaccggagaatggaagtcaccgggctgaccattaacaagttcccgaatgtcagaaggaagtttatcgatagaatccgcggagctctaaacgcctgggaacgcaatgactatgcaaaagtccagaagggctgggaggatagaattgcagccgccgaaaagctacacgttgatctcaagccgtggaaaagacaataccgatcaggccgtctggctcagcttaaaaatgtgctctggggtcaactgctatatgtgcgtatggtgcgcggcaaggacgacctcctgtacacccgcctcgccgaacgatacaacgcagtagtagcgaaagagcgcgccgccggaccctttgcagcgaaagttctgcccgtggaacccgttgtgagagacaaaactaccctgcgggatgcctgcttcgtcgtggagtggacgggggattacgacgagccaggtggtgggtccgaaataccctattcgcagggcactgcgtttgtttaccgtgagctgaaccttcttgtcacatgcaatcatgtgctggaatgggagaacgaagacgcgtctaaattcccagccatgattgactatgagagcccatatttgacaggcaagagccttaatctcgtccagccagggaccaggttatcctggcctgccaagatactgtaccggaacaagccaatggatttcgcaatcttggcatttgaggaccccccgccccacaggtattttagtgcgatggacaatcccattcagcccggcgctcatgggtacttggttggatatcctgcctggaaaaggtggaacttgcccgacgtgaacgctcagacagtgttgaatcgtacttccccacaccacggaatggatagcttcacaatcactggagccgggtctattcgccccggcaattccgggggccctttcacagacgatcggctgcgggtggcaggtatggctcaacggggagcccatatgggaagtaatcacgacgaatcgctctgtctggagatcatcaacacactgattgatacctataaggccaccttagctcctcccgcccctgtaggtgctgccgatgttgtggctctgccacctgctccggcaccaatcgcagtcccttcagctcaagtcgcacctgttccaactgccccagccgaagggaccgctgctcctatcgcacctcctacaggcgcaggagccccagacggattacagccgacgtga

SEQ ID NO: 7716 - RNA, 1839 nt, unidentified
  source 1..1839: mol_type = other RNA; note = synthetic construct
atggaagttaatatcttcgacctcgaagagataggcgagaggctgacgagaacagacgtccccatgtttagcagaagcgtgttgggcatcgaatactctaagttagcttcgatcatatatcctaccccaccatacaaacatttcacgataaagaagagagacgggtcatctcgccatctggctgaacctcgccgaaggctgaaggatctgcaatataaggtgttggggttcttgaccgaacgtatgaccgcactgaaacccgctgtgcacggattcgtgcctaaccggagcatcgtgagtaatgcgaacgcccacgcccataggaagaaccacttcatcctaaatttggatctggaagacttctttccgagcatcaccttctacagagtgaggggagtcctgacctcccggccattcaatttttctcatcaggtggctactgtgattgcgcacatgtgtacgcttcatggcactttgccccaaggtgcccccacatcaccattccttagtaatcttgtgtgtcgcaccatggatagagatctaaccgagcttgctcgccgaaaccgggccacctatactaggtacgccgatgacatcacattcagctttattgttcgggcccggaggggtctgcctagtgcaatctgtacagctgacgatgaaggacacctggccctcggggccgagttacaggagctgattacaaacacgcaccatttttccatcaatgaagccaaaactcgcctatccgaccgacaccgccgtatggaggtgaccggcctcacaataaataaatttccaaacgtgaggcgaaagttcatcgatcgcatcagaggggcactcaatgcctgggaaaggaacggatacgcagcagctcagaaaggttggcaggacagaattgccgctagtgcctctcacgcctatgaggagaggccgtggaagcgccaatatagatcgggcgggactgcagagctcaagaatgtcttatggggtaaactgctctacctccgtatggtccggggcaaagatgacctgatttacacccgcctggccgaacggtataatgctcaggtccagaaggagcaggaggcgaaaccttttaccgcatcactactgccagtagaacccgtagtgagggatcatgcgaccgcactggaggcctgcttcgtggttgaatggttcggggagtactgcagcagagcaggtgtagtggatgacattcccatgggacagggcacagcctttgtctatcgagagttgaatctgttagtcacttgcgaccacgtgtttgaagcctttgctaatgtaaacggacactcatttaagaccgattacgaggcgcaggaggtgatcaataagactcttaaccttattcggccagatacacaacaacggtggcccgcgaagatcctctatcgaaatgcccagctcgatttcgcccttctggcttttgaggatcctgttcccccgcaccgttacttttccccaatggacaaccctatagagcgcagaagcgacggcgtgttgattggctttccggattggaaacagtggaacctcccagacttcaacgaccagaaagttctgaacagaaccgaacctaacaagggaatgatttccttcacaattactggcgccggatccattcggcccgggaattctggcgggcctttcaccgacaacaggctcagggtcgcaggtatggcacagcggggagcacacatgggctctgggcatgacgagtgcctgtgtctggatattatcaacaacctgatcgccaagtacaaagctgccctgactacagttgcttccactcccacgacatatgctgtcgactga

SEQ ID NO: 7717 - RNA, 1986 nt, unidentified
  source 1..1986: mol_type = other RNA; note = synthetic construct
atggacatccatagcctggatgacctgggtgagctcctgacccgtaccgacgtggctgtctttagcagatctgttctgggtattgagtactctaagctcgccagtattatctaccccacaccaccgtataagcacttcatcattaagaagcgtgacggctctcctcgctatatcgccgagccccgcaaacgcctgaaggtcctgcagtataaggtccttagctttctaacggagcggatgactccgctcaaacctgctgtacacggattcgtacctcaccggagtattgtgtccaatgcaaaggcacacacgtcacgaaaaaatcacttcgtgttgaacctggacatcgaggatttttttccctcaattacctttttcagagttcgcggcgtgttaactagccgaccttttaattttagccaccaggtggccaccgttattgcccatatgtgtactctcgggggaaaactgccccaaggagcccctacttccccgcttctgagcaatcttgtgtgccgcacgatggacagggatatgaccgacctggcgaggcggaatagagcgacttacaccagatacgcagacgacattaccttttccttctccgttagggcacggcgatcccttccccaggccatttgcgcggcggatgatgaaggtcatgtggcattgggcgcagagctccaggatctgatcacaacaaagcaccatttttcgatcaacaccgccaagactagactctctgaccggcacagacgcatggaagtgaccgggttaaccataaaccagttcccaaacgtgcgaaggaaatatatcgatcggattcgcggtgccctcaacgcttgggaacgaaatgactatgctgccgctcaaaaaggatgggaagcccggatcgccgcttcgactactctactgtacgaacagaaaccttggaaacgacaataccgttccggggggatcgcggagttgaagaatgtgctgtggggaaaattgctctatctgagaatggtgagggggaagtacgatagtatctatacccgcctcgcggagaggtacaacgcccttgtgcagaaggaacaggctgctggtccgttcgccgcacctatactgcccgttgctcccgtggtcagagatcacccgacagccctagaagcctgctttgtggtagagtggctgggcgaatatcactctacaccaggggtttccgatgatatacccatgggccagggaaccgctttcgtgcacagggagttaaatcttctggtgacatgtaaccatgtcttcgaagccgtggctcacgtgaatggccatccatttgagactgactatgaggccgtcgaagtggtaaacaagacgctgaacctgattcggcccgacacccagcagaagtggccagctaagatcttgtaccgcaatgcccagatggattttgcaatccttgcctttgaggaccccgtccccccccatagatacttctcacccatggacaaacctatcgagcggagggctgatggtacgttgattggattccctgattggaaaacatggaacctccccgacttcaacgatcagagggtattaaaccgtactgaaccaaataaaggaatgttcagtttcaccattacaggcgcagggtcaatacggccagggaattccggcggccctttcacagacgacaggctgagggttgcaggcatggctcaaagaggcgcccatatgggctcagggcatgacgagtgcttgtgtctcgacatcatcaacgatctgatatctaagtacaaggcaaccctggcaccacctgcagcacacgccaatgcccctgctgtcagtgcaacaatgcctgcccccgtcgcctctccacctataagactcctggccccactacccctgagcgatccagcacctgaagctccagcgcaagctgccagcccacctacagccccaccattggctgctaacagcgagcccccgcttggagacgtttga

SEQ ID NO: 7718 - RNA, 1977 nt, unidentified
  source 1..1977: mol_type = other RNA; note = synthetic construct
atggtgatcccatcactgaacgtgatcttcgaacaactgacgaggaccttcgtgccctcattcagccaggctgctctggggattccatacgctcaacttaaggacataatatatccgtcgccaccctacaagcacttccagattaaaaagcggaacggatctcctaggttcatcgccgaacctaggcaaaggctgaaggtaatgcaggagaaggtgctgactttcctcgaggaacgcatgagccctctcaagcccgccgttcacgggttcgtccccaaacgcagtatcgttacaaacgctcgcgcccactgctctagaaaaacacagttcgtgttgaacttggacctccaggactttttccccaccatcactttttttcgcgtacgaggggtgttacggaatcggccctttaattttagtcacgaagtcgcgacagtaatcgcccacatgtgcactctcaacggaagtctaccgcagggggccccaacctccccatttttgtcaaatctggtctgtcgaacaatggatcgggatctcaccgacctggctcgtagaaacagggccacctatactcgttacgccgatgatatcacgttcagtttcgccgtgagaactgcgtccaggcttcccgcggccatttgcgtggtggatgaagacggccatctgaccctcggggccgagcttcaggacttaattacaggcaaacaccactttacgatcaatccgcccaaaacccgattgagcgaccgggctaggagaatggaggtcacaggtttaacaattaacaagtttcctaacgtgaggaggaagtttatcgaccgtatccgcggcgcattgaacgcgtgggaacgcaatggatatgcaaaagccgaatcaggctggcaggctcgggttgcaaacgcagagagcggtccctacgaaaagaaaccctggaagagacaaactcgcacgggtgcccctcctaagctccagaatgtcctttggggtaagctgctgtacctccggatggttcgcggcaaagacgacctgatctataccaggcttgccgagcgctacaataaagccgttctgaaagagcaagctgcgggcccttttaaagcacctaagctgcccgttgagcccgtggtgcgggacaaagttacagcacaggatgcctgtttcgtggtggactggtacggggattataaggatccaacactgggggaggagatgcctatggcccagggaactgcctttgtgtacagagagctcggtctgctcgtaacctgcaaccacgtctttgagtgggagggtaaggtcgggaaggccgacacggtgatcgactacgagtctccatatctgacttccaagattctacagcttatacaaccgggaaccaaaaaatcctggcccgcaaaaattttgtatcgagacaagcagatggacttcgccctactggcttttgaaggcgatcctccccagcatcgttatttctccgctatggataatccgatcgaaagcggcgcccagggagtcctgattgggtacccagcatggaaacagtggacctggcctgattttaacgatcagaaggtgctgaaccgaacctttccgcatgtcggaatgaatagcttcactatatctggggctggcagcattcggcccggtaattccgggggccccttcacagatgacagattcagagtcgctggcatggcgcagagaggcgcctacatgggaaccggccatgatgagtgtctgtgtcttgaaatattagatggcctcattgccaagtataaggccaccttagttccacctgtgccaccagcacctgccacagtattgggagctccgccaactccagcagcgggatctgccgctctacctctgcctgtgcccgcagcaccagcagctaccgtcaatggagctgccgctccagcagcaagagccccagcacatcccgtgcctgctgctcctatcccccctacactgccatga

SEQ ID NO: 7719 - RNA, 1875 nt, unidentified
  source 1..1875: mol_type = other RNA; note = synthetic construct
atgaatctggatgctttcgacgagatgcagaagagaacatctgtgtcttggttctcacacatagtcctgggtactccctactcccagcttaaaacagtggtgtaccccaagccgcactacaaaagcttcgttatcaagaaacagaacggcggacctagggtcatccacgagcctcggaaggagctcaaactcatccagaaaaaaatcctggcctttctgagcgagcgagccggtcccattaagccagccgtgcacggctttgtgcacaaaagaagtatcctcactaacgcattgaaacattgtagcccaaccacacatcacatcttgaatttagacctgaaggatttctttcctagcatcacctttaggagggtcagaggcgccctgcggaagcatcccttcgattgttctcatgaagtggctacactcattgcccacatctgcacgttcaatggtaccctcccacagggcgctcccacaagcccttttctgtctaatatgttgtgccggagaatggaccgggaccttactgatcttgcccgtcggtatcgggcaacctatacccggtacgccgacgacctgaccttttcctttaatgtcaggagtgcagagaggctcccctcggctatttgcatggtggaagatgggaacgtagcaccaggaactgaattgactgaactgataaccaccaagcacggcttcgccatcaacccgacaaagacgcggctgaacgacaggttcgggagaatggaagtaactggattaaccgtaaacaacttcccaaatgtgaggcgcaacttcatagatcgaatccgtggggccttaaacgcttgggaaacatatggctatgctgccgctcagctggaatgggagaagcgcaatgccacttacatagcggccccctatatcacaaagctgtggcgtagacagacccgagccaatttcgtacccaaactgaagaacgtcctgtggggcaagctcttgtttgtgagaatggtgcgtggcaaggaagacgccctctacacccggctagctgagcgctacaataaggcatgtgcagctgagcaagggaccgtgccttttgtctatgaaaaacttcctatcgagccagttgttcgagactacgggtctgcggaggacgcagtgttcgttctggaatggatgggcgactaccacagttcccccggcgtctttgaagatatggtctgctcccagggtacggcattcgcctacagagagctgaacttatttgtgacctgcgatcatctcctatctggagctaaggccaaagttggtactttcgaggtggaggccgattacgatgccaaggaaatggtgaataaaactcttcagcttgtccacccatttacgaaacagagttggcctgccaaagttctttataggaatgcacaactcgacattgccttgattgcttttgacatgccacaaccgcccccacatcgatactttgctgcaatggagaatagcattcgcgtgcgcacatccgggatactaattgggtttcccgcgtataagaattggaacagacctgatttcctggaggagaaggtgctgaacaggacagaacctaataagggaatggcatcattcacaatcactggagccggttccattcgccccggcaacagcggaggaccgtttgtggatgaccgcttccgcgtagctggagttgcccaaaggggggcctatatgggggatggccatgacgagtgtttgtgtttcgaggtcctgaaccagctgatcgacaagtggaaggcgccacaagcgaaatcagtgctgccagagaacaaaattgctgcaaccattgtggctacgtcacctggcgcggtttcgaccgctgcacctcagacatga

SEQ ID NO: 7720 - RNA, 1806 nt, unidentified
  source 1..1806: mol_type = other RNA; note = synthetic construct
atgaccacgacattgtccactataagcctgaatgacatactcctaaggcatgacgtccaccatatgagctcaaaaattctgggcgtcccttacagtacactgaaggccctgatctatccactgccaccctataagtcatttgttatcactaagcggaacggttcccctagacttatccaggagccacgccgcgcactaaaagagttacagtacaaggccctggattacttttacgaacagtgcggactcccgaaaccctgtgtccacgggttcaccaaagacaggagcatcgtgagtaatgctaagagccactgctcagatcaaactcagcacctgcttaacctggatctggaggacttcttcccttcgatcaccttttatcgcgtccgaggtgtgctgcagaagaagcctttcgaactgtcccatcaagtcgccacagtgctggcccacctctgtacattcaaaggcgtgttgcctcagggggctcccactagcccccttctcagtaatttgatttgcaggtcgatggaccgcgacttgatgtcccttgcaaagcgccacagagcgacctacactcggtatgccgacgatctgaccttttctttcagtgtgcggaggtccgagtctttgccaagcaacatctgttctttcgatggcgggaatctgaccttggggaacgagctgcaagccataattgctgctcattctttccggattaacgctgagaaaacgcgcctgagtactaggttgcacagactggaggtcactggcataaccatcaatgagtttccaaacgtgcggcgggtgttcattgatcagatcaggggcgcactcaatgcatgggagaagtatgggtataaccttgcccagaaggattgggaacgcaggatcacagacggggtagccagcgcgtacgaaaagcgtccttggaagcggcagataagagccaattcccctcctgatctgaagaacgttctctggggcaagctcttatacgtgcgaatggtaaggggcaaggatgatgtgatctacacaagactggctgagcggtacaacgccatctgtgaaactgaagatgcaaaagggccatttgccttcagtcgtctaccggtagagttaatcgttagaaatgcccaggatgccgaacgcgccgtttttgtggtagagtggagcggagattaccagcccgagggcaacacagcaccactagacgtcgtgctgagccagggtaccgcttttgcctacaaagacgtgggactcgtgacctgtgaccacgtcctgagctattctggaaagatcggaggtgtgacctacacaaccgacgttcaatcatctgacgtaattaacaagacactcacagtgagaaatccagttaccggcgctagctggcgtgtcaaagtggttcacagagacgctacgagggaccttgctattctcgtcttcgatgaagcgcccccggcgcatcgacatttttcctccatggtggctcccatgaaccaaggtatgaggggaattttaatgggctttcctaactggagtcccgggcgccgtgtcaatcagacgaaagccgatgtgttatcatgctatgctcgatctgcccttaaacgattcgaaatctccactaatattcggcagggcaactcaggaggcccctttgtggacgagtcttatagagtggcaggagtggcccagcagggtgcaagacaagatgccggaaatgacgaatgcctctgcgttacagacctggacgcttggattgcacagtggaaagcatctgcaatggggaccatggccgcgtcctcatga

SEQ ID NO: 7721 - RNA, 1809 nt, unidentified
  source 1..1809: mol_type = other RNA; note = synthetic construct
atgaacgacattctgctgcggaatgatgtgcattatatgtcttctaaagtgttgggcgtgccatatagcactttacaggccctgatctatccccgcccaccttacaagagcttcactattaacaagcgcaatggctctccgagattgatccaggagcctagacgggcgcttaaggctctgcagtataaggtgctggattacctctatgaacactctggtctacccaaaccttgcgttcacggctttacaaagaacagatccatagttagcaatgcaaaagcccactgtaatcggcaaacgcagcatcttctgaatatcgatctggaagacttcttccccaccatttcattctaccgcgtgagaggggtgctccagaagaagccttttgagttctcccatcaagtggccactgtgttggctcacctctgtaccttcaatggtattttacctcagggagccccaacatcaccgctcctgagcaacctggtctgcagaagcatggaccgtgatctcatggccctggcaaaacggcatcgcgccacatatacgaggtatgcagacgacatcaccttctccttctctgtgaggcggagtgagtcgctgcccgcaaatatctgttcgttcgacagcggcatccttacactcgggcatgaactgcaggctaccatcgcaactcataattttcgcgtaaacgccgccaaaagtcggctttcaaccaggttgcaccggctagaagttaccgggattaccatcaatgaattcccaaacgtcaagagggaatttattgatcgcataaggggggcgcttcacgcgtgggagaaacacgggtatgacctagcccagcgtgcctgggagaagctggtaagcgacggagctattggcacctacacaaggcgaccttggaagaggcaaacccgtatcggcaaactgccaccgcttaaaaatattctctgggggaagctgctgcacgtccgaatggttagaggcaaagacgacgtgatttacaccagacttgcagagcggtataacgcagtgtgcgaggccgagaacgtgaaaggtccctttgcctactctagactaccggtgggcctgatcgtgcgaaacgcacaggatgccgaacgcgctgtgttcgtagtagagtgggacggtgattaccagcctataggatccgctgcgcccctcgacatggtaagttcccagggcaccgcttttgcatataaggatgtcgggttgatcacatgcgatcatgtgttatcatactccggaatgatagatggcaagagttttacaacggatgtccagagcggcgatgttatcaacaagacatttactgtgcggcacccagctacaggcgagtcttggaaagttaaagtggtccaccgagacgccgccagagatttagcaatcttggagttcgatgacgagatcccttcctacaggtacttctcctgtatggccgcgccaactaatcagaatatgcgaggactcttgattggtttccccaactggagtcccggtcgtcctgcaaaccaatcaaaggcagacgtcctctcttactaccctagatcaggactgaaacgctttgaaatttccacaaacatcaggcaaggaaattcaggggggccctttgtggacgagtttttccgcgtcgctgggatagcccagcaaggagctaggcaggatggcggaaacgacgaatgtctgtgcgtcactgagctggacgcttgggttgctcagtggaaggccgccaccactgctagcattagcgctccaacgctggtcgaaccagttgccaagagttttccctga

SEQ ID NO: 7722 - RNA, 1788 nt, unidentified
  source 1..1788: mol_type = other RNA; note = synthetic construct
atggctgttcacgtgccactgacaccatcagcactgcatacactactgatcaggaacaacctgccatacatgtcccggcacgtcctgggtgtctcttatgacactcttcaggcaatgatatacccgctgccaccctacaagacattcgctctgatgaagcgcaatggcactccacgagtgatccatgagccccggcaaagactcaaggtgctgcaggagcgagtgctagccttcctctacgagcatgccgcccctgccaaaccgtgtgtgcatgggttcaccccgaaacgctccatcgtgactaatgcccaaatgcactgttcccagaagacccaacacctgttaaacatcgatatcgaggatttctttcctagcattaccttttaccgcgtgcgtggggtgtttcaaaaaaagccctttgagttctcttttcctgtcgctaccgttctcgctcatctgtgtacattcagcggtgtgttgccacagggagcacccacttccccgctgttatccaacttggtgtgcagatccctggatcgcgatcttatgacccttgctaaacggcacagagccacttacacgagatacgccgacgatctgacattgtcattcagcgtaaggagagccgaaagtctgccaagcaacatctgttcctttgacagtggaatactcacgcttggtcacgagctccaggccctaatcgagcaccattcttttagaatcaaccccaataaatcgcgactcagcacacgtctccaccgccttgaagtgacaggtatcacaataaacgaattccctaacatcaagaggaagttcacagatagaattcgcggagccttacacgcctgggacaagtatgggtatgaccacgcccagttggaatgggaaaggagggtcaacaaagcagctgaggaggcatacgccaaaaggccttggaagagacaaacccggacccggacggttccagctcttaaaaacgtgctctgggggaagctgttgtacgtgcggatggtcaggggggctactaacactctgtatttgcgccttgctgaacgctataatgcgctgtgcgcgcgcgagcgactgaaaagtgagtttgtttgctctagtgtgccaattgatagcattgttcggaatagcaatcaggccaagaaggcagtctttgtcgtagaatggtatggggaactggacggcaaagacgtgggaggcctaggaaccgcatttaagtatgaggacgttggcctgattacttgcgaacacgtaattaagcatcaggaccatggcccctacgcggatgacatccctagatcagagatcttcgtgcgggacgctgaaaccgatgaaacctggcctgtccgtatagttcacagagacaaagatcatgacctcgcaattctccagttcgatacagcgaatccccctgtgtctcgacactttattaggggcgagaagcccatcaccgtgaatgagtctggtgttttaataggcttccctaaccccactcgtggccggcaggcaaatcaggtgaacgcccaggtagttaacgtcttcccaagggccggcctgcccaggtttgagatcaaggagcggattaggcagggaaattcaggcgggcccttcgtcgacgagaattatcgagtggtcggcattgctcagcagggagccgaacaaggaaaggggaatgacgaatgcctgtgtattacggaggtgaatagatggctcgatgcttggaaaaccagtttggtagtagcagtggcggtcgcatcagcccctgatcctatcccctga

SEQ ID NO: 7723 - RNA, 1698 nt, unidentified
  source 1..1698: mol_type = other RNA; note = synthetic construct
atgtctgatcagctctttggcataacttatagtgaactacaggctttactgtatcccaggcagccctacaaaacattcatcatcgccaaaagaaatgggtcaccccgggtcatacacgaacctcggatcgccctcaaggttgtgcaggagaaactattgcatttcttgtacgaaaacgctggcatggcaaaaccctgcgtacagggctttacccctggcagatccatagtgactaacgcgcaaaaacattgttctccacgcaccctgcaccttttgaacatcgatatcgaaaactttttcccgagtatcacattctaccgcgtgaggggcctgtttctcaagaaaccttttgagttctcccaccaggtggctaccgtccttgctcagatctgcacctaccagggaattctgccccaaggtgctcccacatctccgatggtggccaatctgatatgccgatcactcgacaaagatctgactctgctggcaaagagacaccgggctatttatacacggtactgtgatgacattacttttagcctctccgttagagatatcgccaagctacctgtaaacatctgtagtttcgactcaggggtcctcacccttggagatgagctgcagagcatcttcgttaagaattcgttcaggattaatcccttgaaatctcgcctggggaacaggcgacatcgtctggaggtcaccgggatcaccattaacaagagtccgaacgtcaagagatctttcatcgatagcattcgcggcgcgctgcatgcctgggataagtatggttacgaagccgcaaccgcggagtgggaaaagaggccatataagcgtcagagacggattggggggattccatccctcaagaatgtgctctggggaaaactcctttacgtgaggatggtgagaggtggcgatgacgtgctgtatacccgcttagccgaaagatataatatgttgtgtgagaaggagcaggccgcccgcaaatcatttacgtacagttccctgccaattgaggcagtggtccgaaatgccgcagacgccgaaaatgcagtgtttgtcctggaatggctgggagattacaagggagagccagtaggcggccaaggcactgcatttgcctacaaggacgtaggacttctgacatgcgagcacgttttccatacagtgactgaaaacggcgagcccgtgagcttcgacgaggtgaagggtgctactctgacgctccaaaatccctccacagggaagttctggccagcaaaactcatccacaaagacccataccgagacttagctgtcgtgcattttgacacacggattcctcctgcacaccgccacttctcagctctcgaggcccagatcaaccggaattccaagggaatcctaattgggttccctaattggagccctgggaagcgagccaaccaattatatgtcacggtgctgaataggttccccattaccggcctgcagcggatagagatcaatggtagcgtgaggaaaggaaacagcggtggaccatttgtggacgaattgtttcgtgttgccggcgttgctcaacagggcgccacacaggcaaacggaaacgaccagtgcttatgtgtaactgagctggataagtggctggtcgagataaaagggcttgcccacggtttgtctcttgacgcgctgcctgataccccagttgctgactga

SEQ ID NO: 7724 - RNA, 1746 nt, unidentified
  source 1..1746: mol_type = other RNA; note = synthetic construct
atgaccgtcaactttcatgagattctcattagatgcgatgtcgattacatgtccaaacatatcttcagcacctcttatgccgacctggccaaattaatttaccccagcccccggtacaaagcattcgtgatctcaaagcgggacggtacgcctcgcgtcattgaagagcctttccgaaagctgaagcgtctgcagtacaagttacttgactacctgagtaggaacagcagtacaccaaaagtttgcgtacatggattcattaaggagcgtagtatcctgtctaatgctagagtccactgttccagtaaaactagctaccttcttaacgtggacatcgagaatttcttccactcaataaccttttatcgcatcaggggagtttttcagggagaaccctacaactttagctatgagatttccactgttctggcccagctgagcacctttaacggtagactgccccaaggtgccccgacttccccgttcctttccaatctgatctgtcgaagtctggatggggaacttatgcggcttgctaaatcacatcgaggaatgtacacccggtatgcagatgacttaacattctctttttcagctagaaccccactggggctgccaaaaaatatctgtgagttcgacggcgggaacttgcacatcggaaatgaactgctctccatcatcgagaagaattcgttcaagctcaacgagaaaaagtccagaatctccagtcgcaagcataggctagaggtcacaggtcttacaattaatgagtttccaaatgtgcgccggaactacgtagatcaaatcaggggggctatacacgcatgggatgtgcacggctatgaggccgcccagaagcggtggatcgagaagaacaacgttgccgtaaaagtaagacagacaagaaacctctatgcaccacagctcaaaaactacctctggggcaagctcttgcacttgaaaatgattcgaagtcggggggaccccatctatactagactcgccgaaaaatataacaccctgtgcgcgaaggaatctgggaaaggcttcatctttgcgcctaagttacctatcgagccaatcgtgcgcaatgcaaatgatattgagtctgcagtgttcgtcttagaatggtcaggagactacatactgaatgaagcttctcccgagcatacagaggtggttggtgctcagggaaccgccttcatttacaaggacttcggcctcattacctgcgaccacgtattgtcgtctatgctgcgtatagggggtgtggatgtgagcgttgatattgactctgaccggattctcaataagaagctgtatgtgtgtaaccccctcctggccaagagcttgcctgtgagggtgattcaccgcgatcgccacctggacctggctgttctggaattcgtggatggagtggtgggcaaccgctatttttcttcagcggagcgtcctatcctgaggaatgaacagtgcactctggtcgggtttccaaactggactgtcggcagaggcgtgaatctattgcctgtgtcagtggttatccgctttttcaggtccctatttaatcgaatcgagatttccggcgcaatcaggaaagggtacagcggcggcccgctaatagatagcagctttagggtcataggaattgcccaggaaggcgccacacaagctgacggcaacgacgaatgtttgtgcataacggaagtggataagtggctttcggggctcacggtccggccctaa

SEQ ID NO: 7725 - RNA, 1866 nt, unidentified
  source 1..1866: mol_type = other RNA; note = synthetic construct
atgaaagatgtcgaggtggcaacagcgtgggctcatatgactgattcggatatccacttcgacgtgctgaatctgccattccgtgaagctctaattcggaccaacgtggagtttatgtctaggtatctgctaggtatcccatacagcgaggtaaaaaaaatcatatacccaactccttcctacaaaatcttcctcatcactaagcgaaatggaaaggccagaatcattcaggaacctcggaaggctctgaaagagcttcagctgaaggtgttaagttttttagagactcgcgggggcaatcctaaggcgtgtgttcatggctttactaaaaggaggagcatcctcacaaacgccctcagacattgtagcacacagactcatcacctgttgaatatagacctacaggattttttcccaagcatcaacttttttcgggtgaggggggtatttcaaagcaagccgtttgagtgctcttattctgtagccaccgtgctggcacatctctgtacccaccgcaatgaattgcctcaaggcgcacccacctcacccatcctagcaaacttagtgtgtcgaaaaatggacagcgaactgatggccctcgctcgaaggcatcgggccacctatacgcggtatgctgatgacatttctttcagcttctccatacgtgacgcagtccgattgcctgagaacatttgccggtttgagagtggaacactgaccctgggacaagaactccagtcaatcattctggaaaactcctttaacatcaattctacgaagaatcgcctttccaataggctgaataggctggaagtaaccgggatcacaataaatgagttccctaacgtgaaacgcaattttatcgatcggattcgcggcgccttacacgcctgggaggtgtttggttatattaaagcgcgtgatcagtgggacgccttgatatcagaaggcctccgcctcaccagagaaaagagaatttggcttaggcagaggagaacacgggccgtccccgaattggcaaatgtcctttgggggaagctcctgtacctgagaatggtcagaggcgctgatgatgcgatttatacaaggctcgccgagagatacaacgtgctgtgtgccaaggaggttgaggagggcagaaacttcttcttcagcaagctgcccgtcgagcccattgtaagaaatagtcatgatgttgaccacgcagtgtttgtcgttgagtggggcggtctgtatcccgtcgaaggggctaaggccccagaattcgtctgcggacagggtactgccttcttataccagtccaacaattgcctggtgacgtgtgaacacgtgttccggtataaagagtcagttaagatcacaaagtacggggaggaagttgaggagattcttgatactggctacatgtcgcctgacgtgtacgagaaaaacatcaccatacactccccagtccgaggacagacttgggacgcaaagctcgtgcactacgacagtgaccgggacctggctatcctcgaattcgtttcccctccagaaaacgttcgccacttcacaagtctggacgcccccatcaagaaaaatgagccggggtacttgatcgggtttcccaactggaacccggggcgtttcagcaaccagaccaatgcttcagtgctgaataggtttccccggaaaggactgcaaagaattgaagtgagtaccaacgtccgcaagggaaactctggcggcccatatgtggatgagcttttccgcgtggcaggtattgctcaggagggagccacacaatccggaggcaacgacgaatgcctttgcgtgtcagagttgaacacctggcttaaaaattctaccaacaagaaggagacgtga

SEQ ID NO: 7726 - RNA, 1722 nt, unidentified
  source 1..1722: mol_type = other RNA; note = synthetic construct
atgtctaaaaatctgcttggaatgccttacagtgaaatacagaagataatctaccccacacccccttacaaggtgttcgtcatcactaaacggtccggcgggcccaggctgatccaagaacccagacggaaacttaaagagctccaactgaaggtgctggcctttctggaggagcacggaggaaagccgaagccatgcgtccatggctttaccaagaatcgctctatagtgacaaacgcacgtaagcactgtagtaggcagactcagcacctgttgaacatcgatctgaaagacttcttcccatcaattgggttcttcagggtgagaggcgtattgcagaaaaggcctttcgcatgttcacactcagtggccaccgtgctcgctcacctctgcacccatagaaacgaattacctcagggtgctccaacatcccctatgttagccaacctagtctgtcgaagactcgactccgaccttatggacctggctcgaaggcatagatcgacttatacacggtacgctgatgatttgaccttttctttctccgtccgcgacacatcccggctacccgagaatatttgcgcctttgagtctgggggtttgactattgggcacgagctgctgagcattattgataagcacaacttcgacattaacccgacaaagagtcgactttccacacggttgcatagattagaggttaccggaatcactattaatgagttcccaaacgtgaagaggatttttatcgatagaatccgcggggctttacacgcatgggaaaaacatggcttcgacgccgcgtcagcagaatgggagcgacgcatcacgaagggcaaaacctgcatctatgagaagaggccctggaaacgccagacaagaactcgtaaaataccagagctgatcaatgtcctgtgggggaaattgctgtatgtgcgcatgatccgtggcgctgacgacgtgatctacacgcggctcgctgaacgatataacgtgctgtgcgaacacgagcagggcctgagcgccgattttagcttttcaagactacccattgaaagcatcgttcgcaacgctaatgatgctgagcgggccgtattggtggtgagctggctcggtgattaccagccagttggcgtcgcggagagtgaagccgtcggaggacaggggactgcctttccatatcaaagcaataattgtctggtgacttgcgatcatgtactgaggtgggagggcgtcgtgaatgagaataatgtcagcacagactgtaccagcgtcgatgttcatggagcaaatctgaaggtgatctcccccgcactggggcttgagtggccagttcgagtggttcacagggatgtcgaccgcgaccttgcaattcttgaattcatcggccctccgcctaatattcggcattttgctggactcgatgcccctattaagcgcaatgaaactggctatctgatcggataccctaactggaacgccgggagggtggccaaccaggtgaacgttgtggtgaccaacaggtttgcgagaagaacgtttcagcggctcgaaatatctaccacaattcggcaaggtaactctggtgggcccttcgttgacgatctcttccgtgtagcgggtgtagcccaagagggcgcaacccaggtgagtggcaacgacgaatgtctgaccgtagacgagctcgacacctggatagccacctggaagacgcggaattga

SEQ ID NO: 7727 - RNA, 1740 nt, unidentified
  source 1..1740: mol_type = other RNA; note = synthetic construct
atgagcacattcccattgggtatcctcacgcgcaattttgtggagagtctctctgcaaacctgttcgggatgccgtatagcgatttgcagaagatcatctatcccagccctaggtacaagtctttcatcattaacaagagaaacggttccccacgggtgattcatgagccccgagccaagttgaaagctctccaggataaagttctcctgtttctggaagagaatgctgcaccagtcaagccatgcgtccacgggtttatcatcggcagatcaatcgtaacgaatgccaaaaaacactgctccccacagacaaagttcctcctgaatgtcgacctaaaaaactacttcccctcaatcaatttctacagagtccgcgggatattcatgaaaaaacccttttcatgcagtcacgcagtggcaaccgtgttggctcaaatttgtacccacaacaatgaattgccacagggtgcacccacttctcctttcctcgccaatttagccagcagaaggttagacactgagttaatggatttagccaaacggcaccgagctagttacacacgttacgcagatgacctcacctttagcttttccgttcggaaggccagttccctccccgagaacatttgctcttacgattcgggagtactgaccctcggcaaggaattgatatctacgattgagcataactcctttaacataaatcccgtcaaaagtagaatctcaactcctctacaccggatggaggtaaccggcctgacaatcaacgaatttccgaacgtgaagcggaacttcgttgactgggtgagaggaacactgcatgcctgggataagtatgggctggctgcgactcaagtggaatgggagcggaaaatggaggccgcaaagacctccccttacgagaagaagccctggaggaggcagaggagatgcaagggattcccttcgttctataagattctgtgggggaaactgctgtacctcagaatggttagaggacctaatgacgccctgtatacccgcttcgcggaacgatttaatggcctttaccaaagggatatgggcggagccgccctgctgctacctattgagaatatagtgcgtaacgcggctgacgtcgagagggcagtgttcgttgtatcttggatgggggattatcagctggagggtggcgcatcagaattttgtgccagccagggaactgcttttgcctatatgagcgctaataagctaatcacttgtgagcacgtgctgcggtgtgaactcgaggtcaatgggcaggtgttgatggtggattttcaggacgcccagatgcggaacggagaaatgacagcacattctcccacccttggcttttccgtgccagtgagggtcgtgcatcgcgaccaggatcgtgacctggcggttctggaatttgtaaacccgccacctgccaacatccgtcacttcgtcggacgcgactccctgatcaagcgcaatgaacatggcattcttgtcggctatccaaactggaatcctgggaggatcgctaaccaagcggccgccaacgttctgaataggttcccccgacgcggccttcagcgcatagagattagcaccaatattcggagaggcaacagcggtggaccctacgtggacgagcttttccgagtggctggggtggcccaagaaggtgctacacaggctgatggcaacgacgaatgtctttgcgtggaggagctggacaaatggcttgattga

SEQ ID NO: 7728 - RNA, 1794 nt, unidentified
  source 1..1794: mol_type = other RNA; note = synthetic construct
atgaaagatgtagaggtgacacccccgatgcccgtggtcagtagccccatagacctgcatggggtgtttctgaaagtcgatgccgactatttctccaggcacgtgtttggcgtaccatattcctctctgaaagccgtactttaccccacgccgcgataccgggcattcattatcgcgaagcggaacggaagcccacgcatcatccacgaacctaaacggcagctgaaagagtttcagctgaagttactgtcattcatggagagtcaggtgacccagatcaagccatgtgtgcacggctttgttaaaggccggtccatcgtgtcaaacgctgagcgccacctggaaacccaaccacatcacctgttgaatctcgacctggaggactttttccccagcatctccttctacagagtgcgcggggtctttaagaaagctcctttcggcctgtcccacgaagttgcgactgtgctcgcgcagctctgcacatattctaattctctgccccaaggagccccaacttctcccatgctttcaaatttagtgtgtcgttcacttgatagggatttgaccgccttagcacggagacacagggccacatacaccagatacgcagatgatctcaccttttcttttacggtacgggaccccaacaggctgccatcgaatatttgctcgttcgactccgggatcgttaacctgggacatgagctacaagctttaattcaggagcagcatcacttcaggattaacccaaaaaagacacgtatgagcacaaggttccataggatggaggttacaggtctgaccatcaacgaatttgccaacgtcaagagagagtttatagatcgcataagaggcgctttaagtgcctggaagaaatacgggtacggaaagagtcaggccagttggcaggaccgcgtgattgacggccaaactaaaccgtacgagcagcggctatggaggagacaagttcggggcgggggtgtgccagaactgaagaatgtgctgtggggcaagcttctctatgtccgcatggtgcgagggcgcgacgatagtatttacactcggttggctgatctctataatgagctctgcaagcaagaaaagaaagtggataaggacttccttttctcttccctccctgtcgaaaaaatcgtgaggaacgcggtggatgcagagcgagccgtcttcgttattgagtggtcaggagactactgccctcccggagccagcgctagcgaaatggtaggaggccagggcactgctttcgcttataagaaggctgaccagttgatcacctgtgaccacgtgttcaattgggaagggcaatatgcaggggcctcagttagcgtcaactgccagagcagcgatgtacacggcctgactctgcgcgcagtgaatcccgctaccggtctgtcctggccagtgaccatcgtcagacgcgacgcacctagagatttggctgtgctacagatagccggtggctctctcgctcatcggcattttgtcgccattgaggcccctctgaagaggaatactagaggattcctaataggatatcctaactggagccctggacgtgtggcaaaccaggtgacagccaacgtccagtcactttacaacagatctgccctggcacgtttcgagatttccacgttgatccgacagggtaatagcgggggtccttttgttgacgcccagtttcgacttgtgggggttgcacagcagggcgcgacccaacagagtggtaatgacgaatgtctgtccgtcctcgagctcgaaaagtggttgtga

SEQ ID NO: 7729 - RNA, 1764 nt, unidentified
  source 1..1764: mol_type = other RNA; note = synthetic construct
atggcatttctgggagtcaaggagtttcatgactacatgttaagaagtgatgtgccttacttctccaggcatatctttagagctgagtactcctccgtggaggggtatctctacccacatccacgctacaccagctttgtgctcgccaaagctaacggcaagaaccgatttatcgccgaaccttcgaagaaaataaaagagctacagtaccgagccctgcggtacctggagaagacagtgccccagcccaaagcatgcgtacacggttttgtggaggggagatctatcctgactaatgctcgtaagcatttagagcggcgcccataccatatcctcaacttggatttgactgatttctttccctctatcaccttctttcgggttagaggtgcactgatggcccctcccatgaagttcagcttcggggtcgccaccatgcttgcccacctgtgcacacacgaaggaacgctgccacagggggccccaacttctcccttcctggccaatttaatatgtagatctctggactcccagctcactttattgagcaagcgccaccgggccacctataccagatatgccgacgacttgacattctccttcagtcacaggcacgccaacaggctaccagctaacatcgttaattttgacggcggaacagtctccatcggctctgagctgagaagtatcattgagtcaaacagcttcggcattaataatgataagacccgcgtaagcacccgcatgagacgaatggaaattaccggcgtggtggtgaacgaggatcctaacgtgacaagaaagttcatcgataagattaggggggccctccatgcatgggaccgctatggttatgttgcagctctggcaaattggaacgcacgcgtagctgaaacgctaaaggaaccccgggcgggtaaacaatgggcgaggcagacacgtacaggcaacataccgagtctccagaacgttctatggggacggctgctgtttgtgagaatgattcggggggacgatgatcttttgtatactcggctggctgaaaagtataaccacctttgccgcacccacaaagctatagacccggagtttagggccgcaagcttacccattgcactgcaggtcaagaatagccttgacgctgatttcgctacttttgtgttcgagtggtcagcggactatgccgcctccgatgctcacgaatcagagcctctggtgagtcagggatcagcctttgcatacggcgacggccgtcgattcattacctgtgaccacgtgctgaaaggacagtcggctgacggcgaggttgatgtggcaaatcccagggtcaggaatctcaccatgaatctccgcaatcccgtgacaagaatagactttcaagcccgggtcctccatcgggacgcgcatttggatcttgccgtccttgaactggtggatcctgccgccagggccaaacggtacttcgacggcaggactgaaccactggagcgagatgcgcgtgcgaggttgatcggattcccgaactggactcaaggtcgaacggcaaataacagtgtcgtatctgtccagcagcgtttccctcgggctgggctccaaagaatcgaaatcggtggatctatgattcgccaggggaattcaggcggacctctcgtggatgctagctacaaactggcaggcgttgcccagcaaggcgctagccagtcatccgggaacgacgagtgcctgtgtattatggaactggacaggtggcttgcctccctgtga

SEQ ID NO: 7730 - RNA, 1761 nt, unidentified
  source 1..1761: mol_type = other RNA; note = synthetic construct
atggctatactgggtaaaaatgaattccacgattttctcctgcgggctgacgttccttatttctctcgtcacatctttggggccgagtattggaagattgagggactgttataccccacacctcgctataccaatttcgttatcgctaaggccaacggtaagaatcggcatatagcagaacccagtaagaaaataaaagccctgcagtaccgggctcttgcctacctaaaaggaaccgtgccacccgctaagccctgtgttcatggcttcgttgaaggcaggagtatacttaccaacgcagaaaaacatctcgaacgcaggccgtaccacattttgaatctggatctgtctgatttctttccgaccattactttcttccgggttcgaggcgccctaatggcaccaccaatgaagtttagctttgaaatggccaccatgctcgctcatttgtgtacccacgagggctctctgccacaaggagcccctacttccccgtttctggcgaatctcatttgccgtactcttgacagccagttaactctgctgtcaaagaggcatcgggctacgtatacacgttacgccgacgatcttaccttttccttttcacacagaagcgcagagaggctgccagccaacgtagtcgcattcgatggggggacagtctctatcggatccgagctgcggtcaatcatcgagtctaattcctttcacatcaacgagggaaagactcggatttcaaccagactcagaagaatggagattacaggcgtggtagtgaacgagttccctaatgtaacccgcaaattcattgataagattcgaggtgccctgcatgcatgggaggcccacggatacgtagccgcccaagcgacatggactgctcggatcacagagaaattgaagaaccctcctcgggagcgaccctgggctagacagacacgcaccggcaacatcccatccctgcagaacgtgttatgggggcgcctcctctttgtgagaatgatcagggggaacgatgacctcttgtatactagactcgccgagaagtacaatcacctttgtaggctgcaccagacaattgaccccggttttaggggcgcatctctaccaatcgaccttcaggtgaggaatacgctcgacgtcgatttcgctacgttcgtcttagagtggtcaggggactacacggctccaggaaccgacgagtccgaacccctggtgagccagggcactgcgttcgcatatggaacaggcagacgcttcattacctgcaatcatgtgctcacaggtcagtcaaaagatgaagagattgacatctcgaaccctttcgtgcagaacgtgtccatcgttctgcggaacccactgacagggactgtctccccggccagagtgctaaatcgggacagcgcccgtgatctggcactgttggagtttgtggacagcgaaacacgagcgcagcgctattttgatggccgacccgagcctttggagcgaagcgctcaggccagactgatcggtttccctaactggacccccgggagaactgccaacaatacggaagtgagcgtgcaacaccgctttgctagggcgggccttcagcgcctcgaaataggacagaccatcaggcaagggaattcgggaggccccctggtcgattctagttacaaattagccggcgtcgcccagcaaggggcaagtcaaagtagcggcaacgacgaatgcctttgcgtgatggaactggacaggtggctgaccgcattgtga

SEQ ID NO: 7731 - RNA, 1929 nt, unidentified
  source 1..1929: mol_type = other RNA; note = synthetic construct
atgaacaccccaaacactattctgattcaggcccttgttgagaatcaggaccttatggacgcgtgggagcggatggacgtgcacgtgtttagcactggcgtgttgggagtgccctacgagcaggtgcagaaaatcctgtatccgcaccccccttatagggcctttctaatggcaaaaagatctggggggtttagactcattcgggagcctcggagacgtctcaaggttttgcaggaaaaggtcctggctcacctatacgagcgagccgggaccccaaaaccatgtgcccacgcattcatcaaagaccggtccatagtaacgaacgcgaggcgacatctggagagacggccaacattcgttttaaacttggacctggaagcatttttcccctcaatatcattctaccgggtaaggggtgtcctcaagaagcccccgttcaattatagccatgaggtcgcgacagtcctcgcccagatgtgcgtggtcggaaatgaattgccacagggcgctcccacttctcctttcctgtccaaccaggtttgtaggagcatggatagggacctcatggccctggcaaagcgtcaccgcgctacgtatacgcggtacgcagatgatatcactttcagtttttctgctccaacccgcgccgctttgccttccaacatctgtacctttgatagcggagttgttaccctgggccaggaattagtggggattatcaaccagcacaacttccagataaacccttctaagacgcgaatgtccacccgccgtcgaagaatggaagttaccgggatcgtgatcaacgagtttgccaatgtgaagaggattttcatcgacaagatccgcggagccctccatgcttgggatcgttacggttacgcagcagcacaagctgcctgggagcagcgagtgaccaatggtacaaccctcgcctatgagaaaaggccctggaaacggcagacacgcacaggacaaactcccgcgctgaaaaatgtactgtggggcaaactgctctatgtgagaatggtgcgtggggacagtgacgcaatttacacacgcctggccgagaagtataacagactggtggcccgagaacgcgacggaaatgccgacttcgccgcgtcgactctgcctgtggaagcaattgtgagaaatgtcgaggacgccgaaagggccgtgtttgtggtcgagtgggcagcagactaccaaccacccgtgccagggcagccaacaatggtcggaggccagggtacagccttcgcctacaagcagagaaatagactgatcacttgcgaccacgtcttccgcgcagagggagaatatcagttaggcgatgggcccaacgcacaggaaatcccctttaccactgatatcaatgaggctgcggtccaaggactgaacgtgaccgcgatcgatccggtcagtggtcaacggtggcccttgcgggttgtgcacagacatgctcatagagatcttgccctacttgagtttgaaggggccccgcctgaccaccgccattttagcggcatggaggcccccatcaataggcacgcacctacacatcttataggcttcccaaattggaataacgggaggagggcgaacattgagcccgccatagtcacagctcggtttcctcggaccggactgcagcgcttcgagattaaccagctcattaggaagggcaattcaggcggccctgtggtggacgaacttttccgcgtagctggtgttgcccaacaaggcgcccaacaggatgccggcaataacgagtgcctctgcgtgctggaactggatgcctggttagccgaatacgatgccgatgtagcagctccagccgatgtgcccgctgctgaacctgctgctcctgctgctgccgctgaagccccagctgctcctgtagcaccagcagagccggctgcgtga

SEQ ID NO: 7732 - RNA, 1887 nt, unidentified
  source 1..1887: mol_type = other RNA; note = synthetic construct
atgaccaccccactgttaactgccaaggacgctgctgaggctgccaaatgggccgagatttgggctaggactgacgtccacttgttcgccgcagacgtcttcgacctcgcatacgaagagattcagaacatcatttacccaacccccccgtacaaggcctatctcctggccaagcgatctggcggccaacgcgttatccgcgaacctcggaggaggctgaaggatttacaggtgaagttgctgaaataccttatagagcgcgccggtacccccaaaccatgtgcccatgcatttacagaagggagatccatcgtcaccaatgctcggaaacacctggagcgaaggcctcactttgtgctgaatcttgaccttgagggcttctttccctccataagtttttatcgcatcaggggagtgctgcggaaggcacccttcaacctggctcatcccgtggctacaatgttggcccacatgtgtacggtaaataatgaactaccacagggagcccctacaagtcctttcttctctaaccaggtttgtcggtcattggaccgcgacctcatggctctggccaaaagacatcaggcaacgtacactcgatacgttgacgacataactttttcatttagcacacctaatcagatcgcactccctgccaacatctgcacattcgatagcggcgttgtgacccttggccaggagttggtgggaatcataggccagcacaattttcggatcaatcccgcgaaaactcggatgtccactcgtcgacgcagaatggaagtgaccggaatcgtcatcaaccagttccctaacgtgaaaagggctttcattgataagatcagaggtgcgctccatgcatgggacagacacggctataaggccgcggaggagaattggcaagccagagtgtctaacggtgctcgtctcgcctatgaaaagcgaccgtggaaacgtcaggcccgattgggccagccaccagaactcaagacagtgctgtggggtaagctgctgttccttagaatggtgcggggggctgatgacacaatatacacaaggctggctgagaagtacaacagattagtggaacgcgaaagggccggtgatgccccctttgtcagcgcgacacttcccgtggaagccattgtgcgaaatgccgaagacgccgagcgggcagttttcgttgtccagtggctcgccgactatcacccacctaacgccggaacgcaggaagctgttggcgggcaggggacagcgttcgcttataagcgccataataggctgattacctgcgaccacctgttcagagccgatggcgagtatcgccggggcgaagatccgcaagcacctagggtgccctttactaccgatctgactagcccccaggttagaggcgcaatggtcagtgtgaccgatcccgtcaccggacaagagtgggcggtaagggtagtgcaccgcgacgctcatcgcgatctcgccattctggaatttgacgaggagcccccggcacatcggcacttttccgggatggatgcacctatcacgcggcacgccccaggccatctagtaggattcccgaattggaataacgggcgtcgcgccaacattgagcacgccattgtgtcggcccgtttccccagaaccggactgcaaaggtttgaaatcaaccagctgattcggaaaggaaactcaggggggccattcgtggatgagttatttagagtcgctggtgtggcacaacagggggcccaacaggatgctgggaataacgagtgcctatgcgtagcagagctcgatgcttggatcgaggcgtacgaggcaactagggtcagacctcccccagctccaccagcaccagctgcagtcgaacggggacctgcggcttga

SEQ ID NO: 7733 - RNA, 1821 nt, unidentified
  source 1..1821: mol_type = other RNA; note = synthetic construct
atgctgcagaagacccaagtcaatagttttagctcagccatcctgggggccccttatgccacggtgcaaggcatcctgtacccaaggccgccatatcgctctttcgagctggccaagcgctctggaggcatccgtgtgataagagagccccgaaaaagacttaaactccttcagttgaaggcactggaggatctggaacagagggctggacggccaaagccctgtgctcacgggtttgtcaaggaccgctccatagtgaccaacgctcggaaacatctcgagcgtaagccacactttcttctgaatctcgacttggagaagttcttcccctctattaattttttcagagtgcggggggtgctgaaaaaaccgcctttcgggttttctcacgaagttgccactgtattggcgcagatgtgcgttttagacaacgagttaccccagggagcaccgactagccccttcctatccaatgaaatatgcaggggcctggatagggatctgatggcactagcgcgccggcatcgtgccacctataccagatacgccgatgatatcactttcagtttttccactcctaacgccaccagcttgccagccaatatctgtacgtttgatggcggcctcgtcaccctgggccaagagttaatctcaatcatcacttcccatagctttcagattcaccccacgaagacacgcatgtccacccgaagacggaggatggaagtgacaggagtggtcattaatgagttccctaacgttaaaagggtgttcatcgaccggattaggggagccctccatgcctgggaccgatacggatatgacctggcacagaaggcctgggcgaatagagttcaggcaggcgccagtacagcatatgaaaaaaggccctggaaacgacagacccgatcaggtaacccccccgagctgaagaacgtgctctggggtaagcttctgttcgtgaggatggtgcgaggggctgacgacgcgatatacacacgactggccgaaaagtataatcatctgatccaacgtgagcgggggactaagccagactttgcggcctcctcacttccagtggaagctattgtgagaaacgccgaagatgctgagagggctgtgttcgttgtcgagtggagcggcgactacttacctaccgggacgaccgaggctaccatggcgtacggccaaggcacagccttcgcctacaaaaagaaggatcggctgattacttgtgaccacgtctttacagctcggtgcgagattgccggggcatctgtcgatgtcgatattcagagcaaagacctgcgcgaagttagcttggaagctcacgaccccgcaacaggtaaccgctggcccttgcggatcgtgcacagggatgcccctagagatttggccatactccaatttgagggggaaccagcggcacagcgtttcttcagcggcatggatgcaccgatcaatagacacgccccaggtcatctgattgggtttccaaattggtcacctggacggagagcaaatgttgagcctgctattgtaactaaccgctttagaaggtccgcactccagagggtggagattaaccagctaatcaggaaagggaatagtggcggaccttacgtagacgagctcttccgcgtcgccggcgtagctcagaaaggagctacccaggacgatggtaacaacgagtgcctgtgtgtggctgaactcgacgcatggatcaacgcttctggagaagcaccccctcccgctgcttcgacagccagtgcaggcggtggtagagccggagaacctcttagacgccggccaacacgctga

SEQ ID NO: 7734 - RNA, 1674 nt, unidentified
  source 1..1674: mol_type = other RNA; note = synthetic construct
atgcatgtgtttggagtgcagtattccgagctggagaaactcctgtatccaagaccatcctacagggcattcttgatacccaaaaaagacgggggccttcgtgccatccactcccctagactccaccttaagatcatccaaaagaagttgttggagtacctagagagagtcggcaaccctcctaaagcatctgcccacggtttctgtaaagatcggtctatagtgacaaatgctgctaagcactccctggcaaggaccagattcatcctgaatattgaccttgagaacttctttccgtccattaacttctttcgggtgaggggtctgctgttagctccaccatttgggttgagctaccccgtcgcaagcctcgtagcacacatttgcacttatcagaatgagcttccccaaggggcacccacctcaccctacatttcgaaccagatagcccgcagtcttgaccgggatctgatgaatctggctatgcgtcatcgagcgacctatacccgctacgttgacgacattacattttctttcagcgttaggtccgaagccgccctgcctgccaatatttgctcttttgatagcggaattctgtccctgggagccgagctccaggccctaatcgccaagaatggattcaaactcaacgaaaagaagtcacgaattagcagtagccgccggcgaatggaagtcacgggccttaaaatcaatcgcttccctaacgttagacgcaattttatcgacgaaatccggggggctctgaaggcttgtgaaacccatggctatttaaatgccgatgcccactggaagaggtcatttagaagtgacttcggcgtgaaaagagcgaacacatatcgggctctccgcgacgacaaatatcagccagaactgaaggatttccttaggggtaaaatattattcgtgaagatggtgagaggcgaggacgatttgatctacaatcggctcgcagagcggtttaacgctgtaatgccatccacaacagtgcgacctttgaaggtctaccctgttgtcaaaaccgaggatgacctccgaagagcctgctttgtgatctattggcaggcggctatcatggatacggcctctggcgaacgcaagatgctctcgggccagggtactggatttctgtatggcgatgggaacctgatcacgtgtgatcacatcttctacgacacaacagcactcgagggggtacagaaggacgtgcatatcactgaccgggagctggaggatattaagtgcgtcgccattgatcaccaacatatggagcacgacctcaccctgatgcgctgggacgtccctagagacttagccctactgcacttcgatcgtaacgccccacataacaaacacctgacccccgcactgagttctgctaagcgtcatgaccggggatggttggctgggtacccggattggactagtggacgcccggccaatgtggtagaagcacaagtggataactcatacgtgaggtctgggttagcgcgactagaactgaaccagactattaggtcagggtactccggcggcccctatgttgataaaagctacaggctcatcggaatagcacataggggtgcgacccagagctcaggcactaatgaatgtctggccagccacgaactggacaagtggattgctagtccctga

SEQ ID NO: 7735 - RNA, 1707 nt, unidentified
  source 1..1707: mol_type = other RNA; note = synthetic construct
atggctgatgccttcgatgaaatggtgctggccatcgacgtgcgatactttgccagcactgttctcctggaggattataagaagattgcggcacttatttaccccaaacctcgctatagggagtttaacatcccgaagaagtctgggggaaagcgggcaatagctgcgcctagaaaaaagctcaagattctgcaacaacgcctgctgtcttacttggtggccaaaatagatccgccaaaagcttgtgttcacggattcgtccctgggaggaacgtcgtcaccaatgctagcaaacacagcgagcggaaccccagatttatccttaacgtggatttagagaacttttttccaacgatcaccttctatcgcgtacgcggtgtcttcttaaagcgcccttttaacctgagttactctgtagcctccatgctagctcatctgtgttgccataatggcgtgctggcacagggctcgccaacatcccccatactgagtaatctagtctgtagaaagctagacaacgatcttagtgccttagcgcggaaatatcgagctgtgtacacacgttattgtgacgacatcacaatgagtttcgtggcaaaaatggcagataacttgccagctaacatctgcagtttcaacggtgaagccgtgaatattggcgacgaactgaaggcagttattgccgccaatggattcgctctgaacgatgaaaagtcccgactgtcaagctcttcacataggcaggagatcacggggctgacagtcaatgacttcccaaatgtgagacgccagtacatcgactccataaggggcgccctgcactcatgggaggtgcatggctacaagctggctgaggcacggtggcaggaaaccccctataagcggattagagtgtccaacactgttccaaagctttgtttcaacctcaagggtagattactgtacttgaagatggtgcgtggaggcgatgatgagatttatggacggctggcctccaagtttaataagctggtcgctataggagtagtaggggaggtgcctccctgcaaacctttgcccatcgactactcggtcactactgccaacggcgcacggcacgcggttttcgtgctccaagcccaatggttcgagaaaaatgagctgatctttgaaaggcagggaacagccttttttgttggacagggatatcttctcacatgcgaacatgttgtgagcaatgaattgtctagcgatgaaaaagacgatgcgatgggggaactcgagcaagcaagacacaccgtactgatcccgggggggaaagaatatccagttgaactcgtggcagtgcacgagcactacgacgtcgccctcctcaagttttctggcgacggccccgagtatattagaaggttcaagctttcccaggctagcgccaccgtcggccagaaaagctgcctgttgggcttccctaattggagtaacggtcgtcccgtgactgtggtgaatggggaagtaaccagcgtctactctaggtccgctacccagaaattggaaacctcacagcagatccgaaaggggaattcagggggacctttactaaatgcagagcttgaggtggtgggtatggccactgacggcgccacgtacgagaaaggtaacaatgagtgcctcacatcaggccagattaggcagtggctcatcgacattaaagccgaggttcagctgtga

SEQ ID NO: 7736 - RNA, 1662 nt, unidentified
  source 1..1662: mol_type = other RNA; note = synthetic construct
atggaatatgagaaggttggttccgtgatctatccatcaccgctctatacacagttcaccttgccaaagaaatccggtggggtgaggataatcgacgcgcctttccaggagttgaaggagctccagcacaaactgctcgtatttctcaagactctggtagatcctccgaagagctgtgtgcacggatttgtgtctgggcgcagcatcgtgactaatgcactggcccactctgagagaagccccaagttcgtgctaaacatcgacctgaaaaacttctttcccacaatttcgttttacagagtgagaggcatctttttgaaacggccctttagttttagccaccaaattgctagcttaattgcgcatatgtgctgtaaagacggcttcctggttcagggcgcgtcaacctctcctctgatttctaacctaatttgccggaacttggataatcagctccgggggctatcactgcgacataatagtgtatacacacgttactgtgatgatctgactttttctttcccacgggaaagggccgagtctctgcctggcagtatctgttcgttcgctggcgagatcgtgacccttggcgctatgtcattagagataatcgcttcaaacggattcgagattaattccgataaaacgaggatcagctcctccaagagacgtctggaagttaccggcctggtgatcaataaattcccgaacgtctccagagactacgtagaccgattacgcggcgccctacatgcttgggacgtgcacgggtacccaagagccttgaggtcttggaagaacaagattccctatgaaagggctggaaggcgacctaggccaccccttgcagggattgttcgggggcgccttctgtttcttaagatggtgcggggagccgatgatgacctgtacgtgcgcctggccaccaaatttaatatcctcaggcagagggatagtatataccggaaaatccgggcgttgaagagtcttagcgtggactccgtggccaagacggccactgcagctcgcaaggccgtctacgtcattgaagtcgtgtggaccgatgctgctgatgacatgcctcttgttgatcgccgggggaccgtcttcgtcactgagtatgatttactgatctcctgccatcatgttattgacccagatttcagtgacgatgagcgtaaagaaatcagtggaaaaatcctgaaccgctccgtcaagcttattgtgcccgagactaatgacacgtattccattgacgtaatcaagttcgacagccacctcgacattgccctgctgaagttctctgaagcaaaacccgccggcctccgcaaattgctgttttctgaacgtagccctgttcagtcttcaggtacaaccctgctcggcttcccaaactggaagcagggaaggcccctgacaagcgcaagcggtgaaattacatcaatctatcccagatccaacacaaatagattagaggcaagccaagccatacgacaaggaaattcaggaggtcctctcgtcgaccctgattttcgagtgataggcatggccatagaaggggcaacctacgacagaggtaataacgagtgcctggcagccaacgagatcataaattggatccagccagaagtcgacaagctgaagagtcaactcaaattctga

SEQ ID NO: 7737 - RNA, 1728 nt, unidentified
  source 1..1728: mol_type = other RNA; note = synthetic construct
atggcttctttggaatttgatatccggaagattgatgttgagctcatggcacaggacatcttcggcagaccttacgcagagatatcaaagattgtgtacccgcgccctaaatacaagtacttcgtcctcccgaaaaagagcggcgaatataggtctattgtagcacctagtctgaagttgaaaaacatccaggagagcctattagattttctccagcgggagtttccgctcgccaagtcctgtgtccacgggtttcaccgggggaggtcggtcgtgactaatgcccaagcccactgtaacagagacacgagttttgtcctgaatatcgacctggaagatttctttccatctatctcttactatcgcgttcgcggcgtgttcgagaattccccttttggatatgcacggaatactgcctctgccctggctcatatttgctgtaataacggtatactcgctcagggagcccctacttcacccattatctctaatctgatatgcagaggtctggataaagatctatctgccctggcgagaaaacaccgagcgatttatacacgctattgcgacgacattacattcagctttaaaagtggacgagtggataggctgcctgcttccatttgcaagtttgatggcgatgttctggggatcggtgatgagctcaccgagatcatcagttcccatggttttcggattaagcataccaaaaatcgcattagctcccgtcagcgtcgaatggaagtgaccggcatagtgatcaacaaattccccaacgttaggcgcctctatgtcgacaaaatcagaggggcacttcacgcgtgggaaacatacggatatgagatggcatcaaagatctgggaagaaaaaaagtactcccggtccttacgaaccggcgccatcccaaggctgtacaaaaacttgtatgggaaactgctgtacctgaagatggtgaagggcgatagcgacgacgtgtaccggctccttgctatgaagtacaatagggtgtttcttaaaagccaatctctcggcgagctgggagatggtaagctgctatctttaggcagccgggtggtcaatgcttcccatgttaagtcagccgtcttcgtgattcatgcccgatggggccttgacgagctgggcttaccagaggaggaagtccaagggactatcttctgtcttgtcgggaaaattttgatcacgtgtagtcacgtaattgagaaacccgaacatatcaagaccgataccgtggagtactatcttgtggagcccacaagtggaaaggagcacaggctcaacttgatatgcaacgactcacacaaggatatagccgtattgagattcgtggaacagggcgtgccagacgctcgggaattagtgctgtccgagcagccaattagccaaaacgcggacgtgatgctatatggattccccaattggaccagaggtcgtgcactgaacagcttgccaggcacggtcacatcaacctttatcagatccaatatcgactgccttgaagtggactgttcgatcagacaggggaactcgggaggacccctgctcaacgtagggatgcgcctggttgggatggctactcagggcgccgacgtaaagagcggaaataacgagtgcgtgactgttagcgaaatcagggacttcatactgaggtgcagcacatcacatcccctgcacttcgacaagagtttcaacatttccaatctgttctga

SEQ ID NO: 7738 - RNA, 1701 nt, unidentified
  source 1..1701: mol_type = other RNA; note = synthetic construct
atggcaatccacaagaatatattcagcaaaatcagcactctggatgagcttgcatacaagctcgctggaattccttacaatctgctagcgaaactcatttatcccaccccccgttataagtgcttcgacctcataaagaaatctggcggcgtgcggaccattaacgctcctcggagaaagattaaaaagattcaaagggaaacccttgagctgattaaagagtactatcaatccgtaaagagcccggtgcactcttttgtcaaagacaaaagcatcgtgacgaatgcacagcagcatataggcaaatccttcatttttaacatcgacctggaaaacttcttcaccagcatacactttggtcgtatccgcggaatcttcctgaagaagcctttcgaattttcatacgacatcagtacagtgctggcacatatatgctcgaaggacggaattttgccacagggtgcaccaacctcaccgatcatctccaacttgatttgcaggtctttagactctgatttacagaagcttgcacgaaagtaccgcgccacctacacacgatattgcgatgatattacttttagcttcacggttaggagaataagcgatctccctaaacagattgtcgatctttcagttgcgccagccaacattggcactgagctgctcgccatcatcgacaagcacgagctcaaggtaaattctagaaaagtgcggctggaagggaggtcaaacagaatgcaggtcactgggttgactgttaacgagcagccaaacgtgcctcgtacctttgtacacgaaatccggggcatgctgcatgcttgggaaaggtatggcttaaaaaaagcccaggatcaactcaagacaaaatacagtcggcaactgaggaccaccgagatcccccccttttataatgtgttgcgcgggaagttactctttttgaaaatggttataggggagacttccctggtttatgcccgcctggccatgcggtataataagctgatcgatcgagataatttgaagcagaattcgaaactgccactaagtcgcgaaatcgctaatgacattgatgccaaaagggcggtgcttgctatagaatgttgtgaggatatccccagactaaaggaaagcccactcgtgtccatgggcaccgcattcatttaccgcaagaagtacatcatcacatgctggcatgtcatttcccagaaagtcgagtcactgggggaagacattacgtttcatgagacatccatcgagctgtacgactataaaaagaagaagctggaggtgaccattctggctggttgtcctcggagggacgtcgccatcttggctccgaaattcgacatcacggtgtacccatatttttctcccgccactacacctcccctgagtggtgactctctccaaatgcttggatttcctaactatcaggtgaacaagaagatctcatacacaaagactaaacttctgacagaggaatacactaagagttgtgttcagtacattgaaatcagagacacaattagaaagggcaattctgggggacccgtgttcaacagcaattgggagatagtgggcattgctgtagaaggggccacacaggccgacggagacaacggagtcgtggtcacctccgagatcgatcgagtgatcgattccagtgagttcaaataccagcagaaagataagaaccactga

SEQ ID NO: 7739 - RNA, 1680 nt, unidentified
  source 1..1680: mol_type = other RNA; note = synthetic construct
atggcgattcacactccattatctactattcccgacttagagaaattggctgaccgtctggtgggcaatagctatagcgtgcttgccgatctgatctaccctaaaccccgctacaagaccttttctattgctaagaaaagcggcgggatccgaacaattgatgcacccaagaagaagataaaggcgattcagtggaaaacgttggcactgattaaagaatattaccagtgtgtgaagacccccgtgcatggattcgccaaaggcaagtctatcgtgaccaatgcacaacaacacctggagaagaccttcgtttttaacgttgacctggaagattttttcccatcaatccactttggcagggtcaggggtatcttcctgaagaagcccttcgagtttagctatgatattgcttccgtcctggcacatatttgctgcaaggacggcaaactcccccaaggtgcacctaccagtcctgtgataagcaatctagcgtgtcggagattggactccgatcttcaggaattggcacgcaagtaccgcgccacatacactaggtactgcgatgacatcaccttttccttttccgtaaaacggatcaccgacctgccgaagcagattgtcgaccagagggccttccctgtgaaccctggcaccgaactcctggccatcatcgagaaacattcttttcgcgtcaacagcggtaaggtcaggctggagggacgtagcaaacggatgcaggtaacggggttaacggtgaacgaacagcctaatgttccacgaattttcgtgcacgaaataagagggatgattcacgcctgggaaagatacggtcggaacggggccgagacatacctggcctcaaagtattcccggcagctccgaaacccagttagtccaccatttcacaacgttctcagaggaaagctgctgttccttaaaatggtgcgaggggccagttccccggtgtatgctagacttgccgccaggtataattcgctgattgaccatgacaaacttcaaccaaacagcaagcttcctatttctcgtaccgtggctaatgacatcgatgcagtgagggctacatttgctatcgagtgtgtccaggattttcctgagctagccgggctcgagttatcgcccctggtgtcatctggaacagctttcatctaccgcgagaaatatatcgttacttgctggcacgtgatttcacccagaatagaaaaactcggtaagtccttcacttttgatgaagccagtatcgagatctacgactacaaaaagaagaagctccaggtcactgtcctagctaaatgtaaagacagagatgtagtgatcctcgcacctaaattcgacgtgaccgagtatccctatttctccccagcccagctgtctccgagttcaggagatatcctgcagatactgggattcccaaactatcagatgtcaaaaaaggtgagtcggactaaaacagagttgatcaccgagcagtacgccaagcatggggtccaatacattgaagtaaaggacacaatacggaagggcaacagcggcggacccgtattggattccaatcgcggggtcgtaggcctcgctgttgagggagcgacacaggccgaaggcgataatggcgtggcagtcactctggagatcgatcacgtgatcgactctatagttgtgtga

SEQ ID NO: 7740 - RNA, 1686 nt, unidentified
  source 1..1686: mol_type = other RNA; note = synthetic construct
atgccggccccactgtccaaagaggcaacacagctgttaaccctgaaaactcatgaggacgtggctcgtttcttcggttacccaaactatgtctctctccagtccctgatctatccccgccccctgtatacctcctttgttatcccaaagcggacggggtctattcgtattatcagtgcccctcgtcgacgcatcaaggacgtccaaagattactgagcacagccctgcttgatctgtacggccatggcagaaaaccggtacatagttttatgaaagggagatctgtggtcaccaatgcacgacaacacgcccagagtcgctttgtgctgcgcgtggacctgcgagacttcttcggttcaatacactttggaagggtcagaggggtgttgcttaaccgaccttttgcactgcccgaaccggtggcaacagtattagcccacatctgctgtctggacggtaaactgccccaaggcgcacctacatcccctatcatctcaaacctcgtctgtcggggcttggacacagccctgatgaagcttgctggagagtgtcgggctacctataccagatactgtgatgacttggtcttctcattctctatacggcaggctgggaagctgtccgcgaggattgtggcttctgaaggaggagttgtgggagtggggcatgagctcgaaaccgctatcaaacgcgagggttttgaaatcaatgtcgccaagacgcgcttatatcactacggcgccagacagaccgtaactggcctagtggtgaatgagttcccaaatgtgagcaagaagtactataggagccttaggacagcactctacgcttgggagaaacatgggtacgaaagtgccagcctgaacgtacctgggaccatacagcatcgccggtatagatcgggaaaaccccgctgcttgcacaggcttctctgggggaagctacagtacatgagaatggttaaaggagagcgcgatgcgagcctgatctccttggtccaccggttcaaccggctgctagctagagacgctgctgtggtggagaagccagtccctccagcaatacatgtgaagcccaccgttgcaagggcgaaagacgccagggccggtacgtggatgctcgaagctattacacacagggatacgcccgacgaactcctcaatgaaggcactgcgttttacgtccgtggcgtgggatttatcacatgcgcccactgcttgcttaatacctacgtatctcctcctactgcccataatgaattcttcctccactcccacgaccgaaggtataagtaccaggtgactccacaccaatttgattatggcctcgatctggccgtcctagctcctgattctagcttcgtcgagaacgaacacctggcctttgagattgaccctgcactgccagctgtaggcactgcggtggttttgtgcgggtatccgggcaactcaccaagtcggccccccgttatttaccagtcagatgtgagcaggacagttactgtgtcaggcgtgtcgagaattgagattgataagcccgtgcatccaggttccagtggaggacccctccttagcgccttaaccgggaaggtgctgggggttgttgccactttcaagaagggcgatgcaggtgccgatgccgcaatcgccatagcagagattagccggctgggcgctcccaaatga

SEQ ID NO: 7741 - RNA, 1644 nt, unidentified
  source 1..1644: mol_type = other RNA; note = synthetic construct
atgaacaaggaagatttcctcaaaataacgacacacaatgaactagcatccatgttcggcatgtcttatgcgaagctcaccaaaatcatttataaaaccgacggagtgtacaaataccaccagtttcaaataccaaagaaaaacggaggacaccgcgaaatcgcctctccgtccaaaaagctgaaaaagattcagtccgagctcaaggagctattttatgagatctaccctagcaagccttctgcccatgggtttgcgaaaaacaagtccatcgtgacaaacgccgaaagacacctggataagcgattcatcttcaacatcgatctgagtaattttttcggctcgatacacttcgggagaatcaggaacctgtttaagtcaagcccatttaacttcaacaattcaatcgcgactattctggctcaaatctgctgtttcgataattctcttccacagggcgcccccacttcccccattctctccaatatgatcgcatggaaactggatacccagctccaaagcctggcgaaaatgactaatggaacatacacacgatatgccgatgacataagtttttcatttacgacgaccaagggccggctgcctgaggagattgttattttgaggggaggggaagctgcacctggccatgctttgacccatatcatagaagagaatgggttcttcatcaattacgataaagtgcgtctgtgtagtaggttgagcaggatggaggtgactggattgacagtcaatgagttaaccaacgtgaggcgcaagtatgtaagacagctctcaagtatgctgcacgcttggcgaaaacacgggtacgagctcgctgagaaagattttaatgagaagtatgacactcggtacagggcctcaggtaagcctaagtcgttccttcacgtggttaagggtaagttggcctttttacgctctgtcaagactgagcgcgacccgatctacatcaaactggccactcaattcaacgacttggtgacagacgagcacaagtttaaaattaaggtccccagcgaccccgagaagaatgcaattaatgcactgtgggtcatcgaggcatgttacgacaacgaagaaggcgaagctatggtgccacagggctcaggcttccagctggaggacatcgggatcgtgacctgtgcccatgtcgtttccgagaagggcaaaatcttcgaggacctcgaagcttttaagcatgatgatagcaccgttaaatacaagcttagagtcgaacggatttgctcccatcgggatatagctatctgctcacttctagtggaagaaggtaaagagccacccaaacactctgttagccgtagtgcaaacaacgtcgaaatgggccaggacgtaaagcttctgggtttccccgcttatgcccctggacattcttatttcatggtagatacaaaggtggccaaaatttatacccagagccttgtgagaaagtttgagataaacgccctcattcgcgagggcaatagcggagggccaatcattgacagtaagagctccgtggtagggattgccctggagggcgcacggaaagaagccggtaacaatgggtgcctgaccattcccgaactggaggacgtgttatctgacgacaaatacaagatttga

SEQ ID NO: 7742 - RNA, 1644 nt, unidentified
  source 1..1644: mol_type = other RNA; note = synthetic construct
atgaacaaggatgacttcctcaagattacccgtcataatgagttagcttcatactttggtatcacctatccagtgctgaccaagattatttacaagaccgacgacgcctacaaataccaccagttccagattcccaagaaaaacggagggtacaggaaaatcgcctcaccatcaaagaagctgaagctgattcaggaacagctaaaggacgtgttttatgagatctaccccactaaaccaagcgcgcatggatttgcaaaggacaaatctattgtgacgaacgccgaacggcacctggacaaaagattcatcttcaacatcgatctgtccgacttctttgggagtatacactttgggagagttcgcaatctctttaagagctccccattttatttcaacaacacagtgtccacgatcttggcccagatctgctgctttaacaactctctgccccaaggagcccccacaagtcccatcctttccaatatgatcgcttggaaattggattctcagctgcaacatctcgccaagctaactaattcaacctatactagatacgcggatgatatctctttttccttcaccagcaaaaagcgaaggctgcctgaagagatcataatcctccgggacgatgaaggatctcctggccacgcgctgactcatatcatcgaggagaatggcttcaacattaattatgagaaggtgaggctgtgtagcgcattttccaggatggaggtgaccgggctcactgtgaatgaatttctgaatgtgagacgccagtacgtacgccagatatcaagtatgctgtacgcctggaggaaacacggttacgtactcgcagcaaacgagttcaatgaaaagtacgataagcgatatcgtgctagtaaaaaacctaagagcttcctttacgtggtcaaagggaagttagcgttcctgcggtcggtcaggacagggagagatgccatttttaataagcttgccaagcagttcaatgatctggtggaggatgaatacaagttcaaaatcattgaggtcacagaccctgaaattaatgccattagtgccttgtggataattgaagcctgttatgacgacgagaagggggaggctgttattacacaaggtagcgctttccagcttaaagggatcggaatcgtgacttgcgcacacgttgtaagtgagaagggcaaagtgttcggctcactggaggcatttaaacactctgaccctaccgtacgctatgagctcaaggtcgaacgcatctgcgctcaccgagatgtggctatttgtagcatccttgtgaaggaaggaatcgagccgcccgaatatggcatagagaagtccctcaacccaattgagatgcagcaatctgttaaactgctaggctttccggcctacgctcctggccagtctcattacatcgttgattcgaaagtcgcaaaggtctataaacaaagcgctgtcaacaaattcgaaatagactccttaattcgggagggcaatagcggcggcccaatcatagacgctgaatcaaacgccgttggtatcgcattggaaggcgcccggaaggaatccggaaacaacggatgtttggtcataagcgagatagacgatgtgattggtacagacgagtataaaatttga

SEQ ID NO: 7743 - RNA, 1644 nt, unidentified
  source 1..1644: mol_type = other RNA; note = synthetic construct
atgaaagatgcatttctgaacattaaaacgcaccaggaactggccaagtactttggtctaagctacgccgacctttctaagattatttacaagacagacttcgagtacaagtaccaccactttgttattcctaaaaagagcgggggcgagagacacattaacgccccgagcaaaaaacttaaactcatccagatcaccctgaaagacgttctctatgatatttacccaacaaagccagccgctcacggattcgtcaaaaataagtcaattgtgacgaacgctgaaaaacatttggacaaaaggtacatcttcaacatcgacatagaaaatttcttcggcgagatccactttggccgggtgcgcaacctgtttaagtcaagcccattcaacttcaataacaccgtcgcaaccatactcgcccaaatctgttgctttgagaatgcacttccccagggtgctcccacttcccccataatctcaaacatgattgcttggaaactcgacagccagttgcaacagttagctaaaatcaccaattgcacctacacaaggtatgcagacgatattagcttctccttcacttgcaacaagaaccggctgccagaagagattgtgtccgtgagtgaaggagacgccagacctgggcgtaccttaacagggatcatcgaggataacgggttccgaattaattactcgaaggttcggctccgcggaaaatactccagaatggaagtgaccgggctgaccgttaacgaatttatcaacgtaaagcgaaagtttatccggcagctgagtagtatgctccacgcatggcgtaaatttggctatgataaggctgaagaggagtataataacaagtacaatcgcaagcatagggctagcggcaaagagacttcttacctgcatgtagtcaagggaaagctggcgtttctgaacaatatcagatctaaacgcgaccccgtgtacataaaatacgctaagcagttcaacgaactggttggcaatgagcataagttcatcatagtcgaaattacagaacctgagcaaaatgcaataaattccatttgggtggtggaggcatgttatgactataatgacgaggtcagagtttctcagggaactgggtttcacttgtcagatgtgggcatcatcacatgtgcccacgtcgtgagtaatgatgacggggaaatctatgaggagatagaggtgttcaagtattctgagactacaaaaaggtatacgatcaaggtcgatagaatttgccgccatagggatatcgccatttgttccctggtggtggacgaggatgaaaatccgcccaacaatgagctacagaaaagccagtccattccctatatacaacagcaagtgaagctgcttggctttcctggctatgcgccaggtcattcttactcaatcgtggacgccaatatcaccatgactttcgtagaatctggagttaacaaggtcgaaatcaatcagcttatacggtccggtgatagcggaggtcctatcgtagatgccgattcgaacgtgattggcatggcccagaagggggtggacgagaagtataagcgaaacagttgcgtcgtattgcaggagattgaagcggtgtataactcagacggatacaaaactgagtga

SEQ ID NO: 7744 - RNA, 1632 nt, unidentified
  source 1..1632: mol_type = other RNA; note = synthetic construct
atgaaactgaaagagtttcagaaaatcgagacaagtgaggatttggcaaagatttttggcatgtcgtacaaggaactttccaagatcatctataagctaccgttcgaatatagatatacatacttcgagatcagcaagaaaaacggaaccaaacgcctgatatctaagcccaataagaagctgaagcagatccagaacaaattgtccgagacgctatatagcatctacaaacctcgaccttctgtgcacggatttgtaaagcagcggagcgtgatctctggcgccgaaaagcaccttaataaacagtcgattctcaacatagacctcgagaattttttcgacagcatccactatggaaggattaaatacctcttcatggcacacccattcaactgtaatgaaaccatcgcgacgattttggcccacattttttgccatgagaacaaactgccccagggcgcctcaagttcacccatactgacgaatatgatctgctataagctggacaaagagcttcagaatctggccaaacattgtaatgctacctacactagatacgcagatgacataaccttctcttttaccaccaacaagaagaaaattagcaagcagatagtagaggacaccgaagtgctgaccatttcacccgtgctccagcagatcatcgagaacaatggattcaagatcaattacaacaaggtccacctttataaaaagaatcagcggatgctggtcactggcatcaaagttaatgaattcaccaacgtgcagcgcaagtacatttcaaagattcgtagcatgttatactcctgggaagagcacggttacattaatgctaaaaaggaattcgagagcaaatatttgactgagagacatcgggtgttttctagtttgccagagtacaggaacgtgattcgtggaaaactgaattacctcaagatggtcaggtctaaacgcgatgtactctacatcaagtatgccaaatggtttaacaagctcgtggacgagttctccgaacctcatcttgagtacttagaaatcactcccgaggaaaagctcttaatgcagagtgtgctggtgattgaaattctatacgacaactcagaaggggaatgtgtttgtaaccagggaactgggttttatctgaaggatgttgggatcgtaacatgcgctcatgtggttacagatgataaaaataaccccctcgacaacatcgatgtctttcgatatgacaagattacagagaaattccggtgcactatacaaaagatagattccatcctggatctggcgattctgcaacctgtggatccggaatcactgaaggacattcaaccacttgagcagtctagtgagactatagattccttgcacacagtcaagatgattggctatccagcctacaaaatcggccaaaccccatacatcgttgacgctaaaattgctagcatctattgccaatccacaatcaacaagttcgagatagactccctgatcagggaggggaacagtgggggccctatcttaaacagcaacaataaagtcgtgggtattgccgcagaaggggcagaaaagtccggtggcaataatgccgtcctgcgcattgacatgctggagagaatcaagtcttga

SEQ ID NO: 7745 - RNA, 1638 nt, unidentified
  source 1..1638: mol_type = other RNA; note = synthetic construct
atgcccgagaaatcattcctgagcgtgaaaagtcctaaagagctctcactgtattttaacctggagtacgcagcattcagcaaaattttctataaaaccgcaagcgactataagtacaagaagttctacctttctaagaaaaccgggggcaaacggataatctccagtcccaatagaaagatcaaagaaatacagcgttgcttagcctacacactcaagaatatttatcaggtaagaccctccgtccacggctttgtcgagaagcattctatagtcactaatgcaatgccgcatctcgacaagaagttcgtgttgaacctggacatcaagaattttttcgattccattcacttcggaagggtaaaacatctcttcatgtcccagccctttaattttgtgcactctgtcgctaccgttctcgcccagatttgttgttttgaaaacaagctgccacagggtgcgccaaccagtccaatcttgaccaatatgatctgttggaagatggatgcccaactgcaacaccttgccaaaattaaccactgcacgtacacccgctatgtggacgatatcacattcagctttacgtgcaacaaaaaacagatcccaaaaagtatcctgatccagcccgagtctgagctggtggtgggacaggacctaaaaatcatcattgagaagaacggatttgaaataaacctagcaaaacttcgcctttatgggcggaaccaaagaatggaagtgacaggtttgactactaacgagttccctaatgtgcgaaggaagtacatcaaacaaattcagagcatgttacacgcttggcgcaagtacggctatggcctggccgaaaaggacttcaaggagaagtactataagaagcaccgagcttcccagaaaatcccatcgttcgagaatgttattataggtaagctggcgttcctcaaaagcgtcaggggactgaggtcacaggtgttcataaaactggccaagcagtttaatgatctgactgagtccggaaaaatgaagttcaactacatagagaagacgaaggatgagactgacatttccaatagcctgtgggttatcgaagtgttgtacaacgacaagaatggcatccttaaagctgggcaaggcacaggtttttactttgagaacaaaggcttaatcacatgtgctcatgtggtatccgaaaacgacgaaaattttgagaagattaacgctttccagtttgataagccttcaaagaagtatctgttgaagatcaagaagattgacaaccatagagatattgccctttgtgaattcagcgattgcaccatgaacgacattcagatcaataagctcgacagtatcactgtttcaaatgaccaaatttctcagttcttggaggtcaaactgttcggctttccggcctacaagattgggcaaacaccttacatcgccgatgccaaaatagccacaatttatacccagtcggcggtgtctaaatttgaaattgatcaccagattcgggaaggtaacagcgggggccctatcctaaataaagataataagctcatcggagttgcactggaaggggctgagaaagggtcaggctctaacggatgcctccagctggacgaaatagtcaaatttatcaactga

SEQ ID NO: 7746 - RNA, 1683 nt, unidentified
  source 1..1683: mol_type = other RNA; note = synthetic construct
atgacctccctggaaacactccaggccctgacaacttcccaggacgtggccacgctcttcggaaagagctacaccgaactctctaaaattatctatcgcactcctgagaaataccggtatagggtcttcacaatcccaaaaaagaccgggggcctccgcacaattgctagcccaaggcgaaagattcttgaaattcaacgacgcatatccatactgctgcaggacacctatcagcctcctccttccagtcatggtttcgtgagaactaaatccatcgtctcaaacgccgaacgtcacttgaacaagcgttttatattcaatgtggacttagagggcttcttcgattcactgactttcggaagagtgaaacggtttttcatggcacaaccatttaacattcccaacgagccagcaacagttctggctcacatctgttgctttcagaaacgcctgcctcaaggagctccgacctcacccataattaccaacctaatttgcaggaaaatggataggcaactccaggctctagctaaccagaatcatgccacttacactaggtatgccgatgacctgactttctcttttacgcgggggatgagtaagttgccttccgctatcgtgtctcataaagacggcttgcccggcagcggtctgatggagatcatcaaagaaaacggcttcaagattaacccacagaagactagattgaattccaagcatcagaggctggaggttacaggccttatcgtgaacaagtttattaacgtgcaccgcaaatttatccggcggaccaccagtatgttatatgcttgggaaaaatttgggcttgagatggcagagaaagagtaccttagcgtatactctaacctgattagaccatatgcctccgggcaccatccaaagtttcacgaagtcgttaaaggtcgattggccttcttacacatggtgcggggaaaaagggatccgctgtacatcaagctggcaaagcgattcaatgcggttctggatgacaagacctcctctcttccctatatcgaaacgtctagctacgaactgtcattatcggaggccatctacgtaattgagattttgtatgacaagaaggtcaagaagggcaagaatgtgtcagaagaggcggtggtcatgcaaggaactggcttttttctcaaagatattggattcgtaaccgcagcccatgtcctgctcgataataaaggcgtagaacaccccgaaatagaggtgtttagccccaaaaatagcggagtgagatacaagctttccatccagacattggacatccaccgcgatctcgccgtcggaatactattcggaccggacaaaaagaagcacaccagttcaaaccagctgaccgctcagaaatcgctccctgtgcagagagacgcgattaccctggtcggttttcctgggcataaggtaggccacacaaagccctatatcgatgacgggaagatcggtaatgtttacacgcatcagggggtgcaagtgtacgatatcacaacacagatccgtgagggaaattctggcgggcccgttctgcttgggagcacctacgaggttataggtgtggccagtagaggcgcagaggggaagacaggctctaatactgtgatcgcagtcagcgagctcttcaatctgctgagcaagtcaaacagtaaaaagtga

SEQ ID NO: 7747 - RNA, 1788 nt, unidentified
  source 1..1788: mol_type = other RNA; note = synthetic construct
atgcatctgaaccctctaagtaaggccttaagttctgtatcttactctgacttgaccgcaagttttctgcaggtgaagactccagaagaccttgcactttggttcggcttctcaaaatacgccgccctgggtttcttgatttttccacggcccaagtacaccgctttccttataaaaaagaagaacgggagcgaaaggctcatccaagtcccaaacaagaaactcaaagagatccagaaacgtctgctccacgtgctaaatgagctcgataacagtcgcccctccgcacacggcttcaggaagaagttgtcagtcgtatcgaacgccgaacaacatagcggacataagaagcattatgtctttaacctcgatttgaaggacttctttccctcaatcacttttccccgcgtccgaggagtgttcctgtcagagcctttcaagttcccggctaatgtggccaccgttttggctcggatatgtacatgcaatggagcattgccacagggggcacccacttctccaccccttagcaattacatttgccggggactcgatgggtccttacagcagatcgctaaagcatcttacagcacatatacccggtacgccgatgacctgaccttctccttcacaaacaaaaaaagacatcgtctgagccctaacctcatcaatacagccgtcgagaacgctacggtgtccctcaagctgaaagagattatcgaggatcacggattcaagataaactttgaaaaggtgagactcagaagcagacatgccagaatggaggtgactggactgacagtgaatgaattcccgaatgtgaagaggaaattcgttgacgagattcgcggtatgctgcatgcatgggaaacatatggactggaaaaagcccaggagggctttctttcacgactgtataaacgtcaacttcggagcggcggcgttcctgcgttcgagaacgtcctaaggggcaagctgctgtatttaaggcaggtgaagggtgccgacgataaggtgtataatactctggcgaggcgctttaacgcctgttcgaaccttattggcaagaattttcagatggctgtacctatgatcgatgtggcgctaagcgaacaggatctggaaaaggccatctacgtgatctcttgcgtacacgaagagtatgattttgagattaaaggcacgtgcttcttcttaaaaggcgtaggcgtggtgacttgtgaacacgtcatgcgatacccattaaatgtcgacgagaaaggaaacaaaatacacaactttcccagagagctcactgaatcctactttggcctctctcatggtcgcatctttattcaggacaccattgaaaatcctctgtgtgagctggaaattgtttggctggaccggaatgctgacgtggtggtcctcagacccaaagatgaaattaagatcgagcacttgacgctcattggagcaaccgcggagacaaagaccaaagaggtgaggcttgtcggctttcccttccacacccctgggaaatccctgtccgttgctgagggcaaaatcaggtcccgataccggcactttggttatgagaactacgacatcacctcattgatacgccaggggaatagtggcgggccggttctgaatagcgactttcacgtggtcggagttgctaaggaaggggagagacaagatggggggaataacggggttctgatgctggccgagctgatcaagctgcacgcccactataagaacgtgcagggtccactgcctaaaaataaggtgtggagttcctga

SEQ ID NO: 7748 - RNA, 1653 nt, unidentified
  source 1..1653: mol_type = other RNA; note = synthetic construct
atgcctctggtggacaacattcaccagatcttaattaagtctgacgttcagccgttttcacggtactacttcgacctgtcatacgaagagctatcaaagatcatctatccgactcccaaataccaaaccttccacataaagaagaagaatggtactgacagagttattcactcccccagctataaggtaaaacagcttcaatacatagtcattgagaagatcctgaaagagacaatagtgcctcggccatctgtgcacggatttgtgaaggaccgcagcatagttagcaacgctaagctccatgttggcaagagacatgtgttcaatgtagatcttaaggatttctttccctcgattaattttcatagggtgaagggcctttttagaggcaagccctttaactttgcaaataacattgctgtgtgtctcgctcagatctgctgctacaaaacaaagctgccacaaggcgcgccaacttccccaatcctgagtaatattatttgccgtggcttggatggggagctgcaggtactggccaagaacagtcacgccacatatacccgctactgcgacgacattacattctcctttaccaagccgaatcctagcaaaattccaagacatattgtccaagttgactctaatgtggcttccgccggggaaaagctcaacgacattgtcgtggcgcacggcttcgaaattaattgcgagaagaccaggatgtatgactggaaacgccggatggaggtaacaggattgactgtgaacaagtttccaaatgtgaaacgtaagaacattgaccggatccgcatgatattacattgctgggagaagttcgggtacaaaaaagcccaggaaaactacatcgagttcactaaaatcgaaaagtccgatttccgaggcaaatgtttcctcagttacaccaggggatatttgaattttatcaagtcggtcaaagggatggacgaccccgtgtatagaaagctggcaaagaaattcaacacgcttatcgatttcgagttcgatggcaaaagaaaagatctccctgtggggtcagtcgtcaaaattagggaggaactagataaagcaattttcttgatccagtgtgaaaacgcagccggacagtgccaacagggaaccgccttcttcctgaaagatgtgggttttgtgacatgcgatcacgtgaggtggctcaacgaggagaacatccctaccgacgaatatataggctacttttttgaacgggagatcaaaatcctgaatagcgaggagcaggaagtatgtaaagtccgcatcaaaaagtacgatgccaggaaagatttcctgattctcgaaccaaccgaacaggtcatcgtgaacatggcccttctgcctcaggtgaacatccctcagcagggagatcccttaatcctgtgtggttatcctagcccctttatccaccgacagacattgactatcatcaataccactctaatcacgaactataatacgtttggggctgaccatatagagataagcacacaaattcgaaagggtaattctggcggacccgtcctgaactcttcctttgaagttgttggaattgcaaagaccgggtctgagcagcacgggggtaaggacagtgtgctgtgtatacgggagatcttcaattga

SEQ ID NO: 7749 - RNA, 1572 nt, unidentified
  source 1..1572: mol_type = other RNA; note = synthetic construct
atgacccagcggtttattgagatacaaagtaccgacgaactggccgctttttttggtctggactataagcgcctggctgcggctctgtacaggactgacgcaagtcatcggtatcacgagtttaggatacctaaacgaagcggcggagctaggacaatccacgccccaaatcgtagaatcaaggcactccaaaggagactcgcaggcgaactcgacgccctgtacgtacccccgccatgtgtgtacggttttgttaacggccgggggattcgcaaaaacgctgatgttcacgctggcagaacatttgtgttcaacgtggacttaaaggagtttttcccctcaatccatttcggccgcgtgcgtggtgtttttgaaaaggcacccttccacttcacgagagaagtggccaccgtgctcgcccagctttgctgccatcagaatggactccctcaaggcgcaccaacttctcctgtgatttcgaattggatctgtcgcgggatggaccgggaactgatggctctcgctaaatcctccctggcaacatatacccgctacgcagacgatctcaccttcagctttacttgctcataccggaggctgccaggagccttggtcgacgtcagaggcagaaaagctgaaacaggagatgccttgcaaaaaatcatcgaaaaccaccggttcaaggtgaacactgataaggttaggctagccgggaaaagcacccggatggaggtcacggggctgactgtgaatgagtttcctaacgtacagagaaagtatgtacgacaggttcggtctatgttatatgcctggcgagaacacggactgcccgatgcggagcgcgaattcaatgagaaatacgatagagggcatcggccttccggccgacccaaaagctttacagcagtggtagccggaaaactagcttacttgttggacgtgaggggggctgagaaccccacctataataggctggccgccgaatacaatcgccttgttggcgaacagggagatcatctgcctcttgcccctccggggccccttgaaagggaccttatgggtctgcaggcgatgcgaaaggggaaggcccacgctaagcagtacgagaatatcgtcgagtccttactaacacaactgctcagcccatcactggagaatccgcagaaccaggtcagaattaatggaggccgcaaaattgtcgatattacattggataaccacgcaacctcaggcttcttccactatatcgccctgaactacaacgctccccatatcattgtcgagtgcaagaactattctggcgatccagccaacccagagctggatcagttggtgggacgtttcgcccagaaccgtggtcgggtgggtatactcgtgtgtcgaagttttggatccgcagccaagaagaagagattcctggagaggtgtcgcgacactgcaaatgccgggaatggcttcgtgatagccttggacgatacggacatggcgctccttgtcgaggagcgcctgaggtacggggagaaacagtcttatagattactgatggaacggttcaaggcgcttgtgatgtga

SEQ ID NO: 7750 - RNA, 1626 nt, unidentified
  source 1..1626: mol_type = other RNA; note = synthetic construct
atggctacactgaccacccgtaggagcatcgccgaattgatcgaaatgtctccgaccctgctggacgggcttgccaacagcctcaatagaagagcctatcaccggttccacgtaccgaagaagagcggcggatcgcgagtgattactgctcccaccgcgagactaaaagaggttcagaggagactgtaccgagtgctgagcgcactgaccgttccccccacttgtgcatttggtttcattgagagaagaagtacagtacacaacgctcagtctcatactcgttctagatgggtgctcaacatagacctggaagaattttttccttctatccactttgggcgggtgcacggtatgttgatggcccctccatatcacataccagaattgggtgcacagcgcatcgccgctctatgctgccatgaatcagtcctccctcagggcgctcccacatccccaattctggccaacatgattgcccgaggcctcgattttgcgctcagggactttgcaaatcaaaaccggtgtcattacactcgctatgcagatgatttaacattctcacagttccgaaagcgctttccatccgcccttgttactcggggcgtggacaatgtgacacgcgtgtccgatgaacttcgccagatcgtcgagagccatggatttcgcttgaacgccaagaaaaccagacttgcacattatagtgagcggcaggaggtaactggactgatcgtgaatagtaagcgacctaatgtgccccgcgagtttatccggaatctgagagccatgctgcatgcttgggagaggtacggggaagaggcagctgaggccacttaccggaggacattcgcacctagggatgcttcagatcacgtcggactgttcagggagacactgctgggacgtctatcatacctcgccatggtgaaaggaaggtcggaccccgtatacgtcgagttaatccgaagagcaagggagcgagtcgaccgcaagcacggcacgaactacttcgacaccatgccaatccccgaagatggggtggctgttttgatgacgacggaggggagagatagagctggtgagcaaggcacgggatttgtcctccggaatattggcgttgtcacctgctatcatgtggtccggagggccgtaaccgtggaggcttttccatggcacgcgcctttgcgggccaccaacttattcatggaccggttcaatgttgattgggacctggcaatactgcgcggtaattacggagccaagtatcagttcgaggccggggatgacgcccaactgagaatcggaatgcctgttaggattgtgggtttccccaactgggcacctgaccgtccaatgtccattacagagactgtcattcagggcatgaacagtgattacttcggagctcgcaggttcaccgtgcgtgacgccattttcggcggcaattccggaggcccagtgcttaatggcgccgggaaagtgatcggcgtggccatgactgggatgttccaaacaggggggggcacagaaaacatgataaccccgatctcttatgtgcggcgcctcgcggaacagcctgcttacgacccctttagcaacgtcgcgagcaaaaccagggaacactcctga

SEQ ID NO: 7751 - RNA, 1713 nt, unidentified
  source 1..1713: mol_type = other RNA; note = synthetic construct
atgaacctggacaccgcacagcgactcctcgaatgcgagactagagcagatctcgccgagtggctcggtgaagaccctaggaggctggctttttatgcttacgtgctgccggagcacaggcgctattcccatttcacaatagagaagagagcgggagggagccgtcatatccatgcgcccattgcccctataaaggaacatctgcggctcatttctgcagcactgtcccacttctataaccctcggaatgtggtaatgggctttgtgaaggagcggaatattgtcgacaacgctaataaacacagtcgccaggagtggattctgagggtcgatctgaaggacttctttccaactatccattttggtagagttgtaggggtgctgcaggccgcaccttttcagctccgttcagaggtggcccagacaatcgcacagttagcctgccaccaaggagtcctcgctcaaggcgcccctacttccccgatcttttcaaatctggtgtgtaggggactcgatcacgagcttctgaacttggctaggagagggcgctgcagatttactcgatacgcggacgatttgaacttctccactagcagaaagcggtttcctgatctgctcgcagcccgacagcttggtagtgagggccatacttgtgaagtgtctgctgccctgttacaggttataagcaaacacggctttacattgaacgacagtaagacgaggctcgtgcaccgcagtcaacgccagacggtgaccggactggtgtgcaatgaaaccgccaccgtcagcagacgctactatcggggtctgcgggccgttcttcacgtctggaggaaatacggagaagattccgccgccgaatggtttctggccaaccactacaagaggaacaaaccctcggggtctgacttctcctttaagaaagttgtaatcggcagggtgcagtttatcggctatgtttgcgggtggagcgccccaaagtaccagaagctggctaacctcctatcacagttagatccgacattccggaaaaagacagccaagacaccccccccagaaaagccatctggcttggtcatttggggagagggcgagacggactatctgcacttcttcatggcttggaactccctgcatcaggactatccaaaccttacaattgagttcccccaccctgctaaacgaacgaagggggctccaatgctagagaaaatgctggccgtgctcgaaaagacccccccactagaagcaaccgtttgtgtgttcgacactgacgaacctaagatcacctctagatttgagccagtcgagggaagcgcttaccttaagcttggcaccaacctgttcgtagtgctgctgcccactccaagtttcagaagcgggcgagatcccctctgtgtcgaactgctatacgaggaccccgcatcattacgcgatgagcgcggccggcgtctttaccttaaagacgaattccaggcggaggagccttaccacaaaaaagaaccgggagtgatgcggctgaaaccccgtagcaattcacttgtcgtcgaggatgtgcataatgggacaacccagcaaaatgttgcgttaagcaagatgggattcgcaaatttggtgcaatccaaatctacctcgtttgaaggcttcagagccctgttcgatgtgttgaatggcatcgtagaaacagagttgaccttgagtaatggttcttga

SEQ ID NO: 7752 - RNA, 1710 nt, unidentified
  source 1..1710: mol_type = other RNA; note = synthetic construct
atggatgccagccttttcccgttccccatcgcgcccaagtgtaaagttgccaataataaagaactggctgctttgttgggaattaccacggccaaactaacctactatgcctaccatctggctgatgacgaaaagtacaaggaatttaccattaagaagcggaacggaggcgatcggttaattgaggcacccatcaaaggcctgaaagatattcaggagagtatcgccgatattcttgaggaaaattacaaacctcgagcctgtgtcttcgcatacgtgaaagatagaggaatcgtcgagcacgctgctacacatattggccagcgttggctattacggctggacctgaaagactttttccacacaatctctttcatcaggatcgctggtatcttacgcagatcaccttataacttcgcagagactccagctaagacctccgcgctgctctgtactaaaggccagaggctgccacagggtagccctgcatctcccgtgatatccaatatcctgtgcaaagggttggactacaaactgaaagagttggctgcacttaacaaatgctattataccaggtacgcagacgacatcttcataagcaacaacgggtcaaagtttccaccgtccatagcaatccgggatgaggacgggtctgcagaactctcagacaccctcaagaagattataattgatgccgggtttgaggtcaatctggataagacaattctacgaaagagatcggaacgtcagctcgtgaccggcgtggtggttaatcgcaagtctaatgttcccaaggagctgatcaaaagcattcgagccgcgctctacgcctgggaacagcatggactcgaagctgccgaagactactggaagagaaaaatcgataagtctaataggttcgatggcgagtcccctcagatgaagttggtgctcaggggcaagatcactcacgtaggtcatgttaagggttattcggacggcactttcctcacgctcgtgaaacgattgcaagccctcgatagtgactatcacattgatgagcaaaagattagtcgtactataacaggggagatccacatttacacggagggcgtaaccgacaccaaacattttcaggcggctcttagggcatttcagcggagtggcgagtttgccggactgaatcttattttcagaaacagcaagaagaccgggagcagtggattaaaagccttgtgcgagaacctgtgtgaaacactgcagaggcaccttactatatgcatctttgaccgcgatgaaagacctattatcaacgagatgtctgggtccccaggtaattaccgcgatcacacaaacaatgtcttttccctgattatcccaacacccgaattccgcgacccctccgatctgatctgcattgagcacctatatcaagacgcccaaatctatactccagacagccagggtaggcggctgtatagtaaggacgaatttgattctcttggatgtcataaggacaaccctcagctgttctgcagagtgagcaaacaatcactgatctatgatgaccaggtgattaacctgcaggagaagaagaacatagccctgcctaagaacaaattcgccgactacatcttcaacggcgcaccacccttctcaaatgtcgacttttcagggtttcgcggaacatttacccagatagtggctatcgccgcgagctactcccggtga

SEQ ID NO: 7753 - RNA, 1707 nt, unidentified
  source 1..1707: mol_type = other RNA; note = synthetic construct
atggacgccttcttccccttcgacccatctcccaagtataaaatcagcaacaacaaagagctggcagctctcctgggcattagcacagctaagctgacttactatgcttattatcttgctgatgacgacaagtacaagagcttcaagattaagaaaagagcgggcggggaacgtttgatagaggcccctaacaagggcctgaaggaaatccagaaaaacataagtgtgtttctagcccagtcttacaagcccagagcctgtgtatttgcctacattcaggaccgaggcatcgtcgaacatgccgctacccacataggacagcgttggctgctgcgtctggatttgaaagatttctttcactccatttcgcttgcccgggtaagtggtgtcctgaggcgcgcaccatacaatttcgccgagagtccagcaaatacaactgcaaggctgtgcaccctcgggagaaggttgccccaaggatcaccagcttcacccataatttctaatattctatgccgcggactcgactacaagctgaaagaactcgccgcgtccaacaaatgctactacacaagatatgcggatgatatcttcatttccaacaatgggtcagccttccccgccagcatcgcgatcaggtccgaagacgggtcagctgagctctctgacacaatcaagaagattattacggacgcggggtttaatatcaactttgagaagactatcctccggaagaggagcgagcgacagctggtgaccggcgttgtggtgaaccgcattagcaacgtccctaaggattttataaaaagcatccgcgctgcactttacgcctgggagaaacacggactcgaggctgctgaggagtactggaagcgctcaatcgcccagacaaatagatttgacggggaatcaccgcagatgaagcttgttgtgcggggcaaagtgactcacgtgggacatgtcaaaggatattccgacggaaccttcttaacgctcgcaaaacgattgcaggcactggattctgaatatcggatcgacgaacaaaaagttctcaggaatataacgggggagatccacatatatactgaaggcgtaactgacaccaagcactttcagaccgcactccgggcattgcaaaggaggggcgagttcgtgggtcttaacctgagtttcagaaactcccgaaaacccggttctagtggtctgaagctgctgtgcgagagtcttagcgaaaccttgcagagacacctgacaatctgtattttcgatcgcgatgagcgccagatcattaatgaaatgggcgggagccctggaaattaccgggaccatgccaataatgtgttctccctgatcattcctacaccggagttcagagattctggcgatttgatttgtatcgagcatctataccgggacgcccagatttatttaaccgataatcaaggccgcaggctgtattccaaggaagagtttgattcgttagggtgtcataaatccgagcctgatctgttttgcagaactaccaagcagagcctgatctacgacgaccaggtgatcaacttacaggagaaaaagaatgttgcccttccaaagaacaaattcgctgattacattgcagccggtgctccacctttcagtaacatagactttgaaggatttcgaggcacctttacacaaatcgtcgaaatcgcctcttcatattcccggtga

SEQ ID NO: 7754 - RNA, 1707 nt, unidentified
  source 1..1707: mol_type = other RNA; note = synthetic construct
atggataccttctttccttttaacacttccccaaagtacaagattgagaacaataaggagctggccgaattattgggggtcactacggcgaaactcacatattacgcatattacttgcgggatgacgacaagtaccacagtttcaagattagaaagcggattaatggggagcgactcatcgaggccccaaatcgaggcctgaaagacatacagaagacaatttcacatttccttgaacggaactatacaccaaggtcatgcgtgttcgcttatgtaaaagagagagacatagtggagcatgcaagcattcatgtgggacagcgttggctgctgcgcctggaccttaaggatttttttcacagcatctcatcagcaagagtatccggggttctcaggcgcgcccccttctgttttgccaagtctcctgctaataccgtggcaaggctgtgtacgaaggacggaagacttccacagggaagcccggcttctcccgtgatttcgaatatactgtgtaaaggcttggactacaaactcaagcaattggcctcttccaacaaatgctattatacccggtacgccgatgacatcttcatctcaaataacgggagtgtctttcccagtgcaattgctattagaggcgatgacgggaacgtcgagttaagcgaagagatcaagaacataattatcaactccggcttcgaggtgaacgccggaaaaacgacacttaggaaaaagagtgagcgacagttggtgacaggcgtagtcgttaataagaagaccaatattcccaaggaatacattaagtccatcagagctggtctgtatgcctgggaaaaatttgggttggtggccgccgaggaatactggaaaaaggagatagagcggagcaataaattcgacggccagcccccacagatgaagctcgtgattcgcggtaagattatacacgtcgggcacgtgaaaggctacaccgatgcaacattcctaactttagttaaaaggctgcaggcgctggacagcgaattcaagatcgatgaacaaaagttccgtcgggaaattacagacgaaatccacatctataccgagggcgttactgataccaaacatttccaggccgccctgaatgcgttccaaaagagagacgaattcctggatctaaagatcatcttcaagaactccagcaaacctggctctgctagcctaaaaactctctgtgaaaacctgagggaaaccagccaaaagcacctcactctgtgcatctttgatcgagatgaaaagaatatcgtaaacgagatgtctggatcacctggaaattatcgcgatcatggtaacaatgtcttttcgcttatcataccaattcctgagtttaggaagggaaatgactctatctgcattgagcacctgtaccgcgacagcctcctgtttacctatgactccgaagggcggcgcctctactttaaagacgagttcgattctcttaactgccacaaaaccgatcccaacctgttctgccgtatctccaagtcctctctcgtgtacgatgataatgtcatcaacctgtcagagaggaaaaatgtggctctgccgaagaacaaatttgcagactacgtgtgtagtggccagcctccctttaacaaagtggactacggtggtttttacgaggttttcaaacagatcttagagatcgctagtacttataacaaatga

SEQ ID NO: 7755 - RNA, 1707 nt, unidentified
  source 1..1707: mol_type = other RNA; note = synthetic construct
atgaaagaacctaagttcatgcagaacttgcccagctataagatctctaacaacaaagacctggccctgctctttggagtaccgacagccactctcacatactacgcgtatcacctgtcagatgagcggaaatacaagtccttcaaaattataaagcgcagcggcggagaaagactaatcgaagcccctatcaaaggactcaaagaccttcaaaaaacctttagcaactttctgtccgaaaatttcaagcctagagcttgcgtttacgcgtatgtcaaggataggggcatcgtcgagcacgccgcaacccacatcggtcagcgctgggttctgcgtatagatctcaaggatttcttccactctataacaagcacacgcattactggccttctacgcaagtccccgtacaattttgccaagagtcctgcggaaactgtggccaggctctgtaccattgacgggcggatgccacaaggctccccagtcagtccaatattctcaaacattatttgtcggggcctcgactataaactcaaggaactgtcgagcctaaacaaatgttactacactagatacgcagacgacatctttatttcaaataatggcagcctcttcccaagcgccattgcttctagaaacgacgacggttctgtacagttaagcgatgctatcaaggacattattacgaaggcagggtttgtgatcaatatcgagaaggtgatccttaggaaacggagtgaacgacagttagtcactggcgtggttgtgaacaaaaaatctaatgtccccaaggtgtttgttaagagcattcggtcttcactgtatgcttgggaaaaatttggcctgccggccgctgaggactactggaagcgcgagatctacaagaataatacccataacggtgagattccaagtttcaacttggttattagggggaaggtgacacatgtggggcacgtgaaggggtatgcagaccctacctatctttcactggccaaacggcttcaggcgctcgattccgaattccatatcgacgaggagaagatattcaacacgatcacttctgagattcatatttacaccgagggagtcaccgatacaaagcatttccaggctgcactcaacttctttaagtccaagggagatttccaggccctgaacctggtgtttaagaatccccgaaaaacaggcagtgctaaccttaaagcactgtgcgaaaacctgagtgaaacccagcagaaacatctgtccatttgcatctttgatagagacgagcccgctatcatcaaagagatgtcgggttcacctgtaaactatagggaccacaacaataatgtgttctccctgatcatttcagtgcccgacttcaggcgagacttggattacatctgcatagagcacctgtataaggactccgatttatacatcgccgatctggaaggaagacgtctgtattccaaggatgagtttgataatctggggtgccacaagtatttggataatttgttttgtcgctctagtaaaagctccctgatctacgacaatatggtcatagatttacccacgaaaactaacgtggcattgcctaagaacaaattcgctgagtacattatcaatgccaaagcaccctttaatgatatcgacttcgaggggttcaggccaacctttaatcaaatctttgagatagccagcacctatagaaagtga

SEQ ID NO: 7756 - RNA, 1719 nt, unidentified
  source 1..1719: mol_type = other RNA; note = synthetic construct
atggattcattttatcccttcattcccaatcccccctataagatctcaaataatactgaactggccaatcttcttaagattccagtggcacgcctgacttattacgcctactatctgccagatgagcagaaatacacttcttttaacatacgcaaacggaacggcaacccgcgactaatcgaagcacccatcaaggggttaaaagacatccagcgcgcgattagcgtgtatctttacgaacaatataagccaagatcctgcgtgtttgcgtacgttcagggaaaagggatcgtagaacacgcttcaatacacatcggacagcgttggctgttacgcttcgacctgaaagacttcttccatacaatcaagacgtccagaatctcgggactgctgcgacggcccccttattcccttgctaaaggccctgccgagacaatcgccaggatctgctccaaagacggtaggctgacccaggggagcccctctagtcctgtcattagtaacctcctctgcaaggggctggactacaagattaaggagttggcagcaaagaacaaatgttactattcccgatacgccgacgatatttttatcagcaacaacggatcagtgttccctagcgccatcgctatccgtaccctcgagggaaccgcggagctcagtcttgcccttcaggaaatcgtaagtgcgtctggcttccagattaacaaaagcaaaacaactctgcggatgaggtccgaaagacaaattgttaccggtatcattgtcaataggaagtctaatataccgaaagaattcctcaattctgtccgggctgccttgtacgcatgggagagatttggcttggaggctgctgagaattactggcggaagaatatagaccctaaaaacggctttaaccaggaggacaaagagggcccacgcttgaggtgggttatccgcggaaagatcaaccatattgcccatgtgaagggttattccgatagcacttttttgagtctcgctcggagactgcaatcactggattcctcttataagatcgatgaacaaaagatcctccatgccctgacagacgaaattcacatatacacagaggggatcaccgatacaaagcacatcgaatctgctctgaagaatttcaagaaaaaccaggagttttccaacctgaatttggtgctgaaaacccccaggaaaccaggttctgcttcactaaagtcgttatgcgagagcctctctgtcgcccctcagaagcagctaaccatttgtatatttgatcgtgacgaaccaaacatcattaaggagatgggcgggtctagcagcaactaccgagatcatacaaataacgtgttcagcatgattatacctaccccagacttcagggacgctaatgagccactctgtattgaacacctgtacaaagatgaggcaatctacatcaaggatagtcacggccggagactgtacagtaaacacgagtttgatagtctggggtgtcacactttagagccgggactgttctgtagaatttccaagaatacgctcatttatgacgacaacgtgatagaacttagcaagaaagccaacattgcattgagcaaaaataagtttgccgactatatatccaacggtgcccctcccttttgcaatattgatttctcaggcttcaggaatatgttcagccagattacgcaaatcgcaggcctgtacaagtcaaactga

SEQ ID NO: 7757 - RNA, 1707 nt, unidentified
  source 1..1707: mol_type = other RNA; note = synthetic construct
atggacgcatctctgcctttcgggcaatttcccaagatttccataagctcaaacaaagagttagcagtgctgctaggaatcagtgttaataagctgacgtactacgcttattacctggatgaggagtcaaagtacaagacattcaacattagcaaaagaaacggcggagtccgagtcatcgaagcgccggtgaagggcctcaaagacatacagaaaaacatcgtcacattgattgaacctaactataaagccagatcttgtgttttcgcgtacgtcaaaggccgcggcatcgtggaacacgcagctgtgcatacaaatcaacgctggctgctgcggttcgacctgaaggacttttttcatactatttccgccgtacgcgttgccggtcttttccggcatccgccatttaatttctccaaaaatgtggccgagacgatcgcccggctatgcaccaaagctggcagactgacccagggtgcacctacctcgcctatcataagcaacatactctgtcgggggctggattataaacttaaagaactcgcttcacagaataagtgctattatacccgatattctgacgacgtattcatcagtaataacggatcattgttcccttctgcaatcgcggaacgggggagcaacggcgtggtgaagcttagtgatgacgtcctggagattattgggggcgccggcttccagctgaatctgagcaagaccatcttgaggaacagagccgagcggcaactagccacaggggtcattgtgaaccgcaaactcaacgtgcccaaggaatatataaagagcgttcgagctgccctctacgcttgggacaagtacgatcttaaacaggccgaagagtactggcgcgagcatattgatgaccgaaacaggtggggagacagtttaccaaggctatcctgggtgatcaggggaaagattaatcacatcggtcacgtgaaaggatataatgaccccgtgtttcttaccctggcaaagaagctccagtcactggatcccacttaccggcttgatgagaggaaaatcctgcgttctttgactgacgaaatccacgtatacgcagaggggatcactgattgcaagcacctcgaaacagccttgaagttttttaaagccagaggggagtttacaaacctcaacctgaacttcaggaacactcggaagcctggctcctccgtcttaaaagctctgtgtgagcatcttagtgaagccccccaaaagcacttgaccatctgcgttttcgatcgcgatgagaggccgattatcagcgagatgggtggaagccccgggaattatcgcgatcataccaataacgttttctctctcataatcccagtgccagacttccgtgattccgacattatctgtatcgagcacctgtacaatgatagtcagctgtacattcccgacaatcagggtcgaagactgtattccaaggaagagttcgattcactgggctgttttaaaggggaagcgcacttattctgcaggatgaacaagcagtcgctcatctatgacgacaatgtaattgacatggtggagcgtaggaatgtcgctttgcctaaaaacaagtttgctgattacattgtgtctggcgccccaccatttagcaatatagatttctccggctttagaggagtgttttctcagattgtcgaaattgcaggattttacggtaagagatga

SEQ ID NO: 7758 - RNA, 1737 nt, unidentified
  source 1..1737: mol_type = other RNA; note = synthetic construct
atggtgctgctgaactttccactgaaggaacaggctccagagtataccatcagtaataacaagcagatggcacaagtcctggggattaaaccctcgaccctgccctactacgcttactacctccccgacaacaaaaagtataccagcttcaacatttcgaaacggggcgggggtctgcgtctgattgaagctcccaataaaaggctgaaggatctgcagagggcaatcgcagagtacctgggagagcattataaaccacgggcctgcgtatttgcctatgttgggaaaaggggcattgttgagcatgcatcagtgcacgtatgtcagagatggttattgcggctggacctaaaggatttttttcattctatcacagctcctcgcttggcaggattactctcagcccccccattcttgctcgcaccaaacttagcccgcacgctatcctttatatgtacgaaagatggccgactcactcagggggcacccgtctctccggtcgtatctaatataatttgtagggggctggactattccctgaaggcctacgcggcgaaaaataagtgctactacaccagatatgctgatgacatctttttcagcaacaacggagccatctttcctagttccctggcccggaaagacgaggccggaacagtgatcctgggcgatgaattgcaggagataataaaagccagcggattcatcattaatgagtctaagacattcctgcgaagtcgcgcagaaaggcagatcgtcactggagttgtcgtgaacaagaaacttaacgtgccaagagaatacgtgcgacagatcaaagccgcgctccacagttggcggaagttcgggttggaagcggccgagaagtactggaacgaaaaaatcgacaaaagaaacagatggtctggcgcctccactagcttcaaacttgcagtgcgtggtcagatcaatcatgtgggccacgtgaagggctattccgattcagtctacttactactagcgaggaagctttcccaactggataacacatttaacttcgatgaaagtgctattgccgagagcatcgctgaggagattcacgtgttctgcgaaggagagtcagacatcctgcacctgggtcatgcctttcgatgtcttaagccgcggtatccttcactcaatctgatcttcaaactgcctgggattggtaagggtgatggctctagcgtattgaagagtttttgcgacaccgtgcggaatcacccgcagaggcacctgacaatttgcctctttgatagagacgagcccagcatcatcagggagatggcaggctctgctgtgagctataaggattatggcggcaatgtgttctcccttgtcatgcctcccccttcctttcgcaagaatgataacatctgcattgagttcctctaccaagacattgaccttctcagaagagatactcagggccgccggttatatctgggagaagagtttgaccaaaatagctgtttcaaaggagaagaaatgctctttaagaaattccctaagaacagcttgattctcgattccgacattatcgacgctcgcactgggaataatgttgcccttagcaagataaagttcgccgagtacatatcttcaaaggttgacccattcagttccgttgacgtgtcaggtttcgctattatctttgacgagatagccgctatccgtgaaacctacatgcgccctttccacgacgtggatggggattga

SEQ ID NO: 7759 - RNA, 1719 nt, unidentified
  source 1..1719: mol_type = other RNA; note = synthetic construct
atggtttctttgaacttttatctcaaggaacaggccgctgagtataaggtcctgagcaacaaacatatggctcagatcttaggggtgaaaactagcgtcctggcctattatgcctactatcttcccgacaacaagaagtacaacagctttaacatcgccaaaagaggcggaggctttcgcttgattgaagcccccaataagcggcttaaggacctccagcggataatcgctgaatacttgggtggttactataaaccgagggcctgtgtattcgcatatgtgggtaaaaggggaatcgtggaacacgctagtgtgcatgtgtgccagcggtggttgctgcgactggacctgaaggactttttccactccattaccgctcctagactcgctggcctattgtccgcacccccatttctgctggccccaggtgtagcgaggacaatttctttcatctgtacgaaggatgggcgtctgactcagggagccccagtttctcctgtcatttccaacatcatctgcagagggctcgattacagcttgaaaacgtacgcagccaagaataaatgttattacacacggtacgcagacgatatctttttctcaaacaatggcgcagtatttccttcctctctcgcgcggaaggatgaggctgggactgttattctgggggatgagctcaaggacataattaaggcaagcggctttctgattaacgacaataagaccttcctgcgctccagggcggaacgccaaatcgtgaccggcgttgtcgtaaataagaaatccaatgtgccccgtgaatacattagacagataaagtccgctctccatagttggaagaaatttggtctggaaagcgcagaaaactactggagcgagaaaatcgataagaggaatcgttggaacggcgctagcatctcttttaagcttgccctgcggggtcagatcaaccacgtgggccacgtcaaagggtactccgactctgtgtatctgatgcttgcccgaaaattaagccagctagataacacctttaattttgacgagcgaagtattgccgagagcatagccgaggaggtgcacgtcttctgcgagggcgagagtgacattcttcatctgagacatgctttccaatgtctgaaatcagagtacccctcacttaacttaatcttcaagctcccgggcattggaaaaggtgatgggtcctcagtgctgaagaatttttgcgacatggtgaaaaatcacacccagagacacctgacaatctgtctattcgacagggatgaacctaatattatccgagagatgtcagggtcagcagtgccttataaggattacggaggaaatgtgttcagtctggtgatgccttcgccagatttccggaatgagaacatatgcatcgagttcctgtacaaagacgttgacctgttacgccaggatactcaaggcaggcgcctctatctaggcgaagagtttgaccagaacagtcgctttaagggacagggaacaattttcaaaaaaattcccaagtcctctcttatcctcgatagcgacatcatagattatcaaaccggcaacaatgtcgctctctctaaggttaagttcgccgaatacataagcaacggagtcgcgccattcgacagtgttgatgtgtctgccttctcggtgattttcaatcaaatcgcagccatcagagactcctacatgtcattgggggtctga

SEQ ID NO: 7760 - RNA, 1734 nt, unidentified
  source 1..1734: mol_type = other RNA; note = synthetic construct
atgtccgcccaggacgccatcgatgagaatctcaacatttacagtatctctaccaaccgggagttggccaaaattctcaaaactaagacgagtactctatcgttttacgctcattacctgcccgataaaaagaagtacaaaacccacaccatctccaagagaggaggaggagccagaataatagatgcgccaaacaagaaccttaagactctgcagaaaagtatcgcgagttttcttaacgagcactataaggcacgcgcatgtgtctttgcgtatgtggctaatagaggtatagtggaacacggagaagttcatgttaaccagcgttggctcctcaggctggacattaaggactttttccactccataaccaccgctcggctggtcggcttgcttattgcaccaccattctgcatagcccccaacgtagctcggacaatcagctttatctgtacaaaagacggcaggctgcctcagggctctcctgcaagccctgtcatcagcaacatcatttgtcgggggctggactataaactgaagacgatcgcctctaaaaataagtgctactatacacgctacgccgatgatatattcctgtcaaataatggggcgatttttcctccgtccctggctttaaagaacgacacgggaatcgtggcactgggcccagaaatttcagagattattaccagcagtggttttagcattaacgaagagaaaacctttctgcgctctaggggcgagcgccagattgtaactggtttagtggtgaacaagaagctgaatgtcccgaaggaattcgtcagaaatatcaaatccgctctccactcttggagaaaatttgggttcgaggccgctcagaaatattggagggacaaaatagacaagcgaaatcggtggcttgtggaacatgctgattataaactgagcgtaagggggcaaatcaatcatgtgggttttgttaagggctattccgaccccatttacctctcactggcccgaaagctgagcgaattggattcaactttctctttcgatgaggaggcacttgccaacagtatcgcagaagagatacatgttttctgcgaaggcgacactgacctcctgcaccttgaacatgcttttcagaagttaaaaaacgagtaccccacactgaatctgacttttaagctgcctaataccggcaaaggtgacgggagcagcatcctaaagaatttctgcaacagcgtgagaacgataccacaaaagcacctcacaatctgtctgttcgaccgcgacgagccgaccattatccgcgagatggccggctcagccttgccatatagagatttcgggtcaaatattttctctctcgtcatccctcagcccgattttagggatcacgaatgtatttgcattgagcacctatacaagaatgatgacttacttaagaaggacagccatgggcggcgattgtacttgaatgaggagtttgattctaactcaaggcacacaggaggagaattgctatttaaaaaaatccccaaggcaacactgatcctcgatgccgacgttattgatttcaagaccggagagaatgtggctctctcgaaatccaaattcgccaactatatttacaacgagacacctcccttcacctccatcgatgtgtccggcttcaaggtgatcttcgaccaaatcgcaacaatccgtgaagcctactccaacgggatgcatggccagaaaactatctga

SEQ ID NO: 7761 - RNA, 1737 nt, unidentified
  source 1..1737: mol_type = other RNA; note = synthetic construct
atgtcagtgcccgaggtgtccccattgcctgcgagcttcttggacctccttgccccagccgtaaaaattaagaataacaaggagctagccgctgagctcggaatctctctgggccgtttgacttactatgcttatttcctgcccgaccacaaaaaatacaaaaccttcacgatctccaagagagggggtggagaaagaatcatagaggctccagtgaaggggctgaaggaccttcagaaaacgattcttgggaaattcgagccttactacaagcccagggcctgtgtctttgcttatgtgcaggatagaggaattgtggagaacgccgacgtccacgactttcagagatgggttctgagggtggatctgaaggacttcttccattctatcactcagcgtagagtaatcggaatcttctcttccccgcccttctctttaagtcgggacgcagccagaacactgagctttctgtgcactaaagatggcaggttgacacagggcgcaccaacctcccctttgatcagtaatctggtgtgtaagggactggattacaccctcaaagaactggccgcaaagaacaaatgctactatacccgctacgctgacgacatctttttctctaactccggcgccatgtttccccgcattatagctgagaagatggaggacggtagcgtgaagataggggaagagctgaaaaacttgatagagggtgccggcttcgctatcaatgaagagaaagcgttcttaagatcccgcgctgaacgccagatcgtcacaggcctagtggttaacaaaaaggtgaacgtgcctagggagttcactcgagaggtgcgagcggccctatacagttgggaaaagcacggcctggaatctgcagagaatttttggaaggaaaaagtcgacaagaaatcccgccacagcgaatctgacagcaggtttaagtgggtggtgaggggaaagattaatcacatcggtcatgttaaggggtattcggatccggtattcctgagcctcgcccgacgacttaaggccctcgacgatacctataagctggatgagcggaaaatcacagttgctatagcacaagaaatccacatttacaccgaaggagtgacagacaataaacaccttaagaacgcttacgagcacttcaaacgttctaaccaattcgacgacctgaacatcctctttaaggaaaccaagaagtcagggagtcccgccttaaaagcactttgcgagaacctgagcgaggccttacagcggcatctaactatctgtatttttgatagggacgaaaaggacattatctcaaatatggggggcagccctggtagttataaggaccatggcaacaatgttttttccctcgtaatcccggttcccgattttcgcgatactcaatttgtctgcattgagcatctgtacaaggatgagcagctgtttcaggaagacatagaaggccgccggctcttttccaaggatgaattcgattcacttagttgcttcaaaggcgagaaaccattgttttgtagactgcctaataagcagagcctcatttacgactcagagataattgatatgtccaagaaagtcaacgtcgccctctcgaaaaataaattcgcagattatatcctgagccgggtcgcaccatttgataagattgatctgagcgggttcacaggtacctttgaacaaattcgggagattgcgaggtcatatggaaataaacggtga

SEQ ID NO: 7762 - RNA, 1737 nt, unidentified
  source 1..1737: mol_type = other RNA; note = synthetic construct
atgcttaacatcgcaggcaagcctttgtttgttccctttctggacgcacctctccccgaggtgaaaattaaaaacaacaaagagcttgcgggcttcctcggcatctccttgggacgattgacctattacgcctactacctcccggagaacaagaaatacgccagcttcaagataaagaagagagggggtggcgaacgcctcatagaagcgcccgttaaggggctgaaggatatccagcgagaggtcgtgaggaagttcgaagacgacttcaaacccagagcttgcgtgtactcttatgtaaagggcaggggtattgtggaaaacgccgatattcacgatctgcagagatggatcctccgaatcgacctcaaagatttttttcactccattactcagaagcgagtcgccggtattttcagcagtccacctttcatgctgagccctgacgctgctcgcactctctcattcatctgcaccaaggatggaagactgacacaaggggctccctcatcgccattcttaagcaatctggtttgtcgtggactggattaccggttaaaagagctagcagccaaaaacaagtgttactacacgagatatgctgacgacattttctttagtaactccggcgccatttttccaaggtctttggccgagcgcctagaggacaatagtcttaaactcggagaagagctgaccaatatcatccaaggggcagggttttctatcaacgaaaataaggcattccttagaagcagggccgagcgacaaatcgttacgggcttagtagtcaataaaaaggtgaatgtgccgaaagaatttatccggtctgtgagggcgtccttgtactcctgggagaagttcggactggaacttgcagagaaacattggcgcgagaaggtggacaagcggtcacgtcatgaacgggagtccccccgctttaaatgggtggttaggggacagatcaaccacattggccatgtcaagggctattcagatcctgtcttcctgtcactggcaagaagacttcaggccctggattcccagtacaaactcgacgaaatcaagataatcaacagtattgccgaggagattcacatctactctgaggggattactgatataaagcacctcaagaacgcttatattgaactgcagcgtagtggagaaatcaatgacctgaacatcgtatttaaggagacaaagaaaagtggctcaccagctctgaaagcactttgcgagaatctgtctgaggccctccagcggcacttgaccatttgcatctttgaccgcgacgagagggatataatcacctctatgggtggatctcctggttcctataaagaccatgggaataatgtctttagcctggtgattcccgtgcccgaattcagagagacagagtttgtttgcatcgagcatttatatagggatgaacacctattcctagaagaccaagacgggagacgcttgtttgctcgcgacgaattcgatagcgtgtcatgtttcaaaaaagaacggccactgttttgtcggtatcctaataagcagtcgctgatatatgacagcgacgtgattgatctggctgagcgtaagaacgtcgccctgccaaaaaataagttcgccgagtatgtgacatccaagactccgccattcgataacatggatataagcggcttccggtgtgtatttgaacagatccgggatattgcgaaatcctacaggagcaagaggtga

SEQ ID NO: 7763 - RNA, 1746 nt, unidentified
  source 1..1746: mol_type = other RNA; note = synthetic construct
atggccaagttaccgcggaaattctctttcagtagctttttgaattcccctgcacccgaagtgaaaatcaaaaataataaggagctcgcagaggtgcttggtatctcagtgggaaggctaacatattacgcttactacctgtcagcagatgagaagtacagttccttcaacatcagcaagcgagggggtggggagaggcttatcgaggcacccgtaaaggggcttaaagacctccaaaagaagattgtcgagtacctgactactttctttaaacctcggtcttgcgtgttcgcatacgttgaagggaggggcatagttgaaaacgcggacgtgcatgacttacagcgttggattttgcgcgtcgacttgaccgacttttttcacagcattacacaaaagaggctggtgggcgtattttccagtcaacccttctctatgtctcacgatgctgctcgcacactcagttttttgtgcacaatgaatggtaggttggcacagggggctccgacctctcccattctctccaacatcatctgccgggggttagattataaactgaaggagctcagcgccaagaataaatgctattatacccgctacgctgatgatattttcatctcgaattccggtgcatctttcccacgtactattgctgaaaagctagaggatggctcggtggagctgagcgagagcttttgtgaagtagtgtccaacgcgggttttaaggtaaatctgaagaaggtcttcctgcggtcaagagcagaacgccagatcgtcactggactcgtggtgaacaaaaaaataaacgttcctcgggaatttgtcagaagcattcgggctgccctctattcatgggaaagcttcggactggaggatgccgagaagttctgggccagaaacattgataaaaaatctcgccacgagaggtccagcccacgttttaggtgggttctgagaggccagatcaatcacgtcggccacgtgaagggctattcagacagcgtgtacctaggactggccagacgactggccgcccttgatgactctttcaagttggatgagcgtaaaatccgaaaagccatcgctgaagaaatccagatttacacagagggcccaacggacatcaagcatctttcaaatgctttcgaagtgtatcagtctagaggcgagtttcaggacctgaagctgatcttcaatagaaccaagaaggccgggtcaagtgtgctgaaagttctctgtgagaacctttccgaggcccaacagcgccacctgaccatttgtatcttcgaccgagacgaaagggagtacataaagtcgatgggcgggtccccagggagttataaggaccatggcaacaacgtcttcagtctcgttattccagtgcctgatttcagggataccgacctagtgtgcattgagcatctctaccgggacgaagatctgtaccgggaagatgtcgagggacgccgactgttttccaaagaagattttgatgccgtcagttgttttaaaggagacagacccttattctgtagaatacccaacaaaaactccctgatatatgattctgacatcattgacatggtggagaagaaaaacgtggccctgagcaaaaatgcttttgcggacaacattgttactaagacggcccctttcaataacgtcgacctgtcaggatttaccgagacatttgaacagatccgcatcatagcgggcagctatcggaataggggcgtgggagtatga

SEQ ID NO: 7764 - RNA, 1737 nt, unidentified
  source 1..1737: mol_type = other RNA; note = synthetic construct
atggccaaaccagatgagtttctggatctgcctctgcagcctcccattaagatcaaaaataacaaggagctagcagactttctggagatcaaggtgaacaagctgacttactatgcctatcaccttgacgatagaaagaaatacacgacctttgagatcaagaagagatcaggtggtctgaggaaaatcgatgccccgatcaagggactgaaggacattcatcggcaggtgctgctgaaactcgatccatactataaacccaggtcctgtgtgttcgcatacattaagaaaagaggcattgtggaaaatgctgacctccacaaggggcagcggtggattctcaggatcgacctggtggattttttcaacaccattaccttcgaacgtttaaaggggctttttgccagccaaccatttagcatgtctgagaacgctagccgtaccctgtcgatgatctgtactaaggatggtcacctcacacaggggtcccctgcttctcccctactctctaacattatatgccgcggcttagattataagttgaaggagatatccgccaaaaataagtgctactatagtcgctacgccgatgatatatttatcagcaataatggggccattttcccaaacgcgattgcggaaaagaagtctgacgggagcgttgagctgaacccgcagatcttgtctaccatatatgacgctgggtttagtcccaacaaagagaaaatcactctgaggtcaagggcagaaagacagattgtcgcgggcgttatagttaatagaaaaacaaacacgcctcgcgaatacatcaagagtataagggctacactttacagctggaggaagtacgggttagaatccgccgaggagtactggcttaagcatatcttcagacagtctccgcatggagataaccaacctagaatgcggtgggtactaaggggacaaattaaccatgtgggccacgtaaaaggatactcagacccagtctacattggcttggcaaagaaacttaagagcctggacccaactttcaagttcaatgaacagaatgccatcgattttgtccgagaggaaattcacatctattctgagggcattacagaccgaaaacatctggaaaacgcactgctgtccctaaaatcccaaggcttgttcacggaacttaatctggtgttccgagaaacctctacagacagcaaaaagcagggcagcgcagcattgcgctcactgtgcgagacattatgcgctgccacccagaaacacctcactatctgcctctttgaccgcgacgagaaagaaatcaccgaatcgatgggaggatccacccgtacatacaaagaccacggaaacaatgtctggagcctgataatccccgcaccagaattccggacactcacctccttctgtattgagcacctctatcgggatgagcagttgtatcagtatgaccaagagggccgacggctctactcaaactcagagttcgatgacaatcagtgtcatcgcgaccctgacaagttggtgtttcagaaacaccctaacaagaaagctcttattctcgacgatgccgtgatcgacattactactaaaacaaatgtcgctctgcccaagaataagttcgctgattatatcagtagtaagactgccccctttgacgacatggatttttccggtttcatccccacgttcgatcagatcatagagatcgccgcgcggtacaccagtaataaatga

SEQ ID NO: 7765 - RNA, 1677 nt, unidentified
  source 1..1677: mol_type = other RNA; note = synthetic construct
atggcaattccgcagataaaaaacaatcaggacctggccgatttcatcggggtgaaaaaaggcgtggtggcatactatgcctattacttggacagcgctaaagcatacacgtccttcaccattaagaaaaggagcggcggagatcggactattgatgctccagttcgggggctgaaacagttacagcgaacgatactgaataagctgagtcccgaagcagcctttcgccattgcgtgtacggctacgtaccaggcagagatatcctgcaaaattctgctattcacgtgcgccaaagatgggtgcttcgggtcgacatcaaaaatttcttcccaagcatcacaactctcagagtctccggtatgttccgtagccctccctttgatatggaaccgaaggcagcccgcgctctggcattaatttgtaccaaggacggtcttttacctcaagggagcccactgtcaccctggatcaccaacgtaatatgcaaggggctagattacaaccttaagaggctggcctcaaaacataaatgttattactcccgctatgccgatgatctgttcttcagcacttcaaacggcctttttcctaccgccctcgctagaaaaagtgacactgagagcaatgttattatcggggaggaactcaagtccgagattttgagcgccggcttcctgcccaatgaagagaagacatcgctgaagcccatctctcagagacaggtggtcaccggtattgttgtgaattccaggacaaatgtccctcgggaatacatacgaaatctacgagcagcgttgtactcctgggataagtttggactagaggctgctgaggagcattggaggaacaaagtggacctgaagaaccgggtgggagagcaaccacgttttaggtgggtcgtccgcggccagattaacttcgtaaagcacgtgaaaggggaagcggatcccgtttatcttagtctcgccaagaaactgaagaagctggacgagaagtttacattcgatcccaaggtgagcgcgctgagcgtgaccgaagaggtgcagatctttgttgagggtatcacggataaaaagcacatcgagaaggccttcaggaacgcgcagggacagggactttatctcgacctgaacctgactttccccaaccaaagagaatacggttcgtctaatttgaagtcactgtgtgagacactctccgccaacgcacagcgttgccttacaatttgcatctttgatcgcgacgagcagccctatgtgaaaagtatgggaggatccagtggcgattatatggaccacaataacaacgtattctctctcatcattcctaggcctgagttccgggtcgaaccggacatctgtatagaacacctgtataaggactctgacctcttcaaacatgacttggccggccgaaggttatactctaagtctgaattcgataagcactcatgtcattgcgaggaccctaatatctttatacggaccccaccaaagagtttgatttgcgactccggggtcattaacatctctaccaaagcttcagttgccttgtccaaatttgacttcgctactaatatctacgatggggtgcctccatttgacagtatctcatttgaaggctttctgcctctctttacaaaaattcagcagatcaagaacctctttagaaagtga

SEQ ID NO: 7766 - RNA, 1677 nt, unidentified
  source 1..1677: mol_type = other RNA; note = synthetic construct
atggctatccccccaatcaacaacaatcaggatctggccaactacatcggcgtgaaaaagggggtaattgcttactatgcgtattacctggtgagttctaaggcctataccagctttgccataaagaaaagatccggaggagagcggactattgacgcaccgatccgcgggttgaaagagctgcagcgtaccattcttgataaactgtcccctgagacaaacttccgacattgcgtgtatggctatatccccggaaggggtattctccagaattccgcaatccacgtgaggcaaaaatgggtgctgcgggtcgacatcaaagatttctttccatcgatcacaaccgctagaatctcggggatgctgaaatcccccccattcaatatggcgcctaaagctgcccgcgccctagctctgatttctactaaagacggggtactgccccaaggctctcctctgtccccgtggataaccaatgtaatctgtaagggtttagactacaacttgaagcgtcttgcctccaaacataagtgctattactcacgctatgccgacgacctttttttcagcaccagcaattccttctttcccactgccttagcacgaagaggggacgccgaaaagaacgtcataatcggcgaggatcttgaactagagatcctgcgggcgggtttcttacctaatgaagagaagacaagtctgacacctattagccaacgccaggtgatcacgggagttatagttaacagtaggactaatgtccccagggaatttgtcaagaatgtgagggccgcactgtactcatgggaaaaatttggattgaaggcagctgaagagcactggagatcaaaggtggattctcgaaaccgggctggagatccgccacggttccgttgggtgctgagagggcaaatcaatttcatcaaacacgttaagggcgaggcagaccccgtgtacatatccctggcaaagaagcttaagaaactggacgataactttacgttcgacgccaaagcatccgcactatcagtgatcgaggaagtccagattttcgttgagggcattaccgataagaagcacatagaaaaagcctttattgatgcccagaaacagggcttgtactctgatctcaatctgacatttcctaaccagagggagtacggcagcagtaatcttaagagcctctgcgaaaccctctctgccaatgtgcagagatgtctcacgatatgcatttttgaccgagatgagcctgcttacgtgaagaacatgggcggcagttcaggggactatatggaccacaacaacaatgtcttctctttaatcatcccacgccccacttttcggtccgaaggtgatatctgtattgagcatctgtataaggacgccgatttgtttaagtatgacaccgccgggcgcaggttgtactcaaagagcgaattcgacaagcactcatgtcatatcaaagaccctctgatcttcattagaactccaccaaaaagtctcatttgcgatagcggagtaatcaacattagcacaaaagctagcgttgctctctctaaggcggatttcgctaccaatatttacgaagagattccaccctttaacaaggtcagtttcgagggtttcctccctctctttacaaaaattcaggagataaagcatctgttcaaaaagtga

SEQ ID NO: 7767 - RNA, 1680 nt, unidentified
  source 1..1680: mol_type = other RNA; note = synthetic construct
atggcaataccacccattgtaacactgcaggatttggcaaattacctaagcatcaaaaggggcaaactcgcttactatgcctactatataaagcctgccgacgcttataatactttcgcgattaagaaaaggtctgggaaggaccgctcgatagacgctcctatcaagggtctgaaggacattcagaaactagtctatgagaacttttctggagagatcgagtttcggaaatgtgctttcggatacatacctgggaggggaattctgcaaaactccgaacggcatgtccgacagcggtgggtcttgagagtggatttaaaagatttctttcccagtgtcaccgcggttagagtggctggcatgttctcctcccagcctttcaacctgagttacaaaactgctcgcgccctggctcttattgccaccaagcatggcactttgccccaggggtcgccactgagcccatggatcaccaacgtgatatgccgcggtttagattataatctccaaaagttggcctcacggtacaagtgctattacagtagatacgccgacgacctgtatttctccacctccaatagtctctttcccctggcacttgcacacaagtcagagaacgatagcaatgtcatcatcggagaagaactcaaggcagtgattctgaccgctggatttacgcctaatgaggagaaaaccagcctgcgtccgactagccagcggcaaatggtgacaggcattgttattaattccaagcccaatgtgccgaaagaattcattaagcagatccgtgctgctctctatgcatgggaaaatcacggcctggtagcagccgaggaacactgggcaaagaagagcgactttagaaataggtttgagaaggccaagcctagatttagatgggttctccgcggcaaaattaaccacctgcgacatatcaagggggaatctgacccagtgtttctgaagttggccaccagattaaagaagcttgacccaacgtatagcttcgacccaaaactcagcgcgcagtctatcacgcaagaggtgtgcctgttcgtggaaggcattactgatcgcaaacatatcgaaaccgcctttaaagacgcacagaacaggggattatacggtgacctaaaccttaagttcaacgagcctaaagagaatggctcctcaaacctgcagaaactgtgtcacaacttgtccgccacaccccaaaggtgtcttacaatttgcctgtttgatcgagacgagccatcttatatcaaatcaatgggcggttcaagttccgattacttggatcacaacaataacgtatacagcctaatcctcccctaccccaaattcagggccgagcccgatatatgcatcgagcatctctacgaagacaaagatctttttatgccagacagtaaggggcggcgtcttttctcacgagacgagttcgataagcactcttgtcacatcaaggaacctaacgtgtttattaaactccctgcgaagtccctgattgtcgacagcaacgttatcgatataagtacaaaggaatctatcgccctgtctaaaaatgattttgcctctcagatctatactgccacacccccgtttgacaatgtgagcttctcagggttcattccactgttcgataagatccaggagatcaaaaacctgttcatccgctga

SEQ ID NO: 7768 - RNA, 1677 nt, unidentified
  source 1..1677: mol_type = other RNA; note = synthetic construct
atggccctacctgcaatcaattctctgcaagacctggccaactttttgtcagtgaagcgtggtctgctggcctattacgcattttatgtctcacctggtgatgcctatagcaacttcagtataaagaaacggtcaggttctgatcgaagtattgatgcgcctgtcaagggattacgcgacatccaaaccatcatatacaagaagttctccggagagatcgaatttcggaaatgcgccttcggatacattcccggcagaggcatctttcagaacagcgagcgccacattcggcaacgctgggtgcttcgaattgacctgaaggatttcttcccctccattactgcggtgagagtagccggtatcttcagtgcgcagcccttcaatatttcgtataaggcagcccgaactttggcgctcatcgctaccaaaaacggcgtgctgcctcaaggcagccccctaagcccttggattagtaacgttgtgtgtagaggcctggattacaccctccagaaattggctagccgccataaatgttactatacaaggtatgctgatgatctgtacttttctacttctaattccgtattcccatcagctctggctcataggtccgagaaagaaagcattatagtgatcggggatgagctaaaagctgccatcattgccgctggcttcactcccaacgaggagaagacgtcgctcagacccgccagtcagcggcagatagtcaccggggtggtggtgaatagcaaacctaacgttcctaaagaattcgttaaaggaatccgggctgccctctacgcttgggaaaaacatggactcttaagcgcagaggaaaattggcagaaaaatgtggacgtgcggaataggtgggattcagcaaaccccaggtttagatgggtacttagggggaagattaatcacctgaggcacatcaagggagaagccgatccagtttatattaagctggccagcaggctgaagtctcttgacaatacttactctttcgacccgaagttatccgcactgtccattacacaggaggtttcagtcttttcagaagggattacagacaagaaacacctggaaatcgccttcaagcatgcacagagcaaagggctttacccggatctaaacctgaagttttatgtgccgaacgaggctggcagttcaaatctccagaagctgtgctatggcctttcttctacccctcagagatgcttgacaatatgtctgttcgatagagatgagtcccagtacataaaatctatgggcggatcgagcagtgactatctggaccataataacaatgtctattccctcatactcccacacccagccttccgcacagagccagacatctgcatagagcacctttacgaggacaagtacctctacatgcccgactccaaggggcgtcggttttatagcaaaaatgaattcgacaagcacaactgttacatcaaggagcagaacatctttatcaaagccacctccaagtctttgattatcgacagcaatgtcattgatatctccaagaagacctctatcgcattagcaaagaacgaatttgctagtctgatctacacaagcacgcccccatttgacaaaatctcctttgacgggtttctcccactgttcgacaaaattcgcgaaatcaagaacttgttcaaatga

SEQ ID NO: 7769 - RNA, 1695 nt, unidentified
  source 1..1695: mol_type = other RNA; note = synthetic construct
atggagatctcaagtgtgaaaaatttggatgatctggccaagtgtcttggacagtccaaaaaaaccctcgcctacttagcatatcatgctcccgtggataagaagtacaagacctttagcataagaaaacgttccggcgggaacagaacgatcacggcaccatgctcgaagctgaagagtatccagtatagcatctataatcagcttaatagcttctatcagcctaaaaaaagtgtgcacggatatgtaaaggacaagagcatcgttagcaatgcgagcatccacgtcggccaacgctggctgggtaaagtcgacgtcaaatcttatttcccttcaatcaccacaaagcgagtggtgggactcctgcgcaatgagccctttaacctgccaaacaagatcgccgctaccgtgggattgctggttacctataacggctacctaccactcggtagtccttgttcccccatcatttcaaacttaattacccgtcgcctggatgccaagttgtccgctctgtcacggggttataaatgctacttcaccagatacgccgatgacatatttttttccacaaaccgcaaggtcttccctcgggaacttattcaccacaacgaagatggcgtctctactatagggcataaattgaacgaagtgtttgaagaggagggtttcaccgtgaatactgacaaggttagcctgaaagacaagtcacaacggcaggtggtgaccgggatcgtcgtaaacgagcgaatgaatgttcctaaagaatacattcgggaactaagggcaatgctctattcttgggagaaacacggcttggaggcagccgagaaagactggctcaagaagtatgtgaacctgaatagaaacggacaggatatccccagccaaccgaggtacaggtggatggtgcgtgggaagctgaatcatatagccgctgttcgcggctctaacgatgaagtctatctcaagtacgcaaagaggctggctaggattgacaacacatttaagatcgatccaaaagccattactgcctccattgccagcgagattaaggtgcacattgagggaaaaactgacgccatccacatgagggctgctatgcacgctctccatggtgctggcaaatacacctctttaaagctgtctttcccaaatgaagacactgcgaagggagacggggagctgatcaaagcatgcaaagttatgagtagcagcaatcagacgcatctaactattttcctctttgattctgacgtggacaagacaactcgagagatgaaagggagtacacttgcctacaaggatcatggcaataatgtctactctgtggttatgcctaacccctcttttagaaatgacgaaaagatctgtatcgagcacctttacaccgacgaagacataatgaagaagacagaaaatgggctgcggatattcaagtccgacgagttcaataaaaagaacggactgcatattgaggagaaaggcattatacggctttaccccaacaactcaacattaattgtggattccaacgtcatcgacgtagagtccggcgagaacgtggcattgtcaaaagcgaagttcgcggaactgattgaatccaaaagagccccgttcgattcggtaagttttgacgggttcgagccactcctggatatctttgaaaagctgcacacagattacatcaaatga

SEQ ID NO: 7770 - RNA, 1392 nt, unidentified
  source 1..1392: mol_type = other RNA; note = synthetic construct
gacgcggccggaggtttgcgtgggagaagccaggaaatctcccgatggacaaggcatacctcaattgttcttctgttagaactcgagactactgagctttgtgaagtcttaggcattaagacgtcgtatctgaactacctcctctataagttgaatgagggggagagatacgagagctttgaaattaaaaagcgcggaggcggtgctcgaaggatagatgcccctattaagccattgaaagtaatccaacgcaaactaggtgacttgttgaaagagatttactctccaagaattggcgtgtacggatacgtggagggaaggggcatcaaagaaaacgctgaggttcacttagggtgcaacgaagtttgccgaatagatgtgaaagacttcttcccatctattcacatcgggagagtcattggactgttcaaaagcaagccttttcttttccccgagcctctgagcgtcctgctggcacaaatctgttgcaaagatggagctcttccccagggggcacccactagcccagtaatttctaatatgatctgctggctgatggataaggaactctaccggtatgcccgtattagcggatgtcgctatacacggtacgccgacgacatctttttttccaccgtaaggaaacggctgtcgcggcgaatttgtagtgtcgagcattctgaatttgatttttcaatcgcactgtccccggcggtgatcagtataattgagaaacatgggttcaagatcaatgtccataagacatatatggctgacaaatcccagaagcaggtgctcagcggtgtgatagtgaacgaaaagctaaacgtggaccgtgagttcgtcctcaagctcagggctatgctacactgttgggagatggaaggtctggagaaggccgagaaaaagtttcattctaaattcgccaggaattacattgttccacccctgtttatgcaggtggttaggtcaaaggtggagtacctgggctatatcaaaggttatgacgatcccgtatacctgaaatacgccgataagctttccagactgcacccgcactacacctataacaagaggaaggtcgtggcccatggcgggaatttgatcagagtgtataccgaaggccccacagataagatccacttcaatgctgccttagagtggtttcggggccggggcgaatatgctagtctcggggttgtgttcgagcacctccctgaggcaaacggcggagactcactgatgaaacacgcaaagactatcagtaccgaagcacgcgccgaccggaaggtgttctactctataaaaatgtgccagaagctgatacgcaagctgatccgctcccaggaaagaatcaccgattttcttctgacgacattcggctggccttga

SEQ ID NO: 7771 - RNA, 1698 nt, unidentified
  source 1..1698: mol_type = other RNA; note = synthetic construct
atggacgtgaatatccagaaatttctgaacatcgagtcaaaagctcagttaagcgcgtttttaggcatttccacagaaaagttaaactacttgctgttcaagctgccacatgaagagaagtacaattcattcgagattagcaaaaagactggcggaaaaagaatcattgatgctccgataaaaccgctcaagctgctgcaacgccagattgctactattttgttcgaggtttacaagccaaaaacaggcgtctatggctacgtgaagaatggtggcgtaaagaggaacgccgaggtgcacctcagaagtaaagtgctgttccgggctgatatcaagaacttcttcccatccatccacatcgggcgggtcatcggcttgttcagttccaaacccttctctttcccccgaaatattgccgtgctcctggcccaaatctgctgtaaggaagatgtgctgcctcaaggcagccccgcctctccaattatctcaaactttatttgtagggggctggaccgtgatctccttgagtacgccagatcggttagatgcaaatacagtcgatacgccgatgatatcttcataagcacctacaagaagtttatgcccggatctatctgcaaattggagcacgatgatggggtgggcttttgtaacataaacgatggactggaagacatattcgagacgcacggcttcagcctcaataagaacaagctatccgtggcatataagcataacaggcagatagctgcggggatcaagattaacgagaagctcaatgtagaccgcgagtatgtgctgaatttacgggccatgctccactcttggcggaaagacggttacgatgtagccgcagcaaaatataatgagctaaaacccaatccttcctatgcacgtgcgttcaaaaacgctgttcgatccaagctggagtaccttggatatgtcaaaggctatggtgaccctgtctatcttaaatacgccatgtggctaagccggcttgatgatgggtatacctttaacaagagaagctacgaaatggagaacaataagaagctcgtggtctacaccgagggcgttaccgaccagctgcatattcaggctgccaaaaattacttccgcgaaaagggggaatttatgcacctagactttcgtttcgatgataagtccgaagtcaacggagcacctgacctggagaaatacctgatccaggacagaaaggagcccaaccaagaattcaaggtttatctgttcgatgacgaccttaagaaagtcacaagcaaactcgacatcgccccaggtgaatcatctaggtggttcggaaataaaatttgggccgcattgacccctaaacctcagcatcgcaaggacgacgagttgttttgcatcgagatgtattactttgatgctgacctcgaaaggaaggactcttcaaataggcggatatacttgaactcggagtttgacgcaaaaggatttcacaacacagaaagcgtggtaaagactaagcccggttcaggactgatcgtggacaatgatgcttatagtatggtttccaaagaaaaggtgtctctgagtaagattgcattcgccgagaatatcctttataagaaacaggggtttgaagacgtgaactttgaagggtttcgcccactgtttgagctgcttcagaacatttacaatcaggcgtatctgcattga

SEQ ID NO: 7772 - RNA, 1845 nt, unidentified
  source 1..1845: mol_type = other RNA; note = synthetic construct
atgtccggagaggccgaccagagaggtatgtcaccaggcatgcaggccgcaatcgaccggctcaatctcatgggaaccaacacccaggaggctctgttcagcggctttgctcagttgacttccaaggcacaactgtgtcagtttctagggattaaaactgctaagctgaattttctgctgtacaagcttaagcccgcacataggtacaaaacagagactatcaagaaacgcaacggggacgatcgattgctccgggttcctgtaccgctgctaaagcaaattcagcgaatcatcgcctctgagctcgcaaaggagtatcgccctcgacaacacgtgtacgggtatgtgaaaggcaaaaatattgcacagaaggccagaatacacgtcgcccagaaatgggtagcccgcgtggatctgaaggacttttttcccagtgttaatttcggccgcgttctaggaatcttccggggccatccctttcatttcaacgatgagctggctacagtcctgacccaaattgtcatggacggcaacgaactgccacagggcgcaccaaccagtcccatcatctccaacctgatttgccgctcgctggacttcgaactgaagaggatggccaaggaacatcgctgcttttacacaagatatgcagacgacctagtcttttctacaagtcttaagcggttatctccgcagatctgttccccagcggcccctgatggtgtgtcaatacaggcgaatgtgggggacggactgaggacgctcattgcacgccaggggttcacaattaacgacgccaagacaagaatattcgatcgctcaagccggcagcaagtcaccgggctcacagtgaatgaaaaggttaacgtgtcgcgggagtacgttagaggattaagggctgtcttgcacgcttggttcaagtttggtgaggagagcgctgcctcatggttctttgccaatcactacaaaaggaacaggcctgattggaaaagcactccagcggatttcagagaagtgattcgaggccgattagccttcatccgttttgtaaagggggctgacgataccacttaccttgccctggctaagaagctcgcgaaactggacgacggcttccagctgggtgtggaagaacagattcaggtgaacagcccaaggcttatgttgtataccgagggagttaccgacaccattcacttacgtcacgccctccaacggttcaaggcagacggacagtattctgatctgaatatcgactgggccgaccatagcgatagacctcgtggcgaggggaaactgtggcaaaactgtctgaacgatgctaagcgcgacgaattcagacaccagacacaggtgtacgtctttgatagggactccgatttcgctaaaaaggccgaagataaatatggcaaactgaaacatcacgggaacaatacgtactctctcgttctccctatccccgagcataggcaaggccgggcacagatatgcatcgagcacttgtacgtggatgatttcctttggcagcaggacgtgcagggacgtagactgtttgctcgggaagagtttgagcacgacggcaatcatgtgggaaatgttgaggtgatgtataggcaccccaaagccactaccttgatcgtggatactgacgtagtcggttatggttccctcagaagcaaacccgtagtgatgtctaagaagcagttcgccgacgcagtggaactgggcgtgaaaccgtttgacgccccttccttggtcggattccaaggggtcttcgatatgcttcgggatttaacgaagaaccttaccggtgaagtgaaagccgatgctagtgcgtttgtctga

SEQ ID NO: 7773 - RNA, 1779 nt, unidentified
  source 1..1779: mol_type = other RNA; note = synthetic construct
atgtcaaataccactcaagcagccctttttaatgcattccccttcctgacatctaaggaacagctttgtcaatatttcggcgtgccaccgcggaaactgaatttcctgctatacaaattagcccccgctgacaggtataagacagtcgtgatcaagaagaggtcaggagctgatagacagcttcgcgtaccagtgcctctcctgaagcaaatacagaaaatcattgccgccgagttagcaaaagaataccggcccaggcagcatgtgtacggatatgttaaaggtaagaacatagcccagaaggctcgcattcacgtggcccagaagtgggtcgcgagaatcgatcttaaggactttttcccctctatcaactttgggcgggttcacggactctttaaaagccatccctttcagttcaatgatgaagtagcgacaatcctgacccagctggtcatggacggtaacgaacttcctcagggcgctcctacgagtccaattattagcaacttcatttgcaggagtctggacacggagctcaagcagatggctaaagagcaccgctgtttgtatacgagatatgctgatgatctggtgtttagtaccaatcttaaacggttgtctccccagatttgcagcccagcagcccccgacggagtttccatccaggcgaacgttggagaagggctgcgagctgttatacagcgccatggctttacagtcaacgatgttaaaacccggattttcgataacagtgcccgtcagcaggtgaccggcctcactgtcaatgagaaggtaaacgtgtcgagagaatacgtgcgaggcttgcgaatggtgctccacgtgtggcaaaagatcggcgaggcaagcgctagcgcttggttctttgaaaagcactataaacgcaatagacccggctggaaaagagctgaacctgactttagggagattgtgcgggggagattgaccttcgtgcgctttatcaagggtgcgaacgacactacatatctgaccctggccaaaaaactatcaaaactggacgatggctttcgcctgggcctcgatgaagagattcaactttcctctccaaggttgatggtgtatacagagggcgttactgatactatccacttaaggcacgcactccaacagttcaaggcacgaggagtatacaacgacctgaacatagattgggcagaccacgccgatagacctcggggtgagggcaaactatggcaaaattgcctctcagacgcaaagcgggatgaattccggcatcagaatcagatatacgtgttcgaccgcgatagcgactacgctaaaaaggccgaggatagctacggaaaggtcaagcaccatgggaacaatgtgtactctttggtcttgcccatccctgagcaccgtcgtggcaggaagcagatctgtattgagcacctctacgaggacgcctttttatggcagtccgacgcccagggaaggagactattcccgcgagaggactttgatcaggaagggcatcatacaaaagggctggaggtcatttatcgtcatccgaagagtgccactctgatcgtggacgccgatgtactggggtacgggccactgaagtctaaaccagtcgtcatgtccaagaagcagtttgccgacgccatcgaccaaggtgtcaagcctttcgacagcccttccctcgaaggtttcgaaggggtgttcaatatcctcagagagctgaccaactccctggcaggagaggttaggtccgatgtgatcgacctggtgtcatga

SEQ ID NO: 7774 - RNA, 1824 nt, unidentified
  source 1..1824: mol_type = other RNA; note = synthetic construct
atgtccagagaaacagagcagccagatcgcagggtcgccggattgtctgccaccattggtaggctgaaccggatgggaaccaccaatcagaccacgctcttcggctcattcttagaggtgggcagtaagcaggacctctgcgcttttctggggctgagcgaaagcaagctgaacttcttattgtataaactgaccagtgccgaacgatacaagactgaggtcattaagaaacggaacggatctccgaggaccctgcggatccccattgcaccactgaagaaaattcagaaggttattgcaggcgaattgagtaatctctaccggcctagacagcacgtctatggatacgtaaaaggaaagtcaatcatacagaatgcccaggtgcaccttgctcaaaggtgggtggcccggatcgaccttaaggactttttcccttctattaatttcgggcggacacatggcgtgttcaagggccacccctttcactttaatgacgaggtggccaccctcttggcccagatagcgacagaccagaacgaacttccccagggtgctcccacttccccaattatctccaatttcatctgtcgatcactcgacctcgaactgaagcagatggccaaagaacaccgctgtttttacaccagatatgcggacgatctgatattctcaactaaccttaaacgtcttagcccccagatctgcgttcctgcagcaccagaaggggtgagtgtacaagcgcatgtcggcgatgggctaagagccatcatcgagaagcaggggtttagtgtgaacgacataaaaacgcgtatctttgatcgctcaggacgccagcaggttactgggatcacagtaaacgagaagttaaatgtatccagagagtatattcgtggcctgcgatccgttctccacgtgtggagcaagcatggagagccccatgctgcagcctggtttttttctaatgagtaccaccgtaataggccaggttggcggcctgacccccctgattttagagaggtgattcgcggcaagctgggctttgtgaggtccgtcaaaggtgctgaagatacgacatatctcacactggcgcgcaaactcagcctgttggacgacaacttcaagctgtctcaggcagagcaacagcaagctgagtctcctaggctcatggtgtataccgagggggtgaccgatgctatgcatttgcggcatgctctacaccagtttaaggcagacggcctgttcactgacctgaacattgattgggccgatcacaccgatcgcgctactggcgaaggaaagctgtggcagacatgcctatcagatgcaaagagggaagagtttagacaccagacacaaatattcctgttcgaccgagatagcgatttcgctaaaaaggccgaaagtaaaccagggaagttgaaacaccacggaaacaatgtgtactcgttttgtcttcccgttccggctcatagggtggacaggacacaaatctgcatcgagcacctttaccatgatgagtttcttttccaaaaagacactcagggcagacgcttattcgccagagaggaattcgaacaagatggcaatcatgttcgacatgaggatgtcttttgtcggtactccaaagcgactctgatcgtggatagcaacgtctcggggatcgggagcctcagaggaaaaccggtggttctgtctaagaaacagttcgccgactatgtcgagcaagccgtggcccctttccaaagcccatccctggacggctttcagggtgtattcgaggtcctgcagcagttcgtgcacaaccagattcagggtgacgcatga

SEQ ID NO: 7775 - RNA, 1776 nt, unidentified
  source 1..1776: mol_type = other RNA; note = synthetic construct
atgggaacggacaatcagcagtcaatgttcaattcattcacatctctgaccagcaaggtgcaactgtgccagttcctcggaattaccacaactcggctcaattttctgctctatgggttgccatgcgaaagacgctataaaactcacgctatcaagaagcgcaacgggggagaaagacgcatccgcgaaccaatccctcctcttaagaagatccagaagattattgctggagagctcgcaaagcagtatcgccctaggcagcatgtctatggctacaccaaaaacaaaaacatcgtgcagaaagcccgtgtccacgtcgcccagaaatgggtagccagagtggatctgaaagacttttttcccagtgtgaactttgggcgggtgaagggacttttccggggccatccatttgattttaatcatgagatagccacactactggcacagttagtcatggacggaaacgagctcccacagggcgctccaacctctcctatcatcagcaacttcatttgtcggagtctggattatgagctcaaaaggatggctaaggcccatagatgcttttacactcggtacgcagacgacctggtgttcagcacatcacagaaacggctgtcccctcaggtgtgtagccctttggctgccgacgggataagtgtgcaggcagttgttggcgacggactgagggcagtggtagagagacaaggctttgtggtcaacgacgcgaagacaaggatcttttctaagtcgagcaggcagcaggtgactggcatcactgtgaatgagaaagtaaacgtatccagggagtacattcgtgggctccgtgctgttctgcacgcctggagaaaacacggcgaggaggctgccgcctcttggttctttgccaatcactacaaacgtaataggccccactggaaaagccagcccgccgatttccgcgaggtgattcgcggccgaatgacctttgttcgattcgtcaaggggggggatgacaccacctaccttacccttgcgaaaaagctggcgcaactggatgatggctttcagctcgacgcagctgaacagcttcaggcgatgtctcccaggttgatggtgtacacggaaggggtcacagatactatacacctgcggcacgctctctccagaatgaaaggagacggaaggtatgttgatttgaatgtggactgggctgatcactctgatcgaccccggggggaagggaagttatggcagaactgcgtgaatgatagtcggcgggaggaattcagacatcaaattcaggtttacctgttcgaccgcgactcagatttcgccaagaaggcagaggacaaatatggtaagctgaagcatcacggtaacaacgtgtactccctcgtattgcccattccggagcaccgacatggccgacaacaagtttgtatcgagcatctataccgggatgaatttctgtggcaaaaagatgcacaaggcaggcgcctgttcccaagagaagacttcgacctggatggtcatcatatcgggggtttggaagtcctataccgacaccccaaggccggaacgttaattgtggactccgatgtcgtcggctatggcggtttaagaggtaagcccgtggtgatgtcaaagaagcagttcgcagacgccgtcgacttgagggttgaaccttttcacgcgccgtcctttgctggcttcgaggccatattcgacacactgagcgaactgtcccgcagccttggaggtggccacagaccagaggccagtgatctgctttga

SEQ ID NO: 7776 - RNA, 1854 nt, unidentified
  source 1..1854: mol_type = other RNA; note = synthetic construct
atgggtactttaaatatcacctcccttctggatgaatcagtacagccccccctgatctctccatttctcctgctgagatctgtcgaagacctgtgttcattcctggatatcagccatagaagactcaactttctcctatatgtactcactcccggcgacaggtatagatcttacgaactgaagaagaagaaatcgtctgggactcggacaattaagtcacctattaagcctctgaaagaaatccagcggaggctcgccaatgagctgtctgcggtatacaagacacctctgaatgtgtacgggtatgtcaagcaccgcgacgtggtggataaggctaagcaacatgtgggacagaggtgggttgcccggattgacttggaaaacttctttggaaccttcaactttgggagggtccgtgggatgttcagagccaaacccttcaatttcccagactcacttgctacagtgctggcccagatttgcgttgacacgaacgaactaccacagggagccccgaccagcccgataataagtaatattctcttctggcgcctggatgcccgactgcgaagacttgcaagggagcaccgctgcgtatacactaggtatgctgacgacttagtcttttccaccaataagcgccatatgtcctcaggaatttgtaccgtgctggatgagctttccgagactcctacaatcagggtcggcgaaactcttcggaaggaaatcgagggagaggggtttaaggtaagcgacagtaagaccagactcttcggtcgcaccgcccggcaacaggttacaggactaactgtgaatgaaaaagtgaatctgggccgcgagtacgtgaaagaactccgggctattctgtacgcttgcagaaaatttggggtcgaagcagcaaaggagcgcttcatggccagccactatggcaaaaacgttcctcctggcaaggccgcaccagcattcgcagagataatccgaggccgcgttatgtacgtgggcagaatcaaaggctattcttccagagccttcttggctctcgccaggggaatgccaatcctcgatcccaacttccgggtgcctgaagaacacgctgcgcccagagcgtacctgtttacagagggggtgactgactatttgcatctggacgccgcccttaagcggttccgcaaagccggcgaattcgccgatgtgaccgttgagtgggacgatcatacgaaacgggagcaaatgggcgacaaacgtctcctgcagatctgcgatgacattgcaaaaggccctaagcaagaccggctctgtattttcgtttttgatcgtgacgtgccagatacgatcacaaaagccgaggcccctgacggcagcccgaagttacgaggtaacggagtcgtgtccatgtgcctaccggtgccaaagcaccgagatcagtcgagtcccatgtgtattgagcacttgtactccgacgagttcttataccagtatgatgctgacgggaggcggctgtttgcccgtgacgagtttttgccatcaggtttccacaagagtgaggattttcttagccggcagcccaaaaccagcttaatcgtggatagcgatgtcgtcctgagtgcaggagaacgaaggggcacctccgtggcgttgtctaaacgccagtttgcaatgttcgtgaacctgcagacggcaccatttagtgagccagaccttagcgggtttaggcctttctttgaagctctgagacaattgatggaggctcacgaggctatccaggcaatgcccgtcacaccccccgctaacgatcgtgggcagagggttcccccacctggaacaggtgcaggtgcgacccagatagaggcctga

SEQ ID NO: 7777 - RNA, 1824 nt, unidentified
  source 1..1824: mol_type = other RNA; note = synthetic construct
atgggaactcccaacttgaagtcactgaattttgaaccggagcaggccgcattaattcatcccttcttgctcctccggagtgtggacgcgctatgtcagcacctgggagtgtctaaacgcagactgtccttcctgctgtacgttctccccgccgcacagcgttatagaagctttgagctgaagaagaggaaaagcaaggctacccgtaccatcaaaaatcctgtgaaacctctcaaagagattcagcagcacctggcaaaggaccttttggacatttatagagctcctctaaacgtatacggctacgtaaaggaccgcgatatcgtggacaaagctgagaggcatgtggggcagcgttgggttgcaaggatcgatttagaaaacttcttcggcagcttcaattttgggagggtgcgcgggatgtttcgcgcgaagccattttatttcccagatgcccttgctacagttctggcacaactctgtgtcgactccaacgaactaccgcagggggcccctacttcacccgtgatctctaatattttaatgtggcgactggacgccaggctgcgaaggatggcgagggaacatcggtgcgtttacacacgttacgccgatgacttagtcttctcaaccaacacacgaagaatgtccagcggaatctgcaatgtgctcaacgccgattctgatgccccaattgtgcggccaggtgatgccctcttgaaggagatcagagacgagggcctggcggtgaatgactctaagacacgcctgtatggccggactgagcggcaacaggttactgggcttacggttaacgaaaaagtaaacctcgatcgcgattacgtcaaacaactccgggccgtgctgtatgcctgcagcaaagtcggagtcgaggcagctgctgagcgctttttcgcctcgcactatcccaagaacgtgcctcctgggaagagagtgccccaattcgctgacgtgattatggggagggtgatgtatgtgggtaggattaagggctattccagcggagcttttctcgctctggcatccagactgaagatcctggtccctgatttccgagtcccagagatgccagtcaccccgcgggtgtacatacacacggaaggcgctactgactatcttcacttgcacgccgccctgaaaaaactgcagtcgggcggtgagtttacagacctttcagttggctgggacgaccactccaagcgtgagcagcttggcgataagagactgctccaactgtgcgaagatactgcaaatggtcccagacaggaccgactgaacgtattcgtgttcgatcgcgatatcgcagacaccgtgaccaaggcagaaagggagggggagcctcgagtgaggggtaatggagtggtgagtctctgtcttcccgtcccagctcatagacccgcgagttctctcatgtgtatagagcatttgtacaccgacgaatttctgtaccaacaggacacggccggtcgccgcttgttcagtagagaggaatttcggccagacggctttcataacactgaggattacctataccggcagcccaaaacaacattgatagtcgattccgacgtgcttgttaccagcggcgaaaatcgaggaaaatccatcgccctgagtaagaaacagtttgcccggtacgtctcagaacaggtagagccctttgctgccccggatctgtctggattccggcctttcttcgagaggttaagacatattatagaggcacacgaatttctgcacgacgttccaaagcgcggcggggaaggaagcgatatctctcgggtagccgtcgataccccttga

SEQ ID NO: 7778 - RNA, 1629 nt, unidentified
  source 1..1629: mol_type = other RNA; note = synthetic construct
atggccaaagtggagctgcgcattcttacatggctggcttggggtttaaatgaacagaggaaatacaccactttctccatcgctcgcaggaatggtagcgtcagacagatcagtgcccccataaagcccctcaaggagtttcagcaggctctggcggaatctctgttggagggctatcgggcgccagctcacgttcacggattcacgaccggtcgtggaccccgaactaacgcagaggtccatgtcgataagttccacgtgttcagggcagacctcgcagacttcttcccgtctatcacctacaggcgtgttagggggctgttcagacgatggcctttcgagcatccggacgatctcgccaaagtcctggctaggttgtgttgtcaccaggacgcccttccacaaggggcccctacatcccccatcattagtaatttcatttgcagacggatggatcgcgagctggcacagttagcggccgcagaaaggtgccatttcagtagatacgccgatgatctcgttttcagtactaatcaacacctgtttccccccgccatcgggctagtggaggaaggaacggccgtggcaggggatagacttaagggaatagtgacaactaacggattctcaataaatgccgacaagacgactctgacacgcgaaacccagcgccaacgcgttaccgggatcgtggtgaatgagaagatcaacccccccagagaatatgtgcggagcctgcgttcactcctttacatatggaaaacatatggacaacctgccgcagaggccgctctggctaagcatgatcctccttctggcaaccggccaccgggcaaatccctccctagattcgaacaggtagtgagaggaagggtgcagtatgtcggctctctgaaggaatttagaaaccctacctactatcgattggcaaaacaactgtccgaagtagacgagggtttctcaccacctccgatgcctatcattgaggctaacctatacaccgaaggcccatctgattggaggcatgtcctcgccgcccagcgccattttaacgagttgggcgagtttaccgactttcacctcgtgaaaggcaaggaggctagccgagaaggtgaaagccagctgcggaagttcgctgagaggctgggggaacgcgaacagtcagagttcagtgtgtgtttatttgacagcgacgtaaaacccgctcttgaagcggtgggtccagatgggtggcggcgttacggacctcgagtagtggctgttggccttgccgtcccagcagccatggatcgccgggaacccctctttattgagaaactgtactccgaggaagtcctgaaaacaaagctggccaatggccggcgagtgtatctgggcactgagtttaacccaaagtctggccaccatttagaggaggactgctccattgtaggggaaggcaaggagtttattcagcagtccgttcacgcctttgatactcacagcgttatcagcctaacaaaagtggacttttcgaaggcggtgtatgacgacccagagcacttcggaaccgagatctttgaggggtttcggcccacctttgagcggattgatgaagcattgagagactcatgggaggtcttgcagtga

SEQ ID NO: 7779 - RNA, 1659 nt, unidentified
  source 1..1659: mol_type = other RNA; note = synthetic construct
atgctgacccaccagctgagagctaggcggcgtgaaaccatgagatgccctgcgcagtatcaagaacgacagaaaaggcatgatagagccgattactattttatgaccctgaactccgcttactccttctcttccctagctgccgtactcggcattactcctaagcagctcggctattacctgcacaaacgtccattggcgagccagtacaaacagttcaagatcccgaagaaaagtggggattatcgagtcatctctgcaccggccacaaacctcaagctgatccagaagtccattgccaagcagctgaacgagatcagattatttaagccttgtgtcaatggcttcgtgccgaagagaaacatcaggaggaacgcatctatgcatgtgggacggcgatttattctcaacattgacctagaggactttttcggctcaatcaccttcgcacgcgtctacggtatgctgcaaaaagagccatattttctagcacagccagttgccgcagcaatagctaaagcgtgcacattggatggagtgcttccccagggagctcctagcagcccagtgattactaacctgatttgtgccaagatggacgccgaattaacaaggttcgccgaatcgaatcgttgtaaatatagtcgctacgccgacgatataactttcagcaccactcggcccactatgccctttgcctcagctcttaaagacgccgagggaacgactgtatacgagctcaatccaaccctgagagacatcatcgagacgaatggttttaagatcaacgaaaagaaagtccgcctgcgcgacgctactgctcggcaagaggtgaccgggctcatagtaaataaacgcgtgaacgtgaagcggcgggcagttcgcgagattagggcaatgcttcacgcatggagaacatttggcttgcccgccgccgctactatgggaaaggacaaatacgggcttaaaggcaactttgaagcagtcctccgggggaagatcgagttcgttggtcacattcgaggacggcctgaccccctttttagaaagctggccgaccagtttaattccctgcccgtggctgggcgaatcagaacggtgctgacacctgaagagattgcacgtaatgcgacctggataatcgagtcggatggtgacgtgcaagggacagccttctttgtggacggggtaggcttggtcagttgcagtcactgtgttgggcccaatgcctatatcttgcatcccacagaccctacaaagaagcaccgcgttaaaatcattaaggaggatagccaccgggatattgcgatcctggagtgccctaatggtttcagcgtaccaggcttccagctgcatgctgcctctatagtcaaagatggcaccgagattgtgctcctgggttatcccaatcatagggctggaagcaccatacgcgtggaggccggaaaattgctgaggaggatagtcagttctgccgttgagcactacgaaattaccccaaagattatcgggggaaactccggcgggccaattgttaatagcgattacgaagtggtgggcatcgctgtgaggggcctttcaggcaaggccaagttctctgatgtggaattcatcggcatcaactcctcagaactgaaactcgtcttatcaggaaagtga

SEQ ID NO: 7780 - RNA, 1554 nt, unidentified
  source 1..1554: mol_type = other RNA; note = synthetic construct
atgccactcaataagatccacaatctgacaggcctggcctacttattggggtgcagagctcaacagttaggatattatatctacaagcgccccttgatcacacaatatcgtacattcgaaatccccaaacggcgggggggtacgagaaccatagcagccccgagtacaaatcttaaaattatacagcgcaacctggctaaggagctagatgcactgttcacctttaagtcctgtgtcaacggctttgtgaccgatcgtgacatcaagaggaatgctacaactcacgtgggagaacgcttcgtcctgaatattgacctcgaaaacttttttgggtcgatcaactatggcagggttttcggtttgctgtcaaagcccccacactccttaaatcgcactgttgccgccgccatcgcaaaagcctgcacactgaacgatgccctgccacagggagctccaacgtcacctgtgattagcaacctaatttgcgccaaaatggatagcgaactgctcaggtttgccgctgccaataggtgcaagtacactcgatatgctgacgaccttaccttttccaccaaccggacgagtatgcctttcgccacagccagcaaggccgccgacggaaagacctattgtgagatcaatgcctcacttagaaccatcattgagagtaacggctttcagataaacactaacaagctgagactgcgggataatacagctcggcaggaagttaccggactcattgtcaatgaacgggtgaatgtgaagcgacgcttcattcgtgagactagggccatgctccacgcatggcgcaagttcggactgcttgctgcggccgctgagcataaaaacaagttcggcggtggtactgcgtttgaatcgattgttcgagggaaaatagaattcatcggccagattagagggcggcctgacttggtgttcaggaggctggctgttcaattcaacgccctcaccacttctggcaaaattagaacagctctgagccctgaggaaattgtaaagcaggcaacgtgggtcatcgagcattccggtgatgggcagggcaccgctttctttatcgagaagtacggcctgatcacctgtgcgcactgcctcggatctaacccatacatttatcatcccgagaaccctgcaaagaaaatcgcagtcactgtactctctcaagataatcatagggaccttgcagcactcgagatccctgcggagctgaaaaccatctcaccgattcctttgtacaaggggcccccactaaaagacggcgcatccataaccctgtgtgggtaccccaaccacttcctggcgaaacccattagaatcgagcagggcaagctcatccgaacatttcccaaaagcgcagtgtcttacctggaggtcaccccgaaaatcataggtggaaatagtgggggcccattagtaactgaagacttttctgtggcaggggtggctgtgttgggccttagcggaagcgtgacactgtcccaggccgagtttttcgccgtcaatatagccgaattggtggcttggcttaaatga

SEQ ID NO: 7781 - RNA, 1560 nt, unidentified
  source 1..1560: mol_type = other RNA; note = synthetic construct
atggacctatccaaagcctatgacctgacgtcgctggcgatcttgctcgactgtagcgccaaacagttgggctactacgtgtataagagggatctggctacacaatacaagcagttccagatcaagaaacggagtggcggagcaagaattattaaggcacctgccacaaatctcaaaattatccagcgctccatcgtgagggaactggaacggttagtgaggttcaaaccgtgtgtgaccggcttcgttaagggaagagatattaaaagaaacgcagtgctgcacgtggggcagcgacatgtactaaacgtcgatctgcaggacttcttcaatactatcaactatggcagagtgtatgggctgctgaccaagaaaccttacggcatagcccccaaggttgctgcagctatcgccaaagcttgcactctagacaacgcactaccgcagggagctcctactagtccaatactgagcaatttgatctgcgcaaagatggatgctgaactttcccggtatgccctcgctaacaaatgcatttacactagatacgcggatgacctgacctttagcacgaatcggcagttcatgccaatggcggctctgaaccttaattctgacggaaccccaatcaccgaattggcacgaccccttcgtgagatcatagaggccaatggattcgtaatcaatgagaggaaggtgcggttatctactcgcggacgcaggcaagtcgttacgggcctggtcgtaaacgagagagttaacgtacgtagatccgcaattcgggaagcgcgcgcattgttacacgcgtggcgaaaattcgggctcgtgaaagcctcatcagtcttcaacgagaagtttggaggggctgggagagattttgaggccgtcgtgcgaggtaagattggcttcatcggacaaatccgggggcgcccagacgagtcatttaagaaactcgccctcgagttcaataagcttactgcaaacgggaagatcaggacagcccttagtcgtagcgagatcgctgcccaggctatctgggtgatcgaacatgacggtgattcgcaaggcacagccttttttctggacggtgtgggcattgtcacctgtgctcactgcctgggcgagaacccttttatataccatccctctgaccacaccaagcgctttaagctcaaggtcagggccgaagataagcaccgcgatctcgctatactgtacgttcccgtggaactggaaaacgttgtccccctgtctgcctacaagggcgtcgccctcgcaaacggagctgacgtttcactgtggggttatccaaatcatttcgccgccacacctattaggatggaacgaggaaagctcatacggtcctttgtgaaatctgcagtctcctacttagagattagccctaaaatcattgggggtaatagcgggggacccgtgctgaatgatggctatcaggtgattgggatcgccgccgtagggttcggtggctctacaaagtttaccggtgtggagtttatggccgtgaatggcattgagctgagtgcgttgcttagcaaatga

SEQ ID NO: 7782 - RNA, 1605 nt, unidentified
  source 1..1605: mol_type = other RNA; note = synthetic construct
atgcgcgtcaatagtaaacaggacctggcctgtgcaataggaattcccctggagctgttagagaggcgcgcttttggaataccccagcacattctatacagtcggcatgagtatcctaagagggacgggagtaccagactcatctattctccacactggcccctgcggcatattcagagccggctggccaacctgctagatgaaatctatgagccttcctcaagagttagcggcttcgtgaagggaagggggattagatataacgcgtctctccatgttggcaagcgcttgctgctgaacttcgatctgagtgatttctttcctacaatccattttgggcgcattcgcggtaggcttcgtgctcggccttatcagttaaatgccgttatcgctacaaccatcgccagattgtgtactcttgacggaaatctgcccataggcgcaccctcttcaccagtccttgctaacatcatctgctcccacttagacggtctactgacgaggctggctcgagagcacgggtgcttttactcccgctatgcagatgatattaccttctccaccaataggagatcatttcctaactctctggctacagtggaccacgagaatggtttagccgcggtaggcgccctgatctctgctgctgtgaccgaggcaggatttatcgtgaatcccaggaagacgaggatcctggacaaatcaagccggcaggaggtgagcggagtcgtgattaatcagttcttgaatgtgccacgtagctttatgcgagaaattaggggcgctctcaacgcctgggagaaacacggacacattgcgtctgagcaatacttcaaggaaaaatacaattggcgatccagccaatcatttgagaaccacctgagagggcgaatacagcacgtcattcatatccgtggcagcgacgatcttgtggtctggcgcctcgttaaccgtttcaataatcttccggatcgggcccattcttcgatctcctatgatcggccgaaggacgagcgggatagactgagcctcgctgtgtgcagggtcgaatccggtaacgacgagcttatggaatacaaccagggttcaggaataaagcttcccaacggcaacgtcttgaccaacttccataacatcgaaatctgcgggactgtcgcccctataatcgagatttacttgactgataacgcaccagttcccgtaccaatgcgggtactcaagcatgacttcgcaaaagacgttgcaatcctggagcctatcgaccctgaatggaaaatgccaatcgccgcagcctcagccgaactctcgttctccgaatgtaaggtgggtgacgacgtgaaagtgggcggcttcccgagttaccagttgggcgactcctgtcaaattgcaactggggaggtgcgcgccttttccaaaattgaaggaatcacatacttccgagtgtctgtccccattgtaaagggcaatagcggcgggccagtgtttaatattgatgggcaggtggtggggattgcgagtagaggcatagatacacacgagatcactaacgccgcctttaatggatgcctcgaactcttcagatttgaaaagttcctgcaaagctga

SEQ ID NO: 7783 - RNA, 1221 nt, unidentified
  source 1..1221: mol_type = other RNA; note = synthetic construct
atgaagttccccccgacctcccctatcctctctaatctgattgtcatgaaaatggacgggcaattaagcaaactcgctaaagataatctctgcttctacacaaggtactgcgatgacatatacttttctaccaatcgaaagaagttcccccaaaatatagcttttttcgatcattcctctgataacagattttgccaaattggtggcgacctggagaagatcatcaaatctaacgacttcattatcaacgagaagaaggtgtatttgagtgataaatcaaacaggcagtttgtgacagggcttgtggtgaatgagaaaattaacgtaaaccgcaagtttatcaagaacatcagacctattctgaaaaaactgcagaaggatgagaacttcaagaaagagtatttcgagaagtttaacaagaacatcctgagccagctgcgagggaaaattgagtttattggcaacattaggggttacgatgatcccgtttatagaaaatatgccctggccttgtccaagttggatcctagctacatcttcaacaagagaaatctatccttcggcgatggacagcttgtcgagatttattgtgagggcattacagactacctgtttctgaaggagtacttgcgcctatttaaaaataggggaatgtttacggacttggaaatacggtttcgggaggactccaactttactggcggtgacacccagctgctggacgcatataagaagattcagcagatgaatagtagcctgaataaccatctcactatctttatcttcgacaaagacaaccaaaacatcatcaagtacttcgaaaatctggaaaacgaactcgatggcctaaaacacctgtttctgccatgtccagatggatactcaaatagcgagtactgtattgagcacctgttcaaattcgaggacatcctgaaggttatagacaacgaaaatcggcggatctacctcaagtcagaatttaacagtaaggggttccacgaagaagagaatcttatatacatgcgtatgaaccagaaaactcttgtcgcggacgacgaagtgctctgccttcgcacccagaaaaatgtggccctttcaaaagccaatttcgcagatttagctacgggaaagtatttaacactgctcgacctcagcaatttcgaaaagctcttcttggaaatcacctatctgaagaatgagttctataagtcgccacagtga

SEQ ID NO: 7784 - RNA, 1536 nt, unidentified
  source 1..1536: mol_type = other RNA; note = synthetic construct
atgcctaaaaaggatgggggcatccgccaattgtatgttcccaaccagctgattaaaaagattcagaagcagatcttcgatgatctgcagccaatatactcgccaagagcatgtgcatttgcctatgttaagggccgaaatatcaaagagcacgccaagaaacatgtcaataagcggtggattcttcgcgtcgacctgcaagatttttttcctaacatccattttgggagggttagaggcatattcaagttactggggtgtaacgaagaaatatccacctacctggctcagctgtgctgctacgagggtaaattaccccaaggaacatctacgtcgcctctaatcagtaatattctcgcatccaaaatggataggcagttgtccgagatggctaaacagaatcagtgcttttacactcgttattgcgatgacctgtacttctcaaccaatcggaaattgttccctcagaacttagcctttttcgacaacagctctgggaacagattctgtcagcttggtgaagacctcaagaacattattgactctaacgacttcattgtcaatgagaagaaagtgtacctttccgataagagtaatagacaattcgtgaccggactcatcgtaaatgagaagctcaacatcaataggaaatttgtgcgttctctaaggcccgacttgaagaagctaaaggacaacccgaactacaagaatgaatacttcgagaagtacaacaaaaacctgctggccaaaatacggggcaagatcgaatttatcggctacatccgcggatatgaagatactttataccgaaagtatgccctggagctgagcaaactggattccagctacattttcaacaagaggaatcttagcttcggggatggaaatttagtggagatctactgtgaaggcgtaacagactatcttctactcaaggagttccttaagtttttcaagagtaatgggatgttcacagacttggagattaaattccgggaggattctaatttcactggaggtgactctcagctgctggatgcctacaaaaagatccagcaaatgaatagcaacctcaatagtcacctgacaattttcatctttgacaaggacaatcagatcatcgtgaagtactttgaagctctgaagaatgagctgaaaggcctgaaatatctctttcttccctgtccaataggctatgaaaagaaagagtattgcatcgaacatctctttaagttcgacgatatattgaaggtggtggacgaagaaaaccgccggatatatctcaaggacgagttcaatgcaaaaggatttcacaacaatggtgagtgcatttatatgagaatcaaccagaaaacccttattgcggatgacgaggtcctctcactgagcaatcagaacaacattgcgctgtcaaaatccaaattcgctgaactggccacgggcaaatatttgaaggagctcgatctgagcaactttgagaaactctttatcgaaattaccaacctgaagaacgagttttacactctgtcacactga

SEQ ID NO: 7785 - RNA, 1590 nt, unidentified
  source 1..1590: mol_type = other RNA; note = synthetic construct
atgaaacggattaagaatctcacagccttcgagagacaagcactcacagaaaaagacatatgttcttacctgggcgtttacgattctgaagtgaataagatcattcggctgcctactaagtacaaatacaaagtgttcaccatccctaagaagaacggcgcccaacgaaccattcaggcccccacgtaccgcctgaaagagatccagaagcgcatcagtatcctgctgtgcgacttgtatccccccaagaagtctgcgtccgcttttattaagaaacggggcatttgctacaacgccaacttccacataaacaacaacctcattctgaatatcgacctggagaacttttttcccagcattcattttggacgcatattcggtttgctgaagtccacgccttataacctcagctttatcgtatccaagatcatagctaatctctgttgtgtagacgggagactgccacagggagcgcccagttcaccggttattgctaatatgatttgcggtaaactcgacgcccagctgtacaaaatcgcaagagagaatcagtgcctttacacaagatactgcgacgacatcactttcagtaccaagcagaactcttttcgaggaattgccacgatacacgatgatgaattcgcgttggtccaactgtccgataagctggaagatatcatcgaagacaatggcttctatgtgaacaaggataaggtgcatttcgcctccaagaagagcaggcaatcgatcactggcatcgtggtgaatgaaaaaatgaacgtccgccgtacatatgtcaggaatctgcgtagcgctatttacaaaatggagaaagatatcgacgcagccgaatccgagtatatcgcaaagtacaagaagagtatgaattatgcttcctcatcttcgatttttgaccatatctcagggaaactgtcttatctcaagatgattaagggggacaaagataaaacctacaagttgcttaaacacaggttcgatctactactgggcaaacagagcttcttttttagcactcaaagggaacagctcaccgccgcgatatgggccattgaggacaaaaacaccatagagactggtactggctttatgttaaagggcgtcggcatcataacatgcgcacatgtcattcgagataacccttgtgctattttagacaccaggccaggcgctccccttcgcaagatcgacatggaaattattaagagagacgaggcactggatatagccattctgaggccactaggagtggacatcagaaagtattatgctctggagaaatcagacgccgagttccacaatacaccagagcagttgatcttggccggatatccggggtatcggttaggacacacccttagcatcaaagagacatactgtatttctcaccgggtggagcacgccatccagctgatcgaactctccgatcagatccataaggggaattcaggtggccctgttctggatagcgagcttaaagtggtggggatagcagcaaaaggaggggaaccagggcagcaggatctcgctatccacattggtatgcttagcagtttagttatccggggatga

SEQ ID NO: 7786 - RNA, 1674 nt, unidentified
  source 1..1674: mol_type = other RNA; note = synthetic construct
atgagcttgaaaccatttgcgaatctgcggcagatcgccttcgccttgcgaaggaattatcgaaaacgtttcgtgtacattgcgtacggactggcgccgggcgctagatacaaggagttcaccatccctaaaaagagcgggggaacaagacggatctgtgctcctcgtatcgcactgctgggacttcagagggacatcttaaggctcctggagtcagattatcgcccgcgggcacacgtccacggttttgtcggggggcaccaacgctctatcgtctcaaatgccagacagcatgtgggaaagaggtgggtgctgaacatcgatctggaagactactttgagacaattcattttggacgcatacgcggccgattaatggctcccccatacgactaccctgaagagatagcccaatttatcgctcacatagcctgtttccagactgaaaaagaagtggagggctctctgaggactacccatgtgcttatgccgggcgcagccctaagccccattttggccaacatcgtgagtgacaagctcgacgccgaattagccagattttgccgccagttgggatgcacgtacactaggtatgctgacgacattaccatctctagtaaccgaagaacatttcccgctccaatcggccggttcgctaaccctgacagtcacgacgattttatcctcagcgacactttccagcagatgatcgaagataatggcttccgtataaaccatgcgaagacgcgactcctgggagccgcctttcagcaggaggttacaggcctagtggtcaacgagaaagtgaacgtgaagcggaagtttgtacgcgacgtgcgggccatgttgcacgattgggagtttaacggttatgctgcagcttccgccagacactttaacgataaaagaccagataggggcaggctccccgagcaagaggctactaacttcgagtgggtgcttcgcggtaagattgagttcataaggcaagtgaaagggtccactgaccaggtatttcgcggcctggctgcaagattcaatgccctcagttcaggcgggcagttcagtattcccttagttgaagatagcgaggtgctcaacgcagccgtgtggtatctggaaaatgacacagacgggggttccgttggtacatgcttcgcagtagccgagaatttgttcgcgacctgtgcccattgcctgggaccaaatcttaggatttttccccggcaatctcccgccttcgccatggaggccgatgaggtcgcgcgtgatgaacacaatgatctggctctgattagactgaggaccccaatgccagccttcaatcctgccgccactctgcagatggcttccactgcagaggccggtgcacttggcattcggtcagctgttcaggcagctgggtacccttccaatctcgacagcacctctctgaccatcagagatacagaagtcacagggtttagccggcagaccttcgacggcacccctgctacgtcggataacgtaatcgcacttctgtcagggacatatgaaggaatgtccggtggccccgtcctattttctgggaaggtggtcggagttattgttcgaggccccaacgacgatgaccggaccattcctttcctcgcagtgcgctccgaattcgtcgatgcactgctcgcaaccctttga

SEQ ID NO: 7787 - RNA, 1605 nt, unidentified
  source 1..1605: mol_type = other RNA; note = synthetic construct
atgacttatatcgcttacggattagccgtgggggcgcgttataaggagtttaatatccccaagaagaacggggggactcgcaggatttgtgctccacgaatcgccctattggaactgcagcgagacatcctgcgactgctggagggtgattacaagccgagagctcccgtgcatggttttgtggggggacacaagcggtccattgtcagcaatgctcagcagcacgtggggaaacgctgggttcttaacattgatctggaggactactttgagtccattcattttggaagggtccggggcagactcatggccccaccatatgactattctgaagaaatcgcccagtttgttgcccacatcggctgctttcagacggaaaaggaggtggacgggaacgtccggaccacacacgtgctaatgcccgggggagctctctcacctcttctggccaacatcgtatctgataaacttgatgcagaactgtccaggttctgtagacagctgggttgtacatacacgcgctatgcagacgatattagtatcagtagtaacagaaggacgtttcccgcatccattggccggtttgccaatcctgacagccaaaaggagttcgtgctctctgatacattccaacaaatgattgaggacaatgggtttagaataaaccactccaagactcggctcctcggccatgcgtttcagcaggaggtcactggtctggtggttaacgaaagcgtgaatgtgaagcgcaagttcgtcagagacgtccgagctatgctgcatgactggaaactaaacgggtgcgaggtggccagcgcaagacacttcaataagaaaaggcctgatagggggagactccccgagcaggaagctaccaatttcgaatgggtggtccggggcaaaatagaattcatacgtcaggtcaaaggatctaccgatcaagtcttcagaggactcgccgcgcgcttcaacgagttgtgtttaggccgcaggttctcaatccctcttgtggaggacactgaagttctggatgcgaccgtgtggtacttggaaaacgacacagatgccggttctgttggcacctgcttcgcaatttctgagaacttgtttgtcacctgcgcccattgtctgggaccaaatctgcgagtgttcccccggaaaaatcccgaattccagatggaggccgaagaggtagctagagatgatcatcacgacctggccttgattcggattagggaacctttaccagcttacaatccagcaaccgttctgcgtatcgcgtcaaccgccgatgccagcgagcttggaatccgctcagcagtgcaaatagccggctacccctccaatctcgataataactcgctgacaatccgggcaaccgaggtaacaggcttcagcaggcagacctttgactcaactcctaccatgagtgacaacgtcgtggagctgttgagcggcacatttgagggcatgagcggcggacctgtgctgttcagtggtaaagtggtaggagttatcgtgcgcggcccaaacaaacacgaccgtactgagccgtgcctggctgtaaggtccgaattcgttgacgctcttctcgcaacactttga

SEQ ID NO: 7788 - RNA, 1686 nt, unidentified
  source 1..1686: mol_type = other RNA; note = synthetic construct
atgagtctgaggaggtttgctaatcttcgccaggttgcctttcacttgcaccgggactacaggagaagaatgttccatattgcatatggcctgcctgctggcgcacgatatcgggagtttaccattcccaagcggtcaggtggtacacggcgcatctgtgcccccagaaaagcgctcctcaacctacagcgggatatgctgcggctgattgaaccagattaccagcctagggcccacgtccatgggtttgtgagtgggcgccagcgctctatcgtgagtaacgccaggcagcacgtggggaagagatgggtgctcaacattgatctggaagacttcttcgaaacaatccatttcggcagggtgcgcggaagactagtggcaccgccttacaactatcccgaggagatcgcacagttcgtggcccacattgcctgctttgagactgagaaagaggtgaatggaaccaggcgcaccacttccgtgttaatgcccgggggtgcgctgtccccattattggctaacgtcgtcaccgataaactcgacgccgagttagcccgattctgcaggcagctcgggtgcacttacacgagatatgctgatgacgttaccataagctccaatcgacgcacatttccggcccctataggccgctttgcagacccagagtcttttctcgagtttactctgagcgacagctttcaacaaattgtagaggacaatggcttccgtatcaatcacgataaaaccaggctcttgggccaagctttccaacaggatgtgacgggcctggtggtaaacgagaaggtcaatgttaagagaaaattcgtgagggaagtccgagcgatgttgcatgactgggagtttaatgggcttgcccaagcatcagcccgccacttcgacgagaaacggccaaacaggggtagactccccgaacaggaggcatctaatttcgagtgggtggtgagaggcaagatcgaatttatccgtcaggtcaaggggagtactgatcaggtttttcgtgccttagccgctcggtataatgaccaatgctccggccaggaattccacatccctctggtggaagatcaggacgtcctgaacgctgccgtctgttacttggaaaatgatgcagacggtggagcagtaggcacctgtttcgccatagaggatgatctgtacgtgacctgcgcccactgtctgggaccgaatctgcgagtgtatccacggcagaaccccgccttcccacttgaggccgatgtggttgcgcaggatgaccataacgaccttgccctgatcaggattagaactcccctcccagcttttcgccctgctgctttcctccagcttgctgaggcaaccgaagctgccagtgtagacatcagatccgctgtgcagaccgctggctacccatccaatctgcattctgcatcgctgacaatgaacagcacagaagttacgggcttttcccgacagagcttcgatggaactccccctacatctgacaacgtcatctcacttctaagcggaaccttcgaaggtatgtctggcggacctgtgttgcatgaggggaaggtcgtgggagtcatagttcgtggacccaacgaagacgaccggacaattccttttctggcaactcgggtatcattcctggaaacactgagagccggggttagcagcgcgtcatga

SEQ ID NO: 7789 - RNA, 1674 nt, unidentified
  source 1..1674: mol_type = other RNA; note = synthetic construct
atgtctctgaagaagttcaagaacctgagacaggtggctaatgccctagggcgggactacaggaaacaggttttgaacattgcatacggcttgccccctaaggagagacacactgagtttgcgatacctaaaaaaggggggggtactcggaggatttgcgctccacgcgctgccttgctgggcttacagcatgattgcctggaccttctgcagatggattaccgacccaaagctcaggtccacggatttgtgtccggcagaggcagatctatagtaagcaacgcacggcagcacgtcggcaaacgctgggtcctgaacattgatctggaggactatttcgagagcatccacttcggacgcgtaaggggaaggctgctggcctctccgtataattacagttctgaaatcgcacagttcgtggcccatattgcatgttttcagacaacaaaggagttcgacggggtccatcgtttcaatagtgtcctcatgccaggcggcgccttatctccactcctcgccaatatcgttagtgacaggctggatgcggaaatcggtcggctgtgtcgtcggttgggctgcacgtacaccagatacgcagacgacatcagcatctcgacggaccgacgaactttccccgcacccattgggaggtgttccgatcccgagaggctgcgggactttactctgtcggacggctttcaagagatcatcgagaataacggatttcgcgtgaacaattcaaagacgagaatgctcggacgggagttccgtcaagaggtgaccggcctggttgtgaatgacaaagtgaatgttaagcgcactttcgttcgtgaagttagggccatgctgcacgattgggaatttaacggctatgatgttgctgccgatagacattttaacgaaaagcgccccgatcgcggcagattaccagcttatgaggctaccaacttcgagtgggtggtgagagggaagatagagtttattcgccaggtgaagggggctgcagaccaagtcttccgagcgttggcagccaggttcaaccagctcacaagcgggcaggcttttgtcatccccctcgtggaggatagagaagtgctggacgccgcggtgtggtatttggaaaatgatgtggacgccggatcagtcggaacctgcttcgcagtaggtgaaaacctgtttgtgacatgtgcccactgccttggccctggattacgggtattctcccgcagatctcccaatttcagtctaaatgccatagaaatcgccagggatgagaaaaacgatctagcgctcattagggtggaatcactgccaagcggccttaagccagaagccatcctgcggctggccacacttgctgagtgcggtaatgtgccaactggtgccgctgtgcaagccgcaggttatccttgtaatttgcatccggactccctgacagtgacccctgctcaggttgccgggtttagccgacagacctttgatggttcacagcacaccgaagataactgcattggcctcctttccggaacatacgccggaatgagcggagggcctattcttcacgaggggaaagtcgtgggagtcatcgtccgaggccctaacgactccgaccggaccctacaatgtctcgcagtacggtccatgtacctcgaacgccttctccaggggctgtga

SEQ ID NO: 7790 - RNA, 1665 nt, unidentified
  source 1..1665: mol_type = other RNA; note = synthetic construct
atgacgctgaaatcagtgcctgatctgaggtttctggctgctgctctggggagaaacctgaaaagaaggctgacctacattgcctacaaacttccttcaagtagcaagtttagggaattcactatccctaaacgctcgggagggactcggaacatccaggcccctaaggtcgccctgctgaacctccaaaagagcattaagcccctcattgaaaaggattacagaccaagggtgaatgtgcacggattcgtcgccggccagggacgatccatcgtatcaaatgccgaaaagcacgtgctgaagaagtgggtgttgaacatcgacctcgaaaactattttggtagcattcatttcggacgcatcgctgggcggctccagagcaagccatataactatgctccggaaatcgcccggttcgtcgcacatatagcttgctatcccacacagactgtcatagcaggccagatccaggacagttctgtgctcatgaccggtggggcaattagcccattgcttgccaatattgtgaccgataagttagattccgaaatagcacgtttctgcagtcagctcggttgtacctatacccgctacgcggacgacattaccatctcctctaaccggaataagtttcctggaaaaatagcgcgatttgaggatccagatgaccagaagtccgtggtcctgtccgaggagttcctagacttgatcgagggcaacggcttcgctgttaaccatgccaaaacacggctgctgtcccggatattctctcaagaggtaactgggttgattgtgaataagaaagtgaacgtgccccgcactttcatcagacaagtgcgtagtatgctccacgactgggaagctaacggatacgccgcggcacaagagaatcacttcaccaaatacagacccaaccgcggcaggttacctgcatatgaagccaaggattttcagtgggtggtgagagggaaaatcgagtttatcaagcaggtcaagggggcaaccgatcaagtttttcagacactggccaggaagtacaatagtctgacctctggaaagaagattgccatcccgatcgtcgagacgaatcgaatcatcgaagaggccgtttggtacctgcacacagagaaagacattatctccacggggacttgttttgccgtggagggcggggctttcatcacgtgcgctcattgtataggtcccaatatgactgtgtttcctaaagccgcgcccaagttccctgtggctacagcagccttgaacgtcgacggcgttaatgatctggcactactagatttaaccgctttacttccagcgcacgccccgaagggccttctgaaactcgccaacgtagccgaggtaagcgccctgcaggtaggcgacaaagtgcagattgcaggcttcccaggcaaccttaatcctgacgctgtgacaattgcagaggccacaattacacgattttcaaaaacaaccttggatggctctattcccgcatctaataacgttatggtgcttgacggaggaaccttcagcgggatgagcggcggaccagtcctctttaaaggtaaagtagttggcgtcgttgttcgcggtcccaatgataatgaccccaatgagaagtgcgaagctgtgttctcaactctggtcctcccaatgttttga

SEQ ID NO: 7791 - RNA, 1665 nt, unidentified
  source 1..1665: mol_type = other RNA; note = synthetic construct
atgaccctgaagagcatcccagacctgcgtttcctagctgcggccctcggtcggaaccttaagcgacgggtgacctatatcgcctacaagcttcctccatcttctaaattccgagtctttaccatcccaaagaggtcagggggcactaggacgatccaggctcccaggatcgctctactgtcattgcagagatcagtcaggcttctcttggaacgcgactattcccctcgggttaatgtgcatggcttcgtacccggccacggaaggtcaatcgtcagcaatgccgagaaacatgtactgaaaaaatgggtactgaacattgacctggagaattatttcggaagcatccacttcggtagaatagccggaagattgcaatccaaaccttatggctatactccagagatcgcaaaatttgtggcgcacatcgcatgctaccccacccaggcccttatagacggaaaaatacaggactccagtgtgctgatgactggtggtgccctgtcccctctcttggcaaacattgtgagtgataagctggatagcgagattgccaggttctgcagccaactgggctgtacctacacacggtatgcagacgacatcaccatttcctcaaaccggaataaatttccaggcaagatagcacgacttgaggatcccgaagaccaccgctccgtggttctctctgaagcttttctggatctgatcgaagggaacgggtttgccgtgaaccatgccaaaaccagacttctccctcggtctttcggtcaggaggtgacggggttggtggtcaataaaaaggtaaatgtccctagatctttcatcagacaaatacgcgcaatgctccatgattgggaaacaaacggctacgcggctgctcagattcgccacttcagtaagtttaggccgaatcgcggacgcctcgatgcccatgaggctaaacactttcaatgggtcgtgagggggaagattgaatttgttcgaaacgtgaaggggagcactgatcagacctttcagacattagcccggaagtacaattccctgacaagtgggggaaagattacgattcctattgtggagacaaacagaattattgaggaagccgtgtggtacctggtgaatgagaataaggtcgttaccaccggcacttgcttcgcgatagagggcagtaagtacattacctgtgctcactgtattggacccaacatgactgtaacacccaagagcgccccaaagttccccgtctctgtgaaagctctcaagcaggatcgtgtgaacgacttggcgacgctggatttatcggctctactgcctgcccacactccaaagggtatgctgaaacttgcaagcatcgccgaggttggggctctcaaagtcggcgacaaagtgcagattgccggatttcctggcaacttaaatgaagaggccgttactatctctgaagcaaccatcacaagattttccaaaacaacactcgacgggtcgatcccagcaagcaacaatgtgatggtcctggacggcgggacattctccggaatgtcaggcggacccgtgttattcaagggtaaggtcgttggggtggtggtacgtggcccgaacgatgatgaccccaatgaaaagtgcgaggcagttttcagtactttgatcctgccgctgatctga

SEQ ID NO: 7792 - RNA, 1677 nt, unidentified
  source 1..1677: mol_type = other RNA; note = synthetic construct
atgcctgccccaactccgttgctgaacagtatcttcctcccacgtcaattagccagcgtcattggcgtgggattccggaggttcgcatatatcgtgtacgtcattcagggttccctaaagtatcgcaactttaagctgcccaaacgcaggggcggcgaacgacttatcgaggcacccaggtggccactgctgagaatccagaaggagttaagaccactcgtggacgagctgtacagaccccggggggtggtacacggcttcctgaaggataggtcggtgttaacaaatgcgcgggtgcacctgaaagctagatgggtcctctccctggatctgcaggatttttttcatgcggtaacatttggtagaatcaaaggcagacttgaagccaacccctttaatctcacccctccgattgcccacgcaatagcaaatgctgcttgcgtcagcggcaggctccctcaaggaggagcccttagtccagtgctcagcaacatggtcgcagatagattggacggtgagctgtccaggctgtgtcggaagttccggtgtcgttatacccgttacgcagatgacataacaatttccaccggcgcagctcgattcccccatgctcttgctcacttggacgacggtgagaagaggaccctgattattggggaagccttaagagcacttattgagtctaacgactttaaactgaacgaatcaaaaagccgcctgtctggacgaggtgaccgacaggaagttaccggactcattgtaaacgagaagctaaatgtgcctcggactttcgtgcgccagatccgggctatgatgcacgcctgggagaagtttggccgcgtagccgctgaagcggaacatctcaccaaatggcgcaagtcagacggacgattgcgcaagcatgaccgcgacaattttgaacacatcctccgtggaaagttggagttcctcaaatgtgtgcagggcgagaatgagcctgtctgcaggaaactgctgctaagatttaatgccctccccgaccgctccaccacttcattccggctgctgccagcctctgccatcgaacttctccgtgaatctacctactgcctggatataacaaagtatgtcgggccaagctctgagggctcagcccatgttcgggagtacttcacaggaacggctttttttctcaaaggggtcgggctggttacttgcgaacattgcacaggggacgagatgcagatataccatcctgatcggaaacacctaaaataccgagtgcacccccttaaggtggatgccctggcggacgttgccatcctggaggttcttgatacgatgctgcctagcccaagggtggaattggaggcagccgtttccgccgtagcgatcggcgatgaagtacgcgtcgctgggttccccgcaaagttccctgagggcagtatcagcattgccagaactgaggtgatcgcaacttatgataggtccagacaccccgtgatatggaaaggggacgctacagttcggtatttaatcgagaagggtgttccggatggagtgagtggagggcctgtcttggacgccaggggcatggtgattgggctgggcgtgaagggtccctctgaggatgaccctttggtgccgtgtgaagtggtgccaatctcagctgtccaaaggctgctgagaacgagttga

SEQ ID NO: 7793 - RNA, 1740 nt, unidentified
  source 1..1740: mol_type = other RNA; note = synthetic construct
atgaaaaataaaacaactctccctacacccacaaaggagctgttacaggcttcctccaataaagatctggcaaggttgttgggcttccgtacgtctagcctttgttacatactttacaagctcccaagcaggccttacaagaaattcgggatccctaagaaaagcaaaggagtgcgcataatttgcgcgccacgtaaacctataactacactccaggagaaagtgtaccacctcttgctgccgctatatcggcccaagaagtcagcttccgccttcattaaaaatcgatctattgtcttcggcgccgataagcactccagaaagaggcacctcgtgacctttgacctgaaagatttctttgatagtatccactttggccgcgtccaaggcctgctcatggccacaccctttaacatccacccagacgtcgctcagagtctggctaacatcatctgttatgaggacaagcttccacagggagggatcacctctccgcttatttcaaacatgatctgttggaagctggacacacagcttacagaactcgccgtaaatactggatgcacctatactcggtatgcagacgacatttccatctctacgtggaagaaagaactgccaccagagatcggtaccctgagcaaatatgatatcaccttgtccgaggaagtccagaaaatcgttaatgacaacgggttcgaggttaatccatcaaaaacacgctacacccatcctagcacccgaatggaagtaaccggactaactgtgaacaggcgaccaaatatccagcgcaagaagatcagaaacttacgcgcccttttacatgattgggacataaacggttacgtggaggcagagcagagatacagggacaagtcctcgaatcctcctcgggaggaggccaccctggaggaaattgtttgcggcaagctggcttttttaaaaatggtgaggggggaaaacgaccccgtatacagaaagctcaaacgcaaacatctcatactgtctacagggtctattcccactggcctactggatgccgtccccacccttaacgctgatagtaattacctatttggcgagggacagaccgactggaagcatctgtatgcggcctttcgttactttagaaatcaaggtctgtacaatgggctgaatcttgtgattagtccccccccagctgtgtgggaaggaggtttttcgaacttgaagatgatggtggagcgatataagctgctccacaacacgaactcaaaattgttcttcctctttgacacagacgagcaacaagccgtgaagtacgcccggggcaggaaggataattctaacctgtaccatcaccaggggtcaaacgtgtataccctgttgctgtcccacacgcctaatctctgcatcgagcatctgtatcctgaagaggaactgaagagagccaacagcgcaggacggagactgtatctctccaatgagttcactgagcagggcgtcctgaaagataattcaagcatcacttactgtagtgaaaagaagcccttcgataagcggtgggttcacaaaaagcatatcctggacgctgatgtgataaaaaccattaacggcaagaaaaagaacattgcatgcagcaagaaggactttagtagccaggttttggcccggccggatactgaactggtctttacattcgatgaattcaagcccattttcgacgcaattgaaaaagctttagcagcgtataaagcctga

SEQ ID NO: 7794 - RNA, 1614 nt, unidentified
  source 1..1614: mol_type = other RNA; note = synthetic construct
atgctgatcacactgtctgctcttaccccgccaaattttctcgacctcaagagcttcagcgatctcgccttgttttttggcattccctcaaacaagttaggttatttgctgtatgctctgcaagacagtgataagtacaagtcttttaatgtcccaaagaaaaccggcggcactaggcagatctcagagccacatcccctactcaagaagatccagcgtaaactggcagactccctcctcgaactgtacaagcctaagcagtcagtgcacggctatctgaaggacaaaagcatagtatctaacgctaagatgcaccttcggaaaagatatcttctgaatttcgaccttgcggacttctttacgagcattaacttcgggcgggtgcgaggcttgttcctgaatcacccattcaattttccacaggaggtcgcaactgctttagcccgcatttccactaaagaaaactccttgcctcagggagcgccttcgagtcccgttatctccaacttcatgtgttgggggctggacaattacctccgcaagttctgctaccagctgggctgtacttacacccgctacgcagatgatattagcatatccaccaatagagagaacttccccacagaaatcgctaacgtgaaacacgacccatactctgccgtcatcagcgagattcttactacaaaaatcgagcagaatggcttcacgattaataatgctaagacccggtttagcacacctaggcaatcccaagtggtgactggcctgaaggtcaacgagtttgcaaacgtttcgagaaaatatgtgaggaatctccgggctatgctgcacgcctgggaaaaattcggactagacaaggccgagtctgagtttagagaaaagtacgtctcaaagcatcgagccccctttcttcctcccgtcagtttcaaacaagtactgcatgggaagctgacctttctcagatccgtgaggggccccaatgacgatatctaccagaaactgttgggacgctattctctggtggcagacctgaggaggttaaccaaatttggttttcctaagcagattaaccgtgcactttggatcttggaaagcgatctgtttgaagatgattactaccaaggaaccggtttctgcctagatgggattggcatagtcacatgtgcgcacgtgttaaagcccggcaccaaagcacggcgcatatacaaccatctggagtcactcaatattgaaattgtggagagaaacgacgccctggactatgccataataaaagttatcggaggggtggaggaggtgagtctaatcgccgatctggacttcaatcatcagctgggggggcaggttcgtacgatcggtttccctgctcacgatggcacagcctccgtggcgtacgaggacggagttattgtacagtctcggtataacgcagccggacagaagtggttccgagtcaacaccaacatcgtagccggcagcagtggagggcctgtgctcaatagtgaaatgaaagtgatcgggattgttgcctatggagccacaaacttgtcagggggtggcgatccaatcaattccggatatattccgatccagtgcttaaacggtccggcttga

SEQ ID NO: 7795 - RNA, 1515 nt, unidentified
  source 1..1515: mol_type = other RNA; note = synthetic construct
atgagaatcattacttctctgtggcagctggaagaggagtggggctatgaagctggaaccttagccttcgttgcttatagaaccaatatcgactcgaggtacacgacttacaatatcagaaagcgcacccagggctaccgtcagatcgacgaaccagacgaactccttaagggtgtccagaggaaaattaaagagttcctcgaggacaaatacgtgccgaccacttcagcatacgcctacgtgtccaaccgatcccctgtgaagaatgcagctctgcacacgcggaaaaagtggatagtcaacatcgacatcaaagactttttcccatctatccactttggccgaatttgcggtgttttgcaatcaaagccctttcaccttgaagcatctactgccaaggtactagccacaatttgcaccaggaatcacgctttgccacagggagccccttcctctccgatcctcagcaacatcatttcctacagtctcgatatagcgcttatccaatttgcccggtcacatggcttttactacactagatatgccgacgatattaccttcagtacatggcagagcaagtttcccaatcagcttctcacagtggatcatgagggaacccgtgtggcagattccttagagcaaataattagcgggaatggttttactgtgaacggcctgaaaacccgctgtctggagaggcgacaacgccagagcgttacaggtctgacggtaaacaagttcgtgaacgtccgccggaagtatatacgacaggtgcgggggatgatacatgcgtggcagaagtatggggaggaatctgctcagaaaacctttgaggaaaaacacctgaacaagcattatgttcccagcgggagaattcccaagttcaggtgggtcctcctggggcggttgcagtacatcggccatgtgaggggatggcaggaccctgtctatcgtaagtactttagacaacttagcgaactctggccagacctgtcgaagagaatgagggatcggttcgatatattggcccagaacttccttgagttgagtaatatgacagatcaccgggctaaggggtatgcactggagaaattcatttacgagctgtgtgacgacggaacagtcggagtgtccggccaattccgacgccagaacaacattgagcagattgatggtgctatctccttcaattctaatgccgtgctcatcgaatgcaaattctactctgagaggattggcgctcttctgatcgatcccttttccatgaagttagctcgctcaggggccggaacacaaggcctactgatcagcatgagcgggtatacctcagaggcactcgaaactattaaactgaaccctggccagaatctgatgctgttaactgatgccgatctgcaggtgtggttggaccgccggctcacaacctatgaggtaatcgccgcaaagctaaaagcgctgcaggttctgagagaacctgcgttgagtctggccgaaagtgtcgagatcgaggaatga

SEQ ID NO: 7796 - RNA, 1641 nt, unidentified
  source 1..1641: mol_type = other RNA; note = synthetic construct
atgccatctgacacctcaacgccaacacagcgtaaagcaagggaacctggtccacccgccatcacaattaacgggcgagcgctgcagacacctttcgatgtggcccaatactttaaagtggcccacagccacatgatgtgggtactgttcaaggcccccgccgcgagcagatatcgaaccttcgagattccaaaacggacaggcgggatgcgattaatcagcgctcccaatgggttggtgcgcgacttacagaccaagctggcaccagctctcgctgcagcttatgaggcccacccgtcggcccacggattcttgaaagctaagtccgtcgtgactaacgcacatgagcacattggccagcggctggtcgtcaacattgatcttgaagatttcttccctacgattaactttggaagaatacgtggcctgttcatgtctcggcccttttacatgggagctggtgctgcctccgtcatggcccagatcgttacgcacagaaacggcctaccacagggcgcaccaacttcccccgccctaagtaattttatagccgctaccttggacagaaggctaacaagattagccaaggaaaaccgtctgcgctacacacgctacgccgatgacattacattttcaactaatcagcccacatttcctccttctatcgtgatgaccgatgtggctactggacgggtggtccccgcggaaactctggagagagcaatcgctgcggctgggtttgccattaataggaaaaaggtcaggctccagactaggcatcaacgccagaccgtgaccgggctggttgtcaattctagtactaacgtgcatcgcgcacggatacggaaaatcagagctatgattcacgcctgggagaagtttggtctggacgcggcagcatctgagcatttcgccgtacacaggggtagcagtggcaagatgcctgaccatccagcagcagccttccgaaatatcgtttatggccaactgtcatttgtaaaaatggtgcgcggcaaagccgaccccgtttttctcaagctctgcgctaagttgattgatttggacccgaaccccagtaagttcatccgccaaatggtgttcggcgcagatgactatgatgtcttcatctcgcacgctagcgaggacaaggaaaccattgcaaggcccatcttcgaagcctgtgctaggcggggcgtgaaggccttccttgatgaggcccatataggttggggagaagattttaccaagaagatcaatactgcccttgggtccgctcggaccgtcctgtgtgttatcagccaggtgtccgtgacgaaagagtggccgctcgcagaggtcaatacagccctttctatggacgtgatcggacagaaacgggtggtcccactgatcgtgggcagccctgacctgtccaagctgcctctcatcagaggacgcgaccagcttgtttggaggggagatgcggagattgttgccgccgaactggttaaggtggtaagaccgccaaaacccgaggtaaccaaaggcggtgccgcagtgcctgtgatagctcctaactcacccgctgaagccaaacgagcagcccaagctaaaggggcgaaaaaggggggaggcttttttgggctcttccagaagaagtga

SEQ ID NO: 7797 - RNA, 1638 nt, unidentified
  source 1..1638: mol_type = other RNA; note = synthetic construct
atgccttctgaacccgggtcggaaaaacctgtcagagatcctggccccccagccattctttggcgcggaaaaccgctcgaaactccatttgatgtggccggatacttcggggttgcacataatcatctaatgtgggccctgtacaaagctcctccccagaccagataccggaccttcgagatcccgaagagaaccggtggcatgcggttgatctccgcacccaatgggctggtaagagatctccagaccaaactggcaccagtgctggcagcagcttatgatgcccaccccgccgcacatggctttctgagtggcaagtcagttgtctccaacgcccgagagcatgccgaccaaaggctggtgttgaatatcgacctggaggatttttttccaaccatcaattttggcagggttcgagggctgttcatggcacgccccttcttcatgggtgccggagccgctgctgttatggcgcaaattgttacccaccgcaacggattgccccagggagctcccaccagtccagtattgtccaactttatcgcggcaacgctggacagaagacttactcggcttgcaaaggaaaacaggctgcgatatacacgctatgccgacgacatcacgttctccaccaaccagccgacatttccgccttctatagtgattacagaccaggccagcggaaagatagtccctgcagaaacattagagcgggccattgccgccgctggtttcgcaatcaataggaagaaggtgcgcctccagaccagacatcaacggcagagtgtgacagggcttgtggtcaacacagctcctaacgtccaccgtgctcgcgtgaggaaagtcagagctatgattcacgcgtgggaaaagtttgggttacagtctgcggcgtacgagcactttaggaaataccgtggggcctctggcgctatgccagacgaccctagcactgccttcaggaacatagtctacggccagctcagcttcgtaaaaatggtgaggggccgtgacgacaaggtgttcctgaagctctgtgctaaactcatcgatttagacccaaatccctcaaaattcatcaagcaaatggtgttcggcgctgatgattttgatgtgttcatttcccacgcatcagaagacaaagagacaatcgcccggccaatctatgaggcttgcgcccgcttgggcgttaaggccttcttggatgaggcccacatagggtggggagaggacttcaccaagaaaattaatactgccctgggcgctgcccggacagtactttgcgtgattagtcagactgctgtgactaaggagtggcccctggcagaaataaatactgcgctctcaatggatgtaattggacagaagaaggtggtgcctctaatcgtgggtcagccagacctaagcaagctgcctctgctgaaggcccgagatcagatggtgtggaggggtgacgccgaaatggtcgcacgggaggtggccaaaatcgccaaaccacctaagccagatgttgtcaagggaggcgctagcctccccgtcattgcacccaacagcacgatcgaggctaaacgagcggcccaagaggctggggggaaaaagaaaggcggaggtctgtttggatggtttggcaagaagtga

SEQ ID NO: 7798 - RNA, 1716 nt, unidentified
  source 1..1716: mol_type = other RNA; note = synthetic construct
atgccaccctccacctccgatgccccacctgaacccccacaagctggcgctccagttccaccgcctcctttgggagccctcgccattgacggagcgcctctgaggaacgcttacgacgtagcaagatattttggcgtcgcccacggcacaatggtctgggttctgtacaccgctcctgagaaccagcgttaccgtacgtttgagatacccaaacggagcggcgggatgagaaggattgacgcccctactggtctagtacgccaaatgcagaagaagctggcacccatcctggcaggcgcatatgaggcccatcccagcgcccacggcttcattaaagaacgcggggtgctttcaaatgctaaagggcatgccgggcagaggctcgtgctgaacatcgacttggaggactttttcccttccatcaattttggaaggattcggggcctgttcatggctgctccctttctttgtggccctggggccgcaacagttctcgcacagatctgcactctacggaatggacttccgcaaggggctccaaccagccccgcattgagcaactttatagctgccagtctggataggcggctcacgcgcctcgcaaaggatcacaacctgaggtattctaggtacgcggatgacatcactttctcaactaatcagggagttttcccccctgcggtcgccatgaaagtgcagaccgagggtgcctctcttggggttcgacccggtgaggcactggatagagccatagctgccgccggcttcgccattaatctgcggaaggtgcgtcttcaatctagatccgtgcggcagaacgtcaccggcttaacagtcaacgtggccgcgaatgtggagagatccaggattcgcaaggtgcgcgcgatgcttcatgcatgggaaaaatttggtctggacgccgcggggagtgaacactttctgaaacatcgtggagccaagccaaaaaagggccgagggcctgtaactccaggagcagcgttccgaaacgttgtctatggacagctggcctacatcaaaatggtacggggcccagccgatccggtgtttctaaagctttgcggccgcgtcctggacctggatcccaatcccagcaaattcattaagcagatggtgttcggggccgagaatttcgaggtgttcatcagccacgctagtgaggataaggaactgattgcgcggccaatctatgaggcctgtgagaggctcggcctcaagacctttttagacgaaccccacatcggttggggagaaaacttcaccaagaagataaacacagcattggggtccgcacgcacagtgctcgcaatcgtgtcaagtaactcagtagctaaagactggccagtgttagaaatcaacaccgccctggccatggaagtgaatggtcagaaaagagtcgtccctctcattgtgggtaagccggacttagcaaagttcccattgctgaaaggcaagaatcatgttgtgtgggcctctgatcccgacaaggtggccttgcgactcttggatgcagcaagaccgccaccgaaacctcgcgctgctcgaccagcttcgaggacagctgtgcccgccactggagcataccagcctgtccccgctggtcccaatgctctgccaccactgtttgccccttacccccctcgggctcctaaacccaagagatctttcctggagtggatctttggcagaagaggatga

SEQ ID NO: 7799 - RNA, 1683 nt, unidentified
  source 1..1683: mol_type = other RNA; note = synthetic construct
atgcagcccccccctaccgatggagaagcctcgaagcctgcagctcctgctccctcacctctgagcattgacggggtacccctccgctctgcagaagaggtagcgaggtttctgtctgtgccctatggcaggatgatctatactctttacaagagccccgacaaagcgaggtacaggggatttgagatacccaaacgcagtgggggcatgagactcatccagtctcccaatggactgttgcgtgagatgcaggagaaactggggcccgtgctccaagctgcttatgaggctcatcctgccgctcacggattcatcaagacacggagtgtggtgagcaacgccagactgcacgttgcccagcgcctggttcttaacatcgatctagaagatttcttcccaaacgtgaacttcggccgggtgcgaggcatctttatggccccaccctttagttgtgcaccagccgctgcgtctgtgctagcccaaatttgcacacacaggaatggtctgccccaaggagcccccacatcaccggctctcagcaacttggcctctgctactctggataggagattgacacggttagcaaaggaaaatgggctgaggtactctcgctatgccgatgacataacattttctagcaaccattcccagtttcccccggccgtggcgattttcacggaggatggtaaaaaaggcctcgccgttagaccaggcgaagcactcgagcgtgctattgccgccgccggattttcaataaatctccggaaggtgcgcttgcagccacggcacgtgaggcaagcagtcaccggactgaccgtcaacgccgcgcctaatgtcgaacgaaagcgcatccggcgcgtacgggccatgcttcatgcgtgggccaaatttggcgccgaagccgctggtgcggagcacttattaaagtatcggggggcccattccccaggagagcagtcagcacgggcttttcggaacgccctttacggggagctcgcctacattaagatggtacgcggtcaggaagaccgaatctttctcaatttgtgcgcgaaggtgcttgagctggatcctaatccgtccaggttcattagacagatggtgttcggggctgacgactacgatgtgttcattagccatgcatccgaggacaaagatgaaattgctcggcccatcttcgaagcatgtgggagagcaggcctgaaggcatttctggacgaggcacacatcggatgggggcagtccttcacccagaagataaattccgcccttggtgcggccagaacggttctggtgatcgtgagctcaactagcgtgtcgaaagactggccagtcctggaggttaacaccgccctacagttcgaggctgcagggcagaaaaaggtcgtgcccgtcatcgtcggcaagcctgacttatccaggctgccactgctgagtggcaaggacgggatggtttggagtggcgatgctgatgctgttgctaccaggctgcaggccgccgtcaaaggtgacgcaccacgtcgtccagaacgcggtgcagcaaaaccaccggccagagccgctcctcctcaaccaccaccacgagcagctggacgaccgggaagaactgctgtacctgtcactgcccctcgaggccctagaaggggcttctggtcctggttgttcggcgcacgccctagatga

SEQ ID NO: 7800 - RNA, 1692 nt, unidentified
  source 1..1692: mol_type = other RNA; note = synthetic construct
atgccagatcctagtacgcctagcgatcgcaccagagcccctgcctttggggaactccgtttggaaaccgtgtctgacatcgctcggttgctgcgtacacatccaggccagctgagttggactctctataaagccccagagactgcacggtatagggcattcgagatcccaaagcgctcgggcgggatgagacagattcatgcacctattgcccacgtccgggactggcagacacgccttgctcccatcctgcaggcagcctacgaggcccacccaagtgcacatgggttcctgcgtgagaggggcataatgactaatgcccgaacccacgtcggccagaggctggttctgaacatcgacctggaggactttttcccctccgtgaattttggaagggtacgggggctctttatgcggagccccttcaattgtggccctgcagcggccacggttcttgctcagatttgcacgcataggaacggattaccacagggagccccgacctccccagcattgtcgaatttcgcggcagctgccctggataggagactaacccgcttagctagagacaacaacctccggtactcccggtacgccgacgatattaccttctccacaaatcagccccagtttcctccagccgtcgcggaaatgcgagccggtgaaggggacgccctgaaggtgcgagctggcgaagcacttgagagagccgtcgctgctgccggtttcagcattaaccacaaaaaggtccgcctccaaagaaggtcacagagacaatccgtcactggagtggtcgtcaacgcccgcactaacctgacaagacagtgcgtacgccgggtacgggccatgcttcatgcctggaaaaagtatggactggaggcggccggcgccgaacactttgatcgctggcgcggggcacaggccaataaaagagctactacagtgggccgggccttccgtcacatcgtgtatggagagctctcttttctgaagatggtgcgaggtgcagacgatcccgtgttcctcaaactgtgcgcacaactgatagaactggaccccaatccttctaagtttgtgagacagatggccttcggagccgacgactacgacgttttcatcagtcacgcttccgaggacaaagatgcggtggcgaggcccattttcgaggcttgttctaggttaggcgtgaaggcatttctagatgaggcacatatcgggtggggccaaagctttaccacaaagatcaacaccgccttgggagctagcaggactgtcctggccatagtctcaagccactcagtgacaaaagactggccggttttggaggttaacaccgctttagctctggaggcgaatgggtttaaaaaagtggtgcctcttttcgtgggcgcacccgatctctcaaagctccccctgctgcaggcaaaggacgccatggtgtggaagggtgatcccgatatggttgcaaagagagtgcaagctgcgttgaagggggaagctcctaggcggcctgctgaagtagctccccgaccacgatggatgggtggccgttctgccacagctctcccaatagtgggcgtagctccgagaggagttgccgtgcgcgttgatccccctccaattcttcctccgcccaggcggaccctatgggaatggatctttgggaggcgaggtccgccaagctctcgctga

SEQ ID NO: 7801 - RNA, 1671 nt, unidentified
  source 1..1671: mol_type = other RNA; note = synthetic construct
atgcccagttcatcccaggcggagactgcagaaaccgctctgcttcacaacgggaggccgatactgactgcctacgatgccgccaagttttttggagccccacttgggaaactggccggggtcctctatcgtgcgccagaggaggaaaggtacaagtcctttgaaatcccaaagcgcaccggcggtatgaggccaatcttggccccgatcggcttaactcgcgagctccaggagaaattggcaccagttctgcttgagcgttatagtgcgcatccagccgcacaagggttcctgaaagaacgcagcatactgaccaacgctcgagtgcatgccggtcagagactcgtgttgaacattgatctggaggacttcttcccctccattaacttcggccgggtgagaggcctgttcatggccgaacctttcaagctcggccccgctgctgctgccttattcgcacagctgtgtacataccggaatggtctgcctcaaggcgcacccacaagcccagccctgtccaactttattgccgcagacctcgatagacgcttggcacggttggctcgagagtctaatgtccgatacacgcgctacgcagacgatatcacattcagtagcaatcagccgacacttccccagacactcatcgtcaccgtcgccggcgaaggaagagcctctgtgcaggtagctgaacccttagagagagcgatcacagcttcaggattcgctattaaccacaaaaaagtcaggttacagacgcgacaccagcgccagtctgtcactggtctgcatgttaatgccaagcccaatgtgtcacgtgctcggatcagaaggatgagagcgatgctgcacgcctgggagcgctttggactggatgcggccgcctacgagcactttctcaagcacagaggcatgctgaaacctcctcgggacccatcgcgcgcatatcggaacgtggtctatggtcagctgtctttcattaagatggtgcggggaggggatgaccccgtgtttctagggctggcagcaaaactgattaaactggacccgaaccctagtcgattcattagacaaatggcttttggcggtgacgacttcgacgtgtttatatcgcacgcgtccgaggataaggatgaggtcgctcgacctatctttgaagcttgcgcccggctgggcgtgaaagcttttctcgacgaagctcatataggctggggacaatcttttacccagaaaattaacaccgcccttggctccgccaggactgtgttggccatcgttagccaaaccagcgtgaccaaggagtggcccgtaattgaggtgaatacggccctctcactggaagcaagcggacagaagaaggttgtgcctctcatcgtgggaaagcccgacatgtctcgcctgccgctaatccatgggaaagacgcaatggcatggaatggcgatgccgctaatgttgcaaggaggctcaaagcggctgttgatggggctgctcctaggaggccagccgcacaacctgcaaccactgccgtacccgtaactacagataagcctcttgccctaagagcacggagccaggcccctcttgccatccaggaacgtggaccatggcggcctccacccaagccaaagagaggattgttcgactggctaggggggcggaagaggccctaa

SEQ ID NO: 7802 - RNA, 1464 nt, unidentified
  source 1..1464: mol_type = other RNA; note = synthetic construct
atgctgttacacgagggtaagcctatcctcactgcctacgacgccgccaagtacttcggggtgagtgtaggtaagctcgcacgtgccctttacaggagtgcagacgaggagcgctatgtacgttttgagatcgccaagaggagcgggggcatgaggcctattagcgcccctgttggattgactcgcgagttgcaaaccagactggcccccgttatgcaagcccggtattctgcgcacccagctgcacaggggtttatcaaggagcggtcaatcctcaccaatgcgagagtgcacgtcggccaaaggctggtgctgaacgtggacttggaggacttctttccatccgtcaacttcggacgggtgcgcggactctttatggccgagccctttaaactaggcccagccgcggcatctgtcttcgcccaattgtgtacctataaaaatggcttgccccagggcgcacccacatctcctgctctgtctaattttattgccgctgatcttgatcgccggcttgctcgtctcgccagagagtccaacgtgcggtatactaggtacgcggacgatataacctttagtagcaatcagcagtccctcccgcagacgctaatcgttcatgcgcagggaggcgatggccatggtgttgctgtggcagaaacactggagagagcaataacggccagcggcttcaatatcaaccacaaaaaagtgcgactacagacacgccatcagagacagtcagtgacagggctgcaggtcaattcacgggctaacgtctcgagggagcggataaggcgcgtgcgtggaatgctgcatgcctgggaaaagtttgggctgccagctgcagccagggaccatttcctcaagcaccgaggcatgttgcggccgcctaaagatcccccgagggcgtttcgcaatgtagtctacggacaactggccttcatcaagatggtccgaggagccgacgatcctgtgttcctgaacctggcagccaaacttatcaagattgatccaaacccaagcagattcgtgagacagatggcattcgggggggatgactttgatattttcattagccacgcctctgaagacaaagatgctatcgcacgccccattttcgaagcatgcgctaagttaggcatgaaggcttttctggacgaagctcacattgggtggggccaatcattcacccagaaaatcaacaccgctctgggttccgccagaactgtgctggccatagtgtctcaggtgtccgttaccaaagaatggccagtaactgaagttaatacagccctcagcctcgaagtcagtggccagaagaaggtggtgcccctgcttgtgggacgacctgatctgtccagactgcctcttgtccaggggaaagactgcatggcatggaacggtgacgccgcagctgtagctcggaggttaaaggccgcggttgagggagctgctccccgataa

SEQ ID NO: 7803 - RNA, 1671 nt, unidentified
  source 1..1671: mol_type = other RNA; note = synthetic construct
atgcctttaacatccatagaagatgctgaaggacttcggctgccggacggtcggcttgtgttgtcagcccgggacgcagcgatctatttcggagtgagtttcggcaagctgacccacgcgctgtatagagcagacgacgagcagcgctacagagcctttgagatccccaagcgcacgggcggaatgaggcagatctatgccccccacggcatcattagagagtgccaggagaagctggccccagtgctgcaggaattctacgccgcccatccagccgcacacggattcatcaaagagaggtcgatcctgtccaacgcaaaactgcacactgggcagcgttacgtgttgaacgtagaccttgaggacttctttccttcaatcaactttggcagagtgagaggcctgttcatggccgcccccttcaagttgggacctgctgctgccagcgtgtttgctcaactgtgtacacacaggaacgggttgccacagggtgctccaacaagcccccccttgtcgaactttatttctgcgcaactggaccgcgcactgtcacgacttgcccgcgaaaatggggtgaggtactctcggtatgctgatgacataaccttcagcaccaatcaaggggccttcccacctgctattgccgtcacctctaggggggaagacggaggagaaggcgtgcgaacaggcgaggcactcgaacgcgccgtgatagcctccggcttcgccatcaaccataggaaggtccgcctacagaagagagatcagaggcaaagcgtcaccggcctaaatgtcaatgagaaagctaatgtggcccgcaaaagaatcagaaggatcagagcaatgctgcatgcctggcagaaacatggcctcgaagcagccgctgctgagcactacttgcggcataggggcatgctccagttgccccagaatttcgatcgggcatacaggaatgtagtttatggccagctcgcttttgttaaaatggtacggggggccgacgacccggtattcctcaacttatgcgctaaagtgctggaaatagatccaaatcccagccgttttattcgacagatggtgttcggtgcggatgattacgatgtatttatctctcacgcgtccgaggataagcacgagattgcacgaccgattttcgaggcatgtgcaaagctcggactgaaggccttcctcgacgaggcccatattgggtggggacagagctttacccagaaaattaacactgctctcgggtctgccagaacagttctcgccgtggtcagtagcacatctgtcagtaaagagtggcctattgtcgaagtgaacactgctttagcgctggaagtttcagggcaaaagaaggtggtccccttaattgtgggcaagcccgatctgtccaaactacctctgatccggggcaaggatgctatggtctggaacggggactccgctgctgttgccaagcggctcaaggccgctgtgagcggtgatgctccccgaagaccagtgatcaccccctcacgtacggcactgcctcccgttagtgcagcacctgcctccgcgactgcaccacttcgccaagcacctgttggaactggtccttgggcccctccaccaccgaggaaacggaagcttagtttttttgagctgctgtttggtcgacgtaaacgctga

SEQ ID NO: 7804 - RNA, 1770 nt, unidentified
  source 1..1770: mol_type = other RNA; note = synthetic construct
atgcatgccgacagacggcccgatgatgcacctccccaagctcctgctattctggtttctggcagggcccctcagtcagccagtgacgtggctgctctgtttgacgtgtctgcctcctggctcacctatgtgttgtaccgcgccgacgagtctcaaaggtaccgggcattcgaaatccccaagagatccggcggcgtaagggagattaatgctccaattggagtggtccgggattgtcaggaaaaactcgcccctctgctcctagcggcctacagagcccatcccggagcccatggctttatcccagagcggtcgatcctgaccaatgccaaagcccacgccggccagcgtcttgtgtttaacgtcgacctcaaggatttctttcccactgtcaatttcggccgggtgcgagggctcttcatggcatccccctttttcatgggtcccgcggccgccacaattatggcgcaggtttgcacccacaagaatggtttgccacagggtgccccgacttcccccgttctgagcaactttgtagccacagcactggaccgcaggttgacgagactggctcgcgagaatggcgtgcgatactcccgctatgccgacgacatcacttttagcacgaaccagaccggattcccagctgccattgtcgctttcgagcaagacggggaaaaacggagagcagtggtcggggatgctctggccaaggccattgccgatagtgggttcgcagttaacttcggtaaagttagattgcagactcggcacgagcgacaaagcgtgacagggctcgtggtcaatgcgatgcccaacatagagcgggccagagtgaggcgaataagggccatgttgcatgcatggagcaagttcggactggaagccgccggcgaggagcactttcgcagatggcgacgcgcgaagcctaaggtaaaagatgggactgctgggactgctttccgcaacgtggtgtatggagagcttgcgttcgtgaagatgatccggggcagggaagatcctgtgttcctcaagctttgtgctcaggtgctagcgctggatccaaaccccagcaaatttgtgagggaaatggcatttggtgcagcggactatgatgtcttcatctcacacgcttcggaggacaaggacaccatcgcccgcccaatctttgaagcttgcgagaaattagggttgaaggcttttttagatgaggcacacatcgcttggggggcctccttcactgaaaagataaatgtggcactcgggtctgcccgtaccgtcttaacaattgtcagccctgcatctgtcgccaaggattggccggtgctcgaagtaaatacagctctggctctagaggtttcaggcgagaaaaccgtagtccccctgatagtgggaaagccagatctgagcaaacttccgctgattaaaaccaaagaccagctggtctggaccggcgacgcgatgttcgtggcaaaaaacctgaaggcggccgtagaaggcagagttggtgttaagcagagacggacacctgacggaggactggcccctgcaccagcagcaacaggagctccaggccctgctgttgctgcaagggccgagagttctcgtggagccgctcagggatggaccccaggttggcagtcaacggcacccaagccgtttgaaatcaggcgcaagtccaaaagtgggggccgttggttcgtgacagcactttgggctgcacttgctgccgccttagccgcagccgcttttctgtttggcttcggctga

SEQ ID NO: 7805 - RNA, 1536 nt, unidentified
  source 1..1536: mol_type = other RNA; note = synthetic construct
atgagcgagaagttctccgcacaggagttggatcagctcctgaatctgaaactggaaaccgctaacgacgtgtctaagtttctgaagatttctaaaccgcagctgctctttgcactttaccgagccagcgacgagcagaaatacgactcttgggagattccaaagagatcaggaggcatgcgcagaattgactctccgcgccgagtgattcgggacggtcaaaaagctctgctaccatatttagaggccagacagaatgcccatccagccagccatggctttttgtccgatagggggattgttactaatgctgatgcacataagggacagagaatcgtactaaacatcgatctcgctaactttttccccagcgttaatttcggccgcgtacgcggcctgttgatgaagcctccttttgagatgggggaggctgcagcaaccatctgcgcacagctgtgtacatttcgcaacggcctgccccagggagcttgtacatctcctatcctctcaaacttcattgcaacctcactggatcggcggcttctcagattagctcgcgcgacaaggatgcggtatagtcgatacgccgacgatattacttttagtacaaatgccgaggccttccccgaacaaatcgtcaaggtctttagtgccgccccgctcactgacgaagctctggaggcagccatggaaggccctgcttctaaggcgccaaaacccgcagctccagcccctaaaatcggacccgctctggaaagggccctcacccaatgcggcttcaaagtgaatcctgctaaggtccgggtgcagcgtcgggatgaaaggcagacggttactgggctgaccgtgaatcagtttcccaacgtggaaagaaggcggatacgcagaatccgggccatgatacacgcctgggaaaagtttggtttgcagaaggctgggcacgagcacttccaccgatatgcacccaggcaaacctcgcctggcttcgatgtggcgcgggcttttcgcaacgccgtgtatgggcaactcgccttcgtcaagatggtgagaggagctgaagatcccgtattcctaaagctttgttccaaactgaccacgctggacccaaacccaagcaagttcatcagacgaatggttttcggagccgatgactacgatgtgttcatatcccacgcagccgaagacaaagacgcggtcgcgaggccagtctttgaggcctgcgagaggatgggtctgaaagcattcttggatgaggcacacattggctggggtgagaattacactacaaagatcaacgcagccatggggtccgcgaggtgcgttctgttaattatcagcagtcattcagccagcaaaccatggcctctggccgaaatcaacacagcgttatccttggaagtcatcggcgagaagatggccgctccccttgtggtggggaagcctgatctttccaagattccgctcatcaaaggaaaagactacatagagtggagtgacaatcccgacctggtggcccgtcgtcttaaagacctctga

SEQ ID NO: 7806 - RNA, 1677 nt, unidentified
  source 1..1677: mol_type = other RNA; note = synthetic construct
atgcctgaaaacccagcctctaccgccggaccacctacacctcccacacctcctgctttacctcagcatctgcggttgagggggcgaccgctccaaacgtcacaggatgtggccgactatctggggatacggcaccggcttatgatagatactctgtataaccagcccccaaatgcacggtacagacactttgaaatcccaaagcgcacaggcgggatgaggcctattcacgcccccgtgggccacactagggctatgcaggacaggctgctaaccgattttaaggcactttaccggccccatcccaatgctcacggtttcatcgaaaagaggtccgtgacatcgaacgctacctgtcatacaggacagcgctgggttctcaacatcgatctcgagggctttttcccatccataaacttcggtagggtgcgcggcctgttcatgaggccaccatttgagatgggtcaagcggcagccaccgtttgcgcccaaattgtaacatttcggaatggacttccccagggggctccgacatcacccgtcttgtccaacttcattgcggctcagctggacagaaccctgtcccgtctagcacgccagaacagactcgtgtactctcgttatgccgacgatatcacttttagtaccaacctcactcagtttcccgcgtctgtggtagtgcgggagatggtggtgggcggaggctacaaagtccgagcaggagacgccctcgaattggccatccagaaatccggattcgagattaatgagaaaaaagtcagactgcaggcccactattttcaccaggatgtgaccggtctgtgcgttaatgagcgcgtcaatgtggctcgcgaaagagtgcgaaagttacgcgctatgctccacgcttggcggaagttcggactagagagggctggccaggagcacttcgcaaaacataggggaagtaggagattaaagccacctagccagcctggggccgcatttagaaatgtcgtgtacgggaatctctcgttcgtcaagatggtacggggggctgatgatccggtgtttctcaaactgtgcgcacaagtactggcccttgaccccaatccatcaaagttcttacgccagatggtatatggcgccgacgactacgatgtgttcattagtcatgcaagcgaagacaaggaagctattgcacggcccctttttgaagcatgtaatcgtctgggtctgaaggccttcctggacgaggctcatattgggttcgggcaatctttcgccgccaaaatcaacaccgcgctgggcgcttcaagaacgattttggccgtggtcacccctcactctacaactaaggactggcccctgcaggaaatcaacacggccttggccctggagatctctggcgagaaaaaagttgttccagtgatggtgggctcccccgatcttacccatttgcctctgcttcgaactaagagatggattagttgggagggaaacgcggattccgttatacgacagatgaagcagcaggttggcccactgcgcgaggcgaaaaaagcaggtagcgtccccggcatcgcaggtaagaaggctgcccgtccggtccctcaagccaaaccgatgagcggggcccagagccaaactaccccaagaagcgacggatggatcagcaggctctttggcaagaagtga

SEQ ID NO: 7807 - RNA, 1686 nt, unidentified
  source 1..1686: mol_type = other RNA; note = synthetic construct
atgctctctagcgacaccagcaaccccgcaccagaaaccccgaaagagactctgcaggaacccccactggagccccatccatttgcctggggcgccctgcaaacagtggcggatgtagcagagttcctcggagcgcgcaggagcgatctagcctattggctgtatacagcctcccctgacaaaagatacaccgagttcgagattcccaaacggacaggcggaatgaggctgatctctgcaccaaccgaccagattaagacatggcagaatagggttgctgagaagctcgcacagtcttaccgcccacatccctccgcccatggcttccttgaaaagcgaagtgtgctgaccaacgctagggatcatacaggtgtgcgatttgtccttaatgtcgatctgaaagacttcttcccctcgattaacttcgggcgcgttagaggattgttcatcaaacctccttttgcaatggctccgcccgcagcgactgtgcttgctcagctctgcaccttcagaaacgggctgcctcaaggagcccccacatctcccatcctgtccaatttcgttgcatccgagttagatcgtcgccttactcgcctcgcgaaatccaatggagtggcctattcgagatatgctgacgacatctcatttagctgtaacagagccgaatttcctcctgacctggcccattacgaagtggatgcaggcgggctgaagacactcagacttggggcggctttagcaaaggaaatttctgctgctggttttgccccgaatctagggaagctccggctgcagacccgtgccatgaggcaagccgtgaccggactgacggttaacgccaaggctaatgtccagcggaggcggattcggagagtaagggccatgctgcacgcgtgggagaagtttggcttacaggccgccggccaggagcacttctctaggtaccgacccagcgccgccgctttgagagatccaggcccacgctttcggcacggcgtgtacggtcagctgtcatttatcaagatggttaggggcgtagatgatcctttgtttctgcgcttatgcgctagagtattggacctcgaccccaacccatcacggttcctgaaaaagatggtcttcggggatgagctatacgacgtgtttatcagccacgcatcagaggacaaagacgccatcgcaaggcctatcgctcaggccttggcccggcaagggttgaaggctttcttggatgaagcgcacatagggtggggagagaatttcactaagaagattaacaccgccctgggcgccagcagatatgttctggctatagtttccagtcactccgtcactaaggactggccaatcttggagctcaacgcggctctcgccatggaagcaaacggcctgaagactgtgatacctgtggtcgtgggtaaacccgaccttggcaagttaccgcttctgcaggcaaaggattggtacgtgtggaaagacgatgtcgaagctctggcactccgggtgcgtcaggtggtgaaaggtgagctacgcggagccgctcgtcgccaagctgtggaagcccgagggagttcagctagtgccgtccctacggaagtcgcccaggagggtactggcccaccagtagcaagtagcgacattaataaaaagcctggattttttgcacggctgttccgaaaacagtga

SEQ ID NO: 7808 - RNA, 1509 nt, unidentified
  source 1..1509: mol_type = other RNA; note = synthetic construct
atgtttcgggccatcgtctctgtccgcgatgtcgctgacctgctcgaattagactggagccagctgtactacataacctcaagggccgccgaccgctactcctatcgaacctttgccattccaaaaaagggggggggcgagagggtcatacaaacgccccatcccaccgtgcgaatacttcagcacaagctactggaagtgttgtccctagtataccagccccacccagcagcccatggattcgttcacgagaggagtattaagacaaacgctacaccacacgtgaaccgccgctgggttttaaattacgatctccaggatttcttcccgtcaatcacatttcctagagttcggggcatttttatcaagagatttaggctccctcctggcccggccactgtattggctagactttgttgcaatactggtgatactcctgaccatctgccacaaggcgccccaactagccccatcatttccaatatgatctgtcactctttggaccaccagtttgtccagcttgcaaagcggaatggggtgttctatacgcgctatgcggatgacctgacctttagcacaaaccggaccgcctttcctctgggcatcgccgagacatctggggcccagcttatcggcgtcgggaatgatgtcaaggagatcataaaacacaaccatttcgacctgaaccatcgcaaggcccgaatttcagggagagcgagtaggcaagacgtgaccggtctgactgtgaataaacgcatcaacgtgaggcggcgattaccccgggagatccgcagtatgctccacaaatggaaagcccacggctatgaagcagctgaggtagaattccataccaagtttgatgtatacggtcgcggagccaattatagaaacgtggtgtctggaaagctcgctttcttgcggaacgttcgtggaattgatgacagagtgttcaggaggttatacggctgggccaaggaactcgataacgatagtttctctgagctaccccccctggcaacaaacgcccccagcttggcagaggcagtacgcgactttcccaccattaccgcttccgataataaacagacacgacggggctatctgaagagaatgttcgcgtccgctcggggcacactgtgggttgtggatccaaatctgaaggctgacctcctgactgatctggttgcgtccatcgaacctggaagagtctcggacatcagactgcttagccgggacgagagactgtcaagccgtcagaaagtgaaatacactacaagcaggcagagcctgctcgctaaaggggtgaacctcgaatggcgagtgctgccaccgccacagcgttatttccatgacaggtggctggctgacgactccgattgcgtgtcaattggaggtcctttttctagtatttacgatccgaggcctcccttgggtcaaaatcttctggcacgtagaccagagcagttcgacacgtggtggaaccgggcaacccctctcactaccggatga

SEQ ID NO: 7809 - RNA, 1782 nt, unidentified
  source 1..1782: mol_type = other RNA; note = synthetic construct
atggcgtcaaaccatcctgaggtgcccagcgatccaagacagctgagggcctccttcgttgcgcttaagactccacaggaggtggcaaagttaattggcatttcctacgggcagctctgttcgataatctacgctaagcccggcaaattcccctacgaaacattctttattcccaagaaaaacggcaccctgcggaccatttctaagccgcatccagccgtgcgatctctgcagaataaactgctcccctttcttacttccgcatatcgacctaaaccaagtgcacatggctttgtcgtccaaagatccatcgtaagtaatgccaggccacacgtaggaaaacgcttcatcttaaacatagacctcgaggactttttcccttcaatccatttcgggcgcgtgaggggaatgctcatggcagtgccttatcagttgccatcatcagttgccagcgtcctggctcggatatgttcgaatgaaggagtcctccctcagggagctccaaccagccccatcatatctaacatgatttgcgctcggatggatgctgatttgcagaggcttgcaggaaaacatcggtgcacttacagccgctatgcagatgatctgaccttcagcacgacaagtcgccgttttcctgagcaacttgccgtgcccagacacgggctggtgggtgaaaatctgcagataggcgagccactcattgccacaatcacagctaacggctttcggattaacactgcgaaacagcgattacaacctaggcaccatcaccaggaggtcacggggatcacagtcaatcgcttcctgaaccctagaaagaagctcgtccgtcaggcccgagccatgatttttgcctggaagaagtttggacttcaggccgccgcggccgaatttcgggagaagtacgatcccaaaccacgccgcgcctctaaaccgcagccaagcttcattcgtgtggtattgggtaaggtggagcacatccgaaatgtgggaggcgaggggcacccaggctataggaaactgctagctgctcttcaccaggcagacccgcaccacttcgagaagcccgccgaagccagaacctggaaccccagacccgcagacaccagttcctgggggtatctggccaagagatttcggaattctgtgttccacctggaggtgactaacaaagaaggggacctacagaatgggacgagcttcctctgggacgcaggctatctcgccacagcccaccataacttgatcggccccgttagcgtgatgatcaatggcatttcctcacctgttggggccggtgatcaactacaccatcccaaggctaatgagggcgtagatgctgccctgctgaaagtggcgcatacagcgactgcaggtaagctggctttcaagactcgggaatccgcaatcgaaatcggagagtccgtggcagccctgggctttcctaccgttcctatgtacgactctgccttgatcgtgagaaccggaatagtcgagggcaccgctccccagtacagcaaccaaatcgacggtattcaagtgtctatcaagttaacaggagggttcagcggcggcccggtgattgattccagtggtaggctggttggggtcgtgatggaagctaccttcgagaaaactgctgctggagtcccggggggtgaatttcaacacattctgcctgcaaggtacctcacagagatcagtaaggactctgccgaaacgtcacctcagttgccactgcagctgaaagtagttgattcaaagcaggacaccgactga

SEQ ID NO: 7810 - RNA, 1419 nt, unidentified
  source 1..1419: mol_type = other RNA; note = synthetic construct
atgctcacagagatgtacgtgccaaaagctgctgcccatggtttcgtcctaactaggagcattgcatctaacgcccggagacatgttcggcgcgagttgcttctgaatgtcgacgtggaaaacttctttggatcaatccactttggccgcgtgcgcggcatgttcggcaaacctccattcagtttcccaggcgttgtagcggcaaccttggcgcagttgtgcacagacaccggaactttaccacagggcgcgcccaccagccctatgatttctaacttcatttgtcggcgatttgacaatgatttacttcgactggccgggaaacaccggtgtgtatataccagatttgccgatgacatctcagtctctacacaagaattggccttccacgagtcaatagtgaaatcattcgactcctatggagcagacgtaacacttggggccgaacttgtcgcactctttgggaagcataagttcacggtgaacgccaagaaaacccgggtgcagtctcggcatcgcagacaggaggtgacagggctgatcgttaaccggcgactgaacgttcccaggatctacaccagaaggctcagaagtattatccacagttggcgtaaattcgggaagaccggggctgaaaccgtttttaagacactggatgcagggaggaagacccgctcaggagcttccccggatatccgatcccaccttaggggaaagatagagttcctgcgcatggtccgcggaggcggagacttgatctataccaagtacgcactggccgcctctaagctggtgggatacgatagacctggcagaattgagggggctgctgccgccatatttgagttttatagggaagctctctgggtcgtcgtgggcagagatgccctcggctcgctcatttcccagggtacagcgttttttctggacggcgtgggtttcgtgagcgcactgcatgtcctttaccctgctgactccagcattacaaagtggactctgattcgtgggtgcgcaccttacgatgaattcgcagtggttggctgtacacggcacccagcactggacctaacgatcctccagactgacgcaaggacgcatgccctgctgcgtggagatgagggccaaactctgcccggacaggccgtcgtagtgctgggtttcccaaattggcacactagcgccgataaacccctgagggccgatgccctgatcgtgcagcaaaagaccatcagtggttgcaaactagctagcgtgaactatccgcttttatccggggcctctggtggtcccgtcttgaatgccgaaggctgggtggtgggcgtgactgtgcacaatgctacttcccctgttctccccaatagttttctcgcgatagagcattttgctagcatcgtagggagccccttccacgctctgtga

SEQ ID NO: 7811 - RNA, 1674 nt, unidentified
  source 1..1674: mol_type = other RNA; note = synthetic construct
atggccaagagagatcaggtgaacgacgtggagccgttaggtacggacgcccacctgcgtgaagcctttccccgtcttatgactcgatgggacgttgctcgcctgttgagggtagatagtaaggatctccactattggtgttaccggaacggcgctcggtaccgagagttccaactccccaagaagtctgggggctatcggacgatttctgccccagaaggagggatcaggctggttcagcggaaattgtgccagattctcaatgctatttatgtgccgagacactctgttcatggcttcgtgccgataaaagggcgcgggatacttacaaatgctgagccccatgtcaaacagcgttgggttctgaacgtggatctgagcgacttcttcgactccattcactttggacgggttagaggcgtgttcgaaaggtttggcgctggtcctgacgccgcggatctgatggccagaatctgttgttttagaggccgcttaccacagggcgtgcccacaagccctgtcgtgaccaatctcgtgtgtcgcagcctagatcgcgctctgcaggccttcgcaaagacccataggtgcgcagtaacacgatacgcggatgatataaccctatcaactggaagagcagggtttgatgacgcggtggtgtctgtcaagcatgacgagggcaggcgggtggctgagattggacacgggcttcgctttcttatcgagagccacaacttctcagttaatgagagcaaagtgaggctctcgggaaccttggatcgccaagaggtgaccggtcttattgtgaatcggaagaaaaacgtcccaagggaatacgtgcggaacgttcgggcaatgattcacgcagtagaaaggtacggtgttggcgaggctgaaagagtattccatgaccggttctcccgatctagacgaccagaccttcctgccgccgactttcttagggcactgcgtggccggctggaatttatcaggatggtcaagggggatcatgacgctacatttgtatcactgtggaatcgcgccgcacggttccaccagtggctgactcccagaatcgtggacttgtcccatgtagagcaggccctctggatcgtagagtccgaggtggccactcagggagtgtccatcagacgtcacggaaccgcattcgtcctgaaggacgtgggattggtcacagctggtcattgcgtcggggaaagaatgcgcatctggcacccaacacgacctgcagagaggttccctgcccgaataagagcgctgtgcacggccagtgacctgtgcgtgctggaacctcctcctcgcgatcgactgccagctctggacagaggtgatgcaggcactgtcgccgaaggagtcgaaatcggcactgcaggatttccagacgaacctgttaaagtggcccaattggagggacgggtcagtatgatcagactgcggtttgggcaccgcaacctattccccagctttgagacaaggaaggggatgtcaggggccccattactcgatgccaggctccgtgtggttggcgtggtcctgtatggccccgacaggagcccctctggtgaggaagatcgcgtgcccagttcggctgtcgcgatcgatctgattgacgagctcccaaaattcaccggctcctcccccgccttactcacctga

SEQ ID NO: 7812 - RNA, 1467 nt, unidentified
  source 1..1467: mol_type = other RNA; note = synthetic construct
atggtcgatagacctgttaaatctctgctctccgtgaggacgatcaccaatctagccgatctgctcgatgtgactccgaatcagctcaagtatcttatgcgagggttgcgctcagaggagcgatacttgcggtttcacattccaaaaagaaacggaggcctgcgggtaatctattctccacgacgtgagctgaaagccattcaggaaagattttctcgcttgcttgtgggcatttacaacccaccaggaccggctcatgggtttaccgccgcacggtctatactgacaaacgcaatcccacatgttcggtgtaggtgcgtccttaacgtcgatttggaggacttcttccccagtataaatttcggccggatccgtggcctgttcaaatcattaggtgtgcccgaaagcggcgccaccgtgatggctcagttatgttgccacgatggcatcctgccccaaggagcgcccactagccctgtgctcagcaatatggtgtgcctgagcctggacaggaaactggtaaagctggccgcagtgcaccggtgtcgttacacaagatacgctgacgacataacattctcccataagcaccaaattctgccctccgagcttgcttatgtcgacgacaagggagagcctgtagtcgggcatgagctctatagggcgatcaaggagagtggatttgaagtcaatgtgaagaaagtccggttatttgacaacaggcatcgccaggaggtgactggactgactgtgaatgagaaacctaacgtgccaagaagattgattagacagatccgcgctatgatccacgcctggcggaaacacggtgaagctgctgcagaggaggaacacttccaatgttactataggagggtggggcggcgatctcccacgaatagttttagagacgtcctggtgggtaaaatgcacttcgtgcgcatgatcaagggggccgatgataggacttaccgtaacctccagaggcagctggcccatgtttatcctgagtacctagcggttatgcagaaagagaatctcaccctgaagaaacggcatctgttcatctgccacgcctccgaggacaaggaatcgtttgtccgccctctcgttgatcagctgcttctcagaggggtttcagtgtggtatgatgagtatgaacttacagtgggcgacaaccttcgcgagaagatcgacgaaggcctcaagagctccctgtacgctgcagccgtgctaagcacatcatttttcggcgacaaaaagacctggaccaccagggaaattggtggagtcactgccctggaagatgcagacttaagacctcgaatgttgcccatatggtacaacctgcgccagagtgaggtagcaaactacgctccaaccctggcggggattgttgccttgtccagcccccgccaaacaattgaagaaattgccgatgaactcgcaaagaaggtactaaagaagtga

SEQ ID NO: 7813 - RNA, 1419 nt, unidentified
  source 1..1419: mol_type = other RNA; note = synthetic construct
atggccagcctgcttgacgtgagctcaagacagctgaactatctgctatatgtacggggcgagtccgagcgctatatcgctttttctatacctaagcgtcgaggggggattcggcagattctcgctccccatgatgatctgcgccatgtccaacacagactggccgaggttctcaatagcctttacgcacccccggacgtcgctcatgggtttgtggcgggccgctctatattgtcgaatgccgatgctcacgtgcgcaggcggcatgtgttgaacgtggatctggaaggattcttccccagtattaacttcggccgggttagaggcatgctcctgtcccctccctacagtctgactgcccaggctgctaccgtgtttgcacagatctgctgtcacaataatgaactgccacagggagctccaaccagccctgtggtcagcaacatgatttgccgacggttagatcgacagctatcgagactggctggcaaccacggatgtggatatactaggtacgtagatgacctgaccttttcccggagaacgggggccttccctcctcaactggcgaggtggggggaatctcgacgctgtatagtttctgacgagttgcgctgcatgattgaagagaatggattctcaatcaaccccagaaaaacctggctgttcagtagatgccacagacaggaggtgacaggcctgaccgtcaacacaaagaggaacgtcccgcggaaatacgttagacagattcgcgccatgatccacgcgtggtcaagatacggcatagaaagagccggccaggtgcacgcagccgaattttaccgacggcaaggtcgccaaggcgatgtccccccattcgcactcatcgtgcggggaaaactggaatttttgaggtccgttaagggcacaacagacccagtgtacaagaatctccagagccaactcgtccgactggacccagcctatttgcaggtgatgcttcgggagaatgccatgcttaatcgtagggatgtatttattagtcatgccagcgaagacaaagacgtcatcgcgaggcctcttgcagaagagctaatcaggctcgggctgaccgtatggttcgacgagtatgagatctcaataggtgattcccttaggcagaagatcgatgacgggctgagccagtctgccttcggtgtggttgtgctctcacacagttttttcgccaaaaggtggacaaggcgtgagttagacggattaactgcccaagaggacgctacgaaccgcaatcgcatcctcccagtctggcatgagattacccacgccgaagtgtctaagcattcccccacattggccggtgttcgggcagcaaggacttccgatcagactgtgcagcagatcgctcacgagattgcagaagtgatccgtaacgcatcctga

SEQ ID NO: 7814 - RNA, 1716 nt, unidentified
  source 1..1716: mol_type = other RNA; note = synthetic construct
atggccgacctccgcttgacgagccccccttacgttctggttgctgcatttcgcagtctaacctcagtcggcgatctcgccactctcctgcaggtgcgcccggatcaactccgacactatacatatgggagggggtatagataccgcgccttcacaattaagaagaggaggggaggggtcaggaccctcaaagaaccacactccgggttaaaaatcgtgcagcaaaagttagcacaagttctgacaaccctgtacgaggcgccagactgcgtgcacgggtttgtggcaggtcgcagcatcgccacaaatgcccacttgcatatagggagtgaatgggtgttcaatgtagacctgaaagatttcttcccgagtataaacttcggccgggtgcgaggactgttcatcaagaggtacggactgcctgcgaacgtggccacggtgatagcccgcatttgtacccacaagaatgagcttccgcagggggctccatcctcgccaatcgtatctaacatggtggcggagcgactggaccgcgatctgcagagactggcacggaggtaccggtccgcctatacccgctatgcagacgacctgactttctccagaaacgatcggtttcctgacgcaattggttattgggaccctatagccctcccagtacggcaaagccgggtgggacacttactggaagccgccgtcatgaaaaatggttttgagattaaccctgcaaaggtacaccttcgcctaaaggacgagaggcaggtcgtaacaggactagtggtgaatcgtaaagtcaacgtccgcaagctttttgtgaggcggattcgtgcaatgctgcacgcctgggaaacccatggcgagaaagaggctgaacaggaatactttaacagatacgacacgaaggacagagctccccatgctatcttttccttcaggcgggtcgtgaaagggcacatcgatttcctgggcatgatccgtggcacagatcatagttggtaccgacgattcgttatgcagtacgcccacctggtgccaggttatgttgctcgtccagaacattgccggaggcctaatcatctcaggacctggaaggatgctatctgggtcctcgagactgaagagtcccagggcacagccttcgagctcactggctacggcctggttaccgctgcgcatgtggttagggatacgactttgcccggacatcctccatactctaatcctcacgtctttagcccccggaatgaggcacttaaacatccggtgcgaattgccgcctatgacgccgacctggacttggcaatcctcgaatttgatgcccccacacgttgtgccttgagaactagaatggctcccgcggctgtggctggagatcctattagagctgccggatttcctagctatgcgcccgggtcacagttgtgggaagagtccggctggattaaccatgttcggagacacatcaccgcacccagatatgtcgtgacaaccccaatcatcgccggggcctctggctctcccgtaatggaccttgagggacgggtcattggcgtggctaccaccggcgtgctgtcgttctcagctgctgcagctagatcaactggtgccgccggactgcccgattacggtgtggtgccaatagcgttacttgcaagagtctctgttgccgctactcccgcaagctttagcgcccctgatgcacacggctctccctga

SEQ ID NO: 7815 - RNA, 1494 nt, unidentified
  source 1..1494: mol_type = other RNA; note = synthetic construct
atggccgccactgaagtcgtctccgccctaggcggagtgaggacacgcagtgacgtggccaacctgctcgcaaccagtgacgcccagcttcgttacctgctgtatgggagacatgaggatagccgctactgtaccttcagagtacctaaaagaaaacgaggctttaggacaatcgaggcgccaagggaggaccttaaactcctccaacggcgtctggtcgtgattctttcggctatctaccaaccccgcgctggggttcacggcttcactgtgggacggtccatagtgaccaatgcaaggcagcactgtgggcggagatacgtcctcaatgttgatctgaaggacttcttcacaagtatcaacttcggtcgcgtgtttggattgttccgcgccccacccatctctgcgagctacgagacagctactgtgctagcccaactgtgctgtcaccggaacgtgttaccccaaggcgcccccacctcaccgatcgtttctaacatgatttgcgctcgcttggaccggcaattgagcaagctggcacagcggaattggtgtaggttcacgcgttatgctgatgacattactttttcaaagcagcgaggggagttccctgaggaaataggttacctcgaccgagaagatgtagctcagcctggcagtgaactgcggagaatcatagaggcaaatggattcgctatcaacccatccaaagtcagcctgcgaaccaaaaagcgctctcagtctgtgaccgggttaactgtaaacgagaaatgcaacgtgcaccgcaactttgtaagacaggtgagggccatgattcattcatggcagaagtttgggttcgacgcggcccataatgaacatacgtcgcgttattacagaaggcttgggaaactgggtaaccctccacggctcgatcagatcattaggggaaagctcgccttcgtgcggatggtcagaggcggcttggaccccgtatataagaatctgcagcttcagttgtgccgagtggatccctcctatttggacgtgatgaggaaagaaaatgatcggatgaagagaagagacgtttttctgtctcacgcttccgaggacaaagagactctggtgcgacctctggcagattctttaatcgcagccggcatatcagtgtggtatgacgaatacgagattcagctgggcgacagcctgcgcgaaaagattgatgaggggctggcaaagtcaaggtttggcgttgtggtcctgagcagacacttttttagtaagaggtggccacggagggaacttgacggtctgacagctcgcgaggatgccagccatggaaatatgatcctgccggtgtggcacggattgtccaaggccgatgtcgcaggatatagccctaccctcgcgggtttaaaggcccttctaaccgatgggaagccactagctgaggttgccgtcgaactggttgcacagctccgtggcagactcaaaaaaacaggcggatggtcctga

SEQ ID NO: 7816 - RNA, 1479 nt, unidentified
  source 1..1479: mol_type = other RNA; note = synthetic construct
atgcggatctggacggtgtccttcgagcccaccgtgttccaagaggtgactagtatcgtggacgtcgcaaacctcctcgggacctctgtaaagcagctaatttacctgctgtatgtgcgatgggaaacagaaagatacacaagctttgcgattgcaaagcggaccggggggactaggacaatttcagcccctaaacccgagctgaaacgaattcaaagacgccttgctgactttctgcaggacaacttgaccccaaaaacctgcgcacacggatttgctaggggccgaaatatagccagcaacgccgaggaacatgtgcaccatcgtatcgtccttaacatcgacctatccgattttttcccgacgatcaacttcgggcgtgtacgaggggtctttatggcccagcccttcggcgcatcccctaaagtcgccaccctcttggcgcagatctgctgccacgaaggtagcttaccacaaggagcacccacttctccagtcgtgagcaacatgatctgttttagaatggacgcccaactcatgaggctggccaaggagcacggttgcttctatacacgatatgctgatgatatcagttttagcaaaagaaagggagagtttccagcggagctggcaaccgtgggcgacaatggcaaggcagttgtgggaaaaagcttgcgcgacattatcgagcataacggcttcagggttcaccccctgaaagtgcaccttcatcacaatactaccaggcagatggtcacggggcttaccgttaacaatcgggtcaatgtgccgcgcgccttcatcagaaacatccgggccatgattcatgactggcgcgtgaatggctacgaggccgctgaaacacggcaccatgccaattactattctcaccctcaccgctccgttaaaccccctctgcgcaagattattgagggaaagctgtctttcctcaagatgatttccggagtcgatgacccagtgaggcagaatctgcagcggcagttcgttaacgtatgtgaagaatacaaagcggtgatggaggacgagggtataatgcatgattttttcatatgtcacgccagtgaagacaaggacgaccttgttagacctctcgctgaagccctgcgcagctggggagtaagtgtctggtatgacgagtacatgctcactataggcgatgatctgagagaaatgattgatgcaggcttggccaattcgaggtacgggatcgtggtactgtcccctaggttcttcggcgtgaagaagacttggcccaaacgggaggtgggtgccctgttcgcaatggaagacgctgatggcaagtctagggtcttaccaatctggcatgaagttactcagcctgatgtggccaagcggtcaccaacattagctcgtatcttggcttggcactcagctgatttttcacccgaggagctggctgctaagtttagagattttatagtgacacggagacgctga

SEQ ID NO: 7817 - RNA, 1677 nt, unidentified
  source 1..1677: mol_type = other RNA; note = synthetic construct
atgttcggaataccagccggtctgcacgagtgttttacagtgagtgacctgtaccaattcctcggtgtcgatcccgagactacagggggctttctctacggggacgccaccaaatacagagtttttagcgttcctaaaaagtcagggggggagagagagatagtggctcccacaaaaaggctcaaatacctgcagaacaaagtgaaagccgagcttgagagttactatagtccaaggaagtgtgtacacggcttcgtgtccggacgctctgtaataagcaacgcccagtcacatgttcggaaggaatatgtgctcaacattgatctcgaagattttttcggaagtatcaacttcggccgtgtgtccaagctgtttcagaggcctccattgaacctccctcatggcgtggcatccgtccttgctcacatttgctgccaccggggagttttgccacaaggcgcacctacatcccccattatttccaacatgattgctttcaagctggatcgacagctgagggagctggcttataagtgtagttgcacttacacacgatatgcagatgacatcagcttttccttcaccaatagaaagaagtctttacccaaggccatcgccttttttgattcgaatgacgaactggtgctgggcaaagaactgaaggacattatcgaagacaactggttcaaaatcaatgataagaagacccgtattcagcatcgcacgcagcgtcagtctgtcacgaatataaccgttaatgagaaagttaacgtgaatcggaaattcattagacagacctcctctatgctgaatgcattgttcaagtatggagctgtggaagccgagcgcgaatatttcgaaaagtaccataagggctatattgccaacagacagcgggctaaaatgagcgagcaaccaggaaaattattcacccagaaaattaggggccgactcaatttcataagaagcgtacgcggatcaagttgcaacgtttggaggtcattgatgtaccggtatactgtggctatcggtaatccgaacgaaatctacaaccgctcttggtgggagatcgccgcagagtcaacctatatcttatatgacctctcagcggaaggcaatgggcagggaagcggattcctgcttgatggcatcgggctggtgactaatgaacacgtcattgccggcgtcgaacagaacaacatagtggataccctgtccatcgagtggctgcccaacaccaaaaaggagtttatcgggctaaacgtggcctggaagaatgcggaaaaggacctagcagttattacgagcgactttgtattcaatgatactgtcccgctgacactagagcgaaatcccaattactcggtggggacagagatctttgctatcggttaccctgcttacgagacacggggggccaacaaggcaaccatccttcaggccaaaatcaccggcgaggtggttcgcgaaggacaagacagggtcgtgattgaccagcccattatccacggccattctggtggggtcgtattgaatacagacgggagagtcataggtgtcgtggccaacggcaacgctgagggtgaagtgaggactactccttctgcgtttatcccaatcagcgtcctgcttgaagagcacgatcggcaaactaaggcgagctccgtggaggcatga

SEQ ID NO: 7818 - RNA, 1677 nt, unidentified
  source 1..1677: mol_type = other RNA; note = synthetic construct
atgttcggaacccccaacggcctgcatgaatgcatgacagtcagcgacttgtatcgcttcttggggtatgacgaaaagaacacgggcggatttctgtatgggtcagcgattaaataccgagcattctctgtggccaagaaagggggaggcgagcgaaaaatctactccccaattaaaaagctcaagaacttgcaacacattgtgaagagtgagctggaaagctactatgttcctcgccaatgtgtccatggattcgtgagtggtaagaacattatttcaaatgcccagccccacgttagaaaggagtatgtactgaatattgatctcgaggatttcttcgggtctataaatttcggccgtgtgcgcaaactcttccagtcatcccccctcagccttcccccgtctgttgcctcagtgctggcccatatctgctgttaccgcggagcactgccacaaggtgctcccacctcgccaattgtatcgaacatgattgcttttagactggacaggcagctacgggagttagcatataagaattcctgcagctacaccaggtacgccgatgacatctcctttagttttactaaccgcaagaaatctctccctaaagcgatcgcgttttttaacggagaggacgaactggtcttagggaaggatctgaaagacatcatcgaaaacaactggtttaaggtcaacgataaaaaaacacggatacagcacaggacccagaggcagtcagtgaccaacatcaccgtgaatgaaaaggtgaatgtcaacaggaagttcattcggcagacgtcttcaatgctgcatgctatcattaagtacggcgccgtgaaggcagagcaggagtattttgagaagtaccacaaaggctatatcgccaacaaacaccaggctaaaatgcgtgaagaaccgggcaaactgttcgttcagaaggtccgtggtcggctcaattacattggaagcgttagaggcaattcctgtgatgtctggaggaaattgatgtataagtacaccttggcaattgggagccctaacgaagcttacaacagaagttggtgggagatcgccgaagagagcacttacatactctacgaccttagtgaagtgggcaagggacaggggtccggctttctgcttgagggtattggcctgattactaatgagcatgtagtgacaggtgtagaacaaagcaatatcgtggattcccttgtgattgagtggctgcccaatcaaagcaaacagttcatcgacttaaatgtcgcctggaaagacgtggacaaagatctggcagtcatcacatctgattccatttttaatgacactgaacctctcaaggttgaacccaatccaaattattcacggggcaccgaggtatacgccataggatatccagcctacgagagtagaggtgataagtctgccacaacactaaaggcaaagatcactggggctacaaaacgggagggccaggacagaatcgtgatagacaagcctatcatacacggccactccggtggagccgtttttaatctggacgggcgcgtgatagggatcgtggccaacgggaacgctgagggcgctatcaaggctacgccatccgcgttcatccctatcagcaccctacttgatgagcacgatatccgaatgaaggcacagtctactcagacctga

SEQ ID NO: 7819 - RNA, 1692 nt, unidentified
  source 1..1692: mol_type = other RNA; note = synthetic construct
atgttcggcgtccccaccaagttacacgaatgtcttaccgtaacagacctgtatcagttcttgggcgttgatgaggacaaaactgtgggtctgctttatggcgataatatccgttacaggtcttttcaaatcccaaagaagggcggtggggaaaggacaatttttgcacctgtgaagtctctcaagaacatccagaaaaaggtccaggcggaattggaaacgtattacaagccacggaaaagtgtgcacggcttcgtcgcaggacgatcagttctgactaatgcgaagccccacgtacgaaaggagttcgtcctgaacatcgacttaaacgactttttcggctcaatcaatttcggtcgagtgtctagattattccagagcccaccactcagtctgaatcagaatgtcgcttctgttctggcccagatttgctgttatgaaggcgtcctccctcagggagctccaacgtcccctgtgatctccaacatgatatcctttagactggatcggcaactgagaaaccttgcacatagacattcttgcacctacacaagatacgcagacgatatcagctttagcttcacaaataaaaagcgcagcctccccaaagagattgcattttttgatagcaatgacgagcttgcgctcgggcatggtctgacatcaatcatagagtccaactggtttgagatcaatgacaaaaaaaccaggattcagcatagaacccaacggcaaagtgtgacgaatgtaactgtcaacgagaaagtgaacgtgaaccgcaaattcatcaggcaaacatctagcatgctgaacgctttgctaaaatttggggccattgaggccgagcgggaatattttgagaagtaccatcgcggctacatcgctaatcggcaacacattaagattgccaagagccccggaaagatctttctccagaaagtgcggggacgtctgaactacattaggtccgtccgagggaagacctgttccgtgtggcgcaagctaatgtttgactataccgtggccattgggaagcccgacgaaacttacaaaaaatgcttctgggagattgcagccgagtccacttacatagtttatgacataacagccgaaggagacggacaggggagtgggttcttactcgagggggtgggcctggtaactaacgagcacgtgatcgaaggcgtgaccaatgagaatatagtagacgcactggttttgaggtggctgccgaatgaatctaaggaattcataggcctggaacttgcctggaagaataaggccaaagatcttgctgtcataacctcggatttcattttcaaagataacaatcctctcgagatcgagccggagccggattattcagagggagccaccgtgttcgctatcggataccccagcttcgagtcagaacatggaaacagagctacaatcctgaaagcaaagattaaacgccagatgactcgtgaaagtcagcccaggattctaattgatgagccaatcattcacggtcactcgggcggggttgtgctcaacgaacacggtagggtcgtgggggtggttgccaacggcaatgccaaaggagccttgcgcctggcccctgatgcgtttatccctatccaggtgctgatcgaagagcacgctaaccggcagtccgctaagaaggctgccgttttgcaggcagtgaactga

SEQ ID NO: 7820 - RNA, 1674 nt, unidentified
  source 1..1674: mol_type = other RNA; note = synthetic construct
atgttcgtcacccctactggcctgcatgagtgcaaaactgtctcagatctctacagattcctcggttgtgatccagcgaccttcggcaattacatttacggaaatggcatcaagtacaaagagttcaccattcctaagaagaacggggattcacggaccatcctggccccagttaagaagttgaaattcctgcagcagaagattaaagctgagttagaatcctattacactccgagacagtgtacacatgggttcattccaaagcgatccatcatcagcaacgccaaatcccacgtccgaaaagaattcgtccttaacattgacctcgaggggtttttcagctctattaactttggtagggtgagtaagctcttccagagcccacccatgaacctgccacccaacgttgcaagcgtcttagctcacatctgctgttacaaaggctgcctgcctcaaggtgcccccacatctccagtgattagtaacatgatcgcttatcgtctggacaggcagcttcgcgaactcgcatataagaactcctgttcttacagccgctacgccgacgacattacgttcagcttcacaaataagaagaagagtttgcccaaatctattgtgttttttaacggggaagatgaattgactttgggaaacgacttgactaccgtgatagaggggaattggtttaaggttaatgagcagaagactcggatccaacataggacccagcgccagtccgtgacctccataacggttaatgagaaggtgaacgtgaacagaaaatacatcagacagacaagcgccatgctgaatgcactgcttaaatacggtgccgaagaagctgagagagagcactttgaaaagtatcacaagggatatatagccaataggcagtatagtaagataactgagaggccgggcctgctgttcacgcagaaggtgcgcggaaggctcaacttcatattaagcgtccgtggacagtcttgcgagacatggcgaaaactgatgtataagtacaccctagccatcggcgagcccaaagagcaatataataagtcttggtgggaaatcgcagctgagtccacatacgtgctatatgacatatcacaggatggcgacgggcaaggttcagggtttctgctcgagggcattggcctcatcacaaatgagcacgtaattgagggggttgaacagcaaaacatcatcgatacccttaacattgaatggctttcgaacccatctaaaacgtttctggccctggagcttgcgtggaaagataagcaaaaggacctggcagtaattaccagcagtctggcgtttaatgacgtcgaacctttgaaggtggagcctaatcctgacttttccgtcgggacagagattgtagccatcggctatcccgcatacgaggcgagaggcctgaacgaagccaccatcctcaaagctaaaatcacaggtacccagaaacgggagaatcagcctcgcatcgtgatcgacaagccgattgtgcatggccattcgggaggagtggtactaaataaagatggccgggtgatcggggttgtggcaaatggaaatgctgaaggatcagtccgggccactcccagtgcttttatccctattactgtgctgatcgatgaacacgaacaccagaaaataaagaaaacagagccctga

SEQ ID NO: 7821 - RNA, 1698 nt, unidentified
  source 1..1698: mol_type = other RNA; note = synthetic construct
atgattaaacccccacccatcttttttagctgggatattctgaacatgttttgctccgttaccaagttgcacgaatgtaagaacgtcgagcaactgtattactttcttggatgtgaggctgcggagatatctaagttcctgtactcaggcgtgatcaaatacagatcctttagcattctgaagaagaatgggaatctccggaatattcgtgctcctgtgaaatacctgaaggagatacagtacaagatcaaagacgaacttgagaaatactacacgccaaaatcttgcgcccatgggttcattactgggaggaatatcatcactaatgcaaggcctcacgtgcgcaaagaatttattctgaacgtggatctgaagaacttttttgactcaatcaacttcggcagagtaagtagactcttccaaagtcagcccctgaacttgcctgagaatgttgcgcacgtgctggcccacatttgttgttacaataaagctttacctcagggtgcacccacctccccaatcatttccaacatgattagctacagacttgacagacagttgaaagaattagctaggaataatgcctgcacttatacccgttacgccgatgatatcacattcagctttactaagacaaagaagtatctaccgaagtctatcgtttctttaagcaaggataacaacattatcctcggacatgagtttaagaaagtcattgaggacaactggttcgagataaatgaagagaaaataaggctgcaacacaagacgcaacggcagagcgtgacaaatataaccgttaacacgaagatcaacattagtcgcaagttcaagaaacagactagtgctatggtcaacgcattattcaaatacggagccgctgaggccgagagagagtacttctcaaaatatcacaagggctatatcgccgagcggcagtataataaaatcaaggagaaacccggcctcctgttcacccaaaaggtgaggggccggctcaattatataaggttggtatgcggtaagaataatgaatcctggcgtaaactgatgtataagtacacacttgctattggccagcctaacgaggaatataatcgaactctttgggatatagcaggggactcgacttttatcctgtgggcaaattcatcacaggggtctggtttcttcctcgaaaacataggtctagtcacaaacgaacacgtaattaaaggcattgaggactccaatatcaacaacgacttgataatcctgtggctgcctaacgaacgaaaggagtacatcgaactgcatttggcctggaaagacgacaataccgaccttgcagtcataaccagcaacatcagttttctcgatatcaagccgctccaggtggaacccgttccaatctacgatatcgggaccgaggtttatgctgtgggatatccaaactatgatgcccgcgggtccattggcaaaccgaccatcatcacagcgaagatcacaagcatcatcacccgggaacgccagaaacggattgtcatcgaccagcccatcgtgcacggacattctggaggcgtggtgctaaacgccgatggacgagtcattgggattgtagccaacggtaatgcagagggcgaactccgcgtggtgccaaacgccttcattcctattgagacactgctgaatgaacataagtcgcgcaccaagctgtga

SEQ ID NO: 7822 - RNA, 1608 nt, unidentified
  source 1..1608: mol_type = other RNA; note = synthetic construct
atgctgtcttatctgtacagcaaggatatcaagtatcgcaatttcgaaatagacaaaaagaacggcaagaagagaaaaatcgtcgctcctgtgaagaaattgaagttcctccagtacaaggttaaggctgccctcgagccatattacaaacccaagaaatgcaaccacggatttgttaaagaccgggacattgtcaccaatgcacaggcacatctgcgcaaagagttcgtgctcaatatcgatctggtggactacttcggaaacatcacattcggtagggttaaacgcctgttcgagtcaaatcccttaaacctgagtcactctgtggcaacagtcttggcacaaatctgctgccataacggctgtctccctcaaggcgccccatcttcccccatcgtgagcaatatggttacgtttaagttggacaatcaactccgagctttagcgattaagtcatcttgttcctatagcaggtatgcagatgacatcactttttcctttactaacagagaaaggagcctgccaaaaatgatcgccttttacaagaacgagaaactacagctggggagtagtctggaaaaggtgattgaagagaatggattcagtattaacgacgacaaaaccaggatgcagcatcggacccagagacagtcggtaaccaacataactgtgaacgagaagattaacgtgaatcgtagatttatacggtccacttctgcaatgatcaacgcccttattaaatatgggccagccgccgctgaaaaggagcacttcgaaaaatacctaaaggggtatatcccagcccgccaccatatgaaaatggctaaatatcccggaaagatgtttatccagaaagttagaggtcgactgaactttatacgaatggtgcgtggaaacacatgtgatgtttggcgtaagatgatgtacctttacaccgtcgctataggtgctcctaatgaagattacaatatgtcatggcttgaactggccgcggagtccacactcgtgattcacacctacactgattccaatatggcacaggggtcaggatttatagtggaggatattggcattattaccaacgagcacgtcgtcagaggcataacaagcaagaatatcaaggatggactggagatgcataggtggaataatgaaacagccaagttttcctttgtagaattgatcgggatggatgaggatatagatcttgccatcttcgaaccatccattcacttagccaccttcacaccgctgaagatcgagaacaatcctgactactcgaacggtaccatcgtgcatactatcggatatcctaactaccagagcggtgaggagcctacgtacatcacagccaagatcatcggcaaaaccaaaaggatgcttcaaccccggattaagattgacgaaaacatccggcacggcaattctgggggcgtggtaatgaataccgatggcaaggtgattggggtcgtctcaaatgggaacgccatcggcgctacgtctcagaatgacagcagtttcattccgattcagactctcctggaatatcacgagaaactgcggaacttggtagcgcgccccttccttgacgaggtggacagcctctga

SEQ ID NO: 7823 - RNA, 1698 nt, unidentified
  source 1..1698: mol_type = other RNA; note = synthetic construct
atgcggcaaaaccctcccgccttccttcgcgaactgaggtatcttatggactctcagactgtgctacccccacgggctaaactggccaattgctcaactctggatcagctggcctctctgctgaatacagaggtagataaactgctaaagctgatatatccccataacaggcagtacattagtttttcaattcccaagaaagacgggtcccggaggttaataagcacgccaaaaccgacactgaaaaactaccagatgatcattgcaagcgagcttcaccatcattacatcccgagagcatccgctcatgcctttatcgagcaaaaatctgtgctcaccaatgcttcccctcatgtgaataaaaggtacgtcttgaatttggatctggaggacttcttcggaacaattacttttggccgcgtcaagcgtcttcttcagagccctccactgtctttaacccacaatgttgctactgtggttgcacacatttgttgctacaagggcagactgccacaaggagccccgtcttcaccaatcattagtaacatgatcgcattcaagctggacaatcagctgctgaagctcgccaagcagtaccgattcacttacacccggtatgcggatgatatcacgctcagtttcaaccagaagcggaagacaagcctgcctaccgatatagtgaagtttgatgaagactcgctggccctcggtcggttactgctgcgtacgatcgagtctaacggattttcagtcaatgacgacaaaaccaggctagccactaaaaacgaccgccaggccgttacaaatttgaccgtcaaccaatttgtaaatgtcaacagattgttccttcgacagacctctgctatgatcaatgctctcaatgtgtatggagcccaggatgcagaaatcgagtacctaaagaagtaccacaaaggctatctttcaccccgaaagcagttaaagcacaagaatgagcccggcaaattctttaagcagatggtgcgtggcagactcaactttatccgcatggtcaaggggaaggatagcctggtctggcgaaagctcatgtaccgctacacagtcgcgattggtgagccaaatgcgaggtatgcgttgtctcccgcagaactcgccaaaagatccctctttgtaattcacaacctgacagatgattccgagggggtggggaccggtttcaagctgaacacatttggcatggttactaaccaacacgtgattgcttatctcgacaattcgaacctggccgacttctgtgtgattgagtggattgaaaaaatggaccagcaatttcccagtgtacagctcatcttgagtgatgaaaagtccgatattgctatagtggaaggggcatccatgaatatcgtgcctgccttggacgctagcacatccccagattatacccctggcaccacgtgcacactgcttggattccctaactataaaaccgaagacagcccaaccgttatagaatgtagaatcgtgcgcgagatcgaggtcgataacgaacccagaatcgttgtggacgagaaagttacacacggaatgagcggtgggcctgtgatcgacagtgacggcttggtgatcggcattatttcaaacggtagcaaatacaattccactgacgacagggtgaacgcattcatacctatcaagaccttactgctcactaaaaactga

SEQ ID NO: 7824 - RNA, 1722 nt, unidentified
  source 1..1722: mol_type = other RNA; note = synthetic construct
atgttcaccctggaggatcacatcaatccaaccagacttgagcactgttcagacctccatattcttagccgtctgttaggggtgaggagggattacctgcttaaactgctttattcggagaataggttgtactatcacttcgacatctcaaagaaaaatggtgataaacgcactattcacgctccgatcgagccactgaagaacctacaaaggaaaataaaggtggagctcgagaagtactatatcccccgaggttctactcacggattcgttaagaagcggaacattataaccaacgcaaccccacacttgcggaagcgccatgtctttaacattgatctcgcggacttcttcgggaccattacgttcggacgcgtgcagcgcgtgttgcaaagttctcccttcaacatgccttataacgttgctacagtggtggcccagatctgttgccatgaaggcgctctgccccaaggcgcacctactagcccaatagtatcaaacataatcgcgtttaagctggacaatcagctgcttaagctagcccagaagtacaggtgtacatacactaggtacgccgacgatatctctttttcgtttagacaacagcgtaacaagctgcctgaggccattgtttccttcaatggcgacaaagttataccgggggctaaactcactgacgtcatctccaagaacggcttcaaaattaattccagtaagacccgcttgcagtccaagcagaacagacaggccgtcactaatatcactgtcaatgagaaacttaacgtgaatcggcggtttctgaggagaaccagcagcatgctcaacgccgccttgcggtatggatttcctaaggcggaaagcgtacacttcgagcattttcactccgactacatccctccccgccacagcaaaaaaatgcatgaagaacccggcttactgttccggcaaaaattaagggggagactgaactttatccgcgaggtgagagggaaatcctgccccgtgtggcgtaagctgatgtacatgtatacagttgcaactgaagagccaaatgaggattacaatcttagcatagatgctatcacggcccgaagtacggtggtcatatgggacctcagtaattcatgcggcgaaacattcagtggctcaggtttcatgttgaaaggggctggtctagtgacgaaccagcatgttgtaaagggaattatcagcggcagagaggcaacagaactgcagatcgactggctcgaaaagaaatgcctgaattttctcgacgcccgaatcgtgattgcagatggatgtgccgacgtagccctgatcacaagttctatcgccgatcggcacatggagcccctcgatattgaaccctatccagattactccgtgggcagggctgtcaagctgattggataccctgattatcgggaaggcgacaccttttctgtaaccgataccgtgattgttcgagagtacgggcaggctgacagccgcagaatcgaagtcagagagcagattttccatgggatgtcaggaggagtggtcctgaatgaagacgggcgggtcatcggcatagtgtctaacggtattaaatatggcacaacatcccagctgccaagcagttttatccctatctcaacactgacagcaaaggtgaccaactttcgaaaggtgaaaattgagcagttactctccattttcgcatcctctatcaattctacctga

SEQ ID NO: 7825 - RNA, 1662 nt, unidentified
  source 1..1662: mol_type = other RNA; note = synthetic construct
atgttcgatatcatcgaccccaagacactgaacgaatgcttcacagtagagctcctcgctaaattcttgaatactgactacccgaatctgagtaaactgatttatggcaagaagtcaccttaccgaactttttatatcccaaaaaagagcggggggactcgtgaaattaaggctccaatcaaaaccctgaagctcatccagcaaaagctgaaagtggaattcgaagattatagctcaccccgcgtggcttctcacggatttgtgaaaggcagatccatcctgacaaacgcaaaactgcatataaaccggaattatgtgctgaacgtggatctcgaaagcttcttcaacagtattaattttggccggatcaagaagttgtttgagtctacccccttcaagtttacttcccctgtggccaccgtgttagcccaaatctgctgtcatgagaattcccttccacagggggcacccacttctcctattctgagtaatatgatcgcgttcaagctggacggagagctgatgcgcctggctaagaagatcaacttcaggtatactagatatgtcgacgacctaactataagctgccagtccttagcccagcttgagaaacataagatcatttacaggtcgaaggaagcgaaatacgaggctggctttacgctatcacgactgattgaaaagaacggtttcaagatcaacaacgagaagactagattacagcagaggaccgagcatcagggcgtcacaggattgaccgtcaacgtgaagctgaatgtaagtagaacatttatacggcagacctcctcgatgattaatgcactcattattcacggagctgagaaaagcgaacacgagcacttcaccaaatacttcgatggctatgtacccaatcgccaacagcagagaattagcaagaagcctggtgatctttttataaaaaaggtgaaggggagggtaaactatattaaaatgatccggggagccgcatgcccagtttatcgcaaactggcctaccagcttacgtgtggcctcgggtgtcccaatgaagattataataaggattggctcgattggatctctgacagcgttttagtgctggacaataatctcgacatcctgcagggcacagccttttacgcagacggattgggtatcgtcaccaatcaacacaacctcgagtccatcaccgaagataacattgccgggaatattaccttggtggagccactcaactattcaaagaaataccagctgctaggcttgaacaagacatccgaaaaatacgacattgcgctgatcgacttcggagtgcacgccaaatcaaagagggctcttgagatcgcagattctccgctgtacaaaacagggacaacagtttacgctatagggtaccccaatcactctgagggcactaaacctacgatacttgaatgtaagatcgttaacaaaaccaagtggcagggtgagtgccgttacaaaatagaccaaaatatccaccatggatttagcggcggcccggtcatagacaccgatggcaaggttattggtatcgtgagcaacgggaacgccgtgggagcaagtaaatccaccgaggacatgtttattccagtcgaaacggtcatgaagtttgccaacgacgccaaacctgaggattgttga

SEQ ID NO: 7826 - RNA, 1647 nt, unidentified
  source 1..1647: mol_type = other RNA; note = synthetic construct
atgtttggtattaccgagcccaagactcttaatgagtgctttaccgtggaatccctggccaagttcctgggcactgactattcaagtctggcaaagctcttgtactctaagagatccaactatcgaactttctacattcctaaaaagaccggcgggactagggaaattaaagcacccaccaaacgtctgcgcttcatccagcagaagctcaaggtgattttcgaagaatattccagtcctagggctgcgtcgcacggctttgtcaagaagcgcagcatagtgacaaacgcacagcaccatgtaggccgcgccttcgtgctgaacgtagacctggaggatttctttggctccatcaactttggccggatcaaacgactgttcgagagccagccctttaatctggcccaccccattgccacagtgttggctcagatttgctgtcatgagggttgtctcccacagggggcgcctacaagccctctcctgtctaacatgatagcctttaaacttgatggggctctgatgaagatggctaaaggcgtgaattttcggtacactagatatgtagacgatcttacaatttcatgccagtctctgacccaactcataaagcataagattgtgcagtgtgataaggacgggaagtattctgttggcttcatcctcaaccagttgatcgaacagaatggattcaagactaagagcgacaaaacaagattacaaaagcgaggagaacatcaaggtgttacagggctgactgttaacgagaaaattaatgtctcgaggaccttcatccggcagacctctagtatgattcacgccctgatcaagttcggagcagagaaggctgaaaaggagcactttaccaaatactttgatgggtacatcccaatcaggcagcaacagaggttgtcaaagttcccaggggatttattcattaagaaactgaaaggacgggtcaattacatcaaaatgataagagggagtgcttgcccggtgtaccgtaaactcgcgtaccagctcacgattgggctgggctgtccaaacgaagactataataaggactggctgaactggatcagtgagagcgtcctcgtcttggacaataaccttgatagcctgcaaggaacagcttttttcgctaaagacattggattcgtgacgaaccagcacaacttgaagagcatcaccaaggataactttagtggtaagatcaagttaactgagcccctgaattatagcaaaagctatccccttatctcctttctaaaatcatccgaggagctggatattgccctcatagactttaatatccatgagaaatccaagcggcccttagagatcgccgaatccttcgtgtgcagagcaggccagacggtttacgccatcggataccctaaccacgcagagggctcacctccgacaatccttgaatgtaaaataatcgaccgcgccaaatgggataaccaacttcgcattaaaattgaccagaatatccatcacggcttctcaggaggagcagtgatagacacggatggtaaactggtgggtatagtttctaatggcaatgccgtcggggccccacactctaccgataatatgttcatcccaatcgaaacactactaacctttgcgtccgaggactga

SEQ ID NO: 7827 - RNA, 1638 nt, unidentified
  source 1..1638: mol_type = other RNA; note = synthetic construct
atgctgttcgggaccacacccaaggatctcaagagttgcaacacagtagaaggtctggctcatctcctgggcacagactataattccttgggaaagctactctatgggaaaaagactttgtaccgcgcttttgacatagtaaagaagtccggaggcgtgcgtgaaattacaacgcccatcccatcgctgaaagtgcttcagcgcaaacttaaagatctgatcgaaccctttacaagccaccgagaggccgcgcacggattcatcagaaaacgaggggtgctgacgaacgctaccaggcacgtcggcaagaagcacgtgctaaatactgatctggaagacttttttgggactatcaactttgggcgcgtgaaacgactgttcgagtctagtcccttcgaattaagcagccaggtggcaactgtgctcgctcagatcgtctgctacaagaacagactgccacagggggcacccacctcaccaatcatctctaacatgatcgctttcaaactggatggtaacctcactagccttgctaggaaggccaaaagtacctacaccaggtacgcagacgatctgaccttctcctgtcattcatccatgctgttggagaaaaacggcataatcaaattcgacaaagataataaggccattgctggcaaggagctggtggccattataaaatcgaatggcttcgagatcaaccatcaaaagaccaggctgcagtcacgcggatctcatcaaggggtcacaggaataaccgttaatgagaagccaaatgtttctaggactttcattcggaaaacttccagcattctgtacgcaattaatcgctggggcgctgagcaggcagaagaggagcactttgccaagtaccgccgtggatattctccccctcgggcccaattgaggcggaagaagaagccgggcgacctcattctgaagatggttaagggacaggttaactacaacagaatgatccgtggtgagtcttgtccagtctatagaaagctagcgtaccagcttacaatcgcccttggttgtccgaacgaagacttgaataaagattggcggagctggattgctgagagtacattcattgtggacaatgtggaggatatttgccagggttcttgcgtgttaattaaggatatcggctttgtctccaaccaacacgtgctgaacagcatcaccaaatccaattttaccgccaacgtaacgatctgcgatccctatgactactcacggaaatatcctcttataagcctcctgaaaatgtccatagagaaggatatcgccttaatcgacgcaggggtacacgcgctcagcctgagaggcctcgaagtcgccgaatcacctaattacaagatcggcaccaaagtgatcgcgattggcttccctaatcacactgaaggtacgcctcctacaatactcgattgtaaaataatcggcagaactaagtggcatcatgaacctcggatcaaggttgacagtaatatccaccatgggttttcaggaggggccgtcgtggacttagacggcaaagtgattggaattgttgccaatggaaccgcagtcggtgctccgaaggccgcagacaacttgtttattccaattgagacagtggcccagtatgcctga

SEQ ID NO: 7828 - RNA, 1650 nt, unidentified
  source 1..1650: mol_type = other RNA; note = synthetic construct
atgatagacttcttcccaaaaaagttgtctgactgtgctaatgtggagatgctggcctaccttttagatacaaactatgaagcacttgggtccttcctatattcaaaacgcaagttgtaccgttcgtttgagattccaaagaagagtgggggcatgcgcgaaattaccactcctatcaaacccctcaaagagatacagcggaaactgaaaccgctgatcgaaccgtatacctcccacagagaggcagcccatggcttcattgagggaaagagcatcgtgagcaacgcctcccgccatgttcgaaaaaattttgtgttcaacctggatctgctggattttttcggctcaataaatttcggcagagtgaagagactcttcgaatctgcccccttcaacctccctgcaaaggtcgctactgtagtagcacagattgtgtgcttcgataatcagcttccccagggggccccaacttccccattgatcagtaacctgatagcctttaagctggacggcaacctgaccgctctggccagaagggcgggtgtgaattatagtcgctacgctgacgacctgaccttttcatcaaacagcttaaatctgctgaagaatcacgggatcctgacgatagatgagagcgcccaagtaaaagtgggaaaggaccttaaaaacatcatcaaggcaaacgggttcgatatcaatgtgaacaaaacccgtttgcaaggcagaggtcagcatcagggggtcaccggaatcactgtcaatcggaaggtcaacgtcactaggtctttcgtaaggaaaacagccagcatcctgtacagtatctgcaagtggggttctgctaacgctgaacgggagcacctgaagaagtatcgcacaaagtcgttgtctccccgggcccggcaaaggacctttctaaacgagggcgacttaatcctgaagattgtcaaaggaagggtcaattatattaggatggtcaaaggagaagcaagtccggtctaccgacgactagcttacagattgacagtggcgcttggctgtcctaatgaggattataataaggactgggaaaccttgctggccgaatccgtgtacgttctccataactattacgactccacccagggttcctgtgtgctgatcgagaatctcggctttgtgactaacaagcacgtgctcaagtgcgtgacgacttcaaattttgaggggcatgttgttattacggggccatttgattacgccaaggacctccctctcataagctttctcggggcgagcgacaccaatgacgttgccctaatctgcccctccgtgcaccaacactctcagcccagcctcaaaattgctagtagccctgattaccgtaaaggcacaaaggtggtggcgatcggattcccaaatcacacagagggcacacctcccgaaatcctgtactgtaccatccagggaaagacaaagtttcagaaaaacgatcggtatctgctctcatgcaacattcaccatggcttctctgggggtgcagtgcttaatcttgatggagacgtcatcggcattgttagcaacggaaacgaagtgggtgcccgcaaatccgttggaaacatgtttattcctattcaggatgtagctgaggcattatctcacatttccaaatga

SEQ ID NO: 7829 - RNA, 1806 nt, unidentified
  source 1..1806: mol_type = other RNA; note = synthetic construct
atggctgccttcgaatttaatttccccacaactatttgtgtcgggcatttttctaccgctgttttacactcgaagtttgcagataagttcgtagcgcagctggcgatcgaaaagacttggccgccactctttcacatacggattttcatgcctagcttcagtttaaaagagtgcaatgatgtgtggaagctctgcgatctcctgggtgtaaatttcgagaacctgagcaaaaaggtgtatccttctaacaatagactttatcggtgcttctttatcccaaagaagagcggcggccttagagagatttattgccctattaagtctctgaaaaacctccagaaaaagatcaagatcgagctggagaaggaaatcaaatatcgttctccagcccatggcttcataaagggtaagtctattatcacgaatgccgagcaacatatcggaaaaaccatagtcttaaacctggatctcgaagatttcttcaagaacattcacttcggccgcatcaaaaaactctttgaaagttccccactaaatctaaaacactccgtgtccacttttctggcccacatttgctgccgtgggggggtgttgatagccggttcaccaacatcacccatcatctccaatatgatctgttacaaacttgatggacagctgcagagactcgcaaaaaagaatcactgtacttacaccaggtatgccgacgacataacattctcatttacatgttcagagcgaaaactgccccgaggtatagtgcatattgacgagagcagccttctggggtttaagctgggagacgagttatccgaaatcatcagttccaataacttcacccttaacgagagcaaaatcaggttgtctaggaagagccagaggcaggaggttaccggacttatcgttaattctaaagtgaacgtcaagagggactttatccgcagaacaagctccatgatccatgctctcaagattcatggtgccgaagacgctgagaaggaacactacctgaagtacaagaaaacatacatccccgagagacaaaataaacggcagaaagacaagccgggggacttgtacaccaaagtgatcaaaggaaggctcaactacctgcgcatggtccgaggcgaagactgtaacctatggcggaaactgatgtacgatttcacagttgccatgaaaaacccagacgagtcatataagcgcacttggctggatgacgcagcagaatccaccgtgatatttaatacctatgacggctgtggaagtgggttcttgattaaccacgacatcaagaagtatccaaacggccttattataacaaattaccatgttatccccgagattaacagtgataacatctccaacattgaagtgcacacctggatgaatccttcaaagggctttttgctcctgaaatttgtggcatctagcaaggacctggatattgctatactgaccgccgatatcccgtttcctgtgtcgaaatttctggtcgtcaacagttgccccaattacagacctggcataaaaattcacacgattggctatcccgattactccagtggtgaggaccctactttcatctcaaccaagattaagggaaaaacgacttatcatggccagttgcggtaccaaatcatcgatgaaattaaacacgggaacagcggggggcccgtctttgatagcgaccgcaaggtaatcggaattgtgtctaatggaaacgagaagggcgctcctaagaataataagagctccttcatccccattgaaactttgctggacttcattaactgccagaagtga

SEQ ID NO: 7830 - RNA, 1647 nt, unidentified
  source 1..1647: mol_type = other RNA; note = synthetic construct
atgcaagtgcccctacccaacaaccttaaggactgttcttgtgttgaaggacttgcccagtatttaggctttactaactacgatgacctgaaaacactgatctacccctccgtcgatcacctctataaaggattctcaatcccaaagaagaacggcgagttccggctgattgatgcgcccaagaaggagttgaagaaaatacaaagattcctcgcaaatgaattggcccaagtgtacaccccgcgcaacgctacccatggattcgttaaagaaaggagtatcgtaacaaatgcctccaaacatgtcgacaagaaatacgtgctgaacctcgacctagaggacttctttggttccatccacttcggccgagtgcgcaatctttttcagagccacccattgaaccttcaccacagcgtggctactgtgctgagccacctctgctgtcacaacggcaagctgccacagggcgcccctacttcccctataatttctaatatgattgcctatcgcctcgataagcagctccagacgttagcgtctaaaaatcgatgtacttacaccaggtacgctgacgatataacctttagcttcactcagaccagagggcggttgcctaaacccatcgcagtcctgaccagggatttacaactcagcctcggaaacgagttgaaggagcttatcacggaaaatggcttcgtcatcaattcagacaaaacaaggatcgcagcccgaagcaatcgtcaggaagtgacaggggtgatcgttaatgagaggatgaacgtgagtcgcaaatatataaagcaaactcgctccatgctgtacgcttggaagaaatttggcctggaggacactgaggaaacgtatctgcgccagttccatggcaagaccgtttttgagaagcaccagagaaggatcgacgaaaagaagggtcagtttttcaagaaaatcgtgaaagggagaattaatttcatcaagatggtgcgtggtgcagatgacttaatttacagaaaggtggcctatgagttctcggtgctcatcggaaagcctaaacccgagctggtgcagacacctctggacaaagcctgcgattctatttttgtggtcgagaatctgctagatgactctcagggcacagctttcctcctaaaagggattggaatcgtcacaaatgagcacgttgttagaggaattgatgaagatctctcagaactgctggagttgtttagacatcacgaacaagaaaccaagcggccagtcaagttccagaaatcttgccggagccgtgacctggccattctgaagccaactacctcatttaacgggataaaaaggctgcaggtcggtgacgattcccagatcggcataggaagtgtggtaaccgtattgggctttccccagtactcaccaggggagacgccttatatcaacacagggaaaattattcagtcgaaggtcctttttggcgaacgggtgtggctgctggatattcctgtcattcatggtaacagtggggggccagtgttgaacgaccggcaggaggtaataggcgtagcagcgatcggttcccccacccatgacctgagtacaaagcttcatggattcatcccgattagcaccctgctggcttacgttgaagagtgcaattga

SEQ ID NO: 7831 - RNA, 1716 nt, unidentified
  source 1..1716: mol_type = other RNA; note = synthetic construct
atggtagatattgccaaaatcgcagccatcgccgcctcatcctcatttacttcggtgcccgtaccagtgcagctgaaggattgtacttgcgtggaaggcttagctaagtacctgggcttcaaagattatgacgaactgaagggcattgtatatccctccacttcacaccattataagtctttccgaattcccaagaagaatggcgactttagaaccatcgaggcccctaggaaacaactcaaaaagctgcttaagcgtatctccacctctctggaagaggtttatagcccacggaacgctacccatggatttgtgaagggacgcagtattgtcactaatgcgagcaagcacgcagacaagaaatacgtcctcaatttagatctgaacgacttctttggtaccattcatttcggacgtctgaggaatctcttccaatcccacccacttaatctaagtcattctgtggccacagtgctgtcgcacatctgttgccacaacggtaagcttcctcagggtagcccggcgagtccgattatatcaaatatgattgcttaccgccttgataaacagcttcagacgctagctagcaaaaatcgctctacttttacaaggtacgcggacgatcttacattcagttttacccaaacaagaggaaggctgcccaagcagatcgtttctttgtccagagatctccagctgaaactggggcacgagttaaccgacatagtgaatgaaaatgggtttagcattaacagcagcaaaaccagaatatccgcaagatctcatcgccaggacgtgacggggatcatagtcaacgagcggatgaacgtcacaaggaaatacatcaagcagaccaaatcaatgatatacgcatggaagaagttcggaatcgagaatgctgaagatgagtacttgaagaactatcacgggaaaaagatcttcgaaaaacaccagaggagaatcaacgagaaaaagggacagttcttccggaaaatcgtgaagggcagggtcaatttcattaaaatggtacgcggatcagatgacctaatctaccggaagctggcctatgacttttccgctctcattggaaagccaaaacccgacctgatacgaactcctttggacaaggcctgtgactctattttcatcattgagaacatgctggaccagagccagggcaccggctttctgttgaagggaatcgggatcgtcactaacgagcatgtggtgagtgacattgacgaagatctcagcgacctcttggagctctttcgacaccatgaacaggatatcaaaagacctgtgaagttccagaagtcttgcaaatcccgcgatttggccatactgaaacctaccacttcctataatgggatcaagcggctcccagtgggtgatgatagccagctgggcgtcggttccaaagtcaccgtgctgggctttcctcaatactctcccggcgagacgccatatatcaacacaggcaagattatacagtcaaaactgttgtacaacgagaagatttggctgctggatatcccagtgatccacggcaacagcgggggtcctgttttaaatgagcggcaagaagttgttggggttgctgcaattgggagccccaaacacgacaatagtacaaagcttcatggctttattcccatcagtacactcatcaattacgcccaagaaaacaacaagtccaacaacaataacaactga

SEQ ID NO: 7832 - RNA, 1680 nt, unidentified
  source 1..1680: mol_type = other RNA; note = synthetic construct
atgaccagcgcaatatccattttttctcttatctcccctatcaccacacccacgacactgaatcagtgcgtttgtgtcgaacggctggccagattcctcggtttcgctagttacagcgagcttcaaaatctcttctacccgtcaacttcgatccattaccgggggtttcatatccccaaaaaaaacggggaatacagactaatagaggcacctaagaagaaactgaaagagatacagaagctgatttctaaggaactctctgcgctgtatagcccaaggaaaagcacgcatggctttgtaccagagagaagtattgtatccaacgcttcttgtcacgtcgataagaagtatgtgctgaacctggacctcttagatttctttgggagcatacacttcggtagagtgcgcaatctctttcaatcccacccggtcaatcttccacttcctgtggccacagtgctggcgcacttatgttgccacaacggcaagcttccccagggtgcccctacaagcccaatcattagtaacatgattgcttatcgccttgacaagcaattacagactcttgccgcaaataatcgctgcagttacacacggtatgcagatgacatcactttctctttcacccaaacgcggggccgtttacccaaccagatagtgaccgtgactagggagctgcagctctatctgggtacagagctcaagaacgtgatttctgaaaatggtttcaccatcaactcccagaagacgagaatcgccagcaggtcccagaaacaagctgtgacaggaattatcgttaacgagcgcatgaacgtgagtcgaaaatttatccggcagacccgctccatgctgtatgcctggaaaaggttcgggctggaacaggctgaatctgaatacctgcagtcgtaccacgggaaaaccgtattcgaaaagcaccagcgccgtattaacgagaaggccggccagttttttagaaaaatcgtgaagggacgtatcaacttcataaagatggtcaggggcgccgacgatctgatttatcgaaagatcgcatatgattactccgtacggattggaaaaccaaaacatgacctcattaagacaccactggataaggcctgtgagagtatcttcatcattgagtcagagttggactacgcgcaggggactgcttttctcctcaaagacattggactgatcaccaacgagcatgttgttgacggaatcgatgaggagctgtcagagctattgaacgtgtacaggtatttcgaacaagataagaagcgactcgtgaattttgaaaagtcctgcaaatctagggatttagccatcttgaagcctaccactgactttaatggcattaagagactgaaggtcggagacgatagtatgctgaatattggctcaaaagtgaccgtcctaggctttccccagtacagccccggggagactccttacattaacaccgggaagataatacagtcaaagatgttgtatggagaaaaattgtggctgctagacatcccagttatccacggcaattcagggggccccgtgctgaatgacaaatatgaggtcattggaatcgcagctatcggcagccccaaacatgataattcaactaaattgcacggcttcatccctatttccacattgctggcctacgctaaagaaaagagctga

SEQ ID NO: 7833 - RNA, 1668 nt, unidentified
  source 1..1668: mol_type = other RNA; note = synthetic construct
atgcttaatttttccacgagcttgatcatcaagactcctacatgtctcaaagagtgcaagtgtgtggagggattagccagatttctaggcttcacatcatactctcagctcgatgaactcgtgtacccgtccatcaaccacttgtactatagcttcaagatacccaaaaagaatggtcataagaggattatcaaggcccctcgtaaatctctcaagtcaatccaagaactgattaacatcgaactgggtaactacttcagccctcgcaacagtacgcatggattcatcaagaaccggtcaattgtgagtaatgctgccaaacacgtggacaagaagtacgtgctgaatctcgatctagaaaatttcttcgattcgatccactttggcagagttagaaatctgttctgttcatatccactggtcctgtctaaaccagtcgcaacggtcttgtcccacctttgctgttaccagggaaagcttcctcagggggcccccacatctccaattatatcgaatatgattgcctataggcttgataaggagattcaatatctcgcgtccaacaatcgatgtacatacacccgttacgccgatgacctgacgtttagctttacccagaagcggcggaaactgccccggagtatagtgaaggtttcaagtgacctggacattaccataggccacgaccttaaggagatcatttccaaaaatggctttacaatcaacgattctaagaccaggatcagctctaaatgccaaaggcaggaagtgactggcattacagtcaacgagcgcatgaatgttccgcgcagctttatcaaacaaacacggagtatgttgtatgcttggaaaacttttggactcgagaacgcagagttccactacctggataagtaccataaaaagaccctgttcgaaaagcacaagcgcaaaattgacaaaaaggagggcgtgtttttccagaagattgtaaaggggcgaataaacttcattaaaatggtaaggggaagcgaagacatcatctatagaaagatagcgtacgattattccgtgctgactggtaaaccaaattccgatctgatcaagactcccctggataaagtctgcgactccattttcatcatcgagaatatgttagacaccgcccaagggaccgcttttctgctgaaagacatcggtatgataactaacgagcacgtggtagacggcattgatgaggacaaccctgaactactcgagttctttcgacattttgaacagaccaacaaaaaaaacgtgacctttaagaaatcctgcaaaagcagggatttggcaatcctgaagccaacaaaggatttcaatggcatcaaacgcttagacgtcggggacgattcatcacttgatatagggagcgaggtcaccgttctgggattcccgcagtattctcccgacgaaacaccctatattaacactggcaagattatccagtctaaaatcctctacgaccagaagatttggctgttagacattccaatcatacatggtaatagtgggggccccgtgctggataaagaccagaaggttattgggatcgctagtagaggaagcgcaaaacatgaccagagcaccaagttgcacgggtttatccctatttccactctccttaagtacttcaaagagaagtattga

SEQ ID NO: 7834 - RNA, 1698 nt, unidentified
  source 1..1698: mol_type = other RNA; note = synthetic construct
atgacccttcccaacactatactgctctccctgaagaccgcaaagttacagctgaatccaacaaagcccacttgtattacgggttgtcattctaccgatagcctggccttgttcctgggttttcagaattacaacgagctacaaaagttgatctatccatccgtgaaaaatctctacagggcgttttacattgataagaagaatggggataagagactgatttccgctccaaagaagaaactgaagtccatccagcggattatttcgcaaagtctctcaaatgtctactctcccagaaaaagcgcccacggctttatccaggggaagagcatactgacaaacgcctccatgcatgttgacaagaaatttgtcctgaatatcgacctgctgggcttcttcgattgcctccacttcggccgcgtgagaaacctgtttcagagttatcctcttaatcttaccccctccgtggcgactgttttagctcacatctgttgcctgaatgggaaacttccacagggcgctccaacctctcccataatcagcaacatgattgcatacaaactggacaaggacttgcatcaactggcacttgcaaatcggtccacatatacacgatacgtggacgacattactttcagttttacacaatctcgacgccgtttgccacgcgacatcgtgacagtactgaagggcaacaatttgaaattaggggagaagataacttctatcatcgaaaagaacggatttaagatcaataccgataaaactcgctgtttctctcaaaactttaggcaggtggtaacgggccttgttgtgaatgaaagagctaatgtgagtaggaactttatccgtcagactagatccatgatctacgcttggaagaagttcggcttagtaaatgccgccctggagtatctctcaaaatatcacgacaagtcaattctggagaaacacgaattcttcatcaagaagaacaaggacaagggtgtttttttcagcaagatagtgctcgggaggatctactttataggcatggtacgggggaaaagtgaccgattgttcagggaaattctttactcgtacactgagtgcattggaaaacctaaccgggccctgattaacacccccctcgataagatcggtgaaagcattttcatcattgataacctcctcgacgatagtcagggcaccggtttcttgctggatggcgttggactgatcaccaaccagcatgtcgtggatgggatagagaaagagaacagcgagctcctcgaaatttatcgctattacgagcaggacaaaaagcggaaatccaatttcgaaaaagcctgccgtgccagagatctagccatcttgaaacctacaacagaatttaatgggatcaagaggttaaaagtcggagacgatagcatcctaaaaataggatcaaaagtgacggtgatgggtttcccgcagtattcacctggagagacaccgtacatcaactccggcaagattgtgcagagcaaaaaactgttcgagaataatgtctggcttgtggatattcccgtcattcacggaaacagcggcggacctgttctgaacgacaaactcgaagtgattggaatcgcttcaatagggtctgcacggcacgaccagtcaaccaagctacatggctttatccctatttctaccctgatcaactatgtcaacgagtga

SEQ ID NO: 7835 - RNA, 1701 nt, unidentified
  source 1..1701: mol_type = other RNA; note = synthetic construct
atgatatatataaactacttcgtctcacagctgtccactcagcttccaaaaattacgttgcgaccttgggtccgaagtctgaagcactgtacatcagtggacgacttggcgcactttctcggatttaattcatacggcgaactcaactccctggtgtacccacataccaagaacctctacaaatctttctccataagcaaaaagtctggaggggagagaaatattaaggcaccaaagtccaagttaaaatctatccagaggtggattggccaggacctggagaattattataggcccagatccgctagtcacgggttcattaatggaaagagcatcatcaccaatgccaaaggccatgtggataaacgctttgtgctaaacattgatttggaggacttttttaccactatccactttgggcgggtaaagtcgttgtttcaggctcatcccctgaaccttagccactcagtggcaaccgtgcttgcccacatctgctgcaatgagggcgtgcttccccaaggagcccctacttctccaatcatatctaacatgatcgcctataagttagacaaggagctgacaaacctggccataaaaaatcggtgtacctatacgcgctatgtagacgatatcacattcagcttcactcagaaactgggtcggctgcctagaagtatcatcaaggttacgaagcagaacaaacaaatcttggggaacgatctcctgggcgtcatttccaccaacggctttcggatcaacagtaagaaaacaaggttgctctcccgggatcaaaggcaggaggtgaccggtcttactgtcaacgataaacttaacattcccaggaccttcattagagaaacgagatctatgctatacgcttggaaaaagcacggcctcattgaagcggaggaagagtacattaagaagtaccacaagaagaccttaacatataatcagcagcggatgctcaaacataacaaaggtaacttctttcgtaagatcgtccatggaaaagtcaattacataaagatggtacgcggagaagatgatcctatttaccgtaaaatagcttatcagtacctcagtcgaatcggtaagcccgataaagacctgcttaaaactccacacgacctgatagcagactcaacctttataattgagtgctacctggatcaagggcaaggcacaggattcctgctggaaaatatcgggctcgttacaaatgagcacgtaattgaaggaatcgatgccagcgacgccgacctgctggagatttaccgttactatgagatggacaataagcgcaaggtgagcttcggtaaatcggataagtcactagacttagggatcttgaagccgaccactgatttcaacggaattaagagactgaaaattggcgatgatagcaccctatccgtgggccaaaaagtgacagttatcgggttccctcagtattcccccaatgacaccccttatatcaataccggcaagatcatccagagtaaagtcctgtttggccagcagatctggctgctggacattcccgtgatccacggtaactctggcgggccagttgtgaatgaaaataacgaagttattggcgtggcaacaaggggggctgaaaagcatgaccagagcacaaagttccatggattcatcccgattagccgcctcgttgagtaccatactacagacacttga

SEQ ID NO: 7836 - RNA, 1656 nt, unidentified
  source 1..1656: mol_type = other RNA; note = synthetic construct
atgtttgatccatttaaggtcgctcctcctaaattaaaactgcatcagtgtgtcgatgtgcacgaactgagtgctatcctgggaactaattacaaccagctgtcaaagctgatctatcctaccactcagaattcttactactgcttcagcattgacaaaatgaacggaaataaacgcgtcataaatgcaccgaaaaataaactgaagtccatacagcgaaggctcgcatacctgctcaacgagtattatcccgtgagagacgtagcacacggatttatcaagaacaagtcaatcgtcagtaacgccgaacagcacgtgctaaaaaactgcgtattcaacattgacttagagaacttctttggacaaatccattttggacgtattcggaacctgttgttctctcccccttttaacttctcgacctccgtttcgacagttatctctcacatctgttgttctgacgggttcctaccacagggcgcgcccactagcccaattatttctaaccttatctgctacaagctggataacgagctgcgcaggctagctgtgtatcataaatgtacgtatacaaggtacgtggatgatatcacattttcatttacgtgcaaggcaaaccggatccccagtcagatcgtggtgtcctccggtaataccgtgactcccggcaatgagatcaatgcaatcattacacgcaatggattctccatcaatgacaagaagactcgcctccaacaaaagaatgagcgtcaaatcgttacaggtatcgtggtgaataaaagaaccaatgtgcagaggtcttttgttaggaaaaccaacagcatgctctatgcctgggagaagtttggggccattctggccgaaaaggactactttgacaagtacaacagcaagatcaagacaattaagttgaaggacttcatagataaccccggtgagttattcaaatccattgtgaagggcagaatcaactacattaaaatggtgcgaggcaaagacgatgtaatataccgcaagtttgctcaccggatctcatgcttgttcggtaaatttgacaacagataccttaagactccgtacgacttcgccattgagagcacgttcgtcctcgaaaatcggtgcgacgacagccaggggaccgcctttttgctcgaaaggattggccttgttacaaatcatcacgtcgtcgaggacatctgtgacattaccgatgagtttatagaccttttcctgtggaacgaaattgggaacatccggaaaacaaagttcattatgtccaataagctgttcgatatagcggtcttcgagagaactagcgatttcgacaatattaccccactcaaaattggcgatgattcaggcatcaaaaacggtaccgtaataactgtgattggatttccccagtatagtcctggggagtccgcttatgtgaataccggtaaagtgatccagagtaagaccatgtatgggaataagttttggctgatagacatcccggtgatacatggcaactccgggggaccagttctgaacgataagttcgaagtcatcggcattgccagcatcgggacggccaagaatgatagcagttcaaaacttcacggcttcataccaatttctacattgctccgatataccggcgaagataaaccttga

SEQ ID NO: 7837 - RNA, 1650 nt, unidentified
  source 1..1650: mol_type = other RNA; note = synthetic construct
atgtttaacccctctaacatcttacctccaaaaatcaaactcaacaagtgcggggacgtgcacattttagcggctctatttaacctgacctatgaggagctgtcaaagttgatttacccgactcccaatagaagctactatcaattcgccattgacaaaaaaaacggctcaaagcgcgttatatcagcccctaagaaaaagctgaagatcgttcagaagaagatcgcagatgaactacttaccctctaccctattagggacgttagtcatggtttcatcaaaggtaaaagtattgtgagcaacgcagagaaacacgtgctgaaatcctgcgtgctgaatattgacttggaagatttcttcggatcaattcattttggaagagtcagaaacctcctcacatccccttcctttaacataccattgcccgtggccaccgtgatttccaacatatgctgttataatgggtccatcccccaaggcgcaccaactagtccgataatcagcaacctgatatgttacaagttggacaacgaacttcgccaactcgcgggcaaatacaattgcacttatacccggtacgtagacgatataaccttcagctttacttacaaagctaaacggataccccatcagctggtaacgagtgatgctaacatcattaatattggcgtcgagctggaggaaatcatcacgaggaacggattttctataaacaagaataagacccgtctgcaatctaagaacgagcgccagactgtgaccggtattgtcgtcaataagaaaaccaatctgcagaggaaattcatccggcagacatcaagcatgttatacgcctgggagaaacacggcgtcgtcgcagccgagaatgaacatttcgtgaagtacaatgagaaaaagaagctcatcaaacttcgggatttcgtagacaagccaggagaattgttcaaaagaattgtcaagggaaggattaattacatcaagatggttcgaggcgaagatgatataatctatcgcaaattcgcccaccggatctcatgtctgtttgggaacgtcaataataggtatctgaagacaccttcggactttgccatcgatagtatcttcatacttgagaacgaagtggatatctctcagggcaccgccttcctgctagaagacgtgggcattgtgacaaattatcacgtagtgccaagcatcgatgagtacaatgacatcgacctgagcctctttagatacaatgagctcgacaacaaacgtaaggtgaagtttattatgagcaacaagctgtacgacttggcaatttttgacacaaatgggaacttcgatgatatcaaaaagttcagcataggcgatgactcgaacctgaaagttggatctgagatctccgttatcggatttccgcagtataccacgggggaatatccatatatcaatacaggcaagattgtgcagtctaaggctcttttcaacaataagatttggctggtggatatccccattattcacggaaacagcggtggtcctgtcttcaatgagaagtttgagatcatcggggtggcttccaacgggactgaacgaaatgaccagtcttccaagcttcatgggtttattcccatctccacactcattaaattcatctctagtaagtga

SEQ ID NO: 7838 - RNA, 1797 nt, unidentified
  source 1..1797: mol_type = other RNA; note = synthetic construct
atggatattgacgagattttcaaggatctgtttggaccagggtttaagtctttagacggtttttgccagctcctgaaagttgatcaggacaagctgctgaatttcctttacaaacggaaaggtagccactatgtcagcttttctatcttgaagaagaacaagacccacagaacaatcaaagccccaaaacgggtgatgaagaaaatccagcatgccctactacctcatctggagaagtattacagccctaagccgtcatcccacggattcgtgaaagggcgaaacgtaaagactaatgcccagattcatagtaggaaacgttacgtgttcaatatcgacctgaaggacttctttgagagcattcattttgggcgcgttcgcaatctgtttatggcccaccctttctctgctcctcataatgtagcaactgtgatggcacagatatgttgctccgatgggaaacttgctcagggggcaccaaccagcccactcatctcgaatatgatctgtcggaaactggattcccagctgcaggccctggccaagtccggaaaatgtcactttacccggtatgccgacgatataaccttctcattcacctctacagccaagtacctccccaaagacattgtggaagtctctgaagacggaagggcaattcctggccgtgagctagaagagatcatcaaatccaatggtttcatcatcaatagtgaaaagaccagactgcagcataggacgcaaagacagatggtgactggcctcgtggtgaacgagatgcccaatgtgaccagggagtttattcgcctcacaagtagcatgattaacgcgttaaaaagatatgggcctgaactggctgaggcaaaatacctcgaaattctgaagggagaaaaccaacgcctgcagcctcgacagatcctgaggacaaaggactcagcaggcgatttttttataaaagtcgtgaaaggccgtctcaattatattcaaatggttagaggacgaggggataatatctataggagactcgcatacgagttcactgtggctataggcaaggaaaaccccgagttcaagaagagtccagaggaaattcttggtaactccatattcgttgtcaacaacatcatagaggagtgccaaggcactgctttcctgctggagggtgttggcatcgtcacgaatgaacatgtggtcaccggtgtcagcaagaccatcgctcgccactcaatctcattctcacgggcgggggatacacgggaatactccgctgagctgattctctcagacaagaaagctgacctagcgattttccaccccaacgaagaatttcgcaacatccccgctctgcggaagagtgacaagactatagtacgacccacagatccggtgctgagcatcggattccccaaacaccgagacgggacaacgcattacatcgccaagggccacaccacacaaaggagacggcaggtagacttggatctttggttagtggattttactttgatggagggcaattccggaggcccaatatttaacgactctatggaggtgatcggtgttaccgccaggggagccaagaacaatattgatgccgccctgtatggctttattccattggatagccttaactcttttacttcccgcgccgacttccttctgttgaaaaggttgtacgactatctcggcaacggctcgttgtctcttttacccggaatcctcggcaaagggattttcagcagtgcttaccagacaaaactgcacaaggagagattacagaaggcaaaggcggcctga

SEQ ID NO: 7839 - RNA, 1797 nt, unidentified
  source 1..1797: mol_type = other RNA; note = synthetic construct
atggacattgatagcatctttaaggatctgttcggtcccggctttcaatctctggatgggttctgtcggctgcttgaagttgatcagaacaaattgctgaactttctgtacaaccgcaaggggagccactatgtgtccttctcaattctcaagaagaacaaaacgcatcggtccatcaaggccccaaagcgcgtaatgaaaaaaattcagcacgcactccttccccaccttgagaagttctacagtcctaagagctcaagtcatgggtttgtgaaaggcaggaatgtaaaaactaacgcacagattcactctagaaaaaggtacgtctttaacattgacctgaaggacttcttcgaatccatccactttggccgggtcaggaacctgttcatggcacaccctttcaacgcgcctcataacgtcgccactgtaatcgcccagatctgttgctcgtacggaaaactggctcaaggagcccccacttccccgttgatatctaatatgatctgccgaaagttagacagtcaactacaggcactggcgaagacctctaaatgccatttcaccaggtatgctgatgatattaccttttcctttactagcaccgagaaacaccttccaaaagacatcgttgaagtcagcgaggatggacgggccatcccaggaagagagctggaggaaattatccgagccgctggtttcgccatcaattcagagaagacacgcctccaacacaggacgcagaggcagatggtgacagggctggtggtgaatgagatgcctaacgtcactcgtgagttcatcagactcacatctagtatgataaatgctctgaagagctatggtccggagttagcagaggcgaaatacttggaaatcctgaaggcaaagaatcacacccttcaacccaggcagctactgagaacgaacgacgggaatggagatttttttattaaggtggtgaagggccgtctcaattatattcagatgattagaggacggggcgacaagatataccgccgcctggcttacgaattcaccgtggccctcggcaaagaaaatccagagttcaaaaagtccccagaggaaatcctggggaacagcatcttcgtggttaacaatattatctcagagtcgcagggtgccgctttcttgcttgaaggcgtcggcatcgttaccaacgagcatgtggtgtccggagtatcaaagaccatagcccggcattcaattagctttcaccgtgctggtgatacaaaggagtacagcgcagagttgattctctcagacaagaaagccgacctcgccgtgtttagacccaatgaggaatttagaaacattcccgttctgaagaaatctgacaagaccattgtgcgggctatggatgcggtcctatccatcggtttcccaaaatatcgcgatggcactgcccattacatagccagaggccataccacacagcggcgacgccaggtggatttggacctctggctggtggactttatgctgttagaagggaactccggggggcccatgttcaatgattccatggaagttattggcgtgacagcaaggggagctaagaataatatcgacgcagccctttacggctttatacctttagagagtttgaacagcttcacatctaggagtgactttatcctactcaaccgacttcacgactatatagggaatggaagcctgagtctgctgcctcagacactgggcaaaggagtcctgtctatcacctatcaggctatgctccgaaaacagcacctcttgccgttaactgaaaattga

SEQ ID NO: 7840 - RNA, 1797 nt, unidentified
  source 1..1797: mol_type = other RNA; note = synthetic construct
atgaacatcgaggagatcttcaagaacctttttatcccaggattcagctcgctcgacaacctctgccgtcttcttaaggtcgaacaggataagctgctagcattcctgtataagaagaaatccagccactacgtgagcttcttcatccctaaaaagaacggcacccggcgcacaattaaggcccccaagagagtgatgaaaagactccagcgtgaattactggtgcacctcgagaagttctatagccctaaatcatcctctcacggattcgtcaaaggcagatcaatcaagacaaatgcccaggtccacgccggcaaaaggtacgtgttcaacatagacctcaaagacttttttgagaatgtgcactttgggcgagttcgcaaccttttcatggccgaaccattcaaggctccgcataatgtggccacggtaatggcgcagatctgttgcagcgaaggccgtttagcccagggagctcccacgtcaccattgatcagtaacatgatttgtagaaagctggatgcccagttgcaggccctcgcgaagtctggaaagtgccatttcacaagatacgcggacgatatttctttctcctttacttcaaccctgaggcacctccctaaagacatcgttgagatatctgaggaccggagggcaattcccggccgcatgctggaggaaattatcaaagccaatgggtttacgatcaactccgagaagacacggctgcaacatagatctcagcgccagatggtgactggcctggtggtcaacgaagttcccaatgtgactagggattttgtgagattgactagctccatgatcaatgcccttaaacgatacggggctgagctggctgaggctaagtacctggaaattctgaagggtgacagccagccactgcaggttagacaaaacgtaagggttcgggagaatgcaggagatttcttcattaaggtggtgaagggccgcttgaattatattcagatggtgagaggtcgatctgacagggtctaccggcgccttgcctatgattttaccgtggccattggccgagagaaccctgagttcaagaaaagcccagaggaaatcctggggaattcgatctttgttgtgaagaatataaccgatgactcccaaggaaccgctttcttgctggatggggtaggtatagtgactaatgagcatgtcgtgagtggagtctccaaaacaatggctccacacatgatctcctttcagagggtaggggagaacaaggagtacgctgctgaactgattctaagtgacaaaaaggctgacttagcaatttttcagccgaatggagaatttcgcaacatccctccactacgcaaagcaaatcgtactaccattaggcctatggagtcagttttgagtattggcttccccaaatatcgggatgggagcgcccattacatagcaagaggtcatacaacacaacggcggcgccaagtcgacctcgacctttggttggtggattttaccctgattgaagggaatagtgggggtcccttctttaacgattccatggaagtcatcggggtagcagccaggggcgcctctaacaacatcgagtctgccctgtatggttttatccccctggaatcactaaaccggtttatagcgaggaaagatttcgtcttcctcaagaaaatccacgagctgtccggcagtaaactcttaggccccctgaccatgcggagcggcaatggagtgttttcagaagtttatctcgcaggtaagtacggaggctgtcgactgaagcctgcaaaaatatga

SEQ ID NO: 7841 - RNA, 1791 nt, unidentified
  source 1..1791: mol_type = other RNA; note = synthetic construct
atgaacatcgaggagatctttaagaatttattccgacctggcttttccgacttggacaatctttgcaggctactgaaagtcgatcagaaaaagctcttgtctttcctgtacaagaaaaacagttcacactacgtttcctttagcattccaaaaaggaacggaacccctagagccatagtcgctcccaaacgtgtgctcaaaagactgcagcgggagctgctggaacacctcgaaaaattttatacccctaaatcttcgactcatggttttgtcgagggacgtagcatcaaaacaaatgcacaaatacatagcggaaagaaatacgttttcaacatcgacctgaaagacttctttgggtcgattcacttcgggagggtgcgcaatcttttcatggctcaaccgtttaacgcacccagaaatgtggccaccgtaattgcacacatctgctgttccgatggtcggctggcacaagggtcccccacaagtcctctgatcagcaatatgatatgtagaaagctggacgcccagttgcaggctctcgctaagactggcaagtgccatttcaccagatacgctgacgacattacttttagttttaccacgcccctgaagtatctcccaaaggatattatcgaggtatccgaggataggagggctatccccggccgagagctggaagagattataaaggcaaacgggtttatgatcaatcctgaaaagaccaggcttcagcacagatcccagcggcagatggtgacaggactcattgtgaatgagcggccaaacgtgacccgggagtttgttagactaaccagctctatgatcaacgccctaaaaaggcacggttgcgaactggctgaggcaaagtatctggagctgctgaaaggagaaagccacccccttcagccaagacagataatcagaactaaagacaatgcgggcgacttcttcattaaagtggtgaaggggcggctgaattatatccagatgattcgcggccgtggagacaaggtttatcgacggctggcatatgattttactgtagccattggtaaggccaacccagagttcaagaagacacctgaggagattttagggaacagcatcttcgtcgttaataacatgacggatgactctcaggggacagctttcctgttagacggtgtcggcattgtcaccaacgaacacgtcgtccggggcgtgtctaagagtatggccccacacatgatctcatttcaaagggccaatgaagagaaggaatacactgccgagttaatactttccgataagaaggccgacttggcaatcttccatccgagtgccgaatttcgctccattcctagcctgcgcaaagctgaacgctcaattatccgcccgatggaatctgtactctcaattgggttcccacggcatcgagatggggccgcacattacatagcccggggccatactacacagcgaaggagacaggtggacttggatctgtggctggtggatttcaccttgtttgaaggaaactcaggcggccctttcttcaacgattcaatggaagtgatcggcgttgcggcgaggggagccaagaataatatcgagagcgccctttttggtttcattcccctagagtctcttaacaccttcatcgctcgaaaggatttcgtgttctacaaaaaactgcatgacttactcggcgggtgtctcttgaaggccctccccaagcgcagtggcgatggagtgtttacagagatccaccaccaacgcacggaacgtgtgacagcgcgcctccaggagtga

SEQ ID NO: 7842 - RNA, 1785 nt, unidentified
  source 1..1785: mol_type = other RNA; note = synthetic construct
atgaacatagacaagatcttacaggatctcttcatgcccggctttgggtcacttgagggcttttgtcaactgctcgaggtcgaccagaagaagctgttgaatttcctgtataaacgaaggacaaaccattatgtgagctttagtatctccaagaagaacgggacccacaggtctattaaagccccgaagcggaccctcaaatttctacagagaaaactccttgcccatatagagaaattctatagccccaagccttcaagccacggctttgtgccagggaggtccattaagaccaacgcccaaacccactcagggaaaaggtacgtgttcaacatcgacttaaaagagtttttcgacagcatccacttcggcagagtgcggaatctgtttatggcccaaccctttaatgctccccacaacgtggctaccgttatggctcacatctgctgtagcgacggtaggcttgcccagggagctcccaccagtcctctcatcagcaatatgatttgtcggaagctggacactcagttgcagacccttgcaaaaagtggcaaatgccatatcacacgctatgcagatgacatcaccttcagttttacatcgactctgcgccacctgcctaaaaacattgtcgaagtgtctgaagatggccggccaatccctgggcgagaactggagaatatcatcgaagcaaacggtttcgtcataaattctgagaagacgagactgcagcattgctctcaaaggcagatggtcacaggactggtggtgaatgagacgccaaacgttccccgcgactttgtgcgcctgacttcctccatgattaatgcaatgcgacggtacggaccacagctggctgaggcccgttatctcgagatactcaagtctgaaagccaggtcatacccacccggcaaacgaacagagcacgtgataacgcgggggacttcttcataaaagtggtaaagggccgcctgaattacattcagatgatcagaggtagaagtgacaatgtctaccgcaagttagcctacgcattcactgtcgccttgggtaaagagaatctggaatttaagaaatccccagaagagattctgggcaattcgatcttcgtagtcaacaacatcctggatgattctcaagggaccgcctttctcctggacggagtggggattgttacaaacgagcacgtagtctccggaatcacaaagaccacagccccccacgtgatttccttcaagagagctgacgatcctaaagaatacacagcggagctaattctcagtgacaaaatcgccgacctagccgttttctatccaaacgcagagtttaagaatattcctgggctgaggaaggcggataaggaaactattcgagctatggaccctattctctccataggcttccctaagcatcgggagggcgcggctcattatatcactaggggcaacactactcagttgaggtaccaggtggatttgccactttggttggttgatgtacccttgatcgagggtaattccgggggaccgatcttcaacgatagcatggaagtgataggagtggccagccgaggaagctctaataatattcaggctgcactgtacggctttattccattagaatgccttaaccgctttgcaaagagaaaagatttcgccttctaccgtaagcttcacgaaattctggctggtggcaaattagtgcgggccgcctctgttagaggaggcggagtgctgtcaacacgcctccagatcctgctgatctcacatctaaactcaccgtga

SEQ ID NO: 7843 - RNA, 1755 nt, unidentified
  source 1..1755: mol_type = other RNA; note = synthetic construct
atgactctggactttcttagcaaggatctcgcctttagcaagttccagtcattatctagcttttgtaagttgctgcaggtcgaccaggacaagctcttgaaattcttgtacaagaaaagcagctcccactacgtgtcatttacaatctcaaaaaaggacggctcactgcgaagcatcaaagcccccaagaaggtaacgaagatgcttcagcatcgcctactgtcgcacctggaggagttttacactccaaaaagtagcagtcatggattcatcaaaggtagatccatcaaaacaaacgggcaaatgcacgtcgggaagaactatgtgttcaacattgacctcaagaacttttttgagtccatacacttcgggagagtgaggaacctgtttatggcggccccgttcaatgcggcctataacgttgcaacagtgatggcccagatttgttgctgcgagaataagttagcacagggtgcccccacaagccccctgatctctaatatgatttgtcggcggctcgatgcacagcttcagaccctggctaaggcccaaaagtgccacatgacacgctacgcggacgatatatccttttcatttacctcccggctcaggcatttacccaaagaaattgtagagatatcagaggatggcagggtcatcccaggccaagccctggagactctaattaagacgaacggctttgctatcaattctgacaaaacccggctgcagcacagatcccaacggcagatggtgactgggcttgtcgtcaataagttgcctaatgttcctcgcgagttcgtgcggcttacctccagtatgatcaacgctatgaagaggtatggaccagcccaagccgaagcccgttacctggagattctggcccagacaaagcaaattgtgccggaaagacagctggctcgcgtgaagtctaacgcgggggatttttttatcaaagttgtgaaaggccgactgaactatatacagatgatcaggggacgcagtgataatgtctaccgtaagctcgcttacgactttacagtggcactgggcaaagaaaacattgaattcaagaagacacctgaggagattctgggaaactccatctttgttgttaccaatatccttgatgactctcaagggaccgccttcctcttggaaggcgtcggcttggtcaccaatcagcacgtggtgtcgggagctacccatgctctcgccagccacgtaataagtttcaagagggctggcgacgagaggtcttacactgctgaattgatcttcagcgatctcaagtctgatctggcagtgttctatccggggcctgaatttaagaatatcccacatctgcagaaagcagacaaacatattattcgtgcaatggatccagtgctgagtatcggcttccctaaataccgcgatggctcagcacattatatcaccaaaggcagcacgacccagctgcgacgacaggtggatatcgacctgtggctcgtggacatgcctctcatcgagggaaactctggtggacccatattcaacgacagcatggaagttattggaatagcctctagaggttccgtaaataatctgcaggctgccttatatgggttcattcccatcgactccctcaccagattcattagtagacctgccttcggacttgctaggagagtccacgatctgcttgcaggtgacaaattcaaaccactgtccaagactgggcacactcggctactattaaaatgcgcaccctga

SEQ ID NO: 7844 - RNA, 1767 nt, unidentified
  source 1..1767: mol_type = other RNA; note = synthetic construct
atgaatctggacgatcttctcaaagcaatgttcgcaccttccttagggagcctgccctctttttgtaatctgttgggagtcgagcaggacaaacttctgagtttcctctacaagcggacgagctcacactatatatctttccacatccccaagaagaatggtgcaacccgcgtcattaaagcaccaaagaaggccctgaaagagctgcagaagcggctggcttcccacctcgataaatttcattcaccaaagccttcatctcatggcttcatcaaagggagatccattaaaagcaatgccctgccacacataaataagaccttcgttttcaacgtggacctcaaggacttttttgagactattcattttggtagagtgaagaacctctttatgtccgaacctttttcagcaccccataacgttgctactgtcatggcgcatatctgttgtcacgatggcaaattagtacagggagcgccaacgagtcccctgattagcaatatgatatgccgcaaactcgactctcagctgcagtctctggctaaggcccaaaaatgccacgtgacacggtacgcggacgacatcacattcagtttcacaagcagcatcaagcacctgcccacagacatagtggaggttacccaagatgggatggctattcccggacgggagttggagcaaattgtaagggtgaacggatttacgatcaatgcagaaaaaacacggctccagcataggtcccaacgacagatggtcaccggcctggtggtaaataaattccccaatgtgccacgggccttcataagaaagacttcgtccatgattaatgctttgcgtagatatggaccggtactagccgaagagaagtacctccagatcttgaagggcgataagcaagccctacccgctcgacagcaccgacggatcaaggacaacgccggagactttttcatcaaagttatcaagggcaggctcaattacatccagatggtgaggggacgcagcgacagtacctatagaagactagcctacgattttaccgtcgccattgggaaggagaaccctgaattccgaaagtcacccgaggagattctgggcaactcgatctttatcgtctccaacctgaccgacgattcacagggcactgcgttcttgcttggcggagtgggtctggtgactaaccagcacgtgatttctggcgtgtccaagacaatggctccacacatgatttcattcacacgcgttggcgacgataccgagttcagtgccgacctaattatcagtgacgccaaagaggatcttgcagtgttttacccaaacgaacaattcgataggatccctatgcttaaaaaggcaagcaaagaatctatacgccctatggagcctattcttagcatcgggttccctcgtcatagagatggtgctgcccactatattaccaagggaacaaccacccagctgcgcaggcaggtcgatttggacttgtggctggtggatgtgcccttaatcgaaggcaattccggcggccctatatttaacgatagcatggaagttattggtgtggcggctcgtggggccactcagaacaacatcaatgccgcactctacgggttcatcccaatcgccagtctgaacagatttgtcgctaaaccggaatttaagctggccaacagccttcatatgtctctgcgcggtaaaccgtgcaggccattatgtgaagctactgggaaatatatcaggaagatgactatttgctcctttgggtga

SEQ ID NO: 7845 - RNA, 1764 nt, unidentified
  source 1..1764: mol_type = other RNA; note = synthetic construct
atgatcatcgacgatatcctcaaggctctgttcacccccggtctggggaacctgtccggcttttgcgatctgttgggcgtggagcaggaaaaactcctggattttctgtacaaacggaagagttcccactatgctgccttccatattcctaaaaaaaacggggccacccgcgtggtgaaagctccaaagaaagctatgaaggagctgcagaagagcctcgcattgcacctcaacaaattctactaccccaagccgtcatctcacggcttcgtgaagggccggagcatcaagtctaatgcactgccccacgtaaataaaaacctggtgttcaatatcgacctcaaggacttttttgaaaccattcatttcggccgtgtgaaaaacctgttcatgtcggccccgttcaatgcacctcataacgtggccaccgttattgctcacatttgttgtcatgacgggaagctggttcaaggagcacctacatctcccctcatctctaacatgatttgctggaagcttgactcacagctacaggccctggcgaagagtaaaaaatgccacgttacaaggtttgtggacgatatcacattctccttcacaagcagtttaaaacatctccctgccggagtggtggaggtcactcaagacggtatggctattcccggaagagagctcgaacagatcgtgaaggccaatggctttcttattaatgccgaaaaaactcggttacaacacagaagccagcggcagatggtgaccggattggtcgtgaataagtttcccaatgtaccacgcgaattcattagaaagactagcagcatgattaacgctctgcgtcgatacgggccagaactagccgaggaaaaatatctgcagattctcgccggcaacaagcaagtcgttcctgcacggcagcatcgcaggatcaaagataacgccggtgacttctttatcaaggtccttaaggggaggttaaactatatacagatgatcaggggaaggagcgacaatatgtacaggcgtctcgcatacgatttcacggtcgcgatagggaaggagaatctagagttcagaaagtctcccgaggagatattagggaatagcatattcgtggtgaaaaacctgacggatgactcccagggaacagcctttttgcttgacggcgtcggcctcataactaaccagcatgtcatttccggtgtttcaaaaacactggcgccacacatgatctcatttttgcgcgcgggagatgaggccgagttttcagcagaacttatcttaagcgatgttaaggaagatcttgcaattttttacccaggcgagaaatttgaccagatcccccggttgcgaaaggccaataaagaggctatccgccctatggagcctatactttccattgggttcccaaagcacagggatggagccgctcactatatcactaagggcaataccactcagctccggcgacaggttgacctggacctgtggctggtggatgtacctttgatcgaagggaacagtgggggacccatctttaatgatagtatggaggtgattggagtagccgcccgaggcgctgctcaatcgaatattaacaccgcactgtatggtttcataccgatcgcgtctctgaacagattcgtcgccagatccgaattcaaatttacctcctctctgtacgcagtcctagacggcaaggccttcaggccactgtgcgaggtagctggtaagtatgcacgcagaggctgttttttcatcttttga

SEQ ID NO: 7846 - RNA, 1767 nt, unidentified
  source 1..1767: mol_type = other RNA; note = synthetic construct
atgatcctatacaattttctggctgccatctacgcccccggcttatccagcctgccagcgttttgcaaactcttgggggtggatcagaataaactgctgcattttctttacaagaggaaacaatcgaactacgtgtccttccacattcccaagaaaagtggcgccactagagtgatcaacgcacctaagaaaaccctgaaagtcctgcagcggtcactcgccgagcacctagagaagttctactatccaaagagctcctcacacggcttcgtgagggcccgttctattaaaaccaacgctcaaccacacgtggacaagaactatgtcttcaacatcgatttaaaggactttttcgacaccattcattttggacgggtccggaatttgttcatgtccgagccattcaacgctcctcacaatgtcgcaacagtgatggctcacatatgttgtcacgacggcagactcgcacagggtgccccaacctctcctctgatcagcaacatgatctgccggaagttggactctcagctccaagcactggccaagtccaagaagtgccacgtgacccgctacgcagatgacataactttctcttttactagtagcttgaggcacctgccccccgacgttgtggaggtgacaggagatggggtggtcattccggggcgcgaactggaacatatcataaaggccaacggctttctcataaactctgagaaaacaaggcttcagcatcgttcacagaggcagatggttactgggctagtcgtgaacgagttcccgaatctgccacgagcctttctgagaaagacctcctctatgatcaacgcacttagaagatatggaccggtgctggcggaaagcaaatacctcgaaatcctgaacggggacaagcagtccatccctgcacgacagcacattcgcgtgaaagataatgccggagattttttcatcaaggtcgttaaagggcgcctcaattacattcagatgatcaggggacgtggagataatgtatatcggaaactggcatatgacttcacagttgctattggcaaggaaaatagggagtttcgcaagagccccgaggagattcttggcaactccatatttgtagtgaagaatattagcgatgacagccaaggcacggctttcttgctggacggagtcggtctggtaacgaatcagcatgtggttagtggcattagtcgcctcacagctcctcatatgattagttttatcagggctgggttagatgaagctgaaatctctgcggaacttatcctgtcagatgagaaagccgatcttgcaatcttctatcctggacccgagttcgacaaagtgcccaggctcaaaaagagcaagaaggaactgatccggccaatggaccccgtactctcgatcgggtttcctaagtaccgagacggggccgcccattacattacaagaggtaataccactcagctgcgccggcaggtggatttggacctatggttgattgatgtgccccttatcgagggcaactcaggtggtcctgttttcaatgattctctggaagtgattggtgtcgccgctagaggagccgcgcagaataatatacaagccgctatgtatgggttcatccctatttccagcctgaacaaatttgttcagcagagtgagtttaaggttacccggtcaatactcgacatcctgggcggcaagttatttcaacccttagccaacgcaaagggcaaattcgtaagacgaaaaatactcattccattctga

SEQ ID NO: 7847 - RNA, 1818 nt, unidentified
  source 1..1818: mol_type = other RNA; note = synthetic construct
atgagctctgtgccttttagttttgctgacatcttcaagcctggcttgtcggggctgccaaatctggcaaggctgctcgggactaatcaaaacgccctgctagagctgctctatccaaacaacgtgcgcaactacaagaacttccagatcaaaaaaaagaacgggaactctcggtccatccatgcgcctaagaaggtgctgaaggctttacagagaaatatggcagactacttgacgacactgcacactcccaaaccctcttcacacggcttcctcatcgagagaagcattaagtcaaattctatccctcatgcaggaaaggagtatgtctttaacatcgacttagaggatttcttcgaaagcatccacttcggtagagtgaaaaatctcttcatgagtcggccttttaatgctccacacaatgtggctgttgttttagcccagctgtgttgttatgatggcaagcttgcgatgggggcacccacttctccgataataagcaacatgatatgccgcaaactggatagccagctgcagctgctggccgctggtaaaaattgttactatacacgatacgctgatgacatcactttctcctttacaagctccaaaaagctgttgccctccgatattgtccagattaccgagggaggtgttggagtgcctggaggggcattacttagtattatagagaggaacggcttccgggtaaatccgaccaaaaccaggctgaggcatcgttcccaaaggcaaattgtgaccggccttacagttaataaatttcccaacgtctcaagatcattcatcaggaggaccgcctccatgattcacgcgctcaaaaaatttggagccgtcgatgctgaacaaagatacttggaaattctctcacgccaggaaatcgatctggccccccgtcaggcaaaacgcacaacggactccaaaggagacttctttcccaaagtgatcaacgggcggcttaacttcatacagatggtgcgagggaagaatgacagcatctatcggaagctagcctacgccttttctgtcgctgtcaatgaggaggacaaggacctgctgaaaagcgcgcaggagattttaggggaatccgtgttctcagtgcttaatctggccgacgccaactccgaaggatcggcctttctgctcagcggcgtaggcattgtgactaatcagcacgtgattgacggtattgatttcgatagtccattggaactactggagttcagcaccaccgagaatccaagtagaaagctaaacccccagctgatctataagtcaaaggtcccggatatagccattttctaccctggcgaggaatttgaccgtatccgacctctcgtgatttcgaagcagaagcatatcaggcctctggaccccatattggctgtaggcttccccgggggctttgatagttgccctagcccatatatcaatggaggtaaggtcgttcagggaagacatatttacgaacaacagcactggctcgtagatatcccactgcttcaaggaaactctggcgggcccatatttgatacttccatggaggtgattggcgtcgcctctcggggtagtaaaaagaacaacctggagtctatccttcacgcctttatcccaattgacacagtggtaaaagctatccggaaaccggaattcttgtaccgccagagatatattgagctccgccttaaccgaaagacgggcaaggttgtgtacacccgctgcgtttttgcagaagactgcatctttaagtcagcaatcgagctctattggccactcagtaagtccttctcttacagctga

SEQ ID NO: 7848 - RNA, 1854 nt, unidentified
  source 1..1854: mol_type = other RNA; note = synthetic construct
atggacaatcggaacatcctggaaaagaccttcgaagggcttttcagcacagcaccattcaccccagggttccataacctcgatgggttggctctattgctggacacagacctgaccaggctgttatatattctgtacaaaagtgatagccctaagtacaaccactttaagatccaaaaacgcaatggcaattcccgaagcattcacgcacctatcccagaaattaagaagctgcagaagaagctggccacactgttgcaggcactgcatgttccgaaactgagctcccacggcttcttggccgacagaagtgtcaagacgaatgccctcccccatacaaagaagaagtttgtgttcaacatcgacctgaaagatttctttgaaaccgttcatttcggcagagttaagaatctgtttatgtcccgtgctgtgggagcaccgcacaacgtcgcaacggttatggctcatttatgttgttttaatggacgtctcgcccaaggcgccccaactagccctataattagcaacatgatctgcttaaagcttgatgcccagttacaggccttggctcacaaggaaaagtgccactacacccgatacgcggatgatattactttcagctttacctgttccaaaaacaaactgccaaaagacatcttggtgtatagtgaactcgacgcaatatcagctgggaaagggctggaaatcattattgaggcgaatgggttcaaaatcaatcccgataaaacccgggtgagacacaagtcccaaagacagttggtgaccggactgaccgtgaatgactttccaaacgtgtcacgcgagtatatcaggcgtaccagcgccatgataaatgcccttagaaagtatggcgaagtgctagcggagaggaagtacgttgagattaataagatcaacgccgtccctctagcagctcgccagctgaaacggctcgaacggaaagagggcgacttctttatcaaggtagtcaagggacgcctgaattacatccaaatgatacggggtcggggcgacccgatctatcggaaactcgcatactatttcagtgtcgctgtgaagaaggagaacaaagagtttcttaagaccgctgaggagctcctgggtgaagccctcttcatagtgaagaatagtctcgacgaggatagtcagggaactgcgtttctgcttgacggtgtgggaatcgtgactaaccatcacgtaatcgacggcgtcgatcttatcacagccccccattgcatcgagttcataactacagagaaaattcctcgcgtgctttcagctgagctgatttttacttcgaaatccatggatctggcagttttccacccatcttcagattttgaaaccctgaggccactccagatgtctcgacgcaaaaggcttaaagccctcgaccccattctggccatgggcttcccttctcacatcaggggtgccacgccctacatcaacacaggaaagattgtccagtctagagaggcctatcggtcaactttttggttagtcgacatccctctgctgagaggaaattccggaggccccgtgtttaacagctctatggaggtgataggtgtagcaactatgggttctaaaaaccacgacaggacaacaattatgcacggctttttgcctaacgatggcatttctacgatcctgaaaaaccccgatttcctctatcgacgcgagatactgaaaaccaagaagacaggcattagatcaatctcgaccaggctaaaaggggtacagactttggctttctacgaacataagcatgtggggccttacccccttattcacgcctcctggccctttctctccggagctggggggtga

SEQ ID NO: 7849 - RNA, 1758 nt, unidentified
  source 1..1758: mol_type = other RNA; note = synthetic construct
atgacgacaatcccgaactttgctttttccttgattaaggttaagcccggctttggcagcattgaatcgctggcccttctgctgggcaccactcaggacgccctacttgggctcctgtatccgcagaccaaaatcaactacgtcaccttcactattcctaagaagaacggggatattcgaacgattcatgcacccaaaaatcacttaaagcactttcagagactccttgctaaatacctgctcaccacacacaacgcgaaatcgtgtacacacggttttgtggagaataagagcataaagacgaacgctcaaccccatattggcaaagagtacgtgttcaacattgacttaaaggatttcttccaaacgatccattacggacgggtgaaaagacttttcatggcgtacccttttaacgccccagagaacgtggccacagtaatcgctcagctatgttgtttcaatggtcatctggcccagggagctcctacttctcccattatttccaacatgatcgccctcaaattggacggccagatcttgagtgtcgcttccaagaaccagtgccactacacacgttatgtcgacgatctgactttctctttcacctgcaagaagcaccgactgccaaaggacatagtcaaaattagtaacgaagatgaagctacaccaggcgatacactcactaatatcattctgaagaatggctttacggtcaaccctgaaaagacccgcttgaagcacagatctcaacggcaagtggccgccggtgtcaccgtaaacgaatttaccaacctccctcggagctacatcagactgaccggatctctcatatatgcactggagaaatttggacccatcaatgccgagatcaagtatgtggaggggttaaatgagatccatcagctcactccgtaccagctagacaaaataaagcggtcaaacggggagtttttcaagacagtcgtaaaaggaaggctagacttcctcaaaatgataaggggcaaatcagatagtatataccggaagctggcgtatcgattttccaaagcaatcggaaaggaagataagaacttgatgaaatccgcacaggatatcctgggggagtccgtgtttgtggtggaggaaatgatgtcagaaagccaggggacagctttccttctggatggcgtcggcgttgttacaaacttccacgtggttggtggaattactcaagagctcgcacccgattgtgtgagcttcatcactaatgaggccacctccaggactctgtcagcacagctcatcttctcatgcaaagaaagagatctggccgttttctatcctgaccatagttttgacacaatcaggcctctcaaaacccgtaagaaaaatggtctgacccgcgtgttggaccccatcctgtctatgggatacccaaatcatagcgcaggaacccccccctattttaacaccgggaagatcgtgcagcagcgcaacgtgctgggtaggaattactggttggttgacatcccattactgaagggcaattctggcggaccaattttcaatagttccatggaagtaattgggatcgctacaattggcactaccagaaatgacttggcctctatactgcacgggtttcttccagtggagaagcttaaagagattatcaagctgcctgagttcatatatcgcaaacgctacctggccctgaaaaataatcagccaaatttaagctgcctgcttcctaagagcaggccctattattactga

SEQ ID NO: 7850 - RNA, 1833 nt, unidentified
  source 1..1833: mol_type = other RNA; note = synthetic construct
atgacattaccattaggcgagaacttcttttcaacagcgcagactattgccaatgaactgggtatgtcttacaagcagctctcttcctttatttatcccactaccaataaatcgtaccgaacgttcacaattaagaagaaaggggggggcgaacggaccatcagtgtcccaaagaagaaccttaaaaagatccaacgcatgatcgttgacaagatcatgaagtactataaccccaagctcagctgccacggctttactgaatcccgttcaattgtgaccaatgcctatcgtcacgtcggaaagcagtttgtttttaacgtcgaccttaaggattttttcggcaccattcacttcgggcgggtgcgcaacttgtttatctccaaaccattcctgtattcccattcagctgccaccgtgctggctcagatttgttgtaaggatggagtgttaccccagggagcaccgacttcacctatcatctctaacctgatatgctggaaactcgacgcccaactccagaccctggctgcaaagaataattgtcactatacccgatacgccgatgatatcacgttctcttttagctgcaataagaagtatatcccaaaatctatcctggacttcgacaacgatggggtagtggttgttggcagttctctggaaaggatcatcaaagaaaacggcttcaatattaactacgagaaagtgaggttgaagggcagatctcaacgccaggaggtgacgggaatcactgtaaatgagtttactaacgtggagcggaagttcattaggaagacccgctccatgattcatgcttggcgtaagtttggatcaattaaagcccaggagcattacatctccaattatctggaaaaggatattcttcctagacaagctaaaagcattgccaaaaacgacggggaattctttatcgatgtggtgaaggggcgggtgaattacatacagatggtgaggggcagggcagatcccatctacagaaagctggcttaccagatgacactggctatggggaagcctaatcacctatttttgcggaaagcagaggaggtcataagtgacagcgttttcatcgtggagaataatctcctgtgcgagcaggggagtgcctttctgcttgatgacattggcatcgtaactaaccaacatgttgtggagggaattgatcacgagaaccacgagcttgtcgacttctaccgagaagacgacgtaaagaacaaaatgaatagcagctttgtctattcctctgcaagcaaagatatagcgatatttctcgcaacagccaactttaataatattcctccgctgccaatcggcaacgacaaaaatcttagagtgggagactcaatcattgtcgtgggctatccagattacagcgaaggggaaacggcgtacatcaacagagggaagatagtgcagtcgatactccggttcggaaaacgcttttggctcatcgacatccccgtcatacacggtaacagtggtggtcctgtcttgaatgagaaactagaggtggtgggcattgccaccctcggaagtgccatcaatgatggtaagaacaaattcaatggtttcgttcctatttccacattgactggcatcctgaacaccccccagtacaacaaaatttacaggtattccctactgcatagcaaaaagcccaaggtcgagattgaaaaagacttgttctatgttgatggactgacatattgtaagaagtgtttcctggacaagaagcaggccatcacagtgtacaaaaccaaaagcaacgtattcttcaactgcaaaatatgcggcaagacatacagaaaatga

SEQ ID NO: 7851 - RNA, 1674 nt, unidentified
  source 1..1674: mol_type = other RNA; note = synthetic construct
atgattgatttctctgacactattctgcccagccaggaggctattgccaagaaattcggctacacatatgatcagctgtcatctctgatctaccccaaggtgaataaatcataccattccttcacgatctctaaaaagaatggagaactgcgcgaaattaatgcgccaaaaatcctacttttgaaagtgcagcagactctggccgaggagctgagctcctgttacacgcctaagaatgctacccacggatttattaaggagaggtctatcgtgaccaacgccaaaaagcatatcggtaagcgcaacgtgtttaacatcgatctgaaggacttctacgggtccattcactttgggcgcgttaggaacttgctaatgtctaaaccctttatgtatagccaaagtgaagctactattctcgcacagatttgttgttataacggagccctcccccagggagctccaacatcgccaataataagcaacctcatttgctggaaaatggatgcactgcttcagaacctggcaagcgagaatagatgcacttacaccaggtatgccgacgacataacctttagcttcaacgtgaagaagtctaaactgccgtcatctatagtccggtttgacttaaaaaaagaccgagcgattgtggggtatgaactctccaagataatcgaagagagtgggtttgtcattaatgaggagaaggtcagactcgcaggaaaaaaccagagacaagaggtaacaggcatcactgttaataagaagccaaatgtgtccagaaagtttatccgacagacagcctccatgctgtatgcgtggaaaaaattcggagcagaacaagccgagcacgattacctggacaagtaccgggttaaaaaacttactaattggcaaagcgagaaattcaaaggcgcgaagggggagtttttcattaaagtcgtgaagggtcgtgtgaattacatccagatggtcaggggccgcgacgataagatttaccggaagttagctttcaaattgaccgatgccctcggaaagcccaacatccacttcacgaaatcacgggaagagcttgcaacctacgtgatcgagtggatggaagcccagggcaccggtttcctgctggatggcgtaggcattgtaactaacgagcacgtgatcagcggtatcactagtgataattacgccatgtgtaacgtctatcgttgctatgaggaagataagaaacagaagtgcccgttgatcttcgcagacaaagctatagacctggccgtgctggaccccacctcctaccttagtgacgtgaagccttataagatcggggaggacaaatatttagaaattggcgacacagtcaaggttatcggttttcctaaattcggtcctggctcaacccccaacatatccgagggcatcatcacaagcaagaagaagatccacgggatcgatgcttttatcgtgaacacacctataaccgatggagccagtgggggaccggtactagacaacaataatgaagttattggcgtggctttctggggcccagaacataatgatgggtcaaaccctatcaatggcttcattcctatttccacattgaagaacgctctcgaacagcatagtctcaccaattcgtttggagccaaaaagccagttaagcagcaaaaggagaagtga

SEQ ID NO: 7852 - RNA, 1632 nt, unidentified
  source 1..1632: mol_type = other RNA; note = synthetic construct
atggacaacattgattttaaagattgcagaaccgtcaaagacctgagtcatttccttggcatgaactacaagaaactgtcttcgctgatctacccaaatacaaatcgactctacgtgacctttattatccctaaaaaaagcggagaggaccggacgattgacgcccccaagcctattcttaaagctatccaacgtaaactgtccattgagttcaacaagatatataaccccagaaagaatacccacggcttcatttgtggaaaaagcatagtcaccaatgccaatcagcacatcaacaagcgctacatattcaatatcgactttaaggacttcttccattccattcattttgggaggataagaaacctctttatgagcgacctgtttgcgtttacttatgaggtggctacggtcttggcacacatctgttgtcacaacaaccggctgccacaaggtgcacccactagccccgttctcaccaatatcatctcttttaagctggataacgacctcttcaaacttagtttcgacaacaaatgttctgtgacaaggtatgcggacgatgtgagcttctcattcagctgcaataagaggaattttcccaaggatatcctttactttaacaaggctaaagagatcgttccgggcataaaactaagggaagtgatcgaaaaaaacgggtttgagattaacaacaacaaagttcgcttgcagaataagacacaacggcagcaggttacaggcattacagtgaaccagaaactgaacattcaccggagttacataattaaaactaggtctatgctgcacgcctgggacaagtatgggttggagcaggccgccaaggaatatctatccaagtacatcgaaaaagactacagcaataatgataagaaccgaatcaattccaacgagagtctctttttcaagcaagttatttcaggcagaattaattacatcggtatggtgcgcgggattaacgatgagatttaccggaagattcgctataagtattcatgcctgattggggtgcctgatgaaaacctgaagaagtccttagatgatattctttcggagtcagtcttcatattagagaacaacataggaatcgctcagggaactgcctttttagtggagcagctaggcctggtcacggcctatcatgtgatagaggacatcaatgaggaaaatagctgcctgatcgatttttttcgatgcaatgaagtggataagaagagaaaagctacactcttcaagacctctcagaagaatgacatcgccatcttcactcttaacaataacttccaagacatcacaccgctgaaactgggggacgcatcaaagctcaaacgtggagtagaaatcaagctcttcggatttcctggctacaataccggggatgaatgccattgtgacaacgggaaaatcacccagaagaaaaagttgtatggtttcgatgtctggctcgtcgatatcccaattacccacggtatcagtggaggcccagtgttgaacgcaaataatgaggtaattggcatcgcaatagtaggctccgaaaagaatgataaatctactatctcccagggtttcattcctatcactaaggccctggctatgctgcaggaccagtga

SEQ ID NO: 7853 - RNA, 1626 nt, unidentified
  source 1..1626: mol_type = other RNA; note = synthetic construct
atggagcagacaatcaacaagaatttcaactctctagatacccttgtatctctctttggcatcaattattccaacttggctaaactgatttacccaacgacaaataacctgtatcattccttctcaatcccaaagaaatccggggaacttcgggagattaatgcccccaaccgaatattgaaggaaatccagtataagctcctcaatgaactgcaatcatactatagcaaaaggaactgtactcacggattcataaatgaacgtaatgtcgtcacaaatgctcggccccacgtgaagaagaacattatcttgaaccttgacttgaaagagttttttcagagcatacacttcggacgggtcagaaacctgtttatgagcaatcctttcaacttcaataagaacgtagccacagtgcttgcacagatttgctgtcataaaggccacttacctcagggcgcgccaacgtcacccctgatcacaaatctaatttgctataagttggacaaggagctgagcaagctcgcattcaacaataattgcaccgtgaccagatatgtggacgacattaccttttcctttaactgctctcacgataaaatcccgagagatatccttgatggcatttctggcgaatcaattagcattagtaaaaagctggtgaacatcatcaataagaacggattcgagatcaattacaaaaaagtgaggctgagttcgtccaatcagagacaacaagttactggtattgtaacgaacgtcaaggtcaacctcccacgaaagtacatcaaaaaaactcaaagcatgctgtacgcctggaaaaacttttccctgcccaacgcagagcaggcccatataaacaattacctggagaagccttacaagtaccagcgctttattcgctacaacaaagacaagagttacttcaacctcatgattaaaggccgcattaattatataggcatggtgaggggccaatccgactgtatctatcggaagttactgtaccagtacaccgaactcatcgggaaccctaataaggagctcctgaagtcggtggatgattgtctggctgacagcgtttttatcactgagtatcctattgagagtaaacaggggaccgctttcttcctgaaggatattgggctcgtgacagccgcccatgttgttgagggaattcacgaaactaattcttgcttcctggactttttcaggcactatgaagttaaaatcaagcgtaaagctaccctgttcaaaaaatctgaagagaaggatattgccatattttacgtgggcgatgactttaagaaccttccctcattgaaagtgggggacgactctaaattagccatcggggaccagatcaagctgatcggattcccggattataactaccacgactcctacttatccaatctgggaaagatcatccagaaaaagactatgtacaacctggatgtatggatcgtggacctacctattaactttggggtgagcggaggtcccgtcttcaataacaagaatgaggtgataggtgtcgcgctccagggtagtaagaaacatgatcagtcaacctatagtcattattttgttccaatcagcaaggtgatagaaatggcacagaattga

SEQ ID NO: 7854 - RNA, 1617 nt, unidentified
  source 1..1617: mol_type = other RNA; note = synthetic construct
atgaatttcctgcaactgcagaccacacaggatttggccaatttctttgaaatagacctaaagcatctgatgtacctcgtgcatgttatgcctgggcacattaaatacaagtccttcaagatcatcactaagaagaaagagcgtttgatttcatccccatttttcaggctcaaaaaaattcagtaccgcctgaaagaagagttcgaaaagatctataagccccggaagagcgtctatggatttatcaaggataagagcatcaaggaaaacgcaataaaccatctgaacaagcgttacattttcaacatcgatctgcaagacttctttgggtctatcacagccataagaatcaaatatctcctgcaatcttacccttttaattttcccagcatagtggcagagataatcagtaagcttatctgctaccagggggtactgccacaaggctcaccctgctccccaattatttccaatatgattgctcaccgaatggacggtgaactgagcttccttgctaagaagaataacgccacttataccaggtacgtagatgatattacgttctctttcactaagcggtttaaagccctgccgaaagatatcctgacatttgagaacggagatttaaatgtgggcgccaaactggaccagatcatcaacagcaacggcttcatcgtgaaccagaaaaaagtcagactcggtaaaagaagtactcgaatggaagtgaccggcattaccgtgaatgagaagctgaatgttccaaggaagtatatacgcaagatacggactctgttacacctggtggaaaaatacggcgaacaggaggccgataggattttttcgacatataagcggactcgcgtgagtaaatatccgcctagaatcgagaaagcaatttttggtatgcttacctacttagctcaaattgtgggatacaacaacatggtgtactataatcttgcgaagaagtataacagtctcgagtttaaatctaagctgctcatcattaagcctgtcgacttgcagattatcgacgcactatgggtcatcctgcttcctacgtgtgaagagggaaccgctttttctatatccaacaacctcgtagttacagccgctcacgttgttatcaacgaagatacaaaccagccattcgaggaaatccagatctacaagtctttcgcccaggaccagatctaccacctagaggtattgaagtataatattgacgcggatgtggcaatttgcaagatcatggagaattacaaagacgactccttctttgagttggggggaaacatcgagaataaactcaaactcctgggcttcccacagtttcagcccaaccagcataagcctcatagcgctgactgtgacttaatgttcaaaaccacaatcaaggagtacaagtatttctccataaatacgcccattattggggggaatagcggtgggcccgtcatcgactcatgcaaacgcgtggtcggcgtggcctcaaaaggctattttggacaaggcattattgaccagggcagtctggttaataaatcaatccacgtcaccatcatgggacacaacttgtgtagcgatatacagaatgtgaaggatcttattgactga

SEQ ID NO: 7855 - RNA, 1695 nt, unidentified
  source 1..1695: mol_type = other RNA; note = synthetic construct
atgaacggagggttctttctcaaattttctcccaccctgtccccttctacgacaccaattgagcttgccgaattgctgggcaccgactacgcaaaaatcaagaggctgtactatcacggcgacatgcagcggcattacctggctttcgacattcccaaaaagtccggcggtaaacgtagaattctggcaccaagcgataagttgaagacccttcaggggcggctcgctagcctactgaagaagatatataagccccgagatcctgttatggctttccgcgacgggtcatccattgtgacaaatgctcatgcccactgcagaaagaaatatgtcttcaacatcgacttggagaattttttcgggaccataacttttgcacgggtgcgagggatgttaattagtaaaccgtattcgctgacagctgaaacagcaactgttattgcccatttggcgactattaatggtgctctgcctcagggcgctccctcttcacctatcctgagtaatatgatctgtgccagtctggatagagatctgtatagtctggccaagtcatacagggccgtatatacgagatatgcggacgacatcactctgtcgttttactgtctggccgaatttttacccaccgagattgtagagtactctctctccaacggtaagcctaatcactatttcagcaaggtcgggaacgagttggggagtctcgtgcgtagacacggcttcatcatcaacgagcaaaaagtgcgcttgcaggggccaggtgagagaaggaccgtgactggcctcgtcacaaaccagaagccaaatgtgccgcgcccttatatcaggaagactgccgcattaatccacagcttcgagaagctcggagagcaagctgcgaacatactttacaaacagaaaaacccgaatagctccggaatccttgagtcccacctgcagggcaggctgcttttcatcaagcaggtggccggactggaatctgtcgtttacagacgtcttgcccaacgctataatatgctgcctcttaaatcaaaggtccccaatacaccaattgctaccacggaagatagcgacaacttcaaagtcggtgagtttattaaaaacaagtgctgggtgacagaaatttccgagaacgtcgaggatgaactagttcatatccaaggaaccgccttcatgattcagggctccctactcgtgacatgtgaacataacctgagctaccagacgaagcagaaacggcacgagtatggtgagtgcctcgtgtatcgcgtgggggagggccaagcagtgtacgaagcgaaagtgatcatacgggacaaagatctcgacatagccgtgttacggatatcagatgcaccagcaggcttagagcactttaccctcgaagagacaagggaaccaaacatcggagacagggtcgcaattctgggcttccctaatcacaagaccgggccatacgtcggcatcctgaagtgccgcgtgactaataagtaccccctacataacgtgcagcattctgaagttgataaaactttgtacgccggaaattctggtggccccgtaatcaacagcagctaccacgtagttggaatcgctgccaaaggagccgagggcaatcccaacgggaagaattcatttatccgagtgaccgaactcgttaaatacctggagaagagtggatttgaaatgtga

SEQ ID NO: 7856 - RNA, 1692 nt, unidentified
  source 1..1692: mol_type = other RNA; note = synthetic construct
atgaacggcggcttctttctcaactttctgtcccttagccccagtacatcacctgcggagctggcgcaacttctgggcaccgactacggcaaaataaagcgtctctactatcgcggagacaggcagcgacactacctggccttcgacattcctaaaaaaaatggagggaaacggcgaatcctggccccgtctgacaaattgaaaactctacagagtcgattggccagtctcctcaaaaaaatctacaaacccagagagcctgtcaaagcattcttagatggcggatccattgtctccaatgcctaccctcattgtaggaagccctatgtgtttaacattgatctcgaaaacttcttcggaaccattaccttcgccaggataagggggatgcttataagcaagccctactcactgacacccgagacggctactgtgatcgctcatttagctaccattaatgggatcctcccacagggggctccctcttccccaattctgagcaatatgctgtgcgcaagtttggacagggacctctacagccttgccaagcggaaccgcgcagtgtacaccagatatgctgacgacattacactcagtttctactgtccagcggaatttctgcctccgggagtggtggagtattcaatctctaatggcaagcctaaccattattactcgcggacaggtcaggaactccagagcttggtgagacagcacgggttcacaatcaactttgataaggtacgactccagggacccggtgagcgtagaaccgtgaccggcttggtgaccaaccagaagcctaacgtaccaagaccctacattcgcaagacagccgcactgatccattccctggaaaaaaacggcgtggaagctgccaatgcgatctataaacaaaagaacccaaatagctccggagtactcgagagccacctgcagggtcgcctactttttataaagcaggtggtgggtgagtcttccgtcgtttatagacgcctagcccaaagatacaacatgctgcccattcggagcaaggtccccaacgcacctatcgcaactaccgaagactcagataattttaaggtcggggagttcattaagactaaatgctgggtcacagaaatctcggaaaggattgaggataacctggttcagattcaggggaccgcctttatgatccagggcgggctgatcgttacgtgcgaacataatctgagctaccagactaaggagcgtcggcacgagtatgatgaatgcctggtgtaccgggtaggagaggatgagggagtctacgaggcccaggttatcatccggaataagtatttagatctggctgtgctgaagatcaaaaatgcacctgacgatttagagcacttcacactggaggtcactaaggaaccaaatattggagatagggttgccgtgctgggtttcccaaaccacaagacgggctttcacgtggggatcttgaagtgtcgcatcaccaataaatatccgcttcacgacgtgcaacactctgaagttgacaagactttgtatgctggtaattcaggcggcgccgttatcaattcttcttaccatgtggtaggagtcgccgctaaaggggcagagggcaatccaaacgggaagaacactttcataagggtgtccgaactaataggctatcttcaaaagtcaggttttgatatgtga

SEQ ID NO: 7857 - RNA, 1695 nt, unidentified
  source 1..1695: mol_type = other RNA; note = synthetic construct
atgaacggcggcttcttcctgtccctcttccagctgagttcttccacaacgccaggcgaactcgctcaactgctcggcacagactacggcaagatcaaaagactttactataccggtgatatgcaccggcattacctggcctttgatatacccaaaaagagcggcggtaagcgccgcattcttgctccgagcgaaaaattgaagacactccaggcccgactggccaccctgctaaacaagatttatactccccgtgagcccgtgaaagcttttagagaggggtcgagcatcgtagcaaacgcctacccgcattgcagaaagaagtatgtgttcaatattgacctggaaaatttctttggaaccataacgttcaggaggattagagggatgctgataagcgagccttactcactgtctgcggagactgctagcgttatcgcccacttggcaactgtgaacggcattctgcctcagggggcaccatcctccccgatattaagcaatatgctttgtgccagcctggatagagacttgtattccttggccaaacgcaatagggctgtttatacccgttacgccgacgatattactttcagtttttacagtccagcagagtttcttccccaaaacgttgtggagtattctctcagtaatggaaagcctaatcactactactccaaggtgggacaggagttagaaaccatcgtgcgccagcatgggtttacaattaatctgaccaaggtacgactacagggaccttcagagcggcgtatcgtcacaggccttgtcactaaccaaaaacctaatgtgcccagaacctacgttcgcaaaacggctgccctaatccactcaatagagaagaatggtgaggaagccgcgaacgctatttacaaaaaaaaaaaccccaactcctctggaatcttagagtctcacctgcaggggcgactcctgtacattaagcaggtggttggcgaggatagcgaagtctatcgcaggctggcccaaaggtacaatatgcttcccatcaagtccaaagtgcctaatacacctatcactaccactgaggacagtgacaacttcaaagtgggtgaattcataaagtcaaagtgttgggtcaccgaggttagtgaaaacattaatggaaagttggaacagattcagggaaccgcgtttatgatccaagggggcttgctcgtgacatgtgagcacaacctcacctatagggacaaggataacaagcggcatgagtttaatcagtgttgcgtctatagggtgggggagggagaaggtctttatgaagccaacgtgatcatccggtgcgagaagctggatctcgctgtcctatctattaaagaagctccaacaggcctggagcatttcaccttagaagtcacacgagagcctaacatcggtgaaagagtagccgttctgggatttccaaatcacaaaactggtagccacgtgggcatcctgaaatgccgggtcacaaacaaatatcccttgtatgaaatccagcactcggaggtggacaagactctctacgcagggaactccggggggccagtgatcaattcatcataccatgtcgtgggggtagcagcaaagggagcggagggcaacccaaatggaaaaaacacgttcatccggatttctgaactgatcaaatacctgcagaagaagggctttgagatgtga

SEQ ID NO: 7858 - RNA, 1695 nt, unidentified
  source 1..1695: mol_type = other RNA; note = synthetic construct
atgaatggtgggttctttctgaacttcgtggccctgaacccaagcaccactccgatcgagttggcggaacaccttggaaccgattacgggaaaatcaaacacctatactaccggggagggatgctcagacactacctggaatttgaaatccccaaaaagaacggcgagaaacggaagatcctggctccctctgacaaattaaaaactctccagtctcggcttgcgggccttttgaagaaaatctataacccacgcgagccagtgaaggcttttagagaagggagctccattgtagccaatgcatggccccattgtcgtaagaagttcgtattcaacattgatctggagaactttttcgggactattaccttctcacggattcgcggcatgctgatcgcaaaaccctacagcctaacccctgagacagctacggtgattgcccatctgacgacagtgaacgggattctgcctcagggagcccccagctcccctatcctgtcaaatatgctgtgcgcttcaatggatagggtgctgtactccttagcgaagcataatagagccgtctacactcggtatgccgacgacattacattttctttctattgtcccatcgagtttatccctagcagtatggttgagtctagcgtcagtaatgaccgaccaaatcattattactctaaggtgggctacgaacttcagtcagttatagaccagcacggatttacaatcaacacccgcaaggtgaggttacaggggcccggtgaaagaagaactgttactggattggtcacgaatcaaaagcctaatgtgccccggccttatatccgcaagaccgctgcactgattcattccatcgagaagcacggtgagcaggcagccaacgcaatttacaaagagaagaatcccaacacaagcggagttctcgagtctcacctccagggcaggctgctctttattaagcaggtcgtcggtgaaagttctgtcgtttacagaaggcttgcccaacgctacaacatgttgccaaccaagtccaaggtcccaaacaccccgcaagccaccgacgaagatagtgacaattttaaagtgggcgagttcataaaagacaagtgctggattacagaagtcgagcagaaattggacaatgacctggtacaaatccagggatccgcttttatgatccagggcggcttgctcattacttgcgaacacaatctttcgcacaagatcggagataaatggttcgaatttaacgagtgtttagtgtatcgtgtaggggagggcgagtccatgtatgaagctaaggtgatcatacgagataagaaactggatctcgccgtcctcaagatccaggagcctcctctggggctaaaacatttcaccctcgaagtgtcaaaagagccgaatataggcgagagggttgcagtgctgggcttcccaaatcataaaagcggtagccatcacgtaggtatacttaagtgccgactgacaaacaagtatccactgcacgatgttcaacacagtgaagtggataagaatttgtattctggcaattccggcgggcccgtgattaactcgtcatatcacgtggtgggagtggctgcaaagggtgccgaaggcaaccctcatggaaaaaacacattcatcagggtcagtgagctgattaaatacctggagaagtccggggtgatactctga

SEQ ID NO: 7859 - RNA, 1692 nt, unidentified
  source 1..1692: mol_type = other RNA; note = synthetic construct
atgaacggcggttttttccttaatttcgtggccctaaatcccaatacatcgcctgatgaactggcggccttactgggtaccgactacggcaagattaagcacttttactataggggcgagatgcagagacattacttggcttttgatatccctaagaaaaacggagcaaaacggcgaatcttggctcccactgacaagctgaaaacgatacaggctcgtatcgcaaatctgctgtccaaactctatactccacgagaacccgttaaagccttcctggaaggcactagcatagtggctaacgcccgcccacattgtcgcaagaagtacgtgttcaatgtcgacctggagaacttttttggcaccatcacctttgcccgcgtacgagggatgctgattgccaagccatacagcctctcccctgagacagctaccgtgatcgcacatcttactactgtgaactcaatcctccctcaaggggccccctcctctccaatcttgagcaatatgctatgcgcatcccttgatagggatctgtactctctggccaagagacaccgctcagtgtataccaggtacgccgacgacatcacgttctctttctattgtccgatcgatttcgtaccagcagagctggttgattggagtgagagtaatggccgcgctaatcactatttttcccaagtcggatacgaactgggcagtgccatcgaaaggcatggcttcaaggttaaccagtcgaaggttcgcctgcagggacctcacgaacgacgcattgtaacaggcctcgtgacgaaccagaagccaaatgtgccgcggacctacattaggaagacagccgccttgatacattctattgagaaatacggcgttgaggccgccaacattgttttcagagaaaagaaccctaacagcaccgctaccgtggagtcccacctccagggacggttactctatatcaaacaggtggtgtcagaggacagcgaagtatatcggagattggcgcaaagatataacatgcttcccattaaaagcaaggtccccaatgctccacaggcgaccagagaggattctgataactttagagtggggaaatttgtcagggacaagtgctggatcactaatatagaagagtacaggaacggtaaattggtgatgatccaaggatctgcatttctgatgaaaggaggccttttagtcacatgtgaacacgtgctcagcgctatcgtcgatgactcaagggaagagtttaacgagtgcctcgtgtcccgtattggagatgatgaatccatttatgaggctaaggtgataattagaaacaaagagcttgacattgctgtactaaagattaaggacgcccccgcagacctcgagacattcacactggaggaagtgaaagagcccaatattggagatcgggtcgcggttctgggcttcccgaattttaaagaaggttctaaagacgttggcattctgaagtgccgtataaccaataagtaccctctcttcggggtgtcccacagcgaagtggacaaaactctgtatagtgggaacagtggaggtcccgtcatcaattcaagctatcacgtcgtcgggatcgcagcaaagggtgcagccgggaaccctcaggggaaaaatagtttcatccgggtgtctgagttacggaagtacctggagaagtcaggggccatctga

SEQ ID NO: 7860 - RNA, 1692 nt, unidentified
  source 1..1692: mol_type = other RNA; note = synthetic construct
atgaatggaggtttctttcttaactttacgaccctcaacccctataccgcgccagaggacttagcaaccttgctgggcaccgactatgggaagattaaacatttctactatcggggcgagatgaaacgccactatctggccttcgagatctccaagaagagcggcggaaagcgtaagattctggctcctacagacaaactgaagactattcagggcagaatcgctggtctgctatcaaagttgtataaacccagagccccagttaaagctttcctggtgggccagagcatcgtagcaaacgcacgcccacattgtcgtaaaaaatacgtgttcaacatcgatttggagaatttctttggcaccattacctttcggcgtgtgaggggcatgctgatggccaagccttactcactgtcccctgaaaccgcttcggtgatcgcgcacttgactacggtggatgggctcttaccgcagggagctccatcttctccagtgatttcaaacatgatttgcgctagcctggaccgggagctttacagtctggccaagaggcatcgcgccgtgtacacacgctatgctgacgatatgacattcagtttctatacacctatccaatatgttcccagagagctcgtcgagtggtgtgagttggatggccgacccaaccattactcctctaaagtcggccacgagctagcagccgtaatagctactcagggtttcaagatcaatgaagataaggtgcgcctccaggggggtagggaaaggcagctggtgactggcctggtcacgaatcagaaacccaacgtaccgcgcccctacattagaaaaacagctgcccttgtgcacagcgtggaaaagtttggactggaagtgtcaacctctatatttaaggagaagaatccaaactctaccgcaaacatcgagacacacttgcagggacggctgctctatattaaacaggtcgtgggggaggaaagcaaggtctaccgacggctcgcacaacggtacaacatgctccctattaaatccaaggtgcccaacactccgatcgccacacccgaggattccgataatttcaagatcgggaagtttatcaaagacaaatgctgggttatcgagataaacgaggagataaatggaaagttagttagcagtcaagggtccgcgttcttgatcggaggtaggcttctggtaacctgcgagcatgtcctggccgaaaattttatcgatggtgagaggattgaggtcaacgaatgcctgatcagacgaatgggggacgaaaatatttacgaagccaaggtcataatccgatctaaggacctagatatcgcagtgctcaaaattgtggatccacctgcgggactggaggtgtttagtctcgaagacattaaggagcctaatatcggcgacagagtggcagtgcttggatttcctaattttaaagaagggagcaacgacgttggggttcttaaatgtaggcttacaaacaaatacccactgtcaggagtaatgcacagcgaagttgataagactctgtacagtggcaatagcggcggccccgtcataaatacttcctaccacgtggttgggattgctgcccaaggtgccgccgggaatcctgaaggaaaaaactcgttcatcagagtctccgaattaaagcggtatctcgacaagtctggcgccatatga

SEQ ID NO: 7861 - RNA, 1680 nt, unidentified
  source 1..1680: mol_type = other RNA; note = synthetic construct
atggaagctttcttaaacctcattggccttactcctcacaccaccccccaggagctagcccagctgttgggaacagactactctaagattaagcggttatactataggtcacccatcacccgacactatcacgaatttaacatcccaaagaagaacggtgacaaaagaaagatactggcaccaagcgagaagctgaaaacccttcaactgcggattagtgcgctgctgaacaagctgtatgatccacgcgcaccggctaaagcctttatccaggggaggagcatcgtcgataacgccgcaccgcactgtcgtaaatcctttgtgttcaatattgacctcaacaactttttccccagtatcaccttcgggagggttagaggcctacttatggcaaaaccttacagtctgtcctccgagacagctactgtgattgctcacctgtctactgtgaatggaagcttaccccaggggtcaccatgctcaccggttatcagcaatatgatttgtgccgggctggatagggaattgtattcattggcgagggaacatcgcgccttttacacacggtatgctgatgatatcacgttttccttttactgtcctcttggctttatctctcgaaagattgttattccctccctcagtaaccagcacacgaaccattatgattcaaaggtcggcgagctacttaatgagatcatcatctcccacggattcacaattaatcaggggaaagtccgattgcagggatccaacgagagacaggtggtaaccggactcaccacaaatcaaaaaccaaatgtgcctcggacatttatccgcaagaccgccgccttaatccactctattgaaaagacgggccttgagcaagcaaatctcatattccgtgagaagaatccaaacagcaagggaacattggactcacatatccgcgggagactgctgtacattaagcaggtggtgagtgaggaaagcgtggtctacagaagactggcccatagatacaacatgctgcccatttcggcaaaagttcccaatcccgccatttctgccatcgaaaataacgagaacttcaagatcggagagttcataaaaaacaaatgctggatcgtgaatctgtgtgaagacattgatggcgatgtggttgtcctccagggtactgcatttacaataaagaatcgcctgctggtaacctgcgcgcacgtactgcagtattccggtaaggacttcgacgattgcgaaatcttcagggtgcatgaagctcaaaagactctaaaggccaaagtcataatccgtgacaaccaatctgacatcgctatcctgaagatcctcgagcctcctagcaatttggagccattcacccttgaggaggagaaagagcccaatattggcgaaagggtcgctatcctcggctttcctaacttcaaagaaggggccacaagcgtgggcatactccgctcccggattactaataagtatcctctgtttgcaccacccgtgatgcatagcgaggtggacaaaactctctacgccggtaattccggcggtccagttataaacagttcttaccatgtagtgggaatcgcttcaaaaggtgccgcgggctctcctactgggcagaacagcttcatacggatttcggagctgattaaaatattggaacgatacgaaaccaactga

SEQ ID NO: 7862 - RNA, 1680 nt, unidentified
  source 1..1680: mol_type = other RNA; note = synthetic construct
atggacggagggacattcttgcttggcactctgggtcctacaactacccctgatgaactggcgcggatgctaggaacctcctactcaaagatcaagcatttctactacagtagggacatgggatctaattataggcagtttacgattccgaagaagaacggggaaaaacgcgtgattctggcacctgaaaattggctaaaaacactccagctacgactcgcgaaacggctccaattgctctacaagcccagaaaaggggtaaccggattcgtgaaaaattcaggaatcgctgataacgccaatctgcataaaagatcgcgatacctgttcaacattgatctgaaggactttttcccctcgataaaattccacagaatacgtggcctcctcattgcaaagccatactcacttatgccagagacggccagcgtgatcgctcatctgtgtacatttcggggttccctgccacaaggggccccaactagtccaattttatccaatatgttctgcgcatcactagacagggaactgtataccttggcggtccgacacaacgccacgtatagcaggtatgcagacgatattagcttttctttctattgcccactgcggagtctgccccctgaaatcgtcgtcacaagcgagagacagggcgagttaaatcactataaagccaccataggcgataagctgcgtgaggctatactgaggtttggctttgaagaaaacgaacgaaaggtgcggcttttgagccgaactgagaagcagctcgtcaccgggctggtgtcaaactgtaaggcaaacattgaccggaggtacgtacgctctaccgcggctatgattcactccctggagaaagacggtgagacagtggcaaatgagaggcgcaaggccaaacacccggacagcactactcccgtggctgcacacgtgcagggtaggttgcttttcatgcaccagattttgggtaaaaattctccagtttacgcccggctggccaatagatttaatgtgctgccactcaagtttaaagtgccccctcctagtctgagtaccagcgaacgcgaggcatctatagccgtaaacagattcgttagagctaagtgttgggttgtcgaagtagctattgacgtgcccggcgattgcatcatttcccaggggtccggcttcatgatcgagggtggactgctggtaacctgcgcacacgtgctggaggagaagggagtcttggtggacgagtgcgagatctatcacgtggatgatgatgcccagcgctataacgctacagtcctccatcgtgaccggaacgccgacatcgccctgctcaagatcgaagactgttccgagaatgagtactttcatcttgaaagcgatgaggagcctaatatcggggacagggtggttatccttggctttcctaacgttaagaacggcgccaaggttggcgtgctccaagcccaggtcagtaataaataccccctctacgatccggaaatcatgcattcagaagtggataagttactgtatcccggcaatagcggcgggcccgttatcaacgctagacaacgcgtggtggggatcgcagccaaaggagctgccggatctgctgagggccagaactcttttatccgcgtctccgagttattcaaggtccttaaagcggccgacgggttaaactga

SEQ ID NO: 7863 - RNA, 1680 nt, unidentified
  source 1..1680: mol_type = other RNA; note = synthetic construct
atggacggtggtattttgatcaacgactgcctgaatcctagcacaaccccggaggacctagctttcatgctcggaacttcttacaacaagatcaagcgcttttactacgatagggacatgtccgcaaactaccggcatttcactattccaaaaaagaatggcgaacccagacacattctcgcccccgaaaattggttaaagacgctgcagataaggctggctaggcggctcaccctcctttatacacctcgcaaaggggttaccggcttcataaaagagagtgggatagtcgtgaacgccgataagcacaaacggtcttcgtacgtgtttaacgtggatctgcaagatttcttcccctcaattaattttcatcgcctgcgcggtatgttaatcgctaagccatattcactgctgccccagaccgctagtgtgatcgcgcacctgtgcacatacagagggtccctgccacagggggctccaacttctcccgtgctttcaaacatgttctgtgccagcatggatcgcaaactatatgagttggcgatccggcacaaagctacttattctagatacgcggacgacatcacctttagcttttactgtcccctgaggtatgtgtcaagtgcaatcgtgaaggcctctggcagacagggcgagctgagccactacaaggcaacgcttggcgacgagctcaagtccattatcaataacttcggatttgtagagaacgagaggaaggttcgactgctgagccggacagagcagcagttggttaccgggttgctcgctaacgccaaggccaatattgatagaagatacatccgtaagaccgccgctatgattcactccctcgagcgagacggcgagacagtcgcgaatgagaggaggaaggagcagaacgctgatagcagtacacctcttgcagcgcacgtgcagggcagactgctctttttacatcaagtccttggcaagacctcacctgtctatgctcgtcttgccaaccgattcaacgtgctgcctctgaaattcaaagtaccgccaccacagttaacgacttccgaacgcgaggcaattatcgcagtctccaagtttgtccgggccaaatgttgggttgtgcaggtcgccatcgacgtcaacgacgactgcataattgcccaggggtcgggattcatgattgaaagtggaatcctggtgacctgcgcccacgttctggaagaaaagggggttactgttgacgagtgcgaaatctatcaggtggatgatgacggccagaaactgacagcagaagtcatataccgaaatagagccattgacattgctattctgaaagtgcatgattgtggtactcaggagtttttccatctggaaaccgatgaggaacccaatataggcgatcaagtggtgatcttgggatttcccaatgtcaaggatggcgcccgggtgggagttatccaagcccgtatcagcaataaatacccattgtataaacctgaggtgatgcattccgaagtagacaagatgctatatccgggaaactccgggggacctgtgataaattctcgccaacgagtggtaggaattgcagccaaaggggccgcaggctctagcgaaggtcagaatagcttcatcagggtatcagaacttatcaaaatcctccctgcactcaaggagcggttgtga

SEQ ID NO: 7864 - RNA, 1677 nt, unidentified
  source 1..1677: mol_type = other RNA; note = synthetic construct
atggggggggtattcttgctttctgatcgtctgggacctacaaccactgccaacgaactcgctgtgatgctaggtactagctacgctaagatcaagtacttttactattctcgtcccataggcgactgttataagcagtttagcatcccaaaaaaaagcggaggcaagaggctgatcctggccccagatgataaactcaagacactccaaacaaggctcgcaatacggcttgcagagatctataccccccggaagggagtcaccggttttatcccaggttccaacatcaccaaaaacgccaagctgcactccaggtctaagtacgtgttcaatattgacttggagaacttcttcccttcaataaagttctacaggattcgtggtctactgactgcacagccttatagtttgatgcctgagacagccacagtaatcgcccacctgtgcaccctcaatggcgctctcccacaaggggccccaacctctcccatcctctcaaacatgttctgcgcatccatggaccgcatgctttattcactggcagtgaagtttaaggcaacatatagcaggtatgccgacgatatctcctttagctttaagtgcccgctgcgcttcattcctgaggacatagtcaaggtgttttccagacagggcgagttgagtaactataaggcagagttggggagtgtgctgtcagtgattattgctgactttgggttcagcgagaacaaaaagaagactcggctgctgtcgcgatctgagaaacaaattgtcaccggcttggttgtgaacactaaggctaatgtggacagacggtacgtgcggaagaccgccgcgatgattcatagtcttgaacaggtcggggaggaagtgtccaatgagcgcagagccgaaaaaaccccgggaagcacgactcctcttgccgctcatgtccagggccggttactgttcatacatcaagtgttaggcaaaacctccccagtttacgctagactcagtaaccgcttcaacgtcctgccattaaaatacaaggttcctagctccatggtgcttactagcgaaagagaagcctctattgctgtaaataagttcgtgcgatcaaaatgttgggttgtcgaggttgcaatcgatatcccaggggattgcattatctcccaaggcagcggcttcatgattagcaaaaacatgttggtgacatgtgcgcatgtgctggaagagaagggagtgagggtgaatgagtgtgaaatataccaggttgataacgatgcggtccgccaccaggccgaggtactgtttcaggacttcaatacggacatcgcagtcctgaagctgctggactttcaggttgacgagttcttccacctggaggaaggtgaagaacccagtatcggtgatccggtcgtggtactaggatttcccaatgtgaaaaatggggctaaagtcggcgttatgagagcgcaggtgacgaacaaataccccctctcaaaaccccccgtaatgcactccgaggtggataaaatgctttaccctggcaattcggggggacctgtcatcaacgcacgacagcacgttgtgggcattgccgccaaaggagccgctggatcagccgaaggacagaattcttttattcgcgtgagtgaactgtctaagctcttagccgctaataaacccgcgtga

SEQ ID NO: 7865 - RNA, 1686 nt, unidentified
  source 1..1686: mol_type = other RNA; note = synthetic construct
atgaacgggggtttcttcttaagctccgatcatctgggacctacaactacccccgatcagctagctactatgctggggaccgactacgcaaagctgaagtacttctattacagaagcggcatgcagcagcactacagagagttcaagattcccaaaaaaagcgggggtgtacgcactattttagccccaggggataagcttaaaacactgcagctgcggttggccaagaggctgacccggatgtaccgaccgcggaagagtgtaaaggcttttgtcgagggcacctctataactcataatgcagccgctcattgtggcaagaaattcgtgttcaatatagacctcaaggacttctttaccagcatcacgttcgcccgggtacgaggtctgcttatcgctaaaccctattccctgatgcccgaaacggccaccgttatcgctcaccttacaactgtgggaggcgtgctaccgcaaggagcccctagcagtcctgttctctccaatatgctgtgtgcgtccctggatagggacctttattcactcgcggtcaagaatcatgccgcttatacaaggtacgccgacgatatatccttttccttttactgccagatctcatacctgccatcagaactggttgtgacaactggttctagtgacaacagtaaccactataatagcttggcaggagaagaactcagccggttgatttctcgccatggatttcgcgtcaacgagaaaaaagttcggctgcaagcttatacagagaggcaggtggtgacaggcttgatcgtgaataggaagccaaacgtggaccgccgctacataagaaagaccagcgccctcatccacgctctcgagaagctgggggcagaagaggccaacgccgtacgaaaagtcaagcagccggactctacaacccccctggaggcccatatccaaggacgtctactgttcattaagcaggtggtgggactcgaaagtgaggtgtataagaggcttgctgatagatttaatatgttgcccatccagtacaaagtgcctaaaccagtctcggagaagttggaaaaggacctgaactttcgaatagggaaatatgtcctggacagatgctgggttgtggatgtgtgtatcgatgtccctggcggatgcgtcgtatcccagggttccgccttcatgatgaaaggccaactccttattacctgtgcgcacgtcctagcagagaagaaaattactgtcaatgagtgcgaagtgttcagggtagattcgccagatgagaggtacgaagcgaaagtgatctacagaaatgaccacgtcgatattgcaatcttaaagattcaggacggcctcgaaaattatgaaagcttcaacttggaggaggcagaagagcccaatatcggcgaccgtgtggtggttctgggctttccaaactttaaagaggggagtacgtctgttggggttattcgcaccaagatctcaaacaaatatccactggacaaacctggcgtgatgcactcagaggtggataagctcctgtaccctgggaactctggaggccccgtgcttgactcagccaatcacgtggtcgggatcgcagctagaggagccgcaggtaacgctgagggccagaactcttttattcgggtgtccgaattactcaagattctgaaagcccgtcaagttgtgtga

SEQ ID NO: 7866 - RNA, 1698 nt, unidentified
  source 1..1698: mol_type = other RNA; note = synthetic construct
atggacggtgatatcagttctcctaagccaaccctggatagttccacgactcctgaacttcttgcaaccatcctgggaacttcatacggcaagattaagtacttttactatgggcgctcaggatcaagaaccgcgtccttctacacccgattcgaaattaacaaaaaaaacgggggggtccgggagatttatgcccccaacaaacaactcaaagtgttgcagggcagaattgcctcattgctctctaatctgtacaagcccaaaaagtatgtcaccgcatttgttaagggaacaagcctctacgataacgcaatcaatcacacaagaaagtcgttcgtattcaacattgacttgaaggacttcttccctactataacttttgcccgcgtccgcggccttcttatttctaagccttacagtctggacccatctactgcctctgttatcgcacatttgactactgtcaatggtcatttaccccagggagcaccaagttcaccagtgatctcaaatatgatttgtgcctccttagatcgccagctaaatagcctggcaaagcagcatcgggcgcagtatacaaggtacgccgatgacattacattttccttttattgtcccctcaaatatctccccctggaaattgtcaatacccaagccaaccccgagaagataaaccactacaacgctaggactggctcgaaactgcgtgaaataatctccaccaacgggtttattgtgaatccgggcaaggtgcggctgcaattcaaacacgagcggcaggtggtcaccggtctgacagtgaacaaaaaggttaacgtagatcgaagatatatccgtaaaacatctgcgatgattcatagcatagagagtttgggtatcgagggcgccaaatttttgaacatcgctctgaatccctccaaggagaatcctgatgaagccgccttcgagctggaaccacatatacaggggcggctcctgtttattaagcaaatcaagggcgagtcatgtcccgtgtacaggaatatggctatcaagtttaactccctgtctgaagagtacaaggtgccactcagcagccacgaaagcaaagacaatatctccattaatgcaaacgtcgtcgacaagtgctggatacttgagattgaagaaaccattagccaggggtctggatttatcgtcgaagggggactactggtgacatgcgcccacgttgtagctagtaaggacgatgctgataagcctgtggagtcctgcaccgtgttccgagtgagcaataaatctgaccagtataaggctatcgttgtgcattacgacaaacacagagacattgcactcctgaaaatcgaccatgatacacacaagttcccgttcttcaggatcgaggagaaaataccagtaaagcagaatgataaggtgtccgtgtatggattccccgattataaaccggcttccacgtacgtcgggtgtgtctgggccagggtagtgaacggttttatcgctagcgccgtgacatactatgaagtggacaaagtgctttactcgggcaacagcggcggacctgtgctcaacagcaatctgcacatcgttggcatcgctgccaaaggcgcggttgacggtcacgagctaaacgcctttttatgcaagagcgagctggagaaagttatcacgacctatagtgctctgcacaatgacgcatga

SEQ ID NO: 7867 - RNA, 1743 nt, unidentified
  source 1..1743: mol_type = other RNA; note = synthetic construct
atggacgaaggttctctgccggaggaatctttaaaactgacatcagagagttcggtagacgacctggccgcaattctcggcacaacctatccaaagattaagtacttctactactcatcatcggtggcaggccactatagcaagttctccattgccaaaaagggaggggggaagcgtgagatccttgcccccgataaccatctgaaagtgctccaaaaacggctggcccaccagctgagcttcctgtacaagccaaacccacgagctaccgcctttctcagtaactcctccatagttcgaaacgcgtcatttcatacgcgcaagcggttcgtgttcaatatagatttgaaggacttctttccttccatcaccttcgctagagttagggccatgctgatgtccaaaccctactctctgacgcctcaaacagccactgttatcgcgcatctagccactgttaaggggaagttaccgcagggtagcccatgttcccccgtcataagtaacatgatctgtagtagcttagacatgcaacttagaactctcgcaaagaggcacaaggcaagctacaccaggtatgccgatgacattaccttcagtttctacgtgcccatgcagtatttgcccgaggatatcgtggtattggggggcgatgacggcgagaaaacccatcacgccgtgtcggtgggaactgcactgtctgaaatcatcaccaaaaaaggctttgtgatccaccctgggaaggtgaggctgcaacgccgcgatgagaagcaggtggtcacaggactcgttgtgaatcagatggccaacgtcgataggcggtacattagaaagaccagcgccatgatccacagcctctcaactttggggctggagactgccaacttaatccacaagtctaagagccctgacctgacctctaaactgagcgcgcatgtgtttggccgtctcctatttatccaccaggtgaaaggagtggattcaccagtgtatcggagactgggcatgcgatttaaccagcttgagtcccagtacaaagtacctctggccaagctgctggaatcttattctgatgctggaatgaaacacaatcagcttaacattcgccgctgctgggtgttggaaaatgaaaagtggggcacacaggctacaggatttatgcttgagaataatctcatgatcacctgcgctcatgcattcaattatgtgctcaaccccgaaattgactcagacgtggagtgttgtatagaacacgattgcaaagaggtttggttcgatgactgcacagcttatagagtaaatgaccgaagcatcaaatacacggtcaaggtgctttttctggataaacatcgggacttggctgtggtcagtttcagtgaaactaatgaaaagttcgagtactttaggctggagtacgacctgcaggcagaaattggggataaagtatccattctcgggtttccgaacttcaaagttggcagtacagacgtctttcgtttttgggctgctgtcagcggaaggtacgttagatccacaatagaatgcggctctattgacaaggtcgtctattccggcaattcaggcggacccttgatcaatagcaaccagcatgtcgtcggggttattcggcgcggtgctgcaggtgatccagagggtactaacgagttcgtatgtgcctccgaggtggcgaatgtgctaacgcaatatctttctaccctagttgtcgcacctgagagagtgtga

SEQ ID NO: 7868 - RNA, 1731 nt, unidentified
  source 1..1731: mol_type = other RNA; note = synthetic construct
atggacgaaggatcctccgtggatgagtctctcagattaacatctgagtctgacgtggatgacctcgctaacattttgggcactacttatcccaagattaagtacttctactattcccgcagagtagcctcccattactcaactttcagcatccctaaaaagagcggcggcaaacgacagatccttgctccagataaccatctcaaagtcctacagaaacgtctggctcggcaactgtcatttctttacaagccaaatccacgggcgactgcgttcctgagcaactccagtattgtgagaaatgccagctttcataccaggaagaagttcgtttttaatattgacctcaaggacttctttccctcaattaccttcgcgagagtcagggctatgctgatttcaaaaccctacagtttgacccccgagactgccacagtgattgcgcatctcgcaaccgtcgacggaaagcttccccaggggtcaccatgttcgccagtgatttcaaatatgatctgcgccagcctggatacacagctgcgcacgcttgctaaaaagcataaggcaagttatacaaggtacgcagatgatataacgttttcattttacgtgcccatgttatacctgccggaggatatcgtcgtgctggatgataatgagggcggcaaaacgcaccacgtggtgtccgtgggacctgttctgtccgaaatcatctccaagaaagggttcaagatcaattccaagaaagtacgcctgcaacggcgggacgaaaagcaggtagtgaccggattggttgttaatcagaaggtgaacgtggacaggaggtacataaggaagacatcagcaatgatccacagtctgttcaccatcggggttgataaggcaaacattattcacaaggctaagagccctgaatctagcagtgagctgtccgcccacgtctttgggcggctgttgttcatccaccaagtcaagggggtggactctcccgtctatcggcgcttagcaatgcggttcaaccagcttgagactccttataaagcaccgctagccaagttcgttgaagtacacgaagacgccggcatgaagcataaccagctcaacattcgcagatgttgggttatcgaaaacgaacagtggggtacccaggccaccggctttatgcttgaaaataacctcatgatcacctgcgcccacgccttcaattacaaactaagcgacaaaattgacagcgacatcgagtatgctatcgaaaacaattgtgacgaggtgctgtttaaagattgcgtggtgtatagagtcaacgaacgagccaaaaagtattcggccaaagccatctttttggataaacaccgcgacctggctatagtcagtatagatcagacagatgagcgtttcgagttttttaggttggaagagaacctggaggtggagataggtgataaggtgtctgtcctcggtttccctaacttcaaaattggcagcaccgacgtgtgccgattttgggcagccgtctccgggaagtacatccgaagtacaatcgagtgcgggtctattgacaaggtcgtttattctgggaactctggcggaccactgataaatagcaatcaacatgtagttggagtgatccgtagaggagctgctggtgaccctgaaggcactaatgagttcgtatgtacatcggaggtgtttaaagtgctcaaagagtaccagagcaccctggtggtcggttga

SEQ ID NO: 7869 - RNA, 1731 nt, unidentified
  source 1..1731: mol_type = other RNA; note = synthetic construct
atggatgaagggtcctccgtagatgaaagtctaaggctcacatctgagtccgacgttgacgatcttgcgaacatcctgggaacgacataccccaagataaaatatttctactactcgcgtagagtggcatctcattatagcacatttagcatcccaaaaaagaatggcggcaagcgccaaatttcggccccagacaatcacctgaaagttcttcaaaagcgcctggcacggcagctttccttcttatataagccaaaccctcgcgccaccgctttcctcagcaacagttccatcgtgaggaatgcaacattccacacccggaaaaagtttgttttcaacatcgacctcaaagatttctttcccagcatcaccttcgcccgtgttcgcgcgatgctgatttccaagccatattcgttgacaccagagactgccactgtgatcgcccatctggctaccgtcgacggcaaattgccccagggaagtccttgctcacccgtgattagcaacatgatctgtgcctctttggatactcaattgagaacgctcgcaaagaagcacaaggcttcatacaccaggtacgccgatgacataacctttagtttctacgtgccaatgttgtatctcccggaagatatagtcgtgctcgacgataaagagggcgggaagactcatcatgtggtgtccgtcggcaccgtgttaagtgagatcatcagcaagaaggggtttaaaatcaatagcaaaaaggtccggctacagaggcgagacgagaagcaggtggtcacaggactggtggtgaatcagaaggttaatgtcgacagacgatacatcagaaagacatccgctatgattcattctctgtttatcattggcgtggataaggctaatatcattcacaaagctaagtcacctgagtcttccagcgagctgtctgcccatgtatttggacggctgctgtttattcaccaggtgaagggggtcgactctcccgtgtatagacggctggccatgcggtttaaccagctagagacgccttataaagccccgctggctaaattcgtggaagttcacgaagatgctggcatgaagcacaatcagctcaacatccgaaggtgctgggtcatagagaatgagcagtggggtacacaggcaaccggtttcatgctggagaacaaccttatgatcacctgtgcacacgcgtttaactataagctgtctgaaaagattgacagtgatatcgagtacgctatagaaaacaattgcgatgaggtcctgttcaaggactgcgttgtgcaccgagtgaacgagagagctaagaaatactcagccaaagccatcttcttggacaagcaccgggatctcgccattgtcagcattgatcaaactgacgaaaggtttgaattctttcgccttgaggaaaatctcgaggttgagattggcgacaaagtaagtgtgctgggtttccccaattttaaaattgggagcaccgacgtttgtcgtttttgggcagcggtgtcaggcaaatacattaggtctactatcgagtgcgggagcatagataaagtcgtatattccggaaactcaggaggacctcttgttaatagcaaccagcatgtcgtgggcgtaattcgcagaggggccgcaggtgaccctgaaggaaccaacgagttcgtgtgtacttcagaagtgttcaaagtgctgaaagaataccagtccactttagtcgtaggttga

SEQ ID NO: 7870 - RNA, 1596 nt, unidentified
  source 1..1596: mol_type = other RNA; note = synthetic construct
atgagcgcctattataggtctttctccatccctaaaaaatccggaggggtaagaaccatctttgccccatccaatagattgaaagtgcttcaagcccgcctgaaagtgcagctatccaacctttatttgccatcaccttgcgctaaagcctttctcaaggatacctctatagtgtcaaatgcgaatgcacacattcggaagaaattcgtttttaacctggatctcaaggactttttcccaaccatctcgttcgcacgagtcagagggctgcttatctctaagccttactgcctgaaaccagaaaccgcctccgtgattgcgcatttggccactattaacggcaatctgcctcaaggggccccatgttcccccgtcatcagcaacatgatgtgtagttctttagacagggaactgcgcgcgttagctatcaagcaccgagccaattacacacggtatgctgatgacatcacattctcattctatacgcccatggaatacttgcctgctgacattgtgatcgttaacgccggtaccctgaccagccatcacctggcaacagtcggacccgagctcctgaaaattatatccggtaaaggattccaggtgaattttagtaaggtcaggctccagcgccaggacgaaaagcaagtggttacaggactgctagtgaataagaaagtcaacgtggaacgaaggtacatacgcaaggtcgccgctcagatccacagcatgatgtgcattggtttggatgcagcgaacgctattcataaggccaacgatccggacgctaatactacactggaggggcacgtgttcggaaaactgctttttattaaacaggttaagggcgttgactcatccgtgtaccgtaggctagcaatgaagttcaatcagctcgacgccccctacaaggtcccccttgcgaagctcgaggaattttcgggcgacgccggcctgaagcacaatcagctgaatataagaaagtgctgggtactggagaacgaagactggggcactcaggcaacaggtttcatgctcgagaataacatcatggtaacttgcgcccacgccttcaactacaagttaaacgaggataatgactctgatgcagactacatgttcgagcacaacgtgactgaggtgtggttcgaggaatgtgtggcctatcgggctaacgaacgcagtaaaaagtacgctgccaaagtcctgtacatggaccggcatagagatgtggctatcataagcatcgttgatgctgatcggagatttgaattctttcgtcttgaggagaacattcaggtggaggtaggcgatcgtgtcagcgtctttgggtttcccaatcaaaagccaggctcaaccgacgtgtgtcggttttgggcagatgttaacgataggtatgtgcgctctatgatccagtgcgcaagtattgacaaggtgatgtatgctggcaacagcggaggcccggtactgaacttgaatcagcatgtggttggcattgtgaggagaggggcagccggagatcctctcgggacgaatgagttcgtatgtagtagcgagatctttaaagtgctcgaagacatgaacaaggttgtctga

SEQ ID NO: 7871 - RNA, 1668 nt, unidentified
  source 1..1668: mol_type = other RNA; note = synthetic construct
atgagtaaactggactctgctattgatgttgacggcctggcttctctgctgggtacaagttacaccaagttacgccacttctactacaagccagatacaagcgcatattactccacgttcgagatcgacaaaaagtcgggcggcaaacgaacaatcatgtccccggaaaaaagactgaagaccctccagtcaagactgaaagtgctgttggagggaatctatgtcgcaaagaagcaggtgaatgcatttgtgaaggaccggagcattgtcaccaacgcccgagcgcacactaggaagaagttcgtttttaatatcgatctcgagaacttcttcccttccataacctttgcaagaattcgggggatgctaatggctaaaccttactctctgcagtcaggggtggcgacggtcatagcacacctggctaccgttcgtggatttttgccccagggcagtccctgctctcccattttgtcaaacatgatctgctcgtccctcgatagacagctactgacactggccaagaagcacaggggggaatactcacgctacgctgatgatatgaccttctccttttacgacgatctccagtttgtgagtgaagagattgtgaggtgtttaaagggcgacggacttagcaatcattaccactgcagagtgggcttttatctcgagtcagtaatcctcaagtccggcttcaaaatcaacgagagtaaggtccgattacagggccgttatgagcggcaaatcgtgactggtcttgtggtgaacaagaaggtaaacattgagcgccagtatatccgtaagacatccgccatgatacatagcatgtcttccgacgggctggacttcgccagagagaagtttaaatctaaggcgaaggagtcaagtgtaatgctggatgcccacctccagggccgcttgctgtttattaagcaggtcgtttcggttgactcacctgtgtataaacgattggccaaaaaattcaacctgctcgggcttaaatataaagtgccactcgggaaatccaagaatatcaggggagccgaaagcagaaggtattctaaatggtacgacgatcggtgctgggtgattgaaagcgagctgactactgccgacgtttacgactgcgcccaagggaccggcttcgttatcaaggacggatacgtcatcacatgtgctcatgtggttaagttcaacggagtcattgctaatgaaatccagctctttcgcgtaagctcccgcggagacgtgtgcaaggctagcgtcgtgatgtgtgatgaagatcgggaccttgccatcctgaggatactagatcctgccttacaagatcttccctactttgacctgagcgatactagtgcagatattggcgatggagtcgacgttctaggtttcccaaatgataaactgggtgccacgcatgtcgggcggcagaaagtaagcgtgcggaacaaattttctatatccgcagtaaccttctgtcaaattgataaagaactctatgccggcaatagcggaggtccagcacttaacgaagacggcgacttggtgggtgtcgtgactgcggggaatgatggagacggctataatgaccatagcaggttcgtgtgtatttctgagctgaagaaagtgctgcacttgcttatcggggtgaaggacgcttga

SEQ ID NO: 7872 - RNA, 1677 nt, unidentified
  source 1..1677: mol_type = other RNA; note = synthetic construct
atgaagctggactctaccctctctgtggacggcctagcaagcctcctcggaacctcctacatcaagatcaagcacttttattacaagcccaatacctccgcctattattctactttcgaaatcgacaagaagtcagggggtaaacgcaaaattatgagtcctgaagaaagactgaaaactttgcagagacgattaaaactgctgctagagggagtgtatgtttccaaaaagcaggtcaacgctttcgtaaaagaccgatcaatagttactaatgcaaagtcacatacccggaagaaatttgtgcttaacatcgacctggaggatttcttcaccacgatcacctttgctagggtccgcggcctcctcattgccaagccctacgctttgcagccttccgtggctacggtgatcgcccacctggctactgtccacgggttcctgccccaggggtcaccatgcagtcccatcctctccaatatggtgtgttcctccatggacagacaactcttgagtttggcaaaagcacacagggcagagtattctcgttatgcggacgacatatcttttagtttttacgacaacctgcagttcatcagcgaggacatagtggagacagtaaagtctgatggactgcataatcactaccagtgtcagactggtcaggcccttgagagtatcatcctgaggagcggcttcaagatcaacgagagtaaggtcagattacaggggcgctatgaacgccaggtggtcacgggtcttgtcgtgaacaagaaggtgaacgtggatcgccaatacatccgcaaaacaagcgccatgatccattctatttctaccgatggtctagcattagcgcgggagaagtttaagtcaaaggtcaaagacagcagcgtgatgctggatgcccacctgcaaggcagactgctttttatcaaacaggtcgtaaccgtggatagcgtggtttataagcgtcttgccaagaaattcaatttgctcgaaattgactacaaggttccgctgggcaaatccaagagcgttcgtggactggaatcgcgacggtactctaagtggtacgatgaacggtgctgggtgatagaaagcgagctgtcaacagccgaggagttcgattgtagccaaggaacaggctttgccataaagggaggctacattatcacatgcgcacatgtggtgaaattgaagggtggcatcgccaacgatatcagtctctgcagggtgtcaaaaaggggagaagtttacaaggctagcgttattgtgtgcgatgacaatcgggaccttgctgtcctgaaaattgtagagccagcacttgccattctgccttactttgacatgtctgagacaattgcggatattggtgacggggttgacatactgggctttcctaacgataaactgggggccacacacgtgggccggcagaaagtgtcagtcagaaacaaatttgccatttccgccgtgactttctgtcaaatcgacaaggaactctatagtgggaattccggagggccagccctgaatgatgatggagacttaattggggtcgtaacctcgggaaacgatggcggcggcttcaacgatcatagcaggttcgtctgtatttccgaactaaaaaaagtactccaggatctggtggttgctgctaatgagcaggctttggcgtga

SEQ ID NO: 7873 - RNA, 1725 nt, unidentified
  source 1..1725: mol_type = other RNA; note = synthetic construct
atgagcaaactcaaactgtgcaaatccgtcgacgagcttgctgccctgctgggtactacatacggaaagattcgctacttttactacctgcatcctacatctgagtcttactcgacattcgagattaagaaaaagagtggtggcgtgagggagatttcagcaccctccgacaagttaaaaactttacaggggagactcaaggtctttctgtccgaaatctatgagcccaagaaatacgtaactggattcgtaaacggcaagtctatcgtggcgaatgccaagcctcacacccgtaagaaattcgtctttaacctggacttgcaaaatttcttcccgagcattacctttgcacgcgtccggggcctgctcatctctaaaccttacagtttgaacagctccgtcgccaccgtaatcgctcacctggttacagtgaatgggaagctgccacaaggagggccctgtagcccggtgatatccaatatgatatgtagttcactcgaccggaaactgaaaacgttggctgtcaaaaatagggccgagtatacccgttacgcagacgacattacattcagtttttacgatgacttggagtatgtggcaagcgacatcgtacagattctgaagggcgacgagttgccaaatcactattttgccaggtgtgggcgcagcctggaacggttgattatcgatgcaggtttcaaggtgaactacttgaaagttcgccttcagggccgatatgaacggcaggtagtgactggccttgttgttaacaagaagcccaatgtgaaccggcagtatgtcagaaaaaccggggcaatgatccactcaatagaaaccaagggtctagaagaagccagaaggatccacagtgagaaaataattaagcaggagaagaaatccggaagcggcaaggaagaggagatcaaggttccacctgttgaggctcatatccaggggcgactcctgtttctgaaacaggtggtgggactcgagagccaagtctaccgccgactggctctcagattcaacttactgagactgaagtacagggtcccactgggagtgtcaaaaaacaagttttccgaagatttccggaaattcactaagtggtatgactcaaaatgctgggtggtagaagttgaaggcgagattagaggcgagtttgagtgcgggcagggctcagggttcatgattagtgatcaagtgctcgttacgtgtagccatgttctggacctcaagggagtgaagctagatgaagccaccgtgtatcaggcgtcgtccaggtctaggtcttacaaggccaacctcctatatcgggatgatcatcgcgatatagccttactgaaaatctcagtggacaaatccgaatttgattacttcgaccttgaaacatccgttcttgctgatgtgggggatgaagtaagcatcctcggttttccccaggataagctaggcgcccaatctgcgggaaaccagaccgctttcgtgagaaataaattccctatcagcggtgtgggctttgtcgaggtggataaggagctgtatgctggcaactctggcggacccgtgcttaatcaggacagccgtgtggtcggaatcgtgggggtcgggaatgacggtgaatattgcgatcactctcgatttatttgcgtgtcggaacttctgaaggtcctggagaggttcaaggcagcctccgtggacaagagtaaattagagccagcctga

SEQ ID NO: 7874 - RNA, 1701 nt, unidentified
  source 1..1701: mol_type = other RNA; note = synthetic construct
atgactaagcttaattcaacgactgatgtggacggatttgctgccctgctggggacatcttaccagaacatacggtactactattatagcaaacccatgagcctctattataattcctttgagatcccgaaaaagaatggtggcgtacgggtgatcatggcgcctagtgagcagctgaaaactcttcaggacaggcttaaagtgctgctcgacgagctgtacacaccgaaatcgtcagccacagcgttcataaagggcagatctatcgtggataatgccaagcagcacaccaggaagaagtatgtgtttaacatcgacctgagtgatttctttacaagcatcaccttccctcgggtgaggggccttttgatggcaaaaccctactcactacaatctggggtggctacagtggtggcccatttgtgcactgtctctggcgtactccctcagggatccccttgctctccagtaattagcaacatgatctgttccactatggaccgacagcttaaggggctggcgatacgcaatcgggcacggtacagcagatatgccgacgatattaccttttctttctacgacgacatcaaatacatctccggtgaactggttgcctgtttaaagggtgacgatctgccaaatcactacttctcacgctgcggaaaagtcctcaatagcattattgaatcctgcggatttaaggttaattccagtaaggtgcgattacagagccggtatgaaaggcaggtggtcaccggcttggttgttaacaagaaagctaacgtcgagcgtgcttatattcgtcaaacctctgcaatgatccattctatcgagaaaaatggcctcgctttcgcaagacagagattttcagagaaaaatccccccgaccctaagtccggcaccaagctagtgctggatgcccatctccacggccgcctgttattcatcaaacaggtcgtgtctattgagagcgaagtgtataggaggctggccatgcgtttcaacttcctggatctgaactataagctgccactgggcgtgtcgaaaaatcatcgcgggatagaatttagaaagtccacgccctggtatgacaagaggtgttggatcgtggatacggagttcgacctagtatttggtcagggcagcgctttttttgttaacgacgagttcctgattacatgttcccatgtcagtgaatttgatggatgcttcgtagacgtcgccgaagtttacagagctgggtcacggggggataaatatagcgcaaaagtggtttaccgagatgtcgccagagatatcgccatactgatcattgacaccgatcgaccattagcgttcgagactttcgacgttgccaccaagatggccgacgtgggcgacgtcttgtccgttgtaggattccctaaagataagctcggggcacaacacgctgggaggcagagtgtcgaggtgcgcaacaagtttgcaagtagcggcgtgaaatactttgaggtggataaggaattgtacgcaggaaacagtggtggtcccgtcctcgatgccgacaacaacgttgtgggaattgtggcaaaaggaaacgatggcgactactgtgaccacagccgcttcatttgcatttccgaactggcctcagtcctccaagggtacgaaaagcaaaagcacgtggctccagtcgtggagttggaacttgagaaggcttga

SEQ ID NO: 7875 - RNA, 1677 nt, unidentified
  source 1..1677: mol_type = other RNA; note = synthetic construct
atgagcaaactcaacagctccattgatgttgacgaactcgcaggactgcttggcacttcatacggtaagatccgttactattactactccaagcccatccctgactactacaagacgttcgaaatttccaaaaaaagcggaggagttcgggttatttccgcacctcatgaccagcttaaggtcctgcaggagaggttgaagatcctgcttgatgagctgtacacccccaagtcaagtgccatggcattcataaaggggcggtccatagtagagaatgctaaacaacacacaagaaagaagtttgtcttcaacctggatttgtccgacttctttagcagcataacatttccccgggtgcgcggcctattgatggccaaaccatattccctgcaatcaggcgttgccactgtcatcgcccacctttgtaccctcaatgggatcttaccacagggcagtccatgctcccccgtgttaagtaatatgatctgttctggtttggaccgccaactgaagagcttcgccatcaaacacagggcgaggtattctcgttacgctgacgacattactttctctttctacgacgatttgaactatatcagtcctgatatggttagtgtgctgatgggagatggcgtgtccaaccattactatgtgaaatgcggcaggccactggtgaccattatcgagtcgtgtggcttcggcattaatctgagcaaagtgcggctgcaggggagatacgagcgccagatcgtgacagggctagttgttaacaagaaggtaaatgtcgaacgcagctatattcgaaagacatcagccatgatccacgccattgagacgaagggactaggttttgcccgcgagagattcgccgcatcaaatcccccggttgatccggatactggggtgcaggtagttctggacgcccatctgcatgggcggctcctctttattaagcaggtggtcggtgtcgaaagcgaagtgtatcgcagattggccatgcgattcaacttcctcgatctgaattttaaactgccccttggagtgagtaaaaaccggcgaggtgtcgaatttaggagaagcactccatggtatgataaaaggtgctggatagtagagacagagctggacttagagtttgggcaaggctctgcattttttgtcgcagacaatgtgcttgtgacctgctcgcacgtctccgagtttaccggaagattcacatccgagtctgaggtctatagagctaatgctagagggaaaaaatataacgctggcgtggtctaccgcgataaagctcgggatatttctatcctcaaactcaacgacgaatctctggtgttcgaaaagtttgaaatctctacccgactggctgacgtaggcgatgtactatcagtgctgggtttccctaacgacaagcttggggcacagcatgctggccgtcagaccgttgtggtgaggaacaagttctcgatgagcggcgtacagtactttgaagtggataaggagttatatgcggggaactctggaggccctgtgctcgacgaggacaacaatctggtcggagtcgtcgccaagggtaatgatggacactactgtgaccacagtaggttcatatgcgtgtcagagctcttggtggtgctcgaagactacaaaaaggcgatcctgcaggtgagcgtgtga

SEQ ID NO: 7876 - RNA, 1665 nt, unidentified
  source 1..1665: mol_type = other RNA; note = synthetic construct
atgacaatcccccgtctcaaggcctgtaccaatgttgacgatctggcttccatccttaatacgtcctacaagaagatcgcatatttctattacgaggtggactactctaagaagaggtactatgagaactttgagattcctaaaaagaacgggaacaagcgcacaattagcgctccactcgcacagttaaaaaaccttcagaagaagatcgcagtgctgctgggtgaactgtatatcccaaatccaaatgcccacggcttcatagcggaaaagtcaatcataacgaatgccaaaattcatacccgcaagaaatacgtctttaacgtcgatctgaacgacttttttaacaccattactttcccgagagtgttcgggctgctcactagccagccttatctaattaacgagaaagtggccagtgtgatagctcatttatgcacactcgacggatgtctcccacaaggagctcccacctctcccgtgatttccaatatgatctgccagaaactggatcgacaactcagtcgactggcattcacacacagagctgtctatagccggtatgccgatgatctgtctttctccttttatgctccagaattgcacgtgtctggggagattgttgtgtttgagcagggggcaggcaactattacgccaaggcaggggagcagcttaataggattgttaacatcaaccgcttcagcatcaatcccggcaaaactcgattgcaggataggttcgaacggcagaccgtcacaggcttggtcgtgaataaaaagatcaacgtacccagacaatttgtgcgcaagacgtgtgccatgatccacagcatagaatcgtttggattaaagactgcacaggaaagattcctgatcgagaacccaaattcgaagtcatcaatcgacaacgtgatttttggcaggattctgtacatgaagagcgtcgtggggtattcctccgtggtgtacaagcgcgtagcgctgcggttcaaccagttggacctggagcgtaaagtgcctctctccagttcaaaggacggtaagttttccgccaaatacctgaattgggttaatcggcggtgttgggtaattgataaccatgaaaccatagagcagggtagcggctttatgatggccgggaatcttctgataacatgtgcgcatgtggttggtaatgccaaagaaattgaggtgtacagaacctgcgataccgagaagtacaaggccactgtatgctacgtgagcccggacaaggccgttgacgtggctatcgctttgatccaaaatccccccacaaggtttgaagaattccatcacaaagaagagactcctaatatagaggttggcgacctgctgaccgtcctgggattccctaaatataaagacgacgcaaaaaacgtctggatcaataaggccagcattgtcaaccagattaagagttcttcttcactcattggctaccttgataaggagctatacggcggaaacagtgggggccctgtgttaaacgaggatggatctctcgtgggaattgtcatcaaaggtaataaagatgccgaaggaatcgatgatatctatgttgaccactccgccttcttgcacctaagttacgtcctggcgtgcgtaaaatcacttaaagagaaatacgctgctgacgacatctga

SEQ ID NO: 7877 - RNA, 1650 nt, unidentified
  source 1..1650: mol_type = other RNA; note = synthetic construct
atgtcaaagctgcaggagtgcctgaacacccaggatcttgccgatgccttaggaacaaactataagaagatcgcgtacttctactacgacgttgattatagcaagaagagttattacgagaacttcgagattcctaaaaagaatggcggctcacgggtcataaaagcccctgtggcaagactgaaaaacctgcagaagaagctgtcatttctcctggacgagatgtttgttcctcattcttgtgctcacggcttcgtgaaagaaaaatctatcgtaacaaacgcgaaaaaccatagcagaaaaaagtacgtcttcaacatcgacttgaataacttcttcaccacaatcacatttcctcgcttgtatggactcctgatctctaaaccctattcccttaacaacgatgtcgcttccgttatagcccacctctgtactgtcgatggatgtttaccacagggcgcccccacttcacccatcctgtctaatatgatttgtcgctctctggataggcagttgagacgcctcgcccgcttgcacagagccgattacagccggtatgcagatgacattactttcagcttttacgcgccagagtccttcgtgaatgaatctatcgttgtgttcaaagacggatctggaaattactttagcagtgcaggtaacacgctgaagaagataatcgacaagaacaagttcagcattaacgagtccaagacccgactgcaggaccgttttgagaggcagcttgtaaccggacttgtggtcaataagaagcttaacgtgccgcgagcatttattaggaaaacctgcgctattatacacagcatcgaaaatttcggtatcgcttcggctcaagcccggtacatcaaagagaacccgtgcagcatggcacgagtggagaatgttatctttggtcgcattctccacatcaagaacgttgtggggtttgattccgtggtctataagaggatcgcactgcgttttaaccagctaaacatcaacagaaaagctcccttatcgaatggcaagaatggggtggtgtccgctaagttttgcaattgggcaaacaggcggtgctgggttattgaaaacaatgatgaaatctcccaagggagcggcttcatgataagtgagaatctgttgattacatgcgcccacgtgatcggctccgccaaagtggtcgaggtcttccgggcaggtgaaaacattaaatatgaggcagtcgtctgttacactagtagtgacccccatattgacgttgctattttgaaaatcaaggacgcccctgcaccatttgaggaattccattacaaagacgaggccgaagctctcaatagtggggagacactcacgattctggggtttcccaagtacaagcacgacgccaaaaatgtatggatcaacaaagctctcctaataaatcaagtgaaaaccgcctcttcatcctacgggtacattgacaaagaactttatgcgggtaattccggcgggccagtactgtcagaaaatggcgctctcgtgggactggtaattaagggcaataatgacgccgccgaagtggatgacatatatgtggatcatagcgccttcctgagtttctcagatgtgctaacttgtgtgaaggcgctgaaggctaagtataccatgtga

SEQ ID NO: 7878 - RNA, 1653 nt, unidentified
  source 1..1653: mol_type = other RNA; note = synthetic construct
atgaacactcccatccttcagcagtgccggagtgtagaccacctgagcgctgccttaggaactaactacaagaagatctcatacttctactacgatctggactctaccaagatctcatattatgaacccttcctcatccctaaaaaaagcggcggaacgcgtcaaatcctggcccccaagcctcaacttaaaaatctgcagaagaaactgcaggacctgctggaggacctgtttaaaccccatgcgtgcgctcacgggttcatttcggagcgcagtatctgtaccaatgctaccccgcatacgagaaaaaagtacgtgtttaacattgaccttcaggatttcttcagctcgataactttcgcacgcatcttcggtttgttgattagcaagccttattccatagaaaaatctgtggcctcagtggttgcgcacctctgcaccgtcaatggacacttgccacagggagctcctacaagcccgattatttccaacatgatttgtcggacattagatcggcaattgacacttctggccgtggccaatcgagcagcttactcacgctacgctgatgacatcactttctccttttacagcccacaggaacatacttcaagcgaactcgtcaaattcgagaaaaactcaggcaactatttcgcactacccggggaaattctgtcccagataatttccaggaacaagttcaagattaaccccaagaagacccggttacaggatagatttgaaaggcagattgtgaccggtctggtggtaaataagaaaatcaacgtgaggcgggagtttgtgcgcactacttgcgcaatgatgcactccatcgagtcctttggcttggccagttctcaggcacgatatgaaattgagaatccggggagccagagtaaggttgagaacgtgattctgggaaagatcctccacataaagaacgttgcttcttttgcctcccccgtctataaaaggctggccaggagatttaaccgactggaactaagtctcaaggcaccattgtcttccacgaatgaggacaactttgatgccaaatattgtaactgggtcaatagacgctgctgggtcatcgacaataacgacaccattagtcagggcaccggcttcatgatccaagaaaatttcctcatcacctgtgcccacgtcgctgatggcgcgaaggaactcgaggtgtaccgtgcctgtgacgagacaaaatacacagcctgggtgctcggtacctatcctcaggtagatgtcgccatcctgaaaattcagaattctccagggatatttgaggaatttcattccagagagacaccaaggaaacttaatatcggcgacaatctgcatgttctcggattccctaagttcaaatctaatacaaagaccgtgtggatcaataaggctaagttgattggccatacaatcgtccacaacagtaatgttaattacatcgataaggagctgtatggcgggaacagcggaggtccagtgttagatgaggacggcgcgctaatcgggattgtaataaaagggaacaacgatactgacaaggtgtcagatatatatgtggaccatagcgcatttctggactttcaacacgttctggattgcctcaaacttctgaaggagaagtactctaccacatga

SEQ ID NO: 7879 - RNA, 1764 nt, unidentified
  source 1..1764: mol_type = other RNA; note = synthetic construct
atgccgatcacatctgcacagatcgctgccagtggaacccccctacggctcaaatgtaagctggtgatgaggaaagtcaagccaaaacggaggccaatgttggataccaaaaccacaccccacgaactggcagtgctgctcggtaccacctactccaagttgtgctacactctctataagaaacatactgacaacctgtacaaggactttactatcccaaagaagaacggcggggtacgaaaaattagttcccctaagcctattctgaagaatctgcagagcaagcttaagctgttactggatgacatctaccgccctcaccccagcgcatctgctttcatagctaacaggggacttatctacaatacaaccccgcacattaaaaaagcactcatcttcaacatcgacctaaagagcttctacggttctatccatttcggccgggtgaagggcatgctcatcagtaagccatattgcctccgtgaggacaccgctcaactcatcgcccacatttgctgctattacaagactattccccagggagcgcccacatccactaccatctctaatatgatctgtagacgccttgatcgcgagttaagcttccttgcgaaaaagaaccatgcatactacaccaggtatgccgacgatctgactttcagtttccacaaaatcaaaccaaatgagatctgtgccttcgaggataacatttggaagccttcggataggctgataaacgtgatttcaaacaacacctttaagatcaacaacacaaaaacaagaggggaaacaagccgatgcagacaagtggtgacgggtctgaaagtgaataccaaggtgaatgttgacagaaggtatatccggacgacaaaggctatgatccatagtctgtcccttgatatcgagtccgcgaacgagtacttttcaagcatacggaaaggagagaatgaagccactttggagacggtcgttgccggccgcatcaactttataggcatggttaaagggactgagtgctccatttatcagacgttggcacataaattcaacaacctgaatatcgacttgaaggtacctactcgcagtaatattgataccacgagccaaaatgacaatcagctcaagaccctagaataccgaaagcaggaaaagctcaagaagtgtatttgggtggtgtcctttgacggtatagaaggcatagaactcgatgagcaactgacccagggcacagcttttatgattaagggacagaagttgcttacatgtaatcacacctttgagaaagccgggaatccatcttattgtttaattcacaggatcgatgactccagcattaagtattatgcccgcctggtcaaagttgacaaacatagagatgttgctctcctggaaattgactcgaaagataaagtgttctttgaccacctggagatttacttcaatgacgatatgcactcaggctataaagtcaacctagccggctttcccgagtacagatcagggcatagagacgtaacagtgcttcctagcacaataatacggcatgaagtggtcagtctggtaaagcactactcagtgaacagcgaactgctgggggggttctcaggcggtcccgttttgaacttatataatcaggtcgtgggcatggtcactaagggacgttacatttcccacgacaaagatgccggacagtccactctggaagggagcaattcttttatctctgccgtcgagtttgagaaattcctgggatcatctaactga

SEQ ID NO: 7880 - RNA, 1641 nt, unidentified
  source 1..1641: mol_type = other RNA; note = synthetic construct
atgctggacagcaataccacacccagacgcctagctgcactgctcggaacaacttaccctaacctttgtctcacagtatacaaagtacggccaaataacctttacacgacctttaaaattgccaagaagtctggcggagttcgcactatcgctgcccccgataaaagactcatctatttgcaggacaagctgaaaagtctcctcgaggaattgtattcaccacatcccgccgcgactgcattcatcaaagacagggggatcatttataacgcgtccccgcacgttgggaaagcccttgtttttaacatcgatctggccgatttttacggccacatcaatttcggacgtgttaggggactgctgtcagcacctccctacaatctgcgccctgacactagccagctgatcgccactatttgttgcctcaatggtagcattccgcaaggtgccccaacctcaccagtcctatctaatatgatttcacgtcagctggatagacggttatcccttctagcaaaaaagaaccatgcattctacacaagatacgccgatgacatcacttttagctttagaaacaacaacttcgaaggtgtttgcttttcggtcaatggcgttttccagccatcctccgagctcataaagctggtcgaaaagtcaggcttctaccttaacaagcaaaagacccgtggggaggtgtctcgatctagacaggtggtaacgggactcaaggtgaataagaagataaacgtcgatcggcgatatgtccgcacgaccaaggcaatgatacatgctttgagcggcgacattgatacagcgaacgtggtgttttggcagaaattccccgaaaaagagcccaaacgccttgaaaatgtggtggccggaaggattaatttcatcggcatgatcaagggagtgaattcgagggtgtatcaaatgctggctaaaaagttcaaccgattgcctttaaagcaaaaactgtctacccggacgagcaagctggtggacaccgaccaaaagtatagagatatggcaaagcagagggagctgcagaagtgtgtgtggattttagacttcgaaggggcccctaacgtgaccgacgaagctgaattcatccagggtaccgcttttatggtaaaggggcagcaggtcctgacctgttcccacactttcaacaaagctgatgatgcagagtactgctatatcagtaggatccatgagcgaggggtgaagtatctgatgaaagttgctaaacgctgcaaacaccgggatatagccgagttggagtttgtcaatgagcctaacgagatattccagtccttggacatttaccataaggaagaaatgttcccaggttaccaggttagcctggtgggctttccggactatatgtccggccacacaaccgtgagcgtcatcaatacttctatcactagccacgtgaatatcagtacagtggacaattatgaggtcgacgccgaaattggggctggctactccggtggccccgtaattaacgatttccaccaggtgattggcatgatagtcagtggacggacaacatcagtggactttgagacacaggagagtgcactgaccgggaggaacgccttcatttctgcccaccattttctccaattttga

SEQ ID NO: 7881 - RNA, 1635 nt, unidentified
  source 1..1635: mol_type = other RNA; note = synthetic construct
atgataagcagcaaaaccactccaagagcccttgcgcattccctgggcaccacactgcccaaactgaattacaccgtctacaagctgggcgtcagcaggttctacaatgagtttgaaattgagaaaagcgacggcggaaagagaaccataaatgcacctgaggggcgcttaaagatcatccaggataggctcaaggttctgttggacgagctgtattcgccacaccctagcgcttctgcttacatcaaagagcgaggtatcgtctacaatgcaaagaaacacgtcaaaaggaaggtggtggctaacatagatctgaagaactttttcggaactattcattttgggagggtgcggggtgtacttattgccaagccctattgtttgagggctgacaccgcgactctaatcgctcacatttgctgcctggacggggtcctcccccaaggaagtccagcctctccggtgatatccaacatgatatcaagacgtatggatcgggaactctctcttatggccaagaaaaacagggcccactattcacgttacgccgatgatattacgttctcctttaagagcaagaaagacacagagttgttcgatttcaaaaatcggagtgttgggtcaaaaatcgtacggtgcatagaggagaatggcttctcgcttaacgaacggaagactcgaatccaattctcctctgagcgccagacagtgacagggcttaaggtgaataagaagattaacattgaccgccgctatattcgcgagacaaaggccatggtccactctctctcctttggctctctggaggcaaataagaagttcatcgacaaatacggcagggatgatgcacagttggaagatgtggtatttggacgcgtggcctacatcggcatgattaaaggccgtgattcttccgtgtaccaggggctggctagaaaatttaacaacttagattgggacaggaagttgagcattaatcctggcaagatcctcaaggatttggaatggtccggcttcgccttcaaggccgaaggctatagagctcgattcgagcaatgtgtctgggttgtttcctttgacggggtgaaaggactgggtctggatgaaatgctggtatccggctcagcatttagcctgaaaggtggccgcgttcttacggcatttcacgtgtttgtgaaggcaggcatgccggactattgttatctctaccgaatcaataagcccggaaaaaagtacaaagctaagatcaaaagcgtgtatgaagacagagacgtcctcgagctaaaattcgatgaagaggtggagaatattcggtatctggacgttgccccaaacaaattcccaggtaccggttacgaactggcagttctggggttccctcagctacatcccgggcaccagtcactcactatcctgccttgcaaggtcgtcaacacatatatcggaagtacctttagatattgtgaagtggacgcccagattagtggagggaacagcggaggtccagtggtgaacgcctacatgcaggtagtgggaatggcgttaagaggggtggacgttgcttcacatgaggaccgggtggaactcgaaggaagtaacgcctttatcagtgcggagcatttcccttctccctga

SEQ ID NO: 7882 - RNA, 1635 nt, unidentified
  source 1..1635: mol_type = other RNA; note = synthetic construct
atgatacagcctactacctctccgtccgatttggcatcgctgctggggacaacacatagcaaacttaactacacactttattccttccccttggaatacagttatacaaagttcaccatcgagaagaaaaacggctccagccgacaaattcgggccccaaatcccaaacttaagatcattcagaagagactgaaaaaccatctggagaagttatatcgccctcattctgctgcgaccgccttcgttgctggtaggggcatcgtggataacgcaaagcggcatataaagagggagtgcgttttcaatctggacctcgattcattttttgactacatccacttcggcagggtaaagggcctgctggttgcccccccctataacctgcgcgatgacactgccaaactgatcgcccacatatgttgtctgaatggacggctaccacaaggggcccctacgtccccacttattagcaatatggtggccagatctctggaccataagctcagtcgattggccaaaaaatataaggcgagatattcacggtacgctgacgacatcactttctcgtttcaaaagaaaaccgacggaataattttccacgtggatgagggagttgtcaagccctcagtggaattggtcgacattatcgagaatgccggattcctgatcaatatccgcaagacgcgagtacagtactacgaccagaggcaggtcgtgactggactcaaagtgaatagcgtcgtgaatgtggatagaagatacattaggactacccgtgcaatgcttttctcccttagtcagggggtggagagcgcaaacatgaaattttttgaaaaggtaggcggcgaccccgaaaggcgcttggaaaatgtggtgcacggtcgcattgcattcatcggtatggtgaaggggagaggcggcagcgtctatcagacactgagtcagaaattcaatgacctcggactggacattcagtctccaattggacccgcagaaatcaaagacgaactggagcagaagctccacttttattcatacaaaaaccgggctcgtctacagcgctgcgtgtgggtggtcgatttcggtggggttcctgggttagatatggatcaagagctcgtgcagggaaccgcttttatgattggcggccagcggatcctgacttccgcgcatacatttgcaaaggccggcaacccggttcaatgtaaattatacctcgttaacgagccaggaaagaagtacagcgctgaggtcgtcaacataaacaacaattccgatattgctgagttgaagctcattaacgtggatggttcatttccggtcctcaaggtggctcctaacctgaaaacgaacaccggttataaggtatctatagcaggctttcctcagctacagccaggacaccagagcgtagccattactccttgcacagtgatcaataccttaaatatcagcagtcaccgttacatcgaagtagacacacctatccaaggggggtcttctgggagtcccgtgctgaacgtctacatgcaggtggtgggtatggccgccatgggcgtttccgtcaccaaagatggcgaagacgtgcagctggaggggaccaatgcgtttgtctcagctgttcacttcccatga

SEQ ID NO: 7883 - RNA, 1758 nt, unidentified
  source 1..1758: mol_type = other RNA; note = synthetic construct
atgaataacaagccctcgctgagcctgttcgacgacccccaggtagcttccttcttggctgccaacactaaaatggagctggcggccgccataaatgagccatatcggaggttcacttatttattgttcgccatcgatcctgaccgccaatacaagtcctttgatattgccaaaggaaacgggaaaagcaggattattgacgcccctgtgaccgccctaaagaatatccagaagaagatctgtgctattctgagtaaaatctacgtgccaccttatccagctaatgcctttattttcggccggagtatagtgaccaacgccatcccccacgtgaaggctaagtcagtactcaagctcgacctccaggactattttcccagtattcactttggacgggtgagagggttattcatggcacctccgttcagcttcaatcaggatgtggcaacaaccttagcaagggcttgctgcaagggtggctgtttgcctcagggggcacccacatctccaattctctctaacatgatctcacttaagatggatgcccaacttaacaggatcgcgaaaagcaaccgatgtaattactcccgctacgctgacgacatcacattcagttctacaaaggacatttttccactcgtcgtcaccaacgcaaagggtttgtatgaaccagcccaggaaatcacagactgtatactgcggaatggctttgctgtcaacacctacaaaactaaattcatggtaggcagagactcaaaattcgttgcgggtataaaggtcaattcaaagattaacaccagcaggaagcatgtgcgagctgtccgggccatgctgcatgctctagagaaatttggacccgaagcctctgtcgccgaacatctgcggcggtggagacgtagacacactatctctagccccactaacttcctgcagatactgaagggcaaaatcagttttattcgtatggtcaaagggggcggagatctgtccgtcgtgcgtcttgaaaaccgcctcgacgagtggatgtccttatactccggagcccaggtggatgtccgcagggtagaaacgctgatcgcacaggatgatacgtatcacgctgtggtttacacagaaggcaagacggatgcactccatttgagatatgcactcaagcgccttcagaaacttagcttgtacaacaacatgaagctgatcttctatgatttccctccggataccacatcaggcgaaaccgagcttaaaaaaatcctgggcaccgctaaagttgccaataataccggcaagctgaagattgttatctttgacagagacgtgaccggagacgtgggcgattctaggcgcccaaaatattggggttctaatgtatggtccttcaaactgccgtgccccggtcctaggactctgtacgagaatgttatcagtattgagcattactaccctgacaagatcctgtttaaacaggacaacgaagggcggagactattttttgtggatgagtttgatgccaatactctcgcacacaagagcattgcgggggttatatgccgaaaggatgtgattggtaaaaagcgacccggagtggtgatctgtgagggagtgagagatcaacaggggaaatcactgacactgagcaaatccgacttctcgaagaatatagcacgagggcaatttttcgtttctgacactgagatgctcgagttcaagccagtgttttccgcgattgagcgcctgatcaagaaaaaccactactgctga

SEQ ID NO: 7884 - RNA, 1062 nt, unidentified
  source 1..1062: mol_type = other RNA; note = synthetic construct
atgaaggacagctctaaactggtgttgaccgatactcctgagtcactgcgtgaaaagttctattctcttaagcaagccagtgatatcgccgacctgttgggcgtctcatacccgaggcttgtatatcacatctacgtagtggatcccaaccaaagatacaccactttcgaaattgcaaaaaaaagtgggggagtccgacagatctccacgccaatcactgccttaaagatcattcagagaaagctcaaccaggtgttacaggcagtctacgagattaagcctagcgttcatggcttcgtgatggggaagaacatagtgacaaatgctcaggcacacgccaagaagcgctacgtgtttaatatcgatctgaaggacttcttcccatcgatcaacttcggcagggtgaggggcatgttcatggcaactccgtatggcttgcaccctgaggtcgccaccgttctagcacaaatctgttgccacaataaccagctaccccagggggctccaacatctcccataatcacaaacatgatttgcgctaaaatggacagccaacttcagagactggccaaagagtgtaaggccacttacaccagatatgctgacgatattaccttttcaacaaccctcccaaagtttcctagggacctggcttacattgttaacgacgagaacgaggaaaaactgaatgtcggtgacaccctcatccagattatctctgaaaacgggtttgaggtgaatgagtccaaagtgcggctccagataaaaggtaatcaccaagaagtaaccggactgacgacaaatatattccccaacattgatcgcaattatattcggcaagttcgggccatgttgcatgcctgggcgaaatttggtctggaagacgctgaaaaagagtatcagcgcaagcatgaattccgatcccgctttaatcagaaagagcagcattcctttaagcagattatcctcggaaaaattgagtttatcggaatggtgaagggcaagaacgatacaatctacaagaagtacatgcagcagtataaaatactggcgagcctgtga

SEQ ID NO: 7885 - RNA, 1017 nt, unidentified
  source 1..1017: mol_type = other RNA; note = synthetic construct
atgcgcgaaaagttttattcactcaaacaggcaagtgacattgctgacctgctcggcgtgagctaccctagactcgtgtatcacatctatgtggtggatcccaatcagcggtacactacatttgagatagctaaaaagtctgggggtgtacgtcagatcagcacccctattaccgccctgaaaatcattcagcgaaagctgaatcaagtcctccaagctgtttatgagatcaaaccgtccgtgcacggctttgtgatgggtaagaatattgtgactaacgcgcaggcccacgcaaagaaacggtatgtcttcaacattgatcttaaagacttcttcccttccatcaatttcggaagggtgcggggaatgttcatggccacaccttacggcctgcaccccgaagttgcgacagtcttggcccagatctgctgccacaacaatcagttaccacagggagcccccacctccccaatcataaccaacatgatctgtgcaaagatggattcacaactgcaaagattggctaaggaatgtaaagcaacgtacaccaggtatgccgacgacattactttctcgacaaccctgcccaaatttccacgcgatcttgcctacattgttaatgacgagaacgaggaaaaacttaatgtcggagatacgctaattcagatcattagcgagaacggttttgaggtaaacgaaagtaaggttcgactgcaaatcaaggggaaccatcaggaggtcacagggctgactaccaatatttttcccaatatcgacaggaactatatacggcaggtgagagccatgctccatgcttgggcaaagtttggcctggaagacgccgagaaagagtaccagcgcaagcatgaattcaggtctagattcaaccagaaggagcagcatagctttaagcaaatcatcctagggaaaatagaattcattggcatggtgaagggcaagaacgatactatctacaaaaagtacatgcagcagtacaagatattagcttctttgtga

SEQ ID NO: 7886 - RNA, 1206 nt, unidentified
  source 1..1206: mol_type = other RNA; note = synthetic construct
atgatttccgttgtagaccctgcgactgtgtacttcaccgtgtcctttaacccagacgtgcatcccgacaattgcttcatactgagtagaatctccgagaacattccagcatcggacatctttttgctgagcacgacggataaagtcccaaaaaagtcacatttattccttcagcgctctcccgaactgctccgagaaaaattctactctctgaaacagcccgtagagatagctgatctgctagagattagctacagccggttaatctatcacatctacttggtgaccccggaagagagatacaagtcctttggaattcctaaaaaaagcggaggcatacgtcaaattacaacaccgataactgctttgaaaatcatccaatcaaagctgaaccaggtgctccaggccgtctacgatattaagcctagcgtgcacggtttcgtcatggggaagaatattgtgactaatgcccaggctcacgtcaagaaaagatatgtcctcaatatcgatcttaaggacttttttccatctatcaacttcggacgagttcgcgggatgtttatggccacaccctatgggcttcatcctgaagttgccacagtgctggcccagatatgctgtcacaataaccaccttccccaaggtgcccctacctcacccattatcagtaacatgatttgtggtaagatggatagccagctgcagcgtctggctaaagactgcaaagcaacttataccaggtacgcagacgacattactttcagtacaactctgagtcaatttcctagagacttagcttatatcacgaatgatgaagatggcgagaagctcgtgatcggcaattcactgctgaacattatcaacaccaacggcttcgaaataaatcagtctaaagtgcggctccagacccgcggaaatcaccaggaggtgacagggctgaccaccaacgttttcccaaatgtagataggacatacgttcggcaggtcagggctatgctccatgcctgggccaagtttggcctggaggcagcggagaaagagtacctttccaagtacgaattcaagaataggctcccacagaaggcaaagcccacttttaaacaagtgttgcggggaaaaattgagttcatcggggtcgtgaagggcaaggacgataccatctataacaagtttatcacccagtataacatcctaaagaagtggtga

SEQ ID NO: 7887 - RNA, 1134 nt, unidentified
  source 1..1134: mol_type = other RNA; note = synthetic construct
atgcagaaaaatagcaagcttttccttacagaaacgcctgaggccttaaaggagaagttttattctctgaagaagcctaccgacattgccgacttgctggaggtgtgctactccaacctaatctatcacatatacgtagtcaaacccgaaaaacggtacaagatctttgatattcccaaaaagagcggtggcattagacagatcagtacccctattaccgccctgaaaataattcagcggaaactgaaccaggtcctacaggctgtttatgaaacaaaacccagtgtgcatgggtttgtttcctcccgcaatgtggttaccaacgcacagaatcatgttaaaaagaggtacgtgttgaacatcgacttaaaggacttcttcccatcagtgaattttggtcgggtcaggggcatgtttatggcaacaccatacggcctgcacccggatgtcgccactgtgctggctcaaatttgttgttataaccatgaattgccacagggagctcctactagcccaatcatcactaacatgatttgcgccaaaatggacggccaactgcaacgactggccaaagagtgcaaggctacatacactaggtatgctgatgatattaccttctctacctcccttagcaagctgtcgaaggatctcgcatatattgtcaacgaggaggaccaggagaagctgataatcggagacaccctcttcaagattataaaacagaacgggttcgagctcaatgacaataaagtgagactgcagactagaggaaatcaccaagaagtgacaggcctcacaacgaacgtattccccaatgtagacaggaattatgtgcgtcagatccgcgccatgctgcacgcctggtcaaagtttgggttagaggcggcagcgaaagagtacagtatcaagtatgagagcaaatcacgactcatcaataacgaaaagttggaattcaagcccgtcatccgcgagaagattgaatttctcggcatcgtggagggaaagaaagatcagctcaaattcaagaaggtgatcagagggaagatcgaatttctgggtatggttaaaggaaaaaacgatccggtgtaccagaagtacttcaacatataccagcaacttatcaagtctgtctga

SEQ ID NO: 7888 - RNA, 993 nt, unidentified
  source 1..993: mol_type = other RNA; note = synthetic construct
atggatatcgcagatctgcttgaagtgtcctattcgcggctggtttaccacatctacctggtcgaaccagacaagcgctacaagaccttcgaaatctctaagaagtccggcggcattaggcagatttccacgcctattactgcgttgaagataattcagaagaaattgaaccaggtgctccagacggtctacgaaataaagcccagtgtgcacggtttcgtgacagggaagaacattgtcaccaatgcccaagcccacactaagaagaggtatgtgctgaatttagacctgaccgacttcttccctagtatcaattttggtagagtacgcggaatgttcatggccacaccatatggtctgcacccggatgtggccactgtgctggcccaaatctgctgccataacaatcaactgccacagggagctcccacgtctcctattgtaaccaacatgatctgtgcgaaaatggatagccaactacagaggcttgctaaagagtacaaggcaacctatactcgctacgctgacgatatcacattctcaaccaccctgcctaaatttcccgaggagctagcctacattgttgctgaagaagacgtggacactgtgtttataggcaacagattactgtctatcatcaacgacaacgggttcgaggttaataatcataaaaaccgactccaggtgaaaggaaatcaccaggaggtaacaggactcactacaaacttgttcccaaacgttgaccggaaatatgttcgtcaagtcagggctatgctccatgcctgggcaaaatttggccttgaagcagtcgagaaagattaccaggataagtatgagagtaagtcccggctctcaacaaagggcgagcccaattttcgacaggtcttgagaggcaaaatagagtttatcgggatggtgaaagggatcgatgacagcatttaccagaaatacctgaagcagtatcagctgctcagcacccttgtgattagctga

SEQ ID NO: 7889 - RNA, 993 nt, unidentified
  source 1..993: mol_type = other RNA; note = synthetic construct
atggatatcgccgaccttttggaagtgagttatcctaggctagtgtaccacatttatctggtagaaccagacaaaagatacaaaaccttcgagatccctaagaagagcggaggcattagacagatcagcacccccataaccgccctgaaaattatccaaaagaagttgaaccaggttctgcagactgtctatgaaattaaaccgtctgtccacggctttgtcatggggaaaaatatcgtgaccaatgcacaagcccatacaaagaagcggtacgtgctgaatctggatctgaccgattttttcccatccatcaacttcggacgagtaagaggtatgtttatggctaccccctatggtttgcaccccgatgtcgccactgtgctggcacaaatctgttgccataacaaccagcttccccaaggcgcccccacatcaccgattgttaccaatatgatatgcgcgaaaatggacagccagcttcagcgattagctaaggagtataaggccacatacacacggtatgcggacgatattactttttctacaactctgccaaagtttcctgaggagctcgcttacattatagctgaagaggatgtggaaaaaatcttcattgggaacaggctcctgtccatcattaacgagaatggatttgaagtcaatcaggaaaaagttaggctgcagtcacgtgacgaccatcaggccgtgacagggctgaccactaatcaatttcctaacattgaccgcaagtatgtgagacatatacgggcaatgctccacgcctggtctaagttcggcctcgaggctgcagaggaacagtacctcacgaaatacgagaataagtccaaactaccaatcaaagacaaccctacgttccaccaggtgttacgcggcaagatagagttcatctcgatggtgaaggggaaggacgatccaatctaccgcaagtacatcaaacagtacaagaaccttgttagtttcagcaggatctga

SEQ ID NO: 7890 - RNA, 1089 nt, unidentified
  source 1..1089: mol_type = other RNA; note = synthetic construct
atgcagaaggattcgcacctgatactcactgattcccccgagacactgcgtgagaggttctactcactgaccaagcccatcgatatcgcccacctattgggaattagctacagacgactcgtctatcacatctacctggtagaacctgaaaaacgctataagactttcgacatccctaaaaagtctggcgggatacgacagatatcaacaccaattaccgctctgaagctcattcagcgcaagctgaaccaagtgctgcaggcagtatatcagaccaaaccaagtgtgcatggctttgtgtccgggaagaacatcgtatccaacgcccaggctcacgcaaaaaagcgctatgtcctgaatctggacataaaggacttctttccttctgtgaattttggacgggttcgtgggatgtttatggccaaaccctacaatttacatcccgacgtcgcgacagtcctggcccaaatttgttgccataacaatcaactgccccaaggagccccaactagtcctatcattaccaatatgatctgtgcgaagatggatagtcagttgcagcgcttagctaaagactgcaaggcaacatacacccggtacgccgatgatatgactttctccacaaccctcccgaaattcccagaggaactggcttacatagtggcagaagaggaatgcaaaaaaattgtgatcggtaacagactaacggctgtgattaacgaaaatgggttcgaggttaatcagcagaaaaaccggctgcaagtgaagggtaaccaccaggaagttacgggattaactacaaacctctttcctaatgtggacaggaagtatgtcagacaagttagggcaatgctttatgcctgggctaagtttggccttgaggccgccgagaacgagtatttcgagaaatacttgtttaagagcaggttgccgattaagaaagatcttaagttccagcagatcctcagaggcaaaatcgaattcatcggcattgtgaagggcaagaatgactttatctaccagaaatatagcaaccagtacaagatccttaccaagctctctatcagcaataaaattcgggaggactga

SEQ ID NO: 7891 - RNA, 1089 nt, unidentified
  source 1..1089: mol_type = other RNA; note = synthetic construct
atgcagaaggggtccaattttatccttaagtacaagcccgaatttctggccgaaaagttctatgccttgaagaatcctatggatatagctgacttgctcggcatcagttacggccgactggtctaccatatatacgtgattgagtccgagaacaggtacaagattttcgacattccgaaaaaaagcgggggaattaggcaaatcagcacgcctatcacagcactgaagattattcagcagaagctcaaccaggttctgaaaaccgtatataaaccgaaagcttccgtgcacgggttcgtcagtgacaagaacatcgtgacaaatgcacaagcccacactaaaaagaggtatgtactaaacatcgacttgaaggacttttttccctcaatgaattttggtcgcgttcgtggaatgttcatggctacaccatacaacctacctcccgatgttgcaaccgtgttggcccagatatgttgtcataataaccagcttccccagggggcaccaacttcgcctataatcaccaatatgatttgcgctaagatggattctcggttacagcgcctcgccaaggactgcaaagcaacttatacccgatacgcagatgatattaccttctctacaacactgccacaattccctaacgatctggcctataccggcacggaagaggataccgagaagatcttaatcggaaatagactgcttgccatcatccacgaaaacggttttgaagtcaacgaacaaaaaattcggctgcaagtcaaaggcaaccatcaggaggtcacaggcctgactactaatatctttcccaatgttgaccggaaatatgtgcgccagattagagcgatgctttacgcttgggccaaatttgggctggaggcggccgaaaatgagtatttcgagaagtatgtgtctaagtccagactgagcattaagccaaaactcgagttccagcaggtgctcagaggaaaaatcgagttcatcggtatggtgaaaggcaaagaggactcaatataccagaagtacatgaatcagtacaagattctggctaggctcagcatcgtgaacaagaacagtgaagactga

SEQ ID NO: 7892 - RNA, 993 nt, unidentified
  source 1..993: mol_type = other RNA; note = synthetic construct
atggatatcgccgaccttctggaaatctcatatagccgtttaatctatcacacctacattgtctatcctgagcgcaggtacaaaacttttgagattcccaaaaagagtgggggcatcagacagataagtacccccatcaccgccctgaaaattttacagcgaaaactgaatcaggtgctgaaggctgtgtacgaacctaaagcatccgtacacggtttcgtcaccgggaaaaatatagtcactaatgctcaagcccatgtgaagaagaggtacgtgctcaatatcgacctaaaggactttttccacagcatcaactttggtagggttagaggcatgtttatggctaccccctatggattgcatccgaacgtcgcaacagtactagctcagatctgctgctacaagaaccagctcccacaaggagctcctacgtcgccaattatcacaaacatgatttgtgccaagatggatggccagctgcagcggcttgcaaagacatacaagctcacgtatactcggtatgccgatgacatcacattctcaaccaccctgccccacttccctcgcgaactcgcctacatcctgactgaagaggataatgagaagatcgttataggcgacaacttgctgcgtattattcacgaaaacggcttcgaagtgaacgagcagaagattcggcttcaggtgaaaggcaaccatcaggaggtgacgggattgacaactaatgtgtttcccaacgtcgatagaaaattcgtgcgccaggttagggcaatgctgtacgcatgggccaagtttggtatagaatccgcggagtccgagtatctgactaaaaatcggtacgagtctattttcccagggaaagaaaagcctacatttcaacaagccctgagagggaagattgagttcatcgcgaccgtgaagggaaaaaatgacccgatttaccgaaagtatctcagcatctacaaacagttgataaagccagagtctgtttga

SEQ ID NO: 7893 - RNA, 1080 nt, unidentified
  source 1..1080: mol_type = other RNA; note = synthetic construct
atgcagcaggattcccaactgcttttgaaattaacctcagagacattacgagaaaaattttacgatctgagaagggtgctcgatatcgccgagctcctcgaagtgtcatatgatcacttggtccatcacatctatctgatagaatccgaacatcgttataccaccttcgagattcccaagaaatctgggggcattcggcagataagcactccaattacggccatcaaaattatccagaagaagctaaaccaagtactgcaggccgtttatcaaaccaagccgtcggtgcacggatttgtgaatggtaagaatatcgtgacaaacgcacagtcccactgtaaaaagtgctatgtgttcaacattgaccttaaggactttttccctagtatcaactttggcagagttcgcggaatgctcatggccaccccctacaacctgcctccggacgtcgctacggtgttggctcagatctgttgctataataatcaactgcctcagggggctcccaccagtcccataattacgaatatgatctgcgcaaaaatggactctcagctgcaacgcctggccaaagattgtaaagctacctacactcggtatgcagacgacattaccttcagcacaactctcccaaagttccctaacaaactggcctatgtcctgactggtgaggatacagaaaaggtgttcatcgggaataggctacttgcaatcatccacgaaaatggtttcgaggtgaacgagcaaaagataaggcttcaggtaaaaggaaatcatcaggaggtgactggcctgacaactaacctctttccaaatgttgatcgaaaatacgtgcggcaggtcagagccatgctctacgcgtgggcgaagtttggcttggaagccgctgagaatgagtactttgacaagtacgttagcaactcaagactgccaattaaacagaagttaaagttcaagcaggtactgcgcggcaaaattgagttcatcgggatggtcaagggaaaagaagacagcatctaccagaagtacataaaccagtacaaaattctgaggaacaagaagtccacaaactcttactga

SEQ ID NO: 7894 - RNA, 1122 nt, unidentified
  source 1..1122: mol_type = other RNA; note = synthetic construct
atgacaatcaactttccccagggacagttaattagcccaccgtgggacaagaagtcactcttgctgctcaatcgaagtccagaagagctaaaaaatgatttctaccagctgaagactcctctagacgtggcaaaacttctgaacattccccataagcgtctagtgtaccatctttacttggtggactcccagaggagatacaaaacgttcacaatacccaagaagtccggaggccagcggcaaatctcgactcccatcactgctctgaaaattattcagcagaagcttaatcaagtgcttcaggcagtctaccaagtgaagccttctgtccatgggtttgtgcaggataaaaacattgtcacaaatgcgaaagcccacgctaagaagaggtatgttctgaatctggatctggagaatttctttcctagcgtaaatttcggaagggtgcggggaatgtttatggcgataccctatcatttaccaccagacgtcgctacgatcctggcccaaatttgctgtcagaacaatgagctgcctcaaggggcaccaacatctcccatagttacaaacatgatatgcggaaaaatggatagccaactccagcgcctggccaaggactgtaaagctacctatacccgctacgctgatgacatcaccttttcaaccaccttaaagaatttttccactgacctggcatacgtggttaacgaaggtgaagcagagaaagtagtcctcggcgatctgctgagtggcatcatcagagagaacggtttcaacgtaaatgagaaaaaaaccagactgcagaccaagggtaaccaccaggaagtgactggcctcaccacaaaccagtttccgaatgtggaccgacgctatgtgcggcaggtcagggccatgctccacgcttgggccaaatttggcctcgaagccgcccaaaaggaattcgaggaaaaatataaccacaaggccagattctctgggaaacagattcctcacttccaggatgttttgaagggcaaggtggagttcattgggatggttaaggggaaggatgacttgatctatcagaagtacatcaacgagtataagcagttgcttaatctgaacttccctaaaaacatctga

SEQ ID NO: 7895 - RNA, 1110 nt, unidentified
  source 1..1110: mol_type = other RNA; note = synthetic construct
atgacaatcaacctgccacagtggcaattaattttcccacatcttcacaaccagaatcctctgttattgcaagacagtcccgaagaactgtccaaaaagttctacgagctcaagacacccctggacgtcgcgaagttactgaatattcctcacaagaggctcgtttatcacttgtatctggtcgacagccagaaaagatataagacctttaccatcccaaaaaagtctggaggcgaacgccagatcagtactccaattaccgctctgaagatcattcagcaaaagcttaatcaggtgctgcaggccgtgtaccaggtaaaaccctcggtccacggcttcgtgcaagacaagaatatagttacaaacgcaaaagctcatgtgaagaaacgctatgtgttgaacctcgatctagagaattttttcccctccgtcaacttcggacgggtgagggggatgtttatggccataccctaccaccttccacctgatgtagccaccgtgcttgcgcagatctgttgccataacaatcagctccctcagggcgcaccgacatctcccatggtgactaatatgatttgtgccaaaatggatagtcagctgcagaggctggccaaagactgcaaggccacctacacgagatacgctgatgacataactttctccacgactctgaaagactttccgcctcatttggcttacattgtagactacggtaacaatgaaaaagtgatgctaggcgagagcttgctcaacatcatccgagagaatggattcagcgtgaatgagaagaaaacaagactgcaaactaaggggaaccaccaggaggtgaccggcctgacaaccaaccaatttcctaacgttgaccggcgctatgttaggcagatacgagccatgctccatgcctgggcaaaattcgggcttgagtcagctcagaaggaattcgaggaaaaatatcaccactccgcacgttttagcggaaaagagatcccacggtttcaagatgtcctgaaggggaagattgaatttatcggtatggtcaaaggtaaggatgattcaatctatcagaagtacatctctcagtactatcagctcctgaagatttacttctga

SEQ ID NO: 7896 - RNA, 1125 nt, unidentified
  source 1..1125: mol_type = other RNA; note = synthetic construct
atggtgatcaatctgcctcaggggcagctgatcgagaaaaagcgctctaagcgggagcaaaaatcttcacttctgctcctgaagaagtcgccagaagaactgcggactaagttttttgaactaaattccccccgggatgtcgccaagcttctcggcatcagctacggtcgattagtgtatcacatttacatcgtgtccgaagccaataggtacaagacttttgaaattcccaaacgttcaggcggagtacggcagatctctacccccagaaccgctctgaagatcattcaatggaagctgaaccaggtgctgcaagctgtttataagccaaagccgtccgcacacggtttcgtgcctaacaaaaatatagtgacgaacgcccaagcgcactctaaaaagaggtacgttctcaatttggatcttaaggacttcttcccaagcgtgaactttgggcgagtcaggggcatgtttatgggcacaccatacagtttgaatgccaacgtggctactgtcctcgctcaaatatgttgccataataatcagcttccgcagggcgcgcctacatcccctattattaccaatatgatctgcgccaaaatggattcccagttacagcaccttgcgaaaagttgtaaagccacctataccaggtatgcagacgacataacttttagcactaccctaaagcagttcccagagagcttggccagagtgatcacagaggaaggagaggagcgcgttattctgggcgaacctctcctgggtataattgcagagaacgggtttgaggtaaacgagcagaagatccgcttacaaaccaaaggaaaccatcaggaggtcacagggctgacgacaaaccagttccccaatgtagaccgccgcttcgttaggcagatcagagctatgctgcatgcatggcagaaattcggattggaagctgcagaggccgaacaccgagagagatacagaaacaaagccaacttccccggcaagagtgaatcaaacttcaaggaggtgctccgggggaagattgagttcattggtatggtcaaaggacgtaataacgaaatctatcagaaatacctccagtggtatgtgaagctgctgaaatttgggagcaattga

SEQ ID NO: 7897 - RNA, 1104 nt, unidentified
  source 1..1104: mol_type = other RNA; note = synthetic construct
atggtgatcaatttccccaaagggcaactgattcctgaaaactccaacataaagtctaagtcatatgcccacctactgttgaaagataaccctgagacgttgagggaaaagttcttctcgctctcaactgctcgcgatttggccaagctccttaacgttgagtatcggcgcctcgtctaccacatttacatagtgccgccttccaagcggtacaaaacctttgagttgcccaaaaattccggcggaaccagacagatatccactccccagacagctttaaagattatccagtggaaactgaatcaggtcctgcagacaatatatgaacctaagccttctgtacatgggtttgtaagtggtaagtccattgtgacaaatgcccaagcacacgccaagaaacggtatatcttaaacctggacctgaaagacttctttccctcaatcaacttcgggcgagtgaggggcatgtttatcgctgcgccttacggcctgactccggaggtggctaccgtgctggcccagatctgctgtcataacaatcagctgccacaaggagcccccacaagtccaataattaccaacatgatttgcgccaaaatggactctcagctgcagcaactggccaaggcatgtaaggcaacttacacaagatacggggacgatattacatttagcactaccctcaaagaatttccagagagcctcgctaaggtcgtcacggaagaggggaaggaaaaagtggctctcggagagccccttttaggcatcatcgcagagaatggtttccaggttaatgaaaacaagatccatctgcaggcaaagggcaatcaccaggaggtgaccggccttaccgccaataagttcccaaatgttaacaggaagtttgtcagacaggtgcgcgctatgcttcacgcatgggcgaaattcggtctggaagccgcggagaaggagttccaagaaaaatacgcttcaaaaagccgactcccaagcaaatctaccgccagtttcaaagaagttctacgtggaaagatcgagtttattggaatggtgaaaggcaaggaggataaaatctatagcaagttcatcgacaagtttaacatttga

SEQ ID NO: 7898 - RNA, 1131 nt, unidentified
  source 1..1131: mol_type = other RNA; note = synthetic construct
atgctgaatagcgctgttcaggaaaaaatcaacattcaccctctggaccaccaggcacagataaaggaaagattcacactcccaggaagcccggaggaactgaggcaaaaatttctcgctctccagacccctgacgatttagccagtctgttaaatctgacttacccccgcctcgcgcatcatatctacagagtaccttctgataagaaatataagaccttcactctgccaaagaaaatggggggggagagaaccatctcgactcccataagcgcactaaagatcattcaatggaagcttaaccagatcttgacagcagtttacgaggtgaaaccatccgctcatggctttgtgccaggcaaaaatatagtgaccaacgccaaagcgcacgcaggtaaacggtttgttctaaatctcgacctcgccgattttttcgggagtgttaatttcgggcgggtgcggggtttattcatggccaccccctataacctgcctgcgaaggtcgccacagtgttggctcaaatttgctgtcacgaagacaaactcccccaaggggcacctacctcccccatcattacaaatatgctgtgcgccaagatggattcccagctgcaaaggctggctaaagaatgtcgagcaacttacacccgttatgccgacgacattactttttctacgacgctgaaagagttcccagaagccctagcgtacgccatcgaaaccgaggatggagacaagcttcttctgggagatcgattactgggcatcataactgagaacggcttcaaaatcaacgagaagaaagtgaggttgcaggtgcgcggcaatcatcaggaggtaacgggacttacaaccaacgaattcccgaatgtcaaacgcacatatgtcagacagatcagggccatgttgcacgcttgggctaaattcggcctggaggctgcagagaaagaatactatcagaagtatgaggagaaggtcaagttttcactcaaaaaaaaggcctcattttctcaggtggtgaagggcaagattgagtttctgggaatgattaagggtaaggacgatgacctgtaccagaagatgctgaagagctacttgaagcttaagaagtccgcccccgtcacaaactga

SEQ ID NO: 7899 - RNA, 1125 nt, unidentified
  source 1..1125: mol_type = other RNA; note = synthetic construct
atgctatccagtgtcatagagaataaggtgatagtccatcctctcgatcgccaagctcaggccaaagaacgctttgttttacccggttcccagactgaacttaggcagaagtttctcaaattgcaaacacctgacgacgtcgcacgtctcctgaatctggactaccggaggctggctcatcacatctatcatgtgccaaccgagcagaaatataaaactttcacactgccgaaaaagacgggaggcgagagaaccatctctacacccgtgagcgccctcaaaatcattcagtggaagttaaaccagctgttaacggcagtatacgaagtgaagccaagtgcgcacggcttcgtgcaggggaagaatatcgttacaaatgctaaggtgcacgcaggaaagagattcgtcctgaaccttgacctggcagattttttcggatcagtcaattttggccgagtccgaggactgttcatggctacaccatacaacctccctgctaaggtggctaccgtactagctcagatttgctgtcatgaggacaaacttccccagggtgcccctacctccccaatcattactaatatgctctgtgccaagatggactctcagttgcagcggctcgctaaggaatgcagggccacatatacgcgttacgcagatgacataactttcagcaccacattgaaggaattcccggaagccttggcctatgccgtggaaactgaggacggtgataagttgctgctcggggatcgcctgctaaacattatcgccgataatgggttcaatattaacgagaagaaagtgagactgcaagttcggggcaaccaccaagaggtgaccggcctgaccaccaacgagtttcccaatgtgaagagaacctacgtacgccaaattagggccatgctgcacgcctgggcgaagtttggcctggaggcagcagagaaggaataccacgagcggtataactttaaagcgaggttcgccctgaaagaggaggctagctttaaacaggtgctgaagggaaaaatcgaatttcttgggatggttaaagggaagaaaaatcttgcctacaacaaattcctgaagtcatattacaaccttactaacttcggcaagaaatga

SEQ ID NO: 7900 - RNA, 1020 nt, unidentified
  source 1..1020: mol_type = other RNA; note = synthetic construct
atgcagacccctcagaacgtcgcggtactgctggatgtggaatatgacaagctcatttaccacatttactccagtaatgtggatgagcgctacaagaaattcgaggtctataaaaagtccgggggaattcggacaatcacaacacccgttactagcctgaaattcatccagtggaaactcaatcaggtgctcaacgcagtgtatcaacctaaaccagctgttcacgggttcacgttgaataagaatatcctaaccaacgcccaggcacatgtggggaagcggttcgtactgaacctggacctggaagattttttcccaagcatcaactttggcagagtgagaggactatttatggctcccccctatcagctaccggccggtgttgcaacggtgctggcccaaatttgttgttatgacaatcagcttcctcagggtgccccaacatcaccaatcgtcagtaatatgatttgcgccaagatggatacccagttgcagagactcgctaaggaatgcagagcgacctacacacggtacgctgacgacatcaccttttctactactctgcgtgagtttcctgaggacttagcatatcccgtgaaaaccgaggagggcactcagttcgtattgggagatcacctccttcagatcatagccgaaaacgggttcaaaataaacaatcagaagactcgacttcagaccaaaggttcgcatcaagaggtcaccggcctgactgtgaatcagtttcccaacgtgaaaaggacatatgttaggcagattcgcgctatgttatatgcctgggaaaaatttgggctgcaacaggcctcccaagagtactacttcttctacaaggattataaccgcctcccgctgaaattcaataataagagctcagaagacgactttgtgcaggtcattaagggaaaaatcgagtatcttggcatgatacgaggcaagcaagatagcatatacaggaagtacatctctaagtttaactacctgaagaactacaacggcaggtga

SEQ ID NO: 7901 - RNA, 1116 nt, unidentified
  source 1..1116: mol_type = other RNA; note = synthetic construct
atggaatctaatttgcctgagcatcaagccgtgaatccagagtcaagcaaaagatcattccaacgaaaaaagggttgtctgaacttgactcaaaccccagaagagttacgagctgctttcctggccctaaaaacgccccgcgatatagctagactgctgaacgtgcgttatgacaggctcgtttatcacatttataaggttccccttgagaaccggtacacgacctttgagatccccaaaaagtccggcggtaccaggacaatctctgctcctgtcacagccttgaagcttatacagaggaagttaaatcaggtgctgcaagcggtctacgagcccaagccttcagtgcacgggttcactccaggccgcaatattgtgtccaatgcgaaaccacacgttaagcggcggtacgtgcttaatttggacctgaaggatttttttccgtcgattaatttcggcagggtgagaggaatgttcatggggatcccataccacctccctgaacctgtagccacagtgctggctcagatttgctgtcataataaccagctcccacaaggggcacccacaagccccgtaatcactaatatgctctgcgcccagatggactccagactgcagcggctggcacagaaacttaaatgcacctatactcgctatgcagatgacatcactttctctaccaatatgcctgaatttccggccgatttagcaattgaggtgaccacagacgaaggaacgaggatcaagatcggggagcccctgcgccagatcatcgaaagctccggattcctaattaacgacaaaaaagtccggctgcagaaaagaggacatcaccaggaagttactggccttaccaccaacgagtttccaaacgtcgatcgtcgatacgtccggcagataagagccatgctgcatgcctggcgcaagtacgggaaccagaacatcctcagcgtcacaagtaaaagtaaccaccccattagttacgagtcttttgataacttcaagcaggtgctcaggggccgcattgagtatgtgggcctcgtgcgtggtaaggaagaccctatatacatcaagttcctgaaccagctgaagatgtttgaagaggtattttga

SEQ ID NO: 7902 - RNA, 1116 nt, unidentified
  source 1..1116: mol_type = other RNA; note = synthetic construct
atgcgagatcgacttaagggaacacccgaccagcttcgggaggccttcctgaagctgaggagccccagggacgttgccgagctgttagatgtgagatacgatcgcctcgtgtaccacatttatgtggtgccagaggccaagaggtacacggttttccacatacctaagaagagtgggggacaacgcgaaatactggcaccagctacccctttgaagctgatccagaagaagcttaatcaggttctgcaggccgtgtaccagccaaaaccatctgcacatggtttcctgcctgccaggaacattagaaccaacgctgaaccgcacgcaggtaaacgttatgtcctgaacattgatctcaaggacttcttccccagcattaattttggccgggtgcgcgggctgtttctttccaaaccttataacttaccggatgaggtggcgactgttctcgctcaaattgcttgctatacccatcctgaggatacatggcagcataatggcaaggtggtacggagatcataccttccccagggcgccccgacatccccaatcatcacgaatatgatctgcgctggaatggacgccgaactccagagattggcgaagcgttgtagggcgacttacacaagatatgccgacgatctcactttttcaactaccctacgaaccttccccgaggacctggcccaggtagtggatgacaccgaaggccgcaagcgcgtcttcttgtcggaaactctgaggagcataatcgagaaacacggctttgaggtcaacgacaaaaaagtccggttacaagaccgcagatttcggcaggaggtcaccggattgacagtgaatgaatttccaaacgtccgccgttcttttgttcggcaagtgagggcaatgctccacgcatgggataagtacggtctagaacaggccgaaagagagtacagagtgaaatatgaatccaaacaccggggcccctatcatgccgctcccagtttcgctcatattgtgagggggaaattggagttcatcggaatggtaaaagggaaaggggaccctgtctacctcaaatatctgggccactactactctctgatcgagcgagacaagctggcaagcaagtga

SEQ ID NO: 7903 - RNA, 2262 nt, unidentified
  source 1..2262: mol_type = other RNA; note = synthetic construct
atgagcttgtacgacttttcaccagagcttgtcgctaaaacaatcggagtggattatcacagtctcattgagctgctcgaacaggtagatgagatttatagagacttcaagattccaaagaagagtggcggcgtgaggacaattcgaacccctcgctctactgaatacgaggatggagacatcacattactggacatccagaagaagatcagtaaggagatccttcagcccgtgtatcagccgaagccttgcgtgcatgggtttactgctaaaaaatctatagtcaccaacgctaaagctcacaccaagaagaagtacgtgctgaaccttgacattcaagactttttcacttccatcaaattcgaaagggtgagaaagatgttcatggcacagccttataatgctaacgatgaagtagccaacttgctggcacaaatttgctgctatgaagaccagcttcctcaaggggcccctacttctccgatagtgtcaaatatggtttgcgcaaaaatggatggtcaactgctggatatcgctaggcagtacaaggccacatatacaagatacgccgacgatatcacattttccaccaatctggaggagttccccgaggcgctggggtacgtcgtgaacgagggatctatccgacggttcttcgtcggccatgaactacaggaaattttcaatagcaacaactttgaggtcaacgagagaaaagtgagactgcagacgcagaattgtcgccaagaagtcaccggcttgaccgttaaccacttccccaatgtaaacaggcagtttgtacgacagattcgggccatgttatatgcatggcagaagttcgggatcaacaacgctgcctccgagtatatctctaagtacggccgctacggcgagttctacaaaatcattctgaactacaagtccggtgttgaggccaagcggttccatcatgttctgcggggaaagatagaatttctggggctcgtccgggggaagaatgatcccatttacaaaaagtatctcgcccagtacaaacgtctcttgtatgaggagatcgcacaggagcctcgattgccaagcgtgctgaagactaaaggctggcaagaaggccggctgtctcttaacaatcacgattggaatgccaatatccgtaagagaggcctacttctgcccaactacattaaaactagctacctcctcagcgttcttacctccctgtacactgggcagatagtgctgttaaatggctccgttggaataggtaaaacatcgctagttgagaagagcgctaagatcttcaatggcaatagcaagattatcccagtgcggcctgcatggaccgactccaccgatctgctcgggttttacaatcccgtgaacgactcatttcacccttcaatctttctaaccgcacttcagcaggcctcagaaaatttcgaacaaattttcctcgtgtgtctggatgaactgaatctcgccaagattgaaaattatgcggcggacctgttatcctgtctggagtatagcaaaacaggtcagggagcccagaaacttatcttgtattcgccgagcatcgaagtccaaatccgccaggaaatcaagttacttcagagccaaaagagcaaaacatttgagcagtccaacaggctggctaagctgcagaacctgcttaacacttaccccgctgagttcctcctgcccaagaatctagtgttaatcggcactctgaatagtgacgagacgacctatgatatttcaccaaaagtcattgatcgttccttcgtgataacgtatccattgccagattttgccgaggatacaaaagccaccccttctagtaatccaataactggaacgtacatacccagtctcttccaggagctcgacaacaaaattctgcaggcgcactcatcaagcgacgaatttaacgacagttggtacaccctgctcaactggaattctaggtatctctctcagtgtggtatcccactcggttaccgcgtcaagcgagactacaaagtgttttatgccgcaagccaaattatcggactgacggtggaagagtgcttgggatatttcttgtttaccaaattgatgccgcgcctgagttttttcaaagatgagtctcgcgaaaacatttgtctggagtggctggaagagatagaaaacaactactcccagtttggcacacccgacgtgatcgagaatctacggaaccaaattcaggacatcaggagaagaaatgtaaggtactgggggtga

SEQ ID NO: 7904 - RNA, 2262 nt, unidentified
  source 1..2262: mol_type = other RNA; note = synthetic construct
atgtctttatacaatttgtctcctgaactggttgccgagcaactgggcgttaactaccatagcttgattgagctactgcagcaactagatgaaatctacagagactttgtcatcccaaagaaaagcggcggagttaggactattaaaaccccaatgagcattcgggaaattataagaggatacgaggatggatattttcctcttctcgatatccagaagaagctgagtaaggagattcttcaacccgtgtatcagcctaagccctgcgtccacggcttcacggctaagaaatccatcgtgactaacgccaaggcccatacaaagaaaaagtatgtgctgaacctcgacattcaggatttcttcagctcaattaacttcgaaagggtgaggaaaatgtttatggctcagccctataatgcaaacgatgaggtagcaaacctgctggcccagatctgttgctacgaagatttattgccccagggtgccccaacctccccaattgtcagtaacatggtttgtgctaaaatggactcacagttactgacactggctaagaagtataaagccacctatactcgctatgccgatgatattactttctctactaacctggatgaattcccagaagccctcggctccgtagcggatgaaggcggtatccgcagattcgtggtcggggaggagttgagagagatcctaaacagtaacaacttcgaggtgaatgagagaaaggtccggctgcagacccagaattcacgccaggaggtgacaggccttacagtcaataggtttccaaacgttgaccgaaaattcgtgcggcagatccggtccatgctgtacgcttggcagcgttttggaatagagcaggccgcgggcgaatacagctccaggtacgataagaagtacaagtacctcatcaatcgctctggcgaagaagcgaagagatttcaccatgtcttgcgcgggaaaatcgagttcctggggatggtgaggggaaaaaatgaccctatatacaagaagcacctggcccagtataagcggctgctctacgaggagttagcccagaagccacggctctcttcctctctcaaaaccaaagggtggcaagatcgagtatccctaaataatcaagactggaatacccacatccgggtggctggactcctgctgcccgattatataaaaaccagttacctcttggcaatcctcacctccttgtataccggccagatcatattgctgaatggatcagtgggcatcggtaagacgagcttggttgaaaagagtgcagagatcttgaacggtaattccaagattatcccagtccgacctgcttggactgactcaacggatctgttagggttctacaatccggtgaatgactcatttattcccagtagcttcctgaccgccctccaaaaggcatctgagaacttcgaacagttctttctggtgtgcctggatgaattgaacctggcacggattgagaactatgccgctgacctgctgagctgcctggaatactccaaatcagggcagcaagcccagaaacttatactgtattcaccgagcatcgaggtccaaattagacaggaaatttcactccttcagagccaaaagactaaaacgtctgaacaatcgaatcgacttgcaaaacttcagaacctcctgagcacctatccggccgagtttagcattcccaaaaacctggtgctgatggggacacttaactctgacgagacaacatacgacatcagccccaaggtaatagaccgcagttttatcataacctatccttttcccgacctagctggagacaccaatgcaacaccttccaataatcctatcacaggcacttacattccgtcgctcttcaaagagctagacaataaaatcctgcaggaacgaagtacaaatgacgagttcaacgaatcttggtacattatctcgaactggaacagcaggtacctttctcagtgtggcattcctcttggttaccgggtcaaaagagattataaggtgttttatgctgcgagtcagattgtgggtctgactgttgaagagtgcattggatacttcctctttaccaaactgatccccaggatctccttttttaaggacgattctcgtgagaatatatgtctcgagtggttagaagagatcgagaataattattcccacttcgtgacaccagacgtaatggggaaccttagaaaccagatacaggacatccgccgtaggaacgtgcgctactgggggtga

SEQ ID NO: 7905 - RNA, 2274 nt, unidentified
  source 1..2274: mol_type = other RNA; note = synthetic construct
atgaacctaaaggatctctattgcttatcccccgagctcgtcgctgagaagttaggggttaactatcattccctgattgagctgttagaacaggtcgatgagatttacagagagttcaaaatccccaaaaagagcggtgatgttagaacgatcaggacaccaatctcgtcttctgaacgctacaagatttacgaaggagaaggctacttcccattgcttgatatccagaaaaaactcagtaaggagattctacaacccgtgtatcaacccaagccttgcgtccatggttttacagcaaagaaaagtatcgtgaccaatgccaaggcgcatacaaagaaaaagtacgtactgaatctggacatccaagatttttttgcgagcatcaatttcgaacgcgtgcgggctatgttcatggcgcaaccttataatgccaacgacaaggtggctaatctgctcgccaaaatatgttgctataaagaccagttgccacaaggcgccccgacttcccctatcgtgtccaacatggtgtgtgcaaaaatggatcggcagcttctggagctggcaaaaaagcacaaggccacctataccagatatgctgatgatgttacgtttagcacaaatcttgaagagtttccggaggctcttgggtacgtgattaatgacggatccgtccggaaatttgtcgtgggagaagagcttcgggagatcataaattctaacaacttcgaagtgaacgagaggaaggttcgtttacagacgcagaactatagacaggaggtcactggactgacagtcaatcaccgcccgaatgttaaccgaaagttcgtccgacagatccgtgcccttctccacgcatggcagaaatttggaatcgagaaggcagcggacgaatatagtagcaggtacgacaagaagtacaagtacctgaagatcaggtcttccgagaacacaaagcggttccaccacgtcgtacgaggaaagattgagttcctggggatggtgcgtgggaaaaacgatcccatctacaaaaaatacttgtctcagtacaagaggctcatctatgaagagctggcccaagaacctaagctctcttttgtactaaaaactaaagggggcaaggaacgggtgagtctgaactatcaagactggaacgccaatatccgagcccgaggactgctgctgccaaactatattaagaccagttacctcctgtcagtgttgacttccttgtatgccggccagatcatactgcttaatggctctgtgggcgtgggtaagacgagcctggtggaaaagagcgcgaccatcctgaacggcaactccaaaattattcctgttcggccggcttggattgacagcagcgatctgctggggttctacaaccctgtgaatgactcatttaatccctcatcatttctgacagcactccagcaggctcaggaaaagtttgagcagtttttcctcgtatgtctggacgaattgaacttagcccggatcgagaattacgccgctgatctgctaagttcattggagtatagtaagtccggtcaaggagctcagaaattgatcctttactcaccctctattgaggttcagataaggcaagagattaaactcctgcagtcccagaaaagcaagacttctgaacagtcaaacagactcgccaaactgcagaactttctcaatacctacccagcagagttcagcattcctaagaacctgatactagttgggaccctgaattctgatgagactacctacaacatcagtccaaaagtaatcgaccgctcatttgtgattacttatcctttacccgacttcgctgaggatactaacgctaccccaagtagcaatcccatcgcaaaaacctacatacccagcctcttcaaagaattggacaacaagatcctgcaggccgacaattcaaatgacgaattcaatgactcctggtataccatttcgaactggaattccctgtacctgtcgcagtgcggcatacctctcggttatagagtgaagagggactacaaagtgttctacgcagcctctaggataatagagctaacagcccaggagtgtatcggctatttccttttcaccaaacttttgccaaggatcagcttctttaaggacgaagagcgcgaaaatatttgcctcgagtggcttgaagaaattgagaacaactactcccactttggcacaccagatgtgattgagaatctgcgcaaccagattcatgatacaagacgcagaaatgtcagctactgggggtga

SEQ ID NO: 7906 - RNA, 1746 nt, unidentified
  source 1..1746: mol_type = other RNA; note = synthetic construct
atgagtatcctgctggagagcgctgacactacactccgggagcggttccataatcttcgtgacttcgcagatctggccgatctcctcgagattaaaaaaagcctgctctattactacgctttcaaggctcgaggagtggatcactataaggtatttcaggttccgaaaaaaagtggcggaacacggcagatctgttcaccgtccagccctcttaagttgattcagcgaaagctaaatcaaatctttcaatccgtctacgtaccaaaagcctctgtccacggcttcgtgaaagataggtcaatagtcacaaatgccaggcggcacatcgacggtactccacggaaacgttatgtgctcaacatcgatatagccgacttttttccatcgataaccgagggcagaatcaaaggactgctcatggccacgccatacaacctcccccgggacctggcacatgttatagccgggttagtctgcttagacggtcgcctacctcagggggctcctacctcacctgtgctgtcaaacatgatctgtgctcggatggacactcagctgaggagattggcacagaaatataggtgtgtttacactagatatgcagatgatatcaccttcagtacttccctgccccgcttcccagctggattggctacaggaaacgatacaaaccgacaaatcgttgtcggggacgaattagcgtctgtgatttccggtaacgggttcgcggtaaatcaaaaaaaagttagactgcgctctaaggataataggcaggaggtgacgggcctgaccatcaaccgctttcccaatgtgaccagaagctatgtccgccagattagggccatgcttcactcttgggaaaggtatggatatgaaaacgctaaccacgagtacgcccagaaatatttcgcgggcgatgaggacaaagccccatcattgaggcaggttctctatgggaaaatggagttcctcagaatggtgcgaggcagtgacaattccatctttctatcctttcgggaaaagctgaggcgcatagaccccgagtacaagcccctggagctgacacctataaatgcctccatccctatttacgtggtcacggagggtaagaccgactggaagcatcttaaggcggctctgcacaggcttaaggagcagggcctctttattgggctcgaaattgaattctgggaatacgaagatgacgtgagtatgaacgatgcagaattgcttaagagatgcaagtacaaggacgacatcgacctgcccaaactctatatctacgtgttcgaccgtgataagcctgatatcgtgagacaagtcaccggcaccgacggcgatttcaaacagtggcgccgtagactgtactctatggcaattccggtacccgcacacagagtcgggaaccccgatctgtgtattgaactgctgtacgacgatgacagcgtgaagcagaaggatagccacggccggcgcctgttccttagctctgaatttgataagcattcctgccgccatttaaccgaggacctaaactgcactgataacaataaggtgaagcagcctctggcaattattgacaatgccgttttcgacagcaatcggaagaatgtggccttgtctaaatcggagtacgctaccaacgtgttgacaaaagtaccaggatttacaacctttgacgtggccgcctttaagctggtgttcgagactttagagcgaattatcaagtacgataatcagcattga

SEQ ID NO: 7907 - RNA, 1149 nt, unidentified
  source 1..1149: mol_type = other RNA; note = synthetic construct
atgttccgtagccgtattaaacggagcagcacactgctgctctgcaagaattgcgacgaacttaagcaggagtttctcagcttgaaaactgcaaaagacattgcaacccttttggaagtcccctactatcagttggcctaccatctgtacaaggtggccgagaatgagaagtacagggagttctcaattccaaaaaagagcggcgattcaagaaccatcaccgcccccgccaaagcccttaagatattgcagagaaagctgagccaagttctctattcagtttatgagcctaagaaaccagtccatggatttgtgcccgctcgcagcatcttaacaaacgcaaagcagcattctcacaagagatttgtgctgaatatcgacctgaaagacttcttcgattctattcattttggccgcgttaaagggatctttataaaacctccttgtaatctccccgaggaggttgctacgatcctcgctcggatctgttgccactctggtaaacttccacagggggcgcccacatccccagtagtctcaaatatggtgtgtgcccgcctggatcgccaactgaggctgttagcggaagaatttcggtgcacttatacaaggtacgctgatgatatcacctttagtactactatgagtgatttccctaaggagattgccttcgctaatccagaaggggacaacctggagagtctactgggtgagcgcctcatcctgaccatatgggataacgacttcgagattaacgaaaacaaaattcgactgcagcacaaaggccaacaccaaagtgtgactggattgacagtgaatcagttccccaatgtgaaaagggcatacgtcaggaagatctcctctatgttacacgcatgggataagtttgggcttgcctccgtgcagcagcgatacgtcgaaaagcattataaggaatcgggaaaattcaacaaagagattccttctttccaggaggtgctgcgaggcaagatcaactttctcggcatgattaggggtaaggacgacgaaatctacagaaagtatctaacctggtatcggaacctgtccgtacgggaaataccgatcgacctctctcagctagattccaagacccaaccttcccagtcgcacccgacggacagaggatga

SEQ ID NO: 7908 - RNA, 1014 nt, unidentified
  source 1..1014: mol_type = other RNA; note = synthetic construct
atgaaaacccctaaggatgtggcaagattgctcgaagttacttatgaccggcttgtgtaccatctgtacatctcttcagaaaatacgaaatacatcgagttcagcatccctaagaagagcggtgactctaggactataacagcaccctccacagctttgaaaatcctccagaggaagctgagtcaggtgctttatagcgtgtacaagccatccgactcagtgcacggcttcgtggccggaagatccattctgacaaacgctaaacagcatctgcgaaaacgttttgtgctcaacattgatttgaaggccttcttcgatagcatccattttgggagagtacgaggcatattcattgccccgccttataatttgcccaaagaggtggccactgtacttgctcagatttgttgtcacagcaacaagctcccacagggggccccaaccagtcctattgtttccaatatgatttgcgtccggctggatcggcaactgcgcctgttagcgaagaaatataagtgcacctacacacgctacgctgatgatattaccttctctaccactctgcccaactttccaaaggagattgcgttcgaaagtcccggtggggacgacctggagtcattgctgggtgaggagctcattctaacagtctgggacaatggctttgagatcaatgaaaacaaaatcaggctgcaacacaagaataatcaccaaggcgttaccggcttaacggtcaatcgcttcccgaacgtgaacagagattacgtccggaagatcaactcgatgctgtatatctggcaggaatttggactcgcctcagcacagaaagggtacatcgagaagtacaacgaaaagtccggaaagtttaatgaggaaatcccccttttccaggaggttctgcgtggcaaaatcaattttttagggatggtcaggggaaaggacaacgagatatatctcaaatacctagactggtattgcagtctgtctaaccaggaggaaataagcaaagaatga

SEQ ID NO: 7909 - RNA, 1086 nt, unidentified
  source 1..1086: mol_type = other RNA; note = synthetic construct
atgttaaaggaaaactccactcttatcctctacaagaattgcaacgagttaagacaggaatttctggctctgaagagtccccgagacattgccgagctgctggaagtaaagtacgagcaactggtgtaccatctttataaggcccctggatcctccaaatacaaggagttcagtatctctaagaaaagtggtcactctagaactatttcagcccctagctccgccctcaaaattcttcagcgcaaactttcacaggttctctacagtgtctatgatccaaaatatccggtccatgggttcctgcctgagcactcaatcgtaactaatgcaaagcaacacctgcggaagaagtttgtcttaaacattgacctcaagaatttcttcgatgccatccacttcggccgagtgagaggtattttcctagctccgccttataaactccctgaggaggtagcaacagtgctggcgcaaatctgttgccattccaacaagctaccacaaggggcccccacctccccagtggtttcaaatatagtctgcacacggattgattcgcagctgcgcttgctggctaaagagctcaggtgtaattacacacgctacgccgacgacataaccctgtcaaccacccgtcccaattttccaattgagatcgcatatgaaagcagcgaagacaacaaggtcaagatagttttgggagagaggctaatcagcatcgtgcagaataatggcttcgagataaacgataggaaaatccggttgcagcatcgtagccagcaccaggaagtgacaggactgaccgtgaaccagtttcccaacgtgaaaagagattacgtccgagagattagtagcatgctgcacgtttgggacaaatttgggctggctagcgcaagccagcggtatgcggaaaagagatctcgcgaactggaaatctcccaggaggaagtgccatcgtttcaggaggtgttgaggggcaaaatcaatttccttggcatggtgcgcggaaaagagaacgagatctataggaagtatctcaactggtactacattttgtctaaccggtctgaaacgccctctggcgggtga

SEQ ID NO: 7910 - RNA, 1092 nt, unidentified
  source 1..1092: mol_type = other RNA; note = synthetic construct
atgctaacagaaaccgaaataaattcgagccttatcttactggaggactgcgagaagctgaagaagaagtttctctcactcaaggatcccagggatgtggccgctttactggacgtcacctatgatcggctcatttatcatatttatcgcgtgcctgactccgagaaataccttgaatttaaggtgcccaaaaagagcggccagatgagaaagatcagtgccccgtcaacggcgttgaaaatcatccagagaaaactatcccaggtgctctattctgtctacgaccctaaggcccctgtgcatggctttgttccttctcggtcaatcctgaccaatgcacgcccccacctgaggaaacgctttgttctcaacattgacttgaaagactttttcgacagcatccacttcggccgagtcaggggcatttttatggccccaccatacaacttgcccgctgatgtgagtagggtgcttgcccagatctgctgtttctctcgtaagctcccccaaggtgcaccgacttcgccagtggtttccaatatgatatgtgctcggctggattctcaactgcggctgcttgcgaaggagaatcattgcacttttactcgctacgctgatgatataaccttcagtacaacgctgcctgtattcccaaaacggttggcctatatcgacagcgacgttaaagaggacgaggaaaagaccgtgctggggtcatccctggtatccattgtccgggaaaacggattcgagatcaattggaaaaaagtacgactccagcacaaaagccaccaccaggaggtgacaggaataactgtcaaccagttcccaaatgtgaagagggacttcgtccgaaagattagcatgatgttacacatctgggataagtatgggttggatagcgcaagaaagcgccatgccgaactgctgtctaaatccctggagattcccgaagaagaggtgacagattttagagagatgcttcgtgggaagattaacttcctgggaatggtccgtggtaagaacgactctatctacgttaaatacctaaattggtactgtaacctcagtgcaagagagaggagaatgtga

SEQ ID NO: 7911 - RNA, 1080 nt, unidentified
  source 1..1080: mol_type = other RNA; note = synthetic construct
atgtctgattctaagtttaaagagaattccacccttctcctctataaaaactgcgacgaactgaaggaggaattcctgtcgctgcaaacaccccgcgatgtcgctcggctactcgaggtcagttacgatcgattagtgtaccacctctatatcgtgcctgagaatcggaaatacgccgaattcagtgtaccaaagaagtcaggcgacacgagaattatcagcgcaccggccaccgccttgaagatccttcagaggaagctgagccaggtcctatatagcgtctacgagccaaaagctgccgtgcatggcttcgttccctcccgatccatacttacaaacgccaaacaacacctgcacaagcgcttcatactgaacattgacttgaaggacttttttaacagtatccatttcggtcgtgtacgaggtatatttatggcgcctccatataaactgccagaagaagtggccactgtactcgctaagatttgttgctatagcgggaagttgccccagggcgctcctacttcccccattgtttctaacatggtgtgtccccggatggacagtcagcttaggctgctcgccaaggagtttaaatgcacttatacccgttacgcagatgatatcaccttctctactacattgccgaattttccaaaggaaatcgcgtacattaacatcgaggaggataagcctaaaatactggtcggagaaagattgatcagcgtgattcaggacaatggattcgagatcaatgagaataaagtgagactgcagtataaaaccaagcatcaggaagtcacagggttaacggttaaccaattccctaacgtgaaacgcgactacgttagaaaaatctcaagcatgctgcacgcatgggacaaatttggactcgactcagtgcagaaaaggtacatcgagaagtgttccaaggaactgggcattcctgcagaggaggtgcccccattccaggaagtgctgcggggcaagattaattttctgggaatggtgagagggaaggataacgaaatttaccgcaagtaccttaattggtatcggaggttatcaaacagggagtga

SEQ ID NO: 7912 - RNA, 1137 nt, unidentified
  source 1..1137: mol_type = other RNA; note = synthetic construct
atgtctagttcctcttttaccgatctgaatagccagcacaacaaggggtctagcctgttcctgtatcaaaactgcgacgaattgagggagtcattcaagtccctaaagaccccccgggacattgctcggctgcttgacgtgagctataacaagctcacataccacatcagcatattaccagaaaatgaaaggtacagagacttcctaatacccaaaaagtctggacagtcacgcactatttctgccccttgtactccactgaaaatcttacagcgcaagctgtcacaggtgctgtacagcgtctatgagcccaaaagtagtgttcatggctttgttcctaatcgctctatcctgactaacgctaaaagacatgtccacaagcgatatgtgcttaacatcgatctcaaggactttttccactcgattcattttggacgcgtgcagggcatattcatgaagcctccatacaatcttccgaaagaggtagcagtggtcctcgccaagatctgctgctatagtggccgtttgccacagggagccccgaccagtcctatcgttagcaatatgatttgtgcaaggatggactccgagttgagaaaactcaccgtggagttcaaatgtacctcctacacaaggtatgccgacgatatcacatttagtaccactctgtccaagttccccgtcgaaatcgcttaccaagaaaaatccggggatgataattcacaaaagctgattctgggtgagagactttcaagtatcattcagagcaatggatttgctatcaacgagtctaagatccggttgcagcataaatctcagcaccaggaagttaccggcattacagtgaaccagttcccaaacgtcaagcgttcattcgtgagggagataagctcgatgctgcacatctgggataggtttggtctgaagagcgcagaacaacgctttcgggataaggccgccgaggacctcaaaacatccgcatacacgctcccttcctttcaggaaataccctcctttaaagaggtacttcggggcaaaattaacttcctccgaatggtgcgagggaaagacaatgcgacgtatctgacttactccaagtggttctacgagttaagcagaaaagaggcgattaagtga

SEQ ID NO: 7913 - RNA, 1131 nt, unidentified
  source 1..1131: mol_type = other RNA; note = synthetic construct
atggaaaatttgtcgcttctgctggagaggtcttgcgaggatctgtgcgaagacttccattcactcaaaaccccgagagatgtggccgctctcctggacgtgccgtataaacgcttcgtttatcatctctataaggaggagaaccgatacacttcctttgagattccaaagaaatccggcgaccgacggacaattagtgccccggtgatcggcttaaagataatccagcgtaagctgtcacaggtgctgtattgtgtatacaaccccaagccatctgtgcacggattcgtcccagctaaatcaatactcactaatgctctgccccatgtgaagaaacggtacgttttaaacgccgatcttaaggacttctttcccagcatcaatttcggtagagtccgcggcctttttatggcggccccttacgggttgagccccgaagtggccacagtgctcgcccaaatctgttgttacgaggggaagctgccacagggagcacccacgagtcctgtcgtgagcaatatgatttgcgcgagaatggatcgccagctgcagcaccttgctaaggagtaccggagtacttacaccaggtacgctgacgacatcaccttctctacaacggttcctaaatttccaaaagctctcgcatatgtgcctgaggagggcgacgaaaaaaagcttatcctgggtgaaaagctcgccgaaattatcatctccaacgactttcgcgtcaacgagcagaaggttaggctacaagataagcggagccaccaggaagtcacaggactaaccgtaaatgaatttcctaacgtagataggagatatgtacgatcaattcgcgcgattctgcacgcatgggataagtttgggctgcaaaaagcacaggaggtctatttggagaaatacgccccaacccctcgttatccccagcaagaaaagtcctctctgaaacaggtgttgcatggaaagatcgagttcttagccatggtcagagggaaggaggaccagatataccagaagcacatcaaaaaatacttcgagctgtcccaacgggacagcattccccacaaagctatattggtgaggcaggaggcagtgcatgaacagactggcaccagcaatgatgaagtttga

SEQ ID NO: 7914 - RNA, 1002 nt, unidentified
  source 1..1002: mol_type = other RNA; note = synthetic construct
atgaaaacacctcgggatgtggcccagttgctcgaaatcccttatcagcggctcgtgtaccacctgtatcaggtccccctggaggagagatatctaaccttcgagctcaagaaaaaaagcgggggggtacgcattgttagcgcccctgcctccgcattgaagctgatccagaaaaaacttaaccaggtcttgcagtgcgcgtaccagcccaagccctccgtgcatgggttcacatttagcaaaaatatcaccactaacgctaaggcacacaccggcaagcgttacgtgctgaacattgacctcaaggatttcttccccagcattaattttggacgtgtgagaggcatgttcatcgcgatgccgtactcattttcgccagacatcgctactatactggcccagatctgctgctacaataaccaattacctcaaggcgctccttcctctcccatagtatctaatatggtgtgtgccaagttggattctcaactgcaacaacttgccaggaagctgagatgtacttacacaaggtatgctgacgatatcacctttagtacgaccgttccaaagtttccaaaagaactggcttatctcatcgacatcaatgagcagcagaaactagttctcggagacggcctgctttcaataataaaggacaacggatttcagatcaacgaaaaaaagattcgacttcagtccaaggatgaacaccaggaagttacagggctgacggtgaatcagttcactaacgtcaatagaaactatattcgccagattagggcaatgctgcatgcatgggagaaattcggtttagagttagccgagcgggagcatcgaatcaaatactacttcaagcaaaagagcccatacaaaaatattccgagtttcaaacaggtcctccggggaaagatcgagtttgtgggcatggtccgcggtaaggaagatcagatttaccagaagtatctgaatcactatctgaggctgaacaacccagtgatttga

SEQ ID NO: 7915 - RNA, 1095 nt, unidentified
  source 1..1095: mol_type = other RNA; note = synthetic construct
atggcaaagacacggaattcaaaatcatccatccagccgacactgaggaaagagggagacgaactccggaaggaatttttccttatgaagataccaagagatgtggcacagcttctggaaataccttaccaacgcctagtgtaccatatctatatcgttccgctcgaagaccgatacctaaccttcgacattaagaagaaaagtggcggtaaccgcaatatctgtgcccctgccaccgcgttaaagatcatacagaagaagcttaaccaggtcctgcaatttgtatataagcctaaaccctctgtccacggattcgtcttgaataaaaatatcgccacaaacgcgaaaccccatgccaagaagcggtacgtgctgaacgttgacttgaaagatttctttcccagtattaacttcgggcgcgttaggggcttgtttatggctctgccatatggcctgtcttccgaagtagcaactgtgctggcccagatctgttgctacaataatcagttgcctcaaggggccccaacatcacctattgtgtccaatatgatctgcgccaaaatggacagtcagcttcagcaacttgctaaaaaactgcgttgcacctatacgcgatatgcagatgatataaccttctccactaccctgccaaaattcccaaaggaattagcttacttcattgagattgagaaccagcaaaaactgatcttaggcgatgacctcctgagcatcattaaggagaataactttgaggtgaacgagcgcaaaattaggctgcagagcaaggattctcatcaggaggtcactggcctgacggtgaaccagtttgtgaatatcgaccggaactacataagacaggtgagagccatgctccatgcttgggaaaagttcggactcgaggacgctgaaagagagcaccaggagaaatattacagcaagtacaaatcgccctataaggtcattcccaattttaagcacattctcaggggaaagattgagtatatcgggatgatcaaaggtaaggatgaccgtatctacaaaaagtatctcaaccactacattaagctgcacaagaacagccagaataaaaagtga

SEQ ID NO: 7916 - RNA, 1149 nt, unidentified
  source 1..1149: mol_type = other RNA; note = synthetic construct
atgagtgagaattatgagaaaaagtctcaggtgatcaaagcattgaaaccatgtcttgacaagaattgcgatgaactcatcaagaagttttactccctgaagtcaggaagggatgttgcccgacttctggaagtaccgtatggcgacttagtctactatttgtacgtgatcccctacgaacagaggtatactacattccagattcccaagaagttaggaggctatagaattatcagtacccctgccacatcgcttaagctcatacagaaaaaactgaaccaggttcttcaatgtgtgtatcaggttaaacctagcgtgcacgggttcgtcaaggataagaatatcgtgaccaatgccaaggctcacattggcaagcgctatgttctgaacttcgacctcaaggacttctttgtatccatcaacttcggaagagtccggggcatgtttatggcccttccttacgcgctaaatccggaagtggcaacggtgattgcccagatatgctgccatgacaaccagctcccacagggtgcacccactagccctattgtgtctaacatgctgtgtgctaagttagattctcagttccaaaagctggcaaaaaagtatcggttcacttacacgcggtacgccgacgatattacattttctactaccaggcccaacctgccagaagagatagcgtacattattattaccgaggagcccgagaaactggagaaggtcgtgctcgggaaagacatttatagcatcgtgaaagagaactcatttgaagtcaatcagttgaaagtgcggatacagaacgacaaacaacaccaagaggtcacaagtatcaccgttaacacattccctaacgtagatcgtaattatataaggcagatccgcgccatgatccatgcttgggagaagtttggtctggagtcaagcgaactcgagtatatcaacaaatacgaattcaaagctcgactcttttccggagatactccaaaatttaagcaagtcctgcgtgggaagatcgagttcctgggcatggtgaaagggaagaatgacaccatctacaaaaagtacctgacccagtacttggaactgaataaacgcgataagaactttttctacagactgttttcctggagagaaggtaatctatga

SEQ ID NO: 7917 - RNA, 1779 nt, unidentified
  source 1..1779: mol_type = other RNA; note = synthetic construct
atgggaacaacagcccttagtagaaccgaagaggaacttaaagaggatttttacaagctgaagacgcgacaggatatcgctcagctcctggaaatctccgattatcagttgagataccacctgtatatatatcctagagacaaagcttacacaaagttccagataccaaagaagacaggtgattatcgcatcatttccgccccaattaccagtctgaagattattcagcgcaaagtaaaccagatcctgaaatgcatctataagtcaaagccatctacctacggatttgtcacaggcaaaagcattgtgactaacgctaaacagcacctgcgacagcggcacgtgcttaacctcgacattaaagatttcttccccagcattaatttcgggagagtgcgcgggctgctcatggcagtcccgtacagctgtacagaagaagtggctactattttggcgcagatctgttgtcacgaaaatcagcttccgcaaggggcccctacatctcccataatttccaatatgatttgcgcaaagctggattctcagctgcagcgtctagcaaaaaagtatcagtgcatctataccaggtacgcagatgacataacttttagtactagcaggactaagtttccaggtcacctcgcctggttcagtcaggaagctgatgtgctgattctcggcaacgacctcaagaacatcattgagaataacggctttatcgtgaacgattctaaactcaggctgtataaccggtacaaacatcaggaggtcaccggaattaccgttaaccagaagctcaacgtgaagcggtcatacattcgtcagatccgagcaatgctgcacgcgtgggaaaagtatggcatcgtaaatgccgaggttgagttttggaataagtttgaccggaaatctagcttcaaaaaggaccgcaagtcattcaagagtatagtcaaaagcaaaatcgagttcattggtgccgtgaaagggaaggacgatactatttacttgaacttcctaaggtggttaaaacggctggcccctgagttggtatctgacaaaaaactaaaccaatacagcgacaaactgctggagaataacttccgcttaaaagccacaatctggaccgagggaaaaaccgatatcaagcaccttaagtccgccctgaagtggttgaaatatcaaggcaaagagttcaacgttgagctagaatttaaggaagatctggacgatcagaagcagggcgacggcgaactgctcaacgtctgtcagcaattctgcaaagagaagaagattatcccaatcatcgccgtgtttgacagagatgtccctaatataattccccgcgttcatgacgatactatggggtttaaagtgtggggtaacggggtgtactcatttgctcttcctatccccttgcataggaaggaaaacaaggatatctgcattgagttttactacacggacgaagagatccaaaagttagacgaagacggacgtagaatttacttatccagcgagtttaattccaaatcgggcaggcatataacctttgatgttaataccacggacaaaaataagctgaagcccaatcaactcaagatcatcgacaatgacgtgttcgacaagaacaataaaaatatcgccctgtcaaagaacaacttcgcagattatattttcgaacaaaagtccggattcaatgactttaatttccgggcttttgaggaggtcttcatcatcatagagaagatcataaagtaccatgcggagataatcaaagagtga

SEQ ID NO: 7918 - RNA, 1776 nt, unidentified
  source 1..1776: mol_type = other RNA; note = synthetic construct
atgggtacaattaatctatctttgactgaggaagaacttaaggaacgctttagtcaattaaagacgcgcaaggacattgccagcctgctggaaatatccgattaccagcttagataccacctctacatttaccccagagataaggcttataccacctttcagattccaaaaaagaccggggagtatagaaccatttcagtcccgcatacatcccttaaaattatccaacgtaagctgaaccaggtttttaagtgcgtttatcagccaaaacccagtacacaggggtttgtgaccggcaaaagcatcgtaacaaatgccaaacaacatttgaggcaacggtatgtgctgaacatcgacattaaggacttcttctcatctatcaacttcggacgcgtacgggggctgctgatggcatctccttacaactgtacagaggaaatcgccactgtcttagctcagatctgttgtcatgagaataagctgcctcagggcgctcccactagtcctattgtttccaatatgatctcagctaggctggatagtcaactgcagcggctggccaaaaagtaccactgtatctacaccagatatgccgacgacatcacattttcaacatcccgaccaaagtttccaggtcacctggcctggttctcggaagaggccgaaaagctcattataagcgacgacctcaaaaagacgatcgaagacaatggcttcatagtgaacgaatccaaaagtcgcctgtatagcaaacaccggcaccaggaggtgactggcataactgtgaacaagaagctcaatgtgaagcgcaaatatattagacagatcagggcaatgctacacgcctgggagaaatatgggttggacaacgcacaagccgagttttacaaccagttcgacaataaatcttcttacctcaaaaagcagaagagctttcagtacatcatcaagtcgaaaatcgaatttgtgggaacggttcgaggtaaggacgaccagatttacttaaactttctccggtggcttaagaggctggctccagaactggtcagcaacgagaaactgaatgtctataacttgcttgaaaaccagaacaaaagctccataaaagcgtctatctggactgaagggaagaccgatattaaacatctgaactccgcgctcaaatggctggaggatcagggccgtaaattcgacttcgagataaacttcaaggacgatctggaccctcagaagcaaggttctagccagctcttggagatgtgcaagcaactttgcaagaccaaacatcagcaaccgatgattgcgatcttcgatagagacgaacccaatataaccaaacaggtcaatgatgattcacttggattcaaaaactggaagaacggcatgttctcctttgctctgcccattcctcaacaccggcatggacagaacgatatttgcatcgagcattactataaagacaatgagatccagcgccaggacgtgaatggaaggaggctctttttgtcaaatgagttccacgatgaaacaggcagacacttcaaagacgatttaaattgcaccgaccgaaataagtacaagtacgatgggaaaatcattgatcaggatgtgtttaacaggaataatgagaaggtgactctgtccaagaacgattttgcagacaatatcttcaacaagaaggagaagtttgatgattttcagttcgaggcattcgaggaggtattcctcatcatagagaagatcgtgaaaagctatgccgaggaactacaggagtga

SEQ ID NO: 7919 - RNA, 1470 nt, unidentified
  source 1..1470: mol_type = other RNA; note = synthetic construct
atgggcacaacactgctttcactttcaaaggacgagctgaaagacctgttctacaaactcaaaactagagaagacatcgcagccctgctgcagatttccgactatcaattgcgctaccacttatacatatatcctcgaaaataccctttgaagaaagcgtacaccgcctttaagatttccaagaagagcggcgggtcccgttctatcctcgcacctaatacgtcgctgaagattatccagcagaaactgaaccaggtgctcaaaagtatttatcagcccaaaccgtccacacatgggtttgttgtcgagaaaagtattgtcaccaatgccaaacagcacctgcggcagagatacgtcctgaacttggatcttaaggattttttcccgactattaacttcggccgcgttcgtggactgctcatctcacccccctacggttgtactgacgaggtggccacagtattagctcaaatttgttgctacgagaatcagctcccccagggagcgccaacctctccaatcatttcaaacatgatttgcgccaagctggatagccagctgcagagactcagtaggagataccaatgcatttatacgaggtacgctgatgacatcacctttagtaccagcaggtcccgctttcctccacatttgacctggttttcgcgagaggccgagaaagcaatactgggagacgaactgaaggcgatcatcgaggaaaacggtttcctggttaatgagtccaaggtcagactgcaaagccgctacaaacggcaggaggtgacaggaatcaccgtgaacgaaaagctgaatatcaatcgcaagtatattcgacagatacgtgccgtgttgcatgcatgggagaaatatggcttggagaatactgaagctgaattttggaggaaggataaaaagcacaggtttcaggctaacagtgactctttcaggaaaatcatccgcggacggatcgatttcatcggcacagtccgagggaaagatgatcagatatacctcaattttctggggtggctcaagaagctagcccccgatctggtgagcgattctaagctcagcttagcatcaccaaagattttgcttgagaatcagaagaagaacagacaagaagcagtgctgtggactgagggcaagaccgacatcaaacaccttaagtctgctcttcggtggctagaaaaccggaagatctcttatgagttcaagctcaactttaaggacgatctagacgaacagaagcaaggtgacgaccagctgttaaaaatgtgcgagcagttctgtaaggaggccagaagcaaacctataattgctatcttcgatcgggacaaaccagactatgtgaggaaagctcatgatgaaactcagggcttcaagatctggggttccggggtgtatagcttcgccatacccataccttgtcaccgccaagacgtacgggatatctgcattgaactttga

SEQ ID NO: 7920 - RNA, 1806 nt, unidentified
  source 1..1806: mol_type = other RNA; note = synthetic construct
atgaatactacgtttctgaacctctctgaggaggaactccgggaggagttttgtcgactgaggactcgggaagatatcgctaaactttttcagatttcggattaccaactgagatatcacctgtatgtcaatccatctcagaaggcctacgtgatattcgagatcaaaaaaaagtcgggcgggattagatccatcagcgcccctaaaacagcactgaagattatccagcacaaaagcaatcagcttttccagagcgtgtataagcccaagccttccacacatggctttacctccaacaagtcaatcgtgacaaacgctaaacagcacctccgccagaggtatgtgctcaatttggacttgaaagactttttcccaagcatcaacttcgggcgggtgcgtgggctgttgatggcgaatccatacaattgcactgaagaggtcgcaacagtgtttgcccaaatttgctgtcacaaccagcagctcccccaaggagccccctctagtcctaccatcagtaatatgatttgtgctaagctggatacccaactacaacgtcttgcgaagaaatatcagtgcatttactctaggtacgccgatgacatcaccttctccacttcaagatcaagatttcctagtcacttagcctggttctctcgcgattctgaaaaattgaacatcggctctgaacttaaagatatcattgagggtaacggatttcagattaacgagtcaaaggtaagactgcagaaccgctacaaccaccaggaggttaccggaattacggtgaacgagaaactgaatatcaagcggaagtatatcaggcagatccgtgctgtgctgcatgcatgggaaaagtatggtcttgagaacgccgagatgattttctggcagaaatacgaaaagcatcggcatacagaatttaaccctgactcatttcgacaggtaattcgcgggaggattgagtatgttggcagcgttcggggaaaggacgaccacttgtacctgaagctgctgcgatggctctctaagctcgcaccagatctagtcaacaaaaccaagtttgacatcgccaatattaacgagagtagtgaagagcaaaaggatctgccccaagtgattatatggaccgagggcaaaacggacatcaaacacctgagatccgcgcatagatggctgcagaataataaaactacccgatacaagatagagatcaaattcaaagacgacctcgatgaccaaaagcagggttccccggaactgttaaagatgtgtgagcagttctgcaaagagaaaaggaacaaccccattatagccatatttgatagggatgaacctgatctaatccggaaagttcacaatgagactaccggctttaaatcctggaataatggggtatacagcttcgcaatcccaataccccagcacagaaaagacaatcatagcatttgcattgagttctactacaaggacgaagagatcaagcggcatgataacgacggccgaaggttattcctcagcaatgaatttaatccgatctcaggacgccacattatagaccgcgatctggtgacacaggaaaccaagaagatcaagaagaacgagatcaagattatagacagcaatgtcttcgacagcaatgacacaaatgtggctttgtcaaaggataatttcgccaactatatcttacaggagagtgctaacttcaatgatttcgacttcaacccatttcttgaaatattcgaagtcatcaaccgcatctccaagcaccatgaagagaacatcaagtccgaacacattactcattga

SEQ ID NO: 7921 - RNA, 1758 nt, unidentified
  source 1..1758: mol_type = other RNA; note = synthetic construct
atggagtccaatgacggcattaaacagctgttgggcggactggaaagtcgacaagacgtggccaccctgctggacgtgacagaccgccagctgaggtacctactgtactcaccacgttataagaaatacgagaagttcgagatcaagaagaagatgggcggagtaaggctgatttattctccttcccatgcattgaagaacctccagagacgcctcaacgccattctgcagcaggtgtaccagccaaagccctctacttacggttttgtgaaagggaaagggatcgtgaaaaacgctgaacagcacctaaggcagaagtgtgtgctgaatctggacctcaaggacttcttctctagtatcaattttgggagggtgcaggggctgctgaaggcagctccgtataatctcctccacgaggtcgctacagtcctggctcagatatgctgccatgaattcgaggtggacgggcagctgaatagaagactcccacaaggcgcgcccacgtctcctgttatttctaatatgatttacgcgcccttagatagccagttgcaacgcttggccaaaagacacaaatgcatctacacccgatatgcagatgacattacctttagcactagcaaatcaaagttcccctcctctctcgccttttactccgtgggcgatgagaagtggttgctaggcaaggagctcctcgaggtcgttgagggtaatggatttagtgtcaacgagaaaaaaacaaggctggccaccaagtaccagcatcaggaggtgacagggatcacggtaaaccaagatctgaatgtcaaacgggattacgtgagagagatacgctctatgttatacgtgtggaggactcacggtcttgaaaaagctgaagctaccttcctcgaaaagtttgacaagaagcaccgtcttaactctattacaccctctttccggtccgtagtcaaaggcaagattgaatttctgggaagtgtgaagggaaagagcgaccccatttatctgaaatttaccgacgaactcagggtgctggctcctgaacttgtcagcatagataaattactgaactcccctattgtaagagcccaaattatgactgaaggcaaaaccgatatctatcacttgagagccgcgtttagcaatctgcaaaagaaaggcctgttcctatcactagcaatcgatttcgtagatctgccacctgaaaagcagggagattccaaccttgagaaacactgcgagagcctctgtatagttactccccagtttccagttattgccatctttgaccgcgacaacagcgctatcttaaagaaggttcatgacgacagtaaaggctttaagagctgggggaacggtgtttattccttcgcccttcctgtgccgtcccatcgccatgaggatccagaggtctgtatcgagctttattactcgaatgaagaagtgactcgattgaacttacaggatcggcggctttttctgaattcggagttcagcaaaaaatcctatcggcatagcgaaaacaagatactgtcaaccacaaagttcaacgaagtgaagaataacagccttaaaatcatcgatagtgaggtccacgatgacgcagataacaacgttgccttgtccaagaacgacttcgccaagtgtatcctcaattcaaatccgggattcgacaattttgacttcagtgaattctcagcaatcttcgaggtcatcgagaaaatacttcagcggcacaatctggattcagcagtgtga

SEQ ID NO: 7922 - RNA, 1839 nt, unidentified
  source 1..1839: mol_type = other RNA; note = synthetic construct
atgggaaataagctggaatacaacgcaaagtacctcgcatttctttttttgctgacagatatggggactacttccctggatctgccgcaagaagagctgaagaaacacttcgagcagcttaaaacccgacaggatgtcgcgcgacttctccaagtgtcggactaccagctgcgttaccacctttatatccatcctcgcgacaaggcctataccacctttaaaattcccaagaaatcagggggacatagattaattacgacaccccagacgtctttgaagattatacagcacaaactgaaccaggtactgtcctctgtgtaccaggtgaagcctagtgtgcatgggtttgcaatccagaaaagcatcgttacaaacgcaaagatccatttgaaacagcgatacatactcaacctggaagatcaggactttttcccaagcatcaactttggtcgtgtacgtggcctattcatcgccaagccctataattgtacacaggaagtcgccaccatcctggctcaaatttgttgctacaataaccagctaccccaaggcgctccaacctctcccattatctcaaacatgatatgtgccagactggactcccagctccaaaagctggccaaaaaatataggtgcatatataccaggtacgccgacgacatcactttttctacttccaggttcaaatttcctcaccggctggcctatttttcccaggatagcgagacattcgtgctcgccgacgaattgattactgttatcaaggacaatggtttttctgttaatctatccaagctgaggctccagaataggtatcaaagacaggaggtgaccggcataatcgtcaacgaaaagttaaatgtcaagcgcaaatacattcgccaagttagagcgattttgcatgcttggaaaaaatacggattagagaatgccgaagctgagttctataaaggattcaacgagaacaacaataacatgaaatcaagggactgctttcgcaagatggtgcaaggcaaaatcaattttattggtttagtgcgcggagataccgaccacatttaccttaagttccttaagcagcttaaggttctcgtccccgacctggctgacgattccaagatcaacttcataacaagcaagttatctgagatcaaatcttcaaacaacctgcacaaggccataatttggaccgaaggcaaaactgatatcaaacatttgaaggtggcatggaagtggctaatcaacaaaaaaatagtcgactacttcgatctggattacaaggatgacctggagccagataagcaggggtcaagtcaactgtttgatgtgtgcaagcagttctgcaaggagaaacggaatattccactgattgctatcttcgacagagacgagcccaatattatcaagaagattcacgacgatagtcaggggtttaaggactgggataatggggtctatagcttcgctctccctataccaaagcaccgccaggatgtgaaggaaatttgtatcgagcactactatcaggattccgaaattaaacggaccgacaaaaaaaacaagcggctctttctgagcaatgaattccatcgggagtcgggcagacatttgagcaagcctcagctcacaacaactgacaataagttcaagagtaaccagctgaagatcatcgatggcaaagtgttcgatagcgacaataacaacgtagccctcccgaaagacgatttcgcaacgtatatctatgacaaagaggagggtttcaatgactttgatttcaccgcgtttaaagaggtgttcgagatcatcgaaaagattctgaatcggcactacagtcagtga

SEQ ID NO: 7923 - RNA, 1746 nt, unidentified
  source 1..1746: mol_type = other RNA; note = synthetic construct
atgagcacggagctgttcgcttcgaacgaggtccttatcgctgcattcttccagctaaaaacccgccacgacattgctaaacttctggaggtgactgaactccagctgaactactatctttacattgtccctagagacaagcgatataagcggttcgagatacccaaaaaacacggaggttcacgggaaatctatgcacccgcaactgccctgaagatcattcagcagaaactcaatcaggtcctccagtctgtgtataaggtgaagccctcagcccatggatttgtccagaagaagtccatcctctccaatgccatcccacacgtgagcaagagatacgtccttaatctggacctgaaagacttctttccgagtataaacttcggaagggtacggggattatttatggcgccaccgtatctacggaataacgaggtcgctaccaccctagcccaaatttgctgctttaatggctatctgccgcagggggctcctacaagccctatcgtaagtaacatgatttgttccaagctggattcacagttgcagaagttagcaaaaaagcatcgttccacctatacaaggtacgccgatgacataaccttttccacatccaggcccaaattcccatctgggctggcttactttctggaagaaacgggcaagttggagatcggcgatgagcttaaagcgctcattttggagaatgggttcgagatcaatgagaggaagaatcggctccagccttactcaaaaagacaggaagttactgggctgactgtgaatgtctttcccaacgtgcgccgagactacgtgagagaaataagaggtatgttacatgcctggcagcggtacggctacgatgcggctgagatgacatatagggaaaaatatgctggcaagcacccagaaagcaagcgagagcagatctcttttaaacgcgtcgtgcaaggaaaactgaactttctcaaaatggtgaaaggcgagaacaaccgcgtttatgtgaatctcgccaaatggttttggcaactggccccagagttcgcccagtctgaggtgttgacccctctccaccttcccaagccaattattttcaccgagggtaaaacagactggaagcatttgaaggttgctttcactagtctgaagaaaatggggatgtttaccgaattggatgtgcaatttcatgaatttggagatgacgtgcagatgggccacggggaactgttaaagatgtgtaaggcctactgcaagagagaaaaccggcagcctaacatcttcatctttgatcgcgacgtcccagcagtggtgaacgaagttatggaaaaagacaaagactacaagaactgggacaataatgttttcagtttggccgtacccattcctgcccacagaacaaacactacagatgtttgtattgagctgtattaccaggataaggatattaagcgcaaagatggcgatgggcgtaggctgtacctgagcgatgagttcgacagcaacaataactcacacaagcaacaaaatgacgtgtacactctgtctaacaagacccgacgcctggtgggcgtaaccattgttgacagtcaggttttcaatttcataacgaaggaaagcgtcgcactttctaaagactccttcgcagagctgatcgccaacgacgatcccaatttccataacgtggactttagcgagtttggtaagatcttcgatgtgatcgtaacaatcctcagggagcaccaatga

SEQ ID NO: 7924 - RNA, 1731 nt, unidentified
  source 1..1731: mol_type = other RNA; note = synthetic construct
atgtcgaccgaactctccgcctccaaagatgagctacgagcgactttcttccagctgcaaactcgacaggaaatcgctgaaatgctcgacattcctgagaagcaactcaactactatctgtacattttgcctgagcacagaaggtataagaggtttgagatctctaagaagcggggaggcaaccgggaaatcttcgcccctgcgacggctctcaaggtcatacagcaaaagctgaaccaggttctccagtctgtctatgaggtgaagcctagcgcacacggcttcgtaccagagaaatcaatcgtttccaatgcacagccacacgcacgtaaacggtatgtcctgaacttagaccttaaggacttttttcccagtattaatttcggacgcgtcaggggtttgttcatgggctatccctatcacagaaaccatgaggtggctacaactcttgcccagatttgctgcttcaaatcttatctgccccagggcgcgcctacgagtccaatcgtgtcaaatatgttgtgtgctaaactagacgctcaattacagcgtcttgctaagaaataccggagcacctatacaaggtacgcagacgatattacattctccacaagcagaccaaattttcccagcgccctggcctacttcagtgacgatactggcaaaatcgaaattggagacgagctgaagagtataattcaggagaacgggttcaagattcatgagcggaagtctcggctgcagcccaacagccgaaggcaggaagtgaccggactaacagttaatgtatttccgaacgtaaagcgtgatttcgtccgggagatccgcggaatgttgaacgcctgggggaaatacgggtacgaggccgctgaacagatttacaggcagaagtacgccggcaaacatccagaaaatgaacgcgagcatctgtcctttaagagagttgtgcagggcaagctgaactttcttaaaatggtgaagggggagaataacagagtgtacctgaacctgattaagtggttttggaaattggcgcctgaactggcaaaacccgaagtcatcgcacccctgcccctggtcaagcccatggtgtataccgaaggaaagacggattggaaacacctgaaaacagccttttatgcactcaagaagatgggtctgtttgagcagctcgatatccagttcttggagtacggggacgagactccaatgggcgattcagaactgttaaagacatgtcaagggggttctaaaatgctgcacgagactcctcaaatctttatcttcgacagggataaaccagacgtggtgaagcatgtgaccgacaccgacaaaccgtacaaagtctggggtaataatgtgtttagccttgctataccgatcccagcccaccgcgttgacatcaacgatgtgtgcatcgagttttactaccaagacaaagatataagacgatcggatgaaaacggacgcaggttatatctgagtgacgaattcgattccaagaacggcaagcacaattcactcaacgtctacaccagaagcgagaaaatacgcaagatcaccatcatagattcacaggtgtttgattttgccggtgccagcgttgccctctccaaggacatgttcgcagaactcattgccaatgggaatcctcagttccagaatgtggatttttccgagttcggcaaaattttcgacgtgatcgtagctattcttagagagaattcttga

SEQ ID NO: 7925 - RNA, 1749 nt, unidentified
  source 1..1749: mol_type = other RNA; note = synthetic construct
atgaccctggtcctcagcgctaaaccggagaacctccgcaagggtttcctgtccctgcagagtgccaaagacatcgcgggcttgttggagattgacctacagctgctctattatcacctttacatacgtccagaatcttctaggtacacttcatttgagatccctaaacgcagtggcggaagccgaagcatcttggctcccattagcgcgctcaaaattatccaacggaagctcaaccaggtgctcctgtccgtctactccgtgaagccaccagtgcactcttttgttctgggaaaatccatcgtgacaaatgcatccgtgcacgtcaaacgcaattacgttttaaacgtagacctgctggacttcttcccaagcattaattttgggcgagttcgaggcctgttcatgggcaaaccctactgtcttaatcccaaggttgcgacaattttggcacagatctgctgctttaagggcaatttgcctcagggagctccaacatcacctatcgtgagtaacatgatatgcgctagaatggattctcatttaacccagctggccaagaagaatcggagtgactatacaaggtacgcagacgacattacgtttagcaccaacaagggggtatttccctctgattttgccgtcataaacgaattagagcagctggaacttgggaaggagctggtcagaatcatatccgataacggcttccagatcaatcatactaaaaccagactccgtagtcgcaagcagcggcaggaagttaccggcgtcacagtgaacaagtttaccaacgtgcgtaggagctatcttagatctattagggccatgcttcacgcctgggagaagtacgatctggagaaggcccaggagaagttctggcatgattatgataaaggcaaataccggtccccatacaaatcaaaaccttcattcaagcgcgtggtgagaggaaagattgaatatctcggtatgatcaggggcaaggacgaccctctgtaccagcggctactggggcaattgcgagtgctggctcccgagctggcaaaaaaggctaagaagattcaacctgtgtatctgcagggctcacaagccattgtgtatactgagggaaaaactgacatcctgatattagagactgcatggaaaaagctgtatcccgacaagctgataccttttatcctcaagccttgcgactttaacccggcagacaaagcacacgggacgggaggtgcctctttcttgtccaattttataaagtacgtctcccccgatagtcccaatgtgattatcggaattttcgacagagatcatgatggcattagggcctacgagggtattggggaaagcttcccagagaaaaagggtctagggtcaaagctggctaaacacggcaaggccggagccatccttctccccatcccaaaaggcaaggaaaagtatgctaagtataagaacctctgtatcgaattctacttctcggaaaaaacactaaaccggaaaaacgagggcggtaaagggttagactttcaatttgggacggaggccatccatgtagccggaaaaccagcatcgggaagcaagcccagcgctattagagaaacccgcaccatcatcagggggaaagatgtcttctctaatgatattgtacctcagctcccgacatcagcgttccggaatttcaaacttctgttcgatgtgatcatcgctacccttgaaaagtgtaaaactaaggttgcctcccactga

SEQ ID NO: 7926 - RNA, 1569 nt, unidentified
  source 1..1569: mol_type = other RNA; note = synthetic construct
atgtataagatagaactgtcagctaatcccgaaaagctgaaggctagattcctggctctcaagaagcctgaagatatagccgagctgttagaggttagttacaaagactttgtgtactggatttataggactccagagaaataccggtatgtgtctttcactatccctaaaaagcatggcaccccacggtatatcgacgccccaaacaacaacatcaaaatcctgcagcagaaactcaactacatcttgcagattgttttctctccaaagtattgcgtacatgggttcaccaacgggaggtcagtcgtgacaaacgccagaaaacatgtcggacgacgttacgtccttaacatcgatctaaaggacttctttccatccattcattttggccgagtaagaggaatgtttatgggcaaaccctataatctccccagcaaagtggcaacgtttctggctcacctctgttgttataaaaaagtgctgcctcaaggcgcaccaacaagccctgtgatctccaatatgatttgcgcgaagatggattctgagttgcagagacttgctgccagcaaccgttgcagctatacaaggtatgccgacgacatctctttcagcaccagcaaacactcctttccatccgcccttgccactatcaacgatctggggcaggtggaagtggggaaggaactggttaggattatcactgaaaacgggtttcaaatacaccccgaaaagatatggttacggcggaaggaccgcaggcaggaggtaactggtatcatcgtcaatgagcgcaccaatctaccccgcaagttcaccaacaatattagggcaatgttgcacgcatgggaaaagtacggtctggaaagtgcccagaagcactttgaagaaaagttcgataaaaagcacagagcgccctggaaaaagaagcctaggttccaagatgtcctgaaaggtaagattgagtacctgggcatggtcaagggtaaagagagctccacatacctgcgttttttagaccagttaggccggctcgctccgaagcttacaggaggacgcggcacgcctcaagatctcctgttccgcagataccaggcgctcttgaaatctgacgatccccagggaagaggctacctgctgcagtcactgctgcatgatgtgttcacttttctgaacgttacgatcgagaagagcttcaccagaaatcggaatggcgagcaaattgatggagcctttatttttgaggggtggcattacattgtggagtgtcggtggcgcgagaaagtgagtgacatccgacaggttgatgggctattgggccaggtcctgcgatccgggaaacagaccatgggagtgttcttcagtattaatggatggtcccaaaatgtgccgacccttttgaaacagaatccctcaaagagtatcattttgatgcacggtgacgacttccacgcccttctttctcagaagatatccctagataagctcctcaagggcaaaatttcggagctcaacctgaaatcggagccttttatctcagcagaagagataatcaagaaagacgacacatga

SEQ ID NO: 7927 - RNA, 1452 nt, unidentified
  source 1..1452: mol_type = other RNA; note = synthetic construct
atgtcgctgtggctcgctgatccccctcatgtgctgaaagcccggttccacgcactgctcaggccatttgacattgccgcactgctcgacgtgcctttcggagactttttttactggacttaccgtgtcccaccaagcaggcggtacactactttttacatcgaaaagcatagtggcgcccctcgcagaatcgatgctcccgaattgaacattaaaatcctgcagcagaagctgaatcaggtgttgcgcgctgtgtacgtgccaaagcgctgcgtgcatgggtttgtgccgggcagatcagtgttaaccaacgcccaagcgcatgccggcagacgtcacgtcttcaatatagacctcagagacttttttcccagcataaatttcggccgggttagaggcatgttcatgggtaaaccttatcggctcccgccaaaagtagcaacggtgctggctaatctatgttgtttcgatcgccggcttccacaaggggcacccaccagtccagtggttagcaacatgatctgcgctcgcatggactctcagattttgggactggcgtatagacacaggtgcacatacacccgctatgcggacgatatgaccttctccacatctagacgacctttccccgctgaaatggccacacttaatgacctgggccaagtggccgttggagctgaactgcggggcatcattgagggcaatgggttccgggtccatccagagaaaatctggctgaggggtagggatcgaagacaggaggtaaccggactgacagtgaacgtagagccaaacgtccgccgacggtatgtgaaccagatccgtgccatgctccacgctgccggtaagtatggcctgccatctgcacagtccgagcgagagcagaggtacgaccacaaacatcgcgcaccctggaatgaccccccttcatttgagcgggcgctgcagggaaagattgaatatttggggatggtcagggggcacgcctgtcccaagtaccttaagatgctggatgatcttgggaggctggccccgcacttattcataataagaggaacccccagggaacgcttgctccggaggtaccgggctcttctaacatctccaaaccatcaggccagggggtatcagttgcaggcactcttcgaggaaggagcaagacctggtagagccggccgcggtggaattagtgccactcctgatcgtggcggtatctgccccggaacgccatcattacgggggcgcacacttgcccctaggtttcctgccagccatcctaccactgctaggggctccgagggccatgttcaggctccctacgaatcccaccctcgaccgagaatccaacccaggcacgggccggttgacgagcaagtagagcgtcacgagaagagagcagttcaccgacaccccgcgcgagatgaaattgtcgtccccgtgcaccatagctga

SEQ ID NO: 7928 - RNA, 1536 nt, unidentified
  source 1..1536: mol_type = other RNA; note = synthetic construct
atgtctgacggacctccaagcaagccactacctctccccctctcccctacactcgcgaaaagcgatgccgacattaaagcagcctttcgggtgttacagtctgtgacagatgtggccgacctgctggaggtacgggagacacagctgacatacgcaatttggcgcacaccggaggagaagaggtacagcacctggagtataagaaagaggtccggcggcacccgcactattgatgctcccaggaagacccacaagatcctgcagcgcaagctggcttatgtcttatccctggtggcccagagaaggagcgttgctcatggattcagccccggtaagagtatcgtgaccaacgccgccgcacatgccaggtgtcgttgggtgttcaacgccgacctcaaggagttctttccaactatcaactttggccgggtacgtggaatgctgatggggaaaccctaccgggtgggggaaagagcagcaacggcaatcgcacagctgtgttgccataaaaggttgcttcctcaaggggcccccacctcacccgtaatttccaatatggtctgtgctcggttggatggagagctgcgaagactggcagagcactacgggtgcaattatactcggtacgccgacgatatcacgttctccacgaacaaaaagacatttccagaagaactggcgactcttataggcgaaggaaccaaggctgccgtgggctcagccctgtctcgagtcattgagagcaatggattccaggtgaatccagacaaggtccggctccaaggcaaacgcactcgccaggaggttactggcttggtggtgaaccgcaggcctaatgtcaggcgtgcattcgttcgacaaatcagagctatgctgcacgcctgggaacggtatggctacgacgccgcccagaaggagttcctggataagtatgatagcaaacatcggccggacggggcctcaggtagaacctacgaacgagtcattaggggcaaacttgccttcctcaagcaggtcagagggaaggacgacaaccgatacctagcaatgcgtcgcagattgagaagattacttggtgaagtggacgctggcgtcggaaggggtgtcgaaatggagtacgatgtctttatttgccacgcatctgaggagaagacaacagtggtggttcctttggctaaagctttaaatgacgctggcatacgcgtgtggctcgatgaggagaagataggatggggggactcagtaaccaaagaaatcaatgacggtctggccaaatccaagtttgttgtagtggtgctgtcggcggcatttatgaaaaagaaatggcctgctaaggaaatgaacgcggttctcaacaaggaaatcgcctctgacattacctgcgctctcccactgatcgtgggcgattcgagtgataaaaagatcatccttgagacttatcccttgctagctgataaacactataaagaatggtccccgtctgatatcgggaccattgttggggcgctgaaagctatgcttagtcgctatgcctga

SEQ ID NO: 7929 - RNA, 1635 nt, unidentified
  source 1..1635: mol_type = other RNA; note = synthetic construct
atgcaggtgcggttgtctcagtcctcagcagacgagctgagaaggcgatttttcgcatgccggacagccagagatgttgcccgtctattggaagtcccatattcggtactgcattatcacgcatgcaaatccccagtgtccatccgctacgaaacctttacggtgccgaagagtacagggggctcacggcaaatccttgccccagccaccgccctcaagttgctccagcgcaagctgaatgtcgtgctgcaggctgtgtacaggccaagaccgagcgcacacggctttctgcccgctagatctattctgacaaatgcccgctgccacagcggacggtcatacgttctcaacgtcgatctggaggacttctttgggagcataaacttcggcagggtgagggggatgtttatggctcgtccatacaacctcggcgagggagctgccaccgtcatagcccaactttgttgtcatctgaatagactcccccagggagctccaaccagtccaatcgtggcaaatatgatatgcgcccggcttgatggcgagctgcagaggttagcgattcggcaccgatgtacatatactagatatgccgacgatctcagcttctcctgtcacagccatacattccctgaagccctcgctacctactctcctgggacaggaacctcggccagagttgggcccgagcttagccgagtggtgcaccagaatggcttccgtcctaaccccagcaaagtcaggctacaaaggccctctgagaggcaggaggtaaccgggctgattgtcaaccgggatcccaatgtacaccgcacgttcgtccgccaagtgcgcgcaatgctgcacgcgtggcgaaaattcggtctggaagctgccgaggctgagtttattgccaagtatgggtggagacacagagcaccggaacgggcgactccaagatttaggcgagtagtgaagggcaaactggactttctgcgcatgatcaggggaaggtatgaccccctgtaccgcaaattgttgcgcgaatactgcaccctttccgatgagcacttcgaagaagcccccaccgcccctactgtagaggccttgattgcacgggctgtttgggtcttggaatgcgatatctgtctccgccagggtacggctttttacctgagaggcaacggattagtgtcctgtgaccatgttgtttgcgaccacatccgggctttccggccagatgcacctggaactaagttcaatatcgacattgtcggacgacattctgtggttgacttagctgttctgcgactgagggatgccgacttttcagacgatggattacgcgctggtacagcgagtgctctccagaccggggacgaactaactgtttggggctttcccaatttccgtcttggggatactgtgcaggtgcatcctggcagggtggcgggattccgtcaggtgtctggcatcagacggattctggtgtccgcacctatagtgcggggggcaagtggtggtcctgtgctcaacaggagaaacgaggtgatcggcgtggccgtaactggtgcagagacaatggaaaccgcccatgagacagaggaccatggcgtccttcctatcaacgccctggagcacgtccccctgcgctaa

SEQ ID NO: 7930 - RNA, 1614 nt, unidentified
  source 1..1614: mol_type = other RNA; note = synthetic construct
atggagataaaactgagagcggatgacagtacactcatcgaaaagttcattgccctccaaagcagaaaagaggttgcggaccttctggagattgatgtgaagaccctgatctactttttgtacaggagaaaggacaaggacaactataaaatcttctacctgaggaagcgaagtggcaaagaacgaactatttgcgcaccgattaactccctgaagattatccagcgaaagctgaactacatcctttccctgatctacaaacccaaaccttctgcccatggattcattgtggaacggtctatcttaactaatgcccaggcccaccttaagaataataatatgctcaacgtcgacattctggacttctttccaaacatcaatttcggtagagtaaggggaatgtttatggcaaacccttacaatatccctccggaacccgccactgtattggctcagatatgctcttgtaacaaccagcttccccagggggcgcctacttctccaatcatttctaacatgatttgcgcacaattagattcccagttacagaaactggctaagaagcattcatgtacatatacgcgctatggggatgacctctcgttttcgacatggcaatacaagtttcctaaggaactgggatacaaaacaaaaaccggcgaggtcatcgtgggaatttccctcgagaagataattaggcagaatggcttcaaacacaacaaagataaagtgaccttgaagagccggaaatcacgcctgtcagtgaccggtctgattgtgaacgaaatcccaaacgtgcccagaaagttcgtgcggcaaattcgggccatgctacactcttgggagaaggatgggctcatcaaagctgagcagatccacctcaataaatatcgctataaacagaagaacccgaaggcatttcaacctaaattttcaaacatcgtccggggaaagataaactacataaggatgatcaagggagaagagaatccagtctatcagaagctggccagcaaattcaatgatctcaacgggggtggttttcccaagtattaccacaatttgcgcgaggaactagaagccgcagtgtggatcatagagggcgaaggcggaaccaaccagggcacaggcttcatgctagaaggatttggaatgattacttgcgctcatgttctgaccaagtccatggaggctttccggtgcaatgactatgggaacaagttccccgtggagatcatttcctatgataacgagaatgatgtagccgtcctgaagataaagggcaatgagaattatcattacctccgtgtgggcgattccgacgagatcgacgttgggagtgagatcaaattgagtgggtttcctaactacaacattggggatagcatatatatcgacgatggcaaagtcacgttgtgtaggaaaagcctgggtcgtaccagataccttataagcgctcgcattgttaagggtaacagcggcgggccagtccttaataagaataatgaggttattggcatcgctgcaaagggagccccatgtttcgaagacaagaatatggacgagaaatttgaggtgattccaatcacaatcatcaatcccgaacccctgtga

SEQ ID NO: 7931 - RNA, 1656 nt, unidentified
  source 1..1656: mol_type = other RNA; note = synthetic construct
atgagaaataggttggacattcaactaagaaagaacattgatgaggccgtcggggagtttcaaagcctttccagtccgcacgatgtggcggccctgctagaaattccctataaggtgttgaatttccacttatacgtcgcccacccaacccgtagatacaagacatttaccgtgcataagaaatctggtggggttagagagatttgcgcacctgtgactgctattaagatcatacagcagaaactcaactacatcctgcagaacctgtacaagaccatatataagaagaagttcagtgttcacggtttcatatatgggaaatcagtgagaaccaatgcgcagagccacacgcggaaggactacgtgttcaatatcgacctgctggatttctttcccagcatcaatttcgggcgggtgaggggcatgtttatggcaaacccatataggctgcctcccaaggtagccacggtcctcgcccagatttgctgttttaacaatcagcttccccaaggggctcccaccagccctatcatctctaatatgatctgtgcgaggatggacgacgaactgtatcgactggctaaacggttcgattgtaaatacacacgctacgttgacgacatgactttctcaactaaccggcctaacttccccgccgaactcgcaaacgtcacccgtttggagagtggctggcgactgaaagccgacgtaggaaaagaactcaacaaaatcatagaggagaataagttctcagtcaacacgtccaaagtttggattcagcaccgcaactgccgacagaaagtgactggcttaatagtaaacgagttcccaaacgtgtccagaaagtatacaaatcagattagggctatgctgcacgattgggataaacatggcctcatagcagccgaaaaccggtttgtgaatgactacgataagaaaaagcgatggccatacgagccaggtatcctttttaaaaacgtcgtgaaaggaaagatcaactttttgaagatggtccggggcgaccgcaatcctacataccagaagttctccgagaagttggcctccctcgatccggatttttctttcatcagaattgttagggaagctgacagcgacaatctgcagcaggccgtatttgtgcttgaatcaccaagagggcaaggcaccgcttttatgctgcgtggcatcggcctagtgactagtgcacataacttaaaaaacgacaagctggacacatatctgtacaagaccgatgaaccagcagacaaacagcggctgaaggtcaagcatatcaatacaaacctcgactttgctatcattgaggttgctcaaggttgggcaaaagcatctctggttaggggagattcgactattcttaagaccagggacacagtgaaggtgatcggatttcccaattatgccaaaggaaagagcattcatattcacgacggaaaaattaccggccgcggacgctggttcaaagtcaagactctcaatgtgagcgctcgcatcatatatgggaactccggaggcccggtgctgaatgataagaatgaggtcgtgggtatcgcgttctacggcgcccctgatcctgagaaagccgatcgcattgaatctggggtaatccccatcgagatcttggataaactcatgtga

SEQ ID NO: 7932 - RNA, 1743 nt, unidentified
  source 1..1743: mol_type = other RNA; note = synthetic construct
atgtcgattagcctcgacgcaagtgaagaggagctgcagaatgacttccataacctggaggatttggaggatgtggctgatcttttggatgtggagtcctcgaaccttatttatcatataagagagagcccagaggagggacgatataaaaccttcaccctggacaagtcaggtggcggggagcgtgagatcagtgcacccgtgagcgcactcaaaatcatacagcagaagttaaaccagattttacaggccgtctacacgccgaaagccgctgtgcacagttttctgcccgacaggaatattcggacaaacgcagaacagcatgtcaaacagagatttgttttttgcgtcgacctcaaggacttcttccacgagattaattatggaagagtctggggccttttgcaggccgtgccttacgaactgcctgaggatgtcgcgaccgtgctggcgcaaatctgctgtcataacaatagattgccgcaaggggccccaactagccccatagtgtcaaatatgctctgtgcacagctggactctgaactgctgcgcctcgcggaatccaataaatgtatctataccaggtatgccgatgatctaacctttagcacatccatgcgccaattcccagacgaactagccaccggaggggaggatggaaacgtgaaggtggggaaggagctgagagaggtagttgataagaatggtttcgaactgaacgaggacaaaactcggctacaacacgaagattacagacagatggttaccggcctgatcgtgaacgaaaaggtaaacgtgccacgagaattcgttcgagagattcgcgccatgctgcacgcatggaaagcccacggctacgaagctgctgaggaagaattcctgagggaatatgacacgaagaatcggaagtccgagaaagaggagcctgtgttctccagggtgatcagagggaagcttgaatttctgtcaatggtaaggggcaaggatgacaagatctacaagaaatatctgacagagtacagtaggttgtctaacacgcctattaatatcgacaatcaggaggagcctgaaaacgacacatctaaactcatcgtgtacacagaaggcaaaacagactggaaacacctaaagcgggccattcgcgaactggctgtcaaccagtccagtgaacttcccgatctcgagttcaacgaaactgagtccgatcgcggcgacgatgaactccttgagaaatgccgacatactagcgagtcagaaggccagcaccagcacgcacacgttttcctgtttgaccgcgatcagccaaatcaggtccaggaagttactgaggatgaccaaagttttcgttcatgggggaataacgtgttttctgccgctatccccccacccccccatagagaggatgtcaacataagcatcgagttgtactacgaagatgacgaccttctcaaaagggatggaaactctcggcggatatttttaggtcaagaattccacaagacctcaggaaagcataaagaagaggccaagatcaattgctctctgctgaacaagactggtgacgaaaaccgtattattgacgatcgggtgttcaatgaggagaatgagaacatctccttaagcaagaatgacttcgctgagtacattttgaacgaggaacctccttttgacgatattaattttaagcccttcgctaggatctttgacctgctcagcgaaatcgaggagcgcgtagactcttga

SEQ ID NO: 7933 - RNA, 1590 nt, unidentified
  source 1..1590: mol_type = other RNA; note = synthetic construct
atgatcacagaactgaccgccccggatatagtgctgactgacaagttttttgccctggcaagccccgaggacgttgcagatttactggaactgaaatcctatgcctttcttcagcacttgatttttatattgccttccagcaagcgatataaggaatttgtcatccctaaacgtcgtggcgggaagagatacctgctcgaaccttcacccaaccttaagatcgtgcagaaaaagctctcttacgtgcttcagctggtttacaaaccaaaacggtcagtgcacgggtacgtcaacggtagatcgattgtgactaatgctattcaacacgtgggacgacgatatctcctgaacattgacctggaggacttcttcccgagcatccactttggaagggtgcggggaatgttcatgtcatatccatacaacttcaacggccgtgttgcaacaacactggcacagatttgttccttgcggaattgcctaccccagggggcgccaacttctcccatcataagtaacatggtgtgcgccaaactagactcagagttacagaaattagccaaacaacatcgatgctactacactcgctatgccgacgacctgactttctccacctccatcaaacagttcccaacagccctggccgtatctattgtggaggggaaacgcctcagggtggaggctggcaacgagctgtccgaggtgatcaataggaacggcttcactatcaacgttaagaaaattagactccagaagcattctcagcggcaggaggtaaccaaccttaccaccaacgaatttgtcaatgtcaatcggaagttcattagacaaattcgcgcaatgcttcacgcctggcgcaaattcggatatgtggctgccgagattgagttcaggaacgaatacaataaaaagccacctaacaagccatacaagaaacagcctagcttcaagaatgtcatcaaaggcaagatcgagtttgtacagatggtcaggggtaagaatgatcggatcttcattatgctcaataatcaagcagcccagttggaacgcatccagaatatcgagccctatcaattccaaatactggaggatgaagaccatgagattgtaagcctgatagcgtctggagaaaccgagtgggtggaatttaaggaaggggcttgtttagaccctcacacaggcgagaacaacaagaagaacatgtctcataagatactcagagctgttgcatccctcattaacagtaaggttgagggcagggtgctgattggaatcaaggacaatggtgctatcacgggcgtcgagagagaatatgctctggctgatcccagcaaggtcaattgggatgggtacgaattgtacctgacaaattttctcaacgattcgctatcaatcgagaatgcgcataacttctttaagatcagtagacacgccattaatgataagattgtgtgctgtatcagcacgaggatggctgataagcccgtgttggtccacgagaaactttatatacgcagtggcaatcagagcaaagaaatcaaaggtaccgaaaaagtggactttatcctgaagtgggccacctccagttga

SEQ ID NO: 7934 - RNA, 1446 nt, unidentified
  source 1..1446: mol_type = other RNA; note = synthetic construct
atgactatcaaattaaccagtaccgatactgtgctaaccgacaaattcttcgccctgacttcccccgaagatgtcgctgatttgcttgaacttaaaagctacagctttctggagtatcttatcttcatcctcccatcttcgaaaagatatcgcgaattcatcatccccaaacgcaggggtggaaagcgctatctcttggaaccaattcctaatctgaagatagtgcagaagaaactgagctacgtgctacagttgatctataaaccaaagcacgcagtccacggctatgtcaacggcaagtctattgtcacaaacgccacccagcatattggcagacgatacttgctgaacatcgacctggaagatttctttccgtctattcactttggacgggtgaggggcatgtttatgtcctacccatacaactttaatgggagggtggctactacgttagcccagatctgcagtctcaggaattgtctaccgcagggagcccctaccagccctataatcagtaacatgatttgcgccaagatggactctgagctccaaaagctggctaaacagcatcggtgttattacacaagatacgccgacgatctcacctttagcacatccatcaagcagtttcccccagccatggtagtgactctggtcgagtctaaaaggcttcgagtggaagtcgggattgaattaagcgagataattaaccgcaatggattcaacgtaaacatgtccaagatcagactgcaaaaggacagtcagcggcaggaggttacaaatcttaccacaaacgagttcgtgaatgttaatagaaagtacatcagacagatccgtgccatgcttcatgcttggaggaagtttggttatgtggcggccgagaacgagtatcgcaacgtgtataataaaaaacctcccgacaaaccttacaagaatgcccctagcctgaagcgggtgataaagggtaagattgacttcgtaaagatggtgcggggccaggaggacaaactgttcattaagttgaacaatcaggcagcccaactggagcgagcggaacgtattgagccctactttttcgatatactgcaagagcccgatcacgaactcatgactgtgatcgctaacggggaaacggatttagttgagtttaaggaaggagcttgcgttaatccccacacaggcaaagacgataaacgcaatatgagctcaaaaattctccgggcagtcgcttcactcatgaactcaaagtcaaacggtgtggtgctgattggggtagcagataacggagcaatatccggggtcgaacgtgagtactctgttgctaatccagcaaaggcaaattgggacggctatgagctctatctgaacaatttgctgaacgactccctgtcagttgagaatgcgtacaagtacttcaatatctccagtctgaccatgctgaactga

SEQ ID NO: 7935 - RNA, 1578 nt, unidentified
  source 1..1578: mol_type = other RNA; note = synthetic construct
atggccatatatctggagtccactcctgagattatcgaagggaggttcagggatcttgccactcctgagggcatcgccgaactgctcgagctctcctctctcgcatttctgaagtactgcctttacaccttgccacaggcccgcaggtatcgcacgttcacgatcccaaaaaggagcggaggggaaagaattatcctggagcccgagcctaacttgaagattatacaacagaaactcctgcaggtcctgacccttgtgtaccagcctaagagagcggttcatggctttgtggacgaacggtcaatcgtgactaacgcctcgccgcacataaacaggagggctatccttaatgtcgacctactagacttcttcccctccatacacttcggcagagtcagagggatgtttatggcctttccatttcatttcaatgacaaagtggccaccattctggcacagatttgtagcctgccacactgtctgccacagggagcacctactagccccatcatcgctaatctaatctgcgcgaaaatggactcacaactgacacaactggctagaacccatcactgctattatactcgttacgccgatgacttgaccttctcaacaagtttagcccactttcctaagtctctggccactattatctctgaggagggagaaagaacagtcgagatacgagaagaactggcacgcattatccacaaaaacgggttccgcatcaatcccaagaaggtccggctccaaacacgggatcaccagatggaggtcaccggccttgttgtgaacagaaaggtgaacgtgaaacgatcctatattcgacatgttcgcgcaatcctgcacgcttggcagcagtatggttaccaggccgccgccgacgagtactttgctaaatacttcggaaaggctccagacaagccctacaagacactgccaggcataagacaggtgattaaaggcaaattatcattcatcgcaatggtacgaggccaggaggaccatctgtatattcggtataacaaccaagccgctcagttagagcgccgtgatctcccggaaccccatatttttcggatacttgctgaaccggataatgctatcgtcaggttggtggccgagggtgagtctgtatgcattgaattcaaggtgggggcgtgtctcaacccccataccaataaacaggataagaaaatgaaggacaagatcgttcgtgcggtggccagtatgatcaacagcttgcccgtggggcacctgctcattggtgtgaaggataacggcgagatcattggcgtcgaacgggagtttcccgtcgctgacagtagtaaacagaatcgcgatggatacgaattgtacctggcaaatatcttgaatgatagcctccaagtgaataacgcacagcagttattcaccattacgtttcataatgtaggttcccacaccgtgtgtcaggtgcagacaaccaagtccatgcaacctgttctggtaaacaatcaactctttattcggagccaggcacagacaagggaactgagcggacaggagatggttgagtacatccagcaatattcttga

SEQ ID NO: 7936 - RNA, 1755 nt, unidentified
  source 1..1755: mol_type = other RNA; note = synthetic construct
atgtccctgcacctctcgtcggatccggacacactccggcagcaattctttcagctgaagtctcgcgacgacctgctgaatctactggacatttctcagcagcagttgctgtactacctctacatctgccctgagaataaaaggtatagacacttacgcctgaggaagaaaagggggggatatcggacgatttatgctccagccacccacttaaagattgtccagcagaaactctccagcatcttacagctcatttacgagcagaaacccgcggtccatggcttcgttccacacaaaagcatagtctcaaatgccgccatgcacttgaacaaaacgtatgttctaaatctcgacctacaagattttttcccgtcaatcaattttggtagagtgcgggggctgttcatgaatcagccgtactatctcaacgaagaagtggctacaatcctggcccagatatgttgtcatagaaacaccctaccacagggggcacctacctccccagttatatctaacatgatctgcgccaagctcgacagagagttattgaggttcgctcaggccaatagatgcgtctacacgaggtatgctgatgatcttactttctccactaatacaagacagcccccttctaagctggttcgcaggactgaggccacagctagcattgagctggggcgcgatttggtgagcatcatcaccgcgaacggcttccaggttcatcctgagaagagccgtctccaagtcaaaggcagacgacaggaggtaacaggcctgaccgtgaaccatttccctaacgtcccccgtcgtcttattagacaaatcagagcaatgcttcacgcctggcggaagttcggtctggatgcagcccaacagcactattatgctcattattgccaccggcagtacccagtgtttaaaccccgaccccccttccggcaagtgttaatcgggaaaatcgcatttgtaggcatggtgcgcggcaaacacgatcaactgtacctccgccttcgagatcagctcttgaaccttgatccaacttacagggcggcggtggaaaagaaggctgaagaaacttttattctcagtacccccctgatcaagactgaggggaagaccgactggaagcatatcaagcacgcactgcgagtgttgcaagctcaaggcctgtatgccggactgtctctggatttcgatgagagtttgaccgagggaggatcaagcgagttgaagaaaacttgctattacctttctcgggtcaagcaggcccagattataattgcactgttcgaccgagacgagcccaacatcatcagagaggtggccgacggtgatcggttcaaggcttggggaaatcaggtgtttagctttgtactgcccattcctgaccatcgcacccacacccctgacatatgtattgaatttctgtaccctgacaacaacctgctcctggtagacgaacacggcaggcggctgtacctgtcctcagaatttcatgaaacaagtggtaggcataaagaaaatccagccatatcatgtctgctttccagcaagttcaaaaaggacgcaaaacttagtattatcgacgcgagtgtgttcgatgcaaatcatcgttccattgccctcgccaaagatgcctttgcagactacatcttgcacgatcaggtgccttttaaccgcatgaacctagacggatttaagccaatcttcgatatgataatcgctattcttagggctgagacaaataagacatga

SEQ ID NO: 7937 - RNA, 1689 nt, unidentified
  source 1..1689: mol_type = other RNA; note = synthetic construct
atgctgagcgctgccctcgctatctcgcgcatcggaggccaggtgagcctacgcatccacccagtgcccacatccacccagactcgccacttgaccgcttcggacgacgatttcaggcagtctttcgccagccttatcgatagggacgatgttgtaagattgctcgaggtgactgattctacactgatatacctgttgtatcggcctaggcctcggtacacgacttttactgtaccaaaacggggtggcggaataaggaagatcatggccccagttggcagtttgaagatcgttcagcaaaagctgaatcaagtgctaaatgccgtctatagggtacgaccctcagtccacggctttgcaatcgacaggaatgtgaagaccaatgctctgccgcacgttgggaagagatgggtgctgaatatagatctgctcgacttcttcccctctataacctttccacgggtgcgcgggatgttcatgggtcgaccatacgctatccccgaaagagccgccaccgtccttgcacagatttgctgcaaggattctctccctcagggcgcaccgacatcacccgtggtcagtaatatgatctgtggcaaaatggactccgagctccggcgcttggccactcactatcgctgtgtttatacgcgttatgccgatgacatgactttcagctgtaactcaaaggaatttcccgctgatttagccaccacttatctggacggagaaatgcggccaattgttaccgtcggagatgtgctggtgaaagccatccaggccaaccacttttcaattaacaacagcaaatccacactgagagggcatggtacgagactcgctgtgactaacgttaccgtcaacgagtttcccaatgtccctcgaacatacatccgccaggcacgctctatgcttcacgcctggcgtaagtatggcgtcgagagcgctgacgactcttacagggccagtcgaggcttaagacctgcggacgaccggtcaaggggtcaggttttccgaagagtggtgctgggaaaactggaatacgtgcgtatgatgaagggagacacagatccagtgtacattaacttaaagaaccgattagctgacgcggaccctcggtacccaagggtcccaaccatcgtaacagagcaacagctgggcgctgcactgtgggtggtggttagtcaacggggcgaagagattcggcagggaaccgcttttatgctgcaggggtttgggctggtcacttgcgaccatgtaatcctggaccgcaccgaggtctaccagatatccgatcctaccaatgcatttgacgcaacacccgtaaagagaaacggtcatatcgacctcgcgattctgtccatcgatcagaaacccgaggcacagttcacaggggccggaagagcagccattctcggcgaggatgtgacgctcattgggttcccgaaccttggtcccggcgataccgagcgcacagaaagggggcatgtgaccggactaaggactcggttcggggtgaaacacatacttatctccccgacaatttacagcggccatagcgggagtcctgtgcttgatgcggaattgcgtgtgattggcattgcccaaagaggaattgattatagaaacgacgatcctgatgcaatcgagccttccgcgattgccatcgacgaagtcaataaactgtga

SEQ ID NO: 7938 - RNA, 1695 nt, unidentified
  source 1..1695: mol_type = other RNA; note = synthetic construct
atggccaaggcttactcaagagagctgaaggacccaccgagtgtcctggcctcacgcttcgcgagtctccgggattacagggacgttgctgctttattggaggtggatgctccaacactcgggtttctcctttatcggtccccccctagcgtgcgttatcatacgtacgatgtgccaaaacgcagagggggttcgcgcaccatatcagctcctatggcctccctcaaattcgtccagcgcaaattaaaccaggtcttgcaagccgtgtacagcgtcaagccatctgtgcacgggtttgtggacgaaaagtcaattatcagtaacgcagattgccatgatcgcagacgtttcgtgctgaacgtggatctggagaatttctttggggttatcaacttcgggagggtgcggggaatgttcatgggtaagccatatcgcttacctgagcgagctgccacagtgctcgctcagatttgttgcttcaacaatcagttgcctcaaggcgcccccactagccctgtcgtctcaaacatgatttgcggccagctggatgcacagctacagcgcctcgcccgggaccataaattgacatatagcaggtacgccgatgaccttacgttttctggcacgaatcatgtaccgtctgagcttggagccgacagacgagcacccaaaacatttgacgtgggccctcgactgaccgcggttatctccgcaaacgggttcgcaatcaaccggaagaaagtgaggctcgccacagctgctgaaagacaggaggtcacaggtctggtggtgaatcgaaaggtgaatgtaccgagaaaatacatcaggcaggtgcgagcaatgctgcacgcctggaggaaatttggactggctgcagcggaagccgaattctttgcacggtatgacaaaaagcataggcccgtgagtaagcgccctactttccggagagtggtgaggggtcggttggaattcattgggatggttcgcggaaaggacgatcccctctttcagaacctgctggcccagtatgacgcctgtgtggctccgtccggtagaagcaccccaagagcacccaacgatgtgattaggggagccctttgggtcgttgaagaagaccacagcgagatgtaccagggcaccgcctttgcagtatccgccgattccctgcccgagcacctgagagttgcggtacgggctgcaggcgtcgagtggactctgatcacctgcgaccactgtctgctttctggaatgaaagcatatcaccctgctaatagcggagcattctttcctgtggaagtcgtggcgcgtgacaatacactggaccttgccgttctggctgtcaggactgccagtctgggcaccttgccattagacctgtccgctaccatgacagatggaatgtctctacgtgtagctggctttcccaactacggtcccggcatgaccgccccaatatactccggaaccgtcgttggcactcgagcctggcatggccggcaactgcccattctcgatgcgactatagtagctgggatgtctggcggccctgccctgaataatagcggggccgtgattggggttgcggttaccggcgcaatcgaccacgcatctgccaaggctactgagaagcacggagcagtccccatcgccgccctttcggagttgcaagccctaccaaagcccgagccactctga

SEQ ID NO: 7939 - RNA, 1521 nt, unidentified
  source 1..1521: mol_type = other RNA; note = synthetic construct
atgtcgacagagctccactctaatccagaggtacttcgcgaacaattctatggcctggagcaccccaaggatatcgcaaaaatgctggaaatctcctacctgactttgaactactacctgtacaggttacccgagaacaaacattacaccattatcgagatacctaaacgaagcgggggtaagagaagtttaagggtgcctatcagccccctcaaaatattacagtccaagctatatgaggtgctgttgtgtatataccaaccgagggcttctgtccacggcttcgcgaggggacagtcaatcctcactaacgcagaagctcatctccagagaaagaaccggaccttcatcctgaatattgatatcgaagatttcttcccgagcatcaattttggccgcgtccgcgggatgtttatggcccgtccttataacaggtctgaaaaagtggctacagttctggcccaaatctgctgcgttgataaccagctgccccagggttccccaacgagtcctattattgccaatatgatttgtgccaaactggactcacagctgcaacggttggccaaggaacaccgatgcttttatacacgatatgcagacgacataactttttccacttcactgtcttcattcccacgcgcgctggcgaaggtggaacacaacacctccggcaatcccctgattcccggatcaaagctgaatgagatcgtggagaagaacgggtttaccatcaatcctgacaaggtccggctgcagagttccgacaggcggcaggagattacaggattgacggtaaataaattgccaaatgtccctcggaagttcttgaaccaggtgcgggccatgctccatgactgggaaaaaaatggatacggcagagcccaggaaaaccacttccagaattggagaaagggatacagctctccgtacagtagccctacaagctttgccgctatcgttcgagggaaaattgagtacattggtatgattagaggtacacagaatcgcacatatcgtaaactactgaagaaactcagtgagctggatcccactttcaaaaaaagtgggcttgtggatatgcgcgagcagatctttattagctatagccacaaggacaaaaaatggctcgaggaactaaagcgtcatctaactgtcctcgagcataaccataagttggttgtctgggacgataccaagatcgaggctggctccaagtggagacaggagatcgagaaggcacttaactctgctaaagcagccatccttcttgtgtccgataacttcctggtgtcggactttatcagagaacacgagctcccccctctgttacaagccgctgagaaggagggcctgaaaatactctggattccagtaaccagcaccatgtatgaatataccgagattgtggaataccagtgcctgaccgaaccatcccggccacttaattcactcaagaagtctgaaaggaacagggagctggtggagatctgtagaaagatagcagaacttgcctcttga

SEQ ID NO: 7940 - RNA, 1542 nt, unidentified
  source 1..1542: mol_type = other RNA; note = synthetic construct
atggacatcgagctctctgcaagtcctgaagatctccagaaaagatttttcgcccttcaaacatctgaggacatcgccgagttgctcgagattccttacgactaccttatttactacttataccgggtaccgtttgagcaccagtacacgacattcttcatccctaagaaaagcgggggaacgagaaagattacagccccaatttcccctctgaaaatcattcaaagaaaactcaaccaggtgctgcaggctgtatatatccccaagccttcagttcacggatttgttcccggccggagtatagtgaccaatgcagaagcacatatgtacaagcggatacagaagaagaaatcacagaaggttgagaagccacgcaattatattctgaatattgacttggaggacttttttccgtcaataaactttggaagggtccgtggcatgttcatggccgtcccctataagtgtcccgaaagggtggcgaccgtgctcgctcagatatgttgcgcgtacaatgaactaccacaaggggcccctacctcacctatcgttagcaatatgttgtgctccaagttagatagccagctgcagcgactcgcacagaaataccgctgccactacaccaggtatgccgacgacattacttttagcactagccttctatcgttccctcgcgctttggccacaactgaatactcatctcagagcgggtaccaagttgtggtaggtccagaattgaacgtgatagtcgaggagaatggcttccggatcaatcgacaaaaggtgagattacagacccccgatcgcagacaggagatcacaggactcaccgtcaatgaatttcccaacgtcaggcggcagtacattaaccagatcagggcaatgctgtatgcttggaaaaagtttgggcatgacaacgctgaggaaaggtatcgagagctccacgataatcaggaataccaatgcccggacaaactgctgccatcctttagaagtatcgtgcgtggcaagatcgagttccttggcatggtgcgtggaaagcaagacaggacttatctgcgcttcctggaaaaattggccgaggtcgatcccgaattcagggccaactgggagatgaacaagatcaaaaaaggcggcaccaacaaacaggtcttcattagctattctcgaaaagatgaagatttcgctcggaagctggtgaatgccctgtcgaatcggaacatcggtgcgtggctggatgtaaacgaaatcagtccaggtgaaaattgggttaatgtgattcagaacgggctggtggtgtgtgagctgatgcttgtcatcatatcccccgatagcatgtcttcttcccaggtggcagaggagtggcagtattttctgtcccagagtaaacccgtgattccacttctgtataagaacacaaacactatcccatacaagctagataccaagcagagaattgatttccaagagcattatgaattcgactccgccatggacatcctgctgcgcgctctcaatagagagaacatcgcttccaactga

SEQ ID NO: 7941 - RNA, 1665 nt, unidentified
  source 1..1665: mol_type = other RNA; note = synthetic construct
atgacagatgtcgaacacagggaagacactggcgcacggttttcagccctcaaagacgcgcgggatgtagctagcttgctggacgtgtcctatgagtacctacgtcaccacctctatcgcgcccccgcaggtgagagatacacgttattcaccattaggaagaaaagcggaggcgtgcgagaaatcatggcgccccgtcgaccgttgaagctgctgcagcacaggcttgcaaaagtcttagagtgtgtgtacgaaccaaagtcatccacacacggtttcacccgcaagcggaatgttctcactaatgcccatattcatgcccggcgtaagcacgttcttaatatagacctcctggacttttttccctccatcaatttcggccgggtcaggggaatgtttatggctaacccataccgctgcccacctgaggtggccaccgttcttgcgcagatctgctctcataacaatcagctgccacaaggagccccgacatctcctgtgatcagtaacatgctgtgtgccaggatggatcgccatctccaggaagttgctaagcagtaccgatgtgcctataccaggtacgccgatgacctgacttttagcacctatctggacgagtttccacctgagttagcatcaatgcagaccgaacacggtgtagacagatgcgtcccgggccggacactggtgaatatagtgaccaagcgcaacggattcagaatcaacgagagcaaggtgaggttgcaaaacaacaaacagcggcaagaagtgaccgggcttacaacgaataaattcccaaacgtgcagcgagcctatgtgagggtagtcagagccatgctccataactggaaaaagcacggcctcgaggcagcacaacgccaatacttgagcaagtataacaaacagcaccgccctccagaatctgtgcaacccctgttccgatacatggtgaaagggaagattgagtacttgggaatggtgcggggcaaggacgacgctatctatcagagatttctcaagcgcctgagggaattagcccctgatctggtcaaggcatcttccgtagacgatccttacgccaagatacttgacagactgtgggtcctggagacagaggaaatcggcaagtgtagtcagggaactgctttctatattcaggattacggcttcgtgacctgcgcacatgtgctgggggagtctgagcttgccatcattactgcacacaccagacatgacgcttcacagaaatatagggtcaaggtaacagccaaagacgatcagattgacttggctcgtctggaagtcatcggggtgacgcctcaggtcggtctgaaagtaggggcctccgagagtcttcagatcggggatgcaataaaactcgccgggttccccaaccaccatatcgatgataccggaattgttgctagtggcactgttattggccgaagaaacgcgcccgtgactagagagccccggatcctgattagcgctaatatcattgccggtaacagcggcggacctgttctggattcgaacaatagagtgatcggagttgcggtcagggggggggctaatgaagaggagtcccgcaatacagaatttcacggcgtggtgcccatagaggctctaggacggctagttgtggctggcgtcggtgggaattga

SEQ ID NO: 7942 - RNA, 1662 nt, unidentified
  source 1..1662: mol_type = other RNA; note = synthetic construct
atgacagcaagccctcaaagggaggagatacggacacagtttacttcattacgcagtaggtccgatgtggcatcactcctcggggtcaccgatcgtgcccttcgctacagattgtacgggctcccgatcccttcacagtacgtggtattcgaaattagaaagaagtccggtggcctgcgcagtattgccgctcccatccctccacttaagatcctccagcgccggctgcggaagatcttagagtgtgtgtatgaaccaaaagatgtggtccacggatttaccgtggagcgctccattaaaaccaacgctactcggcacgagaagtccaagcacgttctcaacgtcgacatctccgaattcttcttgagcattaacctcgggagagtgcgtggaatgtttatggctgcaccgtataaatgcgagaaagaagtcgcaaccgtcctggcccaaatagcctgcctggagggcaaattgcctcagggggccccaacaagtcccataatttctaatatgttgtgcgcacggttggatgctcatatgaataggcttgcaggatcttttaaatgtacgtactcaaggtacgcagacgacctgactctgtccacgctgcagactaagttcccgcgggaggtggccgaactgagaattgtggatgggcagcccaagtgttttgccggtcctaaattgattcgggtactaacaaggagaaatggcttcaagatcaacctgagcaaaattcggctggccaatagaagtcagcgccaagaggtgacaggcctggttgtcaatgagaaggtgaacgtccctcgactttttgtgcgagagatacgtgcaatgctccataacctgcacaaaaaaggcgtcgaaaagtgtcaacaggattatgagactaattacgcccgacacaggcgcccttcttcgccagtgcccccattcctgtgggtgctgaggggcaaggttagctatgttggaatgattcgcggggagaatgacgagctgtatcggaaactgttgaagaggctcgacgagctggcacctggactagtgaaggttcccgtcatcaaggacgagctggattccatatttgagcacctctgggccattcaggtggagacagaggctggggacggaggacagggcactgctttcatgttgcggggagtcggtctagttacagcgagccacgtgcttggcaccaagaaaatcctgggtataaagatgcagagctccgacggacgagtggaaagagaagcgaccgtgtttcgaagagatggcctgctggatctcgccattctcgaatctcctgacctagatccctctcgtgggctggaagcctctactcttaaatccaccaggaagatggctgtaaccttattaggcttccccaatcataacacaggggaccccggccatttcgatcagggtatcgtaacctcaatgaggagaagtccactttcggaggaccaaatgtttctgatctcatgcccaatcatccatggccacagcggcggacccattctggacagtagctctaaggtacttggggttgctgtgcgcggcgctatcagcagaaaggaagccgcgctcaccgagttccatgccggtatgccaatcgctgcgatcgaaaaattaacgaacgaaatggccgaacccgaaaaatga

SEQ ID NO: 7943 - RNA, 1635 nt, unidentified
  source 1..1635: mol_type = other RNA; note = synthetic construct
atgccatatcatctgaccaagagcttagatctgctcagagaggaatttaaaaagttgaactcccctcaggctgtggcagcccttttggaagtagactacaaacgacttatatatcacttgcacaaagtcccaccttcaaagaggtataccgttttcacaattccaaagaagtccggtgcggccagacagatcactgcccccatctcccccctcaagattctccagaaaaagctgtcattcattttaagcagcgtggtggattctaagcattccgtgcacgggtttgtgcgagggagaagtatccggaccaattctagagtccacgctggcaagaagtatgttttcactatagatctggagaacttcttcccgtctatcaacttcggccgggtacgcggtctattcatggcccccccgtttaaatttaacgctgaaaccgccacaattctggctcaaatctgcaccttcgagaattccttgccccaaggggcaccaacctcccctgtcgtcagcaacatactgtgtcggaagatggatcagcaactcagccggctcgcacgcaactacaaatgcgactacactcgatatgctgacgacatcaccttcagcacagccaaggaaacctttcccaagtcaatcgctttcacgctccctgactcaaaggaaccgcattgtggagatgagcttagcaggatcatctcggatagtggatttactataaacgccaaaaaagtgagactcattgagcgctgtaggcagcagaaagtcaccgggctcgtttccaatgaatttcccaatgtcgatcgccgttttatccgccagattagggcaatgctgcacgctgcgcagaaatttggcttcactgccgccgagaaggacttccacgcgaggtactacaataagctactaaaacctggtggtaaaaagccctctttcaaaaaagtgctcaagggcaagatcgactttgttggcatggtgcgcggcaaacttgataggctgtacctgaagctgattagaaagttacagctgctggatgagacactggtgcgggcagtgcctagtgaggcttggattaacgaaatcaaagcagccctgttcgtgatagacgttcataagcctgctgaaaagcctggggtcccaacaatcgaacaggggacgggctttctattaaagggaatcgggctggtgacgtgcgcccacgtcattaatgagcgaattgggaaactggaggtgtatcagggagccgaccccagcaaactttacgacgtggacgtttctattgaagatctggacgccgacatagcagtgctgaccatccatggattcacagggccccaactcttgcagggggacgatgggatcgtacgggaggatacagaggtgattctggccggatacccaggctatgcccgtggccatagtggtactataggccggggcagagtagtgggcactaatctgcactttgacaaaaagcgcatgcttatcgatgcagttatttttccaggaaattctggtggccctgtcttgaacaacgagaggagagtaatcggcattgccgcaaaaggagacggaggacaaaattcaattgtgccaattagtgcgatcaaggaggctatgatcaggtcgcgttga

SEQ ID NO: 7944 - RNA, 1758 nt, unidentified
  source 1..1758: mol_type = other RNA; note = synthetic construct
atgtccattagcctgtcattactgaacgaagagttaaaggagagactcttcaacctccagagcaggaaagatctcgcagatttgctcgaaattgatgaaaagcagctgatataccatctctatatcattccgcccgaccagaagtacaagaaatttatcatctccaaaggtcatggctccgtgagacgtatagacgcaccaatcagtgctctgaaaattatccagcggaagctgttgaaggtgcttacctgcgtgtatcgcgtgaagaagcctgtacacggcttcgtgtatggcagaagcatcctgtcaaatgctaagacgcatagacgacgccgctatgtgctgaacctagacctgcaggacttttttccctctataaacttcgggagggtgaggggtatgtttatggcacggccgtaccaccttaactccgccgttgctacagtgctcgcccaaatatgttgtttcaacaatcagcttccacagggagccccaacgagccctattgtctccaatatggtgtgcgctaagcttgacgatgaactccaacggctgtcgggaaaatatcggtgcatgtatactcgctatgcagacgatataactattagcaccaatctgcccgcattcccttcaaatattgctaccctcagtgataagacagggcaacccgagctgggagtcgaactgcagaggatcattgatgagaacgggttcgttgttcacaaagataaaacaaggctccaaattaagtcgcaacgccagcaggtgacaggccttaccgtgaatcgtaaggtaaatgtgaggcgttcttttattaatcaggtccgagcgatgttacatgcctgggacaaatatggcctcgaagcagctcaggaagaatttatcaataagtacgacatgcggtctagaagtccttacaagaacaagaatggggtttctttcgcacgggtggttaaaggaaaaatagattacctggggatgatacgtggtcaggatgacacgatctatttaaaatactacgcccaatactgcaggttggctggcattcctaaccgccgggccttgacttacccagtggacgaaactttgcttcctctgattgtcacagagggaaaaaccgactggaaacacctgaagattgccctgtccaagctgcagtcagagggaatcttccagaacctgaacatcagcttccacgagtatgaggacaatatggaggcgggcgacaatcgaatcatccagatgtgcagagatcgggctttgctgccaaataacgtcataactatcttcatcttcgaccgagataacaaggaggtgataaagaaagtaaccgagaacggccaggagtacaagacttggaataacaatgtgtttagctttgccatccccgtcccgaatcacagaaccgagacaccagatgtctgtattgagctatactacaggaacgaggaaattactagggaagatggtaataagagacgactttacttgagtcgcgaatttaatcctgagtcagcccgcaatcatgacgggagtctgaactgtaccgatatgaacaaaatccgggatcagaggaaggttaacgtcattgactctaatatctacaactcttccaaagagaatgtagccctacccaaaagcgactttgcggactatatcctgcaccaggaggaaaacttcaacgactttgattataccgagttcaaagccatctttgagatcatccaaagaatcattcaggaaaaccccattacatga

SEQ ID NO: 7945 - RNA, 1434 nt, unidentified
  source 1..1434: mol_type = other RNA; note = synthetic construct
atgggaaagctcctctcaagatctaattcccagatcatcgaaagattcgacgcgctggagactcccaaagacatcgcagatctactcgaagtcgactaccagcattttgatagcatactgtttaaaaccgcccgcgccaccctgtatagagagtgtctaattccgaagaaaaacggcgagttcagacagataaacgtgcccgcagtgcagcttaaaaatattcaacgccgactccatgaagccctgcaagtcatccataaaagcaagctcccttctcacggattcgagcgtgaacgttcaatagtgacaaacgcagaagctcacgtcaagcaaaaatttgtgcttaatctcgacctgaaagatttcttcccttccattaatgctgggcgggtgtggggcatgtttcagaccgtgccatttaactgcaatgaaaaagtggcttcaatcttagccaacatctgtactttcaaaaatgagctgcctcagggggctcctactagcccgatcgtgtcaaacatgctgtgcaggaaactggattccgagcttcagaagctggctaagaagtataatgcaacgtacacccgatacgctgatgatataacaatctcctttagctacggggagatccccaaaaacatcgccacaacgaacgagttgggccaattagaacttggtaacgaaatcaagaacgtcattaagaacaatggcttccggatcaattatgacaagtttaggttgcagtctaagaacatgcggcaggaagtgacaggtctaaccgttaatgagtttgtaaacgttaatcgcaagtacgtgagacagattcgggcgatgttgcatgcttgggataaatacggatacgagaaagcagaggaagagtttaggagagagtatgacaacaagtatcgcccacactggaagagcaacccctcgttcaaaaaggttgtcaagggtaagatagatttcctcggaatggtccgagggaaagatgacaaggtgtacattaagtatagggaaaagctcagggagttggccccagacattatctctgaaccacctcctccaccagagagtgagtccccccaaagtatggtacccattatccggaccgagggaaaaaccgattggaaacacctgaaagccgccttaaggtggctgattgacagaggcgagataagtgatctgcagattgaattcgacgaattcgaggagactttgggggaacctctgctgctgcaggactgtgaagcactttgccggcataagcagcctaggcccattattgccatctttgaccgcgatactaagaacgttaataagttccacaacgagaagaagggctacaaggactggggcaataatgtgtttagcttcgctatcccagtaccggcccaccgcaaaaatacacccaaagtttgcattgagctgtactattga

SEQ ID NO: 7946 - RNA, 1743 nt, unidentified
  source 1..1743: mol_type = other RNA; note = synthetic construct
atgaaaaacctccttcaatatagccctgagatcctgaagaataagtttcactccctgactacacacttcgacctgtgtgacctgttagagatcaagtacaaggacttaatttactacctttacaggattgatcccgatgtccaatacaagaccttttacattccgaagaagaacgggtcattccgggagattaacagccccatcagcactattaaaattatccagaagaagctggcccagatactcaatgctgtgtatctgcctaaggaacctgcgcatggattcatcatcgaaaaatccatcctgagcaacgcccgactgcacgttcgccgtaaatatgtgcttaatctggacctcgagaatttctttcccacgattaactttggcaggataagggggatgttcctcaaaaagccatacaattttgaccccaaaacagccacaattatcgcgcaaatatgctgttataaaggatttctgccccagggcgctccaacatccccaatcttgagcaacatgatttgctccaagttagactcaaatttgagctttcttgccagcaagaacaaatgcatctacactcgctacgctgatgatctgtcgttcagcacctccttgactaattttccaaaagcaatcgcaaaaccgaatcctaccggtctggtcgagttgggcgaagagctgaagaagataattagagacaatgggtttgaggtaaattctgacaaaatcagactccagtacaaacaacagcgccaagaagttacgggtctagttgtgaatgaattccctaacgtaaagcgtaaatttgtccggcagatacgggcaatgctccacgcctgggagaagtttggctatgacagtgccaattatgaatactcaactgtgtacaacaacaaaacccggtttgcctcatcttctgtcgatttcgcgaaagtggttgcaggtaaaatagagtttcttgggtttatcaagggaaaagacaaccagatttatcagagcttcttgaacaaacttatcgctctggatcccgagaagtttaagtatttggagaagttcgtgatttcttctaccaactacgttaatcccttggtgtttaccgagggcaaaaccgacctcaaacatctaagagctgccctgaatcatttccagaagaatggcgagtttaccgagataaagctggagttcgatgaagaggaaaaggaaatgggggacgaagagctgctaaagttatgcaaaaactacgtgaagatgacaggaaatgcaaagccaataatcttcattttcgatcgcgacaacgaaaagataatttcccaggtcgacaataaagggagttacaagatttggggaaataacgtgtatagtttctccatccctattccagaccacaggacagatctcacttatagtccgatcgagttctattataagaacgaggaccttaaaatctgtgacgtaaaatcaaggagattattcctctcagatgaattcgataagaactccggacgacatctgttcgagaaggaactgtcttgtaacaacctgaagaagatcaaagattcgaagctgaatattatcgataactctgtcttcaacagcgaatctgtgaacgtgtccctcagtaaaaacgatttcgccgaaaatatcctcctaggcatcggcaagtttgctgacgtggatttcgccagtttcaaaaagatttttgatctgatcctgcagatcatcaaaattcaggacaattga

SEQ ID NO: 7947 - RNA, 1467 nt, unidentified
  source 1..1467: mol_type = other RNA; note = synthetic construct
atgagccacaagctgaatagcccaccacaggatctggccaagtctttctccgcccttaaagacgggcgcgatgtcgctaaactcctcgaggtggagtatgcccacttggtgtatcacctgtataaaatcccacaagaggctagatacagccagttcaaagtgaagaagcgcgggactaacgaattcagaacgataagcatccccaacgggtccctgaagatcattcagaccaaattggtccaggtgctggaagctgtgtacttccctcgtatcgcagttcatggattcattaaaggtaaatccatcctgtctaatgcgagaatacacgcgaaccagaagtgggtcttcaacgctgacctggagggcttcttccccagtattaattttggaagagtgcgaggcttatttattgctaaaccgtatgttcttccggacaatgtcgccacagtgctggctcagatctgctgttataacaatgaactcccacaaggcgcacccacgtcgccgattctcagtaatatggtttgcgcaaagttggatagcgagctgcggatcctcgcacagcattcccggtgcaactatactaggtacgccgacgacctgaccttttcaacatcttcacctaagtttccccctcagatagccagtattgatggcgattcccagaacacaattatcgagctgggagagcagttgcgcacaatcattgggaataatgggttctgtgtcaatgcacagaaaacccgactccaaactaagactcaccggcaggaggtaaccggactggtgacaaaccagtttcctaacgtgtcacggcaattcatcaggcaggtgagggccatgctgcacgcatgggagaaatttggattagagaaggcccaaaccgagtacttaatgttgtaccgggaccagcagcgcaaccccctgaagaacgatcccaagtaccgtaatgtatcacttaaggacgtaatcttgggtaaaatcggctttattggatctattcgcggtaagactgactttatctacattaagctactcaacaaagtgataagtctctccccagaactcgccaagcaaaaggataagattagtgcacttatgtcgagcgggccagctccccttataagggtgaccaccgaaggccctacagattggatgcatatcgaaaccgccttcaataacctgcagtctaaaggcctatttgccgggctagcgttcgacttagttcgatacgaacacgatatgggccattctagactgctgtccatttgtgaagcctacgctaccctgccaatacctggtggacttagccatgtttttatctttgatagggacgaaccccagatcgtcaataaggtcaatgaacatggcgacgtgaggaaatggcctaacaacgtatattcattcagcattcccatcccaacgcacagaactaaaacacctgagatatgcatcgagctgaattga

SEQ ID NO: 7948 - RNA, 1635 nt, unidentified
  source 1..1635: mol_type = other RNA; note = synthetic construct
atgcccgaagcccagagatataccacattcaaactggctaaggcttccggcggttttcgaatcataagcgtccctaatcactctctgaaaatactccaacaaaagctgaaccacatcctacagatggtgtaccagcctaaggcctccgtgcacggcttccttcaaggaaagtccatactcacgaacgctgaacgtcacgttaagaggaagtatgttctgaatctggacatcgaggcattcttcccttctatcaacttcggcagggtgcggggcatgtttatcgccgccccctataacctgccagagaatgtagccacggtattggcccagatttgctgttaccagaatcagctcccacagggtgccccgacttcacccattataagcaatatgatttgctcccgcatggacgtggctttaaaaagattggctcagacatataagtgtacatatacacgctatgccgatgatattaccttctctacctcgaagccccagtttccaccccagatcgcgtcaatctttaacaagcaggagacttctgtcattgtcctcggaacagaattgaatcatgttatcgagtcaaatgggttcgaagtgaacagttccaaggtgcgcctgcagactaaaaatcaccggcaagaggtgaccggggtgacggtcaatcgatttcctaacgtcaagcgggcttacattagagagataagagcaatgctacacagttggcgggagaacgggtttactgaggctgagcagatctttagggaaaagtacgacagcaaacaggagaacagaaaccctaaccttcccatcccatccttcgcaaaggtgctgaggggcaagattgagttccttggcgccgtgagggggaagaatgaccatatttatctgagatatctgaacgagctcagcagcttggcaccgcctggcaccattaagttgccaaaatctgtgggcaagagcaatatcattaaactgaaacccaccgtgtacgtcgagggaaagaccgacaaaaaaatactttcaattgcttgggccaagctctttgaatcccgcccaatccctttcaacatagaagatagtaacctgagtcaaacagaccagggaggaggtcttgggggggcagagattctcaaacagttcattagtgttgtgcgtgaggaccacttgcatctggctatcgcgatgtttgatcatgatcaagaaggaatcaagtgctacaatagtctcccaaaatacttcgatcaggtatcggagctcgaggcgaaaattagcaggcatggcaaagccgcagcctttctgcttcctgccagtgatcagaaatccgaatacatcaagtacgagaattttgtgatcgaatacctgttctctgatgctgccttagccaaaactaccgaggacgcacaggggctgatcttccagcaagcgtctatcgaacagcgcatcgttggctctggtaaatccttccggctgtcaagcacaccgtccagcattcccgaaacccgtaccatcaaggagggaaaggttgtattcgcagaacggatcgtgccccacctagacaagtcagaatttactgaatttcgatttgtcttcgcaaaaatccagcaaattataacttacatggccagcttatga

SEQ ID NO: 7949 - RNA, 1695 nt, unidentified
  source 1..1695: mol_type = other RNA; note = synthetic construct
atgaataatctgtcccctgtgctgtcggcctcagctgaggagttgagaaaaaagttccaggagttacaaacccgtgaggacgttgccaatctcctggagatagatgaatcccgcctgaattactacctctacatcattcctgagcctcatagatacaccacatttcaaatcccgaagaaaagtggaaaattccgaacgatttctgtcccagcgaccgccctgaagattttgcagaggaagcttaatcaggtccttctcgctgtctatcagcccaaagcagctgttcacgggttcgtcctcgggaaaagtattgtgaccaacgctcagatgcacctaaggcaaaagttcgtgctgaatatcgacttgaaagatttcttccccagcattaacttcggacgcgtgagggggatgttcgtcgcacctccatacaaactcccgcctatggttgccacaatccttgcacagatttgctgctggaacaaccagctgccacagggcgcaccaacaagccccatagtgtccaatctcatttgtgccaagatggacagtcagctgttgcggctggccgagaaacaccgctgtgtgtatactaggtacgctgatgacataactttcagcacatctaccagtcagtttccgatcgcaattgcacgaaagtctgaagtcaccaatcaggtggaagttggtggggacctgggtagagttattaacgaaaacggttttgagatcaacagcgacaagatccggctacagacaaggcaacaaagacaggaagtgaccggacttatagctaatggcaagacccctaacaaaacacccaatgtccaacgacgctatttgaaacagatccgggcaatgctacatgcctgggaaaagtttggcttggataacgccgagaaagattttctcgagaagcatgacggtcactataggcaccccaacctcaacgaaccatcttttaagaaggtggtgtgtggcaagatcgaatttctcgggatggtccgtggaaaggacgatgtgacttatcaccggtttagagataagctgtggtcccttgcgcccgagttagcccggtttgatccagagatagaatcaactaacattcccacttctgtactgataattacagaggggcagactgattggaaacatctcaaggccgccttacagcagctcaaggaggccggcgacttctccgacctgaatatcgaatttcgcgaatatgacgacagcatccaaatgggtgatggcgaactggtaaaactgtgtattcagatggccaagatccctcaatctaaaattacaatctgcctgttcgatagcgacgcaccctccaccctgaaaccactggctctgagcgacgctatgtacaaacacatgggaggcaatgtgttcgctatggtactaccaacgcccaaccataggcagggactgcctggggtgtgcatcgagcactattaccaggatagcgaaatcactcgggaggacacccacgggagacggctttacctttccaatgagtttcatgagaagagtatgctgcatcgcacgaagcacggcatctcaacatcagacagacgcgtacatgatttgaaaaaggtggtttgccaggtgctgtgtaagttaggcggcgcgggacaggccttagtctcaaccgtgatgaggcgtaacttccgactgagaatcactgcgtga

SEQ ID NO: 7950 - RNA, 1959 nt, unidentified
  source 1..1959: mol_type = other RNA; note = synthetic construct
atggtgaacgtagacgaggagttgataaagaactttcagaacctgaaatctgtgaagggcctatacctcctgctgcagaaattccacacaggacccgcatcatttccagactatagcacctttagacagattctgttcaatcaatggcaagacgagccctatgagtccttcaaaatggccaaaaagaatggcagtcataggaccattgaggtgcccaagcctgagattaagctgctccagcagtctcttaatacaatcctccgtggtatctatgaaccaaaagccagtgtacacgggttcaccatcaaaaagaacatcatttcaaacgctcagaaccactgtggcaagaaatacgtgttcaatatcgacctggcagatttcttccacagcataacccaacagcgaatccggggggtgtttatgaaacccccttatagtctgccttccaaagttgccactgctatcagccacctgtgttgctacaatgatcgattgccgcagggagcaccaacttcgcccattatatcgaatatagtgtgcgccaagcttgacagcgggctgaggcttcttgccaaggaaaataactgtttctatactcggtacgccgacgatataacttttagcacgacacgcaagaactttcccactgacttaggagtaatatacggcggtggaacccaggatatcaagattggagacaaactcgcctccatcttagctgagaacggatttaccgttaatgctgcaaaaacaagaatccagattaacactcttagacaagaagtcacaggcctcactgtcaatacaaaggtgaatgtgtcccgtgattatataaggcatgtgcgcgctattctgcacgactgggagctgaacgggtacgtgaaagcgaactcaaatcactggtcacattgttctaaaaagcacttacggcatgggaacattgatgacgttctgggcggtaaactggcttttatcggccaggtaaggggcaacgaggatcttttgtataagaagctgctccagaagtatgcggggctaattgttaatgaaatggctcgcgatttggctctcaagttcgacaacaagttatacgagttatggtcaggtgtgatcgatcagtacctggaacaagcagtgattgattatgtcgccaacgagaacattacaaacgaggacataaagaatggatttgaggaactgaagaaactgaagcctattaacggccgggactacaagcaaagacaggacccagactacaatcaagtgggcgtccccgtcgcctacacctttctctatctacctcgcaagatcatggcagccactgcgatcctgacacattactttggacagaagaacagtaggatcccctataatatcctcgatattgggtccggcacgaatgctgtttctatcgcaatcgggctgtttttgttcaccgataagatcaatatcaacttgaccgccctagaaccatcccactatatgcgccatttctgctcataccagccaaatttcagtcatctgaatattagctacagggaggggatggttggagaatggcaggatgtgctgcattccaactactacgagcttatctttatgtcctctgtgctgcagaattctttcaatgaccaacaggatacctggtgggaagatcggtgtcgagaactctataactgctgcaaaaacaacggcacgtttattatagtcgagccaaacgccaaaatggatctgctcaattctctggtcaacgccatgcagaaaattggttggagtttcaaagaaagactcttcctgagcaatctcttgcctaaggtcagcaagaacgacgaattgatcaaaatgcagaagctgaccgaccttaaaaaagaatacaagtgcgactatcacaattacagcgtgtgtaactggaatcctaatccgaagtataacgagatcatttacatcttcgagaaatga

SEQ ID NO: 7951 - RNA, 1932 nt, unidentified
  source 1..1932: mol_type = other RNA; note = synthetic construct
atgaggtatttactgcgcgaggctagcgaaattgtggagagcttccggaaaattaacagctttcaggactttgcagacctcttggaggtagattacttttggttcaagcaggaactgtttgccgtgcctctggaggagaagtatacatcatttaccatacccaaacggaatggggaatccagagagatctatagtcctgtgtccgggatcagggagattcaggcccgtcttaatgaagtcctgaggcttgtctacgagcccgaacgcaaacaatctgtgcatggatttaccacatcccgcaacattgtaacgaatgccaaaaaccactgcaacaagaaattcgtcttgaacctcgatattaaagacttcttcccaaccattactcagcaaaggatcagaggtgtaatgatgagcccaccatacaacctgccgagccagatcgctaccaccatatcacatatctgctgttatgagggcaaactacctcagggcgcaccaactagccccattattagtaatatcgtgtgtgccaagcttgactcagagcttaggttgctcgcaaagcagaataaatgtttctacactcggtacgccgatgacattacgttttccacaattgtcaagaacttcccgctctctatcgctaagataactggacttaaaatcactgatgtgtctctctccgacaatctgatcagcattttcaagtctaacggtttccagattaatttcaacaaggtgagaatccagggagacaatcagagacaggaggtcacgggacttactgtcaacaataagcccaatgtctccaggaaatacattaggcaggtaagagcaatgctccacgactggcacaaaaacggttatgtgcaggcctatatcaatgacagtgctatacgctaccaaaaaaacaagaaccgagttaactttagctcggccctgcgggggaaaatcgagtttattgggcaagtgaggcaaaaagatgacttcatataccagaagctcctgacattttacgagaaactgatcgagcgagaaatcatccgtcagagatccctgaagttcgacgacaaagattataacaattggtgcgattctgtggacgagtacgctctacatatcattaacaactacatcgatgcgataagcgttgatatcgataatatgaaggagtgtatacaacagggatttgacgaacttgataaactccgcaagaagcaggatccagattatgacttgcctggtgtgccgatagcttatgcattcaaatacctcccccgcaagatcatagctatgacagcggttctgagtcactatttccgtgaggaaaatgtgcctatccctgagaaaatcttagatgtcgggtctggcacagacgcagtggggatcgcgttaggcctgttccggcaaaagatgtcatttcaaattaccgccatagaaccctgctcctatatgagacagtttgccatgttccggccttctctgcccaatttggaagttctcaatgtgaatggccgactaggcgactggttcaactacttgaacaacaactactttaacctgatctttatgagctccattctgcagaattcattcgaaaatctgggaaattcgtggtggctggagtgggcaaatgaactgtatcaagcctctaccaacaatgctcgattaattcttattgagccttcagttaaggttaagctggtgaacaagatgaagtgggccatggaaagttccggctggatcctgcgggaacagctgctcctgtcagatttgtttccaaacgtgttcaataagggctgccagttaaagaaactgacaagtctcaagcaggagctaatcggcaactactgtccatggcccgtcagcgggtggaatacctattacaagtacaacgaagtgattcacatctatagtaagaataaccagtga

SEQ ID NO: 7952 - RNA, 1725 nt, unidentified
  source 1..1725: mol_type = other RNA; note = synthetic construct
atgactaaaacactgttgagtatcactccgattgaacagagggaggccttttttgccttaaaaaccagacgcgatatagcagtcttgctcggctataggtacgacggcctggtctaccaaatttacaaaatccccgcagaaaagaaatacgaaacattctttgttcccaagaagagcggggagctaagaaccatccacgcaccttcaccaaagatcaagcgcattcagcgattactgaacgaagtacttcagaatgtgtacaaaccgaaacccgttgttttcggctttactagtgggaagaatatcgtcgacaacgccagtaaacacaaaaagaagaattgggtgctgaacgtagacctcgagaatttctttccatctatcaatttcggacgagtgagagggatgttcatgcacaagccctacaacctccccgatgaggtggccacaacactggccaagatttgctgcttcgagaatagcattccacagggagcgcctacttcaccagtgataagcaatatgatttgtgctcaaatggacagtcagctgcaggatctggcttggaaacacagatgtttctataccaggtatgccgacgatatcactttcagcactaccctgcacgaatttccactggagatagcaaaggtgaactctgtcctttcaatcgatcttggtcaagagttaatcaacatcatccaacagaatggtttcgagataaaccatggaaaagtgagagcctttgcttatttccagaggcaagaagtaactggcctgacagtgaataagttccctaatgtgcggcggaagtttgtaatgcagatacggtctatgctgcacgcatgggacaaaaaagggctccagaccgctgaggccgaacactacgaactctacaataagagacatcataaccagaactctaagctgcccgcctataagaaggtggtgaaaggcaaaattgacttctttgggatggtgaagggattaaacaattccaggtacatggaattcaagcgcgagtacttgcgtctttcccgacgggacaaaaacgtcccttttaaaaacatttcggcgaaaaccgagagcaaaatcattatttacacagaaggcccgaccgatcccccaattctgaaaactgcctggcagaaactttatcaggacgagatccttttcatcattacccctgtggaaatcaagcccggaattgctacaggggcaaccgcactagccgctgagctcaatacccatcgcaagcagcatggcatagttattggtatcttcgatagggatgctgaaggcatcaaggcttataagtccctccacagcggagagtttgaggaaaaggatggattcaagatttccatcgaccggaacgcagccgcgattatcttgcctatccctaccggtaaagagaaattggccgaactggataaactgtggatagaaaactatttctcagaaacggccctaaatacgaaaacgaccgacggaaagggcctggcgtttgagtataagccagttgtcgtgaccaaaaagattggggacaagatcattgaagagacaaagacagatgagcgttccctcgagacagccgtcataaaggacggtggcaagcgcatctttgctgagaagatcgtgcctacgctccccgttgacgagtttaaggggttcgagctggtctttgagaaaataaacgaaatcgctgagttgctgcaggagctgtga

SEQ ID NO: 7953 - RNA, 1662 nt, unidentified
  source 1..1662: mol_type = other RNA; note = synthetic construct
atgtcgccccacctcccacattttgttgcacgcatcgtgctgttgaagaacctgctggacgtgaatacgtcaagagagctggccacctttctgaagatcaattacgaaaaccagctgatatttcacgcttaccgcgtgcccagccacgagaaatacctgacattcgagattcccaaaaagagtgggggaacccgtaggatcctagctcccgcgactgctctgaaactgattcagagatctctggccgaaaagctgttggagatctataaacctcgagcatcaacctacggtttttgcctcggacggggggtcgtcgacaatgccaaacagcacttgggcaagcgggtgattctgaacgtggatttcgagaatttcttcccctccattaactttggccgcgtccgaggactgcttatggccaagccttactctatgcctaaggaagttgccaccatcgttgcgcagatatgctgccatgacaatcagcttccccaaggcgcaccaaccagccctgtggtgagcaacatgatctgcaggtccctcgatcggcaacttcagattatggcaaggaaacataattgttggtacacgcgctacgtcgacgacatcacaatttctactaataggaggcggttccccccgcagattgcccagagaaccgatgacctgtctgctaccgaagcgcagttaggggaggagttcaagggtatcgtggaaaatgcaggattcaattttaacccctccaaaaccaggatcttaacaaacatggaaagaaaggaagtgactggcgtgaccattaacgaattccccaatgtgccccgtagctacgtaagacaaatccgcgcaatgctccatgcttgggagcactatggctttgccgcggcccaagaagagtatattaaaaagtatcagccagcttgtcggaacgataagaagggcgcagtgaactttgagtgggtcgttagaggaaagctagagtatctccgtcaggtgcggggcacacaggatccaatcttcatcaagcaggcttcacgcttcaatcttctggcaagctcctctataaaattgccgctcgctgccgagacaacagatgtaactacctccacttggatcgtacagtctactagtgccgacggcaagaccctccaggaggggacagcctttttcttggaaggcgtcggtctggtaacatgtgagcattgcataatcggccctactattatattttcagcctccagcccaacgattgagttcccggtggtggctagtaaaaaaaacgcttataccgacgttgcgatcctgaactttacagatgacctccagcctacgaagacacaagacctcagaagaaacaaaggactgggcgataatctgccacctcctcttactgatatccgattaataggatacccaaactgggcacttggggccggtatgagtataaggctcgggcgagtgacctcaattaaccacgacgaacctcggtattttcagatcgacgccagcatcattagcggcaactccggggggccagtcttggatgccgaaggtttcgtcttaggaatggccagtaggggggcaccaaatcaagaggatgctcaaaagactaatgatcaccgcgttgtcccgattcaggccatcttcgacctatgtaatcagtga

SEQ ID NO: 7954 - RNA, 1773 nt, unidentified
  source 1..1773: mol_type = other RNA; note = synthetic construct
atgtcactgagtaatccgctgcccccccgaaacgctgcctccttaaccgagctgtccatactgcagaccaagagggaggtggcctccctgcttggtatcaagtacaagtacctcatatactacatccataagtatccccacgacaagaggtatacttctttccagattccaaaaaagagcggaggcgtgcgtgaaatcctaagcccaatcggccccctaaagtttattcagaggcggttgtctgaggtgttgctcaaggactataaagtaaaaccttccgtgtatgggttcgtgaaggaaaaatccattctgaagaacgcacaaagacatgtgggtaagcgttatgtgttcaacgccgaccttaaagacttttttccatccatcaactcaggacgcgttcgcggtatgttcatgtcacctccttactctttaaataaagaggtagccaccttcctgacacagatttgttgtcacaataatgctttgccagcgggggcccctacgtctcctattatcagtaacatcatatgtcggtccctggataaccagttgcaagaactggcaaaggagaaccgatgcacctacacccggtatgttgatgatatcacgttcagcacaacactcagatcattcccccaatctattgctcacattaacgaagccggtcagatcgaggcaggcagccggttaaaccagatcgttagcgccaatggattccagtttaactctaaaaaagtccggctgcaggctaagaacaagagacaggaagtcactggattgacagtgaacgaaaagccgaatatcacccgcaaattctctaaccagattagggcgattatccacgcaatcgagaaatatgggctggaggcggcagagaaggagtttctggctaaacaccaaaaaaaacaccgcaatccaaaacttccaactgcgagtctgctgcgcgtgctgaaagggaaaatcgatttccttggcatggtacggggcaaatgcgacccgctgtatctcaagttcctgagacagctgaaggccatagctccacaaatggtgaaggacctccctgaacccaggaaggagtgcacaaaagttgaagtctggaccgagggcaagactgattggaagcaccttaaagccgccttcacaaatttaaaaggccaggggtactatatcaatcttgagattgacttcaaggaattcgaagacagtatgggggagggagagctgtttaagcactgtcccatttggagtaagacaacccatcagagccccttgatatgcatcttcgaccgagatattcctactagaacaaaagaggtcatgaataatggaaggtttaaagattggaccaataatgtcttctcttttacgatcccggttccagagcaccgtcagtccactcaagaggtatgcatcgaactctactacaaggattccgaactgaaaagagaagatagtaacgcaagacgactatttctctcgaatgagtttgacgcaaaaaccactattcataaggagattcctggcctcatatgtcctgataagaaggctaaagacgccaagaagttgaccgtcattgacaacaacgtgtaccatagcctcaaccataaacgggagaatatcgccctgccaaaagacgatttcgccagcaaggtgcttgctggcgaaaagaactttgatgactttgacttttcgcagttcaagaagatctttgatgtcattgtggaaatagctgacttttcaaggcgcaattaccccagcaacctctcaccctga

SEQ ID NO: 7955 - RNA, 1641 nt, unidentified
  source 1..1641: mol_type = other RNA; note = synthetic construct
atggaaaagatgcagctgaagcttacagcatcagatgacgaacagattaccaagtttaaaaccctcaaaaactactacgacattgccaatctccttgaggtcgagtctcgctatctgaagtatttgttgtaccaccccaagaagacgcactacaagatcttcttcatcaagaagaaatccggcaatctgcgaaaaatctgcgcccccatttcctcactcaaaattatacaacagaagttggcacacgtgctttatctaatctatgctgcaaaaccaagtacacacggcttttgtccaaataagtcaatcgttacgaatgcccagctccatatcaagaaaaagtacgtcttcaacatcgacattaaagacttcttcccctcgattaactttgggcgggtttacgggatgtttaacgggtggccttacggccttccgtcgcgtgtcagcgctgtgcttagcaagatctgctgcaacgacaacgaattaccacagggggcccccacctcccctataatcagcaacatgatttgtgccaagttagatagcaaactccaggaactcgctaaacggtgcaacattacttattctaggtatgcggacgacataaccttctcctccacttcccggttgcctaaagagattgtggaatttgaaatcctggattccagtgtcgccataactacaggcgaaagacttcgaggtgttctgaacaacaatggcttcgagataaataacgaaaaggtgaggctcaagtataagaccaatcgccaggaagtcactggactcacagttaacgagatcactaatacaaaaagaaggtacgtcaaacaggtgagagcaatgctgaatgcctgggagaagtacggcttgaaaaaggccgacgaggagcatttcaacaagtttaacataaagcagcgtaaccccgagttcaaaaaagccagcttcatgcaaatcgtggaagggaaaatcagttttatcaagatggtaaagggtgagaagtctcccgtttaccggaagctggccaacaggttcattaatctatctggcaaaaagaagctgaagtatttcatcgatccaaacgatgagattaaagctgctctgtgggtactggaggacgacattacgggataccaaggcagcgcttttatgttgagcggagtgggactggtgacctgccagcacgtgctgtcaaagaatatccaggctttcaagtgtgaagatccatccaaaaaataccgggtatcttctgtactgcaagacaaagattgtgatctggcaattctaaaaatcgataccgaggatagtcattatttaaaagcgggaagatcagaggtgataagacatggtgagctgatcacaatcgctgggtttcctcaataccgactgggaggttctcttattatcattgagagcaaagtggcaggtttctatcctcgctttaattttaagaggatcctcatcgacaaacagattgtgggaggcaatagtggcgggcctgcgctgaatcgcgataatgaggtcattggcatcgtggcaaccggggccgaaaattttgaaactaccacaaagaccatagagtatggaatcattccgattgagctgatattcgaaatgctgaagaagagcgagatctgtatttga

SEQ ID NO: 7956 - RNA, 1611 nt, unidentified
  source 1..1611: mol_type = other RNA; note = synthetic construct
atgaacaactatatagaagtggacaaaaacgtactaagggaattcaagaacctgaagaatgagagggatgttgctaatttactccaaataccctataacgtcctgcattactacattgtcatcaataggaacaacaactacaagaagttcatcatcaaaaagaagaacggagaaataaggaccatttatgccccaatcagttcactgaagattcttcagagaaagctccacaaaattctgagcgagttctataaggtgtactatcgcccatctgtgtacggcttccgagataatctcagcattgtggataacgcacggaagcaccaggataagaagaacattttccacatcgacattaaagacttcttcccttcaatctcttataaaagggttattgggttactctcatccgggatatttaactttccatactccgtcagcatcatattaacaaaaatctgctgttaccagggcatgctgcctcaaggcgctccgacaagccccatcctgtccaatattatttgcagtaaactggactacgagctgcaactcatctccaaagacaattattgcacgtatacaagatacagcgatgacatagtattttcaaatacggcgaatactttccctaaagacatcgctaccgacggcaaatgttcagacaaactcgtgagcattctgctccggaatggattcaagatcaatgattccaaggtctatttgcaaaggaatattcagagacaggttgttactggactgacagtaaatcagtttcctaacgtgaaacggatttacgttaaaaagatccgtgccattttgcattcctgggagaagtatgggctaaagaacaccgagtccatctactgtaagaagcgggaagtcgagaaagaaaaccggaaggaatttatgtgttctttggtgaaggtgattgagggcaaaattgcctttctgaagatggtgaagggtaaggacaactacacctacctcaaaatctacaagagattctgcgatcttattgggcgcgaatttccctaccacgatctacttaatgcactgaaagtggagaaacgagtcatgcttaataagtacgccaagtctatcagaaaatgtatctaccggtgcaatcagtcttacgcttacgatatctttaaacccacgaatgatcttatcaacagtttggacaatcttggaatcgacgccagagattaccatcgttttggtgataggatcgacgatttatatatgatcttctatgagggaaccggttatatagaacgcctgaaggagcattctttggatcgtacaataattaccgaaatcaacatactcaggacctattatcgacacgacattgatcacgggaagactaatgagatccgccggaaacgaataaaaacgatgaaggtgattcagaagtacatcaacaaaaacagcattatcaacgcaagtgaattggacctgtatatcttccagaagaagctgtacgacaacgtgatgatatttctggaagagctggaggagagcatcaataagaatacctataacaatgacacgactggcaacatccgccgcctcatcaaagagattattagttcgctgaaaagactgtga

SEQ ID NO: 7957 - RNA, 1530 nt, unidentified
  source 1..1530: mol_type = other RNA; note = synthetic construct
atgcaggcattttttaaggcgtccaatctggaactgattaacagatttcacaaagtcgatgggttaattgacctggccaatctgctggaggtggattctagcgagcttctgcttctgttttacggattgaggcgggggggcggctactataaagagttcagcatcccaaagaaaaccggcggtgaacgcaagatactggcacccgactcgcgcctcaaattcgtccaacggaaactggcttacgtgttaagtctggtgtatttcggaagacccagcgtccacggtttcaggctaggtagaagtataattaccaatgctgaatgtcacgccagaaagaaatgcttgctcaacatagacctcaaggacttcttcccaactatacacttcggccgggtgcgagggcttttgcaggctaaaccctatggtctatcaaaaacaggcgcgaccgccgttgccggaatctgttgcttttgggggaagctgccccagggggctcctacttcacccgtaatttccaatatggtgtgcgccaaactggactatgagcttcaagccctcgccaggggagagggagctacctattcgcgatatgcagacgatatcaccttctcaactcaaaggaggaatttgtccgagaatatcgtgaagttcgaaaattctagctttattgctggccctaagctggttgaaataatcaggaagaatggcttcgagattaacaaggataaaattaggatgcggttccttaccgaaagacaggaagccaccgggcttgtggtgaacaagtttcccaacgtcaaacgttccttcatccgcgaaatccggattatgctgcatatgtggcggaaatttaacctagaaacagcctccctcttctatggtatgaaatttccaggacgtgagatctactttcctgaaattgtacgaggtaagattaacttcgtgaagctggtaaaaacggagcgggatccaacatacctcggacttgcagagaagtttaacgacttggtgggcaaacccgtctttaaaatcgtgccaatcaaggattggcctgacgaggagtacatcccggcaggacatcgctacagagccatcgagacgctcgagactatcttcgctaacgctgacaaggaaatcttaatcagcgacaactttctccgaaaagatatcgttggcctactggagaagcaggttggccgcagccctcgcctgaagattcgcctgctcttttctagaggccgttacaagtcagaggagcgaaagtacgcagagtgcattgaagcaattaagaagatggtgtccctccataaagatctgtctatcgactgtcgggaggttttaccagggggccctcatgggagaaatattatcatagaccgggaagaagtctaccacagcggacacagtttggatcagctggggtctagggccgatagtatcataaggatgcgcatccagtccgccaagagagatgccctgcaggacatcgagacatggttcgcgaactctgctgaaattccgttgatttga

SEQ ID NO: 7958 - RNA, 969 nt, unidentified
  source 1..969: mol_type = other RNA; note = synthetic construct
atgcgcccggatttgctgaattcccctgaggtcctcaaagaaaagtttcggaacctaaaaaccttgatcgacgtggccgatattctggaaattgattgcaaaaccctgatttatctcgtgtaccggaagaataagcctacaaattacaaggaattcgtgatcaagaagaagtctgggggggaaaggcgtatactggcacccacctccactctgaaaattctccagagaaagctgaactacatcctgtcaatctgttacgagccgaggccctcagttcagggttttgtcaacaatagaaacatcgtgagcaacgcctccgcccatagcggaaagaaaatcgtgtttaaccttgacttgaaagacttctttccttcaatcaactttggacgggtaagaggcctcttcttaaaaccaccattcagtctcccagcacccgtcgcaactgcccttgcaaacctgtgttgccacaataatcagcttcctcagggtgctcccacatctccaatcatttccaacctcatctgctctagaatggacggagcgtttcaagcgctagtaaaaaaatataacgccgtctacacccggtatgctgatgacatcactatctctacacgacaagcttttttccataaagagattgttgagagtgggtcggcccctctgtgtgggaagggcatattaagtatcattgcaagcaacggcttcattataaatgatgccaagacgcgcatattacgtacaggtcgaagacaggaggttactggactggtgaccaatcgcacgcccaatatcaagagggagtatattcgggaaattcgagtgttgctggacaagtggaggaagtacgatctgagggtggctgaggaagcttatttcaagaatcgccttaaggaacgcgccccacacataaagagcgtggagttcagcaaaatcattgagggcaaaatcaacttcgtcaaagacggctga

SEQ ID NO: 7959 - RNA, 1656 nt, unidentified
  source 1..1656: mol_type = other RNA; note = synthetic construct
atggatacgcagctaaaggcgagccaggatacaataatttctttatttgcagcactgcgcacccccagggatgttgcgaaacttctcgaagtgccttacggccttttgatctatcatctccacaagactcccccaagcacccgttatatctctttcgccatacgaaaaagagccggtggcgaacggattatttcagcccccggaaccgcgctgaagatcttgcaaatcaaactgaattacgtgctcaaaacagtataccgtccaaacagctgtatttatggattcatcgtcaacggagggatcgtgaaaaatgcaagcgtccatgcgaatcggaggctggtgtttaatctcgatctgaaggatttctttccaagtattcacttcggtcgggtaaagggcatgttctcatctcctccctacaactgtccctccgaggtgtcaaccgtcctggctcagatttgctgtcttcccaagacttatccctccctggctccatatgctcaattaccgcaaggggcccccaccagccccattgttagcaacatggtgtgctcaagtctcgactcccaactgctaagactagccaagaagtacaagtgcagttactcccggtacgcagacgacattacattttccactaacctgccacgcttccacgaggccatcttagtggagtcccaggccgaggaaggccgcatctctgtgacagctgggagtgagcttaaagctatcatctctagcaacaccttcagaattaatgagaacaaagtccggcttcagagggcaatgcaacggcagtcagtgactggcctgactaccaataaattccctaacccgccaagacgcttgatacggcaaataagggcaattctgcacgcttggaccaagtatgggtatgagaacgcccagaacgagtttaggtcacgatactttaatagaaccaggaatcctaacaagatggctcccgagctgaagcatgtcctgcacgggaagataaactatgtgggcatggtgagaggccagacagacccactgtatcttagctatctcaaacagctgaaagccctggcccctgaactcattattaggcaggtgattgacgttatggacgccctgtgggtcctcgaatctgatggcgcttacgcccagggaacgggatttagtttgaaggggtacggtatcgtcacctgctatcatgtgctgcgagctagaacaaaactgttcaaggccaatacgcctgcaaagaagtacaacatcgaagtcatcatacaggatcaggaactggacatcgcagtattggccacggacgggcctcagggccctgaattgctcctagaagaaggagagcgtccacgccaggatgactggattcttctgacagggtacccttcttactccgcccacgcaaccggagtggtcagaagggggcgggttactggttactatcagtttttcggcactgagcgaatgctcatcgacacaccgatcgtgtacggcaattccggtggacctgtgctcaatcaaagcaataaggttgttggcatcgcggccaaaggacccgtatcgttgaacgatgcccagaaaacagagaaatttgaggtgatcccgatatcgatcctgcgccgcttagctcccccagcaccaactgctcagtga

SEQ ID NO: 7960 - RNA, 1587 nt, unidentified
  source 1..1587: mol_type = other RNA; note = synthetic construct
atgaatacagagctaaagagttcggacgaggaattgaaaaagaaattcttcgccctcaagaataaacacgatatatgcgccctgctggaaatcgacattaagactcttatctacatcctttaccgaaaaatgccatcgaccaattactccactttcacgattcagaaacggtctggggggcttcgcgtcataaatgcacccagcacatctctgcgcatcctccagcagaagttgaactacatttttcagctcatcggtatgatcgctccttgtgctcatggctacatcaatggtaaatccatcgtttccaacgctaagcctcacgccaagaaaagatatgtcttcaacctggatatcgaggatttctttccaagcattaattttgggagagtgagaggtctgtttatgagctacccgtactacctgccaaaagaggccgcaactatactagctcagatttgtacttatgagaacgaacttcctcagggcgcaccaacctcacccatcatatctaatatgatatgcgtcaagatggacaagcagctcatgaaactggcctatgataccaaaagctattacacccgatatgctgatgacatgacattttccacaaccctccggatgtttccctccgaactggcttataataaggccagtggggaaatcgtggcgtcttcaagtcttaccaaagtgattatcgacaatggtttcaagataaacaactccaagattaggctgcagaagtctacccagtcacagcaagtgaccggcttgaccattaaccaaatgcccaacgtgaaaaggacttatattaggaacattagggcgatgttgcattcttgggagaaatacggattagataaagcagaagaagaatatctgagtaagtacaactatcggaacaaggattacatcaaaccatgctttcaagacatcgtgaaaggaaagataaacttcgttaagatggtaaagtcagaggactcaaaagtcttccggaacctagcgattaagtataatcaattagccggaagtggattcagcgattatacaatcaatcagccctcagaggagatcctcttacagatctataccgagggaaaaaacacagaacatatcgagaaggcaattcacatactggacaaagatttgtctgccctgatttacaacgggaagattaagatcgttaatggggtagagcacagaagcggcgaccagcaactcaagaccacatacgagattatgagcaaaagtaagaactccaacaagttcttgtttgtgtgggattgtgactctaagaataagattaatagcctggttgaggagaataacttcttcaagtttgtgtttgcctccaacactgataatacgaaagtcgaaaagggcattgaaaatctctatcctgagtccctgttcactcaggacctctactccctggaagaaacaaaaaatgattacggcggcaaaaagagcgaggagaaattcgacaaaagcaagtttcttaacaagatcaaggaagaaacggacccttacgtgtttgagaattttaagccgctgttccgtgagatccgcaacatcctggacatgtga

SEQ ID NO: 7961 - RNA, 1584 nt, unidentified
  source 1..1584: mol_type = other RNA; note = synthetic construct
atggacgtcgaattaaattactccaatagggagttgaaacagaagtttgctaacctgaagagtttgcgggaggtttcagatcttctcgagatttccagtgacaagctcaagtattacctctacattcttgatgacgagaagaaatataacgagttcaagattccgaagaggtcaggtggcactaggtctatctcagcgccaaacgatagcctgaaaatcctacagcagaaactgaaccatatactccggttgttctacaatccccgcgtttgcgtgtacggttttgtgaacgacagggatatcgtggaaggggcctctaagcatacggacaagaaatacgttctcaacgtggatattaaggacttctttccctctatcaatttcgggcgggtgtggggactgttccaagcaaaaccctttaatcttcccgaggaggccgccacagtcctcgctcaaatctgtatctttaagaattcactcccacaaggagcacccaccagtcccgtgatatcaaatttcatttgtgccaaactggatagtgagctgactcgacttgctaaaaagcataaggtcacatatacaaggtatgcagacgacctgacattttccacaaccatcccagttttccctaagagcctggccaaaattaacgatgccgggcagactatagtgggatctgagttggaggagatcattaacgacaacgggtttgaggtgaatcacgataaagtcaaattgatgaacagcagtcaacgacaggaggtgactggcatcaccgtaaacgaatttaccaacgtaaatcggagctacgtccggaaaatcagagcaatgttacatgcatgggaaaagttcggttatgaaaatgctgaagacacttttcacagagaatattgcaaccctggtataaaccctgaaagatccaaacctcctcttgataaagtaatcaagggaaaattggagcaccttggcaaggtgaagggcaagcacgatccggtgtttctgaagtattatcacaagctcgtaaaactagacgataagtacgaacgcgaacactataataagaagtaccagctgctggaccacaacgaataccccttcatcctggatcgcttgaatgaccgtttccaggacatcaagaagctgaaaccacatccgagaggctatgcgttcgaggacttcttaaacgagctgttcaaaacctactcgctagagccacgaaagccttttaagaatgtgggggagcagatcgacggatccctgaattttgagggaaatgcctacctgatagaagctaaatggcaggataaaaacatcgaggccaaacacctgaataatttccaggtgaaagtcgactctaaggccagctgggctcgcggcattttcataagcatctccccattcaccgatggatgcctgaaaaactttcgcgaaggcaagagcacgaagctcctgggcattctgggggatgaaattgaatccatgctcaagcataaaattgacttaagagaggttctgaagtacaaagcccgtaagtctgtcgagacaggcgattttttcaccaggattgagaacgaacttaaatga

SEQ ID NO: 7962 - RNA, 1095 nt, unidentified
  source 1..1095: mol_type = other RNA; note = synthetic construct
atgagtaaagatacaagccattctctcctcctttatgacagttgtaaggaactgagtgagaaattcaagaagcttgagtcgcctcaggacgtggctcagctgctggaagtaccgtacaagaatctcatctactatatctaccgaaaaagcgaagatagccggtacaatacatttatcgtgcctaagaagtccggcgggtctaggacgattcattcccccaataaatctctggcgatcatacagaggaaactttcccaggtgctgtacactatctatagacctcgtgccagcgtccacggtttcgcagccaagcgtagtatcgttaccaatgcgaaggcacacatcaagaagaagttcattctgaaccttgacttgaaggattttttcgattcgatcaactttggacgcgtgagaggggtgttcatagccaagccatacgaagtcaacgagaaagttgccaccattctggctcagatctgctgtttcaacaataaactgccgcaaggcgccccctcttctcccataattagcaacctgatttgcgccaaaatggactccgaattacagcggttcgctgaggagtacggattattttataccagatacgccgatgacataactttttcaattaaccgcgatgaattgccatctgcactggtcgactcctataaaaaaggcctcccacatgtggtgctcggtaaggagttgaaatccatcattgagaagaacggattccagattaacgatgccaaagtcagactggcctataaaacacagcgacaagcagtcaccggcctgatcgttaacaagagcgtgaatgtaaaccggaaatatattcgcaatctctacggggcactacacgcatgggagaaatatggtctagaacaagctgtggagacttatatatcaaagtacgctaaaaagcccattctgccagagaaggacattcctgcttttttggactcattgcgcgggaagatcgagttcatcggaagcgttaggggcaaagacgatgacctgtaccagaagctcttaaatatctttaatggccttaggcggaaggaggccgataaggaatcaatcgctgtggaatga

SEQ ID NO: 7963 - RNA, 1095 nt, unidentified
  source 1..1095: mol_type = other RNA; note = synthetic construct
atgtctaaaaacttgtctcattcgattctgctctatgatagttgcgaagagctgtccaagaaattcaaggaactgaaatcgccacgagatgtggctcggttgctagaggtaccattcggggacctgaattattatctctacaggaagtccgaagacagcagatacaaaactttcattgtgccgaagaagtctggcggttccagaaccatctactctccccacaaatcactctccatcatacagaggaagttaagtcaggtgttgtacgcggtgtaccggccccgtgcatccgttcacggctttgctgtccagcgcagcatcatctccaatgcaaaggcccacacgaagaaaaagtttatcctgaacctggatataaaggactttttcgactcaatcaacttcggaagggtgcggggggttttcataggcaagccttatgaacttaatgatcaagttgccactatactggcgcaaatttgctgttttgacaacaaactgcctcagggagccaggacatcacctatcatcagtaacctgatttgtgccaaaatggattcagagctgcagcgctttgcagagaagtacggttttttctacaccagatatgccgatgatatcacttttagcattacacgtgaagagcttccaaccgagcttgtcgcttgctataagaagggcctccctaaggtcgtgcttgggaccgagctacggagcatcatcgagacgaatggctttgaaatcaatgaggcaaaagtccgcctcgcctacaagacccagaagcaagaggtaacagggttaatcgtcaataacaagagcgtgaatgtgaacagaaaatacatcaggaacatatatggcactttccatgcttgggagaagtatggactggagaaagctctcgaaatttacaagagcaagtatgccaagaaaagcattcttcccgagaaagacattccccattttctcgatagtctgcgcggaaaaattgaattcattggttctgtgcgaggaaaagacgacaacctgtaccagaaattattgaccatcttcaatgacctgaaatctaaggagacaaatgccgaaaacattgaaaaatga

SEQ ID NO: 7964 - RNA, 1134 nt, unidentified
  source 1..1134: mol_type = other RNA; note = synthetic construct
atgaagaagaaagcatacctgtcgcttttcctgtacgagtcttgcgaagagttgtccaagaagtttcaggagttacaatcccctcacgacatagctcagttactgcaagtcccatatgagtatctgacttattacctgtaccggatccctcatggcagtcgttacacagagtttcgggtactgaagaaaagcgggggatacagaaccatccacagcccgaagggatcactagggattgtgcagagaaagctcagccaggtcctgtatgctgtgtacagaccacggccttcagttcatgggttcgccgccagccggtctatagtgaccaatgcaaaagcccatgtcaacaagaaattcgtcctgaacgtggacatcaaagatttcttcggctcaatcaactttggccgcgttcggggtatgttcatcgccaatccatacaaattggacgagaaagtagccacagttcttgctcagatctgttgcttcgataacaaacttccccagggcgccccgacgtctcctgttgtttccaacctgatttgtgcgaagatggactcagaactacaacgatttagtaaacagcatggtctgctgtacactagatatgccgacgacataaccctcagtagtaaccgcaacgaactccccacttctttagtctcccactatgagaaaggactacccaatgtgatgctgggagatgagctgaggtccgtgattgagagaaacggctttcagattaatgaggcaaaggtccgcctcgcttataagacccagcgtcaagaagtgaccgggctcattgtgaatcaaactgtgaatgtatctcgcaaatatgtgcggaatatcgacggtgctctccacgcctgggaacgatatcgcctggaggctgcgacagaaacctaccgagcgaaatacgccaagaaaactactttccccgagaaggaaagcgcactcttccttgatagcttgaggggaaaaatcgaatttgtgggctccgccagggggaaggacgatcacctgtaccagaagctgctcaagaagtttaatgatctgaggaccagggaagcaattgaccagaagacaacagagacagagccattgcagaccacgttggaacttccctttaacgattga

SEQ ID NO: 7965 - RNA, 1077 nt, unidentified
  source 1..1077: mol_type = other RNA; note = synthetic construct
atgaataagaacagttctttatcaatcctgttgtatgattcatgtgaagagcttagcaagaagtttaaacaactacagtcccctcaggatgtggcacggctcctgcagatcccttacgactatcttatatactacctgtaccggcggcccgatgacctgaggtacacaacattcagcatacccaaaaaatcagggtcgcatcggactattcactctcctcacaaatctctcgccattgtgcaaaggaagctgagtcaggtcttgtacgcggtgtattctccacgcccctccgtccatgggttcgcagcttccagatccatcgttactaacgctaaagctcacaccaagaagaagttcgttttgaacattgacatcaaggacttttttgattccattaacttcgggagggtgcgtggtctgttcatcgccaaaccgtacgagttaaacgagaaagtggcaaccattctcgcccagatttgctgctttaataataagcttccccagggggctccaagtagcccaattatcagcaatctgatttgtgcgaagatggattcagaactgcaacgcttttcgaaggagaatggattgttttatactaggtacgccgacgacatcaccttcagtctgacaagaaacgagctgcctccgggcctggtaagttcttaccagaaaggatttagccaggtagtgctcggcaacaaattacgatcaatcatcgagaacaatggtttccagataaacaatagcaaagttagacttgcctatagaaatcagaggcaggaagtaaccggcctaatcgtcaatcaaggcgttaacgtcaatcgtaagtatatccgcaacgtctacggcgcactgcatgcctgggaaaaatacggccttgaggaagccgtgaaggtgtatataagcgagtatgctaaaaagtccgtgtctccaaagcagaagtatatccaagactaccccgattatctgacgtccctgcgaggaaaaattgaattcataggaagcgtgcgcggaaaagatgacggtttgtaccagaagctcctcaacatcttcaacgagctcattaataagtga

SEQ ID NO: 7966 - RNA, 1101 nt, unidentified
  source 1..1101: mol_type = other RNA; note = synthetic construct
atgaagaagaacatctccttatccccattgttatatgattcttgcgaagatctatctagtaagtttttgcagctcaaaagtccgcgtgacgtggctagactgctgcagatcccatacaactatctgatctacgccatttatcggaaagacgagagcctgcgataccgtacattcaatatccctaaaaagtcgggggattaccgagtcatttcctcccctcataaatccctcgccataattcagcgcaagctgtctcagattttgtacgcagtttataaaccccgccccagtattcatggctttgcggccaagcgcagtatcattaccaacgcccaggcccacaccaagaaaaagttcatccttaacatcgacatcaaggacttcttcgatagcattaatttcggcagggttagaggcctgtttatggcaaaaccttacgaactgaatgaaaaggttgccaccatcctggcccagatatgctgtttcaataataaattgccgcagggagcaccatccagccccatcatcagcaatctgatctgttcaaaaatggactcagagcttcaaaggttcgcgaaggagtattcgctgttctacacaaggtatgccgacgatctcacactatcattgactcgggatgagctgccttccgagctcgtagcttcatacaagaaagggtttagtcaggtcgtcattggaaatgaagtgaggagcattatagagcagaacggctttcaaattaacaattccaaggtccgcctggcacatcggacccagagacaagaagttactggccttattgtgaacaaaaatgtgaacgtgaaccggaaatacatcagaaacattttcgggactttacacgcttgggagaagtacgggcttgaagaatctgtaaagacatacataagcaagtatgctaagcaacccatactctctcagaaggacgtgccaacgtttctggacagcctcagaggtaagatcgagtttgtgggatctgtgaggggtaaagaagatcccatctatcagaaactgctctcaatatttcacggacttaagaacaaagagatcgataacgctattgtcgtggacagcgagaattga

SEQ ID NO: 7967 - RNA, 1065 nt, unidentified
  source 1..1065: mol_type = other RNA; note = synthetic construct
atgtatgaaagttgtgaggacctcggaaagaaattcaaggagctgaaaagtgcccgagacgtggcacagattctcaaggtaccatataactacctcatttactacatctaccggacctctgagaattctaaatatcagacgtttaacctggagaagaaatccgggggctacagaacaatccactgtccaaataattccctggaaatattgcagcggaagttgtcacaagtcctgtattcggtttacaatcctaagccctgtgtacatgggtttgcagccaacaggagcatcgtcactaacgccaaggtgcatacaaggaaaaagttcgtgctaaatatcgatatcaaggactttttcgacgctattaattttggtagagttaggagcctgtttattgccaagccctatcaattgaataaagaggtggccaccatcctggcgcagatctgctgctttaaaaataaacttccgcaaggagcacccacctcacctatagtcagcaacctcatctgcgcgaagatggacaaggaactgcagaattttgctaaagagaacgggattttttacacacgctacgccgacgatatcaccttctcaataaaccgtgagaatcttccatccgggctggtcagttcttacagcaagggttttagcaaagttattctaggcgacgaactcagatccattattgaaaacaatggcttccagatcaacgagagtaaggttcgattagcctacataaatcagagacaggaagctacaggactggtggtgaacaaaggcgtgaatatcaaccggaagtgcatccgcaacctgtacggtactttacacgcttgggagaaattcggcctggagcaagcacagaagacttatatcttcgagtatgctatcaagcctgtgagccccaacaataaggtccctcccttcttggattctctgcgcggaaagatagaattcattggctcagtgagggggaaagatgatccactttatcggaagttacttaacattttccacgaactcaaagaaaaggagtccgataaaaacaacatcattgtgccgtga

SEQ ID NO: 7968 - RNA, 1095 nt, unidentified
  source 1..1095: mol_type = other RNA; note = synthetic construct
atggaatcacgctctgatttcctgcagcccctcctgtacgaaagttgcgaggaactggccaagtcctttaaatcgctgaagtctccacgcgggctagcaagcctgttgaaaatcccatatgagtatcttgtgtactatgtataccggtttccccaggacaggaaataccgagctttcaaaattttaaagtccagtggaggtcatagggcgattctggtgccaaataaaagcctcaagatcgtacagagaaagttgtcacaggtcttatatagcatatacaaccctaggccgtgtgtgcacggatatgttcccggcaagagtattattaccaatgcaaagtctcatactagaaggaaattcatcctgaacatcgatatcaagtcattcttcaagtctatcaactacgggagagtgagaggcctctttatcgccaaaccttattgtttaaacccccctgttgccacatttattgctcaaatatgctgccacgagaatcatcttcctataggcgctcccacctccccagtggtttccaatctaatttgctccaaaatggatagtgagctgcagaggtttgcaaaggagcacggttgtttctatacccgctacgtggacgacatgacttttagcatcaacaagaagaatcttcccagcgctctcatagccaaccatggccctggcttttccgaggtggtcctcgggaatcaacttcgtgagataatcgaagaggataatggttttcagattaacagcagcaaaattcgtttgcggcactacacgcaaaagcaggaagtgacaggactgaccgtcaacaagttcgtcaatgttgaccggaaatatattcgaaacctgctcgccaccattcacgcgtgggagaagcacggcttccagaacacgatcgacatgtatatgaaaaagtacgccaaggaatcggtcctgccagggaaagaaacaccgaacttcctttcttacctccggggaaaaatcgagtttgtgggctctgtgcgcgggaaaaatgacttgacatacaagaagctgctgaataaattcttcgaactgaagactagagattcaaagatgatccggggaatctga

SEQ ID NO: 7969 - RNA, 1119 nt, unidentified
  source 1..1119: mol_type = other RNA; note = synthetic construct
atgcgtaatcagaaaaccatctccctggaaggacgcacagacgatctgcagcaagactttctcaaggtcctcaacaacagagacttagcgaagctgcttgaaatctcatatcctcagttgatctatcatagcctgaagacaattaatagtgtcactcggtatcaaacattccaggtccagaaaaagtccaaggggactcgtaaaatttgtgtgcccaacaagtctctgaaaatcattcagactaagatatcccagatactatacagcatttacgagcccaaaagttgcgtgcacgggtacgtggttgagaaaagcataatcaccaatgcaaagtcacacaggagaaaggagtttattctcaatctcgacatccgcgattttttcggatctattaatctcggccgggtgcgggggttattcatcgccaagcccttcagcctgccaaaagaggtggctaccactatcgccaatttgtgttgccacgaaaataaactaccacagggcgccccgtcttcacctattctgtccaaccttatttgccagcaattggatagagagctccaatatttcgcacagaagaatcgactttattataccaggtacgctgatgatatcaccttttcgagcgagtatctggagagcctcaagtctctgataaagaacctggaattagtaaccgaaaactaccctatcctgctgaacaacgaacttgagtacattttcacaaagaatggtttcaccatcaaccaaaagaaggtgcggctcctgtacccccatcaaaagcagcaggtgacgggcttgattgttaacgaaaagctaaacgtggacaggaagtacatcagaaatttgagggccgcattgtatgcctgggagaaattcggacttgaggaagctagtcaggtttacctggaaaaatacgcgaaaactcctacactgcgaaggaagaaaaaaagttcttttatcgaggccattcgcggcaaaatcgagtttctgaagaatgtaagaggtgaatcagatccaatcacacgcaagtttctggacaagtatagcgagctctacgaggaatacaaaaaaaacgtcatacaggctaaagaggagccagactcccagtccacgtga

SEQ ID NO: 7970 - RNA, 1110 nt, unidentified
  source 1..1110: mol_type = other RNA; note = synthetic construct
atgcggaaccagaagaccattttcctcgagggcaaaacagatgatttacagcaggatttcctgaaggttctaaacaaccgcgaccttgcaaaactgctggaaatctcatatcctcagctgatttactactccctgaagactatcaactccgacaccagatatagaacatttcaaatccagaagaagacaaagggtacaagaacgatttgtgttcccaataagagcttgaaaatcttacagaccaagattagccaaatcctgtacagtatctatacccctaagagctgcgtgcatgggtacgtcttcgggaagaatatgattactaacgcggcagcccaccgacgaaaagcatttgtgctgaatttggatatccaggacttctttggatccataaatctaggtcgggtgcgcggcttgcttatggctgaaccatttagtctgagcaataccgtcgccaccaccatttcaaacctgtgctgctaccagaataaactaccacaggggagcccgagttcccccattctgtccaaccttatttgtcagaaactcgatcgggaacttagccattttgcgaagaaacaccggttctactatactagatatgccgacgacataactttttcctcgaagagtttggatgccctgccattcctgattaagaatctggaccttgtgaaggagaaatatcccatactcctctctgacgagctcgaatacatattcacgtctaacggctttacgctgaatcagaataagatcaggatcctgtatccacaccagaaacaacaggtaacaggacttgtcgtgaacaaaaagctcaatgtgaaccgtaaatacatccgtaacctgcgcgccgccttgtacgcttgggaggaattcggactggagaagacatctcaagtgtacctcgagaagtacgctaaaacacccactttgaaacagaagaaaaagtcaccttttgtcgaggcaataaggggcaaaatcgaattcctcaagaacgtaaggggcaaaagcgatcctatcacccagaagttcttagacaaatattcggagctctattctagggacgttactcaagctaaggatgatcaggactctcaatcaacctga

SEQ ID NO: 7971 - RNA, 1056 nt, unidentified
  source 1..1056: mol_type = other RNA; note = synthetic construct
atgtacctggaatccagctgtgaaaggctcaagcacgattttctaaagcttgagaataaccgtgagctagctgagctcttaaacataagcttcagccggatcacctactatgtcgtgcggataccagattcggcacggtaccgctcctttcagatcaaaaagagaagcggcgggtttcggaagatcgatacacccattaaatcactcaagatcatccagcagaaactgtctcaggtgttgtattcagtctaccaggaaaagtcttgcgtgcatggcttcgtggtaaacaaggacatcattagtaatgcacgagctcacaccaaaaaggacttcgtcctcaacatcgacttggagaacttctttggaacaatcaattttgggagggtacgcggcctgttcattggagaaccctataatctgccccaggacgtggcaactatgattgccaacatttgctgctataacaatcagctgcctcaaggtgcccctacgtccccgataatatctaatatgatttgtgagcgcctggacaggaagctgcagcaattcgccaggaagtataagctgttttacacccgctacgcggacgacattacactgtcagcgactcgaaaggagattccttcctctttagctaccgtctcacccgagaatagaaacaagatcgagcttggtgacgaattgcagaaaatcatttacgagaatgggttctccattaatcataaaaagacgagaatcgcctatagtgatcaatcccagaaagttactggcctgatcgtgaacaagaccgttaacgtgccacggaaatatatccgagacgtgagagcagcccttcatgactgggataaaaacggctatagcaaagcccaggaaaagtaccaccttaaatacgctaaacaaccatcactgcagagtaaggatagcccttctttgcacgattccctgagaggatctatagaatttattgggcacgttaggggaaggaaagataaggtgttctgtcgcctcatcgccaagttaacagtcctcaaataccgtgatctgagcaaaagttga

SEQ ID NO: 7972 - RNA, 2148 nt, unidentified
  source 1..2148: mol_type = other RNA; note = synthetic construct
atgatagagtatgacaacaagtacaatcagtacttgcataagttcaccaaaatcaagacgtctctatctgaggataaatttaggctggtagaaatcaatctgaaaactatcctgagtaccaaaacattcaatggcctcttattcaccaatgagtgtcttaactacttcatcaacaaggacaagaataagtttcccgattggttcataaacaacattgaaagcgagatcaagcgtcgcgacgagctcctcaccctgaagaataatttcttcaagatcaaacacgagcacgagttagcggggatcttagggctggactacggtactctggtatatcacatcttcaaggtgcctgacaacaggaagtataagattttcaagatcccgaaaaagacaggaggatataggactctgtgttctcccatcagtaacatcaagttgatccagaaaaagcttagcgaaatcttgtacgaaatttatatccctcggattaatgctcacgggtttattcccggccgtggcattgtaaccaacgcacgaatccatgtgaaacagaatgcaatcctgaatattgacatcaaggactttttcccaaccattaatttcggccgggtgcggggcctctttctgaacaaacctttttattttcccaagtggattgcgaccttaattgctcagatctgcacataccagaatcagctgccacaaggatcaccagtgagtccaattatctcaaacatgatttgtagcaagctggataacaagcttagcgcaatctcaaagaagtatttctgctatttctcgagatacgccgacgacatcactttttccacgaagaaatatgatttccccgaggagctcattaggaaaatcaggattatcattgaggaggaaggattcatcgtgaataataacaagttccgcatccagaaaaagaatcagcgcaaagaggttactgggataacagtcaacgaaaagttgaacgttaagcgaaaatacatacgcaaaatacgggccatgttatcatcctgggagaaactaggatatgagaacgccaacaacacttttaacaagaaaattaagcccacttacccccacattaactttctccctcgactcgataattccttgcatggtatgattgaatatgttggtcaggtgaggggaaaagaggacaacatatacctgaagtttctagagaagtacaatgcccttaataagacaccacactccgaaagagccataaacaataacgaaacagactcaaaagtggagaaacgggaagagcacaatcaaaacccgcaacatgtgcctataaaagtgtgcgaactgctgaatagctttaaaaaagagggctcttacctcaagaaactcgttcacaatgatgaggataagcctgacctgccaaaaatcttggacggtgctaaaaatgagatcaacaccaagaagtcaattctgccctacgaactttattccaacatttgggtgaacctgatacgtctttacgaaaaggaggggatgggcgtctggaatagaaatgataagaagcacccaattagtattaccaagttcaacgacaagatcatccaatttaagaaggatatcagattcggcgcctcttcggatcagacgagcatgtttacaaccattcagtccattatcaaagagctacccaacaaacagctcgaaaacaagattaaagtcaaccctaatctggacaaattggacatctatactgatgtgcagcatatcagaaatgggttgaagataatcatagagcacgttattaagtacatcgacaaagggaatggaattcggattaatctgtccgaacttaaatgggtcaatgaaaagctgtacaagtatgaaatcagcatctgtaacctgaactcctctagttatatcaacaagcaggtgctgattaagcgctttaacgatctcgagcatgacctcccaaaactgaaagataaacacagttccaaagggcatctgtttaatagatgcgactggtacatagaggctatctttgacggccaaataagcaagattaacgtccttagcaaagataacccggatggttctacattcgaagatgcaaatcctaaatctaacgatggcttcacccatatactggtcttctacggaatgtga

SEQ ID NO: 7973 - RNA, 1650 nt, unidentified
  source 1..1650: mol_type = other RNA; note = synthetic construct
atggtgtatatctataagatcgaacctaatcgcagatatacaattttctcaattcccaagcactccaagggtgagcggaaaatctctgtgccctttaaatccttgaagttcattcagaagaagttgagcaatatccttcagactgtgtatgagcccagcattcaaactcacggattcatccaagagcgctctatcctgaccaacgccaagctgcactcacggaaaaagtatgtgcttaatctcgacctcaaggacttttttccaagtattaatttcgggagagttcgagggttatttatccaccattacaatttctcaccagcaattgcaaccgtgctagcccagatttgctgttttgataatcagctaccacagggcagtccaaccagccctattatttcgaacatgatctgctctcgaatggataacgagttggctaaactcgccaaacggtacaattgtatctattctaggtacgcagacgacctcaccttttccacttctgaatactacttcccccatgagcttgctcggaccaaaatcgtgaataatttcacgataacgagactgggcgaagaattgagagacacaattgaggataacggctttaggatcaataacgagaaagtccgcctgcaaaagacaaacgagcgtcagatagtaactggactagttgtgaataagttcccaaatacaacccgcaagtatgtgcgtcagatccgtgcgatgttatatgcatggggtaagttcggactgcagccggccgaggaagagtacttcaaaaagtacgacaagaaatacagagccccctataaaatcaaaccgtcctacaagaacattgttcgaggtaagatcgcctttctgggaatggttaaaggcaaggaggataaggtgttcattcggtactggaaccaactggtggccctggctcccgagttcggtaaaccgatcgtcccaagtaccatatctgcttttatcccccctattatatatactgaaggcaaaaccgaccctaaacacatggaagcggccttgcaacatctgaagaaacgcgggacatttcacgacctgatcataaaattccatcaggaggagggcgattccgggctgggccatgacaacttactcaaaatgtgccagaacttcagtaaaactcctaacagcgaggccaggatctttctgtttgaccgggatgtcccaggaaatgtgaagagtagggtaacaggcaagggagaattcaagtcctgggggaacaacgtcttctcattcttacttcccattcctacgcacagagaaaacaacgcggatagcgtctgtatcgaactgtactttgaagataaggatctgatgctgaaggacgaattcgggcgacgcatttttcttaatagggaattcagcaacctcagcggcaggcacaaatcccttgatttgatttgctccgacagaaataagataaagagttcactcctcgagataatcgattcttcagtctacgattctaatgaccagaacgttgccctgagcaagaacgacttttcgaacctgatactcgagaggaagcatcctttcgatcaggtcgacttttccgcttttctgaagatcttcaaagtaatcggggacattatcagcaaagtgaacgctaatgcatga

SEQ ID NO: 7974 - RNA, 1695 nt, unidentified
  source 1..1695: mol_type = other RNA; note = synthetic construct
atgaagaagtatactgtgaaattaaacgagaacgaaatcaaaaggcggatagccgacttttgtgacgattccaaaggcgaaaaaacgattgaggacttcctcgatacaagtttaaagggcctgaagatcaaactgtacaagaactacaatgaactctataaggaaaagatgatcctcaaaaggaacggtgagcagcgtatattaagagtgccgaataattacctcaaaaaaattcagcgcaacctcaattacatcattcaaacaatctacaagggaaagtttactagtcatgcgtttgagaaagcttccgagggcaaatccaaaaatattatcacaaacgccaagattcacactaataagaagttcatccttaagatcgacttgaaggatttttttccttcaatatcgttcccccgtatttacggagtgttccagaaacctccattcaattttgataacaagactgccaggttgctggctcatatatgcatattccagaagtccctttctaaagacgatgtcggagaactaccccagggggcacctaccagcccaattctgtctaatctggtttgccggaatctggacaatcagcttttcaaattgtgctctaaaaacaagtgtcaatacagccgctatgctgacgacattaccatcagcacgaatctgagcatcatgcctaatgaaatttacagcaacaacgatatctccacccagataaaggagattattaagcagaacggtttcattatcaaccaggaaaagaccaaattgttgacacagaaaagaaggcaaatggtaacgggattggtagtgaacaaaaaagtcaacctgaagcgaaattatatcaagaatatccgcgctatgcttttccagtggcagcaaaagagaatcaaatacatgcgcatactcaagaataagaagaacatcttcaccatcattaagcttatcaagaagtcgaacttcaagaacattaactctaagaacaagaacgagcgaaagaaaataattaaggatctgctgagcaatgacaagtacaacaatactatctacttcattgccatgaaaagtgcactactggatgtggagaaagagatgcacgacaagtactatcagaacaagtttgacaaacccaaatttaaacgggtgctgtcaggtagaattgggttcgttaggaaggtgaggggggatgaggatgatatctatcggaaactctggaatcaatattgctacctgaacaataagaagaagaagatcaaacccctgataatcaagaatgtgagcgacgatccgatttggaatattattaacaaaggggagtctatggagctggaactaaaacaggaatactcagaacagcatttactggagacaatcaacgcctttctcaattccaaatttaatggcacactcatctttggcgttgaagacctgacccacattatctacggcatcgacaaagagctgaagactaagagtaaagacgcctttcgaaatgagatcatacacaaaatcttcgatacctttaacccacagaagcagctgcccgtcatgtgtaaattctatgagcgctacaagaaaaccatttgtataatcgaagtccagccatatggagagagaatctatcttgacgcaaagaacaagatttatttcgaacggatggatgggtattcacaaaaaagacaagacccttga

SEQ ID NO: 7975 - RNA, 1731 nt, unidentified
  source 1..1731: mol_type = other RNA; note = synthetic construct
atgaagaagaagtttcagcatgacctcaaggcttccaaacagcagattcttgaaaaactggacaagatcagcaataatccccttgccaccaagaaagacgtggccgacctgttggaacggaacctgcaggcactttgtataaaactgtacgtcaacaccgatgatctctacgagatcagtaagatacaaaagaagaatggcaaggaaaggataattttcaagccaaacccttatctgaagcaggttcagcgcaacttgttgtatatcttgaacttgaagtacgagtcaaaattttgtagccacgggttcgagaaagacaaatccatcaaaaccaatgctgccactcatgtgtctaaaaaatacatcctgaagtgcgatatcgagaatttttttcccacgatcaacttcaagcgcgtctatggagttttcaaatctccaccttacaactttaaccctgagattgctgcattcttagcacacatttgtatttatcaggtgtcaacaactgataagcacgatctcggtatattaccgcagggggcgcctacctctccccttatagccaatctggtttgcagaacgctggataatcaactattcaagctggcgaagaacaataagtgctattacacacgttatgcagatgacatgtatttcagcacttatctaaccaactttccggagaagttgtatacgaatggtaaactgagcaacgaaattgaggagattatctacaacaacgactttcgaattaactatgacaagaccaaactgatgtacaataatcaaagacaagccgtcaccggaattatcaccaataaaaagctcaacgtgaaaaggtcctacattaaaaacactcggactatgttatacctgtgggagaagttcaagaataaatatacgctgcagctgtttaatgctacatccgaaaaggataccgttcttcatctgctaagcctctgcaaatctctgatattcttcccttcaaaatctgaattcaagaaataccacacactcaacgtcactgaacaggaggaccttgtgcaaaagtacctcaatgacgataataaacgtaagaacatgtactacgccatcgctaccgagttatccctttatgaagccgaacagctcatgcacgagaaactgtataaaaacaaagtcaagaagccgttctttaaaaatgtgctccggggcaagattggctatattaagctgatcagaggagaggacgacaacttgtatcgcaaactgtggaacaggtactgcaagatcataaactcaaatcagtttaagccactaatctaccccaatactcctgataatagaatctacaacatgctccacagcgtgaaagaagggctggatgtggaattcaaagagtattacgacaagaaaaagctgctggagacagtaaatagttttctcaattccgataagggaggtcagcttatcttcggcatcaacgacattaccatggagatcaccggcatcgacaaggagattaataagcaacaaaaaggggaagacggcttacggacaatgataactaacatcatttgctcgaagtttcatcccacaagtcagctcaacatcacctgtaaattccacaagatctacaacaagacaatttgtcgcatcgaagtacagccataccataataagccaatctactacgagcccgggaaatattatattaggcaggatggacgaaaacagctggtgcagacatga

SEQ ID NO: 7976 - RNA, 1737 nt, unidentified
  source 1..1737: mol_type = other RNA; note = synthetic construct
atgaagaaaaatgaacacaaaccgaaacacaatctctttttctccgacgaaattatcctggagaagattagtagtctccagaacaatgtgttcgccgagaaaaaagatatggcagccttgttaaaatccaatatcatagccatcggaattaaactgtacaagcacaatcatcttctgtacaaaagcatatctatcactaagagggatggcaccactcggacgatccgagagccaaatgcttatctaaaacagcttcaacggaatctggtgcacattctcaacctcatctacaaaggtaagttttgttcccatggatttgaaaagggcaaatctattgtgaccaacgccaagttccataccaacaaaaagtacatcttcaagatagacctgaaagactttttcccatcgattacctttgcccgcgtctatggggtattttgctcgccgcccttcaacttcaacaaagatatctctatcttgctggcacatctctgcatataccaggagactctgtcaagtgactctgagggtgaactgcctcagggtgcgcctacaagccctataatctctaaccttatatgccgtagccttgataatgacttgttcaagttatccaagaagtataagtgcaattacacaaggtatgctgatgatattacgtttagcacaaatctcagcgtttttcctaaggagctgtacgataattcccagatcggcaccgagctgaataagattatcattaagcaccagttccaaattaacgagtctaaggtcagactggtgtcaaataagagaagacagatcgttactgggatcgtggttaacaaaaaaaccaacacaaagcagagctatatcaagaatatacgaacaatgctccacaattgggagaaggcgaagtataaatatgtgcatatcctgttagactccaaggtaactctggagaagaaaattcagctggttaagctctcaaaaattcccatcattaaaccatgttccgaggaagtgcaggtggagaactttaaaaagtttttcgacgaagagaacaagaagaacaatatccacaacatcatcaaactggctatcgagcttggtctgcaagaagcagaagccgagatgtatgagaaattgtacaaagacatcgaaaagaaacccagttttcaacgcgtgctgctcgggaagatgggacatttgaaaaatgtgcggggcgaagacgataacgtttacattaagctttggaatcgctactgcaggatcgtgaacatgaacaagtacaagcagtatagcgtcaaagacattaaagaggatggattgtggttcctgctgtacagccaggaggaaaatcttaacatcgagttcaaggaaaactatcaaaaagatactgtgctaaaggtgataaactcatacctgaatagtgaaaccggaggagtattaatcctgggcgtctcagactatcctagagagattgtcgggatcgaccatgaaattaaaaagcaccagaaaggcgaggatggcttcaaactatccatgcagaatgctatcattgacaagttcaagccaaacaagtcactcaacattaactacaagttccacaaattctgtaacaagacgatttgtgtcatcgatattaagcatgagaaagagcccatatactttagccccgaagagaaggaattttatgtcaggcagaacgggaatacaagtaagttgaaccactctaatccatccgaaaccatatga

SEQ ID NO: 7977 - RNA, 1602 nt, unidentified
  source 1..1602: mol_type = other RNA; note = synthetic construct
atgaagcataatctcaagagaaagcccaaagacatcatcgagaagtttaaagctctctcttcacgagaggatgtcgcggaccttctggaaatcagcgataagcagctgcggtactacctatactccctgtccgatactgagaagtacaccaagtttaacatacccaaaaagaatggggggtccagggatatcacggctccaataaagaacttcaaactcatccagaagaacctggcccatattctgtatcttatacacaatcctcggatttgttcttacggcttcgaaaagaattacaagaacaaagaacaggagacagtgtacaaaggcatatgtccaaatgccaagctgcatatcaataagaacaacgtgctgaatgtagatctgaaggacttctttactagcattaattttggccgcgtgagaggaatgttcatggctttaccccataattttagttcggatgttgctaccgttatcgcccagatctgctgcaccaataatgcactgccgcaaggggctcctacttcacccatcatctccaacatgattctaaaaagcttcgactccaaaatgctcaagttggtgaaacctttgaaatgtacatattctcggtatgcggacgatatcactatcagcacaaacctgaagacgttgccaaaagagatatacgattacacccagaatagcatatcaaccgacttaaacagtattattgaggataacggattcgaggtgaacaaacagaaaatccggcttcagacaaagattcaaaggcagtctgtgaccggactaatcgtaaataagaaaaccaatgtccctcgtgattatattaagaacattagggccctcctgtttcgctgggagaaagatggcgaagaaaatgccgacaaatacttccaggaacactttaaaaagtgtaagcttagaagagtgcttctcggccggatctcacatataggaaacgttcgaggtgtggaggacccgattttcattaagctctggaacaaatatcacatcttaatcgggcaatccgataagatcaaggcactgattagtgaggacaaggagattttgacactgattagtaagggcgaaaatagcgagctcgaattcaaacaggcatatgaatatagccaggatgaaaaacgctgcaacaataagctgtattacaggcctcaagggaaaaaagaggacatccccaccatgaaacacaaagtattgaagacagtctgcgcctttctgaactccaattcgggtggcacacttctcctgggagtcgaggacaattcaacgataagaggcctgaaagaggacatcaagaacaataagaacaacctggactctttagccttgtctattgaccacgcaatcaaggacaacataactcctagtccaatcggtaacattaagaccaagttctacaagattcacaacaaatacatctgcaagattgatatcgagccatattacgaccccgtttatctgaaaactcacgggggaattttttatgtgcgtcatgacgtcgagagcgtggaaatcaaggaaaaagataagattgaccagtggatcagggcccacaacaaactccaacgcaattga

SEQ ID NO: 7978 - RNA, 1713 nt, unidentified
  source 1..1713: mol_type = other RNA; note = synthetic construct
atgaagaaaaacttcacggatctaaagacaaaaaacgacctggccgagtttctagacataacaataaagcagcttgattacaatgcctataacgaggacaagaaatacaacaaattccacgtacccaaaaagaatggatccaagcgcgagatatatgcaccaattccaagcctgaaaaccatccaaaaaaaactcagtaaggagctcactaaactgtacttgcctaaaaaacacgtgcattcctatacttcaaaaaagggcatccgcaccaacgctaagattcatgtcaatcagaggtttgtgttcaacatcgatttggaaaatttctttccaagcatcaactttgggagggtcagtggcgttttcaaagcacctcctttcaattttaacaacgaagtggcctacatccttgcgcagttgtgctgtcaccagaactcactgccgcagggatccccctgttcccctgttatttctaacctaatttgtcgctcacttgataacgacctgaaacgcctggccaagaataacaaatgcttctactcgcgttatgccgacgatatcacattttctactagtctgcgcagattcccagattctctctgtaagatagtgaagcacgagatccaaattggtgaaaagctcaacgagatcatatgcaagaatcgatttagcatcaatccgaataaatctagtctcaagcggccatatgaacatcagtatgtgaccggcctgaccgttaaccagaaggtcaatgttaaacggaaattcctgaagcaggtgcgagctatgttacacgcttgggagacttttggattatccaatgccgcgcaagaacattttaacaagtatagcgtaaggcacaaatctaagaaggacgactcattgtttatcagaattatcgaaggcaaactgctgttcgtggcagatatacgggggaagaatgatcccatcttcaaaaaactcctggccaagtttaaggtgcttgctccaaaggatacgttaaagaactacctctcttatcagggcgataagatcctggtgtataccgaaggtaacacagactggatgcatctgaagcacgcactggagtcctttaacgtaattaataactacctgcaagtgaattcggcaattaaaatctacgagtacgatgagactttaacaattggtgacaaaaagcttatggagatactaaggggccatttgctgtccgacaacaccaggcccataattggggtgtttgatagcgataaccctcagacactgggggagttcaatcctacccgaaaccggaagtacctgaatttcgacaatcgcgtctttaccttctacctgccccaaccctttcatcgtaagacggacaaaaattgcattgagcactactataagaaccacgacctttgcatcaaggacgagtacggacggagaatttttctgagcaatgaattcaatgaccagtctggagaacatatcgaaatggaaaatgtgcgttgtgatttcggccagaagaagctcagaatgactgacgggattatcgatagcaaagtctatgatttggaagagagaagtctcgctctcagcaagaaagactttgccaggaatatccttagcaaacacgacaacttcaaaaaggtcaatattgactcattcagattgattttcgaccggatccaggaaatcattaaggatatcgagtccatcaagaacgagtga

SEQ ID NO: 7979 - RNA, 1797 nt, unidentified
  source 1..1797: mol_type = other RNA; note = synthetic construct
atggaatcaaataaactgtcaccagaagaactcgctaagaagaacgaagaactccggaattcatttctagccactgacagtattaagaaactggctgtgttcttcaacttacggcactctgtgctgacttaccgcgtatataaagtgcctgaggacgagaagtacaaggagttcaaactcaagaagaaaaatggggggattagaatcatcttgtcacctaatgagaagctgaaattcttacagcgcaagatatcggacgttatatacttgatttaccggcccctaatctatagccatgggttcgagaagggtaaatccgtcaagaccaatgctcagatacatgcaaagcagaggttcatcctcaacatagacctcaaggatttttttagcagcattaatttcggcagagtgaggggaatgtttatgtctccaccctttgccttttctcctgaaatcgccacaatcttagcccagatttgctgttacaaaaatgcgctgccccagggggctcctagttctccagtgatctctaacattatctgccttaagcttgatcgccagctgtccaaattcgcgcttgaaaacaagtgttactactcacgatacgccgatgatatcacattctctactagctgcaagaaatttccgaaacagatctcctctatcaaaacgggcaaggtcaagctgaatactaaactcgaaagtatcatcagcaagaacggctttgagatcaacgaggaaaagattagtttccggtcggagtatcaacagcaaattgtgacaggcgtcgtggtcaatgtatcccccaacgttaagagaaagtacgtaaggcaagttagggctatgctgaacgcctggggaaagtatggcctcgaggaagccgagagagagcacttcgagaaatacagcacaaagaacagaaacatcctgcgacagcgcccgtcacttcgtgatataatctccggtaaagtccactacatcgggtatattcgcaaaaagttgaccggatccgacaagctgtatatcaagctcaagaaagatctggagaaactgattaaggaggaagacagcatccccaagtatcaggacaacggtagccagctaccattgattataactgagggacatacagactggaaacacctgaagaacgcactgtcacattttaaagggtttaagaaggatgcaattgacgtggagttttgggaatatgaacaaaacctgaagttcggagactcggttcttaaaaagttttgtctgaaagagtcacacaagcccaaatcccggaaatacatttgcatttttgaccgtgattctcctgaaatcattaagtccatgaatggcgataacaacagtagtttcaaatattggggcaataacgtctactctttttgtctgccaactccatccaatcgagaaaattattccaatatcagtgtggagatgtattacacggattccgaggttaataccattgacactgacaccggaaagagcctgtttttcaccaatcagataaaggaaaccattgaggtcaatcttaccaacaatacaacgacccagaaaagggagatcctcaaaacccctttggcaatcaacgagttcgataagaagatattcgactacaaagtggatttgatcaagaacacaacaggcgtgcaagtggcccatagtaaaaccgtgtttgcatccagggtatataatagccacaaagacttctctaactttgatttaagcgagttcgaaaaagtgttcaccataatcagcgagattattaaacacaactctagccagtga

SEQ ID NO: 7980 - RNA, 1632 nt, unidentified
  source 1..1632: mol_type = other RNA; note = synthetic construct
atgaagttcacagagcttaaagcgaacattcagcttgccgccaagctgaacatggattatagctacttcacctatctcatctacaaacgcaccgacgatcaaaattatatcccatacatcatccccaagaaatccgggggctataggaaaattgcagctccttgtaaaactctcaagtatatacaacggcagatcgccaattttatctacgacgaaatacaggtgaaagattgtgtccacggttttgcaagaggcaaggacattaaaactaatgccaactatcatctcaagagaaagcatatcctgaacctggacttgaaagacttcttcgatagcatcactgtcaaccgagtgtacggtgtatttcatgggcacccgtttaactttccagaaaagttatcaagctgtctggctaagatcgcaacatattacggctctctcacacagggcagcccacttagtcccatcattagtacattggtgtgcagaagattagataatgaccttaaagcctttgctgtcaagtacggactcaggtactctcgatacgccgatgatattaccttttcctctattcggaccatgaaggagctgtttaaagagaatcccgtgacaaacaaaattattttgtgcaaggagttggtggatatcataacgagaaatgacttccaaatcaacgaagataaggttcgatatcgcaacaagacccaaaggatggaagtcactggcctgattatcaacgataaaccaaacctcgtccgcaactatcgtgaccagataagggccatgctgcacgcctggaagaagttcggttatgagaatgcggagaaagaatacctgtccaagttttcccgcggacacaaaagcttcaaacaggtcatctacggtaagctcaatttctacaagagcgtgcgtggcgtgacagaccactactaccagcagatggctaaactgttcaatacactatccccagacatgaagctcttgctgaagcctacacctgaggaaataattcagaaggcagtatgggtcattgataatacagtaaatgctgagaagaacgattctccgattgaacggatgtctcaggggacgtgctttttcctaaagaacatcgggatcgtgactgccgcccacgtactgtttcctaacaaaaagaacaccaccgacgagttcgacgtggacttcaatcagtcacccatgtccaatttctatatccttaacccaaccaatcctagccatagggtgaatgttcagctcgtgaatctggacaagaatcgcgactgggctgtgttatccctgaaaaacactaacgatctgtctattaaccgggactacttcgagcttgaatcatgctgcaaaattcagacgggcactgaaatcatgctgtgtggatatcccagttttgaactggggcaccagatcaggaaagaaaccggccaaattgtggcaaagaagaccgagcacgcggttaagaaattcgagatcactgctgatatacggcatggcaacagcggaggacctatactgaataataagatgcaggtgttgggatgggcagacgccgctgaccccagtatcgttaatgagattggggagctactggataactacaaatcgacctcagtttga

SEQ ID NO: 7981 - RNA, 1671 nt, unidentified
  source 1..1671: mol_type = other RNA; note = synthetic construct
atgaatgatcccaccgagcaggccaaactggagcaagccttcagaggccttaagacacgggatggagtcgctgctttactgggcgtcaaccgtagaagcttggcataccaggtgtttaggcaccctaagccgtatatttcctttgctattaagaaaaggagcggaggtatgagaactatctctgcccctaaccccagcttgaagaaaatacagcggtccctttctaagtacctctgcgcagtttataggactcggaatcctgtgcatgggtttgccctggaacgatccatcgccaccaatgggaacgtccatctggacaaaagatacattttgaagatcgacctcaatgagttctttgactcaattcacatcggccgcgtgatcggacttttcgagaaggtgtttcacttcaacaaagacgtcgccactttgctggcccaaatctgctgcaggacaggctctcttccgcagggcgcacccacaagtccagtgctatcaaacctgatatgttggaacctggataatgaactccggcgcgtggctatgacacatcggtgctcctacacccggtatgctgacgacataaccttcagcaccaaccaggcacgcttccccaaagatctcgccacgatcgcagaaatcgatggagtggccgcagtgactgtcggtgctgccattattggagttgtgactgccaacggtttcaccattaatcaaagcaaagtgcgactgctcacgaagacccagaggcaggaagtgactggagtagtggtgaatgtcaagagaaatgttgaccgtcgcttcatccggaacataagagctacactctttaagtgggagaaactggggactctgcacctccagaagcagtacgaagatgtttatcgtagatcggcaaatccctctaggccaccagccgccatagaagatgttattcgcggaaggattgagcacatcgcttatatcagaggtcaaagggacacactatatgctgggctggccacacgtttcaataagctcgcggaaaaatggctgatcattcccgcgaccgcctttgaggcgttcaccgctcgattacggcgagcggtttgggtgattgagtgtgacggagacaaactaagtcctgatagtgagccaagcgacggcgccttgatgcaaggcaccgccttttaccttgaggggaccgggtgggtcacttgtgcgcactgtgttgagtgggatgggattgacaatagcaaggtgaagtacctgtttcgacctgataacccctctaagcggtactctttcaaaatctccagatcccagccgacggtagacgtcgctgtgatatccgccgacataccagcaagcgaatacgaacccctgcagattgccgctacagcaccttcacgcaacaatcttgtacaggtggtaggttggcctgagttccgcctgggcgatgagatcaccgtgatggacagtagaatcatctcgtttacaatggtcagtggcatcaggaggatgcgcgtctctgccccaattatcggcggcaattcaggtgggcctgggctcaacgctgatggccaggtgatcggagtggttgtaacggggtcccataaaggcgaacagactattaacaacgcattaatccccatttcagcactgagctatctggaggatacaccagactga

SEQ ID NO: 7982 - RNA, 1137 nt, unidentified
  source 1..1137: mol_type = other RNA; note = synthetic construct
atgatctgtagcccgctggatacccaactaatacggttagctaagaaatatggaatcgtgtacactcgctatgtggacgatataaccctcagcacatttaacgattccttccccgaagctatagtcaagggtgaggtgtccaatcttattatcggctccgagctggagaacatacttaagcggaactccttcagtgtgaatctggacaaagtctttctgaataataacttcacacgccaagaagtcaccggccttatcgtgaatcgattcccaaatgtgaaaagggagtacatcaaaaaccttagggctattctccacaactgtttcaaagaaggaatatacgaaacggccttagaatacatttgtaagggctactgcaagaacaaggatattatcaagaattctgacaacaaggagtgcgtgaataattggttcaaatacgttctgaagggcaaaatcaacttcatcagagaaattaaaggcgccaatgattacatctttctgaaatatgcccagcagctgaatagattgttcaacgaggaactcttcaatctggactttttagacgagttcatctacaacgtcgttgtgctggagactatgaaccccgataatattgttcaggggtctggtttttttattaaggatcgtgggctctttactaactaccatgtaacggagaacaacgaattttactcggtaaaaacatacaagatggagaacctcggcgcggtgttgaaggggatgaatgaaatcaacagtaacattgacatcgattatgcactgtatgacctgaagtcttcaaagatctcaggattggagctgggagagtctaagaatatcaagataggggacaaaatcgtcgtgataggttatccagaatattgcgataatgacagccctaatatccagacctgcaatatcattagcaggaccaactatcttggggaatgtctgtatactatttcagggagaattgtccatggcagcagcggcggcgtagtgctcaatatgaaccacaaagttatcggaattatcaaggcaggggtggtcaccctcaacgagtcagacacatccagtaaacagggttttattcctattcacctggccctagagcatttgaacaagggagtttga

SEQ ID NO: 7983 - RNA, 1665 nt, unidentified
  source 1..1665: mol_type = other RNA; note = synthetic construct
atgctgcgtgatgagttctaccggctgtccactcgagaagacgtggccaagatattggagatcgaggaaaaaagcctacggtacttcctttacgccaagaaacctgataatatgtataccaccttcaagatagctaaaaaaagcggcggcacccgggaaatttccgcacctgccaaggaactgaaggctatccagcgcaagctcgcttatatcctgaatctggtctaccgggtaaaaccaagtgtctatggcttctttcatgaacgcaatatcaaggacaatgcctctaaacacactaggagaaaagtcattctcaacatagatctgaaagacttcttctcccaaatccactttggcagagtgcgaggtatgctgatgaataagccctacggtatcgggcaggaggctgctaccgttatcgcacaactggcgtgttacaaggggatattaccacagggtgcgccatcaagtcccgtgttaaccaatatgatttgcagccctttggacacccagctcacaaacctggccaaaaaacacggtctggtttatacaaggtacgcagacgacattacgttttctactttcaacccggtatttcctaaagacatcatagagcgagacttgagctctattatcatcggccaggagttggatgctattctgaaaaaaaacagcttctccgtaaatcccaagaagatcttcctcaataataacaaggtgagacaggaagtgacagggctggtggttaataagtttccgaatatcaagcgcgagtatatcaagtccatccgggccattcttcataattgtttcaaaaatggcgtctacgaaacagctatcgattacgtggcacgtgggttttgtaagaacaaagacatcgaggagaacatcgataacatcgagtacagggacattatcatattatggttcaagtctgtcctgaagggcaaaatcaattatatcaaggagataaggggctcagatgactacacattccttcaatatgccgatcaactgaacagactcttcggagaggagatttttaacgtcgagaagcataatgagttctttaacaagatcgcctacaacgttgtgattctggagaacagaaacaagctggtacaggggagcggtttctttttgaaagatgttggactggttactggataccatgtgactgaagatcgcggattttttatggtgaccacatataaaggggagaatattggcattgtgtctaaggagatgaatgagatcattagcgacaagaacattgactacgcaatctataatcttaacaactcgtcgatggagggactcgaactcggggattccaatgagatcgagattggagataaagtgacggtcgtggggtatcccgactacattgagggcgatacgccctatgtgcatacctgcgaagtgacatcaaagaccaagtatctaggagaatgcctatatactgtctcagcgaggattattcacggggcctctggcggggccgttcttaacaaggacaacaaggtaattggaataatcaaggccggcgtggtcagttacgaagaaaaagaagacgtgggtaagcacggatttgtgccaatacacatagcactcaaacactggatgagtcagcaggaaaaccagaaaattaacactgaaggctga

SEQ ID NO: 7984 - RNA, 1665 nt, unidentified
  source 1..1665: mol_type = other RNA; note = synthetic construct
atgattaatatcttctccaaaaacgacgacgaattaaaaaaggccttttatgcccttaagagtcggaatgatttggccaatctccttgagattgaggaaaaaactctgaggtactttttgtatggaaagagcgacgacgataaatacaataccttcgaaatccctaagaagaacgggcagtttcgcaagatagctgcacccatatcacctctgaaaaccattcagaggaagctaacatatgtactctctctggtttataaagtcaagccgtgcgcttatggattcctcaaagaccgcaatattaaatctaatgccaagaaccattccaagaaaaaggtgctgctcaacattgacctgaaggacttttttagtcaagtccatttcggaagaatacgtgggatgctgatatcaaaaccatatgacatcggcatcgaagccgctaccagcattgcacagttgacttgttataaaggggttctggcacaaggtgcaccttcctctcctattctaactaatatgatctgttccccaatggatactcagctgatcaagctcgcgaaaaaatacaaacttcaatacaccaggtacgctgacgatatcactttctctaactacaatgagcaatttccgcagggaatcataaagggggaaatcaataacctgattatcggagatgaactgaataacattctgacaaagaacggctttgaagtgaacatgaacaaggttttcctgaacgacaacttcacaagacaggaggtgacagggctgatcgtcaacaaattccccaacgttaaacgagagtacgttaaatcattacgcgcaattttgtacaactgttcccgagatggcgtgtataataccgctaaggagtacataagtaagggcttttgcaagaacaagaatgtgctcgagaatcaggacaacgaggagctggtgatcaattggtttaagatggtactcaaagggaagatcgacttcatcaaagaaatcagaggtagtaacaataacatcttcctgaaatacgcgcagattcttaataaggtgttcaacgaggatatttacgacctcaacattttgaacaagctcacgaataacgtggtcattctgaattacgaagacaataagtgtatgattcagggtagcggcttcttcgtaaaagatgtgggcttatttacctcataccacgtaacagagtcaggcgccttctttagcgtgaaaacccagtatctggaaacaattggtagcgtggccaacgagtttaatgagatatccaaagataagcggatcgactacgcgatctacgatataaagaagtctacaatcgagggatttgaagtcggcaacagcaaggatataaaggtcggcgataaagtcattattatcggctaccccgagtatcaggaaaaagataccccaaccatccagacgtgcaatattaccagcatgactacgtatttgaaggctccactatgcatcgtgagcgggcggatcatacacggagcctctgggggtgtggtgcttgacatgaatcacaaggctatcggcatcattaaggccggggccgcctccactgagaaagaatataaaggaaagcaaggcttcatccccattcacctggcacttgagcatatgaagaacaacaagaaatcgatcagtaattga

SEQ ID NO: 7985 - RNA, 1266 nt, unidentified
  source 1..1266: mol_type = other RNA; note = synthetic construct
atggtgaatatcttcaagaagagcgatgaagagctgaaaaaggagttttacaacatgattagtcggaaagacgtcgccaagctgcttgatatcgaggataagtcactcagatattttctgtatagcgacaagaacaaatctatgtacactacattcgaaatcccaaaaaagaaaggcaatcctcggcgaatcaacgctcctaacgaggagttaaaaaatatccaacgtaagctgtcatacgtgctgaacctcatctataaagtgaagccgtgcgcctatggcttcatcaataacaagaacatcaaggataacgccaagaatcacgttaagaaaaagatgatcttgaacattgaccttaaggactttttcactcagattcatttcgggcgggtccgcggcatgctaatgaaacccccctatggaattggtgtacaggcggcaaccgtgattgcccagatcgcttgctacgacggcgtacttcctcagggagccccatccagccccattctgacgaacatgatttgctcccctctcgacactcaactcactaatctggctaaaaagtacacactgaagtacactagatatgccgacgacattaccttcagcacctatgagagtacattacccaagagcattctcgattaccaagttaattctctgacaatcgggaatgagctgaatcacatactgaacaaaaactctttcagcgttaatccagacaaggtgcacttgaataataattacacaaggcaggaagtcaccgggttggtcgtaaataaatttccaaacatcaagcgcgaatacataaaaacattaagggcgatcctgaataactgtaccaaaataggagtttacgaaacggcattggagtacataaacaagggttattgcaaaaacaaggaaattgctacgtccaaagaagataaagagaaagtttgtaactggttcaagtgtgtcctaaaaggcaagatttcatatgtgtcccagatcagaggctacaaggattacatctttctcaagtacgcacagaaactgaacaggatattcaacgaggagatttttaatctcgactatgtggatgactttatttataacgtggtcgtgcttgaaacctccaatcttgataatgtgagtcaggggtcggggttctttatcaaggatataggattgtttaccaactatcatgtgactgaaaatggagagttctacaacgtcaagacctacaaaatggaaatcctgggtgtggtgtctaaagagctgtga

SEQ ID NO: 7986 - RNA, 1659 nt, unidentified
  source 1..1659: mol_type = other RNA; note = synthetic construct
atgttcaaaaagacagatcaacaaatcaaggactgcttctataagctgaaaaaccgctctgatgtatctgatcttctggagattgaggataaaagtctgcgctactttctgtatgtgaagcgaccagagaatctatatgtcacctttacagttttgaagaagaacgggaataaacgcataatcaacgcgccgcaggccgaactgaaatctattcagaggaaactggcttacattctcaatctcgtgtacaagatcaagcctagcacacacggctttgttattggaaagaacatagtcaccaatgctaataaccactgtaagagaaaggcaatcctaaatattgacctcaaggatttctttacccaaattcactttgggcgagtcctcggcatgttggtgaaggggccctatgacatttcgaaagacgcagcaatcgtgatatctcagatcgcctgttgtaatgctgtgctgccccaaggtgctcctagcagccctatcattaccaacatgatttgctccccactggacactcggctgaccaggcttgccaagaagaacaatagcaagtacactagatacgctgacgatattaccttcagtacattcgacaagcagttcagtagcaatatgattaattccgatatcctcaacctgaaactaggaaaagacctgaacaaagccattaaagataacggctttgtggtaaacgaagacaagatattcctcaatacaaagaacacaagacaggaggtaacaggcctggtcgtgaataagtttaccaatatcaagagggagtatctcaagaacatacgggctatattgcataattgcgagaaggataatgtctacaacactgcgaagacctacgtaaaaaaagggtattgcaaaaacggacagatcaaagccaatatcgacgataaaaattacgaaacccaggtggtgctgtggttcaaggccgtcattaaaggcaaaatcaatttcatcaaggacatccggggaaagaatgacttcatttacttaaagtgtgccgagaaagccaatattatcttcaaagaccagatcttcaacatatccaagctgaaggattttaaggacaaaatcatctcaaacgtgctggtgttaaaaggtgataacaacggcgtgcagggatcagggtttcttcttaaagactttggattggttactagctttcacgtcactcaggataacgcattttacaaggcctatcattacaacgagtatgaggagacgtctctttgcgtgatttccaaggaaatcaacgaaatcaaaagcgacttgaatatcgattacgcaatctacaagttcaacaaggataacgagaatttcctcgaagccggctcttcggttgaagttggagacaaagtgaagataataggttatcccaactttatgaagggtaacagttataacgtgcagacttgttatattacctcccgtaaatactacatgggcgcaattttctttacggtagggggtacagtcttccatggcgcttcaggaggggtggtgttaaatgatcaaaacaaagtggtcggcatcattaaaggtggggttgtttccaacactgagtcagaaaccaatgaaaatcagggctttgtcccactggacatcgtgctgacgcacttccatcagcagtga

SEQ ID NO: 7987 - RNA, 1719 nt, unidentified
  source 1..1719: mol_type = other RNA; note = synthetic construct
atgttcaaagcatcagacgacgaacttattgagaagttcaacaacttgaagaaccgagccgatgtagctgagctgcttgaggtggacgaaaaatctctgagatatatcctctacgttaagaggcttgagaacatgtacaagaagttcaacattagtaagaagaagggcggatttagaaccattaatgcccccgagggtagcctcaaaaccatccagaagaagctgtcttacatctttagcctgatctacaataagaaggcttgcgcgtatggttttataaagggacgagacatcaggggcaatagcaagcagcacatcaaacgcaacttcattttgaatatcgacctggagaactttttcgactcaattaatttcgacagagtcatctgcatgttccaaaaacctccttacaatgttgagaaagatgcagcaaccgtcctatctcagctggtgtgttgtgatgggattctacctcagggggcaccaagctcccccatcataacaaatatgatctgtaggcctctggacacccaactggttaggctggccaagaagtttagcttaaactacacccgttatgctgatgacatcactttctcgtgcaacaagtcaactttcccaaaagaaatggcctactatgatatgcaggaaaaactctgtatagggaaatcgcttcaggaggttatatcacgcaatggatttaagatcaacacaaacaaagtcttcctgaactataaggaccggggccaggaggtgacaggacttatcgtgaatagatttccgaatctgcgtcgcgaatacctgaaagaaattcgagccattctctacaactgtcgcaggtatgatatatattcccaggccaagaagtacatcaaagaatcctcctacactaacaagaacataatgcggattagtatgttagaggacaaaaagagcaaggagattatctacaactggttcaagaatgtcattatcggcaagattcggttcattgggaatatccggggcaaggagtccccgtgctatatcaaatatgcgctcgaatgcaacaaactcttcgatgaggagatattcaagatcatcaaatctaagagccaagaattgatagagaacacagtgtttgtggtgaagattgagaaagggagcaagtatattcagggaagtgggttcttcattaaagatctaggatttgtgacttctatgcacgttacaccagatattgatgagacgtacgacgtatttacccccaaagaggacatcccccggaaactgtgcttgtttaataataaagccaacaaccaggaactcgattactccatatatgaccttaagaatccaacgagtaactacctcaaactgggcgatagttcaaatttgaatatcggtgacagaattactgtatgtggctaccctatgtatgataaaggcgatagcatctatattcaaaacggcgagataacaaatctgaagaaggactattttggcagtagaatatacaccgtgtcacaaaggctcatccatggtatctccggtggcgccgtgttaaataccaataacgaagtgatcggaattatcaaagctggggctgaaaatatggacgaggaagacgaatccattcaggggtttatccccatcaatgatgtcattgaggatgtgaagtctcagggaattgaactgcgcccaaaatctatcctggtcaaatccaacaattacaactga

SEQ ID NO: 7988 - RNA, 1665 nt, unidentified
  source 1..1665: mol_type = other RNA; note = synthetic construct
atgctggaggagccgaatatggtgagggagaaattctttaacatgaaaagccgtgaggacgtggcggatattttgggcattaaggagaagagcttacgctatttcctgtattcgatcaaacctgataatatgtatgtcgagttctcaatcagcaaaaagaacggcggggagagggtcatatgcgctccaaacgacaagctaaaagctatccaacgaaagctcgccgtaatcctgaacatggtctacaaaaccaagcctgcagcccacggattcgtgctcgataaaaacgtggccactaacgcaaaaggacatgtgaagaagaaatacgttttcaacattgacctggagaactttttcgatcagattcatttcggccgcgtcagaggaatgctgatgaagccaccctataatttgggagaagaagcagctctagtgatttcccaaatcgcatgctacaaaggcaagttgccccagggtgccccaacctcacctatcctgaccaatatggtttgtgcacccctggacacgcagttgacgaaattagccaagaagtacaatctgcaatattctcgatacgcggatgacattacatttagcacctacaaggctgacttccccgtggagatagcctacgtggactttaacggtgtccatgttggaacagtgcttgaggagctcattaagaaaaacaacttcctgatcaactacaacaaggttcggatttccgactataggcagagacagatagtgaccggtctggtcgtgaatcagttcgttaaccttcgtagagattacatcaaagagattagagcgttgctttactcttgtaaagtgaagggcctgctcgaaagtgccaagctttatgtagaaaaaggcaagtgcaaaaatccaaaaatcatcgaggccgtcaattcaggtaagagtgagaaggaagatgagataataaactggtttctgcaagtcctcaagggaaaaatagaatacatcaagtccattagaggcgataataatccgacctacctgaaatatgcctctgagctcaatcgggttagcggcaagatcttttttcgggttgacgagtatctggattttatcaagcagattgaaaagagcgtctttatcatcgaaattaacgctctggacgattacattcagggcagtggctttctcctggaccccgatctccttttgactaaccaccacgtgactaagaaggagggcttttataaggtgacaaccttcaaagaagatcagatagggatcatctccaatgacatcaagttcttaaagcgcaatgagaatatagactacgcctgttataatgggtttgggcgcgaggatcttatcccttgggaactgggagactccgatgacatcaaaattggctctaagatcattatgatcgggtaccctgattataatctaggaaatactccagacgtccagacagtgtatgtaacaggggaaaggacgttcatggggcagaaactgatcactgtgagtggtaggattgtgcatggagcttctggcggggtagtactcaacgaagaacacaaagtgattggtatgatacggtgtggggttgtgtcctactgcgaaaccgatacaactaacaatcacgggttcatccccattaacgacatcatgaaagacattaagtcatga

SEQ ID NO: 7989 - RNA, 1662 nt, unidentified
  source 1..1662: mol_type = other RNA; note = synthetic construct
atgaggcaggatagcgaacagataaaagagaagtttctcacactggagacaagagaagatgttgctgccctgttaggcattcaggacaagtctctgcgctatttcctgtacagcattaaaccggacaacatgtactccgagttcattatcaagaagaaaaatggagaagaccggcacatttacgcaccagatcgccgattgaaaaatattcagcgcaagatggcgcagatcctgaattgtgtctacaagatcaagcccgctgctcacggattcgtgcttgacaagaacattgtcactaatgcggagaatcatatcaagaggaagtacatcttcaatatcgacctggaaaacttctttgaacagatccacttcggaagagtacgaggtatgctgatgaagcctccatactctatcggtagtgaggccgcactggttatcgcccagatagcttgttataaaggcaagctccctcagggagcccctactagccccattctcacaaacatggtatgttccccccttgacacccaactaaccaaacttgctaaaaagtacaacctgcactatacccgatatgcagatgacatctccttctcttcctaccgcgatgagttaccaaccggtatcgtgtacgaagacctcgagggtatacacatcgggaaagagctacgtgagattttatcccagaatagctttgccgtcaatagcaagaagacccgcgtctttgactatagaaaaagacaggaagtcacagggctggtggtaaatgagtttgtaaacattaggagggcctacataaagaagattcgtgcaatcctttaccattgcaaacaggatgggatctatgaaaccgcaaaagaatatgtggagaagggcaattgcaaaaacagctcgatcattgagatgattaagaatgaaaccgaagagaacaaagaacgggttgccgaatggttcaaagaagtgcttaaggggaagattggatatattaagttcgttcgggggaagaacgattacgtgttcctgaaatacgctaaagagatcaatgagctctatggggaggaagtattctcaatcgagacggagttgaaactgatagacaagattgaaaagtccgtgttcgtgctggaatttgagagtgaggataattatgttcaagggtcagggtttatcgtgcgggatattggcctgctgacgaactatcatgtgactgataataacgagatttacacagttaacacgtataaaggcgagaaaaaatgctgcgtctctaacgagatgaacctaataaaaaacaacgagtccatcgactatgcctgttatctctacggcaagactagtgaggacgcgctcgaattgggcaactcagatgagctggacattggatctgaggtgcttgtcatcggctacccagactattacactggcaactcacctgaaattcaacacgtgaatataatctctcaacggccgtttatgggccagaagatctttacaatatcgggtagaatcgtgcatggcgccagcggaggagtggtcctcaacatgtcataccaggtggttggggtcatcaggtgcggaagtgtgactctgaaggaaaccgagagtaatagcttgcaaggctttatacccatcaatgaaattgtgaacgatttgatggcctga

SEQ ID NO: 7990 - RNA, 1695 nt, unidentified
  source 1..1695: mol_type = other RNA; note = synthetic construct
atgataaacgccaggactgatattgagactgaaaaactgttttaccagatgcagagcagggaagatgtggccgacattcttcagatcgaagataaaagcctgcggtacttcttgtacgcaataaaacccgacaatatgtataccgaattcaaaatccccaagaagaacggagagtaccggaaaattagcgcaccaaataaaaagttgaggagtattcagaggaagctcgccgatatcttaaacattgcctacaaagtgaaaccagcaagttacggtttcgtcaaaaacaaatccatttaccagaacgctgataatcactgcaaaagaaagaacgtgctgaatatcgacctcaaagacttctttacccagatccattttggccgcgtgcggggtctatttatgaagcctccgtataatttaggagaagaggccgccatggtgattgcgcagatagcttgctatcgcggggttctgcctcaaggcgctcctacttcaccgattattaccaatatgatttgctcaccactggacacacagctgacacacctggctaagaagaaccaggttgtctatacaagatacgctgacgacataaccttttcgtgttacaagaacagttttccagaggcactcgtgtaccttgacaagggagatatccatatcggcaaagagctggaattcatcttgaagaagaataacttcgtggtcaacatgaataaagtgcgcctgatggacaacagaagacggcaggaagtaacaggcctggtagtgaataagtttaccaatctgaagcgcgaatatatcaaagaggttagggcgattttacattgctgtaagaataagggcatttatgactctgccaagatctacgttaacaaaggtaagtgcaataatcaccgaatcaaggcctatattcagaatgaggacaaggtggacagaaaggaggatgtctctaactggttcgagcaagtgctcaagggtaagatagggtacattaaactcattaagggcaacgataatcctacattcctgaaatacgccaaacaacttaatatcatctccaacaagaagatcttcaacatagatgagtatgacaagtttcacaatatgatcgacgacaatatctttattctgcaatgcaccagcaagaatgtcgcgcgtcaagggtccggcttcttgctgaagacttatggccttatgacctcctatcacgtgatccctgacgataacttctattccgtgaagaaaaacacgggcaaacaggtcggagtcatcacaaaatcatccaacctctataaggagtcctacgagatagattatgcatgttacatcaacatctgtaacaatttcgacaaaagtcagaacgggtttgagcttggagacagctctaatctaaaagccggagataaggtgattatcattgggtaccccaactatatggatggagatactccctatattcatacgtgttacatcacaaacaagacctcttactttggccaggagctgtacaccatcagcgggcgaattgctaagggtgcttcagggggcgttgtgctagatttgctccacgaggtagttggaataatcaaaggcggggtcacttctctcgaagaagatgacgaaagcaatgacccagagttcaaacacgggttcatccccatacacgatgtaatcgaacatatgcgtaactga

SEQ ID NO: 7991 - RNA, 981 nt, unidentified
  source 1..981: mol_type = other RNA; note = synthetic construct
atggaaatctcggcactgaagcatgtgaaggacaaattttacaccttagagacaagacaagacgttagcgaactccttggtattgaagaccgatccctgagatattttctcttcaagagacggcctgagaacctgtattataaattccgaattccaaagggcatggatgggttccgtgaaatcaatgccccaaaggatgagctgaagacaattcagaggaaactggccaatatccttaatgaggtatacgaagcaaagatctgcgcctacggcttcattccagggaaggatataatacagaacgctagaagtcatgtcggacggaatctggtcctaaacattgacctcaaggattttttcatacagatccacttcgggagaattaggggcatgctgatgaaccctccctactccttaggccgtgaggccgctaccacaatcgcccagatcgcctgccttaacggcactcttccgcaaggagcccctacatctcccgtgttgagcaacatgatctgtgcccctttagacaattctctgatgaaactggctaagaaaacgaagtgcacgtacacccgatatgcggacgacctgactttttcaactcaccggaaggagatggataaagctttggtgtacttcgataataacaacgacgtggtgttgggagcaggtatactgtctctactgcggaagcacagctttaaagtcaatcccgataagatcgctttccgcaccaggtatgatcgccaggaggtcaccgggctgactgtgaatgtgtttcccaacgttcgccgctcctacattaaaaggctccgggcaatcctccacaaatgtaaaaaggacggagtatacggtaccgcaaaggagtatgctattaaaaggcagataaagaatcgcgtttggttcgtcaaccatgcggacagttcacagaagaaagaactcatcaactggtttaggcaagtgttgattggcaaaatctga

SEQ ID NO: 7992 - RNA, 1683 nt, unidentified
  source 1..1683: mol_type = other RNA; note = synthetic construct
atgaatcgcgacgaagtgaagaaagcattcctggagttaaagactcgagaggatgttgccgaattgttgggaattaaggaacgtagcttgcgctacttcctcttcaaaagacggcccgaaaggctgtacaccacattcactattacaaagagaaacggaaagcctcgagaaatctctgttccttgccgcgaatggaaagagattcagcggaaacttgctgatgtgctttcctgcgtgtacgcacctaagatatgcgcctacgggttcatacccgggaagtctatcgtggataacgcgaggcaacataccaaaaggcaccttgtgctgaatattgacctgaaggacttctttacgcagatccactttggaagggttcggggcctgctcacttccccaccctatggtatcggggaggaggctgccaccacgatagcacagatagcctgtgtgaatggggtccttcctcagggcgcaccatgttctcccgtgctgaccaatatgatatgtgtcccactagacaattctatgatgaagtttgccaaagcaaccgactgcgtctacacacgttatgctgacgatatcagcctgtccacttttaaaagatcgttcgatccagaggttgtgtatctggatggcgagaaactctgcattgggtcgaagttacagcatatcttcgataagcactcattccagatcaacccagaaaaggtggcagttcggagaaacacagagcggcaggaggtgactggcttgacggtgaatgttttccctaatctgagaaggtcatatattcgcaatctgagagctattctggaccactgtcaacgcgacggcgttcaccaaaccgcgaagacttatatcgagaaggggttttgcaagaatccctctattctcgctacgtacaagtgcgacgaggcacggggttctgtcgaagattggtttatcagtgtcctaaagggcaagattgaatatatccgtaatgtcaaaggcgctgagtcactcacatacctgtcctttgcccaaaaactcaacgaaattgtaggggtggaaattctggacatcagtctgttgaacaggctcgagacaattgccgagaagaacacctttgtgcttgagtgtaaccagggggagagcttctatcagggcagcgctttttatgtgcctaatatcggtttaatcacttcctaccatgtcgtcgagagcggcgagtttttctatggctacacccatatggactacccgtcaaaacccgccatggtgataggattgtccctgaaccgagtcgcggataaccgcgaaatcgattatgccatatttagtcccccactcacagatctaggtgaatacgccctgaagattggagacagcaaaaagttaagagttggcaacaacgtcaccatcatcggataccctaaccaccaaatcggaaatacacccttcatccagaattgtgcgattacaagtgaaaagactttcatgtccgctccgtttttcaccgtaagcgggagcattgtacatggagcctcaggcggtctggtgctcaacaccggttttgaagtggtgggaatcataaaaggcgggattcagtccctggacgacgacgatgtgagtggaaaccagggcttcatcccaatccacctggtacttgaggacatggccgagaaaaggaaagatgtaaaatga

SEQ ID NO: 7993 - RNA, 1701 nt, unidentified
  source 1..1701: mol_type = other RNA; note = synthetic construct
atggaatctaaagaaatcaagaccaaattcttccagcttaaaacccgaactgatgtcgcagatattttaggaatagacgagagatccctgagattctttctattcaaagtgcgccctgagaacatgtacataaggtttcagattgcgaagaggggtggagggttccgggaaatatgtgctccaaacaggaagctcaaaagtatccaaaggaaactcgccgatatccttgaaatcgtttatagggaaaaggcctgcgcctacggctttgtgcgtggaaagaacattgtgcagaacgcacgcaatcataccaaatcagaacttgtgctcaacatcgacctgaaagatttcttttcccagattcattttggccgggtaaggggcatgctgattaagcccccatacggtttgggggaagaggccgctacaacaatcgcccaaatcgcgtgcttggacgggaagctgcctcaaggggcaccgtgttcccccgttatcacaaacatgatctgtgccagcctggataaccagctgatgagactagccaaaaagactgggtgcatctacacccggtacgctgatgacatcaccttttcaactaataagaagcagttcgacgatgagatcatttttctgaacggcgggtcactggaactgggaaaaggcctgtccaacgttctcactaaaaacagttttattgtgaacccggacaagatcacgttaagagcgaagagctctcggcaggaggtgacaggcctggttgtcaatcaatttccaaacctgagaagagagtacgtcaagcagctacgggccataatctataattgctccaaaaatggggtctatcataccgcccagcagtatatcgaaaaagggttctgtaataacaccaaaattgctaccgtggtccacgaccctaatcaccgagaagaggtagagaattggtttcgccaggtcatagtcgggaaaattaattacatccgacagattaagggggcaggacacgccacatacaaaagcttcgctctgcgttacaatcggttagtaggcgaggattttttcgaagtgcctcaggatgatctcttggctgaactgatgcggtcggtctatgttttggagagcgaggagcgacagggcagtggttttgccgtaaagggtataggcctcttcacttccaatcacgtgactggcgacggagcaaagtatgaggtgtttctgcccgatggccagggcgatgtcgaaatcaaaggcatcataagcaacggtgataacctgatagactctgatgacacgattgacttcgccctctttgatgttcccttcgccaatgaaagcaatctcgagatcggtgactctgacgaggtgaagttcggatccgacgtgattattgcatcattcccagactatgcgaagggaaactctgtgaggatcgagcatcgcacagttgccggcgaggctcgcttgttcggatctaagatcattatcatcgacggggtgattttccacggagcaagcgggggcgtcgtggttaatgacaagaataaggtgattggtattgtgaaggctggcattcaggatgctgtgagtaaggacgaacttcttagtaatcagcgccatggatttgtacccatcaacctggtgatgcaacacataagagagcaccaacgtccagcatcagaggagaaccaccaggagacaatgacgtga

SEQ ID NO: 7994 - RNA, 1668 nt, unidentified
  source 1..1668: mol_type = other RNA; note = synthetic construct
atgttcaaacgcagcgataacgaaataaaggagctcttctccatcgctaagactaggactgatattgccgacatgcttgagattgacgaaaaaagccttcggtactttcttttcgtgctccggccggaaaacatgtaccggtccttttttatctccaagaaaaatggcgggacccgccagatctttgcccctagtaaaaagctgcgaaatattcagcgaaagctcgcatatatactcaacctgatgtacaaaccaaaaatttgcgcgtatggctttatcaagaacaagacgatcttagggaatgctttgcagcatactaaaaaggccgaaatcctgaacatagacctgaaggattttttttcccagttccatttcggtcgcgttgtgggcctgttgtgttctaaaccctattcgatcggaaaggaagccgcaactaccatcgcacaaattgcgtgcttaaatggtattcttccgcagggagctccaacaagtcccgtgctaactaacatgctgtgcgtccccttggacaatcaactgatgcagtatgccaagaagtatggactggtatacaccaggtacgctgatgacattacattttcaagttacaaccgttgtatctctgataatatcatctccaaagtgggcgataagatcctcttggacgacagtctaaaaaaggtgctcgacaagaatagcctgatcgttaatgacgagaaaatcactttcaggaccaagaatctgagacaagaagtgacgggagtcattgtaaacaagtttcctaacgtgaaaagggaatactacaaaaacataagagctctgctgcacaactgcatacagaacggcatttacatcgaggcacttaaatacattgacaagggctactgtaagaatagaaacatcatctctttccggagcgaccccaagaagcaacctctgattgaggagtggtacaaatccgtcttgatcgggaagatacattttatcaagcagatcaagggggagcactctttcaccttctatagcctcgccctggaggccaacaaggtcttttccaagaacatatttgacctcacctatttcaatcagatgaacgagattatcaacaaaaacgttttcgtcctgcagtcgaccgatgaaatgaagcagggcagcggattctatgtgcccgggtatggactatttacctcataccacgtgacagaggataaggatttctattacctgtggcagaatgacgtgaaagccgtgatttctccaatttcagcggacataaatcaagtgtccgccgataagatcatcgactatgccttgtataacatatctatcgctaacgtagcaagtctcagcatgggaaattcatcaaatctgaagatcggtgatacagttgttatcgcaggattcccaaattacatcaaaggggatacgataactaaagaggagtgtaaaatcacaggcaagacaaaactttttggcgctcctttctacaaagtttccggtaaaattgtgcacggcgctagcggcgggattgtcttaaatacaaaccaccaggtcgtcgggattattaagggaggttgctctagtgaggatgaagacaatacctctattaagcagggcttcgtacctattgacctggtgattagcgatttaaaagccaaatcagtgctgtga

SEQ ID NO: 7995 - RNA, 1707 nt, unidentified
  source 1..1707: mol_type = other RNA; note = synthetic construct
atggatggtaacctgccggaaaaaaaactgttctatgagttaaagacccagaaggacgtggccgccctgatcggctgtaaggaacgaagtttaaggtacttcctctacgctggaaactgtattgtgaaatacagaacctttaccctcaagaagaccgatggctctcagcgcattatatctgccccaattcctccccttaagaagatccaaagaaaactagccaatattctgaacgtggtgtacaagcccaaagcgtgcgtctatggatttgtcccgaaaaaaaacttcatcgaaaacgcaaagcaacatgtcggctgcaaatatatcttgaacatcgacctcaaaaacttcttcaatcaaatccactttgggcgtgttcggggagtcttaatggccaagccatatcagctttcacaagaggcagctggagctatagcacagctggcatgttttaacggcactctgcctcagggtgctccctcctctccaatcttaacaaacatggtgttcagaagctttgacaatgagctgatcaagtttgccgctaacaacggaatcaaatatactaggtacgcggacgatatgaccttttctagttaccggaataaaatccccgaggagctggctacggtcagcggcaacaatgtgcgccttggcaccttcctggaaaagctgctggagaagaataactttgagatcaatcccaacaagattcacctcttcctcaaaaatcagcaccaggaagtgactgggctgactgtgaatgcaatagtgaatatcaatcgacggtatctgggccttctgcgcgtgattctgtacaactgcgacaaaaagaacattgataatcccatctatgagtccgccaaaaggtatattaagctcggttactgcaagaacaacaatatcatcgagttggccaaaaacgataagaacaaggacaagatcgaaaagtggttcaagcaggtactgatagggaaggtgcgctttattaagcaagtaaaaggcgccgattcgtttagctactattatttcgctacacgttataacaaggtgttcaaagatacggtcttcgatctcagtctattcaactacgttaacatgaggattcagcagaatgtctttatcgtcgaagccggcactaatcaggggtctggcttctacctgaaaggctacggatttatcacctgttaccatgtggttgagaaaaataaggaggaaaagaaagagaatgagaaggagatatatgattccgtgtgtatttacagatgcgttgatcggtcaaaacagccatttaagagactaaggaaggaagagattattctgaaagacaagttccttgactatgccctgtaccggctcgacgagaacgaagtcgagagcgcttacaaaatcgggaatagtgaaaaagttgagttgggtgaacaggtgaccataatagggttccctaattacctggaacaggacacatttagcttgatcaagacacacattacttcaaagagcaatttcatgaatgcacctgccttcttggtggactccaaaatctttcacgggacatccggtggagcggtgctcaataaagactcggaaattataggactcgtagtagcagggagccaggatacagcctatgaactaaagaatgcgtttgttcctatccatgagattatggcttctctttcctcaaagaacattcatgagttgtga

SEQ ID NO: 7996 - RNA, 1650 nt, unidentified
  source 1..1650: mol_type = other RNA; note = synthetic construct
atggaagataatgttaaacggaagttcaaacagcttaatagtcgcgaagacgtcgctaatattctggaaatcgaagacaaatctctgcggtatttcctgtattgcgtaaaacctgacaacatgtacaagaacttcgagattaacaaacggaatggagggaccaggattatctccgcccccaataagaagctgaaaaacatccagagaaagctgctgcaaatactcgaaaacgtctatacccccaaaatttgcgcttacggtttcattaacggcaagagtatctatgataacgcctcaatccacttaaaacgcagacagattctcaatctggacctgaaagactacttccttcagataaactttggacgtgtgcgcggcatgttgctgaagaaaccttacgagctgggggaagaagcagccactgtgattgctcaaatcgtgtgttacaaaggtaaattgccacagggcgccccgactagtcccatcatcgcaaatatgatctgcgccccgatggataaccattttatgaaactggctaaggccaacaatatgaaatataccaggtacgccgacgatctcacctttagcactaggacagagtttcctacctccattgtgcgcatcgaaaacgatacagtagtggtaggcaagaagatcctgcaaatcctaaagaaggacggctttttgctgaatgaggagaagatttatttgaggtcaaaggacaaaaggcaggaggtgaccggattagtggttaataagaaggttaatgtccgaagagattacgtccgggagctccgagcaatactgcacaactataaaaacatgggtgctgaggacgcgatcaagttatatgtgaagaaaaagaagtccacaaacatttcagctgtgaatatagacacgctaagcgacaagaaaagacaggaaaccatcaatcagttcaatgagattctaaaggggaagataaacttcatcaaagacatcaggggcgaggacgatttaatttacatcaaatacgccaatgagcttaacagaatttgcaacaaggagatcttcaatctcgacaaacagaaagcgtttatggaaaagttgaagaacagcattttcattctccagtcccgctacacttgtgtgcaaggaacaggctttctgcttaagggcatcggactgataactaattaccatgtaactgaggatgatgatttttacgacgtttgtatgtgtaacaagaacaagattgccgtcataagtaataagctcaacctcatcaaacgttctaaacgaattgattatgcatcctacaagattctcgatgcaaaagaggatcaattcttggattgcggcgacagcagcaatctgcagatcgggagcgaactgaagatgatctcttatccagagtataacgatgaggacacgcccaacatacagacaattgagatcacgggttcacgggagtacatgaagaataagatcatcaccatctctggaagagtgatccatgggtcgtctgggggtgttatccttgatcagaaacacaaagtcgtgggcgtggtgaattgtggaccagtctcccttgaagaaacagacgacacaattatacaggggtttatcccaattaacaccatactgaaggatattagcatgcctacttga

SEQ ID NO: 7997 - RNA, 1083 nt, unidentified
  source 1..1083: mol_type = other RNA; note = synthetic construct
atgttgttcctgagacaggccgaggcgagtcctgtgatagattttggttgcgaccctcagcccgccacctgcctttttcctacttccgcctgccctgtcgctttgagacatgcaggctgcagcggaagagaggcggagtgcagaaggacctcagcactcccgctgttgcattcgcagccgcagccattcctgcgtgcttcagataacgagttgcggacaaaattccgggccctacgggcgcttgaggatgttgcagacctattagaaatccagcccaggagcctgcgttggtatctctacgtggacaaggtgcgatgtcaatataaggaacggtcactgccaaaatcccacggcggtaccagacgcatttgtgttccgccaattcccctccgcatattacaggacaagcttctgcgcatcctgacgttgatctatgccgctaaaccctgcgtgactggatttgtcctggggcgcagcgtcgcaaacaatgctaacccacatgtgtgtaagcaacacgtactgactatcgacctggataattttttcccctctatccactttgggcgagtacgaggaattctgcaatctccaccctacggcgttgcccctcctgctgcatcagtgctcgctcagctggcctgtcatgatgacggacaccttcctcagggggccccaaccagtcccatagtcgccaacatggtgtgcggtcctcttgactctgctatgctccagatggcaagcaacaataggctaacctacacacgctacgctgatgacatcaccctgagcactaatctgcggaccttcccatccgatattgtccgtcaggatgagcatgacacttgcgaggttggggtggttctgcgcgacctcctggccgaacacggattcacgatccgggaaggcaagacaaggctgagatccagattaaggcggcagacagtgacagggctggtggtgaacgaggttgtaaatgtcaggaggtcttatgtgaggcaactccgagccttgattcacagttgtagcacagtgggcctccttccctccggctactgccaggaactctgtattgaatgtgcatga

SEQ ID NO: 7998 - RNA, 1365 nt, unidentified
  source 1..1365: mol_type = other RNA; note = synthetic construct
atggaaattgtgctgcgcaccaataaagaggagctgaagaaaaaattcggccggcttaaaagcagggctgatgtggccgatcttctggaggttagcgaccactttctctgcaagatcctgtatggtgtgaaggaacgcagaaaatataggatcttcgagatccagaagaagtcctccaaaactcggcagattagcgcacctcctaagaatatagcaatcctgcagtctaaactcaacaccattctaagtctggtatacgagcccaagccttgtgttcacggattcgctgagggaaggaatatcctatccaacgctcaacaccataccaaaagacgccacgtggttaacatagacctgaaggattttttcccgtctatttatttgggaagggtaaagggcgcgttaatgtctaaacccttttgcgtcggaagaattgccgctgaagtgatatctcagatttgctgtagagacgatgggatcctccctcaggggggtgcaacatcaccaatcatttccaacatcatatgtcgttctctggataacgatttaatgtccttcgcacgaaaaaatcgatgcaagtatacaaggtacgccgacgacattacactgtcaactagttccttcagacttccaactgccgtgggcaaagtcgagaatggtaacctcatcctgtcagacacactggtgctcatcgtagaaaaacacaagttcatcataaacccaaagaaggttcggtacaccccccctttcttacggcaggatgtgacaggcctcattgtgaatgagtttccaaacgtgagaaggtcatacgtgagggaggtccttggggctctccatgcctgggaaaaacatgggtatcgggctgccaataagcgctatatgtctcactttcgcctgcgagggcaagccgggctggatcttgagaacgtcttgagaggaaagatcagctttattcggatgattcttggagacaatagcccaatctttcgaaaactggcgcgtaagtacaacggattggcaagtaataagatcgcaattatccaaatcgaggagactgatccctaccccctacgcggggggaatacccgtatccagatgtggaatcggtggttcaacagatacaaagccgcgattttcttcatagaaaccacgaacagcaaaggcgacaagtcggccggtacagccttctatattggcaacaatctgtttgctacggccggtcataacctggaatacggcaagccgatcttttactttggagacagtcccaaggctgtcgacacctttaccgaatacaacaagaagagcactgacatcggcttgataaggaatatgggcgagattctcggctcggaattggattga

SEQ ID NO: 7999 - RNA, 1677 nt, unidentified
  source 1..1677: mol_type = other RNA; note = synthetic construct
atgaactcaaggcaagatgtggctacttacctgggaattagcgatgccagactatgcgccattctgtatggctattgtgaccgccggcggtacacggagtttcaaatccccaaagcgtctggcggccaccgtaagatcttggcacccccgaaacgactcaagtggctgcagtccaccttacttcgccgcctcgaagggcagtacacgcctaaggtctgcgttcatggtttcgttaagaatcgctccatcgtaacaaatgcccgggttcactgtggtagacgactgactgcatcctttgatttggaagactttttcccaagtatacacattggcagggtcaaaggtatctttaagaatcccccttttagctttggtgaggatgcctccgaggtgctggctcagatttgctgctgtgatgacggcaaactgcctcaaggaggagtcatgtctccctatcttagtaatctggcctgcagatctctcgataacgacctgcttcgcctcagtcggcagcataggctgaggtactcacggtacgcagacgatcttacattctctagcaatgatcgctactttcctcacgaggtggtggaactggacgttgagcagcctcagccgggagagagattagtggaattgattacctccaatgacttcaggctgaatcattccaaaatggtcttcagaactagtacacgaagacaggaagtcaccggcttgaccgtcaatgcatttccaaatgtgtccaggaaattcgtgcgcggaatcgaggcagccctctcatcatggcgccgatttggctacgacgcggcccaagctcacttcctagagaagtaccacgaaggagggggcagcgagctctcttctgtcctccgagggcggatcgcctttctgtcgatggttagaggcaaggacgatttcatcgtgaggcggctgagccgggaattcaacgacttggggcagccatccataaacgtgaagccactgactaccgctaggccttcccccagacacaacagcagggctgagtggcaaacttggatcaggaagtatagtgagggcgtattacatttacttttcaccagtcctgaaggcgacccaagttgcggtactgcctttcacataggaaaagggaccttcgccacggcacgtcataacgtctttacagaatgtggtgcggtacatgacgacctccggctgaagcatgacgggaacgagttcgtcgcaaacgtgctcgctcctctagatgccgatgcgaacaccccagacgtagccctgctttcgtgtaacgccctgtctaaactggccagaatacccacacaggtacgactgcccgaacttggagaggagattgttgctattggattccctagcatcccacagcggaatgtgacacaagtggtgcacagcggtatcgttgaggccctgccggtgaactacagcgatcgtctacgttttatccaggtgtcattccagtccgggggcggcttatcagggggatcactcattgatgccgggggcaatttgctgggggtggtggtggagaacgtgttcatgcaggctgcagacgcaggcgggattacagctcccagcagaccctatggacaggctgtcccagttgaatatctggatgacctcttgaagtcttatgatagacagcagaggcccatccgctga

SEQ ID NO: 8000 - RNA, 1548 nt, unidentified
  source 1..1548: mol_type = other RNA; note = synthetic construct
atgcgactcagagtccacttagcacagggtgccagggggaaggctcacctgagcaaacttcaattccatcttaacaagcctctcgaagaagctgccgcacagattgtgggcgctcagacggccgacgatattgctgaggtgctcgaggttccgaagggccaactgctccacatcctatattcatatcctgacgagaagaagtacatcagcttcgacatcaaaaagaagaatgggggatataggaacatcaaggctgcgaagggaggattgagagtgctgcagtctaaactggcccccctgttggcttcgcattatcggcttaaaaatcccgtgcatggcttcgttaaagagagaaacattgtgtccaatgccactcagcataaaagaaagagatatgtcttcaatgtggatctgagtgatttttacggtaccatcaacttcggaagggttcgggggcttttccgcgccaagccatttgaaatgggcgagaaagccgcaagcgtggtggcacaaatttgcatctttaaaaactctctgccccagggtgctgctacatcccccataatcagcaacttcatcgcctcagagctggatagaaaattatcaaggctggcacgacgttacaagctcacttacactagatacgccgacgacattacgttctctagcaataatcgcaattttccagagggcatagcattctacgacggtaataatccaattacaaacgactgtttcgtgggccaggtcttggaagagacagttagtggctgtggattttccatcaatcacgaaaagactcggctacaaattcggggggttaggcaggatgttaccggactgaccgtcaatgagttcccaaatgtgagaaggtcgtatatccgaaacattcgggccttgctgcacgcctggcgtaaatttggccctgatggggtagaggtgatatatcgaaggaagtacgctaaaaataagtcccgcctggtagataccgaacgccattactttaaggaggccctctacggaatgttggcatttctgaggatggtgcggggcgaagacgaactttatttaaaactatgcctccagaccgcggagttggacaaggcgcctcctgagctgatcaaacgtatgaaggagcagtacaagatgtacgatgtgttcatctcccacgcctctgaagataagattgacatagtacgccctatctacgacgcgtgcaagagtctcggcatatccgcctttcttgacgaagaagaaattgattggggcgacagcctgaccgaggtactgaaccacgctctcgggaagagcaaattatttctggccgtcctgtctaacaactctgtcggaaagaaatggccccggaaagaaattaacgccgcgttggctcgccagatggatgggaaacagaagtttcttccactggtggtcgggtcacccgatatggacattttcggtctaacaaatgacctgctctatgtgaactggaaaaacaacccggatgagatcgcagagaaactcaagtttatcctgagtaagtatgcatga

SEQ ID NO: 8001 - RNA, 912 nt, unidentified
  source 1..912: mol_type = other RNA; note = synthetic construct
atgtcaaagctgcaataccagctcgtcaagtctctggatatagcagtaaagcagatcgttaaactacagacagctgaggacattgcccagcttctggaagtaccaaaaggccagttactccacatactctactcgtatcctgcggaaaaaaagtacatcctgttcgatatcgctaagaaaaacgggggattccggaacatcaaggcacccaagggcgggctgcgcatcctacagcagaaactggctccgatcctgtattcccactacaagaggagaaatcaggtgcatggattcgttaaggacaaatccattttgactaacgctaaaatccataagaggaaacggtacgtgtttaacattgaccttcatgatttctatgggagtattaacttcggtaggatcagaggcatcttcaaggcgaagcccttccaaatgggcgataaagcggcaaccgtgttggcccaaatctgtacatttgaaaatagcttaccacagggtgccagtacgagcccaattctgagcaatttcattgccagcagcctggatcagaagctctctcgtatatccaggcgctataaactcacctacactagatatgctgacgacattaccttcagttctaatgcacgagactttcctgaggcaatcgccttttttgatggtggcaaccccataacaggagactgctatgccggacggatcctggaggagacaatagtgtcctctggatttgctattaaccacgccaagacccgattgcagattaaaggcgtgcggcaagatgtgaccgggctgactgtcaatgaatttcctaatgttcgccgctcctacatcagaaacattagggcccttatccacgcctggaataagtacggggactcaggcgtcgaggacgtgtatcgttcacagtga

SEQ ID NO: 8002 - RNA, 1530 nt, unidentified
  source 1..1530: mol_type = other RNA; note = synthetic construct
atgcctgaaaaactgaagcccgaattaaacaagaacctggatgagtcagtgagagccatctctcagctgtccagcgtgtcagacgtggcttcttattttgaaatacctgaaggccagctgttgtacatcctctacaagctgccagataacaagaagtaccgtttctttgagatcaaaaagagacgaggcggccatcgcctgattaaggcgcccataggagggaccgctatcctgcttaagaaattgaaaccagcgctgcaccaattgtacaaaacgaaatcgtgcgtgcatggttttgtcaatgggaagtcaattgtcagcaatgcgaaacagcacaagaaaaagagatacgtgctgaatgtggatctcgccaatttctacgacaatattaactttggacgtatcaggggcttattcatgtccaaaccgttcaacatggcaccgaacgcagctaccctgatggcccaactatgtactcatgacaattctttgccacaaggtagccccgtaagccccgtgttgtcaaactttatcgcctcaaatctggataagcgccttaccctcttagcaaagaagtatggactgcaatacagtaggtatgccgacgacattacattctctacatccaagaaagatttcccaaagtcttttggctattacgaggggaataaccctataacggggaatatggtcatcggcaagctcctggaagatcagattttggctagcggtttcgtcatcaattatgacaaggtgcgcttacagtatcacggagttaggcaggaggtcacaggtcttaccgtcaacgagtttcctaatgtggagcggtccttcgtgaggaagatccgggctatgattcacgcatggaagaagtttggactgattgaggccgagaaaacttacattagctgctacgcgaagcctactctggacatctcaagcgataacctgaacggagcctattacaagagtgtggtttacggacgattggcattccttaaaatggttagggacgaagaagatgaggtctatatgaaactgtgtctgaaagtagccgagatcgattccaatgctcctcggaagatcctggaaaccaaagagatgttcaacaagttcgatattttcatctcccatgccagtgaagacaaagacgacgtggctcttcccatttatgaggcctgcaaaaaaatcggcgttaacgcttttctcgatgttaagtatatcagatggggcgacagtctcactgagaaaatcaaccacgcactcgggcagtcgaagtttgtactggctattctttccgaaaatagcgtggggaaaacctggccaagcaaagaaatcaacgcagcactcgcccgcgagattgaagggaaacagaagatacttcccctaattgtaggctccccagatctgagttctgtgagtctactagtggacaagctccattttccctgggagaaggacgcctctaaagttgcccaccggataaaagagctcacatacgagaagtatcagatatccaattgtaagtga

SEQ ID NO: 8003 - RNA, 1515 nt, unidentified
  source 1..1515: mol_type = other RNA; note = synthetic construct
atgctgaatgtcaaacttaagagcaccataggcaacacggtgaagatcttcttgtctagccaaaacaccgaagacgtcgccaacgtcctcgaaatcccaactagacagttactctatctgatctacaccctaacagacgaagaacggtatagcacattctttctgcctaaaaaacgcggcggacagagagagatttccgccccgcgcaaagggatttctatcctgcagaagaagctgttgactatcatcgattcaatctggcaccccaagccctgggtgcagggttttactaacagccgcagtatcctcacaaacgctagacaccacaagaaaaaatcctacgtcttgaacatcgatcttaaggacttttatggctcaatcaatttcggacgcgtgcggggtctattcatgtcctacccttttaagctggggcacaaggctgcaactatcatcgctcaactggtaacatttaataatctcctgccccaaggggccagcacttcacccataataagcaacatgattgcttttaagctcgataacatgctggtgaaaatcgcaaggagatatcatctcacttacacacggtatgcggacgatattacgttttctaccacaaaatccaactttcctaaagaaattgcagagatcgaggggacgaacccatcgaccggcaatattaagctgggacatatcttggaaaaagctattaaggaatctggattctctgttaactacaaaaaggtgcgattgcagatccctttcgtaaggcaagaggttacagggctgaccgttaatgagtttccaaatgtggagaggaggttcattcgtaatgtccgtgctatggtgtatgcctggcggaaacatggcctcattgaagctgaacgagagtacataaacaaatacgcatcacggaagctggagataccatctgggaagctgaagggaagttactacaagaatgtgctctacggcaagcttgcgtacattaagatgataaggggtgaggacgatcagattttcatcaagtattgcctgcagttggccgaactggacagcgatccccccaaacagattcagaaggccaaagaaatgcatgaacagtatgacgtgttcctttgtcacgcctcggaggataaagaggacattgccaagccgattttcgaagatctaagtaatgccggtatcatcgtttttctggacgacaagtacattaaatggggcgattccttcgtggagaagataaatcacgcattaggcaaagctaaatatgtcattgccatcctttcttccaacagtgtgaccaaagcatggcctgttaaggagataaacgcctccatcgcgagagagatagtaggcaaacaaaagttcctgccacttatggtcggggacggaaaagagatccagagctttcaggatgagatgcccttaatcagtgacaagaagtatctgatctggaagaatgacacctcagagattgtggataaaattaagtccctcatgtcaagcaagtga

SEQ ID NO: 8004 - RNA, 1587 nt, unidentified
  source 1..1587: mol_type = other RNA; note = synthetic construct
atgagatatcccaaaattgcgaagccaaccacagagctcgtccgtcccacagaggatagcgttaaattgtttaaagccgctcatacctttggggacgttgccgaacttctcgaagtccaccctggacatctcaagaggtggctgtataagtatccgggacactccgggtacaaggacttcgaaataccgaagaagaatggcaagcccagacaaatcagcgcgccccccaagaacatcagcattctgcagcagaagttcaagaccatcctcgatgctgtgtaccagcctaaagactgtgtcttcggcttcgtcaataaacgctccgtagtcggaggcgcgaacattcacaagaaacagtctcgctgggtgctgaatatcgacctggaagacttttatacctcaattcactttggacgcgtgcggggactgtttatgtcgtttggggctggggagaacgcaagcaccactctggcccacctggtgacaaaggatggcgtgcttccacagggcgcctgcacatctcctgtgatttccaatatgattgcctttaagctcgacagaaaactgatcaacatcgccaacaagtacaatctgaaatattcccgttacgcagatgacataacttttagttaccggtactgtacattcccaaagcatatcgcgatcctggataaatactccggggatgatcaggaacagcataaagagggacaatacaagtctggcctggaacccgaaaatatcaccttgggtcctctgctggtgcatgccatcacgaaaagcggatttaccatcaacaccaataagaaccggttattctcaaagcgacagaggcaggaggtaacaggtctaacagttaacgaattcacgaacgtgaataggaaattcattaggcagatcagagcaatgatccacgctattcggaaattcgggcccgagttggcaggcatcgagtatatagagaagtatcgcgctccttacaagaattgcgaagttaacaaccacgcagagtactttcttaacgtcctatacggcaagttgtcattcctgcggatggtgcgaggtaaaactgacgtatgttatctcgatttttgcctctctatgagcaagattgatccagagccaccaactttcatcaaagaagccgtcaagatgcgacagaaattcgacctatttatcattcatgccagtgaggataagaatgaaatcgccactcctcttcacgagcacctgactaagatcggcctgaatgtgttcatcgacgagaagtatattaaaatcggcgacagtttcatagagaaaattaatcatgcccttggtcagtcaaagcacataatcgctatactgtcatctcattccgttgaaaaaagttggcctaagcatgagcttcaagccgtgttagctagacacattgcatctgatggtaacgggaaaatcattccaattatggctggaaacaagtatgagatacaaacgatcttggacaaatggccgttactcagcgacaaaaggtaccacaagtgggaaggggatcccgacgcagcagcccaagagattgctgactccattggcaccgtgataagttga

SEQ ID NO: 8005 - RNA, 1602 nt, unidentified
  source 1..1602: mol_type = other RNA; note = synthetic construct
atgaagggacaaaagattaacatcaagctgaaaaaacccttcaaagagagcatgacactatttgaaaacttgcagacacaggaggacgttgccaattttttcgaggtcgagcaccgatacttaatgtacctcgcctataaggacaaacgccctcactataaggagttggtgattccaaagaagactgggggcacaaggaagattagcaaacctgtcaaaagcatcgatatcctccaaaaaaagctgctaccattcctgcaggaaaagtataagatcaagaagccagtccatggattcgtaaaaggcaagtccatcctgaccaactcccagcagcatctgaagaagaaattcatcctgaatatcgacctcaaagatttttacgacagcattcacttcggtcgcataaaagggttgtttatgtcagagacatttaagatgggggagaatgccgcaaccctcgttgctcacctatgttgcaataatactaagatcccgcaaggtgcgtgcacctccccgatcctgtctaattttattgtgagtcagctcgacaagaagctgatggaatttgcgaagaccagccactgcacatatactcgatatgcagatgatattaccctgtcctcaagcaagaatatcagcaacactgtcattaaagatgagaatagtagtttccccatcaatggattcgagctgagctctgagttggagaaacttattcacttctgcaacttcaccattaactataagaaagtacggctggagtccaaatacataaggcaggaagtcactggcatcactgtgaacgattttcctaacgttaagaggacattcataagacagatccgcgctatgctgcatagttgggaaaaggatggccttgacatcgcctctcagaaacacctatcctttaaaaaacgggagtacagtatttcatcacccgagaaattctttaagaacgtgattatcggcaaattagcttacttgaaaatgattaggggggaggaagacattatcctgcgtaaactgtgtctcaagtttacggcactggtgtcaaatgatgaagtgctgccaaagttcattcgcaatatcaagatgaagtacgaggaatttcaggtgtttatctgtcatgcaagcgaagataaagaaaagatcgccagacccctctacgacgagttagtaaagcttgggataaagtccttccttgacgaaaaatatatcgaatggggagactctctcaccgaaaaaataaatcatgcccttggacaatctagatatgtgatagccattctttcagacaactcgattgaaaaaaagtggcctaaaaaagagatcaactccacgctgagcagagagatatctggtgataaggtgttgcttcccattctggccggcgacgagcggaaaatctttaaggtgttccctctgctccacgataagctctacaaactgtggaataacgatgctaagttcatggctaatgaaatcaagaacttactgtccagtacagaagactacgaaattaaccatgaggttaacacctctgagtcgtctatattggagaaaatcaaggacttcctcacgaagataaagattctgaaatga

SEQ ID NO: 8006 - RNA, 1512 nt, unidentified
  source 1..1512: mol_type = other RNA; note = synthetic construct
atgaccaagaagctgcatatcaagttacaaaagacctttgaggaaagcttagaactgtttaataacctcactacagcttcagatgttgcttccttcctggagattccactgcaaaccctaatctatatactctacaaagacaccaagctgcactacaaggagttcaagattaaaaagaagagtgggaaagaccgcatcattaacaaaccaattggcagcattagcatcctgcagaaaaagctgctgccatttttgcagttcaagtacaagatcaagaaacccgtgcacggcttcgtaaataaaaagagcgtactctcaaatgctgagcagcatctgaagaagaaattcatcctcaatatcgatctgaaggactttttctcctcgatcaattttggaagagtcagaggtttgttcatctcctatccttttaatatgggcaatgacgccgccaccctgatcgcccagatctgttgccataagaacgggcttcctcaaggcacatgtaccagcccgatcctctcaaattttatagcctctagattagacgtcgagctcatcaagtacgctaacgccactcatacgacctatactaggtacgcagatgatataacattctcaagcacaaagaagctgtcgtccaagatgataatttacgacatggattctaaccctgtgattaacggttttatcctgagtgactctcttaaggaactgattaaattcatggggttcgatattaactacgataaagtccgccttgagacgaagaatatacgtcaggaggtgaccggaattactgttaacgacttccccaacgtgaagcggaactttatcaaacagattcgagcgatcctacactcttgggaaaatcttgggctggaagaagccgagaaaaaacacctggaaacaaagaaactaaagatggacatcagttccattaaaaatgacggcaagtatctgaaaaacgtcgtgattggaaaattggcatacctcaagatgatacggggcgagaatgacattgtcttcattaagctcgcactcaagctggcttctctttcatccgacaacctcccgaaattcatcaaggagattaaactgaaatccgaggagtttgatgtgtttatatgccacgcaagcgaggacaaagagaaagtggccaggcccctttatcgagaactgactgaattgggaattaatgccttcctcgatgaggagtacattgaatggggcgatagtcttacagcgaaaatcaatcacgctcttggacggagtaagtatgtgatcgctatcctatctaatagctcaattaacaaggagtggcctctgaaagaaataaactccacactggccagggaaatcagcggggacaagaaattgctgtctatattggtgggtgatgaacaggagatctttaaagttttgcccttattggccgataagttatataaaccatggaacaacaacgcgaagacgctcgcaatcgagattaagactatgctgatccccaaatga

SEQ ID NO: 8007 - RNA, 1536 nt, unidentified
  source 1..1536: mol_type = other RNA; note = synthetic construct
atgctcataactcactcaaaactacttcctaagatcaagaaggacattactgaacaggaatccttattctctaaacttcagacaaccaaggacgtggcagatttgctggaggtgccctacaaacaattactgtacatcctctacaagcaggacgactctaagaaatatgagacattttctatccccaagaagatgggtggtatgcggatcatcagtaaaccgaaagggtccatcagtatactccagagtaaactattgcctctcattacctccaaatatactgccaagtcgtgtgtccacggatttgtgaaaggaaaaagcatcctcacaaatgccggtgcccataaaatcacgcagcacaccaagatcctgaacatcgacatcaaggacttttacgattccataaatttcgggagggtgcggggcctgatgatgtcccatccctttaacatgggaaacaaagcggccactgtggttgcacagatactgtgttggaagaataagcttccccaaggcgcttgcaccagccctgtcatctccaatatgattttgcacaggctagattcaaagctgaccaaactctgcgaagatctgaagtccgtgtactataccagatatgccgatgatattacaatttctagcaactgccctgtgtttcctgagactatcgccacctgggaccccaagaccaaagaagttcgattgaatcaagacttcgagaacatattcaagtcagagaacttcaacattaactatagcaaagtgcgactcaagtcaaataaagagcgccaggaaattacaggactgaccgtgaacgagttcccaaacgtccgtcgagtttttatccggcagattaaagccatgattcacgcatggaacaagtttgggcttgaggccgcagccaaggagtatatcgaaaaatacgacaggaaaaagttcaacgctgaaaatagcaacgttgtggactatttcaaaaacgttgtgtacgggaaattggcctacctgtacatggtgagaggcaaagagggagctgatcgcatttgtcagagatttgcagaacgcatactgaatatagatgacgaggtgccaaactttatcaagaatatgaaggagtccaagtacgatatattcctgagtcatgcttcagaagacaaatgcattgccgaaagaatctacaaagaatgtacgagcaacaacattaatgcgttctttgacaaggaatgcattaaggtaggcgactcgatcccggagagaattaatgatgctctgcgcacttctaagatcttcgtaattatcgctagctacatgtatagcgaaaagaagtggacatgtgaggagctgtggagtgctgtcaataaaacgatagagacaggggaaattaggatctatccaattgtcatcggcgatattaacgagttcaagcggaattatccacttctgggccataggaaggcaatgcggtgggaaaacaatgaatctgagatcgtaaaggatctggagaattttttacgtgtccaagagaatgaggtcaagtga

SEQ ID NO: 8008 - RNA, 1776 nt, unidentified
  source 1..1776: mol_type = other RNA; note = synthetic construct
atgaaaaaaaaggaggaactggctcccgaataccttgaacgctttctgcaactcaactctattaaggagctttctacctttcttaacctgcggatttcagccctggaatatttcttgttttatgcgccagacgaaaagaagtatcgcattttcaagatacagaaaaggaacggaaatctgcgttctatttcaactccaaccgaaagactgaaagagatccagcaaatcctccagattattttccagtacttatacgccggcaagcctagcgtgcatgggttcgtccagaataagtcgatcattaccaatgctaagctacacattaacaagaagatcctcgttaatatcgatctctctgacttttttagctctatcagttttgggcggattaagggtatattcttaaaccaccccttcaatttcaatgaagaggtcagtaacgctttgacacgcatttgctgtcatgatgggagcttgcctcagggtgcccccacctcacccattctttctaactttgtttgtaggcagctggataaccagtttatgaagctcagcaaaacgagtaaggtgctgtattcgcgttatgctgatgatattactatcagcacaaacctcaagtcactcccgcaaagtatcggcatcatcgagactgataagctcgaactatccaatgagatcaagaagattctgcataaaaacggcttcaagatcaactacaataaggtgcgcttcgcgctgaagacaaataggcaggaggtgaccggcctcatcgtgaacaaattcatcaacatcaaacgcgactatttgcggcaggtaaagtccatgctgaatgcgtgggagaaatacgggctgtacttagccgcattcgagcacttctccaagtttaatcccaagacttatatgccgggcgacattgaactcgcatatacaaaagagttagccgggaaaataaattacatcggaatagtacgaggaagggacgacgggatatacgagaaactgtacacaagaatcaaagtcttggctcctagcgtaatgctgtcaatcatccggagacaaattcagagtagcaaggatcctatcctgttcaccgagggtaagtctgatattaaacatatcgaggcagccttttcccactttcgatcccagggactgtatcataacttgtcacttcatttccaccattacaaagaagaagacaaaatgtctaacggcgagctgcttaaattctgcgagacattcagcaagtcacacgagacgggctccattgtgatttgcttgtttgatagggacgatgaaaactttcttgccaatgtggccagcaccaaaaatactttcaaagaatggggcaataaggtgttctccatggtcctcccaataccagatcaccggaaatttacagacatctgtatcgagcacttttacactgataaggaaataaccaccaaggacaagaatggaaggcgaatctacctgtccaatgagttcaacaaagagactggccagcacgcaaaagaaaaactgaccataaagcacgttaacaaactgcaggctagaagagttcaaattattgacagcggtgtcattaataccgaaaacatcaactttgccctaagtaagaaccaatttgcagagaacatcttcaataaagtggacggatttgacagtttcaacttcgaggctttcaagctaatatttgacaatatccagacggtgatcgactatgccaacgatgaggcaaagaagtccaataaaatagagatgtccattctgtga

SEQ ID NO: 8009 - RNA, 1731 nt, unidentified
  source 1..1731: mol_type = other RNA; note = synthetic construct
atgacccctgaggagattaaagaattaaccgaccgctttctcgccatcaagactccacgccagttagcaaaggtcttagacgttgagttcaagatactgacatactatttgtacaaggtgcccgaactgaagaagtacaacgaatttgacattcggaagcggaatggcaatgctcgccgaatcatagcaccaattggaggcatcaagagaatccagaggagtctgaatttcattctccagacactgtacccaacaaagaaagcagtgcacgggttcactctgggtaaatccatcaagacgaacgcgctagcccacgtcaagaaaaacctcatcataaacatcgacatcaaagactttttccctagtatccattttggcagagtaatggggctgatgatggctagaccgtttaacttcaatgaacctttagcgcgggtcatcgctcaaatctgttgtcataaggctagtcttccccagggagctcccacgtctcccattatctccaattttatctgcaggaagatcgataatgcgtttttgaggctgacatcatacaaccggtgcacttattctagatatgccgacgatataacgatttcaactaaccagaagaagtggcccaccgagattgctcgcatagagaacggtaaagtgctcctgtctaatatcatacagggcattttccactccaatggtttcctgatcaatgaagataaaactcgacatgcaaccagagtcaaccggcaagaagtgacaggcttggtggtcaatgagtcgatcaatattaatcggaagtactatcagcatgtgagagccatgatccacgccgtagagaaatatggcattacacttgccgccaacgagcactttctcaaatacaatataaagtccaaggagcccgataatattgagctgagcttccagaacgaactcgttggcaaacttggatttattggattcattaaggggaaagagaactccacctacaaaaaactggccgctcgtattaacactgcagaacctgggatccgactgaaaatagtgcagaatgagatcgacgaggcagccaaccctattatttttggagaaggcaagaccgactggagacacctaagtaaggccctcacaaaactgaaaaaggaagggatgtttaaaagcctgtttctgcgattcaacaggtacgaaaaccttgaaattaacaacgagcagcttttggatatttgcaaatcactgccaaagggagagccatctaagaagatcgttatatgcctatttgatcgggataccaagaaaattaacaatgctgttgttgagaacggtaaggactttaaatcatggggtaataatgtcttcagcctgttgatgccgatccccgtacataggaagttcgacgagatttgtatcgaacactattatctggacaccgagctcaagcgtacagaccatgatggcaggcgcatcttcacctctgacgaattcgataaagtgaccgggatccataaacaagagaatcttcaatacccatacattggctatctccagccaaacttccctaggattattgacagccacgtgcgcaatgatatcgggcagaatgtggccctgagcaagaacaacttttccaacaacatactcaatgatgtgcccttgttcgatgacttcacctttagccacttcaaaataatcttcgatcgtatcgaagagatcatcactagccaccctgtgggatga

SEQ ID NO: 8010 - RNA, 1740 nt, unidentified
  source 1..1740: mol_type = other RNA; note = synthetic construct
atggaagaagatttcgacaaggacatcctcaattcatttttggaggttgaaactgaccgtcaattagcctcagtcctggacatcccctacaagaaccttatctacaacatctacaaactgccagacgaaaaaaagtacgagatctttgagataagcaaacgaaacaaatctaagcgtcaaatttgtgcacctattagcggaattaagaacatacagaagaaactctcgattatcctgaataatctgcattctcccaaatattgcgctcacggctacgtcaaagataaatccatcaagaccaacgctcagatccatgtaaagaaaaggattctgatcaatatcgacctgaaagacttctttacatccataaatttcggcagaattcgaggcttgttcaaatcctatcctttcaatttcaacgataaggtggccacaatcctggcccaggtctgttgttacaacgggtgtttaccccagggcgccccctcaagtcccatcctatccaattacatatgtagaaggcttgacaatcaaatcctcgatctgagtcagaaatgcaaggttgactacacccggtacgcagacgacctgacgttttcaaccaatcttaaagagctgccaaaagagattggggtgattcgggataacgaactgttccttagcaatgaactgatttctatcattgagtccaatggatttgttatcaatcgccagaagataaggttcgctctcaaaaataaccggcaggaggtcactggactcatagtgaacaacaggatcaacattaacagaaagtttgtgcggcatgtgagagccatgttacacgcttgggagaagtatggactggagaatgcagccatagagcacttcgaaaagtacaattacaagaacaagaaggtggaaaactatatcttctccttccttaaggagatcagcggtaaaatcggctatattggttacatcaagggcaaaaacaacagcgtatataggaacttgtttcggcgcattaaggaacttaacccagagattaagctaccggtgccaaaggatattatcgagtctaatacagccatcgtgttttgcgaggggaaaacggacgcgatacatattgagacagctttgaaatacctcaaaagcaagggagattttatagacctcaacattggattccatccttacgagggtaaagagatcagtaattcaaccctgtatgatatctgcaagaactggagcattactaagaaaagtgatcgcgttgatatattcctcttcgatggggacgatcgccgctataaccgtaagaacatctgtcagtatcctaacttttacaaacactggggggataaagtgtatagcgtgatgctgcccattcctccacaccgagactttgaggaaatttgcatcgaacactattataccgacgatgaaatcaaaacaaagggtaacaaggaaagaagattgtacttaagtaccgagtttgatccgaacacctgctttcacaaggaagaaaatgtcaatttcgctaataggaagacaattcggtcttcgtatcctaagatcatcgatggcaatgaccgcgttctgaatgaattcggcgtaaacgtggccctgactaagatggcatttgcagagaatattgcgaataaaactggggaattcaagaagatttccctggagaacttcaaggtcctatttgatgtgctcctgaagatattggaggactctaaagacgagaattga

SEQ ID NO: 8011 - RNA, 1713 nt, unidentified
  source 1..1713: mol_type = other RNA; note = synthetic construct
atggaggagttgagcaaggataatttcctagcaagcactaacaagcgggaactagcagcttccctcggaatcaagtattccaccttggcctatctcctgtaccacctgacagacgaaaggaggtatagcgagttcgaaattaaaaagaagaacgggaaatcacggatgattgctgcccctacggtggggatcaagcacgttcagtccaacctggcctacatccttctggacatataccctagtaagaaaaatgtgcatgcttacctgaagaagcgaaacattaaatcgaatgcatcacaccacctgcataagaagcttttaatcaacatcgatctcaaggacttctttccgtcaatcaactttggtagagtgagggggttattcatgtcacacccttttaagttcaacgaagaagttgcgactatcttggccaagatatgttgttacaagaatactctgccacaaggagcacccacaagccccattctgtcgaatttcatttgccgcaaactcgacaatcaacttgttgatctggctcagaaaggtcgcttctcctacacgaggtatgctgatgacattacctttagcacgaatcttagtcccctatctcaggtgttgggcaccatatccgataataagattgtgctgtctgaggagcttacctctatcattaccagcaatggctttacagtcaatcaggacaagacaagatatgccaccaatgccaaccatcaagaagtaactggcctggtcgtaaatgagtttcctaacgtcaagcgacaatacgttcgccacatacgtgctatgcttcatgcttgggaacagtatggcctgaccctcgccgcccaggagcacttttccaagtacaatacaaagcacaagataatctcaaacccagagattagctacaagaatgaaattgcagggaagataggttttgtgggctccattaaaggaaaagacgacgatatttaccggaaaatgtgcatccgattgcgcgaactcgatccagatatcaagcttgccgtggcgtttagcaatttccataacgagaacaagcccgtgatttatggcgaaggcaaaacagactggaaacacctcaaagctgcactgcggtactttcagcataaaggggaatttctggacctcaatattcatatcaccgagtactctgaacaggtaaaaatcaataacgcggagttactggcaatgtgcaaaagtaaagccctcgatgccaacaaacacaagctgatattcctgttcgacagagataaccaccagatcaattctgaagctagtttgaacgagtccaactataaatactgggggaacaatgtgtacagtgtcctgttgccaaagcctgaccatagagattttaacgagatctgtatcgagttcctgtatgaagatgaaatcatacagaggaaagacaataatggatatcggttattcatcaacaacgagttctctaaagacaccggaaggcacttaatcaatgagaaactgcaactctctaacctgggtattatccgttgcccctacccacggattattgagcatgatgtgatggacatcgaaaccggcaagaacaaagccctgcctaagaacaacttcgcgacttatattctggagcagcagccgccctttgacaatgtcagcttcgagcacttcagaggaatctttgagctcctaacaactatcgccactgagtga

SEQ ID NO: 8012 - RNA, 1734 nt, unidentified
  source 1..1734: mol_type = other RNA; note = synthetic construct
atgcagaccgagatgcccgacatccagagcaccttccaggcagtgacgactaagcgggagttagcagagaggctggggtctagtctcaagatgttggcctactacctgtataagctcccgccagaacagcagtataaaaagtatgatatccccaagcgggctggaggaacgagagaaatctacgctcctatatctggaattaagcagatccaaaagcgattgagccacatactgcagaattatcagcctgcaaaattttgtgtccatggctacgtcaaggaaagaagcattaaaacaaatgcttacatccacagaaggaagcgcatagtgatcaacttagacctgaaggactttttccctagcattaactttggtcgggttcgcgggctctttaaatcggccccattcggattcaacgatgaggtcgccaccaccctggcacagatctgctgtcatgatggaaagcttccccagggtgcaccaacatccccagtgatatctaactacatctgccgaagactagacaatgagttgattgccttcgcgagaaagcacaagattaactactcacggtacgctgatgatataacattttcaaccaacctccaatttctgcctacagccgtggggcatattaaagagcacaagatcgttttatccaatacgctgcagaagatttttcaggacaacggattcacaattaatgaggagaaaaccagatacgccctgcgcaccaaccggcaggaagtcactggcctgattgtcaatgcaggtattaatgtgccccgcaaatatatcatgagaatccgcgccatgttgcatgcttgggagaaatatgggctggaagccgctgccaaggagcactttgaaaaattcaactacaagcacaaacacccagactacccagagattgcttttaaaaacgagctgactggcatgctgaactacgtgggccagatgaagggtattggcaacagagtgtacattgccctctactatcgaatcaagcgtctagactcaaatatcaaactgtctatccccgaatatatcccggctcccgaaggaactaccgtagtgttctgcgaaggcaagacagatccgctccatttggagactgccctgtcatggtttcaccagcaaggcgagtttagtgaccttgatctgcatttcttcaaatggaggtccgatcttgacattaataacgacaccctcttgcagatgtgtcaaactaggccacaggcaaagcgcgataatcgaatcgagatctatctttttgaccgtgacgtgcccaggtatatacaaaaggccgcggagaaagataaaagctataaacactgggaagccaatgtgtatagtgctttactgcctgtacccgaacatcgggatttcaatgagatctgtatagagcacttctaccctgatgaagacctccttaaagaggataaggacggcaggcggctgtataccactcgtgaatttgaccctgagtccgggtgccatctcaagctcaaagaggtttattacgcgggcacaagggcgcaactacgctgcaagtaccctaagattctggactccaatgttaggaaaaccgggtctgatgaaaatattgccctgagcaagaacaacttcgccaagaacatctttcacaaaacagggtccttcaaagaagtaagtttcagctacttcaaagtgatcttcgagctttttgaagagatcatggctcaggcaaagtga

SEQ ID NO: 8013 - RNA, 1728 nt, unidentified
  source 1..1728: mol_type = other RNA; note = synthetic construct
atggatggttttgacagcaacatgatcgagttctgtgaaatcgattcacgacgggatctcgctgcatatcttggttgccagtacaaggatttgatctataaccttttcgtgctccccgacgacaagcgttataaaaagattcagatcccgaaacggaacggggacacacgcgacattctggccccaagctctggaataaagagagcacagagaatgctggcaacaattttaagcgacttgtacaaaaggaagtcatgcgttcacggttacgtcaaaaaacactcaatactgactaatgcctccgtgcacaagaacaaacgaatcgtgatcaatattgacctgaaggactttttcccatcgataaatttcggcagggtgcgggggcttttcctgaatcccccttttagctgttgtgaggaggtggccactttcatggcacagatctgctgttttgacggcgtccttcctcagggcgctccaacatctccaattatcagtaattacatctgcagatccctcgacaacgaattgctgaagtttgcgcgaaaatatcgtctcgactacacacgctacgctgatgacattacgttctcaactaatttacgcgaaatccccagtaggttgggagtaatccaggagaacaagttagtcctgtcggaatacttcacctccatcatagaagaaaatggcttcaagattaacccgagtaaggttcggtattcttatcatactggacaccaggaggtgaccggcctcgttgtcaataagatagtgaatgtacatcgtaagtacgtgaaaagaatccgcgccatgatccatgcttgggagaagtacggcctcaccgcaacagcaaatgagcacttcgagaagtacaactataaacacaggctacccgaatccccagattacgcgtttaagctagagctgcaaggtatgatgggctttctcgccgcggttaaaggcaaaaacaaccaagtgtatgccaggctgtacgagaggctgattctcctggataagcatacaatcttgcagcctcctctgcggattaccgcccccagagactccgtggtcatttacggggaaggcaaaaccgacgtggttcacttagctgccgcatatcgccattttcaacagcaaggagaattcctggggctaaagctgcatttccatcgctggggtaaccatgatgtaaacaacgagtttgtgtacaatatgtgtagaaccaggagtgaatccaaagagaatgataacctggagatttatatcttcgaccgagacgttgctagatacgtcaaagataccacggagaacgggaagggatttaaaagatggagcgaccgggtatattccgccgtccttcccattcctcctcaccgcgattttaatgatatctgcatcgaacacttctactccgatcaggatctggcccggcgagataagtctggaagacgcatatacaccagctttgattttaatccgcagtctggaaatctgaaggacagcaacgacatctattacccatataggcaggagctgaagaggacttatcccaaaattatcgacgataaagtgatgcgtataagctctggcgaaaacattgccctctcaaagaacaacttcgctttgtatatctctcgggggattggggaattcgctgatgtggactttgagaattttaggcctatcttcaaacttattgaggagatagtgcacaatagtatgcggtga

SEQ ID NO: 8014 - RNA, 1713 nt, unidentified
  source 1..1713: mol_type = other RNA; note = synthetic construct
atgaaaaacaaggaataccgcgatttcttgttacttggaacccgagaagatgtggctaaatttctaggcggaagcctcaagaacctgagctttctgctctatattctgcctaaagagaaacagtatcacgacttcagcattcccaaaaaaaatgggggcaaaagacagatttcctctcccatctcctctattaagcgttaccagagggagctggctgatattctctcagaatattaccacgttaagtctacggtgcatgggtatgtcaagggaaagaatataaagacgaatgcgataatgcattgcaataagaagtggatcgttaatatcgacctgaaggacttcttttcgtctatccacttcgggagagtcctgggggtattcaaaagcaagccatttgaatttaacgacaaggtggcaactcttctggctcagatctgttgctttgatgggaagttgccccagggagccccaactagtccgatcatatcaaattacgtgtgccgaaatctcgataataacctcattaactacgccaagaaaaacaagctaacatactctcgctatgccgatgatatcaccttctccactaatatgagttcactcccagagaacctaggtaaaatttccgaggaccacgaactccggctgtctgacgaactgttgggcatcatcacaaacaataattttgccgtgaactcaaccaaagtccattacgcaaacagaaataataggcaggaagttaccggtctgatcgtgaataagaaggtgaatatcaagcgaacatacatcagaaggataagggctatgctacacgcatggcaaaaattcggcctgtctaacgccgctatcgaacactttaacaaatacagcatcaagacccaaatccctgacttccctgacttggcctttaagaaacgtatcacgggacagataggctttatcggtcacataaagggcagcaatgacaacatatacaggaacctttacaaacggatcaaggaactggaccctatgactaaacttacacttccgaacattatttccagcccagagagctgcaatgccataattctgtgtgagggcaaaaccgatagtatacatcttgagacagctctgaaatatttcatcgaaaggggcgaattcgtaaatctcaagattcacttctacaaataccccgacgaggcaaagatcaacaactcctacctctataagttatgcgaggctcgggatctgatcctgcatgacgtccggattgtgtgcctctttgactgtgatgatgcgaaatatgttaaacactgttgtgagggaaagaaattgtataagaactggggcaataacctgtattcatgtttattgccacaacccatgcatcgggacttcaaagagatttgcattgagcacttctacactgatgacatcctgctgaagaccaacaacaaagggagacgcatttacctgtccaacgagtttgtgtatgagacagggtttcataagaccgagaatattcagatccgcaagagagacgatgccaagagtccctatcctaagattattgacagcggagtcttcaagtcaaatggcgaaaatatcgcgatgagtaagaacgactttgccaatagtattgccgcaggtgaaaaacctttcgataacatatcgttcgagacttttcgcccaattttcgatttaatctccgatatcgtgaacgagtga

SEQ ID NO: 8015 - RNA, 1725 nt, unidentified
  source 1..1725: mol_type = other RNA; note = synthetic construct
atggaggagaacaaaaactacgaagacttcttacaagtcacgaccaggtctgatgtcgccacttacttgggtggcagccttaagaacttatcctacaacttttacgtgctgccaaaggagaagcagtatactaagttcgcaatccaaaaaaagggagggggcgaacgacatatctgtgcaccggccagtagcattaaactctaccagagacgcctggccaccatcctgagcccttactactccactaagcccacggtgcacgggtatgccttaaataagtcaatcaagacaaacgccaaggtccattgcaggcgaagatggattgtcaatattgacctcaaggacttttttcagagcatgcactttggtcgggtgagaggagtatttctgtccaacccattcgctttcaatgaccaggttgccaccaccctgacacagatttgttgcttcgaaggcgtcctgcctcagggggcaccaacttcgcccattatatccaatttcatctgcagacgcttggataatgagttgctagaatttgcaaagaggcacaaactatcctatagtcgatatgctgacgatattactttcagcactaacttggctgcgattcccgctgaactcggcactattagagaagataatatcttaacgctcagcaaggaactgcgggatattattgagaacaaccagttcatcgttaacgagagtaagatccgattcgccggtcggaacaaccgtcaagaggtgacagggctgatcgtgaatgaaaagataaacgtaaagaggacctacattcggaggatccgcagtatgctgcatgcgtgggagaagttcggcatagctaatgctgctaaagaatacttcgagaagtatgccacaaacaacaaaatgcccgactatccggacgttgtgtttaagcggattctggtcggcaggatcgcatttatcaaacagataaaaggcattgacgacaaagtgtatcgcaatctgttcgggaagattaaagcgttggatcctactatcaggttgaccctccccacactcatcacatctcccgatacctgcagagccgtggtactgtgtgagggcaagaccgatggaatacacctacacgcggccctccagtacttcatagagcgcggagagtttgtggacctgaacgtgtacttctataagtacccgaccgaagcagacctctccaatagctacctttacaagtattgcgagtcatcaaatctgagacagcagaaaaagcgtacaatctgcctgtttgattgcgatgattcacggttcgtcgccaagtgtcaagaagaggggaaactttacaagtattggggtaacaacctgtactcttgtatccttccaaaacctgcccatcgaggatttgacgagatctgcatagaacacttttatacagatgaggttctttgtagagagtctaataaacatcggcggatttatctctctaacgagtttgatcctatcaccggcaaacaccgtaccgaggacctgatcatgagaaaacgcacagacgctaagagctcttatccaaaaataatcgactcaggagtttttaaaccaaatggggaaaatgtggcactcagtaaaaacgatttcgccaatctgatcgcaacgcgcaatgccccttttcacgacatttcgttcgaggaattcaggcccatctttgagctgctttccaggattgtgaatgctgcttccgaatga

SEQ ID NO: 8016 - RNA, 1761 nt, unidentified
  source 1..1761: mol_type = other RNA; note = synthetic construct
atggacaccggtaacggaaatatcctgaacgggtttacggacctcaaaagtaaggccgaagtggctgaatacctgggaggatcgctgaagaacctgtcttatgtcttctacgtgcttcctaaagagaagcagtacaagaccttttccattactaagcgcaacggaaaaaagcgcaccattaatgctcccgtatcctcaatcaggctgtaccagaagcggttagctgagattctgtcaggtttttacaaacgaaaaccatgtgtccatggttatgccaaggggtgctccattaagagtaacgccaaaatacactgccgtaagaagtgggtggttaatattgacttgaaagatttcttccccagcatccacttcggtagagtgcggggcatgttcttgtcccagccctttgaatttaatggcaccgtcgcgaccaccctggcccaaatctgctgctttgagggcgcactgccacaaggagccgccacttcacctattatcagcaactttatttgccgccgtttagacaatgatctcattagtttcgcaaagaagcaccgccttacgtacagccggtacgcggatgatataacattctctacgaacctgcccgctctcccggaatccgtaggcaccattgccagcgacggctccttagaactcagcgacgatctgagaagactgattgaaaagaactcattcaacatcaatgagtctaaaatcaggtattccgatcggcataatcggcaggaagtgactgggttaacagtgaatgagaaaaccaatgttcgaaggacttatgtgcggcgagtgagagccatgttgcatgcctggcaacagtatggccttaaggacgctgcgagagaacactttgagaaatattctgacaaagtcatgcccgagtacccagaactgacatttagtcggattgccactgggaggatccgctttataagacagattaaggggcccgatgaccatgtgtaccggaacatgttccgtcagatcaaggcattggatgcaagcataaaactcgatctgccagcattcttcaatacaccggacgggtgtaatgccgtcgtactgtgtgagggcaagaccgatggactacacctccaagcagctctccgctatttcataggaaaaggagagtttacaggccttaagatctactttcacagatatcctgataagatggacatcaacaactcgattttgtacaagtgttgcgagacatccgtgacaaggcagtctaatattttgcgcatctgtctatttgaccgagacgaccgaacatttatgaaaaaatgcagagagggcgatagtctgtataaagattggggtaataggctctatagttgtgttctgcctcagcctgaacatcgggacttcagtgaggtgtgtatcgaacacttttacagcgacgaagtcctaagaactaagtctccaaagggccgccgtatctatctgtcaaacgagttcgatccagggaccggcaaacatctctctgaggaccttacctgtagaaaaaggactgatgctagctgctgctaccctaagatcatagactcaggggttttcaaacccaacggagacaatgttgcactctctaagaacgacttcgctaatctgatctttaacagggagggggacttcgccgatatctccttcgagcactttaggcccgtgttcgaacttctgagcgagatcatagagaaggatggcgcgctaaaggagaaactgagggcctccagctcagcttga

SEQ ID NO: 8017 - RNA, 1713 nt, unidentified
  source 1..1713: mol_type = other RNA; note = synthetic construct
atgacggggggctgtttttacatgtcaatcgagaatagagacattctgttttacaatgctgctacgaaggaaatgctggccgccgcactaggaacccgactgaaccggctcgtttattacctctacgtcgtgcccgactcagaacgttatacaaaaaagtgcatactgaagaagagcgggaaagtgcggaacgttgccgccccaagaagcggtttgaaattcatccagaggaatctggcgagcatcttaaacaccagtgttcctcagaaaagttgcgttcatgggttcgtacctaagaagtccattataagcaacgcatccgtccacctgaaacgcaattttgtgattaacctcgacctgaaagacttctttccctcgattaacttcggccgggtactgggactgtttaagtcggcacctttcaacttcaatgacgaggtcgcagttactttggctcagatatgttgtttcgagggctctttgcctcaaggcgctccttcatctccgattatctcaaatctcatctgccggagcttggataatgacctgatgcgcttagccaagagtctgaaacttagttactccaggtacgctgacgacatcacattctccactaatctgaaagagttgcccaagggcctcggcgaagaggtggaaggcaaatttattccatctgaagcgttggttgacatcatcggccgtaacggtttcgagcttaatttcaacaaactaagatgcagacgcaagtgtcagcgccaagaaatcaccgggatagtgagcaacgagaaacttaacgtgccccgaaattacgtccgccgagtgagggccatgatccacgcttgggaagtatatggtttagagaaggctgcctacgagcactttggtaagtactccaggcgtaggttcctctatcctgaggcatcttttcgcaagagagtggcaggaatggtgggatatatagggatgattaagggggtcgattcccccgtctacttaaagttatacgagaagttgaagtccctcgacgatagtattaagctgaaaattccggaatacagcggctcagccgatatggtagtgtactgcgagggcccaacagatccgatgcatcttaaggcggcgctgtaccactttcggtcaaagggaatgttcaactcccttaaggtggatttccatatgtatcgggacgatatgaccgtcggtcacggggagctgtataattatatggtgcggaagcacctgatgaaaaaggataatgtgatcgaggtgtatcttttcgataatgacctgaagcaatacgtgcagaaactcgacgggaaaccttttatcactgttggacaccccaaaatttatatggcactgctgccaaaaccagaacatagggatttttttgaagtgtgtatcgagcacttctataaggatgaagacctgtgcaggaaggatgcaaacggaagaagactgtattttgcccgcgaattcgataaggacactggcgcccatgtgacagaggatgtcaggtctgtcaaactacatccactcaagcagcccggatacaccatcattgacaacagaattctggataaagacgatcgaagtgtagctctcagcaagaaagactttgcccttgccataatgcatcggaagaaatctcacagcgacgtcgatttctctgcctttaaagctatcttcgagatgctacagatgctcgtgtga

SEQ ID NO: 8018 - RNA, 1713 nt, unidentified
  source 1..1713: mol_type = other RNA; note = synthetic construct
atgggcgccttcttcatggactacgacgagaggtatatgcgtttctatgaagctgacacaagagagctcctcgccgtggcactgggcacaaagccaaataggttaagctactacttatacgtgctaccagagtcagaacggtacaagaagaagtccatcctgaaaaaaagcggtaaggtgcggaatgtagcagcgcctactggaggcttgaagttcatacaaagaaatcttgccgatatcctaactggatctctagcccagaaaagttgcgttcatgggttcgcgccagatcggtctatcgtcaccaacgccaaggttcacctgcgacgaaaccttgtcatcaatctggatttaaaggacttctttccgagcattaacttcgggcgagtgtacgggctgttcaaaagccacccctttaattttaacgagctggttgcagccaccctggctcagatttgctgtttcgaaggcagcctgccccaaggaagcccctgtagccctgtgatcagtaatctgatttgcaggtctttggataaccagcttatgcatctggcaaagtccctcaaaatgagttattccaggtatgccgacgacattaccttctctacgaatttgaaggaaatccctgaggaaatcggtagtattgtggacggccgctttgtcccatccgagaagctgaccgggattatagagaggaacggtttctcactcaacgtaaacaagactagatgtcgcaatagaaaccagaggcaggaggtgacgggtattgtaaccaatcaaatccccaacgtgccgcgaaactacgtccggagaatcagagctatgctgcacgcatgggaagcctacggccttcagaaagctgctgaggagcatttttctcggtactccaggaagcattgtgtgtatcctgaagccagcttcaagaagcgcttggccggcatgattggctacgtcgggatggtgaaaggacgtgattcatccgtgtacataagtctcttcgagaaacttaaagccattgatgaaaccatccggttgcgcctcccggaatactcgggcgatgccaagatggttgtgtattgcgaaggaattacagacccaatgcacttgaaagctgccctgcgccattttcgtagtaaaggcctgtttggtggcctgaagatcgattttcacatgtacagggacgatgtcccagtcgggcacggggagttgtataagataatggaggggcgacacctcgttaagaaagacgatgtgatcgaggtctacttatttgacaacgaccagaaagattatgttaccaagcttaacgggaaggcttttatgacttaccgccaccctaaagtgttcatggcactgcttccccagcccgctcacagagacttctatgaagtgtgcatcgagcatttttattcagattccgacctgatgcggaaagacgcaaaaggacggcgcatctattttgtccatgagtttgacaagtctacaggctttcacaaaactgaatcagtgagatgtctcaagctctcgcctctaaagcagaaagagtatacacccattgtagatggaatactcaatgaaaaggatcagtctgttgccctgtccaaaaaggatttcgctctggcggtactgaatggaaagcaatcccatgcagacgtggacctggatgcgtttaaaagcattttcgagatgttcgagaatatatacatctcatga

SEQ ID NO: 8019 - RNA, 1686 nt, unidentified
  source 1..1686: mol_type = other RNA; note = synthetic construct
atggagctttctaaggcagaatcacgggaggatgtgctcctggccctgtgttctagctggaagaacttggcttattatatatacaggctaggtgatcgacggtacgaaaagatggagatagtaaaaaagagtggcaagttacggaacattgcaagtccagtgcgtggcctgaaatatatccagcggaacttatcggccgccctatcatatggctataggcagaaagggtgcgttcatgggttcgtcccccagagaagtattctcacaaacgcatccgttcacgtcaataggaggtatgtaatcaatctggacctcaaggactttttcccttctattcacttcgggcgggtcgtcggcatgtttgttggaccaccttttggatttaatcacgaggtggctgtgactcttgcccagatctgttgctttgaaagagtactcccacaaggcgctccaagctcacctgtgattagtaacatagtatgccggaagctcgacaatgaactcctggggctcgctaaagaatgtaggttaaactactcccgctacgccgatgatattacattctctactaacctgtgcgagatcccggaacggctgggaagagttgaaggtgagcgtttcattatatctgacgggctccgccgcatcatcgcggataatggatttgaattgaacgatgagaaagtgagatggagctctgagtattacagacaggatgtaactggtcttgtggtgaatgagaaagtgaacgtgccccggacttacatccgtagaatcagaagcatgttgcatgcttggcagaagtttggtcttcaggccgcagcgaaagagcattactccagattcagctttaagaaaactaacaattgcgaagaatcctatcgacgccgcgtcaccgggatgattgggtatgtcggcatggtcaaaggccgcgactccaaggtgtacttgtcgctggtgagcaaactatacgacctggacaagggtatgtccctggccgttcccgatctgaaggacaagacaggcatggtcgtgtactgcgagggaaagacagatcctatccatcttaaagccgccctctcagcttttcgcaagcgaggactgtaccacgaattagacgtgtgtttccatatgtacaagccggacaagtcaatttccaacagtaccctgtacgagatctacgctaaaagggatgtcgtgaaggaagggaatcagatagaagtgtacctcctggattcagacgacaaaagatacacagataaagtgaaggccgacggaaagtgttacaccaaaggcggccaaaatatttatctagcagtcctgcctaagcccgagcatcggaatttcgataccgtttgcatcgagcacttctataccgacgacgacctgcgtcgatgtgacaaaaacaataggcgcatttatctgtctggcgagttcgataagaacacgggactgcacttggtggagtccggcctgaggacgaccaaattgtcacccctggccaagtctgactatgccatcatcagcgagggggtccttgattgtcatgatgtgaaccacgccctgagtaagaatgagtttgcacgagcggtgtcctgcagggcagctagccacaaagatgttgagttcagccacttcagcgttatttttgacatgcttatggacatccaaaaggacgctttgtga

SEQ ID NO: 8020 - RNA, 1701 nt, unidentified
  source 1..1701: mol_type = other RNA; note = synthetic construct
atgaacctgctcaacatcaagtctaaggaggatcttttggattatattgggattgaagaagcccagctgaatcacctgctgtatcggttgcctaacgcctacaagtatcatacctttgaggtgaaaaaaaagaacggctcatctcgtattatcaactcacccaatcctgagttaaaggtcatccagaccaagctcaaagacgaccttgtggagtttttcggcaaaaagaactgtgttcatggctttgttaaggacaagaacatcttatctaacgcgagcagccatctcaaaaaacagatcctcattaacatcgatctgaaagacttctttagcactattcattttggtcgcgtaagagggatgttcctctccagcccctttagcttcccagaaaggatagcaaccctgctcgcacaaatatgttgttttaatgggctacttccgcagggcgctccaacgagccctatcattagtaactttatctgccggaagcttgataacagcttcattcagttctcaaaaaagaattccttcttctacacacgatatgctgatgacattaccttctcctccaatatccgaagtctgtcttcggagctcggaattttcaacaaggaccagttcgagattagtaaatcaattctgaatcagatccacaacaatggttttacgatcaacgagtcaaaggtcaggatggcctcccgatttaacaatcaaactgtgaccggaatcaaagtaaacgtaaaacccaatgtgtccaggttttatatcaagcagattagggcaatccttcacgcctgcgagaaacatggcgtcgaaaagactgccattgtgcacttccagaagaacgaaatcgatttgaacaggctcaagtccccaattgacttcttcattaagagactagtcggtaaaatcagtttcataggtttcgttagaggaaaggatgacttcctattcaagaagctgtatgaccgggttaaggtcatcgtgcccaacgcccggctgagcattatttacaagaagatagacgaatccaagaacacactgatcttgacagaagggaaaacggactggaaacatatcaaagctgcgctgataaaactgcaggcccaaggcgcttataacaacctcaatttgacctttgctgactatctggacgagcacaaggtgtcgaattctgagttattcaagatctgtgaatccataccgaaattaggaatgcagaaaaataagaccatctgcatctttgatcgtgacgataagaacttcatacccaaagtgacaagtataaacgacttttacaaggattggacaaataatgtgtactcaatggttctgcccgtgccaaaacaccggaatttcgagaatatttgcatcgaacattactacacagatgacgatctgttcacttacgatcacaacaatagaagaattttcgtgagcagcgagttcgagaataatggcaatcacaagcttgagaagtatcgctacaaagggaatctggagaagttgaaaaaccgctttcctactatctttgatagtcaagtagtggattcttctggagcttctatagcactgtccaagaatgattttgcagactacgtctacaacaacaatccacgctataattcatttgacgtcgaagcctttaaagagatctttaaccacatctacgtgattgaaaataccactcctaaatga

SEQ ID NO: 8021 - RNA, 1620 nt, unidentified
  source 1..1620: mol_type = other RNA; note = synthetic construct
atgcgctcgcaagaatttctgaaaatcaaaacagaggccgaccttgcgaattttttgaatatctctgaaggcacgcttaagtactactctaatccaatcacaccatccaaggcttacactaccaccattctgaaaaagaagaatggtgaagatagaatcgtgtgtgcacccgtacggatcctgaaatatatccagcggcagattagtgacgtcctgtatgaactgtacaagccttccaggtgcgtgacaggatacgtgcggaagaaatccatttgtgacaatgcaagacctcacacttcaaaacgcatgataatatgcctcgatctcaaggatttcttcaccagtatacactttggccgcgttcgtggcatgttcctcaatcagccctttaatttcaataccacaatcagtactgtgctggccaaccttacatgtcgaaacggatgtttgccacagggcgccccttcgagccctatcattagcaattacatctgccgacggttcgacggggactttatgaagttgtgcgccaaatacaaactagtgtacacgagatactgtgacgatatcaccattagcacaaaggcctactccttcccacattctattatctattttagcaccacttggtccctgggagatgacatccgtgagctgattcaaaagcacaacttcatccttaacgaatcaaaatttcgcgttgtgaccaacaaaacacgccaaatggttaccggactggtcacaaaccagaaggtaaatattcccaagaacaaataccgtaagctacgagcagaattgtattataccctaaaaaacggactcgatgaagccgcgaagcacgatgggtacattcataacaagatcgtggacaagaatgccttcctgaaccatctgcggggaggggttaactttttcaaaagcgtgctcgctgtggacaaccctagatacaagtggttagctaatgagttcaacaaaattgtaggcgagaattactttttcgtgccatctagttgggacgagcttaagaacaaagctatattcgtcctgatgaacaataaggagacgagccaggggactgcattttacgtcaccgacatcggtttaattacctgcctgcacactgtgtgcgcgatatctgggaggcccagcaagtcagacgtcgagactgcactcaacgattattacgcctttctcccgaacactgagtataaccacattaagctgtcttattgttggcatagcaatgatcttgatttgctggtgctgaaattcgtggattacacgatcagaatcgggtatgagatcgagaaaaatattgtcctgagtgatggcataaatcatctgaaggccctcggctatcccgagtatggtttgggttgttcctgctgcttcatacaggacatgtccatcacatctaacagggtactctgtggtttaaaactctacgtggtggacaagaccttttatactggagctagcggggggccggtttttaactccgcaaacaaggtcgttggctatattgataggggaaatgagattggctcagacgaagaaaggtataatgctttctgctcaatcgcccccttactggacgagttcaacaagggcacactgtga

SEQ ID NO: 8022 - RNA, 1665 nt, unidentified
  source 1..1665: mol_type = other RNA; note = synthetic construct
atgtataatgaatttgggaggatccaacactttaagaacattgaaacaaaggacgacctgctctacgtgctgaatatcagtagtcggaagtataactacctagtataccagaagaaaaacctctacacctccttctatattaacaaaaaacagggcggttttcgcaaaatcctttcaccctgttatgatctgaagaagatacagaaggaactcaacattattatgagcaacaactacgagtttaacaatgagacagttcacggctttgttaaagagcactctattaaaaccaacgccacagtccataaagacgctaattacatcgtcaacatcgacctgaagaatttcttcgacaatattcacttcggccgcgtgcgggggatgtttatgaagcctcccttcaatttcagcgactatatcgccacaaatctcgcaaaactcacttgttatgagaaaaaacttccacagggggccccaaccagtccgaccattagcaatataatttgctataggatggaccgggaactgagctacctgtgcaataagtataattgcagatatacccgttacgccgacgatataaccatttccacgaaaatgctctatctgccgaaagagatcgccaaattcagagatggacaggttattctgagcagcaatataacagacactattaagaacgaggggttcaccattaatattgacaagctgaaaatctctcccaatactgatcgccaggaggtgactgggctcattgtgaacaagaaggttaacgtgcagaaggtgtatatcaagaagctgcgggcattgctcaataacgtatctaagtatggcttctacttggaaggatgcaaatactttgagaagacattgaacgattgttctaataaggactatgtggaacatagattcatcaacgtcttgaaaggtaaaatcgagttcctaaaaatgatccgaggcatcgatgactacgtgtacataaaatatgcgagcctgtttaacgagctgatcgggtatgagtacttcgataccgactacggtctgacaatgaaggagttcatcgaaaaaagggtgtaccctcttatctcatacgatgaaatggttcaaggaacttgctttatggctgacgagattggcatgataacttccacacatgtgctaatatcacctcaatcctttatcaccgagaacaaatataaagagatcgagttaaaggacaagtttaatttctgtactgtcggttcaaagccattctatatcctggatcactacaacagaaagtatatcattaaccctgaaatcacccgtgagcagattaactccgacatccttttttacaaatgcatccccagtaagaagcgatttaagataaacatgacgtacgagcccaagatcggcgaaacggtgtatcttgctggctacggagaattcaaagatttcaagacctccacgattaattacataaagtcgaatgtgaccggatacacagaatttttaggaaggaaagtcgcatgtatcaactctaagatataccatgggatgtctggcggtccagtattgaattccaatagggaagtcattggaattatctacgctggcttaaacctggaggatgatgataacggggtcatcagcaagactaatggattcgtgctgtttcagtga

SEQ ID NO: 8023 - RNA, 1551 nt, unidentified
  source 1..1551: mol_type = other RNA; note = synthetic construct
atgaactttatcgatattaagtccactcaagatctggcagactactttgagctggattacaatatcctggctagaattacttatggaccttctcggagcaacctgtacaaggttttcgagattccgaagaaatccggtggctcccgcatcatccacagtccggagaaaaccctcagagtaattcagcgcaagctggccgatgaacttaagcagcactatcgcagacacgacgccgccttcggctttgtggacaaatattcgatcaccgataacgccagtaagcacataaaccaggattggattctgaacttggaccttgctgatttttttccctctattcacttcggacggatcaggggtttgtttcagaaaaccccattcgcctttcctgacaaggtcgcccagtggatcgcacagctggctacatttaatggcaccttaccacagggtgctccctccagccctatcttgaccaacatgatctgcttacgcttagataaagatcttaaaaagctggcacgacggcatgatctgtcttacacaaggtacgcggatgacattacgctcagttccaaaaagtatttccccaaggaaattgccaagatggagaaatcagacaacgaatcactcgcgactctgggggccgacgttgtctctataatagagaagaacggattcaaggtgaatcccagtaagacaaggttggtgagcaaatctggaaggcaggaggtcacgggtatagtggtaaatgagaagagcaacctaccacgacactatatcaacactatccgcggggagatagggcaacttaggtaccttgatggcgaagccaaagatgccctccaactgagagttttgggtcgtctcggacatctgaaaaaagtagtcggcgaatatgaccctcgttacattaagctcaaggctaaactacatggcattaagctatcatgttcccccaacgaaacaatgtacagggctgtgaactggatcgtcgagaacgacgatggcgtgtatgggacagccttccatgtcgaccatcttggatggattaccgcatgccatgtgataaccaaaccagcagctatcctgaatttcaagctcttccatccagacgactcccaaaataagtacgcaatccagctgaagagcaacttcttcgatgctgacatcgactacgtgatcttcaatgcacctatcaaaccaatcataagcgccagaatcgctccgaagcagatagagaatggggaggcctgtgtgctgtcgggatatcccaatcacaatcacaagaacaatagcgtgagcattattgaagcgaaaattacctctacacagacgatctttaaggcccctcggtttgtgatcgacgcaaacatttttcatggcatgtccgggggaagtgtttttaacaaagagaatcagctggtgggcctggtgacccacggcaatgaagacggggggaccactgttctccagtcagcgttcacttcaatccacctcgtcatgaatgacattactaataaatctccccaacgaatcattcggacagaatga

SEQ ID NO: 8024 - RNA, 1734 nt, unidentified
  source 1..1734: mol_type = other RNA; note = synthetic construct
atgtcccacctcgccaagctcaaatccgccacgtctaggaaggagctggcacttatactggggtacaagccaaaaagcatgaccgcaatcgtatataagacccctaccgcagataaatacgccacatttgatattgacaagaaatctggtggaaagcgcactatcaaggcccccgctcctaagctgaagaacttgcagagtcacctgtctcacgtcctctatcagtgcctagctgagatagatcgggcgcgggacgcaaagcctattagctttggattcagacaagatagatccattactgaaaacgccagtaggcacaagcgtcgccgctgggtcttaaatctggacctggaggatttttttccttccttcaacttcggccgggtcaggggattcttcctgaaagacaaagcctttgatctgcatccagaagtagccaccacgatcgcccaaattgcttgcgacggcactgcccttccccaagggagtccctgttcaccagtgatctctgagctcatcgcacagatcctcgacatgcggctggtccgactcgcgaaaaagcacggtgtgacctacacaaggtatgctgatgacattactttctccacaagccagaaggacttccctgccgggcttgcccaggttgacgagagcgatccctccgtttggcatctcagcgatgaattgaccagaaaaatagtaacctccggtttcgctatcaacaacgctaaaacaaggatgaactttcgaggctctaggcagattgtgacgggtcttgtggttaacgagaaagtgaatatccggagtgactattatcgacgtgcgagggcgatgtgcgatacattattccagacagggcaatactataaggctgtgattaagcccgatgatgctgacgaggaaccgaagccggaagtgacttcaaacctgaacccactacagggtatcttggggcacatctacgccgtcactcagagtgccgaacggcgtgaggtgtcggagcagagacaaaatcctcgagccattaggaaattgttccggcgctttctgttctacaagtattgtattgtgttgaacgaaccactgatagtgacagaggggaaaaccgatccagtatatctcagagaggcagtcaagtcaagagtgaagttccagccaatgctaggggcccatggcaaagacggctttaaacacgcagtccgctactttaattatggcggcctggctcatgaggtgatggacctgggaggcggcacgggagacttgaaatctatacctctggactacttaagaaacctgaaacccagtaaaggcactcataaaccttttgcttacaagccaatgaagtaccccgttatcatcgttttagacaatgacgatggactggctgccgtcgcgagcacagtgaagaagaacttcggaaccgagatcgataagaaaagcacacaggatttttacaatgtcatcgacaatctctacattgttaaaacccccgaagacggctccaagaatacctgtatagaagacatgttcccgaaagaatggagagaatacaagatcaatggaaagaagctgaatactgcatcgaaaattgatccctcaaaggacctgtcaaaagaggcctttgcaaaaagcgtggtgaaggcaaatgccgacaaaattgatttttctgggttcgatcctcttcttgagcgcatctgcaaggcagtgcagcactatgccgctaagagctga

SEQ ID NO: 8025 - RNA, 1098 nt, unidentified
  source 1..1098: mol_type = other RNA; note = synthetic construct
atgaccgccatcgtctacaagactccgctcgccctgaagtacaccacatttgagattgataaaaagagcggcggaaagagaaccataaaagcaccagcaccaaagttaaagaaactgcaagcccacctgtcccatgtcctgtatcagtgcctggcagagatagagcgcggtagtgatgctaagcctatatcatttgggttccgtagggaccgctctattagtgaaaatgctctgagacacaaaaggcgaagatgggtactgaacctggaccttgaagatttcttccccagctttaactttggccgcgtgcgaggcttttttctcaaggataaggctttcggcttgcaccctgaggtggcaacaactatcgcgcaaatcgcttgtgacggagccgcccttccacagggttctccctgtagtcccgtgatttcggagctcattgcccagatcttagacatgcgcctggtacggttggcgaagaagtatggggtgacttatacccggtacgccgacgacatcactttcagcacctctcagaaagattttccgacaggcctggggtccgtcgatcccaacgacccagccgtatggcatctttcagaggaactggtggggaaaattgtgacttcagggttcgccattaatgatgccaagaccaggatgcatttcagaagcagccgacagacagtcacaggtctagtggtcaacgagaaagtgaatattcggtcagactactaccgtagggctagagccatgtgtgatacgcttttccagaccggacagtattacaaggttgttatccaacccgacgaagacgaagagcccaaaccagatgttacgagcaacttgtctcctctccagggtcctctcatccccttcgctcaaggccacaccatttcccgggaagaaacttgcggcatcgtctgttgcctactcatgctgttaaaagacgtggcagtgtggtgcagaacaatcgctactcagaaaataaggttcggagctgtgtgccggccaatccctcgcgagtgtaatcctcggtccaccggaaagtgtgatgcattttgcaccgcgacgaatacagggttggttaggtcctga

SEQ ID NO: 8026 - RNA, 969 nt, unidentified
  source 1..969: mol_type = other RNA; note = synthetic construct
atgtcttatcttcacaagctgaaaagcgccacctcccgcaaaggtttggccgagatcctgggatatcgccctaaggccctgactagtatagtctatatgaccccactggaccagaagtataccatcttcgaaatcgataagaactcgggtggtaaaagaacaattaaggcaccagtgcccaagctgaagaagctccagagtcacctgtcccatgtcctcaatggctgcctggctgagatcgaaagagaacgttctgctaagcccattagtttcgggtttcggaagggcaggtctattgctgagaacgctagaaggcacaagcggaagcattgggtgctgaacctggatctggaggattttttcccgtcctttaatttcggaagggttagggggttctttctcaaagataaagcattcggcctgcatcctgaggtcgccactacaatagcgcagattgcgtgtgatggggctgctctaccgcaaggctctccttgttcacccgtaatcagcgaactaatcgcacagattctggatatgcaccttgttcgcttggcaaaaaagtactcagtgacctacactaggtacgccgacgacataactttcagcacttcacagcgtgaattcccaacaggattagcaaccgttgatactaacgaccctcctgtgtggcacctctccgacgagctcgtcgacaaaattgtgacaagcggctttacggtgaacgccgccaaaacacggatgcattttcaggacagccggcaaatggtgaccggactcgtggtcaatgagaaagtgaatatccgctccgattactatagacgagcccgagccatgtgcgacgtactttttcagacgggccagtactacaaggttatgacccaacccgacgacgataacgaggggcccaaaccagaccttacctcaaatttgaatccattgcaggcgagcttagccatcttcacacaatga

SEQ ID NO: 8027 - RNA, 1740 nt, unidentified
  source 1..1740: mol_type = other RNA; note = synthetic construct
atgaacgtaacccatctgaagaagttgcgggccgcatcaagccgcaaagagcttgcggttatcctcggatacaaacccaaaactctcacagctatcatttatcagacccctccagcgctgaagtacactactttcgagattgacaagaagtccggtggcaaacgcacaatcaaagccccggaaccccgtcttaaaaaactccagacccacctgagtcatgcattatatcagtgtctggccgagatcgagaaggatagaggcgctaagcccataagcttcggattcagaaaggaccgttcaatcgcagaaaatgcttcacggcataagagacggcgatgggttctgaacattgacctggaggatttctttccctctttcaacttcggcagagtcaggggcttctttctgaaggacaaggcctttgcgctgaaccccgaagtggcgacgactattgcccagatcgcctgcgatgggacagcattgccacagggctctcccagctctccagtgattagtgagctaatcgcacaaattctagacatgaggctcgtccggttcgcaaagaagtacggcgtcacttatacccgatatgccgatgatataaccttttcaaccagccagaagaattttcctaatggcctcgccacagtcgatcctaatgaccctaccgtgtggcatttgtctgaagagttggttggcaagatagtgtcctctgggtttaccataaataacgccaagacacgtatgcattttcggggatccagacagatggtgacggggctggtggttaacgagaaagtgaatatccgaagtgattactaccgcagagctagggctatgtgcgatatgttgtttcagacagggcaatactataaagtggtaatccagccagatgaggaggacgaagaaccaaagccagatctcacatcaaatctgaaccctctccaaggaatccttggccacatttactccgtgactcagaccgaggagcgcagagaaataagtgagcaaaggcagaagcctagggccatcaggaaactgttcagacggttcttattctacaagtactgtatggcacttaaggaacccttgattatcaccgagggcaaaaccgacccagtgtatctgagggaagccgtgaaaagccgcactaagtttcaccctgctctaggtgctcctggaaaggacggattcgagcacgctgttcgctatttcaactatggtggcctcgcccacgaggtcatggatctgggagggggtacaggagacttaaaaagtatccctctggactacctgcggaatttaaagccatccaaagggtcgcacaagccgttcgcccataagcccatgatgcacccggtaattattgtgctcgacaatgatgaaggcctggccgctgtgggtagcaccgtaaagaagaactttggagttgccatcgatattaaaagcacggacgactattacaacgtgacagagaatctgtacatcgtcaaaactcccgagaacgggacaaagaacacttgcatcgaagacatgtttccaaagaagtggagggaccataagattaaagggaaaaagcttaacacggccagcaaaatagaccctaccaaagatctttccaaagaagctttcgctaaatccgtcgtgaaggccaatgcggacaaaattgatttttctgggtttgaccccctgctggaacgaatcgataaagcaatccagcaccacgcagcaaaaccgtga

SEQ ID NO: 8028 - RNA, 1734 nt, unidentified
  source 1..1734: mol_type = other RNA; note = synthetic construct
atgtcacatctcaagaagctgaaggctgccaccagccgaaaagaactggctgccgtgttggggtacgctccagcctccatgaccgcgattgtctataaaatgcccaaggatagaaagtacactaccttcgagattgataaaaaatctggcggaaaacggaccatcaaggccccggtggctaaactaaaaaagctgcagagccacttgagtcacgtgttgtaccagtgcctttccgagatcgagaaggatcggggtgcgaaaccaatctcattcggcttccggagggatcgtagtatcgctgaaaacgcgtctcggcacaagcgccggagatgggtgcttaatctggacctggaggacttcttcccgtcgtttaattttgggcgcgtccgtggctttttcctgaaagataaggcttttcacttacatccagaggtagcaacaaccattgcccagattgcatgcgatggtaccgcacttccccaagggagcccctgctctccagtgatatcagagctcatcgctcagatactggacatgcgactggttagattggctaagaagtacagcgtgacgtatactaggtacgccgacgatatcacattcagcacaagccaaaaagagtttcctaaggggctggcccatgttgatgccaatgatccttccatctggcacctgtctgacgaactggtgggcgagatcactggctctggctttgtgatcaataacacaaagattcgcatgcacttcagggggagccggcaaatggtgacaggcctagttgttaacgagaaggtgaacattaggagcgactattatagacgcgccagagcgatgtgtgactccttgtttcagacgggaaaatattttactgtcactcagcccccagcaggggaaggagaggaacccgtgccagaacttatcgattcattgagtcccttagagggcatactcggccatatatacaccgtcacacaatccgaggaaagacggtcagtccaggagcagagacagcagcccagagccatcaggaagctttatcgcaggtttctcttctataagtatttcatggcacttaaagcaccactgatcgtaacagagggaaagaccgaccctatttacctgcgggaagctattcagtctcgcgccgacagtcaccccgtgttaggagtactcggagaggacgggtttaatcatgcagtccgatactttaactacgaagggctcgcccatgaaattatggacttaggtggaggtacgggtgatctgaagtctatccctctggactacctgcgtaatctgcgaccttccaaagaggctcacaaaccgctgctccataagccaatggaacaccctgtaattatagtcctcgacaatgatgaggggctggccagtgttgcctccaccgtgaagaagaacttcggcgtcagtataaacttgaagtcaacttcggacttctacaacgtcactgacaatctctatattgtgaagacccctgaaaacggcagcaacggaacatgtatcgaagatctgttccccaaagagtggcgcaattataaggtgaatggcaaaaagctcaacaccgcatcaaaaattgatcccctgaaggacctatccaaggaggccttcgcaaaatccgttgtgaggcctaacgccgactctatcgactttagcaaattcgattccctacttggaaggatcagtaaagcaattgaacactacgccgctaaaccttga

SEQ ID NO: 8029 - RNA, 1719 nt, unidentified
  source 1..1719: mol_type = other RNA; note = synthetic construct
atgtctaggaaggatctggctggcatcctgggatacaatccttcctccttgaccgctattatttataaaacacctaacgcctccaagtatactactttcgagatcgacaagaagagcggcgggaaacggacaattaaggcgccatcaccaaaacttaagaaattacaatcccacctctctcatgtcctctatcagtgcattagcgagatcgaaaaaaatcgggaatgcaagttgaaaccgatatcattcggtttccgtaaggaccgaagcatctttgaaaacgcagccaggcacaaacgacgccgctgggtgctcaatatcgacccagagaacttctttccttctttcaactttggccgcgttcgtgggttttttctgaaggaccgggccttcgcgttgaaccctgaagtagcgacaacaatcgcccagatcgcctgtgatggtgcagcccttcctcagggaagtccatgctctccagtgatttctgagcttattgctcagatcctcgatatgagactggtcaggcttgccaagaagttcggagtcacttacacgcgttacgcggatgacatcacctttagtaccagtcagaaggagtttcctaccgggttggctcgccctgacggcactaatcccacaatttggcatttatctgacgacctggtgggaaaaatcaccaattccgggttcaccatcaactctaataagactagaatgcactttcgcggctcgcggcagatggttactggattggtcgtgaacgagaaagtgaacatacgtagcgactattacagaagagcccgggccatgtgtcaccacctgttccgcaacggccagtatttcaagtccatgctccctcaggagaaagacggtgaagagccgaagcccgagcttaccggaaatctgaatccactagaaggcatcctaagttacgtgtatgcagttacacagagggaagagaggaggaacgaccaggaccaacggcaaaaaccccgagctataagaaagttatatcgccggttcctgttctacaaatatttcatagccctcaaggcccccctgatcgttaccgagggtaaaaccgatccaattcatttaagggaagccgtgaagtccagaaccaaattccatcccgcactcgggaagccgggtaaggacaggtttgatcacgctgtacgatactttaaccacgggggtctggcttcagagatcttggatctggcaggagggggcacgagcaatctccggtcgattcccattgattacaaacggaatctacacgctaataaaaaggaacaaaaggcaatagcccgctgtcccatgagattccctgtcattctggtgctggacaacgatgatggcctgaagacaatcagctctactatcaaagagatgtttaaggtggaatttgtagtgagttccgacgccgatttttaccatgtaacagataatctgtacgtcgtgaagacgccagagaacgggaataaaaacaccagcattgaggacctcttccccgataagtggcgaaacatggaactgagaggcaaaaaattcagctcagcaaataagattgacagtagcaaagagtacggcaaggaggtgtttgctaaatcagtcgttaagcccaacgcctgccagatagatttttcagctttcgatccccttctggaaagactgtgtaaggtgatcgaacatcactccggagcaagggcaagctga

SEQ ID NO: 8030 - RNA, 1707 nt, unidentified
  source 1..1707: mol_type = other RNA; note = synthetic construct
atggcagagatactcgggtaccctccatctagcctgactgctattatatacaaaaccccgacagcatctaaatatactacgttcacagtggacaagaagagtggagggcagagaataatcagtgcccccatacctaagcttaaaaagctgcagagccacctgagccatgtgctgtatgagtgcctcgacgagatagagaagggccgggccgcatcaccaatatcgttcgggtttagggcaggacgctccattgccgaaaacgctgcaaagcacaagaggcgcagatgggtgctgaacatagatcttgaggacttttttccaagtttcaactttggccgagttaggggtttctttcttaaggaccagagcttctccctgcaccccgaagtggctacaactatcgctcagattgcctgcgacggtgtggcattgccgcaaggctcgccatgttccccgattatctccgaactgatctcacagatcctcgactccagattgttacggctagccaaaaaatacggcgtcacttacactagatacgcggacgatatcactttttccaccagcaagaaagagttcccagcgggacttgctacgcaagatgcgacagaccctaccctatggaatctgtccgatgagctcagcggaaagattacctcctcagggttcgtcgtaaataatagcaagaccaggatgcaatttcggggaagtcgtcagatggtgacaggactggtagtgaacgacaaggttaacattaggagtgattactacagacgggcaagggccatgtgtgactctttattcgaaaccggaaaatacttttcctctatggtccctcccgccaaggttggcgacgatgccgtgccaaaccgcaccgacaatctgaaccctttggagggtatcttgtcacacatctatcacattactcaagccgaggaacgcagagatgtgcaggaacagcggcagacgccacgagccatccgcaagttgtaccgcaggttcctgttctataagtattttatcgccctcaaggagccccttattgttacagagggcaaaaccgaccctgtctatcttcgagaagccgtgcgtagactgccccagtttcatcccgcattagggacacctggggctaagggattcaaacatgtgccgcggtactttggttatggaggtctggtcagcgaattgctcgatctcggcggtggcggcacctcaaatctgaagtcaattcctctcgattatcggcgtaatctgaatccaacgaaaaaagagcccaaggcttttgggtttagacctatgagcttccccgtcatcctggttctggataacgacgacggcctctctcctatcgcagggaccatcaagaagaccttcaacatccaaattagtcagtctagcacagaggacttctaccacatcatcggcaacttttacgtagtgaaaacacccgaaattctagccactggcaatccacctcagtcaacatatattgaacagttcttcccccagaaatggcgagattaccccctgaatggcaaaaagttttccaccaaaaacgagattgatatcaaccgcgagtatagtaaagaggtgtttgctaagtctgtcattaaaccaaatgctgcggccatcgatttctctgggttcattcccctgttaaagaggatcgaaaaagtaatgaagcatcatgctgcccagacttga

SEQ ID NO: 8031 - RNA, 1749 nt, unidentified
  source 1..1749: mol_type = other RNA; note = synthetic construct
atgagccacctgaagaagctgaaggccgccacttcacgaaaggagttagctcaattcctcggttacaaaccttccagcctgactgccgttgtgtataagattgccaacgacgacaagtacaagatcttcgagatcgacaaaaagaccggaggtaagcggataatcaaggcacccataccaaaactcaagaagctccagagccatctgtccaacatgttgtatcagtgcctggaggaaattgagaaagacagacagctgaaaccaattagttttggtttccgtaaagaccggtcaattgcagacaacgccagcaagcataagcgacggaggtgggtgctgaacctcgacctggctgacttttttcccacttttaatttcggaagagtgaggggatttttcttaaaggaccatgcatttgagctgcatccagaagtagcgaccaccatcgctcagatcgcttgtgacgggacagccctgccgcaagggagtccatgcagccctgtgatatctgagctgatctgtcagattctcgacatgaggatgctaaggctagcaaagaaatatggcgttacctacagtcgctatgcagatgatattaccttcagcacaaaccagaaagagttccccaccggcttggcatctcaggacacaggggacttcaccatttggcacctgtccgaggaactcgtcggaaagattgagaatgcgggctttactgttaatgatgagaagacgaggatgcacttccggggttctaggcagactgtgacaggccttgtggtgaatgaaaaagtgcaagtcccatccgattaccatcgccgagccagggctatgtgccacgcgttgttcgagactgggaaatattacagatctgaagtggaatcagaagacgaggataaagaaggcgagcttgaaccagaactgattgacaatcttaaccctttagaaggcatactgtcgttcatctatagtgtagctaaacacggcgaccaccgccctatcgaagagcaacgaaagcaccccacggccatcgcccgtctttaccgcagattcctgttttacaagtacttcgtggccccaaagaagcctctcatcctgaccgaggggaagacagatccggtctatctgcgtgaggcagttaagcggcgggacagctttcacccaggactaggtaagccggaaaaggacgggtttaagcatgctgtccgctacttcaactatggaggattggctcatgatattatggggctgggcggtggcggaacatcaaatttgaagagtgttcctctcgattatgcccgcaatctttaccccaaaagaggaaagcccagagctataaaacacaggcccatgaaattccccgtggtcgtagtgctcgataatgacgatggcttgggacccctggcatccacaatcaaggataccttcggcgtgcggattactcagaaatctacagatgatttctaccacgtaaccgataacctgtatgtcgtcaaaacccctgaagatgccgacaaaaaaactttcatcgaggggctctttcctgagaaatggcttaaaaaggagctgaacggcaagtcatttaacgcggaaaacaagatcgatcccgacaaggaatacagcaaagaggtttttgccaaatctgtgatcaaaccaaatgctaaggatatcgacttttccgggtttgatcctctattagagagaattcagaaagccatacttgattaccagacgaaattgggctcctga

SEQ ID NO: 8032 - RNA, 1716 nt, unidentified
  source 1..1716: mol_type = other RNA; note = synthetic construct
atgtctcagttggaaaaactgaaggctgccaaagatcgaaaggagttagccactgtgctgggctacaaaccatccgcactcacagcaatcatttatcaccctccagcaaaggaccgctacacaaactttgaaatcgacaaaaagagcgggggaaagcgcaccataaaagctcctgatgcaaagctcaagaagctccaaagccatctctcccacttattgtatgcatgtctggatgagatcgaaaaggagcgagatgctaagccactgagctttggcttcagacgggatagatggattgccgacaacgccaccaggcataaacgccgaaagtgggtgctaaaccttgacttagccgactatttcccttcattcaacttcggacgggtcagagggttctttctcaaagacaatagcttcgctctacagccagaagtcgctactaccatagcgcagattgcttgcgacgggactgctctgccgcaagggagtccctgctcacccatcatcgccgaactcattggccaagttctggatatgaggcttgtgcggctggccaagaaatacggtgtgacatactctcgctacgcggacgacataactttctccaccagtcagaaagactttcccgctggactggcctcccaggacccaacagatgcgaccatttggcacctatcagacgagttactgggcaaaattactgctagtgggttcgctgtcaatcccgccaaaacaagagtgcagtttcgggggtctaggcaaaccgtgacgggcctggtggtaaacgagaaggtgaacatacctagcgagtactatcgcaacgcaagggcaatgtgcgatgccctctttagcagcggccagtacttcacctccatgaaagcctctgcacccgagccagaccttacgagcaaccttaatcccctggaaggcgtgctcggccacatttatgcagttacccagacagaggaccggcgggacgtacgagagcagagaatcaaaccaagagccatcaggtcgctttaccgccgcttcctattctacaagtattttgtcgcgctgcaggcacctctgatcgtcactgaaggtaaaacggatcctgtgtatcttagggaggccgtcaaggcacgtacagcgttccaccccgtgctcggagccaagacagctggacgttttgaacatgctgttaggtacttcaactacggtggacttgcccatgagattctggatctgtcaggcgggggttccggaaatctcagatccatcccgctggactatcgtcggaattttcagcctagtaaaaatgatccgcgggccatagcacacacacccttggcgcacccagttatcttggtactggataacgatgacgggttggcttcggttgcctccacgatctgggataatttcaaagtgaagatcgatgtgaagactaccgcccatttttatcacattatccagaacttgtacgtggtcaaaacccctgaggccggaggtaagtctgctattgagtctctctttcctgacgtgtggctgaatattgagctgaacggcaagaagtttaattgtagcaacaccatcaaccccgaaactgagtatagtaaagaagttttcgcaaattctgtcgtaaagcccaatgccggtaatatagacttctcaggctttgatttgctgctggagagaattgtggccgctatcgaacatcacagggccaagtga

SEQ ID NO: 8033 - RNA, 1278 nt, unidentified
  source 1..1278: mol_type = other RNA; note = synthetic construct
atgagccagttagaaaagttaaaagccacaacgtatcgaaaagaactcgctgcccttctgggctttaaaccccaggcactcaccagtatcgtgtacaaaacgcccctgagtgaacgatataccacttttgagatcgataagaagacaggaggcaagaggacgatcaaggcgccgtcaccaaagctcaagaagctgcaaacccatttaagccacctgctataccaatgcttggacgaaattgagaagcaacgcggagaacagccccttgctttcggctttcgcaggaagctttggatcgcagataacgcagctcggcacaaagggaggcggtgggtgctgaatttggacctcaaggacttctttccttcctttaatttcggccgcgtgcgtggattctttctcaaggataaatccttcgagctgaagcctgaagtggcaaccaccattgcccagatagcctgcgatggggtagctctgccacagggttctccctgcagccctgtgatatctgaaatgattactcggattcttgacatgcgtatggtcggcctggccaaaaaatacaaagtgacctactctagatacgccgatgacattaccttttccacaaaccataaaaacttcccggtggggatcgccgttccagatggggaggacgcgactaattggaacctctctaacgagctgctgggaaaaattacatcctgtggcttcgaggtcaactcagaaaagactcggatgcagttcgatggatccagacagatcgtcaccggcctgatcgtgaacgagaaagtgaatgtcgcaagtgaatattatcggcgcgccagggctatgtgtgattcactattctcaacaggcagctattttcgcagtatgaaggagcctaaggaagataatgacgagccaactccagacctgatcaatgggctaaatcctttgaacgggatattgggtcatatctacgctgttacagagactgaggagagaagagcgatctccgagcagcgcattaaacccagggcaattaggaagctttacaggcggtttctgttctacaagtacttcgtggcccttgaggtaccactcatcgttacagagggtaagaccgaccccgtctatctgagatcggctgtccgaagaagacccgactttcaccctgtgctggggaaaatgaagggagattctttcatacacgccgtgagctactttaactatggcggactggcccacgaagtactggacctcggtggcgggggagttggtaatttgaaaagctga

SEQ ID NO: 8034 - RNA, 1722 nt, unidentified
  source 1..1722: mol_type = other RNA; note = synthetic construct
atgagctacctgagcaagctgaaggccgctcagtctaggaaggagcttgccgagattctcggttactcagcgcagtcattaaccgctatcgtctatcagacacctgataccagcaaatataccaccttcgagattcccaagcggtcaggcggcacacggactattaaagcccccattcccaagctgaaaaaactacagactcatttatcccacgcactgtatcaatcccttgatgaaatagagaacgggagagaggcacgacctctcagttttggcttccgcaaaggtcgctcgatttccgagaacgctagctgtcataaacggagacgttgggtgcttaacctggatctcgaagacttttttccctcattcaatttcggcagggttcgtggcttcttcttaaaagactcttcttttggcttgcacccagaggttgcaacaactatcgcccagattgcatgtgacggggtgagtcttccgcaaggtagtccctgcagtcctatcatatctgagctaatcggacacgtacttgacatgaggttagttcgcctggccaagaaatacaaggtcacctactctcgatacgccgacgacattactttctctacaagccagaaggacttccctgccggaatcgcactcccggatcctgcgaatagcgcaaattggatgctgtccgaagagttgctgtcaaaaatctctaattccgggttttccgtcaatcagtccaagactagaatgcattttcggggaagcaggcaaagtgtgacaggcctggtagttaatgaaaaagtgaatatccggtcggaatactatcggaacgctcgatccatgtgcttctccctgttcgccaacggcgtgtattataaaaagaacgcagccactggagaaagagagcctaccgacaaccccaatcccctggaggggatgctgagtcatatatactacgtcacccagtctagcgagaaaagagagattcaggagcaacgcattaatcccagagcctcgaggaaactgtaccggaggttcctgttttataaatacttcttgaggctcgacagaccgctcatcgtgaccgaaggaaaaacagatccaatatatctgaaggaagcgatcgagcggctagatgccttccacccagccttgggtcagaaacgcaacggccagttccaccacacggctcgctattttaattacaaggggaccgctcacgaaatcctcgacctcggtggaggaggaacagcaaatctcaagtccattccaatcgattatcgaaggaacctgatgccctacaagaaagaacctcgcgctataagccatcgaccaatgctgcaccctgtgattttgctcgtggataatgatgacggcctgggggctctggcttctactgtgaaggaaatgttcgggacaaacatcagtttgaagactacaaactcatactaccatattgtggagaatctctttcttgttaagaccccagagaacaacgaaaagaagacgtgcatcgaggatatgtttccactgagcgtattgaagagagagcttaatgggaagaagtttaaccctagcaaccagatcgatatcaccaaagaatactccaaggacatcttcgcgaaccatgtggtcaaagccgaagccgatacgattgactttagcggttttacgccactgctagaccgtatcaagaaggtcatagaggactataagatctcacacggctga

SEQ ID NO: 8035 - RNA, 1734 nt, unidentified
  source 1..1734: mol_type = other RNA; note = synthetic construct
atgtcctatctggaaaagttgaaaaacgcaaagaaccgtaaagacctcgctcgccttctgggctttaagcccagcgccctgaccgcgattatttatatgatccccgtggaggaaaaatatactacctttgagatacccaagaaaagcggcggaacccggacaatcaaagcacccgcacctaaattgaaaaaactgcaaactcacctcgctcactggctgtacgagtgcttagccgaaatagaggaagggcgagactccacaccagtcgcctatgggtttaggaggaagggtactatcgccgccaatgcccacaaccataagcgcagacggtatgtcctcaacctggacctagaggacttcttcccaagcttcaacttcggtagggttcaggggttctttctgaaagacaaggccttcgagttaaacaaggaggtggctacaactattgcacagattgcttgtgatggcacagcattgccacagggctcgccatgtagtccagtaatctctgagttgattggacagatcttggatcttaggctgttaagattttcgaagaaacacggagtgcgttacagcagatacgctgacgacatcactttctccacaaaccagaaaaattttccagtggccctggctattcaggactctctcgatctctctaagtggacgctgggcgaagctttgatcaatgagatcgagcaagcaggttttaagatcaacgccaacaaaacccgaatgcattgccgaggctccagacaaatggtaacggggctcgttgtgaatgagaaggttaatatccgatcagattactaccgcaaggcaagggcaatgtgtgacagtcttttccagacgggaaaatactttaaaacactgaaggtgtctgacgatcccaaagaggagccccagcctgatttcaccagcaaccttaatccgctagagggtatcctgagccatatttatgacattacccagaaggaagatcggaggggtgtgtcagagcagagaaaggagccgcgggctattcgggctctctaccggagattcctcttttataagtattgcgtggcacctaaggccccacttatcgtgaccgagggcaaaactgacccagtgtacctacgcgaagcgatcaagtaccgtgactccttccatcctcgcctggggaagcccggcaagaatggctttgaattcgcggtcaagttcttcaattatggaggtcaggcccacgaagtaatggatctgggggggggaggatctggaaatctaaagtctatccctctggattatctcaggaacttagatgctacaaaaaaggggcggaaagctttcaagagcaagcctatggcctaccccgttattctcgtcctggataatgatgacggcctgagagacatagccggaactctgaagaccaacttcagcattagtataaaaaccaataccagctccgatttttaccacataaccgagaacctgtatcttattaagacacctgaaacttcaggccaatcatgcatagaagacatgtttcccgagaaatggaaagaaaagcctctgaagggcaaaaagtttaacccaaactccaaaatcgatcctcagaaggagtacggcaaagaagtttttgcgaattccgtcgtcaagccgaatgccaatgaaattgattttagtgggttcgaccccttgctttctcgcatcgtgagtgtgctggatgactacaaagccgcctcatga

SEQ ID NO: 8036 - RNA, 1728 nt, unidentified
  source 1..1728: mol_type = other RNA; note = synthetic construct
atgagctatctgaagaagctgaagagcgctaaaaatcgcaaagccctggcctcaatacttggcttcacccccagcgcgcttacctcaatcgtgtatcaaaccccgctcgaaaagaagtatacgaccttcaagatcccgaaaaagtccggaggtgacaggatcattaaggctcctaaccctaagttgaagaagcttcaaacacacctcgcgcattgtctgtactcatgcttgtcggagatagaggaaggtcgcaatgccactccagtagcatacggatttagaaaagggggtaccatagccgccaatgcaaagaatcataaacggaggcgctacgtgctgaatctagacctggaggacttctttccgtccttcaatttcggccgggtcaggggcttccttctgaaagacaaagctttcaagctggaagaagaagtcgcaactacaattgctcaaattgcctgcgatggcgaagctttaccacaagggtccccatgttctcccgtgatttctgagctgatcgggcaggtcttagatctcagactcctacgatttgccaagaaacatggcgtgcgttactcccgatacgctgatgatctcacatttagtacgaaccagaaagatttccccccagatttcgctcagcaggacgcctctgatctttctaagtggaccctcggaaatgagttagtgcagaagatagagggagccggctttaaaatcaatgcagggaaaacccgcatgcagtgcaggggaagcagacagatggtgacgggtctggtcgttaacgagaaggctaacattaagtcagagtactatagaaatgccagagccatgtgcgatagcctgttccagactgggcagtactttaagactgtcatcagccccgacatccctaacgacaaacctatgcccgatcttactgacaacattaataggttggaagggattctcagtcacatctacgatgttacacaatctgaggaacggcggcctatcgcggatcagcgtaaggaaccccgagcaatcagactgctgtatcggcggttcatgttctacaaatactgcgtcgcaccaaaggttccccttatcatcaccgagggtaagacagacccagtctacttgagggaagccattagacaccgtaacagctatcatcctaggttgggcaacccgggcaaggacggctttgagttcgccgtacgcttttttaactacgtggggcaggcgcacgaaattatggacctggggggaggcaccggtgacctgaaatcgctgcccttggactatctgcgcaatctggacccaaatcggaaaggaaggaaacctttcaaacacaagcccatggcttgtccagtaatcttagtgctggataacgacgatggcctatccggagtggctggcacaatcaagaaaaacttcgatgtgacagttagtattaagactaccgatgacttttatcacattactgagaacctctacttgatcaaaacacctgaggccaagaagaagtcctgtattgaggatctgttcccccagcagctgaaggggactctcctcaacggcaaaaagttttccgcaaaggcaaaaattgacccacagaccgagtattctaaagagatctttgcaaatagcgtgatcaaacctaacgcctcaaaaatagactttagtggatttgaccctctgctcgaccgaatagtgtccgttctagatcattatagtccccagtga

SEQ ID NO: 8037 - RNA, 1737 nt, unidentified
  source 1..1737: mol_type = other RNA; note = synthetic construct
atgaattatcgcgacaagcttaaagccgcaaaggacaggaaagacctggcacggctgctggggtacaagccatcagctcttacctcaatcatatatgtgactcctcctgagaggaagtacacaacatttgaaatcgccaaaaagtcaggggggatccggaccattaaggcacctaatccccagctgaaaaagcttcagtcccacctggctcattatctctatggctgcttagctgagatcgaggaagaaagacaggcacgtccggtgtcttacggcttccgcaaaactcgaactattgccagcaacgccaagaatcacaaacgccgtcgctacgtgctcaacattgacattgaggattttttcccatcctttaactttgggagagtgagaggattcttcctcaaagacaaagcttttgcccttaaagaacaagtggccaccactatcgctcagattgcctgtgatggggaagccttgccacaaggttctccctgtagccccgtgatttccgagctgataggccagatcctggatctacgacttctcaggatcgccaaaaagcatggcgttagatattctaggtatgctgacgacatcacatttagtacatcccagagggacttccctgaagccctcgccgtgcaagattcagagtctttatttggctgggcacccggcgcagaacttgtccacgagattcgaagggcgggcttcaaaattaaccccagcaaaacacggatgcattgtagaggtagtcgccaaatggtgaccggactggtagttaatgaaaaagtaaacattcggtccgagtactatcggaaggcgcgtgccatgtgcgattctttgttccagtcaggaacttactttcgcagctttaccccgccagtctccccgggagttgatccacagccagacctcacggtgaatttgaatccgttggaaggtatcctgtctcatatatacgccgtgacacagagcgaggacaggaggggcatcaaagaccagaggctcaagcctcgggcgatccgcacgctgtacagaaggttcttattctacaagtactgcatagcacttgatgctcctctcattattacagagggcaaaactgaccctatctatctgcgggaagcgattcggttcagagaaatctttcatcctcagttgggcgagcccggagagtcgggttttaaattcgccatccgtttcttcaattacacgggtcaggctcacgagatcatagatctgggaggggggaccggagacttaaaatcaattcccctggactacctgcggaatttcgatgctcgaaaacgaaagccatttcagcacgtcccaatggcctacccagtcatcctcgtgctggataatgataacggtttggagagtatcggaagtaccgtcagaaagaatttcggcattagcattacagttgacagtaccgacgatttctatcacataaccaagaacctgtatctcatcaagacccccgaaactaaggagcagtcgtgcatcgaggatctgttccctgcagagtggaagaacaagagactgaacgaaaagaagttcaacccctccgggagcattgatactcagaccgaatacggaaaaaagatgtttgcaaagtacgtcgtgcgccccaactcccacaagatcgactttagcggctttgatcctctactggagagaatagtagccgttctagaccactatagcgctgaggggaagcaatctctgtga

SEQ ID NO: 8038 - RNA, 1743 nt, unidentified
  source 1..1743: mol_type = other RNA; note = synthetic construct
atgagccagttagaaaacctgcgaagtgcaaagaacagaaaagagctagcatctttactcggctttcagccatccgcccttacatcaataatctataaaactcccctggccgacaggtactcaaccttcgaaataccaaaaaagtccggggggactagaaccatcaaggcccctaatgataagctgaaaaagctccagaggcacttggcacacctgctatacaattgcctcgcggaaatcgaagacgagctgtccatcgcctccgtcagctacggattcaggcagaatggctcaataattgccaatgccaagaaccataagagaaggcgctacgtgctgaacatcgatatagagaactttttcccttcgtttcatttcggtcgcgtccgaggtttcttcctgaaaaacaaattctttgctcttgaggacgaggtggcaactacgatcgcccagatagcctgcgacggcgaagcattgccacaaggatcaccatgttcccccgtgatctccgagcttattgcaaatattctcgacttgcggctgctgcgtctggcgaaagagcacggggttagatacagtagatatgctgacgatcttaccttttctactaactccaagaagttccccgacgcgatcgccagcgaaggtgctttaggcaactggactctgggaaatgaacttgtcgaggagattgatgacgcgtggtttacaatcaaccacgcgaagacgcggatgcattgccgtgggaaccgccagcttgtcaccggcttagtggtgaatgagaaggccaatatcaaatctgagtattaccggaatgctcgagctatgtgtgattcactgttcacccaaggccggtattataaaagcaagacctctcccgaggacgctgatgccgtacctcagcccatctggacaagtaacctgaatcctctcgaggggatcctgagccatatttacgatgtgacccagagtgaggaacgcaggccagtccctgaacaacggaatgccccacgcgccatcagagctctttaccggagattcctcttctataaaaaatgtgtggctctgacggcacccttgatcattactgaaggcaagacagatcccatctatttgagagaggctattcgccacaggaacgtcttccagccggtgctgggcagtatgggcgatgaggcatttgagttcgccgtgaacttttttaactacgaaggatcctcacatgaactcatggacttggggggaggtagcggtgacttgaggtctattccactggactaccgccggaatctggctcccgccaaagaaaagaaacgtaaacctatgatccacacccccatgtcttatccagtaatactggtgctcgataatgatgacggactcagtgcagtcaccggaacaattaagaagaactttggggttcagattgataagacaacaaccgacgatttctaccaggtgatccaaaacctctatgtggttaaggttcctgaaaccacaagcgacgcacagattgagagcctattccctgactcagtacaatctattaagctgaatggcaaggcttttagcactaaagacaagatcgatcccgagaaagagtatagcaaggcaattttcgctaaatctgtagttaggcctaatgccgataagatcgatttttccgggtttgatccgctgctacaccgaatagtggccgctattgaccactacgacgccaacggaccgaaagccttttcgtga

SEQ ID NO: 8039 - RNA, 1719 nt, unidentified
  source 1..1719: mol_type = other RNA; note = synthetic construct
atgtcatacctgaagaagctaaaagcagctaaagaccggaaagagctggccaaactgcttggctatgagccatctagtctgacagctattatttacatgacacctttgcctgccaagtacagcacatttgacatcccaaaaaagaatggcggggtcagaaccatcaaggctcccgaaccaaaacttaagaaactacaaacacacctcgctcacctcctccaggcctgcctggtcgagattgaggccgataagttgtcgaggcccgtgtccttcggtttccgcaagaagggtcggatcacagacaacgcgaaggttcacaaaggcagacgatatgtgctgaatatcgatttagccgacttcttccctagctttcattttgggcgcgtgcggggcttttttctcaaggacaaaaacttcgagttaagcgatcaggtagcaaccactattgcgcagatagcctgcgatggagctgccctccctcagggatcaccatgttcaccagtgatttcggaactgattggacatgtgctggacgtgcgactgttgcgcctgagtaagaaacatcacgttacatactctaggtacgcagacgatatcacattcagcaccaataacaaagccttccccacggcactagccagccaagacccagcggatcccgccaagtgggtgttgggagacgaacttatcaataaggttcaaaattccggtttccagatcaaccccgctaaaaccaggatgagttgtagagggtccagacagatggtgactggcctggtgataaattccaaggtcaacatcaagagtgagtattacagaaacgcacgcgcaatgtgtgattcactgtttcagaaggggtggtacttccgtgacagtacgccacctgtagaggacggagatccccccactcctaattatatcattagcctcagcccactggaagggattctgtcttttgcctacaatatcacacagtctgaagaccgcagagagatcgcggaacagcgaaagaagccccgtgcaattagagagttataccgtaggttcctcttttataagtactgcgtcgcaccatctcagccccttctcatcaccgaaggcaagaccgatcctatatacctgcgggaggctattatcaggaggacggcttatcatcctactctgggcacttttgggcccaccgggttcaagtttgccattcgatttttcaattacgagggacaggtgcatgagatcatggaccttgggggcgggactggcgatttaaaatccgttccgatggactatctgcgcaacttcaagccctatcggaaacggaaaccctttaagcacaaaccaatgcagcaccccgttataatcgtgcttgacaacgataaaggcctccaaggagtcgcctccttcctcaaggaaaatttcgataccattatttctctgaccaccaaaaataacttctatcacatcatcgagaacttgtacgtcattaagaccccggaatcatcccctatgacttgcatcgagagcatgttcccgaaaatatggctgaagcatagcctgaacggcaaaacttttaacccggataaaccagacatcaccaaggaatttggcaaagaaatattcgccaagtccgtggtcaagcctaatgctggttccatagatttttctggtttcgatcctttcttggacaggattatcgctgtatttaaccacttttatggatga

SEQ ID NO: 8040 - RNA, 1734 nt, unidentified
  source 1..1734: mol_type = other RNA; note = synthetic construct
atgtcctatctagcaaagctgaaggccactaaagataggaaagatttggctcgcctgctgggatttactccctccgccatgaccagtattgtgtaccagacgatgcccgccgcaaagtataccgagttcgaaattccgaagaagtcagggggaaagagagttataaaggcgcccttccctaaactgaaaaagctgcagacccacctcgctcatgtgctctatggctgtttagcagaaatcgagcagaattttgatgcgaaaagcgtgagctacggctttcgaaagggacgtggaattgagggtaacgccaaaatccacaaaagaaagcggtttgtattgaacttggacctcgccgacttctttccaacttttaattttggccgggtcagaggatttttcctgaaggacaccagctttgccctcactaatgaagtcgccaccaccatcgcccagatcgcatgtgacggcgtggcgcttccacagggctcaccatgctctccagttatcagtgagctgatttgccacatactagatgtgaggctgcttcgtttggccaggacgtatggcctccgctacagtcggtacgccgatgacattaccttcagcactaatcgccgggagttcccagcggacattgctagggtcaaccagaccgacccttctacttgggtcattgggaaggagttggcaagtcggatcgatgactgtggctttgcaattaactttaccaaaactcgaatgcactgcagaggctcaagacagatggtaacaggtttgattgtgaacgaaaaggtaaacatccggtccgaatattatcgaaacgcccgagccatgtgcgactctgtgttcaggcagggtgcctatttccatagccaccaaacacccactgtggctgggggaacccccataccagaaatgacagataatctcgcccctctggaaggcatactcaatcacatttactctgtgacacagaccgaggagagacgctccgtgcaagaccaacgatccgcaccccgcgctattcgctccctgtaccggaggttcctgttctacaaaaggttcattgctctcgaggctcctcttattgtgacagaggggaaaacggatcccgtatacctaagagaggccatcaggcatctgccttcctggcagcctagattaggggagcctacagtcaatgggttcaagttttccctgtctttcttcaactacggagggaagagtcacgagatcatggacctgggtggtggaactggcgatctgaaatctataccccttgattatttacgcaatctcgattcgtctaagagcgaccggaaaccaatgcaacataagccaatgaaatttcctgtgatcatggttctggacaacgatgatggccttggggacgtggcaggtacaatcaagaaaaacttcaatgtggggatgtcggtcacctcaacacaggacttttaccacgtgtgtgaaaacctgtacgtcgttaagacacctgaagcaggcggaaaatcctctatggaaagtatgttcccaaagtcatggaccaccatcgttcttaacggaaagaagttcaatccgagcaacaagatagacatcacgaaggaatacgggaaagaggtcttcgctacatcagtcgttaaagctaatgctgctaagatcgactttagcggctttaatcccctgttagatcgtatcgtgaaagtgatcgatcattatgcccccccggcgagctga

SEQ ID NO: 8041 - RNA, 2025 nt, unidentified
  source 1..2025: mol_type = other RNA; note = synthetic construct
atgtccattctccataccttgcggacagccaagacccgttatgacgtggccgcactactcggctataagccctctgccttgagctatatcgtttttcagatcccgacggccgaaaagtacaaaacgttcgagattaagaagaaaggcggcggaaaacgacggattgacgctcctatcccaatgctgaagggattgcagaggaggctcgctgacgtcctgtacgagtgcctccgcgaattagaggaaccagagaagaggaaaaataagctgtctcacgctttccggaaagactatagtatcatcacaaacgccaaggcacacaaatcacggcggtacgtcttgaaccttgacctgcaaaactttttcccatctctgaacttcggtagagtccgcggtttcttcctgaagaacaaccagtttaagctggcagaacccgtagccaccattttagctcagatcgcctgtaatgatggggtgcttccccaaggaagtccttgttcaccaatactgtcggagctgcttactcattttctggatattagactggtcaagttagctgcaaagaatcagtgcagctacactcgatatgccgatgatatcacgttttccaccaatcagaaggaatttccagttgctcttgcagtagcagttggcgagggctggatcctgggagacgaagtaaagtcccggatcgagggggccgggtttaccattaatgacactaagactcgaatgcaagtgcgtggctcccgccagacagttactggtttgacagttaacgagaaggtgaacgtcccccaacgctactgtaaactcgcccgcgccatgacacattcgttccttgccaccggagcctataagagagacggcgtagatgattctagcgtgcctcgcctcgaaggggtgctggatcacatctaccatatcaaagagcgacagatagacattgcgatcgacgccgagaaaaataaagagaagcggcacaagctgcatgctgataggaccaaacacaaaaacgaatacccctcagctataaggctgatctacttccagcttgtgttcttcaaacacttcattgatccatctaaacccttgattatctgtgagggacctacagactctatctatcttaaatcagccattcgcaaactggcggctctccatccaaaactggcgagtaccaaggacggaaaactatccctagacattcacttcttcaaatactcaaagcagtctaaagacctgctgcagctgagaggaggtagcccggatttgaagtttttcctggaggcgtggcgcgacaagctcgcaaagtttaagcacaggcccatgaagcaccctgtcatcgtgctgattgataacgatgatggcgctacccagatctttaagcttgcccagtccaagaaattcggtgtgacaattggccacgctaccgacctgccgttttaccacctcggcggacatttatatctggtgaaaacccccataaaggggcctgataataagtcttgcccagaagactttagcacgaggccttgctggcagcctagaagcactgcccgtcctctgataccgacccggtctaccacacggcttgcgtcgagcgaacgtagttccctacagtccgtgtcatgcgggaggagaagggccgccagcacatcacaagccctcattcccttctctctggcactcactccctacagtatgataactcccaacgcaggcttaagggctcaacggccccgccaccgtagacgaagccaaaggtgccggcatcggcagcgcaggagtgctagacgacagccaccaccctggcctcgccctaatgtcgggtgtgcaagccagtcaatcgatctcgggagaaacagagcaggcggtggagctgcggggagagtgaatcctgtgcaggactccagcagagaagccagtatgttgtttccaaatctcaatacagcattgatggagagcaaaatgaaacgagcctccgcttttagtaaaaagactctatcctgggcaagactgtga

SEQ ID NO: 8042 - RNA, 1824 nt, unidentified
  source 1..1824: mol_type = other RNA; note = synthetic construct
atgtccatactccaatccttaagggcggccaagacaagatacgatctggccgcactgctgggttattctccatccggcctgtcctttatagtgtatcagatccccaaggctgccaagtacaccacctttgacgtgaagaagaaagatggcggacagcgacgcatagacgctcctattccaatgcttaaggcgctgcagaaacgactggccgggatcctgtacgagtgtctacgagagcttgaagagtcagacaagcgccgaaataacttatcacatgcatttcgcaagaaccgttctattattacaaacgccatggcgcatcggagcagaagatatgtgctaaacctggacttgcagaactttttcccgtcactgaattttggtcgcgtgcgcggcttcttccttaataacaaccagtttaagcttgccgaacctgtcgctactactctcgctcagatcgcctgcaatgatggagtgctgcctcaggggtcaccatgttccccaattctcagtgagctgctcacacacttcctggacatgcggatggtgaagctggcaactaaaagcaggtgcagttatacccggtacgcggatgacatcacctttagcacgaatttgaaagcattccccgctagtctggctgtagctgtggggtccggctgggcattgggagatgaactgaagagcagaatagagagtgccggttttacaatcaacgaggcaaagacgcggatgcaggtccgtggctctcgacagacggtcactgggttaaccgttaatgagaaagttaacattccacagagctactataagctggccagagcgatgaccaatagccttctcacaaccggcacgtacaagcgggatggcgttaatgacagttctgtccagagattagagggggtactcaaccatatctaccatatcaaagaaaggcagatcgacctggccatcgatgccgaaaagaataaggaaaaaagacacgctctccacgccgaaaggacaacccaaaagaatgagtacccctctgccattaggctcatttacttccagctggtcttctttaaacatttcattgacctggcgaaaccactgatcttatgcgaggggcctacagactcagtgtatctgaagagcgccattcggaaacaggctgctcttcaccccaaactcatatcgaccaaagacggtaagactagccttaacgtacacttctttaagtattccaaacaatccaaggatctcctccagttgcgcggtggctctccggatctgaaatttttcctagaagcctggaaggaaacattggttaagtttaaacacagacctatgaagcatcccgttattgtccttatcgataacgatgatggggccacccaaatattcaagctgttgcagtcgaagaagttcggcgtcactatcggactggccactgacctccccttctaccacctaggcgagaacctgtacctagtgaaaaccccgattcggggccccgacaataaatcatgtccagaggacttcttcgatccagccgtgctgagtactaaaattgacggaaaaacctttaaccccaataaagaacacgacgccccaggagagttcggcaaagtggtgttcgctgagcgcatcgtacgtccccaagccgggacaatcgattttagcgggtttgatcctttgttggccaggatcgacgccgtgctcgacgattatgctaagaggacagctcctggacctgccgctgctccttctcctcccgcagcaggagcagcaccgaaaatgaagaagaggccacgggcagcaactgctgccgcacaaccctga

SEQ ID NO: 8043 - RNA, 1734 nt, unidentified
  source 1..1734: mol_type = other RNA; note = synthetic construct
atgagcgccctacaggccttgcggagtgccagaaaccgttacgatgtcgccgcaatcctagggtacaagcccagtgctttaagctatattgtcttccaaattccaaccgcgaataagtacaccgtattcgaaatagacaaaaagggcggaggtcaacgcagaatcgacgcgcccatcgagaagctgaaaggactccaacggaggctggccgacaccctgtatgagtgtttaagggaactggagagcaccgacaaggtgaagaacaagctgtctcatgctttccgcgaagatttttctattattaccaacgctaaggcccacagagctagaaggttcgtgttgaacctggacctgtccgacttttttccctcgctgaactttggccgcgtgcgcggtttcttcatgcgtaatcgatccttccgcttggctgaacctgtcgctaccatcattgcccagatcgcatgtaataatggagttctgccacagggctcccctgcaagccccatcatttccgagttgatgacacacttcctggacattcgccttgtaaggcttgcagccagaaatcggtgctcatacactcgatacgcagacgatatcactttttccactaatctggaggagtttccggcagcgcttgcgacggctgagggtcaatcatggaaactgtctgacgaactgcggtctaggattagagatgccggctttgagattaatgatgcgaaaacgagaatgcaggtccggggctctcggcaaaccgttacaggcctgactgtgaatgagaaggttaacgtccagcagtactattacaagtcggcaagggcgatgactcacgcttttatcaccaccggaaagtatattcgtaacggcgacgaagagacgagtgtgcagagactcgaaggaatactcaaccatatctatcacatcaaggaacgcctgatcgacatcgggatagaggctcaggaaaacgatgaaaagcgccataaactccatgccgatcgcacaaaacagaagaatgagtatccttccgccatccggttgctctactatcagctggtgttcttcaaacactttgtggatcccagcaggcccctcatcgtgtgtgaggggccaacagacccagtctaccttaaatgcgcccttcggtcactggctacttcccatcctaaattggcaaccgccgtggatggcaaaattagcctcgccgtgaacttcttcaagtactcagatcagtcaagagatctgctgcagttacggggaggcgcccctgacctcaaatttttccttcagacatggaaagataagctcgcaaagtataagcacaggccaatgaaacacccggtgataattttaatcgacaatgacgacggcgccacagagatttttaaactcttgcagagtaggaagaaattcgggatcgatatttcccatgccaccgatctgccgttctatcacctagggaaccatctatacctgataaagacaccaatcaacggtcccaacaataagagctgcccagaagactttttcgagacatctgtaagggaaactccaatagatgggaaaagatttaaccctgataaggagcacgaggcacctggggagtatggaaaggtggtgtttgctgagcgagtcgttcgaccccaggccgctaatatcgactttagtcgattcgaccctatccttgcacgtatagaagctgttattgatgactacgccgcccggaaaagctga

SEQ ID NO: 8044 - RNA, 1806 nt, unidentified
  source 1..1806: mol_type = other RNA; note = synthetic construct
atgagtagcctccacgctttacgtgcagcgactacccgcaatgacctggctgtccttctggggtacaaaccctccgccctgtcctttattgtatacttaacacctcctacggccaagtacaccaccttcgatatcgccaaaaagggcggaggcacacgcaggattgatgccccaacccccaggctcaagggccttcagaagaggctggcagatctgctgtatgaatgcctgcgtgagatagaggaaagtgaaccaaggaaaaacaagctgtctcatgcttaccggaaacaattttcaatcatcactaacgccaagagccataaatcacgacggtatgtcctgaatctcgatctcgagggattctttccgagccttaacttcgggcgggttcgcgggttctttctgaccaacaatcactttaagctcgcccgccctattgcgaccctaattgcacaaattgcctgtaacaatggtacactcccccagggctccccttgctcccctatcatttcagagctgcttacgcacttcttagacatgagattggtgagattggccggccgtaacaaatgttcttacacacggtacgctgacgatattacttttagcaccaaccagaaagagttcccagaggctctggctgtggctgtagcggagggatggagcctgggagacgaactaaggtcgcggatcgaagatgccgggttttcaatcaacgaatcaaagactagaatgcaggtccgcggatcttgtcagacagtcacgggcctcacagtcaatgagaaagtcaatgtgccacagcgctactacaaactggccagagctatgacccactctttgctgtccacaggttcttatctaagagacgggatctctgaaaccagtgtccaaaggttggagggaattctggactacatatataacatacgcgagcggcagatcgatatagccttgtccgccgagaaggacgctgctaaaaggaagaaactgctgagcgatcgggtagaacacactaacgagtacccttccgcaatccgaaaaatctattatcgactcgtgttcttcaagcacttcgtagaccccaccaaacccttgatcatctgcgagggtccaactgaccccgtgtacctgaaatcggcgatccgacgactggccagcgcacatcccaagttaaccagcgtgagagggagtgacatccttctgaatgtggcttttttcaagtactccaagcagtctcgggatctgctccaaatgcgggggggaagtggcgacttgaagtattttttggagggctggaaagaggaattagccagacataagcatcgcccaatgaagcacccgattattgttctgatcgataatgacgatggcgcgaagtcaatttttggaattctcaggggcaagttcggtcagtccatcgggctcgccactgatcttcctttttatcatctggatggcccactctaccttgttaagaccccgacgaggggtgcagaccacaagagttgccctgaggactttttcgaaagccatgtgctagcaaccaaggttgacggcaaaatctttaatccagacaaggagcacgacgcacccggggaatatggaaaggtgattttcgctgaaaaagtgatcagacccctggcaggtagcattgatttctctggcttcgagccgctcctggctagaatagaggccgtgatagaagattattccaaaagaactgccacacgtccacccccacctcttgcagccgttcgccctacagcatcacgggctaagagggccgtggtggccgcaaaaccctga

SEQ ID NO: 8045 - RNA, 1731 nt, unidentified
  source 1..1731: mol_type = other RNA; note = synthetic construct
atggctgctttactctcctactcaccgtccgcggtgtcatatatcatccatatcactaggcctgccactcgatatatgacatttgatattcctaagcgcagcggtggggtgcgcacaattgacgcccccaatgaccgactgaaaggcttgcaacggagcctatcgaaactgttgtttaaatgccttcgggagatagaagctaaggatcctcgtagaaataaactgtcacacgcctttaggcctggagcctctattatctctaacgccaaaacccaccacagacggcggtacgttctgaatctcgatctcaaggacttcttcccggcttttaattttggcagagtacgcggcttttttctcaagaatgagcactttagattggcagagccggtcgctaccttgctcgcccagatcgcctgcaaggacggtaagctgccacagggctccccatgcagcccaattataaccgaactgatgacccactttttggatattagattggtgaagctagccgccaggcataaatgtacttatacgagatacgctgacgatatcacaatcagtactaaccaaagggagttcccgtcagccttagccgagctggatggcactcagtggaaactcggggaggaactggtcagccgcattcacgacgctggcttcgaagtgaatgatgcaaagacgaggatgcagttacgtggctctcgtcagatggtgaccggattaaccgttaacgagaaagttaatgtcgcccaagcttattacaaacgggtgcgcgccaccgctcatcggttcttgaccacaggcgcctatgaactagatggagccacatgtaactctgtgcctcggctggaaggtatgatcaaccacatataccatgtccgggagcgacagattgatatagcaatcgcgaacgaaggcaacaaggagaagcaacacaaactgcatgccgaacgcacgaagaccaagaacgagcgcccttctgctattagggtggtttattacgaactgatcttcttcaagaactttatcaatcccccccagccactcataatctgtgagggcccaacagatccagtgtacctcaaaagtgctatcagaagactggctgcagcacatcccctgctggccagtgtcgtaggggggaaacccgagcttaaagtcaattttttcaagtactccgaccaggcaagggatttcctgcagcttcggggaggtagtggggaccttctgtccttcctgattagctggaaagaggcgttcaatagatacaatttccgccccgcggaacaccccgtgatagtcctcattgacaatgacgatggagcgggggacatctttaactacctcaagaacaagaagaactatggactggacattgcccttgaaaagcatgaccctttttttcaccttcacggaagcttatacctggtgaagacacccgccctgggcgcaaaccataaaagctgccctgaagactttttcgaccctgccctacttgccgaaaagctcgacgggaagtccttcaataaagagaacaagatcaatccagcaactgagtatgggaaagcggtgttcgctaccagggtagtgcgtcccaaggccggtgccatcaacttcgctggattcactcccctgctggagcgaattgaggcagtaattagggattatgctgcacgaaaagcagctgccgccgcaccagttccagcagctgctgcacctacaccctga

SEQ ID NO: 8046 - RNA, 1707 nt, unidentified
  source 1..1707: mol_type = other RNA; note = synthetic construct
atggcccatctgctgggctatcaacccagtgggctgagctacctgttatacaagctgccggtaggggctaaatacacgacattcacaatccctaagaagagtggtggagtacggcaaattgacgcacctgcaccccgaatcaagcgcttgcaaagggagctggcgaagattttgtataaatgtatcgccgaaatcgaagctcagcccggtagaaagaataccttgtctcacgcctttcgatatggacacagcatcctgacaaatgcgaaagcccataggaaaagacgctacgtgttaaacttagatctgcaggatttttttcctaccctaaacttcggtcgggtccgtggttacttcctgaaaaatagagacttcctcctgtccgaaaaggccggaacgctcattgctcagattgcatgccacgagcaaaccctaccccaggggtcgccatgcagtccagtgatctccgaactgctggcccacttcctggatatcagactggccacccttgccaagaaacatcggtgtacatataccaggtatgcggatgatttgaccttttcaacaaaccagaaagacttcccagctgcgcttgcagtggagacagaggctggctggatcctcggagatggcatagtccagaagatccagagcgcccacttcacaatccacccttccaagacccggatgcagctacgggctcgtaggcaaaccgtcacaggactggtggtgaatgaaaaaacgaacgtcagatcagattattacaaaactgctagggccatggttgacagcctgttccggactggaacttacgtgattgacggggctcccgaaactgccttggcccctattgaggggattcttaaccatatttaccacgttagggaatcggtgatcgatgcagccatcgaggccgagctcgatcccgaacgtaagaaaaagagaaagagcgaacgagcgaaggccaaacgggagactccaagcgctattagagttctgtatcaccgcctgttattctataaacacttcatagccccctctcagccggtgcttttaggcgagggtcctactgactccatctacatcaagaccgctatccgccgcttgccagcttatcacgccgcactgacagagcttaagcagggcaagcaggtccagaggctcgacttttttcgatactccaagcaggctaaagaaatcctgcagctcggaggggggacgggggatttcaaatatctcttgaccgcctacaagaagttcgccccacagtacaagcacgcccctatggctcatcctgtaatactcctcattgataacgactctggctccaatccagtgttctctgtgatggcatcactgtttcatgtaacagcctctataaagactgaccttccattttacaagcttgcatctaacctatatgtggtgaagagtccccctgtggagctcgatggctcctcatacattgagcagttctttgacccggcactcctgaccactaccatcgacggcaaaaccttcaatcccaataaggagcatgaggcagcaggcgagtacggcaaagtctggtttgctgagaaagttatacgccccaacgaagcgaatattgactttactaactttggcccaattttggcaaggatagctgcagtcctggaagaccatgccgctagcaaagcggcagttctcccgcaagccgcccagtga

SEQ ID NO: 8047 - RNA, 1788 nt, unidentified
  source 1..1788: mol_type = other RNA; note = synthetic construct
atgtcgaaactatccttgttgaagtccgccagctccttatcagatgtggcagacctcttgggtttttccccctccgggctgagtttcgtgctctacaagcagtccgcgctcgcaaagtacaagaaattcgagattcacaagaaaacagggggaacacgcgatatttgcgctcccataggagccatgaaagccatccagagggagctggccactgtgctcaacgcctgtagagctgaaatcctcgaagcaactccccggaggcccctctcccatggtttcagagagtctttgagcatcatcacaaatgctcagaaccacaccgcccgacggcacgttctgaatgtggatctggcggacttctttccgacgtttaattttggacgcgtacggggctttttcctgaaggacaaagacttctttcttaacgaaaaggccgccactgtgctagctcagatagcatgttttgagaatacgcttccccagggctcaccatgtagtcctgtgattgccgacatgatcgcccacgtgctggatgtgcgattggtgggcttggcaaaaaagaaccgcgtgacctatagtaggtatgctgatgatttgactttcagcaccaatcagaaggactttccggaagaccttgcaaagcctggagccggccctgccgatccatggatcgtcggagatgaactcctgaaaaagatcgagggagctgccttcaaagtgaaccctactaagaccagaatgcaatttagagggagccgtcaggtggttactggactcacagtgaacacaaaggtgaatattagtcagcgctattggcgttctatccggagcatgtgtcacgcactattccaaaaaggggagtaccaccaccccgccccaaaagcaggaactcccccagggtcagctctggtcatgatcaatagcctggaaccactggctggcatgttgtctcatgcatatcacgttaaaagaaagtctctgcggtttccggacgagaaaaaggaggacgttgtcttcggtcaaacagaccatcgtcgattctggttttacaaagcttttgtagcccctacaaggcccctgatcgtgtgcgaagggcccactgacaacatttaccttagaaacgcaattcggaggctgacagcctatcatcctaagctggggaacatgaccccgcatgggttcaaatatggagttgcactattctcgtacaccaatcaaatacacaaaattctgggcatctctggtggaatcggccccctgctcaccctcgttcatgggtataagaagcagctgaaggagtacaaattccgcccaatggcgcacccagtaatcgtactggtcgataatgacaccgcactgggccagaaagtctgcaattcactgaagaaacactttggtgtcgatgtcacgcaccatagcccttcatcttttttccacctgaccgacaatttatacctggtaaaaactccattagtcgggatactggccatgacctgcatagaagacttatttgacgccgctacaaaagccatgcctttagatggcaagacctttcatacggagaaggcaggcttcgaccctaccaagcacattggcaaggcgccattcgctactaaggttgtgtctcccaacgccgccgctattagctggaacggcttcgtccctctgcttgataggattgtggctgtgcagaacgattactccgcgaagcttggcaccacacctctcgccgctctccctcataccccaacacttgcgccccttagtcccgctgccggtcatccatga

SEQ ID NO: 8048 - RNA, 1665 nt, unidentified
  source 1..1665: mol_type = other RNA; note = synthetic construct
atgtcctttgtcctgtataagcagcatcctgccctcaagtacgccaagttcgaaatccccaaaaaagatggggggacccgggaaatttgtgcaccgctgggaccattaaaagccatacagcgcgagctggctaccctccttaacgagtgtagggccgagattctggaagcgacaaagcgtgcgcctctcagccatggattccgagaagacctaagtatcgtcacaaacgcccataatcacaccgctagacgatacgttctcaatgttgatctcgcggacttcttccccacatttaattttggcagagtgcggggtttttttttgaaggataaggacttcgagttgcatgagaaagtggcaaccgtgcttgcccagatcgcatgcttcgaaaacagtctaccacagggatctccctgctctccggtcatagcggatatgattgcccatgtgctggacgctcgactggtaggtctagctaaaaaggcgaaagtaacttactctagatacgccgacgacctgtcatttagcacaaaccagaaatccttccccgagggactggcaaaacccagcgcagttggcagtggtgtgtgggtcgcaggggacgaccttgttaagaaaatcgaagcctcagggtttaagttgaatccagccaagaccaggatgcagttccggggcagcaggcaagtggtgactgggctgactgttaatgccaaagttaatgtctcgcagaagtactggagaggaataaggtctatgtgccgggccttgtataccactggagcataccacctacctagccctaaagccggcgctcctgctggtgatcctcctgaaaaaattgcttccctgcgtgtgctcgccggcatgttgtcgcacgtgtatcacgttaagagagagtccggattcgctccagatggcgagaaagaagagattgtgttcggccatacagatcatgaaagattttggttcttcaggagctttgtggccttagacaggcccctgattctgtgtgaaggcgtcactgacaacgtctatctgcggaatgccatgcgccaaaaggcagctgcgtttccacaactggccgcgaagacaccggaggggtataagttcgccgtggccctgttctcttacgacaatctcattcacaagatccttggaatcacgggcggcattggccccgtgctcaagctgatccacggctaccgtcgccgcctgaaagcttttaagtatcgcccattcttacacccagtgatcgtcgtggtagacaacgataccgccctgaacgcaaagacatgtaacgctcttaagaaacattttggagtcgatataacacacggctcagccgatgactttttttatctcaccaacaatctctacctggtgaaaactccccttgtcggtaccaaggcaatgacttgcatcgaggatttgttcgatgatgccactttgaaaaaggacctggacggtaaggtgttccacaccgagaaagaggggtttgacgcttccaagcacattgggaaaaagctcttcgccaccaaggtgatcgcacccgaggctgctacgatcagctgggacgggtttgaacctctgttagcacgggtagctgcagtacttaacgcatacgccgccaaagtggcagctgatgcttcatccagtacaacgtga

SEQ ID NO: 8049 - RNA, 1650 nt, unidentified
  source 1..1650: mol_type = other RNA; note = synthetic construct
atggcaggattgctggatgtcgaacctcggcagctgtcatttgcactgtacaagctaactcctcagcagaagtatgacacatttgagatccccaaaaaagggggcggagtgagaaccatccacgctcctcgcggggtgctgaaggacatccaggcgcgactcgcggcactgctgtacgactgtgtggacgaaatccaggttgcgaagccgcgtagaccagtcagtcatgggttccgccggtcgctgtctatcataacaaatgccgccaggcataccaacaggcggtatgtatttaacctagatctcgaggacttcttccctacatttaattttgggcgagtgcggggcttcttcctgaaggaccaggattttcttctgtctgagaaagccgccactttgattgctcagatcgcctgcagggacggagcacttccacagggctccccatgctctccaatcattgcagatctcatagcccacatcttggatgtgaggctcttgtccctcgccaagacttccaaagtcacctattcccggtatgccgacgacttgaccttttcgacaaaccagaagatttttcccccagccattgctactggtggggctggccccgaagatgcatgggttattggatcaccccttgcccgtgttattgaaagagcggggttttctataaacacacgcaagacccgaatgcaagaacgggcttcccgtcagctcgtgaccggccttaccgtgaatagcaaggtcaacgttactcaaagctattggagaagcatcagaagtatgtgccattctctgttccagaccggtgcctactatcgaccgatccggactggggagcctccaacactgttaatgtccctcagcccgcttgcgggaatgctgagccatgtgcaccatgtgaagagggaatcaggagttcgacctgatcgcccgggcaaggactttcaattcggtcacaaagaacaggaggatttctggttttatgcaacctttatcgcccttacacaaccactgatcgtcaccgagggaaaaactgacggcgtctaccttcggaatgccataagaaatttgcccgccttccacccagctttaggtcacattaccccagagggtttcagctttggcgttcgcatcttcaattatgagaaccaaacgcaccagagactgcgcatcacgggcgggataggccctctcagtaccttcatgatccactacggcgcaaggttgaaaagatacgggcacaggcctctagccgctcccgtcatagtactgattgacaacgacaccgcactcacaaaggagctacgcgctgcactggatcggaattacggtgtgaaggtggacctgttaacgcctgcatcattttaccacctgacagacaacctctacctggtgaaaacgcccgagttaggagcctccggcgtgagctgtattgaagacttcttcgataccgcaacaagaaagctgcccctcgatgggaagactttccatgccgatggcaaaggctttgatcctacaaggcacattggaaagagtcccttcgctaaaaaaattgtggctccccgcgccgccactattgattggactggattcgcccccctgctgtctaggatcgctgctgtagtagctcattacaaacattga

SEQ ID NO: 8050 - RNA, 1719 nt, unidentified
  source 1..1719: mol_type = other RNA; note = synthetic construct
atgaccattctgaagaagctccaagatgccaaggatcttgaagacctggccaagattctcggtttcagccctaagggaatctcatacatcatttacaaactcgaggagaattccaagtacaaaaagttcaagatcaagaagagccacgggggggagagggagatttgtgcccctatagagccattgaagactctgcagcgccggctggcaaacgttttgtacgcaagcgtagattccattgaagccgaaaaggggatcaactccacatcccatgggtttagacgcggccattccatcatctcaaatgccagaaagcacaaacgtaggagatatgtactaaatctggatctgaaggacttttttccaactttcaattttgggcgggtgcgaggcttttttatcagtgacaatcgatttggctttcacgagaatgtggcgacgttgatttctcagattgcttgccacgaaaacagtttgccccagggtagcccttgcagtcccatcatcgctgatctgatagcgaacattttggatgctcggctcgtgaggttagccaaagaccacaaagtcacatactcgcgatatgctgatgacatcaccttttctacctccctaaaaaaattcccagcggcacttgctcagcccgttgctggcgaaggtcctgattggaagctcgcagacccgctgaccaaagctatcgagggagctggcttcaaaataaacccagacaagactagaatgcagtttcgtgacggcagacaactggtgacaggcctgaccgtcaatgacaaagttaacattaggcctgaatactatcggtacgcgcggtctatgtgccaccaggccttcaaatcaggaaagtattacaggccatctaaagtctctgtggtgggagagaaagagcctgagatgatagaaagtcttaacccgctagaagggatcttgtcacatattcaccatgtgaaagatacaatcgatgtccgcattgagcccgaaaagcggaggcatggaactgccgcccgccaactgtatcgccgcttccttatcttcaagaagttcgtttgcctcgatcagcctctggtgatatgtgaggggaagactgactctatttatctgaagtgcgcactgaggaaattaaccccatccttccccgagttagccaaaataaaggacgagaagtttacaagcaaaatctcattcttcaactacacgggcagagtacactctgtgctcgaacttggtggcgggaccgaggatctgaagtttttcttcattaagactcggtaccacgaaattattaatcgtttcggccacaagcccctgcaacatcccgtgatcgtgctcatcgataacgacgatggcgccaaaggactcttcaaaaccataaagcagaatttcggaatcaccatcgatctacagagcgacgacaagttttaccatattacagacaacctgtatctggtaaagacaatcgagaaaggcgagtccggtaagagttgtatcgaagattgtttcgaaccatcgttacttgagacgaaagtcaaaggaaaaaaattcaacagcctgaagtatgggggagcaagcggtggatatggcaagtttgtttttgccgagcaggtcgtccgaccgaatgctgacaaaatcgactttaacgggtttaagcctctgctcgaaaggattactgccgcaatagtggactacaaaagcagagtgccctga

SEQ ID NO: 8051 - RNA, 1692 nt, unidentified
  source 1..1692: mol_type = other RNA; note = synthetic construct
atggcttatatattgtacaagatacctgacagtgccaaataccagaaatttactatccctaagtccggaggcggagagcgcgaaatttgcgcccccgttgaacggttgaaaacactgcaaagacacctggctaacgctttgtatgcttgccgggatgagattgatagggaatctggacttcgccctctttctcatgcatttaggcgtaccgtcatcgttaccaacgaccgaaggcataagctttcaatcatcacaaacgcgagaagacacaaacgacagcggtatgtgctaaatctggacctccaggatttttttcccactttcaatttcggcagggtaagaggctttttcattcacaataacgacttcaagcttaacgacaaagtcgccacgatcattgctcaaattgcttgctttgagaatgcgctacctcaggggtcaccatgtagcccaattgtggcagacttaatagcccatctgctggacgtcaggttggcgcagctcgctaaaaagcatcagctcacctactcacgatatgctgacgatctgacattctcaacctccagaagagactttccgccttcgatcgcagcgccagttacacccgagagccctgagtgggctcctggacgtgaactcgccaaggtgatcgataaaagtggcttcgtgataaatcccaccaaaacccgcatgcagttcaggatgtctcggcaactggtgactggcctcacagtgaatgccaaggtgaacattaggccggagtattatcggcgggccagagccatgtgccactccctttttgaaacaggccagtactaccgtcctctcagtgtaccggaaaccgaggccgaagatggggaggatgtcaaacttgaacccgtgacaagcctgaatccactgcaaggaatcctgagtcacatccaccacgtgaaggacgcaattgatgatcgccccgagccagagaaacgcatggatgcaactgccgctcggaagctgtatgcccgcttcctgaagtacagatacttcgtgcgcctggacagaccactgatcgtctgtgagggtaagaccgacaacatatatttaaaacacgcaatacggcagctgactgactttcaccccaagttaggtgaatgggaggataatagcttcaagtctgctatcaggttttttaactacacgggccaggcccataaactgctcgagttgggcggaggcgcctccgatttgaagtacttcttcatcaagaatcgctatgccgaagacgtcagggggttcaagcatcgaccactggcacatccagttgttattctcattgacaacgacgacggtgcagacgggaagaaagggctattaagcaccatcaaaactaacttcaacattaacatcgacctcaagtctaatgacagcttctttcacatcacggataatctatacttggtcaaaacccccgggaaaggtaaaaaggtgaaatcctgtatcgaggatttcttcgatccgaagctgctgaagacaaagcttaatgggaagaagctgaacctgaaaaaggaccatggagccgatggtgaatacggcaagtatctgtttgcggagaaagtggtacgacccaacgccgataagatcgacttttccgactttaagcccctcctcgagcggattactgcagtgattgatcactacaaacctccagattga

SEQ ID NO: 8052 - RNA, 1719 nt, unidentified
  source 1..1719: mol_type = other RNA; note = synthetic construct
atggccgccctcctgggatataaacctaaaagtctggcctacatcctgtacaagatccctgatggggctaagtacacaacttttacaattcccaagaaaactggaggagagagagagatctgtgcccccatcgcccagctgaaattgctccagcggagactggctaacattctatatgcttgtcgcgacgaaattgataagagcagcaagctcgggtctttaagccatggtttcaggaggggacacagcatagtgagcaatgccaaacctcatcggaggagacgatacgtgctgaatctggatctgaaggatttttttccatcctttaactttggaagagttcgaggcttttttatcaagtctaaagccttcgaattgaacgagaaagtggcgaccctgatcgctcaaattgcatgccacaacaacgcattgccacagggctcaccctgctctcccgtcatctccgatttgcttgcccacctgctcgatgccaggctcgctaaaatggcaaaagcccagggtgtgacatacagccgctacgccgacgacttaactttttccacatccaagaaggagttcccggccgccctggcaaccagtaaggaaggcgaaacaaatgtatgggagttgggggaggaactcgttagtagaattgttgacgctgggttcgccatcaacccagacaaaacacgcatgcaatgccacgcgagccgacagctggtgacctctctgaccgtcaacgccaaagtgaatatccggcaggagtattaccggcgtacacgcgcgatgtgtgacgcactgttcaagactggacaatacgctgacgtcccctttaataaaagtcttgcccgtcgccaggattcagttacggctaatgaaggtggagctaccggttctggaccctgggctccagctaaggctggaataaaatccctcggtccgttaggcggcagacttgcgcacatccactatgtgaaggatactattgatacacgggaggagatagataagaggaagcatatgactgcatttcgcatgctgtattatcggttcctcttctacaagaacttcgtcgccctggacaagcctttagtgctcactgaggggaagaccgacaacgtgtacctatcactggctgtcaggcatttacctaagttccatcccaaattggggcagccatcggccaaaggcttccaatccgccctgcgatatttcaatcatgtgaacaaaacgagcaaggtaatggaactggacggcgggtccggcaacttcaaattcttcgtcttgcgttatgcagatctgatcgcaaagttcggccacaagcctcagctgcatccggttattatgcttcttgacaatgatgacggcgcaaaagacatactcgccgttatcaagaagaattacgggattgagattaagccctcatctaccaacagtttctttcacattaccgacaatctctatgtagtgacgactccccatgtgggcaagaaggtaaaaacctgcatcgaagactttttcgaaccttcactactgaaggaggagttgaatggcaaaacacttaatctcggtacccctaacccagcgaccgaatacgggaaacacatatttgcagaaaaggtggtgaggccaaacgcatcgacgctaaaatgggatggctttgagccacttctgcagagactgtccgatgtccttgaccactatgagccccctacctga

SEQ ID NO: 8053 - RNA, 1764 nt, unidentified
  source 1..1764: mol_type = other RNA; note = synthetic construct
atgtcaatccttaaatctctgaaggccgctgaagatgtggacgatcttgcggtcctccttggatataagccaaagagtctcacttacatcctgtataaattgccagacgcagctaagtatacgacatttaagatcccaaagaaaacagggggcgagagggaaatatgtgcacccacggaccagttgagacttctgcagcgccggctggcgaacatcctgtacacttgcagggacgagatcgatcacgaaagtggaaaaggatctctgagccatggctttagacgtggtcacagcatcgtgaccaatgccaagccccaccaccgccgacgatttgtcctcaacctcgatctcaaagattttttcccgtctttcaattttggacgtgtccgcggcttcttcataaagtccaaggcatttgaactgaacgaaaaggtggctaccctcatcgcccaaattgcttgccatcagaacgcgctgccacaggggtcgccttgtagtcctatcatttccgacttactggcccacctgttggatactcggcttgcaaagatggctaaaaaggagggcgtgacatatagtcggtatgctgacgatctaacgttctcaaccaacaaaagagtgtttcccaccgcattagcaatccagaatggcgataacgccaaactgtgggaactaggtgaagagttaacctcccgcattgcagatacaggctttactataaacccggataagacaaggatgcagtgcagaatgtctagacaactggtgacatctctgactgtcaatgccaaggtaaacgttagaatggagtactataagcggacaagggccatgtgtgacaccctattcaaaaccggattgtactccgacattccctttaataagtctctcgcacgccggcgagataatgccctggctgtagccggatcggagaaagacaaagatggtgtgaaagccgctaagaccagcatcaccagcttagggcccttgtccggcaggttggcccatatccatcacgtgaaagaccgcattgatacgcgagaggaatgggaaaaacgtaaacacaagacaacattcaggatgctgtactgcaggttcctgttctaccggaatttcgccgctcttgataaaccccttatcctgactgaaggtaagaccgacaatgtctacctcagcctggccgttaaaaattccccaaagttccaccccaagttgggccagctgacagccaaggggtttcagagcaacctccggtatttcaaccacctcaacgagacacataagattatggagctcgacggagggagcggcaacttcaagtttttcataatacggtacaaggagattatggactccttcaagcacaagccaatgctccaccctgtggtactggttgttgacaacgacggtggggccaaggatatttttgctaccatcaagaccaattacgggatttcaatcaatcatgacggcaaacatggattttaccatgtgactcataatctatacctggtcaaaactcctcacgtggggaagaaacaacaaacctgtattgaagatatgttcgagccggcactgttaaaggaggagttggggggaaagaaactaaacctgggcaagctggaccccgcgaaagagtatggtaagcatttgtttgccgagaaagtggttagacctaaagcttcaactctgaaatgggacggcttcgagcctcttctccagagggtagtggaagtcctggaccactataaaccacctacctga

SEQ ID NO: 8054 - RNA, 1680 nt, unidentified
  source 1..1680: mol_type = other RNA; note = synthetic construct
atgagtgtgttgggcgatttaaaggcagcaacctctcttagcgacctcgctaagttgattgggtacaagcccagcgctctgtcttttctgattcatcacgcacctgctacttcgaagtatacttccttcagtgtcccaaagaagagcgggggggtacggctgattaacgcgccctccccgaaactgaaaaccctgcagcagcacctagtgaccctcttgacaaaatgtagaaaagagatcgacgaagctagtaacctcaaaccactatcccatggcttccggaaagggcaatccattataacaaatgccaatccccacattcgccgccggtacgtgctcaacctggacttagaagacttctttccttcaataaacttcggccgagttcgcgggtacttcataaagaacaacgatttcaagctacataaggacgttgccactgtgatagcccagattgcctgtcacgcaaattccttgccccagggagcaccaacgagtccaatcattagtgatctggtggcacatttgttagatgtgcgtttagtgaggctcgccaaaaagaataattgcacctacaccagatacgcggatgacctgaccttttcaacgaatgtcaaagtctttcccacgagccttgctctgcagactagcccaagcgattgggagctggggaagcctctctccgacgtgatcacagatgtgggcttcaaggtaaatcccctcaagacacgcatgcagttgaggggcagcaggcaaaccgtgactgggctcactgtcaatcagaaagtcaatatccaagctggttattaccgaagggtccgctctatgtgctacgagcttttcaaaaccggactttattttcagcagggttccgcaccagtaagcgctctgcctgtcgtggagggccaactgaaccactgcttcagagtaaaacatgaggtggcctattctcggaaggtggacattcagaacgataaacgggacagaggcgtgcgaaagctgtatcgcagatttctattctacaagcattttgtccagctgactaaacctcttctcatctgtgagggcaagacagatgttatctacctgaaacttgcactccgttccctggccgcctcttttccttccctcgttacaaccactgccgcgggcgaggtcaggaacgtaggttttttcaatcacaccgatatcgctgacaacctgctgaagctgggaggtggcagcggaggaatgcagctcctgattaaggattatgcctctgtgctgaaatattttaggagtaaaccactggcccacccggtgatacttgtgatcgataacgacgatggggcggacgacatcttcgcagccatctataacgtgacaaaaaccaaggtttcaagaacatcaaccgccgacttttaccacatcgtcaataacctttttttggtgaagacgccagaatctggtattcacggcacttcaagaatcgaagacttgtttaaaccttcggtgctgaaaacagttgttgacggaaagattttcaatcctgccaagaagatcgatccgacaaaggaatatggaaagattgttttcgctgaaaaggtcgtgcggcccaatgccaacaagatagacttctcagcctttaacaaattcctgggaaggatcgaggctatcttaaaacattacaaacccccctga

SEQ ID NO: 8055 - RNA, 1782 nt, unidentified
  source 1..1782: mol_type = other RNA; note = synthetic construct
atgctgcttgagctgagacaggccgacactctagaaaggtttgccgcactgctcaactacacaccctctggcttgtcttttattctgtacaaaatggacgccgcaagtaaatatacaacttttgaggtgacgaaggcaagcgggggagtgaggatgatacacgctcctcatattaagctgaaacgcttgcagaaagctcttgccaatatcctactcgcctgtaacgttgagatagagactgccactcccagacgtcccttatctcatgggttcgagaaaaagcgttccatctttacaaacgcttgggaacacaagaatcgccggtacgttctgaatctggacattgaggatttttttcctaccatcaactttggacgcgttagaggctttttcatcaaatcccacgatttcacgttgcctgagaagaccgcaactttaattgctcagattgcatgccgcgacggcaaactgccacagggtagcccctgctcaccgataatagctaatttggttgcccacctacttgatgtgcgactggtaggactggcgaaaagatcgaactgttcctacaccaggtatgccgatgatatcaccttctcgacaaatcaacaggagtttccagctgaactggcggccgaagacccacctcgaagtggcacctgggtccttagcgaagcgcttatcgctcagattacccggactggtttcaccgtgaacaatgcaaaaacgaggatgcaatgccgaccctcccagcagctggtgactggactcaccgtcaatcagaaggtcaacatcagagccgcctactatgcacgcgccaggattatgtgttccagtctctttaaccacgggcattatcatgtcgagatggaaccggcaccagctcctgctccaggaggaacaccaggcaagcccaagcctaagttgctgaccaaaacagccaccttagaaggtatcctgagtcatatatatcacattaagcacgcgcaagaactgaagagcaaccccgagacatataaagctaaagacccggaggctaagaagaagactaaccagaagagggagtatccaggttacagaaagctctacaaaaaattcctctacttccgacatttcgtgtccccaaccgctccgctggtaatgtgtgaaggcaaaacggacaatatctaccttcgctctgccctcaaaggcctggatccctcatatcctaggctggccgaggtcaaagatggcaaactgttcaccaagggccgtttcctcaaacattctcgggcagaacacgatatcctggaactcagcgggggatcagggaatatcgccaacttcatcgctcactatcggagcgccgtgttcaattataagcatcggcctatgaagtacccagtcatcattttactggacaatgactcaggggggaatgctgtattcaatcaagccaaggaaatgtttaagattcgggtgggttacgacacaaccgaggccttctaccacctgtgccacaatctttatctaatcaagacacctgagatggggaggactggagagagctgcatggaagatctctttgatgagaagaccagaaaggagttggtggatggcaaaacattcaaccctaaggccgacaaagatacagccacgcagtacggcaaaatggtgtttgcggaccgggtcgtgcgcgctaactacgcaatgattaacttcgacaagtttaagcccctcttggagagaatcgtggcagttttagaccacttcgacgccaacaagcccaaggcagcgacttga

SEQ ID NO: 8056 - RNA, 1764 nt, unidentified
  source 1..1764: mol_type = other RNA; note = synthetic construct
atgctgagccagctgaagtcagcatctacaatcgatagattcgctgccgccctgggatataaacctgctgcattggcttttatcctcttcaagatgacagacgcagagaagtaccagactttcaccattgcaaaagcttcaggtggcgtgcgaactatccatgcgccgactgagaagctgaaacgcttgcagaaacgtttggctaacgttctcgccgattgcagaaaagaaatccacgataaaaagcctttatccaccctaagtcacggatttgaaccagatcgtagcatttttacaaacgcatgggctcataaaaacagaagatacgtgttgaacttagatctagaagactttttccccactattaattttggaagggttcggggctactttattaacaaccgcgactttcagctgcctattaaagccgcaacccttattgcacagatcgcctgttttcaaggcaagctgccccaaggttcaccctcgagtcctattatttcaaacctgatagctcacctcctcgacgtgaggatggctagactcgctaaatccaacacgtgcacctattctagatatgccgacgatctcactttttcaaccaatcagaagcagttcccaccagacatcgccacccaggttccagatgagcccgggaactgggtccttgggaatcggctaacaggcgaaatagtgcggacaggcttcacgatcaaccatcagaaaacccggatgcagtcccgcccgtcacaacagctggtcaccggtctgaccgtcaatgagaaggtcaatatcagggccagctactataggcacgcccgaaaaatgtgtagctcgtttttcaatcatggggtgtactacaatgagatggagtttgtattcggggttgagggaccaaggccaaagctcattgatacacccagcgtgttagagggaatcctgtctcatatctaccacattaagaatctccaattgacccgcagcacagagcctgaagagctcaagcagaaatctaacaagatcaaatatcccgcctatcgccacctttacaagaagtttctttacttccgacatttcatcaatctcgacgcccctctgatcgtttgcgagggaaagacagataacatttatctgcgtagcgccctgaaggccctctatcccgcattccctgttctggccgacgtcaaaaagggcgagctgcgaagtaaagtaaaattccttaagcactctaggatagaacacaacatattggaattaagtggcgggagtggtaatatcgcaaatttcattgcacactaccggggggccgtatacaattataagtacaggtccatgaagcatcctgtgatcgtgcttgtggacaatgactccggccagaaaggatccgtgttcccccaggcgaacaagcttaatgggaagatcgatataaactattcctccaaggaaccattttatcacctgtgccacaacctatatctgattaaaaccccagagattggcctgacgggcgaatcttgtatggaggatctgtttgacgcggcgaccttggctactaaggtggacgggaaaacattcaaccggaaagacgacaaggatacgtcaactcaatacggtaagatggtgtttgcggacaaggtagtccgcgctaattacgataagatcgacttcagcctgttcgtgccgctgctggaaagaataactaaggtcatcgctcactacaaaagcaatcccagcgcctctgcctccagtcatgtgaaatcttga

SEQ ID NO: 8057 - RNA, 1515 nt, unidentified
  source 1..1515: mol_type = other RNA; note = synthetic construct
atgtcaaccctactcaggttgcgaaccgccaagaacctgaaggatttgagcgtaatccttggctatgagcctaagaagttgtcttacatcctctacaaaatcccagagcaggaaaagtacaactcattcgagatcaacaaaaaagatggggggaagcggttaatagaggctccaataccgcaaatcaagaaactccagaagcatctttgcaacatattgactctgtgtagcgtcgaactggccaaagacagtccaaataacattcttagccatggctttaagaagggctcctccattcaaacaaatgctcagaagcacaagaataaacggtttgtcttaaacttcgacattaaagacttcttctggtcgataaatttcggtagggtgagaggattctttatcaagaataaggacttcctactggacgacaaagtagcaacaataatcgcccagattgcgtgttacaatggaagacttccccagggctcacctaccagtcctatcatcagcaatctgattgctcacttgctggatatccgccttgttggagtggccaaaaaatatggctgtgtctacagtcgctacgccgacgacatcaccttttctacaaaccagaaagagtttcccctggatctggttaggaggtccagcgagaacccagagctgctcctcctcgggacacctattgaagaggaagtgaagagatctggtttttgtgtgaaccctctgaagacgagactgaagtaccgagacacacgacaagtggtgacgggactcgttgtcaacaagaaaattaacgttcgttccgaatactatcgcctcgcccgcgccatgtgccactcctattataagactggcaaatacctcataccctctaagatcagcccgatcgacattccaagcaccctgtgcgacagcgatgtcaaggctgatctgaaccggctcggaggcatccttaactatattttctacacccggaattactcagaccaaagatgtttgagagacaagcaggataataaatccgggatttggaaaatgtatcgcgattttatctacttcaagattttcggtgccctggagaggcctctaatcctgtgcgagggtcccactgattcgatttatctgaaagctgcaatcaagtcactgcacaatgaatatcccgaactgattgaaaaatgctctgagaggtttatctataacatcagtttcctgaagtactctaaaaccatccgggagctgttacatttgaccggggggactggcgagttagccaattttgtgggatattacgcatctatggcaaagcagtatgtgatttggaatccgatgcaccccgtgattatagtgacggataacgacggcaaacgtaagaacgcagcgactaaggtatttgctgcggtgaaacagaattccaaaaatagtcatcccactacagaagatgattccgactttttccacattaacaataacctttacctggtcaagatgccacatatcaataacaagaaatga

SEQ ID NO: 8058 - RNA, 1752 nt, unidentified
  source 1..1752: mol_type = other RNA; note = synthetic construct
atggcatacttagaaaaactcaaggccgcatcaaccattcaggatctggccgctctgttaaacttaaaagcttcacacctggcttatgtgctgtttgtgctgcccgacgagacaaaatacaagcaatttgagattccgaagaaggccggtggtgaaaggatcatcaatgccccacatgaacggctcaaacacatacagcggtgtctggcccaccttctacagtattgcgtgctggaaattgaacactccaaaccccagcccacccctagggtgttatcccatggcttcagaaaaaaaacggaggtgaacccaaatcgaaaaagcgacatttccattggcatccacactaatgcgtacagccatcaaaataagaagtacgttctgaactttgacttgagcggattcttcgggtcttttaattttggccgggttaggggattctttatcaagaataatgacttcggcctgcatccctctgtcgctacactgattgcgcaaatcgcctgcttcaaaaatgagttgcctcagggatcaccttgctctccaatcattacaaatcttatcgcacacatcttggatatcagacttgtgagatgggctaaaaaaaataggtgtagttactctcgctatgtggacgacatcactctgagcaccaatcaggaaataccccagaagcttgcaacccagtcggaggagcttatgaagtggtccttaaataaggagatagagaacatcatcactcacagcgggtttcagattaatcccctgaagactcgcctccagatgcacagctctaggcagattgttacgggcctcgtggttaacaaaaagataaacgtcaagaaggagtattaccgtagtaccagagccatgtgtcatgccctgtattgtacagggtcctttttcctgctgggcgataagagtaagcctggcactctgcagcaattgaacgggatattggagtacatctacttcataaagcagaagaatcactgcaataaggaaccatgctataaaactaacgtggagcagcataacattaccaacctatactcccagttcctgtattttcgctacttcatcgctttggaaaaaccactcatcatctgtgaaggcaagacagatgtcgcctatctcaaaattgcaattaagcagctgaaaaagcagggcaagtacctgctgcctcaccagatcgattttttccactttacggaacgtatcagcgaggtcatgcatatcaatgctggaaccagcctactgaagaagtttatcgagaactacaagaagaacatagccttcaccaaacaaatacctcggagtcctgtaattgtcctcctggataacgacaaggcagctggagacgtcatacagtgccttgaaaacaagttcaagaaaactaacgtgaactacgaccggaaaaagaatttcatttacccagtgatcgagaacctttatgtggtattgctcccaattagaaatccccctgaagacatcatcatcgagaactttttcgagaaatcagtgctagaaaccaaactcggggagaaaatttttagtccggaaaatggaaacggttttgactcgcagcgccattattcaaagcaggtactcgtcgagaaagtgattcgacccaagcaagatacaatcaacttctctgggttcacagatattctggataacctcgttaccgcgatcgagcaatataaacccggtccggacaaaatacaggatcaagccgtatccattatttga

SEQ ID NO: 8059 - RNA, 1743 nt, unidentified
  source 1..1743: mol_type = other RNA; note = synthetic construct
atgtcttcactggcaaaactgcagagcgccaagtcgctcgacgagcttgccgctatcttgggatacaagcccgcagcattggcctacctgctatatcatctgccgacagctcgcaaatatacaacctttaccatccctaagcgcgatggcaccccccgtgatattctcgcacccactccgaaattaaaacttctgcaacggcgcctcgctaacgttctgtatctggccctcgcagatatcgacaaggctggggctccacgacggcatctgagtcacggattcgccaaacacctgtcaattgtgaccaacgctaatgttcaccgacggagaagatacgtccttaacctcgatcttaaggactttttcccttccatcaacttcgggagggtgaggggaatgttcattaaggacaaacgatttgctctggaccccaaaattgctactctgatcgctcagatcgcctgccataacaacgtccttccacaggggtcaccatgctccccggtcatcagtaacgtcataggccacttacttgatattagacttgtgcgcctggcaaaagcgcaaaagtgtacttattccaggtacgccgatgacatcaccttttctacaaatgctaaactgtttcccgcggatatggcggctctcgtggcaggtaccgaacacgaatggaccctgggtgccgccctaatcgaggagatcgataaagcggggttcgcaataaacccggtaaagactcgtatgcaatacagagggagtcggcaggtgacgacaggcttactggtgaatgagaagcccaacattttgccagagtactatagacccgttcgggccatgtgttggtctttgtttaataatggctcctattatagggttgtacccgccactttggccggtgggaagccaggagatcccgatgtgcaggaacccgcaacgagcctagctcccttacaagggatgctgggacatatataccatgtgcgcgaccagattgaccagcgctcttctgcggaaaagaaaaaggaaacaaccgcaaccgcaactaggaagctctatcacaggtttctgttctacagaaatttcattgtcgcccctaagcctctgatcataccagaaggcaagacagacagcatctatctgcaggcggccattgagaagctgattgcctaccatcctcagctcggcaggatggacaaaggcaagttcaagagtgccctgaaatttatgaacttcagctcaacagtccatgctgtgctgcagttagggtccggatctggggacctcttccattttattcggaagtaccacgagttgctaaagcactatcaccaccggcccctccctaatccagtgatcgttctaatagacaatgacgatggtgcaaaagaaatctttggggccgccaaaggcttgggcgctattggcatctcactcacttccactgatgctttctaccgcttgggcccaaacctgtacttaataaagacccctgagacgggacctaagggaaagtcctgcatcgaggacctctttgatccaacactgctgaaggccgagatcgacggaaaaaaattcgacgtgaataagaagcacggcgagcctggtaaatatggtaaacagatattcgccgaaaaagtggtaaggccaaaaaaggacatcattgacttcagcaagtttagcggcctccttgatagaattgtcagcgccctggatgattacaccgccagtccaccccctccttga

SEQ ID NO: 8060 - RNA, 1407 nt, unidentified
  source 1..1407: mol_type = other RNA; note = synthetic construct
atgctgaacctcgacatcaaagacttcttccctagcataaactttggccgagtccgcggaatgtttatcaaggataagaggttcgcgctagaccccaaaatcgcaaccctgatcgcgcagattgcctgccacgatcacgtgctcccacaggggtccccctgtagtccagttatttccaatgtggtcgggcatctcctggatattagactggtccggttcgcgaaggctcaaaagtgcacctattcaaggtacgcagatgacattaccttctctacaaacgcgaaggcttttcctccagacattgcagctccggtggctggttctgaacacgactggacattaggggccgccctgctcaaggagatcgagaaggccggatttgaagtcaaccccactaaaacccgcatgcagtaccgtggcagccgtcaggtagcaacaggtctgctggtgaatgagaagcctaatgtcagacccgagtactaccgcacagtgcgggccatgtgttggtccctgtttaattcaggcacatactatcggatggtacctgccgcacttgctggtggcaaagcaggagatcccgacgtaccagaacctgcaactagcctggccccactgcagggaatgcttggacacgtctatcatgtgagggatcaagttgacacacggccctcggccgataaaaaaaaagacgccacggccactgcaacacgcaaactttacatccgtttcttattctaccgcaattttgtcgtggcaccaaagcctctcataattcccgaaggaaagaccgacacggtttatctccgggcagcgatggaaaaactgaccgcctatcatccaaggctaggcgccatggataagggcaagtttaaaccggcactgaaatttatgaagttcagctctaccatccacgatgtgctacaacttggtaacggcgccggggacctgtttcactttataagacgatatcctgacgctctgaaaagataccgacataggcctttaccaaacccgattattgtgttgatcgataatgatgatggggccaaggagatcttcggggctgctaagggactgggggctgctcacattgctaggacttccactgatcctttctaccggctcgctcccaacttgtacttgatcaaaactcccgaaatcggcgctcagggtatatcatgcatagaggacttgtttgacccagccctcctgaaaaccgtgatcgatggaaaggtgtttgaccccaataagaagcatggcgaggccgggaagtatggcaaagcaagattcgccgagaaagttgttcagccgcagaaggacacgatcgatttcagtaagttcgccggcttgctggacagaattgtggctgcccttgatgactatgtggccaacccccctcccccatga

SEQ ID NO: 8061 - RNA, 1737 nt, unidentified
  source 1..1737: mol_type = other RNA; note = synthetic construct
atgtctagcctggctaagctccaggctgccaagtccctagacgacttggcagcaatccttggatacaaaccagcggcccttgcgtacctgctttaccatctaccggatgcccagaaatatacagcatttacaatccccaagagaaacggaaacccaaggcctatactagcccctactcctaagttgaaattgctgcagaggcgacttgccaatgtgctgtacctggccttggctgatatcgacaaggccggagctcctaggcgccctctaagtcacggctttgcaaagcacctctccattgtgactaatgctgcagtgcataggagacagcggtatgtcctcaacctggatctgaaggacttttttcccagtattaactttgggagagtgcgggggatgttcatcaaggacaaacgattcggccttgaccccaaagttgccaccctgatagcccagattgcttgtcacgaccatgtgcttccccaagggtcaccttgctccccggtgattagcaacatcgtcggccacttgttggatatccgcctggtgcgctttgcaaaggcacaaaagtgcacctactctcgctatgcagatgatatcaccttcagcacgaatgccaaagccctgcctgcggaagtggcggtacccattcccggctccgagcacgattggaccctcggagcggctttgctgaaggaaatcgataaggcagggttcgaggtgaaccctgccaaaacacgcatgcagtatcgggggtctagacaggtaaccacgggcttgctcgttaatgagaagcctaatatcaggcctgaatactatagaaccgttcgagctatgtgctggagcctgttcaatagcgggacctattaccggatggtacccgctgcactcgcaggaggaaaacctggagatcccgacgtccaggaaccagcgacaagtctggctcctctgcaggggactctcggacacgtgtaccacgtgcgtgaccaggttgatacccggagttctgtggataaaaagaaagaggccaccgccacaaggaagctttacattcggtttctgttttatcgacattttgtggtcgcccccaagccactcatcatcccggagggtaaaacggactccgtgtacctgagagctgccatggaaaaattagccgcctatcatccccagctcggcgctatggataagggcaaatttaagccagctcttaaattcatgaacttctcatcgactgtgcacgacgtgctgcagataggcaacggtgccggcgatttactccactttataaggaagtatcccgacgccttaaagcattaccgtcaccggcccctgcccaatccaattatcgttttaatcgacaacgacgacggagcaaaggacatcttctcagtcgctaagaacttcggtgcaccgaatatctcgagaaccagcactgatccctttcatcgcctggccgcaaacctgtacctgataaaaacaccagaaattggggcgaaaggtacatcatgtattgaggacagcttcgacccagctctgctcaaaactgttattgacggtaaggtcttcgacccgaataaaaagcatggcgagccaggcaaatatggcaaggctcgtttcgccgagaaggtagtccaaccacaaaaagacactattgatttctccaagttcacatctctgctggataggattgtcgccgccctcgatgattacgctgccaatccaccaccaccttga

SEQ ID NO: 8062 - RNA, 1611 nt, unidentified
  source 1..1611: mol_type = other RNA; note = synthetic construct
atgccgaagcgcgatggcacacagcggcagatcctcgcccctaccccgaagttgaagttattgcagaggcgactcgccaatgttctgtaccttgctttagcagacatagataaggcagggactcctcgtagacagctgtcgcacggattcgcaaagcatctgagtatcgtgaccaacgcggcggtacacaagcgacgcagatatgtgttgaatttagacctcaaagacttcttcccctccattaacttcggaagggtgcgcggcatcttcatcaaggacaaaaggtttgccctcgatccaaaggtggcaactctgattgcccagatcgcttgccacgaccatgtcctgccacagggctctccatgttcccccgtgatttctaatatcgtgggacacctgcttgatatccggctggttcgcttcgctaaggcccagaagtgcacttacagccgttacgctgacgacattacatttagcacaaatgcgaaggcgtttcccgcagatgttgccgccccggtgtcaggtagcgaacatgactgggcccttggagcagccctccttaaggaactcaagaaagccgattttgaagtaaaccccgccaaaacaaggatgcagtacagggggagtagacaagtcgccactggactactggtcaacgaaaaacccaatgtccggccagagtactacagaacagtacgggccatgtgttggtctttgtttaactcaggcacgtattatagaatggttcccgctgctctagcgggtggaaagccaggggatccagacgtgcaagagccagcatcttccctggcacccctccagggcatgctaggctacatctaccacgtgagaaatcaagtggatactcggcctgccgcagaaaagaaaaaggaggaaacctcaactgctacgaggaagctttatgtgaggtttctgttttatcggaacttcgtcgtcgctcctaagcctctcataattccagagggcaaaaccgattccatctacctgcgcgctgctatcgagaaactcaccgcttaccagccccgactgggggagatggataaagggaagtttaaacctgctcttaagttcatgaactttagcgcggccatacacgatgtgttgcagattggcaacggcgccggggatctcaaacatttcatccgtaaatatcctgatgcccttaaacactaccggcataggcctctgccgaatcctgtcattgttttaatcgacaatgacgacggagctaatgacattttctcagtggccaagaatctgggggcacctcacataagccgcaccagtaccgaccccttctatagactggcacccaacctgtatttgatcaaaacacccgagatgggcagtaaaggtacgtcctgcatcgaggatctgttcgagcccgctttgcgcaagaccgtgattgacggaaaggttttcgacccaaacaaaaaacatggtgaagctgggaaatatggtaaggccagatttgccgagaaagtagtccaacctcagaaagacaagatagatttcagcaagtttgccgacctgctggatcgaattgtggctgtgctggatgactacgccgcaaaccctccacccccatga

SEQ ID NO: 8063 - RNA, 1716 nt, unidentified
  source 1..1716: mol_type = other RNA; note = synthetic construct
atgaaggctgctacctctctggaggattttgcgacattactgggatattcgccagccggcttgtcatacatcttgtacaggcagcctcccgccctgaagtaccgaagctttacaattcccaaaaggtctggcgaggaacggctgatctttgccccaaagcccaaattaaaactgctccagcgtaggctcgcggacctcctgtatgccgttttggcagacattgacaaagcggggaacccgcgtaaacctctttcacacggctttgcaaaaaatctaagcattgtgacgaacgcaaaaaatcacaagagaaagcggtttgttctgaacttcgacctcaaaaattttttcccttccattaacttcggccgtgtccgaggggttttcattaacgatcgaagattccagtttgatccaacgatcgctactcttatcgcacaggtggcctgtcacgagaatgctttgcctcaggggtccccctgttctccagtgattagcaatatcatcggtaacctgctcgatattaggcttgtcagattcgcccgcgcccataaatgcacttattcccgctatgcagatgatataacctttagtaccaacgccaaacatttcccacccgaagtggccgagcccctaagctttctgggtgacgaatgggtagtgggagctaacctggaggcagaggtgagcaaggccggctttcaaattaatcctggcaagacgaggatgcagttacggggaagtagacaacagactaccggactggtggtgaacgagaagccgaacatatgcagtgagtattaccgctcggtgcgcgccatgtgctcaagcctgtttaacacagggtcatactatcgcatggtcccagcggcattatccggtggggaaccaggagaaccagatgtccgcgatcagaccacaaagctggcccccctgcaggggttactcggacatatctaccacgtccggaaccaaatagatagaaggacctccagcgaaaaaaaacagaagcccactgctactaggagtctttatcagcggttccttttctaccgaaattttgtggtggccccccaaccactagtggtccctgagggcaaaaccgacagcatctatctcagagctgccatcgagagactgtctgaatatcatccgcggcttggctccttcgaggatggaaagttcaagcagtccgtgaagttcctgaatttctctccggccatccatgatgtcctccaactcggcggaggctacggcgacctgcaattctttgtacggcagtaccgaatatcactgaagaggtttcggcacagacctttgccaaatcctgtaatcgttcttgtggataatgacagtggtggtaagcaggtgtttaatgcagccaagggactagggatcgatggcatttctctgaaaagctccgaccctttctacaggctgacagagaatttgtatctggttaagactcccgaactgggcaacgaagggaccagttgtatcgaaaatttcttcaaacccgagctcttcaaggagaagataaatggtaaagaattcgaccccgcaaagaagcacggggctcctgacaaatactctaaacaggtttttgctgagaagattgtccgcgccaagaaggcggagattgacttttcagacttcgctcctctcctggggagaatcgtagctgtgttggacgactacgcagctaacccaacaaactga

SEQ ID NO: 8064 - RNA, 1743 nt, unidentified
  source 1..1743: mol_type = other RNA; note = synthetic construct
atggggggacgggtcagtctgctccttaaattgaaaaccgccaagtcactggacgatattgcctccctgttaggttaccagccacagggcctggcttatattctctacaagatccccgaatccgtcaagtataccaccttcacgatcgcgaagcgaagcggtgagctccgcgagattaaggcacctattccacatctgaaaatcttacagcggagactggcaaatctgcttaactcatgtcttggagaaatagagaatgccggggaaagacgtcggcctatttctcacgggtttgtcccctccctgtccatcattacgaacgccagtgtgcacaagaggcggcgatacgtactgaatcttgatctcgagcatttcttcccctcgatcaatttcggccgagtcaggggcgtgctgatcagggaccgtagatttgagcttgattccaaagttgccactgtggttgcccagatcgcatgccacgagaactcactacctcagggcagtccctgttcacccgtgttgagtaacattgtgggacatctcctggatatccgccttgtgcgtttcgcgcgtcagcataagtgcacatatagcaggtacgttgacgacataaccttttcgaccaaccggacagcctttcctacagaacttgccgcacagcaagagagcggctcttgggggctgagccagagtctggtgagcgaaatcgagagggccggctttcgcgtccatgctaggaaaactaggatgcaggtgcgggggagtaggcaactcaccactggcctgttggtcaacgaaaaagtgaatgttagaccggaatactatcgcactactcggagcatgtgtgctgctctattcaacaaagggacatattacgaaatgaaaccagctacactggccggtggcaacgtgggggatgctgcagtgaaggaggttgccaacagcttggacttgctggagggaagattgggatacatataccacatcaggaacacagtcgatcgcagagagtctgctgagaaaaagaagaattccactgcaacaagaaaactcttccacaagttcttgttttacaagaatttcgtggctctggagcgacctctcataatcaccgaagggaaaacggatagcatatatctccgatgcgctataaggtctttatcttcatttcacggaaaactgaccattgaccggggctctaagccacgcctgtccgtcagttttctgaattttacatccactgttcacgatgtgctgcaattagggggcggaacgggggactttaagttcctaatgcttaggtacaagcaattgcttgatgaattcaaacacgccccgctgatccatcccgtgatcctcctcatcgacaatgatgatggcgcaagagagatcttcggagtggcgaagcagctaggtgttgcagacgtgagcctcgtatcacgcgccgctttttatcgcatttgcgctaatctatatctgattaagacaccagaaggtacctcccagaatcccaagacctgtatcgaggacctgttcgacagctcagtacgcaacactttactgggaggtaagtcttttgacccagacaagaaacataacgaggaaggaaaatacggcaaagcccacttcgcagaaagagtgattagacctcagtccaccgatattgacttctctaagtttgagatgctgctcgatcggatcgtagcggtcattgaggactatgccccggccaagggcatctga

SEQ ID NO: 8065 - RNA, 1749 nt, unidentified
  source 1..1749: mol_type = other RNA; note = synthetic construct
atgagtgtggtgaagagtctcaaggaggctaagagcctgactgatttggccaagatcctaaactacaagccttctggcttatccgctattttgtatcacattcccgacgccaataagtacacagagtttagcatcccaaagcagtcagggggcctcaggaccattaaagccccagttgatagattgaatctgctgcagaaaaggctcagcgatctcctgtatagctatctggacgagatcgaacctaagaagaacgggttcaagaccgtctcccatggattcataaaagaccgatctatcatcaccaatgcccaagttcacaaacggagacgctacgtccttaacattgaccttaacgagtttttctctacgatcaattttggcagagtgagaggcattttcattaaggataaacgtttcgagttccaccaggatgtggctacaatcattgcccagatcgcatgtcatgctaactctctgccccaaggctcaccctgctcaccaataattagtaacattgtcggaaggcttctggacgtacgcctgattcggctggcgcgattatataagtgcacctattccaggtatgctgacgacatcacattttcgaccaaccgcgcccagtttccctcggaactggcacatcctgaccctgccggatcacctagatgggtactcgggtttgccttgacgagtgagattacaaaccgaggattccaagttaacaacaataaaacacggatgcagttcaaggctagccgacagcttgtgactggtcttatcgtgaatgacaaggttaacattaagcaggagtactacagaaatgtgcgctctatgtgttcgctccttttcaaatcaggaaaatactaccgggttactcccgccgtgttcgcaggtggatcagcgaatgatcccccggtgaaggtggaattcgatactttaggctctctgggaggaatgctctcttacgtgtatcatgtcaagaataccatcgataggcgggcgtccgtggaaaagaaaaaagaggcaacaagcgccgcaatccgcaagctgtaccacctctttctattctacaagaacttcgtggacctgaagagtccgctgatagtaacagaggggaagaccgatgctatttatctgaaatctgccgtcgaaatgctgagcaaatttcatccacagttgggcagcctcaacggtggtaagtttgtgcacaccgtgcggtacctgaaattcacgagcaccgtgagagacgtcctgcaattagggggcggttcctctgatatcaaattctttatcgagaggtatgcgaagattctgcggaaatttaagcacgggagtttgagccatccagtgataattttgattgacaatgacgagggcgccaaagatatattttccgtagttaggggcaatactccccacaaagatataagccttgacaagactgataagttttaccgtatctactccaatctctatctggtgaagacacctgaagttggtaaggtcaagaatatgacatgcatagagtcctttttcgaagacatcgttctgaagactgtactggagactaaaaccttagacctaaacaaaaaacacctagctcccggcaaatatgggaaacaggtgttcgcagaaaaagtggtccgtccaaataaaaagtccatcaacttttcagggttcgacccactgctcgaacgcatcgtcgcagtcatcgatgattacaaaaccaacccttccagtatctga

SEQ ID NO: 8066 - RNA, 1758 nt, unidentified
  source 1..1758: mol_type = other RNA; note = synthetic construct
atgaccgtctccatagtgaaggacctaaaagcagccaaaagccttgacgacctggccctcctgcttggattttctgcatcgggcctgtcctacatactctacaagtcaaactctgccgcccgatacaccgaatttcagattcctaagaggaagggcggcactcgcactattaaagcgccggaacccaaactgaaactcctgcagaccagactcgctgaaatcctgtataattatctggacggaattgaggagaaaaagaaaccattcaaggctgtttcccatgggtttgccgaaggcaagagcatcataactaatgctgcagtccacaagcgccggaggtacgtcctgaatatcgatcttgaggatttttttccaaccattaacttcggacgcgtgcgtggcgttttcatcaaagatcggcgattcgaattcgaccccaagattgctacaatcattgcgcagattgcttgccacgatcattctttacctcagggctccccttgtagtccggtgatcagcaatatcgttggaagactcctggacgtccggttggttcggttggccaaggagcacaagtgtacctactcccggtatgccgatgatctcacctttagtacgaaccaatcaacatttcctgccgctttggctgccccagatcccgctgcagcaggcaagtggatcgtgggtaacgcccttgacgctgaaattgtgggtactggtttcaagatcaaccacggaaagacacgtatgcagtttcgcgactctaggcaaacggtgacaggtctgttggtaaacgagaaggtaaatatcgtgccagagtattaccgggctgcccgctctatgtgcagcgcctttttccaaaccggcaaatattaccacagagttcccgctgccctcgtgggagggaaagctgaagaccccatggaagatatagtctatgacacccctccagtgttggagggcatcttgagtcacatctatctcatcaaaaataccgtggatcgtaggacttccgctgaaaagaaaaaggaggagaatgtgacagccataagaaagctctaccatcatttcctgttctacaaaaacttcgtaatcagcgtcaggccgctgatagtgacagagggtaaaaccgatccaatttacctgaaagcagcaatagagcgactgccaaaattccatcccaagttgggcgcctttaaaggagggaagttccagactactgtaaggttcctgaactttacgagcactgtgagagacgtcctgcagcttggcgggggatcaggggacctgatgcactttatagagaagtatttcaagatcctctcaaagttcaagcacgcacctttagcggcaccagtgattgtcttaattgacaatgatgacggcgcggggaagattttcgggaaaatccagggactgacaaagtgccccccaattagcaccttaacaacagaacccttttactatatcaccgcaaacctatacatgattaagactcctgagatcgggaaagacaagggcatgacctgtattgagacatttttcgaagatacggttctcaagaccgtgctaggtggaaagactctgagtctaaacaaaaaacaccttgagcctgggaaatatgggaaggcaatttttgccgagaaggttatccgccccaataaagcaacaatcaaattcgatgcgtttgaaccgcttctggacagaatcacggccgtgctggatcatcatgccgctaaagcccctcccgccgcctga

SEQ ID NO: 8067 - RNA, 1743 nt, unidentified
  source 1..1743: mol_type = other RNA; note = synthetic construct
atgagcatcgtgaacaaacttaaaggcgccaaaactctcgatgagttggccgacctgctggggttcactccatccgggttttcctacatcttgtaccgtctcccaaatgctatcaaatacaaaagcttcagcataccaaaaagggggggaggtgctcgaactatcgaggcacctgatgatcgcctcaaactgctgcagcgcaggcttgcaaatgtcctctatctgtatttagacgagatcgaaaaatctgggaaagaacacacacctgttgctcacgggtttgcccggtcactgtctattattaccaatgcagcatgtcataagagaagacggtatgtactgaacctcgatttagccgagttctttcctgcaattaactttggcagagtgcgaggggttttcctaaaagacaagagatttgagtttgcccccaagatcgccacacttatagctcaaattgcatgtcataaccatgctttgccacagggctccccctgtagtcccgtgatctcaaatatcgtggcgagactgttagatgttcggctggtgagacttgccaagcagcacaagtgtacctactcgcggtatgcggatgacatcacgttttctacaaaccagaaggagtttccagtagacctggcgttgcctgacccgagtggtaagggcccctgggttgtaggccccgctttgaccgctgaaataaccggaactggcttcgtcattaatgcatccaagaccaggatgcaaattaggggatctagacagttggcaaccggtctgctagtcaacgaaaaggttaacgtgtgcccagaatactacaggaccgtgcgcagcatgtgcgccaggctgttctccactggcgaatacttcgccatggtgccagccatgatggctggtgggaaggtcggggacccggatgttcgaaccagtttcaaaacgtttcctctgatcgagggtcgcctcgggtttatttatctagtgcgcgacggactggatcggcgggatggagtggagaaaaaaaagtcgcctacagccacccgcgtattataccatcatctcttgttctacaagcattttgtggctggcgccaggccattagtcatcacagaaggaaaaacagaccgcgtgtatctacgggctgccattgagaagctcactagcttccacccccgactgggaaagattgagtctggcgccttctcaagcagcatacgttttatgaatttctcacgtatcgtccacgacgtgctccaacttgggggtgggaccggagatctgaaattcttcatgcttcattatgccgacaccctgagaaagttcaaacatgccccccttaaggcaccaatcattgtcctgatcgataatgatctgggaaccaaggacatttttggcgttatgagggagaagactgtccacaagacaatcagtacgcagactaccgcgcctttctaccgagtgcacgcaaatctctatctggtcaagactccggaaacaggaaaggataagggcatgacatgcatcgaagacctctttgagccttgcgtgctggctacgaaaatagacggcctggtgtttgatcctgacaagaaacacaaggaacccggtaaatacggcaaggccgtgttcgcggagaaagtggtccggcccaacaagtccgctattgtatttgatggcttcgaccccctcctgcagaggatctgcgatgtgattgacgactatgccacacacccgggacacatatga

SEQ ID NO: 8068 - RNA, 1761 nt, unidentified
  source 1..1761: mol_type = other RNA; note = synthetic construct
atgacctatcttaaaaaaattcgcgaggcccaaactctcaaggacatcgcccacatcctcggggtccagcccaagaccgtctcatacctgctgtatatcttgcctgacgcagaaaagtaccgcccatttgaaataccgaaacggaatggtggaaagcgcttgatcaacgcacccgaaccccggttaaaaatggtgcagagaagattggcaaacgtcctctacgagtgcattgccgaggcagagaagtgtgccccacctagacgacctctagctcatgggtttgcacgtccgcgggtaattggcaccgatgccagcaagaataagaaaaggcggtatgccctgggcatattcagcaatgccgctatccataagaataggagatacgttctaaatctggacctagaggatttttttccttctctgaatttcggcagggtacgggggttcttcattaaggataaaaggtttgagctcaatgagaaggtggcaacggtcatagcgcaaatcgcgtgtcaccgcaacgagcttccccagggctccccatgctctccaattatctcaaacctgctggggcatctcctggatgttagactgttccgtctggctcgcaaatacaagtgtacgtattcccgctacgccgatgacataacgttttctactaacaggaaagactttcccgccgctttagccaaacctatccccgaaaaggtgagctattggcaactgggaagtccgcttgtgaaacagatccagagggccggttttaaggtgaacaacgataaaactcggatgcagtggaggggctctaggcagatggccacaggattaattgtgaacaagaaggtcaacataagatccgaatattaccgcacagctcgggcaatctgcaatcgtctgttttcaaccggagagtattacattagtgatccagagaaatccctggacggactgaacaagatcgaaggtatcctgtctcatattcactatatcaaggatagggcagaccttagagagaaagaggagaaaaagaaggacccactggccattcggaagctctaccggcgcttcttgttctataagcatttcgttgctttggagaagccattgatcgtgacagaggggaaaacagaccccatttacctgagagctgctatatcgaaattgcctaaataccaccctcagctgggagaatttgtcaatggcaaattttctagcgctattcgattccttaagtatagtgataccatcgacaagattcttcgcttatcgggcgggaccggcaacctcaaggatttcattcttaagaactacaagaaggacatcaattcctttaaattccagcccctagcctatccagtgattatcctcatcgacaatgatcagggcgccagagacatcttcaacatggtgactaagagatttgaaataaagatctcccctgaaactacccaaagcttctatcacctgcacaaaaatctctacattgtgaaaacacccgaaaacgggaaaaatagtatatcatgcatcgaagatctgttcgacccagagctccgtgaaacacctattgacggtaagaccttcgacttctcaaaaaaaaacaaggcggatgataagcacggaaaaacagtgtttgcgactaaagttatccgaccccaggctgaccagatcgacttcagccgatttgagaagctgctcgatcgaattattgtagttctggacgattactacgtcaggcaaaagagcagtagcgtggattcctga

SEQ ID NO: 8069 - RNA, 1710 nt, unidentified
  source 1..1710: mol_type = other RNA; note = synthetic construct
atggaaaatcttgagcgcctgcgtgaagctactagtttaaaggacatcgctcgaatatttggggtgcaaccaaaaaccatctcattcctcatttatgtgctcccggccgagcatcgttatcataccttcgagattcctaaacagtcgggcggcatgaggacaattaatgctcccgaaccgcggctaaagatgatacagaggcgactcgcggattgtttatataaatgcacgggagagatttatggcgagccccccaaacgcctactttctcatggtttcttacgatcccgatccattttcacaaacgcctcaatacataacagtagacgctacgtacttaatctggacctggaggactttttccctagctttaattttgggcgggtacgcggttttttcatcaaggattcacggttcaaactgcaccagaaggttgccactatcattgcccagattgcctgtcaccaaaatgagcttccacagggatccccttgctctccaatcatcactaacctcataggccatatgctggatgttcgcctggttaaactcgcaagaaagtacaattgcctgtactcccgctatgcggacgacatcacttttagcacaaacctgaccaattttcctgtcgacctcgccaaacagagcgatggagatctgagcaagtggcaactgggcaaaaagttgaccaaggagattgaagattctggcttcgacataaacaagagtaagactaggatgcagtggaaatgcagcagacaaactaccacaggactgacagtgaacaagaaagttaacatccgttctgaatactatagaagagcaagggctatatgtcaccagctgttcactagtggttcttattacacgtttgacgtggagtctcagtccgaaaaccttaataaaatcgagggcatcttgtcccacatctaccacattaagcagcagagcgccgtggccttcgaacgaagtacgcagcggacttgggatgccaagacaaccggtctgtacgccatcaggaagctctaccgcagcttcctgatttacagatatttcaacgtcagcgtaaaacctgcaattgtgacagagggcgtgacagaccctatatacctgaagctggcaattaagaaaatcaaggcctatcagccccaacttggggaatttacaaacggaagattccagtacaagatgtcgttcatcaaacattcaggcaacacaggggaggtgctccaattggacggaggggtcagtaaactgaacagcctcattaagaactaccggaaggacttagatcggttcaagtacactctgctgaccaatccagtcgtcgttctgatcgacaatgataagggtgcaaaggaagtatttaacaccgtgaagaatcagtatggcctagagatctcacacaagaaagaaaaacccttctatcacctccacgctaatctgtacttggtgaaaacccccctaaccaacaatcggtcagagtcctgcatcgaggattgttttgaccaggatacccttgacatcgagttggatgggaggaagtttgatccagctaaaaaaaatgggtccgaagacacgtatggaaagaccaccttcgcgagggaggtgatcattccaaacgctgacgtcgtctcctttgaagggtttgatgaagtgttgtctaggatttctgcagtgttggatgactacagagtgcggaggcagtga

SEQ ID NO: 8070 - RNA, 1689 nt, unidentified
  source 1..1689: mol_type = other RNA; note = synthetic construct
atgtcccgcctcataaagctgcgagaagctaaatctttgtcggacctggccgttttgctgggctttaaaccgaaagccgtgtcctacattctgtataagatccccgagaacaataagtacatcgagttcgagatctctaagaaaaatggagggaaacgactcattaaggctcctaccgaaaaattaaaaaagttacagcggcgtttggccgatctcctgaatgagtgtttcaatcagatttccaaggagagcgggaagaaatcgctggctcacggctttattgagaaccattcaatcgtgagtaacgctaagaatcacaaaaacaagcgttatgtgttcaatgtcgacatccaggatttttttccctctattaactttggacgcgtcagaggctttttcattaagaacaggcacttttccctggatcccaatgtggccaccgtgatcgcccaaatcgcttgtcataataatgagcttccacagggcagtccctgctcacctatcatatctaacctcataggacatctgctggacataagaatggcgaatctaagcaagagagccaagtgtacgtacagccgctatgcagatgatctgacttttagcacaaacaggaaagattttcccgaatcaatcgcaattatgcaagacgacaataactgggttgccgggtccagacttatcaaagaaatcgataaagtcggcttctctctgaatacaaaaaagaccagcatgcagtttaagacttctcggcagatggccaccggattgattgtaaacgagaaggttaacatcaaacgcgaatactacaaaattgcaagaagtatgtgtcatgaactattcaacactggcgaattctatctgaataacaaggacgatagctcaggcgagacggacaacaatgaggataaggggaccacaataagtcagcttgaagggattctcaactttatataccagattaaacggcctcacgataccgctaaactgggtgaccgccggtttcaccctaatgcaattactaaactacacagggatttcctgttttacaagcacttccactcaatgcagatgccggtgatcgtttgcgaaggcaagacagatatcatctacttgaaatgcgccctgaaacagctggcgaagacatacaacgaattcattgagctcaatgatgacggcacggagtataagatcaacttccttaatttctccaagaaactgagggacgtgttcgcaataagtactgggacaagcggactcaagcatctcatggagattttcgagaagaatatgtgcactttcaacgtaggtggcaaaagcttcccagttgtggtgattatcgacaacgatgacggagcagaggacattaaaaagaagctgaagatcaagaactccgaggagatcaaggagttctatcacttcgtggaaaacctttacgtgctgattatcccaaaagacaagggtaaagcgatcgaagatttatttgagccagaagtgcttatgaagaaagtcgacggaaaagtgttcaataggcagaaagagctcgacgctgaaaaggagtatgggaaaatagtattcgccgaaaaggtcgtccgagagaaccaacaacatatcaactttgacggttttaaggaagtgtttgacaagttgaagaccgtcatcgacgattatcggaccaagaatgtatga

SEQ ID NO: 8071 - RNA, 1686 nt, unidentified
  source 1..1686: mol_type = other RNA; note = synthetic construct
atgtctaggctcgaaaaacttagaaagaccaaaagcttatccgatcttgctaaactgttgggctttcaacctcgtgcagtgagttacattctatacaaaatccccgaagacagaaagtacatagagttcgaaatccctaagaagaatggaggcaagcgaattattaaggcccccacagaaaagctgaaacagctgcagaaccggctggcggatctgctgaatgagtgcttcgaccagatttcaaaggagagcaacaacaagagtctctctcacggattccgcaagaaacactccatcgtgacaaatgccaagaatcataaaaacaagcgctatgtcttcaacgttgatttacaggattttttcccttccatcaatttcgggagggttcgaggatttttcatcaagaaccaccactttgggctcgaaccaaaagtggcaaccgtgatagcacaaattgcgtgccacaacaatgaattgcctcagggttcaccgtgctctcccatcatttcaaatctgataggtcatctccttgatgtccgaatggtaaacttggccaagaaagcaaagtgtacctattcgagatatgccgatgatctgacattttctaccaacaagaagaacttttcacccctcattactatcaagcaggatgagaacaactggatggccggcgaccggctggtgaaagagatcaagaaagtaggattcacccttaatactgaaaaaacgtccatgcagtttaaaaccgctcgccaaatgacaaccgggctgatcgtcaatgagaagattaacgttcgtagagagtactacaagaacgctcggagtatgtgttacgaattgtttaggactggggagttctacatcgacaagaaagacattccacttaacaacgaggaagggcacaaggaaattggcacaatcaatcaactcgaaggcatattatccttcatttatcagatcaagaggcctcatgacaaggctaagcttggcaatagacggtttcatccaaccgcaataactaaactgtatcgggatttcctcttctataagcatttctacttcatggagatgcccgtcatcctgtgcgaagggaaaacggacatcatctatctgaagtgtgccttgagacagctggccaaaagctatactgagtttgtggagatgaatgacgatgggacgtcttacaagatcaaattcctcaattcgagtcgcaattttagggatgtttttagcataagcacaggtacctccggcctgaatcacctaatggagatctacgagaagaacattagcaaatttaaggtgaagggcaaagcctatccggtgattataataattgataacgacgacggaagcaaagagatcaaaaaacgcctcaacatcaaaaatgacgaaaaaatcaaggacttctaccacttcgtcgaaaacctgtacgtgctaattattccaaaggacaaggataaggccatcgaggacctgtttgacactggcgtaaggaaaacaaaaatagacggaaaggtctttaaccgcggaaaaaagattgacgagaagaaggagtatggtaagattgtgttcgctgaaaaggtgattaaagctaatcagcagaagatcaatttcgatcgttttaaagaggtgtttgatgaggttcagaaaatcatcgaggactacaaaaaacggaatgtctga

SEQ ID NO: 8072 - RNA, 1662 nt, unidentified
  source 1..1662: mol_type = other RNA; note = synthetic construct
atgtcacaattggagaagctcagaaaaagcacttgtctgtcagaccttgccacgatactgggctacaaaccgaaatccgtcagcttcattatttacaaaatccccgaggacaagaaatacatcgagtttgaaatcccaaagaagaatggaaaaacccgaaaaatcaatgctccagttgatcagctcaagcacctccaacgccgtctcgccgatctgctgaacaactgttttaacgaaatcagtagtgaagcccagaaaaagtctctgagccatggcttcagaaagaataactctatcatcactaacgcgaacaaccacaaaaacaaaaggtacgtgtttaatgtggacctaaaggattttttcccttctatcaatttcggccgcgtaagagggtttctgattaaaaacaacgacttctcccttaatgaaaaggtggctacagttattgcccagatagcctgccacaataatgaactgccccagggcagcccatgctcacccacaatttctaacctgatcgcttacctactggatattcggatggttaacctggccaagcattcaaaatgcaactattcccgctatgcagatgacttgacgttctcaacaaatcggaaggatttcccaaatctgattgcgataaagaaagatgacaagagctgggacgccagcaagaaacttattcctgaaatagagaaggttggcttttgcattaatccggataagacgtctatgcagtttcgaacttcaaggcaggtgacaacaggtttgattgtgaacgagaaggtcaacattaagagtgaatactacaagaaagccagatccatgtgtcatgctgtctttaataccggacagttctacatcgagggagatgataccgaaaaggaaaacactatcaagcaacttgagggaatcctgagtttcatctactatgcaaaacggccacacgagcccagtaaggatgggtctaggaaatataaccctaccgctatcacaactctgtataggaaattcctcttctacaagcatttctatagcctggagaaacctttaatcttatgtgagggcaagaccgacatcatctatctcaaatgtgctttgaagcagctgagcaatacctatagcgactttgtcgatacctcgaaggacaaaattacctacaaggtgtctttcctaaatttctccaaaaacctcagggatgtgttttctatttcaaccggcacttccgggttagacttcatcatcgacaattataagaagctgagccctacctttaaggctcctcgcaaaccctacccagtggtcgtgattgtggacaacgatgacggttccaaagagatcaagaagaaactcaagataaacaatggggacgcaatcacagatttttatcacttcagtgacaatctgtacatacttattgcgcccaaaaataaaactggagcaatcgaggactttttcgacgataacattttgtccaccaaaatcggtgggaaatcctttaaccgtgagaaaaagatagatcccaattccgaatatgggaagatggtatttgccgaaaaggtagtcgcagccaatcagaagtcgataagtttcgacaagtttaaggaggtgttcgatggtatgcggaagattgttagagactgcgacgacaaaattgtgtga

SEQ ID NO: 8073 - RNA, 1695 nt, unidentified
  source 1..1695: mol_type = other RNA; note = synthetic construct
atgacaaagttggagaaattacagaaaactacaagcctgagcaaatttgcaaagctgttgaactatcaaccaaagacgatcagttatatcctatacaagattcctgaggaggacaaatacaaccagttcgagatctttaagaaaaacggggaaaagcgtaagatccaggcccccataaaaaaactgaagctcctgcagagacggctcgctaatctactgaatgaatgcttcgatgagatttgcaacaaaaataagaagaccaagtccctctcacacggctttcggaagaagcatagtataatcacaaacgccaaaaaacacaagaatcgccgatacgtatttaacgtggacctccagaacttcttccctagtataaattttggaagggtgattggcttctttatcaagaacaaccacttttcattgaagccagaagtggccacagttatcgcccaaatcgcctgccatgataatgctctgccacaaggctctccttgtagccccattatctccaaccttattggacacttactggacatcaggatggtgaatttagcgaagaagaccaagtgtacctactctagatatgcagacgatctcaccttttccacgaataaaaaggaattcccggaaaaaattgctattaagaagaacgagagcgattgggtcgcgggaagggcactgaccaaagagattgaaaaaatgggcttttcggttaatgcaaagaagacttctatgcaatacagaacctcacgccagatggcgacagggctgattgtcaataagaagatcaacgtgaaaaaggagtactataaaaaggcaagggccatgtgtcacaatctgttcaagtcagacaatttctatatcgacaaaaactctgagaaggaggggacacttaagcagcttgaggggataatctcctttatttaccaggtgaaatcccctcattatatcgagaacaaaaaacccactgccataactgcactgtaccgaaagttcctgttctacaagcactttttttctatagacaagcccctgatcgtgtgtgaaggtaagacggacattatataccttaaatgcgctctcaaacagttggagaatgagtataaagagctgatggggaagtccgacaaaggaatcaacttcaagatcaagttcttgaacatttccaagaacttcaaagaggtgctaaatgtggccgagggtacaaccggcctcttgagcctgataaacatgtacaaagatggattcaaacacttcaagggcaaaggaaaaaaatatccagtcatcattgtcctggacaatgataaagctactggcaagattaagagccgcatacaggagcagcttaagcttaataacgataaaactgccgataagaagaaacagaaacaaaagctggacactaacaagtactatcatttcgctcataatctgcacatcatgtttgccattaaagaggatggtaaagaaatcgaagatctctttgataaggaagttctcgacaccaacgtggaaggcaaaaaattcagtcggaaggataaaattgacaccaaacaggaatatagcaaaaccatttttgctgagaaggtcatcaaagccaaccagacaaagattaattttgaagggttcaaacccgttttcaataaggtaaagaacatcatcaaggaatacagtaagaagaattctcagtga

SEQ ID NO: 8074 - RNA, 1758 nt, unidentified
  source 1..1758: mol_type = other RNA; note = synthetic construct
atgtcccacctggagaatttgaaaaaaacgacaacactggctgaactagctctgttgctcgggtataagccaaaagccctctcatatatcctgtataagatccctcagattaataagtacaaggacttcacaatcccgaagaaaaatggtggagagcgccgtatacaggccccagtggacaaagtaaaacaccttcagaaacggttagccgtgttgctctctcagtgttttgacgagatctccaaaaaagcaaaccacaaacggtcgctgagtcatggatttcgcaaggaccacagcataagtaccaatgcaaataatcacacaaacaagagacacgtcttcaatatcgatttgatggatttcttcccctcaattaactttgggagggtgcggggttttttcattaaaaactcacacttcgggctgaaacccaaaatcgccacgattattgcgcagattgcgtgccataataatgagctgcctcaagggagcccctgctcccctatcatctccaacctgattgggcatctgctggacatccgaatggccaattttgcgaagaaaactaagtgcacctattctaggtacgccgacgatctgacctttagtaccaatcgaaaggaattcccggaaaagattgccagccaaaacaacggcaacgaatgggctactagcaggactttgaagaaggagattgagaaggttggtttcaaagttaacgaaaagaaaaccagccttcaatacaaaacatctagacagatcgctactggtcttgtcgtgaacaaaaaggtcaacattaagaaggagtattacaggcaaactaggtctatgtgccactctcttttccagagcaatgagtttttcctaggcaatacgtattccgctaagcctgctatttccgaaaacgcaaagatcaattcaaccagtcctgctaccaactctaagactccgctgcccaaaaatccacaggggaagattaagcaacttgaaagcatcctgtcctacatctatagcgtgaagcgcagacatgacagagataatgcaggaaaaagaaagaactaccctaacgccattacaaaactctatcgtaagttcctcttttacaagcatttcttttccctcaattgtcctctgatcatctgtgagggcaaaacagacatagtctatctgaaatgtgccctgcgacagttggctaatgaatacggagaattcattgaaaagaccggacccagttttatactaaagatcgatttcctcaacctgaccaagaatctcaaggatgtgctggcaatcagcgaaggcacaggcggacttgggtctttaatgggcatttacgagatttacatgaagcccttcaagggtgagggcaagaaacatccagtcatcatcctgattgataacgactcaggctcaaaggagataatcgagataatgaagcgcaaaaaaaagtgggacccatcgaagccattcgcttttttcactgagaacttatacgtggttcacatctcctcagaatctgggaccagtgagatggccattgaggatctctttgatgatcagacccagaataccactgtggacggaaaaaaattcaaccgcaagcccaagatagacagtgcaagcgaatatggcaagatagtatttgccgagaaagttatccgggcaaacgagaacagcatcaactttgacggctttaaaaaggtgcttaactcctttaaagccgccacgcaggattacaataaacggataacagtgtga

SEQ ID NO: 8075 - RNA, 1161 nt, unidentified
  source 1..1161: mol_type = other RNA; note = synthetic construct
atgagcaaactcgagcgtttgcgagaagccaagtccttatctgacctcgccaatctgctggggtacaagcccaaggcagtctcctacattctgtataagattccgagtgagaaaaaatacagcgcatttactatcccaaaaaaaactggaggggataggcggataaaagccccaatcgatcctcttaaagacctacagggccgcctcgcagatctactcaacacatgtttcgatgagatctgcattaagagcaaacataaacgatccctgagttatggttttagaaagggcgagtcaatcgttactaacgcaattaatcatcgcaacaagaggcacgtatttaacgtggacctgcaggatttctttccctctatcaacttcggccgcgttcgtgggtttttcattaagaacaagcacttcgagttagaccctgacgtggccacagtcattgctcaaattgcttcacacgaaaacgagttaccccagggatcaccttgtagcccagtcattagtaacctcatagggcacctgttggacatcagaatggttaatctggcaaagaaagctaagtgcacgtactctagatacgccgacgacctgacctttagcaccaaccggaatgaattccccgagatcatcgctatgccggagaaatccggtagcaatatatggcttgctggcgagactttggagaaagaaataaagaaggtggggtttaccatcaacaaaaataagaccacaatgcagtacaaggcccggagacaaatggtcacaggcctggtcgtaaacaagaaaatcaatgtgaaacgggaatactataagcacgcgaggtcaatgtgctattcgctgtttcagtctgaccagtactatattgacaagcatctgaccatcccctccgccggaacgacaatactggacgatggagctgcggataaaaagtctgaacctaccaaggagtatgaaaagatcgtgggaaatatggcccagcttgaaggtatcttgaacttcatctattacgtgaaggatatgcatgataagagggaaaagcgggagaaaagaaaaaataggagtgccatggtggagctgtaccgcaagttcctcttctataagtacttcttttccgtggagcgaccacttattgtgtgtgaaggcaaaaattga

SEQ ID NO: 8076 - RNA, 1752 nt, unidentified
  source 1..1752: mol_type = other RNA; note = synthetic construct
atgagttccttggaaaagctaaaaaaagccgtgacactcagcgacttggccgtactgttaggctacaaacccaaagctgtgtcttacattctgtacaaactttctctcgaggaaaagtataccgtatttaccataccaaagaagggaggcggagagagaaccatcaaagccccgacagagcaactgaaacgtcttcagaaacgactcgcagaccacctgggcaaatgctatgaggagatctacacgaaaggcccacataaaaaccccctgtgtcatgccttccgcaaaaagttctctatcgttacaaacgcagaaaatcatgttaaccgcaggcatgtgttcaatgccgacatcaaagactttttcccaactatacactttggtcgtgtccgcgggttttttattaagaacgtccatttcaccttggaacctaaggtggctacagtgattgcccaaattgcctgctgcggagacgaactgccccagggatcgccatgttcccccgtgattagtaacctagttgcaggccacctggacatcaggatggctaccttggccaagaaagccaagtgtacctactcccggtacgctgatgatctgaccttttccaccaaccgaaaagaatttcccgatctcattgcagtgctgaaggagggcagcgataaagagtggactgccggacctgggctcctgaaagaactgaaaagagctgattttaccattaatgagaggaaaacatccttacaaaactctactggaagacagatcgcaacagggctcgtggtcaatgataaggttaacgtcaggagagagtactataaacaggcacggagtatgtgttactccctctttctaaatggtgatttctaccggggctctcaccatgtaagcacgatcgaacagcccgttgcgagctctgatgtacaggcggaggcttccgccgaaaaacacgctaagtccgggacattgaattatctggagggtgtgttatcgtatatctactccgtgaaggcgtcacacgaccagaggaaaacctgtgccaagagatcatatccaagcgcagtcatgaagctgtaccgccagttcctgcactataaacactttttcgtgcttcagaagcctcttatcatttgcgaaggtaagacggacgtgatctatcttaaatgcgccctgcggcagttagggaagagccatcctagcctgatcaaactgaatgggaaggagttcgtgtatgaggtcagtttcttgaacatgagtaagaacctgaaggaggtgtttgcgatgtcagaggggaccccaggattggccagcataatggagaacttccacaaaaacatggcaggcttcgagggtgagggaaagaagcatcctgttatccttctggtcgataacgatagtggcgcaaaggagataaagaagaagattgatcacaagaatccggcaaagacttttcaccggtacgccgacaatctctatgtcatccttatccccaataagccgggccaagaagaaactgctatcgaacacctgttcgacgctaagacactgtctactactattgacgggaagaaatttaattcaagcgccgagctcaatcctaagactgaatatggcaagatcgtgttcgccgagaaggtgataaaggctaaccagcagaatattgacttctcaggttttgatagcattctccagcaattcgaagctgttattgtggactacaacaaacagcaaacacagtctgtcacgtcatga

SEQ ID NO: 8077 - RNA, 1710 nt, unidentified
  source 1..1710: mol_type = other RNA; note = synthetic construct
atgtcaaacctggagcggcttcaattagccacaaccctgtctgatttggcagacatcctaggatataagcctagcgcgctgagctacatcgtgtataagattccatctacaagtaagtacaccacttttgatattccgaaaaaaagcggaggcacgcgactgattaatgcacccgacgaacgtctcaaacgcctgcagaagtcgctcgcgaaactactgatgaagtgcgaaatcgagataaacgataaactcaaccacaagaacaatatatcccatggctttaagaagaagtttagcatcatcaccaacgcaattccccacaagtcaaaacggcacgtgttcaatgtcgacctgaaggatttcttcccatctataaatttcggtagggtgagaggcttctttatcaaaaacaaacactttcagctgtgtgataagattgccactatcatagcccaaattgcctgtcatgataattcgctcccgcagggatcaccatgctcccctgtcatctccaatttggtcgggcacctgctagatatcagaatggtgaacctggctaaaagagctaaggtgacctacactcgctatgccgatgacttaacgttctccacgaataaaaaagagtttccttgcttgatagcttacaaaaagagcgggagtgacagtgaatggctcccctctaaaaaactgacaaaggagatcgacaaagtgggcttcactctgaatagcgacaaaattagcatgcaatataagacatctcggcagattgctactgggcttgtcgtgaacaaaaaggtgaacgtgaagagagagtattacaaaaagacaagggccatgtgtcatagtctcttcaggaacgatgaatactacttcgaaacattggacccagctacaaagaccattgttaagagccccggaaattttaaacaattagagggctacctttccttcacataccaggtgcggtccagtaataaactcaggaaggataagcagaatcagaagaagaactttatcggcaacattaagaagttcaacggaacatcaaataccgccaagatataccgagattttctgttttacaagcattgttttgccctggaaaaacccttgataatttgcgagggcaaaaccgaccgcatctaccttcaatgtgcgctgaagaaactcgcttcagcctatcctactttaattgacactactccagcagtgtcataccttatcaccttccttaacaagaccaaaaactttctgaacgtttgcaacttggctgacgggacgtctgggctcgaaggtatcatggataggtacgagaaacagatgggttattaccacggcactgggcagaaacaccctgtgattattttggtggacgatgacaagggagcaaaggagatcaagaagaaaatcatcaagaagaatggaaaggttgaaccctatcagaaatataccgacaatctgtatgtcgtctttattcctcgcgtatcctctaaaaataccgcaatcgaggatctctttgatccaagcgttctggcaacagtgatcgacggcaagaccttcaacaaggagaacgacatcgacagagataaagagtattccaagcaggtattcgcccataaagtcgtaaaggctaatcaggactccatcaatttcgacaacttccgtggtgtttttgatctgttcctggacgtaattagtgactatgcctga

SEQ ID NO: 8078 - RNA, 1371 nt, unidentified
  source 1..1371: mol_type = other RNA; note = synthetic construct
atgactagattagaggctctgcataatgccaagagcatttacgatctttctaagttgcttggtttcaaggctaagtccatctcatatttcctctaccatagcactgaggaaaaatattataccttcgagatccccaaaaagaacggggaatttaggaaaatccaggctccaacggataagttgaagaagctgcagtctagactggcaaccctgttaagcgactgctttgaagaaatagacagaaatcagggctaccccaactccctctcacacggattccggcgtaaacactcgatcatcagtaacgccaacttgcacaagaacaaaaggtacgtgttcaacatcgatctgaaggatttttttcccaccttcaattttgggcgagtgcgcgggttcttcattaagaacaaacatttccagctgagcccaaaaatcgccacaattatcgctcaaatcgcctgtttcgataacggcctccctcagggctccccttgtagtcctatcatcaccaacctgatcgcacaccttatagatgtgcggctggtcaatcttgcgaagcatgccaaatgcacttattccaggtatgcggatgacatcacattctctaccaatagaaaggactttccaaaagaaatagcgtacaaaaccaacgccaatcaatgggtagtcggaaataaccttaatgccgagatcactaagctcggcttcaccattaatgacaaaaagacaaacatgcagtaccgaatgagtagacaggttgctaccggcctaattgttaacgagaaggtcaatgttaaacgcgaatattacaaaaaggcccgggcatgctgccagcttctctttgaaattgatgacttctacttgtccgagggcaagagcgggagtctgaaccagctggatgggatcctcaatttcatttaccaagtgaaaagaccccacgacaaggagaatatcggtccccggcgatttaaacccaatgccattactaaactgtaccgcgagttcttatcttatcgtcactttttctcaggagataagccgctgattatttgtgaaggcaagaccgatattacatatctgaaatgtgcactcaaacggctccaccctgacttcaaccaattgatcgagtttaaagacggaaaaacaaagcacaaggtgtcctttttgcgcttttcagacaggctgaaggatgtatttgctataagcgaggggacacctggactaactgccctaatggagatgtatgcagacctgctcaagcgctttaaaggtgtgggactgattcatccggtgataatagtcctggacacggactctggcaataaggaaattaggaagaaactggaggagaagacatacgaatttccatga

SEQ ID NO: 8079 - RNA, 1785 nt, unidentified
  source 1..1785: mol_type = other RNA; note = synthetic construct
atgtcagatttagagaagctgaagagctgcaagagcttgaacgatctggctgtcgttttgaaatacaaacccagcgcactagcgtatattctgtacaagcttccagattctcaaaaatacgaggaattcaccatacctaagaagtccggtggttctcgtaagatcagggccccgaaagagagactcatggcccttcagaaaagactctcagaagtgctcaacaactgctactctgaggtcattaaaaactatgggaatcctttgagccacggcttccggaaagactgttcaatcgtgacgaacgccctgctgcacaggaatagacgcttcgtgtttaatatcgacctcaaagattttttcccatccattaacttcggccgtgttagggggttctttatttacaataagcacttctcccttgagccaaaagttgccactgtaatcgcccagattgtctgttacgacaatgagctcccgcagggatctccatgttctccagttgtgagcaacctggttggccacctccttgacattaaattggtgcagctggctaaactgcataaatgcagctacagcaggtacgctgacgacatcacattttccacaaataagaaggacttccccgaagagatagcgtacatagccgctgggggagattgggaaccgggtcctaagttaaccgcaactatcaataagatggggtttgccgtgaacgagagaaaggtaagtatgcaatccaagacccgccggcaggtggtaactgggcttgtcgttaacaaaaaggtcaacgtgaagaaggagtattatcggattgctcgagcaatgtgccacagtctctttaacaacggctctttttacatctcaacaatgggcaatgataccacacagagtgggacgattgattcaaacaataactgtaccgcgaagcagttagaaggcatcctgagttacatttatatgattaagggcgtgcatgacagtcgcaccaatgtagaaaagcgaaataagcccgcaagcattatgaaagcatatcgccaattcctgttttataagcatttttaccaggccgagaagccagtcctgatatgtgagggcaagaccgaccatatttatattcggtgcgctctaaaacagcttcatcaacattaccccgcactgatcgagaaaacgacagagggatggagctggaaaatcactttcctgaaaatgtcggaaaattttagggaagtgctgtctatcgccgaaggaacgtccggactagccgcactcatggacatgtacaaaaagaacatcggaatattcaaggatggtacaggaaaaaagcaccccgtcgtcatgttaatcgacaatgataagggcgccaaggaaatcaaatcgaaactgaagaagactgaggatgggaagggctataaaccttattttaccgagaacctgtacgtgatgacactgccccagggggccaacggggaagaaatagaaatcgaggatttgttcgacaaggatctgttggagacaaaagtggctggcaaatccttcaataagaagacaaaaaccgacaccaaaaccgaatattccaaaatcatcttcgctgagaaagtgatcaagcccaagcagcacatcattaacttttccaatttcatgcctgtgctgaatcacctaaatggcatcatacttagttatcagcacctcaagggatcagctcccaccgaaaaggagactgaggccctcaacgtcctgctgccaactcagactcctcaacctcccatttacgtgcctggtgtgtga

SEQ ID NO: 8080 - RNA, 1680 nt, unidentified
  source 1..1680: mol_type = other RNA; note = synthetic construct
atggcgcgtctcctcgggtttcggcctaaagctctgtcatttttgctgtacaagctacctgacaatagcaagtataccacatttaagatccccaagaagtcaggtggagaaagagaaataaacgcacccgacccccgtttgaaagggctgcagaaacggctggctaaccttctccaaaattgttttgaggaaatttacggcagggaaagatataaccattccctatcccacgcgttccgaaaagaccacagtataatcactaacgccagggcccacaagaacaagaggtacgtgttcaatatcgatcttatcgatttcttcccttcgattaattttggtagggttcgaggctactttatcaaaaacaccgacttcggactgcatcctaatgtggcaacagtgatagcacagatcgtatgttataacaatgagctgccccagggatctcccacgagtccggtcctctcaaatctgattggccacatactggacgtccgattagtgatcctggctaaaaaaaccaagtgccagtattctagatatgccgacgacatcacattcagtacgagagagaagcagttcccgagtaccattgccacacaggatgatgccgggtgctggcatcctagctcaaagctcttgtgtatcattcgcaagtctggctttgaagtgaatcacaacaagaccaccatgcaacatcatgcttataggcaggtgacgacagggctcgtcgttaaccggaaggtaaacatcaaggcttcttactacaggcaagcacgggctatgtgctcctccttattcaagactggcgcattttacatcgggactgaggtacgtaagggtcgcagcgcaagtatttctggaaaagacctgggctcaattaatgtactgaggggcgtgttatcccatatctacaacgtgaaacgcctgaacgataaacgagatcagaaagagcggtggggcaagccaacagcaatccacaagctttatgagaagttcgtcctgttcgaaaaatttcacaacctgagaaagcctctcattttctgcgaagggaaaaccgattccgtttacttgaaatgcgccctttatagcttagcctctgagtatcccgatttgatccaagtgtctaacggggaggttaactacgccatagactttttcaagcactcgaagagcaatcaggacctgctacaattctccggtggcaccggagatagccggtacctgatcaaggattacaacaaaaagatgaagccattcctttgtaagggaaaaagatttccagtgatcattctggtcgactccgaccagggaagcaagaaagtgtttagtgctgcgaaggaggtgataggcaataatgagaacgtcactggcgacgaggacttttattacatcacacagaatctgtacctgatagcccttccaaagatcaacaatgtgtcctcagttgctattgaggacttctttgagaaaagcgttcgggaaactaaaattgatggaaaaagcttggccaagtccaatgaatctgacaaccgcaaatactatagcaagcacatctttgccgagaaagtgatcaggccaaataagggtaaaattaatttcgagcgcttcaaggggattctcgatagaattctcaaagtcattcaggattatgaaagtcgcagagaaactaaatcatga

SEQ ID NO: 8081 - RNA, 1746 nt, unidentified
  source 1..1746: mol_type = other RNA; note = synthetic construct
atgagtgtcctccaaaagctcaaggacgccaagtcactgaaggagctggcgattctcctttcttttaagcccagccgcgtttcctatctcctctacaagctcgatgccgagaaaaagtattcgaagtttcagattccaaagaaaagcgggggcattagagaaatccaggcgccagaacccaggttgaaagcactgcagaaatccctagccgacctgctgtatgagtgtaccctggagatcgagtctaacggcaaaaagcgaccatctttgtcacacggcttccggaaacatcatagcatcgtgaccaacgcccggggacacaacgggaggaggtatgtcctgaatgtggatttagagggcttcttcccatccattaattttggccgggtgagaggcttcttcatcgccgataaatccttttccctgaatgagaaagtggcaaccgtggtggctcagatagcctgtttcgagaataaacttccccagggctctccttgctcccccgtaattagtaatttgatagggcacttgctggatgtacggttggtacgcttggcaaaagcccaaaagtgttcatactcaaggtatgccgatgacatcacttttagcactaaccagaaaaacttcccacccgctatggcggttcaagatgaaaagaacccagagaaatggatcgccggcaccaccctcagcaaaacaatcgagaacgcttggttcaaagtgaatcatgccaaaaccagactgcagagtcgaacaaaacgccaaagcgtgactggtgttgtggtcaataagcatgttaatgtggaagcttcgtactataaaaacgtccgcgcaatgtgccacagcgtgtttgcaaaaggtgaataccacaagccgattgttaagtccggggacccctctaagggagcagagccttccggacctgaaatgctgaaaaacatagcacccctggaggggatgctagcccatattgactacgtcaagtttgggcgcgactcaccacggtcaacggtcgagaacgcgagtggaaagtcgaggccccctgctacaaggcgactgtacgaaaagtttctgttcttcaagcactttgtctatctagacaagcctctagtgctttgcgaaggtaaaactgataacgtctacttacacgcagccatccgacagttaaaggctcaccacagcacgtttatcggaggcagcgaccagaagcctgagatgaaaatccgtttctttaagtacagtagaactagcaatggtatcctggggctgaatggtgggtctggacacttagcaaatctgatcgcctactactctaagaatctgaaggattacaactttgcccctctccttcagcctgtgattgtgcttatcgacaacgatgacggcgctccgccaattttcaagaccattaagcagaactacaaagtgacaatagatcatagtagcgcggaccttttttaccggatctgccataatctttatctcgtcaagactcctgaaaaggctaccacatacaaatcttacattgaggaactgttcgacgacacagtattgcagaagaagctgaacggaaaaacattcactacgaagaaagactatgataaagctacccaatatggaaaggaatacttctccaagtatattgttagacccaacgaggcttcaatcaatttcaccaagtttagtccgctgctcgaccgtatagcctccgccgtgtctcattatggcgccgctgcagataaatga

SEQ ID NO: 8082 - RNA, 1770 nt, unidentified
  source 1..1770: mol_type = other RNA; note = synthetic construct
atgttcaaactccaagccctgagggatgctaagaaactggaggacgtcgccagactcgtcggtttcacaccaaagggactgagctttgtcctatacaagctgcctgactctaaaaagtataattccttcgagattgccaaacgtggaggaggcaaacgacagattaaggcccccgagcccagtctctctttgctgcagagacggctcgcaaccctgctgaccgagtgtctcgaggagttgaagaaggccgcgcctccccgaagatctctagcacacggcttcgaaaaaggacgcagcataattacaaacgcccagctgcacaaacgtcgcaggtatgtgtttaacgtggatctggctgatttctttccttcaatcaactttggaagggttcgggggtttttcatcaacgacaaaaactttagtctgcaacctccggttgctacagtgcttgcgcagatagcctgtttcgagaatcaactcccacagggttctccatgttcaccagttatcagcaatctgattggtcatgtgctcgacgggcgcttagccaggtttgcaaagactcacaaatgcacctactcgcgctatgtcgacgacattaccttctcaacgtcacggaaacattttccacccgagattgggacacctatcgctgggactgctgcctggcaggctagcaatgaacttcgatctcgcatcgaaaatgcaggctttaagatcaacgacaagaagacaaggatgcagtatcacgcctccagacaggtggcaacaggactggtggtgaacgagaaggtcaacgtgaggcaggaatatttcagagctgcacgaaatatgtgcgatgctctatttaaaaccggaagttacttccggatggtcccagctacactgaccggcggcgctgtaggtgatcccccagtaaagaatgtcataacaagccataaccagctcgggggaatgctcgcccatatttaccaagttaagaatagcaccgacttgcgcgccgatgacgtgaaaaaagcgaagcccactgccacccggagcttgtacttcaggtttctgttctacaaaaacttcgtcgcgaacaaaactcctgttatcgttcccgaggggaagacagataccgtttatctgcgggctgcaatccggtatagttcggcgtaccaccctagactcggggaattaaaatccgggaagttggagactaagattaggttcatgaatttctccaagatcgtgcacgatgtgatgcagcttgggcacggcacttccgaacaaaaatttttgatagcggattacgaacggaatcttagaggctacagacatgcccccctggctcacccggtgatcgtccttttcgataacgacgatggagccaagagtctgtttggttatgccaagaacaagcgccactctaagatcggcctggactctaccgacccattttactacttgggctacaatttgtatctggtaaagacccctgaatttgggggaggcaagaagtcctgcattgaggacctattcccctcaggcctgcttaagacgattatcgacggtaaagtgtttgaccctaacaaagaacacgaggaagctggcaaatatggcaaggtggtgtttgccaaacaggtggtgacgcccaatgccagcactatagatttctccggcttcgctccgctgctggaccgtatcgtagccgtactcgatcatcatgcaacgttaaaaaaggcaccacctgccccgttagcagcagcccttgtggcaacttcctga

SEQ ID NO: 8083 - RNA, 1575 nt, unidentified
  source 1..1575: mol_type = other RNA; note = synthetic construct
atggatgccgaccatccacgcagtggtgtacttatcgcatctcgttctactaggaagcaggagaatagtagattctggtttgcttcccacggcttccataagggacggacaatcatctccaacgcggaggtgcatcgccgcagacgcttcgtctttaacttagacctggaggatttcttcggaactatcaatttcgggagggtgagaggcttcttcatccacgacaccatgttttctttagaaccaaaagtcgccaccctcatcgcacagatcgcgtgccacgaaaatgcgcttccccagggttccccatgtagcccggtgatctccaatctaattggaaatatcctcgacagcaggctcttggccttagcaagagacgcgcactgtacttatacaaggtacgctgatgacctgacattctcgactaacgaaacactattccccacggagattgctgtgaacgtgcacggggcagattgggaggtcggcgtgaaactgcgtaaaacgatagaaggcaccggatttttcatcaatctggccaaaacccggatgagtttacggcaatcccggcagacagtgactgggctggtcgtgaacgccaaggccaacatcaatcaggattattacagagccgcccgagctatgtgcaacagcctttttcagactgggtattatttcaggcccggagacaaccccgcctcagctacagataagttgggcccactagacggtactctttcccacatacacttcgttaaggcacgccgggaccgccaccctaaagtcaataaactggccaaagccgcgggggaatttcatccccctagggccccagaggagctgtaccgaaagttcttgttttacaagtactttgcagcgccaacagctcctctgattgttacagagggcgtgagcgatataacctaccttcaatgtgcaattcgtgccctcgttaaaaagttcccgttgctggccgaggaagtcgacggcaaggccgttaggctcgtgcattttctgaaaagctcaggcaccagcagagaattgctgaatttgggccatggagctgctggacagggagccctgattagccgatatgagaacatgctcgaggattttaagcacaaacctatggcccaccctgttattatactctgcgacaatgacgacgggctgaaatcggtgattaagaacgccaagagtaagatctcaaagattgtctctacgacgaccaccgatcccttttaccacctcgggcttaatctgtacctggtaaaggtgcccgaaggcgcaccgcccgttgataaggatattgagtcactgtttgatcccgcactgctcgccacactgctcgacggtaagaaattcaaccctaaaaaggagcatgctgaccataccgaatatggcaaagtaatctttgcagaagccgtagtgagagccaacgccggcaccgtggacttctctggttttgaggggctgctgactcgaattgaagatgtgcttcggcactatgctgccttgatgaccgctgctgcaatacctgcagcagctgcaccaggagctgctgccgctccttga

SEQ ID NO: 8084 - RNA, 1770 nt, unidentified
  source 1..1770: mol_type = other RNA; note = synthetic construct
atgagcagcttggaaaaactgcagaaggccaagagtctaaccgaccttgctaagctgctcggctttactcccaagggagtgagttacgtgttgtacaaaatggatgcagccaaaaagtaccgttcattcgacattcccaaaaaatccgggggtgtccggactatccatgcacctgagccgcaactcgctttgttgcagaccaggctggcggaactgctgtatgcctgcgtgcacgagaaaaagaagacagacagacggttttggttcgcttctcacggctttcatcagggacgaacaattgttagcaacgccgaggtgcatcggagaaggcgattcgtattcaatcttgatctggagaatttctttggcaccatcaatttcggaagagtacgcggcttcttcattcacgactcaatgttttctctagaacctaaggttgcgacaatcatcgcccagattgcctgccatgataacgcactgcctcagggttcaccctgtagccccgtcatttctaatctgatcgggaacattcttgattcgcgattgcttgcactggccagggatgctagatgcacttacactcgctatgccgatgacctgacctttagcacaaacgagaaactcttccctaccgagatagccgtgaatgtgcacggggccgactgggaagtagggaaaaagctccgcaaggaaattgagaaatccggcttcttcatcaacccagctaagactagaatgtccctgcgccggtctagacagacggtcaccggccttgtcgtcaacgaaaaagccaatatcaaccaggattattacagggccgccagggccatgtgtaattccctgttccagacagggttttatttcaagccaggagacgatcctgcggacgccaccgacaacctaaatccattggagggtacactcagccacatctactttgttaaagctcgtcgtgataggaagccccgcgtgaataagttagcaagagctgccggggaattcaatcctccacgagcaccagaggacctgtaccggaagtttctcttctacaaatattttgcagcccctaaagccccgctcatcgtaactgaggggatttccgatatcacatatctccagtgtgccatccgggctctggttaagaaatttcccctactgggtaaggaggaagatggaaaggtgattagactggtgcacttcttaaagcccaccggcacctcgagggacatattgaacctgggacatggtgctgccggtcaagccagtctgatatcctcttacaccaacaacctgaagaactacgcgcataaaccaatggccaatccagttataatcctgtgcgacaacgacgacggacccaagacagtctttaaaaacgctgagaagaagggcggaaccaaaattactactacgacaatcgatcccttctactatctcggcgagaacctctacttagtgaaagtccctgaaggagcaactccacacccccgggaaatagaagagctctttcaaccggccctgcttgcgaccaaattaaatggcaagtcattcgacccgaaaaaagaccacggcgatgatacgcattatgggaaggtggcgtttgccgagagtgttgtgagggcgaatgctagcacggtggacttttctgggtttgagaagctgctcgaacgcatcgaggctgtgcttaagcactatgccgctctgttagctgctccagccgcaccagctgcagcacctgcagctcctgcagcaggcacagcaaccccctga

SEQ ID NO: 8085 - RNA, 1758 nt, unidentified
  source 1..1758: mol_type = other RNA; note = synthetic construct
atgtcccagctcgaacggctgaagcaggcgaagaacctgacagatttggccaaactgctggggttcacccccaccggagtgtcgtttatactctacaagatggatcccgccaagaaatatcggagcttcgacatcccaaaaaaatcaggcggtgtgagaacgattcatgcccccgaggcacagctggcccttcttcagtccaggctagccgacctcctgtatgcatgtgtcagaatcagaaagaaagaaaacgcgcgcttctggtgcgcttctcacgggtttcatcagggcaggaccatagtgagcaacgctgaggctcatcgcaggaagcggttcgtattcaatctggacctgatggatttcttcggcaccataaattttggtcgggtaagaggcttttttatacatgactccatgttcgggctggaaccgtccatcgccacattgattgcccagattgcctgccacgataatgccctgccccaaggcagtccttgttcacctgttatctccaacctgattggcaacattctagacgctcggttattggcccttgccagggacgctcgatgcacttacacccgctacgccgatgatttgacattctcaactaacgagaaattgttccccagcgagatcgcagtgaatgtgcacggggcagagtgggaggttagcgccaaactcaagaaggccattgaaaaaactggtttcttcatcaatcctgttaaaacccggatgagtcttagacgttctcggcagacagtcaccggactggtggtgaatgacaaggtgaatgtctcacaggactattacagggccgcacgcgccatctgcaacgctctatttcagacagggaagtaccataaacccggagacgacctcgccgacgcttctgacaatctgaatccggtggagggaatgttgagccacatctactttgttaaggccagaagggatagactgcccaaggttaacaaactggcgaccgtggctggcgaatttcgctctcctagggctccagaagagctttaccgaaagttcctgttctataagtactttgcagcccctaaggccccactcatcgtgactgagggggtttcagacataacatacctgcaatgtgccatccgtgcactcgtgcaaaagttcccgctgttagcaaaagaggaaaatggcaaagtagtgcgtctcgtccactttctgaaaagttctggaacgagtcgagatatccttaacctaggtcatggtgctgcggggcaaggcgcgttaattagccagtatgaaaacgctctcaaaaagtatccccacaagccaatgagcaacccagttattattctttgtgacaacgatgacggcctgaagtccgtcatcaaaaacgccaagagtaagattggaaagatcgtgtcgactacaactacagattccttttatcacctcggcctgaatctctaccttgtaaaagtgcctgagggagtgccccctgcagataaggatatcgagtctttgttcgatccagcattactgaccactctgttagacggaaagagctttaatccaaagaaagaacatgccgaccacaccgaatacgggaaggtggtgtttgcagaggcggttgtccgctctaacgctggcgctgtcgatttttcagggttcgaaggtctgctgacccgagtcgaggatgtcctcaaacactatgccgcgttgagcgccgctacggtagctgcacctgctgcaggagctgcatccgccgcaaattga

SEQ ID NO: 8086 - RNA, 1236 nt, unidentified
  source 1..1236: mol_type = other RNA; note = synthetic construct
atgagctcccttacccagctgcaacgagctaaggatctggcagacctcgccaaactactcggcttcacacccaaaggggttagcttcgtgctttataagatgggggagactaagaagtataggtcattcgagattcctaaaaaatccggtggctttcgaattattcatgcccctgagccccagctcgcattgctgcagcgtcgtctcgcaaagtttctctatgactgcgtacaagagaggaaaaagaaatacccaaggttttggttcgccagtcatggatttcatcaaggaagaaccatagtgtctaatgcggaagttcataagaggcggagattcgtgttcaatatcgacctggaaaactttttcggaatgatcaacttcggacgcgtgagggggttttttctgcacgactccatgttcgtcctagaacccaagatcgccaccattatagctcagatagcctgccacgagaacgtcctcccgcagggatcgccttgttcaccagtgatttctaacctgatcggtaacatcttagactcaagacttctggccctggctcgcgatgctagatgcacatacactaggtatgcggacgacctgacattttcaacaaacgaaaagtttttcccaaccgagattgccgtaaacgtccacggggccgattggcaggttgctagcaaacttaaaaagaccatcgaaaaaaccggctttttaatcaatcctgcaaagactagaatgtccctgagaagaagccgccagacggtcacaggcctggtggtgaacgataaggtaaatatcaatcaggactactaccggaccgcccgggcaatgtgtcacaacttgtttcatactgggttgtatttcaaacctggccacggtcccgcagatgcgaccgataatctgaatcctctggagggcacgttgagtcacatctacttcattaagaaacgccgcgatcgttgccagcgagtgaacaagctcgccgaaaatgcgcgcgagttttatccacccaaggccccggaagcactgtatcggaagttcctgttctacaaatacttcgccgctcccgcagccccccttctcataacagagggcgtctccgacattatctacctgcagtgtgctatccgagccctggctcaaaaatttccactacttgggaaagaggaagctggtaaggttaagtctctcgtgaggttcttacggccaagtagcacttctcgggatgtgttgtga

SEQ ID NO: 8087 - RNA, 1773 nt, unidentified
  source 1..1773: mol_type = other RNA; note = synthetic construct
atgagcagtttggagaatctaaggaaggcaaagtccctaaccgatttagccaaactgctgggattcactccaaagggggtatcctatgtgctgtataagatagatgccgccgaaaagtaccgttcatttgagattcccaagaaatctggaggcaccagggtaatccacgccccggagccacagcttgcattgctccaatctaggctggcagagatgctctatgcatgcgttcaggaacgtcagaaggtgaacaggaggttttggttcgccagtcacggcttccatcagggccggaccattatttcaaacgctgaggtgcataaacgccgacgcttcgttttcaatctggaccttgaggactttttcggcacaataaattttggccgggtgcgggggttctttatcaatgaccaaatgttttccctggagccaaaggtggctactattatcgcacagatcgcctgtcatgacaacgccctgccgcagggatcaccatgttctcccgttatcagcaatctgatcggtaatattttggacagcagattgctcgctctcgcccgcgatgcgcattgcacctatacccggtacgcagatgatctgacattctctactaatgagaaactctttcccacagaagtggctgttaatctccatggtgccgaatggcaggtaggggttaaacttaagaaggcaatcgaaaaaaccggcttttctataaaccctaccaagacgcgcatgtccttcagacgaagtcgccagaccgtgacagggctggtggtgaatgacaaggcgaatatcaatcaggactactaccgcgccgcaagagccatgtgccacagcctgtttagaaccggatgttattttaagcccggcgacgacgccgcaaatcccacagataacttaaacccccttgaaggcgctctgagccacatatacttcgtcaaatccagacgagatcggaaacctaaagtgaacaaggtcgccaaggccgcgggtgaattcaacccccctagggctcccgaaaacctgtaccgtaagtttctgttttataagtacttcgccgcccccactgcccctattattgtgactgagggaatttcggatatcacttatcttcagtgcgcgattcgggcacttggaaagaaattcccactactggctaaagagcagggcggcaaaataacaagacaggtgcacttcctgaagccctctggaacgtcccgagaaatcctgaacttaggccatggcgctgctggccaagcgagtctcgtttcttcctatacttccaacctaaaacactacactcataaaccaatggctaatcctgtgatcatcctctgtgataacgacgacggtcctaagacggtattcaaaaacgctaagaccaaggctggggtcgccatttcgaccaccaccgcggatccattttactacttgggggacaatctgtacttggtcaaagtgcctgaaaaactggccgctatccctagggagatcgaagatctcttccaaccagcactcttggggacaacgcttaacggtaagacattcgatccaaaaaaggaccacggagatgccaagcactacggaaaagtggcctttgccgagagcgtggtcagaccgaacgccggaaccgtcgacttcagcgggtttgaggacctcttaactcggattgaggacgtcctgaagcactatgctgggctgagtgcagctagcgcgatgactacactgaacacatcagccgtcgccgctggtacatcagcagcaccttga

SEQ ID NO: 8088 - RNA, 1725 nt, unidentified
  source 1..1725: mol_type = other RNA; note = synthetic construct
atgtcccggctgcagagcttgcagcaggccgaaaacctcgatgatcttgcgaagctactgggtttcagtcccactgggttaagctatgtgttataccgcataccagaggacaaaaaatacagggtctttgatgtgccaaagaaaggcggaggtgtgaggattatcaaagccccgaacgaccgtcttggcctcctgcagcttcgccttgcagagctcctcagcgactgcggagaagagatccgcaagaagaaacaaaaccactggcattctagccatggtttccgaaaaggccgaaatataattagtaacgctgatgcccatcgccgtcggcgcttcgtgttcaacctggacctcgaggattttttcggaaccataaactttggacgggtaagagggctgttcattgccgataaagctatggccctgaggcccaatatagccaccttaatcgcaaaaatcgcttgtcacgacaatgccctacctcagggctctccttgcagtcctgtcatatccaactttgtcggcaacattctggactcgcggatgcttgctttggccagagacggccggtgcacctatactcggtacgccgacgaccttacgttctctacaaacgagaagatctttcccaaggagatcgcagttaacctgtttggcgcagactggggaatcggggaaaggctgagaaaggaagtggagggcgccgggtttcagatcaaccacgggaagacccgcatgttcttgcgccaatcaaggcagactgtgactggcctggtagtaaatgcgaagaccaacattaatcaggattattaccgtaccgttagagctatgtgtcactctgtgtttaagtcagggacatatcatcgagagacacctgccggagcaaaaacaaccacgaacttagcccccctggaaggcatgctgtcccacatttacttcgtgaaggcaaggcgggacaggacatacaagaataactcggccgctagggacgctggagaattccgaccacccgaggctcccgtgcgtctatacgataagtttctcttctacagacggtttgtcgccttgcctgcccctctgatcgttcctgagggcaaaacagataatgtctacgtgcattccgcaattagaaatctcgtatctagtttcccaaggttgggcacgatgtctgggactaagttcgaatgcctggttgacttcctgaaaccaacacctatcactaaagacgtcatgaatatcggacatggggcctccggtcagaacgcgctgattagcaaatatgcgaagcaagtgaaaagatatccgcacaagcccctcgatcaccctgtgattatcctgtgtgataatgacgacgggcccagagcggttttctcatccgccggtagactggcagggaagacaattactaagcagaccaccgatccattttactatctcggcgataatttgtatctcgtcaaagtgccagaaggaactccggctaccgaccgagatatggaggatctgtttgatccggtgttgcttgcacaaaaagtcggaggtaaaccatttgacaagaagaaggagcacggtgacggcaccgcttacggaaaggaaattttcgctaatcagatcgttagaccaaattggcagacagtgaattttgagaacttccgcgagctgctggaaaggatcgaccaatgtatcacggattattcaagccggaagcccgcagggagcccctga

SEQ ID NO: 8089 - RNA, 1734 nt, unidentified
  source 1..1734: mol_type = other RNA; note = synthetic construct
atgaaaaggctgaaagccgctaagtcccttgatgacctggcactgatgctgggatttacgccgaagggactggcatacattttgtatgtaatggccgatgctgccaaatacagtacgttcgaaatccccaaaaaaaccggcggtagccgtacgatcagtgcacctattccccatctgaaactcctgcagggcagactggccgatctgttgacaaagtgcgtgactgagataagcaaggaaaagaagaattattggagggcctcacatggcttccaaccaggcaagactgtggtgtctaacgctgaggtgcacaagctgagacggttcgtgtttaatctggacctaagcgattttttcgggaccatcaactttggtagggttcgaggattcttcatccgggacaagacatttgagctggatccagctgttgccacggttattgcacaaatcgcgtgccatgataacgctcttccacagggctcgccttgctccccggtcataagcaacttgatcggtaatattctagacgtcagattattggccctagccagagattgcgggtgtacatataccagatatgccgacgatatgactttctctacaaacgaagtccttttcccaacagagatagcagttaatattttgggggcagaatggaccatcggaaagcgcctcgacggggaaattaagcgagcgggctttgccgttaaccccgccaaaaccaggatgagtctacgccgttcccggcaaaccgtgaccggcttagtggtcaatgccaaagccaacattaacatagactattaccgcacagccaggtccatgtgtcacagcctcttcaaaacaggtcagtatttcagacgggatggcgaacaaatcgaaagtctcgggccactcgagggcatcctgtctcacatatactttgtcaagacaaggcgtgacaggggagcgcggatcaacaaacttgctaaggaggctaatgagttccggcctcctgaagccgctgtagcactctacagaaaattccttgcctacaaatactttgtcaaccctgcagcccccgtgattgtgaccgagggcatctcagatatcacttatattaagtgcgccatcagaagcctggggaaagattttcccctgcttgaggagtccaaggacggaacatctaaacgactcgtgaatttcctgcgctcaactcccaccaccagggacgtgttaaatctcgggaatggcactgccggtcaggctagccttgtgtctcagtacgctaagacggtcgctgcctttccttcacgcccgatgaagcaccctgtgatcatcctgtgtgataatgacgacggacccaaaaatgtgtttaagaacgcgaaaactaaggcacacgtggaaatatcccataccacaacagagcagttttattacttgggggaaaacctctacctggtcaaggtacctgagggcgtcccacccgagatgcgagagattgaaaaactgtttactgctgaactgttggcgacccagattgacggtaagtctttcgatatgaagaaagaccatggaaacgaaaatgcatacggaaaggtggtatttgcagagaagatcgttcgcttacagtggaagaccactgacttctcagggttcgctccactgctgagtcggctcgaggcctgtattacccactatcaggcgctcacatccgcccaggtggagactgaggctgttgccgcaaccgctgcatga

SEQ ID NO: 8090 - RNA, 1752 nt, unidentified
  source 1..1752: mol_type = other RNA; note = synthetic construct
atggacactctggagcgcctacaaggcgccaagaacctcacagatttcgccaagctgctcggcttcactccaaaaggaatgagctacgtgctgtatcaactcccgaacgacacgaaatatagaacttttgagatccctaagaaggcaggtgggaccaggaccataagggcccctgaacatcgactcgccctgctccagacacggttaggcgagatgctggatgaatgcgtgggcgagctgaagcagcgcaacaggaaattttggagagctagtcatggtttccagaaaggaagaaccattgtgagcaatgctgaagtacacagaagaaggcgcttcgttttcaatgtagatttggaagacttctttgggactatcaatttcgggagagtgcgggggtttttcatcaacgacaagtctttttcgttacacccaagcatcgccacgctcattgctcagatcgcgtgccacgaaaacgtgttgccccagggaagcccttgctcccctgtgatctccaatctcataggaaatattctcgacgctaggctgctagctcttgcacgggacgagcattgtacctacacaaggtacgcagatgatctgacattctcatctaacgagggtttatttccaacccgtattgcagtaaacgtgcacggcgccgaatggaaagtgggtaggaaacttcggcaggagatcgagggtgctggcttcaaactgaatgaaacgaagacccggatgagcctgcggtgtagccgtcagactgtgaccggattggtcgtcaacgcgaaacctaacattaagcaggattattacagaggcgtgcgcagtatgtgccattccctgttccgcaacggagagtatcaccggcgggttgctgagcgcgaagacacaaccaatgcgttgaccccattggaggggatgctttcccacatttactttgtgaaagcccgacgggatcgagcctacaaggtcaacaaactcgccatcgaggcagccgaattcagacctcccagggcgccagttgagctttaccgaaagtttcttaagtataagcactttgtggcccccccagcacctctgattgtcactgaaggaatatcagacataacctacttggagtgcgccatccgcgcccttgctgcatcatttccggtcctggcaaaaaatgatggcggcaaaatcgtgcgccttgtgaattttctaagaccctccggcactgccagggatatactgaatctgggccatggagcgtctgggcaggctgctctgattgggcaatatcgaaatatgctgaaggagtaccgtcacatgcccatggtccatcccgtgattgtgctgtgtgataacgatgacggcccaaaggaggtttttaagagtgcagccaagcgctccggactcacgatcagtacaacaacaactcgtcccttctatcatctcggggacaatctgtatctggtgaaggttcctgagggcgccttaccacagtctaaggaaattgaagaactgtttcagcccgccctactggccacaaaagttgataacaaaccatttgacccgaagaaagaccacggtgacgaggccgcatacgggaaagtcatcttcgctgagaaggtcgtaagaccccactgggcttccatcgacttcagcaacttcacagagttattgtctaggatcgaacaatgtctgacccattacgccgcggtcaagagtgctaccactgccgcacctgctgcagccgcttcttcaccctga

SEQ ID NO: 8091 - RNA, 1773 nt, unidentified
  source 1..1773: mol_type = other RNA; note = synthetic construct
atgacgggaattgatctgttaaagcaggcaaaatcgctcaccgatattgccaagctggtgggattcactcccgctggcctgagttatattctgtacaggatgcctgagtctgccaagtaccgggcttttgagatccccaagaggtctgggggtacaagaactatcaaagcccccatgagagagttggctcttctgcagagccggttgaataccttcctcggccagtgcgcagaagagctggcaagagacaacccgaggttctgggccgctgctcatgggtttagaaaagggcgcaccattgtaaccaatgccaatgcccacagatctagaaggtatgttttcaacgtagacatcgctaacttctttgacagcataaacttcggtagagttcgaggtgtgttcataaaggacagggcatttaatctagagccaacagtggccaccatcatcgcgcaaatcgcctgttttgagaacgccctaccgcaaggaagcccttgctcccccatcattagcaactttgtcgcagggatactggacgcccggcttctccgtctggccaaacacgccagatgtacatacacaaggtatgcagatgacctgaccttctccacaaacgagcggctgttcccaaccgaaatcgctagggagcttgctggtccagattggtgcgttggccctcgcctgtctgaagtggtcgaagctagcggctttcaactcaatcccggtaaaacgcgcatgagcctgcgacggtcacgccaaacagttaccggccttgtcgtaaacgaaaagcctaacatcaaacagaagtattacagggatactagatccatgtgctctagcctgttctcatctgggaagtggcaccacggtaccggagttgacgaacaacagacttccaatctgcgtccactggagggccgcctggcacatatatattacgtgaaagcccgccatgatcggtcccagaagcagaataagcacgcggaatacgtccccccgacagctcctgtggaactctataggaagttcctattctacaaacatttcgtggcaaatgacttgcccactgtggtgaccgagggcgtgtcagacatcacctacttgaagtgtgccattcgaagtctgtctgcaaagttcccatccctcatcgggatgtcacgcgggaaactcaaggtcgatttacagtttctcaaccctactgggactagccggtcagtactgaatcttggacatggcgcctccgggcaggcctcattaatacagcagtacagtaaccgacttaagaactataaaaaccgtccccttgcgatgccggtcatcattctctgcgacaatgacgatggccccaaggaagtcttcaagaatgcctccggaaaaacaggaaagaccattagcaaaagtacgacagaccctttttattacttgggagacaatctctacctggtgaaagttcccgagaacggcacacagtcgcgcgatatggaagatatgttcccagcctccgtgctagatgagttactggaaaataagccatttaacaagaagaaagagcacggagacggcactgcttatggcaaggtcatttttgcggagaaagtggtgcggccaaaaacgggcaccagcatctttaatgactttgaggatctgttgactcgaatcatcgcgtgtattgctcactacgcagccattcgggccaccaaagccgctgctagtagtcctgcccctgctttgtcagtgcctactgcagcagcggtggcagccccaacaacgtga

SEQ ID NO: 8092 - RNA, 1770 nt, unidentified
  source 1..1770: mol_type = other RNA; note = synthetic construct
atgagtaagctcgaacgcctcaagaaaacaaaaaacctgtctgatctcgcaaagttactcggttttaccccaaagggcttgtcctacgtgatttaccagataccagatacaaagaagtataaggttttcgacattcccaagaagacaggtggaatcaggaccatcaaggctccggtggaccagctgtctctgcttcaatcgagattggccgaactcttgacagagtgtgtcgaagagctgattaaggacaacccacgctactggaccgccagccatggttttagaaaatccagaaccatagtttccaacgccgatgctcacagaaagcggcgatatgtgtttaacgtggatctggctgactttttcggaaccatcaatttcgggcgggtacgtgggtatttcataaaggacaactcatttggtctggaccctgcagtggcaactgttattgcccagatcgcatgtcacgagaacgcactgccccagggcagtagttgtagtcctgtgattagcaacctcgtggctaatatcttggacgcacggctactgaggctggctaaggctgccggatgtactttcactcggtacgctgatgacttgaccttctctacaaataaaagcattttcccttccgaaattgccaaagaactcgcaggggccaattgggaggtcggcaagcagctgcaggacctgattgaaaggtctggatacactctgaacatagcgaaaacccgcatgagtttgcgtcagagcagacaaaccgtcactggcttggtggtcaatgagaaaccgaatatttctaaagactactaccggtgcgtacgggctatgtgccattcggtctttaccacagggtcttggtatagacccgtccaagctgcgggagccgttcctgtcccaactgcatctctaaggcccgtcgaggggatgctctcccacatctatttcgttaaggccaggcgagatcgttcccagaggatgaacaaagacgctggttttataacgcccaaaacgtcaacgcgcctttataaggagttcctgttctataagcacttcgtggccagcccttccccaatgatcgtgacagagggcatcagcgacatcacctatataaagtgcgctatccgagccttagccgccaaatttccgctgttagccagtgttaaaggcggaaacgtgacccctgaggtggccttccttaatccaacggggacatccagatccgtgcttaatcttgggcacggagccagcgggcagggaaacttagtagatcaatacgcatcatcactaaagtgctaccgccatctgcctctcacatctcctgttattatcctctgtgataacgatgatggcccaaaagaagtgtttagcaaggcacagaaaaagagtggagtgcccattagcctgactactacaagctcattctaccatctgggccagaatctgtacctggtgaaggtgccagagggcgttccctcagccaaaagggatatcgaggacctgttccccgccgctcttcttgggcagctcgtagacggaaagccctttgataagaaaaaggcccacggcgatcatactgcttatggcaaagtgatcttcgctgaaaaagtggtccgacccaatgccgccaaaatcgactttaccgcgtttgaagagctgctggaacgcatcgagggctgcattaaacactacgctgccatcgtagcggcaaaagctctagccgcgacagcatcagcccctgcagcaaagacctccgcgaccggtccatga

SEQ ID NO: 8093 - RNA, 1755 nt, unidentified
  source 1..1755: mol_type = other RNA; note = synthetic construct
atgtctgaacttaataagctgaaggcagctaagaatctgagcgacgtggctcagttgttgggattctcccccaaaggcctggcctatgtgctgtataaacagaaaccagagcagaaatacaaacacttcgagatacccaaaaaaacgggtggcacccgaagcatctgcgctccgacatctcagctggcacttctgcaggaacggctcggtgagcacctataccaatctgtgctcgagttgaagaaaaaggagccgtacctgtgggctgcaagccacggatttcacaaggggaggacgatcgtgtcaaatgctcaagtgcatcggagaaggcgatttgtgttcaatgttgacattgaggatttctttggtgccatcaattttggacgcgtgagaggatatttcatcaaggatcgcgcgttcgagcttgacccgaaggtcgccacaattattgcccagatcgcttgccatgaaaacgcattacctcagggctccccatgcagcccaattatttccaatctgatcgggaacatactcgatttgcggctgattgccctcgcaaagaatgcaaaatgtacttacaccaggtatgccgacgatcttactttttcgactaacctgaaacggttcccctccaagattgctatctcagttgaacaaggcaaatgggtagccggcgatcggttggtgacagaaatagggcgcgcaggatttaacctgaatagcgtgaaaacacgtatgtcgcatcgacagagtaggcagaccgtaaccggtttaatcgtaaataagaaggttaacatccggcaggaatactacagaactgtcagagtgatgtgtaactccgtgttccagaccggcgtctattaccgacctatcaaggacgaggagacagagcctatctttctgaacaatctgaatcccctggagggcatgctgtctcatatttatttcgtgaaagcacgtcgcgatagacaaccaggcgtcaataagcttgctaagtttgccaacgagctggtggttcccgaggcccctacccaattgtaccgtaagtttctatgttacaagcactttgttgcccttgcgtccccactcatagtgaccgagggcgttagtgacatcacgtacctaaagtgcgcgatcaagtctctgtctaaccagttccccaacctcgtcgaaaacaacaatggaatgcgccaggtcgcaatcaagttcctcaagcctactgggataagccgggatatactgaatttagcgcacggcgccactgggcaggctagtcttattagtaactacgcaaaccagctaaagaaatatacacataagcccatagatcatcctgtgatcattctctgtgataatgacgacgggcccaaaacagtctttaagaatgccaggtcaaagaccggtaaagatgtgagcaaaacgacaattgacagtttctatcacctcgttgaaaacctgtatctcgtcaaagtaccagagggagatccacctggaatcagagagctcgaagatctgtttcctaacgaatggttcgacgtaaaaatcaacggcaaaccattcaaccgcaagaaggaccacggggacaccacagcctatggaaaggtcatttttgccgagagcgtcgtgaggcctaacacccacaaaattgacttcgccggcttcgtgcccttgctgtcaagaattgaagggtgcatcgcccattacaagtcaaggaaactggctgaaatgactaccactgctgcctccgggttatga

SEQ ID NO: 8094 - RNA, 1743 nt, unidentified
  source 1..1743: mol_type = other RNA; note = synthetic construct
atgagcacactggaaaggctgaagaatgctaaggacctgtccggcctagccacaatcctgggcttcacacccaagggggtgtcctatgtcctgtacaaactcaaacctgacgagaagtacagaaccttcaaaattcccaagaagactggcggcgagcgcacaattcaggcgccagagcctcggcttgctcttatgcagaaaagattggctgagcacctgtacgaatgcgtggcagaaattcaacatgagtacccccactactggcgcgccagtcacggattccagaagcggaagactatcgtaggaaacgccgccgttcacacccgcaggcgatatgtgtttaatgtggacatagaagacttcttcggctctattaattttggacgggtccggggcttctttatctctgacaaaacattcgcgcttgaaccggccgtggcaaccgttatagcccagatagcctgccatgagaatgctttgccgcagggttcaccctgtagtccgatcattagcaaccatatcggaaacatcctggatctaaggcttttagctctggctcgggatgctcactgcacctatacgcgctacgccgatgaccttacctttagcactaacctgaaagagtttcccgatgagatcgccgttgatcctgggactgggaggtgggaggaagggcatcggctgaggaaggtgatagaggattcgggcttcaggctgaatccaatcaaaacgagaatgaccttgcgtcagtcccgccagtctgtcaccggcctggtcgtaaacgctaagcccaatattgaccaagactactatagacgagtacgtgccatgtgcaactcactctttggaactggacaatatcacagggtggtgggaggtaaggatgaagtgacaagcaacctaaacccactcgagggcatgctgtcatacgtgtatttcgtcaaggcaagaagggaccgaagcctgcgggtgaataagaggagcaaaaacgaaggcgagtttaatccacctagagcaccaatagagctgtaccggaagtttctcttctacaaacacttcgtatcgcctccactgcctttgattgttacggaaggtgtcagtgacatcgtctacattgagtgcgcaattagagctcttgcaaagtcctttccacgactcgccaaagaagaagacggcaaaatcaagagacaagtgaacttcctccgcccctccgacaccacacgagatgtcctgaccttaggtcacggagccagcgggcaggccaatttaattgggcagtataccagctccctcaagaagtatgcccaccagcccatggctcatccggtcatagtgctgtgtgacaacgatgatgggcctaaaaaggtgtttaaaaatgccaaggacaagtgtgatatggcgatttccactagtactatcgaccctttctactatctcggtgacaacttgtatctcgtgaaagttcctgaaggtgcagccgcccatccccgcgaaatcgaagagctgttcaaacctgagatcctggcttacaaaatcggcggaaagccatttgatagaaaaaaggagcacggggatgagacagcctatggcaaggtgaagtttgccgaagaggtagttaaacccaatgcgagtactatcgatttttctgatttctctgagctcttgtcacgtattgaccagtgtttagcgcattacgggaccgtggttgcagcttctccagtggcagcagctgcagcctcatga

SEQ ID NO: 8095 - RNA, 1707 nt, unidentified
  source 1..1707: mol_type = other RNA; note = synthetic construct
atgtcatatctggatcgcctaaaatccgccaagaatcttagtgatatcgctaggctgctcgggtttacgcccaaagggctctcctacgtgctgtacaagacaggagacacctcgaattaccgggaattttttataccgaaaaagaccggcggcacacgcaaaatcttagcccctgaacggcgcctggcgttactgcagtccagactcggggatcttctttatggctgtgtggaggaacttaagcgtaaggatccttatttttggcacagctcgaacggcttccagaagggtaggtctaccatcagcaatgccaaggcgcacagcaggaggcggtacgtgttcaatgttgacctcgaggacttttttggcacaatcaatttcggtagagtgagaggattcttcattcatgacaggaacttcaggattgagcctccagccgccactattatcgctcagatcgcatgtcataagaactccctgccacagggctcaccttgcagccctgtgatctctaacatgatcggaaacatcttggacgtccggttgttagctctggcacggaatacacactgtacttatacccgctacgcagacgatctcaccttttcaacaaatgaacgggtcttccctaacgagatcgctgtgacgctagagggtaaagggtgggaactgggcaacaaattgcgagaagagatagagcgagccggctttcgagtgaacgacaagaaaaccagaatgtccctgcgggattcacgtcaaacagtgaccgggcttgtcgtaaacgctaagccaaacattaatcaggattattatcgttctgctagggcgatgtgcaatgctttgtttcaaaccggtaagtatcatggagcagacaaacaggagacagcaaacttgaatagtctggagggtatgctctcctacatctatcatgtgaagattagaagagatcgcactcacaggattaataagcttgctagacaagctaatgaattcagggccccctctgcccctattgaactctatagacggttcctcttctataagtactttatcgccagctcactgcccactattgtgacagagggggtcagtgacatcacctacattcgctgcgcgattcagtcactaactccaagtttccccctgctggccgagaaagtggataaaaaaatacgcctgagtgtccgattcctgaagccgtctggcaccactcgtgatgtgctcaacctgggacatggcacgagtggacaggtcaaacttatctccgagtacaagaacaatttgaaccattacaaacacaagcccatggcacatccagttatcattctgtgtgacaatgacaaaggagcctccaacatctttaaggaggccgccagaaagtctggtacagctatacacttggaatctgaggagaatttttaccacatcagcaacaacctgtacctgatcaaagtacccgaaggggaaccaccagccgaaagagcaatagaagatctgtttatgcccgagctcctagcccaaaccctcgacggcaaacccttcgacaggaagaaggagcacggggacaaagcagcgttcggaaaggtaatgtttgctgagtacgttgttcgcccgaaccggactagcattaatttcagcaagttcagccagttactgagccgaatagaggcatgcattaaacacgattccgcccagcgcacttcttga

SEQ ID NO: 8096 - RNA, 1635 nt, unidentified
  source 1..1635: mol_type = other RNA; note = synthetic construct
atgaaaactataactaggcttaagggagccgataagcttgatgaactggcgaaactgttgagctttaccccccggggtctgagtttcgtcgtgtacaagattgatacaatgaacaagtacagagttttcgaaatagcgaaaaaatccggcggaacaagaacgatccacgcccccgagaagcaactcgcccttctgcaaaccaggctggcgaacctactttattcttgtgtggcggagctgcagcaggaaaagccgaaactgtggcacgccagccatggcttccagaaacagaagaccacaatctctaacgcaaatccacatcgacggcgcaggttcgtgtttaacctcgacctcgaggacttttttggctcaatcaattttggccgggttcgtggatttttcatcaacgacaagaacttcaaacttaatccaaagatcgccactatcattgcccaaatcgcctgccatcgcaacgctctccctcaaggctcaccgtgctcccccgtcatttcgaacctgattggtaatattctcgacttacgactgatcgctctggcccgcgaaacgaaatgtacttatactcgttatgcagatgatctaaccttttccactaatgaaatgctgtttccaaccgagattgcaactaaccctcagggctccacatgggaagtgggcattaagctgcacaaggaaatcgagcagaccgggttcaagattaacccccgcaaaacacgtatgtccttgcgacggtcgaggcagacagtgaccggtttggtggtcaactcaaaagtgaacattaagaaggactactacaggtctgctagagcaatgtgcaatgccgttttcagtaccggcgaatatcatatcatcgacaaggacaagaatataagtgacctccgcagcctggagggtatcctgtcacatatatttttcgtgaaagcccggcgggacagagctccaaagaccaataagatggcaatcgaggccaatgagttcaagcttccgtccgctcccgtagagctgtacaggaagtttctgttctacagattatttgtcgcccctaaggctcctctcgttgtaacagaggggataagcgatatcacatatattcagtgtgcaatcagagcattggcaaaaagcttcccagctctcgctctcgaaaaagatggcaagcacaccagactactcagcttcctgaaccccagcggaactaccagggacgtgttaaatctgggtcatggggcctctggacaggcatccttgatcatgcagtactttggcaatctgaaaaagtacaagcacaaacccttggatcacccagtgattattctgtgcgataatgatgacggacctaaaacggtattcaaaaacgctaaatccaagtcaggattaacgatctctaccagtacaacagaccagttttatcacctaggcgaaaacctgtatattgtgaaggtccccgaggggaatcctgccaccatcaaggagattgagaaccttttcgacagtaagctcctgacagagaaattggatgggaaaagcttcgaccctaagaaggagcacggagatccaacttcttacgggaaagtggtttttgctgagaaaatagtccgccctaatgccggggaagggtga

SEQ ID NO: 8097 - RNA, 1689 nt, unidentified
  source 1..1689: mol_type = other RNA; note = synthetic construct
atgtccagatttcagctgctgaaagacgctaccaccatcaatgatatcgctagccttctaaactataaagccaagacactttcctacatcttatacgtgttatctaaacaggatgactattacacgagttttgaagtacccaaaaagaatggcggagtccgcttgatccaagcacccaataaaaaacttaagcaggtccagaccaacctgtctggcttgttgaatgagtgcgtgaatgaaatcatcgaaaaggagcccaaatatttctatgcatcacatggatttctcgctgacaagaccataattacaaacgccaataagcataagaagaaacggtacgtgtttaacgtggacattgaaaacttttttgggtccatcaactttgggcgcgtgatgggattttttatgaatgatcgccactttcggcttgataagaaagttgccacaataatcgcacagatcgcctgtcacgagaatgcgctgccgcaaggttccccatgtagcccaataatctcaaacctcatcgggaatatcattgatatacgactcatcaccctagctaaaaagcataagtgcacgtacacacgttatgcggatgacattactttctctacgaatgtgaaacaattccctacttccatcgccaaaaagagagacgagacttgggaggtaggcactaagctcagcagggaaattcagaagctgggcttcaacattaacgaaaaaaagacacgaatgagcttcaataacagtcagcagatggttacggggatcgtcgtgaataaaaagattaatttcagccaggcctattatagggagctgcggtcacaatgtcacaacctgttcaaaaacggatcatatcatgtcaacaatgaggtatgcagcaatctcaacaaactgcagggtaagctcgcttacctgtacttcatccagaataacaagaagaacatcaagatagacaagaatgaggaggccaactttgggagtggcctcaataagctgtacagaaaattcctcttctacaaatacttcgtggcctcggagaagcctgtgattgtcacagaaggagctaccgacattgggcacctgaagctggcaattgatgccctggatgagaaagacatgaatctgaagttctttaatcctagtaagaccgggattaaactgctgaatctgggcgaaggtacaggcggccagaacaaacttatattcaattacaggtccatgatgaacaaactgggcaaaaacatgccagcgccctttagcccggttatcctactctgtgacaacgacgaaggcgcctctgacattttcaagactatcaacaacaagaagaacaagttttcctgtgagatttctctgtccactactgatcctttctataagctctgccacaatttatacttgatcaaggtgccagagtcaaagggagcagagacaagcattgaggatctgtatgaagaaaccgttttggataccaagttgggtgagaaaacattcaacaaaaccaacaagaagcttggggataacgagtatggtaaacagtactttctggactacgtggtcaggaagaataaaaatagcattgacttctctggattcactccccttttagacagaattaagttgtgcataagcaattgggaatctcaagaaaaatcctcacataacagtaccaactcgcactga

SEQ ID NO: 8098 - RNA, 1713 nt, unidentified
  source 1..1713: mol_type = other RNA; note = synthetic construct
atgagcacactccaaaagctgaagaacgcaagaacgcgaagcgatttggctaagatattaggcgtaacaccatctgggctgacctatgcgctgttcgtgatcccccaggaagcaaaatatcacaaattccaaatccctaaacgatctggaggccatagggagatctcagctcccaattctcatatcaagctagtgcagagacgactcgccagcaagctctacgagtgtaccaaggaaattgaaaacgcccagcctaatcggaagaaagtgacacatggatttcagccaggccgcagcattatcaccaacgccgacagacacaagaaccgtcggtacgtgtttaatgtcgacgtgaaggatttctttgacagtattaatttcggccgcgtgcgcggcttttttaataaggaccgtgagtttctgttggataaggagatctgtaccgctatcgctcagattgcctgctgggagaattctttaccccaggggtcgccttgcagccctgtcatcagcaacctcatcggccacatcctcgatgtcaaaatgttgaaactagcgaaggagtccaaatgtcgctatacgcggtacgccgacgacatgacgtttagcacaaacgaacgcgaatttccctcatctatcgctatccgggatgcacaagacccaggtaaatggtccgtgagcactaaactggaaggactgattaaacaggctgggtttgaaataaatccacagaaaactcggatgcaaattgtcggctcaaggcagctagcaactggacttgttgtgaacaagaaggtaaacatcaaggaagaatactgccggcagactagagctatgtgcaatcacctcttcaaaaaggacgcatactttctgcagaacaccaaagaaggggaggcacctaagttgattaagaatctggacatcttggagggaaaattatgccacattcatgccgtaaagaccagggttgacctgacagaccagcagaaaaagtcaaggaagtttgatccgcctccgggtaccctgaggttgtataaaaagttcctcttctacaagaacttcttcgcgcaagagcgccccctgataatcacagaaggtgcctccgatattatctacctcagaaccgccattaggcactccaaaaagaagttcccactgctgtttgataaaactcttcagatcaggttcctgaaaaactccaagacagtgaaagaggttttaggcctgggagatggatgtggtggcattggtaaactggttgccacctatgccaaggagataagcgcttttggcagacccagtgccttccctattatcatccttatagacaacgatgacgggagtaagaagagtatattcaaggttgccaaggatgccgcaaaagcgactcttaagaaggacattgaaataagtatcgagtccaacgactgttggcaccatcttggggataatctctacctggtgaaagtgccacatggggggtcaaaatctcccaagagtatcgaggagctgttcccagagaagtggctgaaattttctgtggatggcaagattttcgacccctcgaaaaagcacggcgatcacacctcactgggaaaagtcgctttcgctaagaaagtcgtcgagactcatgccggtgagatagacttcggcggattcgactccctcttttcccttattgaaggggcaattgccgattatagaaaaaattga

SEQ ID NO: 8099 - RNA, 1572 nt, unidentified
  source 1..1572: mol_type = other RNA; note = synthetic construct
atgggactggtgcaaaggcgcctcgctacacgcctgtatgagtgcgtgcttgagatagaggagaaacaaccaaataggaggcgagtaacacatggctttcaaaaggggcgtagcattattactaacgctgaccgccatcactcccggcggtacgtgtttaatatcgatattcaggacttcttccagagtatcaacttcgggcgcgtacgaggattcttccagaaggattcaaccttcgcattgaatgatgaggtggcaactactattgcgcagattgcctgctggcagaacggactcccgcagggatctccttgtagtccagtgatcgcaaacttggtcggacatatcctggacgtgaaactgctcaagctggccaagcaggctaggtgtaggtatacgcgatacgccgacgatatcagtttctcgacttccgagagaaatttcccttccttaattgctgctcgcgctgacggcaagcccgcagtatgggaaccctcagagaaccttgcctctgcaattagacaagccggtttcgccataaaccctgccaaaacccgcatgcagataagaggcagccggcagatggccaccggtctgatggtgaatgaaaaggtcaatattcgtcctgagtactataacgagacaagagcaatgtgccatcggctgtttaccacggggagatatgagatcccaaggtggcctgataggcaagagactgaccagcttggagcattggaaggcaggctgtctcacatctttgcggtgaaggcaagattggatctctcttccaaacggcgtaaagaaagacacgtgaaagtcccgagcggcacaatcgaattatgtcgtcggttcctgttctacaagaacttcgtcgttaatccactacccgtgataatcacagaaggtccatccgatgttatctacctgagagccgctctcagggctaggggaaaggagtttcccaaactctatgacgcccgccaggaacagaagtttcttgttcggttcgtgaatcatagccattttatgagagagaacctcctaggccacggcgttggcggtcttggaaccctgatttctcggtatcacgccaccctgcaggaatacgcgcaggagggccaaaccgcacccgttgtgcttctggtcgacaatgatgaggagtccgacaaggcttttaaggcggccaaaaaagccatcaaggaagacggcaatggggctgcaagcatcagcgtcgagagcaatgacgcctggcaccacttgatcgataacttatacctggttaagattcctcatgggggagctgaacagaaaaaacgagtgatcgagcagctcctgccagaagagtggctaaagcacgaagtggatgggaagcggttcgacccctcaaagaagcacggcgaccacagttctctgggcaaggtcttctttgcgaaaaaggtcgtagaagccaacgccgacaagataaactttggggcctttgacgctctcttttcactgctggatggggccttgcgcgattttgaggataaacgaaaacaggaagccggtgggaaagtgatggcagcttcgtga

SEQ ID NO: 8100 - RNA, 1755 nt, unidentified
  source 1..1755: mol_type = other RNA; note = synthetic construct
atgggacgcttagacgaattgaaggctgctaaaaccagaagtgacttggctaaactgctccactttacccctaagggtctagcctatgtgctgtacaaaactcctgctgctgataagtactcaatcttcaccattcccaagaaaggaggaggcgaacgccgcatcgaagcacccgaaccacgattaaagctgcttcagacccagctcgccgccgtgctgtatgactgccttgaggaaatcgaaagtgagacacctaatcgccggtccatctcccatggatatcacaggggcagatccatcgtcaccaatgccgttccgcatagaagacatcgttacgtcctcaatatcgatctgtcagacttctttgggactatcaatttcgggcgggtaagaggattctttatcaaagacagcaactttgctttgactgacgaggcagcgactaccattgcccaaattgcctgtcacgagggtcgcttgcctcagggcagtccatgctccccggtcattagtaatctcattgctagaatactggatgtcagactggcccgtctggccaagtctaccgggtgtacctatacccgttatgtggatgatttaacatttagcacagcccagcggacattcccccctaagctagctaaaaagattgcaactagcccccacaaatggaggctgatgcggtccctgcgtgacgagataaaaaatgcggggttcaaaatcaacaccgccaagacacgcatgcagatttgtgggtcccggcaggaagcaacagggctggtaataaacgagaagatcaacattagtcagccagcctacaggactattcggagcatgactcacactttattcagtacggggaaatacttcgttcctggcggagagcttgacccatcaggcgcccctaagtggatttctgaactggcaccactcgagggtaggctggcccacctgtattttgtgaaggcacgacgagacagatccgagcagcttaacaagcgggagaattttaaaacaccccgcgctgtaaaagagctgtaccgcaggttcctgttctacaaatactgcgtggccccagaggccccccttattgtgaccgaaggtaagacggacgtcatgtatttaaagtccgcactgaaagccaggggtgcactccacccccaactcgcatctgaggaaaagggaaaatcgaagaggcaaattaggttccttccggcaagctacatgaataacacggtgctcgaactcggctctagcgcttcacagctgacaaagctgatagaatcctactcaaaccgacttaaactgtaccggcatagacccttgtcagccccagtgatagtgatcgctgataacgatgacggcgtggacaggatcttgaaggctgccaataagcggtctgagctggaggtcaaggctgggacaccccagtgcatgtttcacatcgttgacaacttgtatctggtgaagacacctcatgtgggcgagaaagcaaagacttgtatcgaggacctcttttcggatcgcctgaagagccagaaagtcaaaggcaaacccttcgatattaagaaggatcatggagacgagacgtcttatggcaaatctaggtttgcggaggaggttgttgcgaagctagcgcaagcccctgattttgctgggttcgaaccactcctaaacgcaatcgaaggcgccatctctgattacagcagccgaatgatgaacaaggaaagaagcgccgcgctcataggcacctga

SEQ ID NO: 8101 - RNA, 1698 nt, unidentified
  source 1..1698: mol_type = other RNA; note = synthetic construct
atgaaacaccttcaggcactgagagacgccaagaacatccaagatttggcgaacatcttagggtacaaagcaaaaggcctttcttacgtactctacaagtacccagaagacaagaagtacacaagattcactattcctaagagaagcggtgaaccccgagtcatttctgccccatgtaagccattaaaactcttgcagagacgcctagctgactatctttatatttgcgaaaaggagatcgaagaggcgcagccccaccggaaaaggctgtcacatggttttcacaaggggcgatctatcattagtaacgccgacctgcataggaaccggcggtacgtcttgaacgtcgatatagaagacttctttggcacgattaattttggacgtgtccgtggcttcttcatcaaggataagaattttctgctcaacgataaggtagctacaatcctagcccagattgcatgccatgccaacgctctgccgcaaggaagtccttgttcccccgtcattagcaacctggtgggaagaatcatggacgttcgcctcgctcagctggcaaagtcatgctattgtacttatagtcgctatgcagacgaccttacattctcaactaataagtccggctttccggagcagctcgctatcatgaaagcagattccgacggttcatggggggtcggaaaagcgctgcagaatgaggttgagcgggccggcttcaaggtaaacaattccaaaactaggttacagttccgctcttcccgacagtctgttaccgggctcgttaccaataagaaagtgaatgtgagcaaggaattttggaggaacgcccggtcaatgagcttccaactcttcagcaccggcaaatacaattgccagcacaagcagccaaacgtgccaaccacttccctcgctccgcttactggtgtgctggctcatatctatcaagtgaagtcaaggagggatctggatgaaacccagatagaggaaaggagctttagtgcccctaaaggacacgagacactgtaccgaaagttccttgactttaagtatttcgtggcgctggacaagcccgtgttactgaccgaaggccctacggatatcgtgtatttgcgggaagccattaaaagtcgggcagccaagttcccttcgctgtacagcggaggggagcaccaactgaaatttctcagacctacggacacagtgaaagagctactgtctgtgggaaccgggtttggggacttgctgggcctgatgtctgagtacgaggagagggttgccaaatttccttattgtcccttgtcccaccccgtaataatgctacttgataacgatgatgctacaagtgctctctcgaagatgaaatacctgaagcgcaagaaaattgtgataaaaacctccagtaccgccgattattaccatatcgcaaagaacctgtatgtggtgaagacgcccgaaggctctcccacaaatgagacttgcatcgaggactgtttcgatgctgccaccagaggtgttactattgacggcaaaccctttgacccaaataagaaacatggtgaccacagctccttcgggaaacaggtcttcgccgagcgtgtcgtcaagcctaattccagcacaatcgattttaccggcttcgaccctctgttggatcgcataacaaaagtggtgagcggatacgtgccacccgccccatga

SEQ ID NO: 8102 - RNA, 1755 nt, unidentified
  source 1..1755: mol_type = other RNA; note = synthetic construct
atgtcagaacttaacaatcttaaggctgctaaaacactcccccagttcgcacatctgctgaaactgaaatcagagacggtcagctatgccctgtactggtacaggcgcagaagtccgtattcccacttcacgatcagcaagaagaatggtggcaggcggcatattgctgcaccaaactctcggctcaaactggtgcagagccgactcgccgaactgttggggcgtatcgagacagagatggagatgaagcgcaccacaaaggtgcgagtgctgtcccacggatttaagaagggcttctccatcatcacgaatgccaatcagcacagaaacaaacggtgggtgtttaacgtggacatcagggatttttttccatccatcaacttcggcagggtgtatggtttctttgtcaaggaccgtaactttcagctcgatcctaagatcgctacaattatcgctcagattgcctgctaccaaaatagactgccccagggatcaccttgctcccccgttgtgagtaacctgattacacacatactggatattaagctcaacaagctcgctaacgacctgcattgtacctacaccagatatgctgatgacctcacattctctaccaatgagaaagaattccccgaacagatcgccaggttagttcgagggaacgatgataagtgggtcgcaggcgacgggctgctttacctggtgtatagagccgggtttcaactcaatcacgagaagaccaggatgcagcgtagggatagtcgccaagacaccaccggcctgattgtgaaccagaaacttaacgttagacatgagtactacaaacaggtgcgcgcaatgtgtcatcatttgttcaatcacggattcgctttttctgaccccggaaaggtccctgtatcaaatcacacagtcgaggggatgttgagctttatataccaaatccggcgcatacggagtcaaaatcttgttgtggaaaaggaaccagaaagaaactcttttttccagaccgaccaggccggtttcactgaactttacagaaggttcctaaattaccgcagcttttatggaatgatcaagcccactattatttgcgaggggaaaactgacaacatttacctcctcgccgcgatccgaaagctggcaccgaaattccctaaattaatcgatcctgctcagaaactaccattgaaagtccagtttttcaactattcacatcggtctgccctgttccagggattaagcggaggtggcgacgagatgtataagctgattaaggactttcgcgagcgaatgaaattctttaaacacgtccctacacaacccgtgattatgatcatcgacaatgatgccgcatccactggtatttttacttatgtggggaccgtacatggcactggcccggtgagtggcttggacccattttaccacgtgttcgaaaacctgtacatcgtccccgtccctacaactgcaggagtcaaggctgtgatagaggatctgttcgaccctgtagtaaagaagcccatatccgggcggaccttcaattcgtctaataaaagcttcgaccagaccaagttctatggcaagaatgaatttgcgactaaaatagttgccccagagcgggccacgattgattttacaaagttcgagcccctattgcaggccatctgtgatgttatggatcactttgcagccaccctggctgccaaaagcatcgttttacctgcaccagtggtggtagcggaagccgcgccatga

SEQ ID NO: 8103 - RNA, 1080 nt, unidentified
  source 1..1080: mol_type = other RNA; note = synthetic construct
atgtccgagttgtccaatctgaaagccaccaaaacattgccccagtttgcaaggatccttgacctggacggacagaccgtgagctacgctttatattggtacaagcggcggaatccttatgaacatttcacgatccctaagaagaacggaggagtccgccacattgccgcgccgaattcaagattaaaggtggtgcagtcacgactcgcggagctgctgggcaggatagagtctgaaatggagctcaagaggaccactaaagcccgcgtgctgagtcacggcttcaagaaggggttcagtataattacgaacgccaatcagcacagaaacaagcgctgggtgtttaatgttgacattcgcgacttctttccttcaattaacttcggtagagtttacggcttctttctgaaagatcgcaacttccaactggatccaaaaatcgccaccatcattgctcagatagcttgctatcagaacgaactccctcaaggcagcccctgtagccccgtgatcagcaacctgatcacccatattcttgacatcaagctaaataaactcgccaatgagcttcattgcacttatacaagatacgcagatgatttaaccttttcgactaacgaaaaggagtttcccgagcgaatagcacggctggtacggggctctgacgacaaatgggtcgctggggatggcctgtcctatctaatttatcgcgcaggatttcaactcaaccacgaaaagacacggatgcaacgtcgagacagtaggcaggataccactggtcttatcgtaaaccagaaactgaacgtgcggcacgagtactacaagcaggtccgtgccatgtgccatcacttgttcaatcatggtttcgcttactccgggccatcaaaagttcccgtcagcaatcacacactggaagggatgctctccttcatttaccagatccgtaggatcaagaaaccggaattgctgtttggcgcctgcccagtgggacggagatttagaccagagcatgacagacacaagttttctaagtgtaggaggattttcgggtctgatgagatcaaatgtcagcgaacatga

SEQ ID NO: 8104 - RNA, 1749 nt, unidentified
  source 1..1749: mol_type = other RNA; note = synthetic construct
atgagtgaattaagcaacctaagagacgtgacaactctgccacagctggcccggcttttggactttcccgcagagaacctgtccttcgccttgtattggcaccggcgaagacgcccttaccaccattttaccatcgccaagaagaatgggggtcgtcgcgttatcgctgcccccaatggtaagctgaaattcgttcagggcaggctagctgacctcctcggccgaattgagagtgagatggaattgaagcgtaccactagatccagggtgttgtcacatgggttcaagaaaacttttagcatcatcaccaatgctaaccagcataggaatcggcgctgggtgtttaacgcggatataaaggattttttccccagcataaactttgggcgggtgtacggcttcttcctcaaagacaacaatttcgaactccacccaaaaatagccactatcatcgctcagattgcttgctaccaaaatcagctgccacagggatccccttgctcaccagtcatctccaatctgattacccacattctcgatattaagctgaatcgcctggcaaacgatcttcattgtacatacaccaggtatgccgatgacatcacgttctctacgaatgagaaggagttccctgaacgaatcgcgagactggtgagaggctcagacgacaagtgggtcgccggtgatggattgttacacctgctctaccgggcaggcttccagattaaccacgataaaacaagaatgcagaggcgggatagccgccaagatactaccggtctgatcgtgaaccagaaacttaatgtccgacatgagtactataagcaggttagggcgatgtgtcaccacctgtttaaggagggattcgcttattctgagccttctcggatccccgtgagtaaccatactctggagggcatgctgtccttcatataccaaattcgcagactgaggtcacttagtatagtggtcgaggacgaaatcgagcgcaataccttctttaaaagagatcagccaggctttacagaactgtatggaagattcctcaattaccgttcattttatggcatgattaagcccaccattatttgtgaggggaagactgacaatatttatctccttgcagcaattaagaagctagcccccaaattcttaaagctgatcgatccaatacagaaggtaccgatgaaagtccagttcttcaattactctcaccaatccgccctgtttcaatccctcagcggaggaggtgacgaaatgtacaagctgatgaaagagttcaaggagcggatcgaattctttaaacatggactcagtcacccggtgattatggtgattgacaacgataaagcatctaaagggatcttctcttacatcggcacggttcacgggaccgggcctgtaagcggcttagacccgttctattacgtgtatgaaaacctgtatgtcgtgcctgttccaaccactgctgatgtaaccgctattatcgaggacttgttcgaccccagcgtgaagaggcctatcaacggccgaacatttagcgactcgaacaaaaagtttgatcttaccaagcactacggaaaaaacgaatttgccacaacaatcgtcgcacctgagagggacacaattgactttacgaaatttgaacccatgctgcaggcaatatgcgacgtgatggatcattttgctgccatccttgccgccaaacccgaagctgccgtaccacctttggccgcgacagggacatga

SEQ ID NO: 8105 - RNA, 1740 nt, unidentified
  source 1..1740: mol_type = other RNA; note = synthetic construct
atgtccgaactttcgaacttgaaagccgctaaaacgctccctcagctcgctcgtcttctgaacctgaacggcgaaacattgagctatgcactctattggtatcgccgctccgcgccctacacctactttaccgttgcgaagaagtccggaggaagaagggctatagccgcacctaacagccgtcttaagcttgtgcagtcccggctaggtcaattgctcgctagaatcgagactgatatggaattgaagcgaacgacaaagtccagggttctatcacacggtttcaaagccgggtttagcatcgtcacaaatgccaaacaccacagaaataaacggtgggtgtttaatgtagacctgaaagagttcttcccatcaattaattttggccgcgtgtacggcttcttcctgaaagaccggaacttcgagcttgatcccaagattgctaccatcattgcacagatcgcgtgtcatgataataagcttccgcaaggtagcccctgcagtcctgtgatcagtaacctgattgcgcatattctcgacataaagctgaataagcttgcgaatgacctgcattgtacatatactaggtatgccgatgacctcactttttcaaccaacgaaaaacacttcccagaagccatcgccaggctagtgaggggctcagatgacaagtgggttgccggagatgggttactgaatctgatttacagggccgggtttcagctgaaccacgagaagaccagaatgcagcatcgagattctaggcaagacgcaacgggcttggtcgtgaatcagaaagtcaacgtgagacacgagtattacaaacaggctcgagccatgtgccaccatttgttcacaaatggttatgcatactccagaaccgaatttgcacccgtgagcaacgacgcagtggagggaatgatgaatttcatctatcagattagagccgtgcgatctcctgacttcaccgctacagaccctagaggtttcttcaagtctgaccagcctggcttttctgaattgtacggacggctgctcaactattgcagcttttacgggatgctccgcccaaccatcatctgtgagggcaagaccgataacatttatctcctggccgctatcaaacaactggcagcgaaatttccacaactcatagaccccgcccagaaggttccaatgaaagtccagttctttaactactctgaacggactgctctgttccagggcctgagtggggggggtgatgagatgtacaagctgatgaaagagtttagggagcgcatgcgctttttcaaacacggcccctctaagccggtgataatggtggtcgataatgacgacgcctcaaagggaattttttcctacattggaactgtcatgggcacaggacccgtgagtggcctggatccattctattacgtatttgagaacctgtacgtggtgccagttcccaaagtcgccggaacatccgcaataatcgaagatctgtttgatgccgccgtaaaaaagcctatcaatgggcggatcttcaattctagcaacaagaaattcgacttaactaagtactacgggaagaacgaattagctaccaagattgtagcccccgagcgtagcagtatcgattttactaagttcgagcctatgttacagtcgttcgccgacatcattatggactatggggcccggctggctgctaagccagcaatggttccggtcaagaatgcagtggctggcccttga

SEQ ID NO: 8106 - RNA, 1716 nt, unidentified
  source 1..1716: mol_type = other RNA; note = synthetic construct
atgtcagacttgactgccctgaggaacgcccgaaacttaccacaactggcccggctgttaaaactcaagggcgaatatgtaagccactccctgtattggtaccagcagcaaaagccttactcccacttcactattccgaagaaaggggggggaaagcgatctattgaagccccaaacagcaggcttaaactccttcaaagacgtctagccgagctgctaatgcggatcgaagctgaaatggagggacagcggactaccaaggccagagttctggcccatggcttcaagcccaatttctctataatgactaatgccgcgttgcaccggaataagcgctgggtgtttaacatggacttgaaagacttcttccatacgattaactttgggcgagtatatggcttcctgttgaaaaatagaaacttcgctcttgcgcccaagactgctgcggttatctcccagatagcatgttatagaaatcatctgccacaggggagtccttgttcccccgtaatttcaaatttcattgcacacgtgcttgacatcaaactgaataaactagcaaacaaactccgctgcacatacacccgctatgctgacgatatcacattctctacgaacgaaaaggagtttccggaagatattgcacgtttagtcagaggctccgatgacaaatgggtcgtgggagacaaggtgctgagggaagtgtatagggctggatttaagatcaatcacgacaagaccagaatgcagcgtcgagacagtcgccaggacactacggggctgatcgtcaaccagaaactcaacgtccgccacgaatattataagcaagctcgcgccatgtgccaccacctctttgtccacggttacgcgcattccggtaccgataggggctcggttccaatcaagaatgaggtggttgagggcatgctgggatttattcatcagataagaagcctgaagaacgccgagttttttaaagctgaccaacccggattcagttctctctacggaaaattcctcgactatcagtctttctacggcatcctcagaccaaggattattggggagggtaagaccgacaatatctacataaagagcgcaatcaaaagccttgccgccaaatttcccgccctggttgatgccacagagcctcttaccaccgcagtcgatttcttcaggtataacaagcggagttccatctttcaggatctgtcaggaggcaccggggaaatgaataaattactggcctcttacagacataggatggcctccttcaaacacatcgcacggcaccccgtgataatggtggtcgataatgacagcggctcggcttcactcttcaattacgtgtcaaaggtgctggggacccctattggcggtctggatccttactaccatgtgtttgagaatttgtatcttgtccccatccctaaaacaagcggtcatgtggctattgaagacctgtttgatgcagccctgttggcggagacaatcgacagccgaacttttgagaggcgcaacaacaagttcgattctaccaagttttacggcaagaacgagttcgccacaaagatcgtagcacccaagcgggccacaattgattttagtaaattcgagccactcttgcaggcctttgtggatatcatggcagattacgagaagcgccacgctgcagctatagtggctgcacggcctccagttgtggctgctgcctga

SEQ ID NO: 8107 - RNA, 1716 nt, unidentified
  source 1..1716: mol_type = other RNA; note = synthetic construct
atgagcgacttgtccgcacttcggaacgctacaacccttcctcggttagccaggctgttaaagctgaagggagagtacctgagccattccctgtattggtataggcagagtaacccttacgctacgttctctatcttgaaaaaaggcggggggagacgcttgattgaagccccaaattcccgcttgaagctcgtgcagtcaagactcgcagacctcctgatgcggatcgaggccgagatggagaacaaaaggaccaccaaagcgagggtgctggctcacggcttcaaaccaggttattccatcatgaccaacgcagcccttcatagaaataaacgctgggttttcaacatcgaccttaaggactttttccactcgataaatttcggcagagtatatggctttctgcttaaggaccggaactttgaattggctcctaaaaccgctgcagtgattgcacagatagcctgccataataaccgcctgccacaaggcagcccgtgttctcccgtcattagtaatctgattgctcacgtgctcgacctgaaactgaacaaactggccaacgcgcaccgatgcacttacacccgatatgccgacgacatcacattttccaccaacgagaaggagtttccagaggccgtggctaggctcatccgagggtctgaggataaatgggtggccggcgacaagatcttgagagaggtatacagggccggattcaagatcaatcatgacaagtcaaggatgcagagacgtgactcccggcaggacactacggggcttatcgtgaatcagaaactgaatgttcgccacgaatattacaagcaggttcgcgctatgtgtcatcatctatttgtacatggatacgcgcatagcggtctgggtgctggcagagatcccgtgaagaacgagagcgtcgatggtatgctcggtttcatacaccaggtccggagtctcaaaaacgctggattctttaagactgaccaacccggattcagcagcctgtatggcaaattcctagattaccaagccttttatgggattctccgtcctcggataatcggcgagggaaagactgataacatttacatccgatctgctattaagagactggcggggaaatttccctctctcattgaaccgtcttccccactagccgaagccgtcgatttcttccactacaatactcgatcagcactatttcaggacctgagtggcgggacggatgaaatgcacaagttactctcaagctatcgtgcaagaaccagttcgtttaaacacatcgcccgccaccccgtcatcatggtggtagataatgacgccgcctccgccaagattttcgcacacctcagcaatatcctgggtactgctgttgggggcatggacccattttaccacgtgtatgagaatctgtatcttgctcccattcctaagaccacaggacatgtggccgtggaggatctgtttgatgccaccgtcttagcacagacaattaacgggaggacatttaatccttcaaacaagaagttcgatcagtctgtgtactacggcaagaatgaatttgccacaaaaattgttgctccgcaaagggctactatagatttcacaaagttcgaacccctgctggcagcattcgtcgatatcatggccgattacgaaaaacggtacgctggagccttggcggccttgaagggaggcatagccgcagcagcgtga

SEQ ID NO: 8108 - RNA, 1716 nt, unidentified
  source 1..1716: mol_type = other RNA; note = synthetic construct
atgagcgatctgagtgctctgcgcaataccaagaaccttccccagttggccagactgctcaagttgaaaggagaattcgtgtcccacacgctgtattggtaccggcccaacactccctactcttgcttcacaattccaaagaagaatggcggtcggcgcttgatcgaagcccctaattctagacttaagctgctccagtcccggttagctaacctcctgatgaggattgagagcgaaatggagggaaagcgaaccaccaaagcaagagtcctagcccacggctttaagcctggcttttccattataactaacgcagccctccacagaaataaaaggtgggtgtttaacatcgatctgaaggacttcttccattccattaacttcggtcgtgtatacggttttctgataaaggatcgcaacttcgagctggctccaaaaaccgccgcaatcattgcacaaattgcgtgtcataaaaatcatctgccccaagggagtccttgcagtcctgttatttcaaatctcatcacacatctcctggacataaagctgaataaactggcaaacaaactccactgcacctatactcgctatgcagatgacatcacctttagcacgaatgaaaaggagttcccggcagccatcgcaagactggtcagaggatctcacgacaagtgggtggccggagacgccgtgttacgtgaggtgtatagggcgggctttaaggtgaaccatgataagtcacgaatgcagagacgagactcccgacaggacactacagggctaatcgtgaatcagaaacttaacgttaggcatgagtactatcggcaagctcgggctatgtgtcaccatctcttcgtgcatggctacgcctacaatggcgcagacacacgtaataaccccatcaaaaacgagactttggatggaatgctgggctttatccaccaggtaaggtcccttaagaatgctgagtttttcaaagaggaccaacccggatttagcagcctgtatggaaagttcctagattaccaggccttctatgggatcctccgccctaggataattggggaaggcaagaccgataacatttacatccgatctgctatcaagagtttggccgcgaaatttccttcactggtcaacccaagcatccccgcgacagcggccttggatttttttcattacaatacccggtcggctctgtttcaggggttgtctggcggtacagatgaaatgcacaaacttctgtccagctaccgctcacggatcagctcttttaagcacatagctagacatccggtgattatggttgttgataacgacgccgcttccacaaaaatcttcgctcacttaagtaacatactggggtatccggtgaatggtatggaaccattttaccacgtatacgaaaacctttatcttgcccccgtcccaaagactacgggacacgtcgcaatcgaggatctgttcgacgcttcagttcgcgcccagcagattgatgggaggagcttcaacccatcaaacaagaaattcgacctgtccatttattacggcaaaaatgagttcgcaaccaaagtcgtgtcgccacacagggccaccatcgacttcagtcagtttgaacctctcctcactgccttcgtcgagattattgctgactataataaacggtacgccgccatcttaggggctgccaagggcgacgtgctttctgccgcatga

SEQ ID NO: 8109 - RNA, 1719 nt, unidentified
  source 1..1719: mol_type = other RNA; note = synthetic construct
atgtctgagctgtcggaactgaaatctgccactactcttcctcaactggctaggctgctcaagctaaagggggaaactgtgagttatgctctctactggtatcgaagagcgaatccttacgactattttgaaattcccaagaagaatggcggacggagattgatcgcagccccaaattcgcggctcaagttagtccagacccggctggccggtctgcttggaagaatcgaggcagaactggaaggtaagagggccacgaaagcaagggttgtgtcccacggttttaagacaggattcagcatcgtcacaaacgccgctcatcaccggaacagacgctgggtcttcaatgccgaccttcaggatttttttccttctatcaatttcgggagggtgtatggctttttcattaaggaccgaaattttcagctggacccaaagatcgccactattatcgcccagattgcgtgtcacaacaacaagctcccccagggaagtccctgctcccctgtgatttcaaatttgatcgcgcacattctcgacatacaactaaacaaaatggccagcaaacatcattgcacctatacccgctacgctgatgatctgaccttctcaacaaacgagaaagagttcccagaagcggttgccaggctggtcagagggagtcgggataaatggaccgcaggcgatgggatcttgcgcctggtgtacagagccgggttcaaagtaaaccatgagaagagtcgtatgcagaaaagggattctagacaagacactacgggccttattgtgaaccagaagttgaatgtgcgccacgagtattataaacaatcccgcgcaatgtgccgacacctgtttcagcacggctgggcccataccggcaccaaacgaggggagaggccagtttctaatgactcattagacggcatgctgagctttatctaccagatacgtcggatcaagaacgacgctttcttcaccgatgatcagccaggcttttccaagctgttcggatactttctggattaccagagcttttacgggattgttagaccccggataatttgtgagggcaagaccgacaatatctacttaagggctgcaattaagagccttcaccttaaattcccccgcctggtcgatgcaactccgaaattcagcctgctggtggatttttttcattataacagccggaccgccagatttcaggacttatcagggggcggtgatgagatgaacaaactactcagctcatatcgtcagaggatgaaaccctttaagcatggagccagccagcctgtgatcatggtggtggacaacgattccggctcaacgaagatcttcaatcacctcacaaacatcctgggcaaacctattgacggatctgacccgttttactatgtctacgagaatctctatgtcgtaccaattcgaaaggttgcgggagcctctacagctatagaagatctcttcgacgggagtgttctcgccgaaaaaataggagtgcgtgaatttaaccgctccaataagaagttcgaccaaacaaaattctacggtaagaacgagttcgctacagagatcattgctcctaagcgcgccacaatcgacttctcccggttcgagcccttgcagaaggcttgttgcgacgtggtagatcactaccaggtgttgtccaaagcagcaccaatacccactccggtacaagtggctgcactgccttga

SEQ ID NO: 8110 - RNA, 1743 nt, unidentified
  source 1..1743: mol_type = other RNA; note = synthetic construct
atggcaaatgaatacccgcaggccacaagtcctatctcagagctggcacaattaaggagtgtcaacactttgacccatttagctcaccttatgggactggaagggtggaccttgtctcacgcgctttatcagcagggtcagaaacggggttacacctatttttccatccccaagaaacgagggggcttcagacagatcgcagccccaaattctcgcctgaagatggtccaatccaaattagccggcctcctgagccgaattgaggccgagatggaggggaaaagggcccgtcagcagtgtatcctgtcccacgggttcaagccaggctactctattattactaatgcagcccagcaccggaacaaacgctatgtctttaatgccgatctcaaagagtttttcccttccatcaacttcggccgggtgcgcggcttcttcatccacgataagaattttcaactgaaccacaagatcgctacaatcatcgcccagatcgcctgccacaacaaccagctgccccagggcagtccgtgttctcccgttatttctaatttaattgcccacatgctggacgtgaagctgaataaagtggcccgaaggagcagatgcacttacacccgttatgccgatgatcttaccttcagcacgaatgaaaaggagttccctacagagatagctcggctggtacgcggagcacatgataaatgggtacctggcaacagcgtggttcgcagtgtgtacaaggccggattcacgctaaacgagttgaaaaccagaatgcagtatagggactcacggcaggatgcaactggactcattgtgaacgagaagcttaacgtgcctcatgaatactataagctcgctcgggcccgatgccgacatctcttccggaatggctacgcctatgaccaacacagcgggactgaaatttccgatgaagctgtggagggcatgatgtcttatatttaccagattcgcagggctcggacagaggacttttggaaggagcagtcaggcttcgcaaaactctacaaacagctgctagatcacaggtccttttggggaattacgaaaccaagaatcgtgtgcgaggggaagaccgacaacatctatctgagagctgctctccaaagcctggcggcaaagtttccagaactgtatgaggctggtgctgaaccccaggacagacttaaggtttgttttttcaaccataccaagagggccgaaatattccaaatcgggtctggtgggtcagagctggcaaagctggttggagcctacaaaagcagaactaaatcattcgaggcgggaatgccacctcatcccgtcattgtggttgcagacaatgacagtggctccaccggactattttccgctatgagcaaaatactcggaacatcggtagggggcgaaaatctgagatactacctgggtgacaacttgtatgtcgtgcccatcccaaagaagaacggtcatacagctattgaagatctcttcgataatcaagtcctggacgaaaagatagatggtagaagctttgaccgcaaggggaaacaggccgacaagaccaagtggtacggcaagaatgagttcgccactaaaatagtccatgcaaagcgtcacgagttggactttgccggatttgaagctgtacttacagccttttcggaggtgatagtggattacgaaaggaagaaaaaggagatcgcgggcgcaaaagcggcgttgaaagtggccgcttga

SEQ ID NO: 8111 - RNA, 1725 nt, unidentified
  source 1..1725: mol_type = other RNA; note = synthetic construct
atgtccgaactggagaaacttaaatcatgtagcacactcccacaattagcacacctgctgggcatcaaaggggagacactgtccagcgtcctttactggctcaagccatcacagaaatatgttcattttacggtgcccaaaaaaaacggaacaagaagactgatagctgcaccaacagaccggctgaagtatgttcaagggcagttggctgagttattgtctaagatcgaagccgagctcgaaggtaggagaactaccaagtactgcgtcctgtctcacggttttaagaaaggattctccatcgtgactaatgcggatgtccaccgcaaccgccgacacgtgttcaacgctgatcttcgtgatttctttccctctatcaatttcggccgagtctatggcttcttccagaaggaccgtaatttccatctcagtcccaagatagcgaccatcatcgcccagattgcttgtcatgacaaccagctaccccaagggagcccttgcagccctgtaatctccaatcttattgcacacgtcctggacatcaagctcaataagattgcgtccgccggacgatgcagctatacccgctatgctgacgacctgactttttcaactaatgaacgcgagttcccagcatctattgccaggctcgttcggggcagccacgataagtgggtggccggagatttgctcctcgagagggtgtacagatctggcttttcgctgaacgaggctaagacccggatgcagcatagggattcacggcaggacgccaccggcttaattgtaaatcagaaactgaacgtgcctaatgagtattacaagcttgccaggtccatgtgtcatcagctatttaccgacgggtattgctacgtggggccagatagagcctacgtgcccgacgcgaagctggaagggatgcttgccttcatttatcagatccgtaagatcaagatcgaaaacttcaaggccgaccaagctggcttcagcaaattatatgggcggttcctggactaccgatcattttacggtctggcacagccaagaataatctgtgaaggcaagaccgataatgtttacattaggagtgcactgaaggccttagcagtcaaatacccttctcttattgatccaggaaaaaagccccctctgaaagtcgacctgttcaattatactaagcgcgccgccaccttccaagacttgtccggcggcagtgatgagctgaaaaagttgatcaacaactacgcaaccaggacagctcggtttaagcacggggcccctcaccccgtcctcgtaatagtggataacgatgcgggaagtgtgggcatctttcagatgttgacgaaactcctgggtaagcctataggaggactggaccccttctatcacgtgatcgagaatctgtacgtggtccccattccaaaagttgccacgccggtggctattgaagatctgtttgaccctgccctactggctcggaaaatcgacggtaaagattttgacagaacagggaaggagaaggacggaagtaagtggtacggtaagaacgaattcgcaacaaagattgttgccccggaacgcgggactataaaatttgatggctttgagcccctactcaacgccgtggtggatgctattcagcattacgagggcgtgaaagcagccgcagccgctaaagccgctgctttgaaagccgcgaaacctgcagtggtagctattccgtga

SEQ ID NO: 8112 - RNA, 1704 nt, unidentified
  source 1..1704: mol_type = other RNA; note = synthetic construct
atgacaaagctctcccagctcagaggggctaagacccttccccagctcgcgagggtcattggcgtgcaaccacacggcctgtcctacgcgctgtactggctgacagaggaccagaaatacgaaagctttactatacccaaacgaggagggggacgacgtatcattacggcgccaaaaaactacctgaaggtgattcaaacaaagctggcaaagctcctgttggacatccacattgagctggagggctccaggagcaaaagccagtgtagactgtcacacgggttcaagcggggatactctatcgtgactaacgccgctgctcaccggaataagcgatacgtcttcaacgccgatctcaaggactttttcccctctatcaactttggaagagtactgggtttccttactagggatcgcaacttcgccttagagcccaaagtggccactataatagcccagatagcctgtcataataatcaactcccacaggggtccccttgctcacctgtgatctcaaacctgatcgcccacgtcttggacatccatctaaataggatcgctcggaatgctaattgcacctacacccgatatgttgatgatctcacatttagcacaaatgaaaaggagttcccgcctagcattgcccggctggtcagtgggaacacatcagcatgggtccccggcgactctcttattcgctatgtgtaccgtagcggtttcaagctaaatcatgacaagacccgcatgcagaggcgcgatagtcgtcaggacgccaccggcttgatcgtgaacaaaaaagtgaacgttaggaacgagtactataaagccgctagggcaaaatgtcaccatctttttcaacatggcttctgctattctgatcacgacaagacggcactgtcggatgccgctttagaaggcaccatgtcattcatctatcacattcggcgcttaaagaccgtagactggaagttggaacagaagtctttttatcagctgtatagacagttcctggattatagagccttctacggactgactagaccccggatcatttgtgagggaaagacagacaatatatatctcagatgcgcaattggagcgctgagtgcgaagtttccacagtttattcatccagatcccaaagcagggctgaatatcgacttcttttattataccgacacgagcgctacttttcaggacttgagtggtggcaccggtgagttaaacaagctacttgggtcctacagggcacgcgcgtcgagcttcaaacacggcccaacccagccggtgttcatggtggtcgataacgactccgggtctaatggcctcttcaggcacctggccggcattcttgggaaacccgtgggaggtatggatccattttaccatgtttttgacaacctgtacgttgtacctattcctaaagccggggttgccgccgccatcgaagatctcttcgaagccgtgttgctgactcgcacaatcaatggccgggcctttgatcggactggaaaacaaaaggacttgtccaaatggtacagcaagtttgacttcgcaacccaaatcgtgaaacctgaaagagctaagataaactttgcaggtttcgagcctctgcttcaggcaatctccgatgcccgaaaagattttgcttctagagtaagtgctggcgctgcagcagcagctgtcaaggctgctgccgcctga

SEQ ID NO: 8113 - RNA, 1695 nt, unidentified
  source 1..1695: mol_type = other RNA; note = synthetic construct
atgaccaagttgagccaattaagaggggctcggaccctgccacagcttgctcgagtgttaggtgtaaaacctgccagcttgtcatttgtgctctattggttagccgatgatcagaagtatgaaacctttaccattccgaagaaaggcggcgggcgacggctaattactgcaccaaagccccgccttaagatgattcagaccaaactagctgacctgttattggatatacacgtggagctagagagtgctagaagtagagttcagtgccaactggcccacgggtttaaacctgacttttccattgtcacgaatgcgaccgcacacaggaataagcggtatgtgttcaatgccgatcttaaagacttcttcccgagcatcaatttcggcagagtgctcggattcttcacaaaggatcataacttctccctggagcctaaagtcgcgactgtgatagcccaaatcgcctgccacaacaaccagttgccccagggaagcccctgtagccccgtgatctccaatctgatcgcccatgtgctggatattcatctctcaaaagttgcgcgagcgggtcgttgtacgtacaccagatatgtagacgatctgacattttccactaatgagaaggagttcccagctagcgtggcaaggctggtatctggaagatcagacgcttgggttccgggcgattccctggttaaacatgtgtaccgttctggctttaagctgaactacgataaaacaaggatgcagaggcgcggctctcggcaggatgcaactggtctgatagtcaacaagaaagtgaacgtgcggaacgaatattacaagattgcacgcgccaagtgtcaccacctgtttttgaacgggttcagttactctgataaggacaagaaagcaatcagcgataatgcccttgaagggacaatgtcgttcatctaccatatccgtcgcctgaagacagtcgattggcagagggaacagcagtcgttctataagctgtaccggcaatttctggactatcgagccttccacggcctcttgcgacctcggatcatctgcgaaggcaagacagataatatttacatccgcagcgccattaaagcccttggggcaaagttcccagagttcattcactcagaccccagtaaaggtctgacggttgatttctttaactacaccgaggccgcagtgatctttcaggacctgagtggaggcaccggcgaacttaaaaaactgctaacttcatacaggccaagactgtcttccttcaagcacgccgctccacagcctgtcataatgatcgtagacaatgacaaaggaagcactggactcttccatcaactcgctcatattatcggaaagcctgtagggggcgtggatcccttctaccacgttctcgataacttgtatgtcgtgcccgtgccaaaaaccggtactgaagccgccatcgaggacctgtttgactctgctctgctcaagaagacaatcaaaggtcgctcttttgaccgcacagggaaggcaaaagactttacgaaatggtattccaaggtcgactttgccacccagattgtgaagcccgagagaagtactatagacttctcaggatttgaaccccttctcaaggctattctcgacgttaggaaggacttttccctcaggcctcctgtcgctacagctgtcgcacgggctgccgagtga

SEQ ID NO: 8114 - RNA, 1719 nt, unidentified
  source 1..1719: mol_type = other RNA; note = synthetic construct
atgacccaattagctagactacgcggggtcaagactctgcctcaattggcacgggttcttggcgtccagcctgctagtctcagtttcgtgctgtactggctgccagaccagcagaagtatgagcagtttaccatacctaaaaagggcggggggtggagacttattacggcgcctaaaccaaggttgaaaatgatccagacaaagctggcagaccttctgctggatatccatgtcgagctcgaacagtctcgcagcagaagtcagtgccaactggcccatggttttaagcggggactaagtattgtaacaaacgccacagcacacaggaataagcgatttgtgttcaatgccgatctgaaagatttctttccctccatcaacttcggccgagtgagaggtttttttcagtgggataacaacttctcattggatcccaaggtagctaccattatagctcagatagcttgtcgggacaatcagttgccccagggcagcccgtgttcacccgtgatcagcaacctgatcgctcacatcctcgacatccatctgaacagattggcccgcgccggccgctgtacttacactagatacgtcgatgacatcacattctctacaaatgagaaggaatttccatcatctatcgcaaggctggtgagagggagcacggacaagtgggtccccggagacagtctggttaaaagggtatattcctcaggctacagcctgaactacgacaaaacgcgtatgcagaggcgagactctagacaggatacaaccgggctgattgttaataagaaggtgaatgtgaggaatgagtactacaaaaccgcacgcgcaaagtgcgatcacctgttcaagaacggtttttgtttctccgataaggatcggaagccgattttcgacgatgcactagatggaaccatgggttttatccgccaaattcgggggttgaagaccaaagattggcagagcgagcaaaattcgttcttcaagctttatcgacaatttctggactaccgcgccttccacgggatcacccgtcccaaaattatttgcgagggcaaaaccgataatatctacctgcgatgtgccttccagaggctccgggccagattccctgcctttatccacccagatcccctcgttggcctgactgttgacctgtttaactacacagaagcggctgccacgttccaggacttaagcggcggaactaacgatctttccaagcttttatcacattatgccgcgagagtgtctccattcaaactcagccccgaccagcctgtaatcatgatagtggacaacgacaaaggttcggctgatctctttcgtaaactgaccaagatgttgggccgtgttgtgggcgggcttgacccgttctattatgtgtgcgccaacctgtatgtggtcccagtgccaaaagggataactactctcgaagctgcgattgaggatctctttgaacccgccctcctggctcggaccattaagggaaagaattttgacaggaccggaaaggaaaaagaccggtcaaaatggtatagcaaagtggaattcgccacagaggtcgtgaaaccagagagggcaacaatcaatttttccggattcgagccactccttcaggcaatttccgacgcctgcaaggactttactggacggcgcgccgcgccttctaagcctttacccagtgcctccgcttccgcaggctctccttga

SEQ ID NO: 8115 - RNA, 1476 nt, unidentified
  source 1..1476: mol_type = other RNA; note = synthetic construct
atgggtaggcagtggctaaagtcctaccggtacctaactatcgccaatgagtatcctagagctcttcctcccatcgtgacgcagagcgccagtcggttgagcaacgttaagagcttggatcagttagctgcggtgctggaggaacagacaaaagtgctcagctattggctgtacaaggctgagccatcaaagaaatatctcgagtactccatccccaaaaagaacgggggctggaggcacataactgcgcccaaagatgggctgaaaaggatccagggaaaacttgcccggctgctcgctgaaatttacaatgatattgaacaacggaggtccaacgggtcgttcgactcatccagagccagcgagtctgtgctcgcacatggcttcaaagacaagtactcgataatcaccaatgcacgagttcacgtgggtaaacgctacgtgttcaatacagatctcgaggacttttttccatcaattacatttggcagagtacgggcattcttcattgcagataataactttcggctgtccccacccgtcgcgaccatgatcgctcagctggcctgctataggaatcaattacctcagggcgccccgactagtccaattatctctaatttcatcgcccacatactggacattaagcttaacaagatggcgcgcgcagggaattgcagctatacccgttatgcagatgacctcacattttccactaacgaggcacgttttccttctgccattgctagactcgtggccggaactacagatcggtgggtggcaggcgacggtttgctgggaagggtctacgcctcaggcttccgagtcaatcacgacaagtctcgcatgcagttgccgaagagccgccaagaggctaccggtttgaccgtgaaccagaacgttaacgtcgcaagcacatactataaattagcaaggagtatgtgcgaccacctttttacgggaggcacctgttttgaaacgatcgacggaaagtgggtagagttcccagcccataaactgcaaggccgcatggatttcatttatagcgtgaggagaagtagaatcggaatttcccttgaccatgtgtcaaagaagcaacatcccatagcttatcgtgaacgagaagccgagttttgtaagcgccagtcttcttttacaaaactgtatcgcaacctgctcaactaccagtccttccacggtatggagaagcctgtcattgtgggcgaagggatcaccgatggactgtacatccgagctgccatccagtccaccggtgggctgtttcctaagctgtatgaccccactggcgatggcgaagtcctagttagtttctaccgacactcagacaaaaaaaacctgagtaattgggggggaagattcgccacccaggccgtacatcacagagtctacgaggttgatggggctgtgcagaacaaggccaaggccgctcggaattcttacagacgccagaggtga

SEQ ID NO: 8116 - RNA, 1713 nt, unidentified
  source 1..1713: mol_type = other RNA; note = synthetic construct
atgcttgaggaacaaactaaagtgctgtcgtattggttatacaaagccgagccttccaaaaaatacttcgaatactcaatcccaaagcgcaatggtggttggcggcagatcactgccccaaaggatggcctcaaacgcattcagggaaaacttgctagactgctggcagagatatacaacgatctggaacagagaaggctgaacgcagagtttgattcctccagggtttctgattgcgtgcttagccacgggttcaaagacaagtactctattattaccaacgcgcgagttcacgtcggcaaacggtatgtgttcaacgccgacctggaggatttttttccttccataacctttggtagagtgcgtgcattcttcatcgcggataacaacttcaggttgaacccgtccgtcgccaccatgattgctcagttggtgtgccaccgcaatcagttaccccagggtgctccctcgagccccataattagcaatttcattggacacatgctggatattaaactgaataagatggccaaggtgggaaattgtagctatactcggtatgcagatgatcttactttttctacgaacgaaacacgatttcctagtgcgatcgctcgcttagtggtgggcactgccgataggtgggtagcaggagacggcctactcgccagggtgtacgcaagtggtttcagggttaaccacgataaaacgcgaatgcaactgccaaagagtcgacaggaggccaccggcctcactgtgaaccagaatgtcaacgtggcttcaacttattacaaacgcgcccggtctatgtgtgaccatttgttcaccggggggacatgtttcgagatgatcgacgggaagtggattgaatttccagtgtctaagcttcagggcagaatggacttcatttactctgtcagaagatccaggctccgcatgagtctggaccatgtgtctaaaaagcaacatgccatcgcttatcgcgaacgagagacagaattctgcaagcagcagagaagcttcacaacactgtaccggaatctgctcaactatcagagctttcatggaatggagaagcccattattgttggcgaaggcatcaccgacggtctgtacattcgtgcagcaataaagaccataggggcttcatttcctaagctttatgatgctacaggtgacggcggagtgctggtgtcattttacaagcactcagacaaaaggaagttttaccagataggggaaggcgcgagtcagctgaagccctttatcaccgagtacacaaagttgatggatgccttcaagactcggccgaagcaaccagtaatcctcatcgtcgataatgacgacgagggacaatcagtcctcaatgtagctggcaaccggtggaagaaagatgttaagacggccacccccttctatcacttagtatccaatctgtatatcatccctattcccgctaaaaccggcctaatcagcaccgctatcgaagacctctttgacgcggcatggctagctgcccaagacatcgggggacgtaagttcaccaaagacaatgacttcaacagcgccacacattttggcaaggcagagttgctggggcagattgtccggccaagcagagccacaatcaattggacaaattttcagacgctgctccaggggatccagggagccatcttggactatgaggttaaactggccgtctccccttga

SEQ ID NO: 8117 - RNA, 1884 nt, unidentified
  source 1..1884: mol_type = other RNA; note = synthetic construct
atggtagattatgcagtgactgtgaacgctgaatacagcactgaccggtacacagtcaaatcatatagacacctcaccgtcgccaatgagtaccctcgggccctgcctccaatagtgacacaaagcgtcagccgcctccgtaatgttaagtcattagaccaactggccgcggtgctgaaggagcagacaaaggtgctctctttttggctctataaggcagctccccaccagaaatacgtggactatcagatcccaaagaaaaacgggggctggcgccacattactgcacctaaggatggcctgaagaggatccagggtaaactggccaggcttctgagtgagatttataacgacctcgaacaaagacgcatcgaccctgcctttgacgggtcacatccatcatcctgtgtattggcccacgggttcaaagacaagtattcgatcaccacaaatgctacagtgcacgtaaaaaaaaggtacgtctttaatgctgacctggaggatttcttcccctccatctctttcggcagagtgagagcatttttcgtggctgaccagaacttcaaactggaccctgctattgccaccatgatcgcacagttggtgtgctttcggaatcagttgcctcagggggcgccgacgtcacctgtcattagcaatttcattggacatatcctggacgtgcagctgaataagttagcggcgaacggcaactgttcttacactcggtacgccgatgatctcacattctccactaatgagaaggccttctctcccgctatcgcacgactggtgtccggcactaccgatcgatgggtggcaggagacggtctggtcggtagagtgtacgccagcggattccgaataaaccatgacaagtctcgtatgcagctacccaagtctcgccaggacgtgacggggcttacagttaatcaggccgttaatgtctcagcaacctactacaagctagctcgcagcatgtgcgatcacttatttaccggaggcacctgccatgaaaaaattaacggcgaatggcacaggtttccggcctataaacttcaaggtagaatggacttcatctactctattcgtcgcagcagactaaaggtttccatcgactatctgcccaaaaaacagcagccggttgcctttcgcgaaagggaggccgagttttgtaagcaacagaagagcttcacgactctttacaggcatttgcttaactataggagtttccatggcatggaaaaaccagtcatcgtgggggaggggataaccgatggactgtacatttccgctgcgattaagagtttgggagccctctttcccaccctgttcgatgccggcggtgatggggaggtcaaggcatcgttttataaacacaccgataagcggaaattttaccaaattggagaaggggccagtaaccttaagccatttattacggagtatactaagatcatggaaccattcaagaccattccacggcaccctgtgataatcgtggtagataatgacgatgaaggccgggcagttttaagcgttgcaggtaaccggtggaaaaaggatctgaaaaccacagcagccttttatcacctcgtaagcaacttgtacatcatcaaaatacccttcggcagttccgcctcttcctccgctattgaggacctgtttgactctgcttggctgagtgctcaggacataggcgggaggaagttcagcaaagataatgatttcgacagtgctacacattttggaaaggccgacctggttggacagatagtgcgacccaaaagaactacaatcgattgggctggcttcgtcccactcctcgcggctattgagggagccatcatcgattacgattccaagctgaactcagtgccctga

SEQ ID NO: 8118 - RNA, 1779 nt, unidentified
  source 1..1779: mol_type = other RNA; note = synthetic construct
atgcccccaatagtgacccagagctccagtagactgtcgaacgtgaagtcattagaccagctcgccgccgttctgggagagcagaccaaggtgctgtcttattggctctataaagccgaacccgcgcggaaatacgagcagtattcgattcctaagaaaagtggcggctggcggcatatttccgcacctcgcgacggtcttaaacgaattcagggtaagctgagcagactgttggcggagatttataatgatagggagcagaggcgcgtgaacggctcatttgacgggtcccgcacaagcccttacgtacttgctcacgggttcaaggacaaatatagcatcattacgaacgctcagatgcacgtaggcaagcgctttgtctttaacaccgatctcgaagacttctttcccagtatctcctttggtcgagtgaggtctttttttcgcctggatactgacttccggttagatccagctgtggcaacaatgatagcccagctgacatgttttagaaaccaactcccgcaaggcgccccgactagtcctattatctctaatttcatcggtcacatgctggatatcaaactgaataagatggctagaaaaggcaattgttcttacacaagatatgccgacgatctgacattctctacaaatgaagaaagttttccaccagcaatcgctcgcttggttgcagggaccacggatgaatgggtcgccggggatggactactggctcgagtctacgcctcagggttcagggtgaatcatgacaagtctagaatgcaggtggcctccagtcgccaagacgctaccgggctcaccgtcaaccgtaccgtgaatgtcagcgccacgtattataaattggcacgggccatgtgcgatcacctgtttaccgggggtacctgtcatgagatgaaaggcggaaaatggactgtcctcccgcctcatcgtttacaggggaggctcgacttcatttattcagtacgaaggtcccggctgaagatccccctggaccacgtcgcaaagaagcaattcccaatcgaatacatgaagagggaagcccttttctgcgatcagcagaaagcgttctctaccctctacaagaatatgatgaactacatgaccttccatggtatcgagaagccaatgatcgtgggagagggcataactgacggcctgtacatcagagcagctattaagactgtgggacctgcctacccgaagctataccacccttcaggcgacggggaagttcttgtgaatttctacaaacacacagataagcgaaagttttaccagatcggagagggagcggcacccctgagatcattcattgccgagtatcctaaattgatgggcaggttcaagacgaaaccaaagcagcccgtgattttgattgtggataacgacaaagagggaagggatgtgcttaaagctgctggtagccggtggcagaaagatacatccgtgcctagccccttctaccacctcgtctccaacctgtacatcatccccttgccaaagcctggcgccaccgatgtatgcatagaggacctttttgaccagacatggctcgcagctcaaaacattggggcacgtaagttcactaagaagaacgattttgattctgccacatacttcggcaaggcggacctggtcggccagatagttcggccccaacgggctactatcgactggtccggatttgttcccctgctagaggccgtgcagggagccataagcgactatgaagttaaactgagcttaactccatga

SEQ ID NO: 8119 - RNA, 1803 nt, unidentified
  source 1..1803: mol_type = other RNA; note = synthetic construct
atggcttatgagtatccccgggcgctccctccaatcaccacacaatccgtcagcaggctgagaaacgcacatagtcgcgctcagctagccgccattctcggcgaacagtccaaggtcctgagttattggctgtataaggccgatctatctaccaagtacactcagtactcaatcccaaaaaagaatggcggctggaggtatatcaccgctcctcaaaacggcctgaagaggatccagactaagcttgcccgcttacttgcggacatctataatgacattgaacagcgccgactgaatgagagcttcgacggggtcactgtgtcagagtgtgtcctgtcccacgggtttaaggactcttacagtattatcaccaacgccaaagtgcatgtgggaaagaactttgtgttcaactcagatttggagaactttttcccatccataagctttggcagggtcagaggcttttttatcaacgaccggaactttagacttcacgaggacgtggccacggccattgctcagatcgcttgctatcagaaccagttgcctcagggggcaccatgtagtccgattatcagcaattttattgcccacatgctggatatcaagcttaataagatggccaaaaaaggtaattgctcatacacgcgttacgctgacgatctcaccttcagtactaatgaaaaacatttcccggctgagattgcacgcctggtggcagggacaaccgatcggtgggtagcgggaaacggcctgatctcaagggtgtatgcaagtggctttcgaattaatcacgataaatcccgaatgcagctgcctatgtctcggcaggaaacaacaggcctgactgtaaaccagaaggttaatgtacccgccacctattataaagccgcaagatccatgtgtgaccgcctgtttaaggagggatactgctttgaaatagtgtcaggaaaatgggtggaggtgccgtctgtcaaattacaaggtcgaatggacttcatacactctgtgcggatgggtcgcctcggaatatcgttagatcacctgcctaaaaaacgttttccaacagcgtacagggacagggaaaacatcttccgtggtcagcaaaaggccttctcaagtatttacgagaagttgctgaactacagatcttttcatgagatggtgaagccaataatagtgggtgagggcatcacagatgggctgtacattaatgctgccatcagaacaatcggcggactttaccccagactatttgaccctgccggcaacggaacattgctcgtggacttctacaaacacagcgacaagaggaagatctaccagattggcgaaggagctaaacccctgggcgcattcgtaaaagactacgctaagctgatggagcccttcaaggcaaagccctccaatcccgtcatagtggtcattgacaatgataaagaaggacgcgaagtgcttaccgcaattggtaagcggtgggggaagactatcgacgggaaatctagcttctatcacttggttagcaacttgtacgtcgttccagttcccgcaacggggggggttctcactagcatcgaggatctgttcgattcgacctggctcgccgctcaagatatctccggaagaaagttcacgaaagataatgactttgacagctccacccatttcggaaagacacagttcgccgggcaaattgttcggcctaaacgggcctccattaaatgggatgggttcaagcccctgctccagggtattcaggatactatcctcgatttcgaattacagagctctcctggcacctga

SEQ ID NO: 8120 - RNA, 1701 nt, unidentified
  source 1..1701: mol_type = other RNA; note = synthetic construct
atgtccaagctcgacgcgctgaaacaggctaaaagcctgtcggatttggcctacatactcggggagcagccaaaagtcctcagctacgtcctctacatgatcccctcgaccctcaagtacactccatttctgatccccaagaaaagcggtgggacccgtaccatccaagcccccatcgaccgcttgaagcgaatacagagggctctcgcagacctattgcaggacatacaggaggagattagtacaaagcgcaaagtggacaaaagacatgccgtgagccatggattcaagcggaagctttctattatcactaacgccagaaatcacaggaacaagacatacgttttcaactctgatctggagaattttttcccatccattaacttcgggagggtatacgggtttttcgttcacaatgagacatttagtctggaccctaaagtggccactgtgatcgcgcaaatcgcctgtcatgataatagtctacctcaggggagcccctgctctccgatcatttcagactacataggccacatcctggatatgcggctctcaagactagcttcccgccaccgttgtacctatacccggtacgtcgacgatctgtctttctccacctcacaacctaattttccaaaggagattgcataccagcacgagggagatcacaaatggctcgctggcgatgcactcgtgaaaaacgtgtttaagacgggttttaagttgaatcatgccaagacgcgagttcaatataaactttctagacaagaagccacaggcctgatcgtcaatagaaaggtgggtgtgccgactgaattttatcatctcaccagggcaatgtgccactccctgtttaaccaggggttcgccttcgttgtcaaagacgggattgcccagcccgtctcagatgccgttgtgcgtggccgactgtcatatattcaccacgtacggagtatgcagaatacactggaaaagggccctagcttacagggtacggccccttttcggttgtaccagaggtatctcaatttcaaaagcttctacggcatctcccaaccagtcattatcggagagggcgtcacagacactatttatctgaaggctgcgcttaaccagctggccggcaaattccccaacttaatcgacgtgggccatgggaccaaggagcacaaactgactttttttaagtatgggaagtcttcccgggaactgatgggattaagcggaggcaccggcgagctgaaaaacttactgggggattaccgcaagaggatatcaggattcaagttcggaggggcaaacccggttataatcctggtggacaatgatgacggcgcagaaaagtttttcaagactctgggaagcatgacaaagaccaaggtgacgggaaccgatcccttttattatgtatatgccaacctgtatgctgtgcctattcctcccacaggtggaccagtggctgccattgaaggcctgtttgatccatccctacttaatatccctcatgagggaaaaaagttggacctgactaacaaagaaacagatggcactaagttctacagtaaacatacattcgccaaatctgtggtaagaccaaaccaggataaaattgacttcaccggctttgaaccccttttgcttgctatcgagcaggtgattgcggacttcgcaggtcgccttgctgcaggtaccgctccttga

SEQ ID NO: 8121 - RNA, 1704 nt, unidentified
  source 1..1704: mol_type = other RNA; note = synthetic construct
atgagcaaactcgaagccttaaagaaagctaaatccctcagcgatctggcaagtatcttgggagaacaaccgcgggtcctgtcctttattctgtacaaaatcccgagcaatctgaaatataagagcttcgaaattacgaagaagtccggaggaaagcggacaattcatgcccctgtcgcgagattgaagcggatccagaggtcgctggccgaccttctgcaggatatccaggatgagattaagattcagcgcaaagtgaatgataactgcgtagtctcccacggatttaagaggaaactgagtatcatcactaacgccaggaatcaccggaataaaacatatgtgttcaactcagacctgaaagacttctttccctctatcaactttggtcgtgtatatgggttcttcgtacgaaaccaagagttcgcgttggaccccaaggtcgccacagtgatagcccagattgcctgccagggcaactcattgccccagggctctccttgctccccaatcatctctgattttatcggacatatcctggatatgcggctgtcgaggatggccgcaaggcatagatgtacctacactcgctatgtcgatgatctcagcttttccactaataagagatctttcccgaaggctatagcataccaaaatgaggataattctcatgagtggttagctggcgacgccctgttgaaaaacgtgtttaagagtgggtttaaactaaacaatgccaagacacgcgtgcagtataagtccagcagacaggaggcgactggtctgatagtgaataagaaagttgctgtgcccaccgaattttatcacacaacacgcgcgatgtgtcacaacctctttaaagatggctttgctttcatcgttaaggacgggacacctaagcccatatcagacgctgtgctcagaggtcggctaagttacattcatcacgtacgaagtacccagaacaagttagagaacggtcctcctcttaaaactacggccccttttaagctgtatcagcagtacctcaactacatttcctttttcggcagcagtatgccagtgatcataggtgaaggagttaccgataccatctacctgaaagccgctctcaatcagctggcggcaaagtaccccaacctcatcacagttgtggacaaaaagaaggagcacaaacttcagttcttcaagtacagcaactcatctcgagaactgatgggccttagcgggggcacaggggaactaaagaatcttctcggagagtataggaagcgcatttctggcttcaagttcggaggaacccaacctgtcatcattttggtcgacaacgacgacggcgccaaagccttcttcagcacgttgggctcaattaccaaaactaaggtgtcaggcactgacccattctactacgtttatgctaatctgtacgctgtcccaattccacccactgggaatcccgtgaccgcaatagagggcttatttgaacccgcacttcttaataccatctacgacgggaaaaaactggatctcaccaataaagagccagacgggtctaagttttattccaaacacaccttcgccaagaacgtggtgcgtccaaaccaagataagatcgatttcaagggttttgagccactgctgacggcaattgaccacgtgatggccgactatgcagcaagactggttgctgggaccgctccttga

SEQ ID NO: 8122 - RNA, 1704 nt, unidentified
  source 1..1704: mol_type = other RNA; note = synthetic construct
atgagcaaactcgaggctctaaagaaggcccaatcgttgtccgacttagcgtgcatattggaggagcagcccaaggtcctgtcatacgtcctctacaaaattcctacgaactctaagtacaaagccttccagatccctaaaaagtcgggcggcacaagaactattcaggctccagtggacaggctcaagcgcatccaaaagtccctggcatcactactgcaggatatccatcttgaaatccagaaaaaacgaggggttaaggctaactgtattgtgagccacgggttcaaaccgaaactgagcataataacgaacgctaggaaccataggaataagacgtacgtgttcaactcagaccttaaggacttttttcctagcattaactttggccgcgtgtatggattcttcgttaaaaatgaggatttcgccctggatccaaaagtagcaaccgtcattgcccagcttgcatgtcacggtaattccctgccccaagggagcccttgctctccgatcatctccgacttaatagggcacattctggatatgagactctccaaggtggctactcgttatcgctgtacctacacaaggtacgtcgatgatctgacctttagtacaaacgaaagcacatttcctaaggccatagcgtatgaagacaaggataaccagcacaagtgggtggccggagatgcccttcttaagtctgtatttaaaagcggcttcaagctgaatgatgctaagacccgagtgcagtatcagtcctcacggcaggaagcgacagggctcattgtgaatcgcaaggttgcagtgcccaccgagtattatcacgccacaagggccatgtgccacaatctatttaaagagggatttgccttcaccgtcaaagacggcgtggctaagcccgttagtgatgccgtgttacggggtcggctgagctacattcatcatgttagatctatgcagaataagctggaaaacggccccagtctgaagctgactgccccattcaagctataccagcaatatctgaactatgtatcctttttcgggatcagtaaacctgtcatcattggagagggcatcaccgacacaatctacctgaaggcagcactcaatcagttggccggtaaattccccagtctggtggaagtggccggcggagagaacgtccacaagctgggattcttcaagtatggaaatagctctcgggagctgatgggcctgagtggtgggaccggcgagttgaagaatttgttgggggaataccgcaaaagaatctctggcttcaaattcggcggtgcacatccagttattatcctcgtcgacaatgatgatggcgccaaagcctttttttctaccctcggaactatcactaaaactaaagtctcaggaaccgacgcattctactatgtgtacgcaaacctttatgctgttccaatcccaccaactggtaattctgtggccgcgatagaggggctctttgaccctacactgcttaaaaccatttacgatggccggcagctggacttaactaacaaagagccggacggatcaaagttttacagcaagcacatcttcgccaagtccgtggtacgtcccaaccaggacaaaattgattttaaggggtttgaacctctcttgacagctattgaccaagtgatcacggactacgctgctaggcgagctgcgagatccgcaccctga

SEQ ID NO: 8123 - RNA, 1710 nt, unidentified
  source 1..1710: mol_type = other RNA; note = synthetic construct
atgagtttcgaacttgttgccctgaagaatgctgtcgatctgactgatgttgccgtgctgcttggggtcaagccaaaagatctgtcatacgctctatacatccaaccaagcagcgccaagtatagggcttttgagattcctaagaagggaggcggtttccgcctcattactgcccctgaacccagattgaggagtatacaacgccgtcttgccgatctgcttctgacgattcagcaggaattagaggttcagcggacaaaaagcaagggtattgtggcggcccatggctttaagaagtcccttagcatcatcactaatgcacggtgtcataggggcaaatcatttgtgtttaatggcgacctcaaggactttttcccatcgatgaactttggaagagtgtatggctttttcctcaagaaccgggattttgagctgcacccaaaagtcgctaccgtgttggcccagatcgcctgctttgagaatcgcctaccccaggggtcaccttgctctccggtgattagcaatttcatcgccggaattctcgacaggcacctctccaagttagccgcagagaaccggtgcacttatacccgctacgcagatgacctgacattttctacaaatgaggcaatattccccgagcaagtcgctcgcttagttagaggcgccaatgataagtgggtggccggttatgaacttgccgggcgcgtggcacgatccggatttcagatcaacgagctgaaaacaagactccaataccggaattcaaggcaggacgtcactgggctagttgtgaatgagaagctgaatgtgcctagtgagtattacaagttggctcgggccatgtgtcatcacctgtttaaagacggaactgctttccgtacgatcgacggaattaagatccctgtatccgacgaaagagtgaggggcatcctgtctcacatccaccatgtgagaacttcccagggcggtcctaaacacccacctggtgacccaaaagcaccagggcatcagaaactgtaccgacggttcctggattatgtctcattctttggacatcagcagccgaccattatctgcgagggcaaaacagacaatgtgtacataaagacagcgatgcaaatgctggcgccaaagtttcccgacctggtagaggtagcggggaacaagttcgatctcaaagtcaagttcttcaaatatggccgagctagtgcccagattcagaacctgggtggagggagcggggcacttaaaaccctcttgatggaatatgaaaaacgtttgaaagggttcgcaggcaccgcttctcagcctgtgataatggtgctggacgtagacaagggtaccacccaaatctggagtgaaatctctaagattctgggaaccgcagttgcaggccacggacccgatcccttctaccacgtcagaaacaacctctacgtagtcccgattcccgctaaacctggggtggaaacgtgtatcgaggatctgtttgacgccaaaaccttggcaataccccatgacggcaaagtgttcgacaaggagagcgataaggataagcccggcacctacagcaagaacacattcgccaaccaggttgtcagggaaaaccgacactccattgatttctctggattcgagcccttactcgaagctatcaacgctgcgataaaaaactactccaccaaggtggccgctatgacagcctga

SEQ ID NO: 8124 - RNA, 1683 nt, unidentified
  source 1..1683: mol_type = other RNA; note = synthetic construct
atgtcccccgaactcaaactgctcaaggctgctaatggcctgagtgatgtagccagtctgttaaatgtgcggcctgcggacctttcctacgcactctatattctccccaacgaggtcaagtacagaaccttccagatacctaagaaaggtggagggttccgcgttattgcggcacccgagtctcggctccgatacatccagaaacagcttgcggatttgctggtcgctatcgaattggggctggaggcagggcgaactcagaggaagtttatcgtctctcacggctttaagaagaaaatgtccatcgtcacgaatgcaaagaaccaccgcaataaggaattcgtgttcaatagcgacttgaaagacttcttcccatctatcaacttcgggcgcgtgatcgggttttttgtgaaaaatcgagattttgggctgaagccgaaagttgctactgtgctggcccagatcgcctgttttaacaacaagcttcctcagggaagcccttgctctccagttattagcaacttgatagcagggattctggatagacatctctcaaaaatggccgtccagcacaggtgcacgtatactcgttacgctgacgatctgacattttccaccaacgagagagtgtttcccgaagctattgcccggagggtgagaggcgccgaagataaatgggttgctggtcacgagttagtgggaagggtggctcggtctggctttcaagtcaacgagcttaaaacacggctgcagtacaggagcagcagacaggataccacgggactggtcgtgaatgagaagctcaacgttcccgccgaatattataagctgacacgggccatgtgtttccacctcttccgcgatggcaccgcatttgcggtcgatgataatgccaggatgcccattagtgatgagcgtttgcgcgggagactggctcatctgtaccacatccgggggctggaaaacggtcacaaaaagtatccccaaaagaaaggtcctgcttatgtcaaactttatggcaagttcctagactacatcgccttttacggacatcaacgaccaaccatcatctgcgaaggcaagacagataatatctacatcaagaccgccattcaaatgctggccccaaaatttccagagctggtagacgtggtgggtgcagagtacaagttgaaggttaagttctttaagtacggcaaagccagctcaaatctgcaagacttgtccggaggcgcaggccagctaaaaacacttataatggactacggtaacaggctaagtggattcacttcaggagcaaagaaccctgtgataatggtgctggatgtggacaaaggcacaacacagatttgggccgagctttccaagattctgggaaagagtgtggcgggacatgacccatactatcatgtgagggacaacctatatgtagtgcctgttcccgtatcgtcaggcgccgaaggggacatggaggacctcttcgacaagaaaactctggagctcgagtatgaccagaagaaattcgataaaaagagcgacaaggacatgccaggcacctactccaagaatacttttgctaatcacgtcattagagacaaccgtgctaccatcgatttctcaggcttcgaaccgttattaaaatctattcgcgacgtaatagccgattatgcagccaaaatctga

SEQ ID NO: 8125 - RNA, 1728 nt, unidentified
  source 1..1728: mol_type = other RNA; note = synthetic construct
atgagcgtggagagtctgctcctcttaagattgagagcttgtacagatctgtcttccgtggctcgtgtgctgggcttgactcccgctgtgctttccttcgtcctatataaaatccccacccaggccagatatcggacctttagcattgccaagcgggccggaggaagtcgcgcaatcatggcgcccaacgagagattaaaaatggttcagcgtcgactggcctctgtgctgttacagatccagaccgaacaggaacggtccaggacgaagaaagcctgtatactgtcccatggatttaagcgggagcttagcattctgactaatgcccggaaccaccgcaacaagaggttcgtgtttaacctagacctggaagactttttccctacctttaattttgggcgcgttcggggttttttcatgagggaccagaacttccaacttcatcctgccgccgccacagtgttagcgcagattgcatgtcacaataatcacctaccccaaggctcgccatgctcaccggtcatttccaatctactggcacatatgctcgacctcaggctgaataagatagcacgaagacacaaatgcacttacactcgctatgccgacgacctgaccttttctaccaacaagaaggatttccctgaagtcataggcgctaccagtcctggagatccaaataaatggagcgcagggaacgatctcctcgcgtccgtctacctgtctgggcataagattaaccatagcaaaacacgtatgcagtatagagatagtaggcaggagactaccggcctggtcgttaacaggaagatcaatgtgtcagtcgactactacaaattagttcgggccatgtgcgatcgactttttgcatctggtattgctttcagacaggacaaaaacaagattgagccagtgtcccggagccacttgcagggcaaacttgcgttcatctaccatatccgcggtcaggagacgagccaccgcaaactgcagaaaaaagaccagccaggctattatcgcttgtactcacaattcctggactattgtaatctttacgatgtcgaccggccaacaatcatttgcgagggcaagaccgacaatgtatacattaggtctgccatagaagccctctcaagcaaggtacccggattgctcgattcagagaagaaactcactgtcagactgttcaagtacactaaaatcacgtctaccatccaagacctggctgggggcacggaccagctcaagaagctggtgagagagtacgcaaaccgtactcaaatgtttaagacgacacccagccaccctctgatcctcgtgacagatgtggataagggcagtacagagtttttcaaggccgtaagcgctatcttggggacaaccgttgctggagcagacccgttttatcaccttatcaagaacctgtatgtcgtacctgttcctaagattaaacatccagaaacagccatcgaagatcttttcgacgataccctcttgaatgagaaggtggatgggaaatccttcgataggaccaacaaagagaaggatggtacaaagttctacgggaagcacgtgtttgctaccagggtggtgtggcccaatcgatctacaataaacttcgcccgctttgaaccgctgctgcgagccttcgaagacgtgaaatcccactacaaaactctgactagtacctcggttaagtcaccagctcccatcgcggcagcagcttga

SEQ ID NO: 8126 - RNA, 1722 nt, unidentified
  source 1..1722: mol_type = other RNA; note = synthetic construct
atgcctgcagcgagccctgaactgcaacgtcttaagaaggcgaccgaccttcacggggtagctgccctcctaaacgtaaagccttctagactgtcctatgccttgtattatatgcccccagcgaccaaataccggtcatttacagtgcccaagaaaaggggcggcacacgaacaatcagtgccccgcacggaggcctcaaatacatccagaagcaattggcaaccctgctactgagtattgagaaggagctagagggcgatagacggaagaactccatactggcgcacggctttaagaaggagctcagcattattacgaacgccatccgccacaggaacaagagatgggtgtttaatattgacctccgagacttcttcccctctataaatttcggccgagtcagaggcttttttattgctaacaaccagtttgctttgacccccaaaacatcaacaatactcgcacagctggcatgccatgataatgttttgccccaaggctccccgtgctcccctccaatctccaatcttattgctcgctctctggattatcggttgaatcggctcgctcgggaatgcaactgcacctacactcgatacgctgatgacattacttttagcaccaacgagccagagttccctgaaagaatcgcagtactcgcagggcctcatgcttggcagccaagtgaggagctcgcatcaaggattgtgtcgagcggattcgaaattaacccagacaaaacccgcatgcagtatagggacagtcgccaggacaccaccggcttgatcgtgaatagacacctgaatgtgcctgtggagtactggaaacaaactcgtgcaatgtgtcatcgcttatttgtcgatgggcaggcctatagggtgttcgatggcgagaaggaaccgatctccctcgactctcttaggggaaggttaaatttcatctactacatccgttctctgactctgggcaaggcgaatcttgagaaacccaaagggatccccggatatcggaaaattttcgccaggttcttgaattataacgccttttggagcatcgaaaagccagtcatcgtctgtgaaggcaaaacggacggaatctacctccggagtgcaatacgatctctgcatgccaaatttcccgatttcttcgaaactgtggatggaaaggtgaagatccgccccaccttctttaaatacaccacaaacacgcgggaggttcaggacttaagcggggggaatggtcagctgaaaaatctggttgcccagtacgctcacagaacaaagggtttcaaagggactccaaaggccccagttataattgtgaccgactgtgacaagggagccgtacatctgtttgaagaggtgagcaaaatcctggggagaactgtcgccggagctgacccgttctattaccttcacacaaacctgtacgtcgttcccatacccaaactggggcttcctgaaaccgccatcgaagacttatttgataagacactgctggatactaagattgatggtaaaactttcgacaagacaaaccacgagaaggacggtgctaagttctactccaaatttactttcgccacaaaggtgattgctgcctcaaaggtgcctgtggattattcaggtttcgagccactgctacaggcaatgctggatgtcgaggccgattttgccgcacgcctcgctaccgttccacctacggtgctgcccgcccattga

SEQ ID NO: 8127 - RNA, 1749 nt, unidentified
  source 1..1749: mol_type = other RNA; note = synthetic construct
atgtctgtgagttcccttgacctggggcgactcaagcgtgccgctacactgacagatttggccgcagtgctcggtgtggaggctagtacactgtccttcgctctgtacattatgcctgtgcatgagcgttatcacacctttactgtacccaaaaaacgcggaggcgaaagaatcattaatgccccaaacgagagactaaagtttatccagaagaagctcgccgatattctgttgcgcatcgagcgcgacttagaagcacctttgagagaggcagctaacaacggagccaaaaagcttcctatcttgtcacacggctttaagaaggagctttctatcgtgactaatgcccataagcacaaaaatcggcggttcgtttttaatctcgacttggcagatttttttccctcactgaatttcggcagagtgaggggattttttctccacaataatcacttccagcttccagagaaagtggctactcttctcgcacagatcgcctgcttccagaacgagctgcctcaaggaagcccctgttctcccccaatcgctaatctgatagctaatatcctggacgtgcgcttaaacgcactggcgaggagctgtcagtgtagctacacacgctatgcagacgacattaccttctccactaataataaggagtttcccagccatatcgccgcccagaactccgacggccattgggtgccatcggacaagctgattagcaggatttcggccagcgggttccgcataaatgagtctaaaacacggatgcagttccgggattctaggcaggaagccacaggtctgattgtcaaccgcaaactgaacgtgccggtggaatattataaggagactcgagcactgtgccattacctgtttcacgggagagtccctgtgttaaagatcgaaggcggtagcatcccagtgacaacctcatccttaaggggccgactgaatcacattttccacattcgtggcatagaaacggggcacaaaaaaccagagaaaagtaagtacccgggctatttcaagctgtacgcccaatttctcgactacgtctcattctggggtattgagcagcctacgatcatctgcgaagggaaaaccgataacatctacctaaagaatgctatgagagctcttaagcccaccttcccccatttttggaagttcgtagacggcaaagaacagcagaccattaacttcttcaagtacaccaaatgctcaaacatcatacaggacctgtccggcggtaacggacaactcaagaaccttgttcacgagtttgaaaaaaggacccggaagtttcgaagcctccctaaggctccggtgatcatcatcactgacgtcgataaaggggcaaccgacctgttcaaagcgatgaaaaagattctggggtataccgtcgacggcgataagagttggtactatttgcgggataacctatacattgtaccagtccctaaggggggaagagcggaagtcgctatagaagacctgttcgatcccgccttgctcgaggttgagttagagggaaagaagttcgatcggactaaccatgaaagtgatggagaaaaagtttattccaagtttaccttcgctacgaaagttgttgccgcaaggagggatgagatagattttggtagatttcaacccctactccaagccattctggatgtgcaggccgactacgctcagaaaatagcccatgccgtaccatctcctgcgcaggccacagcggcatga

SEQ ID NO: 8128 - RNA, 1734 nt, unidentified
  source 1..1734: mol_type = other RNA; note = synthetic construct
atgaccgttaaatcattaacgcttgaaaggcttaagaaatctacagacttgacagaagtggccatactgttgggcgttaaaccatctgctttgtcccacgccctatacatcacccccactgcaaagaagtatcatacattcagtatacccaagaagagaggaggagagcgtattatcacggcgcctaacgaaaggctgaaactgatacaggctcgtctggccgccctactgcttcagattgagcaggatctggaggccacacagtccaagagttgtatcctggcgcacggcttcaagaacgagttatccatcattacgaacgccgccaagcatcggaacagaaggtttgtgtttaacgtggacctcaaggactttttccccagtattaacttcggaagggtacgagggttttttatggctaatcgcgatttccaattgtcagaaaaggctgcgacaatactggcacagattgcttgccaccagaataagctccctcaaggctctccttgcagtcctcccattagcaatcttatcggacagattctcgatgtgcacctaaacaagcttgcaaaggagtgtagatgcacctatactcgatacgctgatgatatcaccttctcaacgaaccagaagaaatttccggaaaaaattgccgtactccaggccggctctgagcatacttgggtgccatccgatgaattaagctttaggatcatccgtgcagggttcgagctcaataaacagaagaccaacatgcaatatcgcgatagcagacagacgaccaccggtctgatcgtaaatcagaaactgaatgtgcctgtggaatattacaaaactgtgcgcgcgacctgtcacaaactgtttactaccggcactgccttccgcaaactcggctcaaaactgatcccaactaccccccctaaaatccgcggtcagctgagcttcctgttccatataaaggggctcgagactgggcatcggaaattgcccaagcccgagatgcctaacttttacaaactgtacgcgcaattcctcaactttatgtctttctgggctatctctcagccaacactggtctgcgagggcaagaccgacaatatctacatccggtccgccatacgggcactctcggccaagtttccagacctggtggaaaagaaggacggcaaggaacggattaagttgaccttttttaagtacacagggattgccaaaacaattcaggacctcagtgggggaaatggacagcttaagaatttagtccgagaatacccgggcaggactgagaaattcaaagtccaacccgcccaccccgtcatcgtggtcaccgatgtggataagggggccgtagacttatttaaggcagtcagcgacgaggtgggaaaaactattttgggtcacgagcaaccatggtattttctccgggacaatctgtatgttgtgccggttccaaaaggtgcaggtgccgagacagccatcgaggacctattcgattcagctctgctgacaaccgaaatcgatggcaaaaagttcgacagaaccaaccacgaaaaagacggtgacaagttctatagcaagttcacttttgccaccaaagtgattagcgcatccaagacacctattgattacgggggattcgagccccttctgcaggccatcctggacgttcaggctgattacgcagctagaatagcagccccacctgtcggcacagctgctgcagctgcgtcctga

SEQ ID NO: 8129 - RNA, 1773 nt, unidentified
  source 1..1773: mol_type = other RNA; note = synthetic construct
atgacagttgtttccctcaggttggagctgtttaaaaaggcaaaggaccttacagatgtggcaaagatcctggatctcatgcccgctcatatttcattcgccttatataagctggatagacctggcttcgaaccgaagtacgaggaatttactgttcccaagaagacagggggtattcgtacgattaaagcccctcatagggcccttaaagcagtgcagaagcgactcgccaaagatctgctggagattgagcaggccctggaaaccactcgggtgaaaaaggtggactgtattctggcccacggcttcaagaagcggttatccataatgactaatggagaaaatcaccgcaaacgccgctacgtgttcaacgtcgacctcaaggacttcttccccaccctcaactttggtcgcgtgaggggctttttcatgaagcacaaggacttccagctgaacaaggacgtggcaacaattcttgcccaaatcgcctgccatgacaatcacttgccccaagggagcccatctagccccgtgatatcaaacttgatcgccggcgtcttagatatccggctcaatgagctggcacagcaatataactgtacatatacccgttatgcggatgatattaccttctccacctctgaaaagctatttccttcggcaataggccggccagaaccggggagtatcaacctgtgggaggcgggccctaagttactcaaggctattacaagagccggattcgagctaaaccccgtgaagacccggatgttgctcgattggtcacgacaggaggtaacaggggtcgtagtcaaccagaaagtgaacgtgcctgccgattattatgcactcgctgctgccatgtgccaccacctgtttatggacggagcctgttttacaaccgtaggcggtgtgaaaaaaccctatccgcttactaagctccgcggtaggctggcgtacatctaccaggtgagaggaaggggccctaaacctaaaccagctgtggatgacgcagaagataagcctaaattgggcaagccctgggctagcacaaacctttttcagaaatttctggactacgccgacctgtacggaatcgaaaagccagtgctgctgtgcgagggcgtcactgataatatctatctgaaagcagctattcagtccctggcgccaaagtacccaaccttgactacagccgcaggggagctcaaggtaaaacttttcaagtacaccagaagtagtgctgctctgcaacaactgtctggtggggggggaggactcggagtcctagcttatgcatacccccagagagtccgaaagtttaaaagcgggggtaagcatccactgatcctaattggagataatgacgaaggatctgagaagctgttcggggcgattaaggcaaaaactggcaaaaaagtggatgggagcgagccctggtattacttgggccagaatatgtacgttgttccaatcccgaaagttggaggcatagatacccctatcgaaaggctttttgagcctagcctgttagccactcagtatgagggcaaaacctttaataaaacgaacgcttccaaagaccctgccaagtactacgacaaaaaagtctttgcgacgcaggtcgtggccaaagacaaggccaatgtgaatttcgacggtttcgagcccttccttgacgctatcgtctccgttatcaaccatcacaaggctaaggtggggtcaatcccagtaccagctgccgccgttaccatagctacggcagccccctga

SEQ ID NO: 8130 - RNA, 1770 nt, unidentified
  source 1..1770: mol_type = other RNA; note = synthetic construct
atgaccctcccactaaaactgagtctctaccggaaggctagagatctgacagacgttgcaaaaatccttgatttaaaacccgcacatttgtcatacgccctgtacaagttggacaagcccggctttcccccgaaatataaggagtttaccgtccctaaaaaagcaggcggagtaaggacgatcatggctcctcacaaggttttgaaggccgtccagaaaaggctggctaacgacctgttggagattgaacaggtgttagagaagacgcgggtcaaaaaagcggactgtatcctcgcacatgggttcaaaaagaacctcagcatcatgaccaacggtgagaatcatcgcaaaaggaggtacgtttttaacgtggacctgaaagactttttcccaagcctaaacttcgggagagtgcgcggcttctttatgaagcacaatgacttcgaactcgatactgacgtcgctacaattctggcgcagatcgcctgccacgaaaaccagctcccccaaggatccccctgcagtccagtggtgagtaatctaatcgcctccgtgctcgatatcaggttaaatgagcttgcaaggcagcacaactgcacttatacacggtacgcagacgatattacattcagcactaatgaaaagctgtttccaactgcaattggccgcagagagcatggatcactgaatctgtgggaggccggatcgaagctggtaaaagtgattgaacgagctgggttcgaactgaacccagcgaagacccgtatgttgcttgattggtcccgccaggaggtgacaggcgtagttgtgaatcaaaaagtgaatattcccgccgactactatgctactgctgcagcaatgtgtcaccaccttttcatggatggggcctgcttcacaatggtgggaggggtgaaacagcctttctccttgactaaattacgcggacggctggcttatatctaccaggtgcgaggcagaggccccaagactaaacccgccgccgatggtaccgaggataagcccaaatctggaaagttgtgggccagcaccgatctgtttcagaagtttgtggactatgccgacctctatgggatagagcgtcccgtacttctctgtgaaggggtaaccgataacatatacctaaaggctgccatccaggccctggctcctaaataccctgccctggccactgctgccggtgaactgaacgttaagctgttcaagtatacgaagacctccgccgctctgcagcatctcggtggtggagggggtgatcttggaaagctcgccaatgtgtacgcccaacgaacccggaagtttaaatctggaggcaagtaccctttaatccttataggagacaatgacgaggggtctgaaaagctcttcggggcggtcaaagctaaaacaggtaagaaggtggatgggtcagatccttggtattatctgggccagaacatgtacgtcgttccgattcctaaagtgggcggcatcgacacccctatcgagagactgtttgagccgaagcttctggcaacccaatatgagggcaagacctttaacaagacaaacgcttctaaggacccaacgaagttttacgataagaaagtgttcgcgacaaaggtcgtcgcaaaagacaaggcaaatgtcaatttcgacggcttcgaacccctgttgaatgcaatagtgagcattatcaaccaccacaaagccaagattgcgccgattccagccccagctccagccgttctggttgctgccgtcggcccttga

SEQ ID NO: 8131 - RNA, 1767 nt, unidentified
  source 1..1767: mol_type = other RNA; note = synthetic construct
atgacggtggtgtcactgaaacttgaactgtaccgcaaagcggaggacatcaccgacctggccaagatcttgggtctgaaacctgcacatatctcttatgcgttataccacctgcccctgggcgataggtacgaggagttcacagtgccaaagaaaactggcggtgtgaggactattaaggctccccatcggaccctcaaagcgattcagaagagattagcaaaagacctacttgagatagaacaggcccttgagcagtcaagagtgaagaagaccaattgtatcctggcccacggcttcaagaaaaaactctctattatgaccaacggagaaaatcaccgaaaaagaagatacgtgtttaacgtcgatctcaaggactttttccctacaattaatttcggcagggtgcggggcttcttcatgaaacataacgacttcgagttgaaacccgcagttgcgacggtgttagctcagatcgcttgccacgacaacgaactgccccaggggagtccatgctctcctgttatctccaatctcatcgcttccgttatggacattcgtctgaatgaactagctcaccggcacaattgtacctatactagatatgcagacgacattacatttagctcttccgagaaaatattcgctccagcaatcggacgacgcaacgtctccagcattaatctttgggaagctggcatctctctgagccgcgtgatcaaaaaagccggattcaaggtgaacgcagctaagacccgtatgcagctcgattatagtaggcaggaagtcacaggtgtcgttgtcaatcagaaggtgaacgtgcccgctaactactacgctgaggcagccgcaatgtgccatcatctctttatggatggggagtgctttgtaaagatagccggcgtaaagcagccactccctaggcgcaagctgaggggacggcttgcatatatttatcaagtgcgaggacggggtccgctaatcaaggctgcaccagaggaccaggaggaaagacccaaaggaggtaagttgtgggccagctccaagctctttgaacgcttcgtggattacgtggatttatacggcattgagaggcccgtcgtgctttgtgagggcgtcaccgataatatctatataaaaagcgccattcaggccctggcacctatttacccaactctcaccaatcctgccggcgaactgaagatcaagctgttcaagtataccaagaccagtgcagctttgcaacagttgtcggggggtgccggagagttggggaagttggctaacacttatccgtccagaatccggaaatttaagtctggcggacaacacccactgattatcattggggatagcgacgacggctccaagaaactctttgccgctgttgagagtaagacggggaaaaaggtagatgggagtcaaacttggtaccatatgggcgctaacctgtacgtcgtgccgatccccaaaataggtaataaggatacagacatagagcgccttttcgatgtggcactgctgaaaactaattacgatggcaagacattcgacaagaccaacgccgaaaaggacggaaccaagttttatgggaaaaaagtgtttgccacaaaagtagttgcggccaacaaggccacagtgaacttcgacgggtttaaacccctgctggccactatcgcggaagtcatcgatcaccacaagacaacggtcgtctcacctacagttgccgccgtaagctcatcagccgttgccgccgggggaccttga

SEQ ID NO: 8132 - RNA, 1776 nt, unidentified
  source 1..1776: mol_type = other RNA; note = synthetic construct
atgaccgttgtttctctgaagctggagcaatatcgcaaggcagaggatattacggatctggcaaagatctttgactctaagcctgcacatatctcatatgccctctacaaattagaccaggcgcccgccccatcgaaatacacagaattcactgtccccaaaaagagcggcggagtgagaaccatcaaggcccctcacccagctcttaaagccatccagaaaaaccttgcaaaagacctgttggagattgagcaggtactcgaagagacaagagtcaaaaagccagattgcatcctagcccacggctttaagaagaagctcagcataatgaccaatggcgagaatcaccgcaagaggaggtacgtattcaatgttgacctgaaagatttcttccccacaattaactttggtcgtgtgcgagggtttttcatgaagcacaaggattttgagctgaagcccgccgtcgctaccgtgctagcccagattgcatgtcatgataatcaactaccccaggggagcccttgttcgccggtgatcagtaacctgatcgcctcagttctggacatcaggctcaatgagctggcacatcagtacaattgtacatacacacggtacgccgatgacataaccttcagtacaagcgaaaagaattttcctactgcaattggcaggcgctatgtcggatcaattaacctgtgggaagcgggcccgaagcttctgaaagccatctcccgtgccggattcgaactaaacccagctaagactagaatgcagctggactattcccggcaagaagtcacaggtgtcgtggtaaatcagaaagttaacattcccgcggattactgcgccaccgtggctgctatgtgccaccacctctttatggacggggaatgtttcatccaggtggccggggctaaacagccattccctcttaagaagcttagaggtcgcttagcgtacatctatcaagttaggggaaaggggccgaaagtgagaataaccccagaggatgctgaagaaaaacctaagaccccgaaaccttgggcttctactaagttgttcgagaaatttgcagactatgctgatctttatgggattgagcggcctgttttgctctgcgagggcgtcactgacaacatatacatcaaggccgccatccaggccctggccctgaaattcccatctctgactaatgctgcgggggacttgaagatcaagctcttcaaatacaccaagacgagtgccgccttgcagcaactgtccggaggtgccggcgaactcggaaaactcgcgttcacctatgctagtcggatacgaaagttcaaaagcggcgcaaaacatccactgatcctgattggtgactcagattccggctctcagaagctgttcgacgctgtggagaaaaaaaccgggaagaaagtggacggcagccaggcttggtatcatttaggatccaacttgtacgtcgtgcctattccaaaagtaggaaacaaagatacccccatagagcggttatttgaccaggccctcctggatactccctatgagagcaagaaattcgacaaaacaaacgctgagaaggatggcaataagttttacggcaaaaaggtgtttgcgacaaaggtggtcgccgcaaacaagggcactgtgaattttggtgggtttgagccccttctgacggccattgcagaagtaatcgaatttcacaagacgaaggtggctcccccagcaaactccgtgcaagcaattgcacctgtggccgctgccggaccctga

SEQ ID NO: 8133 - RNA, 1764 nt, unidentified
  source 1..1764: mol_type = other RNA; note = synthetic construct
atgaatattgtctcattgaagctagagcagtatagaaaggccacctccctgatcgatatcagccatgtactggctctagagccagcacacatttccttcgccctgtacaagttggacaagccaggatttgcacctaagtatactgaattttctgtggcgaaaaaagcaggaggcgagcgtactatcaaggcccctcacaaagcactgaaagccgtccaaaaaaggctcgctcaggacttattgatgatcgaacaacagctggaggccacgcgcgtgaaacgatctgattgtatcctggcgcacggcttcaaaaagaagctttctatcatgaccaacggcgaaaaccaccgacataggcgctacgtgttcaatattgacctgaaggacttcttcccaactatcaattttgggagagtgagaggcttcttcatgaagcacaagagctttgagctgcaggagagcgtcgccaccattttggcacagatcgcctgtcacaataatcagctgcctcagggaagtccctgctcccccgtgatctcaaacctgattgctagtgttctggacatccgtctgaacgagctcgcacatcagtacaactgtacatatacacgatacgctgatgacatcacattctctacaagtgagcagaattttccaaccgctataggtaggagggatgtcgggtccgtgaacctctgggaagcgggtccgaaactcctgaaaacaatccagcgggcgggctttgagcttaatcccactaagaccaggatgcaacacagctattcccggcaagaagttacgggagttgtggtgaatcagaaagtgaacatagccgccgattattatgacgaagtcgccgccatgtgccatcatctgttcatggatggcgaatgctttattaaaatctcgggtgctaagcagccgtttccgattaaaaagctgcgcgggcggctcgcttatatctaccaagtgagagggaaaggccctaaagtaatacagaagggagaggacggtgagtctaaaggcacccagaagttctgggcctctttcaatttattcgaacggttcctgaactacgcagatctctacgcggttgatagacctcttgttttgtgcgagggtgttacagacaacatatacattaagagtgcaatccaggcgcttgctgtcgcttacccaaccctgacaagcccctcaggcgaacttaaggtgaagttgttcaagtataccaagacaagcactgctgtgcaacagctgggcggagggtccggagaactcttgaagctgattaccaagtaccatctccgcactaataagtttaaagccgggggcaagcaccccctcattgtgatagtggacctggacgaggggtccaagacgatctttaaagaagtggagaaaaagaccggaaaaaaaatcggaacccagccctggttccactgggacaagaacctttacatcgtacccattcccaaggtaggcggcgccgatacgcccattgaacggttattccctcaggctctcctagaagccacctatgacgggaaaacatttgatctcactaactcagagaaagatgggtcaaaattttttggcaagaaagtgtttgccactaaggtcgtcgccgccgataaaggggccattaacttcggtggatttgccccactactggcagctatagtggaggtcattgagcatcacaagacaaagatgagccttcctttagcagctgccgccgctccagttgcagcagctgcaccttga

SEQ ID NO: 8134 - RNA, 1776 nt, unidentified
  source 1..1776: mol_type = other RNA; note = synthetic construct
atgacgaccgcagccgccctaaaactggatctgtacaggaaggctgaggacatccgggatttagcagccatactgggccttgccccagcccacattagctatgcacttttcaagatgcccgacgctaacaaatacaaagttttcactgtgccgaagaaaaccggcggcgtgcgcactattaaagcacctcataagacactaaaggctatacagaagcggctcgcccaagatctgatgggcatcgaagcccaccttgaggccgtgcgagtcaagaaacgagactgcatcctcgcccacgggttcaaaaagaagctgtctatcatgaccaacggcgagaatcataggcatagaaggtacgtgttcaatgttgacctcaaggacttcttcccttcgatcaactttggaagggtttacggctttttccagaaaaatcaaagcttcaatctcaagcctaaagtcgcagctgcgattgcccagctggcctgtttcgagaaccagctcccacagggctcaccttgctccccagtcatctccaatcttattgccgggattctggatgttcgcttgaacgaactcgcccagcagtataactgcagctacacgaggtatgctgacgatattacattctcaacttccgaacagaattttccctctgctatcgggcagcgacacccagggagcatcaacttatgggaagccggcccaaaattgttgaaggctattaaacgggcgggctttgagctgaatgccactaagacaaggatgcaacttagttattcaagacaagacgtaaccggaataatagtaaaccagaaagttaacatccctgtcgactactatgagacagtggctgccatgtgccaccacctgttcatggacggcgcttgtttcaccaaggttggtggtgtcagacatccgttcccccttaagcggctccgtggtcgcttggcgtacatctatcaagtgagagggaaaggacctaagcccaagacggtcgatgaggcaggggagcccaaaggcggagcaaaattttgggcgagcaccaatctgttcgaaagattcctgaattacgctgacctgtacggcgctgaacgcccggtgctgctgtgtgagggggtcacagacaacatttatatccggagtgcccttcacgctctcgcagccaaatatcccacaatgatcactcccgcctctgagctcaaggtaaaattgtttaagtacaccaagactagcgcagcaatccagcagttaggtggaggatcaggagagctagtcaaactgctgcgtgagtacagaaaaagaacggcgaaatttaagagtggtgcgaagcatccattgatactgatcgctgattctgacgaagggtccaaggaattatttaaggaggtgactaagcggaccgggcacaaggtggatggtacccatgcctggtataggatcatgaccaacttgtacgtagtgcccattcctaaggtgggagcagccgatacccccatcgaacgcctgtttgagcaggtggtgctggacaaaacatatgatggcaagaaatttgacatgacaaattccgaaaccgatggaagtaaattttacgggaagaaggtctttgccactaaagtggtggccgcgaaccgcggcgctataaagtttgatggattcgaaccgctgctaacagccattgccgaggttattgaggactataaaacaaaggtggcacctgtgctcgctctgattcctgcagcagctgccccagctccacctgcaccagtacccgcttga

SEQ ID NO: 8135 - RNA, 1788 nt, unidentified
  source 1..1788: mol_type = other RNA; note = synthetic construct
atgacaattgtctctctgaaactcgagcagtataagaaagctgatacattgacagacgtcgctaggattttggacctgaaacccgcccacatttcttacgccctctacaaactatctaacactagcaagtatgatgagtttaccgtacctaagaagtccggaggggatcgcattatccgcgctcctcacaaaacactcaaggctgtgcaaaaaagactagcgaaggacctccttctgatagagcaggaattggaggcaagcagagtgaaaaagaggaactgcatcctggcccacggattcaagaagaagctgtcaatcatcaccaacggggaaaatcatcgtgatcagaggtacgtattcaatgtggacttgaaagatttcttccctgcaatcaattttggccgggtgtttggctttttcacgaaacataaagacttcgccattaaacggaaggtggcagccgtgttgactcagatcgcttctttcgaaaaccagctgccccaaggttccccctgctctcccgtgatctccaatctgatcgctagcgtgatggatatcagactgaacgaacttgcccggcaaaatcactgcacttatacacgatatgcggacgacattacctttagcactagcgagcagcttttccccagtccgatcggtaggagagtcaacggttcaattaatctgtgggaggccggccctaaattagtgaagatgatagcccgggccggttttgagttaaaccacgcaaaaacaaggatgcagtactattacagcagacaggacgtcaccggagtggtcgttaaccagaaggttaatatcgcgtccgactactacgctacagttgcggccatgtgccaccatctgttcatggatgggtcctgtcatgtgaaggtcaacgggactaaacagccatttagtctagccaagttacgcgggcggctggcctttattcaccaggttcgagggcggggcccaaagctttgtcaagtgcccgatgaaaaggacgaacagaccaaagcaccaccacaaaaggtgtgggcttcgttcaaactcttcgagcgatttcttaattacgccgatctctatggtgccgatcgtccggtcgtcctctgtgagggggtaaccgataacatctatattaagtccgcactgcacaacttggccgcgaagtaccctgctttgacctctccagccggcgaactgaagatcaagctcttcaagtataccagaagtagtgcagcagtccagcagctcggcggcggatgtggtgaccttacgaaactggcaaggatgtactcagctcgcataaaaggctttaagtcagggggaaagcatcccgtgattatggtggtggatagtgacgagggcagcaaggatctgttcaagcatgttcaacacgtcactaaaaagaaggtggacggcaccgactcgtggtactttctcgagagcaatctgtatgtgatccctattccgaagatcggcggcgcagatactccaatagaaaagttatttgagcaggccctgctggacaaaccttacgaaggaaaaaagttcgatatgaaactgaaggaaaccgacggagcaacacatatttccaaaaagacgttcgcgtccaaagtcgttgctgttaacaaggccactataaatttcggaggatttgaaccagtacttaatgctgtagtggaggtgatcgaggactataaaaaacgcgtggggtcagtgattccctctgcccctaccgcagccgtagttgctctggccataatcgctgggggcccccagtga

SEQ ID NO: 8136 - RNA, 1758 nt, unidentified
  source 1..1758: mol_type = other RNA; note = synthetic construct
atgaccgttgtttccctgaagctagaacagtatagagatgccgaagacttatctgacattgcccacatcctggatctgaaacccgcccacatatcctacgctctgtataaactccccacccaccaaaagtaccgggagttcactgttcccaagaagagtggcggagtccgcaccatcaaagccccccacaatactctcaaagtaatacaaaaacggctggcacaggatctccttttaattgaacagcagctagagcaagcacgggtgaaggaacgcgactgcatcttagcacatggctttaaaaagaaactctcgataatgaccaacggggaaaatcaccgcggccgtaggtatgtatgtaacgtcgacctccaggatttcttcccatccataaatttcggccgcgtgttcggctacttttcaaagaacaatgactttgcacttaagcctaaggttgcgaccgtgttggcccagattgcttgccatgagaatcagctgccccagggaagcccttgttcacccgtgatttccaatctcatcggcaggatccttgatatcagactcaacgagctggctagaaggtatcattgtaggtataccagatacgccgacgacatcacattttcaacgagcgagaaacattttcctatagcgatcgggatgagggaattgggcagcattaatctttgggctgccggtcctaagctgctggacgcaatcgcccgaaccggatttgagattaacccaaaaaaaacgaggatgcagtatcactacagtcgacaggaggtcacaggcgtggtggtaaaccaaaaggtgaacatctctgcggattattatgccaccgtgtctgccatgtgcgaccatctgtttaagaagggggagtgccatattgacgtgggaggaacaaagcaaccattcagtatcagaaaacttcgaggccgcctggcatacatctatcaggtgcgggggaaagggcccaagcacagacagacagccgatgacaaggatgaccaggtgaaggggtcccagcagcggctctggagttccttcaaactttttgagcgattcctgaactacgctgatctgtatggcgtcgatcggcccgttattttgtgtgaaggtgttaccgacaacatctacattaagagcgcaatccaagctctggctgctaagtacccgacgctcacaaacgcggtcggggatttgaaagtcaagctcttcaagtacactaagacttccgcttcagtgcagcagctgggtgggggttctggagaactcctgaaattggtgaatacgtatagcagcagaactaggaagttcaaaattgcaccgaagaaccctctgattctggtggctgactcggacgatggctctaagcctctttttaaggttatcgagaatcgtactggaaagaaagtagatggtagccacgcatggtaccacctggaaagtaacttgtacgtcgtgcctatcccaaaggtcggtgccgccgatacaccaatcgagggactgttcgaacagattctactggacaccacttacgaggggaagaaattcgaccgtacaaatagcgaaaaagacggaacaaagttttacggcaagaaaacctttgcgacaaaagtcgtggcagccaacaaaggatctatcaatttcggccgctttgagcctctgttgactgctataaccgaggtgattgaggattacaaaccaaaaattgctccatcaccggttccagccttagcccccgccctagtgtga

SEQ ID NO: 8137 - RNA, 1755 nt, unidentified
  source 1..1755: mol_type = other RNA; note = synthetic construct
atggcccacctaaccaagttgcgggcagcatcttccttgaacgatctcgccttcctgctgggagtgaagccctcttccctggcctacgtgctatacaaaattcctgatgagaagaagtacacccagttccccatctccaaaaagaccgggggcgaaagaatcattagtgcccccgatccaaggttgaaaatgatccagcgcaggctggcaaagctcttagcaaaatgtcagattgaggttgaggaaaagctgaaagtgaaaccccagtgcactctggcgcacggctttaaaagcgggttttccattcagacaaacgctgctaatcaccgtggtcaacggtgggtcttcaatgccgacctccacgactttttcccttcgatcaattttgggcgagtaaacggcttttttgtgaagaaccagtactactccctgaattcaaagatcgcacttctcatagcacagatcgcatgtcatgaaaaaactcttccgcagggtagtccgtgcagccccatcataagcaatattattgctcatctgctcgatatcagactgaacgaattagcctctgcgaatggctgcacttatacccggtacgctgacgatctgacatttagcactaatgaaaagaccttccctacgagcttggctaaaagggaccctgctaatcttaacaaatggactgtgggctctgggttagctaaacgtattgccaaggccggatttatcatcaacagcaagaagaccagaatgcagtatagagattctaggcaggaggcgaccgggctcgtggttaacgagaaggtaaacgtcaaatccgactattataagcttgcccgctccatctgctggcagttgatgaaagaggggaaagccttcacgaaagtcaatggagatagtgtcccactgaaactcaaatcagttcgaggaatgatagcgttcatttaccatgttaaacgatgggacgacgagcgcaagcaggttccaatcgatgaaatcgaaaagcgggcatacttcaggctgtatgccgaattcctgaattacatgtggttctttggacaatcccgcccaactatcgtgtgcgagggaaagactgataacatctatattaagtgtgccatcaggtccctggcacagtcataccccagcctggttaagtctagtggggagaagcggggcctgcttgtgcagctctttggatttacgaaaacagctgaccaggtgcaaaaactttctggcggtgcaccacagctgaatatactgttaagagactaccgcaaaaagacagccaactgtaagggcatgccccagcaaccaaccattctcgtggtggacaacgactcaggccctcaaagcttgtatagtcacctgggcaacatactaaagaccaaggtcgacggtagcgaacctttctattgggcctatgggaatctgtatgtcgtacccgtgcctaagattggaggcgctccgacagcaatggaggaactatttgagcaagaggtgctggccacaaagctgaatgggagaaccctcgatctttcaaacaaagaggccgacggcacaaagttctacagtaaaaacgagttctcaattcaggtcgtccagaaaaagcagaaaagcataaagttcgatggtttcaagcccttgcttgataatctcgtggctgtgcaaaaagactacgcttctaaggtggaggctgcgaagaagctgtcggccgccaaaaaggtagctgccgctccaacagccgcaatgccttga

SEQ ID NO: 8138 - RNA, 1752 nt, unidentified
  source 1..1752: mol_type = other RNA; note = synthetic construct
atgactcatttggccaagcttaaggctgcgagctccctgaacgatttagctctgctgctcggagtgaagccctccggcttggcctatgtcctttacaagatccccgatgagaacaaatatactcgctttactgtcccaaaaaaaaccgggggagagaggaccatttctgcccctgatccaagactgaagatgatccagcggagactggccaaactcctggctaagtgccaggtagaagttgaagagaaacttaaagtcaagcccagatgtaccctggcccacggcttcaaaagtgggttctccatccaaaccaacgctgccaatcatagagggcaacgttgggtgttcaacgtggacctgcacgatttctttcctagcatcaacttcggccgcgtccgtggattcttcatcaagaacaaatactacgcactgaattcgagggtggccctgctcattgcccaaattgcctgccatgaaaagaagcttccgcagggctcccccgtgtcaccaatcatatccaatatcatagcgcacttgttggacattagactgaacgaactggcctcagccaatggttgtacttatacccgctacgcagacgatctcaccttctctacctctgagaaatcgttccctacatccctcgctaaaagggacccagcgaatctgaataagtggacagtggggtccgggctagccaagcgaatctctaaggcaggctttgctatcaactcacagaagacccggatgcagtacagagatagccggcaggaagccacaggcctagttatcaatgagaaagttaatgtgcggtcagactactataagctcgcacgctccatttgctggcatctgatgaaagaagggaaggcatttaagaagatagatggggacagtaagccattatcacttaaaagcgtacggggcatgatggcttttgtgtaccatgtcaaacgatgggacgatgagcgaaaacaggtgtccgtggctgaaattgagaagagggcctatttcaggttatatgcggattttctgcactatatgtggtttttcggacagacgaggcccacaatcgtgtgtgagggtaaaacggacaatgtgtacatcaaatgtgctctcagaagcctcgcacagtcatacccgaccctcgttaagactgccggcaagaaaacatctttcctggtccagttgttcggatttactaagactgccacccaagtgctcaaactgagcggaggtgcacctcagttgaataacttactgcgggactatcgccgtaatactgccaattgcaagggcatgcctcaacaacccacgatgctgatcgtggataacgattctgggagccagagtctctattctcacctaggccgaattttaaaaacagatgtagacggatctgaaccgttttattgggtttacggaaacctttacgtcgtgcccctgcctaagattggcagcgggccaacagcaattgagcagctgtttgagaaggaggttctcgacaccgaactggaaggcaggacactagatctgaccaacaaggagacagacggtaccaaattctacagcaagcacgagttcagtatacacgtcgtgcagaagaagcagaaaagcattacttttgacggttttaggccacttttggacaacatggtggctgtacagaaagactacgcatcacgggttgctgctgcagccaaacctcgcacggccagtaaggtcttggccgcggcaacagctagtccctga

SEQ ID NO: 8139 - RNA, 1749 nt, unidentified
  source 1..1749: mol_type = other RNA; note = synthetic construct
atggctcacctgacgaaactgaaaagcgccgcgacactaaacgatgtcgccctcctgttgggtgtccagcccgcttcgctggcctttattctatacaaaatacccgagcaccaaaagtatactaagttcccagtacctaaaaaatccggaggggaacgcatcatcagtgccccggatccacggttgaagatggtgcaaaaacggctggcaaaattgctcaaaaactgtcagctggaagttgaggccattctgaaggtaaaatctcagtgcgtcctcgcgcatgggtttaagcctggactgagcatccagactaatgccgccaatcaccgtggacagcggtgggtgctgaacgccgaccttcaggactttttcccttcaatcaatttcggacgagtttatggtttcttcataaagaaccagcattacatgcttaataagaaagtcgccacgattatatcccaaatcgcatgccatgaaaacactttgccccagggatctccatgctcacccgtgctatccaatatgattgctcatatgctagacattcgcctcaacgaactggcatcatccaatcgttgcacatatacccgctatgccgatgacttgacctttagtacaagtgagagagtcttcccctccagaatcgccaaacgcgatccgagcagcctgcacaagtgggtggctggagcaggcctgtcaaagagagtggaaaaggctggctttgccatcaatgggaagaaaacaaggctccagtaccgggacagcaggcaggacgctacaggcttagtggtgaacgagaaagtgaatgtcaagtccgagtactacaagctcgctcgggccatgtgttggcatttaatgacaaagggcagcgctcacctgaaggtgggctctatcccagtccctgtggatgcaaaaaaagttcgcgggatgctggccttcatctaccacgttaaaaggtgggatgacgacaggaccaaggtgccgaaagaggaaatcgaaaagagagcctattatcgagtctacgccgacttccttaattacattagtttcttcggccagccccatatgaccattgtgtgtgaggggaagaccgataatgtctatctgagatgtgcggtgagatcacttgctgctttatatccatctctcatccaagtgaagggaaaaaaaaggaacttccttttgcagctcttcaagttcacgaaaactgccgatgcagtgcagcacctgtcagggggtgccagtcagctgtctaatctgttgagcgagtacaggaagcggatcaaaaactgcaaggggaccccccaacacccaactgtactggtggttgacaacgatagcggtcccgaaaagctgtttaagcatctctcctctcttctcaaaaaggacgtggatggctctgaccccttttacttcgtctacgagaacctttatgtggtgcctgtgccaaagattggaggcgcatttaccgcaatggagcaactcttcgaatcgcacgttcttaaagagaagttaaacggccgaatactggatctgaccaacaaggagcctgacgggactaagttttactccaagaacgaatttagcgttgagatcattcagaaaaagcaggctagtatcaagtttgatggttttaaaccactgctgaatgctttggtagcagtacagaatgactatgccggcaagattgcagcgaaaaaggccgcaatacctgcccctgctccagttcctgctctcgcagcgccctga

SEQ ID NO: 8140 - RNA, 1836 nt, unidentified
  source 1..1836: mol_type = other RNA; note = synthetic construct
atgttgggttggattgcccatctgcgttttctgcagtttattgacgtgtcatcttgcctgggagtcagtgcctctagactgccatctggagtttcagtcactgggagcacactgaagaccctccaggccatccagaatctgcacggatttgccgccttcctgggagtgacaccaaaggccctaggacatgccatccatggtatccccgaggtgagcaagtatacaaaattcgagattgccaaaaagtctggcggcaaacgcgagatttgtgccccagtgccacacttgaaaaggatccagcgccgcctggcaaacaaactcaaagaaatcgagatgagcttggagggtgagctcaccactaatgaacacgtacttagtcatggctttaaacccaacctaagcattgctaccaatgctcgcgcacaccggggaagaaggtgggtgttcaatatcgacctggccgatttttttccatccattaattttggccgcgtctatgggtttttcttgaaaaattcccgatatggcgtcagcaaaaccgtcgctacgttaatcgcacaaatagcctgctacgagaatcagttaccacaggggagccccagttctccggtgatttccaatatcgtagctcatattttggacatacggctccacgagctagcggccagtctgaactgtacctacactaggtacgcagacgacctcaccttctctacgaatgaaaagggttttcctggcgccatcgctaaacggtcacaggatgaggacgacgtttggaagatcggaaagaaggtcaagagcattattaagcagagcggctttgagattaaccccaaaaagaccagaatgcaatatcggataagtaggcaggatgtgacaggcttggtggtgaacgaaaaggtgaatgttagagccgaatattcacgaaccgccagagcaatgtgtcaccaactgtggacgaaaggcgctgcttttcagaaagacgggaagctgaaactggctaagactcccgaacaagtgagaggcataatgaacttcgtgtaccatatcaaagagtgcgaggaagtgcggcaatctgatggggccgaattcgatccgtccgcacctcttcctggctatgcgagaatatacgctaagcttctggattacctgtccttctgggggacagataagcctgtgctcctgtgtgagggaaagaccgacaacatctatattaagtgcgctattgagaacttagccgcctcattcccaacactcatcgagtcgtcaggcggagtaattgaacctgctgtgcgcttctttaaccgttcagatgttaaagacactaaagatagcctgacctggaaactgcagaaactcgcagggggcgttacagaactgacatcctttctgggagagtatagggaacgtataaaagactttaagcacgggggcaagtacccgcttgtaatcgttgtggacaatgatcaggaatcgaaaggtatgttcagccacattaagaacatcatcaagtccgcagcccctgtagacgggagtgctcctttctattacatctatgctaacctatacgtggtcgcaatccccaaaataggttccaaggacacatacattgagaggctcttctccgataaggttcttaagaaaactctcgatgggaagacgttcgacgtgaccggtaaaaagaacaacaaaacccactacttcaagtctgactttgccaagaaagtcataaagaagaacaaggcgaatatcgatttcaagcggttcaagccccttttagaacgaatcgcggcagtcaaagcagattacgcgactaggatcaagacaactccctga

SEQ ID NO: 8141 - RNA, 1713 nt, unidentified
  source 1..1713: mol_type = other RNA; note = synthetic construct
atgctcttgggcatgaaacccgcagccctggcctatattctgtataaacttcccgcaggagcaaaatacaaaagctttgagatcgagaagaagtcaggcggcgtcaggaagatcatggctccagagccaaggcttaagatgctgcagagacgcttagccgatctgctgctagcctgccagtccgagattgaagcgtccatgaagatcaaagacgattgcgctctggcacacggtttcaagcctagactttccatcttcacgaatgccgagaagcaccgtaaccgtcgatgggtgtttaatgcagacattgaagatttcttccccacaattaatttcggccgagtttatgggttctttcagaaaaatcaccactttgcccttccaaagccagttgctacaattatcgcccaaatagcttgccacgagaaccaattaccccaggggtcaccatgttctccggtgatatctaacatcattgcccacatcttggacattcacttgaatgacctcgcttatagacacaattgtacctatacccgctacgcggacgacttgactttttctaccaacgagaaacagtttcctcgggccattgcaaagcggcaagtcggagatatccatgagtggataccgggaagtggcttgaagaaagccctaaagtctaatgggttcaaactgaacgggagcaaaaccaggatgcagtattgtgactcccgccaggaagtaaccggcctggtcaccaatgaaaaagtgaacgtgaaacaacagtactataagcaggcccgggcaatgactcgcgaactggttaccggaaagaaacctttcgttaccgtagcaggcaaaaaagtcgaggtggccagggatcatctccgggggatgctgaacttcatctacttcattaagagcaaggaaaacaagcgcataggattcacatttgacaaggaaaacgataaactccccactttccacgcaatctacaagcagtttctggattacatttggttttacggaatcgacgagcctactattatctgcgagggcaaaaccgacaacatctacctgaaggccgccattaaggcccgggctgcccattttccagaattagtaaagacagtggaaggtgtcaccaaaatacgacccaggtttttcaaatattcagacacagctgcggagcttcaagacctctccgggggcacaggtgagctcaataatttgctggcgcattaccggaataggattactactttcagagggggcgctaaccagcctgtaatcattattgtggataacgacagcggggctaccgctatattctcgcatatctacaacatactgaatccgaagatcaagagcacgggtggaaaaaaaggaggcgctactcctgctgcccctgtcgatggaagtgaacagttctactacctgtacgaaaacctttatatcgtgcccgttcctaaggtggctggggctgagacacccatcgagagattatttgaccccaaactgctgaagacagtgtggaatgggaagcagctagatctgacgggcgacaaggacccagccaagtactattttaagaacgatttcgcggttcatgtcgtgaaggagggtggcgcaggtgtgaagtttgatgactttgatccactcctcagtgccatcgtggctgtcaaagccgattatgccaaaagagtggcactgctcgcggcagtggcctga

SEQ ID NO: 8142 - RNA, 939 nt, unidentified
  source 1..939: mol_type = other RNA; note = synthetic construct
atgaacaccccactctctaaaattaagagctgtacaaaccgatcagacctggccttactgctaggtgtaaaacccgccgcactgtcctacatcctttacaagattcccgatgaaaataagtactactccttctctattccaaaaagaaatggagatcagcgccagatctcagctccaatcccagccttaaagatgctgcagaggcgcttgagtgagcacctgtacgaatgcctgaatgaaatcgagtatctcgaggcggtggatccgcagtgcgtcgtagctcatggcttcaaaaagcacctgtccatcgcaacaaatggatcacatcaccggtccaaaaggtgggtgttcaactgcgacatcgaggaattttttagctccatcaacttcgggagggtgaaggggtactttgaaagaaacagacactttcaactgcaacctgaggttgcccttgtcgtggctcagatttgttgtcacgagggagttttgcctcagggcgcccccacgagtcctataatcagcaatcttattggctctattctcgacgataggatcagtcggctggcgaatgagctgcggtgtacctatacacgttatgctgatgatttgacttttagcaccaacatggcacacttcccccggcagatagctgttgccgacgaaaagtctcctagccgctggaggattggggacaagctccttagtcgcgtcgcacaggccggtttcagaataaatcatgagaaatctcggatggcaatgccgaactcacgacaaacagtgacagggctaacggtgaataagaccgtcaacgtggccactacctattacaagatgactcgagctatgtgccatcatctctttactaccggctcctattcgagcggtggcttgaacgacgcccccaaaggaagagagctcgcggccctggaaggccgttga

SEQ ID NO: 8143 - RNA, 1740 nt, unidentified
  source 1..1740: mol_type = other RNA; note = synthetic construct
atgaaggtggagatctacaaatttgggctaaaggagctgaaagcatgcgtggatctgagcgacgtggcatttctccttgacgttgaacccaagttcctgtccaaacagatctacaaaacagacgccgctgttaagtaccacagcttcaccttgcctaaaaaagacggaagctcaaggctgataaacgccccgaacaagaaccttaagtttatccagagccggctgagtaggttgctataccagtgttatttcgacattcatgggaagccagagttcccgggacgggtcattagtcacggctttcagaaacaacgggacctttcaatatataccaacgccattagacatatcgggaagagacacgtattcaatgtcgatctggaggacttttttccgtcttttaatttcggcagagttagggggtatttcatcaaaaatgagcgctttgctctgaaccccaccgtcgccactgtgttggctcagactgcgtgccacgacaatgtactgcctcagggagcccccacgtcacctattatttccgagctcatttctcaggtcttagactatcgtctgcaggccgtggcctccaagtacagatgcacctactctagatatgctgatgatatcaccttctcgacaaacctccccgagtttccacaccagatcggcagtcaggatgccggtgtctggaccgcaggactgtctatcgaaaaggcagtatcctcctgtggtctgaagctcaatgcagataagacccggatgcagctcggccagcagcgacaagctacaactggcctcaccgtgaatcgaaaagtcaacgtgggacggcactactacaaaggggttaggttctgtgctcatgccatgatgacgaccggcaaagcagacgccccttcctatctcaaaatccccgagaagcagctgaacagtcatcaaatttggggtatgctgtgccacatcgatgatataaaagggcgcgaaaacaaccatgcacccattagacacttttcttccagccatccagcgccacattacctgcgactgatgcgcgatttcttccacttccatcgcatccacactaatcctaaacccgtaatcatctgcgaaggtaaaactgactacatctacctcaaggaagcgattcgctggaacgttggggatcctatggtggctacattgcttgatgtcgtcccacatacaaaaaagagcaagggcgatcactggaatgtcgatttcgtgaggcattcggacactgctggtgacctgcttgaactggctggcggcgggggagacttacccaaatttgccgagtaccacctcggacgtgtggacaagctgtataatggtgaagccgccaaacctgtgatcataatagtggataacgatgggggctctgacggaatgtggacatggattaagcgggttactgagtcagcgacaaagattgacggctcaaaaccatattaccacattggcaaaaatctctatgtggtgcctattccctccggaggccaagcagatttttatatcgagaagttattcccacaaccatggctaaatgccaagcttgggaccaagacattgaagctgatacagaagaagggggacaagttgagtcctaatgaatatggtaaaggcgaattcgctacgaaagtgattcgtgccaacaggggaaaggtggactgtagcagcttccttcccttgttacataccctgtttgagatcatccacctgaagtga

SEQ ID NO: 8144 - RNA, 1557 nt, unidentified
  source 1..1557: mol_type = other RNA; note = synthetic construct
atgaaggaaaagatctacaagttcggattaaaggaactgaaatcctgtatcgacctgtccgacgtagcggttctcctcgacgtggaacccaagttcctttcaaagcagatctacaaaaccgatgccgctgtgaaatatcacagttttgccctgcctaaaaaggacgggtcgtcacgattgataaatgctcccaataagaacctaaagttcatccagtcccgcctgtcacgcctcttgtaccagtgctacttcgatattcacgggaagcctgagtttcccgggagagtgataagtcatggatttcaaaaacaacgcgatctctccatttatacgaatgccatccgacataccgggaaacgccatgtgttcaatctggatcttgaggactttttcccaagctttaacttcggccgcgtccggggttactttattaaaaacgagcggttcgccctaaatccgactgtagccaccgttctcgcacaaaccgcctgccatgacaatgtacttcctcagggcgctccaacttcgccagtcgtttctgagctgatctctcaagtgctggactataggctgcaggctgtcgctagcaagtacagatgtacatactctaggtatgcggacgacattacattttctacaaacctgccagagtttccgagccagattggctcccaggatgccggtgtctggaccgcaggaccttccatagagaaagcaattagcagctgcggtttgaagctgaacgcagccaaaactcggatgcagcttggccagcaaagacaggccacaaccggcttaacggtgaacagaaaagttaacgtcggcaggcactattataagggcgtgcggttctgcgcccacgcaatgatgaccactggcaaggctgaagccccaaaatacctgaaaatcccagagaaacagctgaatagccaccagatatggggaatgctatgtcacatccacgacatcaagggtagagagaataaccacgcccccatcaggcacttcaataacgggcatagtgcaccccattacctgaagttaatgagggacttttttcatttccaccgtatacacactaaccccaaaccggtcattatttgtgaaggcaagacagactatatttaccttaaggaggctattaggtggaacattggcgatcctatggccgcacccctcttggatgtggtgcctcacacaaagaaatctaaaggagatcactggaacgtggatttcgttcggcataccgataccgcgggggatcttctggaattggcgggcggaggagggatctgcagatccctgcgaaatacaatctgggctgatctcaagtcttcaacaatggcaatgcagcagtcacagagcagtctcagctctatcactatcgtgggagtgaaggcctgtggggtgggctccaggtcaagtagaaacccccggcgcagatcaatggacaggtcccgtactaccactctggctaagacatccaccctgttccctagccgtgtccggggtaaagctacctttacgtctcgaagcagttttccacataatgggtga

SEQ ID NO: 8145 - RNA, 1740 nt, unidentified
  source 1..1740: mol_type = other RNA; note = synthetic construct
atgactaagaagatttatcggtacggactgaaagaactgaaaagttgtatcgatctgtctggggtcgcttttctcctcgatgtggaacccaagttcttaagtaagcagatctacaaaaccgatcctggggtgaaatatcatatattccaggtgcccaagaaagatggttcttctcgtcttattaacgcaccgaacaaaaatctcaagttcatacagtcacgcctctcaaggctcctgtaccagtgttattttgacatccacggaaagcctgaatttcctgcaagagccatcagccacggatttcagaagaaacgagacttgtcgatttacactaacgcattcaggcacaccgggaagcgtcatgtctttaacgctgatttggaggacttctttccttctttcaattttggacgtgttcggggctactttgtcaagaacaagcatttcgcgctcaacgacaccgtcgccaccgtattggctcagacagcttgtttcgacaatgcactgccgcaaggggccccgagttctccaatcattagcgaactgatctcccaggcattagattatcgcctgcaagcgattgcacggaaacatagatgcacatattcgagatatgcagacgacattaccttctccaccaacctaccagagtttcccgagcagatcgggcttgctgatgccggtggatggatagccgggagtagccttgagaaggccgtcacatccagcggcttcaagctcaatgccaaaaaggttaggatgcagttcggagatcagcggcagtcaactacaggtctgacagtgaatagaaaggttaatgttgggagacactactataaaggcgtgcgcttttgcgctcatgccatgatgacggccggaaaagccgaggctccagcaattctgaagctgccagagaaggagctgtctagccatcaaatatgggggatgttgtgccacgtgcacgacatcaagggtaggcagtccgatcacgccgcgatccgatcctttacaaaatcccatccagctccccactatctaagactcatgagggatttctttcactatcatcggatccacacgaatcccaaaccccttgtgatttgtgaaggcaagacagattacatttacctgaaagaagccatccgctggaatatcactgatcccaaggtcgcgaagttgctgaacgtaagccctctgaccaaaactagtaagggagatcattggcacgttgatttcctgcggcacactgatatggctggcgacctcttagaccttgcgggcggaggcggcgatttaccaaagttcgccgcataccatctggaccgattcgagaaactgcacaaggctgaggccaccaagcccgtgatcattatagtggacaacgacaatcagtccgccggtatgtggagctacattaaagaagccattggctctaagggtgtaatcgacgggtcacaaccttattaccacgtgggcaagaacctgtacgtggtgcctatcccatcagcaggcaaaaaagacttctacatcgagaagctgtttccccctaagtggatgaaggagaaacttgggaccaaatcctttaagatcatgcagaagaaaggagagaaactaggcccagacgaatatggcaagggcgagttcgctaccaaagtcattcgcgccaacaggggtaaagtggactgcagcaattttttgcctttgctgcaaactctcagcgacatcacggacatagaatga

SEQ ID NO: 8146 - RNA, 1755 nt, unidentified
  source 1..1755: mol_type = other RNA; note = synthetic construct
atgactaaacagatctacgagtatggtctggcagacctaaagctttgcaacgaccttggtgacttggcacgactgctgcatgtgcgcccgaaattcctgagcaagcagatctaccacacacccgatagcgtgaaatattccgagtttgaattgccaaagaaagatggctccaagcgctccatatctgcgcccaacaagaacctgaaatttatccagagcaggctttccagactcctttaccagtgctacttcgatatccatggagtgccagagaatacagggcgggtgctgagtcacggattccaaaagggtcgggatctctcgatttataccaatgcaaagaagcacattaaccgcaggtacgtgtttaacaccgacatcgaaaatttcttcccctcatttaacttcggcagagtaaggggctattttatcaagaatcagcacttcgacctgaaacctaccgtcgccactgtcattgctcaaacggcctgtttccagaatgcattacctcagggcgctcccagttctcctgtaatcacggagttaattacccaaactctggactacagattgcaggcgctggcccgcaaataccggtgtacatatagtcgttatgctgacgatatcaccttttccaccaatttgaaagagttccccgcagccattgccttcagacctgaaggagaaaacacatggcgggaaggaccttcactgatcaaagccgttgagtctagcgatttaaagattaaggtcacgaaatcccgcatgcaacagagctatcagaggcaggccacaacagggctgactgtcaatgacaaggttaatatcgctgtctactactacaaaggggttcggttctgtgcttacgctatgatgacaaaaggcaaggccgtcgcaactaacaaactactggtgtcgaagaacggagatctctccaaacagcagatctgggggatgatgtgccacgtgaacgacattaagcgacgagaactgccttatgaggccctgagggccttcaaacccgccccaataccatcctacctcaagctcatgaaggacttctaccatttttacagaattcacaccgcggaaaagcccctcattatctgtgagggcaagacagattacatctatctcaaggaagctatccggtggaatgtgagcgacacccgtgtcgccaaaaccctcctaaacggtcccccattacagaatgtaacaagcgataagggagatcattgggcggttgactttgtaaaccacagtgaaatggcaggcaatctgttggatcttgctggaggcgggggcgacctaccgaagtttgctacctatcatctggagcgtgtgcagaaactgttttctgagaagccacccgtgccagttattatcatcgtggataacgatagccaatcagccggtatgtggacgactataaagaaactgactgaggcctcaaagccaatagacggatctgcaccttattatcacgtggggaaaaatctctacgtggtgccaatcccttcaaacggcgctaaggacttttatatagagaaactgatacccaagaactggctcgatcagaaattggacgggaaaactcttaagctcaatcagcaaaaggatgaaaagctgaagcctagtgagtacgggaaaatggactttgcaaccaaagttattagggccaatagaggcaaggtggatttgagctctttcctgccgcttctgcataacatttgcgacatcattgactctgcctga

SEQ ID NO: 8147 - RNA, 1755 nt, unidentified
  source 1..1755: mol_type = other RNA; note = synthetic construct
atgaccaagaagatatatcacttcgggcttgccgagctcaccagctgcgtcgatcttggggatctggctcgacttttggaaatccagcccaagtttctgagtaagcaaatttaccacactccatacggccagaagtatacacacttccctatgcccaaaaaagacggtagcaccagaaacatctctgcacccaataagaacctgaaattcatccagagtcggctgagtcgacttctgtaccagtgttattttgacatccacggagctcccgaatttccaggtcgcgccctgtcccacggttttcagaagggccgcgacttatccatttttaccaatgccaagaggcacacaaatagacgttttgtgttcaacaccgatatagagaactttttcccaagctttaactttggcagagtgcggggttacttcattaagaatcagcatttccagctgaaacccactgtggcaaccgtgatcgcccagaccgcatgttttatgaacatcctccctcaaggagctccctcttcacccattatatcagaactgattagccaaactctagattataggctgcaagccctggctcggaagtacagatgctcatactccaggtacgcggatgatatcacattttctaccaacctcaaggagttcccaagcgctatagccttttgtccccctggagaggtgaactggagagaaggacctagcctggagaaagcggtactttcatccaatctcaaattgaacagcaagaaagctaggatgcagcaatcctaccagcggcaggcaaccaccggcctcacagtgaatgataaggtcaatatttccacctattactacaagggagtccgcttctgcgcgcatgcaatgatgacaaaagggaaagccgttgctaataataaattgtcagtagccccaaatggcaagttaagtaaataccagctatggggtatgctctgccacatcaacgatatcaaagggcgcgagttaccgcataaagctctcagggccttcaagtcttctcctgtgccatcgtacctcaagctcatgaaagacttctaccattactatcgaatccacactgcagaaaagcctctcatcatctgcgaaggcaagacggactatatttaccttaaggaggcaattaggtggaatgtgtccgacgcccgggttgttaaaaacctgattagcggacctgccctgataaatttcacgtccgataagggggaccactggggcgtggatttcgtaaaccattctaatatggccggaaatctgttagatctggctggcggaggcggggacctaccaaagttcgctacatatcatgtggagcgcgttaaaaaactgtttgcggagaaacctcccatgcctgtgataattgttgtcgataacgacaaacagtcggaaggtatgtggacaacgatcaagagtctgacaggcagcccgacacctattgacggatctgccccatattatcatgtcggggaaaatctgtacgtcgtacccatcccctccgccgggaaaaaggacttctatatcgagaagctgatcccatcaaagtggttgaagaagactttgaacgggaaaaccctaaaactgaaccagaagaaggacgagaagttgaagccgactgagtatggcaaaatggactttgccaacaaagtgattcgtgcaaatagaggcaacgtggacttgactagtttccttccgctgctgcacactatctgtgacatcattgaactcccatga

SEQ ID NO: 8148 - RNA, 1761 nt, unidentified
  source 1..1761: mol_type = other RNA; note = synthetic construct
atgaccaatgcgatctataagtacggaattaaagaactcaagacctgtgtggacttgtccgacatcgcttttttactggaagtcgagcctaaattcctcagtaagcagatttacaagacgtccgatgaaatcaaatattacagctttgagatccccaaaaaagatggaagcaagcgggctatctacgcgcctaacaaaaatctgaagttcatccagtccagactgtccagactgttgtaccagtgctactttgatctgcacggagaacccaagtttcctgctaggtctatcagccacgggttccaaaagggacgtgggctgagtatatacaccaacgctattaggcacaccgggcggaaatatgttttcaatgccgatatagaggacttctttccaacttttaacttcggacgagtcagaggctactttatcaaaaataaacacttcgagctcaacgagacagccgccaccgtcattgctcagatcggttgcttccagaatatgctcccgcaaggcgcaccctcctctcccattatttctgagttcattacccagcatctggactataggctccaggcattggcaaaaaagcaccgctgtacctacagccgatacgccgacgacataacatttagcacgaatctgacggaattcccagcccaaattggcgtgctgtcaaccgatcaagaggcctggaccgcaggcgctggtttcgaaaaggccatcagcagctgcggcttcaaacttaatgtgaagaaaatccgcatgcagcagggttaccagcgccaagcaacaacaaacctcacagttaatcgcaaagtcaacatagggagccactattataaaggagtgcggctctgcgcacatgccatgatgacaaaggggaaggctaccgctcctggcaaagtgtctactccccctggggatgaattaaacagtcaccggatttggggaatgttatgtcacattcacgacatcaagggcaggggactgccacatagagccctgagaaattactcacctactcatccagctccccactaccttaggctcatgcgagacttctttcattatcatcggatacatacctcgcccaaaccgctggtgatctgtgaaggtaaaactgactatatctatctgaaggaggccattagatggaacatggccgatgagcgcgtgggaaagctacttgtgaaggccgatcagcttccgcacttgaagaaatcatccaaaggtgaccactggttagtcgacttcgtgaaccattcggacatggccggagatctgcttggcctagcaggcggtggtggcgacttgcctaagtttgcagactatcacctggataggattgggaaactgcatgccgacgccccaccaggaccagtaattataatagtggacaacgattcccagagtgaggggatgtggacatttatcaagaaagcgactggctcaactactaaggtcgatggctctaagccctactaccacgttgggaagaacctatatgtagtaccaatccccagtggcggagcaaaggatttctatatcgagaagctgtttcccgacaactggctcaaagaaaagctcgcggggaaatcatttaagatcattcagaaaaagggcgagaagttggggcctaacgattacggcaaaggtgatttcgctacaaagatcattaaggccaatcgtgggaaggttgattgctctaattttctgcctctgctgcatactctttgtgacgtgatccagggcaagtga

SEQ ID NO: 8149 - RNA, 1755 nt, unidentified
  source 1..1755: mol_type = other RNA; note = synthetic construct
atgacaaaacgcatctatgactacggactggaggagctgaaggcatgcggtaacctctctcaccttgcatttctgctgggcgtcgaaccaaaattcctgagccggcagatttacaaaaccgacgatcagttgaagtaccattccttcgagatcgccaagaagaatggcaccaaacgtaccattaacgctcccaataagaacctgaaattcattcagtcaagattgtccaggctgctctaccagtgctacttcgacattcacgggaagccagactttccagcaagagctacatcacatgggtttcaaaagaaccgcgatcttagcatctataccaatgcagtgagacacatcggtaggaagtatgtgctgaatgccgacatcgagaattttttccctacgtttaacttcggcagggtccggtgctactttatcaagaacaaacatttcaccctaagtgagacagtcgccaccgtaatcgcccagacagcttgtttccagaatgctttgccccaaggggcaccttccagccctattatatccgaattcatcacccaggctctggactacaaactacagtctttagcgaaaaagtatcggtgcacctactcacgctatgccgatgacataacattttcgaccaacttaagtgaattcccctctcatatcggattcctgagtcccgatacggagaattggtcagtgggcaagagcttcgaaaagtccgtcctcagctctgggtttaaattaaacgctacgaaaatccgaatgcaacaacagaatcagcgtcaggccacaacaaacctgactgtgaatcgaaaagtcaacatcggctcatattattacaaaggagtgcgctttgccgcttatagtatgatgaagaacggtaaggccattgccactggaaaactctctctcactgccaaagagttgaatagccatcagatatggggcatgctctgtcacgtgcacgatataaagggcaggggccttcaccacactgcgttgcgcaactatactaatgcgcatcccgccccacactacctgagacttatcaaagatttcttccactaccacagaatccacacatccgccaaacctatcgtgatctgtgaaggtaagacagattacatatacctcaaggaggccattaggtggaatgtggcaaaccagcggattggaaaactgctcgttaagtctggaaagctgtccgaccttaagaacactaagggcgaccactggctagtagattttgttaatcatagtgacatggctggagatctgctggatttggccgggggtgggggagatctcccaaaatttatgacctaccatctggacaggttcgataaactgcacagtgatgcgccgcccaagccagtgattatcattgtcgacaatgactcccaaagcgatggaatgtggtcgacaatcaaacggatcactggcagcaaggcagccgttgacggaacgaaaccttattatcacgtggggaagaatctgtatgtggtacccatacctgccgggggtgcaaaggacttttacattgagaagctttttccggaccattggcttaaggaaaaattgggcgggaaaagcctcaagatcatacagaagaagggcgaaaagcttaccgctgatcattacgggaagactgacttcgctaacaaagttattaaggcaaaccgaggcaaggtggactgttcagcttttctgccgttactcctgaccctgtgcgatattattgagtctaaatga

SEQ ID NO: 8150 - RNA, 1743 nt, unidentified
  source 1..1743: mol_type = other RNA; note = synthetic construct
atgtctatttaccgctatggcattaaggatttgaaaggctgcgcagatctcggtgacctcgcaaggctgctagaagtgcaaccgaagtttttgagtaagcagatttaccatgtggatgatgcggacaagtaccacgtattcccgatccccaagaagaatggttccctgcggcaaatccatgcccctaactcaaatctgaagttcatacagtctagattatcacgactcttatatcagtgctatttcgacctccatggaaagcccaaaaacctgagcaaggtgctctcccatggcttccagagagacagggaccttagcatctttacaaatgcaaacaggcacaccaataaacgctacgtgttcaacgccgatatagataatttcttccccagcttcaactttggccgggtacgtggctactttatcaagaacgaacacttcaagcttactgaaactgtcgccaccgttattgcccagacagcctgttttcagaactcgctgccacagggtgcaccttcttcccccatcatcacagaatttattacccaagtgctcgattataggctgcagagcattgcgaaacgaaatcggtgtacctactctaggtacgccgacgacctcacgttttccactaatctgggggagtttccatctaagattgggtatccattccccttacccgaggtatgggttgcagggcccggattggaaagagcgatcgccaaaagtggcttcaaattgaacgagaaaaagattcgaatgcaacacgcccagcagagacaagccactactaatcttaccgtgaaccagaaagttaacgtggggtcatattactacaagggcgtccgcttgtgtgctaatgctatgatgaggcacggtgctgccgtccggccgaaaaaagcaattgagcctggaaccccactgacggcgaatcagattcttggaatgctagcccatgtgcacgatatcaagggcagagagttggagcacaaggctctccgtaagtacggcaagtttcagcccgctccccattatctgaggctcatgggggacttttatcactacaaacgcatccacatcaatcctcgacctatcgttatctgcgagggtaagaccgattacatttatctgaaggaggccattcggtggaatgtggctgacccaagggtgtcaagccgcctggtggatcctgtccgtctgctggcacccaccggtaaaggggaccagtggctgatagactttctgaaacacacgaagacagctgataatttcctaggacttgccgggggcggaggggatctgaaaaacttcgtgaacattcatctggggcggatcaagatctttcatgataatcctctgttgcagccagtcatcatcgtcgtagataatgactctcagtccactgagatgtggagcacaataaaaaaagcctcaggctccaccaacaagatagacgggagcgagcctttctatcacgttgctaagaacctttacgttgtgcctataccatccggaggcaaaagcaacttctatatcgaaaagcttttcgacgatagttggctaaaagaggacctgaacggcagaacatttaaagtgctgcaacggaaagacgaaaaactcaaggacacagagtacggaaagggagaattcgctgacaaggtgatcagagcaaaccgcggaaaggtcgattgtagtagttttctcccattactgcacactatatgcgatatcattgacaaatga

SEQ ID NO: 8151 - RNA, 1767 nt, unidentified
  source 1..1767: mol_type = other RNA; note = synthetic construct
atgacaaaaatctataattacgggttggctgagcttcagcagtgctctgatttgagcgacatcgcccatttgctgggggtcaagcctaagtttttaagcaagtccatctacaagacacccggagagaataagtaccaggcctttaagattaagaaaaaaaacgggaccgatagggaaattctggcccccaaccccgatctcaagttcatccagtcccgcctgtcaaggctgctgtaccaatgctacttcgatatatatggggccccaaagaaccccatgcgggtgctgtctcatggtttccagaagaaacgcgacctttccatttacacgaatgcttgccgacacactagtcgaagatttgtgttcaacaccgacctggaggatttcttcccatcttttaattttggcagagtgcgaggatttttcttgaagcacaacaagttcaagcttggcgaaaaagcagccaccacaatttcacaattagcttgctttgagaatagtctcccccagggagctccaagtagccctataatctccgagttcctggcccagccattagacgtggcactacaaaagctagcaaaagatcatcggtgtacttatagcaggtatgtcgatgacatttccttttctacaaatctcagagagttccccagcaaaattgcttttcctttccccattcctgaaaagtggattgtggggccaaagctcgagcatgagatcaatcggtgtgggtttaaaatcaatacatcaaaaacccgcatgcaagcccgtactcactggcagagtgtgacaaacctgaccgtgaaccagggcgtgaatatcaaaaagcactactataagggagcacggttttgtgcgcacgcgatgatgactaacggcaaagcatacgccggtaacaaactgaacatagcatacaatgagttgtcgtccgatcaaatctgggggaaactgagacatatttgcgacgtgaaggatagatctggcgccgtccagcccctaaggaactacaatggtagtaacccggcgccgcattacttaagactgagcggcgattatttccactatcacaggatccatatctcgccaaagccacttgtcatatgtgaaggcaaaactgactatacttatctcaaggaagccatcctgtggcacaagggagacgctcgtgtggccgccaacctcgtggacatttcccggttccctacaaaatggaagaaaaccaaaggcgaccactggggtgtggatttcgtaaaacactcaaaatccgctgaccgctttctggacatcagcggcgggggaggcaacctcgtaaaattttgcaagcttcacattgagcggactaagaaatttcattcagttacgggacagaatccagtaattgtcatcgtcgacaatgacaaccagagcgaaggaatgtggtctttcataaaggatgagacgaattcatctaccaaagttgatggctctaagccctactacaaggtgagtaataacctgtatgtggttcctataccgaagccaaagggcttcgcgggcgacgtttacatcgaaatgttgttccctgatccctggctcaaatacgaaatcgacggacgcaaactgaagatcaagcagaagaaaggggaaaaacttaagcctagcgagtatggtaaaggcgagtttgctgacaaggtaattcgcgccaacaggggttccgtcgattgtagcgcattcgcacctctgctggggaccctctgtgatatcgttgacggaaccgctacctga

SEQ ID NO: 8152 - RNA, 1884 nt, unidentified
  source 1..1884: mol_type = other RNA; note = synthetic construct
atgttcatagtgatggtgggcaggaacgcaggacagatctgctcgtcctcttcgttcgcagtcctcagaattgtcgaaatcctggcctgcgttcgcgtccctgagggctacttcctggaggtggagctagtgaacaagctcgtccagctgcaggctacaaaaagcagaagcgatctggcacggctcatcggagtgaagccaaagcacctttcattcacactatataagattcccgagaacagtcgctacacccagttcaccatcccaaaggcctctggcggaacgcgagacatccatgctcccaattctcacctgaaggctattcaaagtaggacatctggcctcctgtacgaatgctaccacattatttaccctaagaatgacatagcaaacttggagcttagccacgcattccaaaaaaatagaggcctgagtattgctagcaacgggtccaaacaccggaataagcgatttgttttcaatatggacctcaaggatttctttggtagctttaacttcggcagagtgaggggctttttgctgtcaaacaatcagtttggactgaacgctgaagtcgccacaactgttgcgcagatttgttgtcacgagaataagctaccgcagggagcacccacgtctcctatcgtgaccgaattcattacccgcattttggacatcaggctgtctaaaatcgctaagaggaatgggtgtacttattcccggtacgctgatgatctgaccttctcgaccaataaacgcgagtttccagtggaggtcgcttttctcgggcttgatggccaatggactgctggttcagccatcgccaataaaatacatacctccgggttcgagattaatcctaacaagtatcgaatgcaattcgccgacagccgccaggagacaaccggtttagtggtcaacaagaaggtgaacgtatccaaaaactacaccaagcaggtgcggtatatggcccactccctgtttcagaaaggcgagtgttttatccaggaaccccagacaaagttgcctattatggtgtctaaccatgttctgggagggaagcttgcccaccagttccatatcaaatcccaagaatacttagattccaaggggaaagcctttccagtcgctaggtttgaaaaggaagggaaaaaggcccccgcatactatcgtaaatacgcagatttcatctacttccagaacttctttcatagcagcaaaccaacgatcctctgtgagggcgtgactgataatatctatatcaagtgcgcgattaagagcctttacagtaaggtgccctcccttggatatgcatcaaaagccgcctctaagatacaactcttgtgcggcttttataattattctcccactgctcaagccgttaccaagttgactggaggggccaaccccttaaaaaccttcattgaaacgtatggtatcacttttgcgcggtttaaggcggctagcatcgaagtaccagtgattgtagtcgttgataacgatgcagctaataatggtctgtggaaaatgctgcaggaaaagttcggtatagccggcgccgacggatcccatgacttctaccacgtgactaaaaacctctatgtggtaccaattcctaagataggaggcgcagacacattcatcgagcatctgtttgacgccaaaacactggcaagtcagctcaagggtaaatcatttgactttgggcagaaggggaaaaaaatcgctccgaacaagtacgggaaaatggccttcgcgaaagacgtagtcagaaagaaacgtgccagtatagacttctcaggctttttacctgttctggtgaatgtggagaaagccctgagcgagcacaagaaaatgctgtcaacccagaaggccacaagttga

SEQ ID NO: 8153 - RNA, 1728 nt, unidentified
  source 1..1728: mol_type = other RNA; note = synthetic construct
atgagtaaactagccagtctgaaatcagtgcgcacccgcggcgaacttgccgacttgctcaactactccaggtcagcactggcctatgccgtgtacaaggtaccggaggaacagcggtataaggagttcaaggtggccaagagatctggcggggagagaattatacacgctccttgtcccgaactgaaaggtctgcagaagcgacttagtaactacctttatgattgccatcgtgaaatctggccacctcttgaatttccacggcacagttacagccatggctttcagaagaaccgtgggctgtcgatcttctccaacgcatggaagcaccgcaacaagaggttcgtgttcaacgtagatttgaaggattattttccatccttcaacttcggccgagtcaggggctattttcaaaagaaccggtcttttgaactgcatcaggatattgctacgctgattgcacagattgtgtgttacgacaacagcctccctcagggagctcctacttctcctattgtttcagaactcattacctccattctggatcagagattaggtaggctgtctaaaaaacatcattgcacctatagtcggtacgccgacgacataactttttctaccaatcaggccgggtttcccgaacccatcgcagacttttccccccaggcagatggagcctggaaggctggatccgagctggtcggactggtggaacgcagcggcttcgaaataaaccccaataagacaagaatgcaactcgcaacatccagacagtctgccaccggcttagtcgtcaaccgcaaagttaatatccccaagcagtattatgacgacgtacgcgcgatgagcaacagcttattcaaaacaggtgtctgccatcaccctgacactaaggaggccgctagcctggccgttcttaaagggaagttggagtttgttcttgcggctaagacgtaccccaaagggctagtgtcctttagtgacctggagctcgccagcaaggcacctggaggtacaccggtgcctagccactacaagctctaccgacgtttcctggcttatgagaagtttcatgcaaatgcccggcctctcgtaatctgcgaaggcaaaactgataatacctacatcaggtgtgcgatcgcaagcctgaatagcaaattcccattgctccagccaactaccgatgccgagggctctgttcggcaagctttatcattcttcaaacacagcgacaaacacgctaagttgttgtctataagcggtggtgccggcgagctgcacaagtttgtgggaaaatatgggtcgctgctgaaagattttcactccggaggcgagcagcaaccagtgatcgtcatcgtcgacaatgataatgccgccaagcccatgtggtcagtgattaaggagaagatgggatcagaggacaaagtggacgggtctgcgaacttctaccacgtgaaaagaaatctattcgtcgtcccaatccccattaaatccggcaaattcgcaagtattgaggatctgtttgataaaaagaccctagcgacagttaataaggggaaaaagttcaatccacatttgaagtcgcaccagactacaaatcaatacggcaaggaaatcttcgctaaatgggtgatcgaggctaacgctgaaaatatcgacttttcagggttcgagccgcttctgggaaggctcgaggaggtgctgaaggtggagctccaggggtcctga

SEQ ID NO: 8154 - RNA, 1725 nt, unidentified
  source 1..1725: mol_type = other RNA; note = synthetic construct
atgacactatcctcttttcgggcctgtaaagacctggccgaccttgcccacctcttgcgagtctcgccaaaaggcttgagctacatcctgtacaaaattccgtcacacctgaaatatacccacttcgagatccccaaaaaatcaggcggagtcagaaccatttcctcccccgaccgccgtctcaagttcgtacagtctcgcctcgcagaattattatacacctgccagcgcgagattctgcctgtggaaaagaacatcaaaaaggtgctgagccatgggtttcagaaaaatcgagatctgagtatccataccaacgcatataagcacacaaacagacgtttcgtcctaaatctggatcttgaagacttcttcccttctcttaattttgggcgagtgagggggttcttcctgaaaaaccgcgattttcagttgaaagaggctctggccaccgtggttgcacagatcgtatgtcacgggaacgaactgccacaaggcgcccctacctcccctataatttcagacctcatggcacgcgtgatggacgtgcacctctctaaaatggcggctagctacgggtgtacgtatagcagatacgtggacgatctgacttttagcacaaaccttgccgagtttccaccggcgctggcgactgaagatccagcaaccggtgcttggagtgccggagctgagctgaggagtagaatttggaggcaaggctttgccttgaacaataagaaaaccagaatgcaggccagaaccagccggcaggaagtgacgggactggtcgtaaacaagtttgtcaacgtccgcactgaggtggaggcttccaataggatactcgtccacactcttgtgaagaaagggaactgcttccaaaaggatccagtgtctggtacgaccaaggccctctccttggagcagatcggaggcaggctgtcttaccagttccagactaaagccgcaagacattctttccgaagtgcgagggagtttgaaaaagcgggggagcccatcccccgtttctatcgcgattacgcaagctatatcaattactgcagtttccacgccaatgacttaccaacaatcgtctgcgagggcaagactgacgtgatttacctgaagaccgctattagagttctatacgctaagttccccaaactggcaggcatctccgctggagagtatgcctcagacgtgcggttttttggccattccaggcatcatacggccgctacaaagctctctggcggcgctggagacattcagcaattcgtgagagaatactcaaagattgtgcacccgttccaccctgggggtcagcttaggcccgttatagttttcgtagacaatgataaggcaacaaatggaatctggagttttattaaggaacggacaggttcaaagacactgatagacggcagcgcacctttttatcatatcgagcggaacctctatgtagtggctgtgccaggaaaggttggcactacagaacggattgttgaggacctctttgacgccaagacaaaaagcatgacctggaatgggaagactgtggatttgaagcaaaaacggggtcatcctcccggaaagggtaagatgtcgaaggagcggtttgccaccaaagtcataagggatcagcgagataacatcgatttttcaggcttcgaacctgttttacaggctttcagcgacattatcgatatcaagctgcccgcctccacttga

SEQ ID NO: 8155 - RNA, 1725 nt, unidentified
  source 1..1725: mol_type = other RNA; note = synthetic construct
atgacattgaagacctttcgggcttgcaagaatctgtccgatcttgcccatcttctgcgtgtctctcccaagggcctgagctacattctgtacaaaataccctcacacctgaagtataccaagtttgacgtcccaaagaaatcaggcggcactcgcacgatctcatcgcctgatcggagacttaaattcgtgcagacacgactcgctaaactgttgtacgcctgccaaagggagatcgtgcccgtggagaacaatacgaaaaaggtgctctcacacggatttcagaagaaacgcgggctctctattcacactaatgctaacaagcacaccagccgacggtttgtcctgaacgtggacctggaaggcttcttcccatctgtaaacttcggcagggttagagggtttttcatgaaaaaccgggactttcagctgtccgaagcctgtgctactgtagtcgctcaaattgtgtgccatgataacgagttacctcagggagcccccacgagtcccatagtctctgacctgatggcacgagttatggatgtgcatctgagtaagatggccgctagctacggctgcaagtattccaggtacgttgacgacttgacattcagtacgaatttggctgaattcccaaccgccctcgcagtggaagaacccaggaccggaacctggtccgctggttcagagctaagagggcggatctggcgtcaggggtttgcccttaatgaccagaagactagaatgcggcgccgaacttctcggcaggaggtgaccggcctggtggtgaataagttcgtaaacgtgcgagctgaggtagaggcgagtaatcgcgttctagtgcatacccaagtaaaaaaagggagttgttttctgaaagatcctaaaagcggagcaacaaccccactctctctcgaacaactcggtggtcgcctgagccatcagttcgaaaccaaggccgcgaggcacaacttcatgtccgcccgtgagtttgagaaagctcgcgaagccatcccaaagttttatcgggattactctgcgtatatttactacagaaacttccacgtgaatgacctacccactatagtttgtgagggtatcacagatgctatctatttgaaaacagccatcagggtcctccacgcgaaattcccgaatctggccggaacatcagccgggaagtacgtatcggatgtgagattttttggatattccagacaccataccgcagccaccaagctgagcggaggagcaggggacgttcagcattttgtcaaggaatatggtaagattgtgcatcctttccacgccgggggccagctcaagcctgttatcgtgttcgttgataacgacaaagcaactaacgggatttggagctacatcaaagaaaagactgggtccaagactcctattgacggcagtgacccattttaccacatagagaggaatctttatgtggtcgccgtgccaggaaaagtgggaggcgccgagagggtcgtcgaggatttattcgacgcagcaacaaagtccatggcatgggagggtaagacagtggatctgaagcagaagaggggccaccctcccgcgaaaggcaagatgtctaaagagcgcttcgcaacaaaagtgatcagagatcagagagacaagattgatttctccggctttgaaccggtcttagaagccttcagcgagatcatcgacattaaattggctggcagcaaatga

SEQ ID NO: 8156 - RNA, 1725 nt, unidentified
  source 1..1725: mol_type = other RNA; note = synthetic construct
atgacactgaagaatctgagagcatgcaaggatctgtctgacctagcacaccttctttcggctagccccaaggggttgtcttatatcctgtacaagatcccccctcacctgaagtacaccaggttcgaagtgccaaaaaagagtggcggaactaggacaatctcctccccagagagacgtctgaagttcgtccaatcccgtttgaccgaattactttacgcatgtcagcgcgagatcgtccctgttgaggagaatattaagaaagtcctgagtcacgggtttcagaagaagcggggtctgtccattcaaactaacgcgggaaagcataccaaccgaagatttgtgctgaacgtggatctcgaggacttcttcccctcactgaatttcggccgggtgcggggtagcttcctcaaaaatcgcgattttcagctgcccgaacctgtggccacagtcattgctcaaatagtgtgtcatgataacgaattacctcagggggcccctacgagccctattgtctccgacttaatggcccgagtcatggatgtgcacctatctaagatggcggcagcgcacggctgtacctatagccgctacgttgatgatctgacattttcgaccaatttggcagaatttcccccagctcttgccctggaaaacccacttaccggaaagtgggatgccggccatgagcttagaggacggatctggcgacagggttttaccattaacgatcaaaagacgagaatgcagactcgggccagtaggcaagaagtgactggtttgatagtgaacgagtttgtaaatgtgagaaccgaaatcgaggcacgaaatagagtgctcgtccatgccctaatgaagaagggtacttgcttccagaaggacccaaaaagtggcgctgctactccaatgtctttggaggaggtgggaggccgcctgtcacatcagtttcagatcaaagctgccagacacggcttcaagagcgccagggaatttgagaaggccggagacgacatccctaaattttaccgtgactatgcacattacatcaactactgctctttccacgtgaatcccgttcccacaattgtgtgcgaagggaagacggacgttatctatctcaaaacagccatccaggtgctccacgcaaaattccctaagctgggcgggttaagcggggggaagtatgcctccgatgttaggttctttggccagtcccgacaccacacagccgcgacaaggctgagtggtggagctggcgatgtacaacattttgtacgcgactataacaaaattgtgctcccctttcatgctggtggccagttgtcacctgttatagtcttcgtggacaacgacaaggccaccaatggaatttggagcttcataaaagagcgcacaggctcagccaccccgattgacgggagcgacccgttttaccacatagagcggaacctcttcgttgttgccgtacccgggaaagtcggaaatactgaacgcatcgtggaggacctgttcgacgcagctactaaagctatgacatgggatggaaaaaccgtagacctgaaacagaaaagggggcagccacccgccaaaggcaaaatgtccaaagagaggttcgctacgaagattgtccgggatcagcggtcaaaaatcgacttctctggcttcgagccagtgctcaaggcatttagcgatatcattgatactaaactcaccccgtctaagtga

SEQ ID NO: 8157 - RNA, 1716 nt, unidentified
  source 1..1716: mol_type = other RNA; note = synthetic construct
atgctggacgatctgaaatcatgcaccagcaggtctggcttagcagtgctactcggcgtgaaaccttcagagctgagttatacgctctacaagatcccggatgccgccaaatatactagtttctgcatcagcaaaaagtcagggggaacaagacagattcaggctccctgtccacctctgaaatggctgcagggcagattgctggacctcctgtaccagtgtgaagatgatatcagtgccgcttctgggctgaagcggaatctgcactctggatttaggcgtggcgtaaatatttatgagaatgcaaacgcccataggggaaagaggtttgtgttcaacatagacattgagagctttttcgaccagtacaactttggacgcgtgcgggcttttttcattaatgaccgagacttcgcgttgcaacccgcagttgcaaccacgatcgctcaaattgtgtgtttcaataatgtcctccctcagggttctcccacatcgccccacatcgcgaaccttctgacccagtttttcgataaccgaatggctcgatttcttcgcccccggcgttgcggatacacacgctatgccgacgacataactatctccaccaatgtaagagaatttcccgctgatgtggctattatgacaccagctgacccccagggctggtctatcgcaccagaattggctgccatatttggccgagcaaatttgccgcctaacccctcaaaaacaagaatgagcgcgtactccagccggcagactgtgactgggctggttgtcaaccaacggcctaacgtgaccagagagtactatctccacacacgggccatgtgcgatcgcttattcaagactggcaccattcagattccagatataacgagtagctacggaaagaactgtccagtatcagacgatgctgagcctgaagccgatgtggacccactcaaggtccttgagggcaggctgtcccatatccaccatatcagagagaaaagtgaccttcgtaatattcaggagaaacaggacaatcccacacaattctggaacatgttgcaggatttctttctgttcaaatacttcgtcgcaaactcgaagcctttaatattaaccgaaggccctagcgatatcttttatcttcggtctgcaatcattaataacaccaccctgctggtgccggagctcaagaaggtcgtgagtgggaaaccagagattcttcccacgtttttcaggttcaatacagtcgctgccaaggtgattggcctgactgggggggcgggaaacattaagcgctttctgtacctctaccataagcaggaaaagaggttcaatcgctccctaagacacaaacctgtaatcattatcatcgacaacgattccggcggtgcggacgtgataaacatggttaacggaatctataagaccaatatttctctcagcgatccgataatggcccacaagatcacagacggtctgatcctcgttaaaacaccacatgtggggtccaagactcacaccgccatcgaagatctgctgccagcctccgttaaggccgttaagctaaatgggaaatcatttagcgccgcaaagaaattcgacgctaccaaacactttggtaagatagcattgggttcctatgtgcaagccaatgcctccagcatctctttccaggggttcgatgactttatcgtcgccatcaacggcgccattactatgtga

SEQ ID NO: 8158 - RNA, 1710 nt, unidentified
  source 1..1710: mol_type = other RNA; note = synthetic construct
atgctcgacgatttgaaggcctgtcggaaccgatcagatctggcacatcttctaggggtcaaaccgagcagtctggcctatacactatttaagatcccagatgtcagcaagtacagtaaattttgcatctccaaaaagcgaggaggcacccgacagattatggctccttgcgtgcgcttaaaaaatctgcaaactagattgttagcgatattgtatcagtgcgaggatgacatagagaaagcatccggcatccaccgctccctccatctcgggtttaggagggaggtgaatatttacgacaacgcacgtctgcaccgcaagaggaggtatgtgttcaacattgacattgagaagttctttgacaactacaatttcggccgagtgagatcgtttttcatcaaggatcatgatttttctctgcacccagacgtggctactacaatcgctcagatcgcctgcttcaataatgtacttcctcagggatctccaacatcacctcacattgctaatttactgtcccagttttttgacaatcggatgagtaggtttctggggcacagacgttgtgcttatagccgctatgcagatgatatcacaatcagcaccaacttgaaagaattccccagcgatattgccagcgttacgaccaccgttccccagggctgggtgattgccccagaactgctgtcaatactgactcggagtgggctccctccgaatcttgccaaaactcggatgtccctcaggtccagcaggcaaatggttacggggctcgtggtcaataaacacccttcagtgcctagggagtattacctgcaaacacgcgccatgtgtgactatcttttcaagggtaagattcctcacatcccggacatcacaagtgactacggcgaaaactgcccaagtagcctcggccataagaagaagaagcccgattacatgagagtcatcgagggacgtctgtcttacatctcttacattcgcaaacggagcgcaaagttttccaccgaatacaaaaatgacaagaactcccagttcaacaatctgttcatcgacttcttgatcttcaagaacttctacatgaacgaaaaacccataattctgaccgagggtccatccgatatcctctacatcaaatcagccattagaagcagtactctttcgttgccccacctcaaaagaatcaattccggaaaattggagattataccccggttcttccggtttcacagtgcttcttctaaaaccctaggcttaacaggaggaaccggcaacctaaaaaacttcctgaatctgtacaagaagagatcaagcaaatttagagtgagccccaacgagaataagatcattattgtcgtggacaacgactctgggggaaaagacactatctgtgcaattaacagcctctataagaagaacattcagatctctgatccaaccataatccataagataactgagaagctgaccctggtaaagacaccccatgtggggattaaaaaagaaaccactatcgaggatctccttcctgacgatgttaagtccgtcactattaacggcaagacattctcagccgaaaaaatactggacgaaaccaagaatttcggtaaaataaagcttgcttcctatgtgcatgataacgcctctgtaatcgactttacagcgtttaatgatttcctgtctgagctggactcaggttttacgacgtga

SEQ ID NO: 8159 - RNA, 1710 nt, unidentified
  source 1..1710: mol_type = other RNA; note = synthetic construct
atgctttccgacctcaaagcatgtcaggaccgtaagggtttggccatcttactgggagtttctcccaaggagtttgcttataccctgttccatattccaggagatcagaagtatgagagcttttgtgtatctaagaaaaacgggggcactaggaatattctggcacccgttccaagactcaagtggctgcagaggcgtctgctagagatactataccaatgcgccgaggacatctcagtgagtgctggagagtcccccaacctgcattttgggttcagaccccaattcaatatatacgaaaacgcattcgtccataggcggagacggtttgtgctgaacttagatatcgtcgattatttcgaccagtttaactttggtcgggtccaaggctttttcctgaaggacaaaaatttcgagcttgtgccggctgtagcaacagccattgcccaaatcgcatgctttgataataaactcccccagggatccccatgttctccccacatagccaatcttgtctcccagttttttgacaatcgcatggccagattcctacgatcacgtcggtgctcttactcaagatatgccgatgatattaccatcagcactaatctgagagtcttccctagtgacgtggcggaggcgtcagattccccacagggctggcagatttcaccaatcttgacagacattttccagcggtccggattcgctataaatgatacaaaagtgcgcatgggagtgttccactcaagacagacagttacgggcctgaccgtcaataaacaccccaacatttcacgagacttttacctgaattccagggctatgtgcaatagtcttatcaagagcggcagtttcatcgttcaggatattagcggctccttcgggaacagctgtaacccagatctccctcctcccatcaaaagtccattaatggtgctggaaggtcgactgagccatatccacaatatcaaggaaaaaaacgatgggcgcgacctcaagtacaaacaggccagccctacccagttttggaagttgctgcgcaagttctaccaatacaagtacttcgtcattaacgactatcctttgatcatcactgaaggcccatccgacatattttatttaaagtctgcgattcggaacaccaaactcctggtacctaacttgtatgctgacgaaaaagggggaaggaggattctcccgcaattctttaacctgtcgaacctacccagtaaagtgctggccttgaacgggggggcaggcaacatcaagaagtttatccaccagtacagtattgagatgcgcaacttcttcacactgaatcggactaatcccgtggttatggtcgtggacaatgactctggcggcgaggatgtgttcggacagatcaaaaaatctttcggactgtctgttaagacgtccgataaggattgcatggtgaaggtgtcagactacctctaccttatcaagaccccgcacattgggcctcaggacaaaacaagcgtggaagatatgctccctagcgctgtaaggggcgtggcgctgaatggtaaaaccttctctactgcttccaaatttgacacctcgaagcactttgggaaggtggctttggccagctatgtgcatgccaacagcggcagtgtcgacttttctggttttgatcctctgcttcttgcactcgaccgcgccatagccgattcgaagagctga

SEQ ID NO: 8160 - RNA, 1710 nt, unidentified
  source 1..1710: mol_type = other RNA; note = synthetic construct
atgctgacagacttgaaagactgtaccaccagagctgcgcttgcctccatcctgggggttgaggcaaaggaactggcctatgtgctttacaaaatcgaccagggctcgaagtacacttctttctgcatatcaaaaaagaacgggggtacccggcagatccaggcaccaattcccaagctgaggttcatccaatcacgcctgcaacaaatcagtatggcttgctgtgatgatattgccgacctgggaatctacaagggaaagctcagttttgcttttcaaaaggaccgtaacatatttgagaacgctagaccacatgtaggcaaacgatttattctgaaccttgacatccgggatttctttcaccagtgcaactttgggagggtcagagggtattttattcacagcaaggaatggaagctggatcccgcagttgcgaccgtgatcgcacagatagcatgtgttgatgagggtttaccccagggctcgccttcctcacccattattgctaatttattggggcaaatcctggatgtccgcctcacaaggttcctccatcctcggcgatgcacctatacgaggtactgtgacgatattactattagcacagacatgcgcgtctttccgcgggacgtggctgtccaggatgactcttggccatctggttgggccctggctgcaccactggaggatatctttgtaagagccgacttccccatcaactataacaagctaaggatgagttttgactgtagtaagaaggtggtgacaggtctgacggtaaataggttcccaaacattgaccgtaaattttatagagacacccgattgctgctggacaggtacgcccagaccagcagctgtaaatacatcgaattcactggaaatttcggcaacaattgcgataacactgagacaaaaaataagaacccgattcttcggctcgggggccggttagcgttcatccaccacattaaaagccgaacctccttgataggatacccgggcatcgtgcaccctcagaacccccagttttacggcatggtgcagacttatgcgttcgccaaagactttgtgtttaattctattcctaccgtcgtgacagaggggccctcagacatcatccatctcaaagccgccattcgtgcaaacccagcctgggcccctcacatatttgactccaaggaaaatcgcttcctggtcaaattcgcccgccatgatggcctcttcgcaacagtgttgggcatgagcggcggtacaggaaatatcggcagatttttggacctatactatagcaggttcaaacggatcaattacaagattcgcacacagccatcagtcatcgttgttgataatgataagggcagccacggaatactcaagagactctctaacatacataagatgaaactgagtaccggagatggtctggtggtgaagaagctacagccttttttctacatctgcaaaacccctcaattagctggcaaagctgaaactgccatagaggatctgctcccttccgcaatcacagggatggtggtgggagggaaaacgttcgagcccgataccaaaaagttcgaatcctccaaaaatttcggaaagattttccttgctaagatggtagctacgcagcactctgcaactgcgtatgccaatttccagcagttcattactgggcttgatgacgccgtggccggagttgccaagtga

SEQ ID NO: 8161 - RNA, 1335 nt, unidentified
  source 1..1335: mol_type = other RNA; note = synthetic construct
atgctcattgatctcaaggcatgcaaggataagagagacttggcgcacctgttaggatttcagcttaagaccataacataccagatcaatatcgccccagacgccgagaagtacaagaagatttgcatcagcaaaaaaaacggcaacagcagaaccgttttttcccccaacccgattcttaaaagtatccagaattccctactggagataattacctcttgctacgaccagatccacggaggcatgaactatccggtgagtttcggcttcatacccaatttgaacatctacgacaatgcaaagcgccatattggaaagaggtgggtcttcaacgtagatataaaggactattttgactcgatcaactatggacgagtgtggcgttacctgcagaaaaacaaaaacttcctgctcaatgccgaaattgccaccatgatctcacagatcgtttgttttgatggtcgactgcctcaaggggcacccacgagccctatgatggctaatttggtcagcgggagtctcgactatagattaagatcacttgcctctgaacataaatgtacctatagtaggtatgccgatgacattactttctctaccaacctccgggatttcccagaggaagtcgctcgatacgatgagccttccggttcctggcttcccggcaaaggcctgttatcttgcgtgagccgcgcgtggtttagtttaaatgatggcaaaacacgaatgagctacaggaggtcaaagcaagtagtgactggtctgatagtgaataagaaggtgaatgttgatagagaatacttcaagctggtacgtgcaaacattcaccatctactgacaggcaggccagtcatactccaggagttttgtgatccatacggagagaattgcgacgggaaggaggtgaaaaataagaacgggatgtcactcattgagggccgcattaacttctgttttgaaatcaacgaccaaggggatgaacggacggacaatgccaagttttttaaaccatcttcagtcagaaagacataccgcgacttcctgatctataaatatttcatccacggggatcggcccatcctgatcaccgaaggtgagtctgacattgtctacatggctgcttacttgaaagcacggagcctgcctcttgctaatttggtggatgtgtccccccccgacaaccggaagatcctgattgacttctatcagtttccaaaacggccttccaaaatcattggcatgactggtggcacttccggggtggctttcgccctgaagtgggttggagagatcctccctcgtctgggaaaaaatgtgagcaggcgcaagttttga

SEQ ID NO: 8162 - RNA, 1842 nt, unidentified
  source 1..1842: mol_type = other RNA; note = synthetic construct
atgacggagccaaagaacttagaaaagctgaagagcatcacaaaacgggaggaattggctgaccttctgggcctctcccgtcgcagattattctgtactttgtatatggaacccatgtcctcaaagtataacactttcagcatcccgaaaaaaagtggctcggacttgagaataattaaggcacccaatagtcacctgaaattcattcagtggaggttagccaagtacctgagtgaatgtctggaggagattaaaaaaaaggaaaagtttccacacctctcttttgcctttcagaagaaactgtcaattaaggacaacgcgctaaaacatatcaacaagcggtgggttttgaatctggacatcagcgatttcttctctagcatatcatttaatcgggtgaacaggttctttctcaagaataagttctttcagctgaacgatgagatagctaccacaattgcccagatcgcctgcgacgaacaggcactacctcagggatcaccgtgcagcccaattatctccgagttcatcacccaaagcttagatgttagactcctgaagctggccaagcaataccacctgacgtactctcgatatgcagatgatattaccctatccacaaatcagaaggtcttccctcgcgaggttgcttatcccgatagctccgccgagaatggatggcaggtcagtgaaaccctgagatcaatcattcaacggtccggatttaagatcaacgaagagaaaacgcgtatgcagaaaaattgcgtccggcaagtggccaccggtcttgtaattaataaaaaacccaatgtcgccgataattactaccgcacggtgcgctccatgtgccatcacgtgttcgaaaaaggggcctactataggagtccagaggacaaagacaatcctacctgtgaccttaatcccctagcgggcaaacttaacttcattcacgacatcaagaagaatagcgatgagactaatagttcctctctccgcggcggaaacaacctgaccctgagcgggttcgatggcctctacaagaagttccttttctatcgtctgtttctttgtctgaacaagcctatgatcgtgacagaggggaaaactgaccctatatacttgcgctgtgctattaaacatgggaacaaaatcaagaatgcttatgggaagaccgtcggcaggtacatcacacagtcgattctgttcttttcaagggagcggtcttatgcagaggcgtttaacttcaaggaaggtgggtcgaataatctcctcgatatcataaagctgtacaaagaatacctgcatagctctaaaaaacgacaaatccagtccagaccctgcgcttttcctgtgattttacttttcgataacgatgacggtataaaaaccactagcagctacgtgaaaaagaactttgacattatcttgaccacagaaacaactgacgatttctactacctgttcgataatctctatatcgtaaaaaccgtggagaagaaatataacaccgagtatgagaagaatgacgataaaaaccaccagtatgacaatatcaagaacaaggtgaagaacaagaagaacctcatcaaaaattctgagtcttgcattgaggactgtttttttaagaagacactcgaaaagacactgcatggcaaaaaatttaccaagaacaacaacggacattccaacacagaatactctaaggataaatttgcaactgagattgtttccgccgagccctggtcaatcgacttcagtggctttgacggactgttggataggataagaaaggtgatcgaagactacaaaaagctgcacaatcacccaactataaaccgatga

SEQ ID NO: 8163 - RNA, 1707 nt, unidentified
  source 1..1707: mol_type = other RNA; note = synthetic construct
atggctctgaaggctgctacgaaccgacacgatctggcggcactgctccggttccagacaaaaatgatgacaagcattgtatacgcgactcatgagtctttaaagtataagaccttcaaggtcccgaagaaatccggtggagacaggacgatagcagcccccatacctcagcttaagctcctgcagcggagattagccgacctgttgatggattgccatgccgccatcatggatacgcaccctcataggaaaggacttcaattcgggtacctgccagagctctccgtggtggataacgcttatcgccaccgccgacggagaatggtacttaacgtggaccttgcagatttcttttcgagcattaactttgggcgcgttcgtgggttttttttatctgacgcagcctttcagctgcacccagtagtggctacaactattgctcaaatcgcatgttggaataatgagctgccccagggtagcccctgttctcccataattagtgggctaataggaggaatcctggatcgaaggctcggcgcccttgcgagagagcacggatgtacttattcccgctacgttgatgacctgacctttagcaccaatgcggatactttccccaacgaattagccgcacttgacccagctacaggaaggtgggcagtcggtggcaagttgagccacgccgtcggcaaggccggatttttggtcaatcctgacaaaaccaggctgttcggcatgacaggacggcagacagttaccggcttagtcgtaaacgacaaggtgaatattaatagagactacgaaatgcggaccagggctgccgtccatcattttatccgtaaaggtgtttacaccgtgccagccagtctggaaagtgtggctgccggcaagccgccagagaaggaaacctctccccaccgcctggaaggcatgctgcagtggatttactccgtgagagacttttcagacgaccggaaagatggctccaagagacatcacccaaccagtttctccaaggtgtatcgagaatttctctttgctaaacacttcctgttcatggataaacctttgatcctatgcgaagggaaaactgataacgtgtacctaaactcagcactgaaacgccttgctgcctcttacccttccctcggatcatgggtgggtgccgatttcaaaagcaacctcagactgttcaggtacactagtaaatctctccaaatcctccatctcggcgggggatgtggcgatattgtgcagctagtccgggactatcgtcggctgtggactagattggtgcatcgccagatcgcccaaccagtggtgctggttgtcgacaacgacgagggtggggctagcgtgtttaaagccatcaaggaagttgggggccctgatattaagattgccgagcctaagatcctcttccacgtgttccacaatctgtatatcatcaagaccccctgcgggagcgggacaccgaaatcatgcgtagaggatttgtttgacgcggcaactttgggccagaccctgggtggcaaaacattcaatcccgcctgcgatgaggagacggccaagcactatggcaagaaaatcttcgcagagggcgtcatcaggcccaattggaagacaatcgacttcgcagggtttcattcgatactggcctcactcgaggacgctattaagggatactatggcatgctggttccttga

SEQ ID NO: 8164 - RNA, 1941 nt, unidentified
  source 1..1941: mol_type = other RNA; note = synthetic construct
atgtcccagcttcagcagctcaaaaactgcaagtccctaagtgactttgcccttctgttaggttacaatgctaaaggcctgtcttatatcttgtacaaaattgacgacagcgctaagtacactagtttccagattgataagaagtccggtggcaagaggactatatctaagccgtgcctgaagctgaaaatgttgcagagaaaactcgcgaatctgctttatgattgcatagaggagaagaagcctaatggggaacgcttgactgattttaaagggtctgacaagaccctgcccaagcggaaacgcgctgccaaatcgatcagccacgggtacgaaaagggattaagtattgcaacgaacgctgaaatgcacatcaaaaaacggtacgtatacaatatcgacctggagagtttctttccctcctttaactttggccgcgtacggggctttttcattaagaacaagcagttcaaactccacccgaaagtcgcaactatcatagcccagatcgcctgccatcaaaaccaactcccacaagggagtccttgctcacccgtaatatctaacatgatctgtaagaaccttgactactacctgctgggaatagccaaagagaacggatgtgtgtacacacgatatgtagatgacttaacattcagcactaataagaagaagttccctgttgccattgctgagaataggctcaagttttttgggaaacagtcctggtcactaggaaaagaggttgaagaagcaatcctgaaggccggtttcaaggtgaaccgaaagaagtgccggatgcagacctcttattcaaggcaggaagtgacaggactgactgtgaacaggaaggtgaacaccagcagcgcctactatcgcaatgtgagagcaatgtgtcacagtgtgttcaagcacggatactacacactccctcaacagaaggaaccaccaaagaagcagggctggctctcaaaactgacttccatattcggcctgaaaattggggtcaatgaacctaacatcgcccagctggagaagcagacatcattggaaagccttcagggtaagctggcacacatctacaacattaagtcctataggaataagttctcccgccgtggctataggccgaccaaacatgatggaatcagaaccaataattcgaaaaacccatttcctcccctggacagatctgagacatataccgatgacaatcatatcgtcgctctggacgggattaaaaacctgtatggcaagttcctatttttcaagcacttctacgccaataagaaaccaactattatctgtgaaggcaaaaccgacaatatctacctcaaatgtgcactggagtcacttgttgctaagtatccccgtctaagcaaagataagaacgggaattttcaagtgcacttcttcaatcgtacggaaacgtccagtgaaatgctcaaattggtggagggatctcccggtctggtctatttggtggagatctataaacgattcaccaaactctttaactcaaatggtcaagagtatcctgtcattattgtcgtggataatgatgatgcgggacggggcgtgatcaaaaaggccgacaaaatacgccaggaaaatagaaacgcaaagagcatcaagaaagtcagaaggagcgactacttcttcgagaacttatacattgttaaggttccctctacagcgggcgagaaggataaggagattgaggatctgtttgatcctatcttattgcagaccaaactcaatggcaagacctttcatcggaataacaccggcctggaccccaacaaacattttgggaaagctcattttagcgagtatgttgtgacacccaataaaggatccattgattttagagggttcgagccactccttgatatcattaacgacatcgtgaacaatttcaacccaaacgacctggactga

SEQ ID NO: 8165 - RNA, 1962 nt, unidentified
  source 1..1962: mol_type = other RNA; note = synthetic construct
atgagccagcttgaagctttgcgcaaatccaaatccattaacgacttagcccctatcctgggttataaaccaaagagtctcgccttcatcttattcaaaattcccgatcaggacaagtatacgtgttttaacgtggctaagaagtccgggggaaaacggaccatctctaagccctgcgacaagctgaaggcactgcagagaaaactggctgacctgctttacagttgtagcgacgaactaaagccgatcaatcaaagcatcaagagctttaaaggcggaaacaaacagatacctctgtccgagagagctaaaaaaagcatttcccacggttatgagaaaggcctgagcattgcctcgaatgcttccatgcatacaaataagaggtatgtctacaacattgacatcaagtcttttttcccgtcgtttaatttcggacgagtgcggggcttcttcataaagaacaagaactttaggctgcaccccaaagtcgcaacattaatagcccaaatcgcctgctttgagaatgagttgccccagggatcacccgcttctccagtgatcagcaatctgatctgtaagagtctagacattgaacttttgagtatcgctaaacgttatagctgcatttacacaaggtacgtcgatgatctcacatttagtaccaaccagaaactttttcccaaggaaatcgccataaaacctagattcggcttcggacgggaaaattggagactgggcaaagaggttgaggctaccatcatcaaatcagggttccagatcaacactaaaaaatgccgcatgcagtataagacgtcatcacaggaagtgaccggcctaacagtcaacaagaaggtgaatgttagaaatctgtactacaggaatgtccgagcaatggccaactcactctttaagtacggtttttactacagacccgcaccatcaactagcaagatccgcgacgaatccaagaaatccctctatcagaggatatactctattttcttccggcgcgttgtgcgtgctgccccaaccaagaagaaggtaaaacagattgaaagtgcggacccactcatcggaatgctcgcctacatattcaacattaagagctatcgaaacaagttcgtgcggcgcgggtttcggccagacatacataatggcattcggaccaaaagcaatgggtccatcacatttccaaccgtagataggtcagagagttacgaagatgataatcacgtcatagccctcgacggcattaagaacctgtatggcaaggtgcttttctacaagtatttctatgccttggagaagcctctgatcattggagagggcaagactgataatatttatctcaaatgcgcgatagaaggccttgctaacactttcccacaactcgcaaaaaactcctccggatcacaacaggtttctttttttaatcgcacacccaccaatacggatatgctgagactggccgaagggacccctgggctggagtatctgatatctatctataagaggttcatgtctttctacaaatgtgagggtaagcagcaccctgttatttttattgtggacaatgatgacgcgggtcgcgggtttatcaataaagcaagcaaaatccgagatcagattcgtagcgcgaaaaaggtgaagactcaaaggcataagtactattacttcgaaaacgtctacatcgtgcctatccccaaacagaaattcaacggcaataaagtgaaggatattgaggacttgtttgacgattctgtattagcagagaagctggaggggaagagtttttacaataacaacaagggattggatacttctaagcactatgggaaagcatacctctccgagtacgtgatcaaaccgaacaagaacaagattaacttcaatgagttccaacctattctggccgatatcgccgacatcatcaagtcttacgataataacaacctggactga

SEQ ID NO: 8166 - RNA, 1956 nt, unidentified
  source 1..1956: mol_type = other RNA; note = synthetic construct
atgtctaagttaacacaattgaaacagtcctccagtctgagtgatgtcgctagcttgctggggtacaaaccctcggcactggcttttattctgtaccgcatggacgacgttgacaagtatttcactttcgatgttcctaaaaagtccggcggtcatagggtaatttgcgctccatgtgataagctcaagaagttgcagcggaaactcgccgacctgttatacgactgtatcgaggaagataagccatctgaggagacactgggcgagtttcgaggcgagaatagtgacctgccactccgaaaaagggctcgtaaatccatgtcccatggctatgagaaggggctgagcattgcaacaaatgcagaaatgcatgtggggaaaaggtttgtgtataatatcgacctcacctcttttttcgactgctttaactttggcagggtgagaggatatttcttaaagaactctaggtttcgtcttaattctaaggtggctacgatcctagcacagatcgcctgcttccagaataagctccctcaaggatcaccctgctcccctgtgattagcaacctgatcagcaaacacctcgattatcatctgctttccatagctaaaaaccatagttgcacctacacacggtatgtcgacgatctgactttttctaccaaccagaaagcctttccaaaggccatcgccaagcggcgcttcctaactctagagaaagggagctggagactcggtagtgccgtgaagggcgcaatcgagaatgcaggatttagcgtgaacgagaacaagtcaagaatgcaatatagggattccagacaagaagtcacgggactaaccgttaataaaagggttaacgtgtcgtcatctagctatcgccagatacgcagcatgtgtcactcaatgttcaagttcggatattactttaagagttcagcccgcaccgtgagcaagcctaaaactaactccatactcacacggctgtacaataaattcgccctgaagtacttcagggtgcacacccaggatgacgaattaggagacactcaggggcaggaatgtactagcctggcctctctcgacggcatgctggctcacatttatcacatcaaatcctaccagaacagattctccagaaaggggcaccggccgtctagccacgatggcataagaaccaagttcaatgaatcttcctcttatcctccgatcgtccggggcgacacttacgcgtctgacaaccaccgtgtcgcgcttgacggtatcaagaatctgtaccgcaagttcatgtttttccggtacttttactataacgagaagcccttgataatatgtgaaggcaagaccgacaacatttacttaaaagccgccattagtcgactcggtaatgcctaccccgagctgtatgatgcaacgaccaaacgctgtagaatttccttcttctctaagagcgatcggaacttggaaatcctgaaaatggctgaagggacaagcgggctgtcatatctgattaagagctacaagcgcctgtgcagcaaatacaaaattaaagggggctcgcatcccgttatcgtaatcgtcgataatgatgatgctggaagaggtgtcatcaagaaagctgagaagattaagaatgacacaatcaagagcaaggggatcgccgcaaactataggcttgattactttttcgagaatctttacatccttgccgtgccatcaggcgctggcgatgcagatatagaggacctgttcgactcatcagtattgaaccgagagctgtcaggaaagaagttcagtcgaaagaataaaaagtccgacggtagtacctacggaaaagcctggtttgcagaacgggtgattaaagcggagagggaaaaaattaactttgccaaatttgccccccttttggaccaggtgcgtgacattatcaaagcgcacgatagtagaaatctcatctga

SEQ ID NO: 8167 - RNA, 1944 nt, unidentified
  source 1..1944: mol_type = other RNA; note = synthetic construct
atgaccacgtcgctcaatagcctgaaaaagtgtagttccctgaatgatttcgcgctgctgctgggataccagccgaagtccctcgcatatgtgctgtataagatcgaagacaagaagaaatacacttcctttgagatacctaagaaatctggtggagtcagggtgattcaaaaacccaatgtgaagctgaagttgctccagaaaaagctggcggtcttactgtatgaatgcattgaggagttaaagcctgaaggtgagaagcttgttgactttaatggagggaaaaacaaactgcctattcgtaaaagagcaaaaaaggccctcagtcacggctatgaaaagggcctatcaatttccaccaatgctgaacaacatatcaacaagaagtacgtctacaatattgacatcgagagtttctttccaagctttaacttcggccgggtgcggggtttttttcttaaaaacaagaacttccggctgaaccccaaggtggctaccgtcattgcccaaatcgcgtgcttcgagaattgtctgccacaaggctccccgtgttcacccgtaattagcaatctaatcgccaaaaaccttgattatatgctccttagcattgctagacgcaattcatgcacctactctagatacgtggacgacttgactttcagtactaatatgcgagagttccctaaatccattgcctatcagaggatcctgacactgcggaagaatccatggatcctaggccacgaggttgagaatgccatcaaagatgccggctttaagattaaccccaagaagtcacgcatgcaaatgaaccattctaggcaggaggtgacggggctgacggtcaataaaaaagtcaatatcagctctggatactataaaatggttcgagccatgtgtcatcagttttttatggaggggtacttttacaaacctcagaaagagaaaaagaacatctctaaaagctacttcaacaaactcatcgacatcttcaagaaagagaggtttgaggttatcaatgatgagtccattgaacgcgtaaaactggactcacccgacatcttacagggcatgctcgctcacatatataacgtgaagtcttatcgtaaccgtttcgcacgcaggggctatcggcctactagacacgatggaatattcaccaaacataagaatccctccccattccccccattagaccggtgcgatagctacacagatatcaatcacattgtggcccttgacgggatcaggaacctttatggacgatttttgttcttcaagtacttctacctcctaaaaaaacctctcatactgtgtgaaggaaaaacagacatcacctatttgcggtgcgcaatagaccagttggcaacatcatatccctaccttagaaatgataagggcaacaaccaggtaagtttctttaacaagaccaagattaacgttgaaatgctcaaactggctgaaggcacaagtgggttgacctacttgatcgatatatataaacgcttcagctcgcagtacaaatgcgagggtcagctgcaccctgtgattctgctggtggattgtgatgctgccgggaacggggtgttgaacaaagctgccgctataagggattccaatagaaaggcgaaaaagatcgaaaagcagcgccatgccgactactactttgagaacctgtacattgtaaagatcccagcaaagaataagggcaagactgacattgagaatctgtttccagatgaggtgctgaacatggaactcaacaagaagaagttcaaccccaagaacaagggtgccgactctgatactgaatacgggaaagcctatttcgcagaatacgtggtcagagctaacaagaacaagattgactttagcggatttaagccgctgctcgataatatccaggacatcataacaacatatgaccacaatgaacttgattga

SEQ ID NO: 8168 - RNA, 1944 nt, unidentified
  source 1..1944: mol_type = other RNA; note = synthetic construct
atgacaacatccctacatagcctgaagaagtgctcttcattcaatgattttgcgatccttttgggctaccagccatccagcctcgcctatgtcctatacaagatccaggagaaggacaagtatacgacttttgaaattccaaagaagtcagggggagtccgcacaatccaaaaacccaaccccaagctcaaactgttgcagaaaaaactcgccaatctactgtatggatgtatagaagaactgaagccccagggtgagaaactggaagaatttaaggggagttttaagtcccctcctctccgcaaaagggctaagaacgcattgagccatggatatgagaaaggtcttagtatttcaaccaatgctgagagacacgtgaacaaacggtacgtttataacattgatatcgagagcttctttcctagtttcaacttcggacgcgtaagagggttcttcctgaagaataaaaactttcggatccacccaaaggtggcgaccgtcattgcacagatcgcatgtcacgataatcaactgccccagggatcaccatgctcacccgtcatcagcaatctcatcgcaaaaaatctggattacatgctgctgagtatagctaagaataatagctgtacctactcccgatacgtggacgacttaacttttagtaccaacctcaacgaatttcccaaagccatcgccagcaagtctgtgctgactctgagacaaaacccgtggttactggggaaagaagtagaaaaagctatctctgacgcaggcttcaaaatcaatcctaaaaaatcccgaatgcagcttaacaactctcggcaagaagtgactggcctggtggttaatcgtaaagtgaatgtcagctctggctactataaaatggtgcgggccatgtgtcatcagttgtttaccgaggggtatttttacaaaccaaaggaagaggttaagctgacaaaaaaaacgctcttttcccgcctgatcaggattctgaagacgtctaccgcagagaaggtgaaggaggagatcgaaaccgtgaaactggactcgccggatatgctgcaagggatgctggcgcatatttataacgtacgttcgtacaggaatagattcgcccgaaaaggctaccgtccaacacagcatgacgggataaacaccaagcacaacaataacaataagtttcctccacttgacagatgcgatagttatactgacgttaaccacgtgctcgccttggatggtattagaaatttatacggtcgcttcctcttcttcaagtacttttatttcctcaagaagcccctaattgtatgcgaggggaaaaccgataatatctacttgaagtgtgcgattgatagccttgctaaggattacccaatcctctgcaagagcaaggaaaacgataaccaggtttccttcttcaacaaaacaaagactaactctgagatgcttaaactggccgaaggcactcctggccttacctacttaatagagatctacaaaaggttttcctctcagtacaagtgcgagggacagcactttcccgtgataatcctggtcgactgtgataaggccggactgggagttttgaggaaggctgcctccattcgggataataatcggaaggcaaaaaacatcacacaggccaggcacaaggactattatttcgagaacctttacattgtgaaggtgccttcagaggacgagaagaaagtggacatagagtatctcttcccggacgaagtgctcaaaaaagaactgaacggtaagaagttcaatcctaataacacaggcggcgacaatgagcacgagtatggcaaggcttacttcgccgagtatattgtcaaggctaacaagaaagacattgatttttcaggcttcaaacctttgctggacaatattcaggatatcataacttcctacgaccccaccaagttagactga

SEQ ID NO: 8169 - RNA, 1764 nt, unidentified
  source 1..1764: mol_type = other RNA; note = synthetic construct
atgagctccctgtcccgcctaaaatcgtgtaagtctctttccaacctggcccatctggtcgggtacgaacctaagaagctctcctacatactgtacaagattcccgatgaagccaaatatacagagttcgaaattccaaaggctacgaagggggttaggaaaatctctgcgccgatccccgaattaaagctggcccagtcccgcctggccaaggtgttacagaactgcctcaccgagatcgaaaaagagcaggctaatggagagaattgtattctgagtcatggtttcaagccgcatctctccatttctaccaatggtgcccagcacgtcgaccgcaagtgggtcctcaatttcgacctgaaggatttttttccaagcatcaactttggccgggtacgtggtttcttcatgaagaacaagcactttatgttggaggagaaagtcgcaactattatcgcacagttggcctgtcacaacggcagccttcctcaaggggccccaacctctcccgtgatttcaaatcttgtcgctaatcacctcgatattcgactgagcaggatttctggcaagaataggtgcacttacaccagatatgcagacgacataactttttcaactaacaaaagcgagttccctgagggaatagccgcaaacagggatgatgaaaacagcgcgggcgattggaagctctcaaaacgcatcagaaccgaggtcaaacgctcagggtttgaaataaatcctgacaaaacacggatgcaatatagaaggtctaggcaggatgtaaccggcctcgtggtgaataaaaaggtaaacgtgaagagagaactgtataagcaggtacgggcacaggtgcaaaatttcattaagaatgacacttgctccaaaaaggttaaaattgggggtgtggagagcgaggttgaagttacagaagctgccctgcaaggatttttgagtcacatattctgggtcaaaggagccgagtttgaatacaagcggcttaacaaggcaacaggacccgccgagccaggcttctataaggagtacaggagattccttgattataagaccttcgttgcttctcagcagcctgtggtgctgtgcgaaggggtgacggacaacatctacctgcagtgtgccatcaaacgtagcaaaaccgctcgacccaaacttcaagattcaggcagttccaacgggctggctgtcaagctgttccagtaccctaagattggaagcaagctccgagtgccgtcaagtgtgcagcacctaaacgggggcacaggagacttaaaggagctcatccataaatataaggtaagaaccgccgacctgggaaaacgcggatttatctctcccgtgatcctcctagtggataatgaccaaggtagtcgggacggattatggggcgccattaaaacaacttccggctccaagaaaaacgttgacgggaaaaagaagttttaccacgtgaccaagaatctgtatgtcataccaacaccaaagctggctggcggcaaagatagcatgatcgaagactttttgccacctgcagtggtgagtcaggtcctggggggtaaaacgtttaatcctgacgagaaaactttcgataaaaagaagcactacggcaaaagaatcttggcagagaaagtgagtaaggatcaggcgacaatcaacttcgatgcgttttcgcccatcttggacatcatggaggagattcttgaccatttctcagctctgcccaagaaacagggccgggtggttttctga

SEQ ID NO: 8170 - RNA, 1764 nt, unidentified
  source 1..1764: mol_type = other RNA; note = synthetic construct
atgtcctccctgagcaggtttcgctcctgtaagaacgtctctgacctggcttacttggtcgggtaccagcccaaaaagctgagctacatcttgtacaaaatccctgacgaatcaaagtatatggagttcgaaatacccaaggcaaccaagggagtgcgaaagatctcagcccctattccagaattaaaacttgctcagagccgccttgcccacgtcttgcaggattgcctagccgaaatcgagaagggccaagccagtggggagaattgtattatatcgcacgggtttaagagacatctcagcatctctactaacggggcacgccacgtgaataggaaatgggtgttaaactttgatctgaaggactttttcccatctattaactttgggagagtcagaggattcttcatgaagaacaagcatttcctcctcgacgagaaagtggctactattgttgcccagctggcctgccacaagggagcgttgcctcaaggtgcccccacaagtcccgttatttcaaacctgattgccaaccaccttgatatcagactgtctcgagttgctaccaaaaatagatgtacttatacccggtatgcagatgacattaccttctctaccaataaaaaggatttcccaaagggcatagcagccaatagagacgatggatccccctcaggcgactgggaactgagtaagcggatcagaagcgaagtgcggcggtccgggtttgaaataaacgccaagaaaaccagaatgctcttcaggaggtcacggcaggacgtgactggactcgtggtgaacactaaggtcaatgttaaacgcgagctctacaaacaggtgagggcccaggtccatagttttatcaaggacgacgtgtgctttaaaaaggttaagatcggaggcgtaaaacgtgaggtgaaggtgagcgaggctgccctagaggggatgctgagtcacatcttttgggtgaaaggcgcagaatttaactataagcgactgaatcggcccacaggccccaatgaaccaggtttttatcgggagtaccgtcgatttctggactacaaaaccttcgtagcatcgccgcagcctgtggtaatttgcgagggcattacggatagcatctacatcaaatgtgccatcaagcgctctaaagcagccagacccaaattgcaagacgcgaaatctctctctggcctagctattaaactgttccagtatccgaaaatcggttccaaattgcgagtccctagcagtgtccagcaccttaatgggggcactggcgacttaaaggagcttatacacaagtataaggtcaggaccaacagcctggccaacaggggattcgtgtcaccagtgattctgctggttgacaatgatcaaggatcacgcgagggcctgtggggagctgttaaaacggcttcgggcgctaccaaaaaagtagacggaacaaagggctactatcacgttacaaagaacctgtacgtggtgccaacaccgaagctgacaggtggtaaggattccatgatcgaggattttcttccttccagcgtggtcacacagaagctggggggtaaattcttcaatccagatgagaagacgttcgatcggaagaaacattacggcaaacgcatcttagcagaaaaggtaagtcgtgatcatgctagcatagactttgcgtccttctcccctgtactcgacaggattgaggaagtgctcgatcatttttctgcgttccctatggtccaggggagggtgaagttctga

SEQ ID NO: 8171 - RNA, 1707 nt, unidentified
  source 1..1707: mol_type = other RNA; note = synthetic construct
atgaagtctatcgagcagctcaaggcagctgcaggactgagtgacatcgcacacatcatcggcttcaaaccaaagagtctggcctatgttctgtacgtgttaccaccggcctccagatacgcccaattttccatacctaagagctccggtgggaccagagatattctggcgcccgtcccacagctgaagttggctcaacgccgactgtgtgaacacctccagaattgccttcacgatatcgaggctcagttaaccgtaaagagcgattgcatcctggcccacggtttcaaacgtgacttgtccatcgtgaccaatgcctcgattcacgtgggccgtagatgggtcctgaatctggatctcaaagacttcttcccatccatcaactttgggcgcgtccgggggtttttcatcaagaacaaacacttctgcttgcagcccgatgcggccaccgtgttggctcagattatctgtcatgataaccagctgcctcagggagctcctacctctcctgtggtcagtaatttgatcgcaggccttctggacatacgcctcaataaaatggctacgcagaatagatgttcttatactcggtatgccgacgacatcaccttttctactaatactagggatttcccacagtcactcgccaagattgatcaggacggtgtgtggacacttggaaatcggctgcataaacggattaagcagtccgggtatgcaatcaacagcaagaaaacacgcatgcagttcaggcgaagccgtcaagaagtcacaggcttgaccgtgaacactgaggtaggtatcaagcgcgagagactgaaaaacactagggcacaggttgataatctggtgcggaacggcgtctgtcatgcgcgaggtaacccaatgcagcccgtaggatctgtttcactccagggccaccttgcccatatagcgtgggtaaaaggccgctatgttgaccacagccgctccgatgggcattggaagagagaacctgcatacgtgcaaacatacagaaaattccttgaccatcagacatttgtcgctagtccgcaacccgtgatcatttgcgagggcaaaacagataacacatactttcggtgcagcattaaccggatagcgggggccccagcaaatctcaccgataaagccaatcccaccggactggccgtcaggctgtttcaatttacaagaacgacgagttgggtgcagaggctaaatgggggcacaggcgacattaaaaacttcattgagtggtacgccgaaaggatgagggttttatcagctactaagttcatttctcctgtggttctcgtggtagataacgactcaggcgtgaaaaagggaggactgaactctttggtgaagagcaagaccaagagcgccgtcgctattgacggcagctccgatttttaccacgtggggcaaaacctgtacctggtgcacacccctaaatcagccactgggggcgacacaatgatagaggacttcttaccggccgccgttaaagggcaaacgctcggaggtaagactctagagctggacgaatcgaagttcgaccccaagaagaactatggaaaggtcccccttgctgaaaccattgtgaaaaggcagcaggataagataaattttgacgcttttctgcccctccttatgcgagtgagtaaggcactagaccattttgataagtcagctttcaaagcatga

SEQ ID NO: 8172 - RNA, 1692 nt, unidentified
  source 1..1692: mol_type = other RNA; note = synthetic construct
atgtcttcactggctaagctgaaaagttgtagcagccggagcgatttggccaagttgctggaaatcgaactgaagcattttacatacctcctgtacggactgagcgatagtgagaagtactttgaattctcaatacccaagaagaccgggggactccgagaaattgtcgctccaatcgatgagctgaaagatctgcaaaagaagctcagcaatatcctccaggagtgcctgtctgaaattgaggccaagagctcacggaaaagccccagccacggtttcaagaaagaaagaagcatcattaccaatgctaaaagccacacccgtaagcggtacgtaattaacattgacttagagaacttcttccatacctttaatttcgggcgcgttaggggctttttcttaaccaataaacacttcgaactgaatgaagaggttagtacgtctatagctcaaatcgcatgttataagcggcacttgccacagggcgcaccgtcttcccccgtgatcacgaacctcatttgcaacatccttgacgtgcgccttagtaacctagctaagaagaataaatgcaagtactccaggtatgctgacgatatcactttttcttctcgttcaaaagtgatcagcaaagagttggtgagacaagagaatcacaaatggtccgtatccgggaaactgaaaaaggagattaaacgggccgattttatagtgaatgataaaaagactcgggttcagtacaaaaattctaaacaggacgttaccggccttgtcgtgaacgagaaaatcagtattccttctaagtattggagaacggtaagggctatggtggataatcttctgtattgcggccactttactataactaagagagttctggaagaagaggagttaaaggaggtcaagatcgaaggcaaaattgagcagctcaacggtatgttatcatacattgacagcgtcgacctgcacaacgcgaaaaagggttcagtccaggtggacctgaaccaacgcgagagaacctaccgcgactttctctattttaacaagttctacgccaataacaagcctacaatcatatgtgaagggaagactgatcatgtgtatctaagatgcgcccttaagaagcagtaccaggatcataatatcttgattgagaagtcaggcgacgatttggtgagtaaggtgagtttctacaagtatacagagctcgagactcgtctgctgggggtgacagggggatcttcgcttctgaaagcctttatagcaaactatcctaaggtcattcgaaagttttccgtgccagccagcaacaaccctgtaatcattttgatagataacgacaagggagccaaagagatcttttcccagatcaaatccatcacagattccaggtccaccatcgacggatctgaactcttttacaaactgtacgacaacttctatgtcatcgcaacacccgcagagaagggtaagatgtccatgatagaaaatttcttcccaaaatcactgcttaagacagagctcggcggcaaaaccctggagctagacgaaaaaaaattcgacaagtcgaaacattacggaaaagcctatttcgcggatcgcgtgatcgcaccgaattacaagaagattgactgttccgaattctccaaaattttctatcgcattgaggccgccatcagggacagtaggcgatga

SEQ ID NO: 8173 - RNA, 1689 nt, unidentified
  source 1..1689: mol_type = other RNA; note = synthetic construct
atgtccgatctagccactttaaaggaatgtcaaaccaagttcgacctggcaaagctgctgcagattgaacctcagaacctcacatatctcatctatggcctcagcgatgaggaaaagtacaatgagtttaccattccgaagaaaactggaggggtccggcgcattcatgctccaattaaggaactgaaagacctacagaggaggttgtcaaacatcttacaaagctgcctaatcgaaattgagtctgaatctaaacggagccccccatcccacgcatacaaaaaagaatgcagcataatcacgaatgctaagtctcatacgagaatgaagtgggtgcttaacctggatttggaggacttttttccttctctgcattttggcagagtgcggggatatttcattactaacaaacacttcgagctcacagaagaggtgtccaccattatagcccagatcgcctgttatgacaaaaagttgcctcagggggctccctgctctcccgtgattacaaacctgatctgcaatatccttgacgtgcggctgagcaagcttgccagggaaaataagtgcaagtattcccgttacgcggacgacatcacttttagtagtcgcagtggcgatatcagtaagaacatagtgaagaataacgatcacctgtgggagattagcggcaaactgaagaaggagatagtccgagccgggttctcgataaataagaaaaaaacgagggtccaatacaagaactcacgccaggacgtgacaggtttagtggtcaatgagaaagtcagcattccaagcaagtattggcggactgtgcgggctatggtagataacctcctgtactgtggattcttcaccataaacaaaatcgttgaggaggagggagagagaaaggaggtaaagatcatggggaaactgtcacagctggaagggatgctgtcacacatcgaaagcattgactcttacaacaagaagatcaaccctacaaaaacacttaatcaacgcgagaaaacttaccgagatttcttatactacaagaagttttacgccaatgacaaaccagtgattatttgtgaaggtaagaccgaccatgtatatctgagatgcgccctgaagaatttgtctctcgatttcccaaagctcattgagaaagttgacggaaagctgagatcaaatctgtcgttttacaagtactccgacctggagatgaaactcctgggaataaccgggggctccgatttgcttagggcctttattagcaattatcctaaggtcatcaagaagttcagtgcaaaagcatcctccaacccggttataattgttatcgacaacgataaaggcgctaaagaaatcttctctcagatcaagtcaatcacccgatctgcatcacccattgatggcagcagtaacttttaccagctctatgatcgcttttatgtgatagccacccccgcagctaagaaatccatgtccatgatcgaggatttctttcccaaagctttgctcagaaccaaacttaatggtaaaacattcgagcctgacgaaaagaagttcaacaaagacattcactactccaaagcttatttcgccgatcacgttgtggccaggacctacaaaacaatcgactgtagcggctttaaagcgatcttcaatcgtatcgaggcggcaatcgaacatagtaagacttga

SEQ ID NO: 8174 - RNA, 1809 nt, unidentified
  source 1..1809: mol_type = other RNA; note = synthetic construct
atgtctaagctcgctgcgcttaagtctgccaatagcgtgagtgatctcgcgaggttactgaaaagtaagcctgatacctttgcatacttcttatacaaagtacctgagaagaacaaatacacaagcttctcaatccccaagaaaaccggaggcgagcgaaagattgacgctccttcagatcagctgagttatattcagaaacaactcgccaaatacctgcaggattgcattgaagaaataggagaactcgagaaacaaaagctcgggaagaagaagtttagctctgcggcacacggcttcactaaggatcgttctataatcacaaatgctcgcccacacagacggaaaagatgggtgctgaatcttgatttgaaggactttttccccagcattaatttcggcagaatacgcgggttcttcatcaagaacaagaacttcaatctggatccagacgtcgcctctgctatagctcacatatgctgttacgagggtaagttgcctcagggatccccttgctcgcccatcatctccaatctgattggtcacttacttgacgtgcggctaatcaaaattgccaagaagtatagctgcacatataccagatatgcagacgacatcactttttccagcgatctgcggaagttccccaaagagattgcacataagaagctcttttcaaaaaagtcctgggaactgtccaacagcatcaaacaggaaatagagaaatcaggttttttcgtcaacgaaaaaaagacgagaatgcagtatcaagagtcccgacaggatgtgacttcactcgtggtcaataaaaaagtgaacgttaagcgggagctgtacaagaccctgcgtgcccagtgtcatacactatttaggactggcgggtgttatgagattgcctaccagaggccagaaaacgaaaagatcagctacctccaacggatcttggataagatattctaccgacctaagaaaatcaaggaaaagaaagaggatcgtaaatacaaaactctggatcagatccagggcatgctgaactttgtttaccaggtcagacacgacagagacaagaagctgggcatcgccgagcgcaaggagattgaatcctctattaagtcactctatcgcaaattcctcttcttcatcaacttctactatatagaccgcccgttgatcatttgcgaaggcaagaccgatcccatctaccttaaatgtgctttaaagagtctgcacctaaagtaccctgggttgatcgagaaaacctccgagggctttgactttaggattaagtttttcacctacagtgacacaaccctggatatcttgaatcttggaggtgggtgcggggatctagccaagctgatcagggagtataatgagtcttgtactccatacaaatgcagtggtcttctgcacccagttatcatcattgtagacaacgacaatgaaccaaccgaaaagctgtttcccgcaattaagggcataacccatagtaagactcccattctgggcgacaaaccattctatacagtgacacggaatctgtatgtcattcccattccccaaaaaaatggaaaaagcacgtgtattgaacactattttgaggagtccgtgtttgataaagacatcaacgggaggaaatttcatcctgacaaaggaccggccgacgggttctcttgctctaaaaacgatttcgccgagaaaattatctgtaagcagcagggatccatcaactttagcatgttctcggacatttttgacaagatcgtggacgttacgatccattataggacccgccgaagctcaccgtga

SEQ ID NO: 8175 - RNA, 1713 nt, unidentified
  source 1..1713: mol_type = other RNA; note = synthetic construct
atgaacgaaaagaagattgagcagctaaaagcctgcgttgaccggaaggacctggctcggctgctgggatttaaacccaaagcattatcctacattctgtaccagcgtactccatgccaaaattacaggacttttaaaattcccaagcgaaaggggggggagagagttattgatgccccgaatccagaactgctttttctgcagaagcgggcatctaatctgctccaggattgcttggatgagattgtccaggacgaagggcacaagcgcaccatacatcacggttttcagcgtaagaaatcgattatcaccaacgcaagggtacatagagctcggaagtttgtgttcaatgtggacctgactgatttcttcccctctgtgaactttggacggatcctgggattcttccagaagaaccgacactttacccttgaaagagaagtcgcggttaccttggcccaaatctgctgttacgacggacaactgccacaaggcgcgccgacttcccctgtcgtgagcaatctgatatgtcagcctctggacatccgtctgtctcggttagccgaaaagtttggctgctcctattctagatacgccgatgatatcacatttagtacctccacaaggaagtttccccgagctatcagcagaaagtctctcatctcatcaaaatggtactcagggcgcatactcaaaaaggagattaagtctgccggcttcgctataaatcccaaaaaaacacgcatgcagtacgctcagagtaggcaaactgtaaccggcctcatcgttaatgataagattaatgtgcctgctgattatacaagactgtgtcgggctatggtcgacgcttatgtaaagtccggcacatatttcatccggaaggagaaattatcgaaaagcggaaaggtgaaagtgaccaaagaacccggtaccgacctgcagctgattggtcgctatagcttcatccacaacgtgaagtcaagcaacttttcaaaggaaaaccccaggcctaaggatttgtttagctatgagaaggactacaggagactccttctcttcagcaagtttcacttcagtaaaatcccactcattctgactgaagggaagacggatacgatttacattaaggcagccttaaggcgccttcataaaagttatccgaccttgatcacaaaaaaagggaggtcctttgagtataacttcgacttcttcaaattctctcctacaaatcgccgcatactaggcattgacggaggcacatcccacctagcaggctttctatctacttatagaaaagaggccaagagtttctgtcctatactgaatcagaagcctgtgatctgtatcatcgacaatgacaacggggccaagaaattcttcaaatggaccgactccagcgggaacaagatcaatcgagatggcgaggtgtaccacctgtttgagaatgtgtacctccttctcaccccattgaagaacggtacagaggattccaagattgaagatttcttcacgaaacatacattgaatgagaagatcggtggaaagagttttaacccagagaacgtcggcgtgactgaagcagagtacggaaaagcctggttcgcgagcaaagtcgtttggcctaagaaatcaaccatcaacttcaacaactttaagccactgcttgacctcatagagaatacggccatgaaagtccataaccccaaaaaatga

SEQ ID NO: 8176 - RNA, 1671 nt, unidentified
  source 1..1671: mol_type = other RNA; note = synthetic construct
atgacctccaagcttacaagcctacgctcagcaaaaaccgtttacgacctcgcctcacttctcggattttccccctcgtcaatcacgtttatcctctataatctgcctccagctactaagtacaagacctttagtatcgcgaaacgatccggcgggacacggttaatatctgctcccgagccccgcctgaaaagtctgcagcgccgccttgccgacttgttgcaggaatgtcgcgatgagattaatgcactgccggaaaataagaaatcccggagccatggtttcgaaaggcaacggtctatcctcactaacgctaatattcacaaacggaagaggtatgtgttcaatattgacctggagaactttttcccctctttcaatttcggtagagtgaggggctttttcatcaagaacaagaaattccagctcgaaccaaaaatcgccacgttgatcgctcagatagccatccacaataatgaattgccccagggaagcccttgctctccggtcatctccaacctggtggctgacgcgctggaccgtagactcgacagactcgcgaggcaaaacaggtgccggtactcacgctatgctgatgacattacctttagcgccagggtcagagacttccccgcagatattgctgtgcccaccggcgctaacttcgatccatctgctgtcttacagtctatcattgctagtagtgggttcgcaataaatcctaacaagactcgcatgcaatacagcatgtcacgtcagatagtgaccgggcttgtggtgaacgagaaacctaacatccgaaaggaatacagacggactctgagagcccaggtcgatagctacgcgaagactggcagctttacttatgttgattcctccgggacaccaatccctggaagagccaggcaactcgaagggaaaatatcccatgcctgtgccgtgaaaatgcataacgcaggcccattgaacgacagcatgcgagtaggagagatctttaaaatcgcccgtaagttctggctttcccacttgtttgcgagaagacttaagccagttatactatgtgagggcaaaacggacaatgcttatctgcgagccgcactcaagtcgctggccctgcagtatccctctatggtcgatagcagtgcacgtaacgccacctttaaggtcgagttcgttaacctgaatagcctagccgccgaggtgattggactggggggaacagccaatctgtgcaagctgattcataattacgacaaggaggtactcaagttctctaggagtcggcctctgcacccactgatcattgttgtagacaatgattcaggcgcaaagggcgtgtttggtaagattaaagaggcaaccggcaaaactgtggatatcaacacaaaggaacatttctaccgcattaaggacaatatgtacgtagtgaaagtccctgaagggcggcttaacgaggaaagggccattgagcacttattcgacccacctgttctgaacacacccctgcacggtaagattttccaccccggcgataaaaactttgatcctaccaagcactatggtaaagaggcatttgcccagaacgtggtgcggccgcaggctaacacattaaattttcgaggattcgtcccactgctggacaggatcgaagaggtgttgaaagattactga

SEQ ID NO: 8177 - RNA, 1524 nt, unidentified
  source 1..1524: mol_type = other RNA; note = synthetic construct
atgctgggcagaaacaacggcgactcagcatccgataatcaggcgaaaaccttttcccaagtctcacacggttttaagcgaaagctctccatccgtacgaacgctagaaaacacaggaatcggagatacgtctttaacattgaccttactgacttctttggatccatcaattttggcagggtaagaggtttcttcatcaaagataagcggttccgccttaacagcaaagtcgcaaccattttcgcgcagatcgcttgtttcaaaaagtctctcccccaagggtcaccatgctcccccgtgatctctaatctcatcggcaatatcctcgacacacacctcgtccggctcgctgctcgaacagggtgtacctacacacgctatgctgatgatcttaccttttctaccaataaacggtgcttccccaggtctatcgccatccaatcagacgatgacaaccatgtctggattcctgggccagaactgttgagattagtgaaccagagtggcttcgaaattaaccctaagaaaacacggatgcagtatcacagcagccgacaagaggtgaccgggctggtggttaataagaaggtcaatattaggcgtgaataccgacataacgttagggcaatggcgcaccgactgtttaccaaagggtctttcttgctcccaatatacgagaaggatgagaacggggattatcttctggagatgaagcccggtagcctgaaccagttacacgggagactgggttttattgacggcatcgacaggtacaacattgagattttgtcagcatctaaagaatcgcagattaagagcaaggagactatctatcggcggttcctgttttacaaagaattttacgccgcttcaaaacccgtgctgatttgcgagggatggacagattacgtgtacattgaaaacgcattgctgaagctggcccctaattatccaagtcttgtgagcttagatgacaatggaaaaggcagttttctgatcaagcgcttcaaatatagccggagtcatactactaagattctgggcatcaaaggaggagtaggagatttcatcaatttcatcaacagctacaagagagagttcgagagattctccgtgccgggcatgagggagccggtcatactattgattgacaatgatgacggcggtaaaaaggtgtttaactgtatacgtagcattctaggaaccgacctagaagagatgcgcaaggccccttatatacacgttcatcgcaacctgtacctgatatctacacctctgcagggcaatcagcagaagtcccagatcgaagatctcttcgacttctctacgctggaggttaaaatcgatggaaagtcgtttgaccgcagtgacgaaaaggtaactgagacgacttattccaaggccgtgtttgcccaaaaggttgtgaaagagatggccagcagtatcaattttcaggggttcatgccactccttgacaggatagccaaggtgatagaatcccattatgcccagcgcaaagaatga

SEQ ID NO: 8178 - RNA, 915 nt, unidentified
  source 1..915: mol_type = other RNA; note = synthetic construct
atgagcgctctcaaaaaactccgggatgccgaatctatcgcagacgttgcttctatcctggggttcagaactaaggcactttcctacatcctgtatgtgcagcccgacagtctgaaatataaagagttcgacatccccaagaagtcaggaggggtaaggagaatcgccgcaccccagagtcgtctaaaattgctgcagaagaggcttgcagatctcctgcaggattgtcttgatgagattaatggagacagcgcttcagacaaccaagcgaaaacattttcccaggtgtcccacggcttcaaacgaaagctgtctatcaggacgaacgcgcgcaaacaccgcaacagacggtatgttttcaacatcgacttgactgattttttcgggagcatcaattttgggagagtcaggggtttttttatcaaagacaagcgctttcgtctgaatagtaaagttgccaccatattcgcacaaattgcctgcttcaagaagagcctcccacagggtagcccatgctctccggtgatttccaatctgattggcaatattctggacacacatctcgtgcgcttagctgcccggaccggctgtacatatacacgttacgccgatgatttgacgttctcaaccaataagcggtgctttccaagaagtattgctatacaatctgacgacgataaccacgtgtggatccctggacccgagctactgcgattagtgaaccagtcaggatttgaaataaaccctaaaaagacccggatgcagtaccattcgtccagacaggaggtcactggcttggtcgtcaacaagaaggtaaatatacggagggaataccgccataatgtgagggccatggcccaccgactgttcaccaagggcagcttccttctccctatttacgagaagatgaagtga

SEQ ID NO: 8179 - RNA, 1758 nt, unidentified
  source 1..1758: mol_type = other RNA; note = synthetic construct
atgagcgcgctgaaaaagctcaaggacgctaccactatcgcggagatcgccgatatactgggatttaaaactaaagctctcgcctacatcttataccggcaacctgatagcctgaagtataaggagtttgacatcccgaagaagtctggcggcgttcgacatatagccgctccacaaggagggctgaaactgctccagaggcaactggctgatgtattgcaggaatgtctcgacgagatcaataatgccacggtcggggatcaagcgaggccattcgtggacattagccacggcttcaagcgcaaactttccatccgtaccaacgccaagaaacaccggaacagacgatacgtctttaatgtggatctcatcgactttttcggcagcattaacttcgggcgggtcagggggttctttatgaaggacgcacggttctgcctgtccccaaagatcgccacaatcctggcacagatagcatgctttaagcagagtcaccctcagggttctccctgctcaccggtgatttcaaatcttattgggaacgtgttggacatgcatctcgttaaactcgccgctcgccgcggctgtatttatacaagatacgcagacgatcttaccttctcgactaataagagatgctttcccaaatctattgcagtacagagcgatgacgataatcatgtgtggatacctggttctgaacttttccggttggtgaaacactccggctttgaaatcaatcccaagaagacaagaatgcagtatcattgttcacgtcaggaggtaactggacttgtggtgaacaagaaagtgaatatcaggagagagtatcgccacaatgttagggctatggcctaccgcttgttcaccaagggaagcttcttgctgcccgtctacgaaaagaacgccaatggtgactactctctggaaatgaaacctggcaacctgaaccaactgcacggtagactcggatttatcgacgggatagatcgctataacattgagcgggtcagtactgctaaggagagccagattaagagcaaagagacaatttatcggcgatttctgttctataaagaattctacgccgcttctaagcccgtgctgatctgtgagggatggactgactacgtctatattgagaacgccttgcgaagccttgcctccaactacccatcactaatctccctcaatgacaacgaaaaggtgaacttcctgattaaatgcttcaagtactccaaatcacatacaaccgagattttaggcatgaatggtggcgttggcgacctgaaaagatttattcccctgtataagtccgagtttgaaaggttcagtgccccagggatggaacagccgatcatcttgctggtcgataatgaccgggcagggaatgaggtgctgggcgtcgttaacaacatggtgaaagggaacaaaaggacaaagaccaaggtcgataacaatgagccctacgtacacatccatcacaacttatacctaatcctgacccctttacagccaggacagagtgaatcccagattgaggatctgtttgatgcttcgacgctcgcgataaaaatcgacggcaaaagtttcaataggagcgacgagtctgtgacggaaaccacatattccaaggccgtgttcgcacgtaaagtggtggaggaacgcgcatcaagtatcaactttgagggatttgcccctctacttgatagaatagctcaggttattgaatctcactatgcaaagggaaaaaagtga

SEQ ID NO: 8180 - RNA, 1740 nt, unidentified
  source 1..1740: mol_type = other RNA; note = synthetic construct
atgttcttcctgcatagcctgaaatccgcgactagcctcaaagatgtcgccgaccttctgggttttaaagccagcgcgctagcgtatattctgtacaagaaggatggggcttcaaaatacaagagcttcgaaattcccaaaaagcacggtggaatacgcaagattttggcaccttccgatgagctcaaactcatgcagcgtcgccttagcgatcttctgctggattacaacagtgagatcaaagcacatgacggtctgaagaatcaaatctctcatggcttcgaaccggacaagtccattgtgaccaacgccgagtgccatcgcaatagaaggtacgtcttcaatgccgatataaaggactttttcggcaccattaactttggccgagtacggggattttttctgaaggacaagaatttcgaactccacgagacagttgccaccattctcgctcaaatcgtctgtcacgacaactccctgccacagggctcgccgtgtagtccagtgatttcaaatctcatcgggcacgtcctggacgtccatttcgtgaagctggcagcgagaagtggttgctactataccagatatgcagatgatcttacttttagcacaaacctgaagactttccccaaggccatcgctaccaatgtggatggggagaatcactcctggatacccggcaaagagttagctagactgattaagcactgtggattcgaattaaaccctcagaagacgcgaatgcagtaccgcgattctcgccaagaggtgacaggactggtggtaaataggaaggtgaacatccgaaatgaatacagacatcatgtgagggccatggtgcaccgtctcttttcaaccgggaacttcgactttgaacagacagtggtcgacgaaaaagggaatagtacaaaaacgaaaacccccggtacgctgagtcagttgcacggcatgctgggctttatacatggcattgatgtctacaacaaagatagactacacaccccccattacgaccaccagcatagtaagctgcctagatcaaaagagacgatctaccgtaggttcttactttttaaggagttctatgccgctagcgctccagtgatcatctgcgaaggcaagacagacaatgtctatcttgtacacgctattcggcggcttgcttccgactttcctaaattagcagcaatcgagaaagacggtgccatcaaactgatgacacggatctttaggtattccgacacttccactggaaaaatcctgggcattaccggcggaggcccatgcttgaaaaacttcataaacttgtatcgggccgaaatcaagcagttcaccgcacccggacggtttcacccggtgatactcctggtggacaatgattcaggagccaatgagatttatagcaccttgaagcaaatagtgaagccccccccatctcgcaacgaccccttcgttcacgttttcggaaacttgtatgtcgtgcctactccattgctacctggggggggacagtctatgattgaagacttttttgattctgggatcaagtcgtctgttgtttctgggaagacatttcaccctgattccgacgccgatacagagactcattacggcaaggttattttcgcacacaaagtgatcaggactaacgccgacaccatcgacttcagcgggtttaaggagatcctcgctaacctcacagccgtaattgatgagcacgctaaaaggttcccatcatga

SEQ ID NO: 8181 - RNA, 1761 nt, unidentified
  source 1..1761: mol_type = other RNA; note = synthetic construct
atgactcacctggatgggctgcgcagtgctaagtcttttcacgacatcgcctccttactcgggttcaaaccccgcgctctggcctatatcatctacaaaattccagtcgaccaacggtatgagagcttcgacataccaaaaaagcgcggtggatacagaaagatctcagcccccaatagcaaactaaaacttgtccaacagcgacttgctaacatcttgcagaattgtgttgaagaactcaacaaatcaaagcggattaacgatcatataagccatggcctgaaaaggaagcgaagtatcctgaccaatgctaagaaacaccgaaatagacgctatgtctttaacatagacctcaacgattttttcgggtccattaactttggcagggttagggggttcttcataaaagacaccaatttcaaactcgagcctaacattgccactattctggcgcagatctgctgccacgatcatagcttaccccaaggagcgcccacgagtccagtgattagtaacctaattggacatatcttggacattcacctcgtgaagctcgcaagtaccaatgggtgttcatacactcgctatgctgacgacatcacattttctaccaacaagagaaacttccccgaaaacatagccaaacaggagaatatcaatatacatgattgggcacccggccatgacctcgaccaacttatcaaaatctcagggttcacagtaaatcctacaaagacacgcatgcagtactgcgacagccggcaggaggttaccgggctgatcgtcaataaaaagattaacgtgaggagcgattacagacataccgtcagagcgatggtgcaccacctgttcactcacgggttttactatctgccccagaataagccgccgaaggagacggaaattagcgaagagaataagggcaccatggatcagctccatggtatgctgggattcatcgactcagtagatctgtacaacaaaaagaacgctagttccgcagtggtgcctcggaccgaaaaacagaagctgacatctaaagagtccatctataggaggtttttgcttttcaagttgttctataaggctaaggcaccagtgatcatctgtgaaggcaagaccgataatatttacattactcatgccatccgttctcttgccaagaatcaccctaatctggcatctattaacaatgatggctctatacagctgaaagtgaggctatttaagtattccgagacatcgacaggccgtattctcggaattaacggaggaactggcgagttaactaagttcatccctttgtaccacaatgagactaagaaattcaaggccctgggctgcgatcagcctattattatcatcgttgacaacgattcgggctctaatggcaatggaagaacgtttaacgctgtgcgggccataaagaaagatgcagacccaaaacacgccccattcacacacatcacccaaaacctgtacctgatagcgactcctctttcattggatgggagcgactccatgatagaggatttttttaccccagagacgctgtctatcgaggtgggaggcaagacatttaaccggggtaacggtatcaacctgaataaagagtacggtaagaacatctttgcccagcatgtggtcaagacaatggccgactccattgactttagaggtttcaatcccatcttaagcacaatcgaaaccgtaattacgacccacgcaaaaaccattacttccgaatccgaagaaacctga

SEQ ID NO: 8182 - RNA, 1719 nt, unidentified
  source 1..1719: mol_type = other RNA; note = synthetic construct
atgtctctgctagcagaattaaaggaagctacaactatccacgatatcgcatcactgttaggcttcaagaccgccgctttgtcctacatactttatgtaaaatcggatgccagcaaatacaagacatttgacattccaaaacgtagtgggggcgtcagacagatttctgcaccctactcagacttgaagttactgcagcgaagactggccgacctgctccagaactgcgccgatgaaatcaccaagaatcaagggaggggtgacgaggggaaaaaccccgacaggatttcccacggatttcgccgacggcgcagtattatcactaacgccaagcagcattgtaagcgccggcatgtctttaacattgatatcgagaacttcttcgggagcatcaattttgggcgggtaagggggtttttcattaaggacaacaactttgaccttaatcccaaaatcgctactatcttggctcagatcgcctgcacaaacggcagcatacctcaagggtccccctgttcaccggtgatctctaatttaatcggacatattctcgatacccatctcgtgaggctggcaaaaagggccggatgcacctatagcagatacgctgacgacctgacattctccaccagcctccgggacttcccagacacgattgcaacgaggtgtccagtgaatgagcacgattggcagccgagtcacgagctggaaaggatcataacacagtgcggattcagcctcaacaatagtaagacacgtatgcaataccaggaggctagacaagaggtgactgggctcgtagtgaataaaaaagtgaatgtgaggtcagcataccggcgcaccgttcgggcaatggtccaccagctgttcaccactggtaagtttcacatccccggaacccctgagactcaaggttctctgaatcagttgcacggcatgctaggcttcgtcgatggcatagatctgtacaacaggagcctgcgagcgaaaaactccggctcgctcggagacaaggaaaaaatgtacagacagttccttctgttcaaagagttttatagtgcggacgtcccagtgttgctgtgtgaaggtaaaaccgataatgtctatattacgcatgcgataagatctctggccgataagtaccctaaacttgccacaaagaagaccgacggctctgtaaccatcgatttccgcagatttcgcttcaccggcacttcaacgggacgaatactccggctacagggcgggacccctgacttgaaggcgttcgctgaactgtatcgcgaggagtccgttagatttaaggctccaggaatgaagcatcccgtgattcttctcattgataacgatgatggagcccgtcgaatctatggtttcattcagggcatcaccggtaagcggcctgacggatccgagagcttcgttcacgtctttaagaatttttatgtgtgcgcaacacctctgctggcgggcgcaaaggaatccaaaatagaggacttctttgatccaaagacactggatactaagattggggccaaaacatttaactctaagaatgagatcgacacagccatgcactacggcaaggccgtttttgcctacaaagtggtggaagctcatgcagacaaaattgactttagcgccttcgctgctatcttcgataacctcgttaaaatccttgactatcacgccgccaagtttgtgactgaaactgcttga

SEQ ID NO: 8183 - RNA, 1818 nt, unidentified
  source 1..1818: mol_type = other RNA; note = synthetic construct
atgagtcagctgacagctctgaagtctgcttcgacgcttcacgatgttgccgctatattggggtttaagcccagtgcactctcttatctgctgtatgtgtgttccgaagccaccaaatacaggacattcgacattcctaagagatccggcggcacaagacagatcgcagcaccagtcggtcctctcaaactccttcagcgtaggctggccgacgtactccagaattgcgtggacgaaatcaaccgaactaataaacgctcagatgacgacaaacaacccgattgcatagcccatgggtttaagagaaagcggtccatcatcacaaatgcacgtcaacaccgtaacaagaggttcgtctttaacctcgacctggaggatttcttcggcaccattaattttggccgagtgcggggtttctttttgaaagacaaaaactttgccctgcaacccaaagtggcgacaattctcgcccagatagcgtgctatcagagagcgttgcctcagggcagcccctgttctcctgtgatcagcaacctaatcggccatgtcttggatattcatttggtgcgcctggcaacactgaccggttgcacatataccagatacgccgacgatctgaccttctcaactaataaacaggccttccctagtatggtggccaggagcgctgtcggcaacgagcatgtctgggagccaggaaaggagctaggcaggctggtcactaagtcgggattcgctattaatacaaataagactcggatgcagtatcgggatagcaggcaggaagtaacaggcctggtggttaactccaaggtaaatgtgaggcaagagtacagacacacggtgcgagctatggtccatcgcctgctttcaaccggtagcttcgatttcgagtataccactacggatagtgccggagttaagtccactattaaaaccctgggtcgccttacgcagttacacgggatgctcgcattcatcgatggagttgacctttctaacaagtccgtgcttcctaaagcttctgggatcagcctcactagcaaagaactgatgtaccggcggttcctcttatataaggacttctatgccgcgaccacccccattgtcatgtgtgagggaaagactgacaatgtatacatcgcacacgcaatccgatccctggctactctataccccaaactggccaccgtggggagttccggtaaaatcacactgaccatcagacgcttcaaatatccaggcaaaaaaactagaaagcatcagtctcgcaatgccgggaactcaacagggaggattttgggagtgaacggagggtctaacgatgttggcaacttcatgcggacctacgctgctgagattggacgatttagggcccccgggaagcttcacccgatcatagtgctgatcgacaatgactccggtgccgccccggtgtacaatacgattcagagattaaccgggacaaagccaaccggcactgaacctttcatccacattataggcaatctgtacgtagtgcccaccccgctgttaaccacaaaggccagcatgattgaagacttttttgactcagccacacgggcgattcaatacaagggaaagccctttgatccatcaaacaagtttgatagcaagacccactacggaaaagctgatttcgcatacaaagtggttcagccaaacgcagacaagatcgattttaatggctttaaggcgatcctcgatcgctttagtgacgtcatcgaccagcacgccaagactcataacgctgtgccattgtctatacctgctgttgcagccgccgcagctccatga

SEQ ID NO: 8184 - RNA, 1809 nt, unidentified
  source 1..1809: mol_type = other RNA; note = synthetic construct
atgagtcagttaaatgccctaaaaaccgctaccactttagccgacatcgcaaaattgctcaacagtgaagcctctggcttagcatacgtgctgtataaggtcccagaagctctaaaatacaaagagttcgacgtgcctaagagatatggcggaactcgcaagatctcagcgccttctgacgcactgcggctgctgcagcaacggctgtctaaccttctccagaattgcctgaaggagatcgaggagtcgggaggccggagacatgatgtttcccatggtttcaagcggggcaggagcataatgtcaaacggggagtcccataggaggaagcgctacgtattcaatgtagacctcaaagacttttttcctagcatcaatttcggaagagtgagaggattctttattaaggacaagaacttcttgctgtcgcccaaggccgcaacatttctggcccagatagcttgttacaaaaacgccctccctcaaggatcaccgtgtagccctgtcatctctaatctggtgagccacgtgttagatacccacctagtacgtttggccgctaaggaagggtgtcggtacactaggtacgcggatgacttaacgttctccaccaataaaacagaatttcccaagagcattgctaaaagaactgatggcgcaccacacgattggattccaggagccgctctggtgaagctcgtggaaaaatctggtttcgcgatcaatccttccaagacaaggatgcagtatcacgactcacggcaggaagttacggggctggtcgtgaaccgtaaggtgaacgtacgctccgactacagacgcaccgtgagacagatgacgcataggttgatgaccaaagggaactttgagagtgtccacaaaatggtgaactcagacggcacaaagagcgtcaccaaaatccctggaactgtgccaggtctgcacgggatgctggcctttatagatcagatcgacttgtataacctgaaacaggttgaaaagggcctggctgatagtgataaggtgaaggagagaattaagcttgcaacaaaagagtccgtgtatcgaaggtttcttctgttctcacagttctacgccgcccccaagccaatcgttctgtgcgagggttcaaccgataatgtctacctggttcatgcaattcgatctttggtggcggacctgcctacactagctaccaaacttccctctggggagattgagatcaacgtccggttctaccgatattttaagcgtcgcaagaagaaactcgcgaacgagcacagtaaggcaattagcagtaccggtcgcatcctggatttgaaaggcggaagcggcgaactgctcaaattcgccaaggtgtacaagacccatctggctaaaatcacagctcccggggcataccaacccgttatacttctcattgacaatgataaaggggccaacgatatgttcggctatattaaaggcgtgacacagatcaaggagcccaagaatgaaccatttgtacaccttcttcgcaacctctatgtcgttcctactccactcacgcccgacaagcccaatgccaccatgatagaggactttttctccgatgattggaagaaaactctcgtggaaggaaagccgtttaatccagagaaggaccatgaagatcacacatgctatggcaaggttatttttgctcacagggtcgtgcgaccaaacgccgaaaagatcgacttctcccagttcaaacaactcctgcttaatatctccagcgtcattgagagccaccggaaaactcatcccccgccggggaaagcctcttga

SEQ ID NO: 8185 - RNA, 1035 nt, unidentified
  source 1..1035: mol_type = other RNA; note = synthetic construct
atgtcccagctgaaggccatcaagactgcaaccagcctggccgaaattgccaagctcctggagtttgagacatcttctttagcctttatactgtacaaactcccagatgcactcaaatataaggagtttgatgtgccgaagcggtacggcggaactcgcacgatctccgccccagtagacaggctgcggctagtccagcagcggctgagcaacttgttacagaactgcctttctgagatcgagaataatggagggagaaaacatgatgtgtcacacggattcaaacgttggagatccatcatgagcaacggtgagaaccaccgcaaacagagatacgtgttcaacgttgatctgcaagacttcttccacagcatcaactttggccgtgtgagggggttcttcatcaaggataagaacttcttactcaatgtaaaggttgcaacatttctcgctcaaattgcttgctataaaaatgttctgcctcaaggttcaccatgtagtcccgttatctccaatctcgtgtctcatatactggacacacacgtggttcgcctggcatctaaggagggatgtagatacacaaggtacgccgacgatctgaccttttcaaccaacaagaccaaatttcctgctagtattgcaattcgagctggctcagccccccacaactggattcctggcactactctggtcaagcttgtggaaaaatcgggcttcgccatcaatcagagtaagacaaggatgcagtactgcgacagccgccaagaggtcaccggccttgtggtaaatcgaaaagtgaatgtcaggaatgactatcggagaaccgtccgggccatgactcatcgcttgatgacgaagggggattttgaattcgtgcacaaaacagtgagcggggacgggaccgaatccgtcagtaagattcccggagcggctacccgactacatggcatgcttgcgttcatagaccagttggacttgtataacatgaaccaggtcaagaaaggtctgattgacactgataaagtgacggaatga

SEQ ID NO: 8186 - RNA, 1770 nt, unidentified
  source 1..1770: mol_type = other RNA; note = synthetic construct
atgccaaggctggcaattctgaaaggtgctgctaatctgtccgacgtggcacacctgcttgggtttaaaccaagctcgttgtcatatctactgtacaaactgccagcccctttgaagtacaccgagtttgacatccccaaacggcatggaggcttgcggaagatttcagcacccattgactcactcaagaatttgcagcagcacctgtctcagttactgcaggactgtctcgatgagcttgaggaggcgggtctgcgcaaaaacaactccgcccatggcttcacaagacacaggaccatcatgacaaatgcaatggagcataggaaccgcagattcgtctttaacgccgatatcaaggacttcttcccttctattaattttggacgcgtgcgtggatttctgatcaaagataaacacttcgccctgaatccagctgtcgccactgtgattgcccagattgcatgccacaataacgcactgccacaagggagcccaagttccccagtgatatctaacctcattgcatacgtgctggatacgcatctggtaagtctcgcgcaacatacgggatgtcactatacaagatatgcagacgatctcaccttcagtacaaatatgccaaattttcccaacgccatcgctgtgtgcgtgggaggcaatgcccataactgggcggctggccagagcctgacagcaatcgtgagcaagagcggtttctccttaaactccgctaaaacccggatgcagtacagagattctagacaggaggtgaccggactcgtcgtaaacgaaaagatcaacgtgcggagtgagtatcgccacaaactgcgcgctttgacttttaggcttattaacaagggggaattttcaattatccataaaagcgtggacatactagggaatattaccactaatgtcatcccagccacccccgctcaattaaaaggaatgttggcctttgtggacgcagtcgacatagcgcaacgggacgacgccatccggcagtttcatgacaagcaccaggatgggcagatcaaatacgagcgttacaagctggtccgaaaagaaaacacctacaggcgtttcctaatgttcaatgagttctttgccactcccaaacctgtcgtactctgcgaaggcccgaccgatcgagtgtatctgagatgtgccgttaagaggctagctgctgatttccccaccttagctacgattaatgccgcgggcgaagtcagtctgaacttcaggcggtacaagtacgccgattccaatactaaccgaatactcaagattcacggtggcgccagccagcttatgggctttatctctgagtataggtccgcggcagaaaagtttctcgcccccgggccgtttgagccggtaatcgttcttgttgacaatgacgatggtcctgaagagttgttcaagtatcttgccaaagtgaacaaagtcaaggccccgcgcactgaacctttcgttcacgtttgcgccaacatatatgtggttcccacaccccttgggcctaatggcgaacctacctgtatcgaggactttttccctagccacctcttcaaggaagaagtggctggaaagacattcaaccctaagaaaaagcacggcgacaatgagaagttctactctaaggagatattcgctgagaaggtgattgccaagaaggctgggactatcgattttgatgcctttaagcccctgctgtcaaatatcgaaagagcaatcaacacacatcgaaaaaaccaccctaagcccaaatga

SEQ ID NO: 8187 - RNA, 1773 nt, unidentified
  source 1..1773: mol_type = other RNA; note = synthetic construct
atgatactgctggctaaactcaggagtgcgaaaacaattcatcacctggccgcaatccttggttttaaggccagcgcactcgcctacattctgtacggcaaaggaggtgcaagtaactacaagaagttcgatatcccaaagagatatggaggagctcgccatattagtgcccctatgcccgaactgaaactgctgcagagccgtctctcagacgtgttacagaattgtctcgcagaaatcaatgaggccgccggcagaagcgacaaaattttcgatcgagtaaattctagggctgaccggatctcccatggctttaggcggcatagaagcatcattaccaatgctcgcgagcacagaaatcgcaagttcgttctgaatgtcgatctgaaagacttcttcggttctattaatttcggcagggtgagagggtacttcatcaaggataagaagtttttgctatccccagaaatcgccacaatgatagcgcagattgcctgctatgaaaacacccttccccagggcagtccctgtagccctatactcagcaatctaatcgggcatgttctagatgtgcacctggtggggctcgctgctaaaaaaggctgcgtgtactcacggtatgcagatgaccttactttttcaacatccaaaccggtgttcccaagttccattgccagctcagacccgactaacgagcacctctggcttcctggcaaggaactggtgaggttagtcgaaaaatctggcttcgaaattaaccctagcaagactcgtatgcaataccggaactctcgacaagaggtcaccggcctgatcgtgaacaagaaagttaatgtgcgttccgaatacagaaacacggttcgcgctatggtacaccacttatttaccaccggcacgtttgagattctgcagcgggtgtctgacggaaaagggggggttactatatctcaggtgcccggcaaggttaaccagctgcacggaatgctggggtttattgatggagtcgacttgtacaacaaaaagctgatcggagtggctaagggagcgtccaatttgccatcaaaggagacaatgtataggcgattcctgttgtacaaagaattttatgccaccaccagccccgtcattgtatgcgagggtaaaaccgataacatctacatactccatgccattcgcagccttgctgccacttatcctaaacttgcaacaacaaacgctgatgggacgatcaagctcaacgtgcgaattttcaagtactcgggcacttcaactggtaggatcctgaagatgcatggagggaccggagacttggggaatttcatgcttgattatcgcacagagtgcgctcggtttaaggcaccaggtcaacagtccccggtcatctttttggtggataacgacagtggtgcgtcttccatctataatattgtcaagcagatcaccaaaaagaaggtaaccgggacagagcccttcgttcatgtcacagggaacctgtatctctgtgctacgccattgatcgcaggcgccacagaatcaatgattgaggacttctttgactcggcaactaaggccataaccatcggcggaaaaacctttgaccccgatttagacgatgagactgccaaacactacggcaaggtggtgttcgcacacaaggtcatcagagccaacgcaaataagatagactttaaggagttcaaccctatactgtccaatatcgtggcggccatcgacgcccactctgagaaagtcgtatccgccggcgtgccttga

SEQ ID NO: 8188 - RNA, 1731 nt, unidentified
  source 1..1731: mol_type = other RNA; note = synthetic construct
atgtgggccactcatcccccaccgtttatgacccaattaaagaagttaaaggcagcgaaagatatctacgacataagtacccttttgaattacaaagccggtaaactgtcttacattctgtatgtgatcgacgaaagcgacaagtacagttctttcgaaataccaaaaaagggaggcggaactcggacaataaaatctcctatccccaaactgaaacggctacagaaaaacctgagcaatctactgcagaattgccttgatgagttaaggtcagagaattcttacgttgatcctatgtcacacggcttcgagaagaaacgtaacattatcacaaatgcagaagtccacagggccaagcgatacatcttcaacatcgacatcaaggatttctttggctcgattaatttcgggcgcgtcagaggattcttcattaaggacaatagattcgagctggatcccaagatagcaaccattatcgcccagatttgctgtcacgagaattccctccctcagggatccccgtgttctcccgtcatctccaacattattgggcatatcctggacgttaggctacttagtctcgctatcaaaaatgggtgttcctatactagatatgccgatgacatcacattctccacaaataagaagaaattcccaagctcaatcgcggctaaagacgatgacggacatggatggtctgtaggtaaggagttaagcgatatccttaagactaacaaattctccgagaacaaaaacaagacccgcatgcagtataaaacatcccggcaatccgtcaccggcctggtggtgaacaagaagattaacgtgagatctgagtatcgaaaacaagttagggccatggtgcactcactgtttagtaaggggacctttttcataccaaaagctggggtggccccaatggatgaatttcccgaagggaccctgaaccaactgcacggtatgcttggctttattgacagcatcgatcagaataatgtcttgagacaggggctggaggcggcaagcatcacgcagaaagaaaagacctaccgcaagttcctgctctacaaagatttttacctttctaccaggccaattattctgtgcgaaggcaagactgacaacatttatttgaagtgcgctattaagagcttggccggtcagcatcagttgctcggagaacgtgtaggcgtggattcatttaagatgaaggttcggttttacaagtatgcagagacatccacagggcgaatcctcggcctgagcggtggcactggagacttccctaagtttatcaactcttacctctccggaatctcgaaatttacggctttggagctgaatcatcccgtgattatgatcattgataacgattccggagctaagggcatttacagtaaactccgggagatcctgaatcgccagatcagccccgctgaagagtatatttatgctggcgagaatctctacatagtgcctacccctatagccaagcacggccaacactcaatgatcgaggactgtttcgacaaagacacgaaaaagattctggtggacgggaagaaatttaaccccgacgacaaagccagtatcgatatgttttatggcaagagcgtctttgccactcaggtgattgaaagattcagcgagaagataaactttaacgggttttcagtattcctcagccgcatcgaaagtgcaataaatcatttccacaacatgaagggttga

SEQ ID NO: 8189 - RNA, 1677 nt, unidentified
  source 1..1677: mol_type = other RNA; note = synthetic construct
atggcaaccattctaagctttcaaccaaaaacactgtcttatctcctgtatgtcgcctctgatactcagaaatataggagcttcgagctgccaaagaagacgggaggaactagaaccatttctgctcctaccgataaacttaaacgccttcagtcaaatctagcagatttgttacagagatgcttggacgacctgaagatcagtgcggaatactcggattcagccagccacggattccaacgcggcaagagcatcatcagtaatgctgcacaacatcgggctaagcggtacgtgttcaacattgacatcgccaacttttttggagcaatcaacttcgggaggatccgaggcttcctgattaaagacacccggtttgccctgcatccaacaatagccaccattattgcccagatcgcttgccgagaaaacagcctccctcaaggctctccttgtagtcctattatcgccaacttggtcggaaacatcctcgacaggcgattaattgcactggccgcaaagtatggctgcacctatacacgttatgcggatgatttgacgttcagcaccaacaagaaagtttttccaccgcggatcgcctcacgcacgactgatcacacatgggctgccggggaggagctgttagccgttctgcaagcatccagattctcccctaacccccaaaagactcgtatgcagtataaaacatccaggcaggaggtaacaggactgatagccaataagaaggtcaatgtgaggagtgactataggaagagggtgcgcgcaatggttcacagactattcagcacaggcagcttcaatctccctgaaaacccaactcctggcgccggtagaacccgggatgcagagccaggtacgttgaatcagcttcacggtatgctttcctttatcgactctgtggaccagtacaatatccagcgatccaagctcaagctcgatcagctcagtcagaaagaaaaaacataccggaagttcctcctttacaaggacttctatctggccgagcaggccattatcctttgtgaggggaaaaccgacaacatatacttgagaaacgctattaaagggctccccaacgattttcccctgctggggtctaatgatagtccggaccagttcaaaattaatgtccgtttctaccggtatgccgaaagctctactggcaggattctggggttatccgggggcactggagactttcctaactttatcaacgcttacctgacagctttggcccagtttcccgctctgaagatcaggcatcccgtgataattctaatagacaatgactctggtgcgcgccccctgtacagttcactggctcagcgcctgcaccggaagattgacccccgcgaatcctttatacacgtggaatccaatctgtacgtggtagcaaccccgatcatagagcccgcgtccgaaagcatgatcgaggacttttttgatgagactaccaaaaagcttgtggttaagaatcgacactttgatcccagagatgacgcagatcagcggtacttctacggcaaaaataccttcgcgaccgaggtggtcgaacgcttctctgatagcatcgacttttcaggcttctcagagctcctgtgtagaattgagatggctatcagacatttccactcggcccattccccagctaactcatga

SEQ ID NO: 8190 - RNA, 1734 nt, unidentified
  source 1..1734: mol_type = other RNA; note = synthetic construct
atgactcagctgcagaagctgaaagaggcaaaaaacttacatgatgtggctacgttgctaaatttcaagcctaacaagctttcttaccttttatacatagccgaagacgaggagaaatataagacctttgaaatcgccaaacgtagtggaggcaccagatctatcgccgcaccagatcctaggctgaaacaattacagagaaacctcagcgtgcttctgctgaattgtttagacgagctccgggagaagaagttgtataaggatgacatggctcatggatttctgagaaagaaaggtattgtcaccaacgccgtcacccacagagctaaacggttcgtgttcaatattgacatctcagacttctttggttcaattaatttcggacgactgcgcggcttcctcattaaagacgaccgctttgagctcaaccctaatgttgcaacaatcctggcgcaaatagcttgccgaaaccatactctgccacaggggtcgccatgttcacccgttatcagtaatcttatcggacatatcctggacgtgaggctcgccggacttgctgcaaaaaatggctgtcggtattcccgctacgcagatgacataacctttagtactaacaagaaggaattcccccaagctattgcaatgcgcgaaccagacagccatgcttgggttgtcggcgccgaactcgaggtggtcctttccgcgaataattactctctgaacaccaagaaaactaggatgcagtactgcgactcccggcagacagtcaccggattggtggtaaataggaaagtcaacgtacgatccgagtataggcggcgggtgcgtgccatggttcaccgtttgtttacgaccggccagtttgcagtgccctcaactaaagtagctgccacagctgccggagcggtatctagcgaggagcctggcagccttccgcaactgcacggtatgctagggttcatagatggcgttgaccagtacaacattcgcaagcatggtctgagactcgaggagctgtccgaaaaggagaagacctaccgcaaatttctgctatataaggatttcttcctggccgagaggcccgtcgttctgtgcgaaggaaagactgacattatctacctgaagaatgctgtgcgccagctggcggctaaatatcccaagctcggggaacaaacaggcgagaacaaatttcagcacaatgtgaggttctacaagtttgcagatagtagcacaggaagaatactcgggttaagcggggggggcggtgatttccagaaatttgcccatgcctatttgtctgaagtggggcagtttcccacacaccctattgctggactcaagcacccagtgattatcatgatggataatgattccggcgccaacgcagtctgcagctacgccttgaaaaggacgaagatctctgtggatcgaggcggcgatttttttcgactcggggaaaacctatatctggtgttgacaccgtttcttcacggcgagaaaccttccactatcgaagacttcttcgatgacgcagtgaagctccggaccgtggagggtaaagccttcgatccaggagacgagcacgacacagggacccactacggcaaggccatcttcgcgaaggaagttgtcgagaagtatgcagatgaaatcgatttcaacgccttcagaggtatcctgagtagaattgaaggggtgatgtcagactattacgccagccggctggccctgtga

SEQ ID NO: 8191 - RNA, 1719 nt, unidentified
  source 1..1719: mol_type = other RNA; note = synthetic construct
atgtccaaactggaatctctacggaaggccagtactctgcacgatctagctcgcctgctgggctttaaggcgaaagctctcgcctatgtgctctacgtaatccccgaggcgaagaagtacacagaatacaagattcctaaacgatctggcggagcaaggacaatccaggcacccgtagcagagcttaaactgttgcaacggagaaccagtaatctgctccaagactgcatcggggagctcgctgacaagggtcagcgcagcgatccatttgtgcatggattcagacgacatcgtagcatcatcactaacgcctcaaggcaccgaaaccggcggctggttgtcaatctggatatatccgatttcttcggttcaattaacttcggcagggtgagaggcctgctcattaaggacgatgcctttagccttaatccatccgtggccaccgtgatcgcccagattgcgtgccatgagaacgcactgccacaggggagcccatgttcacccgttctagccaacctcgtggctcgcccccttgatctccgccttctggctcatgccaagcgccgagggttcgtctacactaggtacgccgacgacatcacgttctctacaagactgaaaaatcctcccgctgccattgttcagcacaaacctgggacaggacttcacgcttgggaagcagccccaacccttgtgcgggctatcgaaaaatcgggtttttctgttaatgccagtaagaccagggcccagtaccgtgacagtcggcaggacgttactggcttggtggtgaatagaagggtaaacgtcccacgcgagtataggcggcaggtccgtgcaatggtacacagactcacaaccacaggcgcgtttgaaatccggaaaaatgtgttagccgccggatccaccaccttgcgcgcaataccggggaactttgaggagctgcaaggaatgctgggctatattgcttccatcgatgctgctgcagagcacaaccgtaaagacaatgctattgccgcaagaagccagagagaaacgtaccgacgcttcctgttctacagggagttcttctgtgtggatagacccgtgatcgtgtgcgaagggaagactgacaacgtgtatctcaggtctgcccttcgcaagctcgccccgctgtttcctagtctggcgtcagtcacagcatctggcgaattacggatgaatgtgaggctgtataaggctgacggaaagaagacttccagcttgatgggtctgacgggaggtgccgcccccttattggcgtttctgcgagaatacagaaaggctagcgagacattcgtttcgaaaggaaacaggttccctctaatcgtcgtagtcgataatgacggcgcatcaaaggacatattctcctttatcaagaagatcactggcagtcataagatgattgacggcagcgaaccttactatcggttaatgccaatggtcttcgtggtccctatacccaaacccccttcctctaccaccgctgccattgagtctctctttgattcaagcctgttgagtaccattcataaagggaagatttttcacgggtccgacaaagggttcgatgaggacaagcactataccaaaagcgtgtttgccaaagaggttgtggaaccgcacttcgacaagatcaactttgatggctttaaacctttgctggatgcaatatccgaggtggtcggattaagctcaccatga

SEQ ID NO: 8192 - RNA, 1740 nt, unidentified
  source 1..1740: mol_type = other RNA; note = synthetic construct
atgtccaggcttgccgaactaaaggcctcaaccactctgagcgacgtggcgcacctgctcgggtataagcccaaggccgtttcatacattctgtacatgctgccaacagaccagaaatataccacattcgagatttcaaaacgaaatgggggacagcgcacgataaatgcaccagttgagaagttgaaagtactgcagagacggctggccgacctgttgcaggattgcctggacgagataaacaacgctaaaggacttaaagacagggcagctcatggcttcaaacgcaagctttctatcatcacaaatgcccggcagcacagacatcggcgctgggttttcaacgtcgacttagagaacttcttcccatctatcaactttggaagaatcagggggttcttcattaaaaatagagacttccaactccatgagaaagtcgctacagtgttggcacagatcgcatgccatgatcactccttacctcagggcagcccgtgctctcccgtaatcagcaacctagtcgctcatctcctggacatgcggttggtgaagctggcccagatcgctggctgtacgtattctcgatatgccgacgatctcaccttcagtacgaataagaaacaattccccctcgaaattggttggcccgccaccgatcaggggcctgattctcacatctggttacccggcgacgcgctgcgcaaaacaattaacagggcgggtttcactataaaccccaataagacccacctgatgtatcggaccagtcgacagcgagtgactggtctggtggtgaacaagaaaattaacatccgttgggaatacaggcacaatgtgcgggccatggtcaacaagctcgtgaatacgggtgagttcgaactcaacggcatagtgcacaaggatggcaatgtctcaatcgagaaacgccctgggagactgaatgaactgcacgggatgctcggctttgttaatgacattgacgtgtacaactccagacaaaccaatgataagcctcctggatttagttcaaccgaaagagtctatcgtgagtttctcatctatagcatcttctatgctgcacagatgccagtgatcttatgtgaaggtgatactgataacgtgtacattacccatgctatccgctcgctggctcgtgaatttccagatctagcagaggtacgggctgacgacaagattgtgctgaaggttaggttgtataaataccccaaaagttccacatcccatcttctcgggctgggcgatgggggatcctccgtattgagcaaatttatctcggagtacaagaaggagatttctaggtttaaggccccaggacttgctcaccctgttatcattgtttacgacaacgatgatggagccaggagtatccgcaatacaattaagcagatcacaaagagcactcctaaggtcaccaatccatttgaccacgtgactaagaacatgtacgcagtgcctacaccgataccagaaggcgaggcagccagcaagattgaggacttttttggcgaaatgattaaatccaccgtcgtgaacggaaagatctttaacgacggcaataatatagatgccactcaacattacgggaaacgggtgtttgcccacaaggttgtacgacctaaggcccagatgatcgatttcactggcttcagacaactgcttagcaacattgtggaggtcataaaataccacaaagcagcggtcgtgatgcccccgccctga

SEQ ID NO: 8193 - RNA, 1749 nt, unidentified
  source 1..1749: mol_type = other RNA; note = synthetic construct
atgtctcgcttggcatccctcaaggcagcaacttcactgtccgatgtggctaaactcctggcattcaaaccaaaagcggtgagttatattctgtacaagcaaccggccgccactaaatatagaacctttcagatccctaaacgtaatggaggcgaaagaaccattaaggcccccgatgaagccctgaaattgcttcaaaggagactgtccgagttgctgcaggattgcgtcgacgaaataaacacagtgaagcagcgaaaggatagaacagcccacggttttaagcggaaacgctccatcataaccaatgcacggcagcaccgccatagaaggtgggtgtttaatgtcgatcttgaggatttcttccccagtatcaacttcggtagggtacgaggtttcttcctgaagaaccgtgactttgagctgcacgaagacgtcgcaaccgtgattgcgcagattgcatgccacgagaatgctctcccacagggtagcccctgctcccctgtaatcagcaatctggtggcacacctcctggatatgcgactcgtacggcttgctagcgacgccggctgtacatattctcggtacgccgacgaccttacctttagtacaaacaagagggagttccccgcaaacatagctgttagctctgggaatgagggagatgcctctcacttgtggttaccaggggaagcgctgcgaaaggtgataaagagaacgggattcaggatcaacgctaagaaaactcatcaaatgtacagggctagtcgccagaacgttactggactggtcgttaataagaagatcaatgtgcggtgggaataccggcataacgtaagggctatggtgcactcactcgtccgcaccggggcgtttcagatacttggggtaacgtctaaggatggccacgctgtgctggagaagaggcctggcgatttaaacgagctgcacggcatgctgggattcatttatagcatcgacgtgtacaacaagacacatccgtcggacgcctttgccgagggtatgtcagccagcgaaaaagtgtaccgcgagtttctcatttactcaaccttttacgccgctgaggcccctattgttatctgtgaaggcgagactgacaatgtctatctgacacatgcaatcaggtcacttgctgccgaattcccaagcctggccgaagtgagatccgatggaaaaatccacttgcgcgtccggttatataaatatccccattccagcaccgcccgattactcgggctgaatgacgggggatccggggttctaagtaaattcatcgctgcctacaaaaaagagacaaagcattttacggcacctgggttgaccgatgccgtcgtgatcctatatgataatgatgcgggagcaaaaggcattagacaggccattaaaaacgtctctggcgtgaaagcgactggggacgaaccgttcgttcacgtcatcaagaatctgtacgccgtttcaacccctgtggaggctcccgctactcagagtaagattgaggacttcttcgacgctacaatcaaggctactgtcatagacggcaagatgtttaacgagggcgacggctttaacgccgatcagcattacggaaagaaggtgttcgcccagcaagttgtgcggagcaaggctgacattatcgacttcacgggctttcgtgccctcctaacaaatctcaccgaggcaattaactcgcacaaagcctctgtggtgccacaaccacccgaaccttga

SEQ ID NO: 8194 - RNA, 1731 nt, unidentified
  source 1..1731: mol_type = other RNA; note = synthetic construct
atgtctagactggccgccttaaaggcctcaacaagtctgtcggatttggccaggctgctggattttaagccacaagcgctggcctacatcctgtacaagcagccggaagctaaaaagtacactaccttccaaatccccaagagaaatggtgggcagcggaccatcaaagctcctgtcgacgcactgaaacttgctcagcggagactgtctcatctactgcaggactgcctcgaagagatcaatactaatcaaaaccgcaaggataggactgcccatggtttcaagcggaaacgcagcattatcaccaatgcccgtcagcatagacaccgacgctacgttttcaatttagatctcgaggacttctttcctagtattaatttcggtcgcgtgcgggggtttcttattaaaaatcgcgatttcgctctgcatgaacacgtagccaccgtgattgcccagatcgcgtgtcatgaaaatagcttaccacagggatccccctgttcaccagtcatcagtaatctggtggcacacttgttggacatgagacttgtctcccttgcctctgcggcaggctgcacttattcccggtatgctgatgatctgacgttctctacaaataagaaggagtttccgacagagatcgccgtcccgttgggaacagagggaggtgaatcccacctgtgggggcctggagacgagttacagaaagttattgaacggatgggcttcagaataagtgcagctaaaacccatttgatgtatagaacaagccggcaagacgtcaccggcctcgtcgtaaacgaaaaaatcaacgttcgatgggaataccgccataacgtgagggcaatggtgcacaggctgataacaactggggcttttgagatctatggggtgacccaacgagatggcaaggctgcattagagaaacgtcagggaccactgaacgagctccatggcatgctggggtttattgactccatcgagaattacaacaagaagaacacacacgattcgcccagcgacaggcctagcagcatggagctagtgtacaggcagttcctgatatacaggaacttttatgctgccgaatctccagttgtaatctgcgagggtgacacagataacatatatctgacccacgcaatccggaacctggcagcagagtttctcgaccttgccgaggtgaaagaggggaagattaggctcaaggttcgactctttaagtaccctcattcatctacagcgcgcatccttgatcttggcgacgggggcagtggggtactctcagactttattggcacgtataagcgggagattggccacttcactgccccctccagccagagccctgtggtaattatttatgacaatgactcaggagcgcgtggcatccgatcagccattagaagtgtgtccaaagttcagccaaccggcaccgaaccctacgtccacgttgtgaaaaacctatacgccctcgcaacgcccttggtgggaacgaccactgaatctaagatagaagactttttcgacgatgctattaaagccaccgtgattgatggaaagaccttcaacgataagaacaaaatagacgccgctaagcactattccaaaactgtgttcgcccacagggtcgtgcgccccaatgctgatacaatcaactttagcggcttcagacctctcctgactaacctggtggcagtgatcaatgcacacaaggcctccatcgctgtctga

SEQ ID NO: 8195 - RNA, 1773 nt, unidentified
  source 1..1773: mol_type = other RNA; note = synthetic construct
atgagtcggttggctggcctgaaggctgccactagcatatccgaccttgctaccttattgggctttaagccaaaagccatttcttacctattgtacaaacaacccagcgagtataaatacacaacattccaaattcccaagagatcaggtggacagagaaccattcaggcacccgttgagcggctgaagctgctgcaacggagattgagtgatcttctccaagattgccacgacgagattaatgcctcggctaaaaggaaagaccagatcgcacatggattcaagcgggatcgctctattatcaccaacgccaaacaccatcggaacagaaggtgggtgtttaacatcgatctggaggacttcttcccaagtattaatttcgggagagtgcggggctactttcttcgcaacagggacttcatgctccaggaacgagtagcaacagtgatcgcccagatctcttgtcatgagaatagtttaccacaggggtcaccatgttctcctataatctccaacttagtgacgcacgtcctcgatatgcggttagtcaaactcgcctccgagtgcggctgcacttactcaagatacgctgatgatctgactttctccacgaataagaaagacttcccctttcaaatcgcaggaccctccgctataagcgcggaccgggctcatttgtggctccctggtgagccgctgaaacaggttatcgagcgtacaggcttccgtgttaacagcaagaagacaagaatgatgtacagagactcacgccagaatgtcaccgggctggtagtcaacaagaagattaatgttgcaagggaatataggcataacattcgagccatggtgcaccgcctggtcactacggggcagttcgaaattctcggccctgttacccgcgacaagaaggtggtgctcgagaaacgacccgggacactgaacgaactccacggcatgttgggcttcgtcgattcggttgaatgttttaatcactctaggaccgacgaatattcagcatctttgaaagccacatatcgccgattccttttttacagcaccttctatgctgcctccgcccctgtgcttatctgcgagggcgaaaccgacaatgtgtatctgacacatgcaatcgtaagcctggcgtcagagtttcctgagcttgcggagctggcaggagccggtaagactaggctcaagatcagaatatataagtacccaaggaccagcactgcccgcatcctgggtctgaaagatggcggttccgccgtcctctgcaactttatcaaggattaccccaaggaagtagccaggttcagtggcccaggcctagctcagccggtgatcgtaatctacgacaatgatgaggggtgtaaaggaatacgttccgtgattgctaatattagcaaagtgaagccaactggaactgagcctttcacgtatgtgtacaaaaacctgtacgccgtccctaccccgctacaggaaggagtcacatccagtaagatcgaagacctgttcgaagcacgcatcaaggagacaatcattgagggaaagacctttaacgaaggaaattctctggaccctcataaacattatgggaaaaaggtgttcgcgcacaaggtgatacggcccaacgccgataaggtggattttaccgggtttagaagcctgctgacttttccccgttttcaccgacacctttataaagaagaatttgacgagattggtgggcagcacgagcaccaggaccagaccgctgtttatggcagggtgtga

SEQ ID NO: 8196 - RNA, 1740 nt, unidentified
  source 1..1740: mol_type = other RNA; note = synthetic construct
atgtcaaggcttaacaacctgaaaagtaccgcaacactgagcgatctggctcgccttctgcagtttaaaccctccgggctgtcttacatactctttaaacagccagctgccacaaagtataagacattcgagatcttaaagcgaaaaggcggcacacggactatcaaagccccctctaatcccctaaagctggtgcagcaaaggctgagtatactgttgcaggactgtgtcgacgagattaacaaggccaaaaaccggaaagaccggattgcacatggattcaagcgtaagcggagcataataactaacgccagacaacacagaaataggagatacgtgttcaacatcgatctcgaggacttttttccctcaatcaatttcggccgcgttagggggtatttcatcagggaccgatcattcgcacttaatgaagatgtggcaacagtgattgcccagatcgcttgtcacgagaatgctcttcctcaaggtagcccatgttcgccggtgatcagcaatctgattgcacacgtcctagatatgcatctagtcaggctcgcttccaaggttggatgcacctattcccgctacgcagacgacttgaccttttctaccaataagaaggacttccctgctgatatcgctaagcctagcgaaacggaaccacatttgtggctcccgggagccgaacttcagcggctcattgcccatgcgggctttagaatcaataccgccaagactcatatgaagtaccgcacttcccggcaagaggtgaccgggctagtagtcaaccagaaaataaatgtacggcgtgagtactctcacaacgtcagagcaatggtccacagcctgttgaaggagggctcatttgaattgtatgctgcaaccgagaaggcgggagctgtaacaatcgagaagcgcaggggtactgtgaacgagctgcacgggatgctcggtttcattgacagcattgacctctataataaaaagaatgctcctgagtccaaagattcaggccgtctctcatccaaggaactgatgtaccgacagtttctgatttacaaggacttctacattgccgaagcccctgttatcatctgcgagggaaagacagataacgtgtacttaacccacgcaatcaggagactggtggccgagttccctgatttagccgaaattacaacccagtctaagatccgcctgaaagtcagactgtataaataccagaggtcgagtacggcccgcattttaggcctgcgggacggaggttctagttgcttgactaaattcatcgaaacctataagaaggagacagacaaatttaccgcgcccggccagaaaaacccagtgattatcctgtatgataatgactccggggcgagcaacatacgaagcttgctcaagcaaacgttcaaacttaccgtgggaaccgaacagttcgttcgcgttgttcgaaatatgtatgtcgtgccaaccccactgctcaacggggccaatgaaagtaaaatcgaggattgctttgatgcagcgactaaagcaaccgtcatcggagggaaaactttcaacgataagaacggccttgacacggccaagcattacgggaaaaagatttttgccgaccaggtggtgcgggatagagaagattccataaactttgagggcttcagacaactgctcacaaatctggtggctgtgattcagtcccacactacagctgtatctggtgccagtgccccccagtga

SEQ ID NO: 8197 - RNA, 1737 nt, unidentified
  source 1..1737: mol_type = other RNA; note = synthetic construct
atgcccagactggccagtcttcagagtgccgccactctgtctgaccttgcacgcctactgagattcgaaccctccggactcagctacattttgtatagaaagcccgctgcgaagaagtactcaacttttgagattcctaaacgccatggggggaccaggaccataaccgccccagacgatgacttaaagttggtgcaacagcgactgagcgatctgctgcaggactgtgtggatgagattaatacagccaagaatcggaaggacaagctcgcacacgggtttaagcgtaagagatctatcattaccaacgcgagacagcaccgcaaacgccgttgggtcttcaacctggacctagaagattttttcccttgcataaatttcggacgagtgcgcggcttctttctcagagatcacaattttcagcttcagaaacacgttgccacaactatcgctcaaatagcctgccatgctaacgggctgcctcaaggctccccctgttcacccgtgatctcgaaccttatcgcacacgttatggacatgcacctcgtgaggcttagcagcaaggtggggtgcacctactcccggtatgcagatgatttgacattttcaacgaacaagaaggagtttccccctgaaatagcaaagccaagtgcgacagatccacatctgtggttgccaggacctgatgtccaagctttagtcaaccatgcaggtttccgaattaacaactctaagaccaggatgaattaccggaccagccgccaggacgttactggcctggtagtcaatgagaagattaatgtgaggcatgactatcggcacaacgtaagagccatggtgcatcggctattctccaccggggaattcgaactgtggggcataattgacaagggcggcaccaagacactggagaagaggccaggttcactcgacgaattacacggccgattgggctttatcgattccatagaccagttcaataagaaaatcgcgagcgacgtcaactacacacgttatccggccggtagggagagcatgtacagacagtttctcatctaccgtgacttttacgctgccagtaaaccggtcattctgtgtgagggagagactgacaacgtgtacttgactcacgccattaggtccctcgctgcttcatttccagagctggccgagatcgattccaatggcaaacgccatcttaaagtgcggatctacaagtacgcccggagctctacggcaaggatcctcggcctgaaagacggaggaaccggacacctcaaacacttcatcggtacttattcgagggaaaccgatcgcttcaaagccccaggactgaagcagccggtgattgttctctatgacaatgataacggcgctaatcccattcgaagtgccatccgggaagtgtctaagaaggccgtgaaagccacagacgcatatactcatgttgtgcggaatctgtatgcggtgcctacccccctgctgaacaatgctaaagagtctaagattgaggatttctttgacgctgcaatcaaagcaacagttattggggggaaaacgttcgtcgcagccaatgattatgattccacaaaacactacggtaagaaaatcttcgcccaccaggtagtgaggcctaaagctgatactatcaacttcaaaggctttgggcctttactgacgaacatcgctagaatcgtaaaagaccatgctgccgtcgtcggagcaacagctccctga

SEQ ID NO: 8198 - RNA, 1902 nt, unidentified
  source 1..1902: mol_type = other RNA; note = synthetic construct
atgactaaactggagcagctaagacgtgccaccacgctgagggaccttgcagagctgctgggtgtgactgctccgggtctagcgtacatcctgtaccacaagcctagggaccagctttacagagcattcgaaatacctaagcggaaaggaggaactcgcagcatttccgccccagcggacgagttgaagactattcaaaaaaagctgtcctctctgttgcaggaatgctgggccgaaataggggatggcaaaaacagtggaaggcacccaggccgcaagggtagggttgctcacggctttctgcccggccgctctatctctaccaatgcacgccaacaccgtcggaagagattcgtctttaatgttgatctagaggacttttttgggagcatcaactttgggcgggtctttggccttctccgccaggacaataattttaaactccagcctcgagtcgcagctgtgatagcaacaattgcctgctttgaaaataaattaccacaaggttccccctgttcgccaatcatctccaatctagtagcaagaatcttagacgcaaggattgccggcttggccgccaaggtaggcgtgaactatagtcgatacgctgacgacttgagtttttcctgcaatggaaggatattccccccggagatagcgaaaaagattgaaggagatgaccactcatgggtggtcggaaaggctcttaactctgtgatcgaaaaaaccgggtatcgggtgaacttgagcaagacccggatgcagtatgaggacagccgccaagaagtcacaggcctggtggttaacagacgggtgaacgttaggtcagagtaccgtcgggctgtcagggctatgggccatagactctttagcacgggagccttcgacgttcccaaggtcgccctgactaagggcaatgacttcccaatgcagtccgtgcagggcaccatcccccaattgcacggtatgatgagctttgtagcgtcaattgatcgtctgcatcgcgaggcagccctcagtagaggagatgcgatcgaggagacaagcgccgagaaactgtatagaaacttcctgtactatcggttcttctataagaacgacgcccctatcattctttgtgaaggcatcacagacaatatctatctgcgctgtgccattcgagcccttagagagagttatcccctcctcgttaagcccaaagcagagcctggggatctcctgattaaattctacaagtaccgaggggctgcagtggatactgtgttaaaactgaaggatgggggcgccgggaacttacagaacttcatggtagcttacaaaaaagcctgtcagttgttcctgggggctggcaaggagaaccctgtcatccttatcgtcgataacgatgagggtgggcggaaggtcatgggagctgcgaaggaactgtcgggcaaggcttacgatggctcccaggcttatctgcatgtgtttggaaacctctatctcattgccacccatccaacagccgtggtggatggtggtcagaaaaagatggctcagaagggcgccagaccctctgactcttgcattgaggaatacttctcttctgaggtgcgctccaccaaactgaatggaaagaccctgacgctgaagaacgattcctccggagtggctcattacggcaaaatggacttcgccaaacacattgttgagaatctcaggggtgcagactcatttagtggattcgccaggttactcgatcgaatcaatctggtggtaaccgcccacgctagcagctcaacagaagccgctgtgtcaggcgcagcggcatcacagctcagcaatggggggcttggggccgcaatacctccaacaggagaaaccattgccgggttcactgagatcgccgaagcagctgattga

SEQ ID NO: 8199 - RNA, 1782 nt, unidentified
  source 1..1782: mol_type = other RNA; note = synthetic construct
atgacacagctcgcggcactgaaaaaagcttccagtttgaatgacgtggctgacctgctgggatataaacctgccgctcttgcttatatcctgtatcaaatcagcgacgaaaataagtacacctcattttcaatccccaaacgttccggtggagtgcgcgaaatcaaggcaccaatcgataaggtgaaggccctgcaaaaaaagctcgccaacgtgctggaccattgcctcgacgagctgaacgcggttcatcagtatcgctaccagtcttcccatgctttccgcaagaataagtctatttttaccaacgcctcgaatcacagagccaagcgatgggtctttaacatagacctggaaaacttcttcactgctattaacttcgggagagtgagaggctactttattcgggatcgacagttcgagttggcgccatctatcgccaccatcctggcccagattgcttgttcagggaacagtcttccccaaggctcaccttgctcgcccgtgatttccaatcttatcggacacatactggatgtacatcttgcaaagctggcagcccgcgtagggtgtaggtacaccagatacgcagacgatatcacgtttagcaccaatgaccctcagttccccagcgctatcgccatatgtgatgtggaggatagtcgggtttggcacattggtaacgagttgcagtgcttaatcgaaagtagcggttttgccgtgaacatcaaaaaaacccggatgcagtttaaagatagccgacaagacgtgaccggcctcattgtaaataggaagattaacgtcaagaaggaatatagacggacggtccgagcaatggtcaaccggcttctgactgttggccactttgagaggaaaaggagagtaaagaacaatgcaggcgaatgggtgctggcggatgtcgctggaacagccgaagagctgcacggcatgctaggtttcatcgagtccgttgacaagtacaacagttctctgcctttaaaaaaaggcgggaaaaggaaggaaggtgaaaaaaccggtgtcgatgagaagcggttaacggcttccacaggaaaggataatttgtacaggcgttttctcttgtacaaagagttcttcgcagccccctgccccgtgatcctctgtgaaggcgaaacagataatgtgtatctgatccacgccatacgctctagggccgcagacttcccgatgcttgccaaggtgagcgagacaaacgaaatcactatcactccccgcttatacaagtacgttaaaacaaattccgggagaatgctcgggttagggtccggaggcaccggagatctgggcaaactaataaagaattatctgagcgagctccaccggttcgttaggcctaagcagcagcatcctttcataattctgatagacaacgacgcaggggctattggcggaggaaggccactcgaggtgctgcgtaaaaaaggcgtggatattgaccggaccgcgccttacattttcgtgatggggaatctgtatttggtgccaactccgctacttggaaaggaggagagcatgattgaggatctctttggccagaatgtactagacgagtctctggacgggaaaactttttgccgcaagaacaaggcagataatggcagacacttcggaaaaactgtctttgcccataagatcgttcgaccaaatgctgaccatatcgatttttcaggtttcgacccactcttgattaacatcacagccgtcattgaggacttctataagaagcacccgagagtcgcctga

SEQ ID NO: 8200 - RNA, 1821 nt, unidentified
  source 1..1821: mol_type = other RNA; note = synthetic construct
atgacgcagctggcagctctaaaagcatccacttctcttattgatattgctcacctcttgggctacaaaccatcagcactggcttatatcctgtacaagatcgatgacgaagtcaaatacgcgaattttgaaatccctaagcggtccggtggaaagcgcttagtgtccgcccccattccagagctgaaagccctgcaaaggaaactcgcagaattgttggaaaattgcagcatagagcttaccgaggctggaaagcacgatgataagtccagccatgggttcaagaaggggaagagcattttttcgaacgccaaggggcaccggaacaaaagatgggtgttcaatatagacctggagaacttctttggaacgatcaattttggacgggtccgtggctatttcattaaggatcggaacttccagctttctcccacagtggctacgattatagcacagatagcgtgccacaaaaattgtctcccacaaggggcgccatcttctcccgccatcagtaacttgatcgggcatatcctcgatatccatctgagtaaacttgcagcaaagttcggctgtcactacagtcgatatgctgacgacctgactttctcaaccaataaaccttcatttccccatcagatagctagccctgactctattgatcctcaagcctggacaccaggttccgaactgagcaggctgatagataactcccggttcagtatcaactcgctgaaaaccaggatgcagtatcgagattcaagacaggacgtgactggtctggtcgttaataagaagcttaacgttaaagccgagtacaggcgtttagtcagagcaatggttaatcgcctgttaaccttgggacacttcgagagagagaagcgcctgtccgacgaaaaagggaatctggtgttgaccaaggtgccaggcaaaacagatgagctgcatggcatgttaggtttcattgacagcgtggaccgctataacctcaacctatcaattccggccggcgggaaagtgcatgacgagaagaagaaagccgccgctgacgagaagaataccagacctggcctgacaggcaaggaccacctctataggcgattccttatctacaaggaattctttgccccctccaggcctgtaatcctgtgcgaaggcgatacagacaacatttacctcatccatgctattaggtcactgtctgccaagtatcctttgctcgccaaactgcagaatgagaaactagagatcctacccagaatctacaagtacgttgatacctccactggccggattctcggcctaaattctggcgggactggcgatctcggaaagctgattagaagctatcttgcagagatcaaccgatttatccgcccagccaatcagcacccgttcatcctcctggtcgataacgacaagggagcaataggtgggggacgtccccccgacgtggtcaaaaaagtggtgggaaaggagatggaccgcagtgccccattcttgtacgtagccgggaacttatacctggtgcctacacctctcctggacggaaaattggaaagcatgatcgaggacttttttgacgataagacccgctctagagacatcgatggtaaagtttttaaccccgcgaataaagccgataacagtaagtactttggcaagaaagtcttcgcccacaaagtgatccggcccaacgcggaagacattgacttttcaaggttcagctcccttctggataatattactctggctctcgaagatttttataagaagcatccgcacagcgctacagtagacaaaccagcaaagaaggctgcctga

SEQ ID NO: 8201 - RNA, 1818 nt, unidentified
  source 1..1818: mol_type = other RNA; note = synthetic construct
atgacacagctcgcggccctgaaagcagcgagctccctccacgggattgcccacttactcggatttaagccagctgccctagcctacattttgtacaagcttaatgattcacagcgatacaagcagtttgaaatccctaaacggtcgggaggcaagagaacaataaaagctccgaccgcagagctcaagcttcttcagcggaaaatggcatctctgctcgagaactgtatttcagaaatcaacgtggccaataagagggccgacctgttcgctcatggattcaaaaaaggtcggtcgattttctccaatgcgaggccccataggaacaggcagtgggtgttcaatattgacctggagaatttcttcggcagtattaactttgggcgtgttagggggtttttcctgaaggacagagacttcgccttgcaccagggagccgccacgattatagcccaggtggcctgtgtggacaacgcactacctcaaggtagcccctgcagccccataataagtaatttgatcggccaccttctcgatgtgcacctcgccaaacttgccgcgagctgtggctgccactatagtcggtatgcagacgatctgaccttttccacaaatgccccgcaatttccatcccgcatcgctacacgaactcgcggtgccgccggtgatgaatggatgccgggcgcagagctgcaccgaattatccagcacgcccgctttgccatcaatccacaaaaaactcggatgcagttcaaggactccagacaggatgtgaccggcctagtggtgaataaaaaactcaacgtgaagacagaatacagacggtctgttagagcgatggtacaccgcctgcttacccatggacacttcgagagaactaagcgggttgatgatggtgcgggaaatcacgtgctggacgctgtcaagggcaccaccgctgaattacatggcatgctggggttcatcgacagcgtcgagcactataacaggaacctggttctgcctaagggaggtaagccaaaagtcgagaaaaaaaaaaaggggactgagcccaacaaaccccgcgtcgctttgactgggaaggaggtactgtatagacggtttctgctgtacaaagagtttttcgctacatcaaatcccgtactgatctgcgaaggcgaaactgacaatatctacctggtgcatgcaattagatccttggcaacacactttcctcttctggctaccgtggtcaagcccggcgaaatcaagattataccccgcatctttaagtatgttgaaaccagcactggccgtatcctgggtttaggcagcggagggacaggcgacctaggaaacttaattaggcagtatgacaaggagattaagcgcttcgttaggcctgccactcagcatccatttatcctcgtcgtggataatgatgcaggagctgtgggcgcagggcgacctttacaggcatctaaacaagtaacggggttggacgttaaccgtcatgctcccttcaccaacgtgtgcggaaacctgtatctcgtgccaaccccatttctggctggcgccgcccagtctatgatcgaagattttttcacgaaggaaaccttggatgagacaatcgatgggaagtctttctgtgctagtaacaaacaagactcagctaagcagtacggcaaaaaggtctttgcccataaggtcgtgaaagtcaaggctgacacaattgactttaaggggttcttcaagctcctggagaacatcacgctggccatagaggatttctacaaaaaacatccttccgcacctatcacctctgctcaagcaatctga

SEQ ID NO: 8202 - RNA, 1713 nt, unidentified
  source 1..1713: mol_type = other RNA; note = synthetic construct
atgagccagctcatcgctctgaagagctgcataaatctgagcgatgtagcggtgctactcggatataaaccttctacactgagttacctcctatacaaaatcggcgaggaaagcaaatacagctctttcgagatccccaagaagggcggggggactagacgcattgaagccccccaaaaagaactgaagctgttgcagaggaaagtggcagatttacttcagaactgcttcgagtccgctgacttgacatccccaaagtataagagcaatcccgtctcctatggattcatcagaggcctcagcataattgacaatgctcaaaatcacagatcacaacgattcgtattcaacatagacattcaagacttctttgggtctattaatttcggcagggtgaggggttttttcataaaagatcgcgacttttcacttcagccccaggttgccaccgtcatcgcacagattgcctgttttaagaacagattgccccaaggttcaccatgttccccggtgatatccaacctggtgggacacatcctagatatgcaccttattaaactggccgcgagaacaggctgccggtatagtagatatgcagacgacctcactttcagtacatcaaagcgggactttccacggcaggtcgccttctacgacgaagagaaggggctttggcacgtaggcgacgagttaaaacgcctgctggagctgtcaggcttcacacttaacagcggcaaaactcgaatgcagaaccgggactctcgccaacaggtgactgggctggttgtgaataaacgagtgaacgtcagtaaagagtacaggaagaccacgagagcaatggttcaccgcttgtttaccaaggggagtttcttttttaccgacgaatccaatttagaagtgaaggctcagaaggaaagttccgatatcggacggctccatggaatgctgggacacatttaccacgttgacaccaaatgtaagacaaagatcgagtcttccaccaatcctcctcagaaaaacgcgagcacctatcggaggtttttgatttataaggaactgtacgcaacgaacaaaccaattatcatctgtgagggtaaaaccgatccagtctacctggtccatgctatccgaagcctgcatagggacttcccgatgctcgcttacagggatgccgagaaccagattcggctgtctgtgcgcctgctgaagtacgctgataaatcgatggcatcgatacttggtcttaacggcggggtaggagatttgcggacttttatagattcgtataggtctgacatcaagcgtttcaatgcccctgggaagtttcatcctgtgatcatcttaatcgataacgacgacggcgccaagcctatcctgtccattgtcaagtcaattaatcccaattccacgtttgatcgcgatagcttttcacatatcgtcggcaatctctacgtggttaaaactccattgctgggtagcgaaaagtcttgcatcgaggactttttcgatggcgatctgaaatcaacaatgatcgatggaaagcagttttctctcgagaaagacgccaacccggaacactatttcgggaaggttgtgttcgcccataaggtggtgcgtccccaggccgacaagatcgatttctccaactttagacacattctcaagtctatgcaggacattattaccgagttcagtagtcagaaacgtatttga

SEQ ID NO: 8203 - RNA, 1758 nt, unidentified
  source 1..1758: mol_type = other RNA; note = synthetic construct
atgtcccagctggctttgctcacttccgccacagaactacaccaggtcgcaagtctgttgaatttcaaggccagcgcactgtcttatgtcttatataaactgcccgccgcccagaaatacacgaccttccagataccaaaaagaagtggaggaatgcgcacaatccaggcgccttgtcctcagttaaagatcctccagcataacctttccaatacactacaaaactgcctggaggagattaatgccagagaaaaacgtaagaacagctttagcaacgggtttacccgaaacagatctatcgtggacaatgccgctccacaccgcaccaaacggttcgtttttaatatcgaccttcgcaacttctttgggacaattaatttcggacgagtgcgtggtttccttatcaaagacaggaattttcggcttgagccaaagatcgcaacaatcctcgctcagattgcatgccacaacaacgaactgccccagggctcaccgtgtagtcccgtaatttccaatttaatcggtcacgtgctcgatgtgcacctggttgggcttgcaaggaggtccggctgtacctactccagatacgccgacgatatcacattctctaccaacaagccagaatttccggcagatatcgccactcggactgaaccctcccatcagtgggagataggggaggagctcaaaaggctgattaagttgagtggattcgatgtcaatagcgagaagacccggatgcaatattgtgactccaggcaagaagtcactggcctccttgtcaacaaaaaggtgaacgttagacccgagtacagacgcaccgtgcgcgccatggtgcatcgtctgttcaccactggtgagtttcacattcctgaagtggtcgacgatgggacaggcaaggcgagcatcacgatgactcccggcgaaatgtctaagctgcatggcatgctgggcttcgtagaccagatcgatctgtataacaagaagaaccggccttcaggctcaaataacgataatttgtcgagcaaggagtctatttttcgagacttcctcttctaccgagagttctactcatgcgataaaccggtactgctgtgcgaggggaagactgataatgtttacctcaaacacgcaatacatgcattggctgctcattttcctagcctggcgagcgtgaacgccaaaggagaggttacacgcaatatacggatctttaagtataccgactccagtacaggtagaattctggggatcaacggagggacagcccccctgtcaggctttatgaggacctacgcggacgcaacttctcggtttaaggccccaggcgaaaataatcccctaatcctggtgctcgacaatgacagcggcgtgaaaggaaaaggtaagatttttaatgctgtgaagcagatttgcaaagtggaaatgaccggtgctgagaagttcgtacatgttgccgggaacatgtatgtgactctgacgccattacttccaggcggagctgactctatgatggaagacctgtttgatttgaacaccaaggccacgataattgacgggaagagtttcaatcctaataacaacctcgattcagcctcacactatggaaagcacgtgttcgcccaaaaaattatcgccgcaaaccctcagtctgtcgactttggaggcttcacacaattgctggataatatctcggctgtgattgatgctcacaaaatcaaagtcagcgagaggcagaccgcgaacgctataaactga

SEQ ID NO: 8204 - RNA, 1752 nt, unidentified
  source 1..1752: mol_type = other RNA; note = synthetic construct
atgccgaatttggcgaacctcaaagcagcagcctccaggcaagacctggccgaattattgggggtcaaggcaggaatgctgagctatgctatttacaaaatccctgaggcgaaccggtactcgagatttgagatcccgaaacgccatggggggatcagagagatccttgccccaactcccgagcttaaattaattcagcgccgtctttcagttctgctccaggactgtgccgcggaaattaacagcgcacacggccatgcggaagatggcactcggttcggcatagctcacggttttaaaaggcatcacaacattatgaccaatgggagggttcatgtcacacgaaggttcgtgtttaacgtggacctacacgattttttcggaaccatcaatttcggtagagtgcgcggcttcttcctgaaggataaaaatttcgccctgcacgcagatgtagctaccgtgatcgctcagatcgcctgcttcgataacaaactgccacagggttctccttgctctcccgtggtgtccaatcttttagcccacagcctcgatattcagctggtgaggctggccgccaagaacggagtcagttatacgcgatatgcagatgatctgacttttagtactaataagccaagcttccccgcagagatcgcggctcctggtgatacgcattcctggaaacccggagccgacctcgagaggatagtggccaattccgggttttccttcaatccctcaaaaactaggctgcaatatcgtgattcacgccaggaggtcaccggcctgaccgtcaacagaaaggtgaatgtgcctgctacttatcggtacacagtgcgggccatggttgattgtctgtttagaacaggcaagttccagttcatatacaagaagaaggatgagcagggaaaggttgttctcgagctctcacatgctggacggaacgagcagctccacggtatgctgagttatattgaccaagtggacctgtttaaccagaaggtctgtaaggaaaacggacgggagcctgaatctaccaccggacgcgtggagctttttcgtcggtttctgtacttcgacacattctatgccgctcccgagcccattgttgtatgcgaaggaaagacagacaatgtctacctgaagtgtgccatcaaaagtctcgtggctaaataccccaaattggtggccgcagggagccctccaaagctgaaactcaggttctttaagtacgcagagacacgcacgggccaagtgaccgatttgaccgggggcgtaggcgggatctgcaaactcttgaagtcttacgacgaagatgttaaagaagtctttaaggcaccagtcagtaagttccctgttatcgtgctgattgacaacgacagcggagcacatgggatataccaggtgatagctggcatcaataaaaagccaaagccacagggcctggccgatttcattcacgtaactagcaacttgtatgtcgtgcccacaccgtttggcccttccaaatctcacacagccatcgaagactttttcgacaaaccaacccttgaaacaaagttaaatgggaaaacgttcagcagagagtccaagctggacgaaacctcagagtatggcaaggctgcgtttgctcgagacgtggtggctaagaacgccggtactattgatttttctggctttcaagccattctagacagagtcatcaaggtactagacgactacgaaatccgattcaagaatgccaaaaaatga

SEQ ID NO: 8205 - RNA, 1857 nt, unidentified
  source 1..1857: mol_type = other RNA; note = synthetic construct
atggcatgcgagatcaaggtacctggatttgcccccagaatatcttccgctctctccgaactgcgccgtttgcggaagagtatccgggagcccttgcctctcagacacatgtcttccttgcagaagctcaaggctgcggccgctagaagagatctagcgatcattttagacgtgtcacccaggaacctcgcctacattctctataagacagcccctgacacgaagtacacccggtttactatccccaagaggcacgggggcgagcgtgagatactcgctccaagcttaggacttaagctagttcagcaaaagcttgcatcagtactgcaggattgttctgatgagattgcccttagccatgtcaagcccgggaacggaaggcggcatggcattgcgcacggcttcaaacgccatcacacaataatgactaatggacgcgtacacgtgacaagacgttttgtgttcaacgcggacctccacgatttctttggcacaatcaatttcggtcgtgttcggggctttttcattaaagataggaatttcgccctgcatccggatgtcgccacggtgatagcccagatcgcctgcttcgaaaataaactgcctcagggatctccctgcagccccgtgattagtaatcttctcgcccacccaatggatattctattatcctcactcgccgctaagcacagcgcttcatacactagatacgccgacgatcttaccttcagtaccaataaccccacatttccaccggaaatcgccgcgctcaacggtgaccacacgtgggttccaggggccgagcttgaccgattggtgagccgctctggcttcgcatttaatccgagtaagaccagactgcagtacagagactcccggcaggaagtgaccgggctgactgtgaaccaaaaagtcaatgtcccagccacctacaggtatactgtacgcgctatggcccactcgctgtttacaacaggcgccttcgagtttgtgtacaaaaagagggatacaaacggtaccatcatcctggaaaatcggaaagctggcgaaaacaagcagctgctgggtatgctgagctatattgaccatgtggaccgattcaatcataagctggcaatcgagaacggacgagaatttgagtctaccgctgggagagtggccctgtttaggcgatttctgtacttcgatctgttctatggactaagagagcccattatcgtgtgtgaaggtaaaaccgacaatgtttacctgcggtgcgcaatgaaggctctgagcgccacttatccttcattggtcgaggcaggggcaccccctaagctgaaggtccgcttttacaaatatgcagaaacccgcactggggaaattacagagttgacaggcggagtcggtggcatctgtaaactcttgaaacattaccatacggatgtgcaacattgtttcaaagctcctgcaccgaggttcccagtgatcgttcttattgataacgataaaggtgctcacagtgtgtatgaggctatcgccgggatcactaaaaagaaaaagccacaaggcttggcagattttatccacgttacgagcaacctgtatgtcgtgcctacccctcgaggaccaaacaactccgagacagccatagaagatttctttgacgaggcgactctgaaggaagagttaaatgggcgcaaatttgacaggtccaaccataccgacgacaagccagggttttatggcaaaggccacttcgctagggacgtcgttgcaaagaaagctggaaccattaatttcgatggcttcactgcaatcctggaccggataattaaggtgaccgacgactaccaggcaaagctggccaaaccttga

SEQ ID NO: 8206 - RNA, 1746 nt, unidentified
  source 1..1746: mol_type = other RNA; note = synthetic construct
atgcgtatgattaatctgactaacctcaagagcacaacctcccggcgagacttatcaaagttgctggacgtgaaacccggcatgctctccttcgcaatctacaaaaaccccgaggcggtgcggtatcgaagatttgagatcccaaaacggcacggcggcactagagagattttggcccccgccagtgagctgaagctcctgcagcagaggctctcggtgctgttgcaggattgtgttgcggagatcaccgctgcacgcggatttgctgaagacggggctcacttcggtatcgcacacggatttaagagatatcataccatcatgaccaacggcagagtgcatgtcacccgcagatttgtttttaatgtcgaccttcacgatttcttcggcaccatcaacttcgggcgcgtgaggggattttttttgaaagatcggaatttcgcgctccaccccgaagttgccactgcgatcgcacagatcgcttgctttgaaaacaagctgcctcagggctcaccgtgttcaccggtgatttctaacctgctagctcatagcctggacattcaactggccaggctcgcagcaagacatggcgcgtcctataccaggtacgctgatgatctgactttctctaccaataagcctgcattccctgccgaaatcggtgtgcttgacgatgctcataactgcagtcccggagccgagctcgagcgcattgtaacccgatccgggttcagctttaacccagccaagacaaggctgcagtatcgggattctaggcaagaagttacggggctgactgtgaatcggaaagttaatgtgccagcaagctaccggtataccgtcagagccatggtcgataggttatttaaaaccggtgccttcgagttcatttataagaaaaaagacgctcaaggcaatgtggtcctcgagcgccgagtcgcagccaaaaacggacagcttctcggaatgctgtcatacatcgaccaagtagaccggttcaatcagaagatctgcgaaaccaacggacgtgagcctgaaagcacggccgggagggtggaactgtttagacgattcctgtactttgacactttctacgccactcgccagccggttatagtctgtgaaggaaaaacggacaacgtttacttaagatgcgctattaaaagcctagctgccaagtacccaaatctggttacccccggagtgcagcctaagctcaacgtgaggtttttcaaatacacagaaacacgtactggtcaggtgatggatttgactggcggggtgggcgggatctgtaagctgctgaagagttactccgaagatatcgagggtatatttcgcgcccctgcgccaaccttcccagtaatagtgttgattgataatgacaagggtgcccatggagtgtatgaagtgattgccggcattacaaaaaagccaaagccccttgggctagctgactttatccacgtcacaagtaatctttacgtcgtgcctacacctttcggccccaagaaggcccacacagctattgaggactttttcgacgccttcacactggagacagagcttaacggcaagaaattcaacagaaacaataagctggacgactctaaggagtatgggaaggccgcattcgcccgcgatgtagtggctaagaatgcagcaacgatagactttacaaaatttcacgccatattcgatcgggtcatgaaagtattagatgattatgaggctcgtaggaaatga

SEQ ID NO: 8207 - RNA, 1743 nt, unidentified
  source 1..1743: mol_type = other RNA; note = synthetic construct
atgtcgagtttgcaagccctgaaagcagcaagcgcccgcagagatttggccgacctgctcggcgttaaacccgggatgctgacctacgctatatacattaccccggaggctgatcgctatacaaggtctaccatccctaaaaaacatggtggggaccgcgaaatctgcgctcccaataacgaccttaagctaatccagcgacggctgagtacacttctgcaagactgcctggatgagattaatgtggcaagaggccataaagaagatcgcgtgagattcggaattgcgcatgggttcaaacggaatcataccataatgaccaatggcagagcccacattacgaggagatttgtctttaacgccgacctgcacgatttcttcggaactatcaactttgggcgcgtaaggggattcttcttgaaggataaaaatttctccctccagcctgaagtggccacaaccatcgcccaaatcgcctgttttgagaataagttgccacaaggatccccctgttcacctatcattagcaatttcttagctcacccccttgatattcgactcgtgcgactggcagcgaagcacggggtcacttacacgaggtatgccgatgacttgacttttagcaccaataaacccgcttttcccgtcgagatcgcgtctcccatcgacagtcacgggtggattccgggtccagagttagaatgtgttgttaccgagtctggcttttccttcaacccatccaaaacacgcctacagtatcgggatagccgtcaggaagtgaccggcttgacggtaaatcgaaaggttaacgtgcctgccacctaccgttacaccgtaagagcaatggtcaacactttattcaagacaggttcctttgagttcatctatcgcaagcggggggacgacggcaaggtaacaagcgagaaccgagagccgggaaccatgcctcagctgctgggcatgctgtcatacattgatcaggtggacctctttaacgagaagctctgcaaggataatgacagagagcctcagccagtggtgggaaggactgcactgtttcggaggtttctgtacttcgatactttctttagcgctcagaggccaactattgtatgcgaaggtaagacagacaatgtgtatatgaggtgcgcgatcaagtcactggccgctgcgtacccaaggctgatcggtggcgaaaaactactcgtcagattcttcaagtacaccgagtctcggaccgggcgggttatggatctcaccggtggcgtcggaggcatttgtaacctccttaaatcatatcatgaggaccttaagttctatttcaaggcccctatcagtaaattccccgtgatcgtgctgattgacaacgattctggcgctcactcaatatatgaagctgtggccggaataacaaagaagaaaaagcctcagggcgttgcagactttatttatgtgacggggaatgtgtacatagttccaacacccttcggcccaggaaagtccttcactgctatcgaggacttctttgacgcaaaaacgctcgccacagaactgaactccaaaaaattcaaccgcaagaacaagaaggaggacagtgaagacttttactctaaagcagcttttgcccgtgatgtggtggccaaaggggccagcactatagactttggaaactttaaggtcatccttgatagaattgaaaaggtcctggatgactacgcagtccggcgtaagacaatgacttga

SEQ ID NO: 8208 - RNA, 1788 nt, unidentified
  source 1..1788: mol_type = other RNA; note = synthetic construct
atgcgtcgtagtatccgggagtcctttttgctgcccatcaaaatgagctccctcaaagatcttaaagccgcaacggctaggcgagatttggcggcactcctacacgtaaagcccggaatgctcacctacgccatctataagtctcctgaggccaatcgctaccgaaaattcgagattaaaaagcgccacggaggcgaaagggagatcctggcgcccgaaaacggcttaaaactgctccagaggcgcctctctaccctgcttcaggactgcatagccgagattaattctttgcacggccatgtggaagacgaaggacggttcgggatcgcccacggcttcaagagaaaccacacaattatgaccaacgggcgggctcatgtagcacggaggtatgttttcaacgtggacctgcacgattttttcgggacaatcaactttggcagagttcgcggcttttttctgaaagaccgaaatttcgcactgcatcctgaggtggccaccgtgatcgctcagattgcctgttttgagaacaaactaccgcaaggcagcccctgttctcccgtgatatctaatctgattgcccatagcctggatattcaccttgttcgcttagcagcaaagcatggtgccacgtatactcgatacgctgatgacctcacattcagtacaaatagacctgagttccccccagagatcgcgaccctgaaggacactcactcatggatcccaggcgtggatttggaacggatagtcacccgaaatggcttctcatttaacccttccaagacacggctgcagtacagagacagcagacaagaagttaccggtttgaccgtgaaccgcaaagtgaacgtacctgcaacatataggtatacagtgcgggccatggtcgacaagctcttcaagactggccagtttgaatttgtccacaaaaagagggatgctcagggtaatgtggtgtttgaaaataggtgcgtgggggagaacaaacagctacttggtatgctgtcgtatattgaccaggtcgatcgcttcaatcataagttatgtaccgacaatggaagggagccagcttccacggaaggacgcatcgcactctttcggagattcttatacttcgatacattctacgcagccagagaaccgataatagtctgtgaaggaaagacggacaatgtgtacctgcggtgcgctatcaagtccctggccacagaatacccaaggttgatcgataagggaacccctccaaagcttgaggtaagattctttaagcatgccgaaactagaacaggccacattgccgacctcactgggggtgtggggggtatctgcaaactgctgaaaaactaccatgaggatgtcaccgagtggttcaaggccccggtatccaagttcccagtcatcgttctgatcgataacgataatggcgcccactcaatatacgaggctattgccggcattactaaaaagcccaaacctgaagggagggctgacttcatccacgtcacctcaaatctgtatgtggttccaaccccctttgggcctaagaagaaacagactgctattgaggattttttcgacgagcataccctggcgactcaactgaacggaaaaacttttaaccgcagtaacaagagcgacgacagtgacaagttttacggaaaaggggcattcgcgcgtgacgtggtcgccaaacaggctaatacaattgacttcactaagtttcgtgctattcttgatagagttatgaaagtgctcgatcactatgaggagagccaaaagaagtga

SEQ ID NO: 8209 - RNA, 1749 nt, unidentified
  source 1..1749: mol_type = other RNA; note = synthetic construct
atgccgtctctcaagcagctacaagccacaacatcattgcgggagttagcaccgctgctcgacataaaacctggcatgctgtcgtacctcctttacaagaagcctaaactggatctctataagaagttcaccattcccaaacgtcatggcggagtgcgtgaaatcaatgcaccagaaggggatttaaaattgctccagtaccggctgtccctccttctgcagaaatgtatcgtcgaaatcaatgcggagcacggacacgctgaagatgacgagcatttgggtattgctcacggtttcaagcgttaccacagtataatgacaaatgggcgggctcacgtcactagacggtacgtctttaacgtggacttgcacgatttctttggctccatgaattttggacgcgtccgggcgttcttcttgaaaaacaacaacttcaagctgcacgccaatgtggcaacagttatcgctcagatagcctgtcatgagaacaagctgccacagggatctccatgctcccctgtgatttcaaatctaattggccatacaatggacattcccctggctaggttagccagagacgagggcgccacctataccaggtacgccgatgatctgaccttcagcacaaacaatccttctttttcacataagatcgcagttcagggctgtgatcaaaaatggctgcccggggaaagtctgcagagaattgtaaccaagtccggattctcctttaacgcgcaaaagacccgaatgcagtacagagactctcggcaagaggtgaccgggctgactgtgaatcgcaaagtcaatgttcccgctacttaccgctataaggtaaggagcatggttgacaaactctttaaaactggggagtttgaattcatctacaagaaactggacactttgggtaaagaggtggccttcaattatcagggcaaaaggaagcagctgttagggatgctgagctacatcgaccaggtagatcgatttaacagtaaactttgcgagaagaatggcctcgaacctcaccccacaactggacgcacaactctgttcagacggttcctttattttgatgcttttttcgcaccagtcgagcccataatcgtgtgcgaaggaaagacagacaacgtgtacctgcgctgcgcaatcaaaaatcttgccgccgcctacccgaagctggttgtcgctggtacaaagcccttgcttaaagtgaggtttctaaaatatgcggagagacgaacgtcacaaataacggaactcactggtggggttggcggggtctgtaacctgctgaaacattatcatgatgacgtgagaaccaagttcaaggcaccagctcctaagcaccctgtgatcgtgttcattgacaatgatagcggcgccgactctatttacggagcaattgcagggatcacgaaacagcccaaacccgccggccgagcaagctttatccacgtaatcgctaatctctatgtagttccaactccacttggaccaaagaacaagaagaccgctatcgaggacttctttgacaagacgaccctcgcaaccaaactgagcgataagaccttcagtagggataacaagatggagaacctgaaacattatggcaaggcggccttcgccatcaacgtgattgccaagaacgccaataccgtgaactttaataaatttgcccctctcctggatcgcatggtggccgtcattgacgactatgctaagaggctaaaggtgcctttaaactga

SEQ ID NO: 8210 - RNA, 1743 nt, unidentified
  source 1..1743: mol_type = other RNA; note = synthetic construct
atgtctaatttgaaacagctccaggatgcaacatctctcagacagctggcgaagctcttgaacatccagttcggaatgctgtcctacctcctgttcaagaaacccaaatccaagctctacaagaagtttgacatccctaagcgtcacggaggaatgcgggagattcacgcacccgagagggacttaaagctgttacagtatcgcctgagcgtgctgctgcagaagtgtgctgatgaaatcaaggcgagccatggtcatgtagaagacgaaaaacattgggggatcgcccacgggttcaaaagacaccacagtattatgaccaatggtcgggcccacaccgcacggagatttgtgtttaacgtcgacctccatgacttcttcggctcccttaatttcgggcgcgtgcgggggttcttcatcaaggacaagaacttcaagcttcacgagagcgtcgctactggcatcgcacagattgcttgttacgagaacaaactgccacaaggctcaccctgctcgccagtgatgagtaacttgatcggccacactatggatataccgcttgcgcaactggcagcctcagagggagtcacctacactagatatgctgatgatcttaccttttctacgaacaattcttcctttcctgaaaagatcgcctacaaaagcggcaatcatacatgggagctgggaagacagctgctgcgtatcgtgcaaaggtccggcttctccttcaacgataagaagacacgaatgcagttacaagacagtcgacaggaggttacaggtctgaccgtcaataggaaagtaaatgtaacagctacctataggtatacagtgcgaagtatggcaaacgccctatttaataccgggaacttcgagtttatctacaaaaaactcgacgactctggagtggagcaggtgtatcgctccaagggaaagcccaagcagctaattgggatgctgagctatattgatcaagtcgatcaatttaacaggaaattgtgggtggagaatggcctagagcctgaccccacactcggtcggataaagctgtttcgcagagttttatacttcgacaagttctacgcactaaaccagcccttgattgtgtgtgaaggtgtcaccgacaacgtatacctgcggtgcgcgataaagagtctggcagctttgtatcctaaaattgtggctgcgggcgcccccccaaaacctatggtgggatttctcaagtatgccgatagacgcacttcagagattacacagctgactggcggagttggtggcatttgcaagctgctgaaaaactatcatgaagatctcggtacccgtttcagggcacctgcccccaaacatccagtcatcgtcctgatagacaatgatggcggcgccgacagcgtgtatggagctattgccggcatcacgaaaaaaccaaagccgaataagaaagcaagctcaatccacgtgactggcaacctttacgtcgttcctaccccacagcttcctggattatctaaaacagccatcgaggactttttcgacgccccaacccttgccactgtggtgaatgggcgcactttctcaaaggaaaataattacgatgggagcaaacactacgggaaggccacgtttgctcatgaagttgttgctaaaaacgccaacgtgatcgattttaaaaattttgctccgctcctggaaaggattgttgccgtaatagatgcctacggggctaagttgaaggccaagtga

SEQ ID NO: 8211 - RNA, 1758 nt, unidentified
  source 1..1758: mol_type = other RNA; note = synthetic construct
atgagcatcctgaaaaaactgcaggaagctaagacccggggacaagttgccgccctgctcgatgtcaagccagccatgctgagttttatcctgtacaagaaacccaaggcaactctgtatacaaagttttctatccccaaaaagcacgggggaacccgtgatattctggccccagagggaaacttgaagttgcttcaacatagactctgccaggttctccaggactcactggacgagattaatgtggccaacggccatggggaatctagagaacggcagggagttgctcatggatttaagagactgcatacgatcatgacaaacggccgaccccacgttgcaaggaggtacgtatttaatgtggatttgcatgacttcttcggcagcattaacttcggtcgtgtgagggggttcttcattaagaacaagaactttctccttcacgaggacgtggctaccgtgatcgcccaaattgcatgtcacgagaacaaacttccacagggctcgccatgttcccccgtgattagcaatctgatcagccactccctagacatgaaacttgttcagctcgcggctcgtgtgggcgcaacatacactaggtatgccgacgacttaactttctctactaacaaccccgattttccacagtatattgctttacgcaaaggaacccacgaatgggtggctggtcggggcctagagaaaatcgtgatgaaagaaggctttagcctgaatccttccaagacaaggatgcagtatcgagatagccgccaggaggttaccggtctgactgtgaatcgcaaagtgaattcccctgctgcttaccggctcaccgtgcgagccatggtgaacagcctcttcaaaacgggcctgttcgagcacgtacgcaaaaagaagggcgccgcaggggggatcagtgtcacaaaatttgctggggaaaagaagcaaatcctcgggatgctgagccacatagaccaggtagacctgttcaatcggcgacttcgggagaagaatggtttagagcctcacaacacctcaggcagggtggccctgttcagaagattcctgtacttcgagaacttttatgcgctagacgcgcctctgatcgtttgcgagggtaaaactgataatgtctatctgaagtgcgctattaagtctctggcgtcaagttaccctaaacttgccacctccgattccctgccgaaactgaagattcgcttcttcaaatactcagaaagacgcgcaggagacgtcattgggttaagtgggggcgtcgggggcatctgtaaattgctcaaaaactaccatgaggacgttagggaaaaattcaaagcaccatctcccaagcatccagtcatagtcttaatagataacgatagcggggccaattctgtgtacgaagccatagcaggaataaccaagaagcctaagccggctggtatggcagactttatccatgtgacgggaaacctttacgtggtgcctactcccttgggaagaggtggcaagaaaaccgccatcgaggatttttttgatgacaagacactcagtgtagcactcaatggcaagacattttcgcgggacaaaaatatcgatgaaacagtccactatggaaaagtcccctttgccatcaatgtggtcgccaagaatgccgataccatcgacttcactaagttcaagaagattttggatagggtagtgcgcgtcattgacgattatgcgataaagatgttggcttcctctcactccgcctcatga

SEQ ID NO: 8212 - RNA, 1749 nt, unidentified
  source 1..1749: mol_type = other RNA; note = synthetic construct
atgtcccagctaaagcagctcaaagctgccactacactctcggacgtggccaggctcctggaggtcaaacccggaatgctgagcttcgtgctgtacaagaagccaaaagccgccctgtacagcaagttcgacattcccaaaaggcatggtggcactcgggagatttgggccccggataaggatctgaagttagtgcagcaccgtttggccaacctgttacagaactgtgtcgaagaaatcaattcctctcggggccatgtagaggacggcaaacggcatggggtggcacacggattcaagcgaaaacatacgatcatgaccaacgctcgagtgcacgtgactcgccggtatgtcttcaacgttgacctacacgatttctttggaacgatcaattttggacgggtgcgaggattttttctcaaagataagaatttcgcgcttcacgagaaggtggccaccgtgattgctcaaatcgcgtgtcatgaaaataaactgcctcagggctctccttgctccccagtgatcagtaacctgattgggcatgtcatggacattatgcttgtccgtctagcatcagccactggctgctcctatagtcgctacgccgacgatcttacattctcttctaacaagtccaagttcagcagcagggtagcaagacaggacgatgcagataaagacttgtggctgccagggcaaggtctgaagcggcttgtggcaaaagcagggttctctttcaacgataaaaagaccaggatgcagtacagggacagtagacaagacgtaaccggattagttgtgaacaggaaggttaatgtccccgctacatatagatacacagtcagagccatggtcgaccacgcactgaagactggagctttcgaacgcatctttaaaaaactggacgctgccggagtggagacaacttttaagcagccaggcaccaatcggcagctgatagggatgctcagctacattgaccaggtcgatttatacaatcgaaaactcagagaggacaacgggctggaaccacatgatacatccggtagaactgaacaatttcgcagatttctctactttgatgcattccacgctatcggatcgcctgtgattgtgtgtgaaggaccgactgacaacatatatctgagacacgctattaagcggcttgcgcccaagtatcctatgcttgcggccggcacccctcccaagttgttgctccgtctgttcaaatatggtcagcgccgaacctctgagatcacgcaactgaccgggggcgtgggtggtttgtgccatctcatgaagcactaccacagcgattttataaacaagatcaaagcctccgccccaaaatatccagtcatcgtgctcgttgacaatgatgcaggggcaaaagacatctacggggctatttcaggcattacaaagaaacctaggcccaccgggagggagcagtttatacacgtggtaggcaatatgtatgttgtacccacacctcttggcgctgggggcgcaaagacggctatcgaggattttttcgacgcgaagaccctggcagaaaccctgggtaccaaaacattttcaagggctcccaagttcgacgatacaaagcactttggcaaagccgcctttgcccgcgagatcgtggataaaaaggctgatagtatcgacttctcaggattcagcgccatattggacggcgttgtggccgtcgttgctgattacgccaagcgccatccgcctgttccctga

SEQ ID NO: 8213 - RNA, 1749 nt, unidentified
  source 1..1749: mol_type = other RNA; note = synthetic construct
atgtcacaactgacccggttgaaagccgccacgtcactttctgatgtggcccgccttctggaggttaagcccgggatgttgagcttcctgctttataagaaaccgaaggccgctctctacgccaagttcagtattcccaaaagacacggcggtacccgagaaatctgggctcccgacaaagatctgaaactcgtgcagcataggttggccaatcttttgcagaattgtgttgacgagattaacgcggctagaggacatgctgaggacgacaaaaggcatggcatagcacacggctttaagcgtaagcacactatcatgaccaatgcacgggtgcatgtgaccaggcggtacgtgttcaatgtcgatctacatgactttttcggtaccatcaatttcgggcgtgttagggggttttttctgaaagataagaatttcaccctgcatgagcgagtggctactgtaattgcgcagattgcatgtcacgataacaaactgccccaggggagcccatgttctcctgtgatatcaaatctgataggccacatgatggatattctcctggtgaggttggcatccgctacgggatgcagttatagtcggtatgcggacgacctgactttctcatccaaccggagcaacttttccccaagggttgctcggcaagacgatgacgataaagatttatggctccctggacagggcctcaagaggctggtggctaaagccggatttagctttaacgaccgcaagactcgtatgcagtaccgcgattctcgtcaggacgtgacaggcctggttgttaaccgcaaagtgaatgtccccgccacttacagacacaccgtaagggcaatggtcgaccacgccatcaaaacaggaagcttcgagagaatctttaaaaaagtggatgccgcaggaatcgagactgcattccggcagccaggcacaaatcgccagcttattggaatgttgagttatatagatcaggtagatctgtttaaccgcaaactgagagaggaccatgggctggaaccacataacaccagcgggcgaacagaactcttcagacgattcctgtatttcgactccttccacgccatcgaatctcccgtcatcgtgtgcgaaggccctacagacaacatctatctgaggcacgcaattaaaagactagcgcccgcatacccaactctcgcttctggcacccctcctcaattatccgtgcgactttttcgctacggacaacggaggatttcccaggtcacacagctaacggggggcgttggcggtttatgccacctcatgaagcattacaactcagacttcacaacaaagattaaggccccagccccccgatacccggtgatagtcctggtagacaacgatgccggcgctaaacctatttacggtgctatctccgggattactaagaagccacggcctactggcgcggaaagatttatccacgtcgtcggtaatatgtatgtggtcccaacacctttaggtgccggggatgcagcaaccgctatcgaagactttttcgacgcaaagaccctcaacgagaagctcggaaccaagacattttcgagagccgccaagtttgacgatacgaagcactttgggaaggccgccttcgctcgcgaggtagtggagagaaaggccgacttcatcgattttagtcgcttctctgatatcctggatcgggtggtggctgtcatgagcgactacgccaagaggtatcccagcctgccgtga

SEQ ID NO: 8214 - RNA, 1443 nt, unidentified
  source 1..1443: mol_type = other RNA; note = synthetic construct
atgtccaatgctcgggcccacgtgacgagacggtacgtatttaacgttgacctgcacgacttctttgggactataaatttcggacgtgttagaggatttttcctgaaggatcgaaattttagtcttcaacccaaagtcgctacagtgctggcccagattgcctgttatgagaacaaactgcctcaagggtccccatgcagccctgtgatcagcaacctaattgggcacatgcttgatatcgccctcgtacagcttgctgcagtcagcggctgtacctacacccggtacgccgatgacctgaccttctccagcaacaagccgactttccccatccagatcgcaagacaaattgataagtcggcggataagtgggctcctgggcgcagtctcgagcgcattgtgacaaaggcaggttttacctttaatgacaaaaagaccaggatgcagtatagggactctaggcaggaggtgacgggactggtggtgaacaggaaaataaattcgccggccatctacaggaataccgtgcgcgcgatggtcgattcagctctgaagcgcggtacctttgacttcatccacaagaaggttgacgccaaaggcgtggccacagtggtgaagcaaccaggtcgcaactcacagttgctcgggatgttggcacatatcgatcaggtagatcttttcaataaacggctgtgcgaaaaagcagacattgagccgccaagcactgccggacgtatagagttgtttagacagttcctctacttcgatgcattctacgacatctccatgcctgtgatagtttgtgagggacccacagataacacttatatccggcatgctattcgaagtctagccttcgggtaccccatgcttgtgacaggcaacgctcctccaaagctgaacgttcggttatttaagtacgcagaaaggagaacttcagaagttacccagctgacaggcggcgtgggagggttatgccacctgatcaagtcctatcacaccgacgtgactgagaagataaaggctcctccccctaaacacccaaccatcgtcctggtcgacaatgattcaggagcaaacgccatatatggtgcaatctctgggatcactaaaaaacctcgacccacaggaaaggagcccttcattcatatcgtcggcaacatgtatgtaattccaacaccattaggcctccatggtgaaaagaccgccattgaagacttcttcgacgccgccacactcgcgactaaactgggcaccaagtcttttagccgcgaaaagaaaattgatgagacgacgcagtacggcaaagctgccttcgcaagagaggtcatcgaaaaaaatgcgggctctatcgatttttccagatttagtgccattctcgacaggattgcggccgtgctggctgactattctaagaaacatcccacaagcgctgtcttgtga

SEQ ID NO: 8215 - RNA, 1743 nt, unidentified
  source 1..1743: mol_type = other RNA; note = synthetic construct
atgagctcactggcggacttgaagaatactaagacactgagtgacttgggtgctctgctggatatcaaagctggcatgctatcattccagctgtacaagcgcccaaaagaggttctgtatactaagttcagcatccctaagaaatacgggggattacgcgaaatttctgcccccgacccaacgcttaagttgatacagcacagactatctgatctccttcaggagtgcctgctggagataaccaaaatcaacggacacgtaaatgatgctaagtcctttgggattagccacggtttcaaaccaggccacacaataatgactaatgccagagggcatgtgggcatgagatacgtgttcaacctcgacctccatgatttctttggtagcctgaatttcggccgcgtgcggggcttttttatcaaggaccgaaacttccagcttacccccgcggtggccaccgtgattgcccaaattgcatgcgccgataataagctgccacaaggctccccgtgttctcccgtgatcagtaatcttattgggcacactttggatatccccctcgtgcgcctggctgccacattaggcatgcggtatacacgttacgcagatgaccttaccttttcaaccaaccagaggatcgtccctgatgaaatcgctctcatggatccagttcataaatggattcctggtagggagctggtgcggatcattaaacggaatggatttgccatcaatgagagtaaaacccggatgcaatactgcgatagcagacaggaggtgactgggctgaccgttaaccataaagtgaacgtccctgctacatacaggtaccgtgtcagagccatggcgcataggctcttcaccactggagaattcgagttcatctacaaaaacaacgagaagacagtagtatcttctagcaaggggtcaccccagcagttgcttgggatgctgtcctatatagaccatgtcgaccagtacaacgaaaagatcaagctcgaaaataacctgcctgttacagaaacagctggacgaacagaactttttcgacagtttctgtatttcgacgcatttttcgcacccgaacgcccaatcgtggtctgtgagggcaagacagataacatatatctaaggtgcgccataaaaaagctggccgccaaatatcctgatctcgcaaccgtggccagaggagtgagcctcaatgtcagattcttcaaatatagtgagcaacgcactggatccgttattgggctgactggaggcgtgggtgggatctgtaaactgctgaagcactatcacgaagacgtatccacgcggtttaaggccccacgtccacagcaccctgtcattgtccttattgacaatgattccggcgcaaacagcatctatgaagctattgctggaatcaccaaacgcaaaaagccgttgggtcgggctcccttcattcacgtcttctcgaacctctatgtagtccccactccgttcggccccaagaatgcatacacagcaatcgaggattgttttgacgccgcaaccctcgccaggcctttagacggcaggacgttttcccgagacaataagcatgactcttcaaaacactacgggaaaaaggactttgcgaccagggtggtggccaagaatgtgaacaccctgaactttcatggctttgagcctttattggagcagatggtggcagttatcaaggactacaagacgagaattagtggagccgtggttgcttga

SEQ ID NO: 8216 - RNA, 1779 nt, unidentified
  source 1..1779: mol_type = other RNA; note = synthetic construct
atggctttaatctacagcacacccgtcctggattccctaaaagctgccacatcactgcacgacctcgcacagctgttgaaactcaagccagcggtattggcgatgcagatttataagaaagacaaacggacagattggtatacgtcatttgagatcaagaaaaagcatgggggcgtgagaaagatcaatgcaccagaaaaacacctaaaactcatacagagtcggctcagtaagatcttgcaggattgtcagctcgaaattgccctgctgaacggacataaggaaggccctgatcggcaagggattgcccatggctttaagagacaccactctattatgactaatgggcggccgcatgtaaaccgccagttcgtttttaacgtcgatctgcaagacttcttcgagacaatcaatttcggcagagtgcgggccttctttcagaagaataaaaactttgccctgaacccaaaggtgagtgaaattctggctcacattatctgctataaaggtagcattccacagggaagtccgtgttcacccgtcgtgagcaatctaattagccattccatggacaccctgctggcaaaagccgccaagatcaatggggctacctacacacgttacgccgatgacttgactttctctactaacagaaaagtgtttcctgccctgattgccaaaaaaatctccgctaatgagtgggaaccaggtgctactctcctcggcgtcgtgacaaagtcaggattctgtttcaataagaacaagacacgtatgcagtataaagacagccgccaggaggtcaccggactgtctgtaaataaaaaggtgaacgtgaccgcagattatcgctacaccacacgagcaatggtccataagctctttaccgatgggaagttcgtgttttgctacaaggtcaaaaactcccacggtgaaaaagagatttttcaggagatcgaggggagggcatcgcagttgctgggcagattaacacacatcgaccatgtggatcagttcaacgagttgattcgcaagaaaaatggtctgccctccgctcttccagaaggccgattgaaacttttcaggaacttcctttacttctaccatttctatatgcctgaccaacctgttatcctgtgcgagggtaagaccgacaacatatatttaaaatgcgccttaaaggctaacgccgcggcgtttccgaaaatcgtcgaggtgtcgactgggagcccccctactctgaaggtgaggctctttaaatattccgagaggcgaacgggcgttgtgaccgatctttctggcggagttgggggcatctgcaaactgctgaagaattttgacagtaacctttctatgtggaattcaggacccaagcctgcacaccccgttatcattgtgatcgacaacgacagcggagctcagaagatataccaagcgatcgcaggaataaccaagaagcccaaaccttctggacgcaataagtttattcacgtcatcgagaacatttacgtggtacccaccccccctgccaaagggatcacgaataccgatatcgaatgtctttttgccgacgccactctgaatgaggagctttctggcaagaagtttaataagtccaaggaaatagaggactcatccgaatacggtaaaaccgcattcgctattaacatagtggctaagaaaagcggcgaaatagatttcactggcttcgttccactcctggagaggattcaagaagccatggaccactactataagagcatcaagaagttcaagaaatga

SEQ ID NO: 8217 - RNA, 1761 nt, unidentified
  source 1..1761: mol_type = other RNA; note = synthetic construct
atggccaaaattttcagcactcctgcgctggattccttaaaggccgcctcatcactgcacgatcttgcccccctgctcggtctgaaacctgctgtgctggctatgcagctgtataaaaaggataaacgcacaggctggtatacaagtttcgagatcaagaagaagtacggcggcgttcgatccataaacgctcccgaaaagcatttaaagctgatccagtcccggctgtctaagattctgcaggactgcctcctggagattgccttgataaaaaaccacaaagaatctccagatcggcagggaatcgcccacggttttaagaggtaccactctatcatgactaatggccggccacatattaatcgcagattcgtgttcaataccgatctgcaggactttttcggagcaatcaactttggtcgagtgcgggcatttttcgagaaaaacaagaacttttccctcgatcccaaagttagtgagatcctggcacacatcatctgccataagggctccataccacagggttctccatgttcacctgtggtatccaacctcatcgcacattctatggacacactgttggccaaggctgctaagaaaaatggcgtcacgtatactaggtacgcagatgaccttacctttagcaccaacaagaaggagtttccactggctatcgcgaaaaagattacatcaaatgaatgggtacccggaaaagaagtttcggttattgtcgagaagtcgggattcttttttaacgaaaagaagacgaggatgcaatataaggacagtcgacaggaggtgacggggcttagcgtgaacaaaaaggtgaatgtgacctccgattatcgctacaccacacgtgccatggtgtcaagcctttttaaaaccggtaagttcaagttttgctttaaagcgaagaatctcgctggggaaaaagaggtggttcaagagtttgagggcaggcctgcccaactcttggggcgtctgactcacattgactacgttgatcagttcaacgaaagtctgagaaaaaagaacggcctaccaccagcactacccgagggcagattgaaactctttagaaacttcctgtactactatcacttttacatgcctgagcagcctgtcatcctctgtgaaggaaagaccgacaatatatacatcaagtgcgccctgaaagcacatgccaatgctttcccttctatggtcaaacccgggagtccgccagagttaaaagtgcgcctgttcaaatatagtgaaaggcggactgggatagtaacagacttgtctggaggggtgggagggatctgtaagttgctaaaaaatttccatgctaaccttagcatgtgggagtccgccccccagccaacacatcctgtcatagtggtgattgataatgatagcggcgcagacaatatttatcaggctattgccgggatcacaaagaagcctaagcccaagggatacgcaaagttcattcacgtcacccagaatatttatgtcgtgcccactcccccggtgaagggcaaaaaaaacaccgacattgagtgtttattctcagacgccaccctcaaagaagaactgaacggaaagaagttcaataaaagcaaggagatcgaagacagcagcgagtatgggaagaccgctttcgccatcaatgtcgtagccaaaaaagcgcacgaaattaactttgcaggcttcactccgctccttcaaagaatcaaggaggccatggaccactactacaaatccatcaaatga

SEQ ID NO: 8218 - RNA, 1860 nt, unidentified
  source 1..1860: mol_type = other RNA; note = synthetic construct
atgagccgggatatgccctcagacatcttgtgctcaaaatatgtggtacaagttgctcccggcagtgtgcgagaaagctttaatcagagccgaaaatctatggtcaaaacttactcaacccctgcattagattctctaaaagcagctcggtccttgcacgacctggcccagctgcttcgcctgaaacccgaaattctagccatgcagttgtacgttaaagacaagcgcaccggatggtacacgagtttcgatattaagaagaagtatggcggggtgcggacaattaacgcgccagagaaacaccttaagtccatccagtccagactgtctaaaattctgcaggattgtctgctggaaattgcactgatcagcggccacaaagagggcccagaccggcttggtatcgcccatggattcaaacgctatcattcaatcatgactaacgcccgcccccatactaataggcgcttcgtttttaatgctgatctccaggattttttcgggactattaactttggaagagttagagccttcttttcgaagaataaaaactttgagctcgacgccaaagtgagtgagattctcgctcatatcatctgttacaggggatctctgcctcagggatctccttgcagcccggtagtctcaaacctgatagcccactcaatggacacgctgctagccaaggctgctcgaaccaatggggtgacctatacgcgttacgccgacgatctaacttttagtaccaatcaaaaggagtttccatcttccattgccgagcgcctggttggcaacgagtggggtgtaggccggactgtggtgaggatcgttgaggagtctggtttcagttttaatcagaacaagacacgaatgcaatacaaagacagtaggcaagaggtgacaggcctgtctgtcaataagaagacaaatgtgacagcagactaccggtataccacaagagcgatggtgcacagcctgttcaaaaccgggaagtttaagttctacttcaaagtgaagaacgccagcggtgctaaagtggtgattaacgaggcggagggaagccctactcagctccttggtcgtctctcccatatcgatcacgtggatcagttcaatgaatccattcggaaaatcaatggactccccgcagcattaccagcggggaggctgaagttgtttagagacttcctgtatttttaccacttctacatgcctgaaaagcccatcattttatgtgaagggaagaccgataacatctatataaaatgcgcactcaaagcaaaggctgcctctttcccttcactcgtcacacactccagcccccccgagctcaaggtaatcctgtttaaatacagtgacaggagaaccggtatcatcaccaatctgtcagggggggtcggagggatttgcaagttccttaagaacttcaattccaacttaagcatgtggatatctgctccgatccctgctcatccagtcatagtcgtgatcgattcggactccggcgcagacaagatctatcaggccattgccggcataacacgtaacaagaaaccaaaaggcagcgaaaagtatattcacgtgaccaaaaacatctatgtggtccctacgccaagaaagattaacgagcaaactactgacatagagtccttgttcacccaggagacactggacacagaactcaacggcaagaagtttaataagagcaaggaactggacgatgcttccgaatacggcaaggccgcctttgctaccaatgttgtcgcaaagagggccagtgaaatcaacttcgatggattcataccgcttttgaacaatattaacgaagcgatgacacattattacaggaccatcaaatga

SEQ ID NO: 8219 - RNA, 1767 nt, unidentified
  source 1..1767: mol_type = other RNA; note = synthetic construct
atgaaactagaagaactgaaagcagcaacatcccttagagacgttgctactttgcttcaggtgaagcccgcaatgctctcatacatcctgtacacaaaaccgaaaccagagctttataccaaattcgaaatcccaaagaggactggcggtgtgcgcgaaatatctgcaccctactcacatctgaagttgatccaacaaaggctcgccgctatactcctggagtgtaccaaggagctgcgtgagaagaacgcatcaaagagcaaaaacaagaacttcgagattaggagcgtcgcgcacgggttcatgccaggtcacaacatcatgacaaatgggcagtcgcatattactaggcgattcgtgttcaatgtcgatcttagcgatttcttcgggtccataaatttcggacgggtgcgcggatttttcattaaggataacaacttcgctctcgacgagaaggtggctaccatcctcgctcagatcgcctgctatgaaaataagctaccccagggaagtccttgttctcccgtgatctccaatctcttaggccatatcctggacgtcgcgttgatcgacctcgcgcggaagaataaatgcacttatacacgatacgccgatgacttaaccttcagcacaaatcggcgagtgttcccacttgcgatcgcctttgcaatccaagaggacaagaatagttggctgccaggcaaagagctgatccggatcgtacagcacaacggttttgagtttaacaagaaaaagactcgcatgcagtataaggacagccggcaggaagttaccggcctttctgtgaaccggaaggtgaatgtgccggccagctacagatacaccgttagagccatggcttctaacttgtttaggacggggaaatttgagcacattgtcagatacaagaattcctcgggcgaggaggtggtatctaaagtagacggcaaaacaagtcagctgctgggtatgctgagctatattcaccaagttgacatgtataacgaagctctggccgtgaaaaataatcagcctctcgcagatacgccaggccgccttgagttgtacaggcgcgccatctacttcgatgctttttatgcacctgaaagaacagtggttgtttgtgagggaaaaacagacaacacttacattaagaacgctatctaccgcctgtttcaagggtatccgctgctgggcgagttggatgctgagggaaagccacagctaaagattcgtctgtttaagtatgccgatcgcagaaccgccagtataactaaattgtctggaggggtcgggggactctgccacctgattaaatactacaactcagacattgtgcagaaattccgagcccctcctgccaagtttcccgtgatattactaatagacaacgacagtggcgctgattccgtctacggcgccatcgccgggattctgaacatccaaaagcccaagggaaaaaagccttttatccatgtctatgagaatctgtatgtcgtacccaccccctttgggctggatggtgaaaagacctccatcgaagatttttttgaccaggctaccagagcaacgcagctgaatggcaagtccttcgaacgtaaaaatgatgccgacaaccagcaccactacggcaaagccgccttcgcaagagatgtgatttcaaagaatgcaagcaccattaactttgacggtttccggcctattttagataggattgaagcggtcatgaaagactatgtgggcaggatacatcagctcgccggatga

SEQ ID NO: 8220 - RNA, 1755 nt, unidentified
  source 1..1755: mol_type = other RNA; note = synthetic construct
atgaagttagaggagctaaaggccgcaaccaatctccgtgatgtggcgaggctgctgcaagtaaagcccgggatgctgtcttatgtgctgtacacgaaaccgaaaagcgaactctatactaagttcgaaattccaaagcgaactggaggtgttagagaagtcagtgcgcccttttcccaccttaaactgattcagcaaaggctggctgcaatcttgttagagtgtaccaaggaactcagagaaaagcatgcttcaaagagtaagaacaaaaacttcgagttccgcggggtttcacatggcttcatgccaggccacagcattatgacaaatggccaggcgcataccacgaggaggttcgtatttaacgtagatctgtccgatttcttcggcagcatcaatttcggaagagtgcgcgggttctttatcaaggacaataatttcgcgctcgacgaaaaaacagccacaatcttggctcagatcgcttgctttgataataaactgccacaggggagcccttgctctccggttatcagcaacctgctcggccacatcctggatgtcgccctggtggagcttgctcggaaaaataagtgcacttatacccggtatgctgacgatctcacctttagtacaaacaaacgcatatttcctagcgagattgccctcgctaccgaggatgacggaaactcatggctgcccggtaatgaactgataagagtcgtgcgtcgaaacgggttcgacttcaacgaacgcaagactcggatgcagtataaagacagtcggcaagaggtgactgggctctctgtgaaccggaaggtgaatgtgcctgcctcttacaggtataccgtgagggcaatggcctcctcgttgtttagaacaggtaagttcgagcacatcataaagtataaatcagcctccggcgacgaaattgttagcaaatgcgatggcaagataaatcaattgctgggcatgctgtcctttatccatcaggtggacgtctataatgaggctttggctgttaagaacaatcaccccatcatcgaaacccccggccggctcgaattatacaggcgagtaatttactttgacgccttttacgcacctgagcgcccaataattgtgtgtgaggggaagaccgacaatacttacatcaaaaacgctatccatcgcctatcccagaactatccactgctgggaggccttgactcagaaggaaagccccagcttaaaatccgtctctttaaatacgcagatcggcgcacagcctccattacaaaattagggggcggtgtcggcgggttgtgtcaccttattaaatactacaaggctgacatcgcctctaaattctcggcccctagacctaagcatcccgtgattatgttggtcgataacgattctggagccgacgcaatatacggagccattgccggaatactaaatgtgcagaagcctaaggggaaaagaccattcatcagggtttatgagaacctttacgtggtgccaactccctttggttccaatggagagaagaccagtatcgaggatttttttgacaaagcaacactggccgtccagctgaacggaaagagcttcgaacggaaaaacgacgctgataatgagcaccactacggtaaagccgccttcgcgcgagacgtcattgccaagaacgccgcagcaatcgattttaacggcttcaagccgattctggatagaattgaggctgcaatcaaggactacgcaacgcagacccagtga

SEQ ID NO: 8221 - RNA, 1752 nt, unidentified
  source 1..1752: mol_type = other RNA; note = synthetic construct
atgacactcgccaatctcaagggggcaactgacctacacggcgtcgctaaattgctagacgtgaaggcaggaatgttatcctacatactttacaagcaaccgaagcccgacctgtacaaaaagttcgagatcagcaagaaaacgggaggagtgagggaaatttccgcgccctgtccccatcttaagctcattcaacagcggctggcagccatcttactgggctgcagcctcgaattgaaggcaaaacacgcaacagcagtcaagaacaaaaactatgttaggagagaggtgtctcatggctttacgaaaggccgttccatcgtatcaaatggcgaggaacatataaccaggagatttgtattcaatgccgatctgtccgatttctttggaaccatcaacttcggacgggtgcgcgggttctttatcaaggacgaaaacttctctttgttccctgccgtcgcgacaatactggcccagattgcctgcagcgagaataagctgcctcagggcagcccttgttctccgattatcagcaatctgatcgggcatctcttggatatgaggctcgtggaatttgctttgcgccagggctgcacatatacccggtatgccgacgacctgacgtttagcaccaataagcccgagtttccaactgctattgctgtccagaaagagggtgatccacacaagtggattcctggagggggtcttcagaagatcgtgcaaaagtgtggctttagtcttaatgagaagaagactcgtctccagtaccgcgattcccgccaggaagttaccgggctgaccgtcaacaagaaagttaatgtccccgctacatatagatatgcggcccgagccatggccaacaatctgtttaaaacaggcaagttccagcacaccattcactttaccgacaaggacggagcagctcaggagctgagacgagatgggcacgctggcgagttgagaggcatgctctcttacgtcgatcagatcgacctttacaactcatgtagggaggaagctaacagcctggtgccattaggtgcccccggtcgactgcaactgtaccggagggtgatctactttgactcgttttacgctctgtcaaaaccaatgattgtttgcgaaggcaagacagataacacctacatcaaacacgccattctgcagctcgccggccattaccctaccctcgcgagtgcgtcgattactggtggcaaaccagagctgaaagtgaggctctataaatatgccgaccgaagaagcgccgttgtcaccgatatcgggggaggagtgggggggctgtgccatttaattaagaactaccacgcagatgtggtgaacaaattccgcgccccccggcctatgcatccagtgatcctgctcattgacaatgaccttggggctgactctatatatggtgccatatccggattactgaaaatcaagaaacccaaaggtctaagaccgttcatacacctgttctctaacctgtacgtagtgccaactcctcttggccccgggaacagtcagacaatgatcgaggacttctttgacgccgctactcaagcagtgactttgaatggaaagactttctcaaggcaggatgaagatagttcaaaacactatgggaaggctgctttcgcacgtgatgtagtggccaagaacgcagatagtattgatttcaatggcttccgctccatccttgatagactgcgggacgttctactggactatccaacacggccttga

SEQ ID NO: 8222 - RNA, 1902 nt, unidentified
  source 1..1902: mol_type = other RNA; note = synthetic construct
atggccaaggaagggaacgtgagggacatttgccctaggcgaactcttctgttgcacaatcactcagtaatactactgaaagagtgcccacaagctctttcacccgaaatggccctcaagaagattgaagaacttaagaaggttaggaccagaattgagttggccgaacttctggaggtgaagccttccagattggcttacgaactgtacaagaaaaaagattcggatcgttaccagcacttcgagattcccaaaaaatacggagggactcgtgaaatccttgcacctaacccaacactgaagactatccagcgtcgactggccatatatctccaggactgtttagaagaagtaatcgcatccacagattccgagcgacacagaggtgggggcataaagctaggattcagtcacggctttatgcgggaccggaccattataacgaacgcaaggcctcaccgcgccaagcgcttcgtttttaactgcgacatcgtcgattttttcgggaccattaattttgggagagtgagaggattcttcattaaggacaaacagtttgcgctggctcaggaaatcgccacctttctcgcccaaatcagttgttttcagaatgtcctgccgcaggggtcgccatgttctcccgtgatcgccaatttgattgccagaaagctcgatattaagctgggtaggctggcttatcaaaccggcatgacttatacacgctatgcggacgatctcacatttagtacgaacaagaagatcttctcccatagcgtcggtgtgcaggatgcatccggtttctggcgggctggtaccgagctgacaaaaatcgtccgagccagcggcttcgagttaaatcctaataagacccggcttcagcagagggacagtcatcaagaagtaactggcttgacagtgaaccggaaagtgaacacaaattcttcttaccgctataccgccagagcaatggttaactcagtgctcaagacaggagagttctgctttagctatagcattaagaatgcacccgaatctctggaggctccggagaagaaaaaaggaaacttgaaacagctgctggggattctgtcccatatcgattacgttgacaggtttaacttcgaactgcggaaaagtaacctcgcccatctggcaaacaaaaaaaatcagaaagcggtggacgatcaactgttcccaagcttatcacgccaggagactttcaagaagtttgtgtacttctactggttctatgcctgtgacgaaccggtcatcatctgtgagggtaagacggataacatttatctcaagtgcgccatcaaagctttaaagctgcgatatcccgatctgatctctaatgacaagaacaacgaaaagctcaaaattcggttctttgagtacaaagagtctagagcaaaaagcctctctcagctttcaggcggggttggcggcttgtgccacttcctagagaattaccataagtacttgaatggcgcattttttgctccaaaacccaaacaccccgtgattgtgcttatcgacaacgataacggaggacagtccgtctactcaaaagtcgctgggataactaagaagaagaaacccaccggaaaggagtcttttattcgcatcgagaagaatctgtacataatcccaactccattaggccctgagggacagcaaaccgcgatcgaggactttttcgacaaagctgtgctcgacgagcagctgaatggcaagtccttctccagggacgacgacttcgataagagcaagttttatggcaaagccgcctttagccgggatgtagtgctaaaaaatagggagaaaatcgatttccagggcttcgatagcatactcagtcgcatcaatagcgttctgagagactatcatctgaccccttga

SEQ ID NO: 8223 - RNA, 1704 nt, unidentified
  source 1..1704: mol_type = other RNA; note = synthetic construct
atgagtaagctccagcatctaaagtcaaccagtaacctgcactcagttgccaatctcttggggctcaaaccagcccacttagcttacaatctctacaaaaagcccgatgcggagaaatacactaaattcgagatccccaaaaggtatggaggtaagaggatcatttctgctcccaatgctgatttaaagcacattcaacgactgctggcagccgttctgatggactgcttaaacgaattgaatgccaagtacaaccgacaagctgcacacggctttattacccagaggagtatcctgaccaacgcccatcagcacagaggtcgcggccacgttctcaatcttgatcttcaggacttcttcggttccattaatttcggaagggtccgcgggtttttcattgctgataaagattttagcctgcatccagcagtggccacagtcttagcccagattgcatgtttcgagaacactctcccccagggatcccctgcttctcccgtcatcagcaacctcataggtaacgtgctggatacccacctgatcaagctggctagaaaacacgggtgcgtgtacacgcgatatgctgacgacctgacctttagcacaaacctgcccaacttcccagaagagctcgcgtactctaaatttggagtctggactacaggaacatccctgttgaaggttatcaagcagtcagggtttgacgttaacacaagcaaagtacggatgcagctggaggacagccagcagaacgtgacggggctagtagtgaatcagaaggccaacaccgccgccagctatagatcgagcattcgggctatggcaaagaatctattcaaaactggcaatttcactcacgattcattcatcaaggactccgccggcaatgtgagcaaaaattccgagctgggcactgtagcccagctgcagggtatgtttgggcatataaaacatgtcgacgaattcaaccttcagattcgtcggcaagagatcccgacgggcagagcctctctgtacaaacggttttttctgttctcgcaattcttttgttcctccaaacctgtgatactttgcgagggcaagacagacaatatctatctactgcatgccatcaggtcacgcgccaaccatttcccccaactggcagaaaccaatgcaaccggctctatttcacttctcatccgtatcttcaagtatgtggaacggaaagcaggtcgcaccctcggaatgagtggcggagacggcgaaattagcaaatttatagggacctacctgacagaggtgagtaagcactttaaggccccgggcgtgtctcagcacccagtcattcttgtggtggatcatgactctggagggaaagggccttacgagacagcgtctaaaaaggtgggcaagacgttggacatactgaatccttttgagcatgtcgctgcgaatttatatttggtagcaacacctcttccttttggagctacctccagttgtatcgaggattgcttccaacctactacattggccaagaccctcggtggcaagacctttaactacaagactaagcacttgaaaccgacagaatacggaaagtcatatttcgccgaacatgtggttcaggcagatgctgggactatcgatttctccggctttgatccactgctggacagaatcaacagcgtcattgtgcactatgcgaagctcccaaagtga

SEQ ID NO: 8224 - RNA, 1767 nt, unidentified
  source 1..1767: mol_type = other RNA; note = synthetic construct
atgaccttgctcgctggtctaaagagtgcgaggactattcaggatgtagccaggctgctgaatactaaagcatctgctctggcgttcatgttatacaaggaatctccggatacgctctataccgagttttccataccgaaaaaatacggagggtttcgcgccatcgccgcgcctattcccaaactgaagctggtgcaacgcaagctggccgacatcttgcagatctgcctccaggaaattaacgagaaagagaactactctgacaaagtcgcccacggattcaagcgcggccgttccatcgtgaccaacgcccagtgtcataagcgtaagagactggtgtttaacctggatcttgaggactactttgggtctataaattttggccgcgtgagaggctttttcatggcagatagaaactttcaacttcatccctcaaccgctaccatactcgctcagatagcctgctataaaaatagtctgccacaggggtccccatgctcacccatcatatcaaatcttgttggcaatatcctggacgtaaggctagtgcggttggccaaggaatctgggcttacatatacacggtacgccgacgaccttaccttcagtaccaatgcccagtccttccctgaatctattgcggtaagctcagctgatagtctacattcatggatggtcggtaagggcttgaatgagttaatcgagagaagtggcttccgagtgaatagcagcaaggttcgtgtacagtaccgccactcccggcaagaggtcactgggttggtcgttaataagcgggtgaatattccatcaacgtatagaaggaaggtcagggcaatggtgtattctctggttacggaagggtacttcgagttcaaagagattggtgagaaagatgcagaaagcgcccagcctaccaaaaaaggaagtctgaaccaactgcacggcatgctgagctatatttatcagctcgattccagtaaccggaaggaactctctgccgctaacttcaaagatggagtccccgtctccgaacgcgacgtacccctcacaacaacagagaaggtgtttaggcgattcctgtttttcaagaacttttactccacccagaagccagttatcatctgtgaagggaagacagacaacatttatttacactacgcactcctttctctggcaacccgatttcctaacctggtggtgaaacaggctcagaaatattcgttcgccttctccctccataggtacagcaggagctctactgagcggattctgggtattcagggaggatcaggcgacctgaagatgtttatgttgaattacctgacctcgtacaatttcttcaaggtgaaggtgaaaaagcaacccgtcatcctgttgattgacaatgacgacggcgcaaacgatatcttctccatggcaaaaaactatctcggctacaagccaacaggacaggaaccatttctacacgtcgatggcaacctttatttaatgcctactccgctcctgaacagcagaactaaaagcactatcgaggacttctttgatgataaagtgaagagtgtgcaggtgtcagggcgatcctttgaccccaagagaaagcacaatggtagcgcttcgacatacggtaaaaacgaattcgcacgggaggtggttgctaagcaagccaatagcatcgacttctccaagtttagctacgtgttcaaaaacattgaggatatcatagccgactttcagagcaaagttgctgccggaaaaatcaagccttga

SEQ ID NO: 8225 - RNA, 1734 nt, unidentified
  source 1..1734: mol_type = other RNA; note = synthetic construct
atgtcgaaacttagccggcttcgcgcttgcaaggacctgagagacttagcgaaactcctgggcttccgcccaagcgctgtgtcctacattctctacatggagtctgacagcgccaagtatcgggagttcgagatccctaaaacaaccggcggaacccgacagataagcgctccccatcccaaactcaagctgctccagacgaggctgagcaacctgctgcaggactgtctgggcgaactggataagctcaacgccgatgcccacagacttgactccctcgcccacggctttaaacgaggtcgcagtatagtcactaacgcacagcggcacaggaatcgaagatgggtcttcaatctcgatctggacgggttcttcaacgatatcaactttggccgagtgcgcgggtacttcattaaggatagaaatttcctcctgcagcccaaggtggccactgtgatcgcacagattgcttgtcataaggggtcccttccgcaaggatcccccagctctcccgtgatttcgaatatggtgggaaggataatcgatcttcgcctgtgcagacttgctgctcgcgctggttgccggtacaccaggtacgcagacgacctgacattttctaccaataaacgaagttttccagaagccatcgccgcccgggacagccaaaatgattctagttggtcccctggggatgaattaataaagatcatcaaggagtcagggttcagtatcaattctaagaagacaaggatgcagtatagggaatcacggcaggaggttactggtctggttgtaaacgacagagtgaacgtgcctgcaacatatcgtcacactgtccgagctatggtacaccgcctttgcatgaccggaacctttgatatacagaaagcaacaatatcttccactaaacagtccaaccaatctgatccaggcaacttgagacagctacacggcatgctggggttcattgacgcggtggacagatttcaccaaaagaataagccaaacgacgcacacgataagcagaagccaagagccagtgagttgatctacaggaggttcctgatttatcaaaatttctacgccgcagaaaagccggtgctaatctgtgaaggcaaaacggataacatctacatcacctgcgccatccgttcattagcgcaacagtttccggacctcgctcgcatcgataaaagtgggaaaatcagtctcgaaattcgtcggttccggtacgccaaaacgagcaccgggcggattttaggtttgaatgacggcggagccccagtcctgaaaaatttcatttgggagtataagaaggagatttctaaattcagagcgacaataagcaagcatcccatcatcatcctgatcgataacgattcagcttcaaagcagatcttcgcatccttgggaaaaattaccacatccaaggtctgtggtaacgaaccttttattcatgcttttgccaatctgtatgtagttgctactcctatacccgagggaaaggattcatccgacattgaagacttgtttgaccaggagactctaggcgccaccattgacggaaaaaggtttagcaggatcgttgaggacgagtcacgtcattatggcaaagccgtgtttgcatacaaggttgtgaagcctagggcagataaaatcgattttagcggtttccgcgaactgttggcccggtttgtcagagccattgaggactatcaggcgaagattcattga

SEQ ID NO: 8226 - RNA, 1683 nt, unidentified
  source 1..1683: mol_type = other RNA; note = synthetic construct
atggctactagcctcagcgacgtcgcgctcttgctgggcttccacccaaaagctttcgcgtgggtcatctataagcaaacagccaagtacgcagtgttcgacattcctaagtcccgaggggggactagaactattaaggcgcccgaacctcgtctgaaaaacatccaagccagactcgcggaacttttgcaagactgtatcgccgacatcaacgaagccagatctcagaaagaaaaactgtctcacgggtttcgcagggggcattcaatcataactaacgcttatcagcatcgagggcgtcggtttgttctgaatgtcgacttggccgacttcttcggcacaatcaacttcggtagagtaagaggttttctgatcactaaccggcattttgcactgcatgagcgcgccgctacagtaatagcccagatcgtttgtgatgataactcattacctcagggcgcccccacatcaccagtggtgagcaatttaattgcccatatcctggatgttaggctcgccaaattggcaagaagattcggactgcactatacaaggtacgccgatgacctgacctttagcaccaattccagagattttcccgaggaggtggcagtacctaatgacgctggccagtgggttgctggtcctgcattggacacggccatccaacgtgcaggctttgcgctgaacccccagaaaacccgagtgcagatgcgtcagagtcggcaggatgtgaccggcctaattgttaatgagaaggtaaatatccgctctgagtactatcgggaggccagggctaaatgcgaccatctatttcgcaccggtgcttatcggaccaagcaattagtgcgcaaggatgacggaacagccgcagtggaagaagtcccaggaacgttagaccagatggaaggagtgctcagtttcattgatagcgtgaaacgatacaagcggccagctgatcgagatcacaagcttacaggcagcgaacagacctacagaaagttcctggtgtacaggtatttctacgcaccatcaatgccagtgatcctgtgtgagggcaaaacggacaatatttacctccgctgcgctattcaggcctttgctgacgactaccctggactcgccgaaaaacaggggtccgcagccactctcaaggtcaggctgttcaattactctgagcacaccaaacggctgctcggtatcgcgggtggaagtgggcacttcaataaccttatacgcgattatcggaaaaacttgaagccctttaccgcacctcacgctgaaaggttccccgtcattctgctggtcgataacgattccggcgccgacgggatatataaggtcgtgaaggctacaacaaagacggcctgcgatggcaaggagtccttttattacgtgggcgataacctttatgtggtaccgaccccccttggaccatcggatgcccagactatgattgaggatttcctgcccgccaaatggcgcgctgagaaactcggcggcaagacccttaacctggggaaggactgcgacattacaaaagagtacgggaaggccctattcgcagagcacgtgattaagaggaatcggaaggacgtggactttactgcaatgagggttatactggacaggatcgtcaccgttatcgacgattacgctgccatgatgggagcaggaccgtga

SEQ ID NO: 8227 - RNA, 1719 nt, unidentified
  source 1..1719: mol_type = other RNA; note = synthetic construct
atggtgggcggcaacgtgaagaggatcgaccagctgaggctaacgaattgcctcgccgacgtagcagagctgctcggttttcaacccaaactatttgcatgggtgatttataagcagccttacaagtatgcaacttttgaaatccccaagtcccgaggcggtgtgagactcatcaaggctcctgaagaccggctcaaaaatgtccagtcaagactcgcgaagttgctacaagactgtatctccgacattaatgaaaaacgcgaacaaaccgaaaagcttagccacggtttccggaggggctacagtattataacaaatgcctatcagcataggagtcgacgatttgtcctcaacgtggatctgacggacttcttcggaagtatcaactttgggagagtccgtgggttcctgatgaccaacaagcacttcgccctgcaggagaggacggccaccgtcattgcacacatcgtgtgtgatgacaactccctaccccaaggagcaccgacatctccagtcgtgtccaacctgatcgcccatattctggacgtgcggctggctaaactggccagaaaatacggcctgcactacactaggtatgcagacgatctcacgttctctacaaacagtcgttccttcagcaccgaagtagcaaccccagatgctgctggacactgggttgccgggaaagcactggagaaagttataaccagagctggcttctcacttaataccagcaagactcggatgcagttgcagcaatcccgccaggatgttacaggcattatcgtcaacaagaaggtaaacattcggagcgaatattaccgggaagctcgggctaagtgccatcaccttttttgtacaggtacttacctcaccaaaaaagttgtccgcaaggaggatggaacctctgccgtagagtctgtgataggtacacttgaccagctggagggtattttgagctttattgattctgtgaaacgctttaagatgacttttgaccgagaatacaagctgactgggccagagcgcttataccgtaatttcctgtactacagacatttctatgcgccccccttaccgatgattctttgcgaaggcaaaaccgacaatatctacttacggtgcgcgatccagaagtttgcctccgattatggacagcttgcccaggaggagggcgatgccatcaagctgagagtcagactgttcaactactctgaccatactaaaaggctcatgagcttggggggcggaaccggacagataaaggatctgctcagcaactattgcaagataatgaaacccttcttgtcgatgggggagaggaatcctgtgatcgtgctgatcgataatgattctggagcgaagtcaattttcagctggatttcaagtactaccggccgacgctgtgatggaaaggaatcattttactacctcggcgagaatttgtacttagttcctacacctcggaccgacgaggatggggatacaatgattgaagacttcctgccactgaaatggagggaggagaaacttgggggaaaaacacttaatttggggtcgaacatcaacagagacaaagagtatggcaaggccctgttcgccgagtatgttatcaagaagaatcgcaaagatgtggactttgtccagatgaagctggtgctggaccgcatcgtggctgtgataaacgactatgctgccatgatggctacttccacatga

SEQ ID NO: 8228 - RNA, 1707 nt, unidentified
  source 1..1707: mol_type = other RNA; note = synthetic construct
atgaaacggattgacgaccttaagatggctactagcctcaccgatgtcgccttgttactgggtttccatcccaaagcattcgcctgggtcatatacaagcagcagcctcggtatacggtattcgaaatccctaaatctaggggcggtacccgcacgattaaagcacccgagcccaagctgaagaacgttcaggctcgtctcgcagagcttctccaggattgtattgccgacataaatgaggcacgatcacagaaggaaaaactctcgcacgggtttagacgaggacactctattatcactaacgcctaccaacaccgcagcagaaggtttgtcctcaacgtggatctagccgacttcttcggcaccatcaacttcggccgcgtgagagggtttcttatgaccaacaagcatttcgctctgcacgagcgggtggccacagtgcttgctcacatcgtttgttatgagaattccttgcctcagggagccccaactagtccagtggtgtccaaccttattgcacatattttggatgtgcggctggccaaattagccaggcggtttgggctgcattacacacgatacgcggacgacctgacatttagtactaacggcagaacctttcctgaggaggttgccgccatcgacgccgatggacaatggatagccggccccacacttaagggagctattcagagagctggctttgagctcaatccagtgaagacaagaatgcagttacggcagtcccggcaagatgtcactggtttgattgtgaacgaaaaagtcaatatccggagcgagtattaccgcgatactagggccaaatgccatcgcctgtttaagaccggaaagtatcaaatcaagcagacaatcaggaaggatgacggctcaaccatcgtcgaagacgctgacggcgcactggatcagatggagggcgtactgtcattcattgatagcgtgaaacgccacaagcaggttgtcgagagggatcacaagctgtctggagtcgagcagatttaccgcgcgtttctactatataggcatttctacgcgccctcaatgccgacaatcctgtgtgaagggaagactgacaatatttatgtgcgttgcgccatccaagcattcgctgatgattatgccaagctcgcagataagaaaggcgaagctgtttccgtgaaagtgaaactgtttaattacagtgaccacacgaagcgattgctgggaatagctggtggtagcgggcacttcaataatctcatcaaagactaccgaaagaacctcaaaccttttacggccccatatgcggagaggttccctgtcatcttgctgattgacaatgatgcaggcgccgacggcatatataaggttgttagagctatcaccaaagggacttgcgacgggaaggacccgttctacttcattggagataacctctacgtagtgcccacaccactgacagacacaggggctgcgaccatgattgaagatttcttaccaagcaaatggagggacgaaaaactgggaggcaaaaccctgaatctgggaaaagacatcgatatcaccaaggaatacggtaagtctctgtttgccgagtatgtaataaagaagaaccgtaagatagtggaatttgacgcaatgagagccatcctggacagaatcgtgaccgtgatcgatgactacgctgctatgatggcagcagggtcctga

SEQ ID NO: 8229 - RNA, 1257 nt, unidentified
  source 1..1257: mol_type = other RNA; note = synthetic construct
atgaagcgcattgacgagctaaaactcgctacgagcttgagtgatgtcgctttactgttagggtttcagcccaagccatttgcttgggtgatctataagcagccagctaaatattctgtcttcgaaatccccaaatcccggggcgggatgagagtgatcaaggccccagagccgaagctgaaagccgtgcaagcgagactcgctgaactcttgcaggattgtattgcagacattaatgaggctcgtagccagacagagaaactcagccacggcttcaggagggggcattccatcattacaaacgcataccagcatcgcagccgccgattcgtgtttaacgtggatctggccgatttctttggcaccattaacttcggcagagtcagggggtttctgatgaccaacaagcacttcgcactgcatgagcgtgcagccacagtcctggctcacatcgtttgtgacgacaattccctccctcaaggagcccctacatcccctgtggttagcaacctgatagcgcatatccttgacgtgcgactggcaaaattgtcacggcgcttcggtctttattacacaagatacgccgacgacctgaccttctctactaattctcggacttttgcgcccgagatcgccattaatgatggagccggaggatgggcagcaggaccagcattaattaaagccattcagaggagcggatttgcccttaatccgaaaaagacgagaatgcagctgaggcagtctcggcaggacgttactggtctggtagtgaacgaaaaggttaatatcaggagtgagtattacagggatgcccgtgctaaatgcgatagactcttcaagaccggtaagtatcaaacaaagcaccttttgcgcaaagaggacgggacttttgctatagaagaactcgacggcaccctagatcagctggaaggcaccctgtccttcatagactcagtcaagagacataagcagaccatcggcagggatcacaagagatctggggctgaacggctgtaccgatcgtttttgctttaccaccacttttatgcctcacaaatgcctgtaatcctctgcgagggcaagaccgacaacatctacgtccggtgtgccgtacaagcattcgtggctgattacgccaaatggccctggcgacgcaaaatgggcctgaatagtcggtatggttgcagcactatacagaccactcagtcagcgtgcagtgtgtccctggccgatcaggtgacactaatggcctga

SEQ ID NO: 8230 - RNA, 1689 nt, unidentified
  source 1..1689: mol_type = other RNA; note = synthetic construct
atggcctatattctcggcgtcacacctaagggattagcatatactattcgtattcaacctctggctaataggtattcttctttcacgattcccaaaaagaccggagggagccgtaatatcgatgcacccgaggtcggtctaaaactggttcagtccagactcgccgatgtacttcaggattgtattagtgacatcgacaaagaaaggggatatccagagaaaataagccatggcttccggcgcggccattccataatcaccaacgccaggaatcactcgaatagacgattcgttttgaatgtagacattgctgacttcttccagaccatcaactttgggcgggtcttaggttactttctcaaaaatcgcgacttctgtcttgacaaaaacgcagccgtcactttggctcagattgcttgtcacaataatggtctgccacaaggcgcaccatcttcccccgtaatcagtaatcttatcacacatatcctggatattagattagctaagatcgccaagaattacggttgctactacacccggtatgcagacgatttgactttttcgaccaatctgcgcgatttccctgagaaacttgcgcggctcgattcagtgagtggcaaatggatcgtcggacgcagcttggaaaaggccatcacccagtccgggttcgcactaaacgcgagcaagactagagtgcaactgaaacagagtaggcaggacgtgactggaatcgtggtgaatgacggtgtgaatgtgaggagagagtattacaaaaatgcacgggcttactgcgccgaactgtttaagacagggaagttctatataaacgttaaggatatcgacgaaaacgggcaggtgagcctcaagaagatcgatgggacgagacagcagctgaagggcattctgtcatttatcgaccaggtgaaatcacaccgacccaaaattacactcgagaaaacaactcctgatcgcaagggggtgaaaggatttaacctgctgtacaagcgattcttctactttgatgctttttttgccaacgacaaacctatgatcctgtgcgaaggcaagacagacaacatctatattcaatccgcggtcgcagccatgttcaacaaatttccaacactaagcggtgagaaaaacggaaaggccgactttaagttcaagctgtttaactacaccaaaacttcccttaagatcatcggcattgggggaggcaccgggcaactgaatgccttcatctccaactataagtctaacgtaggagactttaagtacaagggagaaaagcaccccgtgataatcgtgatagacaatgactcaggcagcagttcaatttataagaccatgaagaccatcctgaacatcgatgtgaaaggcgataagccgttttacttcatgggggagaatctctacattgtgccaacgccaaggggtgttaacggcgaggagactatgatagaatctttcctcccccagaaatggatcgattacaagctgaacggcaagaaattcaacatgaacaataagggccttgataccaaagccgaaattgggaaagctctgtttgccgagtacgttgttaaaaagttcaagaaggacatttcctttgataacttctctccgctcttggacaatataacaagcgccataaacgattattacgccatggtcgctattaaaccttga

SEQ ID NO: 8231 - RNA, 1344 nt, unidentified
  source 1..1344: mol_type = other RNA; note = synthetic construct
atgctgatcgccaaagaatgccagcctgccgcttatttcagcctccagcacggagtgatgaaccgcctagcgttgctgaggtctgccaagacgatcaacgatcttgctgacttacttggagtcaagcactccgggctgtctttcatactctacaagaagcccactgagacgaagtaccagtccttcactgtgccaaaaaaagccggcggagtaagagcgatccacgcaccaacaagtgagcttaagctgttccagcgtaggctggccgacctgctccaagagtgcctgaacgaaattgaggcaaccttcagaaaaacaagcgaggatcgacggcccgagaaaatcagtcacggctttcatcctggcagaagtatcataacaaacgccatccagcaccgtcgtcgaaggtatgtcctgaacgtggacttgaaagactttttcggaacctgtaattttgggcgcgtacgggggttgctcattaagaacgaacatttcctgctccacgacagggttgccactgtcatcgcacacctggcatgtcatgaaggggctcttcctcaaggcgcccccagtagccccgtcatttctaatctgataggtcgggtcctggatatcaggctggtgaaattagctaattcagtcgggtgctcttacagccggtatgcagacgatctgaccttcagcacaaatgacagacagtttccaccgcagctcgctgctgagattcctccatcctcaggtagatgggaaccaggtccggccctccttggggaaattgcatcgtccggattttccctgaatccaaaaaaaactcggatgcagttacatgaaagtcgacagatggtgaccggcctcgttgtgaatacgagagtgaacgtgtctagcgattatcgccacttgattcgggccatggttcaccgcctactgactaagggagagtacgaaatatcaaccgcagctggaccgatcaagggtaccaccgagcaactgcagggcatgctttcctttattgattccatcgacgaatttaataggaagagatttaaggagagggatgtgcccttccctcgccagcgcgatgaaaccttccgcgatttcgttttttatcgacatgtttaccaagcgtcccggcccactctgatctgtgagggcaagacagataacgtgtacctgacccatgctattagagccatggccaaattgtttcctgacctcgcgtctcccggcttctaccctgtatccgcagacacatcaaaaaaggccgaggacgggcataaggagtgcctatgtaggagcgagggctctacagctctttcatcgagcgtggtgttgtggagccggtga

SEQ ID NO: 8232 - RNA, 1800 nt, unidentified
  source 1..1800: mol_type = other RNA; note = synthetic construct
atgtcagagctgtatcagctgcaaaaagctacatctctgcacgatctcgccgccatcctgaactacacacctagcgctctgagttatcttgtctacaagaggccgggcaagtatacgaagttcacgatacctaagtccaatgggtcccctagacagatctgcgctccttgtgacgaactgaaggctcttcagaaacaggttaaaactctgctcgacaaatgtcttgcgaccatcgaatccacagggaaagcacgtggtgccatttctcacggtttcaaggccggtcactcaattatcaccaatgccgagacacacaagaagcggcggtacgtgttcaacgtggatctcgaaggattttttgattctattcacatgggcagaattagggggtttcttatcaacaataaggacttccagttgaatccaaaggtggctactgtgctggcacagatcatgtgtcatgatgataagctcccacaaggaagccccacttcccccgtggcgtctaacttgatcggccatcttcttgatctgagactcgtgcaactggccaagcgtaatggctgcagttatagcaggtatgccgacgacttaaccttctccacaaacaagaaaaatttccccgaagagatagcaagctcagatgaaggcggtaattcatgggcagcagggcctagcctgactaaaattattcagaagtctggtttcgaactcaatcatagtaagacccggatgcagtaccgcaccaaccgccaatccgtcacaggactcgtggttaaccaggtcacgaacaccccagccgaggttagaaggacagcccgagcaatggccttccacttgttcaacaagggatactatttgattaagaacgaggtcgtaggcgaggagaaagcgacagctccgatgatccgggactatacacagctggcctcgctcgatggattattcagctttatatacatggtggatcaattcaatcgcaagaagctggtgaaaaattccaccgttaagatcgagagcattaagaagacagctctggagatcattcatggcgacttcctattctacaaaaacttctatgctagtcccacccccactatcatgtgtgagggaaaaaccgacaacatttacctagcttgcgcaatgaagtccctgatggaaaggtttccaagactttgcaaacccaataaagatggcaaaccggctctgcgcgttcgctttatcaactactcagaactcacacaccgggcgctagggttgaatggcggcagtgcggacttggcagcatttatcagatcatacgctaaaaactgcgggaaatataaagcccaccctcccctgagccctactataatagtcgtggacaatgactcaggatctgacccaatctttaaggccatcaaggatgtaaccgggaaccgatatgtaatagctaatgggaagggaactattctcgataaaagtcaaaccacgtactacattgcccagaatctggccgtcgtgttgactccactgaagaaggacggcaaacctaccatgatggaggacttttttccagcaaaagtgctgcagaccccttggaacaacaagacgtttgaaattttaaccaagtctcccaacaagaatacttacagcaagaacactttcgcccagaaaattgtcaaagccgatcgggcaaacatcgagtttaagggtttttcgccaatactaaagagtatctcccagatcattcgatgttatcatgtggacaaatccttaatcgacaaatctctgaggcccaaaagcatcaatgcccagtga

SEQ ID NO: 8233 - RNA, 1797 nt, unidentified
  source 1..1797: mol_type = other RNA; note = synthetic construct
atgagtgaactccatcagctgcgaaaagctacttcgcttcacgacctggctgctattttaaattacacaccttcagctcttagttatctagtatataagaggccggcaaaatacacccagttttcaattccaaaatcaaacggttctactcggcaaatatgcgctccctgcgacgaactcaaggcactgcagagaagggtgaagatactgttggatgagtgtctagccaccatcgagaattcatccttggcgcggggagccataagccatggttttaagcaggggcactcgattatcaccaatgccgaaactcacaagaagagacgctatgtttttaacgtagatcttaagggcttttttgacagcatccacatgggacgtgtaaggggctacctcatctccaacaatgatttcaaattgaatccaaacgtggctactgtcatggcgcagattatgtgtcatgataataaactgccacagggtagccctacaagtcctgtggtttccaatcttataggccaccttctcgacttacgcctggtgcagctggcaaagagaaacggatgctcatacagccgttatgccgatgacctcaccttttccacaaacaagaaaacattcccaaaggaaatcgcattgtctgatgagaacgataattcttgggcagccggtccagcgctcacgaaagtgattcaaaagagcggcttcgaactgaaccatgataaaacccggatgcaatatcgcaccaatcgccaatccgtcaccgggttagtcgtcaaccagataactaacactccagctgaagtgcgccggactgccagggcaatggcattccatctgttcaataagggacactacctcattaagggcgaggccacaggggcggagaaagctaaagccttggaggtgaaagactatacgcagctagcatctctggatggcctcttctccttcatctacatggttaacaacttcaacagaaaaaagatcgtggagaattctagcatcaagatcgaatcctttaagaagacatccctggaaatgatacacggcgacttcctcttctataagaacttctacgcttcacccctgcctacaataatgtgtgagggaaagaccgacaacatttacctgacctgtgccatgaaatctctgattgataaattcccccagctctgcaaattgaataaagatgggaagcctgctctgaaagttaggttcatcaattactccgagctaactcaccgagtgttagacctgaacggcggaagtgctgaccttgccgcctttattaggacgtatgcaaagaattgcggcaagtacaaggcccaccccccactgaaccccacaatcatcgtggtggacaatgacagtgggtccgatccgatttttaaagccattaaggacgtgaccgggaaccggtactctatccccaatggtaagggcgccatcctcgataaaaccaagacaacatactatatcgctcagaatctttctgtcgtcctgacccctctgagaaaagacggacaacctacgatgatggaagatttttttcccgccaatgtgctgaaggccgtgtgggacaacaagactttcgagattctgagtaagagccctagcaagaacacatacaacaaaaataccttcgcccagagaatcgttaaggcggaccggcctaatatcgagtttaaacgttttgcacccattctgcgaagcattagcgaggttatcgaggggtatcatgtcgagaaaagcgtaatcgaacagaacttgcccccaaagccggccaaaccctga

SEQ ID NO: 8234 - RNA, 1791 nt, unidentified
  source 1..1791: mol_type = other RNA; note = synthetic construct
atgagcaagctacaccagctccagaaggccacttctctccacgatctcgccgccatcctgaattacaccccctccgcactgtcatatcttgtgtacaagcggcctggcaagtatacacagtttagtattccgaagtccaatggctctccaaggttgattagcgccccttgtgacgagttgaaagccttgcagaagcaagttaaggtcctgctagacgaatgccttgctacaattgagaaggttggagctgaacgaggggccatctcccacggattcaaagatggctattcaattgtcacaaacgccgaggtgcacaaaaaacgcagattcgtgttcaatgtagacctgcagggattttttgactctatccatggcggacgcgtacgtgggttcctgatatctaacaaggacttcaagctccatcctaaagtagccaccgtgcttgcacagataatgtgtcatgacgacaaacttcctcaagggtcgccaacttcccccgtggcctccaatctgataggacacctgctggacttacggctggttcaactgagtaagaagaatgggtgcagctactcgcgttacgccgatgatctaactttctcgaccaacaaaaagattttcccagctgagattgccagcagcgataacggctccaatccatgggtggcaggaccagcgctcgcgaaaatcattaagaagtcaggtttcaaactgaaccatgataagactcgcatgcagtacaggactaatcggcaaagcgtcaccggattgaccgtcaaccagatcaccaatacacccgtggaggtccgcagaactgtgcgcgcaatggctcactgtctctttaacaatggcttttactttgtgaaggataaggccagtgtgagtgacaagaaaaacaaacccgaaatcaaggatcacacacaattggagaagatcgacggctatttttcttacatctacatggtcgatcagttcaatcggaagaaaatagttgataactcatccgtgaagatcgaaagcataaagaaggctgctctcgagaagattcacggtgattttctcttctacaaaaacttctacgcatcatcacagcccacgattctgtgcgagggcaaaacagacaatgtgtatctgacttgtgcaatgaaaagtctcatggacagatttcccagactttgcaaaccaaataaggacggcaatcctgcactgagggtaaggtttatcaactattctgaattaacccatcgagtccttgacctcaacgggggatcagctgatttagcggcttttattcggttctatgccaaaaactgcgctaaatacaaagcccacccgcctttacatcctacgatcattgtggtggataatgactctggtagtgacccaatctttaaagcaatcaaagaatctacaggctccagatacagcattgccaacggtaaaggtaccgtgctggataagagccagacaatatactatatcgctcagaacctgtatgttgttctgacccccttgaagggggggcagcctactatgatggaggacttttttcccagctccacgcttcagaaagtgtgggaggggaaaaccttcgaagttttgtccaaacccagcaagaccacatataacaagaatacgttcgctcaacgaatcgtgaaagccaatcggaccgatatcgaattcaagaggttcgcaccagtcctgaggtctattagtgaggcgattaaggactatccgagaatcaaaaagtccgtcatcgagcagaacctggcactgaagagcaaggcctga

SEQ ID NO: 8235 - RNA, 1764 nt, unidentified
  source 1..1764: mol_type = other RNA; note = synthetic construct
atgtccactctgcacaagctccagcaggcctcatctctccatgatctcgctgccatcctaaattattctccctccagccttgcttacttgatctacaagaaaccagtgaaatacaaacagtttgagattccgaagtctaatgggtcacctagagtgatcaacgcgccttgcgacgagctgaaggccctgcagagaaaaatcaagctcctgctcgacaaatgtcttgatgccatagaacaggctcaaggcgtgcgtggtagcattagtcacggtttccggcggggtcactctatcgtgagcaacgctgacgttcataagcgcagaacgtacgtctttaacgtggaccttgaggggttctttgacagtatccacatcggaaggatccgcggctttcttattaccaacaatgattttcgcctccatcctaatgtagcaactgttctggcgcaaattatttgtcacgatgataagctgccccagggctctccaacctccccgttagcgtccaacctgatcggccatttgctggatctgcgattaatacagctcgcaaagaagacgggctgctcatactctcgttacgcagacgatttaaccttcagttccaataaatctgagtttccagccgaggtgagctacaagatcgatgatgggcacacctggattcccggctcctcacttctaaaggttatatataagtgcggctttaaactcaatcacaataaaaccaggatgcagtatgctcgcggcaggcagagcgttactggattgactgtgaatcaaactcccaacacaagtgctgaattgaggagggccgtccgggcaatgacccatagcctgttcctagatggacagtaccatactataaaacagccaggggacaacgatgactcagagaagattaccaagtcttacacccaactggctcccctggaaggatatttctcatatatctacatggtggacaacttcaacaggaaaaagatcattgagaactcctctactaagatggaaaacatcccaaaaacagcgctagaaaatttgcacggagactttctgttttatcgatacttctatgccaatagcaagcctaccatagtgtgcgagggcaaaacagacaacatctatctcacatgtgcaatcaagtccttaatggggagtttccctagactgtgcaaatccaacaaagaaggtaaggcaaacctgaaagtccgcttcattaattacagcgaattgacgcaccgcatgctggggctgaatggtggctccgccgatctggccgccttaataagagcctatgctaagaaatgtgccccctacaaagcacaccctccccttcatcctacaatcattgtggtcgataatgacgccggaagcgacccaatttttcgagccataaaggacacaacagggaatcgttacgctattcctaaagggaagggcacggtactcgaccagtcgaagaccctgtattatattgctcagaatctgtacgtcgtgcttacccccctgaagaaggacgggggaccaacaatgatggagaattttttcacaaccaaactcttggccagtcggtgggagggaaaagagttcgaagtcttcaacaagaactcgccgagcggcacctatagcaaacagatttttgcacaacggatcgtgaagagtgatcaggccaacattgacttccggaagttcaagccaattctgtcatcgatcactgaggcaatcagacattaccccgctatcaaagtacctaaaaagtga

SEQ ID NO: 8236 - RNA, 1755 nt, unidentified
  source 1..1755: mol_type = other RNA; note = synthetic construct
atgcccactctgaaaaaacttaagagtctgacatccctccatgatctcgccgcaatgctgaactacaccccaacagccctgtcctacttggtctataagcggacgggaaaatataccagcttccagataccaaaatcaaacggctctccgcgagaaattttagccccctgcgatgagctaaaagccctgcagaggaaggttaagtctctcttggatgactgtctggattccatagaaaaatcaaagcctctgatcggctctctgtcccacggattcaagagcgggcattctattatctctaacgcagaaccacacaccaaaagattgtacgtatttaacgtggacatcaagggattctttgacgcaattcacatggggagagtgagggggttcctaattaccaatagagacttctcgctgaatcccaaaatagctacagtcctcgcgcagattatatgtcacgacgataaactaccacagggatcccccacctcaccagtggcttccaatttaatcgggcacctgattgatattcgcttggtgcagctcgctaagcgttcaggctgtacttactcccgttacgctgacgatattacattctccacaaataagagcgagttccctgcacccatcgcgtatagaatggatgatacccatagctggattcctggggactctttgctgaaaattattcaccgatgcggatttgagttgaatcacgacaagactagaatgcagtatgcacgggagagacaatccgtaacggggcttaccgtcaacaagacctcaagtgcccctgccgagtttcgaagaaccatccgggctatgacacacaaactttttatggacggtgactatttcatccccgatgaaccaaagcatcagtcgagcagtcgggtggagcttaattacactcaactgaaccggctcgagggaatgcacagttatctgcatatgatcagcaggttccaccgacaaaaaatcgtcgataataccgtgaggcgtcccgaagatatcccactcacggccatggagaagatgcatggcgacttccttttctacaagtatttttacgcctccgagctgcctactatagtgtgtgaggggaagacagacaacgtttacctgacttgcgctattaagagccttcatgccaaatacccccgcctagccaaacctgactctaagggcgttatgaggcttaggattcggtttctcaactattcaaacctgactcaccgggtcatgggcctgaatggtggctctgctgatttgggccacctcattcgcaggtacgcgaaacagtgcgcacgctataaggggcatccgcccttaaagccaactatcatagtcgtggacaatgattctggaagccaacccatcttccaagctatccgcgacacaacaggtgacaggtacctgacacctagtggtaagggcaagaccttcgacaagagcaaaacggtgtattacatcgcccagaatctgtacgttgtcttaactcctctcatcaaaggtggcgatagtatgatggaaaacttttttcctccggccgtgctcaataccatctacaacggaaagaaattcgaagtggtgcacaaaggtccgaaaggctccgcatacagcaaacatcagtttgctcagtatgtggtaaagccaaaccagaagaagattgtttttagccgctttagctcgatcctgaagtcaatcaacagtgccataaaagactatcccctgatcaagatcaccccttga

SEQ ID NO: 8237 - RNA, 1743 nt, unidentified
  source 1..1743: mol_type = other RNA; note = synthetic construct
atgtccacgctgcacagactgcagaaggccgccaccctgcacgacttagcaattatctttaactatactccggcgtccctggcttacctgatctacaagaagaccaataagtataccgaattcgacatccctaagagcaatgggagcaaaagacgaataatggccccctgcgatgaattgaaaacactgcagcggaaaattaagaaggcacttgacgaatgtctcgagtctattgagaaaaaggcacctagccctggccctatatcacacggattcaagaagggacattcaattgcttctaacgctgacccccataaaaaacgcttgtacgtgttcaacattgatatccaggatttcttcggcacaattcatatgggcaggatcagaggcttcctgataagtaaccgggaatttaatttccacccaaagatagcaactataatcgcccagatcatctgccacgacaataaacttccccaagggtcccccacttcacctatcgccagcaacctgatcggccacctgatcgacctgaggctggtacagctcgcgaagaagacgggatgtacatacagtcgctatgcagacgacctcactttttcgactaacaaaccaaagtttccgaaggaaatcgcctatcgtctcgaggagacacaaagctggattcctggaactccactgttaaagatcatgcataaatcgggtttctctctcaaccacgagaaaacgagaatgcaatacgcctgttcccagcaggccgtgacaggcctcgtcgtgaaccagaaggctaacaccccagccatctttagaaggaatgtgagggctatgactcacaagctgtttctggacggggactacttcatccatgagaatcataaaaccaaagaaaagaaggagctcacttataagaacctgaatcagctcgagggaatgttttcatacatctacatgattgatcgcttcaaccgcgagaagatcgttaataattccaataagaggcacgaggactttcccaagaccgccattgagcggctgcatggcgattttctattttaccggtatttctatgcctctccccagccgacaatcatctgtgaaggcaaaacagataacgtgtatctaacatgcgcaattaaggctcttcacgttaatttccctcgacttgctaaaaccgaccccgagggaaaacttaagctgcgagtgcgctttctcaaatacagtaatctaacccaccatgttatggggttgtctggaggaactcccgacattggtcatttcattaggaattacgcgaagcagtgcgccaagtataaggcacatccccctttgcacccaaccattatcgtcgtcgataacgataaagggtctgatacaatattcaaggctattaaagacgtcactgggaccacctatagcatcccagcgggtaaaggcaccaccttagataaaagcaaaaccctgtacaagattgcacaaaatctttacgtggtcttgacaccactctccggtgggaacgacacaatgatggaagatttctttcaccggagtgtattatccatgccatacgaggggaagaactttgaagtgtttagaaaaggtccgccaggcaccacatacaataagaacacgtttgctctacacatcgtgaaagccaatcagaaaacgataaacttcagcaaattctcacccattctgaaaagtatcaacctggccatacgtgattatcctaagattaagttgtga

SEQ ID NO: 8238 - RNA, 1731 nt, unidentified
  source 1..1731: mol_type = other RNA; note = synthetic construct
atgccccgattaagagcactacagaaagccacaaccctgcacgatctagcggtgatactcaattactccccgactgcacttgcctaccttttatacaaaaagacgggcaagtacagcagattccagattcctaagaaaaatggcaccccacgtgaaattctggccccctgcgacgaactgaaaagtttgcagcgcaagctaaaaaaactgttggacgaatgtcttgagagcatagagaagaaacggtcccctttggggagtttgagccatggatttaaggccaatcactctatcatcacaaatgccgagccgcatagaaagcggctttacgtctttaatgtggacataaaagggttctttgattcaatacacatggggcggatcagaggcttcttcatttctaacaaggatttcaacctcaataccaagactgccacgatcctggctcagattatctgtcacgacgataagctcccacaagggtccccagctagtccagtggcctcaaatctgattggccacctgatcgatatccgtatggtccaactcgctaaacggctgggttgcacatattccaggtacgcagacgatataactttctctacaaacaagagcgagtttcctccggaaattgcttacaggctggaaaattcacatgattggatacctggcggagcgctcctgaaggtgatttataaatccggtttcggattaaaccacgaaaaaacccgcatgcagtatgcccgcgcacaacaaactgtaacagggttggtagtcaaccagagcaccaataccccggctgagtttaggagaaaggttagggccatgacccacaaactgttcatggacggcgagtattatgtgcatgaagagaacggcccccggtccccaaagaagaccgagcttaatcactccaagctgaacaagctggagggcatgtacagttacatctatatgactgactgtttcaacaggaaaaagattatcgagaacagcaacagacgccacgaggattttcccctgtcatcactggaaaagctccatggcgacttccttttttataagaacttttacgcctctccagcacccactataatctgcgagggaaaaacagacaatatttatttgacctgtgccatcaaatcgttacacgaaaagtttcctcgcctcgctaagcctgacgcatctgggaaggtgaagcttaaagtgcgattcatcaattacagtgagctgacccatagggtcatgggcctcaatggcgggtcatcagacctgggtcatctgattaggcgatacgctaagcaatgcggaagctataaagcgcaccccccattgaatcccactatcatcgttgtagataacgacagtggttcccagcctattttccaggccatcaaggacgttacgggcgatcggtacagcattccatctgggaagggaaaaatcttcgataagtcccagacactctataaagtggctcagaatctgtacgtggttctgacacctctcctgaacggtaaagactctatgatggaggatttttttccccccgctgtgctacgtgcgacatataacgggaaaagttttgaagccgtctctccaggacctaagggaactacctactcgaaacaccagttcagccagcatgtcgtgaagcccaaccagaagatcattaacttttcccgcttcagccatattctgaaaagcatcaacctcgcaatcagagactga

SEQ ID NO: 8239 - RNA, 1308 nt, unidentified
  source 1..1308: mol_type = other RNA; note = synthetic construct
atgtgtcatgacaatgcactgccacaagggtcccctaccagtccattcgcctcaaatctgattggccacctcatagatattaggatggtggccctcgcagccaagaatggatgcacttacagccgttatgcagacgacatcacattcagcacaagcaagaaaaacttccccacccaaattgcttattgcatcgatgagtcgaacacatggatccctggaagtgcagtgcttaagattatctctaaatgtgggttctctctgaaccatgataagaccagaatgcagtataccagctctcagcagtccgttaccgggttggtggtaaataaaatcgcgcacactcctgctgattacagaaggacagtccgggccatgctccaccggcttttcctggatggtacgtactttactatcaagaagcccaaacatctgaataagaccgaaagaatcaccatcccgttcgggcagttaaacaagctggagggtatgctctcatacatatacatggtggatcgctataatcgcgagaagatagtgaacaacagtaagacgaaacatgaagaaatgctgatgacctcaatcgaaaagatgcacggggatttcctgttttataagtacttttacgccggggacacccccacaattgtttgcgaaggcaaaacagataacgtctacctgacctgtgctatgaaatccctgtttgctaaatatccagagctcgtctctgtggacaaggatggcaaaagaattcttaagtccaggttcattaactacagtgagttgactcaccgaatgctgaacatgtttggtggctcagcagacattgcccaattcatccggttctacgctcgccgttgcaagaagtataaagctcatcccccactacaccccactatcgtagtggtggataacgacactggatctaaggagatctttggtgcaatcaaagacacaacgggcggccgatatataattggagctgggaaggcgcaggccctagacaaaagccggaccctgtactatattgcacagaatctctacgtcgtgctgacacccttgaatgccggcaaagacaccatgatggaggactttttccctactactgttctcacaatgcctcataaaggaaggtctttcgagatattaaagggcgtcaaaccaggaaacacgtattccaaacacatttttgctcagcacatcatcaaggccaatcagaagtccattgattttagcggctttagccctatattggactcgatgaaagccgcccttctggactacccaaagatcaagttaattccggcgtga

SEQ ID NO: 8240 - RNA, 1752 nt, unidentified
  source 1..1752: mol_type = other RNA; note = synthetic construct
atgagcgaactgagaaagttacaaaaggcagctacactccacgatctggctgtcatcttgaattacgagcctaagtttctcgcttacctcatctataagaagaccaacaaatatagccagtttaccattccaaagagcagcggtgcccccaggaacatttccgccccttgcgatgaactgaaggcactgcagcgaaaggtgaaagtgctgctggatagttgcttagagacaattgcattgcaggtgccaaatctcgctaccctttcccacgggttcaaaaaggaccattccatcattactaatgccgacaaacatcgcaaaaagctctatgtcttgaatatcgatatccaggactttttcgggagtattcacgtcgggcggcttcgcggattcttcataaccaatcgatcatttagcctgcagccaaaaatcgccacaatcctgtctcagatcatgtgtcatgaggataaactacctcagggctctcccaccagccctgtagcgagcaacttaatagggcatttgctagacgttcgtatggtttcactggcctctaaaaacgggtgcgtgtatagtagatacgcagatgacatcaccttctctactaacaaactgaaattcccacagtctattgcgtacaagatcgatgacacgcacgattggataccgggatcagacctgctgaagatcatcagtaaatccggctttggactgaaccacaataaaactagaatgcagtacaaccgtgcacagcagacggtaactggccttatagtgaattcgatcacccatactcctgccaattttaggcggacggtgcgggctatggctcataaactattcctcgatggcgattactatgtgcaagaaaagcccaagcaccttaagaaggaaaagattagtatccctcgcggccagcttaagaaactcgagggaatgttctcgtacatctatatggtggataatttcaaccgggccaaaattgtctctaactcaagcaaaaagcaagaagagttttcactaagaagcatagagaggatccacggcgactttctgttttacaaaaacttctacggcgcttccgctcccacaattatctgtgaggggaaaacagacaatgtttatttgacttgtgccatcaaatcactgcacgcgaaattccccgagctcgcctccctcacaaaagaaggcaagaccaggctgaatctccggttcattaattactccaaccttacccatcgagttctgggactgaacggtgggtctgccgacattgggctttttattagaaattacgctcgccaatgcggcaagtataaagcccaccccccgctgaatcctactatagtgatagtcgacaacgactcaggatccaagccaatttttagtgcaatcaaggatgtgaccggtagcacatacgcgatcccgaagggtaagggcaccgtcctggacacctccaagaccctctataagattgcccaaaacctgtatgttattttgacacccaaaatcggtggcaaggatagtatgatggaacatttctttcctgccgccacccttgcaactcagtacaagggaaagacgttcgaggtggtaaggtccggacccccatctacaacttacagcaaacacgtgtttgcccagaatatcatcaaggctaaccagaaaaacatagacttctcggggttcgaggcaatattgggctctattaagttagccctggacgactatcccaagattattacaccatga

SEQ ID NO: 8241 - RNA, 1743 nt, unidentified
  source 1..1743: mol_type = other RNA; note = synthetic construct
atgctgagcctgtacgccctgcagaaagcaaaagacttgcacgacgtggctagtatcctcggatatgagccaaagttcctcagctatattgtctacaagaagaacccaaaatacacctactttacgatacctaaatcaaccggagctccacgcaatatcgctgccccctgtgacgaactgaagactctccagaagaaggtgaaacagctgctggaaaactgcctagtatctattcaactacagggaaccgcccaaggctctctcgcacatggattcaagaagggccactcaattatcaccaacgcagagccccataagagacgacgatttgtgttcaacatcgacatctctaatttctttggttccattcatgttggaaggatccgaggcttcttgattagtaacaactcctttaagctcgaacccaaagtagccactatccttgcccaaatcatgtgtcataacgacgcactaccccagggagctccaacatctcctatcgcatcaaacctgatcggacaccttatcgatatccggttagtgaacctggccgcgaagtatgggtgcatctattcacgctacgccgatgatattacattttcgacaaataagcgcgaatttcccgaacagatcgccagtaatatagaaaaggatgagtggattcccggcacttcactcctgaaagctattcacaagtgtgggttttctctcaaccacaataaaacacggatgcagtattgcgaaaatcaacagaccgtgaccggcttggtggtgaacaaaactctgaatgcacctgcgacctacagacggcaagtcagggccatcctgcacaaattgttcctggaggggaagtatcacctgaaggacaagcctacagaaaaaaaccattccaacatcagcatttacgattacaagaagcttgagaatatcgagggtatgcttagctacttgtacatgatagatagcttcaagagaaagaagttgagcctgaattccaagatccgttgtgaggacatggaacggactagtctcgaagagctccacggggacttcctgttctacaaatacttttacgccaacaacaaaccgaccattatttgcgagggtaaaacagacaatatttatttgggttgtgccatgaagtccctctggaaaaagtttaaaaggttagctaaagaggaggacggcgacattaagctcaaggtcaacttcatcaactatacggagcttacgcatagggtacttgacttatacgggggtactgcggacataagcaatttaatccgtcactacgccaaacggtgcgcaaaatataaagcgcatcctcccctgaaaccaactatcatagttgttgacaatgatagcggcagtgataagatattcaaggccataaaggagacaacagggaaacagtatataatcacaaagggcaaggagactctgcttgataaaagcaggtcgatttactatatagcccagaacctgtatgtggtgctgacacctctgaaaaatggcaacgatacgatgatggaggactttttttccaaatctactctgaagaccaaggttgatgggagattctttgaagtctataagaaatctaccaccggcacatataataagaataccttcgctcagaaagtgattaaggctcagcgcaagagaaaaattttcaatgctttcaccccaattctagcatccatcaccgccgctattgtcgattactccaaactgaagccgtga

SEQ ID NO: 8242 - RNA, 1743 nt, unidentified
  source 1..1743: mol_type = other RNA; note = synthetic construct
atgagtttgcatgtcctacaaaaggccaaggatctgcatgatctggctagaatcctgaactacgaaccaaaggcactcagttacgttctctatgtgaaaaagccccaatatactagctttaccatccctaaatcatctggcgccccccgacatatcagtgcaccttgtgatgagcttaaaacactgcagcgtaaagttaagcgcctcctcgattcctgtattgcatcaattgagctccagggacctgccaaaggtgccctcgcgcatgggtttaagaagggacactcgatcataaccaatgcagagcctcacaaacgcaggcggtttgtcttcaacatcgacatcactgatttctttggtagcatccacgtagggcgagtgagaggattcctgataacaaacaaatcctttcagctggcccctaaggtagccaccatcctggcccagatcatgtgccacgaaaactcattaccccagggcgctcccacatccccaattgcttccaatctgataggccacctaattgacatccggctggtcagtttagcggccaaactagggtgcatatattcgcggtacgcggatgacatcaccttttctacgaataaaaaagacttcccatctagcatcgccattgaggtagacgaaaatgagtgggtacctggcaccactttgttgaagataatatacaagtgtggcttcagcttgaatcacaagaaaacgcgtatgcaatactctgacaatcagcagactgtcaccggtcttgtcgtgaacaaaagcattaatgcaccagctcagtataggagacaagtgcgcgctatgctccataaattattccttgacggcaattatcacagaaaggacgagccccgatataaagctcacgctaattccacgatctacgaccacaagtctctcgaacccctggagggcatgttaagctacctctacatgattaacaacttcaaaatggacaagttgtctaagaacggcaagattcgcaaagaagatattaaaaggacttccttggaggacctgcacggagactttctcttctacaagaatttctatgccaacaagaagatcacaatactgtgcgaaggcaaaacagataatgtgtatcttagttgtgcaatcaagtcactgcataaaaagttcattcggcttgcgaaaacaaccgggggaaaggtggagctgaaaaccaattttatcaactactcaaagctgacacatcgcgttctggatctcaatggcggtacagcagacatcgccaacctgattcggagctacgcaaaaagatgcgggaagttcaaggcccatcctccatcccagcccactattattgtggtggataacgactccggttcagacccgatattcaaggccatcaaagatactaccgggaaaaggtacgaaatcgctaatggtagaggaacgagctttgacaagtccaggcccgtttactatgtcgctcagaacctgtatgtggtgttgacaccactgcggaacggacaggataccatgatggaggactttttcagtaagaacatcctgaagaccaagctggatgggaggagctttgaagtctacaagaaaggactaccgggcaaaacttatagtaagcacaccttttcacaaaaggtgattaaggcccagcagaagaggaaaattttcaacgggtttgtgccgatccttagctctatttccgctgccgtggttgatttctctaagcttaaaccatga

SEQ ID NO: 8243 - RNA, 1761 nt, unidentified
  source 1..1761: mol_type = other RNA; note = synthetic construct
atgttatcactcaatgctctccagacagcacagacgttgcacgacctggctcacatactgaactatgagccaaagttcttgtcctacattctgtataagaagcccgtcaaatactcccacttcactatccctaagtcatctggcgcccctagggacattgctgagccgtgtgaagaactaaaggccctacaaagaaaagttaaggaactgctggaagtctgcttaaagacaattaataaccagaagccccaatacgggtcactgtcacacggcttcaagaaggaccattctattatcacgaatgcctatccacatcgcaagaagcgttttgtgtttaacgtcgatatcagtgattttttcggaagtatccatgtcggccgcgttcgcggattcttcattacaaatagggacttcaggctgagtccaaaagtagccaccattttggcccagataatttgccatgaagatgctctgccccaaggtgcacctacaagccccatcactagcgatctgatcggccatctgatcgacatccggctcgttgaaatcgctgagcgatacaagtgtgtgtactcacgttacgctgacgacatcacgtttagttcaaatgagaagaactttcctagcgcgatcgcctttcccgtggagggtaccacagactgggtacccggtcgggccctactcaaggccatccacaagtgcggattcggcctaaatcacaacaaaactcgcatgctctatagagaaagccagcaaaccgtcacggggctggtggtaaaccagaaagtgaacccacccgcgacatacagacggcagattagagcagcactccataagctttttctggatgggcagtatttcctgcaggagaagccaaggcactcgagttctagcaaggtggatctgggaatcgactcccttgagaaaattgaaggcatgctcagctatgtgtatatggtggataaattcaacagaagcctcaccgttgagacatctaagagcaaaaaggaggaagaaatacctaaaacatcccttgagaagttacacggcgattttctcttctacaagtatttctacgcggcatctaagccaactataatttgtgagggcaaaaccgacaatgtgtatttaacctgtgctatcaagtccctgtacaagaactacccggagttggcaaaagtctctaacgacgaactgaaactcaacgtaaagttcatcaattactccgatttaactcaccgggttatgggacttaacggggggactggtgatattgctaatctgattcgagcctatgccaaacaatgcggaaagtacaaggctcaccctcccctgcacccaaccattgtggtgcttgataatgactctgggagccagcaaatccttaatgccgtgaaagatctcaccacccctaggtacgatgtgcccaatggcaaaggaaccaaactggacactactcaggacttttataagatagcccagaacttgtacatggtgcttacacctttggataagggcaagtccacaatgatggagaacttctttccaactaaggtgttgaatacaatctacaaggggaaaacctttgagatactgaaaaagtcccccccagaccagacctattccaaacatatttttgcccagcatatcgttaaagcagagcagaaaaaaattgatttcgtcggtttttcgccgattctggacagtatcaccaaagcgatcaaagactatccgaccataactctgcctaaaatcaaatga

SEQ ID NO: 8244 - RNA, 1749 nt, unidentified
  source 1..1749: mol_type = other RNA; note = synthetic construct
atgagtaaactgaacatactgaaaaacgccaagaccttaagcgatttagctcacttgttgaactataagccgaagtatctctcctacatcatatacaagaaacagaacctttaccaccagttcaccatccccaaatcatctggagcccctagaaccattctggccccatgtgacgaacttaaagccctgcagaagaaagtctccgagctcctgcaagattgtctagaaaatatgaaccaggacttacagattcacagcagcctgtcccatggctttatgaggggacactctataatgactaatgcagacaatcaccgcaagaaacgttttgtgtttaacatcgatatccaggattttttcgggagcatccatcttgggcgggtaagaggcttttttatcaacaataagtccttccagcttgaccctaaggtggcgactgtgctcgcgcagatcgcttgttataataactcactgccacaaggaagcccttgctccccagtggtgtctaatctgatcggccacctgatcgacattcggctcgtaagtattgcaaaaaaagccggctgccagtatagccggtacgcagacgatattactttttctacaaacaagaccagctttccctccactatcgcaattcaagatgagacaacaggtaattggtctgtttctgagcaactggcgaagattattaagaagtgtggtttctctctcaataccaccaagacccgcatgacctaccgcaagtcccagcagactgttacaggcctggtagtgaaccagaaggtgcatacatcggctagttatcgaaagcaggctcgggccatggcccataaattgtttaatgacgggagtttcagcatccctgacaaagccagtcttgcggcaaaggagaactcccccaagatgattgccgggaccctgaatcagttggagggcatcttcagccatatctacatggtggaccaatttaataggaacaagttgaggggtaataatggcatcagaggggaagatctggaactaactgccattgagaagacacaccgtgactttttgttcttcaaacacttctattccacctcgctgccaaccatcatttgcgaaggcaagaccgataatgtgtacatacagtgcgcaataaggtcactggccacccaataccctgagctcgccacgatagatgcccaaggcaaacggatcttaaaagtcagattcatcaactactcagaactaacccatcgagtgctcgatttgaacggaggcactgccgatatagctcgcctcatttgtggatacgtccacctgtgcggaaagtatcataacacagccccaaagcaccccacaattgtcctcattgataacgatcagggcagccagtcaatcttttctgccataaagtcaacgactaaggatactcacacggcagggacagggaagaataaacagatcgacagaagcaaaaacttctactacatcgctcagaacctgtatgtggttgcaacaccgctgatcaatggaaaagactccatgatggaggatttctttaagaatgctacgctggcaaccctggttgacaagaagacattcagtgtccgaactcccacagctcccactggttcaacctatggtaaacacattttcgctcaaaaggttgtcaaagctaacagggacaaaattgacttctccgactttagtccaatcctcgactctcttaaaagcgtgattcagcatttcaaacttccttga

SEQ ID NO: 8245 - RNA, 1734 nt, unidentified
  source 1..1734: mol_type = other RNA; note = synthetic construct
atgagcaagctggctatccttagatccgcccagggccttcacgacttggccgaactactcgcctacgagccaaagaagctttcttacgtgatctataagatgcccaacaggtatacaaaattcaccatccctaaaagctccggggggaccagatcaatagctgctccacgggaggagctcaaggcactgcaggttaaggtgtctaagttactgcagctttgtatccataacatgaatgctgacctcaatatcactacttccttgagccacggttttacgaaaggtcactctattatgacaaatgctgacttgcaccggaagaagcgctatgtcttcaacattgacatagaaaacttctttggatctatccatagagggcgcgtgttcggtttcctgactaaaaacaagagcttcagtctaaatccaaaggtcgcacgagcgctggctcagatcgcttgtcacgatgatgcacttcctcagggggcgccttcgagccctgtttttagcaacctgattgggcatctgatcgacgtgagattggtggagttagccagcaagctaggatgcagttacagcaggtatgccgatgacatcacgttttctacaaacaaaaagaccttccccaaagagatagctctggtgtcgccgtcaaacgaatgggtggccagccccacgctgattaagatcgtgtccaagtgtggatttgccctgaacgaaaataagactcggatgcaataccaggaatctaggcagagcgttaccggcctcaccgtcaatcgcaaaataaacagtccggctgtgtatcgccaccaggcgcgtgctatggcccactcactgtttaacacaggcagtttctcagtgcctgacaaggatccaaaagtcaaagccaagattccaggaaccattaatcagctcggcggcatgctgtcctacatctatatggtgaacactttcaatcggtccaagattgtggagaattccgcaattagggatgaggacattaaactgtctgctatggagaaggtccatgcagactttgccttttacaaacatttctacggcaaccagaagattacaattctgtgtgaaggaaaaaccgacaatatatatctgcagtgcgcgatcaagagtttggccaaaaagtacaccatcctcgcaaagctcaacgccgatggaaaagccgttctcaacgttaacttcttcaaatataccgacctgacacataggctcttggggttatacggtggaacaggtgatatcggggaacttattaagcgttacgtgtcatgctgcggcaagtacaaaaatcaccctttcaaacaccccacaataatcgtagttgacaatgacgagggttcccagaaaatctttactgcactcaaagtcgtcaccggcaataaatacatgattggatccggcaaagcgcaaaacctggataagtcactggatttctattatgttgcccaaaatctatacgtagtgtttactccccttaagatgagtggcgatgatactatgatggaggactttttcaccagtgacacactgaacaccatcgtggatgggcagagattcagcgtagtccataaggcacccaatcagctggtgtactccaagcacaccttttcacagaaggtagtgaaggcaaaccaaaaaacgatcaattttttgggctttacaccagtcctggatcgaattcaaaaagccgccaaacatttctattctttaccctga

SEQ ID NO: 8246 - RNA, 1767 nt, unidentified
  source 1..1767: mol_type = other RNA; note = synthetic construct
atgattaaacttaagcttctccaatctgccgccacactgagggatctaagtatcgcacttggatttcaacccaaagccgtgtccttcatcctgtacaaatactcaaaagaacggctgtacaccagtttcacaattcctaaaaagagtggcgcactccgcgatatccatgcaccgtgcgcggaactgaagaacttgcagtcaagagtgagcgagtacctccaggattgtatccaggagatcaacgaaagtaagaagattacccagacgttgagccatggctttaagagaggatattccatcgtaaccaatgcctcaacccacaggaagagacgcctcgtgctcaacgttgatctcgaggacttcttcgggagcatcaatttcgggagagtacgtgggttttttatcacgaacaaaaacttctctctcaaccccaatgttgcaaccgttctggctcagattatttgtttcgacaacaaactgccacagggatctccctgttccccagtgatgtccaatctgatcgggcacctgcttgacattaaactggctcagatggccacatcgatgaaatgtacctacagccggtacgcggatgacctgacgttctctaccaataaacaacagttcccactcgagttggtcagtcccggcgacaatcatcacgattgggttgcaggagcgaaacttgaacagatcatatcaaagtgcggatttaaagttaacgcccggaagactcggctgcagtaccaagattcaagacaggacgtcaccggtctggtagtcaacgagaaagtgaacgtgcctgcaccataccgaaggcaggctcgagctatggcccaccgactgtttgaacacgggagctttcaggtcgagcgtctctccattaaggataaaggccaggtcacatctgaacggatcgaaggaagtgtggaccaactatctggcatgttctcctatatcgccatggtgtcacagcacaataaagacttagtgctgaaagccgggcttaagaatgcacagacagagttgtccagtattgagaaagttcatcgcgacctcatcttctataagagcttctacgcaaatccgatgccgactataatatgcgaagggaagacagataatgtctacctaaggtgcgccataagatctttggccaagcagtatccattactggcgaccttcgaggataagaacaaacttaagctaaacgtgagcctgttcaaatattctcgcttaaactcctccctgttgggcatcagtggcggtaccagcaatctgaagccttttatctcagactttagcaagaatattgctaggtataagtcccgcaagagcccatttcctgtgattatcctgatagacaatgacaggggtgctaaggagatttacagcacaatcaagacaacaactaaaactgctgatactattgacggttcgataccctactatcatatcgcccaaggcctttatgtcgtgcccactcccaagttaaacggcgccctggagtccaagattgaagatttttttcccttgcagactctgaaggagactctcgatggtaaaaaattcaacgacaagaacgaggacttaaaggccgatgaatatggcaagcatttctttgctgagcacgtgattaaaaaaaagcagaatagcatcgacttcaccggatttaagcctctgctcgacattataagctcaatcatttcccaatctgtcgccctgcacatgtctgctgtggtgcctcctgctcctccaaaggtatga

SEQ ID NO: 8247 - RNA, 1767 nt, unidentified
  source 1..1767: mol_type = other RNA; note = synthetic construct
atgatcaagttgaaactcctgcagagtgccaaatccctcagggacctgtccattattctgggcttccagcctaaggccgtctccttcattgtgtataagtattcgaaagaccgcctgtatacttcttttacgattcccaaaaagagtggatctattcggacaatacgggccccctgtccagaacttaagaatctccaatcatgcgtcagcaagtatctacaggattgtattgacgagatcaatgagagcaaaaagattacccacaccctgtctcatgggttcaagcggggatactccatcgtaactaacgccagcgtgcacaagaaaagaaggctggttctgaacgtggatcttgaggacttctttggtgccattaactttggaagagtgcgtggtttcttcataaccaacaaaaacttctctctgcagccatccgtggccactgtgttggcacaaatcatctgctacgagaattcaataccacagggttccccttgctcacctgtcgtatccaacctgatcggacatctcttagacattaaattggcaaagatcgcgtctgagatgaaatgcacttattctcggtacgccgatgacttaacgttttctacaaacaagcaacagtttccgctggagctggtatctcctggcaacagcccccatgattgggtggttggtgagaggctcgagcgcgttatccagaagtgtggcttccaagttaatagccgcaagaccaggttgcagtacagagactcccggcaggacgttaccgggttagtcgttaacgagaaagtaaatgtgccagctcaataccgccgcagagcacgtgcaatggcgcataggctgtttgaaagcgggtcatttcaggtggagaaactgagcataaaagacgatgggagggcggtcagtgaaactagagctggctcagtggaagagctgagtggaatgttctcccacatcgccatggtcagtcagtacaataatgatgtggccattagagccggcataaaggacctccgaggagaactaaccagcatcgaaaaggtccaccgagatttgattttctataagtcgttctacgctaaccccatgcccatgatcatttgtgaaggtaaaacagacaatgtgtacctacggtgcgctattcgcagtttagcaaagcagtacccgagcctggtcactgtggaagccccagacaaggttaggcttaacatctcactctttaagtacagcaagctcaatagccagttgcttgggattaacggcggctcaccacatcttagaaccttcatcacggatttttctaaggctgccgcaaagtacaaatcccgtcggtcccctttccccgtgatcgtgctgattgacaatgataaaggggcgcgagagatcttcagtaccatcaaggccaccacacgaacaactgaaaagatcgacggctctatgccctactatcacatagctcaggggctgtacgtcgtgcctacccctaaactgaacggggctctcgagtcaaaaatcgaggatttctttcccgtggctacacttagcgagacactggacggcaaaaaatttaaggcagaaaatgaagacctcaaagctgatgaatatggaaaacactatttcgccgagtatgtcatcaaaaagaagcagggatctatcgatttttcgggctttaagccactgcttgatgtgatctccacaatagtgagtcagaatattgcattgcaaatgagcgctgtggtacaccaggtcgttgtgaagaagtga

SEQ ID NO: 8248 - RNA, 1830 nt, unidentified
  source 1..1830: mol_type = other RNA; note = synthetic construct
atgagcgaatacatcgcacccgaccgtctgtgtaagagagccgtgcagatgggtagatacgagtttcgcgtgcgggtgagcatctccctcttcatgaagataaaattgctacagagcgcttcaaacctcagggactttgcaattctaatcggcttccaacctaaagccatcagttttattctgtacaagcatcccaaggatcgtctctatactcagttcgagatcccaaagaagaacgggagctttagaactatcacctcaccctgcccagaactcaaaaatcttcagtcgatcgtttccaagtacctccaagattgcttagcagagatcgatgaacgcaggccgaaaaaaggaacccttgcgcacggcttcaaacgaggctacagcatagcgtcaaacgctgccgttcaccgcaatcggaggtatgtgctgaatcttgatctagaagattttttcggggccatcaatttcggtagggtacggggcttctttataaatgaccggaatttctcactgaaacctgacgtagccaccattcttgctcagataatctgtttcgagaacaaactgcctcaagggagtccatgttctccagtggtgagtaatctgatcggccacctgctggatattcgactggtcgctctggccagcaagtacggatgctcatactcacgttacgccgacgatattactttttccacgaacaagaagacgttcccgattgaattagcttcctctcagttgattcctaacgtgtggagtctggggcccgaactgtctagtatgattgttagatccgggtttaccataaatgtgtctaaaacccgggtgcagtacagtgactcccggcaagaagtgaccggcttagttgtgaacaagaaggtgaataccgtcgcatcctatcgaagaacagcccgggctatggcagagcgcctgtttagaacaggcagcttccagatcgagaagttagtacttgattctgagggaaaatctaaatctggcaccgtgagtggaacggttgagcagttgaatgggatgctcaactttattacaatgatcaaccgcctgtctgaggagttccgcgtcagtagcgacaaacatgacttatcgtcgatcgagaaggttcacagggatctccttttttacaagtacttttatgccaacaccatgcctactattgtctgcgagggacccactgattctatatatctgaggtgcgcaatcaggaagctggccgctcattttcccgcgttggccggctttaataaggagggagaaattgagctgaaggtctgtctgttcaagtattcagacctcaacgcccgactgctcaaactcactggggggacagctcccctgaggacattcgcatctggtttcagcagcaatgctgcgaaatacaagagcagaaagtcaatattcccagtcattgtcttgatagataacgacaaaggtgccaagcccatttatagcttcatcaagcaactgccgggaaacgggggagtagtggacggctcccagaaacattatcatgtggcccagggattgtggatcgtgcctactccaagaagcgaaggagtccctgagtccaagattgaagacttctttgaagacaaagtcttgaagatggaactaggcggtaaacactttaaccctgaaaatatggatctctccgacgacgagtatggtaaacagtatttcgctgagcacgtgatcaaggccaaccacaagtcaatttccttcgacggctttgcacccattctttccacaatctccagcctgatcacagatagtatcaaccaggccaaatctgcactgaatcgcccatga

SEQ ID NO: 8249 - RNA, 1737 nt, unidentified
  source 1..1737: mol_type = other RNA; note = synthetic construct
atgaaaattaagctgctccagtccgcgtcatctctccgggatttggccattttgctggggtttaaacccaaggctatatcgtttttgctatacaaggttcccaaaccgtatctctatacccaattccagatccctaaaaagaatggctcaactcgcaccatcatgagcccctgcgctgaactgaagaacctgcagtctgtgatctccaattatctgcaggactgtctggaggaaattgacgagaaacggcagaaaaaaggcacactgtcccacggcttcaaaagaggctactctatagcttcgaacgccgcgatccatagaaataggaggtacttactgaacttagacctcgaggacttcttcgggagcatcaactttggcagggtcaggggctttttcattaacgacaagaacttttctctccaccctgatgtagctactgtccttgcacagattatttgctttgagaacaagctgcctcaagggtcaccttgttcccccgttgtctctaacctgattggacacttgctggatatccgcctggtgggtcttgctagccggtacgggtgcagctataccaggtatgccgatgatattagtttttccacaaacaagaaggactttccagcggaactggcagccccgggtagtatgccccacgaatggcacgtaggaccggtgcttacagatgttattatgcgcacaggctttagtattaacgctagtaagacccgggttcagtatagcgacagcagacaggaggtgacaggacttgtagtaaacaaaaaagtgaacaccgcagccacctacagaagggcagcgagagccatggccgaacggttatttcgaacaggttcattccaggtggagaaaatggtgctcaacagtgagggaaacagtgtgtcaggggtggtcaggggatccatcgaccagctcaacggcatcttcaacttcatcactatgataaaccgcttctccgaagtgtcaagagagtcaatccaaaaatcggaactgagcagcattgaaaaggtgcatagagatctcctcttttacaagtacttctacgccaataccatgcccaccatcatatgtgaaggttctacggacaatatttatctccgctgcgcaatacgtaagctgtccgcaaattttccagcactggctggtgtcaatgagaagggggaaactgagcttaaagtgtgtctattcaagtacagcaaacttaacgcccgtcttctcgatctgaccggcggcactccaccattgcgaacgttcatctctgaattcgccaataatgccgccaaatacaaatcccggaagtccatttttcccgtcatcgtcctgatcgacaatgataagggggccaagatcatctacagcctaatcaaacaactaagtggcaatgcatccgtcatcgatgggagccagcgccattaccatatcgcccagggactgtggatcgttcctactcctaaagcagtgggcgtcgtggagagcaagattgaggatttctttgaggataaggtgctggaaatggagttgggaggaaagcacttcaattcagagaataatgacttgtctgacaatgagtatgggaagcaatattttgctgagcacgtggttaaggctaatcataaggacatcagcttcgacctgttcgctccaatattatccacaatttctacgctgataactgacagtattaaccaggccaactctgcccgtaatcgaccatga

SEQ ID NO: 8250 - RNA, 1740 nt, unidentified
  source 1..1740: mol_type = other RNA; note = synthetic construct
atgaaacacctcgacttgatcaaaagctgtaataacctgcaggatgtcgcttttgtactgggctataaaccctctcggctagcttatattctttacaagatgccaaactcgaccaagtatcgggagtttgagatagacaaaaagctggggggtaagagaaaaatctttgcaccctgcccagaattaaagactctgcaacaacggctgagcaagctcctgcaaaattgcatcgccgtcattaataaggagaaaggcattcagaaaagtatttcacacgggtttaaaagagactgttccatctttaccaacgcagaacagcacagaaataagaggttcgtcctcaatatcgacctcgaggatttctttgggacgatcaattttggtcgagtgcgagggttcttcattaaaaacaagaacttcgagatcgacgaaaacgccgccaccgtcctggctcagatagcctgtttcaacaactccttgccacagggcagcccttcctctcccgtgatcaccaatcttatctctcatactatggatatacgcctcgccgcgctggctaaacagctcaaatgcacatactcccgctacgctgatgatataaccttctcaactaacgagaagaattttccgatcgaactggctgagccaacaaacgccgaaggcaccgaatggaaagtgggaaaaaagcttgagagaaagattcagaaactgggtttctcggttaaccataaaaagacacgcttgcaattctcacagtcccgccaggacgttaccggcttagtggtcaacaagaaagtgaacatcaagagtgaatatcatcgcagcgcacgagcaatggcacatagtctattcaagactggcaagtttcacattaaagaaaacaagcaggatgcgaatggtaacatcgtggaaacaaaacgggagggaaagataacggagctgggaggatacctcaatttcatcgatatggccgataaatataggaagcgtcatgtagatgactataaggaaagaaggattctgtcatctagggaggaaatttaccgtgactttctcttcttcaggtacttctatcagccttccagacctatcattctttgcgaggggaagacagactatatttacctgaaatgcgccatcaagagtcagtttagtaagtacccgaacctctgtcagaagaataaacaagatgagaagatccttaaggtggacttctttaagtacacagaggttaagtcaaggctattctcactgagcggcggagcatccaccctgtctacttttatagggaattacacaaagttctgtgaaacttatagcgtggagattagtaaaaaccccgtgattatagtcgtggataacgacatgggagtaaataaggtttttagctctgccaagaccaaaaaatatggaaagagcaaaggcagcaatatcgacggttctttaccattttaccacttgggcgagaacctttacttgaccgctattcccaagaaactgggcaaagacacagcaatcgaggactacttcaaacctacggtcttgtctacaaagtataatgggaagactttcaactacaagaataagaccaagaatgttaaccctaaaacggagtacagcaaagccgtgtttgcggaacacgtgatcgagaagaatcgggataagattgatttctccgactttactcccatcctggataacatttgcgccgctatcaatgactattccaaaaagaaatga

SEQ ID NO: 8251 - RNA, 1815 nt, unidentified
  source 1..1815: mol_type = other RNA; note = synthetic construct
atgcaagcatcccctcttaaaaaatttctgacaagcagtatgcagattcccagcctgcaggatctgaaggagtgtcgcagcagagccgacattgccactctccttggctttaaacctgcagcgctcacatacatcctgttcaaaatagacccccccaaaaaataccgcatctttaccattccgaaaaagagcggaggcactagggagatttcttctccatgccccgagatcaagcagcttcagaagcgcttatcatacattctgtccgacgcctacactcatctatatgacttgaacaacaccaagaaatcagtctcccatggttttcggaaaaagcatagcattattacgaatgccgtcatgcaccaaaagcgaaaaaatatcctgaatatcgacctcgaagatttcttccctacgattaatttcggtagggtacgatccttcttcataaagaacaaggatttcaacctccacccagatgtggcgactacattgacccaaattgtgtgccatgaaaattctttgccccagggcgcaccaaccagtcctataatctcaaactttatcgccagaccccttgacattcgtctgctgtcactcgctaagagccacgggtgtttctatactaggtatgccgatgacatcacgttttcaacaaataagtctgagttccacagtgacattgcaaaacggaattccataggtaacgattggaccatcggagggaagttatccagcacaatcgaaaaatcgggctttatcctcaatgataaaaaaacacgagtgatgtacagcatatcacggcaggaagtaaccggacttatcgttaataaaaagatcaacacccgcattgaatatagaaaactcgctcggtcttatgtgcatagcctgattaacacagggcagtattatctgacctctcatgaggtcgaaaataacaagaagatcaaagttaagcgcattggcagcataaagcaactggacggcatcctgaacttcatctaccacacagaacggttctctaacttgaagctgaacgagaagaagaataagaagacgaatcagaacatctcttacagcaactctgagaagacatataggaagtttcttaaacacaccctcttctgtgagaatgaattcccattcatcatctgcgagggaccgactgatgatatttacctgaaaagtgcattgctgatgaagggcgagaattttcctctgttatactcttcccagtctcgtcctaaaatcaagctaaagttctttaagcactcggagaagatgagacatctccttgggatgtcagggggaaccggagatattaagaacttcatagctagctacaacaaagagattgccagcgaatttaaggagaggcctaagaatcccattattgtggttatagacaatgaccaggggtccgacgaaatctttgcgtggattaaaaggaacattgagccctttaaaagtagaaaggactccaacgtcaagggcgatgagaatttctatatcgtgaaaccatcgctctacattgttccaatcccgcggatcaatgagagtgataccgctatcgaaaacctgttaccaagccacttgataaataatcagatcgacgggaaagaagtgaatctgagtaacaaggccgtggagactaaccagataaacaaaatgaagctggccgatcacgtgagaaaaaacaagaaggatatcgacttttcaggttttaacaaactgctagagtcaatcagtatggcttattaccattacaaagacgaaactgcttccgtcgagaagtcctattcccacggcatgtga

SEQ ID NO: 8252 - RNA, 1812 nt, unidentified
  source 1..1812: mol_type = other RNA; note = synthetic construct
atgagcaatctgaataagcttaaaaactgcgaaacccgggccgatctggctgatctcctggggttcaaggccagttctctcgcatatatcctgtacaaaatgccaccagagaagaagtatgaggagtttctgatcccaaaaaaggcaggaggcaatcggagtatcgccgcaccttgccccggcttgaagaaacttcagaagagattgtgtgagatcttaacagagtgttatcaagaactgtacggagggagcgggataaagaaatccatttctcatggatttcgcccaaagcactctgtcattactaactcactaatgcaccagaagcgtcggcgagttctcaacctggatctgaaagactttttccccagtattaactttggtcgcgtgcgggggtatttcatcaagaacaaagactttgccattagtagcgatgtcgccactgtgatcgcccagattgcttgtcacgacggcgtacttccccaaggagctccaacctcccccgtgataagtaaccttgtgctgcgctcgctggatctcaggctactgactctggccaagaaaaatagctgcttctacacccggtacgccgacgacatcaccttttctaccaacaagacttctttccctgaggagatcgctattaaggaccagctgacacataaatgggacgtggggggggaactggagagtacgatactcagatccggcttccaggtcaatgacaataaaacccgagtgatgtacaaagtgtcacgtcaagaagtcaccggcctgatcgtcaataagagggtttctacacgtgaggagtatagggaccaggtgcgctcgatggtgtattccctaacaaagcgcggtgagttttacttcaaacagatctccatcgttgacgggcaggcgacaactgttaaagaacctggagacgtgtggcagctggacggcatgctcaactacatttacaatgtcgatatggcatatctcacgtgggcagtaggagagaagaaagtcagcgaaaaaaaagataaggatgtcgtgtacagcgcaagagagcaaatttaccgcaaatttctcttctacaccctgctttgcaaaagtgagtctccttacgtcatttgtgaaggcgtgaccgatgatatttatattagatgcgccttgtcttcattagttggggagtttcccacattaagggtggcttcagatgagaaaaagatcaagctgaaattcttcaaccattcaaagaagatgaagtatctcctgggcatgggcggtggcactggagacataaagaagttcctgatcgagtacaaggctgttattatcaagacctttagcgaacggccctcctttccggtgatcgtgatcgttgacaatgattccggctttaggggtagcaaaggcatgtattcttgggtgcgagcgaacgctgaagccattgatgggccaggcttcggtataggacctaaggcaaaagaggggttttacttcgttaagcctagcttatacatagtacccatccccagaggagaggaaagcgaggtggcgatcgaagacctattgccatcgaagattttgacgtccaagatcggtgggaaagaggtgaatttgaacaacaatggagtgtcctccagcgctgaaattggcaagacaaggctcgtcgaacacgtaagaaagaataggaaagatatcgacttcgggggattcagaccgcttttgcgactgatagaaggcgcacttactcactatgacgcggccacaaaatcaggtgtcgaactcgtagccggccctaacgccgtggtggatgcttcaatgtga

SEQ ID NO: 8253 - RNA, 1677 nt, unidentified
  source 1..1677: mol_type = other RNA; note = synthetic construct
atgaccctcctggagcaacttcgacaggctcggacactgagcgactttgcaattattctcggctatgagcccaaaaaactcagctacctcttgtacatactgccgaaggagaaacctttatacaaccagtttagcatcaagaaacgcagtggaggagagcgcgtgatatcagccccctgtgaagagctcaaggaactacagaagcgccttctcaacctccttgataagtgctctcaggagataaatgcttccaaatccaagaaccataactccatcagccacggtttcaaaaagcgtcattccattgtgacaaatgccgtaaagcacaaaaacaaacagtacgtattcaatatcgacttggagaattttttcggaacgatcaacttccagagggtctgcgggttttttgtcaagtcaagggaattccaactccatagtaagattgcagaaatcatcgctctgatatcatgtcaccaagggtccctgccacaaggggctgcaactagtcccattatctccaatctgattacccatattcttgatgttcggttagttaagttcagtactaagataggtgtgttttatagccggtatgccgatgacctaactttttcgaccaacaagaagaacttccctattgaggccgctctgaaatctatcgaactgaaacaccagtggatcatcgggaaagatttgaacgagattattaacagatcgggctttaaagtgaactcaagcaagacccggatgcagtataaaaacagtaggcaggaagttacaggactgattgtgaacaaaaagattaacaccaagcgtgaatacaagcagaaggtgcgagctatggtgcacgccctggtccatagaggtgagtttaacatctttgagtctgactctggaatgtacgtaaaaggttcacttaatcagttacgcggcatgttaagctttatagagtctattaaccccagggacggctgctccaaggcaaacgaaaagatgattggcagggatatctaccataagttcctgttctacaagtacttttacttcggcgacaagccaattctgatttgtgagggaaagacggatggcgtatatatccgcgaggccatcaaatggttttctgggagggatgagttcaagggcctgaaattcgacatctttaagtactcaaaactgaatggacgggtgctggggcttaatggtggctatagcgatctcaccaagtttatcgcgcagtatctgacattcttcaatgtcaataccgcaccttccagtaatatgcctgtgatagttgttatcgacaacgatgacgcggccaagaagatcttgaaagacgaaagaaatgagaatagagacttctatcacaaagtcaagaatctgtatgtcgtgactaccccactggtcgggacagaagtggagtctgaaatcgaggatttgttcaaaatagaggccttgagaattgagctaaatggcaagactttccacaaagaaaaagatctgaacgacggaaagcattatgggaaacacgtgttctccgagaaaatcgtgaagtccaaagaatacaatatcgacttcagcggctttgaggaactgctcaaaagaattcaaaacgccatcaagcactttgagactcagacaaatgaaaatcgaaagtctagcatcgaaccaataaactga

SEQ ID NO: 8254 - RNA, 1695 nt, unidentified
  source 1..1695: mol_type = other RNA; note = synthetic construct
atgagcaagctcaaggacctgaagaatgcgaaatctctcacagatttggccaagctgctcggttttaaaccaaaggctctagcctacatcttgtacgtgatgccaaaagaattgcggtatgcagagtttgaaatccctaagaggactggagggctcaggaaaatttcagcgccctgcagtaagctgaaaaagttgcaaaaaaatctctccgatctcctgctgatctgttgtgacgaactgcactctcagagggagtcccagcacaatcgcaaaatttactcggccatatcacacggattcgtgcgcaagaaaagtatcatcacaaatgctgcaaaccaccgatccaggcgctatgtctttaacctggatctcaatgacttctttgggacaatcacctttcctagaatcagaggcttcttcatcgagaacaagaatttcaacttagaccccacagtggccaccctgatagcccagattgcctgcaataatgatgctttgccacagggaagtccttcctcaccggtcatcagcaatttgcttgctcatattctcgatataagaatcgtggccctggttagtaaggtagggtgtacctatagtagatatgctgacgatctgactttctctacgaacaaaaacaacttccccgaagaactggccaagtttgatgatgtcgaaaagctgtggtcagagggagaggtgcttagaaacatagttaatagcagcggatacaaaatcaattccagcaaaacacgtatgcaggagaagaggagtcgccaagaagtgaccggactgatcgtcaactcaaaagtgaatagtcgagtagagtatcgtaagtctgtgagggcgatggcttatagccttttcgaaaccgggaagttccatcgaaatatctccagactcaacgacgaaggcaaaatcatcgtaattaaggagctgggcaagatgtccgaactcaacggtatgctcaattttgtcgacatgctgtctgattacaaccggggcaaggatagaacctccagcgtggggaatgaacatctgcggaaagagcctaggaaaatggtccagctaaacacaaacgaacggatttaccgggactttttgttctacaagtacttctactctagcgacacgccaaccattatatgcgagggcaaaacagactatgtatatctgcaatgtgcgattcgtaagctgcaccaaaaattccccatgcttgcaggcgtcaacgcctctggcaagattgagttcaaaatcaagtttttccgcttctctgccctaacctcgaaactttttggcctgtccgggggggctacccagctgaaacagtttattattgattatgacgacgcatgcagccgctttaaagcagctggtctgaacaagccggttattgtggtgttagataacgacgcagaggcaaagccaatctacagcctcataaagaactacctaaatattaacgtggacggttcagagcttttttatgagtacaagcggaacttatacatagtggccactcccctgttacctggcttaaaggagactatgatcgaaaattgctttagcacggatgttactgagaaaatcctttccggaaaaaagttctcttgggccaatgactacaagaaagacgagacttatggcaagaaatatctggctgagtacgttgtgaagaagtcagccattcagtga

SEQ ID NO: 8255 - RNA, 1743 nt, unidentified
  source 1..1743: mol_type = other RNA; note = synthetic construct
atgacccagcttaaaaacttaaaagccgccataagtctcaatgatgtcgcaactattctgggcttcaccccgaaagcgttagcctacattctgtacaaaatcccttctgcagagaagtacgcccatttcgacatcccaaaacggtccggcgggatccgtaaaatttcagctcccgtcgcacgcctaaagaaactgcagacaagactcgctttgaccctgcagcaatgcatcatcgagatcaatacttccctcaaagtcaagaatgtcctgtcccacgctttcacaccaaagtttagcatcattaccaacgcagttaaccaccgaaataagaggtttgtgttcaacctggacttagagaactttttcggcacaattaatttcggaagagtgcgcggtttctttattgagaaccgtaattttcagctacacccagacgtagctacagtcctcgcccagattgcctgccacgaaaatatgttacctcaagggagcccaagtagcccagtaatcagcaatctgatcggacatatacttgacatccgcctggcggaactagcacacaaaaccggttgtacttactcgcgctatgccgatgacctgacattctctactaataaggccaatttccccagccgcgtggcgcagctgattaatcaaacgactcatgagtggaatacagggaaagagctggagagactcatccttaaggctgggttcaccataaactcgtccaagacaagaatgcagtatgagagtaacaggcaggaagtgaccggcctgattgtgaacaagaagataaatactcgaactgagtacaggcacttggtgagagctatggctcataacctctacaaaaccggacagttttataaaacagagactgtaagggacgctaccggcgcactcgtgcacacgaaggtcgatggaaccgtcagtcagctgaatggaatgttgtcattcgttgatagcgtgggtgtgtacaacctggaaaaaaacgaacccaaggaattctcagtgacgaaacataaggacgcgaagcccgaggccaagctttccgccatagaaaccgtgtaccggagagtgctgttctttaagaacttttacagtcccgaataccccgtaatcctctgtgagggtaaaaccgattcagtttatatcaaagccgccctccggaaactggtggatgacttcccaaatctcgcagttaagaaaaatggaaaggtcgagtccaagatccggtttttcaactacacaaaaacagccgatcgaatcatgaacttgaacggcggaaccggtcagattaataagttcattgtggattacgctcctaactgcaaaaagatttctgccaaaggccaacttatgcctgttatagttctgatagacaatgatgagggggctaagggcatctactctacagtgtctaaggtgacgaagaaggaagtcaagaacaccgacgactttttctttgtcgccgaaaacctgtatattgttgcaaccccgctgttggagggcaagcagtccactatcgaagatttttttgaaccctatgtgagggatactaaacttcacggaaagagcttttctgggaaaaacacattcgatcctcatactcaatatgggaagcactatttcgcagaatatgtggtaaagaaggacgagtcaaaaatcagctttgagggctttaggcctattttggctcggctggacgccgcgctttccgactataaaaagaagacgtga

SEQ ID NO: 8256 - RNA, 1806 nt, unidentified
  source 1..1806: mol_type = other RNA; note = synthetic construct
atgctgggagctaatgcccatatttctcttccagaatggtcaacccggctggtcactgttatcagagtccgggtgcctataaaccccttccccagcctgatagtgatgagtaaactggcctctctgaagagtgcgaccagcttaagagagctggctgtggtgctgggctataaacccaagaatctcagctacatattgtatatcaagcccaaaaaggaactgtacgaggagtttgagatccccaaaaagagtgggggagtgaggaaaatatccaaaccatgtgaagaattgagagctctacaaagaaagttggctgacttcctgcaggactgtattgatgagatcaactccgaaaagaaagtgaaggttagcatctcacacgctttcaaaaggcgacactccatagctacaaatgcttttgcacacaagaataggcgctatgtctttaaccttgacctggaagattttttcggcagtctcaacttcggaagggtacgcgggttctttatgattaacaaggacttcgagtttcatgaaccagttgccactgtcatcgcccagatcgcgtgcttcaacgggtcactcccgcagggaagcccttgcagcccagtaatctcaaatttaattggccacgtgctggatatccgactcgcacagctagccaaaaaaaccggttgcacatatactcgttatgcagatgacctgactttctcaacaaacaaaaaggtcttccctggcgacgtggcaggatttgacgttggtgcaagcgaatggggagccggcaggaaactgaagaagataattaaggacagcggcttcgtggttaacagtaaaaagacgagaatgcagttttcaacctccgcccaatccgttaccggcttggtggtcaataaaaaggtgaacgtgtcttacgcctatagaaggaatgtaagggcaatggctgattctctgtttaagaccggtaaattccacctgcctgggcctgagaagaagctcggttctgtggatcagctgagtgggatgttctcctacattcatatgattatcgagtttgaacgagcagtgcgtcttaacggttccaaagattcacagcaggagagagagttactcggcatagagaaggtttaccggcaattcattttctttcggaagttctatgcgaacccccgaccggttgtcatctacgaggggaagacggatgccatctacctacactgcgccattcggtactttgcacggattgggaagtttccagaacttgctgtgaaaaagggcgatgaataccatttcaacgtagagtttttccgcttcaccaaaacaacatcccgcattcttggcctttctggaggcgcggagcagttgaaaaacctgatccgtgaatacgctcaggtgtgttccctcttcaaggcaccaggtaataccaaacccgtaatgatggtgatcgataatgacaaaggagccaagaatatctactctctgatcaaagagttccaaaagagcgaggccccaatcgacggctctgctaataactataatgtcgtccgcaacctcttcgtcattcctactcccaaaggcaaaaacaaggaaagcaaaattgaggacttttttgacgatcaggccttggcatcgaagctcggggataagacttttgatcttaattccgactttgacacagccaacttctatggaaagaatgcctttgccgaaaacgtggtgaataagaataaggacagtatcaacttcgtggggtttgagccgattctggcccgcatggtcgaggtgatcaattactataagccttcgtga

SEQ ID NO: 8257 - RNA, 1668 nt, unidentified
  source 1..1668: mol_type = other RNA; note = synthetic construct
atgctgggttttaaaccgaaagccctgtcctacatactttatatcaagaataaggccgacctctacaaccagtttcttattccaaaaaagaccggcggtgctagaaccatactgagcccctgtgacgagctgaaggcgatacagcgtaagctgtccgattatctccaggattgcataaacgaaatcaacagccagcggaaaattaccttctctatcgcccatgcctataagaagaagcacagcattgctaccaacgcaagagtccatcggggcaggcgatatgtcttcaacgcagacttagagaactttttcgattccatcaactttggcagggtgcgcgggttcttcatttccaacaacaattttaagctccaccctgacgctgcaacagttctggcccagatcgcctgtcataataacagtctgccccaggggtcaccttgctctcctgttatttctaatctgatcggacacatactcgatattcgcctggcgcggctagcctcaaaagaaggctgtacctacactaggtatgccgacgatttgaccttctctaccaataaaaagatctttcctaagagcattgcaatgctgtctgattccgaggagcacatctggtcaaccggaaagcagcttgagaaggagatcaagaaaacaggattcgccattaataacaagaagacacgtatgcaatacaaggattctcagcaaacagtaactggactcgtggtgaactcaaaggtgaatactaggtattcctaccgcagaactgcaagagctatggctgatgccctgtttaaaacagggaaattcaccataaagaagcccgtgcaagctaacggcaaatctatcttattggaaacccccggaaccgttgaacagctctgcgggattttttcctatatccacatgattgccgagtataacagaagcatctcgatgagtaacaacaaaaaactcgaactgagcggcatcgaaaaaacctacaaggagcttttgttttatcgccgcttttatgctaatccacgaccactgatcatctacgaaggaaagacagatgctgtctacctgaggtgtgccatcagaagcctgattaagctaggggagttccccgaattaggaggcattaatgacaagtcggaggttgaaattaatgcagacctgttcacatacacaaagactgcgagccgaattttgggcctacccggtggtgccgctccgttgaaaacgctcatcagtgagtacctgcataatttttcccggtaccaggctcctggcaacacaagcccagtcataatgcttatcgacaatgactcaggcagtaaggatatttacagcttgatcaaacaacttcggaaagagaagaatccaatagatgggtctgaggagcactattacatcgcgaaaaatttattcgtggtgccaactcccaaggtgctggggaaagagagtaagattgaagacttcttcacgcggaacaccctcgaaatgaaaataggaacgaaatcattcgactgctccaacgaccatgatacggagacaagttacggtaaaaatgcattcgccgaacaaattgtgaaagccaatcagaatactatcgactttactgggtttcgccctattctgcagcgtatcgtcaatgtaatcaactactatagggcaatctga

SEQ ID NO: 8258 - RNA, 1731 nt, unidentified
  source 1..1731: mol_type = other RNA; note = synthetic construct
atgagcaggttggcaaagctgcggcgcgcagcaggaatcgatgatctggccgagctgctcggctttaagcctaaggcaatttcctacattctgtacataaaggacccagagaagaaatatgtgcaatttgaaatccccaagcgctccggtgggacccggcttatttccgcaccctgcggagacttgatgagcctgcagagacgactggccgagctcctccaggagtgcatagcagagattaatgaggagagaaaagtccgtacagtgctcagccacgggtttaggaggaaacactgtatcaagactaatgcttggatgcacagaggaaagaggttcgtactcaacgttgacttgtcagacttttttggctccattaactttgggagagtgcgtggattctttatggccaacaacaatttcaaactgaacgccaaagtcgctaccctgattgctcagatcgcctgccatgaaaatgcacttccgcagggcagtccctgtagccctgtcatatctaatttaatcggacatctcttggacctcaggctggcagaactggctaagcaatcgggctgcacgtattctcgttacgtggatgatattacttttagtaccaacaagccacagttcccacggaacgtggccgtgcaacgggacgaagacgaccatgaatgggacgctggagccgaccttgtgaggattgttggcagggccggatttcgacttaacgatcgaaaaacacggctgcagtaccacggttcacgccaggaggttaccggcttagttgtcaatgctactctaaataccagagtggaatatcggcacgtggcccgcgccatggtccataaactgatgacgaccggggccttcaaaagaaagaggttcgtacagaatgaggacgggacatgggcgctagccgaagtggacggaaaaatcgaagagttgaacggcatgctgtctttcatcgacagtgttgatctgtacaagcgcagacgccagctgaaggaagtggagagagataagtcgctggtgactcttaaagaccttagcgcaactgagcgctattatggggatttcctcttctacaagaacttcattttcaatgagcggcctgtgatcttaggggaaggcaaaactgataatgtctacatacagtgtgctcttcgatcactcctggcggactatccttccctcatcgctaaaggcgcaaacggtttcgatcagaagattagcctgtttaacaggacctccaccatcgagagactgacgcaattgtctgggggtgctgagcaattcaagacattcgttaaagaatacctggccgcccgccggaaatttcccataaagggcaaggcgcctcccatagtaattgtcgccgattctgatgacggcattggtcaggtcaacgcttacttgaaaaatctgactgggagtccagtggatatgacagccgattttacccacatcaaagaaaacctatacatcgtgtatacaccgcttgacgccggtggtaaaggcgcacccatggaaaatatgttcgagaagtcagtactccagacacagttggggggaaaaacctttaatccaagcaacacaaagatcaatcacgcgaaagagtatggcaaggcgtacttcgcccagcacgtggtgaaaaaggatgctgacaagatcgatttttctggattcaaggttttactggaccgaatcgtcaaggctatcgagcatggctcctga

SEQ ID NO: 8259 - RNA, 1740 nt, unidentified
  source 1..1740: mol_type = other RNA; note = synthetic construct
atgagtcgtcttgctaagctgcgcgaagctacagggttggaggagctggcaaagcttttaggctttaaaccaaagagtattagctacgtgctgtatatcaaggatcctgaaaagaaatatgctaagttcgagattccaaagcgctccggcggaatgaggcagatctctgcaccctgctctgaactgatggggctacagagacgcctcgcagaactccttcaggagtgcatcgccgaaatcaacgaagaaaggggagttaaaacagtgttgtcgcatggctttaggaggaagcactgtataaaaacaaacgcctgggtacataggaataagcgatacgtcctcaatgttgacctccaggatttctttgggtccattaacttcggtagagtgcgagggttcttcattagcaacaagaactttcagctcaaggagaaggtagccaccctgattgcccagatagcgtgtcatgacaatgctttgccccaagggagcccttgctctccagtcattagcaatttgattggtcacctgctggacatccgtctcgcagagctcgccaaacagagcggctgtacatacagccgctacgcagacgacatcactttctctaccaataaacctcagtttcccaagaacgtggctgtgcagcgggatgaggacgatcactgttgggtcgcgggggcagacctagccaaaataatctcaagagccggattcaaagtaaatgataagaagacccgcctccaatatcatgggtctaggcaagaggtgaccggcttagtggtgaacactaagctgaatgcccggtctgagtatcgtcatgtggccagggctatggtccaccggttgatgaaaacgggatcattcaccagaaagggttacgtgctggataaagaaggaaaaggcagtatccaggaggtagagggcactgtcgaatccctcagtggagtgctgtcctttattgacagcgtcgacctgtataatcggatgtccaagatcaagaaagctgaccgggaaaaacctctggtcacacttcaggacaaaaccgccactgagcgctgctacggcgactttctcttctacaagaatttcctggcgaatgagaaaccagtagttctgggcgaagggaaaactgacaacgtgtacatacaatgcgccttaagatcaatgttcgctcagtacccctatctgatcaagaaaaatgccgataagtttgactttcagttctccttctttaatcggaccagtactacggacagagttacctcactttccggaggttcagaacagtttaagacctttgttaaggagtatctggcttaccgaagaaagtttcccattaaggagaaggctccgccgatcgtgatagtggccgattctgataacggcgtgaaacagctgaatggatatattcggagcgtcacgggctcggcagttgacatgaacgccgatttcacatatatcaaggagaacttatacgtcgtgtacacacctatcgcagcggatggcaaaggtgctcccatcgaaaacctgtttgaaaaaaacgtcctagagaaagagttgaacggcaagaaatttaatccaagtaactccggaattaaccctgcaaaagagtatgggaaagcctacttcgcgcaacacgtggtgaaggcagatgccgactcaatcgatttctccggtttcaaggtgctgcttgatcgaatagctaaagccattgcccacggaagcgcaaaggtttga

SEQ ID NO: 8260 - RNA, 1734 nt, unidentified
  source 1..1734: mol_type = other RNA; note = synthetic construct
atgtctcgcctcgcaaaattacgtggggccgcagggatagacgagttggccgacttgctgggtttcaagcctaaggctatctcttacattctgtacatcaaggatcccgcaaagaaatataccaagttcgatgttcccaaaagagggggagggaacaggaccattagcgccccctacgacgacctcatgaacctgcaaaggaggctggctgaactgctgcaggagtgtatttcagaaatcaacggggaacgcaaggttaaagctgtgctctcccacggctttcggcctaagcaatgtataaagacgaatgcttggcagcatcgaaaaaagcgattcgtgttcaatatcgatctgcaggacttctttggttcgatcaattatggacgcgtccggggattcttcataaccaacaagaactttaagctgactgaaaaggtggcaacactcatcgcacagattgcgtgtcacgataacgtactgccccagggctcgccatgttcccccgtaattagtaacctgataggccacctcctcgacataaggcttgccgagctcgcgaagaaaaatgggtgcacatactcaaggtatgctgatgatattactttttctacgaacaagccggaatttccccggaatgtggccgtccaaagagacgaagacgatcatgactgggtagctggtgcggacttggtgaagataatcaacaaaagcggcttcaagatcaatgataagaaaacccgactgcagtatcacgggagccgccaggaggttacgggactggtggtgaatcggaaactctctgcccgtagcgaataccgccatgtcgcccgagccatggttcatagactgatgaagaccggagcttttgtacggaccgcttttgttcaggataaagatgggaaagtcagtctagccaagccggccggaaccatcccccatcttaatggcatcttgagctttattgactcagtggacctgtacaaccggcgtagtttgttaaaagtcgctgagcgggataaagcccttgtatcccttaaggatttgtccgccactgagagatgctatagggactttctgttttacaagaacttcctagggaatgccaaacctatggtggtgtgcgagggtaagacagacaatatctatatccaatgcgcgctcaggtctttactggcaggatacccaagtcttattaagaagggcgtgagcggctacgagatggaactgtccctctttaatagaactcagactacagatagactgatgagtctgagcggtggatctgagcagttcaagactttcgtcagagagtatctgaatgcgcgcaggaaatacccaattaacggcaaagtgcctcctattattatcgtggcagattcagatgacggtgtgaaaaacttcaatagctatatcggggggatcacaggcgcccctgtggatatgaaagccgactttacatacgtgaaagagaatctgtatgtcgtctacacaccacttggagctaccggtaaaggagcaccaattgaggacatgtttgacaagtccgtcttgcaaaaacagctaaacggaaagactttcaacccatccaacagcggcattaatcacgccaccgaatatggcaaagcctttttcgcacagcacgtggtcaagaagggcgcagagggcatcgatttctctggcttcaaggttcttttagacagaatcgttaaggctgtggaacactcatccaaatga

SEQ ID NO: 8261 - RNA, 1776 nt, unidentified
  source 1..1776: mol_type = other RNA; note = synthetic construct
atgagtcatttaaagacattgaaggaggccactaccctccacgatgtagcccatattctcggattccagcccaaatctctggcctatattctgtacaaaaagccgtctgctgaaaaatacaagcacttcaccatcccaaagcggaccggaggcaagcgatctatttcagcaccctatcctgatctcatgaatctccagaaaagattgtcagaccttctccagaattgtatcagcgaaatcaatcaggcccgcaaaatcgaatccacgctcagccatggcttccgaaggaaatattcgattataaccaatgcagctatccacagaaataaaaggtacgtgttcaacatcgaccttgcaaactattttggggctatcaattttggaagagtgaggggattctttattaccaaccggaattttgagctgaagccagccgtggccacagtactggctcagatcgcttgtcatgaaaacacgttgccacagggatccccttgctccccggtgatttctaacctgatcggtcacttacttgatatcaggctggccgctctgtctagccaggtcggctgctcatattcacgttacgccgatgatctgacctttagcaccaacaagcgcaattttcccgcgaaggtggctaagctagccgaagggaaccatcagtggcaggtcgggaaagaattggtccggattatcgaccgcactgggttcaccattaataacaccaaaactaggatgcaatacatggattcgaggcaagacgttacgggtcttgtggttaacagtaagattaacacaagagcggagtaccgcaggatcgcccgtgcaatggtgcacagactgctgaatactggaagctttcagcgcaaacagattagctacgatgaccagggcaatctggtggagactgaggttaatgggacgttggaccagctcaacggcatgctctcttttattgacagtgtctccgtgtttaataaacggaaggataagaatccaacagagaaggagaaagacctgatgcctagcaaggaccccgataataacgaaaaggtttatcgtcgattcctcttcttcaaaaacttctatgcgtctgccaatcctcttattatctgcgaagggaagacagacaacatatacttaaaggcggcaatacaaagattggctgacgcctatccctgtctagcagagaagaaagagaaaggcggaataagcctgaaggtgtgcttttttcggagaaatgcaacctcagggcgcattttgggcctggccggtggtacaggtgagctgatcaacctgattaagatgtatgcaacagagtccaaacatatcactgcgcccgggaagaaacaaccagttatccttctgattgacaacgacgagggcgccaagggcatctacggatacgtaaaaaacctgactaagtctaagggagactccaaggcagctttcatctttgtgacagagaatctgtacatagtgccgaccccactaactcacgatggcaaaaacaccatgatagaagatttcttcgaagagagccttaagaacacaaagttaaacgggaaaacttttaacccttccgacaagggtttcaattccaaaaccgaatatggaaagaattacttcgctaaacacgtcgtcaaggagaaccaagctacaatagattttaacggcttcaaacccatcctcacccggattgaagccgtcctgaattaccactcaaaaaagcctagctccgagagtatggccgagagtatgggcagtgattga

SEQ ID NO: 8262 - RNA, 1746 nt, unidentified
  source 1..1746: mol_type = other RNA; note = synthetic construct
atgagcaagcttaaaatcctacaggccgccaccagcttgcacgagctggcagatttgctgggctttaagcccaaggcagtatcctacatcctgttcaagaaggacttggctgccaaatacactgaattcgagattcccaagagagctggggggaaaaggctgatacaggctccctatccagagctgatgaatctgcaacggcgtttgtctgagctcctgcaagactgcattgcggagatcaatgccgcccgggacattgactccgtattatcacatggattccgccggaaatatagtataatcacgaacgcagtggtccacagaagtaagagattcgtccttaatatcgatcttgcaaactttttcgggactattaactttggcaggatccggggcttctttatctccaaccgaaattttgcgctgcagccaaaagttgctacactgatagcccagatcgcgtgccacgatcatgtgctccctcagggctcaccctgtagcccagtgatatcaaatttgatcggacatctgctggatgtacgtcttagcgccctagcgttccagacagggtgcacctactcacgatacgcagatgacattacgttctctactaacaaacctttattccccgcaaagctcgccaaggccgttgaaggagatgagcacaggtgggaagtgggtaagactctcttcagagccattacaaaagctggctttgaggtaaacgctgagaagaccaggctccagtacaccgactccagacaggaagtcactgggctggtggtgaactctaagattaataccaggagcgaatatagacggacagcccgcgcgatggtgcacagattagtgtctaccggcagtttttatcgcaaacgtgttgagcgggatggtgatggcgaagtggtgatttctgagaaactcggcaccctcgaacagctgaacggaattctgagctttattgactcggttggcgtgtacaataagaaaaaaggaatgaaggacgacgagcgggagaagcctctgactatgccttcctccccggattgccaagaaaaggattaccgcaaattcctgttctataagcatttctttgcaattaagcagcccatgatcgtttgtgaggggaagacagacaacatctatctgtcctgtgccatccgaaggttggcaaagtcacacctgcttctcgccagtccagacggaaaaggggggagcaggctccaggtgagcttctacaaacgcacagcaaccactgaccgcacaatcggactgactggcgggaccgaccagctcattagcctgataaaggagtatagggccgaatcgagacgcattaaaatagctggtaaagtccaaccgctcatcctattaatcgataatgacaatggtgctaaaggtatttttgcctacctgaagaacctgctaaaggtgcagatagaccccaatgctccttactttgaggcccatgagggtttgtatgtggtgccaaccccactgacatcagacgccaaaggaaccatgatcgaggattttttcgatgaatccgtccttaaaacgatgctcaacggcaagaccttcaatccttctaatgaaggcgtcaaccataagacagaatatggcaaagcttactttgcttctcatgtcatcaaaaagcacgaaaacacgatcgattttagtggattcaagccgatccttgaccgattagaggaggttattgcacaccaccagaaaaagcaccaatga

SEQ ID NO: 8263 - RNA, 1734 nt, unidentified
  source 1..1734: mol_type = other RNA; note = synthetic construct
atgagcattctcgagaaactgcaagcggcccaaaaccttcatgatgtcgccttacttctcggttaccagccaaagagtcttagttacatcctctatgtgaaacctaaaacgcagaagtataccacctttaatatacctaagtccagcggcgggacacgagaaatcaaggcaccctacccggacctgaaaacactgcagaaacgcctctccaagctgctgcaggagtgtatcgcggagatcaatctgcaaaaagagatcaccacctctgtatcacacgggtttaggaaaaagcactctatcctgacaaatgccgctgtacacaaaaatatgcgctacgttctcaatctggacctcaaggacttcttccattcaatcaactttggcagggtgaggggcttcttcatcgctaaccagaattttcttctgaaccctaacgtcgcaactataatagcccagatagcctgtcatgaaaactgtctcccccaagggagcccctgtagccctgtgatttcaaatctggtgggccacattctggatatgagactagtgcagttagctcgtaaatttggatgcatctattctcgttatgccgatgacatcacgttcagtaccaacaagaaagtcttccctgtggatttggctaccgcagccctagatggcgagcaactgtggagcgtgtctaagccgttacacgacattatcaagagatcaggatttgatgttaactcggctaagactaggatgcagtataagttttcaagacaggaggtgacaggactgattgtcaacagccgagtgaatgtcagattcggctaccgacggatagccagggcaatgcttcataagctgataactcgcggtgaatttcacaagccaaattctaagaaagtgagttccgtgactaatacaaccgccccaagcttagactacctgaacggcgtgctatcgtttattaattctgtgaaccttttcgtccacaaaaagcatagtttcagagttaaaagcgactccaagaaggcccttgagaagtctttcttgaacttgagtatctctcgcggttaccggaattttctcctctataaatacttcttcgcagctaagaatccagtaattatctgcgaaggaaaaaccgataacgtgtatattcgctcagcaaccaggcaactgagtacacagtacccaatactggggaagtcgagcccagatggtaccatcaacttgaaaatctccttctttaagcggactaagactactgatatgtttctcggcctcacaggcggagcatcccagtttaacaaattcatcgaggatttacggcagcccatttttaaggacttcctgttgaaaatcaagcagcccatcattattgtgatcgacaacgaccacgaggctctgaaggttttctcctacctgtacaagaatttcaacattaactgcgacaaaaccgttggatttatcgaagtcttccgtgggctgtatgtcattcctattcccctgctctccggagcgaatcagtctgttattgaggagctgtttgacatcaaggatcttacacggtccttggacgggaaaaaattcaactataagtccgacagctataatacgaaactggaatacggcaaaagcgccttcgctacacggatagtacaggccaaggaagatcagatcatctttgacgggtttaaacccctattgactcagattgaagaggcgattaagtcattcagatgctga

SEQ ID NO: 8264 - RNA, 1722 nt, unidentified
  source 1..1722: mol_type = other RNA; note = synthetic construct
atgagctttcttacagagctgaagagcgccaagtccctgcacgacgtcgcttatctcttaggatataagcccaagtccctgtcctatgttatctacaaaatgcctgtcaaatacgagactttcacagtcccaaagaagacaggcggcgtgcgcaccattagtgcaccccacccagaactcaagcttctgcaaagaaggctgtcggatggcctgcaaagttgctgggacgagatcaatagtgagaaaaagatcagcaaacctatctcccatggatttaggcggcgatcaagcatcctgactaacgcctccgtgcatcgcggtcgcagatttgtcttcaacgtggacatcaaggacttcttcgactccattaactttgggcgggtctacggattcttcctgaagaatactgacttcgctttaccagaatcagttgccaaaatcctggctgcgatcagctgtcatgaaggcaaactgccccagggctctccttgctcccccgttatcagtaatttaatcgggcaggtgcttgatatccggctggcccaactagctaggagccacggttgttcctattccagatacgcagacgatttgaccttttctacaaacaagcgagtgttcccttcagccgtagcagcacttgggataaatcacgcctgggtagtaggagacgcactgtcaaagattatagaacgctctggttttcagctcaatcctaaaaaaacccggatgcagtattgtgatagtcggcaggaagtgacaggactcatcgtgaatcggcgtgctaacacgcggcctgagtataggaggctgacacgagctatgactcacaagcttgtcacaacgggcaagtttcagatagcaggcatgaaggcggacgcctctggcacctttgcccctactctggtggacggaagcattagccatcttcagggtatgtttggcttcattgactgggtagatttgtcacacaaaaaggctaccgaaacacatgatgggccacctagctcaatctctaaggtctacaagagattcctcatgcatcgtgatttttgggcgagttcattaccagttatcttgtgcgagggcaaaactgatagtgtttacctaagaggcgcgattagacgcctcgccacagctcaccccagtttggtgagcatgaccacggtcgggaaagccgaatacaaggtcaggttttttaactactcttacactagccagcgtattctggatttgtctgggggggccccagccgtgaaaagctttataaccggatatctcaaatctgtaaagaaaaccccagcaccctctaacagacagccgctgatcgtgctccttgacaatgatagcgggggaaaagtgttctattctctgataaaggagtacaatggtaaaaagacccccgtggacggcatggatgacttctaccacctggaggccaacgtgtatgtggtgttcacccctatagctaagcccggggataattcatccattgaggacttctttgagccggccctactcgctactaaaatcgatggtaaatcctttaacccatccaatgaagatctcgacgagaacaccgagtacggaaaggctattttcgcagccaaagtggttaggcccaacattccgaagattaacttcgataagttcggcctgattttggcccgactggaacgcgtgatggacgcacatgtcaaaaagcacgtttcgaaagtgtga

SEQ ID NO: 8265 - RNA, 1725 nt, unidentified
  source 1..1725: mol_type = other RNA; note = synthetic construct
atgtcatttctcacaattctgaagaacgccaaatctctccacgacgtcgcagatttgctcagatataagccgaaatctcttagctatgtgatctacaagatgccagtaaaatatgagacttttaccgtgccaaagaagacggggggagtgcgaacgataagtgcgccgcgaccggagctcaaactgttacaacggcgattatcagacggattacaaagttgttgggatgaaattaacaccgagaagaaaaccaccaataacaaaacaacaaagcccataagccatggcttccgcaagggcgccagcattctaactaacgcttctgtgcaccggggaagaaggttcgtgtttaatgtcgacatcaaggacttctttgattcgattaatttcgggagggtgtatggatttttcgtcaagaacaaggattttgcccttcccgaatcagttgcaaaagtcctggccgccattgcgtgccacgatggcaaattgccccagggctccccttgcagtcccgtgatttcaaaccttatcgggcagatcctagacattcgcctggcccagctggcacataggtatggttgtagctattctcggtacgccgatgatcttactttctctactaacgaacgaatctttccttctgccatcgctctgagtaatattgaccatagctgggttgctggcgtgggactgagcaaaatcatcgagaaggctggctttcaactgaatcctaaaaagacgagaatgcagtacctggactccaggcaagaggtgacagggctgatagtcaatcgccgcatcaacactcggcctgaatatagacgtctggccagagccatgacccatcagcttgtcacaaccggcaagtttcagatcacagccatgaaggcagatgccttggggacacttgtgccatccaaaatcgatggtaatatacggcaccttcagggcatgttcggattcatagactggatcgactggcggcacaaaaaggctcgtggtaccctggccggaatgcctagttccattgataaggtctacaaaagattcctgatgcaccgcgacttctgggccagctccttacccgtcatcctctgcgaagggaaaaccgactcagtatacctgcgtggagccataaggaggctggcaaccgctcaccctaatctcgtcctgatgtctgcagcgggcaaggcagaatacaaggtgcgcttttttaattacagctacacttcccagcggatcttggatctgtccgggggcgccagcgttgtaaagaaattcatcaccgagtacattaagagtgtgaagaaaaccccagctccagcaaaccagaaaccactgattgttctcctagacaatgatagcggtggcaaagtgttctactcgctcattaaagagtacaagaaaactcccgtaaacggaatggacgacttttatcatttggctgccaacgtgtacgttgttttcactcctatcgctaagccctccgacaattcatctatcgaggatttcttcgaacccgctctcttggagatgaaaattaatggcaagtccttcaacgccgataacgaagggctcgacaagaataccgagtatggtaaagcggactttgcaacacaggtggtgaggcctaacatagcgaagatcaactttgacaagttcgatccaatcctggctagactggagggggctatggaggcacatattaagaagcacgtgtcctga

SEQ ID NO: 8266 - RNA, 1716 nt, unidentified
  source 1..1716: mol_type = other RNA; note = synthetic construct
atgttcttcctgacaaacctaaaaagcgcaaagagccttcatgacgtggcatgtttgctgggctataagccgaagtcactgtcctacgtcatctacaaaatgccgctgaattatactacatttaccgtgcctaagaagtcagggggcgtcaggtctataagtgcaccccgccctgagctgaagctcctgcagcgacgattaagcgacgggcttcagtcctgctgggacgagataaatgatcagaaaaaaatcaccaagcccatcagccacgggtttagacgcgatgcgtcaattgttactaatgcctcagttcaccgcgggcggcgctttgtgttcaacgtcgatatcaaggactttttcgattctatcaactttggtcgggtgtacggatttttcgtgaaaaataaggactttgccctgactgagtccgctgccaaggtgctggccgcaatcgcttgccacgacggaaaacttcctcaaggatccccatgtagtcctgtcatttccaatctgattggccagattctcgatgtgcgtttagctcagctcgctcatcgtcacgggtgcagttactccagatatgcagatgacctgacgttttccaccaacgaaaggatttttcccagtatgatcgccctgtcaaatgctgatcactcttgggtcgccggtgctgtgctgtctaagattatcgagaaaagcggtttccaactgaaccccaaaaaaacccggatgcaatacaggaatagcagacaggaggtgaccggcttggtggtcaacaggaggattaataccagacctgaatatcgccgactcacccgcgctatgacgcaccagttggttacgactggaaaattccagttgaccaagaccaaagcggatgtcctgggaaaacttgtgccaacaaagatcgatgggagtattacacacctccagggcatgtttggcttcattgactggatcgacctgtgccataggaaaaaccaggaagtgccaaacgtgcagcaatcagctattgggaaagtctataaacggttcttgatgcatagggatttttgggcgaattctctgccaattatactctgtgagggcaagacagacagcgtataccttcggggcgccataagacgactggccactgcccatcctaacttagtttctactaatgcagccgggaaatctgaatttaaggttcggtttttcaactacagttataccagccaaagaattttggatctgtctggtggagcccccgtggtacgtcggttcatcacagagtatatcaagtccgtgaaaaagactcaggccccagtaaatccgaagcctctgatcttacttctcgacaatgactccggcggacaggtgttctactcgctaatcaaacagtacaacggcaagaagacaaccgtaaacggcatggacgacttctatcacctcgcagagaacgtttacgtagtttttacccctattgataagcccggagacaattcatcgatcgaagattttttcgagccaagcctcctagccaaaaaaatcgacgggaaaacattcaacgcagacgatactacattcgataagaacaaggaatacggcaaggctgacttcgcagctaagatagtgaggccaaatatcgccaagattaacttcgaaaagtttgatcccatactcgcgagaatagaaggtgtcatcgaggcccatagcaagaaacacttcccctga

SEQ ID NO: 8267 - RNA, 1785 nt, unidentified
  source 1..1785: mol_type = other RNA; note = synthetic construct
atgtcccagttacaggcgctgagggcagcctccactttggagcatgtagccgatctgctggattataaaccgaagacgctttcatatattctctacaaaatcccagcagctaataagtacaccacattttctatccccaagaaggacggaaatccccgtgacattaatgccccctgctcagaactcaaggagctccagagccatctgagcgacttcctgatcgggtgcgccaacgaaatcaacgaaatcaggaaattcaaagaccagttgtctcacgcattcaagccagaacatactattgtcactaatgctgtcagacacaagaagaaacggtacgttttcaacatcgatctgaaggatttcttcggcacaatcaatttcgggagggtgaggggctactttctaaaggatgccaacttcatgctgcatgcaaaagtggccaccattttagcccaaatcgcttgtcatgaccacaaacttccacagggatccccttgcagtccagtaataagcaatctggtgggtcacatactcgacatacatctttgtgggctcgcctttaaaaatggctgcacctacagtcggtacgccgacgatatcactttcagtacaaacaagcctatatttcctgagaacatcgcaaagctccttcccggtcaagcacacgcatggcaggtcgggaacggactggaaaaaatcgtttctcgcagtggattcaccattaaccaccagaaaactagaatgcagtatcgaggctcaagacaggtcgtgactggtctaaccgtgaacaaaaaggtcaacatcaagaatgactaccggagaacagtgcggcagtttactcagcgggttttcaacaccggaaagtttcaatatctggcggttgtgacagatgccgctggggccaaaacccctacaaagatcgacggatccctggagcaactgcatggcatgttcggacacatagattttgtcgacaatgaaaacaaggaggctgaggagaagcgggattctggcagctccaaggcaaagaatgccgccaaggacgccctgtactcgaaacgtaagctctataggcgctttttgatcttcaaagacttgtatagcgccccacgccctgtgatcatatgtgaaggcaagaccgacaatgtgtaccttctgcatgctattaaatctctcgctgctaactaccccatattagcttccatcacgacagcgggcaaagtgcagattcacgtgcgcctgctcaaagcattggactcatccattggaacaatcctacacctgggccacggggcttccgatttggacaggttggcaaaacaatatgcagaagagatcctccgctttaaggccgatgggatggagcaggccgtggtcctgcttatggacaatgatgatggtgctgatgagatgtacaagctggcgaaggatctcaccggcaagaatgtaagccgagcggaaccctactttcacctggtgggaaacatgtatgtggtggtgacgccgctgattggcacgaataaacagagcgagattgaggattcttttgccgacacactgaaaaacgttgtccttgatggcaaaaccttatctaccaagaacaagttcgacaccgctaaatatttctcaaagcacgtgtttgcccagcatgttagagagaacgccagcaaaattgacttttcgggtttcagtgggattctagacagagtagctgctgcgatccaggccaatcagattcgaattgccgcaagcgctgctccacaagccgtccctgcaactgtttga

SEQ ID NO: 8268 - RNA, 1767 nt, unidentified
  source 1..1767: mol_type = other RNA; note = synthetic construct
atgtcccaactgcaggctctgcgtgcagccctatccctgcatcaggtggccacacttctgcagtttcagcccaaggctctgagttatattctgtacaagaagcctctgcccacacgttatacaagcttcaatatggcaaagagagacgggggggtgcggaccatcaatgccccaagcccagagctcaggttactgcagcacaacctctcagaccttttacagaactgtgtcgaggagataaatgaggggaagaagtggaaggatcagctggcgcacgggttcaaacgggactgcagtatcatcactaacgcggtcaagcaccgcaaaagaagatacgtctttaacatcgacctgaacgacttctttgggacaattaactttggaagagtcagggggttttttataaaggacgctaacttcatgctccaccctaaagtagccacaatactggcccagattgcctgtcacgaaaatgtgctgccccaaggctccccatgcagccctgtgattagcaatcttattggtcatgtcttggatatccacttgtgcaaactggcagccagcaatggatgtacttactctcgctatgcggacgatattacgttttccaccagtaaacccgattttccagaaagcatcgccagacgagtcaccggtcaagcccacacctgggaagtggggggaggacttcagaatatcgttgctcacactggattttccatcaaccccaaaaagacacggatgcagtacaggggtagtcgccaggtcgtgaccggccttgtggtcaataaaaaggtcaatatccggacagagtacaggcgaagggcgcgctcattagcgcatgagctattcaaaacaggcactttccaacacgtgaaaacaattcctgacgctaatggcgtggtgacccctacggccgttgaaggcaccttggcccagctgcatggcatattcggccacatcgatgccgtggaccatcataacttcaaaattcagtcaaaggccgaccccagagaagccaaaattgtgctgcgaagcaaagagaagctgtaccggcgtttcctgatgtttaaggatttttacgccgcgtctttgccagtactcgtgtgcgagggcaagacggataacatctatctgttgcacgctattagatctctagctgcttattatcccaagcttgctaccgtagctgcaaacaagaaaattactctgaacattcggatcctcaaaacggtgaagaccagcactggtcgggttctccaactggaggggggtgcctcttatttgaaagcattcatcgaacagtacgtgtctgagatccataagttcaaagcacccggaatgcaagcagccgtggtgctcatcgttgataacgattctggcgcagatgaaatctacaacactataaggaagctcgccaaaatcaaagcaccacgctcagacgcatacgttccagtagctggcaatctatacgtggttccgaccccgctgaaagctggtgcgacaaagtccgcaatagaagactgttttgccgacgaaataaagaatctcaagttaggaggaaagactttcaatgccaactcagacgaggacaccgtagcatatttcgggaagcacattttgagtgtgtatattcgcgagaatgcttccaaggttgatttcaccggcttcgccggcctccttgataggattactgccgctatcgaggctcatcaggctaaacaggctgccgttggaatcgcctcggcacctgcagcccagccttga

SEQ ID NO: 8269 - RNA, 1788 nt, unidentified
  source 1..1788: mol_type = other RNA; note = synthetic construct
atgagaaacctggaactgctgaagtcaattaagacacgatccgaattggctgttttactggggtacaagcctaaggcccttacctatctgctgttcaagatgccccccgaacagagatataagagttttcctgtgccaaagaggtctggcggccagcgtacgattaacgctccttgcccagaactgaaggcgttgcagaagcgcctggccggactactggtgaattgctcttccgagctggctttggccaaaaagctgccacgtattagctacgggtttaataagggcggctcaaccctggataatgcctctgtgcacagaaggcggcgttacgtgctcaatgtggatctggaagatttctttgggtcaattcacttaggacgagtgcggggctttttcattaataacgaggacttcaaactcctccccgacgttgcaactgtgatcgcccaaatcgcctgcctcgatgggaagctacctcagggaagccctgcttctccagttataagcaatatcattgggcacatcctggatgtgcatctagcacgcctcgctcggcggtatgggtgtagttatagcaggtatgccgacgatctcaccttcagcacgaataaacctatttttccacagcagattgcttctcttgtggatcccttggagcacatttgggtcgcgggtggtgagttagagagggagatcacccggtgcggctttagagtgaaccattcaaaaacacgcctcgagtataacgatagtaggcaagtagttaccggagtggtagtcaacaaaaagctgaatgtcccgtccgaattcaagagaggcgcacgggcaatggcagacaggctgttcaaaactggctcgtttgaaaatgtgcaggtggttgaactcgacggcgtgaagcaatttgcaagaactagtggaacaatcaatcaactggccggagtcttttcctatatatacatggtcagtcattggaacagcaagaaactggccatcaaacccggtactccactaacttctatcgagcgcgtccaccgcgacttcctcttttataaggacttttacgccaatcagttccccactatactgtgtgaggggaaaacagataacacttacttgaaatgtgcccttaaaggtcttgcttcctcgttccctgcactcatcggtagaaagccggatggatcccccgactataagataaggttctttcgcgggtcacgacttgcagcacggctgcttagcttaagcggcggaaccgcgcagctcaaagacttcattgctgcctacagttcctggtgtgccaaattcaaatctcaggggggcgctaagcccgtgatcatcgtaatagacaacgacgcaggagcgacccatatctacaactggtatgccagcgtaaagaggatccccaaacccgacggaatgctgccttactactacgtcggccagaacctctatattgtgccaacacccaaagccgcgccagccgacatgtccaaaatagaagacctgtttaaggccgacgccttaggggtcattcttggcggtaagcgattcaaccctaacaacgatactgagaataccacagaatacggtaagcaatactttgcagaccacgttgttaaggccagacagaaaacgatcgatttcagcggcttcgagccgctgttggataccatctccaaaattatcttgtcccataccacagctgtcgccgcagctgctgagacatcattcgcggcagctatcgaggcctcaacagctgtggctccggtagcccctccaacctga

SEQ ID NO: 8270 - RNA, 1431 nt, unidentified
  source 1..1431: mol_type = other RNA; note = synthetic construct
atgatcacaaacgctatcaaccatcggaacaagaatttggtcttgaacatcgacctggccgactttttcggctccatacacttcggccgcgtacgcggcttcttcctcaaaaacgagaatttcaaactgtcaccttctgtcgccactgttatagcccagattgcttgtcatgagaatgcgcttccacaaggctcgccttgctcccccatcctgtctaacatgattgcacacatcttagatatccggctagctaggctcgcagcggctgagaagtcatcttatagtagatatgccgatgacatcacgttttcaactaacaaaaaagagttcagcgaaagcttggtgcgatgcattgatcacgtgaaccatacctgggtggccgggacagcgctcgaaaacacgattaaccgcgcctggttttcaatcaatagcaagaaaaccaggctgcagtacagagactccagacagattgttaccgggctgactgtgaatagcaaggtaaacgtgagagccgagtatcatcgaacagccaaagccatgacccataagctgtttcggactggctcctttgaggtcctgaaagctaatgaacatggaatccaagagaaaactgcagggtcccttcatcaattaaacggaattctgagcttcatctacatgatcaatgattacaaccgtaagcttcgcgcccagaatccactcaacccggcattcacccccacccctgatcggttgaagagcatcgagaaatcccacaagaggttcatattctacagagacttctacgcctcaccagtcccgacaatcatttgcgaagggaaaaccgataatatttatctccgtgccgcaatatatagtttgagtgctaaataccccgaactggttgaaaccaataaagacggttctaagaagctgaaaatcaaactcttcaagtacaccgaacagataaagcacctcatgagtctgagcggcggaacaggtgaaatgaccaaattcatgacgagttatacaaaggaatgtgctttctttaaggcgcctatcggcctgaagcctgtcattatgctcattgacaatgatcagggggcaatagagatctacaaacagattcacaagatgaaaaagctggcaaagaaacccgatggttccgacgagctacactttattgggaggaatctgtatgttgtgccaacacccttaaataagggacagaacactatggtggaggacctttttgaaccaaagctacttaagactgagctgaacggaaagaagtttaatcctgacgatgctaagatgacctctaatgagtactctaagaatcactttgctaagtttgtggtgaaagcccagcaagagtcgattgactttagcggcttcgaacccattctgaacacaatcctgaaaatcgtgaagcagcacggaaggttgtga

SEQ ID NO: 8271 - RNA, 1773 nt, unidentified
  source 1..1773: mol_type = other RNA; note = synthetic construct
atgtccgaactggccaagttaaagaaaattatcagccttcaggacctatcatctatgttgggattcaaatctagcgccctgtcttacctcctgtacaagaaacccaaaactgagctgtacaggactttcgaaatcagaaaaaaaacagggggaatccgaatcatctctgctccttgcccagagttgaaattgctgcagagcaacctggcccgcctcctgcagaaatgtgtcaacgagattcaagaggcaaggatcaatataaaccagaacaaaatccagaagcacagatcactatcccacgggtttaaaccaggtttctctattctgacgaatgcgaaaagccacaggaagaaaagggtcgtgctgaacattgatctggaggactttttcggcagtattcatttcggccgtgtaagaggattttttctgtccaaccgtgatttcaacttgtctcccaaaatcgccacaattatcgcacagatcgtgtgtcacaataattcccttcctcaggggagtccttgcagtcctattgtgagcaatctcatagcccatattctggacatccgcttatctaagcttgcattcgagaacaaatgcagctactccaggtatgctgacgatataaccttcagtactaaccaggaaaagcttcccgactcaattgcccgctgcacttgtgaagagagccacatctggatagcaggcaagaatctgcttcgaattatcaaggacagttggttctctattaacagcaagaaaactcggattcaatatagggactcgcgccaggaagtgacgggtctggtggtcaatagtaagctcaatataaaggcggaatatcaccggaccgcaaaatccatggctcatagcttgtttcaaacgggcagctttactatcctaaagagaaatgagtccaacgagctcgagagatgttatgggaccataaaccaaatcaccggcatcttctccttcatctactggatcaataagtataatcgcgagttaccaatcggagtccctcctgacgatgtcccacccccaaaaattgaagatctcaagtccatcgaacgaacacacagaaagctcctgtactacaaatacttcttcgccaatgagattccaacaatcgtgtgtgaaggaaaaaccgacaacgcatatctgaaggctgctatccagagcttggcccagaattatcccgccttagttgaggtcgataaagataacaacaagatcctcaaggtgaagtttttcaagtactccaaacaggtgaaatatcttctggctctgaccggtgggacaggcgatctcgaaaagctgataagtaaccatcccaaagagtgctcatcatttaaggcccgggcaggtaccaagccagtgatacttgtgattgacaatgactcaggcgctaatggtatttacaaccggctgcataagtttctaaagttgagcaagaagcccgacggctcccaggagttttactattacgggaataacctctacattgttccgacaccgttagcggccgacgggggacaaactatgatagaaaatctttttgaccccaccctgctgcagaccgttgtgaataacaagacctttaaccctgatgaaaaagcttcgtcaagtttgtattatggaaagagcaagttcgttgagaacgtagtaatgccgaaccggtccaccatcgattttggcggcttcacaaagctgctcgatacaatttctaaggtcgtggataatcacgccctcctggtttcacagtctaaaccttga

SEQ ID NO: 8272 - RNA, 1818 nt, unidentified
  source 1..1818: mol_type = other RNA; note = synthetic construct
atgtcagaacttatcaaactgaagaagactaattcactctccgacctggctttgtatctgggctacaagccgaagtccttatcgtacattctgtacaagaaaccgaaggaggaactctacagaagctttgaagtgcccaaaaaaactgggggctccagaaccatttccgccccatgcaaggaattgaagctgctccagagtaaattgctagagaagctgcaggcctgtattaacgagattcaaagcctgaaaaaccttagaaaaaccctcacacagccctttaagactgaaaagaacacttctcttagtcatgggttcaagccaggattctctattattaccaatgcaaggcagcaccgccataagagacatgtactgaatatcgaccttgagaacttttttggaagcattcattttgggcgagttcgtgggttcttcataaaaaaccaggatttcaatctgcacccaaaaatcgctactatcttggcccaaatagcttgtcacgataacgtgttgcctcagggcagtccatgcagccccctcattagcaacctggtggctcatgtcctcgatatcagattagccgaactggccaaaaagaatgactgtacatattcaaggtacgctgacgacatcacatttagtaccaatgaaaagaagttccctagttccctggccgtgtgtgtgtgcgaagaggatcacatatggatcgctggcaagactcttgtggatctggtcaaaaaatgctggttcagtattaatcacgcgaagactcgtctacaatataaggactctcgccaggaggtaaccggcttaattgtgaattcaaaggtaaatgtgcgggcagaatatcaccgcactgccaaagccatggcccataggctgtttcactccggtaagtatgagacactcggctttgataaggacggactatcaaaaaaagtcctgggatcagtgaaccagcttagcggcgttttctcctttatctacatgatcaacaagtacaataggaaccttcggacaatcaacccattggagaagttccctaatccccagcctaagctcaaatcgatcgaggagacacatcggaaactgttgttttacaaagacttctatgcaaacgaagttcccacgataatgtgtgaaggcaagacggacaatgtttatctgcgaaccgcaatccggagcctaagtgagaaattccctgcactcattgagaaagacaaggacggagagaagaggttaaagctgaagatcttcaattacaccgatcaggtgaagtatctgatgcacctgacagggggtaccggtgacatggtcaaatttacctccaactatcccaaggagtgctctttctataagagcaaaggtggactgaaaccagtgattctcgttgtggataatgaccagggtgccagcgacctttacacacggatccagaaatttggcaagatgcccgtgaaacctgatgggtctaagccattctacttctattctaacaacctgtacattgtcccgacgcctttaacccctgatggaaaacagaccatgatcgagaaccttttcgatcccgagctgctcaagaccgaactggacggcaaaacatttaaccccgatgaaaaaacagcaacagcctccaactactctaagaatcactttgccgagtacgtcgtcaaggccaatcaaaagaccatagacttttcagggttcgagccactcctggctactatctccaaaataatccaagatcatgagcgcctgtctgcgctcgctacgttgcctctagctaccgcgagccacaaggtagcgaaagcatga

SEQ ID NO: 8273 - RNA, 1686 nt, unidentified
  source 1..1686: mol_type = other RNA; note = synthetic construct
atgagtgagctgaataagctgaaggcttgcacaactatcggcgagctggcactgctgctgggtttccaggcaaagactttgggttatattgcttggggcctcccctcagccaccaagtactctacgttcgctatacctaaacggtccggaggtaaaagaacaatccacgctccaagccctcagttaaagctggcacagggtaaactgtcaatcctcctgcaggcatgcgaaaaggaaattgaggaggaattgggagtgaaacatactgtggcccacggcttcaaactagggcggtcaattctcacaaatgcagacgttcaccggagacagcggtatgtgctgaactttgatctatccgattttttcggcaccatcaatttcggcagggtgcgtggattcctcatcaacaatcgcaactttcagctccacccggacgtggccacactgattgctcagataacctgtcacaaagatatgttgccccagggatcccctacttcacctgtcatatcgaacctcatcggtaatatccttgatgtcaggctctctaaggtggctcgagccaacggctgtgcttatacaaggtacgcggacgatatcactatctctacgagtcagaccgaattcccaaaagccattgcgaatcaggttgactccacgtctggatggaccctggctaaagacgtggaacaagccgtcgccgcctgtgggttccggatcaaccatgccaaaactagattacttcatcatagaagcaggcaggacgtgaccggcatcgttgtgaatcgccatgtgaatgtgaataccgattatagacgagcagtcagggccatggtgaacaatctttgcagcaccggaacctaccaccgcaagaaaagcattgtcgccgccgaagataccacgacagtgtctgtagaggggtctaggccccaactggaagggatgctcgggtttttactgcaggtagagcgctatcgcagaagcgacgagttgccacccccaactttgagtagtaccgagttactcctgcatcgctttctattcttcactacattcgccagcaatgatcgacctacaatactgtttgagggcaagacagacaacatctatatttccgctgcgattaggcggcttcgggaatcttaccccctgctgatggcgccaggaagtaaggagttgctggtcaagcttctcccacacactaagacccgtgaaagaatctttaacctgacaggcggcgacaatcccctgacttccttcatagtgtcatatcgtgagaattacaggcgaattaaggggccgaaaggggcaaacccagtaatcgtcatctttgataacgatagcggtagcaacgccgttattgcagcgatcaaaaagcactacaagcttgacatgcccgacggggaccaatacattagagtttacgacaacttgtacgtactccttacctcgaaaaaggggagtggaaatcactgtatagagaattacttttcagccgccacactggctaagaccctgtctggaaagaaactatccctttccaacaagaagctcaaagacgatgagtatggcaaagcatggtttgctgaaaagattatcaaaccctactataaggacattaacttttccaacttcagcggcttactggatcctatctgcgagataattcaaggccattacccttga

SEQ ID NO: 8274 - RNA, 1686 nt, unidentified
  source 1..1686: mol_type = other RNA; note = synthetic construct
atgggggagctggccaagctcaaagcttgtaccaacacgggcgagctggcccgcttactggattttcaaacgaaaaccctctcatacatcgcatggggaacccctagtgcggccaagtatagcgcctttgatatccccaaacgctcaggcggaaaaagggccatccacgctccgagtccccagttaaaactggtccagggcaagctgagcaaattgctgcaggcttgtgaaaaggagatagaggaggaattgggcgttaagcaccccgttgcccatggattcaaacagggacgatccatccttacaaacgccgatgtccacaggcggcagcgatatgtgctcaattttgacctgacagacttttttgggactattaatttcggcagggtccggggcttcctgatcgggaatcgcaacttccagctgcatcgtgatgtggccacaataatcgcccagatcgcctgccatgacgataaactccctcaaggcgcacctacatctcctgtcatctccaaccttatcggaaacatattggacatacgattgagcaaaattgctagagcacaagggtgcgcttattcaagatacgcagacgacattactatgtctacatcgcagccccagttccctcatgctatcgcccggcagctgcttgctacgcccaattgggtagtaaccaaggagatcgaagaggccgttaaagcatgcggttttaaaattaatcacgcaaagaccagactcctacatcaccgcagcaggcaggatgtcacagggattgtagtgaaccgacacgtgaacgttaatggagattaccggagggcaatccgggccatggtgaaccgcctgtgcagtaccggaacctaccatctcgaaaagacagtgctcgccgcgggacagactatgcttgcctctattgaaggtagcaggcctcaattagaggggatgttgggttttctcctgcaggtggagcgttacagaagatccgacgacctggtgccacctatactttcagcaactgagcgccttctacacagattcctcttttttactacatttgccgcgaacgatagaactgctattctcttcgagggaaagaccgataatatttatatctcctctgcgatccgcaagcagcgtgccacctacccagcactgattgctccagggagcaatgaactgctggtgaagctgttgccacatacaaaaaccagggaacggatcttcaatcttactgggggcgattcaccgctgactaacttcattgtcggttacagagataactataggaagataaaaggccccaaagggtcccaccccgtgattgtgattttcgacaatgacaaaggttctaacgctgtgataggcgctattaaaaagcactataagctggacatgcccgacggcgaccaatacatccacgtgtacgcaaatctgtatgtcctcttaaccagcaagaaaggttccggggatcattgtatcgaacattacttcagtgaggctacccgggccaagaagttgagcggaaaaaagttcaacctgagtaataagaagcttaaggatgacgagtatggtaaggcctggtttgcggaaaaaatcgttaagccatattacaaggacatcgacttctccggctttgcaggcctgctagatccaatttgtggcattatcaagtctcaccacccatga

SEQ ID NO: 8275 - RNA, 1686 nt, unidentified
  source 1..1686: mol_type = other RNA; note = synthetic construct
atgtccgaacttgccaagctgagggcctgcactacaattgccgaagctgcccaactgctcggtttccaaaccaaaactctgtcattcattgcttggggtctgagcccagcgatgaagtattctgtgttcaacattccaaaacgatccggcggaaaacgcactattcacgccccgagccctcagctgaagctggcacaggaaaaattgtcaaggctcctccaggcctgcgaaaaagagattgaagatgcgctaggcgtaaagcacacagtgagtcacgggtttaagtcgggacgttccatactgaccaatgccgaggtgcacaagagacgtcgatacgtgcttaatttcgacctagcagatttcttcggcaccattaacttcggaagagttcgcggtttcttgatcacaaatcggaactttcaacttcatccagacgttgccacactcatcgcacagatcgcttgtcacgaggacaaattaccgcagggcgcgccaacatctccagtgatctctaacctgataggaaacatcatggatatccgtctgagcaagattgcccgagcacatggctgctcctatagcagatatgccgacgatataactatgtcgactagtcaccctcagtttcccggcgcgatagcccatcaaataggaacaccatttaaatggcagatcagtaaagaactggagactgctgtgggggcttctgggttcaagatcaaccacgccaagacgagattactgcacgctcggtcacggcaagacgtgacgggtattgttgtgaataagcatgtcaatgtgaatactgattaccggcgggcagtgagagctatggtgaacaatctttgtagcacggggacatattaccgggagaatcctgtactaggggtcgacaacaccaacatgacccttgtcgaaggctcaagacctcagctggagggcatgctgaactttctcctgcaggtcgagaggtataggcggagcgatcatctgaccccactggagttgagtgccacggaacgcctcttgcataggtttctgttcttcaccacatttgcagacaacgataaacctacaattcttttcgaagggaagacagataatatctacatcagctctgcgattagacgcctgcgggcatcttaccccctgttaatggcacccgggtctagggatctcctggtcaaacttctcccccacacccgaactcgcgagaggatctttagtctgaccggaggagactcccctttgaccaacttcattatttcctatcgcgaaaactataggagaattaaggctcccaaaggcaccaatcccgtaattgtgatctttgacaatgataggggctcaaacgggatcatctccgccatcaagaaacactacaagttagacatgcaggacggtgaccagtatatccgagtctacgacaatttgtacatactgctcaccagtaagaaagggagcgagaagcattgcatcgagcactacttctctgaggctactcgcgctaagaagctatccggcaagaagttatcactgtccaataaaaaactcaacgatgacgaatacggcaaagcttggtttgccgagaaaattgttaagccctattacaaggagatcgatttttccggatttgccgcactcttggaccctatatgtgagatcatccagagccatagcccctga

SEQ ID NO: 8276 - RNA, 1704 nt, unidentified
  source 1..1704: mol_type = other RNA; note = synthetic construct
atgagcgacttgatcgccctgcgagcttgtactaccattgccggtgtggccaaactgcttggatttcaagccaagacgctggcatatatcgcctggggagcaccgtccgcaacaaagtactctgtgttcgacatcccaaagagatctggaggaaaaagaaccatccacgctcccgccccccaactgaagcttgcccagggaaagctcagcaacctcttacaggcatgtgagaaggaaatcgaggactcactgggtgtaaagcatagcgtgtcacatgggttcaaacgtgaaaggtctatactcactaatgctgaggtacaccgccatcagagatacgtgctgaatctagatctgttggacttctttgggaccataaatttcggccgcgtccggggatttctcataaacaaccgcaacttcaaactgcaccctgatgtagctacacttatcgctcagctggcttgccacgaagacagactgccacaaggctctccagcgtccccagtgctcagcaatttgatcgggaatattctggacatcaggctgtcaaaaatggccagagcccatggttgcgcctactcccgctatgcagatgatatcactttatccacttccaagcccgaattccctactgcgattgcccaccaggtcgacgcatttaaatggcaggccagtgaagatctcgagagtgctgtcggcgcctctggctttaagataaaccatgctaagaccagactcctacaccaccggtcaaggcaggatgttaccggaatcgtggttaaccagcacattaatttgaacagtgactatcggcggaatgtgcgcgccatggtcaacaagctgtgtagtacaggcagttaccagagggataagactatactcgctgccgacaatacaacaaaggtgtcggtcgagggcagctacgcgcaactgcaggggatgctggggtttatgatgcaggttgagcgtcatcgacgctccggaggtcccctaccaagcactctgtccgcaactgagaggctcctgcatcggttcctgttctacacgacattcgccggcaacgataagcccgtgattctgtgcgaaggaaaaaccgacaacatttatatttcagccgctgttaaacgactaagcgccagctatcctaagttaatcgagccggagtccaaaaatctgcttgtcaagatattgcctcacaccgcaacccaagagagaatctttaatcttaccgggggcgataacccccttgtgaatttcattatcgcttatagggacaactataggttaattaaggcgcctaaaggcgcaaatcctgtgatcgtcatctttgacaacgataatggctctaacgctgtgattgccgccattaaaaaacactttaagattgagatgcccgacgatacccagtacatccgggcctacgcaaatctgtatgtgcttctcacaaccaagaagggcacaggtaaccactgcatcgagcatttctttccgagcaaaacgctcaaaaaaacgttgtcaggtaagaagctgaatttgagtaacaaaaagctgaaagatgacgaatacgggaaagcgtggtttgctgaaaagatcgttaagccttactaccacgacattgatttcaccgggttctcgggcttacttgatccactctctgaaatcattacacatcatgcaaaccacaagatagacgagaaagggtga

SEQ ID NO: 8277 - RNA, 1710 nt, unidentified
  source 1..1710: mol_type = other RNA; note = synthetic construct
atgagcaatctctccagactacatgcctgcacttcagttgtggacctggcgaatctgctgggctttcaggccaaagcgctgggattcctggcatggggcttaccacccacagcccgatattccacgtttgacatccccaaacggtctggcgggaagcggactataaacgcgcccatacctcaactgaaactggcacagcagaagctggcagccatcttgcagagttgcgaggcagagattgagctcttgctgggggttaagcggtcagtcgcccatgggtttaaacccaaccactcaattcttaccaacgcagccgtgcaccggaggcagagatatattctgaacttcgaccttgaggatttttttggcaccatacactttggaagggtccgtgggttcctcatcactaacaggtactttaagttacatcctgacgtggccactctgattgcacaactgtgttgccatcagaaccagctccctcagggtgctccaacatcaccagtgctgtctaacctgatcggtaagattcttgacgttagactctccaagcttgcccggattcatgggtgtgcctatacccggtacgccgacgatatcaccatgagtacatccgctccagagttcccagctgcccttgctactgaatgtgccaatagtctgacctggcaactaagcgctagagttacatctgctatcgcggattcacgcttcaagctcaaccctagtaagaccaggctccaacacagaagatctcgtcaggacgtgaccggcatagtggtgaaccagacactgaacgcaaattctgactttcgtaggagtaccagggccatggtagacaaactgtgtcgaacaggatgttaccagctggtcaaaccgactttgcttgccggagataccgtaagcgaacctagagaaggtactaatgcccagcttcacggtaaaatcggcttcctgttgcaagtcgaaaggtttcgccgcgctggagatcccgaaagccctcagctctcagcaactgaaaagctccttaagcgatttttgttctataccacgctggccaatgctgagaggcctgtcattctctttgagggaaaaacggatgagatatacctccggtgcgctattaaacgcctggcctccgcctttcctcggttagctgcggccgcaactggtgaagtgctggtcaatttgttctcgcacacccccacacgccagagaatctttggcctgacagggggagatccgccactaacaaacttcgtgaatgagtaccgagaacactaccgcccaataaaagggccgaagggcacacaccccgtgatcgtcttgtatgacaatgataatggcgccaacagcattttcgctgcaatggacaaaatctacaaggtgaaaatggcagatggcctccagttcatccgcatctacgacaatctgtacattgtgttaagcagtgcaaagtgcgctcccggaacgggccattgcatcgagcacttattcgataaatccgtacttacaactaccctctctgggaagacgctgagcttgtctaataaacccctgaaacccaccgagtatggcaaggcttggttcgctgagaaggtgattaagactaactataagtccatcgatttcagcggattccaccctctattggaagcgatttccacaatcgttaccacccataaggccagctcgtccccactgccatga

SEQ ID NO: 8278 - RNA, 1689 nt, unidentified
  source 1..1689: mol_type = other RNA; note = synthetic construct
atgagcaaactcttggccctgcacctgtgtaattcggccagcgacgttgcacggctgatcggcttccaacccaaggcaataggatatctggcctggggaaccaaggcccgctatacaacatttgagatccccaagcgaagtggagggaagagaactattaacgctccaattctgcacctgaaaatcgcccagcggaagctggccgacctgctacaggaatgtgagagcgagatagaagaggccattggggttaaacagagggtgtcacacgggtttcggagggaccattgcatccttacaaatgccagtgtccacagaggcaagcgctacgtgttgaatcttgatttagaggatttcttcgggactattaactttggtagagtcaggggctatttcatcacgaacaagcattttcaactgaaggcggacgtggcgactctcttggcccagctggcttgtcatgactcaaagttgccgcagggcgcccctacttcccctgtgatttccaatctgatcggaaacattctagacattcgactgctaaagctggcgcgcgctcacggctgttcctacacaaggtacgcggatgatataacgatttccacatcagcccctacatttccagtggaaatagccctagagggcccaaccaacacctggacattaagcaaaacccttaatgattctgtgaagtcttctggtttcgcagtcaacgctaaaaaaacccgcctgcttcaccggaggagtcgtcaggatgtgaccggaattgtagtgaacaagtgcctgaatgtaaattccgactatcagcgacgtgtgagagtgatggtgcatcatctgcgctccaccggaaagttctaccggaaactctccagtttgacagctgccggtgataccgaggtacaatcacgggatggtactagagcacagctgcagggtatgctcggctttgtcatgcacgtggagaggttccgtcgaggagatgagcctcttcctgagaagctcactgggatcgagaagctttatagacgcttcttattttacacgcagtttgccaaccacgagatgcccgtcctgctgttcgaagggaagacggacaccatctacttgggagctgctattagggctcttgcccccgcgtaccctacactcatcgcagcaagcgcactccaagtacacatgctgcgcaacaccccacgaatcgaaagattattcgggcttaggggcggtggcgatcagctgtttaacttcgtcggagaataccatgaggaatataggcatatccagggcccaaaagggacacggcccgttatcgtggttgtcgacaatgacgccattggcagaaatatggttaaaaaagtcgaggggatgacaaagaccaccatacccgtgggttcgcagtggttccgggtccaagataatctctatgtagttctcacttctcctttcgaccccaagggcgccatgcactgcatcgaagcatgctttgaccccaaattcatggcaactgctctcgggggcaagaccctcagcaaaggatccaaaggcaagaaattggacccagctaaagaagtgagcaaggcatggtttgctgaaaaaattgttaaaccgaacaccaagagtatctctttcgctgggttttcatctctgctggattgcatcagcgacgtgataactaagcatgtgccatga

SEQ ID NO: 8279 - RNA, 1692 nt, unidentified
  source 1..1692: mol_type = other RNA; note = synthetic construct
atgtccaaactgtttgccttacaacagtgttccggcgcgtccgatgtggcacacctcattggcttccagcccaaagccttggggtacgtcgcgtggggaacgaaggctagatactcggcattcgatatagccaagagatcggggggaaaaaggactattcacgcccctatcccacagctcaagctggcacaacagaatctagcagaacttttacaggagtgcgaactggagattgaggcggcacttggagtcaaaaagagactcagccacggattccgccgtgatcattctatcctgaccaatgctgacattcactgcgggaagaggtatgtcctgaacttcgacctggaggacttctttgggacaattaacttcggcagagtcaggggctatttcacaaacaataagcattttcgactcaaacccgacgttgctacgctgattgcccagcttgcctgtcatgaatcaaaattaccccaaggtgctcccacttctccggtaattaccaatctgatcgggaatatattggatatgcgcctggttaagatagcccgagccaacggatgcgcttattcccggtacgccgacgacattacattcagcaccagcgcacccgaatttcctactgctgtggcctctgagatcgcaccgcatgcttggactctgtcaaagactgtagaggactccgtcaaagcctcaaggttttctattaatgccagcaagacccgaatgctataccgccgcagcagacaagacgttactggcatcattgtcaacaagttcgtgaatgtcaacagtgattaccagaaacggctgagagtgatggtgcaccacctgcggagtagcgggatcttccaccgcaagaactcagtgcttggggctagcggtaatacctcagtgcaaaaagaagtcggtaccaggaatcagctgcagggcatgatcggctttgccttgcaggttgaagcttttcggcggtatggagcccctcctccacctgagctcacatcaacggagaggctctacaaacgttttttgttctacacccagttcgcagcccatgataaacctgtgctcctgttcgaaggcaaaactgacgtggtgtaccttaagtctgcaataaagagcttgtccgcgagttatcctaccctatatacagggagtgacatcctcgtccatctgctgaggcacacaccccgtatggagagactttttggactgtctggcggcggtcacccattgatcgcatttattaagaactaccatgaggaatatcggcacatcaccggcccacgaggcgccaaaccggttattattgttgtggataacgaccagataggacgcaatacaatcaacctgatcgaaaagattaccaagacagtggtagcccccggtacacaggccgtaaaggtgttcgacaacctccacgtgatcttaacttccccacacgataaggatagtgagcttcattgcatcgaggattgtttcgaccccgcatttattaaggctgaactggacgccaaaaccatctacaacgggaagaagatcaagaaaaataacgagtttgacccaagcatccatatatccaaatctgcattcgccgagacgatagtgaaagctaaggctgcggcgatcgattttgctggatttaagccactcctggatcacatcgccgccgtgatcgctaaatattga

SEQ ID NO: 8280 - RNA, 1938 nt, unidentified
  source 1..1938: mol_type = other RNA; note = synthetic construct
atgattcagatagggttggcaaatgcacaccgcaagttggcgctcgcggcactgacttccatcgccagccaggccgcactatgcctgcttctgggcgttgccggccgtttcggctgtagaaggatagctgccagtgaagccatcgcacgttggatttgtccagtgacactgtctgcaacccgacggtcccttggggttcgggagagttcttgcaacccctcatttccagcttcacatggggacggaatgagtaagctcctcgcgctgcagatctgtaactcagctagtgacttggcccaccttatcggattccagcccaaggctctgggctacgtagcctgggggaccaaggctaggtactccactttcaacattccaaaaaggagcggcggtaaacgaacaattaatgcccccatcccgcagttgaagctcgcacaacagaagcttagctcactgttgcaagaatgtgagagagagattgaagagactctcaatgtccgacaccggctgagccacggcttccgtaaacaacactccattttaacgaatgctgccgtgcatcgggggcagcgttgtgttctgaactttgacctgcaggatttctttgacaccataaatttcggacgggtcagaggctactttatgaccaacaagcatttccgcctacgcccggacgtggcaactctcattgcccagattgcttgccacgacagcaagcttccacagggcgcccctacttctcccgtgatctctaacctcgtggggaacatactggacatgcgcctggtcaaaatcgctcgcgccaatggatgcgcctacagccgatacgcagatgacattaccttaagcacgtctgccccagagtttccagaagcaatcgccatcgagggccccacccattcatggaccctgtccaaagccgtgaacgatgcagtaaaggcctccggatttagagtcaacgcagctaagactcgacttcagtataggaggtctaggcaagacgtaaccggcattgtggtgaataagtgcgttaacgtcaatgcagactacaggagaagagttcgcgtgatggtgcatcacctgaggtcgagtgggaaattctatcgcaaaagctccggtctaagtgccgccggagatactgaggtgcagcagcacgaaggtaccatcgcgcatctgcagggcatgatcgggtttgtcctacaggttgaacgctttcggaggggagaagatcctgcgccagcggaactgtctggaattgagaagctctataggcggtttctcttctacacacagttcgctaaccacgagaaaccagtcttgatgttcgagggcaaaaccgatgtcatatatctggcctcagctatcaaatcgttagcagctgtatatcctacactgatagtgaagccccctgagctccttattcacttgctgagatatacccctagaatcgagcgcctgttcggcttaagcggtgggggccatcaactcatcactttcatcaagaattaccatgacgagtatcggtacatacaaggtcccagaggaagcaagccggtgattgctgtagtggataacgataaaatcggtagagatacgatcaatctggtggaaaagattacaaagacgcctatgcctacaggagcccagagcgttcgggtctatgacaatctgtacgtggttctgacatccccccacgataaggccggaaagcaccattgtatcgaggactgctttgatcctgaattcgtgaaatccgagctggccggtaaaaaaatttctaaggggaccaagggggtgaaacttgaccccgtcacagaagtgtcaaaagcctggtttgcggaaaagattacaaaaccgtccttcaaacccatcgattttagtggctttcagcctctcttaaacgagatagctgccatcatcgctaagcacgctccatga

SEQ ID NO: 8281 - RNA, 1770 nt, unidentified
  source 1..1770: mol_type = other RNA; note = synthetic construct
atgtccaaactggccgccttgaaagcttgcagcagcattggggatctggccctcctgttgggcttcaaagcacagactctcggttatattgccagaggtctgcgagatccggcaaagtacacatcattcgatatccccaagagaagcggggggaagaggacaattcatgcccccgtgcccaaactgaaattagtccagcgtaaactatgtaatctcctggaggagtgtcagaaggagatagagtccacccttggagtcgaaaaaagactggctcacggattcaagaagcaccactcgatcttcacgaacgccgacgttcaccgtagacagaaatacgtgctgaacttcgaccttgaagatttcttcgggacaatcaatttcgggagagtccggggcttcttcattgctaaccgacattttaagctgaactctgatgttgcaatgttaatcgcgcaactggtgtgttgcaacgccaagctgcctcagggctctccaagcagtccaatcataagcaacctgatcgggaacatcctggatattaggctcgccaagcttgcccgcgcaaatggctgttcttattcgagatatgccgacgacattacgatctcaacttctttgcccgatttcccttccgccatagcttcattggtcacagggagccacgtatggactctgtcgtccgacgtgatgaataccattagcgcatgcgggttcaaactgaatcccaagaagactcgcttgcaatatcaccatagtaggcaggacgttacaggcatcgtcgtcaatcgccatgtaaacgtgtcctccgactatcggcgcaaactgcgagccatggtcgaccgacttcgcagcactggttcttttacctactctgcaacagagctcgacactgctgcctcaacaaaagtgagcgtgaagacgggaaccaggaaccaattacaaggaatgttgagttttgctctgcaggccgagaggtataggcaggcttcaacttccacccctgcgcccgaatgtctgacaggtaatgaaaagctcctcaggcggtttctcttctacaccacctttgctagtcacgagcggccactggtgatctccgagggaaagaccgacggaatctatctggcttctgccatccggtccttagccgccacctttcctgagcttgtggcgcccaagacaggtgtgcccgctgttcgttttcttcggctcacccggtcaatggaacgcctgtttggccttagcggaggagatggccccctgaaggagttcgtgcatcagtacgctgaagaatacagacacattaaaggccctaaggggtccatgccggtaatcgccatttttgataatgataccggcgcgaagggggtcttgggcctactcaagggtttttacaaaatgcctatgcctgccggggcacagagtgtgcatgttcacggcaacctgtacgtcgtactcacttctcctcatattacaggcgctccctcccactgcattgaagactgcttcgacgcggcaaccctagccataacactgagcggaaaaacgctgagcttggccaacaaaactctcggcccgaatgagtacggcaaggcttggtttgcggagaaggtgatcaagcctaatgcaaaaaccatcgattttgcaggttttaacggccttctaggagtgatttcacagatagtgaagggacataccccacctccagtggcaccaccggctccaagtagtgtggcactccctttagttactccaaaaccatctataccctga

SEQ ID NO: 8282 - RNA, 1743 nt, unidentified
  source 1..1743: mol_type = other RNA; note = synthetic construct
atgagtgcattgacaaacatcaaagcttgcaacacattcaatgattttgctcggctgctaggctttaaggcgaatagcctggcctaccttctgtggggaatgcacgccgatacgaaatataccacctttgatattccaaagaggtctggtggcaagcgcacaatctgcgcccccaacccaaagctgaaactggcccagtcaagactgtcggagctgctccagcaatgtgagaaggaagtggaggtgattcacgccgtgaaaaaatcactcagtcacgggtttaagaaggaacatagcattttgaccaacgcagaggggcactgcggcagacgctacgttttaaatattgacctggaggacttcttcggcactatccattttggccgggtacgtggattcttcatcaaaaatagacagttcgcgctgaatcctaccatagccatgacaatagctcagattgcctgccacgagaataaactgccgcaaggaagcccctgttcacccgtgatctccaatttggtggccaatatcctggatatcaggttggccaagctctccaagatccacgggtgttcctacacacgctacgccgatgacattacttttagcacctctatgcccgacttccccgaaagcatcgcatttaagcagatcgactcgaaccattgggtactcggcaagccactggtcgacgcgattaaggcatgcaagttccgtatcaacctgtccaagactagactgcaatatcgacggtccaggcaagacgtaacaggcatagtggtgaataaacagctcaatgtgcgttcagagtaccgaaaggccctccgcgctatggtgtacaagttgagggagacaggaagcttcagccgaaactatagccagctcggagctaacggtgatacccaggttattgctaaagatgggtccagggcacagctatttgggatgctgagctatgtcattcaggtggaaaggtggcgcaaccggaggattgactcccctcctgagcggctctccgccaacgaatggcttatgcgggagtttcttttctacaccatgtttgcgaacgccgatagaccttgtatcgtttgcgaaggcaaaaccgatagtatctatatcagagaagcaatcaagaacctgggcgcctctttcccttatcttgctaaatcaaatgccggcaataacgaggtcattgtgagtctcgtcagaaacaccgacttgctggccaggcttttcggtctatctggcggggaaacgcggttaaaggactttgttaagaattaccgcgatgaataccgaaagatcaaaggtcctaaggggagtcatccagtcatcatcctcttcgacaatgatagtggcgcaaaagacgtcctgaacctgctggctaacctgttcaaagttattcccgttgtggggagacaatatttccatgtccacgacaatttatacgtgatgctaactagccctgtgggagccggacctcactacattgagaaatgtttcgatgcagccactcttgccatgacgcttggaggcaaaacttttaatccggctaaccagactttgggaccaaacgagtatgggaaaggttttttcgcagagaaggtaatagctcccaacgcacagtctatagacttctcagggttttccaccatgctcgcggaattttcctctattatagtgagtcatgctgcaccatctccatcattacccgtcccccctggtatggctccatctccgtga

SEQ ID NO: 8283 - RNA, 2142 nt, unidentified
  source 1..2142: mol_type = other RNA; note = synthetic construct
atgagcgcattgaagaggctgcaggccgccactacattgtccgatgtggctaagattctgggcttcaaacctagagcattggcctacttaatcagagtcatgccagccggcagccggtataccgaatttgagatccccaagcgcatgggcggattcaggcgtatctgtgccccgaacaaaaagctggcattggttcagacacgtctggctgacctactaagcgattgcgccgaggaaatagccgctcagagaagcgtaaaaaagtacgtcgcacacgggttcaggcgcggtcatagcatcctgacaaacgctgacgtgcaccgcgggagaaaatacgtgcttaatgtggacctgctgaacttttttgatgccatccacttcggaaggatacggggattcttccatacatctcaggactttcagctggagctggaggtagcaacagtgatagctcagattgcttgccacgaggctaagctgcctcaggggagtccctgttccccagtgatatccaacctcatcgccaacattcttgacatgagactagcaccactggcgcaacactatggctgctcctacacccgatacgccgatgacctgtcttttagcaccaataggcgagaattcccggaagaactcgccgcacaggtgaaaggacaagagccaatttgggaagtcggaccagcacttctcgctgccatcaagacagccgggttttccattaatcccaagaagacccgcgtgcagtatgactgcagcaggcaggacgtgactggcatcattgtgaataagttcttgaacactccaattgagtaccggagaactctccggtccatggtgcaccatctgactgggaccgggaagttctatttaaaagatgtcgaccctgcgaccggcaaaaagagggagggatctcgagctaagctgcaagggatgctgggatttgcctatcaggtggagaaatggagatcacgcaggagtccagtggtttcgggggcccatactgccatggaaaaactcctgcagcggttcctctattacaccgaatttgcctctccttccatcccggcaattgttttcgagggcaagaccgattctctttatctccgcgaagcaattcggagaacaccctcagccatgcccatgctggctacgggtgtgggtggtggctaccgattacgggtgaaattgcaccgtgagtctgtcatcatgcgcaaattcttcaacctttcaagcggcggcgatcctctcaaaaatttcattcgggacttctctaagttatttcctaggattgttggacctaagggcgaaatgcccgtcatagtgctcatggacaacgactcgggttttagttccaccaagagcatgctgaaaaattgttacggtatctcagtgatgcctggggaccaaaaaatccacgtttttgagaacctctacatactgctgacgagtccttatgctgttggcgcctctcattgtatcgaggactgctttccatcgtccgtactggcaacaaaactgggttccaagtcatttagcaagagtaacgattttgatactagcacgcattacggcaaagagtggttcgcggagaaagtcgtcaagcctggcagtaagggaattgattttaccgggttcaatggcatcatcgatggagtaaaggccattttgctggaacacgccgtgtcattcaaagccaaggcgcttcttcccatggcggccccttctgtcggaggagcttctattgctgctccctccgccgccagacgactaatccccaaagtctccaaggcgccaaaaactttagccgcaagcaccccttcagtggccagcaagtcaagtacggcggttctcgatcctaccggcccagaggctcccaaggtacccaaagcaccaaatatccctaaggctcccaaggctccaaaagcacccaaggctcccaaggccccgaaagcccctaaagctcccaaagctcctaaggctccaaaggcaccaaaagcacccacagggcccgaagcacctaaggttcccaaggccccgaagatccccaaagcccccaaagccccgaaagcaccgaaggccccaaaggcaccaaaggctcctaaggcgccaaaagctccaaaggcgcctagtcccaaatga

SEQ ID NO: 8284 - RNA, 1719 nt, unidentified
  source 1..1719: mol_type = other RNA; note = synthetic construct
actactacgatcggattcaagcccaaagcgttgtcatttataaccagagtgaccccaccagccgcacggtatattgagtttgatatccctaagcgctccggaggtacccgtcgaatctgttcccccaacaaacaactgagtctactgcagtcacgattggcagagctgcttaatgaatgcgaagtagaaatagcgcagcagagatcgatcaagagacatgtggcccacggctttagaaagggatactcaatccttaccaatgctgacgtccacagagggaggaggtacgtgctcaatatcgacttgacggatttttttggtaccatccactttgggcgggtgaaagggttcttcgagaactctctggatttccagctgaaagcagagcctgccttagttctagcacagattgcctgccatgagggcaaactgccacaaggaagcccttgcagccctgtgattagcaatctgatcgccaatattctcgacatgcggctcgtagccctctcaaaacggcatggttgttcttacacaagatacgcagacgatctgtccttctccacttccaaactgatcttctctgacgctctggcaacacccagtgaagcgaacaagagtatctggcaagctgggccggacttgattgccgccgtccattccgccggctttaagatcaacccactcaaaacccgggtccagctgtcaaggagcagacaagatgtgaccggcgttgtcgttaatcgacagctgaacacacccgtagagtatcgccgcacactgaggtccatggttcaccgcctttgtagcactggggaatacctcctgcaggagacagacccggcaaccggcaaacagaaggtgggaacacccgcccaacttcagggtatgctggggttcgcctatcaagtggaacgttggaggagtcgtaacgatgaaccagctagtggcgcccagacggctatggagagactgttaaaacgcttcttgtactacaaggagtttgcaagtcccatgctgactgctatagtgtttgagggcaagaccgattccgtctacctgcgggaggcaattaggcgctctggaaccgccttccctatgctaagcaaaggcgctggtacaactttcgagttaaaggttaaactgcaccgggaaagcaaaattatgaagaagctttttggactcacctctggcggcgaccccttgaagaatttcataaaatgttaccgatgggagttttccaggatcgatggcccaaaggggcagaatcccgtgattgtcctcatggacaatgatgacgggtttacaggaactaaggctatgcttttcaacgtctataagatcagcatttcttcaggccagcagttcatacacgtgtgggaaaacctctatatccttctctctagccctttcggtggagctaaacactgcatcgaagactgcttcactgcctccgtgctggccgtgaagttaggcataaaggagttttcgaaaacaaacgatttcgaccctaacatttattatgggaaggagtggctggctgaaaaggtagtgaagccaaactcagccacgattgatttttctggtttcgggaatctattaagtgcgttgcaggacgtgatcctgcaccattctgctaccatgctcagcgcaagggccgctaacacaggcgttccgagcctgcccatgcctctcccaattcctgggggaccagccccctga

SEQ ID NO: 8285 - RNA, 1758 nt, unidentified
  source 1..1758: mol_type = other RNA; note = synthetic construct
atgaaaaaacccactcacatcgcacaactgcggagtcttgctgccctgcatgggcttgccaccctcctcggatatgaggcgaagggtctggcctacgtggtctatggtataaaggacaaggataagtatgtggatttcccgattcccaaacggtcaggcggcacacggattatctcggcacctgtgaagtcactgaagctgctgcagagccgcttatccacactgttggcggcatgcgccgaagagatcgaggtcgaaagaggtgggaaaaacaagtttttccacggctttcgcaaaaatcacagtattctgactaatgccacagtccacagaggcaagcgctatgttttcaatgtcgacctttcagacttctttggatctgttcacttcggccgtctgacaggatttttcaccaagaacagacactttgagctggaaccagtggtagctaggatacttgctcagatagcttgtcataacaccgtattgccccaggggtcgccctgtagtccggtgatctcaaacctgatcgctcatattttggacgttaggatggcacaactggctgcacgtaacgactgctactactccaggtacgccgatgatttaacattctctaccaacagaaacgagtttccgagcgcgatcgccactagggttggggattctaatgaatgggtggcgggtaagtctctcctaaagatcgtaaaggatagtcggtttgagctaaaccatagcaaaacacgcatgcagtttcacagattccgccaggatgttacgggagtggtggtcaacaagaaactcaacgtcccctccgaatacgtgcgcgatgtacgagcaatggtgaacagctttgtcaagaccgagaaatttactcttcggaagaaatataggaacgatacaggagcctgggttctcgagacggtccagggaacgaaagaacagctcaggggtatgctgtccttcattgacaatgtacgcgtgtttcctcagaagaagctcgccatggaaaaaaaggacaaaagagaacaacgaattccacgagtggagttcaaagacatggacggagcctctcgtatgtaccggcggtatttgcagtacacccaattctttaatccagaactcccctttgttatctgtgaaggcaaaacagataatgtgtacatcaagtgcgctctacgacaattagccggcacttatcctcagcttgtttcaaagactgcctccgctaataagctgctgctgaacttcttcaactataccaaggtggcggacaggatcttacaccttggggggggcactggcgatttccagactttcatcggaaattatgggtctgagtttaagggattcaaatccgagaagaagaggaatcctgtgattctcctgatcgataatgacgaaggcaccgccaaaatcttttccagcatcaagacagccatcaagtctaaaagtcccgtcgatgggtccgagccattttaccatattgctgacaatttctacgtggtggctattcctagaaaaggcggcaaaagcaccacaatagaggactttttcgaccctgccctgttgaaaaccaagctgggtaccaaaattttcagcgggaaggacgggttcgatccagctaccgagtacggcaagcactactttgccgagtatattgtgaagaaaggacagaaaacgattgacttcagcggcttccatccaatactcgagagactggtggcagtgttgatggcacatgcagtcaaaccttga

SEQ ID NO: 8286 - RNA, 1758 nt, unidentified
  source 1..1758: mol_type = other RNA; note = synthetic construct
atgaaaaaccccactcacattgctcagctgagggcccagacttccctgcatggtcttgcccgtctgctcggttacgagcccaagggactggcttatgtcgtttacgggatcggcgacgcgtacaagtacgtggacttccccatcccaaaaagatcgggtggcactcgcatcattagtgcgcctgtgaaatccctcaaacttcttcaggctcgggtgtctacattactcggggcttgcgctgaggagattgaagtggaacgcgggggtaagaaccgatttagccacgggtttcggaagaaccactcaatccttacaaatgccacggtgcaccgcgggaagcgctatgtatttaacgtggatctacacaacttcttcggcacggtccactttggtagagtaagcggatttttcgcaaagaacagacattttaagctggaccctgtggttgcgaggattctcgcccaaattgcatgccataacaaagtcctgccacaaggctctccgtgtagtcccgctataagcaatctcatcgcacacatcttggatgttcggatggcccagttggctgcacggcacgactgctattactcccggtacgccgatgacctaactttttcaacaaatcggaaggaattcccggagtcgatcgcaactcgagtttcagacagcaatgaatggattgccggaaaaagcttgctgaagataattaaggattctagattcgagcttaaccactccaaaaccagaatgcagtttcataggtttcgtcaggacgttaccggtgtggtggtcaacaagaagttaaacgtcccaagcgagtatgtcagggacgtgagagctatggttaattctttcgtgaaaacgggccaattcacactgagaaagagctaccgcaacgatgcgggcgcatgggttgtggaagaagtagccggaaataaggtacaactcaggggcatgctctccttcatagattctgtcagggtgttccctcaaaaaaagctggcaatggaaaagaaagataagcgcgagcagcggattcctagggtggaactgaaggacatggacggcgcctctcgaacatataggcgatacctgcagtacacccagttttttaatcccgaactgcccttcgtgatttgtgagggcaaaacggataatgtctacatcaagtgtgccttgcgtcagctggccgacacatatccacagctcgtgtccaagacagccagtgagaataagttgctcctgaacttcttcaactataccaaagtggccgatcgcatcctgcatttgggggggggcaccggagatttccagacattcatcggaaattatggatccgagttcaagggcttcaaaagtaaggaaaaacgaaacccggtcatcctgctcatcgacaatgacgaaggaaccgctaaaattttcagctcagtcaaaactgcaactaaaagaaagagcccagtggatggcagtgagcctttttaccatatagcagacaatttctacgttgtggccatccctaggctgtcaggaaaatccaccactattgaggacttctttgatccaacactgctgaagaccaaattaggcaccaaggtattctcaggcaaagacggatttgatagtgccaccgagtatgggaaacactattttgcagagtacatagtgaagaaagggcagaagaccatcgatttttctgggtttcatcccatccttgagcggctagtggctgtcttaaccgcccatgccgctaagccttga

SEQ ID NO: 8287 - RNA, 1785 nt, unidentified
  source 1..1785: mol_type = other RNA; note = synthetic construct
atgtccgccgatatactgcctctcacaatgaaaacccctacacacattgctagactgaggtccatcagctctcttcactcgcttgcacgcttgctggggtacgagcctaagggactagcctatgtggtgtacggaattgatgataagtacaagtacactgactttcagatccctaagcggagaggcggcgtacgaaccatttccgcaccgatcgagaaactgaagttactccagagaagggtcgccaccttgcttgatgcttgtgtggaggagattgatgccgaaagaggggtgcggaacacactttcacatggattccgtaaaaaacatagcatcctcacaaacgcagcccctcatcggaatcgcagatatgtgttcaacgtggacctgcacaattttttcggcactgtcgactttggccgagtagtgggttacttgaagaagaacaaacatttccaactcaaccccaccgtggcccgtatgctcgctcagattgcctgtcaccagaaagtacttccccagggatccccatgcagtcccgctatcgcaaatctgatcgcacacatactcgatattaggctgggacgcctcgccgcgaggaacgattgtcattactcacgttatgcggacgacctcacttttagcaccaataggccggtgttcccaagcgagatcgccaggagagtgggcgacacgaacgaatgggttgccgggaaaatcctgctcaagatcataaaggaatcacgatttgagatcaacccagagaagaccaggatgcaattcgcaagattccgccaagacgtgaccggcgtcatcgtcaatcgaaccctcaatgttcggcgcgagtatgtgaaaaacgctagagctatggtggattcttatgttaccaagggcgtgttttatagcgagaagcaataccgggacgagaagggagcgtggacgaatgaactggtcgatggaaccgtgggccagctgcgagggattctgtcttacattgactcagtgcggctgttcgaacagcagaagcatgcttctgctaagaagactaaaagagactaccgcgtgcctcgcgtcgagattaaggacatggatagtgcagcaaggacttttaggcggttcctgttgcatacccagttctttaatccagaaaaacccctgataatctgcgaaggaaagactgataaagtttatatccagtgcgcgctacgccaattagttgatgcacacccgcagctggcgacacggacaaaatccggggttgatatccacgtctcttttttcaatttcacgaaagtggccgatcgtatattaagactgggggggggtacgggcgactttcaggacctgatagccaaatatgggacagaatttaagggtttctacgctaaaggccagcgccaacctgtgattctactggtagacaacgacgacggtactaagaagattttcagtactgtgaagaccgcaacaggaagcaaaaccgccattgacggtagcgcttccttttatcacattgccgacaacttttatgtcgtcgccgttccacagttgggcaaaaaagatacaaccatcgagaactttttcgatccagttgtacttactgaacggttaggcacaaaagtcttcagtggcaaggaccagtttgaccccgccacacagtacgggaaacaccacttcgctgagtacgtagtgaagaagaagcagaatactatcaatttcgcaggttttgaacccatcctggccaggctggatgctgtcttgaaggagcatgccgccaaaccctga

SEQ ID NO: 8288 - RNA, 1758 nt, unidentified
  source 1..1758: mol_type = other RNA; note = synthetic construct
atgaataagatcacacatattgctaggctccgcccacttagttcgctacatggcctggcccatctgttggggtacactcccaagggcttagcctccatcgtgtatggcactcctgactcctcaaaatataatgactttcggattaggaagcggtcaggcggaactagacttatttccgaaccaaacgatcgcttgaagctcctgcagcgtagactggcgaacctgctgtccgaatgcattgacgacatcgactccgaacgtagagtaacaaactcattcgcccatggatttcgcaagaaacattccatcctcacaaatgcctctcggcaccgacgcaaaaggtacgtttttaacgttgatttgcacgatttcttcgggactgtggatttcggcagaattagcgggtaccttaagaagaacaaacactttctattggacgagcgagtggcaaggatgctcgcacaaatcgcttgtcacaacaaggtgctccctcagggctcaccctgttctcccgtgatggctaacctcatcgcccacatcctggatgtgcggctggctcggttagccgcgctgcatgactgctactacagcagatatgcagacgacctgactttttctacaaatcgagccgacttcccaagctcaatcgccaaaagggtcgaggattcaaacctgtgggttgcgggaaaggcgttagagaaaattgtaagcgagagtcggtttcagctgaacccttctaagaccagaatgcagctgaatcgatttcgccaggacgtgaccgggattgtcgtgaacagcggcatcaatgtccgtagcgaataccaaaagaccgttcgggccatggtgcactccctggtcaccaaaggggtcttccatatacaaaagctccatagggacgacaagggcgcctgggttcgtgaaaagaaagaggggaccagagctcagctaagaggaatgttgacattcatagacaacgtcaggctgtttgagaagacaaaacgcctgccccccgatagggctcaggatcaacgcggacagaaaggagatccggctgagatggattccgccactagaacatttcgccgatttcttatgttcacgcagttctttcaccctgagaaaccattaattctttgtgaagggaaaacggataaagtctacattcaatgcgccctccgacggttaagcacagcatatcctctactgagttcaaaatccgcaaccaagacaaatatacacgtaagtttcttcaactacaccaaaatagcaagcagggtcttgagtctgggcggagggaccggtgatctcaatggtcttgtagccacctacggatctgaatttgcaggcttcaaatctacaacgaaaaggcacccagttatcctgctggtggacaatgatgagggcacgaagggcatttttagcgccgtgaaaactcggaccaagagtacttcgccaatcaccggtaatgaaccttactatcacgtggcagataacctctatgtggtgtcccttccgctggtgaactctaatatggtgaccatagagaacttctttcccaagcatgtgagagacaccaagctcaacggtaaggtcttcagtggtaaaaatcgctttgatgccaagaatcagtatggaaagcacgtgttcgctgagcaggtcattaagaaaatccagaatgctggggacttcagcggtttccacgacatcctgatgcggatccaggctgttttggtggtacactctgcaaagaagccctga

SEQ ID NO: 8289 - RNA, 1752 nt, unidentified
  source 1..1752: mol_type = other RNA; note = synthetic construct
atgaccaccactcatatccagaaactgcaggcgactgctggtctgtattcattgtctgatttgctggggtatagcgctaagggtttcgcttacattttgcacggcattagtgacgatcataagtacatccaatttgacattgccaagcgttcaggaggcaagcggattataagtgctcccatacccgagctcaaaatccttcaacggcgactggccgagttacttgaggcttgcgtggtcgacattgataatagcagaaagcttaagaacaccttctctcatggctttcgcccaaaacacagcataatgactaacgccagtttccaccggaagcgaaggtgggtttttaatgtcgacctccaggactttttcggaacaatcaattttggtcgcatttgcggcttcttcgcgaaaaacaaatacttccagctggatcccactgtggccagaatcatcgcacaaattgcatgtcacgagaagaaactgccacagggcagtccatgcagtcctgtgatcgctaatcttatcgctcacattctggatgtgaagttggcccgcctggcttcctcctacggatgtttctatacccgttatgcggatgatttgaccttctctaccaactcagagatattcccagagttaatcgccagcaggatcgacgggtccaacgagtggacagccggaaagaaactgctgagaatcattaaagattgtgccttcgagattaaccctgccaagacaagaatgcagtttcgcgagttcaggcaggatgtcacagggctcgttgtgaatagcaaaattaatgttaggaccgattacgtcaaatccgcgagagctatggtgaattccctcgtggaatccggtgaattttacataaagcgtagatttcgagatgaaaacggagccttccgggatgagacggaaaagggagagcccgacgtgctcagggggatgctcaccttcatcgactcggtgcggcagtttgacgccctgaagaatgtacgcgacatcgacaaagctgaccataggccaacccgccccctcgcaaaagacctgtcatctgcagaccggacgtttcgcaggttcctcctttatacccaatttcacaacccacagaaacctctcattatctgcgagggcaagacagacaaggtctatatacagtgcgccctaaaacagcgaaaagacaaatttcccgacctgagcaaaaaagaagatgaaacagatgggaaactgtcgttttttaactacagcaaggtggcagacagaattcttcacctagggggtggcacgggcgatacagatgcctttatcgccaggtacgggaaggagttcaaggggttctttgagaacaagaaacagcatccggtaattgtattagcagataatgattctggcgccaagtcaacattcggcgttgtgaaaaaggctggaaatatccccagtgtcgatggatccgcgccgtactactatatatgtcggaacttgtatatcatcttcatccctaagattgatggcaaagacactaccatagaagacctatttgacaagagcgtcagagaagcagaactgaacggaaaaaagttttctggctctgacaagttcgacgcaaaaactgagtacgggaagcacctgttcgccgaatatgtgatcaaacctaagcaaaaggagattgacttctccaagtttgattcaatcctgaagagcatcgttgacgtgctggcagatttcgaaaagcggcagcctacttga

SEQ ID NO: 8290 - RNA, 1755 nt, unidentified
  source 1..1755: mol_type = other RNA; note = synthetic construct
atgacaacaaggctggcttcattgaaggccgccaactccttgcacacactggcacaggttctcggttatagagcgaaagggctcgcttacgtggtccacggcatccctgattcaataaaatacaccgacttccagattaagaagcgttccggtgggcttagaacgatctctgctcctattcccgaactcaagaagcttcagaaacatctggcccacttactggaggattgtgctgcggagatcaactcaacgaggggaatcaagaaaagcctgtcacatggttttcggaggaagcactccataatgactaatgcagctgcccaccgaggtcgcagatacgtgttcaacattgacctgcaggactttttcggcacaataaattttggacgcgtttggcgattcttcgaaaaacatcgggagttccaactaaatagcgcggtagcgcgcaccatcgctcagatagcttgccacaataaggtgctaccgcagggctctccatgttctcccgccatatccaaccttattgggcatgtgctggacatccggatggcacaattcgccgcaaaagtgggatgccattactcaagatacgctgacgatcttacatttagcactaataagaaggagtttcctgccctgattgccacccgcatgggggataccactcagtggtcccctggcacgaagttaatacgtgagatccgacggtgcggattcgaactcaattttgccaagactcggatgcaattcaaggactttaggcaggacgtgacaggagtcatcgtgaatagtaaagttaatgtccgcaccgaatatgtaaagaacgtaagggccatggtccacgcattggtgacaagaggagaattccagatccgtaaagttttccgagatgattcgggggcatggactgaggctgtggcaaaaggcagtgaagcccagctgaggggcatgttgtcgtttatcgacagcgtccgacactttgaagaatgtagagacactcctaagaataacggagtgccggattacaagctcccccgtagttctctggacgatatggacggcccagcacggatttaccgcagatttttggtctttactcaatttttcaggccagtgcagccactgattttctgtgagggtaaaaccgataacgtgtacatcagatgcgccctccggcagctgtttgccaaataccccgctctggccgccaagaagaagagcggcgagattgagttcaaaatcgacttcttctcccatagcaaagtcgccgacaggattctgcaccttggcggagggaccggggacatgtgcgatttcattgccaaatatggctctgaatttaaggggtttaagcatgacggcaaacgcaacccagtcatcatactaatcgataatgattccggcgcaaacaggatctactccgctatccggtctgccatcaagagtaaagataccattgacggatctaaaccatattatttcgtgcgcgataacctctatattgtgcctgtgcccatgctgggtggcaaccccacagccattgaggacttctttgagaagaaagttctggacaccgtgttaaatggaaaaaagttcagtagagcagacaagtttgatgctgcaacccaatatgggaaacacttgtttgccgagcacgtcgttaagaaggggcagaagagcattgatttcagcaacttcgcagctatcctcgaccggattaacgatgtactgaccatccatgctgcgaaaccctga

SEQ ID NO: 8291 - RNA, 1746 nt, unidentified
  source 1..1746: mol_type = other RNA; note = synthetic construct
atgactcgtctgaagaaactcaaagccgcctcgtcactgcacgcctttgccgatgtactcggatacaaggctaaggggttggcctatatcatccatggcattgacgatagcaaaaagtacaaggactttgagatcaaaaagcggagtggtggattgcggaagattagtgccccaatccctgaactgaagcgactgcagaagagcgtggcccatctgcttgaagactgcgtctctgagatcaactcgcaccggaagaccaagggcacattgtgccacgggttcaggccaaaacactctattatgacaaatgcagccatccatagaaagaagcgctatatcttcaacatcgatctgaaggacttttttgggacgatccatttcgggcgagtttggcggttcttcgagaagaaccgggattttgcgcttgatagtagcctggctcggaccattgcacagattgcgtgtcataacagggaactcccacagggctcaccttgtagtccttccatctccaacttaattggacacattctagatatccgcatggcaaagctggcagctcaggctggctgtcaatactcaagatatgccgatgacctgacattttctaccaatagaaaaaacttcccccccgagatcgcgcaaagagtgggcgacacgaacctgtgggtgcccggtaaacaactggctaatgaaattaaaaggtgccgctttgagataaatcctgcaaagactagaatgcaatttaaggacttcaggcaagatgtgaccggcattgtggttaatagcaaacttaatatacgggcagagtatgctaagaacgtacgtgcaatggtgcacagcctagtgactcgcggagagtttactgtacgcaagaccttcagggatgaggccggggcctggattgaggaggtcgaagctggcactgaagctcgcttgagagggatgctctcattcatagactccgtcaggttttttgaactgcatcgacagacaataaagaaatccgttgcatccgacagcagattgagtagacggcctgtgagggaaatggacaggcatgagagggtttaccgtcagttcttgttattcagcaccatttttaggcccctccagcccctcgttatctgtgaaggtaagactgataatgtgtacctgcgctgcgctctgcagaaattatctggaaagtatccaaaactggtcaatgtgtccggggcaaagataacgctccagctgaacttctttaactactctaacacaaccgaccgaattcttcatttaggtggcggcaccggcgacctcgccgaatttatcggcaattatggggctgccttcaagggttttaaatactcagagaagcgtcgaccggtcatagtcgtcgtcgataatgacagcggcgcacagcccatcttcgctgcgatcaaaaaggctacattcagtaaatctgccatcgatggatccctaccttattaccacattcgggacaacctttacgtagtgccggtgcccaaacagaagggaaaagagacagcgattgaggactttttcgaaaaggccgtgcttgacaccaaactgggaggtaaggagttctcacgccaggataaattcgacccagccactcagtacggcaaacacctcttttctgagcacgtggtcaaaaaaaataaagggagcatcaacttcgacggattcgaaccagtgctggatagaatagttcaggtgctggatgcccactccgtgaagtga

SEQ ID NO: 8292 - RNA, 1806 nt, unidentified
  source 1..1806: mol_type = other RNA; note = synthetic construct
atgtatcgtagtttgtgccaaggagtgtccgtagttccatttcagaccatctacctttttgagaacatgagcaggctggcttccctgaagagcgccacatccctccacgaccttggacatattctggggtacacagccaaggggctggcgtatatcctgcatggcgtgcccgataccgctaagtatagtgaatttacgatcaagaaacgcagtggagggtccagggtgatttctgcccctatcccagaattaaagagattgcaacagcatctcgccagccttctgaacgattgcatggtggagtccgacgcaaacagaggtgtcgtaaacaccctatctcacggattccgccctaaacattcaatcatgacaaacgcagcaatgcaccgcaaacaccgttacgttttcaacctcgatcttaaagacttcttcgataccataaacttcggacgggtctggaagtttttcgagaaaaacagggaatttggtctgaataccgcaatggcgcgtaccattgctcagatcgcatgccacaaggggactctgccacagggctctccatcttcacccgtcatcagcaacttaattgcgcacattctagacattgccatggtgcagctggcagctaaagccaagtgtcattattctcgctacgctgacgatctgactttttcaacaaatgagtcagaatttcccggcctgatcgcaacccgcatcggtactaccacagaatgggctatcgcccccaaagtcgtgagagagatcgtacgatgtggcttccaagtgaatccgctgaaaacgaggatgcagtataagactcgacggcaggatgtaaccggcattgtggtgaacacaaaagtgaatattcgctccgagtactccagagatgtgagggctaaggtcagtagcctgattacaaaggacacgttctcgatcaacaaaacattccgcaatgatacaggggcctggaccacggagacaaaggatggaactgatgctcaactgagaggcatgctctctttcattgactcagtgcggttgtttgaaagaagacgaaatgaacagatcccaccggagacacacattcctaggatcgaactgaaagagatggatggcaatctgcgggtttatcgggcgttcttgttatttactcagttctacagacccgtccgacctctcattatatgcgaaggaaaaaccgacaatgtttacgtgcggtgtgccctccatagtctagccgctgcccaccccatgcttgccaaaacgaccggaaagataagcgagtgtctcatagactttttctcctacagcaagaccagcgatagggtgttgcatctcgccggtggcaccggtgacttaggtaactttatcgccaattatgccaatgagttctcaaggttcaaaaaaatcgacagtcggaatcctgtgatcatcttgattgacaatgactctggcagcagcaagatattctccgtcattaagaaagttactgagtccaccgttaatgtggatggcagtctgaagttttaccctattaaggataatctgtacgtcgtccctatcccgaagattggcggcaaagaaactactatcgagcacttttttaccaagaagattcttgggactaagctcaacggaaaagtgttttctgggacagacaagtttgacccagctactcagtatgggaaacacctgttcgccgagtacgttataaaaaagaacaaggacgacatcaacttttcaaagttctcgatcatactgaagaacatagaagcagcactcaaattccattatgggatgccctga

SEQ ID NO: 8293 - RNA, 1821 nt, unidentified
  source 1..1821: mol_type = other RNA; note = synthetic construct
atggctgcctttaagattacaccgcctaagactacactggagcttttccaaacagctacctcacgcgcagccctagcctcattactgaatatcgagcctaaagacttaacctaccttctgtatgtgctgaaggacgaagataagtactccgtattctctgtaccaaagcgggggggcggggagagacagatttccagcccaatttctcagattaagagcctacaggaaagactggctgacagcctggagcgctgcataaacgacatcgagttgctgaccggtaggagcaattccgcaagccatggctttcggccagagaaatccatactgaccaatgccagcgtacaccgaaataaacgctttgtattcaatctagacctcgaagactttttcccaactataacaggcagaagaatcagagggtttttgatcaacgacaagaacttcaaattccacaaagacgtggctaccaccattgcccacatagcctgtctcgatggtaaactccctcaaggctctccatgctctcccgtcataagcaacttgattgcggggattcttgattttcacctcgctaggctggctaaggcctgtggttgccgatacacaagatacgccgatgacatcaccttttccaccaacaagaaggatttccctaaagagatcgcattttgtgatgttgagcacacccatatatggaaagtcggtaagcagctccgaggcctgattgcgaagagtggcttcgtcatcaatgagaagaagactcggatgcagtattatacatctcgtcagcaagtcactggtttagtggtcaacaagaaaatcaacgtgaccacggaatacaggaaactggtgagggcttacgtctttagtttgatcaaccatgggaagttcacccttaaaactacaactaaggatgcaagcggccaagttaccattaccacggcaacaggaactcgtgcccagctgcatggcatgctcggtttcatccattccgttgataacgtgtatcgcgcagaggtcaaactgcacccctacaactacctaggacaccagcagagcacgaaggaatcagtgggaaatcaggctatctaccgacgcttcctcctgtatacgcggttttatgacaacgacactcccttgatcgtgtgcgagggaaagactgacggagtttacatttcaaacgcagttcaccagtcgaaggcccatttccccaagctccttaaaaagaacgatgatggcaatgacgtcctgtcgttccagctctttaagtatgcccgtaagcacaaaaaaaaggaccatgtgtatctccctaactttagtaccgcgtccatcttgggcgtaggatctggggggggcggaaatttagggaatctgatacggacatatcacaaggaactggagaaattcaagacaccagtgggagcttcacccgttgtgttcatcgtggacaacgatgatgggggacgggcggtgtacaaagtcatcaaaaacatcttgcatatcacagtgtccggccacgaaaggtttgtccacctctttgccaatctgtatatcgtgcctgtgccctttaaagggagtaaggacacttctattgaggacctgtttagtgaagttgacatttccaaaggacttaatagtcgctcattcgatttctctaagaagattgacgccagagcagctgtgggtaaagccgattttgcatacgaattcgtggctaaacaggccgagaggatggattggggcggcttctatccgctgctgcaaaatatttgtgatgcccttgccgattacgcaaaatacaggaaggaaaatgtgtga

SEQ ID NO: 8294 - RNA, 1806 nt, unidentified
  source 1..1806: mol_type = other RNA; note = synthetic construct
atggccgccttcaagttgcctgccccaaagtcagcgctggaaaggtttcagtatgctagtagcagggctgccctggcatcacttttgtctattgagcccaaagacctgacttacctgctgtacgtgctgaaaaatagtgagaagtactctttgttctccatccccagaaaagggggtggcctgagggagattaacgccccgatacctaagattaagtcactccagcgtcgcttggccgaaggtctagagctgtgtgttgccgacattgctcgcttgactggacgctcaaattcagctagccacggattttgcccggggaagagtatactgagtaacgcatccgttcataggaacaagagatacgttttcaacctcgacctaaaggatttctttcccactatcaccggcggacggatacgggggttcctgatcaacgacaagaactttaaactgcacaaagacgtcgctaccacaatcgctcatattgcgtgtctggagggcaaattaccccagggcagcccctgctctccagtcatctccaaccttatagccgggatcctggattttcatcttgcacgcctggccaagaccaacggatgcagatataccaggtacgccgatgacataacattctccaccaacaagaaggactttccaaaatctatcgctttctgtgaaaaggatgcccacagatgggagatcggaaaacagctccagggcctgattatcaaaagcggcttcgtggtgaatgaaaagaaaacccgcatgcagtacaagaccagcaggcaacaggtaactggactggtcgttaacacaaaggtgaatgtcacgcgtgaatatagaaaactcgtccgggcatacgttttctcacttgtgaaccatggccgctacacaatcaagacagtggtcaaagatgataaagggcgtctggttgaggaaacagaagaaggccggcgatcccaactacatgggatgttgggttttatccattccgttgataatgtgtaccagagcgatgtgagagatcacccatacaattatcctggccagcaacggtctaacaagaacccaacggggaatctggccatctatcggaagttcctgctgtacaccctattctatgacaataagatgccccttattgtctgtgaaggcaagaccgacggagtatacatcagcaatgccgtacaccagtcgaaggctattttcccacagttgctcacgaagaatgatgacgggaaagacgtgctctcttttcaacttttcaaatatacccgacagcacaaaaagaagaagtctgtgtatatgccgaacttcagtaccgcctccatacttggcgcatcgtccgggggaggtgggaatttaggaaatttaatccgagcttatcacaaggagttaaatagctttaaagcccctattggagatcaccctgtcatcttcattgtggacaatgatgacggtggtagaacagtgtacaagattatcaaagagactctcaagatcgcaatgtcaggccatgaatcttttgtgcggctgtttgcaaatttatacattgtgcctgtgccctttaacgggaacgcccaaaggtccattgaggacctctttactgagactgatattagtaaaggcctcaacggtaaacgattcgactttagcaataacgcaaatagcagcgcgtctgtgggcaaagctgaatttgcatatgagttcgtggctaaacaggcagagactctcgactggacaggattccactccctgctcaacaacatctgcgccgtactggtcgattatgagacaagtgcgtga

SEQ ID NO: 8295 - RNA, 1791 nt, unidentified
  source 1..1791: mol_type = other RNA; note = synthetic construct
atggaactgctgcaggccgcaaagtctagacctggcctggccaaactcctgcaaatcgagcacagtcagctgacatacatcctgtacaaaaagagcgatgcagagaaatacaaaacattcgaaattcccaagcgtggtgggggactgaggacaatctccgcccccatagccgagttaaagctcttgcagcggcgactcggagacgtactgtatatgtgtgctgtgaatgtggagaatagcaccggtcgaatcaactatagcgcccacggctttaagccagatcggagcattttaactaacgctgccgtgcacaggaataagagattcgttttcaacgtcgatcttaaagattttttcccgactatatcagcaaagcgcatcagggggtacttaatcaatgataagtactatcgagtggtcccagaggtagccaccacaattgcccatatagcttctagagatggtattttggctcagggcgcaccgagttcaccagttatctccaatctcattgccggaattctagactttcatcttaccagactcgccaaatcttgcggatgtcgttacactaggtatgctgacgatatcaccttttccacgaataaaaaggagtttcccaaggaaattgcccgcctggtggcaggggccgaacataactgggaaccagggggagccctcgtacgtctgattaagaaatccggctttgagattaacggggataaaacacgaatgcagtataagaacagcaggcagcaagtcactggtctagtggtcaacaagaagttgaacgtgacccaagaatacagaaaactggcacgcgcatatgttttttccctgatcacccacggcaagtatacggtgaccaagtttactaaaaacacactcggcaatattgaaaaggaagtgatagaggggacgtttgcgcagctgcacggcatgttaggatttatccactcggttgacaacgtctttagggccgatcggaaaaataacccctacaactacgtcggatatgggggcgaaggcaaaaatggagatcagaaactgcagatcttccggcggttcttgtactacactaacttctactgtaattctgcgccactcattgtttgcgagggaaagaccgacaatgcttatatcagtaacgctgtgcatcagtcaaaggcgctcttcccacaactgctgaagaaaggggatgaggacaatgacgtcctcagttttttccttatgaagtacgataggaaacataagaagcgcagacacatctaccttcctaatttttcaaccgtcagtatccttggcgtggggtcaggaggcgtggacaatctgaaaaaccttctaatagggtatagagcggagatagaccgctttcgcgctaaacccggtcctcaccccgtgatattcatcgtggataacgaccacgcaggaaaaaaagtgttcggcacagccgtggaactgtccagccctaaagtttctagcatcaccggtgacgagaagttcattaacatcttcgccaatatttacatcgttccaatacctaaagtcaagaaacccgaaacttctattgaggatcttttctccgctaaggatattcctgctgctatcaatgggaagcccctgaagttcagcaacgacaatgacaagtcgttcgctggcaaggcagacttcgcctttgagcatgtggtaaaaaatgcggacgccatcgactggggcggcttctatcctctgttgaacaacatttgcgacgccatcgagcatcggaaggcaaagttggagggtgcaatctga

SEQ ID NO: 8296 - RNA, 1839 nt, unidentified
  source 1..1839: mol_type = other RNA; note = synthetic construct
atgctcgtgcccgaaattacaacactggaaagatttcaagctgcccactccagagaagctctggccaacctccttgacatcaagcatcagcacttaacttatctcctctacgtgaaaaaagatgctggcaaatacgcgacctttagcatacccaaaaggtctggaggaacacgagagataagggctccaatcaaagagttgaagtccttgcagcggcgcctggccaacaggcttcagaattgtatctccgacgttagtcggattaccggacgggaaaatcagtcaagtcacggcttctgtcctaacaagagcatcttgacaaacgcttcagcgcaccgcaataaaaggtatgttctgaatctggatctgcaggacttttttccaactattacgggccagcgtattagagggttccttatcaacgacaggaacttcaagtttcatcgcgacgtggcaaccacaattgctcatatagcctgcgtggatggggtgctacctcagggttctccgtgctccccagtgatctcgaacttaattgccggcatcttggattcacacctcagtcgcctggctcagaagaacggctgtcactacactagatacgccgatgacattacattcagcaccaacaagaaggagttcccatcccagatcggttttctggataagtcaaccagtgacaaatgggtactagggaaagaattgcgtaggctggtcgccctctgcgggtttgtcataaacgatggtaaaacacggatgcaatgcaagaatagcaggcagcaagttaccgggttggttgtgaatgagaaagtgaatgtaacctccgaatatagacaccttgtccgggcatacgtattcagcctggtgaaccgagggtcatataaaattcggagtaccctcaaaggaggcgacggaaatgagattgtctccgagaaagatggaacccctgagcaactgcatgggatgctgggtttcatccacagtgttgacagcgtattccggacagagctgaagaacaatccgcacaatcacctgcccccttaccagctgagcggtaagactacacccgaccctcttccattaagaaatctgactatctacaggaagttcctcctgtatacgcgcttttacagaaccaccactccactcgtggtgtgcgaaggcaaaacggacatagtttacatctctagcgctgtacatcaatccaaagctgttttccctcagctgataaaaaaaaacgacgccggaaaggatatcctcgcgtttcagttttttaagtatgaccgtaaacacaagaagaaggagcatgtctatatgcccaatttttcgacagcagccattcttggcgtggcatctggcggcgggcctaacctttccaacctgatccgcacctaccataaagaatctaagaagttccagagcccgtgcggtgataagccagtggtgtttgtcgtggataatgactctggcgccacggaggtgttaaaagccattaaggattgttcaggtaaggcatgtgatcgagacgaccccttcattcatgtgtttggcaacctgtacgtggtcttggtgcctcgaaacggactagacaagatggatactgaggggctattcagtccactggacctggccaagggccacaatggaaagaccttcgatttctctaaggacgcagattccagcacatctgtcggaaaagcaccctttgccttcgagtttgtcgcgcccaaagcaaaggaattagactggactggcttccaccccctcctggccaatatcatcgccgccttcgatcattataaggggactatggctgcaatcgtcccctcaccaccttga

SEQ ID NO: 8297 - RNA, 1806 nt, unidentified
  source 1..1806: mol_type = other RNA; note = synthetic construct
atgagttcagaaaaaactatcctgcagctgttccaagcagcgacttcccggtcagatgtggccgccctcctggacataaaagtgaaggaccttacataccttctttatgttatgaaggccgaggataagtataaaacgttcgacatacctaagcgcagtggtggcatgagaaagattaatgctccgattaagaaagtcaaaagccttcagcggaagctggccgacaggttggagcagtgtctgacgttgattgagggcacaacaggcctgacaaatccctcaagccatggattccggagaggcaagtctattctcactaatgcggctacgcaccgaaatagacgttttgtgtttaacgtggacctccaggacttcttcccttccatcaccggccgaagaatcagaggtttactcataaaagaccggaaatttgggtttcacaaagatgtcgcaaccaccattgctcatattgcttgccacaacggcgagctgccacaagggggtccttgttctcccgtaatctccaacatgatcgctagtgtgttagactttcacttgagtcgcctagccagggacaacggctgcgcctatacaagatatgctgacgacatcacgttttccacaaataagaaaactttcccctccgcgatcgctgtctgtgacgaggcatctggccataattggaagttgggcaaccagctggccggattaataaaaaagtccggattcagcgtgaacgagaagaaaactaggatgcagtacaggactagtcgccagcaagtgactggcctggtcgtgaataaacgtgtaaacgtgaccaacgaatacaaacggctggtccgagcatatctattttctctgatcaaccacaacaagttcacaataaaaaaggtcgagccatccgagctgggtgacaaggtatctttaatcgatgggactcgagaacagctccatgggatgctggggttcgttcactctgtggactcagtcttccgcacaaatgttaagcagcatccacagaattatccagggatgcagacagatatcaaaaaggacactaagaaaccgaccgggaccctggagctgtaccgtagatttctcttcttcacccgctttttttcgaacacactccccctaatcgtttgcgaaggaaaaaccgatattgtttacctcagcaacgccgtgcaccaaagcaaattggcctttccaaagctcattaccaagaacagtggcggggccgatgtattgaattttaggttcctgaagtatgcgaggaagcacaagcggaaaaaaaatgtttacctgcctaatttctccaccgtccagattctcggagcagggtcgggcggaggaccaaaccttggcaatctcattttaaattaccaaagcgagttccccaaattcagggcacctaagggcaagtaccccgtgatcttcgtggtggacaacgacagcggaggtaaggatgtcttcaataaagtgaagaacattgtgaagatcaccgggcatgagtcttttgttcgcctgtttggtaacttgtacattgtgcctctacccctgaacggtgccgctgaaaaatcaatcgaagatctttttagcccggcagatatcgccaagggaatggatgggaagccattcgatttcacaaaggattcatccgacgccaccagcatcggcaaggccggattcgcctatgattttgtagcaaaacaggcagaagatctggaatggtctggatttcaccctctgctgcagaatatatgcgccgctcttgacgattacgctgcactggccgctaccccctga

SEQ ID NO: 8298 - RNA, 1794 nt, unidentified
  source 1..1794: mol_type = other RNA; note = synthetic construct
atgtctagtgaaaagtcaatcctccaactgtttcaagccgcctcatcccggtctgacgttgccgctctgttggacataaagctcaaagacctgacttatctcctctacgtcatgaaggatcatgataagtacaagaccttcgatatagccaaacgctcaggaggtaagaggcagatcagcgcaccaattaagaatgttaaatccctccagagaaagttggcagatcggttagaacaatgtcttaccctgattgaatcggctgcaggtcggaaaaatccgtccagtcacggctttcgccgaggtaaaagcatcctaaccaacgccgcaactcataggaacagacggtatgtctttaatgttgacctcgaggatttcttcccttccataaccggacagcgaattagggggctgcttattaaggataaaaagttcgggtttcacaaggacgtggcgaccactattgctcatatcgcgtgccacaatgggaaactgccacagggttctccctgctctcctgttatcagcaacatggtggccgccatattggattttcacctgagcagactggcacgggataacgggtgtgtctacacaagatatgctgatgacatcactttctcaaccaatcagaaggagtttcccatcgcaattgccgtgcgaaaagaaagcaatgggcacgtgtgggaggcctctaaccagctacaagggctgattaagaaatcagggtttagcatcaacgtgggaaaaacacggatgcaatacaagacctcaaggcagcaggtgacggggttggtcgttaacaaaaaggtcaacgtcactactgaataccgcagattggtgagagcttatgtttttagcctgattaatcggaacggattcacagtcaaaaagagtcgtcgaacagagcttggcgacgagatagtgtctgtggacggcacaagagagcagttacacggcatgttgtcgttcgtgcactccgtggattccgtgttccgtaccaatgttaagcagcatccccagaactaccccggtatgcaggccgacgccaaaaagcctactggcacgttagacctttatcgccgctttctgttctttacaaggttcttcagtaacaccctgcctcttattgtttgcgaaggcaagacagacaacgtatatctgagtaacgcagtacatcaaagcaaggtggagttccccaggttgatcactaaaggcaataatggcccggacgtcctcgcttttcattttctaaaatacgcgaggaaacacaagagaaaaaagcacatatacctgccaaatttcagtacggtacagattttaggagccggatccggaggcgggcctaacctaggaggactgatcctgaactatcacgctgaatataccaagtttcgtgcacccaagggcaaattcccagtcattttcatcgtggataatgactctggcgggaaggcagtctttaataaggtgaaacatatcgccaaggtatccggacatgagccattcgtgcgcctgtttggcaatctgtacatcgtgcctgtgccgcttgtaggcgctgcagagaagtccatcgaggaactttttgccccagccgatctcgctaaagggatggacggcaggagcttcgacttcagcaaagattctagcgatgcgacatcaatcggtaaagctggatttgcctacgacttcgtggcaaagcaggccaaggacctcgactggagtggtttccaccccctcctccagaacatttgtgctgcgctgaatgattacgatgccctgtccgctaccctgtga

SEQ ID NO: 8299 - RNA, 1806 nt, unidentified
  source 1..1806: mol_type = other RNA; note = synthetic construct
atgttccccaagtccatgttggagcgcttcaaggtcgccaagtctcgtgaaaccctcgctatgctattagatattaagcacaaggacctcacatatcttctgtacgtgaaaaaagacgtcgagaaatacagcgtgttcagcatggcaaagaagaacggcggctcaagggatatatgcgccccgatcccagagcttaaatctctccagcggaaactggcaactgcgctggagcgttgcattgcagatgtcgaaaccatcacgaagaagaataataaagcttcccatggctttcgccctggaaagagcatcctgaccaacgccgctgtgcacagaaaccgacgctatgtgtttaacgtggacctgcaggatttcttctcttccatcacgggcaaacgtatcaggggatttctgattaaggaccgcaactttgctttcgacgcatctgttgccactgccatcgcacatatcgcctgccgggaaggcaaactcccacagggtagtccttgttcgcctgtcatctcgaacatgatcgctggagtcttggacgttcacctggcgaaattagctcaaatgcatggctgtacgtatactcggtacgccgatgatctgactttttccaccaataaagaagactttccagttgaaatcgcctttagaaatgactcaacaggccacacttggcgagttggggccgaactcaaccgcttgatcttacagagtggattctccattaatgagacgaaaactagaatgcagtacagggacagtagacagcaggtgaccgggttggtggtgaacaaaaaagtcaacgtctctacagagtatcggtaccttgtaagagcttatgttgcttccctggttaaaaacggcactttcacagtaaaaaggcaggcggtcggcgtagatggaaagccccaaacccttgaggaggaaggggtgacagctaaattgcacggcatgctgggcttcattcatagcgtagactcagtgttccggacagatgtgaagaaacacccttacaattaccccggacaacaggcgaacgagaagaagccaaccgggaatctggccatctataggcgatttttgatctataccagattctacgcaaacacagtgcctctgattgtgtgtgagggcaagacagacggagtgtacatcagcaatgcagtccatcaaaccaagaatatctttcccagtctagtgcggaaagatggtgaaggaaaagatgtgcttagcttccagctgctcaagtacgccagaaagcataagaagcgaaagaccgttcacttacccaattatagcacaattaccattcttgggggtggtagtgggggcggtgcgaatctcgggaatctgatacgcgcatatcactctgagctgagtaagtttaaggcccctaggggaaagcagccggtcatttttatagttgataacgattccgggggaaagacagtgttcaaagtggtgaaagacaccctcaagatgactattatagggaccgagtcatttgtccacctgttcgctaacctgtacgtcgtacccgttccattgggagaggacaaggagaggtctattgaagggctgttcgctccaattgacctcgccaagggccttaatggtaaaccgttcgacttttccagcgatagctcctcaggtacttcagtggggaaagccgactttgcatacgaatttgtggctaagcatgccaacgagctagactgggccggcttccaccccctgctcgaaaatatagtaggagcaatggatgactatgccgagagggtgcgggccgcagatctgtga

SEQ ID NO: 8300 - RNA, 1746 nt, unidentified
  source 1..1746: mol_type = other RNA; note = synthetic construct
atgctcctggacataaaacaccaggatctcacttacctgctctacgttaagaaggaccctgagcgctataatgtcttttccatcccgaaaagctcagggggtagcagggatatctgtgccccgacctcagaacttaaaagcctccaaagaaagctggccgctgccttggagcaatgcttagtagacatcgccgctctgacaaagcgcaccaataaagcctcccatggattcagacctggtaagagcattctcacaaacgccgcggctcacaggaataggcgctacgtctttaacctagacctgaaagatttcttcccatcgatttctggtcagagaattcggggattcctgattaatgaccgatattttgctttcgacgctaaggtagcaaccaccattgcacatatagcttgtcgtgatggcgtcctcccccaggggagtccatgctctccggtgataagcaacatgatcgctggaattctagatgcccacctgtcaaaactggcacagatgcacggctgtacgtatacccggtacgcagacgatcttaccttctccaccaataaagaggtgtttccagcagccatcgcatacagagacgacagcaaggaacattcttggcacgtcggagcagagctgcagaggttgatcctgcggtccggcttcagtatcaatgagaagaaaactcgcatgcagtaccgcgacagcagacagcaagtgactggcttggtggtgaacaaaaaagtgaacgtgagtacagagtatagatatcttgtccgagcctatgtggcctccttggtaaagaacgggaagtatacggtgaaacgccaggttcctgacgtacatggcaagctccagacttttgaggaagaaggcacacccgcaaagctccacggcatgctggggttcatccattctgtggattccgtctttaggacggacattaagcggcatccttataactatcctgggcagcaggctaatgaaaagaaacccaccggtaacttagccatctacagacgatttctgatctacactcggttttacgccaatacagttcctctgattgtttgcgaggggaagaccgatggggtctacattagtaacgccgtgcaccagagtaaaaacttgttcccatcgctggtaaaaaaaaatgtcgagaaagaggatgtgctgtcatttcaacttctaaaatatgctaggaagcacaagaagaagaagatggttcatttacccaactacagcaccattactatcctgggaggagggtccggtggaggagccaacctaggcaatttgatccgggcttaccatggggagctcgccaagttcaaatctcctggaggcaagcaaccagtcatttttatagttgataacgacagcggcggtaaaactgtgtttaaagtggttaaggacacacttaagctgactataacaggcgatgagagtttcgtgcacttgttcgccaatctgtacatcgtgcccgttccacttggcaacgcgaaggaaaggtccattgaagacttattttcacaggtggacatcgcaaaaggactgaatgggaagccctttgatttctcctctgaatcatctagcacaaccagtgtgggcaaggcagatttcgcttacgagttcgtcgccaaacaggcgaaggaactggattgggccggcttccaccccctccttgctaatatcgtgtctgcgatggacgattatgccgcgcgtctggctgccgctgcagcataa

SEQ ID NO: 8301 - RNA, 1746 nt, unidentified
  source 1..1746: mol_type = other RNA; note = synthetic construct
atgctgctggatatcaagcatcaagacttaacctacctgttatacgtgaagaaggatgcggagaagtacaacgtgttttctatcccgaaaaagagcgggggctcgagggacattcacgcacctatccctgagctgaaatcactccaaagaaaactggccactgccctcgaagagtgcatcgctgatatcgagaagctcaccaatcgcaagaataatgcaagccacgggtttcgcccgggaaagagcattctgacaaatgcatctgctcatcgcaataagcgttatgttttcaatatcgatctgaaggacttttttccaagcattacaggtaagagaattagggggttccttattaatgatcggaatttcggcttcgatgcaagcgtggcaactaccatcgctcacatcgcctgtcgcgacggaagacttcctcagggctctccctgttccccagtcataagcaatatgatcgccggaattctggacgctcatctgtccaaactcgccaaagcccatgggtgcatatatacacggtatgcagatgatatcacattctcaacgaataaagaggaatttcctactgccattgcatactgtgacgacgctaatgaacattgttggcgggtggggtctgagctctatcggttggtactccgatgcggctttagtgtaaacgaaaaaaagacccggatgcagtatcgagacagcaggcaacaggtgacaggactgattgtcaacaaaaagattaacgtctccacggagtatagatacctggtgagggcctatgtggctgccctcgtcaagaatggaaagtacaccattaaacggcaggtggcagacgctactggtaaattggagacagtgactgaagatggaacccccgcccagttgcacggcatgttggggttcatacactcagtcgattccgtcttccgtacggacgttaagaaacatccttacaattaccccggacaacaggtgtccgacaaaaagcccaccggcaatcttgccatatacaggcgcttcttaatctacacacgattctatgctaacaccctgccattgatagtttgcgagggcaagaccgatggcgtatacatcagtaacgccgtccaccagtccaagactattttcccctctctggttaaaaaagacggggaggggaaggacgtgctgtcctttcagttgctcaagtatgcccgcaagcacaaaaaaaagaagatggtacaccttccgaactattctacaattactatccttggcggcggaagcggcggtggagcaaacctaggtaacctgataagagcataccacggagaactgacaaggtttaaagctccccgaggcgaacagccagtgattttcatagttgacaacgactcaggcggtagaaccgtgtttcgtgtggtcaaagaggttgctaagatcaacatcacgggggaggaaaggttcatccatctcttttccaacctatatatcgtgcccatcccactggggagtgccaaggagcggtcgattgagtccctattttcagatgcggatatcgcgaaaggtctgaacggaaagccatttgacttctcagcggacagttctagtgccaccagcgctggtaaggccgactttgcctacgaattcgtggctaaacacgctaaagatatcgattggactggcttccatcctcttctggaaaacattgtcggggcaatgaacgattacagtgccagagtggccgcagcggccctatga

SEQ ID NO: 8302 - RNA, 1920 nt, unidentified
  source 1..1920: mol_type = other RNA; note = synthetic construct
atggctttcggcaacaatgtcagaacctatgcggcctccgggattattagacgtacaccctgtgtcgctcgcggccaattcgccatggagtgcctgaggggcccacattctatgctgctgcctaagaacaagctgcagtggtttcaagccgccaaaagccgcgccgagcttgccatattgttggacattaagcacaaagatctgacatacttactctacgtgaaaaaagaccctgagaagtacaagatcttctcgattcctaagaaatcagggggcagtcgcgatatccacgcacccatacctgaattaaagtccctgcagcgaaaacttgccactgcgctagaggagtgcatcgccgatgtggaggagctcactaacgaaaaaaataaagcaagccacggattttgccccggaaagagtattctaacaaacgccagtgtgcataggaataaacgatatgtgttcaatatcgacctggaagactttttcccctctatcaccggacagcgggtgagagggttctttattaaagacaagaacttcgcgttcgatccaagcgtggcaactgccatcgcccacattgcatgcagggatggtaaattgccccaggggagcccttgttctccggtgatctcaaacctgatcgctggcatcttggacgtccatctttccaagcttgctaaggttcacgggtgcatatataccagatacgccgacgacatcacattttccaccaataaagagaacttcccagctaccatcgcttaccgagacgaggctaacgagcactgttggaaggttggggaggaactgcgtagactgattctgaagtgtaggtttagcatcaacgaaaaaaaaaccagaatgcagtaccgctcaagtaggcagcaggtcactgggctggtggtgaataaacgagttaatgttacgagcgaatatcggtatttggtacgggcttatgtagccgctctcgtgaagaacgggaaatacactatcaagaggcagatagtagatgccacagggaagcaggagacaattagcacggatggtacccccgcccagctccatggtatgcttggcttcattcattcagttgattcagtattccgcaccgatgtaaggaaacacccgtataattatcctggacaacaggctaacgacaagaagcccactgggaacctggcaatctaccggcgcttcctgatctacaccagattttacgccaacgcactccccctcatcgtgtgtgagggcaagaccgatggcgtgtacattagcaatgcagtccaccaaacaaaatcgatttttccaagtctggtgaagaaagataaggatggcaaggacgtcttatctttccagctgcttaagtacgcacggaagcacaaaaagaaagacgccgtctatctcccaaactactctacgatcactattctgggtggcgggtccggtggcggagctaatttgggcaacctgatacgggcgtaccatggagaactgggaaaatttaaggctccacgtggtaagcagcccgtcatattcatcgtggataacgacagcggcgggaaaaaagtgttcagcgtcatcaaggaagttctgaagaaaaatctcaccggagaagagccttttgtgcggctgttctcaaatttgtatattgtgccgataccattaggtggaaataaggaaaggtccatcgaacagctcttttccgatgtggatattgcaaagggcctaaatggaaaatcttttgacttttctgcggactcttccagtacaacttccgtgggcaaggtcgacttcgcatacgagtttgtggcaaagcaagccaagaatattgactggaagggatttcatcctctccttcagaacatagttgccgcaatcgacgattatgctgctcacgttgtcgccgagggcctatga

SEQ ID NO: 8303 - RNA, 1839 nt, unidentified
  source 1..1839: mol_type = other RNA; note = synthetic construct
atggatactgcttatctgtatgtcaccattggaagtagaaagtcagtatgtggtgccacatttacggatggccatcatttccctaccgtagtcttaagttcattgtccagactgaaggctgccacctctagggcacatttggcaagcatcctgggtatcaagctccaggatctgacttacctgctctataagaagcccatctacaaaaagtacacttccttcgaaatccctaaaagaagcggcggcaagcgtaaaatcagcgcacctatagacagcctgaagtcgttgcagcggaaggtggcggaagtcctgcaggagtgcatttccgagatagaaacctctacaaagaaaatcaatcgcgctgcccatggatttagacttgataagtccattctgacaaacgccgctatgcaccggaataagcggtacgtttttaacattgacctggaggactttttcccatccattacatttcccaggatccgggggtttctgaccagcgataagaacttcaatctggccccagttgtggccaccactattgcgcaaatcgcgtgtttagagtctaaactcccacaagggtcaccatgcagccccgtgatatcaaacctcattgccgggatccttgacgtacacctgagccgcctagctaaggtgaatggatgtacatataccagatatgccgacgacatcacattctccacgaacaaaaaagactttcccatcgcaatagcaatcgagagtcagggtaatgctaatgtctgggtactgggccgtcagcttgccggtctgatcaagaagagcggcttctccgtcaacgtctctaagacccggatgcagtatcgaacgtcacggcaacaagtgacagggctagtggtgaacaaaaaaatctcggccccgaatgagtaccgacaccaggtgagggcatacgtcaactcgctggtaagaaggggtttttacatggtggataacggggaaaaagtggaagaaggggggattcagaaacttcatggaatgcttgggtttatccacgcagtggagagcgtgtacagaaccgacctccagcggcaaccatataattaccctggcgtggttatagacgagaggaggcccactggcaatttgagcatttatcgaaggttcttgttatatactcgcttctatgctaatcaccagcctttgcttatctgcgagggaaagactgacaacgtttatattggcaacgctattcaccagcgtaaatccgaatttcctctcctcatcaaaaagaatgacgatggaaaagatgtcatcagtttccagttcttcaagtacgccaggaaacatcgccgaaaaagtgatatctacctgccaaactatagcaccgctatgatcttaggcaacggtagcggagggggacccaatcttgccgggctaatgtccgcctaccgctcagagctcaaaaagttcaccagtccaggcgggaagtgcccggtgattttcattgttgattccgattctggcggaaagcctgtgtttaaggtgattgaaggcatcactaagaagaaaccttcaggtacagagctcttcatccacgtgtttgaaaacgtgtacgttattcccatttcaaaggatggcaaaagcaatgtctccatagaacacctgtttagtgagaacgataaaagcatattgatggacggcaagcccttcgacttttctggcgaatcttccgactctattctcggaaaagcgtctttcgcttacgactttgttgccaagtacccggagaagatcgactggtctggattctcacgcctgctgaaatctataagtgatattctggagctgcacaaagcatga

SEQ ID NO: 8304 - RNA, 1779 nt, unidentified
  source 1..1779: mol_type = other RNA; note = synthetic construct
atgtcctcctggggcagcacatacaaaatgcgcaagattgaagccttaaagtccgttaagtccataaacggactggcggacctcctgggctttaaggcttcggccttaggctacattttgtttaaactgcctgatgcacagaaatacaactcattcacgatccccaaacgttctgggggtcgacgctcgatcagtgcccctgtccccagattgatgcttcttcagaagaaaatatccaccctgctgaacgattgcctggcagagattgagggaaagcttagcagtccggctcatggctttaagctcgggagatcaatctttacaaacgcggctcaccacagaggcagacgctatgtccttaaccttgacctgaaagatttcttcccaagtatccattttggaaggatcgccggttacttcgagaagtccagggactttggtctggacccaaaaatagccaggattctagccaacgtattgtgtcataagtcatctcttccccagggaagtcccagctcaccggttgtttctaatctgttggcccggatgctcgatatccacctggccaaacttgcaaaacgcaatcgtctgacctataccagatatgcagatgatctgacattctcaactaacctgaatgtttttcctgaggcggtcgccaaaagggtcagcgagcatgtgtggcagctgggtcccgagctcatctctaccatcgggagttgcggatttagcattaacgatctgaagactcggatgctgtaccggagcagtcgacaagaggtgaccggcctcgtggtgaacgataaggttagcgtgccggtggagtatcggagatgggccagagctgctgttgcccgtctcgtgaagaccggagcatatttcaagcccactcctaaaggctttatcgggcctcaacctgctacacccgatgccgggtccctagaccacctcgaaggctgtttaagccacatctataatgctcaccggtttcagcggtcacaggctgctctgggaagagcactgcaccacgcgccagacgagctaaattccgacgaacacgtctacaggaggttcttattttacaccaagttctatgtgccagaaaaaccagtgatcgtgtgtgaaggggagacagatagtatatacattgccgctgctatttccgcaatggggggttactatccagatctcatagacgctaagctgaaacctggcgagcagaaccggttcaacgtccgcttcttcaagcattcttctattgccggcaggttgctggagctgaatggcggcacggatgccctgaagaacttctgcaggatttacgtggaccagaccaaaaagttcaaaggcggtttattgtctcagccaacaattgtgattgtagacaacgataaggctggccgagacgtggtcaattatgcaaagggaatcgccaagaatcaggggctcccagcaatcaaaggactgaattacgtattcacccgccccaatttgtacgtggtcagcattcagtctcctgccaacgcacctgactgcgtcatcgaagacctctttcccgcacatctactcaatactaaactcggggggaaggtgttgactctctccaatcaaaaggtaggtgacaatgaatacggaaagatgtatttcgccaaacatgtagttccacacgccgatcccaaagacttctctgggtttagccaacttctggacactctggtggaagtgatcgcggacttttcaagccgagtgcaagtccagccggccacaaagaaggcgtga

SEQ ID NO: 8305 - RNA, 1722 nt, unidentified
  source 1..1722: mol_type = other RNA; note = synthetic construct
atgaaacttggcaagcttcaggcagccacctcaactatcgatctggcgaacctcctgggatatcaaccgtcggcgttccactacttgatctataaactctctgaggccgccaagtactctgtctttcagattcccaaacggaatggcggaacgcgagaaatcagagccccagagccaaaactgaaactgctgcagcagcatctagcagaatatctgtctgaatgtctgaaggagattgaatcaagctccgactatgccagccctgcacacggcttcaagcctgggcgctccatttttactaatgcagaaatacacagacagaggcgctttgtcttgaatatcgatctcaaggacttctttactacaatccactttggacgggttaagggctacttcgagaaaagtcgggagtttaggcttaactccaccattgcactcgcgattgctaagatagcttgttatgacaggtgcctgccacaaggagcccctacaagtccagtgatctccaacctgatcggacgcgtactggacgggcatatgtgcaaactcgcaaaaaagcataaggtgacttatagcagatacgcagatgacctgactttctcgaccaatctaaaggagttcccgagcgcacttgccattcagaatgaggagcacaagtggcaccatggcaaagagctcggtgaggtggtgaagcacgccggctttgagatcaacgagaagaagacacgtgtgcagtaccgcgcaagccgccaggaggtgacaggtctgatcgttaatgaccgagtgtctatcagggctgaatacagagcttgggcgagagtggctgtgcacaggttggtgcataaggatgggtttttcgaaccaatcgctaaaaccttcgtcgggcctctcccaaatgagaaggctcctgggtcattgcggaagctcgaagggattctgtctttcatctacagtgcccaggtttttcgcagagagatgataattgagaagggcgggcagaacaaagagaagaaagccgaactgcattccgatgaacgactgtatcaaaaattcctctactacaccaagttctatcggaatgaaaagcccctgatcgtctgcgagggcaagaccgacaacgtgtatatacgagccgctatagtggcaatgggtgaaaagttccctacattaaaacaggaaaaaggcgagaaggacagccttcttgtacgtttttaccctcaccccaagtatggaaacaggctgctcgaaatgggcggaggaactgctgggttacggaatttttctcacacctacgtagataagagtagaaaattctcccaaattgcccccaggaatcccgttattatcgtcctggacgccgacgatgctggcaaatcagtatacagctttgcccagaagaatcacgccaaaaaggatgattttcagggtattgtctttttgcatccgaacctgtacttcatttgtatccctgagccaaaaaactccacacataaagcaattgaagggcttttcccctcagtcttgacggatcaaaagttaggcgacaaaagtttcaactggaagaacacgccactgaaggagaaagaatatggtaaagcctactttgctaaaaacatagtgcctttggccacccccgaaatgttcgttgaatttacacccttactagagggaatcgcggctgccatcgagcacttccgtaaactgcccgaggccaagagctga

SEQ ID NO: 8306 - RNA, 1806 nt, unidentified
  source 1..1806: mol_type = other RNA; note = synthetic construct
atgggaccactcgattaccaagccgtgctttacatgtcgcagctaatcgctctgcgtaacgcagacacaagacgcgagatggctgccctcctgggctacgaatctagcaagctcacctatgccctgcacggcttgaaagaggagagtcgttacactcagttcgccattcctaagaaaaacggtgggcaccgcaccatctctgcgcctgatgacgctacaaaggcattacagaggaagctggctgccctgctggccaattgcgtgagagagatccgctccgttgaaagccctaggctgccaggccagagaagaggagtactgagccacggattcgaacccggcctaagcatcatcacaaatgctcgggtgcatcgaaaacggcggtgggtctttaatatcgatctggccgatttctttgattctatccatttcggacgggttagaggatattttgaaaacaacaggaactttcagctcaagcctatagccgcgcttgtcatcgctcagattgcttgcttcaagagcaagctgcctcaggggagtccgagctcaccggtcatcgccaacctggttgcctccattctagacatacatctgtcccggcttgcaacccaggtagggtgtagctatacaaggtatgctgacgacctgaccttctctaccaaccaggaggaatttccttcagccattgcacaccaagtggatcgcgactctaacagatgggaggcctctaaagagctcgtagatgtgatctcccgatcggggtttaaactgaattcccggaagacacgcatgcagtacaggcactcacgccaggaagtcactgggctggtggtaaacagggtcgtaaatgtccctagtgagtatcggagagaggtgagagcgcgtgtccatcggctcataactaagggcgagttttacattagtggtatcggcgaagcaggccaaagcacccaggtcgctgggactcccgcacaactgaggggcatgcttgccttcattgacagggtggacttattcaatctcaatttggcccgggagtcaaagggcgaaccacccatcactcccgcatcagacttggtggatttgacgcggaatgaagaaacgtataggaagttcctgtatttcacagagttctatgcaacaccacttccactcgtgatatgcgaaggatccaccgattacgtttacttagtgcatgcaattcgcgctttggtggatgactttcccgagctggcttacaggaccggggacgaagagattaaatttaagatccgtttctaccggtacccacgcaacagcacgcgccgtttgacaaggatccgaggtggcaccgctgatctcaagaaatttgtggccacttatggcgcggaggtgcagagattcaaagctgggggtcagcaacaccccgtgatagtggacaatgatgccgcaggcagagaggtctacggacccgcaaaaaaactaggagtcgtttttaacaagagtcggccccttacccgagtgagtgccaatctgtatctcactgccacccctttactgggtgccgacgagtcttgtattgagtcactgttcaagacggaagatacagccagattagttgatgggaagtcctttgacccggacgacaaagccgaccgatccctgacatactctaaggcggtgttcgcccaccagattgtggcaaaacacgctgcacacatcaactttgatcgcttcaggcccttgctcgctagcctttcagacgctgttactatgcatagagagtcccgaaccgaagaggttgccccagcggccattacttga

SEQ ID NO: 8307 - RNA, 1815 nt, unidentified
  source 1..1815: mol_type = other RNA; note = synthetic construct
atgatggttaactatctgaaagaacttcagcaagctaaatcattacaagacctcgctaaactcttgggtactaatgagtccaacctaaacatcctgctctacaaaattagtaggaagtcactgtatagaaccttcgagatccctaagaaaggaggcggcttcaggatcatctcttccccagacgaaagcctgaaagtcgttcagaagcgcctggccagcatactgtcttccatattggagccgaactatcagttgaaacacaagaagaaacttcaaaatcccaagaaagagcgggccacccgggcttactctaacaagagcgtgagtcatgcatttaagcagaacctaagtatagcgaccaatgccgaacagcatctgaagaaaaagtacgtgctgaacttggatctcgaggatttttttggcagcatcaatttcggcagagtgcggggcttcttcattaaggacaagcagttcaagctggaccccgtggtggccacacacattgctaatatcatttgccatatggacaaattgccccagggatcaccctgttccccggtgatgtctaatttgattggacgcctgttagataggcacttactccgattagcaaaccggcgtggttgtttctacactcgatacgccgatgatctcacttttagctttaatggcccaaaatttccaaccgaaattgctatcctcgaacaggaccagtgggtcatcggggacgccctgaccgaggtgattgaaaaatcgggctttaagattaagaagtctaaggtcaggatgcattataggacttctagacagatggtgacagggttggtcgtgaattgccacgtaaacgtgccagccgaatactaccgcgacacaagaagtatgtgtctcaacatctttacgactggatcctgttacctgaaaacaaatcggaataagaaccttagtatgcagcaactggaggggcgactcaattacatctaccagatcaagaaattcaagaacatctatgctgaccaggggggatatcgccactccagacacaatggaaagtacaaatcggactcaaatctggaccggtccacccaatatgccgacaactcccatcaggttagcctggatggtataaaaaacatctacggccgttttcttttttacaagaattttttcgccccacaaatgcctctgatttattgtgaagggaagactgaccccgtgtacttaaaatgcgcacttctcgcgctggaaactaagtattcaggcatggtcagcagtggcaagcttaatgtcaggttttttgccggcaataatctcgacggggagatgatgaagcttgtcgatggtacaggtgggatgaagtacctgattagctcttacaatcgcatgaaaaaggagtgcaaattcaacggcgtgcccctgcaccctgtaattattgtagtggataacgattccgccggactggaggtgaagaaggcagctaaaaaaaaacgttccatgacgaacggggtctttcacattttccacaacctctatatcctagagatacctaaaaaccctaccgacgcggtggaaaccgttatcgaggattatttcacagataaaaccctgaacatgaagttcaaaggaaaaacattcaagtcaggggatctggacgagaaggatgcagtaaaccatttcggaaaagcagttctgtctatgcttgtgaagaagagatgcaaaaagatcgatttttcaaagttcagcgaaatattcgacaaggttgatgagattatcaaagactatcagacgatcctaagcacaaagaccagccaggagtga

SEQ ID NO: 8308 - RNA, 1686 nt, unidentified
  source 1..1686: mol_type = other RNA; note = synthetic construct
atgagttatctcgagcgactcaaaagttgctcaaatctgaaagagttcgcagagtatctggggtacaaacctagtaacctttcttatctgctgtacgtgttgaacgatgacttgaaatatcgaaccttcgaaatctccaagaaaagcaaagaggcccgggtgattaaagcaccagaaaagtctcttaaagggctccagcgtagactggccagccgcttggagaattgtcagaaggaaatcgagagcaacctgggcattgtgaaccccgtaagccatggtttcagaaaagggcacagcattgcgacaaatgccaacatccacaaaaggaaacgctacgtgtttaatctagacattaaggacttcttcggcacattggattttggcagggttcggggattcttcataaagaactataactacgagctggctcccgaggtggcaacgataatcgcacagatctcatgctttgataactctctccctcaaggaagtccatgtagccctataattagcaaccttattggcaatatccttgatgtgaaactccttaagctggctaaaaagaatggatgtcactacagcagatacgctgacgatctcacatttagcactaatcagaaagtttttcccgctgacattgccatccaagaccctattaagggcgactgggattgcggcgcggagatctacaagatcatgaagttggtgaggttccagattaatgactccaagacacggatgctgtatcgcaatagtcggcagttagttactggcctggtggtcaacagaaaggtaaatattgcagcagactattggcgcgatactagagctatgctgtggaacctcttcaatactggatcgttttttatcaaagacaactcagaagaggtggccgaagggaccctgagccagctcaacggccgcttagatttcatctaccagattgacgcctataataccaacaagagtaaaggagagaatgttaaaaccgctaagaaagaagcctacaagaagtttctgttcttcaagtccttctatgtcaacgaaatgccaactatagtatgtgagggtaaaacagatcccatttacctaaaatgcgctctcgaatctctcgccgattcacacagggaacttatcgataaggacggaaagctgaatatcgggctgttcaattactccaaggtggccgcggacgtcctggagttatctggcggtaacgccccgatatctaagttcctggaccaataccagaagatgttttcattgtttagggtcaactcctcccaaaatccaacgattataatcctagacaatgacggcgcgggactgcgaacccttaatcatgccaaaagaggggccacctctgaggttaaaatggacggtttcgatgagcccatacagtgcttgccggaaaacatttatgtctttaggattccacggatcattgacaaagacctggaaattgaagattactttaaggaggaggcttttcagatcaagctgaacgagaagtcctttaaacgtaagggtgtcatcgataagaagaaggagttcgggaagtttttattcgctgaaaagatcgtgaagaacaacaagaagaacatagatttctctcagttttcactgatctttaatgtgatccagcaaatcatctcccattcgaaagcatccgcccctaccgattga

SEQ ID NO: 8309 - RNA, 1734 nt, unidentified
  source 1..1734: mol_type = other RNA; note = synthetic construct
atgaacgatttttcaaagttgaaggcccttcagaagacgactacattatcagagcttgcccatctgctccgagtccagccaaagacactgtcttacaacatatacatcatcgacaagaacaaaacaacgactaagaagtattccgaattctctatccctaagaaaagtggaggaactaggatcattctggcccccaatcaaaatctgaaattcatccagtcccagttgtcaaagattctgtattcatgtatcgacgagattaacaaagagaaaggtgttacaggtagtctatcttttgggtaccgtaaaaagtcgtccattttcgacaacgctaaggtccacaagaagaagaaattcgttttcaacattgacctgaagaactatttcgacagcataaactttgggagggtaaggggcttcttcatcaagaaccggaatttttgcctggacgagaatgtagctaccgtgattgcacagatcgcttgtcataataacattctcccacaggggagtccagtcagtcctgtgatttctaatctgattggccacattttggatattcgattgagcaagatagcaagcagctgcgggtgttcctactcaagatactgtgatgacattaccttctccaccaatgaaaaagtgttcccgaaaaaactggcctattctaatacagacaagacctggcatccgtccaaactgcttatctccattgtcagccagtctggctttgagattaatatgcagaaagtgcgcatgagcctgttttacagccagcaacgggtcactggcttaactgtgaataagaaggttaatacgactcgcgcttacagagatctggtgcgagccctggtgcactccctctgcactaaaggagactttgagtttcgcggtgacttttacaaagataagatctccgaaaccaataaacttaacagtctacaaggcatgctcaactatatctcaaggatcgagtaccaagaacttagaggcaatagggagaacaaacggttctatccaaacataaacaaactcaccaagagtgaaataacccttcgtgattatgtgctctttcgctactttttcaatcctgagaaagtcacaatctttggggaaggaaagaccgataaaagtcacctgaagcattatctgaacttcaggtcgaacattgatacaagcaagaatccaatgcccgagagcttttctgactggaagaatatgaattttcacgatttcgagtcaagaattttcgacgtcatcagcaaaagcggaggcacaggcgacatcaaaaagctggtaaccgagtacaagaaatactgcaacaagttctgcatccccgaggttcagaatcccgtgataatactggttgatgatgacgacggatccgcggatctcttgatgaaactggagaaggtgaagaaagataagctcattaaagtggtgagaaaggacttctatcacatcgacaataacctgtacttaatctttctacctcggatcaactcaaccgataccgatatcgaatctttctatagcaaggaagttatagacatcccccgcaatgggttgtactttgagaaatccaacctctctaataacaagcggaactattctaagaaagtattcgcaactgagattatacctagaaaccaggaattagtggattggagcaaattcgaccagatcttcgaaaaagtgcaactcgccatcgaacattttcagagtaagaagtga

SEQ ID NO: 8310 - RNA, 1752 nt, unidentified
  source 1..1752: mol_type = other RNA; note = synthetic construct
atgagcgcccttaagaaactcaaaagtgcatgcgatataaatgacctcgccaagctgctgaattttaaatcctctaacatcgcatacatcatttaccggttgaaggaagaggagaaatattcatcctttgagatcaagaagtcctccggcgggctgagaacaattgatgcaccagagcccaaactaaagaatcttcagagcaatctggcatatctcctacaggagtgcctgactgaaatcgagaagacctcccaaattaaatcaaccgcctcacaagcttttcagcccaagaaatccattatcaccaacgcctccctacatcggaagaaaaggttcctgttcaatttagatatcgagaactacttcggcagcattaattttggtcgagttcgcgggttcttcatcaaaaataagaatttcgagctcgatcccaagattgccaccctgattgcacagatcgcttgttatcgcaaccgtttaccccagggaagccctgccagcccaataattagcaacctcatttctcacatccttgatatgaggctcatcgaactttctgcaaagaataaatgcttctacacaaggtatgctgacgatataacatttagtacgaatcttacggagttcccacctgaaatcgcctatgagagcgaagataagatctggagcccttcacagaagctcactaagctgatcctgaaaaacgggttcaacataaactatcagaaagtgcggatgcaactccattttagcagacaggaagtgactggactaactactaacagaatcattaacacaccgattgagtatcgaaaaaatgctcgggccatggtgcgcagtttgatcatgaaaggctcttttcacatgcctaaagaagagcaggaagcctccgtggaacaacttcacggaattctgtctttcatagaccacgtgaagttggtcacaaagcacgggcattcaaacgacccccattcgttacctgccgccaaagaggagaaaaaatcatctttcgagaaagactttgcggattttctgttttataagtactgttacgcgccgaccaagccactcattatttgtgaaggtaagaccgacaacatctacctgaaatgcgctattaagtcattggattccaagtaccccaaactgatacaccctaataacaaacaggacttcaagattgacttcttcaaatactctagaagtcaggggggcgactcgcagaagggacgtctgttagaattgagagggggcgagggtaatttgaagaatttcatctctgcctatgataagaagtgtaccaagatccgagctcccgggaagcttcacccagtcattgtactgatagacaacgataagggcggcaagcagattctgagcctgatcaagaatctgaaaagagagactagtacggtcacaggaaatgaggactactactttatcaacaacaacctgtacgttatcccaataccggatattatgggaaacaaaaatacaaccatcgaggactttttttacaagaagaccctgaaccggaagattaacggtagggtttttaaccgcaagaatgaccacagtggcaaaaatttctacggcaaatacgaatttgctcaaaaaatcgtacagaaggacttgaagaacatcaacttcaagaaattcatcaagatcctcgataggtttgaactggtgatatccgactataaaaggtatctcaagagtaaagcgctgcagaatagccgcgctaatcattga

SEQ ID NO: 8311 - RNA, 1722 nt, unidentified
  source 1..1722: mol_type = other RNA; note = synthetic construct
atgaccactatggtgtcccggttacaggcttgcattgggaggtctgatctctccagtctgctggggttcaagcccaaggcattcgcgtacgtcctttttcatgtggctgacgctgaaaagtatacagacttcgaaattcccaaaaagaacggaggggtgcgtgtaatatcagctcccatccctcaactgaaactgctgcagtcacgactcagcgagtgtctgcagacctgcctcgctgaaatcgaaaaagccgatggcgtgaaggagtcctgcgccatctctcatggctttcggaagggcaggtctatttacagtaatgcggaagtgcacaagggccgcaggtgggtgttcaatatcgacctggaggactttttcccttcaattaacttcggcagggtgagagggtacttcattaaaaacaagaactttgccctctcacccgacgttgcaactgtgatcgcccagatcgcttgccataaaaatgctttaccacagggaagtccgtgctcccctgtcattagtaaccttctggcccacatgttggatatgaggatcagtcgaatagctaagaaagcccggtgttcctacacaagatatgcagatgacctcactttcagctgtagcaaaaaactctttcctgatgggattgcccaattatcccaggcggaccagggcgtgtggattccatctgataaacttcgccatacgatcttctcttccggtttcaagatcaacaaaagtaagactcgtatgcaggtttactggagcaggcaagatgccacgggcctggtcgtcaacgccaaagtcaacgttccacgcgaatacgtgaaaacagcaagagcccagtgtcatcaactgataacgaagggaagcgtgttcaataaggaggagttgtgggggcaggacgtcaaagtgccctatgatcctgctaaactacaaggcaagctgtctcacatattcaatatcaaagggcaggatctgaatttcgagagacagaagggttcactgaaaacatggccaaatttttaccgggactatcgcagcttcctcgactatcagtcgttcggatccagcccaaagcctgtgtttctgttcgagggaaaaaccgacaacatttatatccgttgtgctttgaattctctggccgctgactatccggaactgatctctgatggggctccaaagcagttaatggtgcgcctctttaactacagccggccaaccaatgccgtacagcagcttgcaggaggcaccggtgacctgcaactcttgattaacaattacgagcttagactgagaggattttcggcagcgacactggcctttcctgttatcctcgtggtagacaatgataaaggatccaccgacctattcaaggcagcaggaagtaagtcagacaccaaagcgaaagtcgatggttcccagcccttttatcacataaccaagaatctttacctcgtccctacaccaacccccaaggggatggttgagagctatattgaaacatttctgcccaacagcgttttgaagaagaagctaggcaaaaagacttttcacctgccggagaagggctttgacgtgactaaacactttggcaaggtactattggccgagcagatcgtgcagcggcaacaaaaggccatctcatttgtcggtttcaagcctcttttggataacatgcgagccgcaatgcaggattacgccgccaagatggcaccctga

SEQ ID NO: 8312 - RNA, 1776 nt, unidentified
  source 1..1776: mol_type = other RNA; note = synthetic construct
atgacattgacggtaatcctccgcattgagagcgcctgcaaacttaccatgtccattgaacgcatgaaccagctgaagaactctcaggggaaatttggattcgcaaacgccctgggtatttctctcaaacagctcaccagggcagtgtacggtattccagtccaaaataggtacagcacttttctgatccccaaatccaccggtggccacagggtgatacatgtgccccaccgagagattaagtttgtccagaaggctctggctaaccttcttcagatctgtctctccgaaatcgagacaaagaagggagtggtgaggccagtgagccatggatttcaccccgggcgatctatttttagcaatgcgtgggcgcacaggaataagaactatgtcatgaacttcgatttggagaatttttttcactccattcactttggtagaatatgttccttcttcgagaaaaacaacgactttctcctgcacccgaaagtggccaatctgattgcaaacctgtcctgtcaccggatagatggaggcggtacattcctgccacagggaagtccttgctctccaatcatcagtaactttatagctatgcctctagaccagaaattaaggaaattagcccgagataacggatgtcggtactcacggtacgccgatgatatcaccttttccactaataaggacctattccccgacgatattgccattttcgacgtgtcatctaagaagtggatcgccggcagcggaatcctgaaagtcatttccaagagtgggtttaagctgaatattcagaagactaacatgtcaatcgctggcacccgccagatagtgactggcctggtcgttaataagcaggtaagcgttagtcgaccagtttacaagtgggctagagcggcggccgatcatatgttcaaggacggcgttgccttcaagagagatcctagcacagcttcaatccatacgacggatcgccaagttaccctcgggcacatcattggccaggtgaatcatatttgctacgcacgtagaaagtcgaatatcccattactgaattctagaaagatggtggggcccgaattgctctatcgccggttgacctattatgagcggttctttgctcataaggaaacccttatcatctgcgagggcgagacagataacacctacctcaaaatcgccatcgacaagctcgggcataagtttaagaacgtagcccgcagggcagacggaaacccccaggtaaaactgttgaatgtgaccccgcacatcacaatctatacagcactcaatggcggctccgaccaacaaaaaagcttccttcaaaactacgacaatgatatgtcaatcgtgggcgaacgttgggctgacaaatgcgtgataattttcggcgacaacgattctggggccaactcaattatgcagatattgagaggaaagagcatcattcctggggacataaaaactgcagacttcacttattacactcgtaatctttatgtcatcctgacacctattcccaacaaaaatagcatctctatgattgaagacttcctagaccctaacgccagtcgggttaagctggaaaataaagtgttccatctgggcgggaaaggtttcgatgaaaaaaaacactatgggaagaaagctctgagtgagcacgtccggcagaatgccagtaagtacgacttttccaagttcgagattatcctgaaaaggatagacctagccatcgatgattactcgtcaagactggctgcattaaagctgtga

SEQ ID NO: 8313 - RNA, 1728 nt, unidentified
  source 1..1728: mol_type = other RNA; note = synthetic construct
atgtccaatggccagctggatcgattaaagaatgcccaaggaaagcttggtctagcaatggctctgggggtccccctgcgtcaactcacaagggctgtgtatggcataccaatccccaacaggtatactgtttttgagattcgaaaatcttccggcgggtcgaggatcattcacgtacctcacagagaaataaaattcgtacagaagagcctcgcccagttactgcagagctgtctgtctgaaattgaaacccgcaatggcgttaagcacccagtgtctcatgggtttcaccccaaacggagtattttcagcaatgcttggccgcaccgaaacaagaactacgtgatgaatctggatcttgaggactttttccattctatccattttgggagagtgtacggatattttgaaaaaaacaacgacttcctcctgaatcctaaggtggcaaatttaatagccaacatctcctgccacagaaatgacgtgggtggaacctttctgccgcaagggagcccctgttcgccagtcataagcaacctgatagcaaggccccttgattcaaagctgagaatcttcgctaaagagaataagtgccggtatactcggtacgctgacgacataactttttccacgaacctcgataactttccagaaagtatcgctctgctggattcagtcaagaaatactgggtggtgggtagtggtactacgaagattatcactaaatctggcttccggttgaatctgggaaagacgagaatgagtgttgccgggacacgccagatggtcaccggactagtggtcaaccggcaggtgtccgttaataagaccacttacaaatgggccagagcagcatccgatcgccttttcaaagagggcgttgcctttaaacgggacccttcaaccgcctctattcataccacagatcgtcaggtcaccattgcccagttgatcggtcaggtgaatcacatttgtcatgcgcgccgcaagagcaacattccattactgcattcaagggatatggtcggacctgagctgttgtaccgaaggctgacctactacgaccgcttcttctccaataaaaacacactcatcatttgcgagggagaaactgacaacatatacctgaagatcgcgcttaaaaaattcggcgcgaacttcaaaaatctctataatcacgtggacgacaaggccaccgttcagctgttgaatatcaccacacacgtaacctcatatacagccctcaacggcggctcagaccagcagaaaagcttccttcagaactttgacaatgacatgaggattgtgaaggacaggtgggccgataagcctgtgatcctattgggggataacgatagtggcgccaatgcaattatgcaaatcttgcgtgggaagagcattatcgctggggacatcaagacagcccaattcacacactatatcaaaaacctctatgtgatcttcacacccgtaacttcaaagacggataacagtatgatcgaggactttctggatcctaaggcttccaaggctattcttggaggtaagagctttcacttgggagggaagggctttgatgagaaaaaacattacggcaaaaaggcactcgccgaacatgtgaaggagaacgctgataagtacgacttctccagcttcaactctatcctaaaaagactggacctggcagtcggcgattatgcggagagactcgctcggtctatggcctga

SEQ ID NO: 8314 - RNA, 1761 nt, unidentified
  source 1..1761: mol_type = other RNA; note = synthetic construct
atgtcctctcttccaagcgaaagtaccctggagagacttaaggcctgcaaggggaagcttggccttgcgatgctgctcggcgtacagttgaagcatctgacccacgccctatacggcattccgatgcctgtgcgctatgctgtgtttactattccaaaatccagcggaggggtaagaattatccatgctcctaacgacagactcaagtttgtgcaaagtgccctggctgctgtcctgcaggagtgtctgatagaaatcgaaactaagtcaggggtccagcggcctgtatctcacgccttccaccccaaacgtagcatcttcagtaatgcttgggttcacagacgcaagcggtttgtcgttaactttgacctgcaggatttttttcctagcctacacttcggtcgcgtgtgcaaattcttcgaaaagagctccgacttccagctccatcccaaagtggccaacctgatcgctaatctggcaacccacccagatggagctgggggcaccttcctgccacaaggatcaccctgttcacctgtgattagtaacctcttaaccaggccactggatcttagactgcgaaagctcgcacagcgctgcgactgtaggtattcacggtatgccgacgatctcacattctcgtcaaacactactgcatttcccgaagccatagctaagctagacaacgagtgttggattgctggggacgaattcgagaagatcgtagtccaatctggcttcttcctgaatcacgctaagacacgcatggctctgaaaggtaccagacaggtcgtcactgggttggtggtcaacaaacaagtttctgtgaaccgagatacgtacaagtggctgcgtgctgcatgtgattctatgttcaagaagggaatcgcgtcacggcatgatccacggacggtgaaggtttacaccatggccaggaaattggaactgaagcagttaattggacatgcagagcacgtgtttcatgcaaggcggaagtccggtattgagctgcccgccatgtccctgatgaaaggacccgagctcctcttgaaacgtctgatttattacgagcgcttctttgcgcatgataggcccatcgttatttgcgagggcgacaccgactatgtttacctgaggatagccttggccaaattcggtcatcagttcgcaaatctggcgccttcgaaagaaggattaccggcaattcggtttttgagatttactcctgtgatcggcaggttcacagggctccaaggagggtctgatcagcttaagacatttttgcagaattgggatgtgaatatggccatggtgggcgacaggtatcccagccagccagttatcctctttatggacaatgacagcggagcaaacgcgacaatgcagatcctccgaggcaaaaaggtgatctcccaagatatcaaaatgatggaattcacgcacgctacaaaaaacctttacgtgatcttcactccagtgcctgatgtgaaaagccagtcctgcatagaggattttgtggaccctacagccaaaagtgttaagctggacggcaaaacatttcacccgggtgggaatgcaacctaccagggcaagaaatggagcgacaccctgcactacggcaaacgagtcctagccgagaaggtagtggccgagaatgtggccaaatacgacttttctttattcaagcccatactcgatagattagataaggcaatcgccgactatcccaagcaggtcgccaaaattgtcgcctccaagtga

SEQ ID NO: 8315 - RNA, 1647 nt, unidentified
  source 1..1647: mol_type = other RNA; note = synthetic construct
atgaagtacctcaaaaggttgcaggacgcaagaacaactgaagacttcgctaagctgctcggtttcaaggccgggaacgtgagttatctcgtatatcattattccggccagaaatactacagcttccaaataccaaaaaagaatggaggcactcggaccatcaacgcacctaacgatgagctcaaaaaccttcagaggcggctctcagactacttgtataaatgcttagaggaaatccacctccaaaacaatattcatgacacagtgtcctatggatatcagaagaacaagtgcatctacgacaatgcccttatccatcggaatcgaaggtacgtgtttaatgttgacctaaaggacttcttcaattctatcaacttcggtagagtgagaggcttcttcattaacaacaagaactttaagctggatccccacattgccaccctcattgcacagacagcgtgtaacgacaatattctcccccagggctccccgctgagccctataattactattctgatcgggggaatattggaccatcgcatactacgtctgactcacaaaattaggtgcagctactctaggtacgtggatgatttgacctttagcacgaacctgaaaactttcccccctgagattgctttttttgatgagacaggtaaatgggtcatcggaaaggagcttaataacatcttgaaaacgagtggttttgaatctaacgaaaagaaagtctccatgcaatacaaggatagtcgacaaacaagcgttggcctgatagtaaataaaaaggtggacgtgccacgcgaatattataaaaccgtaagagccatgtgtaattcgctaatcacccgtggctactttgtcaaaaaagacgccgctgaggatgaaccccccactcttaaccagcttgaggggatgctgaattacattttctcagtgaagtccaagaataccaatgtccgggtgaaagaccactatccaggcttccagaacatatacatcgatttctatatctaccgctttttcttcgctaacgagaagccgatcttattcactgagggcaaaacggacatcatttatattagatctgcgctgaaacatctcaaggccgagtacccaaaactgatcacctcggaggggctgctgaactttcagctgatgtggatcaacgactatttacagtccgtcttccacatctctagcggatgttccggatcactgaaactgctcgttcagtatgagtcatttctgaagcgctacaaaaagaccgaatctatgaaccaagttttttttctgttcgaccacgatagtgggattaaggagatcgtgaacaaatacaagaagtacgattccgccaaggattacttcagcaagaatgacttttctagtttaagtgtcgaagtctataagaatgtgcggtttatctttacacacgaggaacatgataagtacatcgaacagtatttcgatgaggctcttctgtcagagaaaattaatggcaagtcatttacacctgagaacaatgtgcacgatcctgaacactatttcgggaagcaggtttttgcaaccaagataatcaagaaaaagcaggacagcattgattacagcaattttcgaccactgttcaatgaattgtccaaatacctgtga

SEQ ID NO: 8316 - RNA, 1689 nt, unidentified
  source 1..1689: mol_type = other RNA; note = synthetic construct
atgtccttcctcactaaactgaaacaggccaaaaatgtgagtgacgtagctcatattttgggatgcagtccagccgctctgacgtatacaatctacaagaataacgcgaaatacaccacattcaagattaagaagaagtccggtggggagagatgtattacttcacctgatcggaagcttaaagaactccagaaaaggctcgctaaaggcctgcaagagtattttgatgagattaacaaaggacgcgataccgagacttccgcccatggttttgtgaaaggcaaatcaattctaacgaacgcctacaaacacaagaacaagaatctcgtcttaaatatcgatctggagaattttttcgacaccatcaactttggccgtgtgagaggttactttatctataataaagggttcgcactaacagagaaagtcgcttctgtcatcgcacaaatcgcatgcaacgaaaataagctgccccaggggagtccttgttcacccattatcagcaatcttatcggacagatactggacgttaagctttcctctatggccaaaaagaacaaatgcttctatacccgctacgtagatgatatcacattttcaacgaatcagaaagccttcccagagtcaatcgcaaatatcaacgatacacaagtgataatcgggaagaagctgagaaacgaaatagagaaggccggctttaaggttaacgatagtaaaactaggatgcagcttcggaacagcaggcaggacgtgacgggcctggtggtgaatcaaaaggtgagtgtcagatctgagatgagacacttagcacgtgccatgaccgacagtttcttcaaaaacaatactgcgtttatcagcatagatgggaaggaggagaatatttctatcgaacgcctcaacgggattttgagctttatctataacattaggaccggcgtatatggggcaaacggctgtaagaacactagcttgcacgactctttcgaaagaatgtacgcttgcttcttgttctataagaattttgccgccaacaagtctaccgttataatttgcgagggagagacagacaatatttacttgaagtacgcttttcgatccctcgtgggttgttatcctgaactgcaggtgattaagaagggagtaaaaaagcggctggatctgtctatctatcgacagaccaaaacccttgagaatctgctcaatatcaccgatggaacaggcaacaacatcaagttcattaaaacctaccgccagtccatgcgacggtatgcttcccccccgaaagtttttccagtgatcgttctgctagacaatgattcgggttcatcctccatagacggaataatcaatcgcgacttcatcgacacaagggaggtgtgcgatggctttacatacgtctgtgaaaatctgtacattgtcaagactcccctgatcgataagaagaaggaatcgaaaattgaagacttctttgacagccacacattaagcaaaaccctcggctctaaaacctttactagcgaaaacaagttcgacaaagagcagcattatgggaagaaaaaattcgccgaaataattgtgaagcaaaactacaaggagattgacttcagcaactttaagaagattatcgacctgttcaatgacgtcatactgcactaccaggaaaagcggaaccagaggtttaacttctga

SEQ ID NO: 8317 - RNA, 1674 nt, unidentified
  source 1..1674: mol_type = other RNA; note = synthetic construct
atgagctttctcgctaagcttaaacaagcccagtccacatcggatattgccaaaatccttggatgtagcccagcagcgcttacctatacgctgtataaaaatcgaaccaagtacacagagttcaaaattaagaagaagaacggaggagaaagaatcatttcagtgcctgagaaaaagctgaaagaactccagaggcggttgtccaagggcttacaggagtgcataaatgaaatcaacgctaagaggaagttcgagacttcttctcacggcttcgttaaaggaaaaagcatctttactaacgcttacaagcataagaacaagaatctggtgctgaacatcgatctcgctaacttcttcgactccatcaatttcggccgtgtgcggggatatttcatacataaccgcgagtttgccctatctgacaaagtgagcagtattttggcccagattgtctgctacgacaataagctcccccagggatccccgtgttctccagtgatttctaatctgatagcccagattcttgacgtgaaattgtccgctctggccaagaagcacaattgttactacacacgttatgtcgatgacattaccttttcaaccaaccaaaacaaattctcagccagcatcatctcctttcaggaacgagaggttatcgtaagcgggcagttgaaaaaggaaatagagagggcagggtttaaaatcaactccgggaaaaccagactacagtttaagaattcaaggcaggatgtgacaggtctggtggtgaacaaaaaggtaaacgtcaaacacgaattgaaacatatcgcaagagccatgaccaattcattttttaagctaaacagcgcgtacatctcaattgataatcgcgttgaggaagtgtctctggacaggctaaacggaatgctcagttttatataccacattcgctccaagatgaatgacaacaatgacaccaagaataaaggcacacttgatagtttcgacaaaatgtactctaagttcctgttttacaagacctttgcagctaacaagagtacagtggtaatttgtgagggcgagactgacaatatctatctgcagtacgcgttccaaaatctggtcggtagctatccagagttgcagctgatcaaaaaaggcgtcaagaagaagatcaacattttcctgtacaagcagaccaaaacattaagtcacctgctgaatgttactgatggcacgggtaacaacatcaaactcataaagacctacaagcagaatatgtctggtttcgtatgccctccccaaaactatcccgtgatccttctcatggataacgacagtgggtccaatgggatcgaaggcttaattaatcgggacttttcagatactcgcaaaatacatgatgggtatacctatgtctgcgagaatttatatgtggtgaagacgcctctgatagacggcaaaaaggaaactaaaatcgaggacttcttcgattgcaagactctcagcaaaaagctgggggataagacatttagcgcatcgaacaattttgacaaaagcctctatttcggcaagagaaaattcgccgaactgatcgttaaacagaaccacaaggagattgatttctccaacttcaagatgattatcgacctgttttacctcgtcatttgtgattaccaaaagcggctgagttga

SEQ ID NO: 8318 - RNA, 1347 nt, unidentified
  source 1..1347: mol_type = other RNA; note = synthetic construct
atgtcctttctggcgaagcttaaggagtcccagaacatctctgatatcgcaaatctgttgggatgcagcccaaaaagtctcgcatacacgatatacaagtcacagaacaattacatcacattcaagattaggaagaagaacggtgggcatcgggatatcaaagcacctgctaagaaacttaaggaattacagcggcgtttggcaaagggcctccaggaatgcatcgaggagatcaatggcaaaaaaaataagcgaatcagttctcatgggtatacaaagggcaagtcaatctttaccaatgcctatgagcataagaataaaaacctggtgctgaatcttgatttggagaatttcttcgactcaattaacttcggcagagtaagaggttacttcatccacaacaaaaacttcatgttgcccgagaagaccgccacaattattgctcaaatcgcgtgccatgagaattctcttccacagggatccccttgttctccggtcataagcaatatgatcgcccagattctggacgtgaaattgtccgccctggctaagaagaacaagtgcttttatactaggtatgtcgacgatctcaccatcagcaccaatcgaaatatcttccccaatgatattatggaactccacgaccacaaacccattattggaaagtccctgattaatgagattaaacgctcaggctttacaatcaacgacaacaaaactagggttcagtgtaaggactcgcgccaagatgtcaccggcctaatagtaaacaaaaaggtgaacgtgaagagcgagtttaaacacctggcccgcgccatggcaaataacttcttcaaaaacaaccaagcctttattagtctgaacggtgaaaaaactcccattagtctggagaagctcaacgggatgctgtcttttatttaccagataaggaatcgaatggatatgcagaatgctaatggacaacctagaaaaactcacgatagcttcgaaaagacctacagcgactttctcttttacaagaactttgctgcgaataatagaactgtggttatatgtgaaggggaaacagacaatatctacctaaactacgctttcaagaacctagtgagctattatccagagttacagaactatgggaaaggaatcaaaaagcgcattgatatccacctgtttaagcagacaaaactgctgtaccgtctcctgaatataactgacggggccggtaacaacataaaactgctgaacacgtatcagaagcggatgtcaaggttctccagtcctcgggagtccttccaattatactgttatcttatcaccaccgccgaccagctcggctctaaagaatga

SEQ ID NO: 8319 - RNA, 1707 nt, unidentified
  source 1..1707: mol_type = other RNA; note = synthetic construct
atgagcgctttggagactcttaagaagctgaagaacctaaaagatgtggcagtgtttctggactgtaagcccaaattcttgtcgtacctgttgttttttgagaaggacaaatactcggaattcgaacttcggaagaaatcagggggggtccgaatcattcatgcccctaataagaagctcaaggctatacaaaagaagctgagcgacgttctctacgaatgccaggatgagatttaccctaaacagaagttcaaagtcctgagtcacgggtttgttcggaaagagaagatcaagaacaagatcttaatccatggcgcgctaagtaatgcaaaagcgcacaaaaacaagaataacgtgtttaacatcgacctggagaactatttcggctccttcaattttggacgggtaagggggttcttcattaagaacaaagacttcctgttgacagacaaatgcgccactgtgatcgctcagatcgcctgctataataattccttacctcagggatcaccatgtagccctataataagcaacctcatcagcagaagcctggacgtaaaactcgcaaatctagccaaacggaatagcgctacttactcccgttacgtggatgatatcaccatttctacgaacaagaagatattccctaagaatattgcgctgaatgattcccataaaatttctcttggagacgaattcagtaaaattatttccagttcaggcttcaccgtcaactctaagaagacacgcctccagtattcagacagcagacaggaagtgaccggcctcgtggtgaataagttcgtgaacataccacacgagtataggtctaacctcagacccaaagctcattcccttttcctgaccaacagttacttctatgtggataatgagggtaataaatgtgaagggagtattgataagctgaacggcctgttttcctacatccactttatccgaaaaaatacgatcaatcacgggaagtacatccgcgacaagaacggagagcttgccctcgatgggtcagactacttatatagccaattcctgtactacaaatactttgctaacaacgataagcctatcgtcatctgcgagggaaaaacagacgtgatttatctgaaggccgtgctcaaaactctggctgccgactatccagacctgattgaggtgaacaatgacaagacttctctgaagatccaaatcttaccagcatcaaaaaccgtccaggatttacttggcctactcaccggcaccgcagacttgagaaaatttatcctgtcttatgaggcccgcctggaagactttaaaagcccctcccttctgaatccagtcattgtattggtagacaacgatgatggtccacgtaagatcaacaacgccataaaggacaaatataagataagcccggaagcaggcaagccgtctatcatcttttccaatatggtctatgtgaggactcccgaactggagaaaaagaaagaaacatccatcgaggatttcttttccgacggtattcgcaaaattaaaattgatggtaggacgttcagtcccgatattgacgatgataccacagcccactttggaaaaaagacatttgctgaagaggttattctcaagaagaggaagaccctggattttacatcattcaagcccgttttgaatctgctcgttgagtctatcagaatatacaagaaaggcgcctga

SEQ ID NO: 8320 - RNA, 936 nt, unidentified
  source 1..936: mol_type = other RNA; note = synthetic construct
atgactacactggagacactcaagaaattgaaagacttgaaagacgtggcaggtttccttgactgtaagcctaaatttctgtcttatctcctgttcttcgaaaaggagaagtacacaatttttaaggtgccgaagaagaacgggggcgtaagggaaatctatgccccaaaccagaaactcaaagccattcaaaaaaagctcagcgacatactgtacgaatgctattccgaaatctaccctaagaacaaatacaaagtcattagccacggctttgtgaagaaagagaacaactcaaaaaaggaggtcatttatggggcgctgtccaacgccgtcgagcataaaaataagcgcaacgtgcttaatgtggatctggagaattactttggatccttcaactttggtcgggtgcgcggatttttcataaagaataaggatttcgccctgagtgaaaaatgcgcaaccgtgatagcccagattgcttgttataataacctgctaccccaggggtccccttgttctcccattatcgcaaatctgatcactaggcctctggacatcaagttggcttgtttggcgaagaagaactctgccacttatagcagatacgtcgatgatatcaccatctcgacgaacaaaaagaccttaccaaaatgcttttgcctgaataacaagcacgagatttttcccggaaaagctctcgttgagatcatcaacaaaagcggcttcagcataaatgataataagacacgactccaatactccgattctcgtcaggaggtcaccggattagtagttaataagttcgttaatgtgccctatgaataccggcacaatcttagaccaaaggctcatagtctattcaatgagaactcatacttctacgaagacaacgagggcaacaggctttcaggcagtatcgaaaagctgaatgggtga

SEQ ID NO: 8321 - RNA, 1737 nt, unidentified
  source 1..1737: mol_type = other RNA; note = synthetic construct
atgatgagctcactcgagtccctgaaaaagctaaagaacttgaaggatgttgctacctttctgggttgtaaaccaaaagccctgtcctacctcttgttcttcgatgagaacaagtaccgtacgtttgagattaaaaagaagtcaggtggctcccggaaaatcctcgcgcctaatgacaaacttaaggcgatccagaagatactgtctaatgtcttatacgactgctatgcggagatctatccaactaagaagtatagcgtaatttcccatggatatgtcaggaaggaaaagaatcagattaacaaggagaacaatcacacgaaagatcaaaacctttcttatgggactataaccaattctatcccgcacaagaacaagcataatgtgcttaacatagatctggctgattacttttcgtcctttaatcttgggagggttagaggcttttttatcaagaacgagagtttcaagctaagcaccgaatgcgcaacagtgctggcccaaattgcatgctatgaaaatgaactgccgcagggtagtccatgttctcccattatcgctaacctgataagcagaagccttgacgtgaagctagctgggctggcaaaagagaattccgccacatacactcgctatgtggatgacatcaccatttccacaaacaaaaaagtcttccccacgaaaatcgccggcgtgattgataacaaagtgacactgggcaaatcactgcagcggattgtgattaagtccggatttactatcaacccccctaaatcaaggttgcaattctcagacagcaggcaggaagtcaccggtcttatcgtgaataagttcgttaatgtaccatcaaactaccgacataccttaagacctatggtccatagcctctttaagaacaatacctacacctatatgaacgacgaaggagacaatgtaaaaggatctatcgatcggctgaatggaatgctgagctatatccactacatccggtccaacactataaacaaggggaaatacgtgcgcgacgataaaggcgggataagattggacggaagcgatcagctatacgctgacttcttgttctacaaatatttcgccaacaatacccgtcccgttctcatctgtgaaggcaaaaccgatgtgatttatctcaagagcaccctgaaagccttggctgacaattaccctagtctcatcgagaaggatggatctaaaacccacctgaaaattcagatcctgcctgcatccaaaacaattcagaatttacttgggctgctctctggggccgacgacctcaaaaaattcatggagacttacgaagcaagattttcaaaatatgccaagccaagtgcactgcatcccgtgattgtgttagtcgacaatgacgaaggtccccgaaacatcaactccaagattaagaacaagtacaaggtcattccaagtcctgggactccagtgaaggtatggggcaacttactgtacgtgcaaactcccgagatcgtgggcatgaaaaacacagccatcgaggatttcttctcttctgaaattcggaagatcaaggtcgaaggccgcacattcagccctcagacggagacagagacaatagctcactacggcaagagggtttttgccgaggacgttatttcgaagaagcgcaagatcctcaattttgacagctttaagcccatattggatctgctggtgagtagtatcgatctccacaatctgaaaaagtga

SEQ ID NO: 8322 - RNA, 1758 nt, unidentified
  source 1..1758: mol_type = other RNA; note = synthetic construct
atggctaccggcggcagtccatacgagtgcgacaaatcagtgtatagacctcttccctctattttcaacatggatattatgagcaagctggcagatatccggtctttgaagagcttatccgacgtcgcagactttctgggttgtgagcccaaaaacctggcatactcactgtattttgccaaaaacaagtacaaatccttcgagatctataagaaatcaggaggcgttaggattatcaatgctcctaatgagaaactgaagagtcttcagaaaatccttgccgggtacctcagtgagtgtctagacgagatttacaatactcacggtggcaataagatttctcacggatttgtcaagggcaaaacaattatcaccaatgcgagccagcaccggaacaaaaacctagttttcaatatcgatctgagcgacttttttaacacaataaactttgggcgagtaagaggattcttcatcaagaacaagtacttttccatggatgagaaagcggccaccgtattttcccagatcgcatgccatgaaggcagattaccccaggggagcccttgttctccagtgatctccaacctgatactgaatatccttgatatacgactggcttcgttggccttcaaaaatagttgcaattacacccgctatgccgatgaccttactttcagtacaaatcgtaaggaattcccaatcgacatagtgaaagacgagctaggcgattgggtggtcgggaacaaacttcataaggagatcaccaaatgcggattcattatcaataagagcaagacgcgcctccaatacaaagactctcgccaggatgtgactggattggtggttaataaattcgtgaatgtcccgtctgactacaggcgtctcactaaaagcatggcccacgaactatttcggactaacgaattctacataaagttacctgatggggaaagcatagaaggtacccagaaccaactcaacgggatgctgtcatacatttatagtaccaggaagataaccatccacaagaacttcgactcaaccatccccagagacggcaaaggcattcccattctcgatgcttccgacagactgtatagcgatttcctcttctacaagaattttgtggctaacgacaaacccattgttatctgtgagggcaagacagacgtggtctatctcaaacatgctattaaatccaggtatgagaaatacccgaacttggttgaaattaagaagaaggaaaaggccctgaagatccaaattctgggagcaagttttctcgtcaatcacttgctggatctgctcaccgggacaacagccatcaaacggtttgtggaatcttatgccactcggctgagcaaatataaatgccccccactgaacaaccctgtaatcatcctgactgataatgacgatggcatcaaaggtctgatacacgcgattaatggtaagtataaggaatcagaagaccgagatggaatttactttattacgtccaacttgtacctcatacgcacccctctgctgaatgacaagaactcctctaagatcgaggatttcttcactaaggagctgttggccaggaagctcgatggaaagacatttcatccagacaacgacaccgataatacaatgcattactcaaagcaggtgttcgtggagaagattattaagaaggagtataagtccatcgactttagcgggttcgactcgatcattaacttacttgagaagacgatcatcgatcacaaatga

SEQ ID NO: 8323 - RNA, 1674 nt, unidentified
  source 1..1674: mol_type = other RNA; note = synthetic construct
atgtcaaaactgacggagatatcacagctccaaagtctcagggacgtcgcaattttcctggggtgtgagcccaagaatcttgcctattcactgtactttgagaagaacaagtataagtccttcgaaattcacaagaaatctggaggcgtcaggattatcaacgctcccaacgaaaagctcaagtctctgcaaaaaatcttggcctgtcagctgaatgaatgccttgaggagatatacaggatgcacggcgggaataagattagccatggttttacaaaggggaagactattatcacaaatgcaagcaagcaccggaataaacgcctggtgttcaatattgacctgacagacttcttctctaccattaattttggccgggtccgcggcttcttcatcaagaataaccatttcaacttgaacgaaaaggccgctacgatccttgcacaaattgcctgccacgagggaaaactgcctcaggggtcgccttgcagcccagtgattagcaacctcattctgaatatccttgatgtgcggcttgccaaacttgccagtacaaatagttgcacttacaccagatacgccgatgatttaaccttttccaccaacaaaaacgattttcctagcgatatagctcgacagtccgcagagaacacatggatccctggttctagggtgcggaaagaaatcctaagatccggttttagtgtaaatgacaagaagaccagactacagtactatgattccaggcaggacgttaccggattagtggtcaataaggtggttaatgtgcccagcgagtacagacggcttgtgaagagtatggttcatcagttatttaacaccaacgagttctatctgaaactgtctgacggagagtctctggaaggctcccaggaacagctgggaggcatgctaaactatatttacagcactcgtaagacaaccattcatcatgggaaggtcaaacgcgatgctgagggcaacctgctcttggacgcttcagatcgaatgtacgccgatttcttgttctacaaatattttgtggcgaataacaagccaatcattatttgtgaggggaaaactgacgtagcctatatgaaatatgcgatcaagtcacgaagcaatcactttccaagcctcgtggaagaaaccgaaggtaaaaagcaactcaaaatacagatcttggcagcttcaaatactgtgaatcacttgttggatctcctgaatggcacctcctctatcaaaaaattcatagagctgtacgacagtaagttaaagaagtataagaaccccatcctgaaaaacccggttataatactaacagacaatgactccggaagttcaaacctgataccgactatccgtggaaagtacaagaactccgaggaaaaggacggtttttacttcatcacgaagaacctctatctgatcaaaacaccactcatcaacgggaatgactcgtctaaaatcgaggatttctttaccaaggagctcctgtctagaaaactggacggcaagacttttcaccccgataacgatacggataataccatgcattacagcaaaaacgtatttgtggaaaagatcattcgcaaagagtataaatccattgacttttccggcttcgacagcatcctgaatttcatcactaacgtcatcagcacacacaaatga

SEQ ID NO: 8324 - RNA, 1677 nt, unidentified
  source 1..1677: mol_type = other RNA; note = synthetic construct
atgtccgaactcatagaaatatcaaaactgcaaaacctgagtgatgtggcccattatctcggatgcaagccacagtccctcgcttacactctgtatcatgaaaagaacaagtacacgacgttcgaaataaagaagaaaaatggtggtgtccggctgatcaactccccttgtgacaagctgaaggtacttcagcggatcctggctaataaattgtcagaatgcctcgacgaaatttacaaagagaatggaggcaataagatttcccacggcttcgtgaaaaataagaccattatcaccaacgcgagtgaacaccgaaacaagaacctcgtgtttaacatcgacttaactgacttcttcaataccataaacttcggacgtgttcggggctttttcatcaagaacaacaacttcatgcttaatgaaaaggtggccaccatctttgctcagatcgcctgccatgacggcaaactgcctcaaggaagcccctgttcaccagtgatctctaatctgatcctgaatatcttagatatccgccttgcaaagcttgctttttcaagtaattgctactacacacgatacgccgatgatttgacattttccacaaacaaaaaggtcttcagtaagaacattgttaagtaccgggatgacggagcaccagagtcagggcctcttctgacaaaagaaatttctaggagcggcttcattatcaatgacaaaaagactagactccagttctgtgattccaggcaggatgtgacagggctgatagtaaacaaagttgttaacattccctctgactatcgcagactcatcaaggctatgactcatgagctgttctgcaagaatagctactatatcaaaaacgccaacaaaaaggatcagaaaggaaacctggagcagctgaatggcatgctatcttatatctactctgtccggaaaaacaccatacacaaaaatatcaccacaagggacagcaagggtaatccgaggctagacgccaatgagaagatctacagcgattttctcttttatagatacttcgtcgcaaacgacaaacccattctaatctgtgagggcaagacagacgtggcctacattaaatacgcaatccgaagccgctccagcagatataactctttggtagaggaagaatatggggagaagaaactgaagattcaggtgttgaacagcagcggacaagtcaaccatttgctggatctcttgaatgggacctccagcatcaaaaagttcattgagaactatagtgcgcgtcttaaaaagtacgagaagcctctgtttactaatcccgtgattattctcactgataatgacgacggctcatccaaactggtgccagccataaaaggcaaatacagggggagtaaggagataaacggttttcacttcatcacgaacaatctgtttcttattaagactccgctatttccagataaacctgatagcaagattgaggacttcttcaccaaagagttattatcgagaaaactgaatgggaagacctttcaccccgataatgacacagacaataccatccactattcgaagaacatcttcgtggaggagattatccgcaaagagtataagtctattgatttttccgggtttgatgagatactggacttgattgtgtctgtcattgacgaatataagaagtga

SEQ ID NO: 8325 - RNA, 1917 nt, unidentified
  source 1..1917: mol_type = other RNA; note = synthetic construct
atgagctggagatttcttggaagctgccaagtgtgcgttcgcgtgcccatcaacctttttaaatggggccggcgggttaaccggctacttctcctgaagtcggcaaagactaagcctgatctcgctcgaatactgggtgttaaaccatccgctctaacccattgtttatacatcgtgaagcctgaaaaccagtatgtgcagttcgagatcccaaagaggaatggggggaagcgttttatctctgccccctcaggcatgttaaaaaccctgcagagcagcctatcagatctcctgctggactgcctcgatgaaattatctttctaaagttcccagactcagagattactcgcccgaaggcaaagaactcgctttttttgaaggtgaagtgtagcggctctgagacaaagcaaccatctctgtcccacggctttgaacgcaagagaagcatcataacaaatgctatgatgcacctgggcaaaaaacacgtgttcaacattgatttggaaaacttcttctcatcctttaactttggaagagtgcgtggttttttcatcaagaacgggaactttctgctggagcccgagatcgcgactgtgatcgcaaagattgcctgttacaataacgaattgccccagggaagtccttgttccccggtcatttctaatctgattacccatgctctcgatatcaaattggccgcggtcgctgctaagcacagctgcacttatacccggtatgcagacgacattacattctccaccagaaaggagagcctccctagtagtatagctaagagcgataatcatactttcgtggccgggaaagtcatacgcaatgagatcgttaggtctggcttttctattaatgagtcgaaaacacggaatcagtacaaggacagtagacaggaggtgactggactggtcgtcaataaaaagcccaataccaagaaagaatactggagactggtgagggcccagtgtaaccacctgttcaataccggggagtttaaggaaacaataaatggagcggaggttagtggcaatattcacaggctggagggcaagcttacatttattgaccaggttgaccactacaatcggctccgacaaggggagaaactgaaccccaagtatcacctcaaaaaagacgctattagaaaatcaaacccctctatccggcgatatcttcatacctctagggagacaactttcagtaagttcctgttctacaggtggttctatggaaacactaaaccaaccatcctgaccgaaggccagaccgacaatatatacttgaagtctgctatctggaagttagcagcaaatttccctaaactcgcgacggggaaaagtgccacagagccttataaggccttaacacggttctttaaatacaatgagaggaccaggtatctgttagagctgttcggcgggggagattacttgcgtgacttcgtggacaactataaagaactgttcaacgcctataaagcccctaagccgtcccatcctgtcattattttcgtggataacgactccggccccaacaatctgattaacaaagtcaagcgagtaaagggcatcgaaatctttccagcaggtgtcgggctggccgatatccgccagtcagaatttgtacatatcttctgcaacttgtacctggtgctcaccccacaaggtgccggatcctccgagacggacatagagtacttttttagcgatgccgatagacttagggaacacaaaggtaagcgcttcaacacagtggcagaccgagatgaagtgaatgacctcagcaaagaagccttcgccacgcatattgtaaaaacgcagaagggaatcattgatttctcacgctttactcatctccttgaaagaatcgagaaggtaatcgaccactacaactccataaaatga

SEQ ID NO: 8326 - RNA, 1836 nt, unidentified
  source 1..1836: mol_type = other RNA; note = synthetic construct
atgaagaaactggacctgcttaaagccgctaagacaaaacccgatctggcaaagctcctcggggtaaagccctccgcactaacctattgtctttataaaacaaagccggagacacagtatgtgcagttcgagattcccaaaaagaatggaggtaaccgtattatttctgccccctccgggatgctgaagaatatacaggcctccttaagtgaattactgttagactgcctagatgagatcatcatcgacaaatttcctaattcagagatcgccaggcagaaagcaaagaatagtatcatcttgaagctcaaatgcagcgggagtgaaatcaagcaaccatctctgtctcacgggtttgagagaaagcgttccatcatcaccaatgcgatgatgcatctggggaaaaagcatgtgttcaatattgacctggagaacttcttcggtagcttcaactttgggcgggtgaggggtttctttatcaagaataagaacttcctcctggaacctgagattgcgaccgtaattgccaaaattgcttgttataacaacgaactcccccagggtagcccttgttcccccgtgatatctaacctgatcacacacgccctggacataaaactggccgcagtcgcatcgaagtatagttgcacctacagccgatatgcggacgatatcactttttctacaaggaaggattccctgccgtcgtccatcgctaaatcagataatcacacctttgttgctggaaaggtcatcaaaagcgagataaaacggtccggctttagtataaatgaaacaaagaccaggaaccagtacaaggactctcggcaggaagtcaccggattggtagtgaataagaaacctaacactaagaaggaatactggagactggtgcgagcccagtgcaatcatctcttccgcaccggccaatttaaggaaatcgtggacggagtcgaggtggtcggaaacatcaatcggctcgagggtaagttgaacttcatagaccaggttgatcattacaatcggttaagacagtcagagaagctgaaccctaagtaccacttgaaaaaagatgctctgaagaatggctatgccaagtcccgcagatacctacatacttctagggaaaagacgttcagcaagtttctcttctatagaatgttctacggcaacaagaaacctacgattcttactgaggggaagacagacaacgtgtatcttaaggcagctattcacaaactcgctgctttatttcctaaactggccatagagaaaaccgcccttgccccatacaagctccttactcagtttgtcgaatataacgagcgaaccaaatacctgcttgagttgtttggcggcactgactatctgaaagacttcgtgattcattaccgccattacttccacgattacaaagcaccaaagccatcaaatccagtaattattttcgtggacaatgattctggccccaaaaacctgattaactacgtcaacggcgttgagggcatccaaatttttcccgcgggcgttgctgacatccgccaaagcgatttcgttcacattttctgtaacctctacttggtgcttaccccacaagtggaaggatgcccagagacggatatcgaatactttttctcaaatgtggacagactgaaacagcacaagggaaaatgtttcaacactgtcgccgacagggatccgagcaatgatctgtcaaaggaagcatttgccacacatatagtgaacgctcacaaaaatgacatcgattttagtcgctttactagcctattggagcggctggagaaagttattgatcactataacctcatcaagtga

SEQ ID NO: 8327 - RNA, 1836 nt, unidentified
  source 1..1836: mol_type = other RNA; note = synthetic construct
atgaagacgctgcagtcgctgaaagaggccaagactaagccccagctggcaaagatccttggaatcaaaccttctaccctgacacactgcttatatgtgcttaatacgaacaaccaatacatcaagtttgagatacccaagaagaacggtggaatccgggttatccacgccccaaccccaatcctgaagatgatacagaaatcactttcgaagcttttactaaactgtttggacgagattatcttcaccaaatttccaaatagcgaactggccagacagaaggccaaaaattccggaattctgaaggtgaagattagcaacgcagagataaaacagccttccttgtctcacgggtttgaaaggaacaggtctattattaccaacgcgatgatgcatctagataaaaagttcgtattcaacatcgacctgcatgacttttttggatcttttaatttcggcagagtgcggggctactttattaagaaccgtaattttgagctccaccctgatatcgcaacagtgattgctaagatcgcctgttatcagaataaattgcctcagggcagcccctgtagccccgtaattagcaatctgatcactcacgctctagatattaaactcgcaaagcttgccaaactgagctcatctacatacacaagatatgccgatgacataacattttcaaccagactgtcagaactgccgaaatccatagcagaaaaagagaatcacaaatacgaaccaagtaaaaagatcacgaaagagatcaacaggtcaggattctccatcaatacctccaaaactaggaatcagtatgctgactcccgtcaagacgtgaccggcttaatcgtcaacaagaaaccgaacactaagaaagaatactgcagattggctcgcagtcagtgcaatcacctgttcaagcggggcgagtttaaggaacttatcaacgggaacgaagagaaaggtaatatcaactctttggagggcaaactcaatttcatcgatcagatcgaccattataaccgcctgaggcaaactaagaagctcaaccctaagtatcagctcaaaaaggatactatcaagaacggcaacgccaagctccgccgctacctgcactccagtcgtgagaaaactttcagtcagttcatattctaccgacacttttatgggaacgagcttcctaccatcttgacagaagggaaaacggacaatgtttacctgaagagcgccataaacaaactcagcgcccagttccccgaattatccagaagtaagaccagtcaagcagagtataagctcctgctgaagttcttcaattacaacgaacgcactcgatttctgttagagttgtttggaggtaccgattacctcagagactttatcgtcaactacaagaagaacttctcttactaccaagctcccaaacccaagaagcctgtcattatcctggtggacaatgatagcggcccaagggacctcataaattatgccaagaatatagagggcgttatgatttaccccgctggtaccacagaaatccgggatgccgacttcgttcacattttccataatctctatctggtcctgaccccaaagaaaccggggcataatgagacagacattgagcttttctttaaggatgtggatcgcctaaggatttacaacgggaaacactttaatacagccgcgcagcgggataagaatcgagatctctccaaggaagcttttgctgaacatgtgattcatgctcagaaagacgtcattgacttctcagagttcccagcaattctggagcggctggtgaaagcgatgaatcattatgacaccattaaatga

SEQ ID NO: 8328 - RNA, 1650 nt, unidentified
  source 1..1650: mol_type = other RNA; note = synthetic construct
atgattcaaagttcactttctgggctgttgctcgattgtcttgacgaaattatccacaacaaatttccagaatcggaattggctcgacagaaagcaaagaactctaaaattctgaagatcaagtgttcctcagctgagattaaacagccatcactctctcatggctttgaaagaaagcgcagtataataaccaacgcaatgatgcacttaggcaaaaagtatgtgttcaacattgacctggaggattttttcgggagcttcaatttcggaagagtgcggggattcttcatcaagaatcgcaattttctcttagatcctgagattgctactgtgatcgctaaaatcgcctgttgcaataatgaactgccacagggaagcccttgctcacctgtgatcactaacctgataacacattcactggatattaagctagccgccattgcaaaaaaaaattcctttacgtacacccggtatgccgatgatataacgtttagtactcgcaagagcgatttttcaagctccatcgcgaagaaacagaacaacaagtacgtaatcagcaaaagggtgcgcaatgagattatactgtccgggtttatcatcaacgagtctaagactagaaatcagtacaaggacagtaggcaggaggtcacaggcttggtcgtgaataagaaacccaacacgaagaaagagtactggagactcgtgagggcgcagtgcaatcacctattcaagaatggagagtttgtcgagataatcgattccaaagagacaaagggtaatattaacagacttgaggggaagctgaacttcatcgaccaaattgaccactataatcgactccgtcagggtgaaaagctgaacccgaaatatcatctgaaaaaagatgccatcaagaagggtcaagccaagtcccgtcggtgcctccataacagtagggaaaagacattctctaagtttctcttctacaggttgttttacggaaacaaccttcccactattctcaccgaaggcaaaactgacaatgtgtatctgaaagcagcgatccacaagctggctagcctcttccctaagctggcagtcgttaaaagtgcaagctccccgtataagatcttgaccaatttcatcgattacaatgaacggacaaaatacttactggagctctatgggggcgccgactatctgaaagacttcatcatccactacaagaacaatttcaactactacaaagcccccaaacccagcaatcccgttataatttttgtggacaatgatagcgggccaaaagacctaatcaactacgtgtccaagatcaatgatattaagattagccccaccggcctgatggacataaggtcttcagagttcgttcatatcttccacaacctttatttagtcctgacccctcagattaagggctacgctgaaaccgacattgaacatttttttacagacaccgatcggctgcgcccacataaaggcaaggtatttaacacagcctccaagcgagatcctgacaacgacttgtccaaggagtcgttcgctactcacatcgtgcacgccaagaagcatgacattgacttttctggattcacctctctgctggagagacttgaaaaagttatcaaccactatgataccgtaaaagagtga

SEQ ID NO: 8329 - RNA, 1644 nt, unidentified
  source 1..1644: mol_type = other RNA; note = synthetic construct
atgcagagctcgcttagtcgcttgttactcgactgccttgatgaaatcgtatgcatcaagtttcccgattctgagctggcccgacagaaagccaaaaactctaaaatcctgaagctcaaatgctccaattccgagatcaaacagcccagcttgtcccacggattcgagcggaaacggagtattatcactaacgcgatgatgcacctgggaaaaaaatatgtcttcaatatcgacctcgataacttcttcggatcttttaatttcgggagagtcaggggcttctttatcaagaatagaaatttcgcgttggaccctgagatcgctacagtgattgctaaaattgcctgttacaacaacgaactcccacagggtagcccttgcagccctgtgatcactaacttgattacccactccctggatattaagctagctgcaatagctagtaggaacagttcaacattcacgcgttacgcagacgatattacatttagcactcgcaagggcgagtttccctccgccatcgccaaaaaccaaaacggcaagtacatagtgtctaagaaaatccgaggcgagatcacccgctcagggttcatcatcaatgacgggaagacgagaaatcaatataaagactcccgtcaagacgtcaccggactggtagtgaataagaaacccaacactaagaaggagtattggagattagtgcgagctcagtgtgaccacctgtttaaacatggcgagttcctggaagtaattgacggcaaagagatcaaaggcaacgtcaacacccttgccggaaagctcaactttattgaccaggtggaccattacaatagactaaggcagggtgaaaagctgaatcctaagtatcacttgaagaaggacgccaataagaatgggcacgcaaaaaagcggcggtaccttcattcatcaagagagaaaacattttccgaattcctgttctatcggcttttctacggaaacgagctgccaacaatactgaccgagggcaagacggataatatttatctcaaggctgcaatccataagctcgccagttctttcccaaaccttgctgtggcagagagccctggtctgtcatacaagccacgcaccaaattcgttaattacaacgaaaggactaagtatctcctggaactgtatggtggcgctgactacttgaaagatttcgttatccactataagcagcattttaaccgttacaaggcccccaaaccatctaatccggttattatcctagtcgataacgatagcggccccaaggatctgataaactacgtcagcaaggtggacaatataggtatttttccaaccggggtgcccgatatacgcgcaagcgaattcgtgcacatattctgtaacctgtatctggtgttaacaccgcaggtgaagggatacactgggactgacattgagcatttttttaaggacgcggataggttacggcctcataaagggaagttttttaacaccgtatctaaaagggatcacgacaatgatctctccaaggaatcatttgccacccatatcgttcacgcccataagcacgaaattgactttagtgggtttacatcgctcctggaacgcctggtcaaagttattaatcacttcgataccgtgaaatga

SEQ ID NO: 8330 - RNA, 1857 nt, unidentified
  source 1..1857: mol_type = other RNA; note = synthetic construct
atgaacagactgcaatcactgaaggaggcaaagaccaaacccgacctagctaaattgctcgatgttaaacctagcgctttgacttactgcttatatatcttgaagcccgaaaaccagtacacccaattcaaaattccgaagaaaaatggaggagagagaaccatcaatgcccctaatgggttactgaagtctatccagagcagtctttctaaactgttactggactgtctggacgagattattttcaacaaattccccgattctgagctcgctgctgagaaggccaacaacagcaaagtattgaaaatcaagtgttccgccgcagagatcaagcagccaagtttgtcccatgggtttgagcggaaaagatctattataaccaatgccatgatgcacctcggcaaaaaaaatgttttcaacatcgacctggagaatttttttggcagctttaactttgggcgggttcggggcttcttcatcaaaaaccgtaactttgagttagaccaggagatcgcaactgtgattgcgaaaatagcttgctacaataatgagcttccgcaaggctcgccatctagccctgtcattaccaatctgataacacattccctcgatattaaattggccgcgctcgccgtgaagaactcttgcacgtacactaggtacgctgatgacattacattcagtaccaggaaaatcgactttcccagcttcatagccaatgataagtgcggcaaattcgccccgagcaagaagcttcgcagcgagattgtccggtctgggtttcttatcaacgacaaaaagacacgaaaccagtataaagactcaagacaggatgtaactggcctcatcgtgaacaagaagcccaataccaaaaaggaatactggcgcctggtgcgcgcgcagtgtgatcacttgttcaaatatgggacatttgtggaaaagatcgatgacatagaaatcaaagggaacatcaataggcttgaaggtaaactgaacttcattgaccagctggaccactataataggctccggcaggccgagaagcttaacccaaagtaccagcttaagaaggatcctacaaagaatactcaggctaagactcgtcgctatctgcatggcggaagggagtctacgttctcacgttttctcttctaccgactgttctatggtaatactctccctaccattctgacagaaggcaagactgataacgtatatctgaaggcagctatccacaaactggccgccttatttcccaaactggccagcgaaaagagtgccggatcaccctataagagtctcacgcgcttcctggactataatgagcgaaccaagtatctcctagagctgtttggtggagctgattaccttaaggactttgtgatccattacaagtcgtactataagtactataccgcaccagaaccttcccatccagtgatcatttttgtcgacaatgacacggggccaaaagacctcattaactacatcaacaagattgataacgcgtcaatattcccaaaaggactgaaagatattagaagcagtgattttgtccacgtgttccacaacctgtacctggttctaacacctcagaccaaaggttactccgaaacagacatagaacatttcttcaaggacaaggacagactgcggcaatacaaaggaaagtcattcaataccgtctccctgcgcgatcctaacaatgacttgtcaaaggaggcattttccaagcacatcattcatgcaaataaacacgatatcgatttctccggctttacatccctcctagaaaggctggtgaaggtgatagaacactttaatagtctgaagatcaagaacagctccgcaccctga

SEQ ID NO: 8331 - RNA, 1842 nt, unidentified
  source 1..1842: mol_type = other RNA; note = synthetic construct
atggagagactccagctacttaaaaatgctaagaccaaacccgatttggccgcgcttctgaatattaaaccaagcgtgctcactttctgcctttataaggtcaaaccacagaaccagtatacccagtttatcatccccaagaaaaacggcggagaacgcattattaatgccccaactggagtattaaagtcaatacaatctgccctgtccaacctcctgctggactgtctcgatgagataacccggaataagtttccaaagtctgagctcgtgatcgaaaaagctaagcatagtaaggtgctgaaagttaagtgctccaatagtcaatctaaacaaccgaccctgtcacacggattcgaacgaaagagatccataattacaaacgccatgatgcacctaggcaaacgccacgtgtttaacatcgacctcgaggatttctttgcttcattcaatttcggcagggttaggggattctttatcaagaacaagaactttgagctggagcctgatatcgctaccgttatagctcagattgcctgtcacaataatgaactgcctcaaggcagtccttgctcccccgtcatcactaatttaattacccattccctggatatcaagctgtctgccctcgcaagcaagaattcgtgtacctacactagatacgctgatgatataactttcagcacccgcaagaaagaattccctattgatattgcaaggaaaaaaggagagcagtttatcagcggcaaaaaacttcggagcgagataatcagaagtgggtttaagattaacaagggcaagaccaggaatcagtataaggacagcaggcaagatgtgacaggcctgatcgtgaacaagaaacccaacacaaaaaaagagtattggcggaaggtgcgcgcacagtgtgactacttatttaagtacggtgagtttatcgacacagtgaacgggaaagaggtcaaaggaaatattcactctctggaagggaagcttaactttattgatcaggtggaccattacaacagattgcggcagacgctgcccttaaacagtaagtatcagttgaagaaggacgcgattaaaaatggacaggcaaagttgcggcgatacctccactcaggcagagaggagacattcagtaagttccttttttatcgcctgttctacgcaaacgagtctcctacaatattgactgaaggtaaaacggacaacatttacctgaaggcagccatccacaaactggctggttcatacccaagactcgcgtcggaaaagaatgacaacagcccatacaaactgctaacccgttttgtcgaatacaatgaacgaaccaagtatctactcgagctgtacgggggtgccgactacttgaaggacttcgtagtccattataaacaccacttcaaatactatgaggcccccaaccctcagaacccggtggtaatttttgtggataatgactccgggccgaacaacctgatcaactatgtaaacaagatcaatgggaagtgcatctatccagagcatatcaatgatatccgtgcttccgagttcgttcacgtgtttcataacctctatcttgtcttgacaccccaggtggccggcttcaaagaaactgacattgaacacttctttgtggaatccgaccggttaaggccttacaaaggcatgatcttcaatacgattagcaagaggaaccccgaaaaagatctgagcaaggatgcctttgccacacatatcatccacgcaaaaaagaatgagatcgacttcaatgggttcaaatctctgctggaccgcattgtcaaggttatcgagcattacgactcaataaataagaagtga

SEQ ID NO: 8332 - RNA, 1836 nt, unidentified
  source 1..1836: mol_type = other RNA; note = synthetic construct
atgacccggttacaagcgcttaagaaagccaagaccaaacctgaacttgctcatctgctcaatattaagccttccgtgctgacttactgcctctataaaataaagccgcagaaccagtacacccagttcaagattcctaagaagaacggcggggaacggacgatcaacgcaccaactgggacactaaaatctatccagagcgctttgtctgagctcctcttggattgtagcgacgagatcactcgcaataaataccccgagtctgagttagccagagagaaggcgaaacactcaaaaatcctgaaagtaaagtgtagcaactcgatcatcaaacagcccacattgagccatggatttgaacggaagcgctccataattaccaatgccatgatgcatctcgggaaaaagcacgtctttaatatagacttagaggatttcttcgggtcatttaattttggtcgggtgagaggcttcttcattaaaaataagcagttcgagttggagccagagatcgccacagtgatcgcacagattgcctgctataataacgagctcccccagggaagtccatgcagtccagttatcaccaatcttataacacacagtctggacatcaagctcgccgctctggcttctaagaactcttgtacttacacccgatacgcagacgacattactttctcaacaaggaagaaagaattcccgtcattcatagctcaacagaaggacgatcagttttttgccagtaaaaagctgaggagcgagattgtgagatccgggtttaagattaaccctagtaagacgaggaatcagtacaaagattcacgtcaagacgttaccggtttgatcgtgaacaaaaaacccaacacgaagaaagaatattggagaaccgttcgcgcccaatgcgactatctatttaaatatggcgagttcatcgaagtgatcgacggagaaggggtgaaaggcaacattaacagtctggaaggtaagctgaacttcattgaccaggtcgatcattacaatcgcctgcggcagacactgccccttaatcctaagtaccaattcaagaaggataccataaagaacggtcaggcaaagctgcgcaggtacctccattcaagccgtgaggatacatttagcaaattcctcttctatcggtttttttacgcttcggaacttcccactatcctgacagaaggaaagacggataacgtataccttaaagcagcaatccacagactggcttcttcctatccagagctggccctcgagaagaagggcgatagcccatataagctgctgacccgatttgttgaatacaacgaaaggaccaaatatctgctagagctatacggcggggccgactatctgaaggactttgtcattcactataaacagaacttccgcttctataaggcacctaaacctgagaatcctgtaatcatcttcgtcgataacgactccggacccaataatctgattaattacgtgagcggcattcaaggcaagtacatatacccggaatccgtgaaagatatcagagcgtccgagtttgtccacatcttccataatctctatctggtgttgaccccacaggttgctggatttaaggaaactgatatcgaacacttctttaccgacaacgaccgattgagagaatacaaaggcatgtgtttcaatacaatcctgaacaggaagcccgagaaggatttatccaaagatgccttcgcgactcatattgtccacgccaaaaaaaacgagatcgattttgacggatttaagattcttctggacaggatggtcaaggtgatagagcactatgtgtctattaagtga

SEQ ID NO: 8333 - RNA, 1836 nt, unidentified
  source 1..1836: mol_type = other RNA; note = synthetic construct
atggagcgcctccagacgcttaagcaagcgaagacaaaacccgatctagcaaatatactgggcattaaaccatccactctcacgtactgcttatataaactgaagccccagaatcagtatgcccagttcaacgtgccaaaaaaaaacggaggcgtgagggtgattaatgcccctactggcactctgaagtctatccaggctgcccttagtatcttgctgttagactgctgggatgagatcctcaagtctaagttccctgctagcgaaatctccagagagaaggccaaacatggaaaaacactgaaagtaaaatgcagcaactcagaaaccaaacagccttctctatcccacgggtttgaaaggaaaagatccatcataaccaatgcaatgatgcatctgggtcagaagcacgtttttaacattgatctggaggactttttcgggtcgtttaactttggtcgagtacggggctttttcatcaaaaatagggacttcgagttggaccccgaggttgccaccgtcattgcacaaatcgcatgtttcaacaacgaacttccacaaggaagcccttgcagcccagtgataacaaatctgatcacccatagtttagacatcaagttggcagctcttgcctcccggaactcttgcacctatacccggtacgcagatgacatcaccttctcaactaggaagagctccctccccaagtgtatagcccagaatcgtgacggggagttcttagtgggtaaaaaactgagatccgagataactcgctcaggttttaatatcaacgacaaaaagacacggaatcagtacaaagactcgcggcaagatgtaacaggactcattgtgaacaaaaagccaaatacgaagaaggaatactggagaaccgtgcgggctcagtgtaaccatctgttcaacaatgggttcttcattgagtctattaacgggaaggacgttaagggaaatataaaccgactggagggcaagctgaatttcatcgatcatgtcgaccattataatcgtctgaggcagacactgcccttgaaccccaagtaccagtataaaaaagacgctattaagaacgggcaagccaagctgcggcgctacctccacaccggaagagaggatacattttcaaagttcttgttctaccgccttttctatgccaatgatctccctacaattctaactgagggaaaaaccgacaatgtctatctgaaagcggccattcacaagttggccggcggctttccgaaactagccactgagaagaatgggaattcaccttataagctgctcactcgttttgtggaatataacgataggacgaagtacctgctggaactgtatggcggcgcggactaccttaaggatttcgttatcaactacaaccaccactacaagtactataaagctccaacccccaataatcccgtcattatctttgtggataacgacactgggcctagtggtttgatcagctacattaacaaaatacaggatagtgtgatctacccagatggcgtcaagaacattcgcgactctgattttgtccacatcttccacaacctgtacctggttctcaccccgaaagagaatggttacgatggcacagacatcgaacattttttcgtagaaaaagacagactcaggaaacacaagggaaagtgttttaatacagtggcagaccgcgatagcgaaaatgacctcagtaaggacgcgtttgctaaccatattgtccacgctcgaaagcacgagatcgattttagccgattcaacacccttttagaaagaattgtgaaggtgattgagcactatgattccatcaagtga

SEQ ID NO: 8334 - RNA, 1833 nt, unidentified
  source 1..1833: mol_type = other RNA; note = synthetic construct
atgtcaaagcttcaggaccttaaaaaggcaaccacaaaaccagatctggcacatgtgctgggtgttaagccctcagtcttaacgtactgtctctatgtgctcaagactgaaaaccaatacacacagttcaaaatacccaagaaaactgggggcgagagagtcattaacgcacctactggcaagctgaaaacgatacaaagcctgctcagcaatttgctgctggattgtctggacgagattaaccacaaggcttttccaaagtctcagctggccaaagagacagtgaagaacgcagaagtgttgaagatcaagtgttcaacagccctggtgaagcagccagccctgagccacggatttgagcggaaacgttccatcatcacaaatgctatgatgcacctcggaaagaaacaagtgttcaacattgacctggaggatttctttggatcgtttaactttggcagagtgaggggattcttcatcaagaatcggaatttcgagctgcaccctgaaatcgccaccgtcattgcaaagatcgcgtgccacaatgacgaactcccacaaggcagtccttgcagtcccgtcatcaccaacctcattacacatgcactggacataaaattagccaggatggccagtaaaaactcttgcatctataccaggtatgctgacgatatgacctttagctcccgcgagtctacactctccaagaacattgcctatgaagacgataatatattcgttgtatccaagaaactgcgtgcggaaatcacgcggtccggtttcaccatcaatgataaaaagaccaggaaccagtacaaggactctcgccaggaggtcactggcctcgtggtgaataagaagccgaacacaaagaatgagtactggcgaactgcgcgatcccagtgtgatcgccttttcaaaactggcgggtttaccgagctagttaatggcgaagttgtgcccggcaatataaatcgactggagggcagactcaatttcatcgaccaggtggatcattataatagattgcgccagaaacttccgctcaaccccatttatcagaccaagaaagaggtactgaagaagaccaaccaggccaagctacgcaggtatttgcattcaggtcgtgaggacactttctctaagtttctgttttaccggttgttctacgccaatgaactgccgacaatcttaaccgaaggcaaaactgacaacatttacttgaaagcagcgattcagatgctagctaaaaatttccctagactggctactgaaaaaactgccgtgtccccttacaagttactgctaagatttgtcgagtacaccgagcggaccaagtttcttctcgagcttcacgggggggccgattacttgagagatttcgtgattaactacaagaagcactttgagtactataaggctcccaggcctgaaaatccagtgatcattttcgtcgataacgacacagggcccaacgatcttattaactacgtcaacaaaatcgaaggaatcaccatctatccatcaagtcagaatgaagttcgcaaatcggacttcgttcacgtattctgcaacttatatctggtgcttacgcctcgggatagcaacggtaatacagacattgaacatttcttcacgaacaaggacaggctcaggcagtacaaaggacgatgctttaatgtagagagcaaacgggatgttaaaaatgacctgagcaaagacgcctttgctaaccatgtcgtgcatgccaacaaggcttctatagactttgatggatttagtgggatgctggggcaaattgctaaagtgatcgagcactatgatagcatctga

SEQ ID NO: 8335 - RNA, 1833 nt, unidentified
  source 1..1833: mol_type = other RNA; note = synthetic construct
atgtccaggctacaagaattgaagaaagcaaccactaagcccgacctggcaaaactgttgggcataaaacccacaatgcttacgtactgtctctatattctgaagaccgagaaccagtatgcccaattcaacatcccaaagaagaatggaggggaacggacaatcaatgcacccaccggcatcttaaaaagtattcagtctcttctgtcaaagctcctgctggattgcctggatgaaatcaatcacaagaaatttccgaagtctgaactggcacgcgaggtggccagaaacagcaaggttctcaagattaaatgtagcaacgcgctcattaaacagcccagcctgagccacggattcgagcgcaaaagatctatcataacaaacgcgatgatgcatatcggtcggaagaatgttttcaacatggatctggaaaatttcttcggctcatttaactttgggcgagtcagagggttcttcattaagaacaagcattttgagctgaacgatgaaattgccacggtcatagccaagattgcctgtcataacaatgagctacctcaaggcagcccttgctctccagtgatcactaatttaatctttcactccctcgacatcaatcttgccaaattggcctctaagaatagctgtgtgtacacccgatacgctgatgacataacattctcaagtagggagaaagagttacctaaagatattgcacacgaggacaacggagaatttgtactctcaaagaagctgaggtatgaaatcacacgcagtggtttcatcgtgaacgacaaaaaaactcgcaaccagcataaagattcccggcaggaggttaccgggttgattgtcaacaagaagccaaacacaaaaaaagaatactggcgcactgtgagggctcagtgcaacagtctctttaaaacgggggtgtttaccgagatcgaaaatgggaaagctatcccaggatccatcaataggctcgaaggcaagctgaatttcatcgatcagatcgaccattacaaccgtctgaggcaggcaccacccctcaacccaaaataccagccgaagaaggaagctattaaaaatggccaagccaagttgagaagatatttacactccggaagagaggacactttttcaaagttcctgttttaccgcttgttttatgccaatgagttgcccaccatcctgacggagggaaagacagataatgtgtatcttaagagtgctattcacatgttggcgaagaattacccgcagctgtctagcgaaaaaaccgataaatccccatacaagcttctgctgcgtttcgtagagtatactgagcgtaccaagtatcttctcgagctctatgggggtaccgactacctaaaggacttcatcatcggctataaacagcaccttaagttttacaaagctcctagacccgagaaacctgtcattattttcgtagataatgacactggtcctaaggacttaatcaactacgtcaacaaaatagatggcaaggagataagccctagcacagaagttgatattcggtcctcagagtttgtccatatcttctataacctgtacctggtgctcacacccaaagacaacaatatcaacaccgacatcgaatacttctttacagagaaggaccgactgcggcagtacaagggcaaatgctttaatattgtgtccaagagggacctagataatgatctgtcgaaagaggcctttgccacccatgtgattcacgctaataagaaggacatagatttctcgggattcactggcatgctggaccggattgtgaaggtgcttaagcactatgactctataaaatga

SEQ ID NO: 8336 - RNA, 1848 nt, unidentified
  source 1..1848: mol_type = other RNA; note = synthetic construct
atggttaagttgaaagccctgaaagaggctaagacgaaaccagacctcgctcgcttattaggcatcaaaccgagccttctaacacactgcctttacgtgattaagacagaaaatcagtacatccagtttaagatccccaaaaagaatggtggggaaaggattataaatgcgccaaccgacaaactgaaatttatccaatccgctctttcaaatttgctgttagattgcttggatgagatcaattatgataagtttcccaagtccgatttcagtaacatcacaagcaaaagagctaaggtgctcaagataaaaattccaaacagcaacattcgtcagcagagcctgtcccacggattcgagcgcaagaggtcaattattaccaatgcaatgatgcacctgggcaaaaagtacgtgctgaatatcgatctggaagactttttcgggtcttttaactttggccgggtgcggggattctttattaaaaaccgcaactttgagctctcccccgaaatagctaccgtcattgcgaaaatcgcttgccacaataacgagctgcctcaagggagtccatgtagcccagtaataacaaaccttatcgtccattccctggacatcaaactggccaaactggccgaaaaaaattcgtgtatctacacccgatatgccgatgacattaccttctcttgtagaaaaagggatctccccaaggccatagcatatgagcttaacggcgagttcattttatcaaagaaattgcggtcagaaatcactcgaagtgggtttaacataaaccataagaaaacgcggaaccagtataaagactctcgacaggacgtgaccggcctcatcgtaaacaagaagcctaatactaagaaagagtattggcgcacagttcgggcccagtgcgacaatctgttcaaaactggtgccttcaccgaactggtcgacggaaaagacgtcgagggtaacattaatcggctggaagggaaactaaattttatcgatcaggtggaccattacaacaggctgcggcagacacctcctctcaacccaaaataccagaccaaggaggatctgattaaaaataaccaagccaagctgagaaggtacttgcacaatggaagggagaagacgttctctaaattcctattctatcgcctcttttacgccaatgagctgcccactattctgacagagggaaagactgataacgtgtacctcaaagctgcaattcacatgctgtcaaaagattttcctaagctctccagcgtgcaaaccactacgagtaagtacaagcttttgttgcgtttcttcgaatataaggttaggactagatatctactggagctctacggcggcgcagattatcttaagtcctttgtgatcaactatcgctaccagtacaattactacaaggcacccaagccggagaatcctgtgattattgtagtggacaatgacacaggtccaaatggcttgatcaattacgtgaacgggataaccgagaaaaagatcttccctagcgcatctaaggacatccgaacatcggagtttgtccacatctttaacaacctgtacctggtgttaactcccaagggactgggcgggtgcaacaccgatattgaatattttttcactgacaaggaccgtctgagaacctataaaataaaggactctctcaagtgtttcaatacagttgacaagagagatcccaacaatgacctttccaaggaagtcttcgccacccatatcgttcatgcgaacaagaaagatattgatttcagcggattcaaggtgatactcgaaagaatcgtcaaggccatcgaccactatgatagtatcaagtga

SEQ ID NO: 8337 - RNA, 1836 nt, unidentified
  source 1..1836: mol_type = other RNA; note = synthetic construct
atgcagaagctgcaactgttaaagaaaactaaaaccaagcctgatctggcccacttgttaggaattaaaccatctgccctgacttactgcctctacatcgttaagacagagaatcagtattcccaattcaaggttcccaaaaaaaacggtggcgaacggattatcaatgcgcccacagccgctttgaagtcgatccagagttcactgagcaatctgttactagactgcctggacgaaataaacgccgagaagttcccaagtagtgagattgtgaaggaaaaggcgaagaattctaaggttttgaaggtgaaatgctccaacgcaaagacgaagcaaccatccctgagtcacgggtttgagaggaagcggtcaattattaccaacgccatgatgcatctcggcaagaagcatgttttgaacatcgatttggaggacttctttggcagctttaattttggacgggtgcgaggatttttcatcaagaataaacacttcgagctctctccggagatcgcgactgtaatcgccaagattgcctgtcacaaaaacgagctgccacaggggagcccttgttcccctgtcataacaaacctgatagtccattctcttgacatcaaactcgcaaggctggcatccaacaacagctgtatttacactcgctacgcagatgacataacatttagcaccagaaatagagaacttcccgtggctctggcctctgaaagggacggagaatttatcctcagcaaaaaactccgttccgaaattcgccgcagtggttttctgatcaatgataaaaaaacgcgcaatcagtacaaggactctcgacaagatgtgacaggcctgatagtaaataagaagcccaacaccaaaaaagagtactggcggaccgtgcgagcccagtgtaattcactatttaaaactggcgggtttacagaactagtcaacggggaagtagtgaagggtaacgctaacgtccttgagggcaaactgaatttcatcgaccaggtggaccattacaaccgcttgcgccagtcaccacccctgaatcctaagtacaataccaagaaagaagccatcaagaacaatcaggcgaagttaagacggtacctccatagcgggagagaggatactttcagcaaatacctgttttattcccttttctatggcaatgaacttcccactatacttacggaaggtaagacggacaatgtgtatctcaagtctgctgtgcatatgttggctaagtcattcccaaaacttgcttcagagaaaacagccaccagccgatacgagctcctgctgaggttcgtggagtataccgaacgtactaggtatctgctcgagttatatggcgggacagactacctgaaggatttcattatcaactatcgtcagcactttaaattctacaaggctccgaaacctaagaaacccgtcattattttggtggataatgatgtgggacctaagaacctcatcaattatgtcaaccacattgagggcaaaagcatcttccccagctctgccaaggatatcagagcttccgactttgtgcacatattccacaacgtttatctggtgctgacccctcttggaaaagaaaactcggagacagacattgagtatttcttctccgacgcagatcggctgagaaaatacaatggaaagtgctttaacaccgtgagtaaaagggacccagattcggatctatccaaggactcatttgcaacccacgtcgtacacgcaaacaagaaagatctcgacttctctaggtttaaggggattttcgatagaatggttaaagtcatcgagcattacgacagtatcaagtga

SEQ ID NO: 8338 - RNA, 1833 nt, unidentified
  source 1..1833: mol_type = other RNA; note = synthetic construct
atggagcagttaaaaagtcttaaaaaggttacgaccaagcctgagtttgctcaattgttgggcattaagccatccgtattcacctattgcctctacgtgatacgccccgagaatcaatacagccagtttaagatcccgaagaaaaatgacggctataggacaattaacgcacctaccggaaccttgaagacaatccagtctgcattatctaatctcttactcgactgcctggacgagatcaataaagacaaattccctagtagcgagatgttcaaggcagaagccatcaattcaaaattcctcaagatcaaatgctctaatagtgtgattaagcagcctagtctgtcacatgggtttgaaaggaaacgctcgatcattactaacgccatgatgcacgttggaaggaaaaatgtcttcaacatcgatcttgagaactttttcggcagctttaattttggccgcgtgcgaggtttctttatcaagaacaagaacttcaagctctgtcccgacatagcaactatcattgctcaaatcgcctgcaataacaatgaactgccccagggcagtccttgctcccccgtaattactaacctcattgttcatagcctggacctgcgactagcgaagctggcttcgaatgattcctgtatttatacacggtatgccgatgatataaccttctctacaagagaaaacaagttccctataaacatagccaaggaagacgacaataagtttcactccagcaagaaattgaactccgaaattaaatcagctggttttgtcataaacgataagaagacacgaaaccagtacaaggattctagacaggacgtcacgggcctgattgtgaataagaagccgaataccaagaaagagtattggcggactgtgcgcgcccagtgtgactcactgtttaagactggggaattcaaagagctggttggggatagctatatcatcgggaacattaatagactggagggcaagctgaactttattgatcaggtggatcactacaacaagctgaggcaaagtgtgcccttgaatccaaagtattacctgaagaaagaggccaataaatcccaggccaagaaaagacgctacttatacaccggccgtgagattaccttttccaatttccttttctaccgtctgttctacgcatccgaactgccaactatcctcacagaaggtaaaacagataacgtctatcttaaagcggccatccatatgcttgctgacaagcactctagcttagccagcgctaaatcaggtaattccagctataaattgctcctgaagtttgtggagtacagcgagagaacgaagtatctgctggaactgtacggaggaacagattacctaatggacttcatcaaaaactacaacctgaactacaacctctataaagcgccgaaacccaataatcccgtcattatcgtagtggataacgacgatggacctaaagggctgattaattacatcaacaagatcaaggacgcaaagcttttcccacagacagctaaagatatcaggtcaagcgagtttatccacatcttcaacaacctctatctggtgctaaccccacggacggaagacaactgtccaactgatatcgagtacttttttactgacaaagatcggctgcgggaatacaagaacaaatgtttcaatacccactctaatagggacaccgagaatgatctttctaaagactcctttgctaaccatataatccatgccaataagaacgacattgacttctcacggttcaacgggctcctaaacagaataggaaaggtgattgagcactataatttgggcaaatga

SEQ ID NO: 8339 - RNA, 1839 nt, unidentified
  source 1..1839: mol_type = other RNA; note = synthetic construct
atgacacagcttcaagccctaaaagatgctaaaaccaagccggacttggcccgcctcctcaacattaagccatccatctttacgcactgcatctacatcgtcgatactaagaaccagtatacccagtttacaatccctaagaaaaatggcggcgaacggaccattaactccccctcagataaactgaagaagatccagaagagtctctcaaacctgcttctggactgtctcgatgaaataaataagctgcagtttcccgacagtgagatcagtcgccctcgggctagcaactcaaaatatcttaaggtgaagtgctccaattctaaaatcaaacagccttctctcagccatggctttgaacgcaagaggagcattattaccaactcaatgatgcatgtgggcaagaagcacgtttttaacattgatcttgaggactttttcgggagcttcaattttggcagggtacgcggattcttcattaaaaacaagaacttcctcctcgagcccgagatagctacggcgatagctaaaatcgcctgctacaataacgagctgcctcaaggtagtccctgttcgcccgtgattacaaatctgataacacacagcttggacatcaaattatcgaagttagcgttctataactcttgcatttattctcggtatgccgatgatattactttctccactaatgaaagcaagatgccaagacatattgcgagatcagtggacggggaattgattgtgggaaagaagctttattccgagatcaggaggtcaggcttctccataaacaagaataaaacccgagatcagtacaaggattctaggcaagacgtaacaggtctggtggttaataagaaacctaacacaaagaaggagtactggcggacagtccgtgcacaatgtaacatgctgtttaagaccgggagctttaacgaggttttgaacggtgaaataatcaaaggtaacatcaatcgcctcgaaggacgtctgaactttattgatcaggtggatcactacaataggctgagacagcacccagcactggaagctaaatatcagagtaaaaaggaggccctgcacctgagaaatatggccaagctgaggcggcatctgcataacggccgagagaacaccttcagcaagtttatcttctacagactattctacgcaaatgaaacccccactgtgctgacagagggcaaaactgataacgtctacatgaaagctgcaatccatatgctcgcttcatcttacccgcagctggcacaggagaataatggcagtaccccatacaaactactgatgaagtttgtcgaatactccgaaagaactcgatatttgctggagctgttcggaggggcagactaccttaagacttttgtcatgcactaccgccagcactacaaatactataaggctcctaaagccgataatccagtgatcatcttagtagacaatgacgagggaccaaaggaccttatcaactatgtcaatgggataaagtctaaacacgtttaccctacgagctccaaggacattcgatctgcagactttgtgcacatcttccataacttgtacttagtgatgaccccgagagggaataataatcaacacaccgacatagagtatttcttcaaagatttcgaccgtctcaggaaatatcagggaaaatgtttcaacaccatttctaaacggaaccccaacactgacctctccaaggatagttttgccaatcacatcatccatgcccacaagaagtccattgactttagcggattcgatgccatcctgaatcggatcctattggccattgaccattataaaagcagaaaatga

SEQ ID NO: 8340 - RNA, 1851 nt, unidentified
  source 1..1851: mol_type = other RNA; note = synthetic construct
atgcagaagatcgaagcactccgcaaaattaccacaaaaccagagctggcagccctgctcggcatcaaggccagcgtactgacctatgctctgtatatagtgaagccccagaatcagtacatccagtttaagatcaagaagaagaatggcggcgagagactgatctcggcgcctactgacaaactgaaatctattcaaagcgctctgagcgatcttctgttggactgtctggatgaaatctacaagtccaagtttcccgattccgaaattgctaagcagaagcttaagcactcgaaggtgctaaagatcaaaattgggtctgccaaaaacaagcaacctagcctctcacacggatttgaacgcaataggtcaatcattaccaacgccattatgcatatagggaaaaaaaacgtcctcaacatcgacttggaggattttttcggttcgttcaacttcggacgaattaggggcttctttatcaagaatgagaactttaagctggactccaacattgccactgttatagcccatatagcgtgttgcaacaaggagttaccccagggtagcccttgctctcccgtcattaccaatttgatcgctcatagtctggatattcgtctcgccgccctggccaaaaaacactcctgcacatatacacgatacgcagatgatattaccttttccacccgcgaagataccttcccagaatccgtaatgagacaagaaggaggtggctacatagctggaaagaagctcagaagtgagatcagacgcgccgggtttagcataaaagagagtaaaactcggattcagtatgccgacagccggcaggacgtgacggggttaattgtgaaccagaaacccaacgtgaaacgagagtattggcgcaccgtccgggcccagtgtaattcactttttaagacaggcaagttcgttgaggtggccggagaggagcaaaccgtcggcaatatcaacgtgctagagggtcggctgaacttcatagaccagctggaccactataatcgacttcgtcagaaacctgctctggatccgaattaccatcttaagcgcgatgctttagtccagcagaaaaaggcaaagcaacgttctcacttattgaattctagggaaaaggtgtttagtaagttcctgttctataggtacttctatgcattcgataagcccttgatcctgacagaaggcaaaactgacaacacctacctcaaatctgctatctggaaacttgcggcgcattacccaaagctggctaaggccaaatctaatactagtgcttacgagctcctgctgagatttttcaactacacagagaggacgaatttcctcttagaactagcgggaggcggggattattttaaagacttcgccagtggctacgcagagaattataagaagtacaaagcccctcggccagagcacccagtgattataatcgtagataatgacagtgggccgaaggaccttgtcaacctaatcgcaaccaagaagatcgggagcatttaccctacgaaccccgcacactcaaacgtggacgtgagaaattccgactttgtgcacttgtttcataacctctacatcatccttactccactcagcgctgggtcttccagctcagacattgaactgctgttcaaagacgtggatcggctgaggttgtataaaggaaagtctttcaatacagctactaaaagggataatagcaaagacctctccaaggaggcatttgcaacacatatcgtgtcagcccagaaaaacatcgtcaatttcgatggtttcaaagaactgttggacagagttgtttccgttattaaccactacgactcagtaaagtga

SEQ ID NO: 8341 - RNA, 1848 nt, unidentified
  source 1..1848: mol_type = other RNA; note = synthetic construct
atgaggaagttgaactcactggcacagatcaccactaaagcagagctggccgccctcctgggaattaagacctcgttcttaacacactgcctctatgtcattaagcctgcaaatcagtacacgcagtttaagatcgctaaaaagaacggcggcgagaggacaattaacgcccccacgaatagattgaagagcatacagtccgccctatcccatttactacttgactgcctggatgaacttaatagaaagaaataccctgcgagcgaactggccaagtccagtgcccagcattcccatatccttaaggtgaaatgttcaaacactaagaccaaacagcctagcctaagccatggttttgagcggaaacgatctatcatcacaaatgctatgatgcacaccaacaagaaaaacgttttaaacattgacctcaaggagtttttcaactcatttaactttggaagggtcaggggtttcttcataaagaatgacaacttcaagctggacccccacatcgcaaccgtgatcgctcagattgcatgttataataacgagttaccacaggggtccccatgcagcccggttattaccaacctgatcacgcacagtctggatatacggttggccttgcttgctcaaaagcattcttgtacttatactcgatatgccgatgatataacatttagtactcgtgagagtatctttcccccgcaaattatgagagaagaaaacgggcagttcatagctggtaagaaacttcgctccgagataaggcggtctggcttctcaattaacaacaagaaaaccaggattcagctcaaggattcaagacaagacgtgactggcttggtggtcaaccaaaagcccaacactaagaaggaatactggagaatcgccagagctcagtgcaataatctctttaatacaggcgctttcactaaaaccgtgaatggagagacaataaagggcaatgtgcgcgagctggaaggccaactgaatttcattgaccagctggatcactacaaccgcctgcggcaaaagtcccctctgaatcccaaatatcatctgaagaaggacgagattatcaaacagaagaaagcgaaacaacgcagctacctttttagcggccgggaaaaaactttcagccagttcctcttctaccagtttttctacgcctctgacaagcctaccattctcaccgaagggaagaccgataatgtgtatctaaagaccgcaatcaacattctggctgcaaattttcctgaccttgccaaaacaaagacagtcaccacaccttatgaattactcctgcggttcgtagagtactcggagcgtaccaaattcctgctcgagctgcatggaggtaccgactatcttaagcactttatcatgggctacgagagcaagctgaaacgttataaagctcccaaacccaagcacccagtgattatcgttatcgacaacgacacgggaccgcagggactcctgcattacgtggccaatatctcttctgccattattagtccaaactccctgattctgaaacaggattaccgaaaagctgattttatccacatctttcacaacctctatatcgtcttgacaccacggggggccgggaacacacacacagacatcgagtatttcttcaaagatatcgataggctccgaacctacaaagggaaatgtttcaatactgtagcgaatagagatgaagaacgcgacctgtcaaaggatgcctttgcaaaacagattataaaggcgcagaagaaagttgtagacttctctaatttgaagccactgttggagcgctttgtgatggtgatcaaacactacagtactatcaattga

SEQ ID NO: 8342 - RNA, 1908 nt, unidentified
  source 1..1908: mol_type = other RNA; note = synthetic construct
atgacaaagctagaattactccaggcagccaagacaaagtcagacctcgccagtattctcaatatcccccccagggcgctcacataccggttatataaaataagaccagagtcgcagtaccacactttttcgatcccaaagaaaaccggaggttcacgcaccatcagggctcccgagaaagaactgaaaaacatacagtcagcactgtctaaccttctgctcgactgtttggacgaaatcaataaaaagaggtttcctaacagcgagcttgccagccctaaagctcggcacgcaagaacactgaaggtgaagtgtaactccgctcgacagaagcaaccctccatttcccatggcttcgagagaaatcggagcatcattacaaacgccatgatgcacattggacagaagaatgtcctgaatctagacctcgctaatttttttgagagctttaacttcggcagggtccgagggtatttcctcaagaacgaaaactttaagctgacacccgaggtatcaaccaccatagctcagatcgcatgtacagacaactctctgcctcaggggagcccatgcagccctgttataaccaacttgattactcagtccttagatatccgcttggccgcgctggcaaatcgccatagttgcatctatactcggtatgccgatgatataacctttagtacacgcaagaagagttttccctcccagatcatcagaaattctcagggcatccagacactggggaagaaattggcttcagaaattaggagatcagggttttctgttaatcccaagaaaacccgggttttgtatcactcttctcggcaggaggtgactggacttgtcgtgaaccaaaaaccttcagttaagaaagactattggcgccttgtgcgagcccagtgtcatcagttgtttacccatggtagctaccttgaagaagtggacgataattttgtgaccgggagcattactgagcttgaaggaaaactgaatttcatcgaccagatcgatcattacaatcgcctgagagagaaaccaccattggatccacgataccactacaagaaggacgctctggccaaatctagcagcagcaaaagtcgtgagtacctgttcaacaatagggaaaagacattctcacaattcctattcttcaagtacttctacgcaaatagtacgccaacgattctgactgagggtcacactgataacatttatctcaagaccgcactactgcaactgtcttcgaattatccgtccctcacaaaaggatcaccacccaagctgagctgccacctatttaactacacggaacgtactaaattcttgctggagctggccggcggcacggactatctgaaatctttcgtggagaagtacaacactcgttacgagaagtacaacgctcccaccccgacccagcctgtaattatcgtggtcgataatgatagtggtccatccagcctgctgcactctctcaagaagtatgatcaagcgaagctctttcctacgaacttaaagattagcgatataaacgacgtaaagaagtccgagttcatctggattttccataacctgtacttagtcctgaccccgctcaagggaaagaacgataccgacatcgagtccctttttaaagagaaagaacggctgcggaaacacaatggcaaatgcttcaacaccgtggagaagagaaacgaggaaaaagacctttctaaagacagctttgccaggaatattatccgcgccaacagaaaatccatcgacttctccaacttccatgggctcctgaataggataactgccgtgcaaaaacactatgaaggcattaagaatgacaatggctccaaggatatccagccgttccttgcgacattgctgaaaccctcccagagtcctccttga

SEQ ID NO: 8343 - RNA, 1839 nt, unidentified
  source 1..1839: mol_type = other RNA; note = synthetic construct
atgggtagactcgacgaactgagggctgtcaagacgaaatcggaattagcgaaactcctgggaattaagccatcgttcctcacgtaccaattatatgtggtagggctggcttctcagtacaagaacttccacatccccaagaaatcaggcgggttgcggtccatcacagcaccagatgctaaactgaaaagcatccagtccgccttaagtaatctactcctggactgcgtggatgagattaacaaagagactttccctagatcagagttggctaacgaaaaggcccagcacgccaaagtcctgaaaattaagtgtaacagtgctcgcaccaagcagccgtctcttagtcacggcttcgagcgtaaaagatctattctcaccaatgcaatggttcatgttggacagaaaaacgtcctgaatatcgacctccaggacttctttgccagcttcaactttggtagagttcgcggcttcttcattaaaaacagggaattttcactcacgcccgagatagctactacaatcgccaaaatcgcttgctttaataatgaactgcctcaagggtccccaagtagccccgtaattacaaacttgatcacccatagcctggatataaagctcgccggcctggcagaaaaatacagctgtctgtacagtagatatgcagacgatataactttctcaactcgggaggagacttttccacatcagataatgcgtgaaacccgaggggaataccagcctgggaaaaggctcagaagtgagatccgaaggtccggatttacgatcaacaataaaaagacccgcattctatatcggtcttctaggcaggatgtcacagggcttgtggtgaatcagaagccatctgtgaaaaaggaatactggcgcactgctagagcccaatgtcattcgctgttccggaccggaaaatttactaagtccacagatggtcagatcttcgagggtaacataaacgaattggagggccagctcaactttattgaccaggtggaccattacaaccggctacgacagaaacccgccctgaatccacggtaccacctgaagaaggacgaactgtcaaagaataaagactccaagaagaagaggcaatatttactgaacagccgagagaagacattctccaagttccttttctatcgcattttttatgccaataccaagaccaccattctgaccgaaggaaaaaccgataatacctacttgaagagcgccatcagagagctgagccactcttatccctcccttgctaaacctaatccttatgagcttcaatgccagttcctgaattattctgagcgcacaaagtttctcctcgaattgcacgggggaggcgattacttcaagagctttgtggagagttacttggagaaatttcgtggattcaccgcgcctaagcccaaccatcctgtcatcatttttgtggataacgacaaaggcccccaggagcttatctccaggatcaagggcctcaagggcgtgcagatccacccgatccatcttgatattcagaaggatataaggcaagcagaattcctgcaccttcgcgccaatctgtacttaattctgactccgcaaactagctccctaggcgagacagacatagagtactttttcaaggataaggaccggctgaggcagcacaatggtaagtcctttaacacagtgaaaaaacgggacgaggcaaaagatctgagcaaggccgcctttgcacagcatatcgtaaagtcacaaaagaagtctatcgactttagcgacttcacattgctgctggatcgaattgttgcggtgcagaatcactatgactcaatcaaatga

SEQ ID NO: 8344 - RNA, 1833 nt, unidentified
  source 1..1833: mol_type = other RNA; note = synthetic construct
atgagccgacttgaaaatctccgggccgtagtcagtcgaccacagctcgcaaacctgctggggatcaggccatcgttcctcacgtataccttgtatgtgcgcggggtgtcaagccaatattgtaagttctcaatcccaaaaaaggccggaggcaaaagatacatcaaggcccctcagaaagaactcaagtacatccaatccgcgctgagcactctattgctggactgccttgacgagattaacaaagaaaagtttccaaagtctgagcttgtctcacccaaggcagaacacagtaaaactcttaaagtgaagtgcaactccgcacgggtcaaacagccaagtctgtcacatggctttgagcgtcagcgttctatcattaccaattcaatgatgcacttagggaaaaagaacgttctgaacatcgatctgaaggacttctttcagtcttttaactttgggcgagtgagaggcttcttcattaaaaacgagtacttcaagctggaccctaccatagcaacaactattgcgcaaatagcctgctatgataatcagctcccccagggatctccgtgttcccccgtcattacaaatctgattgcccattctctcgacattcgcttggctcgcttggcaaagaagtactcttgtacctatagcagatacgctgacgacattactttctccaccagggagaggatcttccccccgcagctcatgcgagaggatgatggtatctatacacctgggaagaggctgaagtccgagatacagagaagcggattcagcctgaatgatcggaaaactagaatcctgtaccgggacagtaggcaggatgtcacaggtctggttgttaatcagaagccaaacgtgaagaaggaatattggaggaccgtccgcgctcaatgccattggctttttaacattggtgcatttacaatggtcgtggatggcaaagatatcgagggaaatatcaacgctctggagggcaagctaaattttatagatcagctggaccactacaacaggttacgccagaagcccgccctgaatcccaaataccagctgaaacgggaggtgaaggggcgtgattcactcaaagctagacgctacttgttttcagccagagagaagactttctcccagttcctcttctatagactgttctatgcgaacgacaagcctactatccttaccgaaggtaaaaccgacaacatttacttaaagtccgccattcaatccttagccgcgtcgtaccctaagctcgccatcgagaatccttatcaactgttgtgtcattttgtgtcctacacagaacgcacccggttcttgctagagctttatggcggagctgattacctgaaaggcttcatagactcctataaggacaattttgaaatgtacaaggctccgaaaccccgccacccagtgatcgtgtttgtggacaatgatagcgggcccaaggatattatcagccgggtgaatggattaggcgaggcctctgttttccctcccaagatcgagaaggtaaaagacgttagaaaagccgacttcactcacctcatgaaaaatctctatctagtactgacgcctaggtctgaagctgataaagacacggatatcgagttcttctttaaggacgaagatcgactgcggaaatttaatggcaaatacttcaacaccgtagataaccgtgacgaaaccaaggacctgagtaaggaagcatttgctaggaacattgtgaaatttcagcggaaaagcattgactttagtaagttcacaagcctgcttgacagggttgtggccgtgatcgatcactacgagacaataaaatga

SEQ ID NO: 8345 - RNA, 1830 nt, unidentified
  source 1..1830: mol_type = other RNA; note = synthetic construct
atgtccaaactggccaaattgcgagcggcaaagacaaaacctgaactggctgatgttcttggagtgcatccttcattcctgacgtatactttatatgtgcgcggcactaacagtctctacacttcattcaacatacctaagaaatccggtggcgtccgcaccattcaatctcccgatagcgggctcaagtccatacagtcagcactctctaacctcttgcttgattgcatagatgagatcaacctggccaactttccagattcagagctggcaagtcctaaagctagccactcgaatatcctaaaggtcaagtgtaactccgcaaagacgaaacagccatccttgtctcacggatttacccgtcaccgctctattattactaacgcaatgatgcacgtcaataagaaagccatccttaacattgatctgaaggacttcttttcgagcttcaatttcggcagggtgagggggttttttattaagaacaagaacttcgagctcgatgacaatgtggccaccaccatagcccagattgcctgtcatgacaatgaacttccacagggtagcccatgctcacccgtgatcaccaacctgatcacccacagcctggatatccgactggccgacctagcgagaaagaatagctgcacatactccaggtacgccgacgacatcacattttccacagggaaacgaaaatttccctctgagattgtgtcggaggagaatggtatttgtgctctgggaaaaaaacttaagtccgaagtgcggaggagtggcttttctattaacagtaagaagactcgggttttatacaaggatagtaggcaggatgtaactggcctaatcgtgaacaagaaacccaacatcaaagcggagtattggagaacagtgcgggctcaatgcaatttgctcttcaagacgggtaagttctatgacttgatcaacaacaaggaagttgaaggcaatatttatgagctggaggggaagttaaattttatagaccagctggaccactacaataggctgcggcagaaacctgcgttgaatcctcaatatcacagacagaaggacgcacttgctaaaggcgggaaccagaaacagcgacgctacttatataacaatcgggaaaagaccttctctaacttcctgttctataaactgttctatgctaatcccctgaccatgatcctgactgaaggcaaaaccgataacatttacctgaaggcagccctgagtaggctcgctacagcctttcccagcctggctaaatcacagccgtacgagccactgtgccaattctttaagtacacagagcggacgaggtttctgctggaactccatgggggaggtgactactttaaatccttcgtggggtcctacgaagagcgctaccgtctctataaagccccaaagcccgctaaccccgttatcatcttcgtcgataatgataccggaccggaccagttgataagccgtattaagggaatgaagggcatcggcatctatccgacatcactgaacaaaggcgatatcagaaagagtgacttcgtccacataagcaataacttatacctcatccttactcctcagagcaacacaggagacaatacagacatcgagtatttttttaccgactttgacagaaagcgcccatacaatgggaagtgtttcaatactgtgaagctcagaaatgacaatgttgatctatctaaggatgcctttagccggcatattgtgcaggccaaaaaaaatgtcattgacttctctggattccataagttgctcgaaagaatcgtacttgtacaaaaccattacaaaaccctgtga

SEQ ID NO: 8346 - RNA, 1821 nt, unidentified
  source 1..1821: mol_type = other RNA; note = synthetic construct
atgtctaggctcgacaggctgaaggccgtcaatacgaagcctcagttcgcaagacttctgggtatacatcccagcttgctgacatatacgctctacaaaaagcggcccgagcactgctatcatgagttcaaaattcctaagaagagtggcggcaaacggacaatcaacgcgccggacgaaaagctgaagtcgattcagagagctttggcagacctactgctcgattgccttgatgagattaatgccgtgtactttccatctgcagagactctgaagccaaaggcaaagcacgccgatatccttaaggttaaatgtaatagcgctttgtcaaagcagccagctttgagtcacggatttgagagaaaacgctctattctcacgaatgcagtgatgcacttagataagaagcacctcttaaatatcgacttaaaggacttcttcccctcatttaattttggccgtgtgagggggttcttcatcaagaacaaccactttaagctgcacccgtctacagccacacttattgctcagatcgccatccttaacaacgaattaccgcaggggagcccctgttctcccgtcatcgccaatcttataacccaccatcttgatatccgcctggcgagtctagccgctaagtattcctgcacttatacccggtacgccgacgatatcacgttcagtacccgaagagccgcattccccagacagatcatgaacgagaaagatgggggatacattccttccaagcgtcttgcatccgaagtaaatagggccggctttcgcattaactctcagaaaactaggattctctacagagatagccgacaggaggtgaccggcctagttgcaaataagaaagtgggagtcaagaaggagtattggcgaaccctgcgggcccagtgccattccttgttcaccactgactcattcacaaaaatcgtcgatggcaaaaaggttgaaggcaacatcaatgagctcgaaggccaactgaatttcgttgatcaagtcgacagatacaaccgcttgcgccagaaacagccactgaacccattgctggccctgcggtcagagcaaaagaacggagacaaaaagagtaagaggcacctgctcaataatcgagagcggaccctgagcgactttctcttttacaagctgtttatttcgaactccaaaaccacaatcctcaccgaagggaagactgacaacacctatttaaaatccgcgatccaggccctggccaaacgcttccctactctcgctgaaactaaaccctaccagcctctggtacaattcatgaactacagcgaaaggacccggtttctgctggagctgttcggaggatgtgactacctcaaggcatttgccgaaaactatagctccaggcgcaagaagtatctgaaagagaaaccaacaagtcccgtaatactacttttagataatgaccaggggcctaaagacctgataaatcggttctccaaggataagtctattactctcttgccctcaacaagcaaaaacataagagatgctgagtttgtgcatgtgtgcgacaatttgtatctcgtgctcacaccaatttctcctaaacggaaagaaacagacatagagtacttcttcatggctaaaactagactgctaaaggatagcaaaaccggtaaatgttttaacaccatctcaaaaagggatgaaaagcgtgacctgtcaaaggaggcttttgcgcaactggtgaagactaacaaagggagcatcaacttctcccgctttggtcctctgctgacccgaattacaaaggtgcagaaacattacgccgctctgtga

SEQ ID NO: 8347 - RNA, 1857 nt, unidentified
  source 1..1857: mol_type = other RNA; note = synthetic construct
atgagcaagctaaaatatctcaagagtgtctccaccaagcccggttttgccaaagccctcggtgtcgacgccgtattcctgacacgatgtctttacataaatcagccagaaacacagtatcaccagttctctattgccaagaaatccgggggcaagagggtgattactgccccgtccgacgaattaaaatcactgcagaaaagactgagcatacttcttctggattgcattgatgagattaacgctaccaaataccctaactcccaaagagcaaggcctaagctgcgaaagaatggcgatccagattacgccgccgaggtcctcaagatcaaggtgccaacaaccgaaatcaagcagccatctctgtctcacggattcgtacgcgagcgtagcataatcactaatgctatgatgcatgtcggaaagaagcatgtcctaaacatcgacctcaaagatttcttcgatagctttaatttcggtagagtgaggggcttcttcatcaaaaacgttaacttccagttagacccccacattgctactgtgatcgctcagattgcctgttttgataacaaactgccccagggctcaccctgctctccagttataactaatctcataacccatgcactggacatcaggctcgcttcgttagcaaagaagtataagtgtacttacacccggtatgcagatgacattacattttcaacccgtaaggcggactttcctcctcaaataatgagacaggatactgacgggtacattgcaggtaagaaactgaggtctgagatcgagcgcgcaggctttgcgatgaatacctccaagactaggattcagtacaaagacagtcggcaggatgttacaggactggtcgtgaacaagaaaccgaacacaaaaaaggaatattggcggctcgcgcgagccaaatgcaaccagctatttaaaaccggaaaattcacgacgatacacgacgggaatgagattgagggtaacctgaatgagctggaaggccagctgaactttatcgatcaagtggaccactacaatagaatgagacaaaaagctcccttgagcatggagtacgagcataaaaaagtaaccaagtccactagaaacatcttgacagggcgagaacggacgtttagccagttcctttactatcggctattttgcgggaacgacaaaccaacaattctctgtgagggaaaaactgataacgtctacctgaaatcagccatctcagaacttagtacaagctacccccaattatctgtgaccaaggatggcaagtatgaattgctggttcgctttgtagaatactccaagcggaccaggtttctgctggagttgtttgggggcgccgactatcttcgcgggttcattgataactttgagaaaaacatgcgcctgtatgataaggtgaagccaaaacaccccgtgatcgttttcctcgacaatgacgaaggccctaagcaaatcgtgaacctcctgaaacagaagtcctttcaggataaaatcgaactgattccgagctctatgaataaaatggacgacatccgctcctcggagtttatccatgtggtgaagaacctttatgtcatcttcacgcctttgaccgaagatggaaaggagacagacatcgagtatttcttcgatgaaaaaacccggttgtttaaacaccctaagaatggaaaatgcttcaacacaattagtaagcgtaatagcaagaaggacctctcaaaagaggctttcgctacccatgtgatcaaggagaagaagaaggacgttaatttcaatggcctgaagcccttgctggacagtattgtgaaggtgattaatcactacgacagtatcaagtga

SEQ ID NO: 8348 - RNA, 1854 nt, unidentified
  source 1..1854: mol_type = other RNA; note = synthetic construct
atgagcaagctcaggcatcttaagagtacatccagcaagccgggctttgctaaagtccttgatgtggatgcagcttttctaacaaggtgcctgtacatcaaaaaaccggagactcaataccaccaatttagcatcgccaagaaatctgggggaacacgggtgatcaacgctccgtcagaagaactgaaatcgctgcagaaatcccttagtaagctgctcctggattgcatcgatgagataaatgccactaaatatcccaattcccagtggtcaaagcctaagctgcgaaagaatggcgagacggattatgctgccgaagtgctgaaaataaaaattccaaccgccgaaaccaagcagccaagcttgtcacatggattcgtgagggagaggtctattattacaaacgccatgatgcacgtgggcatgaaacatgtgttgaacatcgacctgaaggacttctttgattcgttcaatttcggcagagtgcgaggatttttcattcggaacgcgaactttcaactggacccccacgtcgccacagtaattgcgcagattgcttgttacgacaacaaactgccacagggtggaccttgctctcccgtgatcaccaatctgattacacactcccttgacatacggctcgcaagtctggcgcgcaaatataagtgcacgtacacacggtacgctgatgatatgacattcagcacccggagagctgacttcccagcacagattatgaggcaaagctccaacgagtacctcgcaggcaaacgtctacgtagagagattgagtctgcgggctttgcaatcaattctaacaaaactcgcgttcaactgaagaacagccgacaggaggttaccgggttagtagtgaataggaagcccaataccaagaaggagtactggcgtctcgcccgggccaaatgtaaccatctatttaaaatcggacgcttcaccgtggccaaaaacggcaataatgttgagggtaatttaaacgagttggagggtcagttgaattttattgaccaggtcgaccactataatcgcatgaggcagaaggccccttctattcctgagtatgcatcctccaaaatagggaagaataccaagaacctgctcacggggagagaaaaaactttctcccagttcctttactacaggttattttacggcaacgataagcctactgtcctctgtgagggaaaaactgataatgtttatctgaagtcagccattagtgagcttaacaagtattaccctttactcgtcgatgtaaaggacgaagaatatgatctatctatccgctttgttagatatagcaaacgcactcgattcctgctggagatctttgggggggccgactatctcagaggcttcattgacaatttcgagaagaacgtgaagctctacgaggctatcaagcctaaaaatcccgtaatagtgtttctggacaatgatgaaggaccacagcagatcgtcaagctcctgagtaccgaacgcttccagaaaaagatcgaaattatcccatctaagctgaacaagaaaaacgacatacggaaatcacacttcatacatgttgtcaagaacttgtacgtggtgttcacccccttgacccatgaaggtaaagagactgacatcgagtacttttttaatgataaggccagattgatcaagcacagtaacggcaaatgttataatacagtcaagaacagagacgcaaaaaaagacctgtcaaaagacgctttcgcaacgcacatcatcaaggaaaacaagaagagcatcgatttcgaagggcttaagcccctgttaaactccattgtgaatgtgattaaccactacgaaaagatcaagtga

SEQ ID NO: 8349 - RNA, 1854 nt, unidentified
  source 1..1854: mol_type = other RNA; note = synthetic construct
atgagcaagcttaatagactccgcctgatttccaccaagccctctttcgctagaatcctcggtgttgacgccgcattcctgacgaggtgtttgtatataaacaaaccagagaaccagtatcatcagttccctgtgaagaagaaaagcggaggggaacgaatcatccatgcccccagtgacgaattgaaatctctccagaagtgcctgtctatattactgctggactgcatcgatgagatcaatgcgaagaaatatccccactcccagcacgttaagccaaagctccgcaagaatggagagcctgattacgccgctgaggtcctgaagataaagattccctctgcattaagcaaacagtcaaccctcgctcacgggtttgtgagagatcgaagtataatcaccaatgccatgatgcatgtgggccagaggcacgtgctcaatatcgatctgaaagactttttcggctcctttaactttggcagagtgcgagggtttttcatcaaaaatgctcacttccaactggaccctcatatcgccaccgtaattgctcagattgcgtgttttgataacaaacttccacaaggcagtccatgttcacctgtgattacaaacctcatcgcccatagcctcgatatcaggcttgcgtccctggccaaaaagtacaagtgcacttacactaggtacgccgatgacattacatttagcactagacaggctgagttccccgcaggacttatgaagcaagatgctaattgttatgtcccgggtcgaaagttaaagagcgaaattgaacgggccggcttttacattaatggaaacaaaacccggatacagcacaaagactctcgccaggaggtgacaggacttattgtgaataagaagccaaacatccgtaaagaatattggagattagtccgggcaaaatgcaatcagctattcaagaccgggaaatttacatctaaagaggaagagaaggaggttgaaggcaatttgtacgagctggagggtcagcttaattttatagaccaggtggatcactacaaccgtctgagacagaaaagccctctatcaaacgaatatgctgtcaataaggtagggaagaacacccggctgattctgacagggcgtgagaaaactttctcacaattcttgttctaccggatgttttgtgggaatgagaaaccgacaatgctgtgcgagggcaagaccgacaatgtttacctgaaggccgccatctcctcattgaaaggaaactacccgcaactggcacgggtttccggcgagaagtatgagctgctggtaaggtttgtggaatatagtaaaagaacgcgcttcttcttagaattgttcgggggcgccgactatctgcgcggttttatcgactcgttcgaaaggaacatgaagatttacaactcaatcaagccagtcaaccccgtgatcatattcctggataatgataagggatctcagcagatcgtaaacctattgacaagcaaaacatttgtgaaccggattaagctgtttcctgtgaccctcgacgcaaagcaggacattaggaagagcgagttcatacacatcgttaaaaatctgtatgtgatcttcaccccccttactaacactggcaacgagactgacattgaatacttttttgacgagaagacgcgcctcatgaaacatagtaacggaaaatgctttaacaccctacaaaataggaattccaaagcagatctctccaaagattcgttcgcgactcatatcgtcaaggaaaagaaaaaagacatcgatttcatcggtttcaagagtctgcttgattctattgtgaaggtcattaaccactacgactccctcaagtga

SEQ ID NO: 8350 - RNA, 1854 nt, unidentified
  source 1..1854: mol_type = other RNA; note = synthetic construct
atgagtcggctgaagagattaaaaagtgcttcgacaaagcctgagtttgctaaggtcttgggaatagacgccgcctttctcacacgttgtctgtacattaacaaacccgaaaaccagtatcaccagttctctattccgaaaaaatccggcggagagagattaataaacgccccatcagaggaattgaagagccttcagaaaaatttgtccattctcctgctggactgcattgacgagatcaattctgaaaagtaccccgattcacaatggtccaagccaaagctgcgaaaaaacggcgatcctgactacgccgctgaggtcctcaaaattaagatcccaaatgctcaggtgaaacagccatcactttctcacggttttgtgcgggagcgaagtatcctcaccaacgccatgatgcatgtagggaaaaagaacgtgttgaatattgacttggaatccttctttgactcatttaacttcggcagagttcgcggctttttcatcaagaacgctaattttaacctcgacccccatatcgccactgttatcgcgcaaatcgcatgcttcgacaacaagctgcctcaaggcagtccttgtagccctgttatcacgaatctgattagccacacacttgatatccgcctggcatccctggcaaagaagtataattgcacctatacgagatatgcggacgacatcacctttagtactcgcaagtccgagttcccaccccagataatgaggcagaatgagagtggatacgtgcctgggcgcctcctgaagagcgaaataaagagatccggcttcagcattaactctagtaaaactcggatccaatataaaaacagccgtcaggacgtgacaggcctggtggtgaacaaaaaacccaatgtcaaacaggaatactggaggctagctagagcaaagtgcaaccagctcttcaaaaccggtaaattcacaacaattaaggacggaaacgagatcgacgggaatctgaatgaacttgagggtcagttgaatttcatcgaccaggtggatcattataataggatgcgccagaagacgcctttatcaaccgattatacccacactaaggtgggaaaaaataccaaggtaattctctctggacgggaaaagacctttagcaacttcctgtactacaggcttttctgcggaaatgagaaaccaaccattctctgtgaggggaaaacagataacgtgtacctgaagtccgcaatcagcgaactgtctaaggattacccacagctcgcccatagaaagggaaataaatatgaactgcttgttcggtttgttgaatactcaaaacggtctaggtttctgttggaacttttcggcggggccgattacctgaggggctttgtggataactttgagaagaatatgaagctctacgatgccatcactcccaagcatccggttattgtgttcttagacaatgatgaggggccccaacaggtggtcaacttactaaagagcaagaactttcaaaagaagatagagctaatccctagcactctggataaaaaagaagacataaggaagtctgagtttatccacgtcatcaagaacctgtatatcgtcttcactcccctcgctaaggatggcggggagacagatattgagtatttctttgacgataagactcgtttgatgaaacttccgaatggtaaatgtttcaacaccgtaaagaatcgcgattccaaaaacgacctgtcaaaagacgccttcgcaacacacatagtcaaagagaacaagaccaaaattgacttcaatggtctgaaacccctgctagaatcggtggtgaaggtaattaatcactacgattccctgcgatga

SEQ ID NO: 8351 - RNA, 1854 nt, unidentified
  source 1..1854: mol_type = other RNA; note = synthetic construct
atgagcaaacttaaaagacttcgctctgcttcaaccaagcctcagctagcacgcgtactggaagtagacgccgcctttttgacccgctgcctgtacatcaacaagactcagaaccaatatcaccagtttagtatcgcgaagaagtcaggtggcactcgtctgatcaatgccccctccaaagaattaaagagcttgcaaaaaaagctctccatacttctactggactgcatcgatgagatcaacgcagagaaatacccacggtcccagttggtgaagccgaagttaaggaaaaatggagatcccgactatgccgctgaagttctgaaaattaagatatctaccgcagaaacaaagcagccttccctggcacatggcttcgttaaggagcgctccatactgacgaatgcgatgatgcacgtggggaagaagaacgtcctcaatatcgatcttaatgactttttcgactgctttaactttggtagagtgcggggattcttcattaagaacgaaaacttcaagctcgaccaacacatagccactgtcattgcccagatcagttgttttgataataaactcccacagggctccccatgttcgcctgtgatcactaatctcatcacccatagcttagacatcaggttggcttcactggctaagaagcacaaatgtacttacaccaggtatgctgatgacattaccttctcaacacgtctgtcagaatttccagcccagattatgtggcatgattctacaacgtatcgggccggtaaagccctaaggaaagaaattagtcgcagcggtttcagcattaacaacagcaaaaccaggatccaatacaaggattcaagacagaatgtgacagggttagtcgtgaacaagaagcccaacatcaagcaggagtattggcgcctggtgcgagcaaagtgcaacaaattgtttaagacgggcaaattcacagtggttgaggacggtgagaaaaaagatggcaacatatccgagctggaaggccagctgaactttatcgatcaggtagatcattacaacaggatgcggcagaagccccctctgtctaccgattacagtcacaatagggtggggagaggcacccgaagcattctgaatggccgagaaaagaccttttccaagtttctgttctttagactcttctacgggaatcaaaagcccacaatcctctgtgagggaaaaaccgataacatttacctgaagtctgcaattagcgagctcagccagtcctatccacaactgagcagctctaagggagatgattatgaactcctcgttcggttcgtcaaatacaccaagcgaactagatttttgctggagcttttcgggggagcggattatctgcgtggcttcattgacaatttcgaaaaaaacacgaaggcctatgctaaaataactcccgaacaccctgtcatcatttttctggataatgacgaggggccgaacaatatcgtcaaactcctgagggacaaagggttccagaaaaagatcaacctggttcctccaacactggacaaatccgagggcatccggaaggccaatttcatacacgtggtggagaacctatacattattttcacaccactcacccctgatggaaaggagacagacattgagtacttctttgatgacaaaactagattgatgaagcatcccaatggaaaatgctttaatactttgcagaagcgggactcgaaagtggacctttctaaagacgccttcagtacacacatcatcaaagagaaaaagaagcagatcgactttaacgggcttagacccctgcttgactctgtcgtgaatgctattgaccattacaatagtgtaaagtga

SEQ ID NO: 8352 - RNA, 1860 nt, unidentified
  source 1..1860: mol_type = other RNA; note = synthetic construct
atgtcaaaactcaaccgcttaagaatcgccagttctaagccagattttgctaaagtcttggaagtagactcgtcatttctcactcgcgtcctgtacatcaataagccagaatcacagtatcataagtttacaatagcgaagaagtctggcgggctgagagaaatatcggccccctccatcgaactgaagagtcttcagaagtcactgtctaagctgctgctcgactgcattgatgagattaatgccaaaaagtacccctatagccaattgaacaaacccaagctgagaaagaatggtgaaaacgactacgctgcagaggtcctgaagattaaaatacccacttcctctataaagcagccaagcatttctcacgggtttgtgcgggaccgctccatcattactaacgccatgatgcacctggggaaaaaaaatgtcctcaatatcgatctcgaggatttttttggctctttcaatttcggtcgtgttcggggcttttttataaagaacaagaatttccggctcgatccccacatagcaacaattattgctcagattgcatgttacgataataaactacctcagggatctcctagtagcccagtcatcaccaatttgatcacgcatagcctggacatgaggttggctagtcttgctaaaaagttcaaatgtacctatactcggtacgcggacgatattaccttcagcacccggttaatcgagttcccagctcagatcatgaaacaaaacgaggatggctacatcgctggtaaaattctacgccgcgagatcaaacacgccgggttcagtattaacgagtccaagacccgtattcagtataaaaacagcaggcaggacgtaactgggttaattgtgaacaaaaagcctaacacgaagaaagagtactggagactcgtgcgggctaaatgcaaccatctttttaaaaccggctatttcgtgagtatcgttgatggcaaagagataaaaggaaacattaacgagctagagggacagctcaacttcatcgatcaggtggatcactataaccgaatgaggcagagagcccctcttaatccagagtacgccaggtctagcgtgggaaaacatacacgaaacctcctaactggcagggaaaagacgttccgcaatttcctgttttatcgacttttctgtggcaatgacaagcctacaatcctgtgcgagggaaaaaccgacaatatttacctgaagtccgcaattagtgaactggtgaaggaatatcctcagctggcacgaaaaaaggcctccgagtatgaattgttggtaaggttcgtggaatactcaaaaagaaccagattcctgctggagctgtacggtggaactgactatctgcggaacttcatcgactcatttgaagcgaacatgaaagtttacagcaacatcaaaccgaaaaatcccgtgatcctttttgtggataacgacaaggggacatccaatattaagaacctcctgtcttccaagagctttatcaagaagattaagatcagccccagcagcatcgataagaatgagcaaataaggaagtcccaatttatccatgtagttaagaatctgtacgtggttttcaccccgcttgcctccaatgacgactttaccgacgtcgaatacttttttgacgataaggcacgtttgatgaaacactcaaacggcaagtgcttcaatacagtgaggaatagaaatgacaacaaggatctctctaaggatgccttcgcaacacacatcgtgaaggagaacaaaaagaatattgacttcaccgggttcaaacccttactgaattcgatcgtcgaggtgatcaaccactatgaatccataaagaaagcctga

SEQ ID NO: 8353 - RNA, 1854 nt, unidentified
  source 1..1854: mol_type = other RNA; note = synthetic construct
atgtctaagctgcaatcactgaagtccattagttctaagcctgaattagcaaagctgcttggagttgacgcagccttcctaacccggactctgtacattgtacgcccagagaaccagtatcaccagttcactatcgataagaaaagcggaggaaagcgagtgattaacgcgcctagtgaggagctcaagtccttgcagcgaaaactcagcaatctcctcttggattgcattgatgagatcaataagatcaagtatcccacttcacagctggctgctcctaaagtgagggaaaatggggacattgactatacagcaaaggtactgaaaatcaaaatcccaagcagcaagagcaaacaaccctcactgtcccatggctttagtcggaaaaggtctattataaccaatgccatgatgcacattgggaagaaaaatatccttaacattgacatcgagaacttctttgatcgctttaatttcgggcgggtgagaggttacttcattaagaacaatgacttcaagctggatccccatatagctacggtcattgctcaaatcgcatgttacgacaataagttgccccagggttccccctgcagccctgtgattagtaatttgatatgccacagcttggacattaacctgagctcattagccaagaaatacaaatgcacctatacaagatacgccgatgatatcacattttccacccgcaaatctgagtttcccaagaagatcgccgaacagaacgagggctactatacactcgggaacgaattgctatatgaaataaaaaggtccggattctcagtcaacaacggcaaaaccaggatacagtacaagaacagccgccaagacgtaacgggtcttgtggttaacaagaaaccaaacacaaaaaaggagtactggcgtttggcgagagccaagtgtaatgctctttttaaaactggcacgttcaccaccatcgaggatggcgtgtctgtcattggcaatctggatgaactggaaggacagctcaattttatagaccatgtcgatcactacaacaggctgagacagaaggcgccactttcaccagagtattcacttaaaaccattgggaagtccaccaatatcttgctatctgggagagagaaaacattttcgcagttcctgtattatcggctgttttacgggaacgagaagccgacaatcttatgtgagggaaagaccgataatatttacctgaaatccgccattagcgaactcatggcccattacccaagtctggcaatcaagacagacggcaagtacgaactgctcattaggtttgtggagtataccaaacggacccgatttttactggaactcttcggtggcactgactatcttaaggggtttatcgaaaactttcacaaaaacatggccccctataagaacttaaaaccaaagaaccctgtgatcatcttcctagataatgacactggccccagtaacatagtgtctctcctgcagggaaataagttccagaaaatgatcactctgatcccttcccatctggataaaaaagacgacatcagaaagagtgagttcatccatgtcatggataacctttacgttatattcacaccgctcggcaattcgggcgaggaaactgacattgagtacttttttgacgataaaacacgcctcatgaagcactctaacggaaaattcttcaataccgttgagaaacgtgataccaagaatgatctgagcaaggacgctttcgccactcacatcgtcaaggaaaaaaagaaatccatagacttcacgggtctgaaggtgctgctggaccctatcgctaaagtgattgagcactacaagaatatcaagtga

SEQ ID NO: 8354 - RNA, 1854 nt, unidentified
  source 1..1854: mol_type = other RNA; note = synthetic construct
atgttaaatctagaacggctgaagcagatatcaaccaagcctgactttgccaagctgctgggtgtggatgccgcatttctcacaaggaccctgtacattgttaaacctgacaaccagtactcacaattcaccatcgacaaaaagagtggaggtaagcgaatcattaacgcccccagcgatgagttaaagtctctgcagaagaaactctcaaatctgctgctggactgcattgatgagattaatgctaagaagtttcccaaatcacagtccattaagccaaaactcaggaaaaatgacgagaatgattacgccgcggaagtcttaaagataaagattcctacttccgaatctaaacaaccatcacttagccatgggttcgtgcgtgaacgtagcattataaccaatgccatgatgcatattggcaagaaaaatgtccttaacatagaccttgagaatttcttcgacagttttaatttcggcagggtgagagggttcttcatcaagaacaacaactttaagttgaacgaccacatcgctaccgtgatcgcccaaattgcatgttacgagaacaagcttcctcaggggagcccttgcagccccgtgatatccaatctcataacccactccctagatatcaagttagccttcctggcacgcaagtataagtgcacatatacacggtacgctgatgatattactttcagcaccagaaaggatgatttcccaaaccagctggcaaggcacgacggaaatacgtatatcctgggaaaaaagctactgagagaaatcaaatcctctggcttcagcgtcaacaataacaagacccggatacagtttaaaaattcccgccaggatgtcacaggcctgattgtaaacaagaagcccaatacaaagaaagagtactggcggctggctcgggccaagtgtaacactttgttcaaaactggaacattcacttcgataaaggataatgtagaggtgaaaggcaacctgaacgaactggaaggccagttgaatttcatcgatcacgttgaccattataacagattgagacaaaaacctcccctggttccagagtacactctcaaaacaatcggcaaatctacaagaatcctcctgtctggccgcgaaaagacattctcccagtttttgtattaccgcctgttttgcggtaacgagaaacctacaattttgtgtgagggaaaaacggacaacatctacctcaaaagtgctatttccgaaatgaagaaggactacccgctcctcgctgatacgaaggacgatcattacgagcttctggtaaggtttgtcgaatataccaagcggacccgatttctcctggagatctttggtggagcggattacctaagggggtttatcgacaattttgagaagaacatgaagacgtatgagaatgtgcgaccaaaaaagccggttattgtgtttctcgacaatgacaccggacccgacaaaatcgtgaatctgcttcagggcaaaggctttcaggacaaaatcacccttatcccctctcacctggataagtcgtgtgatattcgtcgcagcgaattcatccatatcaccaaaaacctctatgtgatcttcaccccacgagggagcgcaggtgaagaaacagacatcgagtatttcttcgatgagaaaactcgcatgatgaaacactcaaatgggaagttctttaacaccattaagaaaagagacactaagagtgacttgagtaaagatgcctttgcgactcacatcattagggagaagaagaagaacatagatttcaaagggttgaaacccctgttagactctatcattaaggtgatcaaccactatgacgacattaaatga

SEQ ID NO: 8355 - RNA, 1848 nt, unidentified
  source 1..1848: mol_type = other RNA; note = synthetic construct
atgagtaaactgaaactgctgcgaaaaatcacttccaaacccgaactagccaaattgatgggaatcgccccagtgtttctgaccaaatgtctctacgtcacacggccagagcatcaataccaccagttccagattgacaagaagtcaggcggaaaacgtacaattagcgccccgtccgaagaactaaaatcattgcagaaaaagctgagtcttcttctactggactgcctggacgagatcaactctgaaaagtttccatattcccaggtcccgagtcctaaaaaacggaataatggagacgactactctgccaataaactgaagatcaagattccgtctgcgaaaacaaaacagccatctctttctcatggttttgaaaggaatcggtccataatcacaaatgcaatgatgcatatcgggaaaaagaatatcctgaacattgatcttgccgatttctttgatcagttcaattttggaagagtgagaggcttctttataaagaacaagtacttcaacctcgacacacacatagcaaccgtaatagctcagatcgcatgctacgataataagctgccccaggggagtccttcgagccctgttataaccaatcttattactcactctctggacattcgcctgctatccctggctaagaagtacaagtgcaactatactcgctatgccgatgatctcactttttccaccagactcgacgatttccccgagcaaattatgaaacaagtcgacggcgagtatatcccctcaagtaaactgcttcacgagattacccgttccggttttactattaacaacaagaagacgcgaatccagttcaaatcaagcagacaggatgtcaccggcctggtagttaataagaagcccaatgttaagagcgaatattggcgccaggtgagggctaagtgtaactccctgttcaagacgggtgaattctttagcatcaagaacggcaaaattatcgagggcaatatcaacgagttgcaggggcaacttaactttattgaccaggtggatctgtataatagactcagacaaaagcctcccctgcagcccgaatttgaactgaagaaattggggacctcgaccaaacagatcttatcatctagggagaggacattttctcaattcctcttctaccgcctgttcataggaaacgacaggcctacaattctgtgcgaagggaaaaccgacaacgtatacctcaagagtgccatcaatagcttaaagggagactatcctagccttgccaagatggaggatgggaaatacaacttgctgataaatttcgtggagtacagcaagcgaaccaagtttctgctcgagctcagcggcggggcaagttacctccgggacttcatcctgaactatgagaagaacttcaaaatctacaaggatcattcccctaagtatcccgtgatcatctttttagacaatgattcaggtgcgaatacaattatcaatctcttgcagcagcgggaatggcagcggaagatttcgctgagccccaacacgctcgacaaaaaggacgatatcaggaaaagcaacttcatccatgtcgagtacaatctgtacgttatattgacaccacgcactccaattggcggcgacactgatattgagtatttcttcgatgacaagacaagactactggctcactccaatggaaagtgttttaacactgtgtctaaaaggaaccctaacaccgatttgtccaaagaggcttttgcaactcacattataaaggagaagaagaactcaatcgacttcaccagcatgaaaccattattaaacctcattgtggatgtggtgacggactataatacccgctga

SEQ ID NO: 8356 - RNA, 1011 nt, unidentified
  source 1..1011: mol_type = other RNA; note = synthetic construct
atgtcaaggctggataaactgagatccaccagcacgaagtccgggtttgctgacgtgcttggagtatcagctgtgtttctcacacggtgtttgtacatcaacaaaccagaaaatcagtatcatcagttcaccattgataagaagactggtgggaagagagtaattaatagcccgtctaaggacctgaagtctctccagaagtcgcttagtgatctccttctggactgtgtcgacgagataaattctaaaaagttccctaagagccaactggcgagccccaagctgcgcaaaaataaagagcccgactatgcggccgaagtgctgaagttgaaaataccctccgccaattccaaacagccgagcctgtctcacggcttcgtgcgcaaacggagcataatcactaacgcaatgatgcatgttggctcgaagtacgtgcttaacatcgacttgcaggatttcttcgatagtttcaattttggcagggtgcgaggcttctttatcaagaacagaaacttccaactaaaccctgatgtggccaccgtcatcgcccaaattgcatgctatgataataaactcccacagggctcaccatgctccccagttatcacaaatctgatctctcactctttggacattcgactggctagcttagctaaaaagtacaagtgcacatatacccgttacgccgatgacattacgttctcaacacggatgcctacttttcccgtccagataatggcacagcaagacggttgttactaccctagtaaagctctcatcggtgaaattgagagggccgggttttttgtcaacaataagaagacaaggatcctgtatgaggactcccgccaggaggtcaccggactagttgccaacaagaaacccaataccaaaaaagagtactggcggacagtgagagcaaagtgcgacactctgtttaagaccgggaacttcagtactgtgattgatggcaagaaagttgaaggaaacttaaacgaactcgagggatga

SEQ ID NO: 8357 - RNA, 1854 nt, unidentified
  source 1..1854: mol_type = other RNA; note = synthetic construct
atgagcaggctggagcacctgaaaagcataaccactcgcccttcgttcgccaaggcactcggcgtcaaccctagttttctcactagatgcctctatataattcgtcccgagaatcagtatcaccagttcgaaatcaagaagaaatcaggggggaaacgtattataaaagcaccttccgtcgacctgaagagcttacaaaagaaactctctgacttactgctggattgcatcgatgagataaatgcctctaagtttccaaaaagtcagttggcttctccaaaaatgaggaacaagaaagatttggactacgcagctaaagtcctcaaaatcaagatacctggagctgagagcaaacagcccagcctgagccacggatttgtgagggacaggtctataattaccaacgctatgatgcacctgggtaagaagaatgttctcaacatcgacctggaaaattttttcgatagcttttccttcggacgagtgtgcgcgtttttcatgacaaacaggaacttcaacctaaacaagaaaattgccaccgtgatcgcccaaatcgcttgttacgaacgaaaactgccacagggttcaccctgttcgcccgttattaccaatctgattacgcattccctggatatccgccttgccgtgattgcgaaaaaatataagtgcacttactctcggtacgcagatgacatcaccttctctacaaataaaagcacctttccctatcagattatgaatcagtatgctgacgcctatatcccaggaaaagagctgatctgggagatcgagcgagccgggtttagcattaatgacaaaaagacccggattcaatataaggattctagacaggacgttacaggcctgatcgtgaataagaagccgaacactaaaaaggaatactggaggaccgcaagagccaagtgcaactcattgtttaaaaaagggaagttcacttccatcaaggacaatgtagaaactgatggcaacattaacgaattggaaggacagctaaacttcatagaccaagtggaccattataatcgtatgcgccagaaggcaccttttatcccagaatacactatcaagaatcatggcaaaaacacaaagctgctgttatctgctcgagaaaagaccttctcccacttcttattctaccggctgttctacggtaatgataagcccacaattctttgtgagggcaagaccgacaacgtatatctcaaatcagccatctcagagcttcaggctaattatccgtccttagccacaattaaagataagaagtacaagctcctcctcaggtttgttgagtacagcaagagaacaagatttttgctggagctgtttggcggcgcagattatcttcggggtttcatagacaacttcgaaaagaacacaaaacaattcgaggctcctaaaccgcaacatcctgtgatcattttccttgataacgacgaaggaccccagcagattgtgaatctactacagagtaagagttttcataacaagatctcccttttcccagatgggctggacccaaagaaggatattcgcaaggccacattcctgcacattacgctgaacctctacgtgatctttactcctttgaatagttccggcaaggagacggatatcgagtacttctttgaccgcaagactagattgatgaagcactcaaacgggaaatgttttaataccgtcagaaaacggaattcccgcacggacctttcaaaggatgcctttgcgacccacattgtgaaagcccagaagaagcggatcaatttcaagaaattcaaaagtctcctggaccccatcaccaaagtcatcgagcattacaagacactgaaatga

SEQ ID NO: 8358 - RNA, 1851 nt, unidentified
  source 1..1851: mol_type = other RNA; note = synthetic construct
atgtctcagctgaactatttgcggagaataagcacgaagccgtccttcgccaaggccctgggagtggatcctcggtttctcacacgctgtctttacattatcaagcccgagaatcagtaccaccagtttaccatagagaaaagaagtggagggaagagaattatcaacgcacccggcgacgatctaaagagccttcagaaaaaactctcagatttgctgttagactgcatcgacgaaattaacatcagtaagtaccctagcagtcaactcgctaaacccaaaatgcggaataaaaaggatttggattacgccgccactgttctgaaaattaaaataccgactgccgaaagcaagcagccatccttatctcatgggtttgtacgggaacggtcaattatcacaaatgcgatgatgcacctggggaaaaagaacgtcttgaatatcgatctgaagaatttctttgacagtttcaactttgggagagtccgtggtttcttcattaagaacaacaacttcaagctggatcctcatattgctacaattatcgcccagattgcgtgttatgataataagcttccacagggcagcccatgttcccccgttattactaacctcataacacactcactggacatacgactggcaaagctggccaaaaagtacaaatgcacctactccaggtatgcagacgatattacattctccacgcgtaagtcaaccttccctaaagagatcatgaatgaggacatcgacggctatacccctggaaaaaaactggtaggagagatcgtgcacgccggcttcagcatcaatcataacaaaacacggatccagttcaaagactccagacaggaagtgactggccttatcgttaacaagaaacccaacactaaaaaagagtactggaggactgctcgcgccaagtgcaataacctattcaagaagggaaagttcacctcaatagaggatggcttcgaaatagacggcaacctcgacgagttggaggggcagcttaatttcatcgatcaagtcgaccactataatcgaatgaggcaaaaagcacccctaaccgctgagtatgctattaacaacatcggaaagaataccaagaacctcctctctgcacgcgagtcgacatttagcaggtttctcttttataggctgttctacggcaatgataagcctaccatcttatgtgaggggaaaaccgataatgtgtatttgaagtcagctattagcgaacttctgcccaagtaccccagcttagcaaggatcgaagacaataattacaagctgctggtgcgctttgtggagtactctaaaagaacccgctttctcttggagctttttggtggagtggattatctgaaggactttatcaacaatttcgaaaagaacaccaagtgctatacagcaccagaacctaagcatccagtcatcattttccttgacaacgacgatgctagaatacctaacctgctgaagggtaaatctttcaacaagaaggtgacactgtttcccagtagtctcaattctattgacgacgtcaagaaggccgactttattcacatctttcaaaatctgtacgtggttttcacgccactggggaaatccggcgaggataccgatatagaatacttctttcacaagaaaacgcgtatgatcaaacactccaacggtaaattcttcaatacagtcgataagaggaatccagaagtagacctgtcgaaagacgcgtttgctatgcatatcatcaaagcccagaaaaagtctatcaactttactcgcctaaaaccgctgctcaatcgaattgtgaaggtgactgagcattatgaccagattaagaagtga

SEQ ID NO: 8359 - RNA, 1854 nt, unidentified
  source 1..1854: mol_type = other RNA; note = synthetic construct
atgtccaaactcaaatacctcaaatctatctcaacaaagcctagttttgccaaagctctgggagtagaccctaggttccttaccagatgcctgtacataaccagacccgaaaatcagtacatacagtttacaatcgacaaaaagtcaggcggtaaaagaatcatcaatgccccgaaagatgacctcaagtccctgcagaagaaattgtccataatgctgctcgactgtattgacgagataaatattagcaagtacccttcttctcaactggctcagccaaaaatgcgaaataagaatgacctggattacgcagccgaggttctgaagattaaaatccagtccactgaatctaaacaaccaagtctgtcacacggcttcgtcaggaaacgttccattattaccaatgccatgatgcaccttggaaaaaaaagcatcttgaacatagatctggaggattttttcggaagtttcaactttggaaggattcgggggttcttcattaaaaacgagaactttaagctggatccgcatattgctacgattatcgcacaaattgcatgctataacgatcagctgcctcagggcagcccatgttcgccagtgattaccaacctgatcagccattctcttgatatccagctggccgccctcgctaagcgctacaaatgcacctattccagatacgcggacgacatcacatttagtacccgacgctcaactttcccttcggagatcatgaattatgagagtgattcttacgtgccaggacggaagctgataagggagatcaaaagggcgggcttcagcatcaatgagaaaaaaacccgtattcagtacaaggatagcagacaggacgttacgggtctggtggtgaacaagaagcccaacacaaagaaagagtattggcggattgctagagcaaagtgtaatgtcctgtttaaaacaggtaagttttcaagcatctctaacggcatcgaggtagaaggtaatattaacgaacttgcagggcaattaaactttatcgaccaggtcgaccactataatcgcatgcgccagaaagccccatttacaccagagtactcccctcgggtgatcggcaaaaacacgaaggtcattctgtccgggcgggaagttactttcagcagatttcttttctatcgtctattctatggcaacaataagcccacgatcttatgcgaagggaaaacagacaatgtgtacttgaaatccgctatatcagaattaatcgccgattatcccactctcgccaagatagaagacaagaaatacgaactgcaactgcattttgtagaatattctaagcgaactaggttcctcctagaattgttcggaggcgcagactacttgaagggttttatcgataacttcgagaagaataccttgcctttcaaggcccctctaccccagcatcccgtgataatctttctcgataacgacaaggggccagagaagattaagcaactgctccaggggaagaccttcaatgagaagatctcactcttccccaagggccttgatccgaagacagacgtgaggaaagcgaactttattcatgtgatcaagaacttgtacgtggtgttcacccccctaaaaaacacaggcgaagacaccgatattgagtatttttttgacagcaagacccggctcattccccaccagaatgggaagtttttcaataccattgagaatcgcaattccactactgatcttagtaaagaggccttcgctacacacataatcaagagcaagaagaagaacatcaacttcaagggattaaaacctctgctggatcgcatcgttgaagtcatcgagcactataacactattaagtga

SEQ ID NO: 8360 - RNA, 1857 nt, unidentified
  source 1..1857: mol_type = other RNA; note = synthetic construct
atgccccggctgacccacctaaaaaccgtgtccagtaaacccgggttcgccagagccctgaatgtcgatcccaggtttcttacccggtgcctgtacgttgtgcgccctgagaaccaataccaccaatttagtatagacaagaagtcagggggccagaggctgatcaatgctccttctgatgacctcaagtctttgcagagtagcctgagcaacctgctgttggattgcatcgacgaaattaataagaacaagtaccctgagtctcaaatcgcgtcacctaaaatgctgagcccgaagaagaaagatcacattgcggaggttttaaagattaaaattcccagctccgaacacaagcagccgtctttatcccatgggttcgtgcgtgaacgctccatcatcacaaacgccatgatgcacctgggaaagaagaatgtgctaaacatagatctcaaggacttcttcgactctttcaactttggccgcgtgagaagctttttcatcaagaacatcaacttccgtcttgatcctagtatcgccacaatgattgctcagatcgcatgttacaaagataccctgccacagggttctccatgttccccagtgatcaccaacttaatcactcatagcctcgacatacgactcgcctctttggcaaaagattacaagtgtacgtacactagatacgccgatgatataacattctccacaaggaagagcgtgtttccccctcagatcatgcgggggaaagtcgatgataatcatggatatatacctggcgaaaagttaactaacgagatcaaaagggctggcttcctgattaaccacaaaaagacacgaatacagtataaggactcgagacaagatgtcacaggtctgatcgtcaatcagaggcccaacactaagaaagagtattggaggacagttcgcgctaaatgcaattttttgttcaaaactggcgagttcacctcgataaaaaatgacatagtggttgccggcaatattaacgaactggaaggacagctgaattttattgaccaagtcgaccattacaatcggattcgccaaaaatctccgctcaagccagagctggcactgaaaaatgtaggatccaataccaaactgcttctgtcaggtagagagaaaacctttagccagttcatcttttatcgcctcttctatggaaatgacaagccaacaattctatgcgaaggcaagactgacaacatctatattaagtcagcgatttccgagttggtcattagttatccaaaactcgctagagtagcaaagaatgagtataagcttctcgtccgatttgtggaatacagcaaacggaccagattcctcctggagctatacggaggggccagctacctgaaagattttattgtgaattaccgtacccagtttaaaaagtacaaagcagccaagccccagcaccctgtgatcatcattatagacaatgacgctgggccaaaggatgcaggcatctttggatatatcagtaatcagaaggaagccaagatctacccccagacccttgaccttaaaaaggacctgcgatcagcaaactttgttcatttgttccataacctgtatatcgtgatgacacccaaagggattaaggattgtgacactgacattgagtacttcttcacggataaagatcggctccgggagcactcaaaaaaatgctttaatacggtagctaagaggaacgctgacaaggacttgtccaagggtgcttttgccactcacattattaaggcccagaaaaagaacatcaacttcaacggcctgaagccacttctcgacaggatcatgatggccattgatcattatgacatcaacaagtga

SEQ ID NO: 8361 - RNA, 1860 nt, unidentified
  source 1..1860: mol_type = other RNA; note = synthetic construct
atgttatccaggttgaaaaacctgaagggcgcggccacgaaacctcagcttgcctctatacttaatgtgtccccggtgtttctgacgaaatgtctgtacatcatcaaaccagagaaccaatatcatcagttcgaggtaaataagaagtctggtggaaagcgggtcattactgcccctagcgaggacctgaaggggctgcagtctaagttatcagaattgctcctggactgtatcgacgaaatcaatactctcaagtatccagattcacagctggtgagtcctaagaaaaacatatctaagaagaacgacccatcggctgaggttctaaaagttaagatatcaaacgccgccattaaacagccttacctctcccatgggttcacccggcagaggtctattctgaccaatgccgtcatgcacttgggccagaaatccgtcttgaacatcgacctcgaaaacttcttcgattccttcaacttcggtcgggttcgagggtttttcatcaagaacaaaaacttcgagctaagtccttcaatagcaacagtaattgcccagattgcatgctataaagataccctgccccagggttcaccatgcagccctgtgatcacaaatttaattacccatcacttggacatccgccttgcaagtctggcgaaaagatacaagtgtacgtacactcggtatgctgatgatatcacctttagcacacgcctttctgtgtttcctcccgaaatcatgtgtgacagcctgaatgggttcgcacccgggaagaggctgaaacgggctattaaacatgcagggttttcgattaatgagaggaagacacggatacaatacaaaaattcccgacaggacgtcaccggtctgatcgtcaataagaagcccaacgtgaagagtgaatactggcgaaccgctcgtgccaaatgcaactccctctttaacaccggccactttattaccaacaagaacggaagaagcgtggagggcaacatcaatgaactggaaggccagctcaactttatagatcaagtcgaccactataatcgcatgaggcaaagccccccacttagccctgagtacagtcttaagaactatggaaagcgcacaaacggactactgtccggccgtgagacagtgtttagcaaattcctgttctaccgactattttacgccaatgagaaacccactatcctctgcgagggaaagaccgacaatgtatacctcaaatctgctataaaccagctgcacaatcaatacaagcagcttgtgaacattggggatgagtacaagttgctggtcagatttatcgagtattccaaaagaacaaggtttctcctggaactctatggaggagctgattacctccgtggttttattgatacatatgcggtcaagagtaaaatctacaatgctccaaagccagaaaaccccgtaattatatttatcgacaacgacgacggcccgaagcagattgaaacactgctgcagtctcgcaattttaacaagaagactacactcgttccaaatactttagatccgaagaaagacgtgaggaaggcagagttcattcacgttatcgataatctgtatgtggtgttcaccccccgcggcgatcaggatgaagacactgatatcgagtacttcttcggagatgacgcccggctgagaaaacacaccaatggcatgttcttcaatactgttcagaacagagatcctctgaaggacttatcaaaagaggtgtttgccacgcagatcattaaggcccaaaaaaaacacatcaacttcaatgggcttatccccttgttggacagaatcgtgaatgtgattaatcattatgacagcgtgaagggcctgtga

SEQ ID NO: 8362 - RNA, 1143 nt, unidentified
  source 1..1143: mol_type = other RNA; note = synthetic construct
atgtctcgtctgaagtatctcaaggttgctaagacgaagccacagctggcagatgtattgggggtcagccctgtgttcctcactaagtgtctgtacgtggtgaagcctgagaatcagtatcatcagttcgagatagacaaaaagagtggcggtaagcggaaaattacggctcctaaaaccgaattaaagtcccttcagtccaaactatcagaattgttaatggactgcatagacgagattaacaagtccaaattccccaactctcagcaggtgtctccaaaaaagaatatccaacagaagaaggaccccgctgctgaagtgctgaagattaaaatctctaactcagccatcagacagccctccctgtcgcatggatttaccaggcagagatctatcctcaccaatgcggtcatgcaccttggacagaagaacgtactcaatattgacctggagaacttttttgactccttcaacttcggccgcgttcgaggcttctttatcaagaacaagaactttgagctgagtccatcaatcgccactgtcatcgcacagatcgcttgttacaaggatacccttccgcaaggaagtccctgctcccctgttattactaatctgattacccaccacctggacattaggttagcaagcctggccaaccggtataaatgcacctacaccaggtatgcagatgatatcacattctccacgagactcagcatcttccccccagagattatgcgggatacattgaacgggtttgccccaggcaaacgactgaaaagggccatcaaacacgccggcttcagcattaacgagcgcaaaactcggatacaatataaaaacagcaggcaggatgtgaccggtctgatagtgaataaaactctaggggtcaagagtgaatactggcgaactgccagagcgaagtgtaatagcttgtttaatacagggtcgtttacaacagaacgcaagggggagctcgtcgaaggatctataaatgagctggaaggacagctgaacttcatcgatcagattgaccactacaatcgtatccgccaaaaagccccgcttcaacctgagtactcaatcaagaaggtgggcaaagagacacgccggctccatagcggtagagaaaaaaatttttga

SEQ ID NO: 8363 - RNA, 1890 nt, unidentified
  source 1..1890: mol_type = other RNA; note = synthetic construct
atgtccaagcttaactacctcaggtcaatttcgagcaaaccagagtttgccaaggcactgaatatttctcctaaattcctgactcacactctgtatgtggtcagaccggaaaaccagtaccacacattcaacatagataagaaatcagggggtcaacgtaccatcaacgcccccagcgacgaattgaaatctctgcaggccgcattatccaatctgctgttagattgtgtcggagaaataaacgctagcaaatatccaaaaagccagctagcgagtcccaaactcaaaaacaacaagatcgatagcgattattcggcagaggtactgaagattaagattagcaatagtgccatcaggcagccaagcctgagccatggctttactaaggacaggtcaatcattaccaatgcgatgatgcacatagggaagaagaacatcctgaatatcgatctggagaactttttcgactgttttaattttggcagagtccgtggtttctttcttaagaacaagaacttccagttcaaccccgagattgcaaccgttatcgctcagattgcgtgctatgagaataagttgccgcaaggaagtccctgttccccaattatcactaatttaatcgctcactcacttgacattcagctggcctctctggctcggaagtacaaatgtacctataccaggtacgcagatgatattacctttagtaccaatttgagcaccttccccacagagatcatggcagaggaaaagggcatttatacaagtggcaagaagttaaagaacgagatagagcgggccggtttctccattaatgacaagaaaacacgcatccaatacaaaaattctcgccaagacgtcactggactggtggtgaataagaaacctaacgtcaaaaacgagtattggcgcacagtgcgggctaaatgcaactccctcttcaagacaggcaggtttatgacgaccaaaaacggcgtggaagtcgaagggaatatcaacgaacttgagggccagctgaatttcatcgaccagatcgatcattacaatcggatgagacagaaacccccccttgtttcagagtacgctataaagaagatcggaatcaacgaccacagtacgaaggaactccttactggacgagagaaaactttctctcagttcctgtactacaagagcttttatggaaacgataaacccacaatcctttgcgaagggaaaactgacaatatttacctaaagtctgctatttcagagctcgccattaattatcctaatctggcctccttcacctccgaaatatctaaaaaagggataccgtacaagaaatacaacctcctggtgaatttctttgagtactctaggagaacacggttcttcttagaactctttgggggagtaggagatctgaagaagatcatcctgaactttgagaagtcccagcgaaagtatcagtgctccaaccctaaaaaccctgtgattattctgttggacaatgacactggtcccaaagacatcgtggccctcctgcaaagaaagcctctggtgaataagatcaccctagtaccacaagggctggaccctaagaccgatgtgcgcaaggctcagtttattcatgtcacaagaaacttgtacgttatattcacgccactcgatcctagcggcaatgccaccgatatcgaatatttttttgacgacaagacgcgcctcatgaagtactcaggcaagtgctttaatactgtgaaaaaccgaaacggcacaacagatttgtccaaagacaacttcgccacccatattgtgaaagcacagaaaaaaggtgtggatttcaatgggctaaagccactcttggacagtatcgtttctgttataaaacactatgacaccatcaagtga

SEQ ID NO: 8364 - RNA, 1866 nt, unidentified
  source 1..1866: mol_type = other RNA; note = synthetic construct
atgacaaagattgagctgctaaggaaggcaacgcataagcgggagctggcagcacttttaggatgtacaaccagcgctctaacctatgtactgtatatacttaaggtcgacacacagtacaagcagttcgagatcgacaaacgtaatggcgggaaaagaataatcacagcgcccactgacaggttaaaaagattgcaagcctccctttccaacctgcttctggattgcatcgacgacatcaaccgaattaagtatcccaatagccaggttaattcgccgaaacttatcaacaaaaagttcaaagacgcctcggctgacattcttaaggtgaaaattagcaacgctaagactaagcagcctagtctctcacatggatttgtgcgcgaaaggtccatcatcacgaatgccatgatgcatctcgacaagaagaatgttctgaatatcgatctgcacaacttcttcgattcctttaattttggcagggtgaggggtttcttcatttccaacgagaacttcaaattagacccaaatatcgctaccgtgattgcgcagatcgcctgttacgataacaagctaccacagggctctccctgctccccagtgatcagcaacctgatcacccatagcctcgacatccgcttagcctcactcgctaagaaaaattcatgtacctattctcgctacgctgatgacattaccttctctactaggaaatcagtctttcctaccaaaattatgagacaggaggacggcgagtacattccatctaaaaaactgcgcaatgagataaagaagtctggtttcacgattaacaacaagaagactagaatccagtacaaggattctagacaggacgtaactggcctcattgtcaataagaaacctaacgtgaaaaaggagtactggagaacagtgaaaagccagtgccactcactgttccaaaccggagcctttactaaaaaagtaggcgatgacatcgtcgagggaaatatcaacgagttagaagggcagctaaacttcattgaccaagttgatttgtacaataggcttcgacagaaaaaacccttgaatcctgtatacaaacacgcaactcacgggtataatacctccatcctcctcagtggtcgggaacggacattttcacgttttctctacttcaccttgttttacggcaacaccaagcccactatcctctgcgagggcaagacggataatgtttatctgaagtccgccattaacaaactggcagcaacataccctgctctggctcaggccaagacccccaacaaggaatatgagttgctgatcagatttctggaatatagcaaacggactcggttcctcctggaattgtacggacgcacaagctacctcaactatttcatcgggaagttcgacaagaactttaagttctacaaagctccaacacctcagcatccggtgataataattctggataacgacagtgggtttgtgggcaaaaaggattctgggattgccgggaaactgaagaagatcgatagtgcaaccgcctatccgacaacactgaagaaggatgactttcgcaacgcagacttcatacacgtgattcacaatctctacatagtcctgaccccccttggaacagccaaggaaaccgctatcgaggatctgtttgatgatgagacgcgtcaggtgaaggtcagtggaaagagtttcaatcacaaagatgaccgggataatgccaaagaatatggtaaagaagtgtttgcccaaaaagtcattaaggcccataagtcctctattaactttgatggcttgaagccactgctggaccgagtggttcaagcgatcgaacactatgacactataagcgcggccaaatga

SEQ ID NO: 8365 - RNA, 1845 nt, unidentified
  source 1..1845: mol_type = other RNA; note = synthetic construct
atgaccaaacttgaggccttgaagaaaataacaaccaagaaagagctggctgcactgctgggtgtgaagacatccttccttacgtacaccttatatttcatcaaaccgcacactcagtatacccagttcaagattcctaaaaagaatggcggcgaacgtatcataagctctcctaatgggaagcttaaaaccctgcagaagaaactgtccattttattcctcgatagcatagacgaaatcaacaaggcgaaattccccgaagctgaagccttcaagaacatcaacgacaagataatgtactccccaattctgaaagtcaagataggatctgcaaagatcaagcagcagccctctctctcccatggatttgtgagaaatcgcagcatcattactaatgccatgatgcatctggggcagaagaatgtactgaatatcgatctcagcaacttttttgactcctttaatttcggtagggtgagaggcttttttatcaagaacgaccactttaagctggatccagcgattgccaccgtgatagctcagattgcctgttacgataacaagttgccccagggatcaccgtgctcccccgttataacaaacttgatcacccacagtctggatattagactagcctctctggccaagaaaaattcgtgtacgtacagccgttatgctgacgatatcacatttagcacacggaagaaatctttcccatccaatatcatgagcgaactgtcaggcgaattcaccccctcaaaaaagctaagttttgagattaaacgggccggcttcagcatcaataacgttaaaactcgcatccagtacaaggactctcgccaggatgtgacagggttgattgtgaacaaaaagcccaataccaaaaaggaatattggcgaacagttcggtcgcagtgtaataaactcttcaagtctggcaaatttaccaagactgtcaacgacaaagtggaggatggtaatattaacgagctggaggggcagcttaatttcatcgaccaagtcgatagttataaccgactaaggcaggcggttccgattaaccataattacgcaacctcaaagcacggacacaacactagtaagctcctgtccggaagggagcggactttcagtcggtttctttactacaggctattttatggcaacgataagccaactattatatgcgaagggaagactgataatgtgtatctcaagtcagccattaatcgcctcatgacaggttatcccacgttggcaaataaaaccctcaattcaaagtccaacaaaactgagtataagctcctgattaagatcctgaaatacacaaaacgcaccagatttcttttgcagctttacgggggcacgtcttatttgaactactttatctccaagttcgataagcagtacgagtattacgacgctcctaaaccacagcaccctgttattatactgctggataacgactcaggatttgattgcatcgagaaggagctgaaaaaggtgcaacccgctattatcctgcctccacctttaaaaaagcatgacttcaggaacgccgacttcatccatgtgttccacaacttatacatcgtgctcacccctatgaacaaccaacctaaaacaatgatcgaggatctcttcgacgtagcaactcgacaaatccaggtcgacaataaaacctttaacccagagaaagactttgacaagacaaaagaatacagcaagcaaatctttgctcaaaaagtggtcagtactcagaagagcaccatcaatttcgatggcttcaaacccttcctggacaggattgtcagagtaattgaacactatgacacaattaagtga

SEQ ID NO: 8366 - RNA, 1866 nt, unidentified
  source 1..1866: mol_type = other RNA; note = synthetic construct
atgaacaagttgaaatccttgcaaaaagttagcacaaaaagcgaacttgcctctcttctgggggtgaaagccagcttcctcacacacaccctctacgtggtcaagcccagttctcagtatacgaacttcaagatccccaaaaagtccgggggcgagcgctcgataaatgctcctactaaaaagctgaagacattacagtcttgtctgagtaaactcctgctagactgcatcgacgagatcaataccatcaagtatccagacctcgcctcttacgaagtgacgcggaacaaaatcctgaaggtaaaaattcctaactcaaagatcaagcaaccaagcctggcgcatggatttgtgcggaatagaagcattataaccaatgccatgatgcacgtaaaccagaaaaatatcctgaatatcgacctgaacaatttcttcgacagctttaacttcgggagagtccgtgctttctttatcaagaacaagaacttcaagctgcccgagaacattgcaacaacaattgcacaaattgcctgcaacaataacacacttccacagggatccccttgtagtcccgttattagtaatctcatcacgcattccctcgacataaaacttgcctatctagcccacgagtattcctgcaggtactcgaggtacgctgatgatatcacattttcaactcgcaaaaaagctttcccgaccaaaatcatgtcctacgaaaacaactgttatgtggccggcaaaaagctgcagggagctatcaaacaagccggattttcaatcaatgacaagaagactaggattcagtataaggatagccgacaggacgtgacaggcctgatcgttaataagaagcccaatgtgaaaaacgagtattggcggagagtgagagcacagtgccactctttatttaccactggtcagtttaccaaggaattaaaaggggagatcgtggcggggaacataaatgaactcgagggacagctgaactttatagatcaggtggatcactataaccgcgtcaggcagtccccaccactggatcccaagtaccacctgaagcgagatgagctgttgaaaactaatcaggctaaggaacgccaatatctgtttacaggccgtgagcgaacgttttcacgctttctgtactacaggagtttttacgctaataacaaaccgaccattctgtgtgagggtaagaccgacaatatttacctcaagtccgccattagtgagagggtgaagcggcatccaacccttgcgtcacagaaaaagggcgctgtaccctacgagttgctgatcaatttcttcaattattcccctcggactagatttttgctggaactggcaggcggaactgactacctcaaagacttcgtaattaacttcaataagcacttcaacagctttaaggcaccaaaacctaagcatccggttattattgtgcttgacaacgataagggtcctaatggcttgcttcactatctgagcaacgtcaagggcgcatctataatccccaacaccttgaagcttaaaacagattatcgtaaggccgaatacattcatgtgttccacaacctctatgtcgtcctcacccctttatcaaacaagggcaagtcacaaaagatagaagatcagtacaccgatatagaaagcttattcaagaaagccgacctactgcgcacttaccagaaaaagtgctttaatatcgcttccaaacggaatgaagatattgacctctctaaaaatgccttcgcaaatcagattgtgaaagggcaaaagaaacaggttaacttttctggtttcaacaaactactgaacagaatcgaggaggtcatcaagcattacgacaatatgatcttctga

SEQ ID NO: 8367 - RNA, 1728 nt, unidentified
  source 1..1728: mol_type = other RNA; note = synthetic construct
atgcccaaaaagaatggtggtaaacgggagattaatgctcccattgaaaagctcaagagtcttcagagctcgttgtccaatctgttgcttgattgtatcgatgagatcaataaagtcaagttcccaagatccgaagtgaataagaatcgtgataaatcctcgaaagccaacaatcatgaaatcttgaagatcaaggtcccgaatgccgacatcaaacaacagtccctctcacatgggtttgtgagaaacaggtctatcatcactaacgccatgatgcatctaggccagaagaatgtactgaatattgatctcaaagacttctttgacagctttaactttggccgtgtccgcgggtttttcatcaagaacaagaactttaagctggacagccacatcgccacggtgatagcacaaattgcctgctacgacaataagctgccccagggaggcccttgcagtccagtgattacaaacctgataacgcacgcccttgacattcgcctagctgcgctggcagagaagtattcatgtatttatacgaggtatgcggacgatttgaccttttccactagggaaaaggtgtttcccgaaaaaatcgccagactcgataatgggaagtatgccgcgggtaaaaaattaaagagtgagatatctcgcagcggattcagcataaacgataaaaagaccagggtgcagttcaaggactcacggcaggacgtgaccgggttagtagttaaccggaaaccaaatgtgaaaaaggaatactggaggactgccaaaagtcagtgccactctctgttccggacaggatcatttaccaaaatcgtttccgatgtcgtggtcgagggaaacatcaatgagttggaaggtcagttaaactttatcgaccaggtggactcttacaatcggctaagacagaaggctcctctgaactacgtctaccagttcgcaaaacacgggcacaacaccttaccgctcctgagcgaccgggagcgaactttcagccgatttttgtactatcgacttttctacggaaacgcaaagcctacaattttgtgtgagggcaaaactgacaacgtgtaccttaagaccgccataaagaggctggtttcagcttacccaaagctcgctaagactcgcgtgaattctgagacaaagaaaccatcctacgacctcctcgtgcgcttcctggaatattctaaacgcactagattcctgctgcaactttttggcggcacatcctacctgagctacttcattagcaagttcgaagcccaatatgctttctacaaagcaccaaaaccccagcaccctgtccttattgtactggataatgattctggcttctacaaggagatcgaaaataagctgaaaaaaatcgagacaccgaccgtgtatcctgttagcctgaaaaaacatgattttcgaaaggcggatttcattcacgtcatgcataacctgtatattgtgctaacccccctcagtgctaccggcaaagatacaatgatcgaggatctgtttgatgacaccgcaagaggagttgtcgtgtcaggaaagacattcaaccctaaggacggcagagacaacgccaaggaatatgggaaggaggttttcgcaaagaaagtaatacaagaccagaggaacaagatcaactttgatgggctgaagcccctcctggaccgtatggtgaaagctatcgagcactatgattccattaagaacagttga

SEQ ID NO: 8368 - RNA, 963 nt, unidentified
  source 1..963: mol_type = other RNA; note = synthetic construct
atgaacaagctcaacaagttaaaggcggtgactacgaagcaggagctcgcagaattgctgggagtgaaggctagctttttaacttacgtgctatatatcctgcgaccagagaaccagtatgtgcagttcagtatccccaagaaaaatggagggaagaggaaaatcaacgcccctatagagaaactgaagtccctgcagagctctctttcaaatttgcttttcgactgtgtcgatgagattaacaaggttaagtttcccttctcagagataaacaaagaccgggatcggaattcaaaaaccaacaactacgagatccttaaagtcaaagtccctaatgccgatgtaaagcagcagagcctctctcacggcttcgtgcgaaacaggagtatcattactaatgctatgatgcatctgggtcagaaaaacgtcctcaatatcgacctcaaggacttttttgggtcctttaatttcggtcgcgtgagaggattcttcattaagaacaagaacttcaagctggactcgcacatagccacggtaatagcccagatcgcatgctatgataataagctacctcagggcggcccatgctcacccgtgatcaccaacctgattacacacagcttggatattaggcttgcagcgttggcagaacgctactcctgtatctatacaagatacgctgacgacctgaccttctccaccagagaaaagttcttcccagaaaagatcgcccgtctggacaatggaaaatacgtagccgggaaaaaactgaaatctgaaatttcccggagtgggtttagcattaatgataagaagacccgcgttcaatttaaggattctagacaagacgttacaggcctggttgtgaatcgcaaaccgaatgtgaaaaaagagtactggaggacagctaaatctcaatgccatagcctctttcggactggcagttttaccaaggtcgtgtga

SEQ ID NO: 8369 - RNA, 1851 nt, unidentified
  source 1..1851: mol_type = other RNA; note = synthetic construct
atgaaaaaaatcgaggctttgcaagccgtgcggacaaagcccgaactggctagacttttaggtgtcaaggccagcatgctgacttacgtgctgtacgtgctgaggcccgaaaaccagtacagctccttcactatcccaaaaaagtctgggggcacgcggacgataaacgcaccacacgacagactgcgacttattcagcgagcacttagcgacctgctccaggattgcattgaagatataaacgactccaaacctaagagcgctgtgaaaggcaaattcatcgcagccaaaaaggacgacaacccagactacagacgccataaatttttcgaagacgtatttacccctactctgtcccatggctttgtaagaaaaaggtccatcattacaaacgcgatgatgcatattgaccggaagaatgtgttgaatatcgacctgaaggactttttcgatagttttaatttcgggcgggtgagaggtttcttcattgctaataatcatttcgggttgagccctgagattgctaccgtaatcgcacagatagcctgctacaatcacaaacttccacaaggcagcccttgctcacctgtgataaccaacctgataggccatatccttgatatcaaactcgctctgctcgcacgagagcacagttgtacctatacaaggtatgcagatgacatcacctttagtactcgtagtaagcactttcccgatgctttgatgagagagtataagggtatctacgtcccaggcctggagctagagaatcgcatccgccaagcgggcttccgcgtcaattctaagaagaccagaatccaataccaggattcaaggcagatcgtcaccgggctagttgtcaatgagaaaccgaacatccgctctgagtactggaggactgccaagagtcagtgtcacctgctgtttaaaacaggcgccttcacagaaggagataaggagaagtctctccctggaaacattgagcagcttgaggggcgcctcaactttattgaccagctggatttttacaaccggttacgccagaaaccgcccctgaactcagaatacgttctagaaaagcatggcgtggatactcggaagttgttaggcggacgggaaaggaccttcgggcgttttctatattacagatcgttttacgcttcatcctctccaaccattttatgcgaggggaagaccgacaatatctatgtgaaggccgctattaaccgccttgccgccgattatccctccctcgcccgagtcaaagcctccgagtccgaatataagctgctggttagcattttcaagtatacaccccgaactaggtttttgctgggactctacggaggggccagctaccttaaggaatttatcacacgtttcgaggaagcctattcttactacaaggcgccagacccagagaatccggtcatcatcattatggacaatgacgggggctttgacggagtagatagcctgttaaagggtaagaaactccacgctactcccttccctaaaggtgccggaaaactggaatatagaggcgcggacttcatccacgtgaccaaaaacctgtatattgtgctgacccctatgtcctcatctggcggatccagtgagatagaagacctcttcacgcctagcacgaggagtgagccctttgatggaaagcacctgtgtctcgagaaagatatagatagggcaacacagtatgggaaggatacattcgcaaataaggttattctccccaagaagaactcaattgatttctctggtttcaaagtgctgttggaccgggttgtgatgtgtatcgagcactataagtcagcaaaactcgccttgtcgaaatga

SEQ ID NO: 8370 - RNA, 1848 nt, unidentified
  source 1..1848: mol_type = other RNA; note = synthetic construct
atgaaaaagattgatgcactgagaacagttactacaaaacctgagttggcgagactgctgggaatcaaagcgtccatgctgacatacgtgctttacgtgttgaggccagaaacacagtactccatttttgagattcccaagaaatctgggggtacccggaccatcagcgctccacatgacaaactgaaatccatacaacgcgccttggcggatctgctccaggactgcattgaggacataaatgactctaaacctaagtccgccgtgaaaagcaagttcatcaactccaaaaagaatgacaatccagactatcggaaatccaagtttttcgaagatgtcttcacccctactatcagccatggctttgtgcgtaaacgttccataattaccaatgcaatgatgcacctcaaccgaaagaacgttcttaacatcgatttaaaggactttttcgactcctttaactttggaagagtgagggggtttttcatcgccaatgaccacttcggattggacgagcatattgccacagtaattgctcagatcgcttgctacgagcacaagctcccccaggggagtccctgtagcccagtgatcaccaatctcatcgggcacattctggacatcaaactcgcattgctcgcacgggaatatcgatgcacctacacgcgatacgcagatgatataacattttctacaaggtcgaaggagtttcctgttgaactgacccgggaatacaagggaacctacatcatcggttcggtactggaaaaccggatcagacaggctgggtttcggatcaatccacgaaagactaggatacagtataaagacagcaggcagactgtgacgggtctggtcgtcaatgagaagcctaacgtgagaagcgagtactggcggactgtcaaatcacaatgtcacatgctctttaagtctggcgccttcactgaagatgggcccgaggaaccggtacccgggaacattgatcagctggagggacgactgaactttatagaccagctggatttctataaccggctaaggcaaaagcccccgctcacccctgattacatgctggaaaagcatggggtcaatacccacaaactgctaagtggacgcgagcgcacattctcacgcttcttatattatagggctttctacgggaatgctagaccgactatattatgtgagggtaaaaccgacaatatttacgtgaaggccgctatcagcagacttgcggccgactacccccgccttgccaagattaaaactgctacaagcgactataagcttctggtcagtatctttaagtataccagccgcacccggtttctgatgggcttatatggcggcgcagcctatctgactgattttgttgctaggttcgagaacacgcaccgcttctacaaagccccccgccctactaaccctgttattattatcatggacaatgacggcggcttcgatggagtagagggtatcttcaaaggcaagaagtctaatgccacaccagtgcctaaaggcaccggccgtacagaatatagaggcgcagatttcattcatgtcgttgagaacttgtacgtggtccttacaccactcggaccatccggttcaaaatctgaaatcgaggatctattcacgtcaagtacgagagaggagttggtggacaagaaaaccctgtgccttgataaggaaatcgataggtcttctcaatacggcaaggataccttcgccaacaaggtgattctccccaagaaggccagcatcgacttcagtggatttaagatactgctggaccgtattgtgctctgtatggaacactatgagagttcagtgcttgcatcaacttga

SEQ ID NO: 8371 - RNA, 1440 nt, unidentified
  source 1..1440: mol_type = other RNA; note = synthetic construct
atgatgcatctgaatcgtaaaaatgtcctcaatgttgaccttaagaatttcttcgactccttcaactttggtagagtacgcggcttctttataacaaacaaccattttcggctggcccccgagatagctactgttattgcccagatcgcctgctacgataataagttaccacaaggatcaccagcctccccggtgataacgaacttaattacccatattctagacatcagactcagcatcctcgctcgggagcaatcatgcacatacacccggtatgcggacgatatcacattttctaccagggagaaggtcttccccgagcagatcatgaaggaaattggtgacacctattcccccggacacctactgagcggtgagattaggcgcgccggcttcagtctcaatgctcaaaagactcggatccagtacaaagattctcgccaggaggttaccggactggtggtgaataagaaacctaacgtgaagaaagagtattggagaacggtcaagagccaatgtcacctgcttttcaaaattggcaacttcgtggaaattataaacgatgaaccgcagcccggaaacatcaaccagctggaaggccggctgaattttatcgaccaggtagactactataatcgtaagagacagaaacctcatctgaaccctgagtatgctctgtctaagcatgggaccaacacccacgaactcctgagcgggagagaaaggaccttttctcgttttctgtactaccgaagtttctatggaaacgacaagcctgcaatcatctgcgaagggaaaacagacaacatctacttgaagagtgcaattaataggctagctccagtgtaccctaggctggccactgcaaaatcaactacttcagactacaccctgcttgtggacattttcaattatagcgcgagaacgcgatttctgttagagttgtatggggggaccagttacttgaaggattttatagtgcgctttgagaaacactattcgttctataaagctccacgaccacagaatcccgtcatcatcatacttgacaatgataagggtttcgatgaaattgacaaattgctcaagtccgagaaaagcaaatccaccgcctacccagagatagcaggacagaacaagtacaggggcgctgactttattcacgtaattcacaacctctacgttgtcctgacacctcttgccgcaactggcggccagactgccgtggaagatctctttccccaggtcacacgcgatgaaattgtggatggcaaaagtttctcaacagacaaggagatcgatcgcactacacaatacgggaaggacgttttcgcaaataaagtgatcgcggccaagaagggcagcatcgatttttctgggttctccgtgttgctgaaccggatcgtctcttgtatcgagcactatgattccattaagtga

SEQ ID NO: 8372 - RNA, 1842 nt, unidentified
  source 1..1842: mol_type = other RNA; note = synthetic construct
atgaggaaaatcgacgccttgaaggcggtcagaactaaacctgaattggcctccctgctgggagtgaaggcctctaccctaacttatgtcctgtatgtactaaagacaagcacccagtataagtcttttactatccctaagaagacggggggcactaggaccattcatgcaccccatgatagattaaaagccatccagtcatccctgagtgaccttctacaggactgtattgaggaaattaattcggctaaaccaaagaaagcagctaaaaccaaattcgtcaataccaccaaagacaagaaccctgactacaagaagacaaagtttctggaggatactttcacgccgaccctatcacacggctttgttaggaaacggagcataataaccaacgccatgatgcatctgaaccggaaaaacgtgctcaatgtagatcttaagaatttcttcgactccttcaactttggaagagtgagaggctttttcattactaacaaccattttcgcctctgtgaagagacagccactgtcatagcccaaatcgcatgctatgagaacaagctcccgcagggatctccctgttctcctgtgatcacaaacctgatcactcacatcttagacatccggctcgcagccctcgcacgcgataatgcctgtacctatacccgttatgcggacgacattaccttcagcacacgcgagaagatcttccccgagggaattatgcgggagaatgacggagaatactctacgggtcacctgctgaatggtgagattaagcgagctgggttttccttgaatatccagaagacacggattcagtacagcgattcccgtcaggatgtcaccggccttatcgtgaataaaaagccaaacgtgaagtccgaatattggcgaaccgttaagagtcaatgccacctgctgttcaagtcagggagtttcatcgagatcattgatggcgaaccaaaaagggggaacatcaaccaacttgaaggcaggctgaatttcattgatcaggttgattactacaaccgactgcgccaaaagccaccattaaatcctgaatacgagccctccaaacacggtcacaatactagggagttactgtctggacgtgaaaggacgtttagccgcttcctttattacaggtcattctacggcaacgagaaggctacaatcatctgcgaaggaaagacagacaacatttacctgaagagtgcgatcaaccgcctcgcagcagcctacccaagacttgcaaaagcaaaaagcgcaagttccgcttaccagttgctcatcagtctgtttaattacagcgctcggaccagatttctgttggagctgtatgggggagccccttttctgaaagagtttatctccaacttcgaagagaattatgagctgtacaaggcccccgcgccaagcaatcccgtcataatcgttttcgataatgacgccggtttcgatattgtggattctctcttgcggggcaagaaaatacaagctgtggcctttcccgcttcgtcaggtagaaatgaatatcgaggcgcagacttcatccacgtgacaaagaatctgtacattgtactcacacccctcacagctgctgggacgcagaccgacattgagtctctgtttaccaaagtgactcgggatgaaatctttgaggggaagacatttagcagcgctaaggatttcgatagagctcttcatttcgggaaagacactttcgccaacaaaataatagccgccaaaaaaggcagtatagacttctcaggctttaacatcctcttgaaccgcattgtgcagtgcattaaccactacgactccattaagcagccttga

SEQ ID NO: 8373 - RNA, 1839 nt, unidentified
  source 1..1839: mol_type = other RNA; note = synthetic construct
atgaagaacattgatgccctgagagcagcacgcacgaagcctgagctcgcccttctgctgggtgtgaaagccagtttcctgacgtacgtgctatacgttttaaagccagacaccctgtacagatctttcaccctgaagaagaaatccggcggtacccgtaccattcacgctccttatgaatccctaaaatccatccagagcagcctgagcaacctactccaggattgtattgaggagataaataaggccaaacccgccaaagccatcaagaccaagttcatcattaccaaaaaggacaagaatagcgatcacaaaaaaaaaaagcggcctgaccacacatttactccaactctctctcacggctttgtcaggaaaagatctatcatcactaacgccatgatgcatctgaatcggaagaacgtgcttaacgtggatctgaaggattttttcgacagtttcaactttggcagggtccgaggcttttttatcaccaaccggaacttccaactgcaccccgacatcgccaccgttattgcgcagatcgcctgttataacaacacccttccgcagggatcgccctgctcaccagtaattactaatctgatcactcacatccttgacattaaattggccgctctcgctagaacatacagttgcacttactcccggtatgtagatgacatcaccttctcaacccgaaaaaagatatttcccgaacagatcatgaaagacttagaggggtcttatacagcaggatatctgttaaatggagaaatacagagggctggctttaatctcaacccgaagaaaactaggataagaaaccaggatagccgacaggaagtaaccggcctagtcgtcaacaagaagccgaatgtaaattccaaatactggagaacagtgaaaagccagtgtcatcttctgttcaagtcggggacgtttgtcgacataatcgacgacaaacccgccccaggaaatatcaatcagctggagggcaggttgaacttcatagaccaagtggactactacaaccggttgcgcgataaagcacccctcaaccctgagtacatgcctcacaagccttcaaataatacacgcaggcttctgtcaggtagagagctgacattcagcaggtttctgtattttcgctccttctacgctaatgaaaaggtgacaattatatgcgaagggaagactgacaatatttatcttaaggccgcgattaagaaactcagccctgcttacccgaaattggcaaagcctaaatctgccacaagtgcataccaactgctcgtctctatctttaactatagtgctcgtacccggtttctgatggaactctatggcgggaccccatacctgaaggattttatcgctgagttcaaagagaatcacaagttctacaaagcacccaagccagctaatccagtgatcattattctggacaacgataagggattcaatatcgtggagtccctcctgaggggagataaggtccaggccacaccatatcctcgaacacccggtcagtttgagttccggggggctaacttcatccatgtgacggaaaacttgtatcttgtgctcactcccttggcgccaccccctgatcgccaaactgcaattgaggacttgtttacccaggacacacgtgacgagcaggtggacggcaaaatactcagcttagaaaaggaattcgataaggccacgcattacgggaaagatgcgtttgcaaataaagtggttctggttaagaagtcatccattgatttctcagggttcaatgttatcttaaaccgcattatgcaatgcattgagcattatgattctatcaagtga

SEQ ID NO: 8374 - RNA, 1836 nt, unidentified
  source 1..1836: mol_type = other RNA; note = synthetic construct
atgaaaaagatcgacgccctccgggctgttaggacaaaacctgagctggctttacttctgggaattaaagcctcttcactgacctaccttctatacgttttaaaacctagtacccagtactcgagcttcgagatccccaaaaaatcaggcggcactagaacgattcactctcctagtgagcgcttgaaatctctgcaaagtagtctcagcatcctactgcaggattgcattgaagagattaataaggacaagcctgctagggccaacaagaccaagtttatcaccactaagaaggataaggccagcgactcaaagaagtctaagtttatagagtacgccttcatgtcaaccctggcgcacgggttcgtgcggaaaagaagtattatcacaaacgccatgatgcatctgaataggaagaacgtgttgaacgttgatataaaggacttctttgactcattcaactttggccgagtgagaggatttttcatcacgaataatcacttccgtttagatcccaacatcgcaactgtgattgcccagatagcctgctatgacaataagttgccacaggggtcgccatgctcccccgtgatcacaaatctgatcacccatatcctggatatccggttggccgcacttgcccaggcaaattcctgtacatatagccggtatgccgacgacattactttctctacacgtgagaaattattccccacacagctcatgtctgaggagggtggcacctacattgcaggcaacgaattaaagcgtgaaatacagcgcgcaggattcgagctgaacgcgaagaagaccagaatacaatatcaatccagcagacaggatgtcacagggctggttgtgaataaaaaacctaacgtcaagtccgaatattggcgcaccgtgaagtctcagtgtcacctgctgttcaagtccgggaagtttactgcgaaaaagggtgatgagattctggagggtaatatactggagctcgaaggacgcctgaactttatcgatcaggtcgacttttacaatcggcttaggcagaagccacacctgaatccagaatacgctcttagcaaacatggactcaatacccgccaactcctgagcggacgggaaagaacttttagcagattcctgtactaccgatcattttacgccaacgacaaacccactattttgtgtgaagggaaaaccgacaacatttacatgaagtctgctataagtagcctggctactgattatccaaaattggcgaggcccaaatccgccactagcccgtaccagttgctcatcagcctcttcaaatataatgagaggacaagattccttcttcagctctatggaggcacctcctatttgaaggattttatcgaaacattcgctatgcactacaaattttacaaagccccaaagcctaacaacccggtaattatcatccttgacaacgacggagggtttgactccatcaacgctctgctgaatggcgataagactagggcaacctgctaccctaataccccaggcaagaacgagtaccgagatgcagaatttattcacgtgctggagaacctctatattgtcctgacaccccggggtgtgcccgacaaacatacggcaattgaagaactattcacacaaaaagtgcgcgacgaggtggtttccggcaagaccttcaaccacacgaataaaattgatatcacgaaggagtatggcaaggaaatttttgctaaaaaggtaatcctcgctaagaaagggtccgtagatttcagtggttttagggtcctactcaatcgagtggtccagtgtatcgagcattatgactcaatcaagtga

SEQ ID NO: 8375 - RNA, 1830 nt, unidentified
  source 1..1830: mol_type = other RNA; note = synthetic construct
atgaaaaagatcgatgccctgcgagccgtgcgaactaagccccagctcgcgcttttactgggagtcaaagcatctgcccttacctacctgttatatgtcctgaagcctgccacacagtattccagcttcgatataccaaagaagagcggcggagtccgaaccatcaatgcccccagcgagcggcttaagctggtccagtcgtccctgagcgaattgctgcaggactgtatagaggaaatcaacaaagcgaaacctccacgggcacctaaagggagattcgccaagaccgagaaggaggctggagggaagcgctcaaaacatgtcgaatacgtgtttacttctaccctttcccatggctttgtgagaaaacgttcaattatcacaaacgctttgctgcacctcaacaagaagaatgttctcaacgttgatataaaggacttcttcgactctttcaatttcggtagagtgcgcgggttcttcatctccaacaacaactttaaactggaccccgggattgctaaagtgatcgcccagatcgcatgctacgacaataagctccctcaaggttcaccgtgcagtcccgtgatcacaaacctgattacacatggccttgatataaggctcgccgctcttgcgaagaagagtagctgtacctattccaggtacgcagacgatatcactttcagcaccagagaacggctctttccaagtaacatcgtgaaggagattgcaggtatttactcatatggggacgacctcaaggctgaatttggaagggcagatttcaaactcaatgagaagaagacaaggattcaatatcacgatagccgccaggacgtgactggacttgtggtcaacaaaaaacccaacgtcaaatctgagtactggaggctggttaaatcccagtgccacttacttttcaaatcaggaagattcctggtgaaagaggatggcaaggttaaggatggcaatgttctggagttagaaggcaggctgaatttcatagaccaggtcgattactataatcggttgcgtcagaagaaacctctgaatccagagtacgccctggaaaatcataaattgaacacacgcaaactgctctctggccgggaaagaacgtttagtcgttttctctattaccggtatttttatgccaacgagaagccattggtgctgtgtgagggcaagacagataatctgtacctaaaatccgctgttaaccggctggtagccgcttatcccagactagccaaggctaagaccgtgaatgcaccttaccacctactcatctccttctttaaatattcagaacgcaccaggtttttgttgcaactgtacggtggcgccagttacctcaaagatttcatcgagagttacgagaagaattattccttttacaaggcacccaagcctagcaacccggtgattttggtatttgacaatgacacggggttcaacagcgtagaggcccttctgaaaggctcgaaaatgaaggaagtcgtggcccacccagttgggtccaagaagtcttcgtttcgaaattctgagttcattcacgtgttttacaatctatacgttgtgctgacgccgttaggcgcggctaaaagcactgccatcgaagacctgtttactaggagtaccctggatgaggtagtctcagggaaaaagttcaacccaaccaaagaaattgacgtggacaaggaatatggaaaggaggtgtttgctaagaaagtggtgctcgcaaagaaaggatctatcgactttagcggtttctgccccctgctggatcgcattgtcaaggtattggaacattatgagtctactaagtga

SEQ ID NO: 8376 - RNA, 1830 nt, unidentified
  source 1..1830: mol_type = other RNA; note = synthetic construct
atgagaaaagtcgacgcactacgcgcagtcaggacaaaaccagaattggccttgctccttggcgttaaagctagcgcattgacctacctgctctacgtgctcaaaccctcgacgcagtatacaagcttcaatattgccaaaaagagtggggggatcaggaaaattaattcaccctccgaacgcctgaaagctgtgcaatcctcactctccactcttctccaggactgcattgatgagatcaataaagccaaacctccccgggctccaaaaggtatgtttgccaagactgaccggctatctgatggcaagcgggccaaaagagtggagtacgtgtatacttccacactgtctcacggcttcgtgagaaagcgctccataattacaaacgcccttatgcatttgaacaaaaattcagtgctcaacatagacatcaaggacttctttgagagctttaatttcggaagagtgcgtgggttctttatcaagaacaacaacttccgactgaggcctgatgtcgctactgtgattgcccagatcgcctgttacgacaataagctgcctcaagggtccccgtgttccccagtgatcaccaacctgatcacacattcgctcgatattcgcctcgctgccctggcacgcaaaaactcctgcacgtattcaagatacgcagacgatatcactttcagtacccgggagaaagtgttcccgtcaaacctggtaaggtgggacagtgaagggtatgtttacggagatgacttggagtctgagtttgctagagccgggctcaaactcaacaaaaagaagacgaggattcaatataaggactctcgccaggacgttacaggcttagtcgtgaatcgcaagcccaatgtgaagtgcgagtattggcggactgtgaaaagtcagtgtcatctgctgtttcgtacggggaagtttgccatcaaggatggtgacgagatcaaagatggaagcatcttcgaactagaaggtcgactgaacttcatcgatcaggtggattattacaaccgactgcgccagaaaataccactgaaccccgaatatgctctggcgaaccacaagttaaatacacggggtttacttagtggccgtgaacgaaccttctctaggtttctctattacagagccttttatggaaacgacaagccaacaatactgtgtgaaggcaagaccgacaatgtatacatcagaagtgcgattaatcggctggctgcagagtaccccaagctggctagagccaaaaccagcaccaagccgtacgagttgctggtaagcttgttcaagtacaatgagaggactaggttcctactgcagctttatggtggctccagctacttaaaggattttatagaaacctacgagaagcactacgatttctatatggcccctaaacctgcgaatcccgttatcgtgattctggataacgatactggcttcaactctatcgaggttctgcttaagtctaagatgacaaatgcagctgtctatcccaccggcttgggcgtggcgggatataggaacagcgactttatccatgtcctccacaacctgtaccttgtcctcaccccactgggaacagccaagtcaactgcaattgaggacttatttacccggtccaccctgaaggagattgtcagcgggaagacctttaatcctagcaataaaatggatccagccaaggaatacggcaaagaaatcttcgcaaagaaagtggtacttgctaagaagggaaatatcgactttgtcggattccggcctattctggatcgactggttcagtgcattgaccactacgagagcataaagggttga

SEQ ID NO: 8377 - RNA, 1830 nt, unidentified
  source 1..1830: mol_type = other RNA; note = synthetic construct
atgaggaagatcgacgccctacgcgccgttaggacgaaacccgaactggcgcttttgctcggtgtgaaggcatccgccctgacttacctattatatgtgctgaagcccagtacgcagtatagttctttcgaaattcccaaaaagacgggcgggaccagaactatccatagcccttcggaacgcctgaaggtggtccaatccagtctttccatgctgctgcaagactgcatcgaggatatcaataaagctaaacccccgagagctccaaaggggaaatttgccaagaccgaaaaattacccgcaatcaaacgcacaaaactggtggactacgtcttcacatccacactcagccacggtttcgtgcgtaaaagatccataataaccaatgctctgatgcacctcaacaagaagaaagtgttgaacgtggacattaagaacttcttcgacagctttaatttcggccgcgtcaggggtttcttcatcaagaataacaactttcggctggatccaaatatcgctaccgtaatcgctcagattgcctgttacgataacaagctccctcagggctcaccttgttctcctgtcattaccaatctgattactcacggactggacataaagctggcagcgctggccaagaaaaacagctgtacatactctcgttacgccgatgacattacctttagtactcgtgagaaggtgtttccattaaatgtcatgaaggaggaagccgagggctacgtttgcggggacggattaaaaagcgagattggaagggccggctttacattgaacaacaagaaaacaaggatccagtacaaagattctcgacaggacgtgaccggtttggtggttaataaaaagccaaatgtgaagtgcgagtactggcgaacggtaaaatcacagtgccacttgctgtttaagagcggggggtttgtgaccaaaaatggggatgaaatagaggaaggcaatattttcgagctggagggcaggcttaacttcatcgaccaagtagactattataacagattgcggcaaaaggctcctctaaaccctgagtatgatttggccaagcatggccttaacacccgaaatgtcctctcaggcagagaacgcaccttctccagatttctctattaccggtccttttacggaaatgacaaaccaactattctgtgtgaaggcaagactgataatatttacatcaagtccgcaataagtcgactggcggctgtctatcctcggctcgctaaggtcaaagcactcaccagcgcatatcagctgctcgtatcactctttaactatacagagcggacacggttcctgcttcagttgtatggcgggacttcatatctgaaagacttcatcgagacttacgaacagcattataatttctacaaggcacccaaaccgattaaccccgttattatcatcctggataatgacaccggatttaactcaatcgagacactgctgaaatctaacaaaaagaatcaggctgtcgtttacccgattggagtgcgcggagcgggttgcaggaatgccgatttcatccacgttgtgcacaacctgtatatcgttctcacaccactgggcaaggagaagtcgaccgccattgaagatctcttcactaggcccacacttgacgaaatcgtgtctggaaaaaaattcaacccaagtaacaagatggatattaccaaggagtacgggaaagagatctttgccaagaaaatagtgcttgtgaagaagggaagcatagatttttctgggtttagagtccttctatcccggattgtacagtgtatcgagcattacgacagcgtgaagtga

SEQ ID NO: 8378 - RNA, 1824 nt, unidentified
  source 1..1824: mol_type = other RNA; note = synthetic construct
atgagaaagatcgacgccttgagagccgttcggacaaaacccgagttggcactcttgttaggcataaaggctagcgcactcacgtaccttctgtatgtcctgaagccatccacacagtatgccaggtttgagattcctaagaagtctggggggacacgaactatctttgctccgtctgagagattaaaagcagtgcagagtagtctgtcaatcctgctgcaggattgcatagaagagattaataaagccaaacctccccgagctcccaagggaaggtttgcgaagaacgaaggtaaaacccgcggccgccgagccaaacgcgtagattatgtcttcacctcaactctgagccatgggttcgtccggaagaggtccataatcactaacgctctaatgcatctgggcaagaagaacgtgctgaacatcgatatcaacaacttcttcgacagtttcaacttcgggagagtgcggggattcttcattaccaataacaattttcggctggatcctaacgttgccacggtgctcgcccaaatagcttgttacgacaataagctcccgcaaggctccccatgcagtccagtgatcactaatctgattgcacatagcctagatatcaggcttgccgctctggctaaaaaaaattcctgtacatactcccggtacgccgacgatattaccttctcaactcgaaaaaacgtgttccctatcgcgatcgctaaagacgtgtcaggctcatacgaatgtgggctggatattgagagagagattatccgtgctggctttaaactcaacgccaagaagaccagggtccaatataaggacagtaggcaggacgtcaccgggctggtagtcaatgagaaaccaaatgtgaagtctgagtattggcgcaccgtgaagtctcagtgccactccttattcaggacaggcgaattcgtgatcaataatggagcagtatctagacgaggaaccctgtttgagttggaaggtcgtctgaactttatcgaccaggtcgattactacaatagattacggcagaagttgcccctgaaccgcgagtacgctttggccgaccataaactgaacacccgcgagcttctatctggtcgtgagagaacattttcccggtttctgtactatcggcacttttacgccaacgacaagcctgttatcatttgtgaaggccagacagacaatatatacattcggtcagctattcattcgctcgccgccgcctatcctaggcttgcgaatgtcaagacgcccgtggcaccatacaaactactcattagccttttcggctacagcgagaggactaagtttttgctccagctgtacgggggagccaattacctgaaaagcttcatcgagcaatatgaacgccactacggattttatcaggcacctaagcccaagaaccccgtcataattatgtttgataacgattcagggttcggaaccacggaaaatttcctgaagggtaagtccagcgctgtggtgtatcccgtagcaagcagaggtgcgggctatcgtcacgccgaattcattcacgtgattcacaatctgtatatcgttctcacaccactcggaggcgcaaaatctactgccatcgaagaccttttcttaaagtccacactcgatgagaaagtgagcggcaagaaattcaacccagacaaaaacattgacactgcaaccgaatatggaaaagaggtgtttgcgaaaaaggttattcttgccaagaaagggtctatcgactttagtggtttttcgacaatcctgaatcgcaccgttcagtgcatagaacactacgatagcatcaagtga

SEQ ID NO: 8379 - RNA, 1827 nt, unidentified
  source 1..1827: mol_type = other RNA; note = synthetic construct
atgcgaaaaattgacgctctccgggcagtgcggacaaaacctgaactcgctctcctattgggcatcaaggcctctgcactcacttatcttctatataagctgaagccttctacccaataccataccttcgagatccctaaaaaatctggcggtactcgcacgatccactcacccagtgaaagactgaaagcccttcagagcagtctttcaaacctgctccaggactgcatcgaggatatcaacaaagaaaagcccgccaggacgccgaaaggaagatttgccaagctgtacaagaacctgcaaggtaagcgtggcaaacacatcaattatgtctatatttccaccctcagtcatggatttgtccgggaccgcagcattatcactaatgcactaatgcacttcaggaagaagaacgtgctgaacattgacataaaagactttttcgacagctttaacttcgggcgggtaaggggcttcttcatctcgaacaagaattttcgattgaatgacgagattgctacagtgatcgcgcagattgcttgctacgataacaagctgcctcaagggagtccctgctctcctgtcatcaccaatctgattgcacacagcctggacgtgagactggccgcactcgccaagaagtattcatgtacatatagcagatacgcggatgatctgaccattagcacaagagaaaagctgtttcccccaaatatcatgaaagaagacgctggggtctatacctgcggccgggatctggtatcggagataagcagagcgggcttctccttgaaccacaagaaaacgaggatccagtacaaggatcaccgacaagatgtgaccggcctggtcgtgaataagaaaccaaacgtgaagtgtgaatactggcgcaccgtgaggtcacagtgccatctgctcttccgtacagggaaattccttactaaggtgggggacgaggtgagagatgggtccatttttgagctggaaggccgcttaaatttcatcgaccaggtagattactacaaccgcctgcgccagaaaccagccttgaatcccgagtatgccctgagtaagcatggtgttaatactagggagctcttgtccggaagagaaaccacattttcccggtttctttactaccggcatttttatgctaacgaaaagcccgtgattctttgtgagggcaagacggacaacgtgtatattaaatctgcgataaacgtgctggcggctgcttacccacgtttagccaaagccaaaacagccaactccccctacgagttattggtcagcatgtttaattacacagaacgcacccgatttttactccagctttacgggggcgcctcatacttgaaggatttcatcgaaactttcaagaagcactatggattctataaagccccaaaaccatcaaatccggtgattatcttgcttgataatgataccggcttcgacagtatctgctccctactcaagggcaaatctttcggagcagaagcctacccccctggactcgccatgaatgactgtagggacgccgagtttatacacgttggactgaacctgtacgttgttttaactccacgggtcgcagctaaacattctgctatcgaggacatgttcacaaaggcaactctgggagaggttgtgggagggaaaaccttcaatcctagcaataagatggatagctccaaggagtatgggaaagagatctttgctaagaaagtagttctggcaaaaaagggttctataaacttttccggtttcaacgtcattctgaagaggattgtgcagtgtatagagcactatgataagataaagtga

SEQ ID NO: 8380 - RNA, 1212 nt, unidentified
  source 1..1212: mol_type = other RNA; note = synthetic construct
atgagaaaaatcgatgctctccgcgccgttaggactaagcctgagctggccagactcctgggcgtgagggcatcagagttgacgtacgtgctgtacgtactgaagcccccaacacagtatatctccttcaagattcctaaaaagtctggtggggatcggaccattcacagtccaagcgatcggctcaaggccattcagtcttccctctcagatctgctcctggattgcatagacgacataaacaagtcaaaacctggaaaaccccatttagatcgttttgtcaaagggaaaaaggagaagctgcttgatagcaagaagaaaaagccccttgagtatatctttagtcccacattgtctcacggattcgtgagaaataggtcaatcatcactaatgccatgatgcatcttcacaagaaaaacgtcctgaacgtggacttacaaaacttcttcgacagcttcaactttggtcgtgtgagggggttctttatttctaacaggcacttccagctggacgccaatgttgctaccgtaatcgctcagatagcgtgctatgacaataagctcccacagggtagtccgagcagtcctgtgatcaccaatcttatcacccactcattggacatttctcttgccaagctagcgtttgaacatagttgtacttactcgcgatatgctgatgacataacattttccacgcgagaaaagattttcccccctcagatcatgtccgaggagtcgggctcctacactgcaggcagccaactgacgcatgaaatcactaaagccgggttttctctgaatagcaagaagaatcgcattcagtataacagcagtaggcaggacgtgacaggactggtggtgaacaaaaaacccaatgtcaagtgcgaatactggcgcactgtccgcagccaatgtcatttactatttaagagcggctcctttgtcaccaaaatcaatgatgaagaggttgttggcaacatcaacaaactggaaggccgcctcaacttcatagaccaggtggactattacaaccggctgcgacaaaaaccagctttgaatccagaatacaccctgtcaaagcacgcaattaatacaagagagcttctgtccggacgggaaacaaccttctctagatttctatactaccgggccttctatgcaaacgagaaaccgaccattttgtgcgaggggtgtctgctctacacatcctga

SEQ ID NO: 8381 - RNA, 1845 nt, unidentified
  source 1..1845: mol_type = other RNA; note = synthetic construct
atgaaaaaacttgatgcactacgcgccgcaaagacaaagcccgaactcgcgcaccttttgggagtaaaaccttcttcacttacattcttactctacaaactcaaacccagcacccagtacagttctttcgacatcccaaagaaaaacggcggctcccgtactattcatgcaccctcaaaaaagttaaagaagctgcagagttctctgtccaactacctgcaggactgtatcgatgagatcaattctgctaaaccagccttttccaacaagaagaagtttatcaagatcgacaaagatagggtattggacggcaagacgaagaattttaccgagtacaagtttatttccacgctgtctcacggcttcgtgagggagcgtagcatcataacaaacgctctgatgcacctcaacaagcgcaacgtgctaaacattgacctgaaagacttcttcgagtcttttaactttggcagagtgcgcggcttttttatctctaacaggaacttctgtcttgatcccgatattgccaccgttatcgcacagatcgcttgctatgacaacaaacttccccaaggctctccatgctcacctgtgatcactaatctgattagtcacatcctcgatatacagctggccgctcttgccaaggctaattcctgtgtctattctagatatgccgatgatatcactttcagcactcgtgaacgcgtgtttcctagtgacatcatgagcatagaggccggtgaatatatagtggggcggaagctcaggggaattataaagcgcgcgggttttagcctgaatgagaagaaaacacggattcaatacaaagactccagacaggatgtaaccggtctggtggtcaataagaagccaaatgttaaaagcgaatactggcggaccgttaaatcccagtgtcattccctgttcaagaatgggacctttacagtgaaaaagggatgtgatatagtggaaggaagcattagcgaactcgaaggtcggctgaacttcatcgaccaaattgatttgtacaatcgaaggagacagcaacctaagattaatcccgagatagctctatgcgagcccgggattaataccaggatcttgctcaacgggcgagaaaagacattctccagattcttatactactgttacttctacgctaacaaaaagcccatgataatttgcgaaggcaaaaccgataatatttatatcaagctggccatgtcaaaattggccactgactatccattactagccaagccaaagtcgagcaactcggcctacgagccacttgtcagtctgttcaagtatagtaagagaactaggtttctcttgcagctgtatggcgggacctcctacttgaaaaacttcatcgaaacctacaaaaagaactttgctttctacaaagcacctaagccctgcttccctattataattatcctggacaatgatgcgggattcaaagacattaattcctggctggacaaatcaaagtatgtgacaccgtacaacatcaacattaaggcctctgagaacaacaaatttcggtatgcagaatttatccacgttgtggagaatctgtatatcgtcctgacacctcgcgagaaccctgataagaacagcgctattgaggacctgtttaatccggagatcctgaaggaggaagtctcaggaaaaacgttcaatccgagtaatagcaaaatcgacatcactaaggagtatgggaaggagatcttcgcaaaaaaagtgattttcgccaagcgaaattcgattgactttagccggttcaaagtcctgctcgatagaatcgttaagtgcctcgaacattatgactcaaataaatga

SEQ ID NO: 8382 - RNA, 1503 nt, unidentified
  source 1..1503: mol_type = other RNA; note = synthetic construct
atgagaaaaatcgatgcactccagaaggtcaagacgaagccggagctggctgagctgctcggcattaaggctagttccctgacatacctgctgtacgttcttaagcccagtacccagtactcctatttcgaaatcccaaagaagaatggcggccggagaaccatccatgctccgtccaagaggctgaaaaagctccagagcagcctatctaagttccttcaagactgtatagaggaaatcaacaatgagcgccccgcctcaactcacaagtctcggtttgtgaagatcaacaaagatcgcgtgcttgatgggaagaagaccaagtttatcgaacacaaatttacatctaccctgtcccacggatttgtccgggatagatctattataaccaatgccatgatgcatttgaacaagaaaaacgtcttgaatgtcgatatcgacaacttcttcgatcgattcaatttcggaagggtccggggattttttatcaagaatcgacatttcagcctcgatcccaacatcgccactgttatcgcacagattgcttgttttgataacaaattgcctcagggctctccttgttcacccgtgataaccaatctcatcacacacattctggacattaagttagccgcccttgcaaacgataatagctgcgtttatacaagatacgcggacgatatcacttttagcacacgcgagagagtgtttccaaaagagattatgcgcttagaggacggggtgtacacaccttccgaaaagtttgaacgcgtgattaagaaagcgggattcaaactcaacgagaaaaaaacgaggatccagtataaagactcgagacaagacgttactgggctggtggtaaataagaagcctagcgtaaagtccgagtactggcgtaccgtgaaatcacaatgccattcactctttaaaagtggacactttactgtgaagaaacacgacgaaattattgaggggtctatttctgaactggagggtcggctgaacttcattgatcagattgacctgtacaatcgtctccgtcagaaaccatgcataccccccgaaatcagcatccagcagcatggtattaacactagggagctgctaagtgggagggaaaaaaccttctcccgctttctgtattatcggtatttctacgcccatgacaagcctatgatactgtgcgaaggcaaaaccgacaacatctacatcaaactggccatgaacaaattggctgtagactatcctaagttggcaaagccaaaaaccgccacaagtgcttatgagccactggtgtcgttgttcaagtataataagaggacacgattccttcttcagctgtatggtggcactaattacctcaaagaattcataaccacctacaaaaaacactacttcttcatcaagcaccagagcttagtgatccaactgctactgtcatggataactaccaaggactccacgcttttaacaccatgtctcaaagagattaagagcatgtga

SEQ ID NO: 8383 - RNA, 1761 nt, unidentified
  source 1..1761: mol_type = other RNA; note = synthetic construct
atgcgtaaagttgacgctctgagagccgtgaggacgaaaagtgaactggcccttttactgggattcaagcccgctgccttcacatatttgctctataagctgaagccgtcaactcagtatcagtccttcacaatccccaaaaaaagcgggggtactaggaccatatacgccccaagtgaacgcctgaaggcacttcagaccagtctgagcctgctcctccaggattgtagcgaggagatagagaaggcctgggtcggcggctccgattctaaaagcaccctgtctcacgggtttgtgcgtaagcgttctattatcacaaacgccatgatgcatctccacaagaagaatattctgaacgtggacttgaaagactttttcgactcttttaacttcggtagggtcagggggttctttattaccaaccgggagttctgcctcaatccagacatcgcaaccgccattgctcaaattgcctgtcacgataataagctaccccaaggctccccatgttcaccagtgatcaccaatcttatcacaaacatcctggatattcggttggccgcacttgcgcgctcgcattcctgcacctatagtaggtacgcagacgacttgacttttagtacacgcgaaaaagtcttcccttcgcagatcatgaaggaggatgttggatcttacactcccgggaagaagttaaagtccgagattaagagagctgggtttgaactgaaccataaaaagacccggattcaatatatggacagtagacaggacgtgacaggcctcatcgtaaataaaaagcctaacacacggtacgagtactggcgaacagttagaagtcaatgtcactctctgttcaagagcgggagcttcactaagaaagtggatgggaaatttatagaaggcaacatcttcgaactccagggacagctgaactttatcgaccagatagactactttaatcgattgagacagcatcctccgctcaaccctgagtatgccctctccaaccacttgatcaatacccgcaagctcttaactggtcgggaggtggtcttttcccggttcctgtattaccgccacttctacggcaatgaaacggcgacgatactttgcgagggcaaaaccgataacgtttatctgaagtcagctttgaataagctagcgctgaaatatccgcgattagcaattcccaaatctgcagcaaatccatacaagctcctagtgtcatttatgaactacacagagagaacaaggttcttactgcagctttacggcggtacctcctacctgcacgtgtttctaaacagctttgaagagcactacaagttctataacgccccaaaacctaagaatcccgtggtagtcgtgctcgacaatgattcaggcttcaattccattgatggtctgttgaaaggcaaactctcaggaacgccctatcctgacactctgtctaagtctgagtttcgaaaagctgacttcatccatgtaaccaagaatctgtacgtagttctgaatccacttggacctaagggggagttttcagccatcgaaagcctgttctcccctgctactcgcaatattaaaatcagcggaaaaagcttcaaccccgagaacaacatggataaaaacactgagtttggaaaggaaatctttgcgagcaaagtcgtcgtggctaataaggatacaatcgatttctccggattcgacgtgctgcttagcaggataaccatgtgcctggaacattacgatctgattagatga

SEQ ID NO: 8384 - RNA, 1767 nt, unidentified
  source 1..1767: mol_type = other RNA; note = synthetic construct
atgcgtaagataaatgcacttagggctgctaaaaccaaacctgaactagcgttgttgctcggagtgaaggccactgccctgacctacgtgttatacgtcttgaagcctgatacacaatattccactttcaccattccaaaaaagtctggggggctgcgaaccatctgttcaccttctgataggctcaaaactatccagtccgctctcagcgaactcctgcaggattgccttgatgagctgactgctgttaaagttaaggagaaccacgattacaaatcaaatctgagtcatggctttctgcgaaataaaagcatcatcacaaacgccattgtacacaccggccagcgcaacgtgctgaatttggacctgaaagacttttttgacaagttcaacttcggtagagtgcgcggattcttcatatccaacaaggacttccaactaaatgaacatattgccactgttattgctcagatagcctgctatgacaacagactcccccaggggagcccatgttcgcctgtgataacaaatctgattacccacatccttgacatcaaactcgcagccctggccgagtcttattcatgtatctatagtcggtacgcagacgacatcacctttagcacaagggaacgactgttcccccccaagttaatgaaagaaattgccggagagtatatccccggtaaaaagctgcggtccgagataagaagggctggctttgagattaacgccccaaaaacaagaattcaatttcaggatagcagacaagatgtgacggggctggtggtgaacaagaagcctaatgtcaaatctgagtactggaggaccgtcaagagtcagtgccatagtctgttcaggacaggaagttttaaaaagaaggtagacggtactttcgctgatgggaatatctatgaactcgagggccagctgaactttatcgatcaggttgattactctaacagactgcgccaaaagccgcccttggacactgagtacgaacagcgcaaatccaacattaaaactagggagttactgtctgggcgtgaaaccacctttagccggttcttatactacaaatttttctacgccaacgaaaagcctacgattatctgcgaagggaaaaccgataatatttaccttaagtccgcgatcagctctttggctgcaaactacccaaagttagcgacaccaaaatcggcaaataatccctatgagctgctcgtgaagttcttcaactataacaaccgcacgagatttctactccagcttcatggcggtaccaactacctacacactttcattaacgattttgagagccactacgacttttataaggcccctcggccaaagcagcccattataataatccttgacaatgactcaggcttcaatggaatcgatggcttgctgaagggcaaagcaagcgccaagcggtatccggtcgcgaaaggaaagaagaaggactttcgcaacgcaaatttcattcacgtcgcccataatctctacatcgtgctgacgccgcccactgctacaggtggacacaccgcaatcgagtccctctttaccgcagccacactgaatgaaaaagtccagaagaagaccttcaatccagagtcaaagattaatactaccacagagtatggcaaggagatcttcgctaaaaaagtaatcctggccaacaagaagacaattaacttctccggctttgacgtgatccttaagcgggttatccagtgtatgaagcactatgaaacagccaaatga

SEQ ID NO: 8385 - RNA, 1770 nt, unidentified
  source 1..1770: mol_type = other RNA; note = synthetic construct
atgaaaaagatctccgcattaagactggccaagacgaagcctgatctggccctgctcatggggattgacgcatctttcctcacaaatatactttatcgccttaagccaacaactcagtataccagcttcacaattccaaaaaagagtggcggcgttaggactatttacgcccccagcgatgagctgaagtccattcaatctgcactttctaatctgttgcaggactgtatacaagaaattaacacttccaaagggcctaagttcaaatcaactctaagccatgggttcgttagagacaggagtattctgaccaatgctatcatgcacctgaataaacgcaacgtactaaatatcgacctgaaggatttctttgaccagttcaacttcggcagagtgcgtggctatttcatcagcaacaagatcttccaactagatcccgctgttgccactgtgatcgcccaaattgcctgctacgacaacaagctcccccaagggagcccctgtagcccagtgataactaatctgatcacacactccctggatatccggctcgcctcacttgcgcgcgataattcctgcacctacactagatatgctgacgacatcaccatttctaccagaaaaaaggattttccctccaacctaacatcggatcgagccagtggatacgtgattggctctaggttagccgctgaaattaaacgagcgggattctcagtgaactccaccaagactcggatccagtacgaggatagtcggcaggacgtgacaggactcattgtgaataagaaactcggaactaaatctgagtactggcgcactgtcaaaagccagtgccacgcgttgtttcagacaggcaaattcttggagaactcctcaaatcctccccaggcaggctcgatattcgtgctcgaaggcaaattatctttcattgaccaggtggacttcttcaacagaaaaaggagtaagcctctgctcaatcctgaatacgagcttagtaaacatgggagcaaaaccaggaagctgctgaatggcagggagcggactttttcacgctttctcttctataaacacttctatggaaacaccaagcccacgatagtttgtgagggaaaaacagacaatgtatatctgaaggcagcaatcaataagcgggccgccgcttttccttcattggcgaaagcaaaatcaggcaacgccccatacgagctgctggtacactttatcaactacacaaaccgcacacgttttttactggagctgtacggtggcacaccctacctcaaggaatttatgctcgactacgatgaacagtttaagttttataaggcccccatgccaacccatccagtgataattatcctggacaatgacgatgggtttggaaaaatcgagggagtattgaagggtaataagtactccccgacggtctttcctgtcacccttccggtgaccgactttcgaaacgcagagttcatccacgtggtccataacctgtatatcgtcctgaccccattgaagggcaaaggtaacaagagcagtatcgaagacctgtttacaaaaaagacccgggctaccaagttaggtgggaaggtctttaacaaacagaataagaccgattccgatacggagtatggtaaggaatatttcgctagcaaagtcgttgctcctaacaagcataagatcaacttttctgggttcaatccgctgttgggacgtatagatcagtgcattcagcacttcgctaccgtgaagcttgtgaaaccatga

SEQ ID NO: 8386 - RNA, 1779 nt, unidentified
  source 1..1779: mol_type = other RNA; note = synthetic construct
atgaagaagatcagtgcactacgtctggcaaagaccaaaccagatttagctctgctcatgggcatagatgcgagctttctgaccaacatactctataggctaaagcctactacacagtacacttcctttaccatccccaagaaatcctcgggcgtgcgcacaatctatgccccatccgatgagttgaaatccatccagtccgctctcagcacgctcctccaggactgcatacaagagataaataccagcaaaggcccaaaattcaagtcaacactgtttcacgggtttgtcagggataggtctatcctgaccaacgcaattatgcatctgaaccagcgtaacgtgctgaacatagacctgaaagactttttcgaccaatttaactttggtcgtgtgcggggttatttcatttccaacaagatctttcagcttgaccctgccattgctactgttatcgcccaaatagcttgttatgacaataaactgcctcaaggatcaccctgctctcccgtcatcacgaacttaattacccattcgctggacatccgactggcctctttggccagagacaactcttgcacatacaccagatacgcagacgacattacaatctcaacacggaagaagaccttcccaaacaatcttatgagtggacagacatccggatacattataggcagccggctggccgaagaaattaaaagggctggtttcagcgtaaattcagcgaagacacgaattcagtataaggactctagacaggatgtaactggcttggtggtgaacaaaaagccaggcactaaaagcgagtattggcgcaccgtcaaaagtcagtgtcatgcccttttccagacagggaagttcttagagaacagcagcaacccgccacaggccggtaatatttttgttcttgaaggcaaactgtctttcatcgatcagatcgatttctttaaccggaagcgcaataaggctctcttaaatcctgagtacgagctctccaagcacggaagtaaaacacgaaagctgctcaatgggagagaaaggacgttctccaagttcctgttctacaaacacttctatggcaatacgaagcccacaatattgtgcgagggaaagaccgacaatgtgtacctgaaagcggcaattaataaccgcgccactgcttttccaagcctggcaaaagctaagagtggcaatgccccatatgaactgctagtgaacttcatcaattacaccaatcggactcggtttctgctcgaattatacgggggaaccccgtatcttaaggaatttatcctcgattacgatgaacacttcaagttttacaaggcgcccatgccaacacaccctgtcatcattatcctagataatgacgatgggtttggtaaaattgaaggggccctgaaggggaagcgctacaaccccacgatcttccccattactctgcctcccacagacttcagaaacgccgagtttatccacatcgtgcataacctgtacattgttttgacccctcttaaggggaaagacactaaatcttctatcgaggatctgttcactaaaaagttgagagcaactaagctcggaggtaaggtattcaacaaagagaataaaaccgattcagacaccgagtatggaaaggagtattttgcttcaaaagtggtcacccctaataagcacaaaattaacttcagtggctttaatcctctccttggcaggattaatcagtgtatccaacatttcgccaccttgaaacccgttaagcccgtgaagccgtga

SEQ ID NO: 8387 - RNA, 1773 nt, unidentified
  source 1..1773: mol_type = other RNA; note = synthetic construct
atgaagatgatttctgctttaagagtcgccaagacaaagccggatctggcactcctcatgggcattgacgcaagtttcttaacgaatatattgtaccggttgaaaccagccactcagtacacttcctttactattccgaagaaaagcgggggggtccgaaccatctacgcccctagcgatgaactcaagtctatccaacgtgccctgagtaatttgctccagaactgtatgcaggaaatcaacacttccaaaggaacgaagttcaaccccacactgagccacggcttcgtgaggaatcgctcaatccttaccaacgcaattatgcacctaaacaaaaagaacgttcttaacatcgatctcaacaacttttttgaccagttcaacttcggtagagtgcggggttacttcatttccaacaagaattttcagctggacccagcagtagccacagtgatcgcccagatcgcatgttatgataataagctcccacaaggatctccttgcagcccagtcataaccaatctgataacacacagcctggacatacggctggcttccctggctaaggataattcctgtacttacacccgatatgctgatgacattaccattagcacccgaagagaagcttttccaaataatcttacttcagacggagcttctggctacatcatagagtcacgcctcgcggctgaaattaaaagagcagggttttccattaaccctgcaaaaacgaggattcagtataaagactcaaggcaggacgtgaccggcctagtagtaaacaaaaagcctgccactaagtccgaatactggaggaccgtccggtcacaatgccatgccctgtttcagacaggcaagttccttgaaaacaatagcaatccgccccagaccggaaacatcttcgtgctggagggaaagcttaacttcattgatcaaatcgacctgtttaaccggaagcgtagcaagcccttgctgaaccccgagtatgaaccctccaaaaataagtcaaagacacgcaagcttctgaacgggcgcgagcgcactttcagtaggttcttgttctacaagtatttctatggaaacaccaaaccaacaataatctgcgaagggaagacggataatgtctacttaaaggccgcgattaataagagagcttccgcatttcccagtctagccaagccaaaatctgggaatgatccttacgagctgctggtgaggttcatcaattatacatcgcgaacaagatttctgctcgaactttatggaggtacaccatacctcaaagagttcattctagattatgacgagtacttcaatttctaccgggcccctgttcctactcaccctgttatcataattctcgataatgatgacgggtttggtaaaatcgagggcgccttgaaaggcaagcggtacaatccaactatcttcccctctacactgccggcgaatgactttagaaatgccgagttcatctatatcgcgcataatctgtatatcgtgctcaccccccgtaaaggcaagaccgagaaaagctcgattgaggagctgtttcccataaaaattagggccaccaaactgggcggtaaagtttttaacaaacagaacaagaccgactctgaaacagagtatggaaaggaatactttgctagtaaagtggtgactcccaacaaggacaaaatcaactttagtggcttcaatcctttgctggagcgcatcaacaagtgcatccagcattttaccaccgtgaaactggtgaagcctttatga

SEQ ID NO: 8388 - RNA, 1824 nt, unidentified
  source 1..1824: mol_type = other RNA; note = synthetic construct
atgcggaagtccgcacgcaaaccaccgcattttccggcatggcagcagcgcgttctcaagaaaattgatgacctgagggctgctagaaccaagccggacttggccttgctgctcaagattgattcctctcacctgacaaatgtgctctataggctgcgtccagaaacccagtacaaatccttcaccatccggaaaaaatctggaggggatcggactattcacgcgccatcagacgagcttaaaagcatacagaaagcccttagcactctgctgcaggactgcgctcaggaaatagaaaaaagcaacggccctaaatttaagtctaccttagctcatggtttcgtgcgagatcgtagcattctgactaattccgtgatgcatctcaatcgcaagaatgtcctcaatatcgatttgaaagacttttttgacggtttcaactttggccgcgtgcgcggcttcttcatagctaataggaacttccaactgcaccctgaggttgccacggtaatcgcccagattgcttgctacgataataaattgccccaaggatctccctgttcccctgtaatcacaaatctcatcactcacgcgctggacatccggctggcgagcttagcaaaggacaacagttgcatttatactcgttatgccgatgacatcacaatttctagtcgcgagaaggagttcccccttaccattatggcagagggcgccagctcatatacgcccggaaagcggttgcagcttgagatcaaaagagcaggattcgaaataaatcatcccaagaccaggatccagtataaagatagtcgacaggatgtgacgggcctgatagtgaacaggaagcccggtgtgaagtccgagtattggcgcaccgtgcggtcgcaatgtcactcactctttaataccggggcttttaaggaagatgtatccggcacgcccaccgaaggaaacatctttgttctagagggaaagctgaatttcattgaccagatagacttcttcaatagaaaacggaacaaacctattctcaaccccaattatgagccttcaaaccacggcagtaacacacgaaagctactgagcggccgagaaaggaccctttcgagattcctatactacaagtacttctatggtaatgcaaagccaacagtcgtttgcgaagggcaaacagacaatatttaccttaaagccgccattaacagattagccgtcggctatcccaaattggttcggcctaaaactgtggccgctccatacgaacttttagtccagttcatcaactacaccgggagaactaagttcctgctggagctggccggcggcacagattacctgaaaaagtttgtagctgaattcggttcatacttcaagagctataaggcacccgtgcctacccgacctgtgattctcattctggataacgacgatggctttaacgccatcgagggaatcctgaaagggaacaagtacaaacctacaatctttccatctgggttagccgcgaatgacttcaggaaggctgagtttatccatgtggtccacaacctctacatcgtcctgacaccactggccaagagcggaacaaagacaagtatcgaagatctcttcccacagtccgtgagggacacgaaattgggagagaaaactttcaacaaggagaacaagatcgacataatgaaggaatacgggaaggaattttttgccactaaagtcgtgactccaaagagaaacgagatcgacttttctgggtttaatatcattctgaagagactggagcaatgtattgagcactttgcaaccatgaccctaaccaagtcatga

SEQ ID NO: 8389 - RNA, 1764 nt, unidentified
  source 1..1764: mol_type = other RNA; note = synthetic construct
atgatttccgctctgagggatgccaagaccaagccacagcttgccctccttctgggaatcgacgcgagcttcctgactaacgtcctatacagactgaaaccgtcttcgcaatacaagtcattcacaatccctaaaaagtctgggggggtacgaactatctatgccccatcagaagagttgaaaagcttgcaacgtgcactgtccagcctgttacaggactgccagcaggaaatctacaagagcaagggcccgaaatttaaaagcaccctgtcccatggatttgtgagagaaagatctatcatgaccaacgccgtcatgcacctaaacaagaaaagtgtcctgaacatcgatcttaaggattttttcgatcagttcaacttcggaagagtgaggggattttttattagcaacaccaactttcagctggatcccgctgtagccacagtgattgcgcaaatcgcctgttatgacaataaactgccccagggaagtccatgttctcccgttatatcaaacctgataacccactcactcgatataagattagcatccctggccaaggacaacagctgcacatacactcgctatgctgatgatattactatcagcacccgagagaaggactttcccgtgaacctgatgtccgaggaggccggcgaatacagccctggcaaaaagttggagagtgagattcgccgtgctggtttcgaaatcaaccataagaaaacccggattcagtacaaagactccaggcaagacgtgaccggcctgattgtcaataaacggccaggtgtcaagtgcgaatattggcgaacagtgcgatcccagtgccacgctctctttaacaccggcgaattcatcgaaaatgagtcatctaactccgagaagggcaatgtcttcgtactggaaggccggttaaattttatcgatcagatcgactacttcaatcgcaagcggtctaagcctatcctgaatcctgagtatcaactcagtgatcatggttccaaaactcgcaggctcctttcagggcgcgagcggactttctcaaggttcttgtattacaagatgttctacgggaacgctaaaccaaccatcctttgtgagggtaaaacggataatgtgtacttgaaggctgcgctcaatcggctggctgcaggatttccaaaactggttaaacctaaaaatggtaaggatccttatgaacttcttgtccagttctttaactataccgagaggacgcgctttctactcgagctcagcggcggaacaccctacctgagagaattcattgcgtcgtttgatgagcactttaattactttaaggcccctgttcccactagaccagtgattatggttttcgataatgacgacgggttcaaggtgatagagtccgtcttaaaaggcaagaaagtaaagcccgtggtgtaccccaatacattggcagcaagtgacttccggaattctgatttcatccacgttatccataatctgtatatagtcctcactcctagagcagcagccaacggcgacacagccatagaagacctattcccccagacggtgagggacgtgaaactgggggggaaggggttcacgaaaaagaacaatattgacaaggatacagagtatggaaaagagttttttgcctctaaggttgtggtgccaaataggaacaacattgactttagtggcttcgacattttcttgaagcgtattatgcagtgtatcgaacactttgacacagtgaagctcaccaagccgtga

SEQ ID NO: 8390 - RNA, 1713 nt, unidentified
  source 1..1713: mol_type = other RNA; note = synthetic construct
atgggcgttaatgcaagtcatctgaccaacgtcctctatagaatgaaacctgagaatttgtacaagagctttacaatcgcaaaaaaaagcgggggagttaggacaattcatgccccagtggatgagcttaagtctattcaaactgccctctccatactactacaagactgtgtccaggaaatcaataagtctaagggggataagttcacatccaccctgtcacacggcttcgtacgtgagaggtcgatacttacaaacgctgtcatgcacctatcccagaagaatgtcctcaacattgatttgaaggacttcttcgagtcattcaactttggaagagtgcgcggcttcttcatcgcgaataaaaactttcagctggacccagctgtggccactgtaattgctcagattgcgtgctatgacaacaagctgccccagggaagtccatgttcacccgttataaccaatcttatcacccacagcctggacatccgattagcaagcctggccaaagagaactcttgcacatactccaggtatgcagacgatattaccataagtacccggaagaaggagtttccctctaacctgatgactgacggtcagcaaggctacagccctggaaagcgcctgcaatcggagatcaaaagagctggcttcgagattaatcgatccaaaacacgtatccaatataaagactcaaggcaggacgtaaccggtctgattgtcaatactaagctggccgtgaagaaggaatactggcggactgtgcgctcccagtgtcattcattgtttcagacaggcgcatttaaggaaaacgcctctgggacccccgaggaggggaatatttttgcgttggaaggtcggctgaactttatcgatcagatcgacctctttaaccgcaagcgcaataaaactgcccctgccctggatcatgatagcagccagaagaagtacaacacaaggagattgttgtccaatagagaacggaccttctccaggttcctctactataaactgttctacgggaacgccaagccgacgatagtgtgcgagggaaaaaccgacaatatctacctgaaatctgctatcggaagattagctggcgcttatcctaacttggccaagccgaaaagtgggaacgatccatatgaactcctcgtccggttcgttaagtacaccgagcgaacaaggttccttctagagttaagcggtggcacgccatatctgaaagaatttatccttggctttgacgaacacttcaaatactataaagcgcccgcacccaagcagccagtgattcttgtgttcgataatgatgatggatttgggaaaattgagggggtgctgaaaggtaaaaaatatagccccaccatcttccctacaactctcccgactgatgcctttcgcaaggctgaattcatccacgtcgcccacaatctctacatcgtgctcactccattaaaagaaaaaggggagcatacgagtattgaagacctgtttcctcaggctgtgcgggacattaagctgggcggcaaaaagtttaacaaggagaacgagatcgatattgatatcgaatacggaaaggagtactttgccaagaaggttgtgcttcccaataagaatgacatcgacttctctggctttaacatcatactgaccagaatggtgcagtgcatagaacacttcgcaacactgaccctgacgaagccttga

SEQ ID NO: 8391 - RNA, 1770 nt, unidentified
  source 1..1770: mol_type = other RNA; note = synthetic construct
atgctgaaaattgatgccctcagacaaatcaaaaccaaaccagaactggccctgctgttaggcatcaacgcatctcaccttacaaatgtcctctacataaagcgcctggagactcagtactcttcattcacaattccaaagaagtccggcggagtgagaactatatacgccccatcagacgaactaaagagcatacaagctgcactaagtcatctccttcaggactgtatccaagagattcgaaattccaaaggtgaagtgtccaagagtacattgtctcacgggttcgtgcggggccgctccattatcacgaacgctgtcatgcaccttcgccagaaaaacgttctcaacttggacctcaaggatttctttgaaggtttcaattttggacgggtaaggggctttttcattgcgaacaaagactttcagcttgaccccgtaatcgcgaccgtgatcgcccagatagcttgttttaacaataaattaccccagggatcaccctgcagtcccgtgattaccaacctgattacccattcactggacatccgacttgcatcactcgccaagaagaattcttgtcgatatagccggtatgccgatgaccttactatttctaccagaaaaaaggatttcccgtctaatctcatggccgagggcgtctctggctatagccctggcaaaaaactccaggctgagataaagcgagcagggttcgaaatcaacagctctaagaccaggatccagtataaggatagccgccaggacgttacagggttagtagtgaataagaaaccagccataaagagtgagtattggcgcaccgttaggagccagtgccatgccttgtttcagacaggggcgttcatcgaatccactagcggaacgcctgaggatggtaatattttcgttctggagggcaggttgaatttcatcgaccagatcgatctctttaacaggaaacggaaccgtttcgacttcgtgtcagaatgggattcctcccagaaaaaaatcaatacccggagattgctgagcgggcgtgaacgtaccttcagcagatttctatattacaagctgttctacggtaatagtaagcctacggtggtctgcgaaggaaaaactgataacgtctacctgagatgtgccatggcccaaagggctaacgggtttccagaactctttaagtcaaaagcaggtgatgaacctagcgagctgctggtgcagtttgtgaagtacactgaacggactagatttctgctggagctggcaggcggcacatcctacctcaaggagttcattctgaatttcgacgagcatttcaagtattacaaggcaccagcgcccacgcaccctgtcatcatagtgctggacaatgatgatggatttggaaagattgagggggtgttgaactccaaaaaattcaaggccgttagttttcccgctacactggagggcggaagcttccgccaagccgagtttatccacgtggtacacaatctttatatcgtgttaacacctctacaaggtaagggggagcacacctcgattgaggacctgttcccccaggccgtgagggacattaagctgggagagaaaaagttttccaagaaaaacgagatcgacgcagctacccagtacggcaaggaattctttgcttctaaagttatcactccgaacaagaatacaattgattttagcgggtttgatatcattctgtcgcggatggtcaactgcatcaaacatttcgctagtgtcgacttggctaagtcctga

SEQ ID NO: 8392 - RNA, 1761 nt, unidentified
  source 1..1761: mol_type = other RNA; note = synthetic construct
atgtctaagctggaggcgttgcgtaaaatcaaaactaagcatgaactggcaaccctgctaggaatcaagacttccgtgctgacgtacaccttgtatgtgttgaaaccagacacacagtactccagttttacactgaaaaaacgatctgggggtgaaaggacaatcttcgcaccatcagaacggctcaagtccatccagtccaccctttctgagctgctgcaggattgcagggacgagattaacaacaagaagcaggacgatggtaaattcaattccaccttatcccacggctttgttcgccggcattccatcattactaactcaatgatgcacctgaaccagaaaaacgtgcttaatatcgacctcgaaaattttttcgactgcttcaatttcggacgagtgcgtggctttttcatcgccaataacaatttcaagctcgatcctcatatagctaccgtcatcgcccaaattgcctgccacaacaacaaactaccacaaggctcaccatgcagtcccacaattagcaacctcattactcattctcttgacattcaacttgccaatctggcaagaacatattcgtgtaggtatacaaggtatgccgatgacatcaccattagtacacgcgagaacttatttccgaggaaaataatgagacacgaggacggtaagtttattgccggaaagcggctaaggcgcgagataaaaagagctggctttaccattaacgagaagaaaacacgaatacaatacagagattcaagacaggatgttacaggcctggtcgtgaataagaagcctaacattaagtccgaatattggagaacggtcaagtcccagtgtcacgctttgtttagtacggggagcttcaaagataaggaaaatggggagttcattgacggcaacgagaaaatcctggagggccggctcaatttcattgatcagattgaccggttcaaccgactgcgccagaagacacccctgaatcccgattacgccttagctaagtatggatacgacacctctaagcagctctctggtagggagagaacattcagccgttttctctactacaggttcttttatggcaacaaattccccactattctgtgtgaagggaagaccgataacgtttatcttaaatgtgccatccatatgctgaccagtggatatcctcaattagctaaggaaaagaccgaaactgagccttacaagctgcttttgaccttcctcaagtacactaagcgcacccggtttctgttgcagctgcacggaggcacaagctacctgagcttctttataaacagcttcgacaagcattacaacttctataaagcacccaagccaaacaatcccgctatcatcatagcagacaatgactcggggttttcatcaatcgagtctaagctgcgcaaaatcgacagcgccaaaggatatcatgggaagaaagcagggaaaaattacagacaggccgagttcatccacgtagtccacaacctctacatcgtgctcacccctaccacgaagacgaataaggagactgctatcgaagatttgtttgatagtagcactcgcaagattcaggtaagcggcaaatcttttaatccgtcaaacgacatgaacaacgatactgagtacggtaaggaagtgtttgccaaaaaagtcatacaggctcagaaaggaagcatcaatttcaatgggtttaagcctcttctgaatcggattgtggcggcaatgaatcactacgatgcgatcaaatga

SEQ ID NO: 8393 - RNA, 1764 nt, unidentified
  source 1..1764: mol_type = other RNA; note = synthetic construct
atgtctaaactcgaagcacttaacaaaagtacctctaaacctcagctggctgcattgttaggggtcaaggctcagttcctcactcacgtcctgtatcggttaaagccagccactcagtacacaaattttacaatacccaagaagtcgggtggcacccgaaccatctttgctccctcagaaaagcttaagagccttcagtctagtttgagcactcttctgctggactgcattgatgagattaacgaggcaaacaccgtgaagtatacatataaacacgcactgtcccacgggttcgtcagagaatgcagtattatgaccaacgctgtgatgcacttgaaccagaaaaatgtgctgaatatcgacctcaaggacttcttcgattcctttaacttcggaagagtgagagggttcttcatcaagaataaccactttaagctggacccacacatcgccacggttatcgcccaaatcgcgtgctacgataataagttaccccagggctcaccttgttccccagtgatcacaaacctcataactcatcctctggacattaaattggctagtctcgcgcgaaagcattcatgtatctattcacgctacgcagacgacatgaccttcagcacaaggaaggcagtatttccttctcaaattatgcgccaggagcatggtaagttcataaccggcaaaaagctgaaaaatgagattaaacgggctggattttttatcaatgacaaaaagacccggattcagtataaagattctcgacaggatgtcaccggcctaatagttaatgtgaagccgaacgtgaagaaggagtactggcgtacagttaagtcccaatgtaacaggctcttccacactggcgcatttattaaaaagacagctgccggagacatagatgggaatattaatgaactagagggccagctgaacttcatcgatcaagtagataggttcaaccgcagtagaaagaaacctccactgaaccatacctacaaactcgataatcacggtattaataagacacctctgctgtctggcagagaaaagacattctccaagtttctctattaccggctgttttacgggaacaccaagcctacgatcctctgtgagggaaagacggataacatttatctgaaaagcgccatcagtatcttagtaaagaagtatccaaacctagcctcaactaagactaataaagcggcctacgaattacttattcgccttgtgaaatacagcaaacgcacgcgtttcctgctcgggctgtatggcggtgcttcgtacttgtcctactttacctctaagtttgacaaacagtacgtcttgtacaatgaggctcccaaaccacagcatcccgtgatcataatcctcgacaacgattccgggagcacaagcgtcaaaaagcagttcgagaagattaacagcgccacagcatatcccgctactctgcccaagaaagattacaaaaacgcggacttcatccatgtgacccacaatctatatatcgtgttgaccccactgactactaaaggaaatgacaccgacatagaatactttttcgatgatcccacaaggctgaagcagcataacgacaaatgctttaatactgccgacaaacgggatgacaaggccgatctgagcaaagaggcctttgccaagaacattatcaaggcccaaaagggctcaatcaatttcgatggatttaaaccgctgcttgacaggattgtggccgttattacgcactatgactccatcaaatga

SEQ ID NO: 8394 - RNA, 1764 nt, unidentified
  source 1..1764: mol_type = other RNA; note = synthetic construct
atgtcaaagcttgaagccctcaagcaaatcacaactaagccacgactagcggcgttacttggagtaaaggtgcagacactgacacacgtgctatacattttgaagccctccactcagtataccggcttcaccattcctaagaaaaatggcggtactcgctccattttaagcccttcagataaacttaagtctctacagtcctcactctctaacctgttgctggattgcatcgatgagataaacgagactaagcataagaagaattaccgttacaaacatgctcttagccatggctttgttagagagtgttccattatgaccaatgctcttatgcacctcaacaagaagaacgtgcttaacattgatctcaaagacttctttgacagcttcaattttggacgcgtacgcgggttcttcatcaagaacaatcacttcaagttggacccccacatcgccaccgtgatcgcacagatcgcctgctacgagaataaactgccccaaggtagtccatgctccccagttatcacaaacttgataacgcattctttagatatcaggctggcatccctcgcaaagaaatactcctgcacatattccaggtatgccgacgacatgacatttagtacccgagagagcgtgtttccccggcaaattatggggcaggaagagggacagttcattatcggcaaggaactaaagagcgaaattgaaagagccggattttcgatccatgacaaaaaaactaggatacagtacaaggatagtcggcaggacgtaaccggcctgattgtcaataagaagccaaacgtgaaaaaggagtattggagaacagtgaaaagccagtgtcatctgctctttcagaccggtgctttcataaaaaagaccgtcaatggagacgtggagggcaacattaacgaactgaacgggcagctgaatttcatcgatcaggtggatcgctttaacagaagcagggagaagccacctctcaatccaatttaccagttgcaaaatcacgggcagaataccacgtctctccttagtggaagggagaagacattctcccaattcctgttctatcgtttattctacgcaaatatcaagcccactatactgtgcgaagggaaaaccgacaacatttatctgaagagcgtcatctcaatactggcagagcattatccaaaactggctaaccctaagactaaaaagaacccttatgaactgctgattcagttcgtggagtactcaaaacggagtagatttttgctccagctctatggcggcgcatcctatcttaactactttgtgagtcagtttgacaaacactaccggcactacaaggcccctacaccccaacagcctgtgatcattgtcctggataacgattcaggtagctcatctatcgtgaccaaactgaaagctctggactcggttaaagcctatcccgccacggtcaaaaaggaggactgtgctaaagcagatttcatccacgtcgttcataatttgtacatcgttctgactccgctgaatgctaagaatgaaccgacagacatagaatctctctttgacgacagtatccggctgaagcagcacgacgggaagtgttttaacactcgagataaacgcgacgagaaagtcgatctgtctaaagatgccttcgcgaaccacattattaacgcccaaaagaatacgctcaattttgacaccttgaaacccctgctggatagggtagtggccgctatctctcactacgatagcatcaaatga

SEQ ID NO: 8395 - RNA, 1755 nt, unidentified
  source 1..1755: mol_type = other RNA; note = synthetic construct
atgaataaattggagcggctcaagaaaatcacaaccaagccagccctggctaatttactggaagtgaacccgagtttcctgactcacgttctgtacatccttaaacccaacacccagtataccacgttcaccattccaaagaaatcagggggcatccggaccatcaaagccccctcagtaaaactgaagagcctgcagtcaaacttaagcaagctcctgctggactgcattgatgaaattaacaagagtaagtccctggaagagaaaaattacaagcagacactcagccacggcttcgttaggaaacgctctatcatgactaacgctttgatgcatctgaaccagaagaatgtcttgaatattgacctgaaggacttctttgactctttcaactttggccgagtgcgcgggttctttattaagaaccacaactttcagttggaccctgcaatagccactgtgatagctcagatcgcctgcgatgataataaactccctcagggttccccctgtagcccggttattacaaatcttatcactcattcgttggacataaaacttgcgtctttggcccggaaacatagctgcatctacagtagatatgccgatgacatgacttttagcactcgcaagtctgtattcccacaacagataatttgtcaggagggagatcatttcgtgacaggtaagaatatgaactccgagattgtcagggccgggttcagcatcaacgagaataaaacccgcattcagtataaggatagtcgtcaagatgtcaccggcctgattgtaaataagaaaccgaatgtcaagaaggaatattggcgaaccgtgaaatctcagtgccactctctgttccgaactggcacctttacgaaaaaaacagcagcaggtgtggtcgccggcaacataaaggagctggaggggcagcttaattttatcgaccaagtcgacagattcaatcgccctagacagaaagctcccctgaatccaatttaccaatacaaaaactacgggaatgataagactcccctgctctccggacgggagaagacattcagcaagtttctctactaccgtctcttctatggaaacacgaagccaactatcctgtgtgaaggcaagacagacaacacatatcttaagagcgcaatctccattctcgcagggtcatatccaatcctggcttcagcgaaaacgagaggcagcgcatatgagctcctgatcaggacagttaaatactctaaacgtacccggtttctccttggactatatggtggagccccctacttgtgttccttcataaaggctttcgagaaacattacaagttccacaaggcgtcgaaacctaaatgtcctgtggtgattgtgctggataacgattccggctttaagaactttcccaagatcttaaagggaattaagagtgccacccctcatcccacaacattagagtccgatgactacaggaacgcagaattcatacacgtgattcataacctgtatatcgtgctaactcctctgagatctaagggggaagaaaccgatatcgagtacctgtttgacgatgctacgcggctaaagcaacactcaggcaagtgctttaacatcgtggataaaaggaatgacgaaaccgacctttccaaggacgcttttgccaaacacataatcaaagcccagaaggctagtatcaactttgacggattaagaccactactcgacaggattacctcagccatcaatcactataattga

SEQ ID NO: 8396 - RNA, 1806 nt, unidentified
  source 1..1806: mol_type = other RNA; note = synthetic construct
atgaaaaatctgagagccttgaaagatatcaggacaaagcccgagctcgctaagctgcttgacgtcacaccacagaatttgacgtatacactatacaagatcgggcggaaaaacctttacatctcatttgacatcccgaaaaggaacggaggtatcaggactatatacgctccagtctgcaatcttaagctgatacagtcaagattgagcaatctactgcaggactgcatcgatgaaattaacaacaagccaaataagtcctccaagctggcccatgggtttgtgcgtaagggctctatcattactaacgctaatgtgcacaagaaccagaaatatgtgcttaacattgacctgtctaacttctttgattcatttaacttcggtcgcgtgcgggggtttttcattaagaatcgaaacttcgaactggatcctcacattgccaccgtgctggcaaatatcgcctgcttcaacaataagttgccccaaggaagtccctgtagtcctgtcattaccaatctgattactcactccctggatataagacttgcctccttagctaaaaaaaactcttgtagctactctcgctatgctgacgatattaccattagcacacgcaaagcggtctttcctaaccagattatggaacagcacgaaaatggtaaatatctcgctggaaaaaagctgactcatgaaattacgagggccggctttagcattaacgaaaagaagacacgaatccaacaccaatacagcaagcaggacgtgaccggactgacagttaacaaaaagctgaacgtgaagaagatctattggcgtactgtccggtcacagtgttaccagctcttttgtaccggtactttttacaaaaccacttataaaggccgcgaacagggcaatatcaatgagttagagggccagctgaacttcattgaccaggtggatcatttcaaccggatccgaaagacctataataagaatctccataacagccatcatagaaagattggcaactcgcgggaacgcctcttcggcagattcctattctttaggagcttttatgggaattcccagcccaccatcctctgtgaagggaagactgatataatctacctcaagtcagccataaaaatcctcgctacagacttcccgaacttagcaagaaataatccaaaaaaaggcggctacaagctcctaatccggttcatcaagaatagtaacaggacgaatttctttatggacctgccaaaagatggggggtacggatgcctggtaaccttcatgaagaaattcaacgagaactctctgggttacaaagccccttccccccaacaccctgtgataattgttgtagacaacgacaagggatttgataattttacgactgcgattaaccaaacaaagaaggagtactcccgcaagaataaaagtaccatcaatcccagcaacccaaccgaggagaaggattaccgtaaaaagggattcatccacgttatccgaaatctgtatgttgtccttacacctttaagagacggcgagtctgcctctgacattgaggccctgtttgatgaggacacaaggttgaaaaaacacgagggcagatgcttcaatacagtactgaacaggaatgacaaggatgatttgagtaagaacgcattcgccacccatataataaagaaacagaagacctccatcaacttctcgaattttaaatgcctccttaatcggatttcaggggcaatcgaccactatgcagagaacggaagcgtggcaaaaagtgtgaaaaccgactatatcttggttctgtga

SEQ ID NO: 8397 - RNA, 1776 nt, unidentified
  source 1..1776: mol_type = other RNA; note = synthetic construct
atgtcaaaactaaccaccctgaaatctatcacgacaaagaaggagctggcagacctgctggagataaaacgctccaacctgacctatacgctgtacgttctaaaaccgtcaacccagtatttccagtttcagatacccaaaaagaacggcggattccggaccatcgatgctcccgctaagcggctgaaagatatacagtcaaaactgagcgacctgttcctcgactgcattgacgaaatcaataaaggtaaggagaaaaatcagcataacgagaaacacggcatacacacctatcccatgttatcccacgggttctctaggaagaagtcaatcatcacaaatgccctgatgcacatcaacaacaagaacgtcctaaatctggatcttgacgacttctttgattcatttaactttggacgtgtgagaggcttcttcattaagaacagaaattttgagctccatcccgacatcgctacagttatcgcgcaaattgcatgctataataacaaacttccacaagggtccccctgctccccggtgataactaatctcattacacacagcctggacatcaaacttgccagtcttgcccggaaatattcctgtacatatagccgttacgccgatgatattactttttctacacgcgaagaagtgtttcctcggcagctgatggctgaagagaagggcaagtacactcccgggaaacgacttaggagagagattgagtcgtctggtttcacaatcaatagtaagaaaaccaggatccagtacaaggatagtcgtcaggacgttacaggattgattgtcaataagaagccaaacatcaaaaaggaatactggcggacagctaagagccaatgtcacagccttttccgcactggaacgttctacaagctcacggaccagggcatggccataggcaacattaacgagctcgagggccagctgaactttatcgatcaggtcgacttttttaatcggctgcgccaaaagccaccactaaatcctctgtacaagttagagaatcaccgaaaaaatacctctaatctgttaaccggtcgagaaaagacctttagtaggttccttttttaccgctacttctatggtaacaataagcctacaatcttgtgtgagggcaagaccgataatgtatatttgaagtccgccatcaacgtgctgcaagaccattaccctaggctcgccaaaagcaaatccaaacacggagaatacaaacctatcgtgcatttcttcaactactctaagcgcactagattcctgttagaaatcttcggcggggcagattatttgaaagggtttgtcgaaaactaccagaagaactatagcttttacaaggcgcccaagccaaagaacccggtgattttgctcctcgacaatgatagtgggagcaatggaattatcaacctgataaaaggactgaggactaccaccattcatccatccactaccaagaaaaatgatatcaagaacgccgactttattcatatcatgcacaatctctacctgattctcactcccttgaacggcagcagtgacacggcaattgaggatctctttgacgccactaccaagtcgattaaagtggggggaaagtctttcaaccctggtaagcctgacacttcaaaggagtatggcaaagagattttcgctaatagagtggtaaaggaaaagaagaatagcatcaactttgatgggttcaaaccattgttaaacagaatctccgcagtcatagaacattattctaaacacacatga

SEQ ID NO: 8398 - RNA, 1800 nt, unidentified
  source 1..1800: mol_type = other RNA; note = synthetic construct
atgtctatcctaatcaatctgcagaatgcaaagacaaagaaagacctggcagccatcctggatatcaatacgtcaaccctcaccaatgccctctacaggaaaaaagtctctagtctgtacacagagtttaagatacccaagaaaaaggggggcgaaaggataatctacgcgccccagcgagagttgaagatcatccaaaagaaactgtctcttattttgcaggactgtctcgaagaaataacctccaacgatgaaaagatctccaacctcagtcatggatttatgagggagaagagcatttatactaatgcgacccatcacaagaacaagaaaaatgtcctgaacatagaccttaaggacttcttcgattgtttcaattttggcagggtcagaggattcttcattaagaacaagaacttcgaactgcaccaggacattgccaccgtaattgctcagattgcctgttataacaacagcctcccacagggctccccatgctctccgattatctcaaacttaatcactcattcactggacattaaattgtcacaattagcctcccgctatagctgcttctacactcgctatgctgacgatattactttcagtactcgggagtgcatctttccaacccccttagcccggattgagaacaatgaatatgtgatcgggaaaaagctaagacaagaaattactcggtccggctttgagataaatacaataaaaacccggatccagtacttgtcttcgagacaggacgtgacaggattgatcgtcaacaagaaggttaacgtgaaaaaggaatactggaagtccgtgcgggctaaatgcgacttcctgtttaagaacggatattactacgtgctagacgacactggaaaggagataaaaggctcactcagccagctctatggccagctgaatttcattgaccaaattgactacctgaacaagctgaaaaagccaattgagataaatccgctttacatactggcgaaacacggtaacaataaaacccctttgttcagttctcgcgaacgagtgtttagccactttctcttctataaaagcttctacggaaatgagaacacgaccgttatctgcgaagggaagaccgatattatctacatccgctgtgctatcaaatcactttacaaatcttacccatctctggttgataaggatgggatcatcaaattcgatttcttcaagtatacccgaagaactaggtatcttctgtccttgcatggtggtaccacctatatcgccgactttattaagaattaccgtcagtactacagcctgtataaatcggctaaacccacaaagcccgtgatcataatcctggataatgataaaggccttggggatatcatcggaggcctgcaaaaggagagaaaacctcgtctggtaacagcagacggggaaacgactcttaatggcatcaactccctcaagaagagcctgtacgtgcatgtgtgttttaatctctatctgctgattgtccctcacctgaaccagaaggagacgagcattgaaagtttatttgacaagagtgtcctcgatacaaaactaaacgggaagtccttcaccacagagaacgagtttagtcacgagaaattctatggcaaacacgtttttgctacagccgtgattgagaataacaagcacaaagtggactttagcggttttaaccagatctttaaggcaattgagaaaatccaggatgattataaggatgtacagaagaatacagcaaagccccctattaaaggttccacaattaatgccactccttga

SEQ ID NO: 8399 - RNA, 1248 nt, unidentified
  source 1..1248: mol_type = other RNA; note = synthetic construct
atggcggagatcctggacattaacacaagcaccctgaccaatgcgttgtaccggaaaaaggtgtcctctctgtacagcgaatttaagatcccaaagaaaaaaggaggagaacgcactatttttgccccgcagagagagcttaagatcatccagaagaaactcagcctgattctgcaggactgtcttgaggaaatgaccagtgaggacgagcggacccctaatctaagtcatgggtttatgcgagaaaaatctatatacacgaacgcttcctgccacaagaacaagaagaatgtgctgaacattgacctgaaagactttttcgattcgttcaattttggtcgggtcaggggtttcttcatcaagaacaagaagttcgaattacatcccgacattgcaacagtgattgctcagatagcctgttataataactcccttccccagggaagtccctgctcccctataatctccaacttgattacccactcattggatatccgattatctcaattggctagcaggcactcttgcttttacacccgctacgcagacgatatcacattctctaccagggagtatatctttcctacctcactggcaagaattgaaaatgacgattacgtcattggcaaaaaactgagacaggaaatcaggcgcagtgggttcgagatcaatagcatcaaaactaggatacagtaccatacatctagacaagatgtcactggtctaattgtgaacaagaaagtgaacgtgagaaaggagtattggaaggacgttagagctaaatgcgagtctctcttccgtacaggcacttactatatactggatgacaacgaaaaagccaagcccggaacgctgtcccagctctatggccaactcaactttatcgatcagattgattactcgaacaaaattcgcaagccaataaaaacaaacccgctgtacgttctggccaaacacggatcaaataaggcacctctattttccagccgggagaagaccttcagccggttcctcttctataaaaatttctatggcaacgagaagactactatcatctgtgagggcaagacagatatcatttacctcaggtgtgccatcaaatcactccataatcttcacccatcactggtagacaaggatgggctcgccaattttgagttctttaagtatacgcgccgaactaagtatctgctgagtttgaatggcgggaccccatacctgtccgactttagccgtgaacttttatga

SEQ ID NO: 8400 - RNA, 1833 nt, unidentified
  source 1..1833: mol_type = other RNA; note = synthetic construct
atgctggcagacaaacttgacagcttgaagaacatcaaaaccaagagggagcttgctattctgctgggggtcaaacctagctttctaacacataccttatacattcgaaagcctgaaaattgctattcagagtttgagattcccaaaaagaaggggggctaccgtaagatcaaggccccaaaccctcagctgaaatcgctccaatctaagctgtccgttctgctcctggactgcatggatattatcaagagtatcaatttccccaacgtgattagccacaaacggttgagtgtgtcccgcaatcatctcaagatcaaagtaccaggaagcccacgcaaggaatcaactttatcccatggctttgagagaaaccgtagtatactgacaaatgcggtgatgcataccaatcagaagaacatccttaacatagatctgaaggactatttcgattcctttaatttcgggagagttaggggctttttcataaaaaacaggaacttccaactgcacagcgatatcgctaccgtgattgcccagatcgcctgttttgaggataagcttccgcagggctctccatgttcccctgttatcaccaatctaattacacactctttagacattcgactagcatccctgtctaagaagcactcatgtacttacacacggtacgcagacgatatctctatttcaactcggaagaaaacatttcctgcaaagattgccaaagaggttaacggtgaatatgtcctcgggaagaagcttcgtcaagagataaagcgcagcggcttcaaaatcaataatacgaaaactcgcatccagtataaggactctaggcaagacgtcacaggtcttgtggtgaacaacaagcccaatgtgaaaaaggagtattggagaactgtgcgctcccagtgccatagcctgtttcacaccggggaattcacccagagaaattcagacggagagctggaagaaggcaacatcaatcggcttgaaggcaaactgaatttcattgaccaggtcgatagatacaaccgaatgaggcagaaagagaagatcaatcacttgtacgccctcagcaactacggacacaaaatgagtccttattggtccggcagagagaaaacattcagtaggtttatcttctatcggctcttctattctaacgtgaaaccgactatcctgtgcgaaggtaaaacagataatgtatacctgaaggcagctataaatgaactcgttaaagactatcccaagctggcctctcccccgacgaaggatgaacggtataatttactggtccgattcgtggaacatacgaagcggaccaaattcttgttggagctctcaggaggcagctcgtacatcagcttttttatcggtaattacaagtcccgctatggattttataaagcgccaaaagacaacgctcccgtcatcctcgtgctcgacaacgacagtgggttcgactgtatagagaagaagatcaacaaaatcgattccgtccagatttaccctactaccctgaagaaagacaaattaagggaggccgagttcatacacattacggaaaacttgtacattgtactgacaccaatcagtgccaccgctaaaaaaactgatatggagtccctctttgatgataagaccaggctgattaaatacgacaataagtgcttcaacaccatagacaagagagacgaggataaggacctctcaaaagatagctttagccggcacgtgatcaaaaaccagaagacctctattaatttcgatggataccgccccctattggatagactgaacaaggtgattgaacattacgacaagctgaagtga

SEQ ID NO: 8401 - RNA, 1767 nt, unidentified
  source 1..1767: mol_type = other RNA; note = synthetic construct
atggatactatcacgaaactgaagaattgccgctcaaaaattgatctggctctccttttaaactgtaaaccgagccacttgacatacttactatataagcagtccccctctcaaaaatacacccagttctctgtcaacaaaaaaaacggcggtatcaggaatatatctgctcctattagccagctgaaggagctccaaagcaatttgtcgcatctgctgctcgactgtattgacgatattaacgccacaaagagtatgaagtctaccctaagccatgggtttgtgcgcgaaaaaagtatcattaccaacgctgaaatgcataagaacaccaagaatgtgctgaatatcgacctagaaaattttttcgcaagcttcaacttcgggcgtgttcggggcttttttatatcgaataacaacttcctgctgaataaggacatcgccactgttatcgctcaaattgcgtgtcacaataatgagcttccgcagggctcaccctgcagtcctgtcatcacaaacctcattacccattctcttgatattagattggcaaacctcgcaaaaaagtatagctgcacctatagccgatacgctgacgacatcacctttagtacacgaaagacacaattccctaaagagattatgtgcgagcgcgaaaacgtatttaccccatcaagaaggttaaatggtgagattatccgtgcaggattcaaaattaatcctaagaagactcggatccagtataaggactcaagacaagacgtgaccggcctgatcgtcaataaaaagatcggcgtgaagaaagaatatcggcagataacgaagtccatgtgtaatagtctttttcactccggaggttttacaaagcttgtggatggaaaacacgagaaggggtccattgaagagctcgagggacgactcaacttcattgactccatagacctgtacaatcggctgacctttccagagaagcttagcatacactacccccatgtaaagcacgggattaaaactaaaaaactgctgacgggccgcgagagaactctatccaagtttctgttctataagaacttcttcgccaatgagaaaccaaagatcttgtgtgaaggcaaaactgataacatctatctgatggccgcgctgaataatttgtcaagtaactaccccagcttagcatcccctgccacagccacaaagctctttgagcccttggtttctttcctcaactatagcaaaaggactaagtttctgctcgagctcgccggcggtacgtcatacctggtgggcttcatactggattatcacaaatactactccttttacaaggccgagaagtctaataacccggtgattatcatacttgataacgatgatggcctgggtgaagttatcaaggctatcgccaaaatcaagacctgcgtggtggaggcaccagtcatagctgggcagaatatcaacgaccaggtcaaatcctctaggttcgttcatgtgtgccacaatctttacctcgtaatcacacccctggatcaggggaaagacacaatgatcgagaacttattcgaaccacagctgtgggcgaccccaattaaggggcggaccttcgatcctactgaaaaaaaaaagcccactgacaactactatggaaagaacattttcgccacagaagtggtgaaccccaagaaaggacagatcaactttgacggattcaagccactgtttgacagaatggtcgaggtcttggaacactacaaggtgaataggcagccttga

SEQ ID NO: 8402 - RNA, 1749 nt, unidentified
  source 1..1749: mol_type = other RNA; note = synthetic construct
atgaactctataacccagttgaagaactgcaatacgcgtgtggacctcgctcttcttctgaaagtgaagcctgccgttctgacttttacgttatataagaaaggcccacagaataactataccagttttaacatcccgaaaaagaatggcggggttagaaccattaacgccccaattggtaagctgaaaactctgcagacaaacctgagcaaactcctactggattgtatcgacgacatcaataaagagcgcgggtttaactcagggctggcacacggctttgttcgtgaacggtcaattataacaaatgcgatcatgcacaagaatagcaagaacgtactgaatatcgatcttgataatttcttcggttccttcaacttcggccgcgtgaggggttttttccagaagaacaggaactttcttctcaacgatgaggtggctacaacaatcgcacagatcgcatgttgtaacaatgaactgcctcaaggaagcccctgctctcccgtgattaccaacctgatcacgcactcattggacattcaactgttgaagctcgcgaataagtactcctgcacttactctcgatatgccgacgatattaccttttccactcgaaaatccaagttccctcccgaaatcatggtggagaacaacggcgtgtataacccaagtaaacgcctgaagcatgaaatcaaacgggctgatttcaaaattaacgacaagaagactaggatccagtacagagattctcggcaggacgtcaccggtttgattgtcaacaagaagattggagtgaaaaaggaatacagacgcacaactaagagcatgtgtaatagtttgttccatacaggctcctacaccaagatagtcaatgacaaacacgtagctggaacaatcaatgaactggaggggagactcaatttcatagacagtatcgacctgtacaaccggattaactatcctgagaaacttagtatccattacacccatcggaattatggatataagacgagagcgctgctgactggcagggaaaagacctttagcaaattcctattctacaagtggtttttcgctccatcaaaacccacaatcctgtgcgagggaaagaccgacaatatttaccttaagagcgctattttccaactagccgcacattatccaaaattggtgaaagctacaccatttgagcacctggtaaattatttctcatacaacaagcgttccaggtttctcctggagctctctggagggacatcttacctagccggcttcatctcctcctattccgatcactacagcttatactcggccccaaaatctggccagcccatcataattatcttagacaatgacagcggattaaatgatattatctctgccctcgccaagatcgacacctgcactgtctacccgatcgataaagccacgggcaatataaaagaagatataaagaccgctgactttatacacgtggtccacaatctttacatagtgctcacacctctcaacgggaaaaatgacagtatgattgaaaacctcttcaatcccgcactgtggagcacccctattcagggaaggacttttgatcccaccgagaagagaacccccaagaactcattttatgggaagaacactttcgccactgaggttattaaacgccaaaaagccaccatcgatttctcggggtttcaccctttgtttgagcgaatgacactggcaatcacacattatgagggtattcggtga

SEQ ID NO: 8403 - RNA, 1767 nt, unidentified
  source 1..1767: mol_type = other RNA; note = synthetic construct
atgaatagcattgagaagctcaaaaagtgttcatccaggaatgatctctccattctacttgatgtaaaaccgagtatcttgtcttacgtcttgtttgtggaatcagacgcgagtaagtatcaggaatttacgatctcaaagaagaccggtggagaaagactgatcaaagctcccaacgaccggcttaaagagatccagaaatcattgtccgacttgctgcttggctgcattgacgacataaacaaagagaagaatatctccaacaccttgagtcacggcttcgttaaggaaaaatcgatcataactaacgccgaaatgcacaagaaatccaagaacatccttaacatagatttgggcaatttctttgactcctttaattttggacgcgtcaggggcttcttcatcaagaacaacaactttctcctggatccaaacgtcgctaccgcagtggcccagatcgcatgccataataatagtctgcctcaagggagtccttgctcccctgtgattaccaatctgatcacccactctctggacatctcgctggcgaagctggccaaaaaaaattcctgtcggtatacaagatacgccgacgatatcaccttctccacgagaaaaaatagcttcccagttgaaataatggcagagctggatggggtctataaagccagcaagcgcttagacaaagaaatttctcgcgccgggttcgtgattaacgagaagaagaccaggatccaatacaaagattctcgccaggatgtaacaggtctagtggtaaacgagaaagtgggcatcaaaaaagagtaccgaagaactgttaaggcgatgtgcaactccttatttcacaccggctcttatacaaggctgatcaatgatgagcatgtggagggatcgatcctggaactggaaggaagactcaatttcatagactcagtggatcggcataatcgagtgcactatcccgagaaactctctacccattaccaacaccgtcaccatggtattcggagccgggaagtttggtcaagtcgcgagaagactctgtctaagtttctgttttacaagtggttctacgccaactcaaagactactattctgtgtgagggcaaaacagataatgtctacctgagcagcgccatttataaactgaagggaaagtatccaagcctgatcgacgctaaggccaagagcggggagccaaaatctctcgtgaagttcatggactactcccggcgtaccaagtttattctcgagctggcaggaggaacatcatatctagccaacttcattgacgcttacaaggaacgatacgagttttacaaaagtgagaagcccgaatatcccgtgctgattatactcgataatgacgatgggcttaatgacaacggtggcatcatcgcaaaattacagaagattagcactatgagcatgcaccccacaccacctaagaagggcaacatgaagtctaagattaaaaacagcgagtttatccacgtcatgcataatctttacgtagttatcacccctctcaattctggcaacgacactatgatagagaatttattcgagcagaagctgtggtccacaccactcaacaagcgtactttcgaccccacagagaaaaaggaaccgaaaagcagttattatgggaagaacgattttgctacaagggtcgtgaagaagaaacaggacagcataaacttcaatgggttcattcctcttttggatagaatgcagagggctattgaacattacaaaacggtgtga

SEQ ID NO: 8404 - RNA, 1758 nt, unidentified
  source 1..1758: mol_type = other RNA; note = synthetic construct
atggatgccatcgacaaattacagtcatgcaagacaaggcgggatttagcgatcctgttgaattataacccttctcactttacacacctgttgtatcactcaatcccggaacaacgctataagtccttcctcatcccaaaaaaaaacggcggggagcgctccatttcggctccaaatgaaaagcttaaacaactgcagcggaacctgagcaacctgctccttgaatgtatagacaacatcaataagcggaacggcgtgaataactcactgtcccatggctttgttagagagcgttctatcataaccaacgcggagatgcataagaataagaagaacgtgctgaacatcgatctcgagaatttcttcgggagctttaatttcggtcgagtctccggatttttcatcaagaataactccttcctcctagaagaggtcatcgcaaccacaattgcccagatttgctgctttaataacgagctgcctcagggatccccttgtagtcccgttattaccaatttgattactcacagcctagacattcgactcgctagccttgccaaaaaatattcttgcacctacacaagatacgttgatgatataaccttttctacacggaaatccaccttccctatccaaattatgaatttcgagtatggagaataccttccctcacagaggctgctccatgagatcacccgctcgggcttcaatatcaacaatagtaagaccaggatccagtttaaagatagccgacaggatgtcactgggctgattgtaaacaaaaaggtcggtgtcaagagggagtacaggcagttgacaaaggctatgtgtaataagcttttcaataccggtagatttactaaagagatcgatggacaggaaattgaaggatccctgctggaattagaaggccagctgaactttatcgacagcattgattattacaaccgggtaaattacccccagaatctctctatccactacacgcacagaaattttggattccggactaaattattgctcaatgggagagagaaaatactcagtaaattcctgttctacaagaacttctactcatctgataaaccaacaatcctttgcgaagggaaaactgacaatgtgtatctgctctccgctctgcacgccctcagcagtagttttaaaaagttagccactccccccacaaagacgactgacttcaagacagagattaaattcctgaactacacgaaacgcacaaagtttctcttggagctagctggcgggaccagctaccttgcaatgttcatagccaactaccacagtaactacattcaatataaggcccctaagccaaaacatccagtcattatcatcctggacaatgacgagggcctaaaagacattattaacgagctggagaagatcaaaacttgtaccttttcaccacccaagaccaaggggagcaccacacgcgatgcagtaaagacgtctacttttgtgcatgtggtgcataacctgtatctggtgattacgccgctgtctgacggtaacgacaccatgatagaaaacttcttcgagaaagagctgtgggaaaccgtggttaatggacgtaagtttgaccctactgagaaaaaagaaccgaagaatatcttctatggcaagaatatcttcgcaaatgacgtggtgaagttgaaccgtaagaagattaactttgaaggctttaggccccttttttatagactggagaaggtgataagcaactacaacaagatatga

SEQ ID NO: 8405 - RNA, 1755 nt, unidentified
  source 1..1755: mol_type = other RNA; note = synthetic construct
atgaacgcgatcacccagttaaagaactgccattctcgcatcgatctggccatactgttgaaatgcaaaccatccttcctttcttacgtgctttataaaaaggcagcctcgagcaagtatcacgagttcgaaattgacaagaagaacggcggcaagaggaagatctgtgcccccgccgacgacctgaagagcatccagcgtaacctctcagatcttctgttagattgtatcgatgacatcaacaaggataagaattactacaacacgctgagtcacggattttcaagggagaagtccatcattagcaatgctgaaatgcatagaggccagaaaaatgtgttaaatatcgacctcgacaacttctttggttcctttaattttggacgagtgaggggattcttcatcaaaaaccgaaatttcgagctgaatgaagaggtcgctactaccatcgcgcagattgcttgttatgagaaccagctgcctcaaggctccccatgcagtcccgtcataacaaacctgatagctcatccactcgacattagattggccaagctggcaaagcagcatagttgcatctatacacggtatgccgacgatattacctttagcaccaggctgaaagacttccccgcaaagctgatggcccaaccaacaccgaacgagtatgtggtgggatctaaactcaacagggagatccaaagagctggttttaacataaaccacgataagaccaggatccagtacaaggactctagacaagatgtcactggcctggttgtaaataaaaagatcggcgttaagagagagtatcgccagctgacaaaggccatgtgtaatagtcttttccatacaggctcatataccaagctcgttggggacaaccacattgacggtagcctggatgagttggaagggagactgaactttatagactacgtggacctgcacaatcggttgcagtatccggaaaagctgtccattcactaccctcatcgcaactacggaagcaaaacccgggccttgctgacaagccgagagacaacacttagtcggtttctattctacaaatactttgtagggaacgaaaaagcgactgtcctgtgcgaaggtaaaaccgataatatctaccttaaggccgctctccgccagttagcggcacattatcctactctccagaacgaatccaatcacgagtgttaccttgatttcctgaactattctaaacggacgaagtttctcctcgagctatttgggggcaccgcttatctggctggcttcattacgtcatacaatgatctgtactcctactacaaggggccgaaagcaaataatcctgtaattatcgtgctcgataatgacgacgggtttgacgcaatcgcatctgccttgaataaaaccaaatcgtgcactattaaccccacccccactcacacgaccgggcataacttcaattccactgagtacaagaatagcaatttcattcacgtctgtcacaacctatacgtggttctgacccctctgaacaatggtagtgacactatgattgaagacctttttgatcgctctttatggcagacatccatctccggccgtactttcgatcccacagggaaactaaaaccctctagctcatactatggaaaaaacattttcgccacagaagtggtcgctccacgtcaatcaagcataaatttcgatggctttaagccattgctcgatcggctcaccgacgtggtgggaaattatgccccttga

SEQ ID NO: 8406 - RNA, 1758 nt, unidentified
  source 1..1758: mol_type = other RNA; note = synthetic construct
atgaacaagatcctccagttaaaaaactgccgcaccaggattgaccttgccatcttattgaaatgtaagccctctttcctgacctttctgctctataagacaaaacaggaggatcactatgaggagtttgagattcctaagaaaacgggcggaatcagaaagatctgctcccctaaaggtgacctcaaactgctccagaaacgcctctcactcctcctgttggactgcattgatgacattaacagcaagaacaagataaagaacaccctttcccacggtttcgagagagaaaaaagcatcatcacaaatgccgaaatgcatagagggaaaaagaacgtgctgaatatagacctgaacaatttcttcgacgagtttaattttggtcgtgttcgcgggtttttcatttccaacaaagatttccaactgacacctgaggtcgcaacgaccatcgcacaaatcgcctgttacaagaataaattgccccagggaggcccagccagtcctgtaattacgaatcttattacccacatactcgacgtaattctttctcgactcgcaaaaaagaatagttgcatctataccaggtatgccgatgatatcacattctctacccggaaaaagctattcccctcgggcatcatggaggaaactgatgctaacatttatatcccctctaaatcactgaaccacgagattaagcgggctgggttctcaataaactcaaaaaagaccaggattcagtataaagatagcaggcaggacgttacaggattgacggtgaataaaaaagtgggcgtcaaacgcgaatacaggcagttaaccaagagcatgtgtaattctctttttcatactggagagtacactaagaaggtgaataacgaggatgtggctgggaccttgaaggaattggagggtcgcattaactttatcgatagcattgacttctacaatagaaaaaagcatccgaaaaagctcagtattcattaccaacaaaagaaccatggcctgaataccagactgttgctgtccgggcgagagaaactcctgtccaagtttctgttctacaagaacttcattgggaacgataaagtcactatactttgcgaaggcaagactgataacatttacattaagtcggcgctaaagaccctggtcaataattatccaaagctggccgaaaaaaaggccgaagagccatataagtcctacttaaacatcctgaactatagcaaacgtaccaaatttttcctggaactggcaggaggaacaccttacctgaattttttcatcaagaactacgagaagcactacaacttttataagagtgtgcctgctgaaaagccagtgatcataatactggacaatgatgacggcttcaaactcatcattaatacaatcaaggagatcaagaaccatacttgtctgccatacccgaaccgacggcagacaccaatcgaatacctgaagaacgctgacttgatacacgttacacacaacctatacatcatacttacacccctgagcaatgggaatgacactatgattgagaatcttttccccccagatctgtggaatcaggacatccagggacggaccttcgaccctacagaaaagctaaaacccgaggaaaactattacggcaaaaagacttttgccactgaggtgatcgcgcccaaccgggatcacattaattttgacggctttagaccgttatttgacaggctgactaatgtcatcgaacactatgagaagatctga

SEQ ID NO: 8407 - RNA, 1764 nt, unidentified
  source 1..1764: mol_type = other RNA; note = synthetic construct
atgaattctatagaatccttgaaaagctgtgtgactcgaaaagatcttgcacggctgctgtcttgtgcccctagtcacctcacgtatgtcctgtataagttgcccgcggctactaagtacaagcagttccctgtgtccaaaaagagcggcggcgttaggcaaataaacgcacccacgaccgacttgaagaaaatacaacgctgcttggccaatctgctccaggactgtattgagaacattagcgaagaacatgagtacgacaacaaggccgctcatggattcgtgcgcaagcggtctattatatctaatgccgagatgcacaagagacaaaaaaatgtggcgaacctcgatcttgagagcttcttcgacagctttaactttggtagggtgcgtggtttttttatcaagaaccggcattttgcactgtccgaagaagttgccaccactatcgctcagattgcctgccacaatggcgtgcttccacaggggagtccatgctccccagtgattaccaatctcattgctcattctctagatattagactgataaacctagccagaaaacactcatgcgtctatacaaggtacgcggacgatctcacattttcgacaagaaaagcaactttcccacctcagatccttagggaggaggatgggaaaataatccctagtaagacactccggaatgaaattaaacgggccgggttcagtatcaaccataagaagactaggatacagtataaggactctcgtcaggatgtcacgggtctggtggtgaataagaaagtaaacgttagttcagactacagcagattgacaaaggctatgtgccactccctatatacaaaaggtttctacaccaaagaagagaatggaaagctggtacagggcaccatcaaggaactgaatggacgtctgctgttcatcgactcagtcgataaatacaaccggatcaattaccctgacaaattatctgtgcactacaaccacaaaacccacggatatcgcacacgagtccttcataacggacgagagaaaaccttctccaaatttctgttctacaagcacttttttgctaatacaaaggtgtgtgtgctttgtgaaggaaagaccgacaacatctatttgaaatgcgcactcgattcaattggagcccaatttcccaagctgtacacaccggcagggaacggcaaggatgccatcacacacatcgagctcttcaaatattccaagagaactaggttcttaatggagctgtatggcggcagcagttatctcgggggttttatccagtcatacaaagaacggttaaagtcctacaagaaattgccactgactcgccccgttattattcttctcgataatgacgaggggctgtctaaacatatccgaaccgagatgaagagcgcccacgccactatctacattaatggcaagatcgtgactaacttcgataagaatattaagaaggctgactttgtccacattaccgacaatctgtatgccatcttaaccccactgaaagctgatggctcggatagcatgattgaggacttttttgagcctgcagttctgaacagacaggtaaatgggaggacattcgacccgaaggaagagaaaaagccccccgaaaagttctacaacaagaatacctttgcgacccaggtagtcgaagctgacaaaaaaaacatcaacttcaatggcttcaactccatcttcgagcgcatctcactggcaatcaaccattttgagagccgcacgtga

SEQ ID NO: 8408 - RNA, 1854 nt, unidentified
  source 1..1854: mol_type = other RNA; note = synthetic construct
atggtcatggatgatgaacactccaaactgctgaaacttgcccgttataatcgccttttctcctgtgacagtcgaagtgaactggcaagcctgttgcacgtctccccagtgttccttaccaacatcttgtacattcaaaaaccagagaatctgtatcggagcttcaatattcccaagaaaagtggagggatccggcaaatagaggcgcctgcagaaagcttaaaggaaattcaaagtaagctcgccaatctgctcttggactgcattgatgcattaaacaccattaagggaaatgacagtaatttgacaggctcattcaataatactctgtctcacgggtttagccgtaagaaaagcataatcactaatgctgagcgccatcgcaacaggaagatcatactcaatacagatatagaggactttttcggcagttttaacttcggaagggttcgggggttctttctcaagaatcggaacttttcactctccgagaacatcgctacaaccatcgcacagatcgcctgttataacaacgctttaccacagggctctccttgctcccccgtgatttctaatctgatctgccatagcatggatgtgaggctagctaagctggccaagagacattccttgtactatacgagatacgcggacgacctgacattctctactaacaagcgcactcttccttcagaaattgccattgagaatggttcgcgctatgaaattggttctgttttccagagggagattcacagatcaggattttccataaatcacaacaagacacgcgtaaactttaaagattcacgacaggtgatcaccggtctgacggtaaacaagaaaatcaacacacatcggaactattggcgcttggagagatccaaatgccactacctgtttatgaccggcgacatcccggacgatgggagcagcaccgatctagcttctaagatcaataggctgcatgggcggctcaatttcattgacaccatggacagacacaaccgggttaacctctcaaagatcgagcagcaccttatcagccataaatcgattaatggcatcctgaaagaggacattgaagagatcttgttgggaaaagagaacggaaagaattcgcgaactaagaagaagttaaactcccgggaggaaacctttagcaagttcctgttttacaagaacttctacaacaaccagaaaccccttattattctggagggtaaaacagacaacatatatatagggtgtgcactggaaaggctattctcacattacaaagacctcatcaagtacgatattaaggagaagaagtacgagaagaatatcaagctgtacgagcacactaaaagggctagatatctactggatatccacgccggcgccgaccatctgtttgagtttgtgagacagtatgataagcgatactcttattacaaggccccgattgacaatcaccctgtgattttactccttgacaacgatacagggccaaaggcgatcatcaacttccttaaaaataccctgctcaaaaggtcaggcatagatcccaagaacgaagatttcgtccatatctgtcacaacctctatctcgtgctgactccactgaataagggaagagacacgtccatggaagatttttttgataaaagtgtgctgggcactacaataaagggtaaaaccttcgatccttccaatgaaaaatccaccggcactacgtacggcaaacacgtgttctctaccgaagtcgtcaaaaaaaacaaaaacaccatcagtttcgccagctttcgtcccatcctggaccgagttacagctgtgattaatgactacgcctctaagaaatctagcagctga

SEQ ID NO: 8409 - RNA, 1848 nt, unidentified
  source 1..1848: mol_type = other RNA; note = synthetic construct
atggacgaaaagaaggcccggtcacggaagttggacagatattttaggctgtcaaattgcaccaccagatccgagcttgctagcctcctcaatatcagttctgtgtttctgacaaacgtgatctacattcagaaacccgacaacctctaccgctcgtttaatatcccaaaaaaatctggagggcatcgagtaatctttgcccccgccccgcagctgaaggaaatacaaagtagtctggcccaccttctgttggactgtattgatgccatcaatatcaaaaagggcgaaaatctaaagttgggtaagcctttcatttccaccctgtctcatgggttcagtagaaaaaagtccatcattacgaacgcagagaaacaccgtaatcgccgagtgattcttaacacagatatcgaagacttcttcgggagctttaatttcggtcgggtccgcggcttcttcctgaaaaacaggaattttcaactgttccccgatatcgcaaccactattgcacagattgcttgctacaacaacgctctccctcagggctccccttctagtcccgtgatcagcaaccttatctgtcacaccatggacattcggctcgccaaattggcatctaagcacagcctgtattatacacgatacgccgacgatttaaccttttcaacgaacaaaaaggagatccccgtcgaaatagcaatcaataaaggagggcaatatgaagtgggcatagcgctgaaaaaggagatacatagatccggtctgtctatcaaccacggaaaaactagggttaattttaaggacagcagacaggacgtgaccggccttaccgtgaacaagaaaatcaatacgaaccgacattattggcgtttagaacgctcaaggtgtcattacttattcatgacaggggatataccagatgatggaggttcctacgacctcgagagtaagatttcccgcctgcacggcagactgaactttatcgacactatagatagacacaaccgggttaatctggccaaaattgagcagcatattattagcaacaagtccataaatgggatcctcaaggaagacattgaggaagttcttttaggcaaggacaacaacaagaaaactaagcgcaataagaagctgaactcaagggagatcaatttctctaggtttctgttctaccggaacttctataacaacagtaagccacttataatctgtgaaggtaagaccgacaacatctatattagctgcgctctagagtccctgagcccatcctatccaggattgatcgagcacgataaaaaagagaagaagtacaagaagctcatcaagctgtacgagcacactaaacgtgctagatatttactcgacattcacggcggcgcagaccatcttctggatttcatacggcagtacgaaaagaggttttcctactacaaagctcctatttcgaactctccggtcattctactgctcgataatgacacaggcccaaaggccattatccagtatctaaagaatacattgctcaaaggaacaggaatcgaccccaagaatgaggagtttattcacatttgcaaaaacctgtatctcgttctgacccccttgtctaataaaaaggatactagcatggaagacttcttcgagaacaccgtactgaagacaaaagtgaatgggaaaagcttcaacccttcaaatgatgccgctaccgatactacatacgggaagcatatattttctactgaggtcgtgaagaaacataaaaatagcatcagcttcgatatgtttcgccctatctttgataggatcgtggcggtcattgaacactacgagtcgatcaaaaattcactgtga

SEQ ID NO: 8410 - RNA, 1767 nt, unidentified
  source 1..1767: mol_type = other RNA; note = synthetic construct
atgtcgcggttggcattgttaaaacaggctactaccaagagaatgctcgctaaggttctcgatgtaaacccttctttcctgactaagaccctgtacctgaccagcgatgagctcaaatataagtctttcgaaatcccgaaaaggaatggcgatccacggaccatttatgccccaaacaaagaactgaaagacctgcagtccaggctgagcgtcctcctacttgattgcattgacgaaattaacaaggagagaaagatcactcccaaactttcacacggctttgtccgtaaccgttctattataactaacgccaagaaccatatccacaaaaaaaacgtgttgaatatcgacctcaatgatttttttgggtccttcaatttcgggagagtaagaggtttcttcatcaaaaaccagcattttgaacttcatgagcacatcgctacagtgatagcccagatcgcgtgttacaaaaatttcctccctcaaggttctccctgctctcccgtgattacaaatcttatcatgcattccgtggatatccggctggccaaactcgcaaagaagaacagctgcacatatacgcggtatgcagacgatattactttctctaccagagaaaatgtgtttcccaaggatattgcgatagctgacaagaataaagtgcacctgggaaggcgactgtcaaaggagattactgacaacggcttcacgatcaatgagaaaaagacccgcgtccaactgatggactcacgacaggatgtaacaggactcgttgtgaacaagaaggtgaacattaagagcgattattggaggattaccagggcaatgtgtcactcattatttcaaaccggaagttacattaagtgtgagcagaacggccaagccgtggcaggtacactgtatgagctagacggccgactcaattttatcgactacatcgacaagtacaataatgttaaggagaagggaccaatcgataacaggttcagtctgcgcaaccatggactcaactacagggagaagctgaatgttcgggagaaaacattttcccgattcctattctataagtacttctttgggcataacaaaccaactgttttatgcgaggggaaaaccgacaacatttatataaaagccgcgatcctgcgccttagtgagaaattcgagttactgtcaaatgccaaaactgacgagaaggaatacgagctgctggtgaacttcctagagtacaacaaacgcacaagatacttgttggacctttacggcggcgcttcctacctgaagcggtttgttgagcggtatagatctgattattcatactatcgtgctccagccgccacacagccggtgatcattgtggcagataatgacagcgggtcgacagaattaatcagctacctggtcaatcacaagcccctgtatcctgaattgaagaaggataaggctgagtccaataaaatcataaaggaatccagtttcgtccacgtcgagaagaatctgtacattgtatttacccctctgatcgacggaagggacagcttcatggagaatctttttctgccagagacgttgaacatagaagtggatggcagaaagtttagccctcagcaggaagctgacactaagaacagctacggtaaaaataccttcgccacaaaggtggtcagtgccaagaaacactccattcccttttccgggtttgaacctctcctcacccgcatggaagaagccataatccactatcgcacgaaaatcgaaaaaaaatga

SEQ ID NO: 8411 - RNA, 1746 nt, unidentified
  source 1..1746: mol_type = other RNA; note = synthetic construct
atgacagagctagaacgcttacggaaagccaccactaaagttgatctggccaagatattgaacctaaatgcgccatttctcacacgcacactctacataaacaagatcgaaaaccagtatacgcaatttcagatccctaagcggtccggaggtcatagaaccattaatgccccaacatcagagctaaaggatatccagtcccgactaagcaaattgctcctcaactgtattgatgagattaatgccagtaagaacgttgagcccagattgagccacggatttaccagaaaaaggtcaatcatcacaaatgcagagaagcacgtccaccagaaaaacgtgctgaacattgatctcagcaatttctttgacagcttcaacttcggaagggtccgggggttcttcatcaagaacaacaacttccttctgcacaaagacatcgccacggtgatcgctaagatagcttgcctgaacgatggactcccgcagggatctccatgctctccggtcatcacaaacctgatctcccacagcctggatatccaattggcatctctggccaagaaaaatagctgcacctattcccgctacgcagatgacattaccttcagtacacggaatcgggagttcaaacccgagctggtcaaagttgatggcgtggacatcttcatcggctctaagcttcttcgcgaggtggagagggccggttttaagataaatgaaactaagacgcgagtgcagtttaaggactcaaggcaagatgtgactggactcgttgtgaacaagaaagtgtctatcaagtccgaatactggcgaactacccgtgcgatgtgtcaccagctgtttattagtggcagctacacaatcaagacctcaacggggacacgcgaggggactattaatgaattgcaggggagactcaactttatagactcaattgaccgctataatcatatgaggccaaaaggcccccccgataaattacacatccctatacaggacaggaagaattacagagaaaaactgaatgtacgtgaaaaggtgtttagcaaattcctctattacagaaacttccacgctaatgagaagcctaccattttgtgtgaaggcaaaactgataacatataccttaaagccgcaattcatagtcttagtaaacaatacgggctcttagccaagtccaaaacgaagactaccccatttgaactcctgatcaagtttttcaactattctaaacggaccagatacctgctggatttacatggaggcggctcctatctgaaggattttgtacagcattatcaggagaatctgaaatactatcagaagaccataccaaaaaaccccgtcattctgctgctcgacaatgactcaggccctaaagagctgattgacctgctggtgcatagtaaaaagttccccgattttcccaatggtaaagacgacattaagaatggggaattcgttcatatcacaagcaacctgtaccttattttaactcctctgaaaggcaacaaggacacaatgatcgagaatttctttgacaagaagaccctttcaatcaaagtcgacggaaggagcttcgattattcgaaggaagctgactctaccactaagtacggtaaaaataccttcgctactaaggtagtgctggagaacaagtcgtccatttcttttaagggcttcaagcctatcttgtcccgaatcgagaaggtgattaagcactataaagcattgtccggtgggtga

SEQ ID NO: 8412 - RNA, 1758 nt, unidentified
  source 1..1758: mol_type = other RNA; note = synthetic construct
atgacgaaactcgaacggatacgcttagcaaaggataagaaagactttgcaaaattgctcaaagtgagcacggtgttccttactaatactttgtatcttactcccatagaagatcaatatgaggaattccagatccctaagcggagcggcggatttcgaaccatccacgccccaaccgccgagctgaaggatcttcaaagcagactctctaatttgctgttggattgtatcgacgatatcaacaaagagaaggagattatttccacactaagccacgggtttgtgcgtaaaaggtccattattacaaatgccaggttgcacgtgagacagaaaaacgtcttaaatattgacctcgaagacttctttggatcttttaactttggccgggttagaggcttcttcctgaagaacaacaacttcaaactggataagaacatcgcgaccataattgccaaaatcgcgtgcctcaatgataccctacctcaggggagcccttgttctccagtgatcaccaatctgatcacccacccgcttgatattagattggcccaactggctaaaaagtcctccagcgtttacacacgttacgccgacgacataacattttcaactagggaacgcaacttctctgagaagatagtatccattgaaaacaagaaggttactctctcaaaaaaactgaaagaggagatccgccggtcaggcttcaatattaaccacaagaagaccaggctgcagttcgctgactcacggcaggacgtaaccgggctcattgtcaacaagaagatcaacatcaaaagggagtattggcgtgagactcgcgctatgtgccatagcttatttaagaccggcgagtttaccatcaacgaaaatggaaatcttaggaagggtaccattgatgagctgtacggtaagctaaacttcattgacagcatagacagatacaaccactacaattgcaaagaatctctggaccataggtattccctgaaggacagggggatcgatactcatcgggagaagctgaatggtcgcgaatctacattcagtgatttcctctattacaagaacttcatcgccaacaacaaaccaacgctgctgtttgagggcaagaccgacaacatttacatcaagtacgctcttaaaagcaaatcgaacactagtaacgagctgaaaccgacgaagaatgataatgaccagctagaactcccagtttccctgtttgattacaccaaacgcacaagatatcttctcgacctgtacggcggcggaaactatctgaaattttttagtcagcggtataagaagtccttgaagtactacaatgtgaaaactccacagaatcctgtgattttggtgctggataatgacaatggtcccaacgggctgatcggatggctctcatcacagaagattattttccctaagatcgaagaggataataagaacaacagcatacgaaatagtgactttatccatatcgtcagtaacctgtatctgatcctgacaccccgagacaatgggaatgatagtatgatggagaacctgttcgacgacaaagcactcagttataaaatcgatgggagagagttcgaaccctccaatgaatatgattcgacaacaaaatacggcaagaatacattctctctcaaggtcgtgaaagacaaacataaggagatcaattttgacggattcatccccttacttctgcgaatagcaaaggtgattaagtaccacaaaaagtttgtcaactcttga

SEQ ID NO: 8413 - RNA, 1761 nt, unidentified
  source 1..1761: mol_type = other RNA; note = synthetic construct
atggttcatcgacggaactacctgcttttgaaacaggccaaaaccaagcctgagctggctagcctgctggatgttagtgctgcatttctgaccagaacactttataggcctggggagctatcacatgtaaacagtcactaccaccaatttgacataacaaagaaatccgggggcgtaagaaagatcagcgccccatctgatgaactgaaagaacttcaacgccgcctgagtgatctgctgctcgattgtaaggaggtgatccatttcgacaataaggtggaatgcacgctgagccatggctttgagagggagaaatcaattattaccaatgctcgcatacatcggggcaagaaaaatgtcctgaatttagatctcgccgacttcttcgggagcttcaactttggacgggtgcgtgggtacttcatttccaacaaagactttaagcttgatccgcacattgctactacgttagcacaaatagcctgctataaaaactccctcccgcagggttctccttgttcacccgtgattgccaatttaatcaccaactcactggacatcaaacttgcaaagttggccaaaaggaacggatgtagctacactcgttacgcagatgatattacgtttagtaccagaaaggagatctttcccaaggacattctaaaaaacgtggagaataccatcctgggttctaagctgctcggcgaaatccgccggagtggattttccgtgaacccaactaaaacacgcttgcagtttaaagactcccgacaggaagttaccgggctggtcgttaataaaaaagtgtctgtgaagagcgagtattggagacttacacgcgcgatggctcactcactctttaagacgggcaagtttcaaatcattgaacaggatggatcgtacagaaatggtcacctttccgagctagagggacggctcaccttcatcgattccgtggacttctacaacaacttggagaagaagaaaaaaccagaacccaagtatgaacccaaggtgcacactggcataaataagttccgtggcagattgaattctagggagaagatctacggcatgtttctgcagtacaagaattttttcgccaatgagtatccgacaattcttacagaggggaaaacagacaatgtctatctaaaaagcgccctctcgcagctgcaggccctgtatccaaacttggtgaatagcaagagcgctaccaccgaatactcacccaagctgaaatttcctgatctgaaccgaaagactatgtatttactggacattggggatggagcaactccatttgtcaggttcgtgcagcggtatgttgacgacctcaagaacttcgaagataagaaagccaaaaaccctgtcatcctaatactcgataacgacagtggtcctaaagacttactgaatcacttggtaaagtctgtaaagtcttgccccaatgatattctgatgctcaagtctagcggtttcatccacttgttccataatctctacctcatcctgacaccccttaacagtgggggcaaggactccgcaatggaagatttgttcgacagcactacactcgctactgtcattgatggaaaaaccttctccccagaaaaaaacatcgacattaccaagcagtatggcaagcacatcttctccacaaaggtggtgaggtcaaacaaagcgaagataaacttcgacaaatttaagtacctgttcgacgagatcgagaaggtcaaactccatttcctgaccctgtga

SEQ ID NO: 8414 - RNA, 1689 nt, unidentified
  source 1..1689: mol_type = other RNA; note = synthetic construct
atgatacatcgccggaattacctgctactaaagcagacaaaaacaaaacctgagctcgcggagattttaggcgtttctgccgcctttctgacccgcactctctataaacccggggtgcagtcccacgtgaattcacactaccatcaatttgatgtggccaaaaaaagtgggggcgtgcggacaattagcgcgccatcagatgagctcaaagatcttcagaggaagcttagtgacctgctccttgattgcaagagcgtgatacatctggacaacaaggtagaatgcagtttgagtcatggctttgaacgagaaagatccatcatcacaaatgctcgcatacacagaggtaagaaaaatgttttgaacctggacctggcagatttcttcggctctttcaatttcggacgtgtcagggggtactttataagcaatagggactttaagctcgacccacacattgctacggtcatagcacagatagcctgttacgaaaaccgcctccctcagggaagcccatgtagtcctgtgatcgcgaatttgattacaaacagtctggacattaagctgtcaaagctggccaaaaggaatggctgctcttatacccggtacgccgacgacatcaccttttcaacaagaaaaaagatcttccccaccgctatcctgaaagacgcagagaacgtcattctgggatctaaactgttaggtgaaatacggagagccggcttttcagtgaatcccaaaaagactaggttacagttcaaggatagcagacaagaagcgaccggcctggtcattaacaaaaaggtatccgtgaaatccgaatactggagactaacccgggcaatggcaaactcgctcttcaaaacgggaaagtttttaattgccgagcaagatggttcttatcgagaagggaagttatccgagctggagggacgattgacttttattgactccattgacttctacaacaacatcgaggaaaagaaaaagcccgagcctaaaagcgagcccaaaattcacaacggtatcaacaaatttcggggtaagctgaatagcagagagaaggtatatgccgagttcttgcagtataagcatttcttcgctaatgagtaccctaccatcttgaccgaggggaaaactgataagagcgattattctccgaaacttaaattccctgacctgaaccgcaagaccatgtatttccttgatatcggagacggcgcaacaccctttgtgaggtttgttcagcgttatgctgatgatctgaagcgcttcgagaataaaaaagccaaaaatccagtgatcctcgtccttgacaatgatacgggaccaaaggatctgctgaagcatttggtcaacaaggtcaagtcatgtccaaatgacatgggcactctaaagtcctcgggctttatccacctcttccacaacctctaccttatcctgactccgctgaacgctgggggaaaagatagcgccatggaagatctgttcgacgctgcaacaatcgggactgtgatcgacggcaaaaccttctctaccgctgatcacatcgacatttccaagcattacgggaaacacattttttccactaaggttgttaggtctaacaaggccaagatcaacttcgacaagtttaagtacatctttgacgaaattgagaaggtgaagctgcactataagaagctctga

SEQ ID NO: 8415 - RNA, 1761 nt, unidentified
  source 1..1761: mol_type = other RNA; note = synthetic construct
atgatccaccgcaggaactaccttttactccgcaaagctaaaaccaagccagagctggcttctattttgggcgtctctgctgcctttctgactcggaccctgtatcgctcaggcgtgaaatcacatgtgaactctcattaccaccagtttgacatcgccaagaaatccgggggcgtacgcaccatatccgcacccagcgacgaactcaaagacttgcagaggaaactctccgacctgctgctggattgtaaggaagttatctacctggataaaaaagtcgaatgcttgctgtctcatgggttcgagcgcgagaggagtattataaccaatgcccgaatacacagaggtaaaagaaacgtactgaatcttgacctcgctgactttttcggatcttttaatttcggtcgggtgagggggtactttattgccaaccgagagttcgagttagaccctcacattgcaactgtcatagcccagattgcctgctataaagacagtctcccacagggtagcccgtgttcccccgtcatcgccaatctgattacaaattcactcgatatcaagctgtcaaagctggctaaatccaatgggagtagctacactagatacgctgacgatatcacgttctccactcggaagaaaagcttccccgccgctattgtgaaagacgtgaaaagtataaccctgggcagcaaactgctcggagagattcggagagcagggttttccgtgaacccaaccaaaactcggctgcaatttaaggatagccgacaggaggccacaggcctggttgtgaacaagaaagtgagcgtgaaatcagagtactggaggctgactcgggctatggcccattccctttttaagacggggaagtttcagatagcggaacaggacggcagcttccgtgatggacacctgagcgagttggaaggtagattgacatttatcgactcaatcgacttctacaataatctggagaagaagaagcagcctgagagtaaattcgagcccaagatccacaccggcatcaataaatttagaggcaagctgaattctagagaaaaggtttacggcaggtttctacagtataagcattttttcgcgaatgagtaccctactattttaacagaaggaaagacagattcggtatatttaaagagtgcactcaatcaactccaggcctcctatcccaacttagtaaactttaagtcttcgaaggaggaatatagccctaagctcaagttcccagatctgaaccgtaagactatgtatctactggatattggagacggagctacctccttcctgcgtttcgttcaacgctatacagatgaccttaagtacttcgaaggtaagaaagcgaagaacccagtgatccttgtgctagataacgatgcaggaccgaaagatctacttaatcatctcgtcaaaaaggtgaagtcttgccccgacgacatcgcagtcctgaaaagcggagggtatattcacctcttccacaatctttatctgatcttgacacaattgaacgccgggggcaaggactcggcgatggaagatttgtttgatgcagaaacactttccaccgttattgatggtaagacgtttagccctgcaaaacatatcgacgtttctaaacattacggcaagcacatcttcagtaccaaggtcgtgcgagccaacaaagagaagatcaacttcgataaattcaagtacatcttcaacgagattgaaagggtgaagctccacttttcaaccctgtga

SEQ ID NO: 8416 - RNA, 1806 nt, unidentified
  source 1..1806: mol_type = other RNA; note = synthetic construct
atgtcgtacttttttgcactgaccatcgaagaatgcaaccttattcacaggagaaactacctgttactgaagcaagctaagaccaagccccagctcgctagtattttgggagtgtcagctgccttcctaactcggacactgtataagcccggcgttgagtcccatgttaattcccattaccatcagttcgatattaccaagaaaagcggaggtgtacgaactatctccgccccatctgacgagttgaaggatctgcagcgtaaactgagcgacctattgctcgactgcaaagccgtgatacatctcgataacaaaattgagtgtacactgtctcacggatttgaacgcaaaaggagtatcatcaccaatgcccgcatccatcgcaataagaaaaatgtcttgaatctggatctcgctgacttttttggctctttcaatttcggccgtgttagaggatattttatcgctaaccgggattggaagctcgacccccacattgccaccatcatcgcccagatagcctgttacaaggacacccttccacaaggcagcccctgctcccctgtaatagcaaacctaatcaccaacagtctggacattaagctgtcaaagttggccaaaagaaacgggtgttcatatacgaggtatgctgatgatataacgttcagtactcggaagaaagcctttcccaccgccattgtgaaggatgtgaagaatatcactttgggaagcaaggtgttaggcgagattagaagggcggggttcgcagtaaatcccaaaaagacaaggcttcaattcaaagactcccgccaggaagccactggactggtggtgaataagaaggtcagtgtcaagtcggagtattggagaactacacgggctatggcccactctctctttaaaacagggaaatttcaggtggccgagcagaatgggagcttccgggatgggcatctgtcagaactggaaggtaggctcaccttcatcgactcagtcgacttttacaacaaccttgaaaacaagaaccatcctgagccgaaatttgagcctaaggtccacaatggtctaaacaaattccgcggcaaactgaactccagagagatagtatacgggagatttctccagtacaagcacttctttgctaatgaatacccaactatcttaaccgagggcaaaacagacaatgtgtatctgaaaagcgcactgtcccggttgcaaaccacatatcctaagctggtgaatcctaaatccgcaaaagcgaaatacagcccgaaacttaagttcccgaatctgaatcgaaaaacgatgtacctgttagacctgggcgatggagcgaccccattcgtgaggtttgtgcagcgatacgccgatgacctgaagtattatgagtgtaagaaggcaaaaaaccccgtcattttagttctggacaacgacacgggcccaaaagaactcctcaatcacttggctaagaaggttaaatcttgcccagatgatattgcaactctcaagagttctgggttcatccacctcttccataacctgtaccttattcttacacctctgaacgcgggagggaaggattccgccatggaggacctttttgacgcagcaaccctgggtaaaaccattaacggcaagactttcagcacagctaaccacttcgatgatacaaagcactttggtaaacacgtgttcagcacaaaaatagttcgctctggcaaatctagcattaacttcgacaagttcaagtatatcttcgacgagatcgtgaaggtcaagatccacttttcaaagatcaagaattga

SEQ ID NO: 8417 - RNA, 1761 nt, unidentified
  source 1..1761: mol_type = other RNA; note = synthetic construct
atgatccatcgcaggaattacttactgctcaaacaggcgaagaccaagccagaactcgcactgattcttggcgtgcccgctgcatttctgaccaatacactctataaaccgggggtgaattctcacgtaaatagccactatcatcagtttgacataaccaaaaagtccggtggcgttaggacgattagcgccccgtccgacgagctcaaggatcttcaacgaagactgtctgacttattactggattgtaaggcagtcatccagtttgataaaaagatcgaatgcaccctgtctcatggttttgagcgagaaaagtcaatcattactaatgccagaatccacagagggaaaaaaaatgtgctcaacctggacctcgccgatttcttcgggtcattcaacttcgggcgggttaggggatacttcattgccaataaggatttcaaactgaatccccatattgctaccgtgattgcccagatagcttgctataaagataccttgccgcagggcagcccatgtagtcctgtcatcgccaatttaattaccaactcgctagacatcaaactgagcaagcttgcaaaaaagaatgggtgtagttacacaaggtacgccgacgacatcacattttccacccggaaaaagtgcttcccaattgccatcgtcaaaaacgtcgaaagcctgactctggggtcaaaacttctgggggaaatcaagcgagcagggttcagtatcaacacatccaaaacacgccttcaattcaaagatagtcgtcaagaggctaccggtttggtggtgaacaagaaagtaagtgtgaaatcagagtactggagactcactagagccatggctcacacgctgtttaagactggaaagttccagataaccgatcaggacggcagcgtcaaggacggcaacataagcgagttggaaggtaggctcaactttatcgacgccgtggacttctacaataacctggagaagaagaagcaccccgagcctaagtttgaaccaaaagcacatactggaatcaataaatttcgcggagtcctaaatagccgcgagaaggtttatggacggttcctgcaatacaagctctttttcgcgaacgaatttccaacgattcttactgagggcaaaacagacaatgtgtacctcaaatccgcattaaaccgtttgcagaacctgtatcccaacctggtgacacctaaatcagccaacattaaatattctcccaagcttaagttccccgatttgaataggaaaacaatgtactttctcgacattggtgacggagctacacctttcactcggtttgtgcagcgctatgctgatgacttgaagcactttgagaataagaaagcgcagaatcccgtaatcctggtactggataacgattctggccctaaggatctgctgaaccatctagtgaacaaggttaaatcttgccctaatgacattgccacacttaagaattccggcttcatccatttgtttcacaatctgtacctaatactgaccccactgaacgtcggcggcaaggatagcgctatggaggacttgtttgataccgccactctgggcagaaccctcaacggaaagaccttctcgactgctaaggattttgacgaaacgaagcactatggaaaacacctcttttctacaaaggttattcggtccgacaaggagaacatcaacttcaacaagttcaagtacatattcgatgaaatcgagaaggtgaaaaaccacttctccaatatctga

SEQ ID NO: 8418 - RNA, 1749 nt, unidentified
  source 1..1749: mol_type = other RNA; note = synthetic construct
atgattcacagacggaactatctgctgctgaaaaaggcccagacaaagccggagctagcttcaattttggggatccccgccgcgttccttacacgcgtggtgtacaagccaggcgtctctacacattaccaccaattcaagattccaaagaaatccggcggggctcgctccatctctgcaccatcatccgaactcaaggacatccagaggcggctatccgacttgctcctcgactgcaaggccgtaattcacgtcgataataaagtggagtgtacattatcacatggttttgagagggagagaagcatcataaccaacgccagggtgcacagcaataaaaagaacatcctcaacctcgacttggaggattttttcggtagttttaactttggaagggtgagggggtacttcatcgccaataagcactttaagctccatccacatattgcgactgtgttagcacaaatagcgtgctttgaaaataaactgccacaggggagcccctgcagtcctgctatcgcaaacctgattacaagctcactggatatcaagctgtctacacttgctaaacgctctggctgtagctacacacgttatgctgatgatattacgttcagtacccggaagtcagcttttcctgtggcaataatcaaggacgacgaaaatcttactttggggtccaagcttttaggagaaatccggcgcgccggcttctctgttaatccacgcaagactagactacaattcaaagatagcaggcaggaggccacaggcctggtggtcaataagaaagtatctgtaaagagcgagtattggcggctgacccgagctatggcacactccctgttcaaaaatggaaaatttcacatccctcagcaggatgggacccatagagacggattggtttccgagctcgaaggccgcctgacgtttattgacagtgtggactttttcaacaacctggccaataaaaaacatccggcatctaagtttgagcccagagtccatagtggcttgaatgggttccgaggcaaactgaactccagggaggtggtatacgggagattcctgcactacaagcacttcttcgcaaacgagtaccctacaatactgactgaaggtaagaccgataacgtgtatctgaagagcgccctgtcaatcttacagggtacttatcccaatcttgttaccgcaaagaccgccaccggcccctataagcctaaacttaagttccctcatttgaaccgtaaaaccatgtatctgttagacatcggggacggagccaccccctttgttcgttttgtgcaaagatacgctaatgatctgaaacagttcgaagacaaaaaagcgattaacccagtgattctcattctcgataatgacgacggacccaacgtcctgctcaaccatcttgttaacaaagttaaatcgtgtcccaatgataaggccacgctcaaaaatagcggttttattcacatattccacaatctgtacctcatcctgactcctctgaaggctggaggaaaggattctgccatggaagacctatttgacaaggccactttggctcgaaaagtgggcggcaaaacttttagtacggccgagcactttgataacgcaaagcactacggcaaacatatattctccaccaagattgtccggtcggacaagaacaatatcaacttcgataagttcaaccatcttttcgaggaagtggagaaagtcatccagcactatgaaaccctgtga

SEQ ID NO: 8419 - RNA, 1749 nt, unidentified
  source 1..1749: mol_type = other RNA; note = synthetic construct
atgattcaccggagacggtaccttttgctaaaacaggccaaaaccaaaccccagctagcctcattgttgggcgtgtccgcctcgttcttgacgcgggtcctgtataagccaggagctaacacccattaccacaaattcgatatacccaaaaagtctggtgggatcagaaaaatcagcgccccaacatcagagctcaaagacattcagcgaaagcttagtgatctcctcttggattgtaaaatggtgaatcatattgacaacgagatcgagtgtagtctttcacacgggttcgagcgagaaagatccataatcacgaatgcaagagtgcatcgcggcaagaagaatgttttaaacctcgatctggaaggttttttcgactccttcaatttcggccgcgtgagaggatatttcattgccaacagggatttcaaactcgatccacatatcgctaccgtgatagcacagattgcttgctataatgataccctgccacaagggtcaccttgctcacctgtgatcgccaatctgatcaccaatagcctggatattcgcctcgctcgcttggctcgtaaaaacggttgctcctacactcggtatgctgacgacatgaccttttctacaaggaagagcgagtttccatttggaatagtcaaggacgcgggaaatcgtatcctgggagcgaagctccttggggagattagaaggtctggtttcagcgtaaataacaagaagacccgagtccagttcaaagactctaggcaagaagtgacaggcttggttgtgaacaaaaaaattaacgtgaagagcgagtactggcggagcactagggcaatggcccacaatcagttcaagaacggcagctttgaagtcgtaggcatcaatggcgaaagccgtgtggggacgctgtcagaactggaaggccggctgacgtttatagatagtgttgactactacaacaacctgcaaaataaaaagcaccctaaacccatttttgagcctatgaaacataatgggctttaccagtttcgcgacaaattaaacagtagggaggtcgtttattctaggttcctgcactataagcactttttcgcaaacgaactgcctactattctgacagagggcaagactgataacatctatttaaagtccgccctctcgatgcttcagcccatctatcccaacctggtaaaacctaaaaccatcaacaatcaatacgagcctaagctaaagttccccaatctgaatgacaagaccatgtattttcttgacttaggggacggcgcaaccccctttctccgatttgtgaagcgctacgtggaagattataaatattacggcaaccaggaggccaagagcccggtcattctggttttagacaatgacgatgggccggagactctgctaaagcacctcgtgaagaatgtgaagtcatgtccaaacgatctcgtaactctgaaaaaatctggcttcatacatatctttcacaatctttacctcatcctgacacccctgaacgcgggtgggaaagattccatgatggaagacctgtttagcccagccacactgagtactgtcatcggaggaaagaccttctctaccgctaaaaacatcgacattactaaggaatacggaaagcacatcttcagtacaaaggtcgtgagatccaacaagtctacaatctcctttgacaagttcaagtacattttcaacgagattgagaaagttaaggcacattttacatccctgtga

SEQ ID NO: 8420 - RNA, 1764 nt, unidentified
  source 1..1764: mol_type = other RNA; note = synthetic construct
atgatcctgatccacaggcgcgactatcagctgttaaagaaagctaagaccaaaccggaactcgcctcactgctcggcatcaccgctgcatttctgacccgcgttttgtaccaccctggcgcgaatgaccactaccaccagttcgagatagataagaagagcggagggaaaaggaagatttctgcaccctccaacgagttgaaggatattcagtctaggttgtcgacccttctgcagaactgtttggatgttatcaggttcgataccgaagtgtccagagaatgcctcgtctcccatgggtttgagagagagagatctataattacgaacgccgccattcacaaagggaagcggaacatcctgaatctcgacttagacgacttttttggacaattcaatttcggtagagtgcggggttacttcatcgccaataagcatttcgaacttgacccccacatcgctactgtgatcgcccagattgcttgctatgaaaactcactaccacagggctctccctgttcacctgtaatcgccaacttgatcacagccagcttggatatgaaactcttaaatctcgccaaaagctgtggatgctcttatagtcggtatgctgatgacattaccttttctacccgcaaaaaagagttcccttcttccattgtcaaagtcctggagccactggaactgggaggaaaactaattggtgaaatccgacgtgccggattcagtgtgaacgccctgaaaacacgactacagtacaaagattccaggcaggaggcgacaggcttggtggtaaatcgtaaggttagtattaagtccgagtattggaggctagtgcgagctatggcctttcgcctgtttaaaaaaggcgaattcgaaatcctggacgtgaacggggagccacggatggggaccctgaatgagctcgagggcaggctggcgttcattgacgcaatagatcggtataataacatcgtagcaagacgtagaccgaaggctccttgggggaccatcaaacatactgggctgaacgcatttaagggacgccataacagccgggaggcggtctactcccggtttctgttctataagtacttttattcctcggaatacccaacaattctgacggagggcaaaaccgataatgtttaccttaaatctgcactttcggagttacagggcagctaccccagtctggtgagtcctaagggtcaagacaacgcttactccccaaagctcaagttccctaatctgaacaagaggaccatgtatctcctggatcttggcgacggcgcaactcccgtggctaagctcgtccaacgctacgagacggagcttgcctattttcacggaaaaaaggccactagccccgccatccttatcctggataatgacagcggtccttctgagctgctaaaggaactggccaagcccaaatacagaagttgcccaaattcagtgactgatatcaagaagagcggattcctgcacatattcgaaaacctctacctgattctcactccacttaactcagggggcaaggacagcatgatggaggatctctttgacgcaaagacattggcaacacccattaatgggaagacattctccactttaagcagctttgatactgctaagcattatggcaagcatgtctttagtacaaaagttgtgagaagctccaagtcatcaataaaattcgaccgatttcgctacatcttcgacgaaatagagaaagtgaaggctcacttcgccaaactgtga

SEQ ID NO: 8421 - RNA, 1734 nt, unidentified
  source 1..1734: mol_type = other RNA; note = synthetic construct
atgctcctgcagcacgctcggacaaaacctgacttggcactgatcctgggagtgtcagccgcctttctaacacgcgtgctgtacaggccgggggtcgattcccattatcatcaattcaacatcgtgaagaagtccgggggtactagaattataaacgcccccagtgaagaactgaaagagattcaaagaagattagctactttgctgcaggattgtctggaggtcgttcacttcgacaacaagatcagtctagagtgcacagtgtcccacggtttcgaaagaaataggtcaatcatcactaacgccagcgtccaccaggggaaaaagaaagtgctgaacctcgacctgaacgactttttcggaagcttcaactttggccgcgtcaggggatactttatctccaatcgccactttaaacttaacccacatattgctaccgttatcgcccaaatagcatgttacgacaactgcctcccacaaggatccccctgctccccagtgatcgcaaatcttatcaccaacagcctggatatgaagctctctaggttagccgaacggggcggctgttcctacagcagatacgccgacgacatcacgttcagcacccgaaaaagccatttccctaagtcaatagtcaaggcgattgaaccagtagagctgggcggcaagctgcttggggaaatccgtcgcgccggttttagcgtcaatgccagaaaaacacggctgcagtataaagatagtcgccaggagactacggggttggtagttaacaaaaaggtgtctattaagagcgaatattggcggctcacccgaacaatggctcaccgactcttcaagaagggggcatacgagattaccgaagcggacggcgaacttaggcctggcacccttaatgagctggaaggccgtctagcttttattgatagcgtggataggcataacaatgttgtagattcgagaaggccaaaacctccatatgagatagaaaagcattctgggctgctgggctttaaggcacgacacaattcccgtgaggctgtctacagtcggtttctgttctataaacacttctatgccaatgagtacccaacaattcttacggagggaaagactgacaatgtgtacctcaagagcgcgttgtctgaattacagtcttcgtaccccaagctcgttaatccgaagaccaattctaagccctataagcccaaattgaaatttcctgacctagataaacgcactatgtatttcttagatcttggagatggagctacccccttcttacggttcatcaagagatatgaggccgaaaggtcatacttccatgacaataaggctaaatctcccgtgattctgattctcgacaacgatgatggccctagtacaatcttgaagcatctggcaaaagaggtgaagtcctgccccaatagcgtagacgacatcaaaaaatcaggcttcctccacatatttcagaacctgtacctgatcctgacgcctcttaagtcaggaggtaaagatagtatgatggaggatttgttcgacacaaagactctgaataccaccattgacgggaaaacattttcaactcagagttcttttgacggctctaagcactatggtaagcatgtgtttagcaccaaggtgattcggtcgcagaagtcctccgttaactttgatgggttcaaacacatctttaacgagattgagaaagtgatagcccacttcgagaaactctga

SEQ ID NO: 8422 - RNA, 1719 nt, unidentified
  source 1..1719: mol_type = other RNA; note = synthetic construct
atgcttaaacaaatcaaaacaaaaccagagctggctgctttgttgaagatttgtccttcgtttctgaccaacaccctctacataaagaagtcaaccactaactatcatgactttgagattcccaagaagtccggtggggtgagaactatatctgcgcctcccgaagatctaaaggaaatacagaggaagctcgccgacctgctgcaggactgtaagcaggtgattcacttcgataagtcaatcaaatgctcccttagtcacggatttgaacgcgaaaagtccatcattactaatgctagtatccacaagcgcaaaaaaactgttttaaatctcgatctcgaggattttttcggcaagtttaatttcgggcgcgtcagagggttcttcatctcaaacaaagatttccgtctggatccacatattgccacggttgtcgcacaaattgcctgctacaacgacaagttacctcagggatccccttgttctccagtaattgctaatctcatcaccaattcccttgacataaagttatccaaaatggccagaaagtacggctgttcttatacaaggtacgccgacgacattacattttctacgaggaagattgagttcccaaaaagcattatcaaaaacaatgtgccgttagaactgggcggaaaactgctgggcgaaatccgtcggtcggggttttctgtcaatcctaataaaaccaggctgcaattcaaggatagcagacaggaggccaccggactcgtcatcaataaaaaggtgaatatcaagtccgagtattggagagatactcgagccatggcgcatcgcttgttcaagaagggcaaattcgacgtatacgatagcgacggaaacgtgcgcgatggcaagataagcgagctggaaggccgactggccttcattgacagcatcgattacttcaacaacgtcaacagtaagaataaggtggataaacagaaaaacggcgggctcaattcccacctggaaaaactgaatagccgggagcggatatatgctcggttcctgcactataagaacttctttgcaaatgaacaccctactatccttaccgagggcaagactgataacgtttacctgaaggcagcactgtgcaacctccagaacatctatcccaatttggtgagcaagaaaaccgacacgtcacagtacatccccctgcttcgattccccaacctgaactcaaaaaccatgtattttatggatctgggtgacggtgctactccatttctacggtttgtgcaaaggtatacagtcgatttcaattactacgagaatcagaagcccaaaagcccggtgattatgatcctagacaacgacgacgggcctaaaacattgctgaaccatcttgtcaaaaacattaagagttgcccgaatacattgcccgaattgaaaagtaagggtttcgtacacctattcaagaacctgtacataatcctgaccccactcaataccgacggatctgattcaatgatggaagatctttttgacaagaaaacactcggcacagtgttagacgggaaaaccttttctacagagaagagctttgacgagaagaaacattacggaaagcatatctttagttctaaggtggtgagaagcaataaagcaaacgttaacttcgacaagttcacgtatatctttaacgagattgagaaagttagggcccacttctccaccctcaaattttga

SEQ ID NO: 8423 - RNA, 1758 nt, unidentified
  source 1..1758: mol_type = other RNA; note = synthetic construct
atgataaggaaaaggcggtacctgctgctgaagcgagcaaccacaaagccagaactagctgatcttatgaacattgacccaagctttctgacccgggttttgtatgttgaaaagacaaagagtcactatacggagttcaagattgacaagaaaagtggaggcttcagaactattttcgcccccagtgctgagctgaaggatattcagcgatccttatcagatttgctgctcgattgcaaagatgtcattcaatttgagaagggcgttaaattcactctgtctcacgggttcgagcgagagaagagcataatcactaatgcgtccgtccaccgcaataagaagaatgtgctcaaccttgacttggaagacttcttcggatctatcaacttcggccgggttagagggtacttcatctctaacaacaactttaacctcgatccccacatcgccacggtgattgcccagattgcgtgtcataacaattcccttccgcaggggtcaccttgttcaccggtgatctctaatttaattgcccaatctctggatatcaagctaagtaagatagctaggaagaatggctgcagctatacgcgctacgcggacgacatcaccttttccacaaggaaagaaaagttctcaaagagcattgtaaaggacgtggagaatgtcaaggtcggttccgtggtcctgaaggagatcaaacgatcgggattttctgtgaatgacaaaaagacacgtgtgttgtttaaggattccagacaggaagccaccggactggtgataaataaaaaggtcagcgtcaaacgggagtattggagggagactagagcaatggcccattctctgttcaagaaggacttcttcgaaatccaggaaggtaattcaaacgctagaaagggtacactgagcgaattggaagggcgtctaaacttcatcgattccattgaccactacaataacatccatgaggagaaaaaacctgcccataagtatgagcttaaaaaacactcagggctgtacgactacaaaaacaaactcaatagtcgggagaaagtgtactcaaagttcctctactacaagtactttattagctccgagttctccaccatcctgaccgagggaaagactgacaacgtatatttaaagttggcattgagctcaatgcgcaatttgtacccaaaactcgttgaagtggacaaagagactaaactgtaccgcccactgcttaaatttcctaacctcaacagcaagacccgttattttctagatttagatggaggcgctagccactttaccagatttgtgcagcgctatgtgaaagagtgtgagtactatggcgaacggaaacctaagagccccgtgatcatgatactggacaacgatgacgggcccaagtctctgctgaaccacctggctaatcatgtcaaaagttgccccaataatatcgatagtatcaggggttctaaacatctgaggctctttaagaacctctacctcattctcactccactgggcgaatattctaaggaatcgatgatggaagacttatttgagcctaccctccttgacacaaaacttgacggcaaagcatttagtcgcaacgataagttcgatagcgacaagtattatgggaagcatgtgttctccacaaaagtagtagccaagaataaagcacaggtgaattttgacggctttaagtacatcttcgatagaatactggaggtgaacaaacactacgcctccctggataaagtttga

SEQ ID NO: 8424 - RNA, 1743 nt, unidentified
  source 1..1743: mol_type = other RNA; note = synthetic construct
atgatccacaagcggaactaccttctactcaagctagctaaaacaaagccggagctggcagccttactgaatatttcaccctcctttctcacccgagtgctgtatcacccaggggtcgaacatcactacaattctttcacaattcccaaatcaagcggcggcgccagatccattaatgcaccttcgaaagaactgaaagacatccagaaaagactggcgaatctactgttggactgcaaggatgtcattctgcgggacaacaaagtgaaatgtactttttcccacggcttcgagcgcaaaaagtccattatcacaaacgcggctcagcaccagaacaagaaggttgtgctgaatttggacctgagcgatttcttcggctccttcaactttggacgggtgcgggggtttttcattagtaaccgatatttcaagctggatccacatatcgcaactgtgattgcccagatcgcctgctttaataacagtctcccgcaaggctcaccatgctctccgattatttccaacttgatcagtaatagcctcgacatcaggctgagcacacttgcgcagaaaaatggatgtacttatacaagatacgctgatgatgtcactttttctaccagaaagccaacactgcccaccagcattttaaaagagctaaatcctgtgacactcggatcacgcctgatcaaagagatcgagtctgcaggtttcctgattaatcataagaaaacgcgggtgcaactgaaagacagcaggcaagaggctacaggactgatagtcaacaaaaaggtaaacattcgtgccgaatactggcgtgatgtgcgagccatggcccatagtcttttcaaatacgggtcttacgagatcaaggaaatgaacggcaataaacggaaaggtaccatacaggaactcgaaggccgcttgacctttatcgatcatcttgaccattataacaacattatccgcagcaaaaagccaaagcccatcttcgagcctgccaaacacttagggctgtttcacttcagaaataagctgtcttcccgcgaaaaaacctacagcatctttctgttctataaacacttctatgctaacagctatcccactatcatgacagaaggcaaaaccgacaacatctacttaaagtgtgctttgaactctctccaaaatgagtatccctctcttgcaaagaagaaatccattacgcagcagtatgagcctaagctctctttcttaaacttgaacaagaagacgatgtactttctggacatagagggaggtgcctcccactttcagaggtttgttgccaggtacgagtcagaatttaagtactttaccaatcagagcccttcagctcctgttatcatgatcttggacaacgattcgggcccaaatgccctgatcaatgacctctcaaaaaagcagagctctaatagtgtccctattagaaagcagaggtttactcatatcatccacaatctgtacctcatactcactccccttggtaatagtgaaaacacgatgatggaggacctgttcgataagaacaccctttcaataaagatagacgggaagagcttttccaagaaggataatttcgacattaagaaggagtatggaaaacacatcttcagcaccaaagtgattacccaacatagggacactatagatttccacaagttcaagtacatcttcgatgcaatagtagatgtttgctcccattttagtgggaacaaggggtga

SEQ ID NO: 8425 - RNA, 1758 nt, unidentified
  source 1..1758: mol_type = other RNA; note = synthetic construct
atgataaacctcctcccatacttcctgctgaagcaggccaaaagcaaatcggaccttgccagcgctctgggcgttaccccaagtttcttaaccaacgtcctttatcgacagaggcccgaaaacctatacacagactttgacatcaataagaagtccggagggaaacgcaccattagcgcgcctagtgatcagctgaaggacctccaacgcaggttgtcagtcctccttctgaactgcaaagacgctatccactataaccaggggactaagttcacagtgtctcacggctttgagcgagaaaaaagtattgtaagcaatgctgctgtccaccggaacaaaaaaaacgtgctcaatctggaccttatggatttctttggcacgatcaacttcggcagagttaagggcttctttgagaagaatcggagttttgcattagcaccggaggtagccctgactatcgcacagatcgcttgctaccaagggaagctgcctcagggatctccatgttctcccgtgatagctaatctgatagccaacaccttggacatgcgtctggttaagctggccaaaaaatgtggatgctcctacacacggtatgccgacgatataacctttagcacgaggaagtctgcgtttcccaaagaaatagtgaagttcaccgatgggcattcatatgagctgggcgggaagctggtgaacgagattaaacgcgcagggtttgacattaatccagacaagacacgcgttcagtaccaaaactcccgacaggacgttactggactgattgtgaacaagaaggtgaacgttaaaagtgagtattggcgcgaagtgagagccatggcccatcagcagtttaaaaaaggttccttccacatcgctgactcagacggtaagccacgtgccggcgaactgagcgagcttgaggggaagctcacatttatcgaccaagtcgataagtacaataacattcagcggaagaaacagcccaagattctgtttagcttggctcctttgaaactttcagaacacagactgacgcttaattctagggagaagacctattctaggttcctgtattacaagtacttctacgccaataactatccaactatcctgaccgagggcaagactgacaacgtgtatctgaagtgtgccctcaataggctacagaaagattaccctacgttagtggagtctacacattccaaaacaactcagtataaacctaagctcttgtttccgcatctggataaacggacttactactttttggatctagatggtggcgcaacccactttcttagatttattcagagattctccgaagagttcagctacttcgagaatcaaaaacccaagtcaccagtgatcctcgtcctggataatgatgatggacccaagactatcttgacccatctcgccggaaaagtgaagaattgccccaataccgtagatgagattagaaataagcccttcattcatatcttccacaacctatacttagtgctgacacctctcagcgggggcggaggtacagcgatggaagacctcttcacccaagatactttgcagcaggtcgtcgatggaaaagtgttctccaggaaggacaaactggacaccaataaggaatatggcaagcacatcttctcgacaaaggtggtgcgggacaaaatgcaggaagtcgattttgcaggtttcaagcctgtcttcgatgccatcttagcagtaaacgctcacttctcccgcctgagattttga

SEQ ID NO: 8426 - RNA, 1764 nt, unidentified
  source 1..1764: mol_type = other RNA; note = synthetic construct
atgagtaagaataagtctctgctgaaattgcaggaggctcagactaagcccgacctcgctaagcttctcggactgaagagccatttcctcacatacatactgtacaaaaccgacatagactctcactacaaagagtttgaagtgaaaaagaagacaggcggcgtgcgagtcatttcggcacccagccctgaactgaaggatatccaacgcagactcagtaaactcttgctggactgcaaggacgccattatggtcaagaacgacattaaaaaagagtgtatgcttagccatgggtttgagaggcacaagtccatcgccagcaacgcttatgttcacattggaaagaagaatgtgctcaacatcgatctggaggacttcttcggcacaatcaacttcggaagggtgcgggggttttttataaagaaccgcgattttcagttggacccagatgtggcgacagtccttgcccaaattgcttgtcacaataataaacttccccaggggtcaccatgctctcccgtgattgcaaatctgatcaccaactctttggacatcaagctctccaaactgtcaaaatccaagggttgcagttatagcaggtacgccgacgacatcacaatttccacgcggaaggcagaattcgacaaaagcattgtgaagttagtaaacggtgacataactttggggaaaagactggtgcaggaaatctctcggtccgggttcagcatcaatcctaagaaaacgcgcgttcagttcaaggatagtaggcaggacgccactggacttgtcgtgaacaaaaaagttagcgtgaaatcagactactggcggacagtccgtgccatggctcattcccaatttaagaagggctcatatgagacagttaataagaaaacgggtctggtgatgaaaggatctctagccgagctggggggtaagctggcatttatcgattcgattgatcggttcaacaattatctgaagaagagtcatcccaagccaatctacgagttagttcagcacaagaagtctgcaagttaccgcaatcgactgaatgggcgagaggcggtatattcaagattcacatattaccgcacattttacgcaaatgagtatccgaccattctgaccgagggtgttaccgatccaatctatctcaagagcgctctgtacggacttagacaaatgtaccctaacttagtgcgtagaaaactgctggataaaacctataagcccaaactactatttcctgagtttgactcaaggactaaatacttctgggatctggatgatggcgccggcaccttctccaagtttctggagcgctttgagtccgaatttcattacttcaagaaccagaagccaaagaacccggtaattctggtgttggacaacgatgacggcgtagggactttacttggcaagttgaccaacaaaaagtatcctaattgtcctgtgaaaaccgaggatatgagaaaccaggaattcactcacatattccacaatctctatatgatactcactccacggaaaaaaggccaggcggaatcagatatcgaggaactttttgatgagaagaccaaggctatcaagctggatggcaaatctttctccaaagaacctaaccccgaaaacgaatacggaaaaaagccatttgccctcaaggtcgtcagagccaatagggatactatcgacttcacgaattttaaacccatcttcgacaccattgaaaaggtgaaactagacttcgaaaaaaggtacagctga

SEQ ID NO: 8427 - RNA, 1815 nt, unidentified
  source 1..1815: mol_type = other RNA; note = synthetic construct
atgccagctgcccagggtagcgtgtacaaacccacatttttcttgcctatctatgtgacattcatgaaatcaactcagcaggactcgatcgactgtctgaatgagctgaaaaatgcaaagactaaatctgacttagcccacatcctcgggattacacctagcttcctgaccagagttctttacgtggaaggcacccagaatcaatacgtccagttttcaattacaaagcgcagtggagggacacgcacgattagcgctcctagtattgaactcaaagacattcaatctcggctgtctaaactgttgttggattgcaatgacgcacttaactttagagaaggacggaaaggaggcgcgagccatggatttgagcgcaaaaaatctatcatcagcaatgcggagaaacacaagaaccagaagaacgtacttaacttagatctggaggatttttttgggactgtgaacttcggaagaattaggggttacttcataaaaagcaaggatttcgcactgaactctgacgttgctaccaccattgcccatattgcatgctatgacagaaaactaccacagggctctccatgctcccccgtcattgcaaatctcatcgccaggatccttgatgtgcggctggtcaaggttgctaagaaatatggctgtacttacacacgctacgccgacgacatcacattcagcacaaggaagaaggtatttccctccagcattgtggagtctgtgaatgataaagatgtggttttggggactagtattacgagagaaatcagaaaatgcgacttcaagattaatcacaagaagacacgggtgcagtttaaggatagccgtcaggatgtgaccggcttaatcgtgaacaagaaagtcaacatcaagcgagaatactggcgtgacgctcggagcaagtgtcacaaactgttcacagacggagagttttttaccaaaaactccaatggcgataaagtagttgggaaaatcaaggaattggagggcaccctcacttttattgattccgtcgacgagtacaataacaaacggccgaagggctatgagaagccagttttccagaaaattcacaagcagaagcattaccgaatacgactcaacgtcagggaaaggacctattcagagttcctatattacaagtggttttgcgcgaatgaaaccccaacgattttgaccgagggtaagaccgatgtcgtatacctcaaggctgcactgagtcagctggccagcgattaccctatgctcgccaagtcagaaccatataagcctcagatcaatttctttggatgttctgggaagacaaattatttactgaatctggacggcggtgccgctcattttatagactttgtgaactcctatgagctcaatgcctccatgtacaagaacataaagaagacgtcccctgtgatcatgatactggataatgataccggtcccgtgaacctgcttaaccaacttaaagggaaatacggactcccccaaactgttgacgagatcaggaagagtaatttcctccacatcaagtcgaacctgtatctgatactaactcccctgaatgggtcctcaaagaccgacatggaagacatgttcgaggatcacgtgctgaacgccgaagtcaaaggcaagaagtttaataagtccaacaacatcaacactagtaaagagtatggtaagcatatattctcactgaaggtggtccaagctcgcaaaagtaaaatctccttctcaggcttctgtccgatcttcgatgccattaacaatgtgatcaaccactacgacaaaatgaagtcctga

SEQ ID NO: 8428 - RNA, 1794 nt, unidentified
  source 1..1794: mol_type = other RNA; note = synthetic construct
atgcgcaagggtgttccagcctactccaatctttcagaaatcatctacatgaggaacaatatgtccagcttgaacaaattaaagtctgcccgaaataaagtagagctggcaaaggtgcttggagtgagccccgtgtttatcaccaacatattgtacatcatcaagaaggagaatcagtatacaacctttaccattaagaagaagtcaggcggggacagagtcattagtgcccctaatgactccctgaagaacttgcagcagaagctgtctgacgtgttgctcaattgccttgaccaaattcggaaagacgagaacatctctactaatataagccatggattcgaacgcaagaaaagcataattacaaacgcgatgaaacacatcaagaagaaaaatgtgctgaatctggatctcgaagacttttttgattgtttcaactttgggagagtcaggggctttttcatcaaaaataaccgattctcgctgaatgaggaggtagctacagttatcgctcaaattgcctgcttcgataacaaactgccccaggggagtccgtgttctccagttatcacaaatttaatatgcagctccctggacatcaagttgaataaactcgcaaagaaaaacaagtgcacttacactcggtatgccgatgacattacctttagtactaacaagcaatcgtttgacacagagatcgtgtccagcaaatcgacattttcagacatcattattggtaacgagcttgataaagaaatcaaaaagagtgggttcaagattaactccaggaaaactaggcttcagaccaaaaacagtagacaggatgtgaccggcctagtggtcaataagaaaatcaacacaaaggtagagtactctaaaagcgtccgggcaatgtgtaacactctgtttaaaaccggatcctatacactgattgatcgcaaaacgcacgaagaacggaatggaacggtgaatgagctcggcggtatgttgtcatttattgactacattgaccgttacaacaacatcatctacaagaagtcaatagatcgccccataaataataaggtcaagatcgagaagaagctcaacaaacgcgagcgagtgtattccgacttcatctatttcaacaagttccataacaacgatttccctactattattactgagggtcacaccgatcagattcacatcaagtgtgctttaacctcactgaatgggaactataataacctgattgagaaccatgacaaaaactatcacctgaagtttagattcctcaaactgtcaaacaaactcaaatggctactgaatatatccgagggaaccgatcctatcaagaagttcattagcaattacatctgcaactatcgtaaatatccttgcttcaaggctaaaaagcccgtgatcattatacttgacaatgactctggcagcaaaggctctggcgggatactgagcatcctgaccaatggaagtttttctaacattacggaagataggaatagtctgagacggaagaactacattcatgtgtacgaaaacctctacattattttcaccccaatgattagcgataaagattcttgtatcgaagacctatacgacaaggaaatactcgaaacgaagttaaatggcaagaagttcaagaattctaacatcgacctgaaagttgatgagtattccaagaatcacttcgccaaatatgtcatacagaataacatcgagaacatcaacttttccaatttcaaaagcatcctcaatacaatcgatgaaatcattaggatctaccagtga

SEQ ID NO: 8429 - RNA, 1728 nt, unidentified
  source 1..1728: mol_type = other RNA; note = synthetic construct
atgagctccctgacgaagctgaagtccgctaagaataaagtcgaattggctgctgttctaggcgtgtctcccgtattccttaccaagactttgtacaagataaaggtggagaatctctacacctcctttaccatcaaaaaaaaatccgggggcgatagggaaattttagcccccgacgactccctgaaagaccttcagcagagactcagtaacattctgctcaattgtctcgacgacatccggaaaaatgaatccacgagcaccaatatctcacatggattcgagcgaaagaagagtattataactaatgccctcaagcacactaagagaaaaatagtgttaaacctggacctagagaactttttcgattgtttcaactttggacgggtgcgcggctttttcattaaaaatgacaggttcctgctgaatgaagaagttgccaccgttattgcccagatttcttgtgtgtataataagctgcctcaagggtcgccttgttcaccagtgatcactaatctgatctgctcaagtttggacataaaactgaacaagatcgcacgcaaaaataaatgcacctacacccggtacgccgatgacatcacattcagcacttctaagatctcttttggtaatgaaatcgtttcccccaatagtacgaataaagacattgtgctgggtaaaaagctgaagaaggagattatcaaatcagggttcacaatcaactacaagaagatcaggattcaaaacaagaattcacgccaggatgtaacaggcctagtggtcaacaataaggtgaacaccaagatagaatatcacaaaaacgtaagagcaatgtgtcacaacctgtttaaaacaggcaactttaacctgatcgatagagagactaaaaaagaacgtattggaaccatagatgaattagagggcatgttgtcgtttattgacaacatcgacaaacacaacaacatcatctacaagaaaaacatcaagaccaacagcaagaagagcaaacttgagaagaatctcaataaaagagagcgagtctattcagatttcatttacttcaggaagttccactctaatgaactgcccacaatcattaccgaagggcatactgaccagattcacattaaatgcgccctcacttcactctactccgactttcctaacttgatcgagatgaagaatgaaaactaccatctgaaattcaacttccttaaactatccaagaagaataagtggctgctgggaatgggagagggcacagatccaatcaggtttttcattagcaactacatcaagaactacaataagtatccgtgctttaaagcaaagaaacctgtcatcatcctgcttgataatgacagcgggtctaaaggctctggcggaatcttatctctgttaacacaagggacctttagtaacataaaagagaatcgtaacgagctccgcaaaaagaagtatattcatgtgtacgagaacctgtatgtgatatttacaccactcatcaagggtaatgatagctgcattgaagatctttatgatcggaaaacacttgagaaaaagctcaacggtaagaagtttaagaatagcaacctcaatctgaagccagacgagtatagtaaaaaccatttcgcgaaatatgtcatccaggataacatcgagaacataaacttcgacaatttcaagcagattctggagagcttggataagattatattggagtattga

SEQ ID NO: 8430 - RNA, 1746 nt, unidentified
  source 1..1746: mol_type = other RNA; note = synthetic construct
atgaaaagtcgcagtttggatcttctgagacagactaacaacaaggtggacctcgctaagctcctgggagtgtcgccagtattccttacgaatactctgtaccgtatcaaggttgagactctgtataatcagatcaagatccctaaaaagacgggaggcataaggtacatctattcccctgattcccgcttgaaagagattcagaggaaccttagcaacctcttattaaactgcctagatgagattcgggctgaaaacaaaactaaagcaatcatttcccatgggtttgagcgcgagaagaatattatcactaacgccaagaagcatatcaataagaatattgtcctgaacctcgatctagaaagctttttcgactctttcaattttggccgggtccgggggtttttcatcaagaacaaatacttcctgctgaatgacgaggtcgcgaccgtaatcgctcaaatatcatgccttaatatccaaattggggaacgtaaaatcagcatcctcccccaaggttcaccgtgtagtcctgttatcaccaatctgatatcttcctccatggatattaaactgaatagtctggccaaaagaaatcgatgtacatacacaagatacgccgacgacattaccatctctacaaatctgatgtctttcgggaaacagattgtcaaagacgtggacgagaacaataacgtctctctgggaaataagctgatatcttacatcgaaaagagcggatttgtgatcaatgataagaagacaaggatccagtacaaaaatagtcggcaggatgtgaccggtcttttggttaacaagaaaattaacccatcacgcaaatattcagacattttaaggagcatgtgcaattcactctttaacagtggggaattcgaactgattgacaaggaaaagaaaaaacgcaaaggcacaataaatgaattggagggtaagctttcatttgtggaccagattgataggttcaataacaaagatatcctctctaaaggaggggtgctgttgaaaaatagacgagagaacctatattccaagttcatctacttcaagaagttcatctttaacgacgaagtcaccgtgataactgagggccacacagatcacatttatattagaagcgccgccatctctcggaaggataaatttaatgacctgatcaaggaggacaataagaaaatcaagctgaacttttccttcctcaagatcaacaataagattgagtatctgctggacgtgcgcgaaggcaccagctccattaagaagtttatcgagaggtttcctgagaactactcaaagtataacattggcaaacccaaaaaacccgttataattatcctggataacgattccggtagttccgggtccggcggaatatttcagttgctcatctcggacaagttcaagaacattactaatgataaggacgaaatccgtaacgtggaatttattcacgtgttcggcaacttgtacatcattttcaccccactgaaagatggaaaagacacaagcatggaggacctttttagcgatgagatcttaaacaagaagatgaacgagaagaagttcaatagaacgaacaagaagtgtaaaaacgacgagttcggcaaagattattttgcacggttcgtgatcaaacccaacgtaaaaaccatagactttagcaaattcgacaccatattcaatcgaataaagctcgttattagcgattacgaaaagaaggagatttga

SEQ ID NO: 8431 - RNA, 1758 nt, unidentified
  source 1..1758: mol_type = other RNA; note = synthetic construct
atgactagccccttgattaagcttaagtcgtgcaagagtaaaccagatttggcccaccttttgagactggatcctgtttttctgactagggtagtttatatccggaacacagacaatttgtacacggattttagcattaagaagaaaaacggaaccaatcgaatcataagcgccccagactcagaactgaaagaaattcagtccaaactgtctaaattgctgcaagactgcttggatgacatacgcgagtctctgaaactgaacaatacaatttctcacggctttgaacgcaagaagtccatcattactaatgccgagaaacataaacgtagaaagtggatcttgaacctcgacctgtctaacttttttgacgaattcaatttcggcagagttcgcggctacttcctgaagaataaaaacttcagccttgacgagacaatttgcaacctgatcgctaagattgcatgttataagaatcggctcccccagggatcaccttgctcaccagtcattaccaacttaatattactgtcactggaccagcgactgaataagatctgtaaatctgtcggttgtacatacacaagatacgctgatgatatcacaatctctacgaacaaatcgttcttcccgactaaaatagtgacaagttacgacaacgagagtatcgtcctcaacaaaaaattcctgaaggagatcacatcatctggcttctcccttaatgaagataagattaggctgcacaataagacctatcggcaggaagttaccgggctcaccgtgaatcaattcgtgaatgtgaatgcaaagtacgccaggaaggtccgcgccatgacccattctctgttcataaacgggatttttcatttagtggacaagaagactcgtgagatccgagcgggaaccattaacgaattagctgggatgctaggctttatcgactcccttgacaaacacaataataagaacattcgcgataggaccttgcagtatagcaataaggataagaagctagagcacaacaagagggaaaaactctatgccaattttctctactacaaagctttttacgctaataccaggcctatgataattactgagggtaaaaccgacatcacgtacctgcgggtagccctgaacagcctggcaggcagttatccctccctcattgagaaaaagctcgtcggttcagacagcatttgtgattacaaactcacctttttcaagaattccggcaaaacaaagtattttctgaatctggacggcgggacaggacatctaaaagatttcctgagcaaattcgacaagaaatccaaacagtataagggcaacgaaaacatgaatccagtgattatgatcctcgataacgactcaggatctgatggctccggggggatttttagtatcctcaatggtaagagcttccccaatataaccagtagcaaggatgaacttagaaacaaagagtggttatgggtgatccagaacctgtatatcatctttactcctctgaacggagcgaaggattcctccatggaagacctttttgacaaagagacgcttgatataaaactcgggaacaaggtatttaacaagaccaacaagccgtgcactgagaaccagtatggtaaggaggcattcgccactggagtggtgctgaaacaacgggagaacatcgatttcagtggattctccctaatcttcaatagcatcgtgaagatcattgagcactacaacagcatcaagcagatgaattga

SEQ ID NO: 8432 - RNA, 1737 nt, unidentified
  source 1..1737: mol_type = other RNA; note = synthetic construct
atgccaactcgcctggaaaaactaaagaaatgtacgtctaaacccgactttgccagactgcttggggttgatcctgtgtttcttacacgtgtcgtatacatccgcaatactgaaaagctctacacagagttcaagataaaaaagaagaacggggatgaccgaattattagtgcaccagacaaagagctgaaagagattcaaagtaaactaagcaaactgctgctggactgcttagataacatcagaagttccctggagatcgacaacaattttagccacggcttcgagaggaagaagagtattatttcaaatgccgaaaagcataagaggaagaagtggatactcaatattgacctgaagaactttttcgatgagttcaattacggtagagtgagggggtacttcttaaagaataactacttctcccttaacgaaaacatttgcaatttgatcgcaaagatcgcgtgctacaaaaataagctcccgcaggggagtccatgttcccctgtgattacaaaccttatcttactcagtttagaccgacgtctcaaccagatctgtaaaaatagcggctgcacatatacccggtatgcagatgacattaccatatcaaccaacaaaagcattttccccaagaaaatcataagctcctatgaggagaattctatcacactcggtaagaaattcatcaacgagattatcagctccggatttaccttgaatgagaaaaagattcggcttcatgatacaacacacaggcaagaggtaacgggcctgaccgttaaccagttcgtgaatgtggagaataagtatgctcgcaaggtcagagccatggtacactcgctgttcaccaagggagaattttacctgatcgataaagttacgcaggaggcgaggttagggaccgtgaacgagctaacaggcatgctgggatttatcgactccctcgataagtacaacaacaagatcctcaagaataccataaagcagtcaaacttcaatatcgagctgaataagcgggaaaagatctatgccaacttcttgtacttcaagtctttctactttaacgctaaacctgtgcttttgactgagggcaaaactgacatcacgtatctgcgggtggcactcgacagcctggcctataaatatcccgacctgatcggatataaagaaaacggccggaacaaaataagggactacaagctaacttttttcaagaattctccaaagaccaagtatcttctgaatctggacggcggctctagccatctgaaggaatttctcaacaacttcgagaagaaggcccgaatatacaagactagcggtgagattaaccccgtcattatcatattggataacgattctggttccggggggaacaatggaatctttgagagtctgatgaacaaattgcgcggaaaaatttcatcgaaagaagaactgagaagcaaaaaatggatttgggtgacccagaatctttacattatctttactccgctgaatgggaaaaaggagtccagcatggaagatctgtttgataaagacaccctcaacattaagttgggaggcaaagtctttaatcgcactaattctaagtgtaccgctgaacagtacggtaaggaagtttttgccaatggagtggtcctcaaaaaacggaagtctattaatttctcaggcttttcacctatcttcgatgctatctcagaaatcataacatatcacaactcctccaaatga

SEQ ID NO: 8433 - RNA, 1722 nt, unidentified
  source 1..1722: mol_type = other RNA; note = synthetic construct
atggccactcggttggagaaactgaaagagtgctactccaagcccgattttagtagacttttgggagtagaccccgttttcctgaccagagtcatctatattcgcaatacagacaagctgtactcggaattcacaattaagaagaagaatgggagtgatagagtcatatccagtcccgactcagagttaaaggaaatccagagcaaactaagtaacctcttgcaggattgtcttgagaatattcgggagagcctgaaactggaaaacaatttgtcccacggctttgaaagaaagcgtagcatcatatctaacgcggaaaagcacaaacagaaaaaacgcgtgcttaacctagacctctccaacttcttcgatgaatttaactttgggcgcgtcagggggtatttcttgaaaaacaaccagttcctgctcaacgagtccatctgcaacctgattgcgaaaatcgcttgttataacaacaagctgccacaaggttctccctgtagcccagtcataaccaacttaatcctcctgagtctggaccaacgcctcaacaagatttgtcgtaatgctggatgcacttacaccagatacgccgacgacatcaccatatcaacgaacaaatccattttcccaaagaacatcattacttctcacgaggacgatttagtgacccttaacaaacggttcatcaagaagattacaagcagcggcttttcattgaatgaaagaaagattcggctgctggacaccaaatgcaaacaggaggtgacagggttaacggtaaataaattcgttaacgtggacgacaagtatgcccgaaaggtgcgcgcaatggcccataggctgtttattgacggagaattccacctgatcgataaaaagactcataaaaagagggtaggcaagatcaatgagctggcagggatgctcggatttatcgattcgctggataagcataacaatacatttccgcacaataagaagctgtcactcaataaacgagagaggatttactccaagttcatttactatacagccttttgcgctaacaccattccaacaatactaactgagggcaaaacggatattacttacctcagggttgctctgaatagcctcgccgacaaatatccgaacctcatcggtgataaaaaggtggcaaacgaaactgtgagggactacaaggtgaaattctttaagaatagcgccaagacaaaatactttttgcatctagatgggggtagctcacacctcaaggagttcctggtttcttttgacaaaaaaaccgacggctacaagacggttcggaatagtaatcctgtcataatgattcttgacaacgattctggttctaccgggggaaatggcatcttccaggctctgatcggcaaatctttccctaatataacaatgagccgagatgaacttcggagccagaaatggatctgggccgtgaagaatctgtatatcgtctttacccctctcaacggaagtaaagattcctccatggaggatcttttcgacgtgcctaccttacaaactaaactggaaggaaaggtgttcaatagaaccaatgagaagtgtgctgagaatgaatatggcaaggaggcattcgcaacaggcgtggtcctgaggcagcgcaagtcaatcgacttttccaagttttcatctatctttgactccataatcgagattatcgatcatcacaaggataaggaatga

SEQ ID NO: 8434 - RNA, 1725 nt, unidentified
  source 1..1725: mol_type = other RNA; note = synthetic construct
atgacaacacgcctcgagaaactgaaagcatgcaacagcaaacccgatttcgcacggttgttgggcatcgatcccgtctttatgacacgtgtcatctacattaggaatacggacaacctctatagccagttcgccattaagaagaaaaacggatcagatagaatcatatccgcccccgattctgaactcaaggagatccagtcaaagctttctgacctactccaagactgtctcaacaattttagggagaatctgaaggaagataaccacttttcacatgggttcgagagaaacagaagcattataaccaatgctgaaaaacacaagtcaaagaaatgggtgctgaatatcgacctgtgcaacttcttcgacgagtttaattttgggcgcgttagggggtattttttgaagaacaacaacttttccctgaacaccgaacttagtacactcatagccaagatagcatgtcaccaagacaagctcccacagggttctccgtgttccccagtgatcaccaatttaattctggtgtccctggatagaaggcttagcaacctttgcaattcagtgggttgtacgtacactcgctacgccgacgacattaccatttccaccaataaaaaggagtttcccaaaggtatcatccgggatcatgacgagaagagtatcaccctgaacaacaaattcctgaatgagatcacctcatctggattcaagattaatcataacaagctgcgtctgctggataaaaagatacggcaggaagtcacagggttgactgttaatagatttgtgaacgtcgatagaaggtatgctaagactgtaagagcgatggcccatagcctgttcaaaaaaggcgaatatactctgattgacaagaagacccggaaggaacgggttgggaatatcaatgagctaggtggcatgctgtctttcatcgacttcgtcgataagtacaataatcggttaccacatagcataaagtcgtcccacaataaccgagagaaagtatactcggattttctgtactattccgctttttgggccaacaccaagccaacaatcctgactgaaggcaagaccgatattacctatcttagggtggctttggacgctgtgagtgaaaagcaccctaatttgattgggaacaagaatcctggaaacaaaacagttcgagattacggcattaagttcttcaagaacactagtaagacaaagtaccttctcaacctggatggcggagccccccacctgaaagactttatagtgggctttgagaagaaaaccgaggcattcaaagttatcgcgaatcagaaacctgtcatcgtgattctggacaatgacagcggttccgctggagccaatggaatcttccaaatcctcatcggaaaatcttttccgaacattactttaacccgcgatgagttacgcaaccagaaatggacttgggtgacacgaaacctatacattatattcacgcctctaaacggcttgaaagatagtagcatggaggacctctttcacagtagcgtcctgcagacaaccctcgggggcaaagtgtttaaccgtacgaatacaaagtgcaaagacaatgaatatggcaaagagttcttcgcaactggagtggtacttaaaaagaggaagactattgacttctccaacttcaactacatttttgaaagcatctctgagatcatcgaacacaataattcccgcaaaaagtga

SEQ ID NO: 8435 - RNA, 1725 nt, unidentified
  source 1..1725: mol_type = other RNA; note = synthetic construct
atgacaacccgcctggataagctgaaatcttgcaatagtaagcccgatctggcccgtctactcgggatagatcctgtgtttatgacccgcgtgatatacattcggaacacagacaatctctactcacaattcaccatcaagaagaaaaatggatccgatcggcatattagtcctccggatccagaactgaaagagattcagtccaaattaagcgatcttctccaggattgtctcaataatattcgggagaattccaaggaggagaataatttttcccatgggttcgaacgcaacaggtcaataataactaatgcggaaaagcacaagtctaagaaatgggtgctaaatattgacctgtccaacttttttgacgagtttaatttcggccgggtgcggggatacttcctcaaaaacaaaaacttctccttgaatactgagctatcaacacttatcgctaagatcgcctgtcatcaggacaagctcccgcagggcagtccatgctcacccgtgataacaaatctgatcttgctcagtctggacagacgactctctaacttgtgcaaccgtgctgggtgtacatataccaggtacgccgatgacatcaccatctcgactaacaagaaggagtttcctcgtaaaatcatcaagtcacacaacgagaactctattgacctgaacaaaaagtttctgaaggagatcatctccagcggcttccagataaacctgaacaagctgaggctgttcgatagaaaatgcaggcaggaagttaccggattgacggtaaaccggttcgtcaatgtcgataataagtatgcgaagaaagtgcgcgctatggcccacagcctatttaccaagggaggctacactctgacagacgaaaaaaccagagaacaaagggcaggaaacatcaacgagctgggtggcatgcttagcttcattgactatgtcgacaagcataataatcgcctgcctcatgccactaaaacctctctcaataaaagagagaacgtgtacagcgattttctgtattatagcgccttctgggccaacccaaagcccacgatcctgacagaaggcaaaaccgacatcacgtatttacgcgttgcactggacagcttgtctgcaaattaccctaatcttattgggaacaagaaaatcggcaacaaaattgtgagggattacggtgtgaagtttttcaagaataccaccaagagcaagtattttctgaacttggacggcggggcttcgcacttaaaagatttcatagtcggatacgaaaagaaaacgaacgcattcaaggcaatcgctgaacaaaaacccgttattattgtactggacaacgactctggcagtggaggttccaatggcatctttcagactctcatcggaaaggcctttcccaatatcactctgtccaaggatgaacttagaaaccagaaatggacatgggtcacaaagaacctctaccttattttcacaccattaaatgggctgaatgactcatccatggaagaccttttccacagttcagtgctgcagacaaagttaggtgggaaagtatttaaccgaactaatgctaagtgtaaggacaacgagtatgggaaagagtttttcgcgactggtgttgtgttgaaacaacgaaaagccatcaactttagcaacttcaactacattttcgagagcattaccgagattatcgatcacaatgcctctagaaaaccatga

SEQ ID NO: 8436 - RNA, 1731 nt, unidentified
  source 1..1731: mol_type = other RNA; note = synthetic construct
atgaccacgcctctggataagttaaactcctgcaacagcaaacccgactttgcaagactcctcggtatagacccagtatttctgactagagtggtatacatacgcaacactgacaatctgtactcacagttcacgattaaaaagaagaacggaagtgacaggttcatttctgctccagatgacgagctaaaagagatacagagaaaactgtcgaacctgttgcaagattgtctgagtaatattagggagtccctcaaagtggagaataattattctcatggattcgagcggaataagaacataattacaaatgcggagaagcacaaaaacaagaagtgggtcctgaacttagatctgtccaacttctttgatgatttcaacttcgggagagttaggggatacttcctgaagaataacaacttcagcttaaacgctgagatttcaactttgatagccaagattgcttgccacaacaataagttaccccagggtagtccatgttctccagttattacgaatctgatcctttttagtctggatcggcgtctgtcccggatctgccaacaggtgggatgtacttatacacgctacgccgatgacatcacaatttcaaccaacaagagcaccttcccgcgcaatattattaagtccctcgaaaacgaaaagatcaatctgaatcgtaagttcctgaaggagatcacaagcagtggcttttctttaaaccctgagaagatcaggctccatgaccggaagtgcaggcaagaagtaaccggacttaccgtcaaccagtttgtgaacgtggacaacaagtatgccaaaaaggtccgatcaatggtacatcacctgtttacacagggcgaataccagctcgtcgataagaaaaccggcgaaaagcgtaacggaaaaatcaatgagcttgccggcatgctagggttcatcgacagtctggataaatataacaatagcctgagccacgagcgcaatgcaacacttaataaacgagaaaggttgtacggcgagtttaaatactacactaccttttgggcgaatactatcccggtcatcctgacagaggggaaaaccgatataacctatctcaaggtggccctctccagcttggctgcaaaatatcccaatctgatcggagaaaaaaaactttctaacaaggtggttcacgattacaaaatcaagttcttccgaaacactgccaaaaacaagtattttctagacttggacggcggcacctcacacttgaagaacttcatgatgaagtacaataagaagacagacgcttttaaactggtggcaactcagcagcctgtgattattgtgctcgataatgatagcgggagcactggtagtgacggcatctttaacgcccttgtcggtaaatcctttcctaacatcacggactctatggtgaccctccgcaataagaaatgggtttgggtgaccaaaaacctctacatcattttcacaccccttaatggcaaatctgactccgccatggaagacctgtttgaagatagcgtgttgcagagacaactgggggggaaggttttcaatcggacaaacaagagatgtgaagccaatgagtatggcaaagaggcgtttgcaaccgggatagtcctaaaacagcgggacaatatcaatttctccaagttcagctcgatttttgactccgtgatggaaatcatccaacaccatgctcatcagaagtcatcatcttga

SEQ ID NO: 8437 - RNA, 1743 nt, unidentified
  source 1..1743: mol_type = other RNA; note = synthetic construct
atgactactcgtttaaagaagctgcagaattgtaagagcaagccagattttgcacggctgctcggaattaagccggtcttcctcaccagggtcgtctatataaggaatactgagaagctctacaccgacttcaaaattaacaagaagaacggcgacaaacggataatcagttctcctgatccggaattaaaggaaatccaatcacgcctgtccacgcttctccaggactgtttaaccgatatccgggattcccacgaagtgattaataatttgagccatggctttgagagagaacggagcattataacaaacgctgaaaaacataagcgcaagaagtgggtgctgaacctggatctctccaactttttcgacgagtttaactttggcagggtgagaggctatttcattaaaaacagcaacttcaagctcaatgaggaggtgtccaatattattagtaagatcgcttgctacaacaatagattgcctcagggaagcccctgtagtcctgtaattacaaacctaatcctgcatagtttggatcagagactgaaccttatatgcaaaaaggtgggctgcacctatacaagatatgcggatgatattaccatcagcaccaataagtctgagttccccaaaaagatcattgcatcctgtgagtcaaatattgtaaacctgaaccagattttcctgaaggagatcactaagtctggattttcccttaattttagcaaggtccggttacttggtaaaaattgccgccaagaggtgaccggactgactgtgaataagatcgtcaacgtttcagacaaatatacgcggaatgtacgcgcaatggccaataacctctttaaaaatggggaattctacctttttgacaaacagacaaatcagaaacgcctggggtcaatcaacgagctaacagggattttcgggtttatcgactctctggataaacacaacaacaaaatcagccataagaatcaaggttcacttaataaaagggagcgtttgtacagtgattttctctactacaaatccttctgcgccaatgaaaaacctatgatactcacagagggcaagacagatattacctacctgaaggttgccctggacagtttggctaaagactatccaacactgattggagacaaggaagaaagaatgagttacgttcgagattacaaaatatccttcttcaagaactcgatcaaatccaagtatctgctgaagctcgacgggggaactccccacctgaaagacttccttgtgaattacgacaagaaaagtagcaaatactcaaagagcaagaatgagaaaccagtgatcatgatcttagataacgactcaggcagcaacggcgggggcggaatctttcagtgtctgctagggaagtcgtttcccaatatcaccatcgactcaaaaaagtctttgcgagatgaaaagtggatctgggtcaccaagaacctctatatcatttttactccactgaatggcaaacaggagtctagcatggaggacttctttgatgaatctgttctaaagaggacgttgtctaagaagactttcaacaggtccaacaacaaatgcaaagacaacgaatatggtaaagaggccttcgccaaaggtgttgtgctgaaacgacgtaagaagatcaacttcaccaagttttctatcatcttcgactccataaacgagataattaatcaccacgaatctgtgaacaatctgaaaaccattgcttga

SEQ ID NO: 8438 - RNA, 1719 nt, unidentified
  source 1..1719: mol_type = other RNA; note = synthetic construct
atgacaactcagctcgctcggttaaagttgtgctttagcaaacctgactttgctcgcctgcttgaactggatccagtatttctcacacgcgtcgtctatatgagggatacagaaaaactctacaccgactttaccatcttgaaaaaaaacaagacccagcgggtgatctcagcccctgacgaagagctcaaagagatccaacggaagatcagcgacctgctactagattgcctgactaccatcagaaacgaaaacaagagcaataacaaattgtcccatggatttgagctgggaaagaatattatcactaatgcggagaggcacaaatcaaagaagtgggttctgaatatcgacctgctaaactttttcgatcagtttaactatgggcgggtgtccggctatttcatcaagaacaagtttttcgagttgcacagtaatattgccaacctcattgccaagatagcatgttacaagaataagttaccacagggaagtccctgttcccctgttatctcgaatctcatattgcagtcgctcgaccaacgactgaacaacatttgtaaaaaaaacgggtgcacttactctaggtatgcggatgatatcactattagcacgaacaaaaagaagttccctaaagcaattgtatctaaccatagtgacaaggaaatcaatctgaataacgggttcattaaggagatactaagggctggttttagtatcaataatgacaagactcggctgcgttttaataccctccgacaggaggttacggggcttacagtgaactctaaaattagcgtggacgataaatattcccgcagggtgagatccatggtgcacaaattattcctttcaggagaatacacgctgatcgataagaagacccgcgaaccgcgttttggcacaatcaatgagatccaaggtatgttaggattcgtggactccatagacaagtacaataacaatctcccaaataactctaagcatacccctaataaaagagagcggcttctggccgatttcatttactttacccgattccactttaacaccaaacccaccataattaccgagggcaaaacggatattacctatttgagagtagccctcaatgccctttgcaaaaagtatcccagcctgatcgagaagaaaaaatcatacaagggcgagattaatgactacaagttctcattcttcatcaagaatgccaagactaaatttctgctgaaactggaggatggcagtagtcacatcaagaacttcattaaggactacgacagaaacattgaaaaatataaggctgatggcggcgtcaatcccgtgataataattctggacaatgattccgggagcacaggttctggaggcatcttttcactgctgctctctaacgtgtttcccaacattaaactctcccgcgaagacataaggaaggtcgactggctgtgggtcactaagaacttgtatgttatattcacaccgcttaaagatggtcaggacagctctcttgaggacctgtttgatacaaaaaccttagcaactacactgaacggcaaggtgttcaacaatacaaacaaggactgtaaaccaaatgagtacgggaaggaatacttcgcaaaacatgtcgtgctgaagaacaaggataccattgacttcaagaacttcatcaaaatcttcgatagcatcgaggaaattatcaagcaccattccaagaaatga

SEQ ID NO: 8439 - RNA, 1716 nt, unidentified
  source 1..1716: mol_type = other RNA; note = synthetic construct
atgagtactaaaatagaactgctcaaacagtgtacaaccaagccagatttcgctcgactcctcggtcttgaccccgtattcttaacccgcatagtttataggaaagacacagaaaacctttactcaaactttaccatcctcaagaaggacatgtctgaacgacacatctcatccccagattctaagcttaaggagatccagagaaaggtcgccgatctgctgctaaattgcatagaggatattcgagtgctcacggaatcaaagaatctgctgtcacacggatttgagaaacaacgcagcattattacaaatgcagaacgccataaaagaaagaaatgggttctgaacattgatttgtctaacttctttgaccagttcaattatggaagggtcagagggtattttatcaaaaacacacacttcgcgttagatgagaacattgcaaacatgatcgctaaaatcgcctgttatcagaacaagttaccgcaggggtccccttgcagccctgtaataaccaacctgatactgtcttccctggaccagcggctgaacaaaatctgcaagaatagcggttgctcctatagtcgctacgctgatgacatcacgattagcactaataaaaagacctttcccagcgaaatcgtgaagagctatgatgccgagcacgttgaattaaataagaacttcacgaaggagatcatgagggcaggcttttcattgaatgataagaagactcggcttcagggaagaactcaacgtcaggaggtgacagggctgacagtcaactataacctatctacagacgtgaattacagcaaaaaagtgcgggctatggtgcatcacctgtttatggatgggaactacactctcatagacaaaaaaacaagaaagccaaggaacgggaccatcaacgaggttgagggcatgttgggtttcatcgacagcattgacaagtataacaacaaactggcgtacagagcaaaaggcggcttgaataaaagggagaagctgtatgccaatttcatctattaccggtcttttcatagtaatgaaaaggttacgatcctgactgaaggcaaaaccgacgtaacctacctgaaggtcgccctgcatatgcttaaaggaaaatatcccactctgatcagctccaaaaccgtctctcacaagaccgtgaacgactacaagctctccttcttcaaaaacaacaataagtcgaactacttcctggggctgggcgagggcagttcccatttcaagaattttgtgaagaagtaccaaggcaagatttccgagtttaaggctgtcggtggaaggaagcctgtgattatcatttcagacaatgatagtggcgcaaatgaattgatcagtctcctcaacggtaaaggctttcctcatatcacctccgacaagaatgagctccggaagaacaagtggctgtggatcactgaaaatctatacatcattctgaccccctttgatggaaaaacagatacctcaattgaggacctattcgatacaaaaactctttctcgttccctgaatgggaaaacattcaatcgcaccaataaagagtgtgccttgaatgaatttggaaaggagtactttgccaaacacgtgattttgaaggaccgggacctcattgacttcaacatgttcagttacatattcgatgccatccttgaaattattaaggagcacgatagcaaggtgtcgtga

SEQ ID NO: 8440 - RNA, 1941 nt, unidentified
  source 1..1941: mol_type = other RNA; note = synthetic construct
atgtttataaatacacacgtcggccgatttgtcggttgtgagtcccaaccagttgcactgatggcaggtggaatagcctctctgaaatcactaatccagtcttacaccgccggcgtgctttgcgaaggtgtgccagcatgtgtgtcaccctggcccttcttcctgtgggacgaggaggaaatgacaaagacttccaagctcgatgccctaagagccgcaactagtagagaggacctcgccaaaatcttggatgttaagctcgtattcctgactaatgtgttgtatcgcatcggcagcgacaaccagtatacacaatttactattccaaagaagggcaaaggcgtgagaacgatctccgcccctacagatagactcaaggatatacagcggcggatatgtgatctccttagtgattgcagggacgaaatttttgcgatccgtaagatatccaataactactcctttgggtttgaacgggggaagagtatcattctgaatgcatacaaacataggggtaaacagataattctcaacatcgatctcaaggattttttcgagagcttcaattttggcagagtgcgggggtatttcttaagcaatcaggattttctcttgaaccccgtagtcgcaacaactctggctaaggccgcttgttacaatggcacactgccccaggggagtccctgctctcccatcatcagcaacctgatttgtaatattatggacatgaggttggctaagctggctaaaaagtacggatgtacatattcacgctatgcagatgatattacgattagcaccaacaagaatacctttcccttagagatggctaccgtgcaaccggagggcgtggtcttagggaaggttctggtcaaggaaattgagaattctggattcgaaatcaacgattcaaagacgcggcttacttacaaaacgtctaggcaggaagtaaccgggttgaccgtgaaccgaatcgtcaacatagaccgctgctactacaaaaaaactcgcgccctggcccatgctctgtacaggaccggagagtataaagtgccggatgaaaacggcgttcttgtgtcaggcggactggacaaactggagggcatgtttggatttatagaccaggtggataagttcaacaacatcaagaagaagttgaacaaacaacctgacagatatgtcctgactaatgccactctgcatggtttcaaattaaagttgaacgccagagagaaggcttacagcaaattcatctactacaagttcttccacggaaatacctgcccgacaatcatcaccgaaggcaagacagaccgcatctacctcaaggccgcgctgcacagcctcgaaacctcgtatccagagctgtttcgggaaaaaacagattccaaaaagaaggagatcaacctgaacatcttcaaatccaatgaaaaaacgaagtgcttcttagacctttccgggggtacagccgaccttaaaaagttcgtagagcgctacaaaaataactatgcttcctattacgggagtgtgcctaagcagccagtcattatggtgctagacaatgacaccggccctagcgaccttctgaactttttgaggaacaaagttaagtcgtgtcctgacgacgttaccgagatgcgtaaaatgaagtatatccacgtgttctacaatctgtatattgtgctcaccccactgtctcctagtggggaacagacctctatggaggacctgtttcctaaggacattctcgacattaaaatcgacggaaagaagttcaacaaaaacaatgatggagatagcaaaactgagtacgggaagcatattttcagcatgcgagtggtccgtgacaaaaaaaggaagattgacttcaaagcgttttgctgcatttttgatgctatcaaagatatcaaggagcactataagctaatgctgaattcatga

SEQ ID NO: 8441 - RNA, 1482 nt, unidentified
  source 1..1482: mol_type = other RNA; note = synthetic construct
atgaagaagaacaagagtattatcctgaacgcctatcgccaccgcaacaagagaatcatcttaaacatcgacttgtccaactttttcggctcatttaattttggtcgagtgagaggttacttcatgtctaataaagatttcctcctcaacccaatcgtggcaaccaccattgccaaggcggcctgttaccgcggagtgttaccccagggctcaccttgcagcccagtcattagcaatctgatctgctctattatggacatgagactggccaagctggccaaacagtatggttgttcgtactcccgttatgcagacgacataacattctctaccaataaaccttcattccctactgaactcgcattgctgcaacccgagggggtcattcttgggaaatacctggtaaatgagattaagcgtgcgggctttgaaataaatgacgcgaaaaccaggctggcttacaaaccgtcccgcctcgaagttacgggcttgacagttaataagattgtcaacgttgagaggcggtatagtgataagacaagagccctggctcatacgctttatacaaccggagaatacaaattaccggacgaaaacggagatgaagtcgctggcagccttgataagctagaggggatgtttgggtttatcgatcagcttgacaaatttaacaacatccagaagaagaagagcaaacaacccgaaaaatatgcactcgcacctgctaccctgcattcgttcaagtctaaattaaatgcccgggaaaaggcctacgggaagttcatatactacaaattctttcacggtaacacttgcccaactatcgtgaccgagggtaagacagatcgcatctatcttaaagcagccctgagagccctgagtaacaactacccagaactgtacagggagcgaaaggacaaaaaagggaaagagatcgacctgaatatccttaaaatcaccgataagctgaattatttcctgaacatttccggcggaacagctgatctgaagaaattcgtggagaggtatagggagcattattcaagctactacggaagtatagctaagcagcctgtgattatggtgctagataatgacactggacccaatgagctgctcaattttctcaaaaacaaggtcaaacagtgtcccgatgacgtaggcgctatccggcggatgagatatctccacatcttccacaacctgtacttggtgctgacacccttgactgagggcggcaatgaaacctccatggaagatttttttcctacggaggtgttgtccattgagctagacggcaagatcttcaacaaaaataatgacggagacagcaagactgagtatgggaagcacgtcttctctgtaaaaatcgtgaaggataagaagcgggttattgactttaaccgattcagctacatattcgatattgtgagggagataaagattgactaccagaagatcctcattaaaaacaagccatga

SEQ ID NO: 8442 - RNA, 1557 nt, unidentified
  source 1..1557: mol_type = other RNA; note = synthetic construct
atggtagcaacctccaaacttctccttctgaaagtggcgtcctcccgtgctgatctagctaagcttttggacgtgaagctggtctttctaacaaatatcttgtaccgaattgggaccgattctcaatataaggacttctccatacctaaaaaaggcaaaggggtaaggttaataagtgcgcctgaagacagccttaaggacttacaacgacggatcgccgacctcctgatggattgtagagacgagaacttcaagatcaagaagatcaagaacaactattcctttggtttcgaacggaataaatcgatcatcagtaatgctttcaggcaccgcggcaagaacatcatactgaacattgacctcaaagatttcttcgaatccttcaatttcgggcgcgtgagaggatactttctgtctaatcgggactttctgctgaacccgatagtagccactacactcgcaaaagccgcttgctataaagggtccctcccacagggatctccctgttcacctgtgatcacaaattttatctgtagcatcatggacatcaggctcgccaagctcgcaaaatctctgggctgctcttactccaggtacgccgatgacatcactttcagtacaaacaagaaggaatttccagccgagctggcaatttcactgcccgagggggtggttctgggcggaattctagtttcagaaattaaacgggctggtttcgatattaatgacgcgaagacccgcctcagctataaatctactaggcaggaagttaccggcctgacgatcaatagatttgtgaatgtcgaccgaaaatactccaataagacgcgcgcactcgctcacagcctgtatagcaagggagaatacaaactaccagacgaggatggtaagttagtggtcggctcaattgagaagttggaaggccgtttcggcttcattgatcagattgacaagtttaacaacatccagaacaagctttcaaagcagcccgagaaatatgcccctatccacattaccttgaagaattacagacttaaactgaatgctcgggagaaagcctacagcaagtttatatacttcaagttcttccacggtcatgcttcccctacaatccttactgagggaaaaacagaccgggtctacctgaaaagcgcaattagaagtttgagtactaagtttccggagtttctgaagaaatccgcagatgggaaaaggaacgacattaacctgaatatattcaagtctgacgagaagagcagctattttataaatatgtctggcgggagcgccgatctgaagaaatttatcgagcgctacatggatgaatacagtagttactatggatcgatcccaaaacatcccgtgattatgctgttggataacgattcaggcagcgacgaggtcttgaactttctgaagaacaaggttaaatcttgccccgatgataccgatattatgcgtaagatgagctttatccatgtgttcaagaacctctatattatcctgaccccattaaatgcctcaggagagcagaccgccatggactatagagtgtga

SEQ ID NO: 8443 - RNA, 1776 nt, unidentified
  source 1..1776: mol_type = other RNA; note = synthetic construct
atgactgacaccaagaaaatcgatgccttgaaaaatgccagttctcgttcagacctggccaaactgctaaacgtgaacgttattttcctcacaaacattctgtacaaggtcgggaccgacaaccagtataaacagttctccattcctaaacggggaacggggattagggtgatttctgctcctaacgacaagttaaaggaccttcagcggagaatagcaaatctccttatagattgccgccaagagttgttcaattcgaagaagatcaagaacaacttttcctttggtttcgaaaaagataagagcatcatctcaaacgcatcgcgacataaggggaaacgcataatcctgaatctcgatctgagggatttcttcggttcttttaactttggtcgagtgcgtggctattttatcagcaatcgagacttcaaacttacaccggtggtggcaaccaccctggcccaagcagcgtgctataaaggagtactacctcagggatctccttgctctcccgttatcaccaacttcatctgtaacattatggatatgagacttgcgaaactggccaaagaactgggatgtacatacactcgctacgctgatgatatcacttttagcaccaataagaagatctttcccgaagaactggccattccagagctcgaaggggtcatattaggcagtaggctcgtgaacgagatcacaaaagccggctttaaggtgaatgatgctaagacacgcctcgcatataaaagctcaagacaggaagtaacaggtttgaccgtgaaccagatagtcaatgttgacaggcggtatgctaagaaagttcgagccctggcacaaaccctgtactccacaggaaaatacaaattgccggacaagaatggcaacatgattttgggcaacttagctcggttggaaggcatgttcagctttattaacttcattgacaagtccaacaacattgagaacaaaaagaacaagcaacccgagaagtacgtgaaggtacaggagaaactgaatgggtaccgccttagactcaatgctcgggagaaagcctactctaaattcatctactacaagtacttccacggaaatacaattccaactatcctgactgagggcaagacagataggatctacctgacgaccgccctgcactccctatccgccatttatcctaatcttatcgaagagactaacaacgggaagaagattaagctgaatatatgcaagagcaatacgaaagccagttattttctcgacctgtctgggggcaccgctaatctgaagaaattcgttatgcgctaccgggatgaatatgaactgtactatggcacggatgctaagaaccccgtcataattattcttgataatgattcaggcccaaacaaactgctggaccacttaaagaataaagtcgagaattgtcccaacgacgtgaagtccatgaggagaatgaaatacatccatgtcacccataatctctatatcgtgttgaccccattatccgagtcagtgcgggagacaagtatggaagacctctttagtcccgaggtgctcaatatcaccctaaatggaaagtatttcaacaaggcaaacgaccaggacactgagactgagtattcaaagcacatctttagcactaaggtagtcagagataagaatagaaacatcgacttcaaaggttttaagccaatcttcgacgcgattgaagccatcattaaacactaccaggagctgagcaagagcaggataatcaataaagctcgttga

SEQ ID NO: 8444 - RNA, 1761 nt, unidentified
  source 1..1761: mol_type = other RNA; note = synthetic construct
atgaaaaatacccccggattggacgatttgaaagcggcgaccacaagacgtgacctcgctaagcttcttaacgtgaagcttgttttccttacaaatgttctctaccgcatcggggtggataatcagtactctaactttccaattcctaaacgcagcgggggagtccgtatcatcagtgctccgtcttccaagttgaaagacctccagtcaaaaattgccaagcttctgatcaactgccgccaggagattttcgccattaacggcatcgaaaacaatctctctcacgggttcgaaaaggacagaacaatcatcaccaatgccttaaaacacagaggcaaaaacgtggtactcaacctagacctctcagattttttcaagagctttaatttcgggagggtccgcggcttcttcctctacaacaaggactttaaactgcacccagatatagctactactatcgctaaggctgcttgttatcagggcagtcttccacaagggagcccatgttcgcccgtgattaccaatctgatctgtaacattctcgatgtgaggctggccatgttggccaaaaagttaggatgcgcatatagccggtatgccgatgacattaccttcagcaccaataaaaaggatattcccgaggagctggcactcaacgtgactgacggagtgacattgggaaggaaactgcgtaacgagatcgaacgagcaggctttgagattaatgacagtaagacaagactatccttcaagcccgctaggcatgaagtaacagggttgacggtgaacagatttgtgaatgtcgatcggagatactcaaaaaaggtgcgggcactggctcacagattataccagaccggttcctataccataaagaatgccgacggagaagtcgatggtacactgcaacaactggaggggatgtttggtttcatcgatcagatcgacaagttcaacaacatcgttaacaagaaaaaccgcaagaaggaaaaatatatcctggcgaaacagtccatccttgagcatcgatccagactgaatgccagggagaaagcctacgcaaagttcatatactataagaacttccacggatctatcatcccaaccataatgactgagggtaagacggaccgggtatatattaaaacggccctgctatctctgagtggcaggtaccctggttttatcattcgcgacaacaagacgaagaaggagaagattaatctgaagattatcaacccgcagtttaaggagaaatactttctggacatagaagacggcgccgcctcctttgaaaagtttgtccgacgctacgattcggaattcaagagcttttacggaactaaggcaaataatcctgttgtaatgatactggacaatgacaccggccccaacgagctcttgaactatatatctagggagtgccctacctgccctaatacagttgaggatattcggaaaatgccatttgtgcacgtgatgcataatctgtacctgattctgactcccttagatgccactgggggaatgaccgccatggaggacctgttcgatgcaaaaactctaggcaaggatctggagggcaggaagtttaatcggggcaaaaaatttaaccccaaaaaggaattcgggaaggacgaattttccattaaagtcgtgcgagatatggcaaaggatatcgacttcaacggcttcaatagcatattcgaagcgctcacagatgtggtcaaacattatcgggactcaatcaaagctccttga

SEQ ID NO: 8445 - RNA, 1326 nt, unidentified
  source 1..1326: mol_type = other RNA; note = synthetic construct
atgtttaaacccacgtacctagcccggctgcaagcttgctgtaacaaatttgagctcgccgacctcctccagattaaagtcacttttctgacgaatgtcttgtatcgcattaggccagagaatcagtacaaaaagttcaccatcaaaaagaagtcaggaggcgagcgtgaaattttcgcccccgatgagaagctcaaagatattcagcagcgattgtctgaactgctgtatatttgccaggaagagatctgggcgaaaaataatatcaagcagaatgtgtcccatggtttcgagaagaataaaaccatcatcacaaacgcagagcgccaccgggataagaacatcgtgttcaacattgacatcgaaaacttctttcccagtttcaattttgggagggtgagagggtattttatcgctaaccagaacttcaagttacatcctaacgtggccacaataatcgcccaaatagcttgtctggatggctctcttccacagggcagcccgtgtagtccagtgatcacaaacctgatttgcaggattctcgattttcgcttgagcaaactggccgtgacatacggttgttcctacagtagatatgcagacgacattaccttctccaccaataagaaaaacattccagatgccctagttagcaacgaaaaggagaatgagcctggaaagatcctggtagaagaaatacacagggctgggtttacactgaatcacaacaaaaacagggtgtcacgctgtacctccagacaacaagtaaccggactaactgtcaataaaaaaatcaacgtctcacgagagtatattaagaatacacgggcaatggctcactcgctgtattttgagggctcatacacacttatcgagaaagacgggaaacatcggaagggtacccttagcgaacttgaaggccggtttgcgttcatcgacatgttagataagtacaataacgtggaggcaaagaaaaatgctagacctgagagatacgttgttaagggctttggactcgacttcaagcagcgcctcaatagcagagaaaaagcctattccaagtttctgtactacaaaaacttctacgggaatgaacagataactatattaactgagggaaagactgaccccgtgtatctgaagtgcgcaatcgactctctgtttcttgattaccctcagttggttcgagaagagaagaacactaagaaccgtgtgctcaaggtaaacctgttcaagacgaatgacaagaagaaaattttctctcggttcgtgtggtggagctgcaggctgtttgaggtcttccagaccacttggttcaccttgtga

SEQ ID NO: 8446 - RNA, 1770 nt, unidentified
  source 1..1770: mol_type = other RNA; note = synthetic construct
atggaattcaccattatgttcacgcccagttatcttgaaaggctgaagagctgcaaaacaaagttcgaattcgcccgtctgctgcaaatcaaggtgagttttctgaccaacgtgctgtataggatacgaccagaacatcagtacgagcggttcatcataaaaaaaaagagcggtggggatcgtgaaatatttgcacctacagaaaagctgaaggatatccaacgcagactatccgatctactgtacgtgtgccaaagtgagatttggaagacgaataacattacccccagtctgtcccatggctttgagaagaacaagacaattatcacaaacgcggagagacaccggaacaagacgaatgtcctcaacatagatctcgaggacttttttccaacctttaatttcggacgcgtacgcggctactttatcgccaatcagtactttaatttgcacccctcgattgccactattatagctcagatcgcctgttacgatgggaaattgccccaggggtccccatgctctcctgttatctctaatctgatctgcaatatcctggacattcgcttgtctaagctggctttatcaaatggatgttcctattctcggtacgctgacgacattacgtttagcaccaataaaaaccaattcccagactcaatagttatcaacgaaaacagcaatgagttggggcccctcctggtgaacgagatcgagaaagccggtttcaaaatcaacaataacaaaacccggattctgcgacatacatcccggcaggaagtgaccggtctgaccgtcaataagaagatcaatgtcaacaaggactatatcaaaaagactcgggccatggcacacgctttgtataaagagggcgacttcacactgcttgatatttccggcaaacctagaaaaggcactctgaatgaactcgagggccgattcgtgtatattgacatgttggacaagtacaataacattaatgccaaaaagcacactctccctgaaaagtacgtgctgaagaaaaccggcatcaacttcaccctcaaactaaacagcagggaaacagcattttcgaacttcctccactacaaatatttctacgggaacatcaaacctactgtgctcaccgaggggaagacagatcccatttacttaaagtgtgcgatcgatagtctctatctttcttacccagccctggttcgtgtagatgatagaaccaagaatcgcattctgaacatcactctctttaaaaccaacgccaagaaggaatattttctggacctttacggaggagcagctgactatgtgaggttcttccgacgccatagggagcagtgtaaaaagtttgagagacagcctcccaagaatccggttattattgtgttagataacgatactggacctagcgacttcatcaacaatatcatcaaggagtatagccatctcccgaggaaatcagaggatgtacggaaacacaaatttttacacctcgagaacaatttgtacgtgctgcttaccccactgcttgctggagataaacagtcatgcatggaagacttctttaaagacgaggtcttaacaaaaactatcaatggcaagtccttcgacaagagcaacaatcatgattcaaccacaactttcggtaaggacagatttgcaaataacatcattagggagaatagacagacaatagacttttctcttttcaagcccattctggacgcgatggtcgatataaacaaccacttcaagaacctatactatccatga

SEQ ID NO: 8447 - RNA, 1740 nt, unidentified
  source 1..1740: mol_type = other RNA; note = synthetic construct
atggtagcacccaccactattgagagactgaggttaataaccacaagacaggagctggccgcactgctgaatctaaaagcacatttcttgacgaacatcctgtataggaatggagtgaacactcagtatagccaatttcggattccgaaaaaggatggttccttcagattgatctcctcaccttctagtaagctcaaggacatacagaaacgccttgccgaactcctgtatgaatgtcaggcgaatatccatttcgagagaaagatcaatcctgtgctctcacacggcttcgaaaaaaacaaaaccatcgtcacaaacgccactaggcacagaaacaaacggattctgctcaacattgacctggagaacttctttgagtcaatcaacttcggccgggtcagaggctttttcatcgctaataatgacttcaagctctctcctctaatagccacaactattgcccagattgcgtgctttaataatagcttaccccaggggtccccctgctccccaattatctccaacctgatttgtaccatcttggacatccgattaagtaagcttgcacaaaagaatggctgtcagtactctcgttacgctgatgatatcacattcagcaccaataaaaaagagtttccacaggaactggttatcgacaacgatgttgtgaatgtgggggccgtacttctgaaggagatagagcgggccggatttcgaattaatcatcgtaaaacacgacttctgtacagcaccagtcggcaagaagtcacaggccttaccgtcaataagaaagtgaatgtggacaatcgctattataaaaaggtacgcgctatggctcacacgctgtacaaggaccaatcatttgcaattatcaaagagaacgccaagccgcagaaggggaccttgaaccagctcgaaggcatgatgagttttattgacagcatagacaagtacaacaacaagcttaagttagccaataagcagccccaaaagtatcagtccttcaattacggtttaaactacgagggaaagttgaacaggagggagaagactctgagtaagtttctgtactacaagtacttccatggactgcatgtccctacaattctggtggaaggcaaaactgatagggtgtatctaaagtgcgctctgcgatccctgtttctcacttaccctactctggttaaaaaaaataacgccacaggcaacattaactatagtctcaactttttccgtgagagcacccggacgtcgtactttctcgacatctctggaggggcggctgaatttgaaaagttcatcactcgctatccagaacagtacaaaagatttaatcacacacctctctatcccgtgattatgattctggataacgactcaggaacaaggaccatcgtccggaaaatctccaaatctctcggggtgacggaggattcaataaagaaaaactcattcacccacatcatacacaacctgtacatcgtgttgacaccactactgcccggggatcgcgattcgtgtatggaagacttgtttgatagcagcgttcttagcaccgtaatagatggtcgcagcttcgataaatctaacaactacaataagtccacccactatggtaaaaacgacttctctcttaaggtgatcaaagtgaacgagaagaatattaacttctccggcttcctgccagtgttgaatgctgttagggactgcctcgtccactataataatatctctaagtga

SEQ ID NO: 8448 - RNA, 1758 nt, unidentified
  source 1..1758: mol_type = other RNA; note = synthetic construct
atggctcccctctccatacttgaacggttgcaaaacgccgccaatcggcaggacttagcctccatcctgaacctgaaaactgcatttctcaccgatgtgatctacagacttaaggcggagacgcagtacacccagtttaccattccaaaaaaaaatggcgcacctcgcgttatcagtgcaccaaccactaagctcaaggatattcagaggagactcgccgacgtgctgtatctctgcagagcagaaatctacaagaagtacaacattaaccctgtactaagccacggattcgagaaggagaagagcatcattaccaatgcggaacgccacaggggaaagaccctcttgctgaacatcgatctagaggattatttcgactcgtttaacttcggcagggtcagaggtttctttttgagcaatagggattttcggttaaacaacacagtcgcgacaaccattgcacaaattgcctgttttcagaatggactgccacagggctctccttgtagccccatcattagtaatcttatcagtggcgtgctggacattcgcttatccaagcttgcaaagaaatatgggtgcaattatagcaggtatgctgatgacctgacgttttcaacaaataagaagacgttccccaaggagatagctgacgtggggggcgaaagtgtgacccttagtccgacacttattaaagagatcatcaaagctgggttcaagataaacgataaaaagacgagagtatgctataagacttctcgccaggacgtgacagggctgaccgtgaataaaaaagtcaacgtaggtaaggaatacgctaaagtgacacgggccatggctcactcattgtacaaagatggctcattcgttatcgttaccgaatccgggaagattgagaagggaacctgcgctaagcttgaaggccgattcggcttcatcgattctattgataagtacaacaacttgaagctgaagaatgctcggcaactggaaaaatatcagagcgttaaccatgggctgaactatacggccaaattaaatagtcgtgagaaggcctactcctactttctctactacaagaatttccacggtatggagatgccgactatcctaactgaagggaaaactgatcgtgtgtacctgaaatgcgctctcaaatcactcgccaactcttatcccttgttattcaatagctctgacgattcttcaaaaaacgagtaccgtgtcaacttctttaaagccacagagaaaacatcatacttcctggacattagcggaggggccactgactttaagaggtttatcctgagatatcaagaacagaagaagcggttcgagaaatttaagcctaaacatcccgtcataatgctgctggacaatgattccggacctaaagacctcctgaaccatctgaaggataaggttaaaaattgtcccaacgacgtggatactatccgaaaggcccgatacacacacattttcgacaatctctatctgctgctcacaccactgctgccaggcggaaaagaaagctgtatggaggatttgtttgactccaccgtactatccactgtgctggacggcaaaaccttcaataaatcgaatgacactgacacaaaaacagaatacggtaagcatgtcttctctaccaaggtcatcaaagccaactgtaagaccatctcctttgagaaatttaaggtgatcttcgatggtatagaggagattatagcagactattctaagcgctgcaaggtgtga

SEQ ID NO: 8449 - RNA, 1638 nt, unidentified
  source 1..1638: mol_type = other RNA; note = synthetic construct
atgaaaatatccaggcttaaactgcttagctccccatccgagttggcgcagctgttgaatattccccagaaattctttctgtatcacctgtatggacaacaaccaacaaaccagtatatgcagtggagcatccccaaaaagaatgggggaaaaaggaatattacatccccgaatccagagctgaagatgattcagagtaggctcgctaattatcttcaggagtgtcttcaagagattcggtctaaccagaattttcatattaacctgagccatggttttgaagttgacaagtctattctgaccaacgccgaaatccacatcggccagaagtatatcctgaacattgatctagagaacttttttcactccataaacttcggaaggatccgtggcttctttattaagaacgtccactttcagctgcaccctacaatcgcaacatgcattgcccatattgcatgttacaataactacctgcctcaaggtagtccttgcagccctgttatcagtaatctgatctgctccgtgttggatatacgcctcaaaaatctagccaagaagtacaagtgcttctatactagatatgctgacgacctgacattcagtacctatctcaaatatttcccggagcagattgctaaatcaaattactacctgaacgtcgaactgtctgccctgctgatcaaagagatacagaaggcaggttttaacattaatcctacgaaaacccgacttcagcacacaaatatacgtcaggaggtaactggcctaactgtcaataagaaactttcagtgcatacggattacagaaacttgtgtagagctaaagcacatcacttgttttctcacggctactatttcactttcgataaacagacactctcacagcggtctggaagcttaaaggaactcgagggccagctcgcgtttattaactcgttagacaaatacaatcgcgaaatcaacaaagccaaaactgaaaagaccaataagcgggagaatttatacggcaagttcatcttttacaagaatttcctctgtaacgaaaagaccatactgttgaccgaaggcaaaaccgatatccaacacatcaaatgcgctctaattggattaaagctcaacaccctgagcaacagcctgcaattttacaagcactcccctagtaagaccttcttaatgacttacatctgccagcagaagctcaatttctgtgccggatcccccgggctgaaggccttcataaaggcctacaatagactctacaaatccatcttgaaagggaaacataagccttctaaccccgtgatcatcatagtggacaacgatcacgaaggggaggatattaagaagatcatcatgaaggagttcaacattccaatcaatacaaaccagcccacccgcatcatctacaaccttttcatcatcttcctgagcccgccctcatttatgtcatcacatactaacacagcaccacatcgaaacattgagatcgaggacctgtatccacaatacattctcgacacccagctgaacgggaaaaagttcaatcggacgaatcacgaatcgactgacacggaatatggtaaggatagttttgtgtctaaggtgataaagagcaaaattgacaagcccatttga

SEQ ID NO: 8450 - RNA, 1749 nt, unidentified
  source 1..1749: mol_type = other RNA; note = synthetic construct
atgaaggaattcaatcagattaaaactcgcaatgagttggccgattttttgaatatcccccgcaagcagctgagttacgtgctatacgtgaagggtattaacaacctgtacaactctttcaagattaggaagaagaacggcgggtttagagagattaatgcccctcttgaagagctgaaaggtatccaacgaagactgcaggaggttctctacaagaagatcgggaataagtggattaataggaacataagccatgggtttgaacgcaatcgcagtattattactaacgcgattgtgcaccggaacaagcggattgtattgaacatcgacctcgaaaactttttcgaatccatacattttggacgtgttcggggctttttcaacaagaataagaacttcagccttcctatcgacgttgctacggtaattgcccagatcgcctgttacgaaggaaggttaccacagggagcgccttcatctccgatcataagtaatctcatctgcgagatattggattatcgcctgctgaagatcgctaaaaagtataaggtcaactatacccggtatgctgacgaccttacatttagcaccaatgataagaacttcctgtttttacaacgagagttctatgaggaaatttcccaagagctgattcgaacaggtttcaagatcaatgagaaaaagaataggctgcaactgagagattctagacaggtggtgactggcctcgtcgtgaataaaaaaatcaacgtcaaccggatctattacaaagaaacgcgtgccatggcttaccagctgtacaaacaaggctcctttaaaatcaacgacgagccggcaaccataaatcagctcgaagggcggttcgcattcatcaatcagctcacttggcataataacctagttgatgggattaccgccaactttaataactttacaagtagggaacagcagtatcaaaggttcctattctacaagtatttctttgccaactctaagcctgtcatcgtgaccgagggcaaaacagacgtcagatacttaaagtctgcactgaaatcactctataaagactacccaaaactgattgtcaaacacaaagacggttctttcgagttcaagatacacttcctaaaaaagacaaagcgcttatcatactttctgggaatctataaggatggggcaaacgccttgaacaatatctaccagttttttgggagcaaaaattcaaagctgaactacctgaactatttcaaaaagatctccggcaactcccccgagaatccagtgatcctcttgtttgacaatgaaatcaagtcaggcaataaaaaacccatcggaaagtttctgaactatgctggcttggatgacgagaaaaagactacactgaagaaagaaaacatggtgaatattgtagactcgctgtacctccttaccgtgccacttataaacggcaaactcgaatgcgatatcgaggacctcttcgataacaataccctgttccttaagatagagggaaaagaattttccaagaaggatagctacgacgtgagcaaatattatggaaaggagattttctcccagcacataagtcagaactacagcgatattaatttcaatcagttcagacccgttctggacaacatcaataagattatcgatgtgtacaccagacagaatgataatatgcttgtcaatctggagctgaaaaaggtagacaagaggaacatgaacaaagtggagctttttaaatga

SEQ ID NO: 8451 - RNA, 1749 nt, unidentified
  source 1..1749: mol_type = other RNA; note = synthetic construct
atgagggaattcaacgaaatcaaaaccagaaatgagctagcagactttctgaacgttccccggaagcagctgagctatgtgttatataagaagggcgtagataacctatacactagcttcgagatcaataagaaaaatgggagcgtccggaaaatcaatgcccctttggaagagctgaaagacgtgcaacgcaaactggctgaggtgctctataagcacatgcgcaacaagtggaagaagaaaaatatatcgcatggcttcgagaaaaataagagcatcattactaacgccaagatacacaggaataaacgcctcgtactcaacatagacatcgaaaacttcttcgagagcattcactttggtcgcgtgagaggatacttttcgaagaataacaatttcctccttccaattgaggtcgccaccgtgattgctcagatctcttgctacaaaggtaaattgcctcagggcgccccatcttcccccatcatctcaaacctgatttgtgaaatattggaccatcgtctgctgaaaatcgccaagaagtacaagcttgattatactcgttatgccgacgaccttactttctctaccaacgataaaaagttcttagggctgcaaaaagcattctacaaagtgatctcaaaggaacttataagagcgggatttaagattaacgaaaagaaaaaccggctccagcttcgcgactctcgacaagtggtcacaggcctcgtggttaacaagaagatcaacgtgaatcggatctattataaagagacaagagctatggcccaccaattgtataaagagggaagctttgagattaatggggaacctgcaacactaaatcagctggagggtcgattcgccttcattaaccagctgacctggtataataataaagttgatgggatcaagaccaacttcaataattttacgagccgagagcggcagtatcagaggttcctcttctacaagtacttctttagtaactccaagcccgtgattgtgaccgaaggcaaaacagacgtcacttacctgaagagcgcactgaagtctttgtataaggagtacccaaacttaatcactaaacatagtgatgggacctttgagttcaaagtgagctttcttaagaagacaaagagactcggctattttttgggcatataccaggacggggggtcagccttgaataatatctacaactttttcggctccaagaagagtaccttgaactatctgaacgactttaaaaagatctcaggcaatctcccaaagaaccctgtcatcttaatgttcgataacgagattaagtccggaaagaaaaaaccgattggtcagtttctctcccatgctggactggcagacaaaaagaggctgatactggagtctgaatatatggttgacgtaattgactcactgtacctgttaacagttcccctgattgacggaaagtccgaatgcgatattgaggatctctttgagaaaagtacgctgtcacacaagattgaaggcagggagtttagtaaaaaggatcattacgatacctccaaatgttacggaaaagaaatctttagccagtacatcctgaaaaattacagtgatatcaacttctccgagtttagatctgtcctcaacaacatcaataacatcattgacatctacaagaagaggctggctgatgcggaacacaatctggaggcggaaaatattgataagtcctctgctgacaaaatgctacttgaaatatga

SEQ ID NO: 8452 - RNA, 1746 nt, unidentified
  source 1..1746: mol_type = other RNA; note = synthetic construct
atgatggagttcgacgaaatcaagacccggaatgagctggctgattatctgaacgtcagccgcaaacagttatcctatgtgctgtacgtgaaagggataaacaacctgtacacgtcatttgagatacataagaagaacgggggagtgaggaaaattaatgccccccttgaggagctgaaagatatccaacggaaattaacagaggccttacacagtcatatgaagaaaaagtcgaagaagaagaacaacatctcccacgccttcgagatcgataaatccatcataaccaatgcagaagtgcaccgtaacaaaagactggtgctgaacattgatctcaaagacttttttggctctattcactttggcagagtgcggggcttcttcaataagaacaataagttccttctgccaatcgaagtcgctaccgttattgcccagataagttgctttgaaggtaaactgcctcagggtgccccgtctagtccaattatatcgaacttgatttgcgagatcctggactataggttgtctaagatctctaaaaagtacaagctcgactatacccgctacgcagatgacttgactttctccaccaacgacaagaattttctgggactccaggacgagttttacatcgagatctccaaggaactgatccgagccggattctcaataaacgaggacaaaaaacgccttcagttgaaggatagccggcaagtcgttactggcattgttgttaacaataagttgaacgtgaacagagattattacaaagaaacaagagctatggcccatcaattatacaagcagggaaagtttgagattaacggcgaggtagcaacacttaatcagctggaagggcgattcgcctttattaaccagttgacttggtacaacaataagaagaatggcatcaaacctaagagttttaggaatcttctgtcccgggagctgcaataccagaagttcctgttttacaagtacttcttcgctaatccgaaacctctaatcgtcacagagggcaagactgacatagtatacctcaaaagcgctcttaaaaatctccattctgagtatcccaatctgattacaaaaaatagcgacggttcatttgaattcaaggtgagcttcctgaaaaagacaaagcgtctgaagtatttcctaggaatctatcaggacggtgggagtgcactcaataatatctacgacttctttaccggtaagaagaacacgccagacttcctgtcctattttcgcctgatctcaaacacactcccaaagaaccccgtcatcctcatctttgataacgaaggcaaaaataaacctttgggcctttttctgaaccacgctgtcctggatgtgaagaagagggaaattctggatagctcttatatggtggacctaattgacaatctgtatcttctaactgttcccttgatagacgggaaatcagagtgtgatatcgaagatctcttcgaagatatcaccctgtcctatgaaatttctgggagaaagtttacgaaagaggataaatacgataccagcaagtactatggaaaagacatgttctccaagtacattctcaataattacgcggacattaacttcaatgaattcaggagcattctcgacaacatcaatagcattatagggatctatactaacggcatcgtaggaaccgggcaggagctcgaagcaaaaaacattgataagtcaagtgcggataaagtgttactcgagatctga

SEQ ID NO: 8453 - RNA, 1752 nt, unidentified
  source 1..1752: mol_type = other RNA; note = synthetic construct
atgagcgaattcagtgagatcaagactaggaatgatttggcagatttcctgaacatccctaggaaacagctaacttatgtgctgtatgtcaagggcataaataacctctacacctccttcgagatttataagaaaagtggaggcgctcgacggattaatgcgccaattgaagaactcaaagatatccagcgcaaactggccgaagctctgtacaaacacaagaaaaggaagtggaagaagaagaacaatatctctcatggtttcgagaaagataagagcattataaccaatgccaaaattcacagaaacaagcgatttgttctgaacatcgacctagagaatttctttgaaagctttcatttcggacgcgtcagagggttttttatcaaaaaccacaatttcctgctccctatagaagtggcaaccgtcatcgctcagatttcttgctatgaaggaaagttacctcaaggcgctccgtcaagcccaataattacgaatcttatatgcgagatcctggactatcgcgtcagtaagatggctaagaaatacaaactgaactacacaaggtacgctgatgatcttacattttccacaaacgacaagaatttcctgcgcctacagaccgaattcttgaagaatatttccaaggaactgatccgagcgggctttaagatcaatgaaaaaaaaacccgtctccagctgcgggattctcgtcaggtggttaccggcctggtggtgaacaaaaagatcaacgtgaatcggatctattataaagagacgagagccatggcccaccagctgtataagcaaggcgaatttgagattaaaggcgaacccgccacattaaatcagctggagggaagattcgcctttataaaccaactgacctggtataacaacaagattgatggagttaagcatcactttaacaacttgacttcccgggaattacaataccagaagtttctcttctacaaattcttcttcgcaaatccaaagcctctcatagttactgagggcaaaacagatattgcatatcttaaatctgccttgaagaatctctataaagaataccccaatctgatctcgaagaatagcgatggcaccttcgagttcaaagtatcctttctaaagaagactaagaggcttaagtactttctgggaatctatcaggacggtgggaatgcgctgaacaatatctacaactttttcgactcaaagaagcccgcacccaactacctgtcttatttcaaaacaatcagcaatactctcccgatgaatccagtcattctgatgtttgacaacgagattaaatcgggaaacaaaaaacccataggtaagtttctgaactacgccaacttagacgctgcaaagagagaaacacttgagaacaactacatggtagacattattgataacctttacctcctcaccgtgcctctgattggggggaaatcagagtgtgatatcgaggacctgtttgaggagatcactttgttgaataagatcgacgggaaaaagttcatcaaagccgacaaatacgacgtgaccaaatattacgggaaggagatcttcagcaagtatatcattaacaactacaccgacatcaactttactaaattccgggccgtgctcgacaagatatccaatattatcgagacatacacgaaggggcttgtggatacaggtcataatttagagacgaagattaaggacaagtcaagtgccgacaaagtaccattggagatctga

SEQ ID NO: 8454 - RNA, 1758 nt, unidentified
  source 1..1758: mol_type = other RNA; note = synthetic construct
atgatggagttccaggacattaagaccagaaatgatctggcagattttcttggtatcccccgaaagaagctgtcttatctcttatacaagaaggagattaacacactgtatacctcattcgagatcaacaagaaaaatggaggggttagaaagattaacgctcctctggccgaactcaaggatatccaaaggaagctcagcgaagctctttacaaacacaagaagaaaaagcaagacattaagaacaacctgtctcacgcctttgaaaaagagaaatccatcattaccaacgccaaaattcaccgaaataaaagactcgtactgaatatagaccttgagaacttttttggctccttccatttcgggcgcgtgagaggattcttcatcaaaaataacaacttcctcctatcctctgaggtggccaccgtaattgcccagctgacgtgttatgaggggaaattgcctcaaggagcgccgacatctcccatcatcaccaatttaatatgtgagatcttggaccaaaggctgctgaagatcagcaaaaagtataagcttgactatactcggtacgccgatgatctaactttcagcactaatgataagaactttctggaacggcagactgaattttatgagctgctttcctccgagttgattcgcgctgggttcaaaattaatgagaagaagaaacggctgcagctgcgcgactcaaggcaggtggtgaccggcctggtggtcaacaagaagataaacgtgaaccggattttttataaggaaacaagggctatggcacatcagctgtacaaggaaggcaagtttgagataaatgggaagctagccaccctaaatcagcttgaaggccgcttctccttcataaatcagctgacccggtacaataataaaatcgacggtgataagcataacttcaacatcttgtcatcaagggaaagacagtatcaaaagttcctcttctacaagtacttttatgccaatcccaaacccataatcgtcactgaaggaaaaactgacattgcctatctcaaagctgcgctcaaaaacttacataatgattacccgaacttgatcactaagagttcggatggcagctttgaattcaaagtgagctttctgaataagacaaagcgattagcccactttttgggtatttttcaggacggaggtagtgcactcaacaacatttacaactttttcgacgataaggcaaaaaaaacaaccccttcctatctcgactacttcaaagagatctccaatacattaccaacaaatcctgtgatattgatgttcgataatgagatcaactcaaagaaaaacaagccaatcggcagtttcattaatcacgctaagctgggcgataaaaaaaaaggaatactgctggaacagaacatggtcaatattgtcgacaacctctatttgctcaccgtgccactgatcgatgggaaactggagtgcgacatcgaggacctctttgaaaaaagcacactttctcagaagatcaacggccgtgagttctgcaagaaagacaagtacgactacagtaaatactatggcaaggagatttttagcaagtacattctggacaattacacggacatcaatttcaatgagtttcgttcggttctgaacaacatcaacaacatcatcgatatttacacgaaaggcctggttgacaccggagggaatccaaaggcaaaaagtcttgataagagctctgaagataaagtccccctggaggtttga

SEQ ID NO: 8455 - RNA, 1749 nt, unidentified
  source 1..1749: mol_type = other RNA; note = synthetic construct
atggaatttcaggacatcaaaactaggaatgacctagccgattttctgagaatcccgaggaagaagctatcctatctcctatacaaaaagggcataaataccctgtacaccagcttcgagatcaacaaaaaatccggcggtttcaggaaaattaatgcgccactggctgagctaaaagacatccagcggaaactcagcgaagctctttacaaacataagaagaagaagaggaacattaagaacaatctcagtcacgcttttgaaaaagagaagtccatcattaccaatgccaagatacaccgaaataaacgcctggtgctgaatattgacctcgaaaatttcttcggttcgttccactttggcagagtcagaggatttttcatcaagaacaataacttcctgctcccaacagaggtcgcaacggttatagctcaactcacatgttatgaggggaaacttcctcagggagcccccacttcccccatcataactaacctgatttgcgagattcttgatcagcgtctcctgaagattagcaagaaatataagctggactacacacgctacgccgatgacttgacgttctctaccaacgataagaagtttctggaacgacaaactgaattctatgagatcctttccagtgaattaaagcgggcgggttttaagatcaacgaaaaaaagaagaggctgcagtttagagactctagacaagtggtgaccggactcgtcgttaataagaaaattaacgtgaaccgcatctattataaggagacacgcgccatggcccaccaattatacaaaaaagggagtttcgagatcaatggacagcctgctaaattgaataagttggagggacgtttcgcatttatcaaccagctcacctggtataacaataaagtcgaaggaatcaagacgcattttagtaacttcacaagccgcgagttgcaataccagcgcttcttattctacaagtatttcttcgcgaatcccaagccactgatagttaccgaggggaaaaccgatgtgatttatcttaagtccgctttgaagagcctgtacaaggagtatcccaatctcattaccaagcacacagacgggcgatttgagttcaaggtgtcttttctgaaaaagacaaaaaggcttggctattttctgggtatatatcaggatggcggctccgccttgaataacatttacaactttttcgggtcaaagaaaagtaatctgaactacctgaacgactttaagaaaatctcaggcaatcttccaactaatccggtgatcctgatgtttgataacgagatcaaatctggcaaaaaaaagcctataggccagtttttcatacatgccggcctggcagatgagaagcggaagaaacttgagaacgagtacatggtaaacatcatcgactcactgtatctcctcactgtacccctcattgggggtaaacctgaatgcgatatcgaggacttatttgagaagagcaccctgtcacataaaattgaagggaaggagttcagcaagaaagacaattacgatgtttcaaagtactacggaaaggaaattttcagccagtacattctgaagaactattcggacattaactttaacgaattccggtctgtgttggacaatatcaacaacatcatggatatttaccagaagcggctggcagacactgaaagaaatctggaagcaaaaaatatcgagaaatcttccgccgataaagtgttgctggaagtctga

SEQ ID NO: 8456 - RNA, 1752 nt, unidentified
  source 1..1752: mol_type = other RNA; note = synthetic construct
atgagagagtttaatgatatcgggacccggaatgaactggccgattttttgaaaataccacggaagcagttgtcatatgtgctgtatgtgaagagcatcaacaatctgtacacttctttcgaaatccacaagaagaatggtggggtgagaaatattaaggcgcccctcgaggagctgaaagatattcagcgtaaattggccgaggctttatacaaacacaagaagaaaaagcagggccgaaaaaataaactctctcatgcgttcgagaagaacaaatccataattaccaacgcagaaattcatcgaaataaacggcttgttctgaatattgacctagagaacttttttgagagttttcacttcggaagagtccgcggcttcttcaccaagaacaaaaacttcttgttacccattgaggtagccacaattatagcccaactgagttgctacgaagggaaactgccacagggcgcaccgacaagtcctatcatctctaacctcatctgtggcatactcgactacaggctcctgaagattacgaagaagtataagctcaattacactcggtacgccgacgacctgaccttttccaccaacgataaaaacttcttgaatgtgcagaccaagttctatgaggaaatttcaaatgaactgatccaggcaggcttcaaaataaacgagaagaaaacaagactccaatataaagactccagacagaccgtgactgggctagttgtgaactccaaaattaacgtcaaccgtactttctacaaagaaaccagggctatggcccaccagctgtacaagcaaggcaatttcaagattaatagcgaatctgctgatctgaaccaactcgaagggaggtttgcctttattaaccagctgacccgctacaataatcagaaggacggcgataagcacaatttttacaatttaagctcccgcgaactgcagtaccagaaattcctattctacaagtactttttcgcaaatcctaaacccctgattgtgacagagggtaagactgacattgtctatctgaaagccgctctgaagaagctttacaatgagtatcctgatcttatcacgaaagacataaacggaacttttgagtttaaggtatccttcctgaagaaaacaaaaaggcttggatattttctgaacattcaggagggtggcactggactgaagaacatcaatgacttctttaatagcaacaacgctaaaaagtctgctatgaactacctaaactatttcaagaccatcagcaatacattaccacagtcaccagtgatccttatgtttgacaacgaaattaagtcaggcaaaaagaagcccattggagattttcttcatcatgcaaaagtcgacaatgagcaagttgatacgcttaagagcgagcacaagataaacatcatcgataacctctatctcctgacagttcctctgattgggaagagtgaatgcgacatagaggatttattcgataatacaaccttgtcccataagatcaatgggaagaaattcatcaagaaggacgactatgataccagcaaatattatggtaaggacatcttctcgaaatatatcctcgataactacctcaacatcgattttaacaacttccgcagcgtgttggacaacatcaacaacatcatcaatatctacatgaagcgggtcgtagacactggaaggaatatcgagacgacaaaaaatatagacgaatctgagaaagtgccgctggaaatctga

SEQ ID NO: 8457 - RNA, 1755 nt, unidentified
  source 1..1755: mol_type = other RNA; note = synthetic construct
atgatggaattcaatgacattaagacacgaaacggcctggctgacttcctgaagattccaaggaaacagctttcttatctgctgtatttcaaagacgtcaacaatctctatacctctttcgagattcgcaaaaagaatggcggaagtaggaagatcaaggcccccatcgaagagctgaaggatattcagaagaagctggccgaagcactctataaacacaaaaaggagaaacgagggaaaaagaacaatatctctcatgctttcgaaaaagacaagtccatcatcaccaatgccaagatacatcgcaataagagactggtgttaaatatcgaccttgagaattactttgagagcttccattttgggcgggtacggggctttttcgctaaaaacaatgactttctccttccgattgaggtggcaacagtgatagcccaaattagttgctatgagggcaagctaccacagggtgccccttcaagtcccataatatcaaacctcatctccaaaattctcgatcacaaaatcatgaagatcgccaagaaatacaagctagattacacacgttacgccgatgacttgacctttagcactaatgacaagaagttcctcgaccttcaatcagaattctacgaagagatttccaaagagattaagagggcgggttttaagatcaatgagaagaagaagcggctgcagtttcgtgatagcaggcaagtcgtcaccggacttgtcgtgaacaagaagatcaatgtgaatagggtgtattacaaagaaactagagccatggcgcaccaactgtacaaatatggtaagttcggaattaatggaaagcccgctaccttgaatcagctggagggccggttcacatttatcaaccagctgatctggtataataataagatcaacggggaatactctaatttcaattatctgcactcgagagaactccagtaccagaaattcctcttctacaagtattttttcgctcaccctaaaccactgattgttacagagggtaaaactgacattgcttacttaaagtcagcactgaaaagcctttacaaagaataccctaacctcattaccaaaaaagatgatgggacctttgagtttaaagtttccttcctgaacaagacgaagagactaaagtacttcttgggcatcaaccaggatggcggcagtgcactgaacaatatttacaactatttcgacagcaagaagccagcccccaattacctgagctactttaaacagatctctaataactcccctatcaaccccataattctcatgtttgacaacgaaattgagtccggaaagaacaagcctattgggaaatttctgaaacacgttggattagatgacggcaaaaaggttatcctagaggataaatacatggtgaacttgattgataacctgtttctgcttacggtaccgttaatcgatgggaaagcggaatgtgatatagaggacttgttcaaggacgacgcactgttgcataaaatcgatggaagagaattcatcaagaaagacaagtacgatgtctccaaatattatgggaaggagatttttagccgctatatcagtgacaactattcgaacatcaacttcaagaactttaagtcagtgctgaacaacataagcaacataatcgacatatacactcatcgcctcgtggatactgagcacgatacagaaggcaaaaagatcgacgagtccaacgccaataaagtgccattgtctattatctga

SEQ ID NO: 8458 - RNA, 1758 nt, unidentified
  source 1..1758: mol_type = other RNA; note = synthetic construct
atgatgaaattcaatgatattgaaacccgaaacgacttggcggactttcttaagattccgaaaagccagctctcgtatctgctgtacttcaaagacgttaacaactcctacacaagctttgacatttccaaaaagaatggcggtattcggaaaatcaaggctcctaccgatgaattgaaagaaattcagcgaaaactcgcggaggcattgtataaacaccgtgaaaagaagcagaacaacaacaacatttcccatgccttcaagaaggataagtctatcatcactaatgccaaaatccataggaataagcgctttgttttgaacatagatctcgaaaactactttgaatccttccatttcggacgggttcgcggcttctttgccaacaataagaacttcctgctgcccatgaaggttgctaccgtgatagcccagattagctgctatgacggtaaactacctcagggagctccaacatcacccataatttctaatctcatctcagagattctggaccggaggattatgaaaatcgcgaagaaatataagctgtattacacacgatacgctgatgatctgactttttccaccaacgacaaaaacttttcaaatcttcagaccgagttttatgaggagatctcagaagagattacgaacagtgggtttaaaatcaatgacaagaagaatcgcctgcagtttcgcgattccagacaggtggtcaccggcctcgtggtgaataaaaaaatcaacgtgaaccggatttactataaagagactagagccatggcacatcagttgtacacgcatggcaaatttgagattaatggtgagccagcaacacctaaccaactggaagggagatttagctttatcaatcagctgacctggtataacaacaagatagatggtgagaaacacacattctataatctgagttcgagagagctgcagtatcaaaagttcctcttctacaagtactttttcgctaattctaagcctcttatcgtgacagagggaaagactgacatcgcctatttaaaatccgccttgaagaatctatacgcagaataccctaacttaattaaccggaatagcgatgggacattcgaatttaaggtgtcattcctgaaaaagacaaaacgtttggcctacttcctcaaaataaaccaagacgggggatctgcactgaacaatatttacgacttctacaacgacaggaaaagaaataaatccacgcccaattaccttaggatcttcaaggaactgagtaacactagcccagaaaacccagtaatccttatgttcgataatgagatcaagtctgagggcaagaagcccattgggagcttcctcaatcacgctaaactgaatttcaagaagaagaccaagcttagtaatgactacatggtcgatatcgtcgacaatttatacctacttaccgtacccctggtcaagggaaagagtgaatgtgatatagaggacttatttgatgatggcgccctctctcaaatcatagacggaaaggagtttaccaaagaaaatgactatgatcactccaaatactatggcaaagagatattcagcaagtatgtggagagcgactatagtaatatcaacttcgacaggtttaagtctgtgctcgacaatatgaacttcatcatcgatacttacaagaaagagcacctgaataaggagcactcactggataccatcaacactgataactctaacaaggaccaggtgccgctggaagtctga

SEQ ID NO: 8459 - RNA, 1689 nt, unidentified
  source 1..1689: mol_type = other RNA; note = synthetic construct
atgagggctttttatgacgtgaagaaccgcaatgaattcgcagatcttctgaagatccctcggaaacaactcagctacgtgctgtacattaaagggataaacaacctgtatgccagctttgagatcccaaaaaaggacggtggcatccgaaagattaatgcccctttggaagagctaaaagtcatccagcgaaaactcgctgaggcactgtacgagcacaagaagagtaagcgaaaaaacaacaatatctctcacgcattcgagaaagacaagtcaatcataactaatgccaaaatacaccgcaataagaggtttgtgttgaatatcgacctggagggatttttcgagtcttttcatttcgggcggattagagggttttttttgaagaacaaggacttcttgctgagtgaggaagtcgccactgtcattgctcagatcagctgttatgagggaaaactgccacaaggcgccccttcatcccccgtaattaccaatttgatctgcgagatcctggatcatagaatctctaaggtggccaagaagtacaaaatgaattacacccgctatgctgatgacctaaccttctccactaatgaccggaagtttttagatctccacgtgaagttttatggggaaatcagcgaggaactgattagggcaggctttattatcaacgaaaaaaagacacgcctccagttcagagattctcggcaggtggttacgggtctggtggtcaataagaagatcaacgtgaaccgcatttactataaggagacaagagcaatggctcaccaactttacaaacacgggaatttcgagataaatggcgagcccgccacccttaaccagttggaagggcgtttcagttttatcaaccagcttacttggtacaacaataaaatagatggctcgaaaaaccatttctccaatctgaagtcaagagaactgcagtaccagaaattccttttctacaagtacttcttctccaatcccaaaccattaattgtaaccgaaggcaagactgatatcgcctatctgaagagtgctctgaaaaacctgtataatgagtatcccaacctcataaccaaaaattctgatggcaccttcgaattcaaggtgagctttctcaaaaaaacgaaaaggttaaggtacttcctaggaattaatctcgatggaggtagcgccctgaataatatctacaacttcttcgacagtaagaaaccggcgcctaactatctcaactactttaagtcaacatcgaatacatcaccaactaatcccgttgtcctcatgttcgataacgagatcatctctggaagagagaaaccaattggcaaattccttaatcattccgcgctcgatacaattaaaaggaagaccttggaaaaggaatatatggtagacgttattgacaatctctatctacttacagtccctctgatagatggtaagccggagtgcgacatcgaagacctgtttgaggatatcacaatctcccatcgtattgacggcaaggaatttacgaaggacaataaatacgacaacagcaagtattatggaaaagagatgttttccaagtacattctgaacaactacagcgatataaactttaacgagtttcgcttagttctggacaacctgaacaatattatgaacaactacaagaacgcgttcgtggaacgggtgtga

SEQ ID NO: 8460 - RNA, 954 nt, unidentified
  source 1..954: mol_type = other RNA; note = synthetic construct
atgaaagagttctacaacataaagacaagaaacgagtttgctgattttctcaatatccccaggaaacagttgtcctatgtgctgtacgtgaagggggtcaaaaatctgtacaccacattcgaaattccaaagaagaatgggggaatacgaaaaatcaatgctcctcttgaagaactgaaggatattcaaactaaactggccgaggccttgtataatcataaggagaagggcagaaagaaaaataataacatctctcacgcctttgagaagcagaagaacataattaccaacgcgaaaatccatcgaaacaaacgctttgtcctcaacatcgatctggagaatttctttgaatcattccacttcggaagggtgagaggcttttttaacaaaaacggcaatttcctgttcccaatcgaagtagcaaccgtaatagcacagattagctgctatgagggtaaactcccgcagggcggcccttctagtcccatcatcacaaatctaatttgtgagatcctcgatttccggatcatgaaaattgccaagaagtacaaactgcattacaccaggtatgcagacgacctaacgtttagcactaacgacaagaagtttctgaacctgcaggatgaattctacaacgagattagtaaggaaattgtcagggctggattcaacgtgaatgaaaagaaaacccgtcttcaattccgtgactcccgccaagttgttaccggactggttgtgaataaaaagatcaacgtgaatcgcgtgtactataaggagacgcgggccatggcccaccagttatataaacagggttccttcgagattaacggggaacctgctactcttaaccagttggaggggcggctgtcatttatcaatcagctcacatggtacaacaataagattgacaacatcaagcaccactttaacaatttaagcactagagagcggtga

SEQ ID NO: 8461 - RNA, 1752 nt, unidentified
  source 1..1752: mol_type = other RNA; note = synthetic construct
atgggagagtttaatgacatcaagacaaggaatgagttagccgatttcctaaaagtgccgcggaagcaactgagctacatcctgtacgtgaaagggtctaacaatctgtatacaagtttcgaaatcagtaagaagaacggcgggaccaggaatattaatgctccttcaaaagagctgaaagatattcagaagaagctagctgaggccttgtacaatcacaaaaagaagcgcggatctgcggataaaatcagccatgcatttgaaatcgataaggggataataaccaacgcagagaaccataggaataaacgatttgtgctgaacattgatctggaggatttttttgactctttccacttcggaagggtgagaggctttttcaacataaacatccacttctcacttccaatagaggtggccacagctatcgctcaaatatcttgttatgaaggcaaactcccacagggggccccctccagtccaatcatcaccaatctgatttcagagattctggatcacaggctgctgaagattgccaaacaatacaagctggattacactcgatatgccgacgatctaacgttctcaacaaacgataaaaactttcttgagctgcagaccgaattttacatcaaagccagcgaggtgatcattagagctggtttcaaaataaacgagaagaagactcgtttacagcttcgcgactccaagcaggtcgttactggcctcgtagtcaacaagaagattaacattaacagcgtctactacaaagaaacgcgggcgatggctcaccacttgtataaatatggggaattcgagatcaatgataagcctgcgacattgtatcagttagagggacggttcgccttcatcaatcagctcacttggtataataacaagctggacggagaaaaacatcattttcagcgcctctgcagcagagaaagacagtatcagaagtttctgttttacaagtacttcttcgcaaatcccaaaccactgattgtgaccgagggaaaaactgacgttgcctatctgaagtccgcccttaagaagctctacaacgaataccccaatttgatcacaaagaactccaatggcaaattcgagttcaagatctcctttctgaacaaaacgaagagattgaagcatttcatgggtatttttcaagacggtggtactgcactcaaaaacatatatgacttctttgactcgaagaagtctgacaccaccaactatctcagcttttttaagaaaacctccaatactctgccgatcaatcctgtgatcctaatgtttgacaatgagattcactcgggcgataagaaacccatcgggaactttctcaatcacgccaaactcgatgaaaagaaacgtgaggacttaaaacacaagaacttcgtcgacataattgacaatctctatttgcttaccacacctctgatcggggacaagagtgaatgcgatattgaagacctcttcgaggatagtgtactgtctcacaagattgacggcaaagaattcactaagaaggataaatacgacgtttccaagtactacggcaaagaaatttttagcaagtacatccttaccaactatagctcaattaacttcacaaacttccgcaccatattggacaatatcgacaacatcatcaatacacatcggaaaggcggtgcaggagctggacatgacctggaggaaaaaaatatcgatatgatttccgcaggcaaggtcctgcttgagatttga

SEQ ID NO: 8462 - RNA, 1680 nt, unidentified
  source 1..1680: mol_type = other RNA; note = synthetic construct
atgggtgaattcaataatatcaagacacggaatgggttagccgatttcctcaaagtcccacgaaaaaagctgtcctacattctcttcgtaaagggcacaaataacctatacagctcctttgagattaataagaagaacggagggacccgtaagatcaatgcgccctccgaggaacttaaagacattcaaaagaagcttgccgaggcattgtataaccacaagaaaaaaaaacagcgcgggtctttagaaaagatatcacatgccttcgaaatcgataaagggattattactaacgctgaaaatcacaggaataagaggtttgttttgaacatagacctggaggattttttcgattcattccactttggccgggttagaggttattttcataagaacgatcacttctctctccccttggaggtggccactgccattgcccagataagctgctatgaaggcagcctgcctcagggatcaccaagcagtccgattattaccaacttgatatgtgagattctggatcatcggattctcaagatcacaaaacaatacagactcgactatacacgatatgctgatgatctgactttttccaccaacgacaaaacctttctcgagagtcagacggagctgtacaagagaatctccgaagaaattaacagagctgggttcaaaattaacgacaaaaaaactcgcctgcagcacaaagatagccagcaggtggttacaggcttggtcgtgaataaaaagatcaatgtgtcaagtgtgtactacaaagagacacgcgctatggcccacaatctttacaagtatggggagttcaatataaatggcaatcttgcgactttgaaacagctcgagggtaggctctcttttattaaccagctgacgtggtacaacaataaaattgacggagagaagcatcattttcaacatctgtgttcccgggaaagacagtaccagaagttcctgttctacaaatatttctttgcaaaccctaagcccctgattgtgactgaaggtaagaccgatgtggtctatctgaaatctgcccttaaaaagctgcacaaggactatccatcactgatcataaaaaaatccaacgaggagtttgagttcaaggtatctttcctgaataagaccaagcgtttaaaacactttatgggcatctttcaagatggcggaacagcactgaagaacatctatgacttctttgctagttcgaaaagcaatattaactacctcagctacttcaaaaagacctctaacaaaagtccaaataaccctgtcatcctcatgtttgacaatgaaatcgagtccggaaataagaagcccataggaaactttctgaatcataccaaagcagatgaccgcaccaagatggacttaaagcagaagtacttcataaacatcatcgacaacctatatctgcttacaatccctctgatcggaggcaaaagcgagtgcgatatcgaggatctatttgaggactctgtgatatcgcacaaaatcgagggcagggaattcactaagaaggatgaatatgacatctctaagtactacggcaaggaaatcttcagcaagtacatttccaagaactatagtagcatcgacttcaccaatttcaggtcaatcctggacaacattgacaacatcatcaaatgtacggggtgcaagtga

SEQ ID NO: 8463 - RNA, 1479 nt, unidentified
  source 1..1479: mol_type = other RNA; note = synthetic construct
atgatcacaaatgcacgcaggcacaggaataaaagaattgtctacaacattgacctcgaagacttttttgagacaatccatttcgggcgcgtgcgcggcttctttaacaaaaatcggaacttccagctgcccatcgaagttgccaccgtgctggcacaaattagttgttttaagggcaaactaccacagggatctcctagctcaccaataatctcgaatttgatctgccagatcttagacaatcgactccttaaagttgctaaaaagtacaagctcgtctataccaggtatgctgacgacttaaccttctctacaaatgacaataagttcctggataaccaattcaatttctacaaggacctgagtgaggagattaacagatcaggcttcaaaataaacgagaacaagaaccgaatacagtataaagaaagtcgtcaggttgtcacaggaatcgttgtaaacaagaagctgaacgtgaacagagattactataaagagactcgggccatggctcatcagttatataagaccggcagcttcgaaatttctggggaatccgggaccataaatcagcttgaaggaagatttgcctttatcaaccagcttaccaggtacaataatgagctggataatcagaaacacgacttccataatctgagttctcgagaataccaatatcagaagttcctgttctacaaaaccttctactataatcccaagccagtgatcgtaaccgagggcaaaacagatattctgtacctgaaagccgctctgaaaaatctgtacgatgagtacccgaaactcattacgaagaataacgacggcacgttcaagtataacatcagcttcctgaaaagaactaagcggcttaagcactttttgaacattaacatggatggggcctcagcgttgactaatatctacgactttttttccaaccggaataataagaaggcacccaactatcttaagtattttaagagcctgaacaacagcctgcccaagaatccagtcatcttgctctttgacaatgaattgaacaacaacgaaaagcctatctcccacttttgtaggaaggtcgccaagatcggtgatgagaagatcgaggctctgaaaaccgaattcaaagtaaacctaactgagaacctgtacctcctcacggtgcctttgatcggtgaaaagtcagagtgcgagattgaggatctgtttgatgagtccactctcctagagcgtatagaagggaaaaccttcactaaggcagccaagtatgatgtgacaaagtactatggtaaggagatattctccaaatacattctcaagaactacgcagacgttaattttaatgagtttcgggccgtgcttgacaatatcaacgatatcattgaccagtataacgtggactttgtgacagtgggagataaagcgaaagaggtgcaactgaaacgcagcgatattgacaaagtccctgtggaaatttga

SEQ ID NO: 8464 - RNA, 1728 nt, unidentified
  source 1..1728: mol_type = other RNA; note = synthetic construct
atggagcagtttaataatctcaagagcaggaatgagttttcagattttctaaacatccctaggaagcaattgtcatacctcttgtacatcaagaagatcaacaattcttacacgacgttcgaaatccagaagaaatctggtggcgtccgcaaaatcagtgcaccatcagacgagctgaaggctgttcaaaagaagttggtggaggcgctgtacaaacataggaaaagcggcaatgggaataagtttagccatgcattcgagaaacagaagtccatcattaccaatgcacgtatacatcgtaaaaagcgatttgtgcttaacattgacctggagaacttcttcgagagtatccattttgggcgcgtgcgagggttcttcaacaagaacaaaaattttctgctgcccatcgaggtggccaccatcgtagcacaattatcttgctatgaaggtaaactcccccagggcgcccctagttcaccgattatatccaaccttatttgcgaaatcttggactaccggctgtttaaaatcgccaagaagtataagctgaattacactcggtatgctgacgatctcacgttctccaccaatgacaataattttgtgaataaccaggacgacttttataacatactttacactgagctggaaaaatccggcttcaagattaacgaaaaaaagaagcgcttacagctgaatagctcaaggcaagaagtgactggcttggtggtaaatgaaaaactgaacgtgaatagagtgtattacaaggagacaagggccatggcccaccagttatataagcagggcgaatttacagtgaatgggaataaggccacactcctgcaactcgagggaagattcagtttcattaaccagctgacctggtataacaacaaaatcgatgatcgaaaacacaatttccacaatctaagctctcgggagctacagtatcaaaagttcctgttctacaagtacttctttgctaatccaaagcctctgattgtcacagaaggaaagaccgacgttgtataccttaaatccgccttaaaaagcctgtataaagagtacccaaacctgattaccaaaaacaaggacggggcttttcagttgaaggtcagttttctcaacaaaacaaaacgcctgcagtatttcatgggaatctttcgggatgggggtagcgcgctgaataacatatataacttctacgaccacaagaaatccttaccggactatctcaagtacttccagaacatttccaatacctccccctctaaccccgtctttctgctgttcgataacgagattaagtctaagtcaaagaaacctatcggacagtttctcaatcatattagcctgaccgagaagagaaagtccctcctcgagatcgattatatagtcaagctaataggcaacttgtacctcttgactgtgccccttgttaaaggaaaagaagagtgtgacgttgaggatcttttcgacaacactgtcctgtcgcacaccatttctggtagaatctttactaaagaagacaactacgatgtaagcaaatattatggcaaggatatcttctccaagtacattcttaagaactacaacaacatcaacttcaacgacttcaaaccaattctggataatatatctcaggtggttgatagttactcgaaggagacagtcacaaatggagtgctggaaatcagccacaaagataaagttcctcttgaagtgtga

SEQ ID NO: 8465 - RNA, 1698 nt, unidentified
  source 1..1698: mol_type = other RNA; note = synthetic construct
atgctcaaatttaacgaaattaaaacgaggaacgagctcgccgaatatttaaatatcccgcgacgccagttgtcctacatcctgtacgtgaagggaatcaataatctgtacaccagttttgagatacccaaaaaaaatggagggagccgtaaaattaacgctccctctggagatctgaaagacatccagctcaaacttgccgaagctttgtacgcccacgtgaagaagaaactgaacaagaagaacaatatcagccacgccttcgagaagaacaagagcatcatcaccaatgcaaaaatccaccggaacaaaagatgggtgctgaacattgatctggagaatttcttcgaatccatccatttcggtcgagtccgtgggttttttaacaagaacaacaacttcctgcttcctatcgaggtggccactgtgatagctcaaattagttgctacgaaggcaagctgcctcagggcggacccagctcaccagtgatcagtaacctaatttgcgagatattagactataggctgctgaaaatagccaagaagtacaagctgaactatactcggtatgcagacgacctcaccttttcaacgaatgaaaaaaaattcccggaattgcagatggacttttataaggagatctcgaaagagattagaagagcaggctttatcgttaacgagaaaaagaagagactccaatatgaggacagtaggcaggaagtgaccggccttgtcgtgaataaaaaagtcaacgtaaaccggacatattacaagaagaccagagcaatggcacaccagctgtataagcaagggtcttttgaaatcgatggcgagccagccactattaatcagttggagggtcggtttgcttttataaaccagctcacatggtacaataacaaaattgacggtgttaaacgcaattttcggaatctgtcatctcgcgagagggaatatcagaagttcttgttctacaagtacttctttagcaaccccaaacctctgattgttacggaggggaaaactgatatagcgtacatcaagtcagccctcaagaacctgcatgatgaatatcccgaccttatctctaagaattctgatggcacattcgagttaaaggtgtccttcctcaagaaaacaaagcgcctaaagtatttcctggggatttatcaagacggaggctctgcgctgaataatatttacgagtttttcgatagccgcaaaccaattcccaactacattaagtacttcaagaagattagcaacagcttgcctcagaatccagtgttccttatgtttgataatgaaatccgatcgggcaagaaaaagccaattggaaagtttatagaccacgtaaagcttggtgatgaaaaaaagggaatactcgagaaagactatatggtcaatatagtcgacaatctcaatattctgacagttcctttaatcaaagggaaatccgaatgtgacatcgaggacctgttcgacgataccgttctgtcccatattattaacggcaaggagttcaataagaaagacaattacgattccagcaaatactatgggaaggagatcttcagtaagcatatcctaaagaactacacctcagtggatttttccgagttcaggtccgtattgaacaacatcaacaatatcgtcaatgatcagaagaaggctcttaaagaaaaatctatggtgtga

SEQ ID NO: 8466 - RNA, 1677 nt, unidentified
  source 1..1677: mol_type = other RNA; note = synthetic construct
atgaaagagctgcataacgtgaaaaccagaaacgaatttgctgattttctaaagatcccgcggaagaagctttcctacatattgtacatcaaaaaggtgaacaacctgtatcactcattcgagatctataaaaagtctgggggaatcaggaaaattaatgccccaactgtggagttaaaggatattcagcagaagttagccaaagcactctataagcaccaggctgacaaatggaacaaaaagcggaacaacctcagccatgcctttgagaaaaagaagagcataatcacgaacgctaaaattcaccgaaacaaaagattcgtgctgaatatagacctggagaactttttcgagagtttcaactttggtcgggtgagaggcttcttcataaaaaacaaccatctcttactgcctaatgaagtggcgactgttatcgctcagttgtcatgttatcagggaaaactccctcagggcgccccttcgtcacctatcatcacaaatctgatttgcgagatccttgacctgcgtttactgaaaatcgccaggagatataaggtagattatacaaggtacgcagatgatctgaccttctctacaaataaaaacagcttcctggaacaagaaacccgcttcctcgaagagatttctaaggaactaaagcgctctgggtttgagatcaatgaaaagaaaacaaggcttcagttcaaagacagtaggcaagtcgtgaccggattggtggttaataagaaggttaatgtcaagcgggactactacaaaaataccagggcgatggcacacactctgtacacacaaggcaaatttgagattgatggcgaggaggctacaatcgaccagctcgaagggcgcttttccttcataaatcaattggactggtctaataacatgaaaatcaaccggaacaacaaggactacaaaaatcgctttgctagttttaagagctcagagcgagagtaccagaagttcctgttttataagtatttctacgccaactccaagccactcattattaccgaaggaaaaactgacattgcctatctgaaatccgccctgaaaaatctgtacagcgagtatcccgacttgattacaaagaagaatgatggcacgttcgagttcaaaattagcttcttgaagaagagcaagcgtctcaattactttctggatatcaacaaggacggggcagaggggctgaagaagatctataaccttttctgcgaaaaaggtgatgtacgcaactactccaagtacttcaataagattagtgacacctttcccaacaaccctgtcatattggtttacgataatgagccatcaaatggcaaacccctgaatcagataatcaactatgcaggtctagagagagaaacgatccgagacaaactcatgatcactatagtggataatctgtaccttcttactgtccccccagtgaatgaaccgtctgagagtgatattgaagacctctttgatatcaagacccttgaacacaagatcaacggcaaaaccttcaataagaataatgagatggaccccactaaacattatggaaaggagagatttagccagtttatttccgaaaactactgtgatatcaactttgacaacttcaagcacattctgaataatatctccgacattgtcaaggaatacaaaaagtga

SEQ ID NO: 8467 - RNA, 1710 nt, unidentified
  source 1..1710: mol_type = other RNA; note = synthetic construct
atgaaaaagttcaatgacataaagacaagggacgatctttcagacttcttaaaaataccaaccagcaagttaacctatgtactctacaagaagaaaacctcaaatctgtatacctctttcgaaattcccaaaaagaacggaggcatcaggcatatcaaagctcctctcaaagaccttaaggaaattcaaaaaagactggccctctccttgtggactcatcaaaaatatatctggaaagagaacggcattaatcccaatatctctcacgccttccaaaaggagaagagtattattacaaacgctcagattcacaggaacaagcgctttgtcttgaatatagacctcgagaactttttcgattcatttcattttgggcgtgttaaaggtttctttgagaagaacaagcattttctgctgccacaaggcgttgcaactatcatcgcacagctcacctgttacgagggcaatcttcctcagggggctccgtctagcccaattataaccaatctgatctgcaacatactggatatgaagctgctcaagatatccaagaagtacaagctcaattacacgcgatatgcggacgacctcaccttttccaccaatagtaagcagtttctggttcaacagtcagacttccacgaggagatctcaaaaatcatcgaaaaggcaggattcaagattaatgagaaaaagacacggcttcagtttagagatagtaagcaggaagtgactggtttgatcgtcaacaaaaagattaacgtggacagaaactattacaaggccactagaagcatggcgcacagcctatatacaacagggacctttcagattgatggcgaaactggcacgatcaatcagcttgaaggacggtttacgttcataaatcagttggaccagtacaataacaagattaacaagagtatcgacaagacaaccaagctggggttccatcacctgaatagtcgggagaaacagtaccagaaattcctgctgtacaagtatttttttgtgaacaacaagccgctgatcgtgacagagggtaagacagatattgattacatcaaatccgccctcaaaaatctgtacatccattacccaaacctagtgaccaaaaatagcgacgggacttttgaattcaaggtatctttcctgaataggactaaacgcttgcgatattttctagatattcagcaagacggagccgataccatgaagaacatctataactacttcaacaacaacggcaaggacagctaccccaatcactttaaaaaatttcaggagtctggattcactcctgcaaaccctattatctttattctggataacgaactgtcgaacaaggagaaacccctgaagaatctcacaaatcacatcaaattggacaaagataccgccaagaaagacttcttcaaaactaacttctacatcaacatcacatccaacttatatttgctgacacatcagcttgtcaaggaacttcccgagtgcgagatcgaagatctgtttgatgacttaacgctcaatcagactataaatggaaaacggttcgagcgcgataccaaaatcttcaacagcgctctacactgttctaaagccaaattcgccgatcacattagccagaattacgaaaagattgacttcaacaacttcaagtgcatgctggataatctgaacaccattgtgtcctcctatggtaataattga

SEQ ID NO: 8468 - RNA, 1707 nt, unidentified
  source 1..1707: mol_type = other RNA; note = synthetic construct
atggacaaattcaataatatcaagaccctttacgacctgtcttatttcctgaaaatcccaacgaggaaaatcacctacatcctctataaaaagggaattgacaatctgtacacaagcttcgagatccctaaaaagaacggaggggtgcggcacattaatgcccccagtaaagatctaaaagacatacagcgcaaattggtgttgtctctctgggctcatcagaagcacatctgggaagaatcaggcaagaatttaaacgtctcgcacgcattccagaaagagaaatccattattaccaatgctcaaattcaccgcaataaacgttttgttctgaacatcgacctggaaaatttttttgagtctttccactttggcagggtacgcgggttctttgagaaggacaaaaacttcttgcttccaaagaaggtggcgaccatcatcgcccagctgacttgttatgagggacatcttcctcagggtgcccccagctcacctattatcaccaatctgatctgcaatattctggacatgaagttgctgaaacttagtaagaaatacaagctgaactacactcgatatgctgatgatctcacattttccacaaacaacaaacattttctcgatcaacagtctgatttctatgaggaaataagcaagatcatcgaaagagctggtttcaagattaacgagaagaaaactagacttcagttccgggactctaaacaagaagttacaggtctggttgtgaacaaaaaggtgaacgtggatagaaattatcataagatcactaggagcatggcccacagtctctacacgaaggataattttcaaattgatggggagtttggcgaaatcacacagcttgaggggcggttcagctttataaatcagctcgatcggtataacaatttagtcaagaaggaccgagacaaaaatgtgaagctgaactttcgaaacctgaattcacgggaaaagcagtatcagatgttcctgttttacaagtacttctacaaaaacaagcgcccgctcatagtcactgaggggaagacagatatcgagtatctgaagtctgccctgaagaatctgtataaggactatcccaacttgatcacaaaaaaaagcgacgaaaccttcgagtttaaagtttcctttttgaggagaaccaaacgtctgagctacttcttagatattaaactcgacggagccgacaccatgaagaatatttacaactactacatcggcaaagaaaacaacggttacccaaacttcgtgaaaaagtttaaagacctcggatcgatcccaaataaccctgtgatttttatactcgacaacgagctgaataattcaaataagcccctgaagaagatcatgaaccatatgggcttaaacaaaggcgtcagcaaatcaagtttcttttccgaagattactacattcacataacggagaatctatatctactgactcatcagctagtcaaagatctgcacgaatgcgagatcgaggatctcttcgacgatagtatccttaaccaaaagattcatgggaagaatttcgagagagatgataagaagttcaacattaacaaccactatggcaaggcaaattttgcagactacatatccaagaactataggtccattaacttctccaagtttaagtgtatgttggaccacttaaactctatagtaaccttcaagtccaattga

SEQ ID NO: 8469 - RNA, 1716 nt, unidentified
  source 1..1716: mol_type = other RNA; note = synthetic construct
atgaataagttcaacgaaattaagaccaggaatgatcttgcagacttcttggatatcccccggtcaagattgacatacatcctgtatggcaaaaagattgaaaacttctacacgagctttgaaatactaaaaaagaacggagggactcgacagattgacgccccgaataaggagctgaaaatcgtccagaaaaaaattgcgaatgccctgtggaaccactataagggtctggccaagaaaacttcctcaaagaccaacttttcccatgcctttgagaaggaaaagagtatcattacaaacgctaaaatccatcggaataaaagattcgttctgaacatcgatctcgaagacttttttcacagtttccacttcggccgcgtgagggggttcttcgagaaaaataacaatttcaccctgcctaaagaggtagccacagttatggcacaattagtgtgttatgaaaagcatctgccacaaggagctccttcctctccaatcatcaccaaccttatatgtaacatcctcgatttccgtatgctcaaactgagccgcaaatataaatttgactacacccgatacgcagatgacctcacattctcatccaataacaagtatttcctggagaagcaccaggagatctatgacgagattagcaatgagattgaacgggccggatttagaatcaatgagaggaaaacaagactccagtatagggactctaaacagcaagtaaccgggttagtggtgaataagaaaattaacgtggatcgcgtgtactacaagaaaaccagagctatggcatttagtctctatagctgcggaagctttgagattgagggcgatcagggttctattaatcagctcgaaggtaggtttgcttttatcaatcaactagatcgctacaacaacaaactgtcaagcgagaaaaacgattttcggacactcaacagtcgagaaaagcagtatcaacagttcctgtattacaagtacttctttgctaacaagaagccccttatcgtgactgagggtaagaccgacgtcagatacctgaaggccgcaatgaagagcctgtgcgacgagtaccctaatctgatcacgaaatcctctgacactgaattcgaattcaaagtctcgtttctacgccggaccaagcgtctgaattacttcttgaatataacccaggatggagccgatacgatctcaagcatttataaattttcccaggcgaataatgagaagggctacatcaactaccttgaatacttcaagaaaatcagcaacactaaccctaagaatcccgtcattcttatcttcgacaatgagttgaatggagatcagtccaaaggcaagaacaataaaaataagcccttgcagaagttcatcaacctcattaacctcgataatgaatcccacgagaaattcaagaactcgctttcttacaacattctgggcaattttcacttactgactaaccagttagttaataacaaggatcaatgcgagatagaagatctgatagagtcaaaagtgtggaataataggatcggggggaagacttttagtattgacaaggagtttgacttggacaagcattttggcaaggaaattttcagtcagtacatcgaacagaactatgagacaatcgacttcgagaactttaaaccaatactggacaacatatctcagattatagacgagtataacgtcaagtcttga

SEQ ID NO: 8470 - RNA, 1701 nt, unidentified
  source 1..1701: mol_type = other RNA; note = synthetic construct
atggacaccattgacaaagtaaaaagtcgcaatgaactggcagacttcctggatataccacgcaagaagttgagctacatactgtatatcaaaggcgtggacgacctctacactagtttcgaaattcccaaaaaaagcggcgggttccgccatatttatgcaccacagaaggatctcaaggttatacagagaaaactggccgaagctctatacaactgccagaaagagatctggaataagtgcaacgtcaacccaaatatctcacatgctttccagaaggaaaagtcctttatcaccaatgctaaaattcaccgtaataagcgctttgttatcaacattgatctggagaatttcttcgattcttttcactttggaagagtgcaagggtatttcctcaagaaccggtcttttcagcttccgtctgaagtggccaccgtcattgcacaattaacatgttaccaggggaaacttccccagggcgctcctactagtcccatcatcacgaacctgatctgcaacatcttcgatgttaggatttccaagctggcaaaaaaatatcgactggattatacgcgatacgtggacgatctgaccttttccacaaacaataaggagttcctcaacatcaaaaacatttttttcgaggagctcgaaaaagagatcattaatgccggcttctccattaataaaaaaaagacccgaatccagtacagagatagcagacaggaggtgaccggtgtggtggtgaataagaaattgcacgtcagccgtgattattacaaaaggaccagggccatggcctatcagctttacaagtctggcgaatattttatcgaaaacgagatcaaagggacaatcaatcagctggaaggtcggttttcattcattaatcaactggagtggtacaacaacaagttgaatcttgaggggaaaaaacttacctacgagtacctgaacggtcgggaaagggcgtattcccagttcattttttacaagtacttcttcgccaatcccaagcctttgatagtcacagagggtaaaactgacgtcacttacctgaaagccgcgcttaagaatctgtggaaggaatatccaaatctggtatctcggaattcaaagggccagtttgagtataaggtgagctttttgcaacggtcgaagaggtttgcttactttctcaattttaagaaggacggggcagacactatgaacaacatctataagttcttcagcgaggaggggggagagaagtatcccaactatattgagatgtttaagaacctgggatcaactgtacccctaaacagtgttatattactcttcgacaacgaactcaacaacaaaaacaagcctatctacaagtttgtgtcgaacaaaataagtgatgacagaaagaagcagctatgcacgaggacctggataaatctgctcgaaaatctctacctgatgataacaccgctggtcggcgagagcgaggaatgtgatatcgagatgttattcgatgaagccacattatctcatgaaatcggaggcaagaaattttgtaagaaggacacatacgatacttcaaaattctatggcaaggagatttttagccagtacatcatgaagaactactcctccatcgacttcggaggattcaaacctctgttgaataatattgacgtggtgatcaaggactataaagagcgcattcaatga

SEQ ID NO: 8471 - RNA, 1698 nt, unidentified
  source 1..1698: mol_type = other RNA; note = synthetic construct
atgaacaccatcgacaaaatcaaaacccgaaatgaactggcagatttcctggaagtcccccgtaaaaaactgtcctacattctatacgtcaagggggtggacaatttgtatacctcttttgacatcccgaagaagaatggcgagagtcggcatattcatgccccacagaaggacctgaaagtcgtgcagaaaaaactggccgacgccttgtgtacgtaccagaaggaaatttggaaacgccgtaatatcaatcctaatatatcccacgcgttccaaaagggaaaaagctttatcacgaatgcaaaaatccacagaaataagcgtttcgtggtgaacattgatctggagaacttcttcgactcttttcactttggacgcgtgaggggctttttcttgaagaatgatgacttccagttctccgtcgaggtggccaccgttattgcccagttgtcctgttaccaggggaaattacctcagggagctccttgctcccctatcatcactaatctcatctgcaacatattcgacattagactcctcaagctcgccaagaaatattgtctggattataccaggtatgcagatgacctgacatttagcactaacgatgtaaagtttcttgagatagaagagctgttcttcgagaaactggaaaaagaaattaactcagcaggttttcggatcaacgagaaaaagactagaatccagttccgagatagccggcaagaggttactggcgtagtagttaatcggaaactgcacgtcagtcgcgtgtattataaaaagacacgggcaatggcttataacctttacaagacaggagagtatttcatagaaaaggatactcaagggaccattaaccagttagaaggcagattcagcttcattaatcaactggagtggtataataacaagctgtatccaggtaacaagaagctcattttcaacaatctgaatggcagggagcgcgaatattcccagtttgtcttctacaagtactttttcgcgaatccaaagccccttattgtgacggagggcaagaccgacgtgatatacctaaaggctgctttgaaatcattatggaaggagtaccctgagctggtttctagagataagaacgggcactttgagtataaaatcgctttcctacgaagaagtaaaaggcttgcctactttttaaaccttaaggaggatggcgccgacaccatgaacaacatctacaacttttttagcaagaacgggggagaaaagtatcccaattacatagaggtgtttcggaagcttgggaataggtttcccctgaatcccacaatcttgctctttgataatgagttgagcaacaaggaaaaaccggtgtgtaaatttaccaaaggtaaaatctcggaggagcagcgcgaagaactcaattcgaagacctggatccatatgacagaaaatctgtatctcctcatgacaccactgatcaacgaaaggaacgaatcagatatagaaatgcttttcgacaacttcacactctcaaaggagatcgacggtaaaaagttctgcaaaaaagatcgctacgacactgacaagttttacggaaaagagattttcagcaagtacatcatgaagaactactctaacattgatttcagtggctttaagccactgctgtctgacatcaaaattatttgcgagaactacaagaagaagatgtga

SEQ ID NO: 8472 - RNA, 1764 nt, unidentified
  source 1..1764: mol_type = other RNA; note = synthetic construct
atgagctccattctggttggctatctttcagcctcacataatgagttgccacacgtgcttttctatgttctcggggattctatgaacaattttaaagacgtccgcacccgcattgcccttgcgaatctcttgggcgtgcccgagaataagctgacctatgtcctctatattaagaagattgagaacctctacacttcttttagcatccccaagaagaatggagaatcgcgccatatcaatgcccctcagaaggaccttaaagatatacagaaaaaactggcggactgcctgtacgaatatcagaaggagaataggatcaacaacaacattaagaccaatattagccacgcttttgagagagacaagtcctttattaccaatgcaaaagttcacaggaataagagattcgtgtacaatgtagacttagagaacttttttgggagctttcacttcgggagagtcaaaggcttcttcgaaaagaataaggacttccaactgccatccaatatcgccacggtcatatcacagatcgcttgttatcagggcgagttgccccaaggtgccccttccagcccgataattaccaacctgatttgcaacatctttgatatcaggctgatcaaactcgctaagaagtacaaactggactatacaagatacgccgatgatttaaccttttccaccaacaataagaagttcctagacactatttcagactttcactctgaacttagtaaggagattaaacaggctggcttcgagatcaacaataacaaaacacgtctgcagttccaggatagtaaacaggaagtgacaggtcttaccgtgaacaaaaagctgaacgtggataaaagttacttcaagacaacacgcgcaatggctcaccacctctacacccagggatctttcaaaatcaatgacaaggacggaactataaatcaactggaaggacgttttgcatttattaaccagctggaccggtataacaataagctggataatgggagtcataacattagggaactcaattcccgagaaaggcagtaccaaaaatttctcttctacaagtacttctacgcaaacaacaaacctatcatagtcacggagggcaaaactgatattttgtatctgaaagccgccatcaagaaattccattcggaatatcctgcgttgataaacaaacgatcagacggcaaattcgaatttaagattagcttcctgcggcggacaaagcgcctgaactactttttagacctgcaaaaggatggggccaatactatgaagaagctgtacaatttcttcagtaataaggaatctcggcactttcccaactactctgcatactttaaaaaaaacagcgtggttccaccaaagaatcccgtgatttttgtgtatgataacgagctcaagaataagaagaagcctatcatcgacttcttgaattacgctaacatcaaaccggagaaaagactcgaactagctgagatcctaagtatcaagatcatcaacaacctgtttctactgaccaatcctttgatcgtagaaccagagtccgagatcgaggacctgtttgacgagaagacattatccatcgtgcttaacggaaaaactttctcccggaatgacgatagcaacgataaagagcattatggtaaggagatcttctcaaaacatattagcagcaactactctaagataaacttcgataacttcaggcccatgctcgatcgaattactgccataatggagacgtatgaaaaatga

SEQ ID NO: 8473 - RNA, 1665 nt, unidentified
  source 1..1665: mol_type = other RNA; note = synthetic construct
atgaaaaagttgaaagagcttcaaacaagggaggacctcgcactgtacctcgccataccactgcagaagcttacctatattctgtacaaatctaagccggattcctactacgacaccttcgagatccctaagaaaaacggagagtcccgccaaattcatgccccttcaggagatctcaagcagttacagagaaaactggcccagaggctctgggatgtgtatcgggaatttatagaagagaacgaaattcaggacaatatctcccatgcctttcaaaaaggcaagagtattatcaccaacgctaatattcaccgaaacaaacggtatgtgttaaaccttgacctgaaggatttcttcgatcactttcactttggcagagtgaggggattcttcatgaaaaacaagaatttcgagctccctgtggagattgccactatgatcgcacagttgacgtgctacgagggcaagctcccacagggtgctccaaccagccccattatcacaaatctggtgtgcaacattttggatatgcgtttactgaagatcgcgaaaaaatacagggtagtctatactcgttatgctgacgacatgacattttctactaacgataagaagttcctcgagaaccaggagaacttcatgaaatcgataaagaaggaaatcgaaagctttgggtttgagattaacgataaaaaaacccgcctgctgttctgtgacagccgtcaggaagtgaccgggctggtagtgaataagaaaatctctgtcaatagggagtactgcaaaagaacaagagccatggcggatgctttttatcgaagggggatctttgaaatctgtggggaagagggaagcgttaatcagctagaaggacgaattagtttcattaaccagatagactgctacaataataagaatgaccgggaacagaagcataccttctggactttaaatgcacgcgaacgccagtaccagaaattcctgttcttcaagtatttttacgcaaatacgaagccactaattgttacagagggaaagactgacatcgtgtatctgcgggcagcccttaaaaagtactataaggaatatcccgaactgataaagaaacaagatgacaacttcgaattccaggtcacctttctgcgcagatccagcagactgaaatattttctcggcatccaaaaggacggcgctgataccatgaagaacatctataacttctactctggcaagaacaacgcccccaaactctattcatggttcgcccaaaattcttgtaaaaagtcccagaaccccgtgatttttatcttcgataatgagcaggtatccgatcggcctttgaagaagttcttgaaccacctgaacaacaagggccttctggagagtagcaattataaccatatccaagacaatctctacatattgacaaatccgctggttaatgggaaaaaggagtgtgaaattgaggacctttttgatgatgtcgtgctgtcacacacaatagacggcaagatcttctcacggaaagaaactgacaatgagaagtactacggtaaagctattttttcccagtacgttgagcgccagtacgattctatcgactttagcaattttaagcccatgctagaggacatcaaaagtatcgtcggtagcaaaaagcaggggtga

SEQ ID NO: 8474 - RNA, 1659 nt, unidentified
  source 1..1659: mol_type = other RNA; note = synthetic construct
atgctcaagtttaacgaaatctcctatcgagatgagctggcagagtttctgaatatccccttgaaaaagctgacctatatattgtacgtaaagaaagtggactcttattacacatcctttcagatcccaaaaaaaaacggggactacaggtccatagatgccccgtatggcgacctgaagtatatacagaagattctggccattaagctctgggagtatcacaacaaatacaccagtgataacaacatcaatatgaaagtctcacatgctttcgaaaaaaagaagtccattatcacgaatgccatcattcacaaaaataagcggttcatactgaacattgacttatctgacttctttgcctcattccactttggaagggtgagaggatttttcgagaaaaacaaggagttcaatcttcccatagaggtcgctacgattattgctcaactaacttgctataaagggcatctgccacaaggtgcacccagcagccctatcatatctaacctcatttgcaacatcttggatatgaggttactgggcatttcccaaaagtacaaacttgattataccagatacgcagaggatatgaccgtgtcaaccaacgacttcaaattcatttacttagttgacgacttcatgaaagagatcactaaagagatagagaaatctgggttttctatcaacaacaaaaagaccaggtttgttttcaatgattcacgtcaggaggtgactgggctggtggtgaacaagaaaattagcgttaatcgggattattgcaaaaagactcgggccatggccgatagcctttacagaaagggtgaatatgttatcaatggcagtaagggaactattcaacagctggagggaagattcgcctttataaatcagatcgaccgcttcaataataacttcaactacgtcaagcacaaaatctgggatttcaattcccgcgagaagcagtaccagaagtttctgttctacaagtatttctacgccaatacaaaacccttgatcgtcacagagggaaagacagacattctgtatattaaggctgctctgaagaagtactattataagtaccccgaactaattttcaagaaggacgaagactacatctttaatatctctttcctcaagcgatccagctttctggagtattttctgaatatctatcaggatggggcggatgacatcaaaaatatctacaacttctacgtgggtaataaccattacccaaacctttacgaattttttctcgaaaagtcaagtctcaaacctaaaaatcctgtgatcttgatcttcgataacgaacagaattcggatcggccgcttaagaaatttctcaaccacattaagatcgacagcaaaaatttcaagagcggccagtgtatatacgcgaacatatacctaatcacaaatccactggtaaagggcaaagcagaatgtgaaattgaggatctgtttgaagagacaattctcgaaaacgtcatcgaagataagaagtttagccgcgagaaaaagtatgacatcaataagttctacggcaaagacattttcagtaagtatatcaacgacaactacaaaaccatcaattttgacggctttattcctattcttgacgatatcaacaaggtggtgaccaacatggacttctga

SEQ ID NO: 8475 - RNA, 1686 nt, unidentified
  source 1..1686: mol_type = other RNA; note = synthetic construct
atgaagaaactgatggaaattaagaccagaaatgagtttgccgatgtgctcgagatccccaggcagaaactgagctacatcctgtatgtcaagcacgtggacgaaatgtacacaagcttccaaatcccaaaaaaaaatggcgatttccggaatatcaacgcgcctattgaggatctcaagaatctgcagaagaagctttccgaacttctgtgggagtgtcagaaggagattaggatgaacaatgggatagattcaaacatgtctcacgcattcgaaaaagaaaagagcatcattacgaacgctatcatccatcgcaatcgccggatcgttctgaatatcgatctggaagatttctttggcagcatccattttggccgagtgaaagggttctttgagaagaatcgggattttaaacttagttctgaagttgcaaccatcattgcccagttggcctgctatcgcggagtgttgccccaaggtgcacccagtagccctatcataaccaacctgatctgcaacatgatagacatcagacttctcaaaatagctaccaaatacaaggtaaactacacgaggtatgccgacgatctgactttttctaccaataacaaaccctttctagacaagcagtccgagtttttatcagaggtgactaaggagattgaaagaagtggattcaaggtcaataataagaaaacgcggatcctctttagagactcccggcaagaagtaaccgggctgatagtcaatgagaaaatttcggtgaacagaaagtattacaagaaaagcagagcgatgtcttatcagctgtataaatctggcagctttgagatcgacaatgaggagggcagtgtcaatcagctggaaggacgatttgcctttatcaatcaactcgactggtataacaacaagcgcgatggcttagaacacaatttttggagcttgaattccagggagaaacagtatcagaagttcctgttttacaagtacttcttcaacaacaacaagccgttggttatcacagaggggaaaaccgatatcgattatattaaggccgctttgaaaaacctgtacattgagtatccggacctggtaactaaaaactccgacggtacatttaactttaaagttagtttcctccggaagagcaaacgcctgaggtacttcttaaatattcacctcgatggtgctgacacaatgaagaacatttacaagttctactccgacaaagagaataacaagttccctaacttctgtaagtacttcaaagagctttcaggtaacataccaactaagcccgtgatcctgattttcgacaacgaacttacaaacaaagaaaagcctctatacaagttcgtgaattatgccggcttaaacgggttgtctcagtgtattaaggagaagctgaatactaagctcacagataacctctatctcatgaccaatccacttgtctcaaataagacagagtgcgagattgaggacttgtttgaccgtgaaaccctatcgcatgaaatcaatggaaaattcttctcaaggaacaagacttccgacaacaataaattctacggaaaggaagtgttcgctaaatacatatcctcaaactaccgtgagattgattttgacaacttcaaaccaatactgaacatgctgaatgacattgtgtctctgcgaaagcaggcatga

SEQ ID NO: 8476 - RNA, 1713 nt, unidentified
  source 1..1713: mol_type = other RNA; note = synthetic construct
atgaagttcaatgagatcaaaagtagaaacgagttggccaactttttaggcattagcatcaggaaattaacctacatcctctattctaagaagactgaatcttgctatacgagtttcgatatcccaaagaaaaatggaggcgtgagaaacattaatgcccccactgaagatctcaaacatattcaagtcaaacttgcaaatgcactttgggaatacaagaaatccatcatcaaggagaagaatatcaatgttaagatctctcatgctttcgagaagagaaagtccattataacaaatgcacagatccatcgtaagaaacgcttcatcttcaacatagacctagagaatttcttcaattccatccactttggccgtattagaggatactttgaaaagaacgagaacttcaagtttcctattgaaattgccactataatcgcgcaactgacctgctataatcactgtttgccccagggagctcctagctctcccattattaccaacttcatctgcaacattctggatatgaagctgctgaagatcgctcgaaagtataaaatggactatactcgatatgccgacgatatgacattcagtacaaacgataacaactttctcaacgaaatctccacattttacgccgaaattgaggagaagatcaatcagaacgggtttaccataaatggcaataaaacacgcctggcattccaaaattctaggcaaaccgtgaccgggctcgtagttaataataaaatatccatcccacgggagtattataagttaacacgggccatgatttactcattgtataagaacggggaatttacggctaatggcgtgaattccaccatcagacagctggaaggacggctagccttcataaaccagattgacctctacaataacaggattaccgatggccctcacagcatgcggactctgaattcacgcgagaaacagtatcagaagttcttgttctacaagtacttcttcatcccgcagaagcctctgatcgtcacggagggtaaaaccgatatagtgtatctgaaagctgccctgaagaaatactactataagtatcccgatctgattaccaaaatcggagataagtttatcttccacattagctttctgaaacgcactaaaaggctggcttacttcttgaatattaatctagacggggcagataccatcaagaatatctacaacttctacacaggtatagactcagtgccgaacatatgtaaatggtttgacgagaaaactaacgtcaggcgcattaatcctgtgatacttattttcgacaacgagcaggaaaacaacaagccactcaaaaagtttatcaatcacatgcagaagagccggcagaacaaagagatcaagctggagaaccccaggtacaaaaacatcattgacaacctgtaccttctcacaaacccactcatgaaaggtaagaatgagtgcgaaattgaggacctgtttaataaccagactctttcgcataagatcaacggtaaatctttttgtcgaaatggcaagtttgatagcgaacaatattacgggaaggaaaaattttcacagtacattgcctccgactacgagagtattgacttcaaaaattttcaggagatgctgaacgacataaacatcaccatcaacgaatataagagcgcgaatgagaacgaagagccaatcaaaaaggtatgtaaatga

SEQ ID NO: 8477 - RNA, 1683 nt, unidentified
  source 1..1683: mol_type = other RNA; note = synthetic construct
atggatggctttaccaacattgctagcagaaatgaactggccgatttcctacgtatacctcgcaagaaactgacccacatcctatatatcgaagaggtcaacaatctgtacacatcattcgatattccgaagaagagcggggaaaagcgccacattaatgctcccacagacgacctgaagagcgttcaaaaacgcctcgcctacgctctttgggaacaccagaaaaacgtttgggaggagaaggatgttaatcctaacatttctcatggctttgagaaaaacaagtccatcatcacaaattctcggattcatagaaacaagcgcctagtgctgaatatagaccttgagaacttttttgactctttccactttggccgaatcagagggttctttgacaagaacatcgatttcaaagtgccgattgaggttgcaaccgtgattgcccaactgtcctgctataaaggatgtctgccccaaggagcgccctcctcccctattctcaccaatctgatcgggaatattctcgatatcagactcttgaagctggccaagcagtataagctggattatactcgctacgcagacgacctgaccttctcaactaacaatagggacttcctggctaactatcccacctttatcaaggaactaagtatcgaaattgagtcttctggattcaggatcaatcatcagaaaacccgattgcagtaccgggattcaaaacaagtggtgacaggactgatcgtcaaccagaagattaatgtggacaagtgttactacaaagtgacaagggccatggctcacagtctctattcaaaaggcggactcactataaacggtaaggagggaactatcaatcagctggaagggcgatttagttttatcgaccagatcgagagatataacaacaccatagatgaggacagccatgacttccggaatttgaacggccgggaggagcagtatcggaagttcctttttttcaagtacttcttctccaactccaagccactcattgcaacggaagggaaaacagatgtagcttacctcaaggcagccttgaaaaatctgttcgcgttatatcccgatcttatcagcaagaccgaatcggatgacttcgaatttaaagtaagtttcctgcgtaggaccaagaggcttaggtatttttttgggctgtccttggacggggccgacacgttgaagaatgtctacaatttttacactggcaaagaaggcctgccaaactacctgaagtacttcaatgtcatgtcatctgacaagcctaaaaacccagtcatcttattgttcgacaatgaactggccaataagaacaagcctctgtataaactcgtgaacaacaatggtctgaatgagacacagaagaaagacctcagcgacaaattaaatgtgaagataagcgagaacctttttcttttaacccacccattggcagagggtaaagacgaatgcgagattgagaatctgtttgatatagagacactctcgcatgtgatcgagggtaagactttatcccttgatagcaaatttgacaacaacctgtactatggcaaagaaatattctccaaatacatctctagcaactacaaggatatcgatttttcaggcttcagacagctcctggataaactcaacgagattattacgactttcaatagtacttga

SEQ ID NO: 8478 - RNA, 1785 nt, unidentified
  source 1..1785: mol_type = other RNA; note = synthetic construct
atggctagttttaccgacataaaaacccaggatgacctgtttaagctgcttaacattcccaagaaaaacatgacgtatctgctgtacaacaaagaggagaaaggccctgagaatgcttaccacactttttccattctgaagaaaaatggggacaagcgcgaaatagatgcgcctaacgacgagctcaaatttgttcaaaagcggcttgcaatactgttgtgggccaatcaaaaaaagtcatggcgcctcaataacactaaaccaaacatctcacacggttttgaggagtctaagtcgatcattacaaatgccaaaatccacaggaacaagaaaatcgtgcttaacctggatttagaggatttttttcccagcatccattttggcagagtgaaaggcttttttgagaagaacaagaatttcaaggtgccaaaggaggtagctctggtgatagccaggctcgtctgctataaaggaaggcttccccaaggtgctcccaccagcccgatcatcagcaatttgatttgtagaatcctggacttccggctcttgaagctggccaaaaagtatcgactggattatacacgatatgctgacgacctgacatttagtactaattcctctagtttcgtggatgaagaacagttcttcctcgacaagttagaaaaagaaatcattagagcagggttcaagataaatgccaagaaaaccaggttgcaattttccaattccagacaggaggtaaccggacttaccgtcaataaaaagttgaatgtcagcaaggagttctataagaatactcgggctatggcacataaactgtacaccacaggagagtttttaattgatggtgaatcaggaacgatcaatcagcttgaaggccgattcgcctttatcaaccagctggacaagtataataacggcctagagtacgagatttccctgaataaaaacaatatcgagtaccagaagttcctgctgtccaccattaaagtcgagaataaccatcagatcatgttactgaatctgaacagcagagaaaaggaataccagaagttcctatactacaagtatttttacgggaacgaaatacccacgattgttacagaaggaaagactgatattcgctacctgaaagcagccctgaaaaaaatgtacaaggattatcctatcctgatcgaaaaaaacgggaacgattataaattcaaggtgcactttctcaagcgtgtgaataaaaagggcaacaaggacatttctcgtctgaagtacttctttaacttgccaatcgatggagccgacgcgatgaagaatctatacaatttcttctccgacaagaacaataagttatatcctaactacctggagtatttcaactttctctctacatcaaagcctagcaatcccacttttttcattttcgacaacgagctcaataatgacaagaaaccgctgcgggggttcatcaactacataaacgagaagaagaatatgcagagtcttaaggataacgggagtctccgggtgaccgaaaacctctatgtccttacaaatcagcttatcggtgaagcagaagaaaacgaaattgaggacttgttcgataaaaaaaccttggagcacaaaatcggcgggaaatcattctcgaagaaatccattagcgagaaaaacaatttctacggcaaagagattttctctaagtacgttctcgacaattttgaaaacatcgacttcgagaacttccgcccaatgctaaacaacctctctaggattatcagcgattatggcaagtga

SEQ ID NO: 8479 - RNA, 1749 nt, unidentified
  source 1..1749: mol_type = other RNA; note = synthetic construct
atgaacgttttcaaagatgtggagaatcgcgacgacctctttgaaaggcttggaattagtaaacaactggccacttatctgctgtacggtaaaggcattgataattgctactcaactttcgtcatcgagaagaggaacggcgatccccgggtaatcaatgccccaaataaggagttgaaaagcgtgcagaaaagattggtaaacgcaatcctgctgcaaagaagctgtaataatcaaaacgggaaaagcctcaagatagcgcacgccttcgagaagaataaaagtattatcacgaacgccaaggttcatcggaataaaagattcgtactcaacgtggatttagaagacttcttcacttcctttcactttggccgtgtgcggggctttttcgagaatgataatacattcaaggtccctcgcaaggttgcaactgtgatagcccagttgacctgctataagggagtgctcccacagggagctccttctagtccgattattacaaacctcatctgtcgcatcatggacctgagaattttaaagctctctaagaagttcaacctaaattacacgcgatacgccgatgatctgtgtttttccactaatgaccagaagttcctgttggacgaacaggtctttttatctaaattaaccagggagatctgcaaagccggcttcaagattaactctaaaaagaccagactgcagttcagggacagccgtcaaaaggtgacaggactagtcgtgaaccgaaaacttaacgtcccgagagagttctataagaataccagggccatggctaataagttgtatgcaaatagtgagttcaccatcgacggcaagaaaggctccatcgatcagctggaaggccgctttgcttttatcaatcagattgacaggtggaataactcccttgaattagaacagagtattaccagcaatatgctcaattaccaaaagctactgcttcggtcaaagtatcagaacaaagagatctttggtaggctgaacgcccgggaacgagaataccagaagttcctgtactataagtacttttacgggaacgataaaccaatcgtggtgacagaggggaagacagacattctctacattaaggcagctctgaagaatctctatcagtcgtatcctgacctggtggagagaataggtaatgactataagttcaaggtcagctttttcaagaagtccaagaataacaaggagatcccccgcatcaaatactttttgaacatccctcaggatggggcagactctatgaaaaacctgtactcatttttctcggataagaactcctgctatcccaactatttggactacttccagaaaaaatactctagcaagccccttaatccagtgatttttatcttcgacaatgagattgagaacaataagaaaccagcgcgaaactttgttaaccatattaaaatccgcggggctctgtcagaactgcgtgacaagcagaggctacggataataggaaatctgtacatgatagtcacacctctggtaaactccctcaaagagactgatatcgaaagcctttttagctcacaaaccctggggcacaaaattgatggaaagtctttcaaccggaacgggggtaaagaatactatggcaaaggcatatttgctcagtatgtgtccaaaaactatgagaacattgacttcaccaattttaagccccttctggataacctcaacaaagttatcatcgactacaaagatggatga

SEQ ID NO: 8480 - RNA, 1785 nt, unidentified
  source 1..1785: mol_type = other RNA; note = synthetic construct
atgtcaaacttgagtgagattaaatctagagaagacctctttcgcctgcttaacattcccaagaagaacatgacatacctgctctataacaaagacaaaaagggcactgagaatagttataccactttcaccatcaagaaacgaaacggagaagacagaatcatttgtgctccgaataatgagctcaagttcgtgcagaggcggctagccaatctgttatgggtcactcaaaaaaagatatggcgggaaaataacatcaagtccaccatttctcatggcttcgagaagaataagagcattattaccaatgccagaattcacaggaacaagaaattcgtgttgaatattgatctcgaggacttctttagtagttttcactttgggcgtgtcaaagggttttttgagaaggataggaattttaaggtgccacaggaggtggctctggtgatcgcccagttaacttgctataaaggtgtcttgccccaaggagctccgagctcacccatcataaccaaccttatctgtaacattatggacttgcggatcctgaaactggccagaaagtataagctcgattatacgcgctacgccgatgatttgaccttttccactaacgacatcgttttcctgcattttgaaaaggaattcctgatcaaactagaaaaggagatcgttcgggcagggttcaaagtgaatccaaaaaagacccgtattcaattttcgaattcacgacaggaggtgacaggacttgtagtaaataagaagatttccgtcccaaaggagtattataagaagacacgggcaatggcttacaatctgtacaagaacaaagagtacttcattgataacgtaccaggaacaatcaaccaacttgaaggccgctttgcgtttatcaaccagatagataagtggaataacgtgctcgagtacgagacatccttagacaacaataatctggaataccagaaacacctgctgactatcaagagaaaggagaaaaaccactataatatgctcaagcttctgaatcgccgagagagagagtatcagaaattcctgtattacaagtacttctacagtaacgagaaatccacaatcgtcacggaaggcaagacggacatccgttatttgatggcagccctgaaaagcctttataaggattaccctaacttagtggagaaagtgggcgaaaacttcaatttcaaggtttacttcctgaaacgctctaaaaaaaaagacaagagggaagtttcaaggtttaagtacttcttcaatctgcctattgacggtgccgacgcaatgaagaacctttacaatttctttagcgacaaaaacactctctgccccaattatctgaagtatttcagcagctttgagagcagcaaacccgcttctccaaattttttcatctttgacaacgagatctctaataaggacaaacctctgaaaaccttcataaattatgtgtacgccaaatcacagtctgcaaaggcggaagagatgaaggaaaaactgtacctcaaaatagaagagaatctgtacatagtcacacaccaggtgctagacggatgcaaagaaaacgagatcgaggatctatttgatgaaaaaaccaggggccatattataggggggaagaccttctcgcctaaaggtgattccaacaaccattatggcaaagagatcttttccaagtacattctcaagaactacaagtacataaacttcgaaaacttccggcctatgttggataacatcaacaagatcattaccgaatacaagaattga

SEQ ID NO: 8481 - RNA, 1719 nt, unidentified
  source 1..1719: mol_type = other RNA; note = synthetic construct
atggactatttttctgacataaaaactagggaggactttttcaacattttgaacatccctttgaagaatatgacctacctgctgtataataaggagaaaaaaggaaccgaaaactcctatcacagctttgaaatcaaaaagcgtaacggcggcgtcagagtgattcatgctcctaacaaggagctaaaatttgtacagcagagattgctgaaggctctttggagaaaccagaccaaggtgtggcacgacaaaaaaataaacccaagtataagccatggatttcagaaaggccggtcgattatgactaacgccgaaattcatcggaataagaagttcgtgctgaacgtcgacctcgaagatttttttaacagctttcacttcgggcgggttaagggatttttcgaaaaggacagggactttaaagtccctcaggctgttgctctcatcatcgcccagctggtgtgttataaaggggcactgccccaaggggccccaacttctcctctgatcactaatcttatatgccgaattatggatctgcggctgctgaaactcgccaagcgttacaagttagattacacacgctatgccgacgatctcacatttagcacaaatgacagctctttttctaggctgagtcaagaattcctgctcaaactcgagtcagaaattaaacgagcgggattcaatctaaatcctgaaaagacgcgtctgcaatataagaacagtagacagtcagtgactggactcgtggtaaacaaaaaacttaacgtgcccaacgagtattataaaaagacccgcgcaatggcgcacaccctttataccaatggttcttttctgatcgatggcgtggagggtacactcgcccaattggaagggaggctgtctttcatcaaccagctggagaagcgcaacaatttaagcattaattccggctccaaggactataagaatctgggacggagagagaaggagtaccagaagttcatttacttcaagtacttctatgcaaacacaaggcccacaattttaacggaggggaagactgattcaaggtacctgaaagccgctctcaagaaattgtacaagaattacccgaatctgattgagtataagaacggcgagttcgtcttcaagatactcttcctgcacagggcagataaggagaaaccaaataaaacgacccggctaaaattcttttttaatattggcccccacggggctgatagccttgcagagctttactacttttcctccaataagaagtcaaaagttcccggttacatcaattaccttgagtacttcaagaaactgaaccagaacatgctgacaaaaccaaccattatcgtcttcgacaacgaactgagctccaatggaaaaccgttgcgcacctttatcaatagtttgaaagatgaacaggagatgcatatttctaacatccgccgcgatctgtccacccaggtgactgacaacctctacatccttaccaataaactagtgggcaccagaacagaggccgaaatcgaagatttgttcgacgacaaaactcgaaataaggagattgacggcagaacgttttcagccacagatataggtgagcaatattacgggaagaatatcttcagtctctacatcctcaagaattataaggaggttgatttctcgaacttcaagccaatgctggacaagttaaacgaaatcatcatcaacttcaagtga

SEQ ID NO: 8482 - RNA, 1797 nt, unidentified
  source 1..1797: mol_type = other RNA; note = synthetic construct
atggtttcctattccgatatccagtctagggacgatttcttcaagctgttaaacatttcaaagcagcacatgacatatctactgtataacaaagacaagaagggaaccgaaaattcatactacaccttcgagatagaaaagaaaaacggtggcgtgagggtcatccacagtccaaacgacgaattaaaattcgttcagaaaagactcgcgtctgtgctgtggaacaagcagaaggaaatatggaataagaaagggatccatcccaatattagtcacgcctacgaaaaaaacaaatccatcattaccaacgccaaaattcacaggaataagaagttcattctcaatgtggacctggaggacttcttttcttcatttcattttgggcgtgtcaaaggcttttttgaaaaggacaataacttcaaggtcccctcggaggttgcactgattatcgctcaattgacatgctataaaggggttttgccacaaggagcacctagcagtcccattatcacaaacctcatttgcaagattatggacttccgcatactgaagatagccagaaaatacaggctggattacagccggtatgctgacgatctgacgttttcaacaaatcgaacatcttttttggacgacaaagaggcctttatgaagattttggagaaggagataaacagagccggatttaaacttaacgagaataaaacgaggctccaatataatagttcaagacaggaggtcaccggactgatcgtgaataaaaagctatctgtaccacgcgagtattataaacagacacgggctatggcacatactctgtacaaaactggtgagttctttatcaacaatgagaaaggtacagtgaatcaactggagggccggtttaccttcattaaccaacttgataaatggaacaacaagttggaatacgacaccacccttaacaataacaatttcgaacaccagaagtttctcctgagcctgaaccgaaaaggtgatggcggcgtgcaggagaaactcaaattactgaatacccgggagcgcgagtaccagaagtttctctactacaagtatttttacggcaatactaagcccacgatcgtgaccgaggggaaaactgatatacgatacctgaaggccgcgttgaagaaaatgtatcaggactaccctaaccttattgagaagaagaacaacaagttcatcttcaaggtatatttcctcaagcggatcgggaataaggaaacctcccgtttcaagtatttttttggccttgaaaaggatggcgctgacactatgaaaaacctgtacaactttttcagcgacctgggcaatgaaaaactctacccgaattaccttaagtatttcaacaccttcgataaacaccctctgaatcctacaatctttatcttcgataatgagatcagcaattccaaaaaaccattgggaagcttcatgaactatgccttcaataaaaagaagaaggtgaagcagtctaagatcgattgtctgaaagaaaacctcttcttaaagatcgaagaaaacctatacgtcgtgactaatcagttactgcccgagaaagatgaaactgagatcgaggacctctttgatgagaagaccctgcatcatagcattaacgacaaaactttcagcaaaaagggagatccgaatctgaactatgggaaggagatattttccaagttcattctttccaactacgaagaaattaacttcgagaactttagacctatcctgaataacatcaatcagatcgtgcgcaattttagtaagaatctatga

SEQ ID NO: 8483 - RNA, 1776 nt, unidentified
  source 1..1776: mol_type = other RNA; note = synthetic construct
atgcccagcttttctgatataaaaaccagagacgacttctttaaacttctcaatatcccaaagcagcacatgacgtatctgttgtataataaggagaagaaaggcaccgagaatagttactatacattcgagcttgaaaagaagtcaggtggggttagaataatcaacacccccaacgatgaactgaaatttgtgcagaagcaactgacttctctgctgtggaaagcccagaagaatatttggaacaactcgtcattacatccgaatatctctcatgccttccaaaaagagaagtccatcattactaatgctcagatccataggaataaacgctttgtgcttaacattgacctggagaacttttttaactcattccattttggccgggtcaaagggttttttgaaaaggacaagaacttcaaagtgcctccggacgtggctctcatcattgcccagctgacctgctatcagggggtacttccccaaggtgccccctcatctcctatcatcactaacttgatctgtaggatcctggatttgaggatactgaagcttgcgaaaaagtacaagctggattattccaggtacgcggacgatctcactttttccacaaacatcaggtcctttgatgctcaggaaaaagaattcctatccgtactcgaaaccgaaattaaacgagccggatttaagatcaataccaaaaagacgcggcttcagtttaataattcacgtcaggaggttacaggactgatcgtgaataagaagattaacgtgcctaaggaatattatcggaatacacgtgcaatggctaattccctgtacaagaacgagaagttcttcattaacaacgagtggggcactattaatcagctggaggggcggtttgcttttataaaccaactggacaagttcaacaatagtctggagtacaactcgagcctgcgaaaaaactccattgaataccagaagagcctcctcagcactcagctgaaagagaactcaaatcacaatatgctgttattgctgaacgcccgggagaaagaataccagaagtttctcttctacaaatacttctacgcaaatcagaagccaaccattgtcactgaagggaaaacagatattcgctatttaaaggctgcattgaaatctttgtacaaagactatcctgaaatgatagagaagaaaggtaccaaatacatcttcaaggttagcttcttcaaaagaagtaagcgctttagatacttcttcaatttcagcctggatggcgccgatagtatgaagaacctccataactttttctccgacaacaacaataagctctatcccaattattggcaatatttcgatgccctaaacagctccagttctgtcaacccaattttcttcatcttcgataatgaactcagcaataagaacaaacccttaagaaactttgtcaatcacgtgtgcagcgtggagaaggagaacgcagacgcccaactaaagttgctgaaagagaagcttaatctgcagttaaaggataatctctacctgttgacaaatcagctgcttgatggatttaccgagaatgagatggaggacctgtttgatgcaaaaacactgaaacacatcatcaaaggcaagacgttctctaagaatggagacaacaaagaccactacggcaaagaaatcttctctaagtatatcctagacaactacaccaagattaactttgagaatttccgcctcatactcgacaacatgaatgaaataattcacgactacagtccaaactga

SEQ ID NO: 8484 - RNA, 1050 nt, unidentified
  source 1..1050: mol_type = other RNA; note = synthetic construct
atgagattgaccgagattgaagataagaacatcttttttgaggagtttgacatatctaagcggagtatgacccatctgctgtatgtcaaagggactgatagcttctatgagagctttgaaatcccaaagaaaaatggaggattccggaatatcgacgcgccaaaaggaaagctgaaatatgtccagaaacgactagcggagattttatgggagacacagattgatgtgtggaagaaatacgccaacacctatgaatataatctctaccagaagaatctcaaagatgggattagataccgcgtcccgatgatctcacatgctttcgaggtaaacaaatccataatgacgaacgccaagatacacaggaataagaagttcatcatcaacgtggacttaaaagactttttcaagtctttccacttcggtagagtgaaagggttttttgagaaaaacaaggacttcaaagtgcctaccgaagtggccgttattatcgcacaactgtcttgttataaaggcgttctgccccagggagccccttcatcccctattatcactaacctcatctgccagattatggattacaggattatgcagctggctaaaagattcaagctaaactacactcggtacgcagatgaccttacgttctccactaataacgtccaaatcgtaaatgaataccagacattcttgaagaaactcgagaagaaaatagtgaaggctggttttgaaatcaatgaagacaagacccgcctgcagttcaataattccaggcagaccgttactggcttgatcgtgaataagaagctgaacgtcccccgagagtattacaaggacacccgtgcaatggccaatacactttataagacaggcagctttgatgtgaacgaacgcacaggctcgatcaatcaacttaatggcaggtttgcctttattaaccaactcgacaagtacaacaacaaactggagaacaatgctagcataatgaagaacaacatcgagtaccagaaatacctgctgagtgtggaaaagaaggagaagaatatttga

SEQ ID NO: 8485 - RNA, 1722 nt, unidentified
  source 1..1722: mol_type = other RNA; note = synthetic construct
atgatcttcatcaacaagtttaacgccatcaatagccgaaacgaattgtttgagttcctcaaagtgaagaaggagattatgaactacatattgtacgtgaagaagacagagtgtagctacaattcattcaagattgagaagaagtctggagggtttagagagattaacgctcctgacgatgagctgaaagttatccagaagaaattagcccttagtctctggctttatcagaaggagatctgggacgaaaagggcatcaatcccaatatttcacatgctttcgagaaggacaaatccattatttccaatgcgcgtattcataggaacaagaaatttgtgctgaacctggacctagagaacttctttaagagtttccacttcggtagggtcaagggcttttttgagaaggatagagactttaaagtccctcccgaagtggccgtagtaatcgcacagttaacatgctatgatggctacctgccccagggcgctccatccagtcccatcataacaaatctgatttgccgtattctggacttccgaatccttaagctggccaaaaagttcaaactcgattatacccggtatgccgacgacctgacttttagtactaatcgcaaaggctttctggcagattacatagacttcctggaggagctgtccaaagagattctgagggctgggtttaagataaatgatagcaagaccagaatgcaatattctaacagcaaacagattgtgacgggcctgatcgttaacaagaaaatcaacattgacagcacctattaccggaagaccagggctatagcacacactctctacaaagggaaggaaattgaaataaatggcaagaaagcaacgatcgataatttagaggggcgctttgccttcatcaaccaattggaccggtataataatgctatcaacgctgaaattaccgtgggtaaaaaaaagaagtttgccttcaatggaagagaaatgcagtaccgcaaattcctcttttacaaatacttcttcgcgaacactaaaccactgatcgttacagagggcaaaactgatataaagtatatcaagtccgcactgaagaaactctataaggattacccgaatcttgtctcaaaaacgtctgatggaatctttgaatacaagatttccttcctgaagaagacaaacaggctaagatatttcctcggaatccagaaggatggagccacagctctgactgaaatctataaatactacgcaccatctaatgggcttaacgacccttacatcaattatatggatgagttcaaacggattagcgattctcaggccgaaaagccagtttttctgctcttcgataatgagatgggtaaaaagtctgacaagcctttgaagaaatttgtgggttgtgcgaaaattaacgaggacaaaatctccgaactgaaagataccctcaaattgaagctaatcgacaatttgtacgtgttgaccaacccgctcgtgagtaataaagaagaatgcgaaattgaggacctgttcgacaagaaagtccttgagacagtcataaaagggaagacctttcaacgcaacgaaaaaaagtttaacaaggaaaagcactacgggaaagaaatattcagcacctatattgccgagaattatgagtcgattgacttctcaaactttaagaagatccttgataacatcgagtcaatcagccagaaattcaagttaggatga

SEQ ID NO: 8486 - RNA, 1731 nt, unidentified
  source 1..1731: mol_type = other RNA; note = synthetic construct
atgtgcgagatcaataatattaagaccaaaaaggacctggtgaaaattctggacattagcataaagaagctcacatatatcctgtatgtcaagaaagtagacaatatgtacttctctttcgatattcccaagaaaaatggaggtgttcggaaaataaatgctcctgaaaaaacgttacgcttcatccagcgcaatctggccaaagccctgagtaattacaagaaaaacatctgcgagaatgaaaagattagcaatcgtgtgagtcacgggttcgaaaagaacaagagtttcatcacaaatgcaaggattcacagaaataagctttatgtgatcaacttcgatctgaaagacttctttgactgttttcattttggccgagtgaaagggtattttgagaagaacatctacttcaagttgcccaaagagattgccattattatagcgcagttgacttgttaccacggatatcttccacagggtgctccgacctcccctgtaattaccaacctgatctgcaatatttttgacatgcgtatcttaaagctggctaagaaatataagctagattacacacgctacgccgatgaccttactttctcaaccaatgagaaagaattcatcaaagtgtacagcaatttctacaaggatctcgtcaaagagattgacaaaagcgggtttaaaataaatgagaagaagagccggattcaatattcgaattctaggcaggaggtgaccggggtagtggttaacaaaaagctgaacatcaatagagagtattacaagaagaccagagcaatggcagattctctgtataaaactggccgattctttatagatggaaaggaaggaacaatcaaccagttggaaggcagattttcactcatcaatcaggtggtctggtataacaacaaaattctcaaggaaaaggagaagcataataagtacatcaagaagaacgtcgaaatctacaagaagtcttgtactcgggaaagagattatgagcgcttcctcatttacaagtactttgtcattaacaaggagcccctgctgatcactgaaggcaaaacagataaactttacattcaagctgccttgaaatccctctataaagaataccctaaactgatcatcaagaacaaaaatggcaactttgagtataagatcgatttcttcaacaggactaaacggataaactatttcctggatgtgaataagacaggggccgataccctcaagaacatctgcaactactattttgacaaagttaagaacggatacgagaactacattgaggactttttcaagatcataaacatcaagcccaaaaatccagtaattctcctttacgacaatgaatttgacacctccggtaaaaaaaataacaagcctgttgccaaactatttaataatgacaggctctcaaacaagaaagactacatcataaagaacaggtttctgaagatcaaggagaatctgtacgtgatggtgataccattggtgaacgacaagaagaactgtgaaattgaagatctattcaaggatgagttgctgaaacagaaaatcgacgaccggatctttgaccgcaaatccaatgataatgagacaaagattggcaaagatacgttttccaagtatgtcaaggcgaactataaagatatagacttcagcaacttccgactgcttctggacaccatcaagaacatcttaaacgactacaaaaacaacgagtga

SEQ ID NO: 8487 - RNA, 1749 nt, unidentified
  source 1..1749: mol_type = other RNA; note = synthetic construct
atgtgcgtgatcgatcacattaaaacccggaaagagctcgcgaatatcttaaatatctccgagaaaaagctcacgtatatcctgtatgtgaagaaaatcgacaacatgtatagaactttctctattcccaagaagaatggcgaaacaagggagattaatgcaccagagaaaatgctgaacttcgtccagaagaacctcgccaaatttctcctgaattaccggaatggcatctacaagaccgaaaacattaataacaaggtatctcacggcttcgagaaagagaaatcctttattaccaatgcggaattgcataagaacaaacgatacgttcttaactttgatctcaaggacttctttgattgtttccattttggtagggtgaagggttatttcgaaaagaacagatacttcaagctgtcaaaagatatagccactatcctagctcagctgacatgttataagaagtgccttccacagggagcaccaacatcacccataattgttaacctgatcttcaatatggtggatattcagattatcaagcttgccaagacctacaagttgaactacactagatatgcagacgatatcacctttagcactaatgacaagtttttcttggaaaagtactctgagtttgagaacaagtttctgtacatcatagagaagtatggcttcgtggtcaataagaataaaacgcgcctccaatataaggattaccggcaaaaagtgacaggcttagtagttaataagaaaatcaacgtgacccgcgagtactataaggagacacgagccatggcccatcagttgtataagaccggatcattttttatcgaagagaacaaatctgggaccataaaccaactggagggacgtttttcctttataaaccagatcgagaagtacaacaacatcatcgacattaagaaaggcggcaaaaaacacaggattgtcacgttgtcgaacaaagagaaagaatacagcaagttcctgttctataagaacttcttcaacatgggtaagcctattatatttaccgaagggaaaactgacgtgatgtacatcaaagctgccctcaagaatctctacaaaaaataccccaatctaatcgaggagactaaaactggcttcgattacaagatcattttcttcagaaagtccaagaagatcaggtatttacttaacatcgaagctaacggagctgacacaatgaagaatattgccaatctgtatagtgggagcgaaagtttccctaattacatcgaatacctcaagtctataagcaaacagaaacccaacaatcctataattctgctgtttgataacgagattgaaagcaagaacaagccgattaaaaatttccttagttgcaaagccgtgaagtccttctataaagatgacatactagagaaacagctgaaggaaaaaaactacgcatgtcttaaggataatctgtatgttcaggtcacaccattgatagggaatatcaaagagggggacattgaaacactgtttaaaaaagaaaccctggcacacaagattaatggaaagtcattcatcaagaaggacaaatacaacaacgaatattactacgggaaagagatcttttccaagtatgtgtatgacaattaccggaatattgacttcagcaactttgtctatctgctggacaatattaacgacatcattaaggactaccaaatccgcaaggctggaaatgatatgcaccctaaatattggacctactga

SEQ ID NO: 8488 - RNA, 1668 nt, unidentified
  source 1..1668: mol_type = other RNA; note = synthetic construct
atgtctaactataacaatgccagggaatccctgagtaatttccttaacattagtctgaagtacctgacatacattttgtacgtgaaaaagatcgagaatctgtacacgacttttaaaatcccgaaaaagaatggcggctgcagagaaattaacgcaccccaaaacgagctgaagatgatacagaaaaagctcgttttctttctagaagaaaagatgaaggacaagttcaagactatcaatatttctcatggctttgtaaaggagcggaatattattaccaacgctaagatccacaaaaataaaaagatcgtcctcaacctggacctcaaagatttttttgactcttttcacttcgggcgaattaaaggcttcttcgagaagaacaaggatttcaaatttagccccgagctggcaacccttattgctcaactggcttgttataatgggaagcttccacagggtgccccttcctcaccattgatcaccaacttgatttgtaacatctttgacatccgggtgctgaatctcgccagaaaatacaaacttaattactctcgctacgcagatgacttgactttctccaccaattataaggggtttatcaaaaatctggaggagtttaaggaagacattttgcttgagataaagaagaacgggtttgaagccaacatgaaaaaatatcgcctgacttttcagaacagccgacaggaggttactggtctaaccgtgaataagaagataaacgtcagcaagatttactacaaaaacactcgcgcaatggcctattccctgtacaagaatggcgaatttaaaatcgacggaattaaggacggaacaattaatcaactggagggaagattctccttcatcaaccagttggatatctacaataatttcgagaagaaccggacaaaaaaagaaaagggaaaaaaggacggtatcaaatcctggaatatttataactcgcgtgagaaagaataccagaaattcctattctacaagtacttcttcatgaatcagaaaccactcatagtgacggaaggcaaaaccgacatcttatatatcaaggcagcgctgaaaaatctgtataatgattatccctcactcatcattaaggaggagaacaaattcatcttcaaggttagctttctcaaaaggaccaaactcctgaagtattacctaaatttagccttagacggagccgataccattatgaacatatataaccacttcgtcgatgcttatagctcgttctataactacaacgattacttcaagaagctgacaaaaaaacaggcgtttaacccagtggtgttaatatttgataacgagatcgagacagaaaaacccctgaaaaagtttctggcccatgcttttcctaagtctagggagatcaatgagaagaaggacataatcaagaagaattgcaagctcaatatcatcgataatctgtatctgctcacaataaacctcgtagatgatatgaaagagtgcgagatagaagacttgttcattaaggacattcatgaaaggtttagcttcaataaagacaaccctgacaagaacaaattttcaaagaacatcctgaagaactacaagaacatcgatttcagtaatttcaagccttttctgaacaatcttgccagtattcttaaagaatacaactga

SEQ ID NO: 8489 - RNA, 1680 nt, unidentified
  source 1..1680: mol_type = other RNA; note = synthetic construct
atgtttaattttaagaatgcccgagagatcttgagtaagatcctcaacattcatctaaactatctgagctatatcctttacgtgaaaaagatcgagaatctctacacaactttcaaaattcctaagaagaacggcggctatcgggagattaatgcaccccagaacgagctcaaaatgattcagaaaaaattcgtctccttcctggaagaaaagatgaaggagaagttcaagacaattaataccagtcatggtttcgttaaagagaggtcaatcatcaccaatgcgaaaattcacaagaacaaaaagatcgtgttgaatctggatttgaaagactttttcgactctttccactttggtagagtaaagggattctttgagaagaacaaagacttcaaatccttttttcctgaactgaccagcgagctaagcactctgatagctcagctagtttgcttcaatggcaaactaccacaaggtgccccatctagtccactgctgacgaatctcatatgtaatatcttcgatgtgagagttctgaagcttgccaaaaaatacaaacttacttactcccggtatgccgatgatctcaccttttcaacaaactacaaagggtttattaggaatcttgagaagtttgaggaagacattttactcgaaatcaagaagaatggattcgaggcgaacatggaaaaatatcggctcacatttcagtcttcacggcaggaggtcacagggttaacagtgaataaaaagatcaacgtaagcaggaagtactataagtacacgcgcgccatggcctatagtctgtataaaaacggagagtttaacatcgatggcattgatgggactattaatcagctggaggggagattcagcttcatcaaccaattggacaagtataacaattctgaatcggaaaagcgaaaaaaattcatcgcacgtaatgtgctgaacagccgcgaaaagcaatatcagaacttccttttctacaagtacttcttcatgaacgaaaaaccgctgattgtgactgagggcaaaaccgacatactgtatatcaaagctgccttgaaaaacctctataatgaatatcccaacctgatcacgaaagaggagaacgagtttatctttaaaatctcctttctcaagcgcaccaagctgcttaaatacttctttaatctctctcctgatggagctgactctatgaagaacatttacaactactttggggacaagaatagcaaattctacgacttctacaactatttcaagaaactgacaaacctggaagctttaaatcccgtgattttagtctttgacaacgaggcaactgagaattccaaaaaaccccttaagaagtttctcaatcacattttctccgataaaaacgacaacgacaaaaagaacctcatatcatatgtcaggaccaagtttaagctgaagatcatcaataacctgtacttgttgaccataaatctggtggatggcctggaggaatgcgaaatagaagatctgttttttgaggatacctacaagaagtttagcttcgacaagattaatccaaacaaggacaagttttcaaagaacatcctgaagaactacaagaatatagacttctccaaattcaagcctttcctgaataaccttgaatcgattttgaaggagtacaataagaaggattga

SEQ ID NO: 8490 - RNA, 1701 nt, unidentified
  source 1..1701: mol_type = other RNA; note = synthetic construct
atgaaactgagcgaaatccggtgcagagaggacctcgcttgcctcctgaagattaaaaccagcagtctgacatacgttctctatcgtgccaaagtcaactccttctataaaacctttgatatcccgaaaaagaacggcggcgtcagacaaataaacgcccctaccgacatcctgaagatcatacaagagcgcctggcaagcgccatttactcgtacatgaaaaatctgaggacagagaaaaatatcaacgtgaatatagcccacgcctttgagaagaaaaagtccattattaccaacgctcaaattcacaagaacaagtatatcgtactgaccttcgacctagagcactttttcgatagttttcatttcgggcgggttgccggtttttttgagaaaaacagagactttcaccttccccataatatggcaattatattagcccagttgacgtgttataacgggcatttaccccagggggcacctacgtctcccataatcacaaatctgatattccagatttgcgatatgcgcatcctgaagttagcaaagaagtacaagctggactacactcgatatgctgacgatctgaccttctctactaacaatcatagcttcatcgacgaaaaagaatcctttcagcgagaacttgaacgagaaatcggcaaagctgggttttcaattaaccaaactaagactaggatgtcactccgcaattctagacaggaagtgacaggactagtggtgaacaagaagatcaatgtgaatgcggggttttacaggaaaacgcgtgcgatggctcatcagctttatcagaatggatctttcaccatagatggtaaggagggtagcatccagcagctggagggacgctttgcctttattgatcagctggatcactataataacaaaattgacggcaagatccactcattccgggatcggaacggcagggaaaagcagtacagcaagttccttttctacaagttcttttacgcaaatgagaagcctctcatcgttacagaaggaaaaacagacatcagatacctgaaagccgctcttaagtcgctgtatctggattatccagagcttatatccagaaacaagaacggctcctacacattcaaagtgcaattcttgcacaggactaagcggttgtcttattttctagatatcgcggtagacggcgcaaaaccgctctacaacatttacaagtacttcatcaaagggcgcgacagtgcctaccccaactattataagtttttcagtaaggacggagagaagaaaccacgcaatcctgtcgtcattctgctggacaacgagatgaagcccaacaagccactaaaaggcttcttagaccagatcaagtcaactgaatccgagaaaaatgatctgcagcagaagttgtcactccggctgcttgctagtggcaacttatatctgctcactaatcctttggtggataataaagatgagtgtgagatcgagctccttttcaccgaggaaaccaggggaattaaactggagggtaagtctctctgtttggaagaagaaagctttgagaaatcaaattcctacgggaagaacatctttagcaattacatcctccagcactacaatgagattgacttctctaggttcattccactgctcaacgccttgagttccattatcaaaaactatagcgctgaaatgagaaattga

SEQ ID NO: 8491 - RNA, 1707 nt, unidentified
  source 1..1707: mol_type = other RNA; note = synthetic construct
atgaaaactttcgccaatataaaaacactggatgacctatcaatcattctgaaaatcccaaagaagaaacttacctacattctctacataaagaagcctaacaacagttacaaatctttcaagatcccaaaaaagtctggtggtgagcggactatcaatactccatcaacagatctgaaagatattcagagaagtatactgaagatcctttggaagcagcagaagatcttatgggaagaacacaaaatcaaatcgaatatcagccacgcctttgtgaaaaagaaaggcatcctcactaacgcacgggtgcacaagaataagaggtatgtcttcaatatggatttggaagacttcttcgacagtttccactttggaagggtccgcggcttcttcgagaagaacagagattttttattcccgcagaatattgcgaccatccttgcacagttaacttgttataatgggtgtctcccacaaggggctcccaccagccctattattactaacctgatctgcaacatcttggatatgcgactgctgacagtggccaaagaatttaaactcgactatactcggtacgctgacgatctcaccttctccacgaatgatgagaaatttgtagagaatttggaggatttcaagactaaagccaaggaaattatcaaccatagcggatttaagatcaacgagaagaaaacaaggctgcagtataaaaatagccgtcaggttgttacaggtctggtggttaacaaaaaagtcaatgtgaaccgcgatttctataaggagacaagagcgatggcaaattctctctacaagaatggggagataaaaattaatgagaagagtgccaccatcaatcaactagaaggaaggctctcctttataaatcaaattgaccgagacaacaacaaggtcaacaagaaaagcaataagaagttccattctcatctgtcaaccctgaacggaaaagagaagcagtaccagatgtttctgttctataagtacttcatggccaacaataacccttgcatcattacagagggcaaaacagacataatttacatcaagtatgccctgaagaaaatgcaccgtgactaccccaaactgataaaaaagaattatgacggcacctttcagtacaaaattagttttctcaaccgcaccaaacggctcaaatatttctttaacttggagcttgatggggctgacacgatgaacaagatctacgaattttactcaaacaggaacaatgattcctttcctaattacaacgaaaagttcgagaaattcggcgtgagcccggagaaccccattatttttatacttgacaatgagctgtcgtccaaggagaataagcccctaaaaaaactgatttcacaagtggctctggataagaccaaaatcgcttctttcaaggaaaacaacttcatcaacattacctccaacctgtatcttacaacccatcagctggtgaaggacttgaaggaatgcgaaatagaggacttgtttgataatgatacgctgaacgtcaagttaaataacaagtccttcgaacgcgattctaaaaagtttaacgacaagatccactatggcaaggcaatttttgccgaccatgtgtccaagaattacaagaacattgacttcagcgaatttagacccctccttgacaacttgaataacatcatcaccaattacagcgtaaattga

SEQ ID NO: 8492 - RNA, 1704 nt, unidentified
  source 1..1704: mol_type = other RNA; note = synthetic construct
atgcaaacgtttgaaaatataaagacgctggacgacttatctatcatcctgaagattcctaacaaaaagctaacatacatcctgtacattgttaagcctgacaacagttacaaatcattcaagattccaaagaagagcggaggcgagagaacaatcaacactccatctaccgatctgaaggatatccaaaggagcattgtcaaaatcctctggaaacagcagaagatattgtgggaggaacacaaaatcaagtccaatatctctcatgccttcgttaaaaaaaagggcattctgaccaatgccagagtccacaagaataaaagatatgtcttcaacatggacctggaaggattttttgattcttttcacttcggtcgtgttagagggttctttgagaaaaatcgggatttcctgttcccaaagaatattgcaaccatcctcgcccagctgacgtgttacaatggctgccttcctcagggggcacctactagtcccattatcacaaatctgatctgcaacatcctcgatatgaggctactgaccgtggccaaggaattcaaactcgactacacaaggtatgccgatgatcttaccttcagtacgaatgacgagaagtttgtggagaatttggaagacttcaagaccaaagctaaagagatcattaatcacagcggcttcaagataaatgagaaaaagacacgactccaatacaagaactcgcgacaagtagttactggcttagtggtaaacaaaaaagtgaatgtgaaccgggaattctataaggagacaagatccatggcgaatactctctataagaaagggaaattcgagattaatggaaagactgctacaattaaccagttagaaggacggttcgcttttattaaccagattgaacggtacaacaacgggatctataagaacaacaatgcaccactgaaactgtgtgacttgaacggtaaggaacgccagtaccagatgttcttattctacaagtacttcttcgggaactccaagccttgcatcattactgagggtaaaaccgacattgtctatatccagagcgccctaaagaatctctatgagtcctatcccaaactggtgaaaaaaaaagctgatggcacttaccagtttaaaattacatttctcaggcgttcgaagaggttgcggtattttcttgatttccaacttgacggagcagatacaatgaccaaactgcacaatttttactgcaacaccaataacaactcctatcccaattatccggaaaagtttcgcaagctaggtactacccccaaaaatcccgtgatcttcgtgctggataacgagctgcataataatgagaaaccattgcgcaagctgatcaaaaacgtcaaacttgacaagaatctcagcgaatttgactcatccaaggagaagtaccatatcaacataacctctaacttgtaccttagtactcatcagcttgtgaaaggcctgcaggaatgtgagatagaggacctctttgatgataataccctgaacaccaagatatatgataagacctttgaacgcgatagcaaaaagtattcagacaagaagaactatggaaaggcggcctttgctgactacatctcaaagaactacaaggacatagactttgagaatttcaaaccgctgctgaacaacattaacgagataatcacaacatacagcttgtcttga

SEQ ID NO: 8493 - RNA, 1707 nt, unidentified
  source 1..1707: mol_type = other RNA; note = synthetic construct
atgtatactttcaagaacatttccacgataaccgatctggccaagattcttaagattccaaagaagaagcttacctacgtgctgtacattaagaagaccgacaattcctataagtttttcaagttgcccaaaaaatccggtggagagaggacaatttacaatccaagtgacgacttgaaggatatccagaggtcaatagtgaatttgctgtggacacagcagctaatcatttggaaggagaataacattaagcccaacatttctcacgcattcatcaaagaaaagtccatcataaccaatgctcgagtccataagaataagcgatatgtctataacatggatctggaagacttctttgattcatttcacttcggccgcgtcagagggttcttcgagaaaaacaaagacttcttattccctcaaaacatagccacggttttggctcaactcacctgttataatgggtgcttgcctcagggagcccctactagccctattataactaatctcatctgcaacatcctggacatgaaactgctgcagattgcgaagaagtttaagctggattacactcgctatgctgacgatctgaccttttctactaatgatggacactttcttgagaacatagaggaattcaagattcagaccgagcgtatcataaaatacagcggcttcaagatcaataaaaaaaaaacacggctccagtatcaaaattcaagacaggtcgttaccggacttgtggtgaataagaaggtgaacgtgaatcgtaaattctataaagagacgcggtctatggccaacaagctttatgtaaacggagaatttaagatcaacggcaaaaaagcaagcattaatcagctggagggtcgctttgccttcatcaaccaaatagacaggtacaataactccatcaagatcaacaacaacaaaatccaaagcaagacaagaaatctgaacggcaaagaaaaacagtaccagatgttccttttttacaagtacttcttcgccaacaataatccctgtatcgtgacggaagggaagaccgatattttatacatcaaatccgctctgaagaatctgtatgaagagtaccccaatctgattcagagaaattctgatggtaccttcaactacaaaatcagttttctgaatcgcacaaaaaggctgaggtactttttcaattttgagttagatggggccgacactatgaatcagatttacaacttcttctccaacaagaataacgacaaatatccaaactaccaggagaaatttcggaagcttggctcttcgccaaataatccggttatctttattctcgacaatgagttgtctaaccgggataaacccctcaagaagctaatcaaaccgctggaactcgaaaataactcactcaagtttaaccacttcaaagacaacaactttgtaaacctcactagtaacctgtatctcctgacccatcagctcgtgaaaaacctaactgagtgcgaaatcgaggatctatttgacgaaagcatcctgaacaccacactgcacaataaaacatttgagaaagacagcaagaagtttgatgacaaactgaattatggcaaagcagcattcgcggattacatcagtaagaactacaacaaaatcgactttacagagttcaagttactgctcgacaacttgaatgaaattatcacaagccatagttcaaagtga

SEQ ID NO: 8494 - RNA, 1707 nt, unidentified
  source 1..1707: mol_type = other RNA; note = synthetic construct
atgaatacatttgagaacatcaccacactcgatgatcttagccggacgttaagaattcagaaaaagaagctgacctatatactgtatgtcagaaggatagagaactcctatacttacttcactataccgaagaagagtggtggagaacggaccataaattcccccagcactgacttgaaagaaattcagaagtcaatagaccgcctgttacgcaaacagcagattatcttttgggaggagaacaatatcaagcctaatatatctcacgccttcaataagaagaagtcaatcatgactaacgcaaaggtccataaaaataagcgttacgtctttaacatcgacctcgaggatttctttgatagctttcattttggccgggtgcgagggttcttcgagaaaaataaaaacttcctgttccctcagaatattgctactattctggcacagctcacctgctataacggctctttaccacagggggccccaactagtcccatcattaccaatctcatatgcaatgtgctggatatgaagctgctgaaaattgcaaagaagttcaagcttgattacactagatatgcagacgatttgacattttccacaaataacaccaactttttggaaaacttcgaagagttcaaagaccgcgtcgaggctgtgatcaagtacagcgggtttaagattaatgagaagaagaccaggcttcaatataaggactcgcgccaagtagtgacaggcctcgttgttaacaagaagatcaacataaacagggatttttacaaggagacacggtccatggccaacaccctctataagcacggagaattcaaaattaatggcgagcaggcaaccctgaatcaactggaaggcaggtttgcctttatcaatcaaatcgatcgtttcaacaacgatatctacatcaagaacaacaccgtgaaacccaaactgtgtgacctgaacggaaaagagaagcagtaccagatgtttctattctataagtacttcttcggaaacaacaagccgtgtatcattacggaagggaaaaccgatagtatctacattaagtcagccctcaaaaaactgtataacctgtatcccactctaattaagaaaaatcaggacggttcttacaatttcaaagtgtcttttctgagaaggactaaacgattgcggtacttttttgactttcccctggacggtgccgacagtatgaagaagttgtacaacttctactgtaatacaaacaacgattcattcccattctacgctgaaaagttcaaagaacttaatgttgtccccaaaaatcctgtgatctttattctcgacaacgagcttgagaacaattccaaacctatctccaaactgattaaagcgacaaaactggaaagcgataaacagaagcttgccttcttcaaatctaaatattacgcgaacatctcatctaatctctatctgagcacccaccagctagtgaaagaaaagaaagagtgcgagatcgaagacttatttgatgttaatacgttggagacaatcatcaacaacaaaacgtttgagagaaatagcacaaagtacaaggaccaaaataattatggcaaagctgtatttgccaattacgtgagtaagaactacaagaagattgacttcaacaatttcaagccactgctcgacgctatcaacgaaattgtgtccaattataccacaacctga

SEQ ID NO: 8495 - RNA, 1716 nt, unidentified
  source 1..1716: mol_type = other RNA; note = synthetic construct
atgaaaacttttgaaaatatcagcacccttgacgagctgagtcaaattctgaaagtgccaaagaagaagctaacttatatcctgtatgttaagcgtatcgaaaacctctacacttcttttgagatccccaaaaagactggtggagaaagaacaatttcttcacctagcaccgatctcaaggaaattcaaaaaaacatagctgagctcttgcgcaagcagcagaatatatttctagaggagaacaacatcaagccaaacgtggctcatgccttcaacaagaagcggagcattatgacaaatgccaacctccataaacacaagaggtacgtgctgaatattgacttggagaacttctttgactcttttcattttgggagggtgcggggatacttcgagaagaataagaactttctgtttcctcagaacgttgctactattttggcccagctgacctgctataacggcaagcttcctcagggggcacccacgtcccctatcataactaacctgatctgtaatgttctggacatgaaactgctcaagattgccaagaaatttcgattagtgtactcccgatatgcagatgacttaacctttagcaccaatgatcgcaatatattagaaaatctggaggaattcctggcgcaactggagttcattgtaaataagtctggcttcacaatcaataagaagaagacacggcttcagtataaagattccaagcaagtcgtgaccggtttagtggtgaatgaaaaagtcaacgtcaatcgtttgttctataaagagacacgctccatggccgacaccctctataagaccggcgaattcaggataggagacgataaaggtaatctcaatagactggaggggaggttcagtttcatcaaccagatcgacagattcaataataaaatcgggaagggcaaaaatatcggcaacaaggagtcaaaaaaactgaacggtagagagagacagtatcagatgtttctattctacaagtacttctactgcaataccaaaccatgccttattactgagggaaaaacggacattatctacattaaatcagccctgaaaaagatgtatctttcatacccaaacctgatcgagaaaaactctgatgggacatttcactttaaattcctcttcctgcgccgatccaaacggatgcggtacttttttgaactcaagctggacggcgctgatacgatgagtaagatatacaacttctactgtgacacaaacaatcacaactatcccaattacgtaaaaaagttcaccgagaagtcggtgagtccgattaacccgacaatcctcatatatgacaacgaattgaagaacaaggataaacctttatcgaaggtcacaaatactacgaaaattaggcaggatgaggaaaaatataactttctcaagaccaaccactatgtaaatgttacaagcaacctatacgtccttacccaccagcttgtgaagggactgcccgaatgtgagatcgaagatctgttcgacagcaatactctctccgtgacaatcaacgacaagaccttcgaacgcgatctgaaaaagtttgacgagaacaaaaactatgggaaagcgatcttcgcaggctacatttctaagaactacctgaatatcaacttcgatgagtttaagcccctgttggataatcttaatactattgtcacctcctacaatttgaaaagccagacctga

SEQ ID NO: 8496 - RNA, 1695 nt, unidentified
  source 1..1695: mol_type = other RNA; note = synthetic construct
atgaagaccttcgataacatcaagaatttagagcagttgtcccaggttctgaaggtgccaaagagaaagctaacttatgtactgtatgtgaaacgcattgagaatctgtacatggactttgaaataccaaagaaaacaggaggcaccaggaaaatctcgtctccatccaaggatctcaaggaaatacagaagaatattgccaagctccttgagcgtcagcaggaaatcttcctgaaagagaacaatatcaagtcaaacatcagtcacgcgttcactaaggaccgctccataatgaccaatgctctcattcataagcggaaaaagtatgtcttgaacattgacctggaaaacttttttgatagcttccattttggcagggtcgccggatacttcgagaagaacgagaatttccttttccccaagaaaacagctgtgattctggcacagttgacttgttataatggcaaactcccccaaggttcccctagctctccgatcattactaacttaatctgcaacattctcgacatgaaactgctcaagatctcaaagaaattcaaggtggactatagtagatatgccgatgatttgaccttctcaacgaacaataacaaattcattgaggagctggacatttttttgagccagctggaaaaaatcatcaacaagagtggctttgaaatcaataaaaagaagacacgcatccaatacagagattccaagcaaatggtcacgggacttgtggtgaacaacaaagtgaacatcaaccgaaaattttacagggagactcgggcaatggccatcagtcaataccacacaggaactttcaaaattgataatgaggaagggaacttgaaacgtctggaaggaagattttcatttataaaccagatcgaccggttcaacaagaagattacctctaaaaataccgtggttggcaaaaaaaccaatatactgaatggcaaggagaagcagtaccagatgttccttttctacaaatacttctactgcaactcaaaaccatgtatcgttaccgaggggaagacagacataatgtatatcaaagctgcactcaaaaacctatacaaattttaccccaagctcatagagaagaaaagcgatggtactttccactaccgaatttcttttcttaagagatccaaacgcattcggtatttttttgacctgagcctcgacggggccgacacaatgatcaagatctacaattgttactgcgatgtgaataacgtcaactttcctaactatgccaaattctttgaaaacaaaggtgtcctctatacaaaccctacagttctgatatacgacaatgagcggtccaatacagaaaagcccctgtacaaggctcttaaagccaccaagattaacgaaaacaaggaaaaattggagagcctgaagagcaattactatacgaacattactagcaatctgtatatcctgacccatcagctagtgaatgggctggccgagtgcgagatagaagacttattcgactctaagatcttagagatgaagattgatgggaaatcttttgagaggaaccttaaggattttaatgataccgagcactatggcaaagcaatcttcgctgattacattctgaagaattatcacgcgatcaatttcgacaattttaggcctttcctggactgtctgaataagattgtagaaagttga

SEQ ID NO: 8497 - RNA, 1728 nt, unidentified
  source 1..1728: mol_type = other RNA; note = synthetic construct
atggacacatttgaagatatcaattccctggaggagctggccaagattctcaaaattcccaagaagttcttaacgtatatcctgtataagaagaaggtggagaactcttatactaatttgctgatccctaagaagagtggcggtcagcgaaacatttcaatccctatgaaagagcttaaagacgtgcagaggaatatcgtcaaggtgatgcttacacagcagaacatatttcagtttgagaacaacatcaagtctaatatctcccatgcttttaccaaggacaaatccatcattactaatgccgagattcacaaaaacaaacgcttcgtcctgaatattgacttggaagacttcttcaagtcatttcattttggtcgcgtccaaggatactttgaaaaaaacaagagcttcctgtttcctaaaaatattgccacagttctagctcaacttacctgttacaatggtagcctgccccagggagcccctagttcgccaataatcaccaatctgatctgcaacattctcgatatgaagctgttaaagattgctaagaagtacaagcttgactatagtcggtacgccgacgatttgacctttagtactaacaacaagaacttcgaagaaaaaagcgaggagttcttttaccagctcgaaatcatcataaagcagtctggctttaaaatcaatccaaagaagactagactgcaatacaagacaagccggcagatcgtaactggcctggtagtcaacaagaaagtgaatgtgacacgagaattctacaaaaacacccgtgctatggctaattccttatataaaaccggagcctttaccattaacgatactaaaggcacattaagacaactggagggccgctttagcttcatcaatcacattaataaggtgaacaacaagaagagacagatcaatgataaagaaagtactctgaacttcaggtgcttgaacggacaagagaaggagttccagaagttcttgttctacaagtatttcttcaacaacgagaaaccatgcatacttaccgaaggccccaccgacatactgtatctaaaaagcgcgctgaagtctctgtatgaagactaccccaaactcataaaaaaagtgaatggcgagttcatcttcaagattttttttctggagaggtctaagaagaaaaaaacacagaaggtatccaaaatggagtattttttcgggctcaaagagaatggggcagacacgatgatccagatatataattactacgtcagcaacaaacagaagaagcattgcccgaattattcagaactcttcaagaagatgaacgtgactagcaaaaacccctgtattctcatactggataatgaactgtcagtgaaggagaaaccccttaaaaacctccttaattacatggggattatcgatgggtgcaagatcgcggaactcaaagagaagtgttacctgaattctacatccaacctatatgttgccacgaacccgttggttaatgaactcaaggaatgtgagatcgaggatctatttgaggaggccgtgctgaagaccgaactcaatgggaaaacatttgagaaatccgaaaaagcattcaacgatacccggaattacggaaaaagagcactgtcaaagtacgtgtggaataactacgacaacattaatttcgagaacttcaggccattattggatgcaattgaccagatcgttacgaaatataaccactga

SEQ ID NO: 8498 - RNA, 1752 nt, unidentified
  source 1..1752: mol_type = other RNA; note = synthetic construct
atgaatacgttcgaagatataaccagtattgataacctctcaaacattctgagaactcctaaaaaaaagctgacctatatcctctacatcaagaagatccagaattcttacaccacgtttcaaatatcaaagaaaagcggaggacagaggattattaacgtgccatcaaaagatctgaaggacatccagcggaatatagtaaatatgttgctgaaccagcagaaaaagttctactatgagaacaagattcggttgaacatcgcccatgcgtttacaaaagagaagtctattatcaccaacgcaaagatccacaaaaacaagcgatttgtgctcaatatagacctggagaattttttcgagtcctttcactttggacgagtccagggatatttcgagaagaacaagaactacttgtttcccaagaatattgccactgttctggcccagctgacctgttataatggatctctgccccagggcgcaccttctagccctattattaccaacctgatctgtaacatcttggacatgaagatcttgaagatcgccaagaaatacaagttagattacacccgttatgcagacgacctcacttttagtacaaataataagggtttcgacgaaaaatcagaggagtttatctcgcagctagaaatgattatcaagcaaagtgggtttaagatcaataggaagaaaactcggttacagtacaaacaatccagacaagtggtaactggcttagtggtcaacaagaaagtgaatatgccccgtaatttctataagaatacacgcgctatggctaattccctctacaaaaatggctccttcacaattaatggggttgaaggcagcctcaagcaattggagggcagattctccttcatcaatcacatcaataaggagaacaacaaagagaagaaaaagattgacaagaactccaaactcggttttaggaatctgaatggtcaagaaaaggaataccagaagttcttgttctacaagtacttcttcaacaatgagaaaccatgcatccttaccgagggccccacagacataatctacctcaaaagcgctcttaaaaacctttatacggactatcctaaactgatcaaaaaggtcaatgacgacttcattttcaagatctcttttctgaagcgcggggaagatcctaaggcttcaaaagcgcataagaaaattaaagggcagaaaaccagcaaactgcagtacttttttggtctggagaaggatggggccgacacaatgaaacagatttacaacttttacgtgtctgataaacagaagaaagattgcccgaactatagtgagatcttcaagaacatgaatgtcaacagtaagaatccatgcatattcatcctagataacgagttaaacaacaaggacaaaccgattaaaacccttactaactatatggatctgaagccagataaacttgacgaactgtgcgataagaactatctgaagataatcagcaacctgtacattgttacaaatccacttgtgaatgagctaaacgaatgtgagattgaagatctgtttgagctcgacactctgaagaccgaactgaatggcaaaacattcgaacgctgtgaaaaaaaatacaacccctccgagaattatgggaagagggcctttagcaagtatgtgtggaaaaactacgaggatataaacttcgaaaacttcagaccccttctcgacaacataaatcagatcgtcacgaactataatgactga

SEQ ID NO: 8499 - RNA, 1701 nt, unidentified
  source 1..1701: mol_type = other RNA; note = synthetic construct
atggatacatacaaggacattacatcacttgatgatttgtcacggattctcaagacacccaagaaaaagctgaccttcgtattatacatcaagaaagcagagaattcctataccagcttcaagattcctaagaaatccggaggtgagcgagtgattaatgcaccatctaatgacttgaaagatatccagcgaaacatagtaaaaatgcttcttaagcagcagagagttttcttgtttgagaacaacatcaagtccaatattgctcatgccttcactgaagacaaatctatcatcacaaatgccaaagtccataaaaataagcgttttgtcctgaacctggaccttgagaatttttttgagtcctttcacttcggcagagtgaaaggctatttcgaaaagaacaagaactacctattccctgagaatatcgctactgtgttggctcagctgacctgctacaatggttctcttccacaaggggccccgtcctctcccataatcaccaacctgatttgtaacatcttagacatgaaactgctgaagactgccaaaaagtacaaactggattacacccgctacgcagatgacttaaccttctcaacaaacaacaagaatttcgcggaccagctcgaggaatttaccaagcagctggaggtaatcataaaacagagcggctttaagatcaacgagaagaagactaggctgcagtacaaacaaagtcggcaggtcgtgacaggattagtggtgaataagaaggtgaacgtcaagaaagatttttacaaagacacaagggccatggttaattcactgtataagaatggctccttcaccatcaatgatagcgaaggatcgcttaaccaattggaggggaggtttagcttcattaaccacataaacaaagagagcaacaaagagcggaagaaaattgacaagaacctaaagctcaatttcagaaatctgaacgggaaagagaaggaatatcagaagtttctcttctacaagtacttcctgagtaataaaaacccctgcattcttaccgagggtccaacagacataacatatctgaaaagtgctctgaagaatttgtataccgattatcccaaccttatcgaaaaagttgacgagaacttccactttaaaataagctttctcaagcgcacgaagaaaatgaagtattttttcgacctggaagaagaaggagccgataccatgaagaagatttacaacttctacactgtcaacaaagaaaagaatgattgtcccaactacagtgaaatctttaagaacatcaacgtgctaccaaagaatcctctcatttttattctcgacaacgaactagctaatgacaacaaaccgctgaagaatctcgttaattatatggcgctcaaaaaggagaagattcatgagctgcagacgaagaattatattaatgtgacgagcaacctctatatcgtgactaaccaactggcagataacgtgaaagaatgtgagatagaggacctgtttgacgcagaaactttggacgctaaactgaatggcaaaacgtttgaacgcgacaagactaaatataccgatgccgccaattacgggaagaaggccttcgcctcttacatttggaaaaactacaaggacatcaatttcgagaatttcaggcctctgctcgattgcatcaacctgatcgcgaaagattatatcgattga

SEQ ID NO: 8500 - RNA, 1698 nt, unidentified
  source 1..1698: mol_type = other RNA; note = synthetic construct
atgggaagctttgagaacattaaaaccagaggggaccttgccgggctgctcaatattccttcttccaagctctcttacatactgtacatcaaaaagatcgagaacctctatagctcctttaagctccccaagaagtcgggcggacacagggtcattaactctcccgaagaagatttaaaagatatccagaagagcttggctaaatttctgtctcgtcaacagaagatcatatgggatgcaagaggcattaaccagaatattagccacgcctttattgaagggaagaacattatcagcaatgctgaaaatcacatgaataagcggttcatcctaaatgttgacctcgaagacttcttcgattcattccactttggccgggtacgcggttttttcgctcagaatagggactttagatttccgattgacatagccacaataatagctcaaatctcatgctacaatagaaccctgccacagggcgctcccagttccccaatcattactaacctcatttgcaacatcttagacatccgccttctgaagattagtaagaaatatcgggttaactacacgcgctacgccgacgacttaacattttcaacgaacgacaggtccttcagtgacaaatacatgaaattcttagtggagatctcattggaaatcaaacatgccggcttcatgatcaacaataaaaagaccagattgcagctcaaggatagccggcaggaggtgactgggctgatcgtcaataaaaaggttaacgtcaagaaggagtattacaagaaaaccagggcaatggctgataatctatacaggcataaaacctttgacatcgatgggaagcctggcacaattaacaaactggagggccgcttcagctttatcaatcagctagatcgacgaaataacgagataaaccggaaaagggtggaactgactcaaaagtccaacagcaggcattgtctgaacacacgtgaaaaaggataccagtacttcctgttctataagtatttctttgcatgccctaagcctacaatcatcaccgaaggtaagactgatattcgctatctgaaagcggcactgaagaacctgtatcttgaatttccaaagttgatcgaaagaaaagccgacggaacattcgagtttaaggtgtctttccttcgtaaaaccaaacggttgaagtattttatggagttgcagctggatggtgcggatacactgaaaaacatctacaacttctacaacgaaaagggacgccagcccaatctgagcaaatacttcgaaatgaagtccaagactaagccggacaacccagtaataatggtgttcgacaatgagatctcaaataaaaacaagcccctatatactttcaccaattacgccagtacccaacccgagtccaaacaaatgttgatgaagaacctgtccataaatattaccaacaatctgtttctcctgactcaccagctcgtgggtcagcgaacagagtgtgagattgaggatctctttaataagaaggccctggacaccaaacttgacggaaaatctttctcaaaaaaccctgatacgaaacaagagtacggcaaggagtatttttctagttatgtgctgaagaactaccagaatattgagttcgataatttcagaccaatgcttcaggcacttaattcgatcattgagtcctatagtaaagggtga

SEQ ID NO: 8501 - RNA, 1692 nt, unidentified
  source 1..1692: mol_type = other RNA; note = synthetic construct
atgaatcagcgaggctctgggatacaagataagagagacttatgcaggaagctaaggattcagtacagactgctgacatacatattgtacaagaaaggaatcgactcattttacgagcagttcaagatttcgaaaaagtcgggcggcatccgcattatttctgcacccaagcggccactcaaatttgtacagaaaagactggcccagatgctccaaacattttatgatgggtcaactacgaaaaagaataacatcgctcacggttttctcaagtcacgaagcatcattacaaatgccaggaatcacagaaacaaacggtatgtgatcaacatcgacttggaaaatttctttgacagctttcactttggcagggtgtgtggcttcttcgaaaaaaacaagaacttcctcttccctaaggaagtggccgtgacgctggcgcagcttacatgctacgaagggagtcttccacaaggagcgccttgtagtcctatcataaccaacctcatttgccagatactcgattatcgcgtcctgcggatcgccaaaaagtttaaacttaactacaccaggtacgccgatgatctgactttttcaaccaatgaccgcaaatttgtaaacgagtatgacgagttcatcaagcaggtggaagctgagattatccgagctggattccgcatgaataccaaaaagacccggttcatgtataaggatagcaggcaagtggtgacgggcctggtcgttaataagaagttaaacatcccacatgagtatattagacggactcgggccatggcacactccttgtacacaaagggagaatttaacatcgatggggtgctgggctccattgagcagttggaggggcgtcttagctttataaactacatcgacaagtacgccagcacatacgctgagtataaacgatataaccgtttcactcctaaggaaatgtccggaagggagaggttgttccaacagttccttttctacaagtacttctatcataacgagctgcccgttattattactgagggtaagaccgacaaacgctacattaaagccgcacttaagtccttatgccaccattaccccgctttagtgactgccgttggcaacggacggttcaaattccatattagctttctacgcaggagtaaaagactggaaagattcctggggattcagcacgatggggcagattctatgaaggtgatctctaactattatggtagtcccaattctgagggtctgccagactattactcttacttctcaaaatactcctgtgaggctaccaatccggtatttctgctctacgacaacgagattagtaacaaaaacaagcccatcagaaagatgctgaatttttggaagcaaaaagtcgaagatatcgtcaatatcgtcgagaaacagcagtactgttgcctgcagggcaatctgtatatattgaccttccctaccctcaatggaatggcagagaatgaaattgaggatctcatcctgaaagataacccactgatacagatcggcgggcgtaatttctccagagaggaacgatatgacataagcaagttctttggtaagaatgagttttcccagtatgttctggacaactacgacaaactccgcttcgacagctttcggccgctactagacacactgaattccatcatcaaggaatataaggaatga

SEQ ID NO: 8502 - RNA, 1704 nt, unidentified
  source 1..1704: mol_type = other RNA; note = synthetic construct
atgaagaagttttgtgacattcagtcaaggaatgagctggcggattatctcggcatctctcacaaaaagcttacccacatactctatattaagaagccggacaactactatactacgtttgagatccccaaacgcaatggagaaagccggaccatctgcgcccctagcgggcatttgaaagctttacaagtgaagctggccaatatgctatggtgctatcaaaagagtatttgggaggaaaaaggcgtgaagccgaacattagtcatgcattcgagaaagaaaagtccatcatcacaaatgcgaagattcacaggaacaaaagatttgttttgaacctggatctggagaatttctttgacagctttcatttcgggcgcgtgcaaggctacttcgagaagaataacaacttcaaactgccttatgacgtgtctgtcatcttagcacagcttacttgctaccaaggacgactcccacagggagctccttcaagcccaattatcacaaacttaatttgccagaccatggatatctatctcctaagagttgccaaaaaatataagctggactacacacgctatgctgatgacctgaccttctcaacaaacgatagacattttgtggaaaatcaagagaagttcctggccgaagcaatagccgctatcaagagagctggtttttccattaatgagaagaaaactcggctgcagtttcgagacagtcggcaggaggtaacgggcttgattgtcaacaaaaagctgaacgttaatcacgcctatgtcaggaaaactagagcaatggcgcaccagctgtattccaccggggagtacctgatagatggagttcctggtacgatcaaacagctcgaggggaggttttcctttatcgaccatctggatcaccataataatatcctggacccacaggagattaagcacgatgcgtttcacctcaacggacgtgagcgacagtaccaggcttttatattctacaagtatttgtacgcccacaccgtcccagtgatcgtaacagaaggtaaaacagatatccggtatattaaggccgcactgaagtctctgtacaccaaatatccacggctcatacagaaggacgctgaagggaatttcatctacaactttagcttcttcaagcgcaccaagcggtggaaatacttcttcggcatttccctcgacggcgccgatgccatgaaaattttgtaccattatcatgctggcaatgggaagaagatcccagcttatcactcctactttcgtcagctgtctgggctggagcagcacaaccctgtgatccttttgtacgacaacgagtctaaaagcgaaaggcccctgaaaaagtttctcggagaaggagtgcacgcaactgccgaacagaaagcaactctcaagtcggacctccatataaggttaattcccgatagcaaactattccttgtaacaccccctctggtcggtagcaaagaggaatgtgaaatcgaagacttgttcagtgacgagctgctgagtcttaatctagatggcaaaaccttctgtcgcaaggacaagtttgatgattctaagtacttcggcaaggagatcttctcccagtacgtgtacgagaactaccaaactatcgacttttcaagattcattccccttcttgatgtgatagacaccattatcgccgaagccgagtcacccaagaaatga

SEQ ID NO: 8503 - RNA, 1701 nt, unidentified
  source 1..1701: mol_type = other RNA; note = synthetic construct
atgaagaagttctgcgatattcaatcaaggaatgatcttgcagactgcctgggaatccctcacagaaaactgacccatatactctacggaaaaaagccagactcatattatactacgtttgagatccctaaacgcaatggcgatcctcggacgatttgcgctccctccggagacttgaagactctacaggtgaagctgacaaacctgctctggtcgtatcagaagtcaatttgggaggagaaagggatcaaaccaaatatctcccatgccttcgagaaggagaaaagtataatcactaacgcgaagattcatcggaacaagagatttgtcctgaaccttgacttagaaaatttcttcgactcctttcacttcggcagggttcagggttacttcgagaaaaactgtaacttcaaactgccacatgaagtggcagtgatccttgctcaacttacttgttaccagggaaggcttccccaaggcgctccgtccagtcccatcattaccaatctaatttgtcaggccatggatatctatctgttgcgcgttgcaaagaagtataaactggactacacccggtacgcggatgacctgacgttttctaccaaagaccgacatttcgtggagaagcaggaaaaatttctggccgaagccatcgctgccattaagcgcgccggcttttctattaacgagaagaagacccgacttcagtttcgggatagtcgccaggaagtcaccggcttgatcgtaaataagaagttgaacgtaaaccacgcatatgtgaggaaaacacgcgcgatggctcaccagctgtactctactggcgagtatctaatcgatggagtgccaggcaccattagacagttagagggtaggtttagctttattgatcacctggaccattacaataacatcctggaccctcaggaaatcaaacacgacgccttccacttgaatgggcgtgagagacagtaccaagccttcatcttttacaagtacttgttcgccaatgataagcctttaatcgtaacagaaggcaaaaccgatatccgctacataaaggctgcccttaaaagcttatatgctcgataccccaggctcgtgcagattggagccgatgggaacttcacttacaatttcagtttctttcggaggacaaaacgttggaaatacttctttggtataagcctggatggggctgacgctatgaagttcctgtacagataccatgttggcaagaatcacgttccagaatatctcaaatatttcagacagctatcaggttgcgagcagcacaacccggtgatattgctctatgataacgaactggaacacaaaaaacctctcaagcagtttctcgccgaagaagtccatgcaaccgaagagcagaagacagagctgaagtctcacctccaactccacctgatacccgatagcaagttatacgtcgtcacaaaccccctcgtggactccaaggacgagtgtgaaattgaggatctgtttgcagaggaggtgcagaacattaatctggacgggaagactttttgcagaaaagactccttcgataatagcaagtttttcgggaaagacatcttcagcaagtatattctcgagaactataagcaaatcgactttagccggttcatacccctgctgaatgcaattgactctatcatcgcccagacacaaccaaccgagaaatga

SEQ ID NO: 8504 - RNA, 1701 nt, unidentified
  source 1..1701: mol_type = other RNA; note = synthetic construct
atgaaaaagttctgtgacatccagtcacggaacgaactcgctgactatctcagcgttccaagaaacaagctgacccacatactgtacgtgaaaaagcccgattcttattatacgacctttgagatccctaaacgcaatggagagactagaaccatttgcgcgcctagcggggatttgaaaacactgcaggaaaagttgtcaaatatgctctggttataccaaaagtctatctgggaagagaaaggcatcaagccaaacattagtcacgcattcgagaaaggaaagagcatcataacaaacgcaaagatccatcgcaataagaggtttgttctgaatctggacctggagaactttttcgacagattccactttggtcgtgtccaaggctacttcgagaagaacaataacttcaaactacctcatgatgtagcagtcgtgctggcccagctaacgtgttatcagggcaggttaccacagggagccccatctagtcccatcatcaccaaccttatctgccagccccttgacacctatctcctcaaaattgccaagaagtataaacttgactacacaaggtatgctgatgacctcactttttcgaccaacgatcgacatttcgtcgagaatcaggagaattttctcgctgaagccaatgccgccatcaaacgtgcctccttctccatcaatgagaagaaaacccgattacaatttaaggatagccggcaggaagtgactgggctgattgtgaacaagaagcttaatgtgaatcacgcatatgtgcgcaagactcgcgctatggctcaccagctttattccacaggagaatatctgatagacggcgagcccgggaccattaagcagctggaaggcagattttcctttatcgaccagttggaccggtacaataacgtgctggaccctcaggaaattaaacatgatgcgttccacctgaatggaagggagcggcagtatcaagcattcatattctataagtacctctttgcccataacgctcctgtaatagtgacagaagggaagacagacattaggtacataaaagccgctctgaaaagtctgtacgccaagtacccacgcctgattcagaaagacgcggagggaaactttatctacaagttcagcttctttaggagaacaaaacggtggaaatatctgtttggaatttccctggatggcgcagacgcgatgaagatcctgtaccgttaccacgtcggcaacggtaaaaaaattccggcttacttaggctacttccggcagctcagtgggggggaacagcataagcccgttatcttattgtacgataacgagcctaactcggaccgcccccttaaaaaatttctaggcgaagatgtacaccccaccgccgaccaaaaggccgcactcaaagaaaatctccacatgagacttataccagacagcaaactgttcgtggtcacgccgcctctggttggtgataaggaggagtgtgagattgaggatttgtttgctgatgaactactgaagctgtcattggaaggtaagactttctgccgaaaggacaagtttgacaattcaaagtacttcgagaaagagatcttcagccagtacgtgtacgagaactatcagaagattgatttttccgggttcatccccctgttggatgtgatcgattctattattgcccaaactgagtctgcagaatga

SEQ ID NO: 8505 - RNA, 1704 nt, unidentified
  source 1..1704: mol_type = other RNA; note = synthetic construct
atgaaaaagttttgtgacatccagtcccggaacgaactcgctgactacttgggaattccaaggagcaaactcacgcacattctatacgtcaaaaaaccggatagctattacacaacatttgaaatcccaaagcgcaacggcgacactagggcgatctgcgctccatctggcgatctcaaagtgctacaaaagaagctgtctaatatcttatgcctgttccagcgaaacatctgggatgaaaatgggatcaaacctaatatttctcacggttttgagaaggagaagagtatcattacgaatgccaaaattcaccgtaataaacgctacgtactgaatcttgatctggccagctttttcgatagctttcactttggtagaatccagggatacttcgagaagaacaaccacttcaaactacctcatgacgtagctgtgattcttgctcagctgacctgttatcaaggaagactgccccagggagctccttcctcacctataatcaccaacctgatatgtcagagcctggacgcacatctgctcaaagcagccaagaagtacaagctcgactacacacgttatgcagacgatctcaccttttcgaccaacgataggcactttgtcgagaaccagaagaagttcctcgccgaagcgattgtggccattacaaaggcaggcttttccattaacgagaagaagactagattgcagtttcgcgattcacgccaagaggtgactggcttgatcgtgaataagaagctgaatgtcaaccatagttatgtgaggaaaaccagagccatggctcaccagctgtattcaacgggtgaatatttgatagacggcgttcccgggagtattaaacaactggaaggcagattctcctttattgatcagctggaccattacaacaatattttggacccccaggaaattaagcatgacgcctttaacctgaatgggcgcgagaaacaataccaggccttcatcttctataagtaccttttcgccaatgacacacctgtaatagtgacagaggggaagaccgatatccgctatatcaaggctgctttgaaaaatctgtataacaagtatccacggctcatacagaaggatgccgaaggaaagttcgtttacaccttcagctttttccggcgaaccaagagatggaaatacttttttggcatctctttagacggagccgatgcgatgcggattctctacaggtatcatattggctctaacaaacggattccgccatatctctcctacttccagaaactttcagatcacgagcagcacaatcctgttatcctgttatacgataacgagagcaagagtgagcggcccctgaagaagttcttaggtgaggacgtgcatgcgaccgttgaccagaaagcagagctgaaagccaaacttcacatgaggctgataacttcgtccaagctgttcgtggtcactccccccctgatcggcgataaagaagagtgcgaaatcgaagatctattctccgacgaactgttgagcctcaatttagaggggaaaacattttgcagaaaggacaagttcgacagtaacaagtatttcgggaaagagatcttctctcagtatgtctacgagaattacaggactatcgatttctcccgatttataccacttcttgacgtgatcgacatgataatcgcacaagcagaatcacataaacagtga

SEQ ID NO: 8506 - RNA, 1692 nt, unidentified
  source 1..1692: mol_type = other RNA; note = synthetic construct
atggagaagttctgcgatattcagacacgcaatgagttagcagactttctgaagatcccaaggtctaagctcacccatctcctctatatcgagaaacctgagaatgattataagaccttcgaaatcccaaagaaatccggaggcacccgtgaaatctgtgctccctcgggttccctcaagagtatacagagcaaactggcagaggccctttgggaataccagaaaagcatttgggccgaccgaaaaatccacccgaatatttcccatgcgttcgagaagggcaaatctataattacaaatgctcgcatccacagaaataagcggtttatcctaaatcttgatctagagaacttcttcaacacatttcactttgggcgggtacagggcttcttcgagaaaaattataacttcatgctgccacataaggcggcagtggccattgcccaaatcgcttgctacaaaggcgtattgcctcagggggctcctagctcccccattattactaatctgatctgccaaatactggacacccggctgttgaaaatcgctaaaaaatacaagctggactacacaaggtacgccgacgacctcacctttagtaccaacaatagatttttcatggacaatcacgagaaatttctaactgaggttgccctggagattcgaaaggctggtttcaccatcaaccacaaaaagacaagactgatttttagagactctaagcaggaagtgacaggtctgattgtgaacaaaaaaatctctgtggaccgcaactattataaggagactaaggcaatggcccataggctctatacccagggagagttcgagattaataagcaatcagccactatgcagcagttggaggggcgtttttcgtttattgaccagttggtccactataacaacaagctcgacggcggcacacataatcctcatacgctgaacgggcgcgaaaaggaatatcaagcattcctttactacaagtacttctttgcaaacgatcggcctcttatcgtcactgaaggcaaaacagatatttgttacctcaagtctgcactgaagaatctgcatgccaaataccccaatctcattgaaaaagattcaaagggaaagtacgtgttcaaaatatccttcttcaaacgctcagaaaggtggaggtacttttttggaataggacttgacggggccgataccatgaagaacctgtaccacttttttaccagcaaaaacgatgctcctgattatttaactcgcttcaggaagctgtgtaagtgcagtccgcgtaaaccagtgatcttgctgttcgataatgaaacggagagcagtcggcccttaaaaaagttcctctgcgaaaacaagataaacgatgaagacaaaaagcaacttgaacagaacctacacatcagattgatccccgagtccaaattgttcctcgccacgacccccctggtttctgacaagctggagtgtgagatcgaggatttatttccagacgaagttctgaaacacaaagtggatgggagaacttttacccggaaggataattatgacaagaagaagtactacggtaaggagatcttcagcacatatattgcggccaactatgaaaaaatagactttagccgattcgaagagctgctgaacactctttcaatgatcgtcaagtccgaagaggctccacaggattga

SEQ ID NO: 8507 - RNA, 1716 nt, unidentified
  source 1..1716: mol_type = other RNA; note = synthetic construct
atgaagaatatcaacgaccttaaaactagatccgagcttgccgactacctagggatttcccgtagacgactcacatatattctcttcattaaaacacccgactcatactaccaaacctttgatattcctaaagccagtggtggtgttcgaaatatttgcgcccccacaggcatccttaagagactgcaaacaatcctggcgaaaagactgtggctgaaatatgtgtcagataaagtcaggaacaagatagaaaacaccaacattagccacgcctttgaaaaacgcaagtccattattacgaatgcccgaatccatcggaacaaacgctacgttattaacttggacttagagaacttctttgactcgttccattttggaagggtactcggatatttcgagaagaacaaaaacttcatgcttccccacgaagttgctgtggcgctcactcaactggtctgttatcagaaacacctgccacaaggcgctccgacctctccgatcatcactaatcttatctgccagatactggactttcgtcttctgaagattgccaagaaatacaagctcaattttacacgctatgcggatgatctgactttcagcaccaatgataagaagtttctggacctgaaagaacacttctttaaggaaataaccacagatatcctgagagctggctttagtgtgaataacaggaagacccggattgagtttaaggactcccgccaggaagtgacgggcctgacagtcaataagaaggtgtcaattaaacgcgagtatgtacagaatacccgggcaatggctcatcatctatatacccagggccacttcagtatcgatgggcaagacggtgacatcagccagctcgagggacgtttcagcttcataaaccagttggatgtgtacaataacaggctgttgctgcagttcctgaagatcgacaagaacaacgatctgaagctcaataaacgggaaaaggaataccagaaattcctcttctataagtacttttacgcaaacgaaaagcccttgattgtgactgagggtaagactgatgtgttgtatctcaaagctgccctgcagaatctctatgcacggtatcctgagttaatcgagaagaatgataaagggcatttttcctacaagatcgcctttttcaatcggtctgacaagtgggagcgcttgtttaaattcgttaaagatggggcagacagtatcaagaatctgtacttttgtttctcagaaaagaacaacagctccttccccaactacttcaaatactttctcaaactgtccaatgagaagcagaagaattctgtcatccttctgttcgacaacgagatcgactcagagaataaacctcttaagaaattcctaggcgtgattaaagccagtaatgacgctaaagataccctgagaaccagctatactttgcagttaatcccagatggaaaactgtttctagttactaacccattagcagtggataagaaggagtctgagatagaagatttatttccagtggaggtcttgaacataaagatcgaaggaaaggtcttttgcagggacgacaagtttgacaaaacgaagtactatggcaaacacattttctctaagtacgtatacaagaactacaagatgatcaacttcacagggttcatccctctgctggacgtcattaggagcataaccgtgaatctctctgatcagaaatga

SEQ ID NO: 8508 - RNA, 1755 nt, unidentified
  source 1..1755: mol_type = other RNA; note = synthetic construct
atgaaagagttcagcgacgtgaattctcgcgaggaactcgcattggcactcagggtgccactgtcaaaactgacctacatactttatgttgctacagtggatagttgctacaggaccttcgagatccctaagaagaacggcggcacaagggttattaacgcgccacaacgggacttgatggacattcaaaaaaaccttgccaagttactgtatgaacatcggagtaacattaagaacttcaacaatgtgaagtgcaatattgctcacgccttcgagaaagaaaagggtataattaccaatgggagcgtccaccgaaacaagcgaatcgttctcaattatgacttggagaactttttcgattcttttcactttgggagagtcaggggatacttctggaaaaatcggtatttcaggatgaatctggatgtcgctacgatcatcgcccagttgacatgttatcagggcaaacttccgcagggagcccccacctcacctatcatcaccaatatgatctgtgagatattcgactttaagctcttacgccttgccaagaagtacaagctggactacacacggtacgctgatgatttaacgttttcaactaacaatgcagagttcgagaacagaattgacgaatttactgaagagctcagtaaagaaatcgacaatgcgggctttaaaatcaatcgcgacaagacaagactgcagttaagaaagtccaggcagactgtaaccggcctggtcgttaatgagaaagtgagcgtggatcaccgctattataaagctacacgcgccatggcccataacctctaccgggaaggaggttttgatatttgcggagaagagggcagcctggaacagctggagggccgattctccttcgtgaaccagattgacaagtacaataacaaactggagatgtctggtcgtatcggccgaagtggacgcgcttcaggaagggccggagcaggagctggcggtaatgaaaaaaagaaacacgatttccgtcatctgaacgggagagagagagagtatagaaagttcctgttctacaagtactttgtggctggggaacggccaatgattgtaacagaggggaaaaccgatattctgtacatcaaagcagctctcaagtccttttataaagaatatcccgagctaattgagaagaggaaggacgggactttcgattttaagatcgattttctgcgccgatccgaaaagctcaaatatttttttggactcaccgcagacggcgccgattccatgaaaaatctgtacaactacttctccgatatgaataacaacagcttcccgaactacgccgaatatttcggcgagaagatgaagtgtgcaccccttcatcctaccatactcatcttcgataacgaactggaggggaaggataaacctctaaagaagtttactgaccacattaagatgcaggaccgtaaagagtctctgaaaagggacctagccatgcacatcagcgggtcgctgtttattgcaactttgaaattgccagagggtaagaaagaagccgaagccgaagacatgttcgcccccagcgtcctggagcatgagatacgggggaagagattttcccgctctgacgagtacgacaaatctaagttctacggcaaaaatgatttcgcgcaatatgtgttctttaactacaaggagatcgatttttcaggttttcggcccatgctggacagtatccttatgataaagcggaagtatagatacatgtga

SEQ ID NO: 8509 - RNA, 1710 nt, unidentified
  source 1..1710: mol_type = other RNA; note = synthetic construct
atgggaaactttaaggacatcgcaaccaggaatgagcttgcagactttctggggtttcctagacggaaactgagctacatcctttatgttaagagcactgatgcgtactaccagagttttactataccgaagaagagcggcggagaacgctgcatcaatgcccccaccggggacttgaaggacatacagaaaaagttggccatggccctgtggaagcatcaactcgatattcggactagtaggaatattagaacgaacatatcccatgctttcgagaaggggaagggcataatttccaacgctcaaattcatcgaaataagcggtatgtgttaaaccttgaccttaagaactttttctcatcatttcacttcgggcgggtgaaggggtatttcgagaaaaatcgcgattttgaacttccaaatcaagtggcaacagtaattgcccagctcacctgctttcagggctgtctgccccagggtgctccaacaagcccaatcatcacaaacatgatctgtcagattcttgacatgaaacttctgcggatcgccaagcgctataagttagattacagccgttacgccgacgatctgactttctccacaaataatagggcttttctgggcatgcagagtgaattctatgaagacgtggcaaaggaggtcaccagcgctggatttaccattaacgaaaagaaaaccagactgcagtacaaggattccaaacaggtcgttaccgggctgatcgtgaacaaaaaactcaacgttgaccgaatctacgcccggaaaaccaaagccatggcacacacactctatacaaatggcgagtacaccattgacggtaaaataggaactctgaagcaattggaaggtcgttttgcctttatcaaccagctggacaagtataacaacaaacgtgatggcaaaggtgagcataagggatggaacctcaattcaagggagaaacagtaccaaaaattcctgttctacaagtacttcttcagcaattcgaaaccaatcatcgtgaccgagggaaagacagatgtcgtgtacatgaaagcagcgctacggaagttacacgccgaatatccttgcttgattgagcgcaaacccgacggaacttttgagtaccatgtgtccttcttgaagagatcgaagcgcttgtcttactttctccacatttctcaggatggcgctgatacaatgaagaacctcttcaatttcttctcacctactagtgataacaaaagggtctatcctgactatctaacttatttcatgaaggctgggaactgctccgcgcagaacccggttatactggtgtttgataatgagctgagtagcaagaataagcccatcaaaaagttctctgaccacgtaaaactggacgatgtgaggagagagacgctcaaacgaattctccacctcaagctgattgataagggtaatctatatctgctgaccaaccccttagtggacggcaaggacgaatgtgaaatcgaggatctgttcgacgaaaacacgctgtctcaggtcatcgatggcagaacattctctagggacatcaagaaaggagatacgcagcactacggcaaagaaaccttttcaatgtttgtatcccgcaatcatatgaatattgacttctctcgattcagagagatgttgaatatcctaaacgagattatcgggctgtaccacaaacctgaggtctga

SEQ ID NO: 8510 - RNA, 1719 nt, unidentified
  source 1..1719: mol_type = other RNA; note = synthetic construct
atgtcctttttccagcacatcgagacaaggaacgaactcgccgacttcctgggcataccaaggaaaaaactgacacacctgttgtatgtgcagcggatcgagaattgttaccacatgttcgaggtgcctaagagagctggtggcactagagtcatctgtgcaccaactggcgatcttaagtccttgcagagatcactggccaggaggctgcaggagcattgtctccgttgtcgggaagaacggggattgtccgtaaatatagcacatgcctttcagccccgacggggaatcataaccaatgcttacatacatcgaaacaagcgatatgtgttcaacaccgatttggaggacttctttggtagcatccatttcgggaggattagaggttatttccagaagaacgagtatttccagatgcctgccgaggtggccaccatccttgcccagctgtgctgctaccagggtaagttacctcaaggagcgccaacaagccctgtgctttcaaacttaatttgcgagattctcgattttcggattttgaagattgccaagcactacaagctagactatacccgttacgcggacgatttgacatttagcacgaatgataaaaccttctgctcacgctatgacgctttctatcagcaactgcagaaggagatcagacgtgccggtttcgccgtgaacgaaaagaaaacaaggcttgagtatcgtgacgcaaggcagactgtgaccgggctcgtggtcaatcgcaagttatccgttgaccgctgttactgccgcgaaacccgggccatggctcacaccttgtataaaaccggagaatacaggatccaaggcgcagcagggacaatggcgcaactggaaggccggtttgctttcatcaatcagctggacagatacgaaaataagcacagtctctctaaacctagagactttaagaccctcaacgggagggagaggcagtaccagaaatttctgttttaccggtatttctacgctaatactcaccccttgattgtgacagagggcaagactgatatactctatctgaaagccgccctgatgaatttacatagaagatacccggaactcgttgtccgccaaccagacggcacgttcgccttccaggtcaggtttcttcatcgcagcaagcgactgcggtattttttcgatctgagcctggatggggccgatgcaatgaaaaacctgtacgagctgtatactggcaaaggagcacactggaagacggcttactatccttactttctcgcactttctggcaagaaaccacagtggccggtaattctagtctacgacaacgaaatcaacgacaaaactagacccatctcgaagctgctacattcaattgggatgggggaggaaggcaaagaacgcctgaagaagagtttaaaagaacagctggttgcaggaggcaacctatacctcgtcacacaccccctcgcggaagggaaatctgtgagcgagatcgaggatctgtttgctgaacgaacccgagctgtggttatcgatggccgcgggctgagtcttcgggacgactacgacccccaggtaagttacggaaaagatgccttttctaagtacgtgctctcccactatcaaactattgatttcgtgcggtttattcccctgctggatagaatccgcgacgccgttgctgagacacaagcggctgagcaggagccagagggagtctga

SEQ ID NO: 8511 - RNA, 1863 nt, unidentified
  source 1..1863: mol_type = other RNA; note = synthetic construct
atgaccgcatttaagaatattaaatcccggtctgaccttgccgattacctcaacatccctcctagcaagatcacttacattctcttcaagcgaggcgtagactcatattacaccgagtttgagatacccaaaaagtcgggcgatccacggagaatctgtgctccgactggcgatctgaagggagttcagagacagctagctgacgccctatgggagcatcagaagtccatatacgaggagctgtggatcaaacccaacatctcacacgctttcgaggagggtaagagtatcatcactaacgcaaagatacatcgaaataaaagggttgttgtgaatgttgacctcaaggactttttcgattccattcacatcgggagagtgtgcgggttctttgagaaaaacaagtatttcaacctgccacacgaagtcgccgtaaccatagctcaactggcctgctatcagggaaagttattgcagggagcacctaccagtcccatcatcactaatttgatctgccaggtgcttgacatgcatctgctctctctcgcgaagcgttacaaactctactacactagatatgctgacgatatgacattctccaccaacgatcggagcatcttagagcggtgggattcattctacgaggagctggataagaaagtgaaaaaagccggctttagcattaatgaaaagaaaacccgcattacctatagagattcaaaacagatagtcacgggacttgtagtgaataaaaagatatctgtcgatcacagttactgtcgcaaagtccgtgccatggcccactccctgtataccaacgggtcttaccaagccgatggtgtggaaggcacagccagacagttagaaggcaggttcgctttcattgaccagatcgaaaagtacaacaacacttgtgacagcaccgggaagcacgatgcatttgttttgaatgggagagaaaagcagtatcagcagtttctgttttaccgctatttcttcgatgtcgacaaaccactgattgtgacagaggggaagacggacgtgcgctatatcaaagccgcgttgaggaatttatacacagagtacccagagctaattgaaaaggacgcaaaggggaagttcatctacaaggtgaatctgtttaagaggtccaagcgattcaagtatcttttcgtgctagcgctggatggggccgactcactgacatacctgtataatcactttgtcagtacaggcaaagataataggattaactacttggactacttcctcaaaatcacacaaagggtgcctcaacacccggtgatcttcgtatatgataacgagatcaccaacagcaaaaaaccactctataagtttgccaaccatgccaagcttgataacaatcagcgagctctcctgggtacggaactgtttttgcggttaaccccccgtggtaacttgtttctcttgactaaccctctggtggaaggaaagaatgagagtgagattgaacacatgttcaccgaagagacacggggagtcgaactgggcggaaaaaaactttccctggaaagcaagtttgacaacgctaagttctttggaaaggaccatttctctaactatgtgctggagaattatgcaaaaattgacttttccggctttcgcccctttctgaatactatcagaacggtgctccaggaatacgaacgctctattgctaaagagcaaacaacacctatgcgcacaaagattctcataggtgtttgcttcagctgccagcccctgccacattcgaaacaaaggaaagacagcgcagaaaattgtgacgagaagactaaaaacgcagagattgcgggcttcctgcggaggaatctgctttga

SEQ ID NO: 8512 - RNA, 1698 nt, unidentified
  source 1..1698: mol_type = other RNA; note = synthetic construct
atgaccttcgaatacgtttgtactagaaatgaccttgccgacctcctggaaattccccacggaaagctgacacatgtgctgtatgtcgccaaggtagacagcttctacaaaatcttcgagatccctaagaaaagtggggggacacggaaaatctgcgcccccaccggtgacctcaagcagatccaggagaaattgtatagtatcctgctgcaccaccaacaattcctgcgtaaacagaataacatcaggacaaacatatctcatgcatttgagaagggaaagagtattatcactaacggtgaggtgcacagaaacaagcgcatagttgtaaacattgatctgcaggactttttcgactctttccattttgggagggtgtgcggattctttgagaaaaatagagacttcgccctcccgcatgagctggctatcgtcatggcgcagttaacttgttatcagggaaaactgccacagggcgctccaacaagtccaattatcactaactatatctgtcagacctttgatatgaggattattcgcatcgccaaaaagtaccacctggactatactagatatgccgatgatttgagcttttctaccaacgacaaaaagtttatagagcagtgggagcctttctataatgaacttacacacgaagtagagagggccggtttcaaggtgaataccaagaagacctcagttcagtatcgggattcccgtcagactgtgaccggactggtgataaataaaaaactctctgtggatcacagatactataaacaagttcgggccatggcagatagcctttacaagacggggtgttttgacaataacggggtggagggcaccgtgtctcagctcgaaggcaaatttgcttttattgaccagctggacaaatacaataatatcaaggacgtttcccaacagcactcggtgttttgcctaaatggccgagaaaaacagtaccagaaattcttgttctaccgctatttctttgctcatgagaagcctgtgatcgtcaccgaagggaagactgacataaagtacataaaggcggctctgaaaaacttatataccgaataccccgaacttatcgagaagacacctgaaggccactttgaattcaaggttagctttctgaaacggtcaaaacggtttaagtactttttccatatgtcacaggacggggccgacgccatgaagaatctctacaatttcttctccgataaaaaccccaaatacacgaactacttcaaggtcttttcaggctgcagtgataagaacctatgtaacccagtcattctgattttcgataacgaactttccaacaagtgtaagcccctgcattccttcgtgtcccacataggactatcttccagcgataaagatcgcctcaaggaggacttgtgcatgaaaatcattgacgagggcaatttgttccttgtcacaaatcaactggtcgatggcaaggctgagtgcgaaatcgaggatttattcgacgataccactaggaatcatgtgattgctggtaaaacgttcagctcaaacgataaggcagataaggagaagcactatggcaaagaaatctttgcaaatttcatccaaagcaactacaagagcattaactttgacaactttcgaccgatgctcaataacattgtaaaggtgattgcagagtttgcaggaacagagggctga

SEQ ID NO: 8513 - RNA, 1563 nt, unidentified
  source 1..1563: mol_type = other RNA; note = synthetic construct
atgctcaagaaagacggcaacattcggaccataaaagctccctctagtgagttgaagagcatacagaagaaactggccagcaaactggagtcatgccaaaggaatatttggaccggaataggagttaactcaaatatagcacacggattcaagaaaggcaaatccattgttacaaatgctcagattcatcggaacaagaagtatatccttaatatcgatctgcaagacttctttgattcatttcactttgggcgtgtgcgcggttttttcgaaaaaaatcgcaactttgccctgcctatcgaagtggctactgtagtggcccaattgacatgtttcgagggatgcctgccacagggagcaccaacttctcccatcataaccaatcttatctgccagattctagacaaccgactgctaaagttggccaaacggtataagctcgattacactaggtacgccgacgatctgacatttagtactaatgataaggcctttgtggaacgcaaagacgagtttctttgcgccattcagaaggaaatcgaacgagccggcttcaagatcaacgagaaaaaaaccagactcgtttataaggactctcagcagaaggtaacaggtttggtggtcaatcagaaagtgaatgtcgcgcaggattactatagaaaaaccaaggctatggcacatagcctgtataaaaagggtgaattcacgattgatggccaggcgggcactatcgaacaactagaagggaggttctccttcatcaaccagctcaactgttacaataatcaacacgatggagagaaacatgaatttggtctgctcagcggaagagagcgcgagtttaagcgcttcttgttctacaaattcttctatggcaacgacatccccatcctggtgactgagggcaaaacagatgtgagatatttaaaagcggctctgaagagcttatacaatgagtaccctaatctgatcaccaagtctaaagacggcaagttcagatttaagttttcgttcatgaagcggaccaagcgtcttaggtactttcttggcgtgcaggctgacggggcagatacgattcagaacatttacaagtactttgtcggcggcaaagggagagaatccaagaattatcctaactacttcgcctattttctccgtatggggacgcagccaaaggcaccagtaatccttctcttcgataatgaactggaatccaagaggccgctccggaaattcctgaacgaacagaagttctcagagacacagatcgaccagctgaggaacgagctgtgtctcaaagtctttaatagtgggaagttatacctgctcaccaaccctctcgttctggagaaaactgaatgcgagattgaggatttattttctgaggagacactgaacttgttgataggggggaaaaacttatgtcttaaggacaaatacgacaccgagaagtattacggtaaggagatcttcagtcaatatgtcctgaaccactttgagcaaattgacttcagcggattccgacccctgctagacaagctgtccctgattgtgcggcagtga

SEQ ID NO: 8514 - RNA, 1686 nt, unidentified
  source 1..1686: mol_type = other RNA; note = synthetic construct
atggctcagttttgtgacattgcctctcgcaatgaactggctgatttccttggtataccccggcagagaatgacctatgtgctgtatgtgaagaaggttgagagttattacaccagtttcgagatcccaaaaaagaatggagaaactcggactatcaaggcgccaacaggtgaactcaagttcatccaaaagaaactcgtctctaagctagttcaataccagcgggaaatatggcggtctaaagggatgaaacctaacatatcacacggctttgaaaaaggaaagtccatcgtgaccaatgcaaaaattcacaagaataagcgttacctgctgaacatagatctacaggacttttttgacagctttcatttcgggagagtccggggcttctttgagaagaacagagatttcgccctgcccttggaggtggccaccgtgttagcgcagctcacatgctttgaaggctgcttgcctcaaggcgcccccacaagcccgattctcaccaatctcatatgtcgcatcctagacaataggctgttaaagattgctaagcgctacaagctcgactacacccggtatgcagacgatctgactttcagtacaaatgataagactttcgctgggctcaaggatgaattcctttgtacaatccagaaggagattgaaagggctgggttcaagattaatgagaagaaaacgaggctcgcatgcaagaatagtcagcagaaagtcacaggtctaattgtaaaccagaaggtgaacgttgcccaagattactacagaaaaacgaagtccatggcccactcattatatacgaaaggcgagtttacaatcgatggccagacgggaaccctggagcagttggagggaagattttcctttatcaatcagctggactggtacaacaacaaactggataacgaaacccatgaattcggagtgctggcagggcgtgagcgggagtttaagaggttcttgttctacaaatacttctacggaaattccaccccgatcattgtcaccgagggaaaaactgatgtccgttatcttaaatctgccttgaagagcctgagcaaagagtatccaaacttgattaccaaatctaaagacgggaagtttgagttccgagttactttcctgaagcgaacaaagcgattgcagtacttcctgggtattaggctcgacggcgccgatacaatccagaacatctataggtatttcatgggtggcaaagggagagaaagcaagcgctatcctaattacttctcgtattttctgcgaatgggcgccaaacctaagaaacccgtgatcttactgtttgataacgaactggagtccaaaaggcctctcagaaagtttctgaccgagcagaagttatcagaagcacagatcgaggatcttcgctcaaagctttaccttaaaattctcgacaatggcaaactgtatcttcttactaaccccctgatttctggagagaaagaatgcgagatcgagtacctcttcagcgaagaaacaaggaacctgaagattgaggggaaatccctctgtctgaaggacaagttcgacactgagaagtactatggcaaagagatctttagccagtacgtgtcggctaactttgaacaaatcgacttttccggtttccgcccactgctggacaaattggacctgatagtacagcaatga

SEQ ID NO: 8515 - RNA, 1686 nt, unidentified
  source 1..1686: mol_type = other RNA; note = synthetic construct
atggcgaagttttgtgacattaccagtcggaatgatctcgccgactttctggaaataccacgcaaggttctaacctacgtcctttacgttaaaaagaccgagaatttctacgctagcttcgaaatcccgaagaagaacgggggcacccgaacaattattgcccctagtggcgagctgaagtctatccagaaaaaactggcccgagagttagagagatatcagcaagacatatgggcctcaaagggcatcaagcctaatttatctcacggcttccagaaaaagaagtccatcgtgacaaatgctagaatccaccggaataaaaagtacgtcctgaacattgacctgcaagattttttcgattcctttcatttcggacgggttagaggattcttccataagaataaagactttgctctccccattgaagtggcaaccgtgctcgcgcagctgacctgctttgaaggacggctcccacagggtgcaccaacgagccctgtcgtcaccaacctgttgtgccagatcctcgataaccgtctgctggggatcgctaaaaagtacaagctggattacacccgctacgcagacgatctgacatttagcactaatgacaagatgttcgtggaacacaaagacgagttcttgaggacaattcagaaagagatcgagcacgccggattcaaagtgaatgaaaacaaaacccggctagcctataaggatagccagcaaaaggtgacaggactggtagtgaacgagaaagttaacgtagcccaagaatattatcgccgtacaaaatccatggcccattccctgtacaaaactggggagtttacaattgacggggaggtgggcactcttcagcagcttgagggacgattctcgtttatcaaccagcttacgtggcataacaacagacaggatggcaaggaacactcttttgggactttgagcgggagagagcgcgagtttaagaggttcctgttctacaaattcttctacggaaatgacatacctatcattgtgactgaagggaaaaccgatgtaagatatctaaaggcagctttaaaggccctgcacaaagattatccagacctcattgaaaagaataaggacggcaagtttgaattcaagatcgtcttcttcaagaggacagaaaggttacgttattttttggggattcagttggatggcgctgacgcaatgcaatctgtgtacaaatattttgtcggcggcaaaggtagagagtccaaaaactaccctaactatttcgcgtattttcagaggatgggagcccagcccaagaagtctactatcctgctttttgacaatgagacaaaaagtaagcgcccgctcggcaaactcctgactgagcagaagttcactgaggaacaaataaggaaactgaaacaggaactacatttgaaagtgctcgacaaggggaatctgtacttgcttacgaaccccctggtgcccggcgaagaggagtgtgagattgaatacctgtttagcgaggagacaaggtcaactctgatcgacggtaagagtctgtgcctcaaggataagtatgataccgagaaatactatggtaaggaaatcttctcacaacacatcaccgatcactttgagcagatagatttctccggttttcggcccttacttgacgctctcacgtcaattgttcgccagtga

SEQ ID NO: 8516 - RNA, 1683 nt, unidentified
  source 1..1683: mol_type = other RNA; note = synthetic construct
atgaacaggttctataatattaagaatcgccgggagctggcttcttttctaggaatacctttgaaaaagctcacttacatcttgtacaagaaaggcgtggactattactatgagacattcgaagtgcccaagcgcaattcaggcgcccggataatcaacgcccccagtggagatctgaaaacgttgcagaagaaactgtccaagattctctacgaacatcagattatccacatacagaatcacaagatcaagaacaagatttcacatggctttgaaaaagagaaggggattattactaacgccgagattcatcggaataaacgctttgtcatgaatgtggacatcaaagacttctttgaatcatttcacttcggccgtgtcaaaggttttttcaacaagtcgaaagcgtttaacatgagcgaggaggtggcaattatcattgcacagatcacctgcttcaatggaaaattgccacagggggcacctaccagccctataatcaccaacctgatttgcaatatcctcgatatgaggatactgtccatctgcaaggaatataaactggattacagtagatacgccgacgacctgactttttctaccaatgacaagcacttcattaagaataagaacggtttttacgacaacctgaagagagagatccaagggtttggtcttctgataaatgagaagaagactcggatagagtataaagactctaggcaagtcgtgaccggactgaccgtaaacaaaaagatctctgtcaagagagagtattacaagaatactcgtgctatggctgataaactttatcgaacgggagaattcacaatcggggagaaagccggtacaattaggcaattggaaggcattttctccttcatcaaccagattgactatttcaataacaagaaggacaacaacaagaaacacaacgtgaacaatcttaattctagggaaagagaataccagaaatttctattctaccggtattttctctccaatagcaaaccacttatcgtgacagaaggcaagaccgatgttatgtatattaaagcggctctgaaaaagcactataaagagtaccccaacttaattgaaaagcatcgagatgagtttgagtttaagatcagtttcctgaatcgaaccaaacgcttaagattcctcatgggcatccagatcgatggagctgacacattccttaacatctataacttctacacagggaagaacaacttcaataactacttcaagtacttcaacgacaagtataagataacgccaagtaatcctgtgattctcatctttgacaatgagcagaaagaaaagaataagcccctgtacaaattcaagaaagccgttaaaatgaacactatcgatctcagcagcgagataatcgcaaatctgtttctgctgacagttccgctgtgtaataacaaagaggaatgtgaaattgaggacctgtttgatgagaaagccttgaaccataaaattggcgggaaaaagtttagccgcaaaaacgaaaacaataagaagtattacggcaaagcagacttcgccaagtatatctacaagaactacaaggatatcgatttttccaatttcaagctcatgctcgatgagttaaaccttgtcgtgaataaccacaataataactcaagcctatccaccgtaggagtttga

SEQ ID NO: 8517 - RNA, 1689 nt, unidentified
  source 1..1689: mol_type = other RNA; note = synthetic construct
atgaagaatctgagtgaggttagcacaaggaatgaactcgctgactttttggggatacccatcaaaaagctgactcacattctctatgtgaaaaagccagacacgttttataagcagtttgagattcccaaaaagagtggagagccacgcattataaacgcccctacgggcgccctgaaaagcatccagaagagactattattcgctattgagaaaaccatttgcgatgggtcatctaacaaatcaaacatttctcacgcatttgagaagaacaagagtatcatcactaatgcgaagatacatcggaataagaaaattgtgatcaacttcgacctgaatgacttctttggaagtttccatttcggtagggtatgcggattcttccaaaagaaccgatgttttaacctgccatatgaagtagcggtggccatcacccagcttgtctgctttaatggcaccctgccgcaaggtgcacccacgtctccaatcatcaccaatctgatctcacagattatggatgtcaacctgctgaagctggccaaaaagtataaactcgactttactcgctacgccgatgatttgaccttttcaactaacgacaagaagtttctggagaagtacgacgaattttacgatcagctgtccagaaccatatccttcctgggattcgaaatcaatgagacaaaaacacggctacagttctgtgattctcaccagaccgtcacggggcttactgtgaataaaaagatccaggttccaagaaactactataaaaagactcgcgctatggcacactctctctacaagtccgggagctatacaattgacggcgaagagggcacaattaatcagctcgagggcagattctcctttattgaccaactgaccaagcataacaacaaaattgatggacagaagcaccgactcggaacattttgcgcccgggagacagactatcagaagttcctgttttacaagtatttctttgccgcggagaagcctttgctggtcactgaaggtcagactgatatcacttaccttaaagcagccttaaagaatctgtatctcgaatacccttcactgatttccaaaaaagaggatggcacctttgagttcaaaatcagcttcttgaatcgtaccgacaggttaagctactttctgggattttctaaggacggcgctgatgctatggggtgtctctataacttcttcatcaaaagtaagtccaaggaacacccgaattattacgagtacttcctcaagacaagcgggtccaaagctcactatcctgctatattcgtgtttgacaatgagctggaaagcaaagggaaacccttgaaaaagtttttcgacaactacgtcaaggacgaagaaaccaaaaaagagatcaagacacaattgtacgttcacctgataaagagcgcaaacatctatcttgtgaccaaccccattcttgagtcgagcagtaaggaggccgaaattgagcatcttttctcaaaggaagtgctagaaacaaaaatagatggcaagcctttaagcctttctggtgactacgataaatccaagtactacggcaaagtggccttctccaaatacatcatgaacaactacaagtctatcgatttctcgaatttcaggatcatcttggataacattgacaaaatcctcaaggagtataatgaacattga

SEQ ID NO: 8518 - RNA, 1701 nt, unidentified
  source 1..1701: mol_type = other RNA; note = synthetic construct
atgatttcatttagcgagattaaaagccgcaacgactttgccgatgcactgcagatccctcgaagtgtactcactcacgtactgtatatcgctaaaccagagtcattctatgagtctttcaccatacccaaaaagaacggtgaagataggatcatcatggctcccaagggcacactgaagtccattcagaccaagttaagtaagcagttagtcgaatacagagcctcgatctcacaaaaggggcaggagaagagcaacataagtcatggattcgaacgtgaaaagtctattattacgaacgcccagatccacaggaacaaacggtatgtgataaattacgacctgaaggacttcttcgattcttttcactttggccgggttgtgggattttttgagaagaacaagcatttcctgttgccgtatgaagtggccgttattatcgcgcagctgacatgctataatgggagactcccacaaggagctcctacctctccagtgattaccaacttaatttgcgagattcttgattaccgtgttctcaaaatagcgaagaggtataaacttgattacactagatacgcagacgatctcaccttctcaactaattacagccgatttctcgaagttttcgactcttttgccaaggagctgctccaggagatatctaattccggttttaccatcaatcagtccaaaaccaggctcttgtatcgagactcaaggcaggaggtgacgggtctagtggtcaataaaaaaattggcgtcaatcgggagtacgtgaagagtacacgcgctatggcccaggctctgtatagcacaggggaatttactatcaacgggatcccaggtactatcaagcaactggaagggagatttggctttattgaccagctcgatcactataataacgtcatcgacgacgccaaacatgatgcctacagtcttaatgggcgcgagaagcaattccaggaatttttgttcttcaagacgttcttcttcaatgagtaccctctggtaatcaccgaaggaaagacagatatccgttaccttaaggcagcgctgaaaagcctgcaccagaagtacccagaacttatatgtaaagaagacgatggcacattccggttcaaaatcagcttctttagaagatctaagcgctggaagtatttcttcggcatttcaaaggatggagccgatgcaatgaaattgctctacaggttctttaccgggcagaaaggtgtgaagaattattaccggctgttcgctgagaagtataaagcagtgcaacggaaccccgtgattatgctgtttgacaacgagatggagagtaaacgccctctgaacaagtttatcagcgaggaggtcaaaattccctcctcggaacagcagttgtttaaggagcaactgtactatcacctaatacccggcagcaagacttacctgatgactcatcctcttccgcccggcaaaacagaggccgaaatcgaagacctattcccaaccgaagttctgggcgtcaaactggacgggaaatccttttccactaaggataaatttgacacatccaagttctacggaaaggatattttctcttcctacgtgtatgagcattggaaatccatcgactttagcggcttcatccctttgctggacaaaatcaacatgttagtgcagaatgagaagaaacccggactcaacacctga

SEQ ID NO: 8519 - RNA, 1695 nt, unidentified
  source 1..1695: mol_type = other RNA; note = synthetic construct
atgataaagtttaccaacatccaagacaaaaaccagctggccaatgtgctcaacatcaagcccaaatatctgaactatattctgtacgtcaagaaagtggacaattattacaccgagtttgaaattcctaagaaaaatggagagatgcgcaaaatccacgccccaacgggaatactgaaatctatacagaagaatctcagtattctgttgtctgaataccagtcatacccgtattccaagaattacaaggggaataaaatcagccatgcatttgagaaaaacaagtccatcattacgaacgctaaaatccaccggaacaagaaatatatactgaacatcgacttggaatgttttttcgactcttttcactttggtagagtgaaaggcttttttgagaaaaacaacttcttcaagctcccttctgaaattgcacttatcttggcgcagatgtgctgttataaaggctgcctgccacaaggagctcccacgtcacccattatcaccaatctcatttgtaagatcttggatattcggctgcttaaaatcagcaaaagcttcaaactggattatacacgatacgccgacgatctgaccttctctacaaatgataatgcctttctcgaaaacaagacaaagttcatgaaactgctgacaaaggagattgagcacgccggctttaaattaaatacaactaagactcgcctgcagtataataccagtcgtcaggaagtaacggggctggtggtcaataagaagatcaacgttaagaagagctattacaagacaacccgagctatggcgaatactctatataggaccgggcagttcactatcgacaataacagtggcacaattaatcagttagaagggcggttttcctttattaaccagatcgacaagtacaataactccctcatcaaaaagaaggatttctttaacctgaactctcgcgaaaaagagtaccaaaagttcctattctacaagtacttcttctcaaacgaaaaacctctcatcgtgacagagggcaagaccgatatcgtttacataaagtcagctctcaaaaacttgtacaccgagtatcctaatctgatccttaaaaaagatgacggtagctttgagtttaagatttccttccttaagagaactaagaggctcaactacttctttaattttgcacaagatggtgccgatagtatgaaaaacctgtataacttcttcgacaagaataagtccaataatagctatccgcattatagcaactacttcagcaaaatatcgaataggaaacccaatttcccaatcatattcatcttcgacaacgagttaaacactaagaacaaacccttacataagttcatcaactatatcaacctctgcgagtcaaaatccctaaaattccaggagtactacaaagtcaatctggtggacaatctttacctgcttacaaatcagttgattcagcacaagagtgaatgcgaaattgaggacttatttgataatcaaaccctcactcatatcatttcgggcaagacttttaatagaaacctgaagaagcttgatggaaccaatcactattccaaagagattttcagcaagtacatttctgagaattacaagaccataaacttcgacaactttaagccactgctgaacaacttgaacgaaattctaaaggactacatatccgatatctga

SEQ ID NO: 8520 - RNA, 1719 nt, unidentified
  source 1..1719: mol_type = other RNA; note = synthetic construct
atgttatttaagaaggaagattgcattctctcagctgaactgcagaaatttgcgaacttctttaacatcaaggcaaacattatcagctatgttctctatgtgaagagaacggagaattgttatacagcctttgaaattctgaagaagtacaagaaggaaacaaggataatacacgcccctaataaaactctgaagaatatccaacgcaatatcgccaaaaaattgcacgaattacagcaagacatagactctaagaacaacattaagaccaatatcagccacggtttcgagaagaacaaaaatattgccactaacgctatgattcacaaaaacaagagatacatcctcaatatcgacctggagaattttttcaactcctttcattttgggcgagtaatggggtatttcaacaaaaaccggtatttcaacttcgacaagaagatgtctattataatcgctcagctgtgttgcctgaatggcgctctaccccagggagcaccaactagtcctatcatcagcaatctcatatgcaggatcttcgactacagaattctgaaaatcaccaagaaatacaagctgaattacacacggtatgcagacgaccttacttttagcacaaacgacaactttttcttacaccactacgataacttcttaaaggatattagctccgagattcagaaatcgggctttaaaatcaataagaacaagacacgactccaatacaaaaattcaaaacaagtcgtcaccggcttggtggtgaacaaattcattaacaccgaaaagatgtactacaaaaccacccgcgctatggcctataatctgtataagtctgggtcctttaccattaatgacaaggaaggagaacttaatcagttgcagggcagatttaacttcatcctgaacatcaagagttattcacctgtaatccagaaagataccaagaacaatatactgcatagcaaagagaaggagtatcagaagtttctcttctacatcttcttctacattaacaccaaacctctgctcatcaccgaaggtaagacggatattttgtacattaaagcagcccttaagaatatgtacaaaaattatccccggttcataatcaaaagtgacaacaaattcgactacaaaatcgccttctttaaacgtagttctaaaaacatcgaggagtacttgaacattaagaaagatgggggccatgaactcgtgaagatcatcatttactacttcaacaagaagtacttcgacttcttttacaacctgaacaagaacataacgccaaataaccccgttattatacttgtggataatgagaaagcgaaggataaaccactggagactctgaaaaagaatataccgcaggcttaccggaatgatctaaactttaaagagaagccctggtttcgcattggagacactaatctgtatatcctgacctacaggtcaaatccaaatctgaaagatatagaagtcgaggacctcctcgaggagtctttcattaaagagctaaagatccagaatagggtgtttgacaaaacagcaaataaggattccgagctttacttttccaagaatacattggccaattatgtgtacaagaattacctgaagatcaacttcaacaacttcaagtttatcttcgatgacatccaagatattatcaacgatcacaacaaccattatccgattaatcagacactgcatactctttga

SEQ ID NO: 8521 - RNA, 1647 nt, unidentified
  source 1..1647: mol_type = other RNA; note = synthetic construct
atgtctcttggcaaaatcaaaaatcgtaatgaactggcgaggctgctggaggtgccgactaagttcctcacttacatcctctacattaagaaaacagacaacctctactcccggattaacattctgaagaaaaatggggatgagcgaataatatatgcccccgagaaggagctgaagagcatccaaaaaaagttagcctctattctgtatcaggagcggaaggcttatttcgaaggtcgggggatcactcctaatatatcacatggctttgagcagaaaaagagcataatttccaatgcaagaatccactgtaataagcacgtaattttcaatttggacctggaagatttctttggttcattccattttggaagggtgaagggctactttgaaaaaaacaaccagttcaagttggattcccagatagctattttaattgcccaaatcgcatgttacaaaggatttcttccacagggggcccctacgagccccatcattacaaacatgatctgcagcatcctcgactatcgcctcctgaaactggccaagcagttcaaactggactataccaggtatgcagacgatctgacattttctaccaacgacaaaaaattcctggacaataaggacgtgttctacaaaaagataaaccgtgagattgagaaagcgggttttaaaatcaactgcaagaaaaccagactccaatttaaggactcccatcaagaagttacggggctaaccgtcaataagaaggtgaatgtaaagaggttctactacagacagactcgagctatggcccaccgcctgtataaaaccggcgagtttgaaatcgatgggaagcgaggtactgtggaccagctcgagggacgcttcagctttatgtatgaagtcgcatcatacggatctactaagaagaactattgctacaaggaatacaagaagtttatcttctacaagtacctttacatgaacgataagccagtggtgatcaccgaaggaaaaaccgatattatttacctaaaggctgcactcaaaaatttgtatgaggattatccttccttgattagcaagcagacagacggaacgttcaagttcaaaatcacattcttgaaccggaaaagtgagaggctaaagaaacttcttaatttgcagaaggacggcgctgatggcatccggaccttcattaacgagcactttctgtgtaagaatcccactgccaagtattttaagaacatagatgggccactgtctaagaatgctgtgatttgcatctttgacaatgagatcgaagatcaggataaacctctgagacacgtctggaacggctttaaaaaagattcaaagcgcaaagaggccctgaaaaataatcagaatacccattgggttgacaacgtttacattcttacaaaccccctcgtctcgggcaagaaaatctgcgaaatcgaagacctctttgatgaacagacattaaaccagcaaattatgggcaagaaattcgatagaagtgaggagaaccacaaacatttcttctccatgttcatcaacaagaactacaacgacatagattttacccaattcaaaccaatgctggacaatctggacaagatcatctatgactatgggaacagtatggataagtgtcagtga

SEQ ID NO: 8522 - RNA, 1707 nt, unidentified
  source 1..1707: mol_type = other RNA; note = synthetic construct
atgggaaaactcaatgagataaataatcggtctgactttgccaatctcattaatgtgccaattcagaaactcaccttcattctgtacaaaaagaaggtggagaatctctattcgtcatttagcatcccaaaaaagtctggggggtatcggcgcatctattccccacacgaggacctgctcgatatccagaagaaaatcgcacgactgcttgcgacccagaaaaacgtcttccaggaggaaaacaggattaaattgaacatctcccatggtttcgaaaagaacaagagcattatcactaatgccaaaattcaccgcaacaagaggtttgtctttaatgttgacctggaaaacttttttgagagctttcactttggcagagttaaaggctacttcgaaaagaacaaaaacttccagttgcctaccgaggtggctgtgattctcgcacagctttgctgttatcaaggcgtcctcccacagggtgctcctacttctccaataattacgaacttgatctgtaacatcctggacctacgccttttaaaacttgccaagaaatataggctggattacacccgatacgctgatgatctcacattttccaccaatgatcgccattttctagacctaaagtcagcattttactacgagttgaacggagaaataaaaaaagccggattcaagctcaacgagaagaaatcaaactttcagtacaaagactctcggcaaatggtgactggcctggtcgtgaataagatgatcaacgtggacagaaacttctataaggaaacacgtgctatggctcaccgcctttaccaaacaggaagcttcacaatcgataacgaagaagctgatattaaacagttggagggccggttcgccttcatcaatcagattcagtggtataataaccgaatcgataacgagaagcataatttcaggtcactgaatacaaaggagaagcaataccaggccttacttttctataagtacttcttcgccaataacaagcccttaatcattaccgagggcaagacagacattaaatacctgaaatccgccttgaagaagtactataacgaatatcctgagctggttactaaagacgaaaagaataactacgacttcaagatcagttttctgcgtagaagcaaaaggctgcggtatttttttgacctgagtctggatggggccgacactctgaccgacttctacaagagatttatgtctaacagttaccccgagaagggggcaatcaactacctgatgcacttcaaaaaaatgagcgagaataaacccaagaatcccgtcatttggatttttgataacgaaatagcgaacaaggataagcctatctgtaaattcatcaatggagtaaagctaacagaatataagaaggaatgcctcaagtcttcccagcaaaccctgctgcatgacaacttatttctcttgactaatcctctgagtaacggcgcagaggagtgcgagatagaggatcttttttcggaagacgtgctgaaaaaggaaataaatgggaagacgttctgcagagataaaaaggtagacccggagaaatactatggtaaggagatcttcagcaatttcattgtgaatgagtatgaacggatcgatttcgagaatttcaagccgatgctggacaacctgacgctgatagttaggaattacagatccgattccgtgatcccctga

SEQ ID NO: 8523 - RNA, 1683 nt, unidentified
  source 1..1683: mol_type = other RNA; note = synthetic construct
atgattaaactgaaaaacgtgaagaacaggaaagaatttgctgaattcatcggtgttccactccaaaagcttacctatgtcttatacatcgccaagatcgacaatctgtatacctcattccagattcccaagaggtctggcggcgtgagaactatcaacgccccacagaaagacctcctagatatgcagaagaaactggccaaactgttagctacccacaaatcaattgtacaggaagagaaccacattaagttgaatattagtcacggcttcgaaaagaatcgaagcattatcaccaacgccaagattcatcgaaacaagagattcgtgttcaatgtcgacatcgagaactttttcgattcctttcattttggcagggttaaggggtacttcgagaagaacaacaattttgagttaccttcagaagtagctacgataatagcccaattatgttgctataaaggagtgctgccgcagggagcacccactagcccaattattacgaacctgatctgcaatatactagacatccggcttcttaagctaggtaagaaacataacctggattattctcggtatgctgacgatctgactttttcaacgaatgacaggttgtttcttatcagcgagtctctcttctacgacgagctcactaaggagatcgaatctgcaggctttaaactgaatgagcagaagtcccgcctgcagttcaaagactcgcgtcaaaccgtgacaggactcgtcgtcaacgagaaaattaacgtcgatcgaaggtactataaggagactagagctatggccaacaaactgtacaagacaggtatctttgagatcaataatcaaagcgccaccatcaagcagttggagggccggctgaccttcataaacaacattcagcgttacaacaattctattgatgggaagaaacacgatccttggagtctgaatagtaaagaaaaacagtacagggcgtttttgttctataagtactttttcgcgaacgagaaacctttaatcgtgacagaagggaagaccgacgtgaagtaccttaaggctgccctgaaaaaatattgggagctgtatcccaatctgatcagtaaagattccaaaggagacttctcgttcaaagtttcctttctcaatcggaccaagagactgagttacttctttggtattaaccgcgacggagcggatgccttgaagaatctgtacaacttcttcacaagcagcagccaaaacaatccacctaattacctgtactacttcaagaagatatccaatcgcaatcccgcaaacccagtgattatgatttttgacaatgagctcgtgaacaagaaaaagcctttgtccaagtttgcaaatcactgcaaacttaatgaggattcccgcaacaatctacagacacagctctatatacggctgcaggataacctgtttctcatgacaaacccgctcgttgaagggaaggaagagtgtgaaatagaggatctgtttggggaggacgtactcaacactaagatctcaggaaaaatcttctctcgcgaaaaaaaagcagatcccaaggaacattatggcaaagagattttcagcaacttcatcacaaatgaatacgaaaagatcgacttcgagaattttaagcccatgttggacaatctttccagaatcgtggaaaactataagtga

SEQ ID NO: 8524 - RNA, 1683 nt, unidentified
  source 1..1683: mol_type = other RNA; note = synthetic construct
atggagaatctgaaaaaggctaagaaccggaaagattttgctgaattgatcaatgtgcctttgcacaaactgacttatgtcctttataaggccaaagtcgagaacttatacacctcctttcaaatacctaagaggtctggaggggtgagaaccatacacgccccccaccaggatttaagagatatccagaaaaaactggccgacctcttggtcaagtacaaaaatataatccaggccaccaataacatgaaactgaacatctcgcatggcttcgagaagaacaagtcaatcattactaatgcacgaatccatcggaataaaaggtttgtctttaatgtggacctggaaaattttttcgagagcttccacttcggccgcgtgaaaggtttctttgaaaagaacgagcattttatgctcccaagcgaaatcgctgtgattatcgctcagatttgctgctataaccgaaaattgccccagggggcgccgacatctccagttattaccaacctgatttgtaacatcctggacatcaggatcctgaagctcgcaaaaaaatacaagctggattactctcgttatgcagacgacttgtccttctccactaatgacaaaaacttcctgaatagcaaggatgatttttataacgagctggtgaaggagattataaaggctggattccgggttaatgacaaaaagagtcggctgctttttaaagatagtcgccaagttgtgaccggacttgttgtgaacgagaagatcaacgtaaataggatgtactacaaggagacacgggccatggtgaactccctctacaccacgggctcttttgagattaactcaaagattgccaacatcaagcagctggaaggtagactgtcttttatcaaccatatcgagagatacaacaataacatcgacaagaacaatcacgacttcaggaaactgtcatcaaaggagaaacaatatcgcagcttcatcttctataaatacttcttcgcgaatgaaacaccagttgtgattactgaggggaagacagatatcaagtacctaaaggctgccctgaagaaacattataaggagtaccctgccctcgtattgaaggagtctgacggtacattttcctacaaggtcaccttcctcaggagaactaaacgattacagtacctcttcggactttttcgcgatggcgcacccgcacttaaaaacctctataacttcttcagtcctattagcaataaggatttccccaactatctggactatttcaagaagatttccaactccaatcccaaaaatccggtaatcatgatctttgacaatgaattagccaataagaccaagcccctggcaaatttcgccaaccactgcaagcttgatgaagggactcgtagtatactaaaagagaaataccaggtcaagctgcaggacaatctcttccttatgacaaatccactagtggaaaataaagccgagtgtgaaatagaagatctgtttcacgatgctgtcctcaaaacgattattgggggcaaaatatttagccgggaaaagaacgcggaccctaataagtactatggcaaagagattttcagcaactatattatgcgcaactacagcaacatcgacttttcaaactttaagccaatgctggaaaatttgaatgagattgtgggaagatacaagtga

SEQ ID NO: 8525 - RNA, 1689 nt, unidentified
  source 1..1689: mol_type = other RNA; note = synthetic construct
atggtgaaaatcaatgaggtgaccaatcgcgatgagatcgcctacgccctgggaataccaaagaagaaactgacctatatcctgtacgtcaagcgtactgagaacctctattactcattcgagattcccaaaaaaaacgggggatttagacggatcaatgcacccgacaaagacctcagagatatccagaagagcttagctgatatcttggttaaataccagaaagccatttgggatcgcaagaatataaaaccatatatctcgcacgggtatgaaaaggataagggaatcatgaccaatgcagaagttcataagaataagcgctttgtgttcaacgtggacttgaaggacttcttcgattgttttcatttcggtagggtacggggcttttttgagaagaacaaagacttttgccttcctatcgaggtcgctacgattattgctcagttgacatgttataatggcgtgcttcctcaaggagctccgacttcacctgtgattaccaatctcatctgcaacattttcgacatgagggtcatgaaggttgccaagaaatacaaactgaattacacccgatacgtcgacgacctgacgtttagcactaatgataagaacttctttctcaacaaggagttattctttgagaatctaatcatcgaagtggaaaacgcaggattcaaaataaacgataagaaaactcgcctccagtttaaagattcacggcaaacagtgactgggttggtcgtgaacaaaaaaattaatgtggacagacgattctacaaggatacaagggccatgctggacagcctgtttagaaatggctcctttgaaattgacgggtatttaggcgacataaaacaactggagggccggttgtcttttattaatcagatcgagtggcacaacaatcttaaggataattccaagcacaacgtatataacctatcctctaaggagaaacagtaccaggccttcctgttctacaaatatttcttcagcaacaagaagccaatcctggtaacagagggtaagaccgacattaagtatattaaggcggcacttaagaagtattacctggattatcctgacctgattatcaagaatgagaagcaggagttcgaatttaaaatcacctttctgaagaggactaaacggctgcagtacttctttaacctatataaagacggcgctgatgccatgcttcacatatacaactacttctatgacgttaacaacgacaaattcaccaactacgtaaacttctttacagcccgatgcaaaaggaaacctgccaaccccacgatattcatattcgacaatgaaatcaacgtgaaaggtaaaccattgaaaaagttcgtcgacaatgtcagtcttaatgcgctgaaagtgtctaaactcctcgaagacaattatgttgacatcgctggctccgcatatattctcgttaatccgatcattgatcgttccaagaacgaaagtgaaatagaagatctgtttacacccgagctgctgagtcataagatcaacgggaagacattttgtagagataagtcattcaacagcaataagcattacagcaaagagattttcgcgaaccacgtggtgaagaattaccgctctatcgattttaccaactttaagcccatgttagataacctcgacaagattatcaagaactacaataagtga

SEQ ID NO: 8526 - RNA, 1683 nt, unidentified
  source 1..1683: mol_type = other RNA; note = synthetic construct
atggagatcaacgaaattaagaatagaactgaactggcctggaaactgggcattcccaaaaagaaattgacctatgtgctctacattaagggaaccgatcagctgtacactaccttcgaaattccaaagaagagcggaggggttagaaaaatccatgcgccggagaaggatctcaaagagatccagaaaaacctggctaacatcctggttgactaccaaagtgagatgtggaaaaaaaggaagataaagccgaatatttcccatgggtttgagaagaataagggaatcatgacaaatgccgaggtgcacaaaaacaaacgctttgtcttcaatatcgatctggaaaactttttcgagtctttccactttggcagagtgcgggggttcttcgagaaaaacaagtactttgaattgcctctggaggttgctaccattattgcccagctaacctgttataagggcacattacctcagggttcaccatgctctcccataataaccaatctgatatgcaacatcttcgatatgagaatcatgaagctagccaaaaggtataggttaaattatagccggtacgtagatgatctcacattctccacaaatgacaagagatttatcgacgacaaagaatatttcttcgaagagctatctggcgaagttgagaaagcaggcttcaagattaatgagaacaagacaaacctgaggtataaggatagtaagcaaattgtcaccggacttgtcgtgaataaaaaaattaacgtggaccgttgctactataaaaaaactcgcgcaatgctgaattctctgtataagacggacacctttgaaatcgagggatccactgggactgtgaaacagatcgaaggtcgattaagttttatcaatcagatagactggcacaacaaccagattgatagcaacaagcacgggttcaggaaccttagcgcccgcgagaaacagtaccaggcttttctcttctacaagtacttcttcatcaacgacaagcccattgtgattactgagggcaagaccgatatcaagtatatacaagcagcattgaagaaatactaccttaactatcctgacctgatcgtgaagaatgacgagcataagttcgaatacaagatcatgttcttgaaacggaccaagcgtctgaattacttctttgggcttaatcaagatggcgcggacgccatgcagaacctgtatcactacttttacgactacaacaacaacataacggccaactatatgaagtactttaaggacatctcaaagaagctgccccgcaatccaactatctttcttttcgacaatgaattggcaggcggtgagaaaccagtacggaaatttgtgaaacatatctccctggataaagcccagtatacaaaactcgagaaagaggaatacgctcgattgcacgagtcagcttatctgctggtcaatcccctggtggattcaaaaaaggagtgtgagattgaagatctttttctccccgaaacgctcgaacacaagataaataataagaccttctgtcgggacaaaagcttcaagtctgacgtccattatggtaaggagattttttccaactacatcatgaagaactacaagaccatcaactttaagaactttcagcctatgctcaataatctcagtggaattatctcgagctataagaaatga

SEQ ID NO: 8527 - RNA, 1257 nt, unidentified
  source 1..1257: mol_type = other RNA; note = synthetic construct
atgaaaacactgaaaaatatcgaagacaggaaggatttggccgattacctcaatatccctattaagagactgacgtatatcctctatataaagaggaccgagaacctgtactattcttttgaaattcccaagaagagcgggggcgtacgaaatattgatgcgcctaagagcgaactgaaagcccttcaaaaaaaactggcagctagcctgactaagtatcaggagattctccagaaaagcaaacggaaagcccccaacatcagtcatgggtttgagaaaggcaagtctattatatccaacgccaaaatccacaggaacaagaagatagtgtacaacctggacttggagaattttttcgaatcattccatttcggacgggttagaggcttcttcgaaaaaaacaaagactttgaactgagtactgaagtcgctactattatagcccagttgtcctgctttaacggcgcattgccccaaggagcaccaagttctccaatcatcacaaatttcatctgccgtataatggacatgagaatcctgaagcttgctaagaattacaagcttgactatacgagatatgccgatgacctgacattctctacgaatgacaagaaattcattgaccaaatcgactacttcctccacaagctgacaaaagagattgagaaagctggtttcaagctgaacaagaacaagaccaatctaaacttcaaagattcacggcagcttgtgaccgggttagtggtcaacaaaaagatcaacgttgatcgtcgatactataaagagacaagagcgatggcacaccgcttgtataagactggggagtttcagattgatgataagaatggaactctgaaccagctcgaaggccggttttccttcatcaatcaggtgcaaaggtataacaatgtcatcgattcatcgaagcacgactttaataacctaaatgcctttgagaagcagtaccaggcgtttctattctataagtacttctacgccaacaataagcctcatatcgtaaccgagggtaagaccgatataaactacattaaagctgccctcaaaaaacaccatctggagtttccaaacttaattgtgaaaaaagaggacggagaatttgatttccgcgtggcttttcttaaaaggaccaatcgcctcgcatacttcttaaatatcaagaaggacggtgccgacaccatgaagaacatctgtaagtactttctcattctgaagattatgcgctccccgatcatctga

SEQ ID NO: 8528 - RNA, 1701 nt, unidentified
  source 1..1701: mol_type = other RNA; note = synthetic construct
atgcgtaaattctgcgacgccgagacacgtaatgagtttgccgactttctgaagatttctcgctctcaactgagctatgtgctgtttgtgaagcaccctcattcctactataaaactttcgagattccgaagaaatctggcggtacaagagtcatcaacgccccttatggggaattgaaatttatccaggagcagctgaacaaacggctggctgagtaccagaagtacatctgggaggtcaaaggtgtgcggcctgctattagtcacgggtttgaaaaggggaaaagcattatcactaatgctaagatccacaggaataagaggtacgtggtaaacttagatattgagaacttcttcgggaccttccatttcggcagaattgtgggctttttcgagaagaatcggtacttcaggctgccccacgaggtcgccatcacgatcgctcagataacctgctacaacggtaccctcccgcaaggtgcacccagttcccccattatcaccaattatatctgtcaagttctcgacagacgacttttgctcctggccagagaatatcggctagattacactagatacgccgacgatattacgttcagtactaacgacattcactttacagacaagtatagggcttttctggacgccgtcgacaccgagatacaacgagcgggctttcgaataaattccaaaaagacccgcctgctttttgagtcaagccgacaggaagttacaggcctcaccgtgaacaaaaagattaacagcaacaagcagtttcgcaaagaaaccagagcgatggcccaccacatgtatgctaatggcgaattctcgattgcaggcgactccggcactctggagcagctggagggaagatttagcttcattgatcagatcgagcattacaacaattcactgtcaggaaacaagaagaactaccataatctgagtgggtgcgaacgcgaataccagaaattcttgttctacaagtacttcttcgctaatcagcggccattaatcctaactgagggaaagaccgatgtgaggtatctaaaagcagcccttcggaatctttataacgaatatcccacacttatcaagaaaaatgaagacggctccttccaattcgaagtgtcattcttcaaaagatcgcggcgctgggagtactttttcgggttatctagcgacggggcagatacattgggtaacatctgccagtgttacttctccaaacgcaacactggactcccacaggtgtttgactatatgaagaacatatccggacgtcagccacagcacccagtcatatttctcctcgataatgaaatgaagagcgataagcctctcaagaaattcctgcagaagcagcggattacagacgagaaaaggcgccagcttgtagcacgactttacatccaaatcatggacggaaccaacctctttttggttacaaatcccctcgcgaatggggatgaagagagtgctatcgaaatactgttccctgaagaggtgctgttacatgaaatcgatggaaagaagttttctctggagaacgattatgacacggcaacctattatggaaaagagttgttttccaagtacatcgaggccaattacgaaagcctggatttttctggctttaggccactgctgaatgctctggcagccgccgttgagacatataggttgtcatgtaacacttga

SEQ ID NO: 8529 - RNA, 1143 nt, unidentified
  source 1..1143: mol_type = other RNA; note = synthetic construct
atgaacccgtttagcttcgtgagatccagggccgacgtggcggatgcaataggtattcagctgaaatccttaacgtacatcctcttcgtcaaaaggatagaaaactgttactcaacgttcctcatcccaaaaaagtcaggaggcaaccgcactatctgtagtccttgcgatgagctgaagctgatccagaaaaaacttgctgatgcgctgtgggaacagcagcaggacatttggaagaaggccaacatccacccaaacctgtcccacggctttgaaaagggcaagtctatttttagtaacgccaagaaccatgtcaacaggagatttgtgctgaatattgaccttgagaatttcttcgacacattccactttgggcgtgtttgcggattctttgagaaaaatcggtacttcatgcttccccacgaggcagcagttacaatagcccagattgcctgttataatggaaaactaccccaaggttctccctgcagccctattattaccaacatgatatgtcaagcactagatattcggttgttgcaggtagctaaaaagtacaaactcgattatacccggtatgccgatgatctgaccttttcaaccaacaataggcatttcttagactgctatgaacgcttttacaaaagtttactgcgagagatccaacatatgggatttagcgtgaatgaaacaaagacccgcctgctgtatcggaactctagacaaacagtcaccggcctgactgtaaaccagaagatcaacatcaattgcgactactataaggctaccagggctatggctcactcgctctaccagaaaaatgagttccaaatcaatgggagccctgccacaatcaaccagctcgaggggagatttgccttcatcgaccagatcgaccactttaataataggaaggatactttcccacataatgctcggaatctcaatcgtcgagaacgagagtatcaggcattcctctactataagtacttcttcactaacgacagagtgctgatttttaccgaggggaaaactgatgtgctttatttgaaggctgccctgatggcgctttacacagagtaccccaatttggtgcagcgcgacgaagccggcaagttcctgtttaacgtttcctttttctga

SEQ ID NO: 8530 - RNA, 1647 nt, unidentified
  source 1..1647: mol_type = other RNA; note = synthetic construct
atggagaactttaatgacctgaaaacaattaaggagttcgctaagttcatagataccccactgcaaaaaataacctatatcatccacaggcagaaaatcgaaaacttatacaatagcttcgagattcccaaaaaaaacggcggcattagaactatcgacgcaccacatgacgacttgaagcagatccagattaagatcaagaatatgctgtggaagcatcagaaaaagatctgggaaaagtacaatcagaacaagatacctaacataagccacggatttgaaagcggtaaaacctttataacgaatgccaccgtacacaagaacaaaagattcgttctgaatatcgatctcctggatttcttctattttttccatttcggccgggtcaagggcttctttgagaaaaacaagtactttaaggtgccctctgagattgcgattaccatcgccagactggcgtgttatcagcaaaggctgccccaagggtcaccatgctcacccattatcacaaacctcatctgtaatatcttggatatccgactgctcaaactgggcaagaaatacaaacttgattatacgcgctatgccgatgacttgactttcagcaccaataacaagatatttccaaagcattacgacgagtttctatttgaaatcacatccgtcattgagaaagccggattcaaaatcaatgacaagaaaacacggctgctgtataagaactcaaagcaggaggttactggactagtagtgaataagaaactgaatgtgtctaacgattactacaaaactacaagggctatggctaatacgctgtacaaggatggttcctttaccataaacggcgcagacgggacaatcaatcaattagagggtcgctttgcttttattgaccgtctttcaaagcacaataataaactcgacactaacaaacacgatttctggcatctgtcgggccgggagaaagagtaccagaagttcttatttttcaagtacttcctacagaacacaaagcctctgattatcaccgaggggaaaactgacatcgtgtatattaaatccgcactcaagaacttatacaagaattatcctcgactgattatcaaggaaggtaacaacttcaagttccatatttcctttctcaacaaaaccaagaggcttagttactttctgaatatcaacattgacgggggatctgttatgtccaatatctacaagaacatgtacaacaatgagaattctcttgccaagctcttcaaagacaagtataagaccgaggccaaaaataatgtgatcctgttagtcgataacgaacaaaaaaacgaaaacaaaccgttgagacagctcctcaatagtgccaagattaatctgaaccagaacatctctagccacattacacacaatctgtaccttctaactcatcagcttgtggacaataaaaaagaatgcgaaattgagaacctgtttaccaatgagactctcgggacaaagttgaacaataaaagtctcaacctgaaggaaaaagatttcaacaaggagatacactatggaaaggaaatattttcccagtatgtgcgcaagaattataagcacattgacttcagcaacttcaagcctctcttggatgaactgaacaacttgctttga

SEQ ID NO: 8531 - RNA, 1707 nt, unidentified
  source 1..1707: mol_type = other RNA; note = synthetic construct
atgctatctcttaaagacgtgaaaacccggaaagatttcgcagtttttttgggcattgagctgaaactcttaacctatatattgtaccacatcaaggttgagaacttgtacacgactttcgaaattcccaaaaaaaatggtggaacccggattattaacgcaccagacaaaaagattctgaagaagatacagaaccgacttatgaataagctctacaactatcagaacaaaatcaagaaggacgagaatatcaaaatcaatatctctcacggattcgaaaaggggaaatctattataacgaatgcccgtattcatagaaataagcggttcgtgctgaatatcgacctgaaggacttttttgcctcctttcatttcgggcgggtggtgggtttcttcgaaaagaacatcaattttcgcattcctaaagacattgccattattatagcacagctgtgctgttataaggggtcactgccacaaggcgcacccacctcaccaatcatctccaacattatctgtaacatcttcgatatgcgaatactgaaactggcgaagaagtacaagctggattatactaggtacgctgatgatctgactttttccacaaataacaaggatttcctcaacatctacaatgagtttttgctttgcatatccaaggaagtggaaaaagccggcttttgcatcaatcaaaaaaagacacgcctgttctataaggatagtaggcaggaggtaaccgggcttgtggttaacaaaaagattagcatcaaccacagctattgcaagtatacacgcgccatggctaattccctatacaagaacaaatcgttcaatatcgacgggaaagacgcgacaatgaatcagctcgagggcagatttgcatttatcaatcaaatcgacaggtacaacaacatcatcaatatcaacgacaataagcacaatgatggcaaaaagagtaacgacaagaagttaaactgtagggaaaaagagtaccagaagttcattttctacaagtacttctttgctaaccagaagccgttaattatcacagagggtaaaactgatatcctgtatttgaagtctgccataaaatctctctatgcctattttcctgacctcatcaagaaaaactcaaacgatgaatttgagttcaaggtcagttttctcaggcggactaagcgtctcgaatattttcttaacttcgtgaaggatggagctgacagcatacaaaatatttaccgcttttttgtcggaagagaagtcgtgaactatagcgagtacttcaagaagataacaaaggatattgccgctaatcctgtgattctgattttcgacaacgaaattcccaataacaaaaaacccgtccgaaaattcatcaacttcacgaacaaaaaggaattcgagaacattctagagaaaaagctgtacgccaacattgtcgacaatctgtttatcataaccaatcagctcgtgagagataaaaaagaatgcgagatagaggatctgtttaatgacaagacccttaaccataagatcgatggcaaggttttttgtagagattccgctatctttgataagcagaagcactatagcaaagagattttctcgaagtacatcagcaaaaattacaaagacaaggacatcgacttcatcaatttcaaacctatgctgaaaaacatcgtagagattatcaccaattacaaatga

SEQ ID NO: 8532 - RNA, 1509 nt, unidentified
  source 1..1509: mol_type = other RNA; note = synthetic construct
atgcaaaagtccatcgtcttcaagattctggaccatataagagagactgaaaaggacaagtacatcaagaccaatataagtcatgcctttgaaaagggtaagtcaatcattactaacgcgaaaatacaccggaataagaaattcatcctgaacatcgaccttaaggacttttttgactcatttcatttcggaagggtggcaggctattttgaaaagaatcgggagctcaaattttctagagaaacaagcatactcctggccaaaatcttttgttgtgatgggaaattaccacagggagcaccatctagtcctattatttccaacctcatctgcaacatctttgatatgaggatcctgaagttggctaagaaatttaagctggattatacccgttatgccgatgacctgtcgttcagcacaaacgataagaacttcataaagttctacgacgattttatgacgaagcttaacaatgaagtcaaaagagccggttttaacattaatgacaagaaaacccgcctcctctataaggactctagacaggaagtgacagggctcatcgtgaataaaaagatctctatcaagcgagaatacgtgaagtctactcgcgcaatggccaatacactgtacaataatggctcctttcacattaatgaaaaggaggcgaatctaaatcaattggagggaaggttcaattttattgatcagatcgatcggtataacaacaagatccaaaaaaccaacaagaatcaccggatgttaaactcacgtgagaaagagtaccagaaattcttgttctataagtacttctacgccaataacaaaccgctgatcctaaccgaggggaaaaccgacattctgtatataaaagccgctctcaaaaacctgtattccgagtatcccaaattgattgagaaggtaaacaacaagttcaacttcaaaatctccttcctggaaaggtcttcacgcctcgagtatttttttggcattaccaaagatggcgctgatagcctgattaatatctacaactactacagcggcgaggatgtgaaactgaacctgctgaattttttcgagaaaaaagagacgaagagttgcaaacctgccatccttctgtacgacaatgaacttcacaaaatcaatggtattgagaagcccctgagcaaatttattcgaaagagtgttaaggagaaccaggacaatttcaagaagattatacagaagaacctctacaacaaactccttgggaacttgtatttggcaactatccccattgtcgacacaaataaacaggaagctgaaatcgaggatttacttaataaggaggttctagaacacaagattaataaccgctcgttcagcaaggaccctaaaaatggaaacgagtatggcaagaacgaactgtccaaatacgtgttcaagaattacagcaacattaacttccagaatttcaaaaagctgctggacactttacagaacatcattgaagagtacgagataaaaatctga

SEQ ID NO: 8533 - RNA, 1671 nt, unidentified
  source 1..1671: mol_type = other RNA; note = synthetic construct
atgattagtatcgatcaggtcgagacaagagatgaactcgctgatcttctgcatatccgtcataacctgttaacttacgtcttgtatattgccaaacctgattcctactaccagacattctatataccaaagaagaacggagaaagtagggaaatccaggctccgagaagggagctgaagcgcattcaaaagcgcctcgctcttgagctgtcagtctaccagcaatctatgtacaagactttcgacattaacactaacattgcgcacgcctttcggaagggtagaagcataattaccaacgccaagattcacaaaaataagcgctacattgtaaacatcgaccttaaggactttttccatagcatccatttcggaagggtgaagggcttcttcgaaaagaatacattttaccagctgccctctaccatcgcgaccatcatcgcccaactaacctgctacaatgggcgcttgccccagggagcaccatctagcccagtgattacaaatttaatctgtcaggtgcttgactatcacgtgctgagaatagccaagaaatataggctagattacacccgatacgccgacgatatgaccttctccaccaacatgacagagttctggaatgagcgagagacattcctgtcagatctcactcgggagatcgatcgcaacggttttcgcattaatgatgctaagaccaggtttattaagagggaatcaaaacagaccgtgacagggctaactgttaacaagaagattaatgcagacaggatctattacaaggagacaagagcaatggccgatcggctctacaaaaccggcagttttaatatcaatggcaaaccggggactatatcaatgttagaagggcgtttctctttcatcgaccagatcacgaagtttaataacaaaaaggacggtaaaacccacgacatcagaacactgtgtgcccgggagagggactatcagaagttcctcttctacaagtatttttacgctaacgaaagacccctgatcattacggaaggaaaaactgatatcatctacatcaagagcgccctgaagaaactgtacgatgtgtatccccagttgattaagaaaaactctgatggcagcttctgctataaaatcagcttttttcaccgaacgcctcggatgaagtatttctttaatatctccatggacggcgcagacactatcaccaaaatccatctcttttattccggcaataataaaatgcccaactattaccaggagctgagtacgaatcagaagatgaagaatgcagtgatttttctgttcgacaacgagacaaagtcggaccgaccattgaaaaagttcatcggatattgcaaactggacgacgcacagaaagaggagctgcaagagcaatgtttcactcggctgattgatggctccgagctctatcttgccacagttcctcttgttgaaggggatgacgaaagcgaaattgaggatttgtttcctaaggctgtaaaagacatacggatagaaggcaaaatgttttaccgtaagaacgactttaacccaaaaatacactatggaaaagaggtgttctccaagtacatctataataactacgatgccattgacttttcggggttcatacctctcctggacgcgattgtcaaagctataaaaaccaaatga

SEQ ID NO: 8534 - RNA, 1665 nt, unidentified
  source 1..1665: mol_type = other RNA; note = synthetic construct
atgaagctcattaatgacatttcgacaaggtatgagctggcagatctcttgcatatccgtctgcgccccttggcctatgtgctgtatatctccaagcctaattcttactacagaaccttttacatcccaaagaagaacggcgatttgagggaaattcaggcaccatgtgggaaactcaagtacatacaacagagacttatggctgaacttaacaactatcaggactacttgtccaagacccagggaataaagactaacatcgctcacgccttcataaagaagaagagcatcatttccaatgcgagtatccataagaacaagcggatcgtaatcaatgtcgatcttaaagacttctttcataccatccacttcggccgcataaagggcttctttgagaaaaatcatttctatcagctgcctagcgatattgcaaccatgattgcacaaatcacctgttataatgggcacttaccccagggagctcccagtagccccgtcattactaacttaatttgccaggttctggactataatatcctcagaatagctaaaaagcaccggttagattatacaaggtacgccgacgatctaaccttttccacaaataagggagattttatggacaattaccagtcctttatgacagagcttagtaaggaaattgaacgtaatgggttcattatcaatgagaacaagacacggctcgtgcgccgagaatctaaacagacagtgactgggctcaccgtaaacaagaagatcaacgtcgaccggtccttttataaactgactagggccatggccgactgcctgtataagaccggaagctttgacatcgacggtgaacctgggaccattaatatgctggaaggtcgattctctttcatagaccaaattgtgcactacaataacattaacgatggcaagaaacatgactacaggagtctgtgtgccagagagcgcgaataccagaagttcctgttctacaaatacttctatgcaaacgagcgcccactgatcataacagaaggaaaaaccgacgtgctgcacctcaaagctgctttgagaaaactttatctgcagtaccccgatttaatccagaaaaaacaagatggcagcttcgagtataaaattagcttttttcggaggacaaagcgcatgaaatatttcttcaacattagcccagacggtgcggacacgatgaaaagcatataccagttctacacgggcagaaataacgtgccgaactatttccagaccctctcagcccgtaatatggagaatgccgtgatcttcctgtttgataacgagacttgctcagaacgaccacttaagaagttcatggactgggccaaactgcagaccgcacagcgaactgagctgaaatccaagctgtacgcccaactaatcgatgacagtaagctctacctggccacgactcctctgttggctgagaaaaaagagactgagatcgaagacctgtatccggagtctgtccagaacattaaactctcaggtaaggagttttgcagagcatctgtttttgattctgagaggtactacggcaaagacatcttttccaagtatgtttacaaccactacgattcaatcgatttttcagggtttgtgcctctactagatgcgatccggaacgctattcaatcgtga

SEQ ID NO: 8535 - RNA, 1662 nt, unidentified
  source 1..1662: mol_type = other RNA; note = synthetic construct
atgattgatattgtggaaactagagacgacctggcagatctgctcaatattaggcattcacttctcacatacatcctgtatgtcgccaaacctgactcctattacgagacattctctattcccaagaaaaatggggaccttcgggaaatcgaggcaccccagagggagctgaaacgcttacagaagagactcgcgaacgagctgactgcctatcagcattacatgtacaagcagtttgagattaagaccaatattgcccacgcttttatcaaaggccgaagcattatcacaaacgctcgcatacacaagaataagaagtacatcatcaacatcgatcttaaagacttcttccacacaatccacttcggaagagtaaagggtttttttgagaagaacgagtactataagctacctagtgatgtggccacaattatcgcacagctgacatgctatcaagggcgccttccccaaggcgctcctacaagcccagtgatatctaacctgatatgccagatcttcgactatcgggtactgggtattgctaagaaataccggttggattatactagatatgcagacgacctaacatttagcactaatagaagcgaattctggaatgaataccaggcctttctgagcgaactcgccaaggagataaagaagaacggattcgctattaacgatgccaagacccgtatagtgaaacaggagtctaagcaaactgtcactgggcttactgttaataagaagattaatgtggaccgaaccttctaccgcaatactaaagcaatgaccaactgtttgtacaaaatcggatcattcactatcgatggacagcccgggacactcaacatgctggaggggaggtattcatttatcgaccagatcacgaggtataataacaagattgaaggcaaaaagccagagagtcggaagctaaatgctagagaaaaagattaccagaagttcctcttttacaagtactttttcgcaaacgagaggccgctgattgtgacggagggcaaaaccgatatcctgtatatcaaagccgcattgaagaaattgtatcgcaaatacccacagctggttatacgtaatgccaatggaaacttcgagtaccgtgtgagctttttccgcaggacttcgcggatcagatatttctttcagataagtcaagacggagccgacgctatcaccaccatctatcagctgtacgctggtaaagacgatgagcgaaactactataaaaaaattgccaaccagaccatgagaaatgccgtcatatttctgtttgacaatgaaacgcagaacaagaaaccactcaaaaagttcatagatgttgccaagttgaacgatacccaaaaagacaaccttaggacgaagttgtacaccaggctcttagataattccaaactcttcctggcgacaacccctctgcctgcgggcaatcgaaaatccgagattgaagacttattcacagaagcaacccggaacaccattattggcggcaagcggttttcagccaacgatcagcatgataccgcgcaattctatgggaagaagattttttccgaattcatctacgaccactacgacgccatcgatttttccggctttatccccctgatcgacgctattaataacgctatccagtctaaatga

SEQ ID NO: 8536 - RNA, 1269 nt, unidentified
  source 1..1269: mol_type = other RNA; note = synthetic construct
atggaaatccaaggcctccagtcacgacggcagatcgctgaactcctgggtgtacctttgaaagaactgacttacatcctgtacgtccaaaagccagagactttctaccgtttgtttgagatacccaagaaaaatggcgggttcaggaagattgacgcccctgaggggcctctgatttatatacagcggatgcttgctcgaagattaacagcatggatcctcgagaaaaaattaaatacctcagtcagccacgccttcaagaaggggcgcagcattattacaaacgctcgggcacaccggaatcggcgcttcgtgctgtccgtcgactttcgcgacttctttaacaacattcatttcggaaggatcgaagggtttttccgcaaaaacaagtatttcggcttttcccgagaggcggccattgtgattgcccaactgacctgctaccacgggagccttccccaggatgcccctacttctcgggtgttgtctaacttgatctgtcagattatggatagaagaatactagaactggcatcgaaatatagagtgcattacagcaggtatgccgatgatctaacctttagtaccaactgggctaattttggaaacgagtccaaaaatttcctctcagagctcaccgttgttataggacagtcgggattccaaattaatgagagcaagactagactgcagtacaaggatagcaggcaggaggttacggaacttatcgtgaacgacaaggtcggtgtgccaaagcggtttgttaaaaacacacgagccatggcgaatacactctacaagaccggtcagtttgagattaacggcaaacagggctctataaaccagctggagggccgctttacctttatcaatcagatcgattggtataatcacagggtaatcgacggcgtggaaccaacacattccagcacaagagcaaggctcatgaagctcaatagtcgtgaacgccagtacagacagttcctggtgtataagtattttatttccaactcccagccacttatcgtgactgagggaaaaaccgatatcccctatatcaagagtgctctgagatcactgaaccagcaatttcccgatcttgtcacgttcaatgacgagggcgaatacagtctaaaaatttctttcttcgagcaagggatcaggctggaccatggaaggtctggtaacaagaagaatcagcgtttgccgtacttcttaggcctgaaaatggacggggccgacgaactgcagcacatctacgactattga

SEQ ID NO: 8537 - RNA, 1755 nt, unidentified
  source 1..1755: mol_type = other RNA; note = synthetic construct
atggagaagtttagcgacatcatcacgagaaagcaactcgcacaattcctggaagtgaaattatcccagctgacctatattttgtataaacaggggatagacagcaactatcactctttctccattctaaaaagggatggcggcttccgacggatcgatgcccccaagaatgtactcttgaagattcaaatgagtctagttaacaggttatgggaagtccaggagtctatttgggagaataaaggctaccgctctaagacagcacacgctttcatcaaaggcaggggaattatcactaatgccaagatacatcggaaaaagaggttcgtcattaatctcgatctggagaatttttttggttcgattcacttcggacgagtgaagggcttctttcagaagaacaagtacttcaatatgctgccagagattgcgaccatcattgctcaactgacctgctataaaggatgccttccccaaggggcaccttccagcccaatcatttctaatctgatatgtcagatcctcgatttgagactgcggaaaatcgctaaaaagtacaggcttgattacaccagatatgccgatgacctcacatttagtacaaacgccgattttatcagcgtagagaaggactttttcagcgagattaaggtggaaatagaacgggccggatttcatatgaatgacagaaaaaccaggattcaggattatcatcatcggcagaatgtcactggactcgttgttaacgaaaaactgaacgtgaattcagactactgtcgccagacaagggccatggcacacaatctatacaccaagggtacttttaccatcggttcaattgagggtacgatggaccagatcgaaggccgctttagttttattaaccagcttgactggtataacaaccaggccaataacaaggctaacaagaagaaaaacaactttctgggtcgtgtagacgcctttaacaaacgcgagaaagagtatatgaagttccttttctacaagtacttctggcagaataagaaacctttaatcataactgagggcaaaactgatgtccgataccttaaatctgctttaaaatctctgagcctggagtatcctgaacttgtgaacgtggaggacgatgggggggtgaaatttctggtgtcattcttgaacaaaactaggagactggagtacttcctcgggatcaaccgggacgggggagatacgctcacaaatctgtactccaactacttcgacattaagagaaacgaacgcgaagcaggcacaaatgggcgaaacaacaagagtaagttcgggtacatcgagtacttcaagaaatatagctcaaccgagcggaaggcccccatcatactctttttcgataatgagctgagcattcgtaacaaaccactcaacaagttctccgtgaagctgaattcagaagagaagaatcggttgaagactaatggctacatccagttgaattctgacatgaagctgtttgtgatgaccatgaaactggctgaaaatcaaaccagttgcgagatagaagacctgttcgatgagagaacactgtgccacgaggacgcgaaaggaagatccttttcccgtgaggaccgcccggatctaaacgaattttacggcaaggactatttctcgaagtatgtctgttccaactataaacagatcaacttcgagaagttcaaggaagtttttaatacaatccgcagcatcatggatgaatgtaattaccaggaagaatga

SEQ ID NO: 8538 - RNA, 3030 nt, unidentified
  source 1..3030: mol_type = other RNA; note = synthetic construct
atgaataagttttgtgagattggcactcgcaaggagtttgccgagtttattggagtatccctgaagaagctgacttacctgttatacgtgaaacacgtggataactattaccactctttcgaaatccctaagagatctggtgggagtcgacagatagacgctccaattggagacttgaaaaaaatccaatactccttagctgacaagttatgggaacaccagaagatagtgtggagggagaataacatttacccgaaagtgtctcacgcatttattaaaggaaagtcgatcatcacgaatgccaaagtccacaggaacaggaggttcgtgatcaatctggacctggaggatttcttcggaggattccatttcgggcgcgtgaggggtttctttcagaagaatcggtatttcagcctgccgatagagatagccacaattattagccaactcacatgctataaggggcacctgcctcaaggagcccccacttctccaattatcaccaattttctctgtcaaacacttgattatcggctcataaagctgagcaaaaagtacggcttgaactacaccagatatgccgatgacctgaccttctctacaaataggaactttgtggatattcagggaaacgtgctactggaaattgaacaggaggttggaaagtttggatttcacctgaatcgtaaaaaaactcgcatccagttcaatgacagtcgacaagtcgtcacgggcttggtggtgaataagaagattaacgtggatcgcaattactatagagaaacacgcgccatggccgacaagctgtataaaacgggttgcttttcgataaacgacagttacggggacatcaagcagctggagggacgtttcagttacatcaatcagctaaactggtacaataaccagttggacgatgaaaaacataacctatacagccttaaagggagggaaaaacagtaccagaagttcctgttctacaagtatttttgggggaacgaaaaaccactaatcattacagagggcaagacggacattatctaccttaaaagcgcgttgaagaagctttacaagcagtaccccaacctggtgaataaaaaggatgacgtctttcagttcaacctctctttcttgaatagaaccaagcgcctcaaatatttcttcggaattgagaaggatggcgctgataccatggccggcgtatacaataagttttggtcctcagacaaaaacaagaacaccatcgattacatcaattactttcggacctatgcgaagcagaagactaataaacccataattctgctcttcgacaacgagttcaaaaagggaaagccactgtataaattcgccgagagtactggtctgaaaaatcggatccaaggtatgctcaaagataaaaagcgacggctgttgtacataaagttgagagaagactacaacctgtttctgctgaccatgaagctgcctgaggggaaagaagagtgcgagatcgaggatctcttcgacgagaagaccttaggtcacgaggacaagaatggcaaaaacttctcacggggttcaaagttcgataattccaaatactatggcaaggcctgcttttcccagtatatcctccagaactaccagaacatcaatttcgacaagtttcaaaacatgctggagtctatccagcaaatcgtgtccggctatagagtggctatcagggatctgggcgtccacggggaggggataggttcagtggatggctttacaatctttgttccgggcgctttaccaggcgaaaccgtgactgcagaaattactctgctgaagaaaagctacgccctgggggaactcttatccatagaatgggagagccctttccgcgtggtccctaaatgtccagtctatgagaactgtggcggctgccagctcagccacttgacctatgaaggccagttagacatgaagtaccggagagtgaaggatgtgatcgaaagaattgcaggagagagcggggatttggtgcgccccgtactgccagcagcacatccattcgcctacagaaataagatggcagtgcctgccggccttgtgaaaggcaaggctgccctcggctgctatagacaaggcagtcatgacatcataccagtttcctcttgtgctatccagaaagaggagaacaataggcttctgcagtttgcgagacgatttattgaaaagtaccgcatctcagtgtataacgagaaaacacggaaaggtaatctgagacatgtcatgggccgtgtcggggacgacggcaaagtgatggcggtcttggttactgcctccgaaactcttcccgaagaaaagaggtggatcgaggagattaaaaaggaactcccggaagtagtatccctgtggcacaacatccaaccaaagcctgggaatacgattctcggagccaagattaggcatctctggggtcgcgagacactcacagcctcactttgcggcctgcggtttgaagtttccccctacagctttttccaggtgcataaagagcaggctgaggtgctctatgagaaggcactggagtacgcagacctcaaaggaggagagactgttatcgatgcatattgtgggacaggcacaatcagtctttgcttggcgaaaaaagcaaaacgagtaatcgggatcgaaatcgtgaaacctgctattgaagatgctaagaagaacgctaaaaagaaccacatggagaacaccgaattctatgctgctgacgccggaaagctaatgcctcagctgtatcgaaaagggcttgtgcccgatgttattgttatggatcccgttcgggcgggttgcagcggagaggtacttaaggccgccgccggtatgaagcccaaaaggattgtttatgtctcttgtaaccccgcaaccttcgcacgggacgctaagattctaaaaagcgaggggtatgagataaagaaagttcagcccgtcgacatgtttcctcagaccatgcatgtcgaaaccgtcgccctgatgatccgtgggaagtcaaagtga

SEQ ID NO: 8539 - RNA, 1701 nt, unidentified
  source 1..1701: mol_type = other RNA; note = synthetic construct
atggaatacactaagatcaagaaccggagagatctctcactagcccttggtgtcccgccatctgaactgacctacgtgctttacaaaaagggggtggaccaatattactcttctttcctgatccctaaaaagagcgggggtaatagggaaattgatgcctccaaaggggccctcaaatacattcagagaagactggtggggctgctgtgggaaaggcagaatactgtatggtcagaggagacaatcttacccaatattgcccacgcgttccagaaaaagaagagcattatgaccaacgccaatgtgcacaagaacaagaggtacgtcgtcaacttagatcttgaaaacttttttggcagcatacacttcggcagagtgaaagggtttttcgctaagaatcgctatttttgtgttggtgaagaagtggcgacggtgattgcgcagcttgtgtgttacaagggccggcttttacagggagcacccagtagcccaatcattaccaacttaatatgtggcatcctggatatccgactgctgaaactagcaaagaagtataggctggattatactcggtatgccgacgacatgactttttctacgaacagtgttacagccgaggactaccttaacgattttattgccgatttggctatagaggtagagcacgccggttttaagatcaacgagcgcaaaaccagagtgatctatcgcaactcccgacaggaggtgaccggactggtggttaataaacgaatcagcgttaagagagattattacaagctgacccgcgccatggcagcaaacctgtataaggagaatgagtttaccatcggagggacacgcggtaccataacacaactcgagggcaggtttgctttcataaaccagatcgataagtggaatcggaagatgggcgtcctcagcaaggaactgacttcacgggaggagcagtacaagaaatttctcgtctacaagtacttcttcgctacagaaaggccggtcattatcactgagggaaagacggacgttcagtacttgaaagccgctttgaaagctaacgcagaaaaatatcccgacctcgtgtctaaaaccgacaacgacaagttcaagttcaagatatcctttttcaaccgcaccaagcgtattaagcacttctttggatcggccgaagacggagcggacgcaattaaaccttttgtgctgatgtatggcagtagtaaagatgctatgatcgagtggtttaaacaattcacaggcaataatccatgcaaaccagtaatcctaatctttgacaatgaggactcaaaagaaaagcctttgtccaagatgattgggacactcctgaatgacaaagtgttgcgtaataaacggaaggcaaatgatatgagatgcgagctcaacgagcatgggaaaatgcatgtgaaagacaatctgttcttcgctaccacacctaagaacgccaacaaagactgcgaaattgaaaatctgttcaacaaaaacgagctcgatggaattaggattaatggccgtacttatcatgagggcttcgagaaatccgcaggctgggatcccgctaaacacttctcgaagaatgtactgagcctgtacgttctcaaggactacaagaacatcaacttcgaaggatttatccccttgctggatgccataaattccatcgtcaagaatgacgatcattattga

SEQ ID NO: 8540 - RNA, 1680 nt, unidentified
  source 1..1680: mol_type = other RNA; note = synthetic construct
atgaatctcaataaaatcaatgacctgaaggacctggcttcatatatcggggttaaaccatcttatctggcataccatatctatcataacccgcgcattaaacttaaccagcactataccgaattcgagatctctaagtcctctgggggttctaggattattgcaactcctaacaagaacctgaaaatcatacagaagaaactagcctttaagctcaatcaacacctaaagagcttgggcttttatcgcaataacaagatactgcacgcgtttataaaagagaataagccgtaccaaaggggctttataagcaactcgaaaattcatcgcaagaagaactacatacttaatgtggaccttgaaaatttcttcgagtcaatacactttggccgggttagaggttacttccagaaagatgataagttcaacttcaacaaagacgtagccactatcatcgctcagatttgcacatataaaggttctctgccccagggagctccaacctcccccatcattagcaatcttattggaaatctgctggattccaaaatcctgaagctctcaaagaagtacaaattgcactacactcgatatgccgatgacatgacctttagcacgaatgattacaaattcgtgcgaaacatcaatcagttcaacaaggagctggaaaacatcattagcagcgccggctttaagattaatactagtaagactcggttgcaatataggacaagccgtcagcaggtcaccggcattgtggttaatgaaaagctgaatatcccccgtgagtactataagaaaacaagagctatggcccataacctttataaaaacgacgagtttgagattaacggcgaaaaatctacgctcaatcaactggaggggcggttcagttttatcaaccagctggaatggtacaacaacaagaacaacaagaacaagaagaaaccctatctgaaattatcctcaaaagaaaccgaatatcagaggttcatcttctacaagtacttcataaagaacgatttggcgacaatcatcacagaaggcaaaaccgacgtcctctacatcaaggccgcactgaaaaaaacatggaaagagtaccctaagttgattactaaggataacaatgggaacttcctgtttaagattaagttcctcaataagaccaagcggctcaattactttttggggattggcattgatggaggtgattccttaataaatgtgtacaaccactacaaggggaaagataatgtcaatgacctgcgcaagtactttaacaagttcaactgtaactactccaatcctattatcatgctcctagataatgagattgatgtgaaaggaaaacctctgaacaagatgatcaatatcatcaagtttgagaaggacgaattagaaagaaatttgtatgtcaacctggtagagaatctttatctctcgacaatcccaaagactaaagaaaagaacgagagtgaaattgaggacttatttaatgaagagacgctgaataaaggaatagagggcagacccttcaccaagaaagacaattacaacaaaaaggagtactgcggaaaggacgagttctccaaatacgtgtataacaactataccaacatcgacttcaagaaatttcatccacttctgaaggcactcagtgagatcgtgaataaaaaatga

SEQ ID NO: 8541 - RNA, 1677 nt, unidentified
  source 1..1677: mol_type = other RNA; note = synthetic construct
atgaatttcaatcaaataaacgacaggaaggacttagccaaatttctaggggtgaagccatcattccttacgtatcacatatatcacaatccacagatcaagctgaatcagcattacacagaattcgaaatccctaagagatcaggtgggattagagtgattgccgccccgaacaagaagctgaagatcatccagaaaaaattggctttccagctcaacgagcatcttataagtctgggattttatcgtaagaacaaatctatacacgccttcattaaggagaataagagtaacaaaagggggataatatcgaatagcaaaatccaccgcaataaaaaatacgtcttcaacatcgacttggagaattttttcgagtctatccattttggccgcgttaaagggtattttcagaacgacgataagttcaacctgagcaaggatatagcaattattctagcacaaatctgcacctataagggctccttaccccagggagcaccaacttcccccatcatctcaaatctgatcggaaatatccttgacagcaaaattctgaagctcactaagaaatacaagcttcactatacgagatatgcagatgatatgacattttccaccaatgactacaaattcctggaaaatatggccggttttaaccgtgaactggagaatatcatcgaactgagtggctttaagattaatacctccaagacccggctccagtaccgaacaagccgacagcaggtcacaggactcgtagtgaatgacaaggtgaacatccccagagattattacaaaaaaactagggcgatggcgaataatctgtataagaacggaaaattcgagatcgaaggaaaagaggctactctgaatcagctcgaaggtaggttttcgtttattaatcagttggaatggtacaacaacaagaaattcaagaacaagaagaagcctcacatgaagctgagcggcaaagaaatcgaatatcagcgcttcatcttttacaagtacttcatcaagaacgagttcttggtaattattaccgaggggaagactgatcctctgtacatcaaagccgctctcaaaaaatattggaaatcctatccccagtttattatgaaagactctgatggccattttctgtttaagatcaagttcctcaacaaaaccaaacggttgaactacttcttcggtataaataaggatggcgccgattctctcattaacctttacaaccattacaaaggaagcaatggggtcaataatctcagtgactacttcaagaagtttaactgcaaatactctaaccccttgattatgctgttcgacaatgagctgaatattaaggggaagcctctcaagaaattccacaatcacattcagtttaacgaacctgagctgcaaaacaatttgtatgtgaatctagtggagaacctgtatatcgttacaaccccattaatcgacaaaaagaaagagtcagagattgaggatctgcttccccaaaaaattcttgatgagggcattgagggccggagctttacaaaccaagaaaactacaacaagaacaagcattgcggcaaagacgaattctccaagtatatctacaacaactacaacgagataaactttgagaacttcattccgttactggacgctctgtgtaagatctgtaatgattga

SEQ ID NO: 8542 - RNA, 1677 nt, unidentified
  source 1..1677: mol_type = other RNA; note = synthetic construct
atgactaactttaaagacattaagactcggaatgaattggcagaatttattgggattccaataaggcacttgactaatgtgctctacaagataaatgtcgacaacatgtattcttcctttaagatcccaaaaaagtcaggcggtgaaagggtaatccagagtccaaataaggacctgaaaaacatccaggtgaagatcgctcagagtcttgacgtgcacatcaccaagcagcagaaatacgacaataatatttcacacgcgtttaagaagaacaaagggatcattacgaattctaaagtgcaccgaaataaacggattgttgtgaatatggacctggagaattttttcgaatctatacactttggacgcgtccggggctacttcaacaagaatgatatgtttaagctgccaattgaggtggccaccatactggctcagttaacatgctacaaaggcagcctacctcagggcgggtcaaccagcccgattataagcaatctgatatgtgaggtcctggactatcgaatcttgtcccttgccaaaaagtacaaactgaagtacactcgctacgcggatgaccttaccttctcaacgaataacaatgaattcgtgaacctatatagccagtttagcgatgaaatttcaaaggtgattctgaagtcgggattcagaatcaaccagaaaaagactagactgcaattttggaatagccgtcaaacagttacagggctcgtcgtgaataaaaagatcaacgttcctcgggagtattataagaatactcgcgcaatggctaaccagctctataagaccggagagtatgtaattgatggtgatctgggcacaattggcaggcttgagggccgattcacatttattgatcagctgaccaagtacaacaattctttggatgatgacatcaaacataacaggtttcatctctctggaagggaagtcgagtaccaaaagtttctgttctacaagtacttcttcagtaacagtaaaccgttacttatcactgagggcaagacagacgttagatatctgaaagctgcccttaaaaagcattccctggagtatcccgaactggttgagaaagacaccaacgacaactttaatttcaagataaccttcctcaagaagaccaaaagaatgaaatacttcttcggtatcgtgcccgatggagcctccgccctcaataacgtatacaatttctataaaggggtcaacttagatcccaaccattacgagcacttcatgaagatcagcgaaaatagacctacaaaccctgtggtgttactgttcgataatgagattaccaaggaaaaacctctgaacaagttcatcaaccacgcaaagatcaacaacaagaagtctatcatcaaacaaaacctgaccctcaatgtgatcgggaacctgcacttacttacaactcccttgatggataatcgtctggaaggcgatattgaggatttgttcaagacaagtgagctcgcaatcgtaatcaaaggtcgcaaattcgacaagacggaaaaactagataaatccctctattacggaaaagaccagttttcgaagtatgtcctgctaaactacgaggagattgactttgacaactttaaacccctcttggacaagctctccgacctgatccggaaccattccgtggccagcaagtga

SEQ ID NO: 8543 - RNA, 1674 nt, unidentified
  source 1..1674: mol_type = other RNA; note = synthetic construct
atgaaaaagttcaacgagattcagtcccgaaatgattttgcggatctgctgaaaataccattgagcagtctcacctacctgctgtatgtcctcaagccagataactgctacaacgtatttagcatacctaaaagatctggtggcgagcgcgagatttcagcgccaaataagcggcttaagagcgtccagacagccgtcgcaatggaactttggcgctatatcaagaatatacccgattttaaccgatccgcagtgtctcatgcctttactaaaaagaaaggcattatcaccaacgctgcaattcaccggaacaagagaatagtggtcagtttcgacctgaatgactttttccccagtatacactttggaagagtggtagggttcttcgaaaaaaatagacacttcaaactgccgcatgctgtctccttgattattgctcagattgcgtgccataacggatccctgccccagggttcaccttgtagtccaatcatctccaatctgatctgtcaaatccttgattaccggattttgagactggcaaagaagtataaattggactacaccaggtacgcagacgacttaacatttagcactaactggaaggggtttgttgacgctgagacgtgcttctattccgatctctctgtgttaatatctaaagccggcttcacaattaatgaagctaaaacacgaaccgtgtttaggaattcccgtcaaactgttactgggattgtggtgaacaagaagctcaacatcaatcgggaatactacaaggaaactaaagccatggcgcataacctatatagcaaagggtcgtttgtgattaacggtaaggagggtaccatcaatcagctggagggcaggtttgcctttatagatcaaatcgagctctacaataacagaattgacgggaatcgccacaattatcgcaatctgtgcgggcgggaattagaataccgtaaattcctcttctacaagtatttttacgctgctgacaaaccgacactgatcactgagggcaaaagcgatgagttgtatatcaaggccgccctaaggaagatgttcctgatgtacccttcccttatcaacaagaaggcagatggaagatttgagtataaggttaggttccttaaacgttcgaaaaggcttcagtatttctttggattctctcctacaggcgctgacgccatgaccgaactcaggaagtgtttcatcgacgagtcaaactctacaagcctgttctcattcttcaaccgcatttgtgcctcaggacagatccaccccgtgattttcatctttgataatgagactgagcgggacaagccactcaagaagtttttaaatcagaaacctgccaccagtgaagttgacaaagagttcctccagaataacctatacctgaacataattaagggctcaaagctcttcattatcaccaacaagctggtgagtggaaaaagcgaggccgaaatcgaagatctgttttcagaaaataccctgagcaccgaaatcgggggcaaatctttctgccgcaaggacaattttgatgagagcaagttttatggcaaggccttcttctccaaatacatctacaaaaactacgagtccatcgacttttctaatttcatccccatgttggacgcactgaacaacatcattacgacgtattga

SEQ ID NO: 8544 - RNA, 1683 nt, unidentified
  source 1..1683: mol_type = other RNA; note = synthetic construct
atggagcagggctttaataccatctcaaatcgaaacgagttagcggattacctggggattagtagatcatccttgacgtatgtgctgtatgtcaaggggattgacagtttttacgtttcctttgatgtgcccaaaaaaagcggtggcacacggactatccatgctccgcagggcacactgaaaggcatccagaagatcctgctcatcaagctctataattaccggtataccatcaacgaaaatgagaacattaagctgaacatttcccatgcctttgagaacaagaagtctataataacgaacgcccgtatccacaaaaacaagcgcttcattattaacttcgacctaaaagacttcttcgaatcgttccattttggaagggtgaaggggtacttcgaaaagaataagtatttctgcatgccggaagacgtggctagaattattgcccaactgacctgttattccggcacactgccacaaggagctcctacctcgcctatcatcaccaatttgatctgtcagtctctggattacaagatacttagtttagccaaaaagcaccacctggactacactagatatgctgacgacctgacattttccactaacgacaagaaaatcttagaaaactacgacacgttttacaaatcattggtgaacattatccacgggtctggctttgagattaatgagaagaagactcgctttgtgtacaaacatagcaaacaaattgtgactggactcgttgtgaataagaaagtaaacgtcgactccacttattatcgtaatgtgagatcaatggcacaccacctctatactgagggaaccttttgggacaatgggaatgaatgtaccataaatcagctagagggaaaactgtctttcattaaccagattgacaagtacaacaacaaactgtgcgaggaaaagaaaaacctcgcaaatcttaacaggcgggaacgcgaataccagcgcttccttttttacaaaaacttctatggcaaccctcagcccgtaatcataacagaagggaagaccgacatcctgtacataaaagccgctcttaggaaatactatcttgattacccagaattgatcgaaaagagtaactctggccaatttcattacaagctgacattctttcgacggagcagcatcaagcaattcttctttggaatgagctatgacggagccgacgcaattaagaagatatacaacttcttcaccgataatgatagcggcaggtttccaaattactatgagaagttcaatcagatcagtgcaattaagacctcatcccccattatccttctcttcgataatgagctgaacaataagaataagcccatcaaaaacttctgcaattatgtcggtctgaaacctgagactgtcgattgcatcaagaatggtgggtttatcccaatcgtcgacaacaaattatttctgctcacacaccagctagttaatgatctcgcggaatgtgagatagaggacctgtttgatgagatcacattgaaccataccataaatggcaagaccttttcaaggcagagcgatttcgatattgataagcactatggtaaagagatcttctccaaatacatcatctctcactacgagagcattgatttcagcaacttcaaacccctgctcaactctattaatcagttgattgcccattga

SEQ ID NO: 8545 - RNA, 1443 nt, unidentified
  source 1..1443: mol_type = other RNA; note = synthetic construct
atgaagaaaagccccttctaccagattagcacgcggcaagaactcgccgatgccctcaatatgagactgaaaagcttgtcatatgttctgtataagctcgatccgcagtctttgtacactatattctcgatctcaaagaaatccggcgggaaacgcgagatcactgctccaaagaaacctctggcaaacatacagtccaagattgcgaacgtgctgatgttgcagcctgaaaattctgcactgagatccaaggcctcccacgggtttatcaagaacaaatccatcctgacaaacgctactgtgcatcgcaataagaattacgttttgaacaccgatatccaggatttttttccatctttcagtttcggacgggttctgggctttttcaagaagaacaacgcattcatgatggaccataaagtggccgtagccctgaccaatctgtgctgttataaaaagaagttacctcaaggtgctcccagttcaccccctattactaacttgattttccacattgtcgactttaagattatcaaactagccaggaaatacaatctcgactacacgcgatacgttgatgacttgaccttctcaactaacgaaaagagcttcccgaaagtcagccagaactttctcaacgaacttaacgctctgattacccatgagggctttaaactcaatgaggacaaaacacacctagagtacaagaatagtcgtcaagaggtcactggggtgattgtaaacaagaagcttaatgtgcacaaggagttttataagaacaccagggccatggccgacaacctgtataaaaacacagaattcaccattgatggcaaattaggaaccatcaatcaattagatgggagatttaactacatcaatcagctggtgcgatacaataaaaagtccatcaaacggaaggtggcgtataaaacaaagtataacgtcgagaagaaggactttaaacatcaaagtcgcttcattcttttctccggaaaagagcagcagtacaggaagttcctcttttatgagtatttcatctacggtaacagctcaattattctgacagaaggtaagaccgacgtctcttacataaagctagcacttagagtgtacaaacaggagtatccccagcttatcactagtcacggtaagaagaccgaatattccgtgtctttcctgaaacacacccagaatacatcgaccaaagggcagaaaaagggcaaaaaaaataaccagatgagccataggatcccatattttatcggcatctctgaagatggcggaacaagcatcgacaatttcctcaattactatagcgagatctctacgacaaacctgaatatgtaccctaattacccaaagtactttatttcagacctgggaaagctgcccgataagaaagtgataatactccttgataaggctgactgcaagatatga

SEQ ID NO: 8546 - RNA, 1119 nt, unidentified
  source 1..1119: mol_type = other RNA; note = synthetic construct
atggaaaagagccctttttatcagatctcaacacgacgcgagttagcgtctgtgctgaacatgcagttgaaggcccttagttatgtcctttacaagttaaacccacagaatctctataccagcttttcaatccctaaaaaaagtggcggggtcagaaatattgtggccccgcagaaacccctggccaatattcagaataagattgccaacgtgctcatgctgcaacccgaaaataaagccagcgggtcgaaggcaagccacgggtttataaaaaacaagagtatcctgaccaacgcgaaagttcaccggaacaagaagtatgtcttgaatacggatattcaggacttttttccatccttctcctttggaagagtgctgggattcttcgagaagaataacgctttcatgatggatcacaagattgccgtggctcttaccaacctctgctgttataaacagaaactgccccaaggagctccttcctctcccccaataactaatctgatcttccatatagtcgacttcaaaatcatcaaactcgcccggaagtataagttgacatacactcgatatgttgacgatctaacattttccaccaataatcactcctttctgaagacctaccatgactttctaactgagttaaacgctctcatcacacacgagggcttcaacttgaataacaacaaaacccatctggaattcaaaaattctcgccaggaggtaactggcattattgtgaacaagaagctgaatgtgcacaaggagttctataggaagacaagagccatggcagataacctctataaaaacaacaagttcgtagtggacaatgctgaaggtcggatccaacaactcgacggtcgctttaactacattaatcagcttgtgaggtacaataagaaagtcaagaaaaggggcgcaccttacaagaccaaatatacacatagcagcgaatcattttctaagctggataggttcctttcttttacgggcaaggagcagcagtaccgtaagttcctgttctacaaatacttcgtttacggggattcaagtataatcctgaccgagggaaagactgacgtttcctacatcaagctggcattgaaaaaatactga

SEQ ID NO: 8547 - RNA, 2004 nt, unidentified
  source 1..2004: mol_type = other RNA; note = synthetic construct
atggaaatgatgatgcagatgaataaaagcgccttcttcaaaatctcaactaggaaagaattggccaacgccctggatatcagactgaagacactgacttatatcctttataagaagaagccccaaacactgtacacaaacttttccatcccaaaaaaatctggaggtacacgtgacattgtggcccccgagaaacagttggccaatatccagatcaagattgcacagatcttaatgagccagccagaaaacgactcttcccattcgaaggctagccatgggtttataaaaaatcgcagcattctcaccaacgctcagatccacaggaacaaaaaatatgtcctgaacaccgatataaaggattttttccctagtttcagctttgggagagtgctgggcttttttgagaaaaataacgcgttcaagatggagcacaaagtcgcagtcgccttaacaaatctctgttgttacaaccagtctttaccgcagggagcgccatcctctccgcccattactaacctgattttccacatcattgatttccggattataaagttggctaaaaagtaccacctcgactatacgaggtatgttgatgatcttaccttcagtacaaacgaaaatagttttccagtgacctataagaagtttctgatcgatcttaacaacttgatcgaccacgcaggttttagtctcaaccaggataagacccatctcgctttcaagaatagccgccaggaagtaaccggaattattgttaacgagaagctcaatgtgcataatgaattctataagtccacacgggccatggccgacaagctgtacaaaaccaactctttttcaattgatggcactctgggcaatatcaggcagttggatgggcgctttacctatataaatcagctggtgaggtataacaagcaacgaaagttaatccggtatagaaccaaatatagcacacctcacaacgaaaaggagactaaaaacaccataagtaacaaggacagatatcgcttcttcaccggcaaagagcagcagtacaggaagtttagcttctacgagtactttgtatacgggaacaattccattattctcactgagggaaagacggacatcacttacattaaagtcgcacttaagaagtacgctaaaaattatccagacctaatcaaactccaaggaaacaaatacgactttctgattagcttcctcaatcatcaaaagaataaggagaagagaagcaaaaacttcaagcgtaagaaaaccaagatactggcgaatcagatgtctcatcggattcctttctttctggggatttcagaggatggcggcaccacgtactcagattttctatactactacgcagaaatgactattgagaaagagtcgatttcttacaacatgcaacgatcatatcccaattaccctaagtatttcatctccgacctgaacaagctgtacaagaaaaaggtgatcattctgctggacaatgaagggtctaaccacccccttgaccacttcatcaagacatgcgccaagctgaaaatcaagaaaaaagaggacatagagaacgattttaagaataaaggctactcacacctcaaatataatctattcctgttgactatccccaagaagaatacatctaattcccagaattgcgccatcgaatcccttctaaacaaagacgaaatcgaaaagctgaacctgaagggtaagagttttagttccaagaacaatgagacttccaaaaactcattcggcaaacaagctcttgtgaccaaaatcaagtccgcacctacaaattttgacctctctggcttccgcagtttacttgacttgatcagcaaaataaacagcctccagccaataggtaatgagcagtacaaatacaagaagaagaaagttgagacgaataaggaggtgtatatccgaaattcactgggattccggattcctatagaatatcaaagcatcacccagtacaaagatttcgtcaaatga

SEQ ID NO: 8548 - RNA, 1875 nt, unidentified
  source 1..1875: mol_type = other RNA; note = synthetic construct
atgtccgatcttatcctgttcctgtatagcggaggcatctttttgtttaaagacgtcaaaagcgtcgaatctttaagccgatacattggcgtgagcgtgaaactcatcaatttcgtcgtgtactttaagggcgtcgactccttttatgaggagttctccctccccaagaagtctggagggtcaagatttatttcatgtcccaaaggtcccctcaaaaagcttcagaagaaattgcagaagaaactgtcggaggagtacgataataagtacggctcttttaatgttagccaagctttcatcaagaaacggaacattatgagcaacgccaaagtgcatcgtaacaaaaagttcatcctgaacttagacatagaggatttcttcgacgaatttaactttgggagagtttacggctatcttcagaagagcaatgacttcaaaatgaataagcagctgagtgtcatcttgtcaaaaatcttcacctataagaacaagctgcctcaggggtcaccatcatccccagtcctgacaaatttcatctttaggatcgttgacttcaagattctgaagctgagcaagaaatacaagctggattacacaagatatgctgatgatatgactttcagcaccaatgactctaatttcaaataccgttacatcaacttcgtggaagagctgaagttccttctctatcgacagggttttaagattaacaagaagaagacaaggctacagtttagcagttccaaacaggaagtaacagggctcgttgtgaataagaaaattaacgtcagtaggaagtactaccgcgatttgcgcgcccaggccttcaatttgtactccgacggaaaatactttatcgacggcaagaagttcgacaagcttaataaattggaaggaaggtttgcatttgtaaatcaggtgaagcggtacaattttctgattgagtcgcgcaaatacgccagaaagagtaaggagtattcaaacttcatcaagtctactacaaagtataggtatgaaccgtatctcgggggatttgacgaacaataccgcaagttcctcttttacaaatatttcatccacgggtctaaacctctgatttttgtagagggcaagactgacatacggtatattaaggccgcaatgatgatgtattataaccgataccccgaacttattcggaacaataacggaacgttcgagttcaacattgattttttcaagcggggcaacgaggatctcttaaaggagaactataaacggaacgaaatagactactctatcaaagactactatctcggattaagtgatgatggcgctagcgtgatgtcaaagatagtggagtattggggtatcgctctggataaaaagaccaaggagaataagaactactacgactactttgtgaataagcttggtaataagtccaaaaaggtgatcttactgttcgacaatgagtacctggacaaaaaaaataaacctctccgctccttcctgaaccatgtttatggcaataaggccactagtcaatatagaaaactcatctccgaagggaaactggtgatagcagataacttgtatctgataaccctaatcaaggacaaaaactataagaaagagctagagaactacattgacgaccacattaatgacaagaacttcaagggaaacaatgatctctccattgacattgaaaacctgatcgatctgtctacgatcacgataaaccaaaaaacctttaataggaacgcgaataaagattccgataaagaattcgggaaacagaccctgtctaagtacgtatataaacactacaacaccgtgggcctgagtggttttattccactgctagatcagcttaaagaattttgcaagtga

SEQ ID NO: 8549 - RNA, 1602 nt, unidentified
  source 1..1602: mol_type = other RNA; note = synthetic construct
atgtcatcaaaatataagggaaatagctcacggtttttcattatgaagaaattcgaggagatcaagaaagtagaagatttagccaaagctctgaacattacgataaacaaactctactacttctctaacaacagcaataaaccaaataagctgtacacccagtttactattactaaaaagctagggggtgaaagaaccattaacgcaccaaagaaagaactcaaaaaagccctgaacaagctgttcattattcttaagaatcgccatctcaattacaccaaagagaagaagataaaagacaagatcagctttggcttcaaaaagaataatggcattatcgacaacgccaaaaatcaccggaataaaaaatatgtgctgaacgtggacatcaagaattttttcgatagtttccacttcggccgaatttgcggcttctttatgaaatccaaggagtttaagatcaactctaagaataacgacacagttaaaaagatcagcatcctcatcagcaatttgttgtgctataaacagtgtctgcctcagggatcaccctgttctcccattctgtccaatctgatctttcggacaattgactacgaaatcctcaaactatctaagaagtacaagcttaagtacacccgctatgctgatgatatgacttttagtacgaacgacaacaactttttgaattcctacgagaacttcatatccgaactaaatgagtgcataaacaaaaacgggttcaaaattaacgacaagaaaacccaaatcgagttttacaaatctagacagagggttacaggcctggtcgtgaatcagaagttaagcgttaggagggaattttataaaaacacgaagagcatggcgttaaatttttaccgcaacgggtactttaaaatcaacgataaaatcgggaagctgaatcagctggagggaaggttctcctttataaaccagattgacaagttcaacaacatcgagtcgaataagtatgagaacaagaacaaggatttctattacgtgctcaattcacgtgaaaagcagtataaactgttcctgttttacaagttcttctacaatcccagtaaacctatcattatcaccgagggaaaaactgacatactctacattaaagcagccctcaagaaattctatgagaagtatccgaatatcatccaaaagaaccttaatggtaccttttcctacaaagtgaaatttcttgctaaggagaataagcagttctctaattacaaagaacgactggacaagaacttccaacaaattgagattatcttgaaggacgtcattgaaaacatagacgacaaaaaactggaagacattatacagtatgtcatagatagcatagagaagatcaaggaaatcttcaagagtaagattgtagcaaacaaaacgagttttgagaagatcaagcttaagctgaactatttttgggaagagattgtgaataagaagacttccaaagagttgaatgaaatctggaatgagatcatcaacatttacaagaacatcaagatcaccaatcttaagaaagtgaacaagttcctgtatttcttcaagtattggttctttagaggtttttga

SEQ ID NO: 8550 - RNA, 1785 nt, unidentified
  source 1..1785: mol_type = other RNA; note = synthetic construct
atggactggaacgagattaagtcctgccgagattttgctcggtatctcaatattccatataagcacttaacctacctactctacaacaggaagattgacaaactttatgaatccttcgaaatcccgaaaaagaatggaggtattcgtattattcaggcccccaaaaaagaactgaaggaggtgcagcagcagatcctcaagattctcgagaagcgtgccttatcccttgagaaggagaataaaattagctttcgcttatcacatggcttcatcaagtacaaatcgatcataaccaatgcagagaagcaccggaataagaaaatcatcttgaacatcgacatcgagaattttttcccgtcatttcattttgggagaatcgtcgggttctttgaaaagaacaagaatttcaagctgcccaaagaggtggccatattcctcgcccagttgacaacggtggacggctcccttcctcaaggctctccatgttctccaataataactaatctcatctgccaaatccttgattttaggatcagcaaactggccaaagagtataagctgaactattccagatatgtggatgatatgactttctcaaccaataaagagaactttctggactgttacccagaattcttcagcaagctcagtaatgtgctgattaaagcgggcttcagcattaatgataagaaaaccaggattcacttcaataggaacaagcagatagtaacagggctagtggtgaacaaaaagatcaatgtccagaagaacttctacaaaaatacacgcgcgatggctcacaacttatacaagcagggtacctttttcattgacgaaaaggaagggacaatcaaccaactgttgggtagattcaattttatcgaccagctcgagcggtataataacaagaataagaagcagctgagtttgcagaaaaactacatcgaacagcagaaatacttaaccaaagggcaacaggagattaaaggagattttggctatttgggaaagctgtcttctcgcgagaaagagtaccgcaaattcctgtattactttcacttctttagcagcagcaaacctgtcatagttactgaaggcaagacagactctcggtacttgaaagcagcaatgaagaaatgctttaaggatttccccaatctcattcaaaaaaacgaggatggcaccttcctgtttaaagttaagttccttaagcgaacatctctgctgaaatactacttcaagttttacgaagacggtgctgactcaatgaaaaacctatcgaacttttggataactggcgaagaaaacaaacttttccctaactacaacaagtttttccaggagctgactggaagagttgctagtaatcccatcattttcctttttgacaacgaactatccaacaaaaagaagcccatccgcaacttcataaatcatatcctcaagagcacgcctaatgaggcaggaagtctccggaacgagattagtaatgtcaagtacatcaacatcgtggacaacctgtatatgttgacgcacgcctctctcagcggaaatgaggatgaggaaattgaagatctgtttactaacgatgtactgaatcataggatcaatggcaaatccttttccagagagaacgattatgactttacaaagttctacgggaagaacgacttttccaaatatgtcctgaagaattatcgaagcatagacttcaagaatttcattcccctgctgaataacctgaacaagatcatcctggaatataactcaaagctgaccttctga

SEQ ID NO: 8551 - RNA, 1779 nt, unidentified
  source 1..1779: mol_type = other RNA; note = synthetic construct
atgcagtgggatgaaattaaaactcgagaagattttgcgacctttatcggggtgccctataagtatcttacctacctgctctataaccagcgcatcgaaaacttatacattgctttcgagatccctaagaaaagcggtggggttagaataattaattctcccgaagaccgcctgaagaagattctgaagaagattatgaggaaacttgaagaacggatggtttttctggaacaggaagggaaaatctccagcaaagtcgcccacgggttcattaagagcaagaatatcataaccaacgcctcctctcacagaaaccgaaaaattgttctgaacgtggacatcgagaattttttcccaagtttccattttggccgagtcaagggctttttcgagaagaacaaatacttcaaagtcccgaaggaggtagctgtgttcattgcacagttgacatgctacaatggatctctgccacaaggttccccctgtagcccaatcatcaccaacctcatatgtcaaatcctcgatttcaggatcatagagcttgctcagaaatataatcttaagtacacgcggtatgccgatgacatgacttttagtaccaatgatatgcagttcgttgacacatacattcggtttgtagaggaactgggagacttactgacgaggtccggtttttcactgaatgatgagaaaacacacatccagttccaaagagaaaagcaaactgtgaccggtctgaccgtcaacaaaaaagtgaacgtctcccggcatttctataaaaatacaagggccatggtgaatacactctacaaaaaaggagagttcatgattgatggcgaacgtggcaccattaaccagctcttcggccgtttcaacttcattgatcaactcgttaagtataacaaccggatagagagggaggcaatcattcgcaacgattatgtgaaccagcagaaaaaccttatcaagagtgtccctgacgctgagaacaagttcgattacttgaagaagctcagtgcccgggaaagagagtaccgcaaattcctgtactactactattttttctcgagcactgtgccagtaatcgtgacagagggaaaaacagattctagatacatcaaggcagccttaaagaatttatatcggaggtatccgaagctgatcgagcgcgatgagaagggaaagtttgtgttcaagatcaagtttctacgtagaactgcattgctgaagtactactttagattctttgaagacggggcagatgctatgaaaaatctcagcaattgctggtttggcaaaactgacgagaaactgtttcctaattacagcgagcttttcaaggagatcactaataggaaagccttgaaaccagttatttttctgttcgacaatgagttgaagaataataagaagcctatcaggaacttcataaatcacgtatccaataataccatccacgacaataaaaccatcgagaacgaaatccgagagaacaacatatttaacgtgattgacaacctgtatctactaacacatccctcagaaacagaggacgaagagatcgaagatctgtttgacgaccctactctcgattaccgcattgcgggaaaggtgtttaccaaagagtcgaagtttgatgtggacaagtattatggcaagaatgacttttctaactacattctgcagaattactcacagattaacttcaagaacttcacgcccctgttggacaacctcaataagatagtcgacgtgtacgaagccaaatataaatcatga

SEQ ID NO: 8552 - RNA, 1968 nt, unidentified
  source 1..1968: mol_type = other RNA; note = synthetic construct
atgaataggctcaaacaggtaaccaataaggatgatttcgcaaaattacttggattcaagaactcgcgttatatcaattatgtcctgtattgcatcgggaccgacaaactgtacaaggaattcgagattccaaagaaaaatggcggtgtcagaataatttgtgcacccaaacccgagcttaaactcctgcaaaagaagcttgcctatgtgctctgggattgttttgtagacgatttaagttccaagagtaaggagaagaattacaaaatcccaatgctgagccatgcattcgagaagaacaaaagcatcattactaatgctcaggcccaccgtaataagaagtatattctcaacgtcgatctgaaggactattttgagacttttaactttgggagagtacgcggatttttcatcaaggataaggattttcaggtgtctccagaagtcgccacagtgatagctcaaatcgcttgctaccaaggcaaattgcctcagggggccccctcatcacctattattactaatctgatcacacggatcctggactatcgcatcgttaaaatagctaagaaataccggtttacctatacacgctacgcagatgacctgacctttagcacgaataggaagctgtattcaaataagctgaaggccacaaaagaactggataaatttcttgaagagctggagaaactcattgtgagttctggatttgaaattaactccaaaaagactaggctgagtgacgcgatgcaacgccaggaggttaccggcttaattgtgaacaagaaactgaacgtcaaacgggaatacatcaaaaacaccagggcgatggcctttaagctttataaggacgaaaagtttgagattgatggtaagcagggcacaatcgagcagctcaccggtcgattcgcttttattttccagatagaccagtacaacaattacctcctctataagaagtcacttgtggaaaattccctgaactcccaaaaaaacctactcggacgaaatttgtccaaaaaaagtgacagcaagtactactggaagtatattttctacaacagggacctcagaaaagaactgttctacaataagcagcataaaacctacaatttgccgaaggaattttatgccattagcaaggaggataagaagaactatatggccttttttgactcaaaggagaaagagtacaagaagttcctattctacaagtatttctacggaaatagcaatcccatcatcgtcccagagggcaagacagatcctagatacattaaagctgcgttaaagaacttgtacctgaagtatccagaactgatcaaaaagtcaggtaacaagttcatctttgagattgatttcctaaagcactccaacacaatagaatatttgtttaacgtgcccgagggcggacctgggttccagtattggtataactacttcagcgacaaaaaagactttcccatgtctgataaagagaaactcctgtacccaaactacatcgagtacttttataatcagactagcgcacaccccaaaaaaccaacgatattcttgttcgacaacgaaccttctggcaatcctctgtacgcctttgtgaattacgcaaaagacctggaaattagctcgtctaatctgaaccagattagagggtccagcttttctaaaatcgtgaagaaaaactccctctacattatggccactcccttaattaaaaattggaatcaggggacgtcttccgacatcgaggacttgatagtttccaatgataagaacatcgagcctatccagaacttcatgaagatcaacaagatagatagtcttaacgtgttggacgtgaagaaacataaagaaatcttcagcaagttcgttcttcggaatttcaacaaattcgacttcaccgctttcatcccgctgctggacggcatacgggacaacatcctagattacaaaatgaagaagtga

SEQ ID NO: 8553 - RNA, 1959 nt, unidentified
  source 1..1959: mol_type = other RNA; note = synthetic construct
atgaacaaactcaaacagctggacaacaaggacgattttgctcggctcctgggctttaagaatagctcctacattaactacatcttgtacaacattggaaccgacaatctttaccgcgtgttttctatacccaaaaagaatggcgaggtcaggccaatccatgcaccgaagcccgagttgaaatttctgcagaagaagctagtgaatgtgctctgggactgctatattgacgatctgaccgtaaagtccaaggaaaaaaatttcaagatccctatgctgagtcatgccttcgaaaagaacaagagcataattacaaacgctcaacttcacagaaacaaacaatatatcctgaacatcgacctcaaagactattttgagtctttcaatttcggtagagttaggggattttttatcaaagacaaggatttccaggttgcccccgaggtggccactgtgataacccagattgcatgttatcaggggaaactgccacaaggtgccccctcctccccaatcatcaccaatttgattacgcgtatcctggactatcgcatcgtaaagattgctaagaagtacaggtttacttacacacgttacgcagatgatttaaccttttccaccaatagaaatctccggagcaataagctgaaagctacaaaggagctggacaaatttctggaagaactcgaagagctgattgtctcttcaggatttgaaatcaactccaaaaaaacacggttgtccgatgatatgcagcggcaggaagtgacaggcttgatcgtcaataagaaactgaacgttaagcgcgagtatattaagaacaccagggcaatggctttcaaattatacaaagacgagacattcgagatcgatgggaaacagggaactattgagcaattaaccggcagatttgcgtttatctttcagattggccagtataacaattacctcctgtacaagaaatctctggtcgagaataacctggaggcgcagaagaacctactcggtaaaaaatcaagcaagaaatccgattcgaagtactattggaagtacatcttctataacagggatctcaggaaagagttgttctataacaaacagcacaaaacacacaaccttccagaagagttctattctattggaaaggaggaaaagaaaatgtacatggccctgtttgactcaaaggagaaggagtacaagaagttcctattctataagtacttctacggcaatagcaagcctattatcgtgaccgagggcaagacggaccctcgctatatcaaagctgcccttaagaacctatatccccagtatccagaacttatcgaacgggatggggataagttcatattcaagattgacttcctcaagcacagcaacacaatagagtatctgtttaatgtgcccgagggcggggaaggattcaactattggtacaactacttctctaacaaagaagatttcaagatgtctgccaaagagaaattgctgtacccaaactacatagaatatttccagaagttgaccagtcgacaacctaaacatccaactatctttctgttcgataatgaacctactggtcaccccttttaccagtttgcctcctacagcaaagacctcgacatatcgccgaataatctggacactatcagaaaccctatggtcaattatcgaattaaccagaagtcaagcctctacattatgagtacgccgctggtgaagaatgtgaattcagggagtagctcagacatcgaggatctgcttattgcaaagcaaaaaatgcccactctttatctggatggccagaataagaccttcaaaaaaaacggcgggtttaattactatggaaaggaaatccttagcaactacgttttaaagtactaccagaactttgacttcagtgagttcatccctctcttaaatgggattcgcgataatatactggactatcgaaaatga

SEQ ID NO: 8554 - RNA, 1938 nt, unidentified
  source 1..1938: mol_type = other RNA; note = synthetic construct
atgaataagctgaaacagctggaatccaaagatgactttgctcgacttcttggattccagaacagcaaatacatcaactacctcttatattccgtggggactgacaacctctataaaacttttagcattccaaagaagggcgggggggagcgaataatcaatgcaccaaaaaaagagctgaaatttctccagcggaagctggccaacgtgctgtgggactcatacatagattctctcaaacttaagagcaaggacaagaagtttaagattcctatgctgagtcacgcctttgagaaaaacaagtccataatcactaacgcccaggtccaccgcaataagaggtacatcattaatatagacctcaagaactacttcgacagctttaacttcggcagggtccgcggtttttttctgaaagatcgggatttctgcgtaacgcctgatattgctacaatcattgcacagattgcctgctatcagggcaaactgccccagggagccccatcatcccccatcataacgaaccttatcacacgcattctggactatcgtatcgtgaagatcgcaaaaaaatatcgattcacatacaccaggtacgcggatgatatgacttttagtaccaatcgggatctgtattctaataaactccaggctacaaaggagttagaaaagtttctgagagagctcaacgagctggtgatttcctccggtttcgagatcaattcacaaaaaaccagactttccaatgagatgcaacggcaagaggtgactggactcgtagttaacaagaagttatcgattaagagggagtacattaagaatactagggccatggcatttagactttacaaggatggctacttcgaaatcgatggcaaattgggtacaatagatcagctgaccggcagattcgcattcattttccagataaaccaggttaacaattacctactatacaagaagtccttggtgaaaaacaacttggaattccagaaaaatctgctggcgcaacaaaccttgaaaaagtctgaatcgaagtattactggaagtatatcttctatgctcgtgacctgcgcaaggagctcttttacaacgagaaacacaagacatataacctgccgaccgaattttatgacatcagcaaaaacgagaagagaatgtacatgagcctgttcgacagtaaggagaaagaatacaagaagttcctcttctacaagtatttctttggcaatgacaaaccaatcatcgtcaccgaagggattacagatccccggtatatcaaagccgccctaaagtctcttcatcagcagtatcctgagttgatcgagaaggtggacgacaagtttatctacaaggtcgagttcctgaatcattcgaataccattgagtacctttttaatgtccccgaaggtggggaagggttcaaatactggtacaactatttctccaacaaggaaaactttcctatggatagcaatgaaaagatactgtatcccaattacatcgactattttcaaaagctcaccattaggaaacctaagaatcctacgatgttcctttttgataatgaaccgactggaagccctctgtacaatttcgctcgctatgctaaagatttggacattaactcgaataacctcaaccagatcagacagcccatgctgaactatcggattaaccgcaagtcttctctgtatctgatgctgacaccattgatcatgggatcaaactcaagtgacattgaggacctcctactgtccaaaaataccccacccattttaaaaggaaagtcttttagcaaaggcgggggcagtaataactacggcaaagacgttttcagcaaatacgtgttgaagaagtattcacagttcgatttcagcgacttttgtcccttgttagataaaatcagagacaatatcctggactacaggaaatga

SEQ ID NO: 8555 - RNA, 1959 nt, unidentified
  source 1..1959: mol_type = other RNA; note = synthetic construct
atgaacaaactcaaaaagctagacaataaggacgattttgctcggctgctgggcttcaagaatagtacctacatcaactacatcctttacaacattggaacggataatctttatcgcactttctcaattcccaaaaaaaatggtggaactaggttggtgcacgctcctaagccagagctgaaattcctgcaaaaaaaactggtaaacgtcctgtgggattgttacgtggatgaccttaccgcaaagtccaaggaaaaaaatttcaaaatcccaatgctgtcacacgcattcgagaagaataagagcattatcacaaatgcacaggtgcaccgtaacaagcaatacattctcaatatcgacctgaaggactattttgagtcctttaattttggacgggtgcggggcttttttatcaaagataaggatttccaggtcgttccagaggtagctactgtgattgcccagatagcctgctatcagggcaaattaccacagggcgccccttcctcaccaatcataaccaatctgatcacaagaattctggattacaggatcgtgaaaatcgcgaaaaagtacaggtttacttacacccgatatgctgatgacctcaccttcagcaccaacaggaacctacattcaaataagctgaaagctacgaaggagctggataagtttctggaggaattagaggagctcatagtgtcttccgggtttgaaatcaatagcaaaaaaacacggctaagcgacgatatgcagcgacaggaggtcactggtttgatcgttaacaagaagcttaatgtcaagagagagtacatcaaaaacacacgcgccatggcctttaaactttacaaagacgaagcgttcgaaattgacggcaaacaggggacaatagaacagcttaccgggcgttttgctttcatattccagattggtcagtacaacaactacctcctatataagaagagcctggtagagaataatctggaggcgcagaaaaatctcctgggcaggaatctgtccaagaagagtgacagtaagtactactggaaatacatcttctacaaccgcgatctgcgaaaagaactgttctataacaagcagcacaaaactcataacctgcccgaagaattctactctatcggtaaggaagaaaagaagatgtatatggccctctttgatagcaaggagaaagagtataagaagttccttttctacaagtacttctatggaaactccaaacctattattgttacagaaggcaagaccgaccccagatatataaaagccgccttgaagaacttgtatccccaatatcccgagttgattgagcgcgatggtgacaagtttatcttcaagattgacttcctaaagcatagcaacacgatcgaatacctgttcaacgtccccgaggggggagaggggttcaattactggtacaactatttcagtaacaaggaggattttaagatgagcgcaaaggagaaactgctttaccccaactatattgagtatttccagaagctgacctctaggcagcctaagcaccccacaatcttcttgtttgataacgaaccgactgggtatcctttataccaatttgcatcatactctaaggacttggacatctcgccaaacaatctcgataccataagaaatcctatggttaactatcggatcaatcagaaatcgagcttatacattatgtccactcctctcgtgaaaaacgtgaatagtggctcctcttctgacatcgaagacctgctcatcgccaaacaaaaaatgccgacactgtatctcgacgggcaaaataagacctttaagaagaatggcggatttaactactatggcaaagaaattctctccatctatgtgctgaagtattaccagaacttcgacttttctgagtttattccattactcaatggaattcgcgataacatattggactatagaaaatga

SEQ ID NO: 8556 - RNA, 1977 nt, unidentified
  source 1..1977: mol_type = other RNA; note = synthetic construct
atgaataagctgaaacaattaactaccaaggacgagttcgcgaggttactaggatttaaagacacgaagtacatcaactacttgttatacaagatcagaaccgagaatctgtatgaaacttttagcatccctaagaaaaacggaggcgagcgggtcattcatgctccaaagcgcgatttgaaaattctgcagaaaaaactcgcggaggtgctgtgggattgctacgtgtttgatcttgaaaagaagagcaaaaacaagaacgtaaaagttccgaaattgtcccatgctttcgagaaaaacaagtccattatcacaaatgcccaggtgcacagaaataagaagtatgttcttaatctggacctcaagaactacttcgacagttttaattttggcagggtacgcggcttctttataaaggataaaaacttccaggtggtcccggaaatagccactatgatcgcacagattgcttgttacgatggcaagctgcctcagggggccccatccagtcccattataaccaatctcattacaaggattctggattataggattgtcaagctggcaaaaaaataccgcttttcatatacccggtacgccgacgacctgaccttttccacaaaccgagatctgagttcaaacaaattgcgcagcgctaaaattctggagaaatttctatgcgagctcgagaacctgatagtgtctagcggttttgagatcaattctcaaaagacgcgactatctgataatatgcaacggcaggaagtgaccgggttggtcgttaataagaagatcagcgttaaacgcgaatatataaagaacacccgggctatggcctttaaactgtataaggatgaagagtttgagattgatgggaaacagggcaccatcgaccagctcactggaaggttcgccttcatcttccaaatctctcagtataacaactacctgctctacaagaagtcattgatcgaaaataacttcgagagccaaaagaatttgctgggtagaaattccctgaaaaaatctgagtccaaatactactggaagtacatcttctataacaaagacattcggaaggaactgttctacaataagcagcacaaaacatataaccttccacaggagttctattccatcaataagattgagaaggaaatctacatgagcctgtttgattccagagagaaggagtacaaaaagttcttgttctacaagtacttctacggaaactctaaacccataattgtgacagaaggcaagacagacccaagatacatcaaagccgcacttaaaaatctatataggaagtatcccgagctgatcgagaagaagggagacaagtttaagttcaagatcaacttcctgaaacacagcaacacaattgaatatctgtttaatgtgcctgagggcggtgaagggtttaagtactggtacaactatttttcgtcaactatgccctcaaatattttcaaagagaactttcccccaaagtccctcgggcaagacctctatcgcaagatgtaccccaactatatagaatatttccaggggcttactacacgaaaacccaattacctcactattttcctctttgacaatgaacctgccggcagtcctctctacaaatttgtgaatcatgcaagcgagcttcagatcgacaccaacaaccttgaccagatcagagaaaaaaacttctataggatctcgaccaaaaatagtctgtatgtaatggcaacgccacttctgaacaagggcaacagttcagatatcgaagatctgctgttagctcgtaatcagcttcctgtgttaaatggaaagaactttagcaaatccggtggaagcaattactacgggaaagacgtcctctctaagtatgtgctcaaaaacttcaagaagttcgacttcaccgagttcataccgctgttggatggcatccgtgacaatattctggattatagaaagaaccggatctga

SEQ ID NO: 8557 - RNA, 1980 nt, unidentified
  source 1..1980: mol_type = other RNA; note = synthetic construct
atgaataaactgaaacagttgagcacaaaggacgatttcgcagagttactaggctttaaaaactcccgctttatcaactacctgctctattccattggtacagataatctgtacgaaacctttactataccaaagaagaatggtggagaaaggattattcatgcccccaaaaaggagcttaagtttttacagaagcgtctggctaatgtgttgtgggactgttatctgtatgacctgaagagtaagagcaaggaaaagaaactgaagatccctatgctgtcgcacgcgttcgaaaagaacaagagtattatcacgaatgcacaggttcatcggaataaaaaatacctgctgaacatagatctcaaagattacttcgactcttttaactttgggcgcgtgcggggattcttcgttaaagataaagacttccaggtgacctcagagatcgcaaccgtgatcgcacagatcgcctgctatcagggaaagctgcctcaaggggcaccaagcagtcccattatcaccaatcttattaccaggattcttgactataggatcgtaaagattgctaagaaataccggtttacctatactcggtatgccgacgatatgacattctctactaatcgcgaactgaactcaaacaaactgcgagctactaaggagctcgagaattttctggccgaactggagcgcctgataattagttcaggattcgaaatcaaccctaaaaagaccaggctgtcaaataatatgcaacgacaggaagtgactggactggtcgttaacaaaaagatcaatgtgaagcgagaatacataaaaaacacccgggctatggcttttaaactgtataaagatgggacctttgagatcgatggtaagcaggggacattggaacagctgactggccgtttcgcgtttattttccagacagacaagtataacaactacctactgtacaagaaatccctcatcgagaacaaccttgacgagcaaaaatacctactcggccgcaacagtagcaaaaagagtgagtccaaatactactggaagtatatgttctacaacagagacttacgtgacgagctcttttacaatcagaaacacaacacctacaatttaccaaaaggattctactctatctctgagaatgagaaggaggtgtatatgacgttgtttaactctaaggagaaagactataagcgctttctcttctataagtacttctttggaaacgataagcctatgatcataaccgaaggcaaaactgatcccctttacatcaaggcggctttgaaaaagatgtaccttaactatcctgaactagtcgagaaagtaggtaacaactttgtcttcaagatcgaatttctgaatcggagcaatacgattgaatatctgttcaacattccggaaggaggctctggcctgaattacttgtacaattacttctccaaccagattcccgccaattttttcaaacagaggtttccaacgaataacgatagaaaggacatttacaaggagctctatcccaactacatagagttcttttcaaacctgacattgaggaatcctaagaacagcacaatcttcctgttcgataacgagccgtcaggcaatccgctctttaagtttgtgaattacgccaaagatctccaagtcgagtccaataatttggaccaaatcagaggcacagccttcaagagaatcactaaaaaggggtccctatatattatggccacaccccttttaccaaatatgaacggcggtaacagctctgacatcgaggacctcatccttagcaaaaataccgcccccatactgaaaggcaaaaccttcctcaaaaatggcgggtcgaatcattatgggaaggaaattttcagcaagcacatacttaagaactacaagcagtatgatttctccgacttcattccattgctcgacgggatgagagataacatcctcgattatagaaagaagtga

SEQ ID NO: 8558 - RNA, 978 nt, unidentified
  source 1..978: mol_type = other RNA; note = synthetic construct
atgaataaacttaagcagctggagacaaaggatgactttgcatctctcctcggtttcaagaacagtaagtacatcaactacattctctattctgtgggcaccgataatctgtataaaactttctccatcccgaaaaagaatggaggggagaggattatccacgcccccaaagaaaagttaaaacggctccagagaaagctggcaggcgtcttgtgggattgttatctggaatcgctgaaaatcaagagcaagaacaaaagcttcaaaatccccgctatctcccacgccttcgaaaagaacaagtcaataattaccaacgcccagattcatcggaacaagaaatacatcctcaacattgaccttaaggactactttgatagctttaatttcggccgcgtgcgcggatttttcctgaaggatgctgacttcaaagtcccagaggaaattgcgactgttatagcacagatcgcctgctataaagggaaactgcctcagggggccccaagtagccctatcataaccaatctgatatctcgaatcttagactacagaattgtgaagatcgccaagaaatatagatttacttacacgcgctacgctgacgatatgactttttcaactaactgtgagctgtccagcaataagctacaagcaacaaacgagctggaaaagtttctgaaagaactggagaaggtcatcaccctttcagggtttaaaatcaatccccagaagacaaggctatccaataatatgcaacgtcaggaggtgacaggcttggtggtgaacaagaaagtaggcgttaagcgagaatatttgaaaaatacaagggctatgaccttcaagctgtataaagacgagaagttcgagattgacggaaaacagggtacgatggagcaattaaccggacggtttgcgttcattcttcagattagtcaatacaacaactacttgctctacaagataaattgcaagatctga

SEQ ID NO: 8559 - RNA, 1953 nt, unidentified
  source 1..1953: mol_type = other RNA; note = synthetic construct
atgaccaagttaaatcgattggagacaaagactaaaaacgactttgccaggctgttaggatttaagaatgcccgctatatcaattatctgctgtacatcatcaagaccgataacctgtataattcgttcaccatccccaaaaaaaatggaggtgagcgggtcatacatgcaccaaaaaaggagctgaagtttcttcagaagaagctggctgatgttctgtgggaatgtcacttggagtctgttgaatctaagtccaaggataagaacttcaaaacccctgtgctttctcatgcgtttgagaaaggaaaatccatcatcacgaatagtcaaatgcaccggaataagaaatacatcctcaatattgacctcaagaacttctttgattcattcaatttcggccgagtcagaggtttcttcatcaaagataaagacttcgcggtcagtccggagattgccacagtcatcgctcaaatagcatgctaccagggaaaactgccccagggggctcccagctcacctattataaccaacttgattactcggatccttgactacaggatagtgaaaattgccaagaaatatcggtttacttactcaaggtatgccgatgacatgactttttccaccaatcgggagctgaattctaacaaattaagagcatccaaggaactcgacaactttctaacagagctcgaggaggtaattgtgagctcggggttcgaaataaacccccaaaagacccggctgtctaacaatatgcagcgacaggaagtcacggggctcgtagtgaataagaagatcaacgtgaagagagaatatgtgaagaacaccagagcaatggcgttccagctctacaaagacggagcctttgaaattgataaaaagacgggcacactgaatcagttgacaggccgttttgcattcatcttccagatcgaccagtacaataactatctgctgtacaagaaaagcctaatccagaataatctcgacagtcagaaatatcttctcgggcgcaattccagcaagaagtccgaaagtaagtactactggaagtacatcttttacaataaggacctgaggaagaaactcttcgataatactaagcataacacagacaacttgcctaaggagttctatagcattggcaaagaacagaagaagatctatatgagcctctttaattctcgcgaaaaggaatacaagaagttcctgttctacaaatacttctttgggaacgataaacccgttatcattaccgagggcaagaccgatccacgttatatcaaagctgccttgaaaaagctgtatcaaaagtatccagaactgattgagaaagtgaggaacaactttgtgttcaagattgagtttctgaaccgcagtaacacgatcgaatacctttttaacataccggaaggcgccagtggactgagtttctggtatagctatttctcagacataaagtaccaaactgaggaggccaagaagctgttttatcctaactacatggagtatttctcaaaattcacctctagaaaaccaaaaaaccccacaatgttcttatttgacaacgagccgtcaggccaccctctgtttgagtttgctaatcacgctaaggacctgaaagactcttttaagaatcttgacagcaagagaaacacaagcagcaagaaactggcaaaaaaagggtccttgtacattatggctactccactttcccctgatattaattatgggtacagctctgatattgaggacttactactctcacgcaactccgccccaacccttaaaggtaagacttttagcaaagatggaggcgccaaccactacggtaaagacattttttccaagtacgtgttgaaaaactacaaggaattcgatttcacagagttcatccccctgctggatggcatcagggacaacattctcgattacaaatccctattctga

SEQ ID NO: 8560 - RNA, 2058 nt, unidentified
  source 1..2058: mol_type = other RNA; note = synthetic construct
atgacgaaactaaataggttagagacaaaagatgactttgctcgtctgctcggctttaagaatgctaggtatatcaactaccttctctacatcattaagactgacaatctgtacgatagcttcactattccaaaaaagaatgggggagagcgggtgattcacgccccaaagaaggagttgaagttccttcagaaaaaattggctgatgtactctgggaatgtcatttggagagtatcgaaagcaagaaaacactccagaaacggctggccgcaatactgtgggaatgttatcttaaatgcctgaacttcaactacatagagaataatctcgccaatgtgctgtgggagtgctttttgaaagttttagagtttcgcccgaaggagaaaaatcccgtgttgagccatgctttcgagaagggtaaaagcatcattacaaacagccagatgcacagaaacaagaagtacattctgaatatcgacctcaaagacttctttgactccttcaattttggacgtgtaagaggattcttcatcaaagatcgagatttcgcagtgtcccccgaaattgcaaccgtgattgcccaaatagcgtgctatcagggcaaacttcctcagggttctcctagcagtcccattatcactaatctaattacccgcatactcgactataggatagtgaagatagccaaaaagtaccgattcacctactctaggtatgcggacgatatgactttttcaactaaccgcgaactgaatagtaataaactacgcgcaagcaaagaactcgataacttcctgactgaactggaggaggttatcatttcatccgggtttgagatcaatcccaataaaacacggttatccaacaatatgcagagacaggaagtgaccggcttggttgtcaacaagaagatcaacgtgaaacgcgagtatatcaaaaacacacgcgccatggcgtttcaactctataaggatgaagcatttgagattgataagaaacctgggacaatcaatcagctgacgggccggtttgccttcatctttcagatcgatcaatataacaactacctcctgtataagaagtctctgattcagaataacctggactcccaaaaatatctgcttgggagaaactcatctaaaaagagtgaatccaagtactactggaagtacattttttacaacaaggacctgaggaaagaactcttctacaacaagaagcacaacacctataatctaccaaaggagttttacagtatcggaaaagaagagaagaagatgtacatgtctttattcaacagtagagagaaggagtacaagaagtttcttttctacaagtacttcttcgagaacgacaaacctataatcgtcaccgaaggcaagacagaccctcggtatatcaaagctgccttgaagaaactgtacaagaaatatccagagctgattcaaaaagtcggcaataatttcgtgttcaaaattgagttcctgaaccataccaataccattgaatatctgtttaacgtgcccgagggcggagaagggttcaagtactggtataactatttttccgataaggaaggagtccagatgtctgacaatgagaaagttctgtacttaaactacatcgactatttcgaaaagctgaccaaaaagtctccaaagaatcccaccatatttctttttgacaatgagccgtccggcaaccctcttttcaagttctttaactatgctaccgacctgaatgtcagctctaacaatctgggccaggtaagaggtacttcatttaaccggatcactaagaagaacaacctttatatcatggccacccctctcttgtcgacacgtaacaatggaaacagctcggatatcgagtatctgctcttgtcaaggaatccctcaccaattctcaagggcaaaacgtttagcaaaggtgggggggccaaccactacggtaaggatatcttttccaagtacgtgctgaagaactacaaaaagttcgacttcacagaattcattcccctgctggacggaatccgagataatatactaaattactga

SEQ ID NO: 8561 - RNA, 2052 nt, unidentified
  source 1..2052: mol_type = other RNA; note = synthetic construct
atgacaaaatttaatcagctgcagactaaggacgatttcgctaagctactgggattgaagtctgcgaaatatatcaattacctgctgtacaacatcaaaaccgacaacctgtacaactctttcccaataccaaaaaaaaacggcggcgagcgtgtgatccacgccccaaagaaggaactcaaattcctgcaaaaaaaactcagcaatgtgctgtgggaatgttacctggaatccattgaaagtaagagcaaggataaaaacttcaagactcccgttttgagtcatgccttcgaaaaggggaagtccattataactaattcccagatgcaccgcaacaaaaagtacatactgaacattgatctgaagaacttctttgacagctttaattttggtcgcgtacggggattcttcattaaagatcgggatttcgcagtgtctccagaaatcgcgaccgtgatcgcccagattgcctgctatcaggggaagctgcctcagggagcaccaagttcacccatcataacgaacctcattacccgcattttagattacagaatagtcaagatcgcgaaaaagtatcggttcacttattctagatacgccgacgacttgacgttttcaacaaatcgcgaattgaattccaataaactgcgcgcttctaaagaactggaaaattttctgaccgagttagaagacctcattatttcctcaggcttcgaaatcaatcctaagaagacaaggctgtctaacaatatgcagcgacaggaggtaaccgggctagtcgtgaacaaaaagatcaacgttaagcgtgagtatgtgaagaacaccagagccatggcattcaggctttataaagacggcgcttttgagatcgataaaacaccagggaccatcaaccagttaaccggtagattcgccttcatctttcagatcgagcagtacaacaactatctactgtataagaagtccctgatgcaaaacaacctcgactctcaaaagtatcttttaggcagaaatagcagcagaaaatcggagagcaaatactactggaagtacattttctacaacaaggatctgcaaaaggagttactgcacaacacaaagcatcacacttataatctacctacagagttttacagcattgggaaagaggagaagaaaacctacatgtcactctttaatagccgggagaaagagtataagaagttcctcttttacaagtacttctttgggaacgacaagcctatcatcattacagagggaaaaacagatcctcggtatatcaaggctgctctcaagaatttgtatcagaaatatccggagctcatagaaaaagagggcaacaatttcatcttcaaaatcgagttcctgaacaggagcaatactatcgagtacctttttaatgttccggagggcggcgagggctttaagttttggtacaactactttagcgacaaattctattacaacgagaagaaggaaaagaaattctttgcactgaatagtgaggaaaggatattgtataccaactacatcacgtactttaagcaactcaccaactccctgcctaactaccccaccatcttcttgttcgataatgaaagcaataaccggaatggcaatgataagagtgccctgttcttgtttgcttcccatgcaaaagatcttatgattcccaaaaacaaggatctcgaagactcaaagaatattaagctggaagagaagatctcagacaatctagaaaaggtccgaagggataagccctggaggatcaacaaaaaggacagtctctatattatggccactccccttatgccccatatgaatgatggaaaatcctcagacattgaggatcttctgttttctagttcccagaatagcctgcccattcttaagggaaaagagttccacaaagacggtggagacaatcactatgggaaagagatattttcgaaatacgtgctcaagaactacaaagagtttgactttactgaattcatccctcttcttgacggtattcgagacaatatactggattataagtccttgttctga

SEQ ID NO: 8562 - RNA, 1980 nt, unidentified
  source 1..1980: mol_type = other RNA; note = synthetic construct
atgacgaaactcaatcagctgaaaactaaagatgattttgccaagcttttgggctttaaaaatgccaggtacataaatcacctgctgtataacatcaccacagacaatctgtacgaacctccaatagtgattcccaagaagaacggaggagagcgggtcatccatgcgccccagaaagagctcaagttcctgcagaaaaaactatctaatgtcctctgggaatgctatctcgaaagcattgagtcaaagagcaaagacaagaactttaaaaccccagtgttgtcccatgctttcgaaaaaggcaaaagtatcattaccaactctcagatgcatcgcaacaagaagtacattcttaatattgacctgaagaacttcttcgattcttttaacttcggccgtgtgagaggattttttatcaaagatcgcgattttgctgtcagtcccgaaatcgccaccgttatcgcccagattgcctgttatcaagggaagttacctcagggcgcaccctcctctccaattatcacaaatctcataaccaggattctggactacaggatagtgaagatcgccaaaaagtacagattcacctattcaaggtatgctgatgacatgacattctccaccaattgtgagttgaattccaataaacttcgggcctccaaggaattggataactttctgacagagctggaggaggtaatcattagtagcggcttcgaaatcaaccccaaaaaaacccggctgagcaataacatgcagcgacaggaggtaacgggtctggtggtcaataagaagatcaacgtgaaaagagagtacgttaagaatacacgcgctatggcatttcaattatataaggacggggctttcgagattgataaaaaacctggtactatcaaccaactaacagggcgattcgcttttatcttccagatcgaccagtataataactatctcctctacgagaaatcgttgattcagaacaatctggactctcagaaatacctgctggggaggaactccagtaagaagtcagaatccaagtacttctggaagtatatcttctacaataagaacctgcgtaaggaactgttttacaacaagaagcacaacacctataacctcccaaaggagttttactcaatttccgagaatgagaaagaggtgtacatgtgcctgttcaacagcaaagagaaggaatacaagaaattcctcttttaccggtactttttcggcaacgaccgccccatgatagtgacggagggcaaaacagatcctctctatatcaaggcagccttgaagaaactgtataagaactacccgaagcttatagaaaaagacggtgacgacttcatttttaagattgagtttctgaaccgaagcaacacagtcgaataccttttcaatatcccagaaggaggcgagggcctaaagtactggtacaattatttcagcaatcaaatccccgcaaattttttcaatcaaaagttccccgccaaaaatgatgggaagaagatctataaagagctgtatcctaattacatggaattctttagccaccttacctcaagagagcctaaaaacccaaccatcttcctttttgataacgaaccatccggaaaccccttgtttaaattcttcaaccacgcgactgatctcaatgtttcatctaataacctgggacaggttcggggcacttctttctacaagatcactaagaaggacagtttatatgtgatggccactcctctgatgcctcacatgaataatggaaatagctcagacattgaagatcttctgctatcgtgcaacccaagcccgatactgaagggtaagactttttctaagggtgggggggcaaaccattatgggaaagatatcttttccaagtacgtgctcaaaaactataaagagtttgacttcactgagttcataccgttgctggacggaattagagacaacattttagattacaccagttga

SEQ ID NO: 8563 - RNA, 2097 nt, unidentified
  source 1..2097: mol_type = other RNA; note = synthetic construct
atgaataagctgaatcagctcaagaccaaagacgatttagccagacttcttgggtttaaaaacgcacgatacattaactacctcttgtatgataagcagaccgacaatctctatgagtcctttacaatcagcaaaaaaaacgggggggagcgtatcattaatgccccgaagaaagagctaaaatttctgcagaagaaactggcaaatgtgctctgggagtgttatttggaaagtctggagagcaagaattttcttcagaaacgcctcgctggcattttgtggaagtgctatctgaagtccttggagatcaactacatcaagaacaacctctctgattttctttgggagtgcttcatgaaagtccttggatttaaaccaaaggaaatcaaaactcctgtactatcacacgcctttgagaaaggcaagtcgattatcaccaattctcaaattcaccgcaataagaagtatattctgaacatcgaccttaaagactttttcgggagttttaatttcgggagggtcaggggatttttcattaaggaccgggattttggaatcagccccgaaattgccactgtgatcgcgcagattgcctgttaccagggaaagctgcctcaaggtgcgcccagttcgcccattattaccaaccttataactaggatccttgactatcggatcgtcaaaattgctaagaaatatcggttcacctatagtagatacgccgatgacatgacattcagcactaacagggagttgaattcaaataagctgcgagcatctaaggagctcgaaaattttctggccgaattagaagagctcatcatctcttctggctttgaaattaacccgaagaaaacccggctcagtaataatatgcagcggcaagaggtgaccgggttagtcgtgaacaaaaaaatctctgttaagcgcgaatacgtgaagaacactagagctatggccttccaactgtataaagacggcgcctttgagattgacacaaaaccaggtacattgaatcagctgaccggcaggtttgcgttcattttccagatagaccagtacaacaactaccttttgtacaaaaagagccttatacagaacaacctggactcccagaagtatctgctcggcagaaacagttcccgcaagtccgaatcaaagtactactggaagtacatcttctataacaaagatctacagaaggagctgttcgacaacaaaaaacataacacgtacaacttacctaaggagttttatagcatccccgaaaatgaaaaagaagtgtacatgtccctgttcaacagcaaggagaaggagtacaagaagtacctcttctataagtatttcttcggcaatgacaagccaataatcataacagagggcaagactgatccgcggtacatcaaggcagctctgaaacacctgtatcaaaaataccctgaactgattgagaaagatggcgacagattcactttcaagatagaattcctcaatcatacgaacactctggaatatctattcaatgtgccagaaggaggagagggttttaagtactggtacaactacttctctaatcagattccctccaacttctttaaacagaggtttcctacaaagaacgatgggaaggacatctacaaagagctctaccccaattatatcgagtactttagcaatctcaccacacgtaagcccaagaacccaacaatattcctgttcgacaacgaaccttcagataaccccctgttcaagttctgcaatcatgcagtggatctgaaagtttcatcaaatgatctggatcaagttagaggaacctctttcaatcgtataaccaagaaggacaatttgtacatcatggctacaccattactgtccaaccgaaataacggcaatagctcagatattgaggatttgctgctatcccgcaatctcccacctatcctgaatgggaaaacgtttagcaaatccggtggcgacaaccactatggtaaagagatttttagcaaacacgtactgaagaactttacggagttcgattttgctgaattcatccccttactggatggaatccgcgacaatatactgaactattggtga

SEQ ID NO: 8564 - RNA, 1971 nt, unidentified
  source 1..1971: mol_type = other RNA; note = synthetic construct
atgaataagctgaatcagcttaagactaaggatgacttggccaaacttctcggctttaagaatgcccgctatattaactacctgctgtacaacatacagacagacaatctgtataattctttcaccattccaaagaagaacgggggtgagagaatcattcatgctcccaaaaaggagttgaaatttctccagaaaaagctggccaacgtattatgggagtgctacttagagagcattgagtcaaaatcaaaggggaagaactttaagacaccagtcctaagtcatgcctttgagaagggcaaaagcatcatcaccaatagccagatgcatcgcaacaagaagtatatcttgaacatagacttgaaggatttcttcgactcatttaactttgggcgtgttaggggcttttttattaaagatagggatttcgcagtgagcccagaaatagcaactgtcatcgcacagattgtgtgttaccagggcaaactgccacagggcgctccgtcttcccccattattaccaatctgataaccagaatcctagactatagaatcgtgaaaatagccaagaagtatagattcacttactcaaggtacgccgacgacatgacattttctactaatcgcgagctgaattctaataaactccgggcgtccaaagaattagaaaacttcctggcagagctggaagaactgatcgcttccagcggatttaagataaacccaaagaaaacgcgactgagtaacaatatgcagcgccaggaggtgaccggccttgtggttaacaaaaaaatcaatgtgcgtagggaatatgtaaagaatacacgggcgatggcatttcaattgtacaaagacggcgcctttgaaattgatactaagccagggaagcttaatcaactgaccgggcgctttgctttcattttccagattgaccagtataacaattacctgctgtacaaaaagtcgctgatacaaaacaacttggattcacagaagtatctgctgggccgaaactcctccaaaaaaagtgagtctaaatactactggaagtacatcttctacaacaaggacctgcggaaggagcttttcgacaatacggaacacaatacatacaacttgccgaaagaattttacagcatcggtaaggagcaaaagaagatgtacatgtcgctctttaacagccgggagaaggagtataagaagttcctattctacaagtacttcttcggaaatgacaagcccatcattgtgacagaaggtaagacggatcccagatatatcaaagctgcccttaagaagctttatctgtcttatcccgaactcgttgaaaaagtcggaaacaacttcatcttcaaaatcgagtttctcaatcggagcaacaccgtggagtatctgtttaacatccctggaggtggcgagggactgaaacactggtataattacttctccaacaaggagaaattccaaatggactccaaggaaaaattgctctaccctaactatattgagtacttccagaaactcacaacccgaaaaccccaataccctaccatcttcctgttcgacaatgagcctaacaataggaaaaaggatgataaagcccctctctttctttttgccagtcacgcccgcgacctggaaattgattccgacaacttagaacaggcgaggcgtggctcaagcagtcggatcaccaagaagggatctctgtatattatggcaactcccttattgcccaatatgaataacgggaattcaagtgatatcgaagacctcctgctctctcagaagaaaccacctattctcaagggaaaagcttttagcaaaaaagatgatccgaatcactacgggaaagagatcttctccaagtatgtcctcaagaattatacacagttcgatttcactgagtttattcctctgctagatgctatcagaaacaacatacttgactaccagaatatcaacgattga

SEQ ID NO: 8565 - RNA, 1962 nt, unidentified
  source 1..1962: mol_type = other RNA; note = synthetic construct
atgaacaagcttaccaatgtggagtccaaagatgactttgcacgacttttaggcttctctaattcccgattcatgaactatgtgctatatgtcctcaggactgaagaactgtatgagacattcacaattcctaagaaatcagggggggagagaaccatcaatgcacctaaaaaggagttaaagatcctgcaaaagaagctggccaacctgctgtgggattgctatatcgaggacctagagtccgagtccaaggtgaaaaataagaaaatacccaacctgagtcatgcctatgagaagaacaaaagtatcataaccaacgccaaactccatcgcaataagaagtacgtgttgaacatagatctggaggatttttttgacagcttcaactttggcagagttaggggattttttatcaaagacaggaatttctgcgtgtctagtgacgtcgctacagtgatcgcccagatcgcctgttataaaggtaaactccctcagggtgccccatcttccccaattattacaaatctaattgctcgcatcctcgattaccggatcgtaaagattgcgaaaaagtacaggtttacctatagcaggtacgcagacgatatgactttttcgaccaatcgggagctggcctccaataaactacgaactactaaggagcttgacaagtttctggccgagctcgaaaaagttatcgtggcctcaggattcaagatcaataacaaaaaaacgcggctttccaataatatgcaacgccaggaggtcacagggttagtcgtcaataagaagattaacgtgaaacgtgagtacattaaaaacactcgtgcgatggctcataaattatacctgtctcagaggtttgaaatagatgggcgggaaggcacaattaatcagttgataggcagatttgcattcgttcagcagatagatcagtttaacaactacctgtcctacaagaagagcctgattaaaaacaactttgacgcccagaagtatcttatcgggaaggatagcggcaagaagtcagaaagcaagtactattggaagtatatcttctctaaccgcgacctccggaaacacttgtattacaatagcaggcacgacacctacaacttacccaaaggcttctacacaataggaaaagaagagaagaagatgtacatgagcctctttaattcacgagagaaggaatacaagaagttccttttctataggtacttttacgggaatgacaagccaattattgtaaccgaaggcaaaaccgacagccggtacatcaaggccgctctgaagaaactctattataaatatcccgaactgatcgagaaaaacggttccgatttcgttttcaagattgagttcctgaaacattcgaacaccattgagtacctgttcaatgtcccagaaggcggtagtggatttgaatactggtatcgctacttctcagacaaaaagcgctttcagatgggcgaagttgagaaggtggtgtaccccaactacatcgaatactttaagaaactgacgaacagaccgcccgacaatcctacaatcttcctcttcgataatgaacttcaaggaccgctctataacttcgcgaatttcgcaaaagatctggctatctctaccaacaatttcaaccaaatcagatactccagttttgatagaatcgtgaaaaaggattcactctacgtaatggctacgcctttgatccccaagattaacaatggagtattctctgacattgaggatttgttgctggtgagaaattctactccaattctgcgcggtaaacagttttcaaaacacggagggagtaaccactatggcaaggacattttcagtaaacacgtcctgaagaactatagcaagtatgactttactgaattcatccctctgttggatggggtgaagaacaacataaaggactattaccagaagagcaacaatcggaaaaattga

SEQ ID NO: 8566 - RNA, 1956 nt, unidentified
  source 1..1956: mol_type = other RNA; note = synthetic construct
atgagcgactatgtcaaccttaaaaccaaagatgacctggccaaaaatctgggatatagggactctcggtatctgaattacctgttgtataaagtaggagtggacaacctttataggactttctcaattcctaagaagaatggggatgaacgcataattaatgctcctttgaaggagttgaaaatcgtgcaaaggaagctcgccaacctcttgtggaatcgctacctggagatcctggaaacaaaaagccgagatcgcggaatcaaaattccgagtatttcccatggattcgaaaagaacaaaaacatcatcaccaatgcacagcagcatcgtaacaagaaatatataatcaacgtcgacctggaatcatattttgactgttttaacttcggacgcgtaagaggcttttttataaaagaccgagacttcaaggtcagtagcgatgtggctaccgtgatggcccagatagcttgctatcagggcaagttaccccagggtgccccttcatctcccatcattaccaatttgattgctagaattctggattatcgcatcgttaagctggccaaaaagtacagattcacatatacacgatacgctgatgatctcaccttctccaccaatagaaatctactatccaacaagctcagagctgagaaggagttcaacgaatttctcgtggagcttgagaaaatcataacaactagcgggtttaacattaaccccagcaaaacaaggatttccaacagttaccaaagacaggaagttactggcattgtagtcaataagaagatcaacgtcaaaagggactactttaagaacactaaagcgatggcatacaaactatataaggacggcgaatttgaaattgatggtaaaagtgggacattagagcaactgtctggccggttttcttttatctttcaggccactcagtacaataattacctcttctacaagaagtcgctgattgacaacaacttagaataccagaaaaaccttctcggacaggggacaaacaagaaatccgagtccaagttctattggaaatacatcatctacaacagagatctccgtcgcgagctattttataacgagaagcacaagacctataatctgccagatgaattttacgccatttccaaagaagagaagaagaactatatggcactgttcgattccaaggaaaaggagtacaagaaattcctcttctacaagaacttctatggcaacgacaaacccatcattgttacggaaggcaagacggacccacggtacatcaaggcagccttgaaaaaactttacctgtattatcccgaattgatcgagaaagttgataaccggtttgtgttcaagatagactttctgaaacacagcaatattatcgagtacttgttcaatgtgcctgagggcggtagcggattcatgttttggtacaactacttctctaataaggagaagtttcacctgtcaaatgaggagcaacttctttaccccaactatatagactttttccgtaagttcacctcagaaaaggcgaataacccaactatattcctgttcgataatgagccatttgggaatcctctgtatcagtttgtgaattatgcgaaggaccttcagatcgatacaaataatctgaataccgtgcgggggccctcattcaatcgaattagtaaaaaggagagcctctacctgatggccaccccactcgtttcgaatctgaataatggtaattcttctgacgtggaagatctgctgatatccaccaacaagctggcaatccaaacgttcttcaacatcaagaagatcaattacaagaggctcgaagacgtgaaaaaccataaagagattttcagcaagtacgtcctcaaaaactacgagcagtttgactttactgagtatattccgctgttagatggcatccggaacaacatcttagattacaggaaatga

SEQ ID NO: 8567 - RNA, 1986 nt, unidentified
  source 1..1986: mol_type = other RNA; note = synthetic construct
atggggaagctacaagaactggaaacaaaagacgagtttgctcggctgctcggattcaatgatgcccggtacatcaactacttgttgtaccacaatgagaataaccaggacaagaagttcattaacacagagaatctctactatagctttaccattcctaaaaagtcaggaggcgtgagagaaattaatgcgcccaaggacgaacttaagttcgttcagagaaaactggcagaaatcctgtgggatgactacgtagaaatgctaaaagtcaacagcaagaacaaggactttaaaatcccttccatatcccatggttttgaaaaggaaaagtcaatcatcaccaatgcaaaacagcatcgtaataagaggtttgtgctcaatctggacttggacaactttttcgatagctttaatttcggccgagtgcgcgggtttttcattaaggataaagattttggcaccactccagagatcgccaccgtgatcgctcagattacctgctaccagggtaaacttccacaaggcgctcccagctcccccattatcaccaacttgatcgcccggatcctggactaccgtatagtcaagatcgccaagaagtatagattcacttatacgcgatatgctgatgatttaaccttcagtacaaaccgggaactttattccaataagctcaagtcccgcaaagagctcgagaatttcctcgaagagatcaagataaaagtggaggccagtggcttttctatcaatgagaaaaagactcgcctctcagatcagtcacaaagacaagaagtcaccgggatcgtggttaacaaaaagctcaatgtaaaaagggagtactttaagaacactaaggctatggcattcaagttatataaggacgagaaattcgagattgatggtaaagaaggcaccatagatcagctcaacggcaggttcagcttcatcaatcagattgatcagtacaacaactacttgctgtacaaaaagtctcttatccagaatacgttgagccaccaaaagaatttgattggacaggagctctccaaaaaaagcgagtccaagtattactggaaatacatattccagagtaaggacttactgaaggaaacatactataacaagacacatcacacgtataacctgcccgtagagttttatgacatcgccaagaatgagaaaaagctgtatatgagctatttcaacgctcatgagaaggagtacaagaaattcctgttttacaggtactttttcgggaacgataaaccaattattgtgacagaagggaagacagaccctagatacctgaaggccgcactgaaaaacctttatcttaactatccggaactaattgagaaagtcgagggcaaatttctttttaagatcgacttcctctcgcactctgacactatcgagtacttattcaatgtgccggaggggggagaaggcctgaaatggtggtataactatttctcagacaaaaactaccagaacaaaatgagtgaggaagagaagctattatatcccaactacatatcttacttccgcaagcgcactggaagggatcctcgaaaggcgactatcttcctgtttgataatgaacctaagggatcgccactttttaattttgccaactacgccaaagacctgcagattgacagcaataatctggaacaggttagacgggacaacttctacaagatttctaagaaagagtctctctatctggtggcaccacctctactgacaaacatgaattttggaaactcttccgatattgaggacctgctcctgtccaggcagaaaatgccaactctttacatggacaaacaaatgaaaaccttcaacaagaacggtgggctgaaacactatggcaaagaaatattgagtaagtacgtcctgaagcaccatcagaagtttgactttaccgagttcgtgcccctgctgaatgcgattcgcgataatatcctggattataatgtttga

SEQ ID NO: 8568 - RNA, 1929 nt, unidentified
  source 1..1929: mol_type = other RNA; note = synthetic construct
atgaataaacttcagaccatccagagcaaggaggactttgctcacttgctggggtacaaaaagtattcctctataacatacctgctgtacaagatcgggatcgacaacctttacacctccttcgaaattccaaaaaagactgggggaaccagaactatttatgcaccacagaaggccctaaaaaaactccagaaaaggtttgcaagtctgttatgggaagcatatgtagaaaacttccagccaacctctaataaaaaacacaaaaagctgcccaacgtgtctcatgcgtttgagaagaataaaagtatcatcaccaacgctaaaaggcacagaaataagaagttcgtcttaaaccttgatcttgaagatttcttcggttcatttcattttggaagggtgcggggatttttcctcaaaaatcgggactttcaggttcctgaagaagtcgctaccctgatcgcccagctgacttgttacaaaggctcactaccccaaggcgcacccagctcccctattataacgaacctcatttgccagatattagatcaccgtattgtgaaactggccaagaagtatcgcctcacttatacacgttatgccgatgatctgactttttctactaacgctgaactgccagcggaaagctttgaagccttcttcacacagctccaggatatcattcaccgaagcggcttttctatcaatcaccgcaaaacaagaatcagtgacaatggccagcggcaggaggtcactggcctgattgttaataagaaggtgaacatcaagcgggagtactttaaaaataccaaggccatggcttttcatctttataaggacggacagtttgagatcgacgggaaaccgggaacaattgaccaactcaacggcagattcgcttatatccagcagattgagaactataacaactacttgctctacaagaaatcattatccaccaatggcatcgaatatcaaaagtacttgttgcctaagtatgagaataaaaagggcagggataatttttaccaccattacatcttcaacgagcaggacctggttgagccaaccaatttctggaattccaagcacaagaaatatgagttgccccagacgttctacaaagccgagaagaattcgaactacaactacatggagaattttagtagccgggagaaagaataccaaaagttcctgttcttcaagaatttcttcatgaacaacagacccctgatcgtaaccgaagggaagacagacatcgtgtatctgaaagccgctcttaagaatcttgcatcaaaatacccttccttaattgaaaaggaggacaatcagttcaacttcaaaatcaacttcttcagtcatacagccacaatcgactatttgttcaacattccaaagggcggtggtgaggtgtttaaacatctgtacaactacttttctgacaatacaggaattaagcaacagaagtatctctacccaaactatttgaagtactttagggaacttactagtcgagagcccaaaaatccgacctttttcctgtttgataacgagcccaaggggaaccctttgtataattttgctaaccacgcccgcgacctcaaactggattctcagacgctcgacatactgcgcataaatgcggtcgatattttcgtgaagaacaatttgttcctgcttctcatacccctgctgtcagggaagtcatccagcgatattgaggacctgctcctggccgagcaatccatgcctattctgaacaacaagagcttctcgaagaacaataatgatgaaggtcgaaattcttactccaaggaaatactgagcaaatacatcctacgccattaccaaagctttaacttcaacaagttcatccctctatttgatgcactggagaaaaggattctcgagtataaagagagcaccaagtga

SEQ ID NO: 8569 - RNA, 1683 nt, unidentified
  source 1..1683: mol_type = other RNA; note = synthetic construct
atgaagaaaaaaaacatcctgtacaacgtcatttcaaagagagcattggcaaccgtgctgaatgtccagtataaaactctgacatatgttctgtacaggcggggagtggacagcttctacaatgggttcgagatacagaagaagacaggaggcacaagaatcattaatgctccacaaggtgaattgaaaaccatccagaaaaatctcgccaaaattctggaaaagtcgatcaacaatagctcaaacatttcccacggcttcatcaaaaataagagcatctataccaacgcagccatacacagaaacaaatgctttgtgcttaacatggacctccaaaactttttcgatagcttccattttggtcgtgtgcgcggattctttattaagaaccgcaacttcaattgtacaaatgaaatcgcgacgatgatagctcagatcgtctgttataaaggaaaactgccacagggtgccccttcgagtccagtcattactaatctggtgtgcgggtctttagattatcgcatctctaaactgtctaagaagtataagctggattatactaggtatgcagacgatattacatttagtactaacaaccgccattttatctgtgaatacgagaatttcctgaatgagattaccgaaataatcgagaaaagcggattcaagattaacgataagaagacacgacttaccttttcacacaaaagacagactgtaactggggtagtggtgaataaaaaattgtccgtgccgcgcgagtattacaaacagacacgagctatggccttcaacttttacaagaataggattgcttacttggatgagagcaacaagacgctgaaccagattgaaggccggttctcctacatcaatagttttgacaagctcaataacatcctagaaagcgacaagaataacaagaagaaaaacctgaaggatctgaacaaccgggaaaaggattacgccaggttcatcttctacaagtacttctacatgaattccaaaccactgattattaccgaaggcaagaccgatatcctgtatatcaaagccgctttaaaaaaccttgtagggtcatacaaggatctttacaacggtgagtttaagatcaacttcttgagaaggagtaaaaggtttgcgttcctgttaaagatttctactgatggagcagacaccataaagaacttctacaagaactattacaccaagcctgttatcaaagacctatcctttgactactttctggacttcggctattaccccgactgccccatcattatcctgctcgacaacgagcctgacggcaaacacccccttggcaaatttgttagctccgataaatcatccgagttgttagagcagctcagattgaatggctttatccggctcaataaggttcacaatgtctatctatctgtggtccccaaaaatcctgacaaaaagctcgaccgttacgaaatagaagatctgtttgacgaggaactcctccatatggagctcaatgggaaaaagttcaatcgagagggcctgaaggggtattatacgaaggacgatctttctaagtatgtgtacagtcattacgaggagataaacttcaacaactttaatgccatgttcgagaattttcggaatataattgtggactaccaaaagtggtatcttgccaatatcaacaattga

SEQ ID NO: 8570 - RNA, 1974 nt, unidentified
  source 1..1974: mol_type = other RNA; note = synthetic construct
atgtcatgccacgccctcttcatcatcatgaagtacacagagattaagaccatcattgatttcatcaaagccattaaagtgaacaactactcctacatcaattacctgctgtacggaattaaacccaataaacagtacagcctctttgaaatacccaaaaagaacggcgactctcggcagattgtctctccaaatcctaaactaaaaaagatccagaagcgcatttattcactgctgtggcagagatatgaagaggtgatgctgagtaagaccgggaagtaccagaaaactcccagcctatcccacggctttctgaagaataggagtatcataaccaacgcccagaaacaccgtaaccggaagatcattctgaatattgacctcaaggacttttttgattcctttcatttcggaagggtcaggggattcttcctcaaaaacaagtacttcaagttgcctgaagaggtggctactatattagcacagctcacttgctataacggaaaactgcctcaaggcgctccaacaagtcccttgatcactaatctgatctgtgagatactggactatagaattgtgaccttaagcaagaaataccgggttacttacaccagatatgccgacgatttaacgttctctacgaacaacaattcatttcttcagtcagtgagcgaatttatcattgagctgacaaacattatccaaaagagtggctttgaaattaacgattccaaaacgcatttgtctctgtataaccagagacaagaggtgacagggctgatcgtcaacaagaagatcaacgttcgccgtgagttttacaaaaaaacccgagccatggcccacaatctatacaaaaatggcgagttctacattgacgaaaataacaataagggctcgattaatcagttgcacggccggtttagcttcatctataacatcgagaagtacaataacttcctcagttacaaaaagtccctgtccaagaatagcgtcgaatatcaaaaaaacttgctatcccgcaacattgggataaagggtaacaatgatctctacaccaaattccttttacaggaacacgacataaataataccacttactactcccctgaacataataagcttttccttccaaaggatttctattcctacttcctgaaatacgaatctgactatatcaagtatctgagcgcaaaggagaaagaatatcagaagttccttttttacctgaacttctatgggaattcttatccaacaatcgtatgcgaaggtaaaaccgatcctctctatattaaggctgcgttgaaaaacctgtataaagattatcctgagctggttacgtatgacgatcagaagttcaccttcaagatcaactttttcaaaaggacatctgacaccaataaactcctgtttggcgtgccagagggaggtgggagtagccttaagttcctttataactacttctctgacattaagcccaagaataatactcaagaggatatttacacgaactacctggagtattttgagaatttgacactccacagcgcaatctcacccaccatcttcctgtttgacaatgagggcagcgggcaacccctgtctaactttatatgtcatgtggcaaaagacatccgcataccaaacaatgacctcgatgaccgcagaaaggagatgtactgtcagaaagtcaaaaagaacctttttgtactgagtaccccgaaagcggctcatgatacaaagtccgatattgagtccctgttaatcaacaagcccgttataaatggacgaacatttagctcacaggagtcatataaacgggaatttgagtacggtaaaaatgagctcgccaattatgtgctgaagaactacaagaacatcaatttcgagaagtttaagccgctcttgaacactatcagggaaattaacatctcgtacaagaaggaatacaataagctaaacagcaaacgagaatga

SEQ ID NO: 8571 - RNA, 1728 nt, unidentified
  source 1..1728: mol_type = other RNA; note = synthetic construct
atggagaatttgagcttaataaataccaagcggactctcgcttttcatttgtcaatcccatacaaatcgtttgtgtatcttctctaccatctagaccacccgtatagcaccttcgagattttgaaaaagaatggggagtctagggtaattaattcacctcacccgaaattgaagcggctgcagtataagataaaggatctcctggaaacacagtacaatctcatgatgaaagatcgcgtgtctcacaacgtttctcatgggttcatcaaagagaggtccatatttactaatgccaaaattcaccggaacaaaaagattgtgttcaacatcgacattaaggacttctttaagagtatccactttggtcgtgttaggggctttctgatcaaaaacaaatactttctgctgaacgatgaagtggccactactattagtaagctgatttgctacgaaggcagccttcctcagggagcacccacatctcccatcatgagtaacctcatcctgaacatctttgatatgaaagtcctggacatttgccagaaatattcagtcgattataccagatatgctgatgacttgacctttagctctaacagccggaagttctaccagtccttcggggatttctactatgagatcgaacaactgataaataagaacgggttcaaactaaatggaagtaaataccgagtacagttaaacaactccagacaggaagtcacaggcctggtggtgaacaacagactgaatataaagcgtgactactataaggcaacacgctctctcgtccataaatttctgttggaccagtccccaatcatcaacgagcaggttcttaatgctaatcaaattgagggtcgcctgagcttcatccattctatagagatttacaacaagaagatcgagtacaataaggaacgccaggagaaaagttataggaaggactttacgacatatttacacgattccgtgcttaatgctaaggaaagggagtaccagaaattcctgttctacaaccttttctataagccaaataacatcgtggtcttcccagaaggaaagactgacatctactacataaaagcggcactaaaaaagtattacaaggagtaccctgaactcgtggagttcaaggacaacaagtaccactacaagatcaactttattaagcggaacaagagactgtattacttttttgacctagccattgatggagccgatacaatgagcaagatcctgaattattactcctcaaaaccagggggcaaacacaataaaaaccccatcaactacttccagtacttcaacgaaagactcgatattcaaccctccaaacctgtggtgctgctttttgataacgaaggcaaagacaagcccctccataaattcataaatacggccaaaaagcaactggacatcgattcggatatgttaaagagcaaactgaatacctgtgacccttcccctgtaaatttgatcggcaatctgtatatccttaccattaataagctggaggcggacaaagagtatgagattgaagacatgataaaggagtataccgacaacttggtgatcaatggacgaaaatatctgaacaagggtgaaggcaactcaattagcaaaattgtcctcgcccaaaacgttctggagaattacgaaaccatcaacctcgagaatatcaagccccttctcaataagctgaagattctcaagaatctgtattga

SEQ ID NO: 8572 - RNA, 1680 nt, unidentified
  source 1..1680: mol_type = other RNA; note = synthetic construct
atgaacgattataaggctgcccgtgccgaagtcagcaggttattcggtattaaactgaagatgatcacctatgtcctgtataaaaaaggcgtggagaacttgtatacatcctatgatataccgaagaagaatggaggtactcgcgttatctacgctccagattccaaactgaataagatccagaaaaagatctcagagaaactgtatgagattcacatcaattacatgaatcaggaaaagatcaagtctactatctcacacggctttgaaaagaacaagggaataatcacgaatgcataccgacataagaataaaaggtatctggtcaacgtggatatttccgacttcttctcctcttttaatttcgggagagtgcaggggtacttccataagtcacaggaatttggattttctaaagaggtgtcgacaattatagcccaacttgtttgccataatggcaaactacctcagggggcacctacaagccccatcattagcaaccttatcttcaatatcgtggacaggcggatcttaacccttgccaaaaaatataaactctactacacccgttacgcagatgatatgagttttagcaccaacaataaggagttccaaaaggagtataaaggcttcatccaggagcttacagacctcctcgagaagagtgggtttatgataaatcacaacaagacccggtttgtgtattacagcagtcggcaggaggtcaccggcctaactgtaaacaataaaatcaatgccagtcgcaatttcattaaccaaacaagggcgatggcaaaccagctctacaaaaaggataacttccagatcaacggtaaagacggcacactagcacagctggaaggaagatttagctttattaatcagctggattggttcaataacagactcgaatataagcgaaccaataagaagaagaacaagaagtacatcagcgacttgaatgctcgcgaaaagcaataccagtacttcctgttctacaaatactttttcaagcccataaagcccactattgtgactgaggggaaaaccgatattctgcacatcaaagcggccctgatgaaatactgcgatagatatcctaaactgatcactaaatctgctgacggaaagtacgaattcaaactgtatttcctgaacaagactaaaagactggaatactttctggggatatatagggagggcgctgatacgatgaagaacatttggaacttctataaaggtgctcacggctttacgaacatattctcatatctctctaagaaatgccttggggattccttaaatcgggtaaatccagtgattttactctttgacaatgagcaggttacagataaacccttgcgcaagttcctcaaccatatcggaattaaggccaagatcaatccagacctcatgaaccttacagccaacctgtatctgcaaaccataagtctcataaacgactttgacgaatgtgaaattgaggacctgtacagcgaggatattctgaacatcatcattaagggcaagaagtttgaaaaaaccgtcgagaaggacaaggaagacacgttttccaaagacattttctctaagtacatcttggagcactactacgagattgatttttccaacttcattcctttgttggactcaatcaacgacgtgtgtaaaaccgactga

SEQ ID NO: 8573 - RNA, 1722 nt, unidentified
  source 1..1722: mol_type = other RNA; note = synthetic construct
atgaaaaattataaggatgcccggaaaaaagtagctggatggattaaggtgaaccaaaaggaattggtatatgttctgtatggtaagaaagtggactacttctacaaaagttttcccattccaaaaaagaacggtgaaagcagggtcatatatgcacctaaagacgagctgaaaatcatccagaagaggctttcacagaagctctatgaaacccaccgcgagtacatacgacagtacaggatcaaatcaactataagtcacggatacgaacaaaaacggaacattattaccaatgcccggaggcacaagaataagagatatctcctcaatattgacatctctgatttcttcccttcattcaattttggccgggtgcaagggttcttctacaagagtagagaattttccttttcgaaggaggaggcaacaataattgctcagctcgtgtgttataacgggaaattaccacagggggctccaacatctcctattatcagcaacctgatctttaatatcgtcgatcttagaatcctctctcttgccaaaaagtataaactttactacacgcggtatgtggacgacctgacattttccactaatcataagcgcttcaaggagacgtgcagcgacttcattaaagagctgaccgacctgttgaagaagaacgggtttgaaattaaccagggtaagacacgcctggaatactattcctccagacaagaggtgactggcttgacagttaacaagaaaatcaatgcctctcgtaactttattaacatcacacgggcaatggcaaatcagctgtatcgaaccgacgaatttcaaatagatggagagaagggatcgctggagaaactggaggggcgcttctccttcattaatcagctggattggttcaacaacaaactggaacacaaaataaagaagggcaatttcagtaagcgttataatagcggctttaacggccgagagaaacagtaccagtactttctgttttacaagtacttcttcaagccaaagaaacccactatagttaccgagggaaagactgatattttgcatatcaaagccgccttaatgaaatattcagacaggtaccccaatttgattgtgaaagaggacaatggcacctataagttcaagatctacttcctcaacaaaacaaagaggctcgagtacttcctaggcattagcgtggatggagccgacactatgaaaaacatctggaatttctatcacggcatggaaaactgcttcaacatatttaagtacctgtctgtcaagaacaataatgcaactcttgataaggctaaccctgtcattctgttatttgacaatgagcaggaaaaaaacagaccgctgaagaagtttttgaactacacgaagatcaatctcgaggaggctaatatttgccagaaactcaactttaacctgtacctacagaccattccccttatcgggaagttggataagtgtgaaatcgaagatctgtatcaagaggaaaccctgaatcttaccatcaacggtaagaaatttagccgtgacgccaaatttgatcagaaaatctatttcggcaaggcgatcttttctagatacatcatcgatcattacaacgagattgatttctccaatttcatcaagctactcgacagcatcaatcgcatctgtattaaagaccagaatgcgtacctggacataaacaacaaggtcttatccaactga

SEQ ID NO: 8574 - RNA, 1671 nt, unidentified
  source 1..1671: mol_type = other RNA; note = synthetic construct
atgaatgattataagattgcgcggaaggaattggctcgtctcatcagcgtggacctgaaggaaatcacctatgttctctacaaaacgggtattgagaatagctacgtaagctttgaaattcccaaaaagaatggggaatctagggttatcgacacccccaaggacaagttgaagtggatccagcgaaagctgtcggagaaactctatcagatgcattctgattatatgactcaaaacggtatcaaaaccaacgtgtcgcatggcttcgaaaagaataaaagcatcattaccaacgcctacagacacaagaacaagaaatatttgctgaatgtagacatctctgactttttctcaagctttaatttcggtagagtgcagggatacttttataagtctcgggaattcatgttctccaaagagatagcaacaatcatcgctcagctagtgtgttacaaagggaaacttcctcagggcgcgccaacttcaccgatcatttcaaatctcattttcaacatcgtcgacattcagatcttagcacttgcaaaagaatacaggttgaactacactcggtatgctgatgacatgagtttttccacaaacaacaaagtctttgagaaggagtacttaaacttcatacaagagttgtccgaccttctcggcaagaatggcttcgagattaaccagaataaaactagactggagtactgtagtagcaagcaggaggtgactggccttaccgtgaacaacaaaataaacgcctcccaaaaattcattaagaatacaagggccatggccaatcagctgtataagaccaatagctttcttattgacggcaaggatgggactatcaaccagctcgaagggcgctttagttttatcaaccagctggattggctgaacaataagttagagtaccgcaccaccaagaagaaaaccaataagaaattcatctccgggctgaacgctcgtgagaaacagtaccagtactttctgttttacaagtacttcttccggcccaataaacctacaatcgtgactgagggaaaaacagatatactccatatcaagagtgccctgatgaaatattgcgaccgatatcccaactttataacaaaggtggccgatggagagtatgactttaaggtatatttcctcaacaagaccaaaaggctgaattatttcctaggcatttccggagatggagcagacacaatgaagaacatttggaatttctacagcggcaagaacaactacgaaaacatatacgagtacatgaagaagaagaatcaggccgagtcttctaataaagtcaatccagtgattcttctctttgataatgagcaaaagtccgatagacctttgaaaaaattcctgacgtattcagatgtcaagatggacgatggtcagatctttaaacaactgaaagctaatctgttcctgcaaacgattccactggccaatgggctagaggagtgcgaaatcgaagacctgtatcagaaagaagttctgaacgtgatcattaacggaaaaaagttctgccgcaacgaagaggacgactctgaaaagtacttcggcaagcacatcttttcagtctatataatggagcactacaatgaagttgactttagcaacttcttacctattctcgattccatcgatagtctgatatga

SEQ ID NO: 8575 - RNA, 1650 nt, unidentified
  source 1..1650: mol_type = other RNA; note = synthetic construct
atggtggcaaagctgataaacgtagaattacgggctatcacatacgtgctttataagaaggggattgaaaagtcctataccagctttgaaatcccaaaaaaagccgggggcacaagggtgattgactccccaaacaaacagctgaagagaatacaacggcgtttgggcaaaaagatctatgacattcacaagaactacctggatcagaaccgtattgcatcaaatataagccatggttttgaagttggaaagggtattatcaccaacgcccgcatccataagaataaaaagtatctgctcaacatcgacatcgcaaactttttttcgagcgtgaatttcgggagggtacagggctacttcaacaaatcccaggagttcctgtttagtaaagaagtgagcaccatcatcagccagttagtatgttacgataaaaaactgccccaaggagcccctacctcgccaattatctccaaccttatcttcaacattgtggatctgagaatcctgtctcttgctaagaagtacaagctgagttataccagatatgcggatgacatgtccttttctactaataatagagccttccagactgactacattaattttattcaggagctccgcaatctgctcgagaatagcggcttcgaaatcaatgagaacaagactagattggaatattactcctcacgccaagaggtgactggactcaccgttaataaaaagatcaatgtcagcaggaagttcattaaacagacacgggccatggtggatcagctgttcaaagccaattccttttacattgacgatacttttgggacagaggaacagcttgagggccgactggcctttatcaatcaactcgactggtataataacgaattggagcctgagtccaaaaagcaaaaggctaataagaagtacatgtcaggccttaatgcacgcgagaagcaatatcagtacttcctcttctacaagtacttttttaagccctctaaaccaaccattgtgacagaaggcaaaaccgatatactgcatataaaggctgcgctaatgaaacacagtgatcggtatcctaacttaataacgaaaaatgacgagggcaagtacgtttttaacttgtacttcctaaacaagacgaaaaggctcaaatatttcttcggtatagtccagaatggggccgacactatgaagaacatctggaatttctataacgggaaaaacaactgcgacaacatcttcaagtacatcaatgataagagccagtatggagtcattcgaaacgtgaaccccgttatactcctctttgataatgagaaagaaccggacaagcctctgcggaagtttttaaatcacattggaatgcagtcaggaattgacaagccgtttctgaagctaaaggctaatctctatctgcagaaaatccccaggatcaacaattctgattgtgagattgaggatctgtactctaaagaggtcttgaacatttctatcgacggcaaaaaattcgaaaagaacgtcaaagacagtgtggaggacacattcagtaaggacatattctcaaagtacattcttgagcactaccaggaaatcgattttaaaaacttcctgcccttgctggatagcattaacaacatctgcaaaatcgagtga

SEQ ID NO: 8576 - RNA, 1677 nt, unidentified
  source 1..1677: mol_type = other RNA; note = synthetic construct
atgagcttgtataaaaatgctagagaggaggttgcccggatgcttaatatccatcataaagagctgacttatgtgttatacaaggttggtatcgacaagtcctacaaaactttcaagattcccaagaaaaacggaaaataccgcattattaacgcccctactgagaaactaaaacgcatccagaagaaactggcggacgaactctacaatatgcatatcgaatacctgcacaacaacaatatcaagtctatcatttcccacggcttcgagaagaataagtctatcataactaacgccaccgtgcacaagcgtaatcgatatctcttgaatatggacatactcgacttctttccttcttttaacttcgggagggtacaggggtacttcgaaaaatcacgcgagtttatgttttccaaagaagtctcaaccgttatcgcgcagttagtgtgttttaatggcgaattgccccagggtgccccaacgagcccccttattgctaacctcatatttaacattgtggacatgcagattctgcccattacgaagaaatataaactgaactacacccgctatgcagacgatatgtcattttctacgaacgattacaagttcaagcagaattacgtgtatttcatcgaggagctcacaaatatcctggagaaaaatgggtttggggtgaacacagaaaaaacacggttacaatactattccaaacgtcaggaggtgacaggtttgaccgtcaacgataagataaatgccaacaggaagttcattaacgagactcgggcaatggctaatcaactctataaaaccggaggcttcaaaattaatggcgaggctggcagtctcctgcaactggaaggcagattctctttcattaatcaactggataagtccaacaacaaaatgaatggggtgagcgggaataatagatatatcaacaagttgaacgcccgagagaaacagtaccagtatttcctattctacaagtacttctacaagccacagaaaccgaccatcgtcacagagggcaagacagacattattcatataaaggccgcacttatgaaatactgcgatatgtttcctaagctcgtcagtaaaaacgatggacactacgatttcaaaatttcgtttctgaacaagaccagtaggttgaagtatttcctgggcatcagtgagtatggggctgacgcaatgcttaatatctggaacttttacaccggcaataataacaggaccaacatatacaagaacatctgtgacaagagcatcagagataagaatgagaacataaatcccgtatttcttctgtttgacaacgagaaggaatctgacaagcccctgaaaaagtttctgggatcaaccaaaactgaactggaggatagggaaacactgaagctgttaatctacaacctgtatctcctaaccattcctcttgaaaagggtctgaaagagtgcgagatcgaagacctatattccgatgaactcttgaacatcataatcaatggaaagaagttcagcagaagcagcctggatgatagtaagaatcactttggaaagcatcggttttcaatctatgtgcttaacaactacgaacacattgacttcgaaaaattcctcccactgctgaatactattaactccgtcatcatcaacaacaataatagcaattga

SEQ ID NO: 8577 - RNA, 1524 nt, unidentified
  source 1..1524: mol_type = other RNA; note = synthetic construct
atgcatgccccgaaagataatcttaaatggattcagcggaagctgaacaacaaactatttgaaattcaccttgactaccttgaggataataacatcaagtctatcatctcacatgggtttgagaagggcaagtcgattattacaaatgcctcagttcataagcacaaaaagtacctgctgaacattgacattgcagactttttccctagtttccactttggtcgggtaaggggctattttcacaagtcgaaggagttcaactttagcaaagaggtttcaacaatcattgcacagctaacttgttataaagggaagctgccacagggtgcacccacttctcccatcatctccaactttatcttcaacatcgttgacctgcggatcctcaagcttgcaaaaaattacaaactggactatacccgctacgcagacgatatgtccttcagcaccaataacaaagcgttcaaaaaagattacctggccttcattcaggaactcaaggagctgttggagaagagcggcttcgagataaatcaaaataaaacccgcctcgaatactattcttcaaggcaggaagtcacaggtttgaccgtgaatgacaaaatcaatgccagtcgtacctttatcaataacactagagccatggctaaccagctctataagacgaatagctttcaaatcaatgggaaggacggtactataaatcagctcgagggaaggctctccttcatgaatcagttggactttagcaataacaagctgggatgcagaattactaaaaaaaaggcgaaccgcaagttcttttcagggctgaatgtgcgtgaaaaacagtaccagtacttcctcttttataagtatttcttccgaccagctaaacctacaatcgtcacagagggaaaaacagatgtgctgcatattaaatccgccctgatgaagtattatgaccgataccctaagttaattaccaaaacatctgacggcaaatatgaattcaaggtctacttcctgaacaagaccagaagattagattacttcctcggcgtaagttctgacggcgctgataccatgaagaacatatggaacttttacaccggaaaaaacaattgcgctaacatattcgagtacatcaacaacaagaatcagaatgagagtttagataaggccaacccagtgatattgctgttcgataacgaacaaaagagtgacagaccccttaagaattttctgaagtacctggacatcaaactcgatgatggacaaatatccaaacagcttagggctaacctgttcttgcaaacgatacccctcatgaaggggctagaggaatgcgaagtggaggacttgtaccgggatgaagtgctgtctgtgactatccatggcaagaacttctgtaggagcgccgaagatgactccgagaaatactttggaaagcacattttttccatgtatatcaaggagcactataaccgcattgactttagcaatttcctggagatcttagatagcattaacaatctgtgttga

SEQ ID NO: 8578 - RNA, 1752 nt, unidentified
  source 1..1752: mol_type = other RNA; note = synthetic construct
atgtcctcatacactttgttcctcttcatcatgaacaactatagagaggctaggcagtcggtcagtaaactcattggtatagagttgcggaaactgacatatattctctacgagaagaagacgcatagcttttatagcacttttatcatcccgaagaaaaacggaggcaaccggaaaatctacgcccccgatgacgaactgaagtgggtacagaagaaactggccaataagctacattcaatccacgcgcagtatctggaggacaataacatcaagagtgttatttcccacgggttcgaaaaggacaagaacattataagcaatgcgtacatacacaagaataagagatttgtcctgaatgtggatatctctaactttttcgatagctttcactttggccgagtgaaaggcttctttatcaagaacaaggcattcaatttcagtgacgaggagtcgacaattctggcccagcttgtctgttataatggcaaattacctcagggagcacctacctcccccctcatcgcaaatctgattttcaatatagctgatctgcagattctgaaactagctcgcgcctacaagttgaattatacccgttacgctgacgacctgtctttttcaaccaacatctcaacctttggatctgcctatagtctttttctggaagaactcagctctatactcatcaaaaacgggtttaagttgaatgaggataagactaggttgcaatttttctccagcagacaggaggtcaccggcatcacagtaaatcagaagttgaacgtgagtaagaagtttatcaaagacacaagagctatggccgacaaactttacaaaaccgacgagtttcagattaatggtaccaatggcaccttaaatcagcttgaagggcggttctcattcatcaatcagctggattggttcaataataagtgcgagtacaagattaacaagaaatcttccgagaagaagtatattcatagcctgaacaccagggaaaaacagttccaaatcttcctgttctataagtacttctacaatcccgataaagttactctcgtcactgaaggcaaaacagatataattcacgtgaaagctgcactgaaaaagtactacaataagtaccctgaactaatcgtgaaaaaaggtgacgaattcgagttcaagattaacttcctgaaaaggacagaccgcctggcctattttctaggtatcgttagtgatggagccgacactatgaagaacatttggaacttttacaccgggcataacaatcactataacatcaacgactacttagagaacaagagcctcaacaatataaaacaagtgaaccggaaaccatctattctgctgtttgataacgaacagatcaaagacaaaccccttgattctttcctgaaatacacaaatcttgagctgaaagataaccagatctccatcaagttaattagcaacttgtacctgcaaacgtttccactcatttccaatatgcgcgaggccgaaatagaggatctctattccacagaggtgttaaataccgaaatacgaggaaagacctttaagaaagacaagaagatcaacaagaacaagaagaaaaacagcgacaatgatactgaaagctccaataagcattatgggaaacacattttctcccaatatattaaggagaactacgcatcaatcgacttcactaacttcatcccactccttgattctattaacacgatcgtgatgaataacaaatga

SEQ ID NO: 8579 - RNA, 1455 nt, unidentified
  source 1..1455: mol_type = other RNA; note = synthetic construct
atgaaccggtacaaactggccagaaagaacatagcaaacttaatcgatgtcaaccccagtacacttacttacgtactgtatgtcgagaagatcgagcagtcatacaagataataaacatccctaagaagtctggcggaactagggatatctgcatcccttctcctcagttaaagagcgttcagagaaaactggccaatatgctgtgcaccaagcactccgaatatgtggtctacaataatatcaatcaggctgtgtcccatggatttgagagaaagcgatcaataataaccaacgcaagcaatcacaagaataaaaagtacctccttaacgtggatatcctggacttcttcgattctttccactttggccgcgttaaaggcttcttcaagaagaacaggaattttgtcttttccgaggaggaagccaccatcatcgcccagcttagctgctataagggtaaactgccccagggagctcccacatctcctattatcgcgaacttgattttcaacatagttgacctccagattctcaaactggctaagaagtatcgcgtgtattatacgcgatacgccgacgatctgtcctttagtaccgacatgaacaaatttaagaacatgttaccctcgttcctaaaggaactgaaactcctattggaaaagcacgggttcgagttgaacgatgaaaaaacccggctccaaacgagagagtgcaggcaagaggtgacaggcgtgacagttaatgaaaagctgaatccctgtccaatttttgtgcgtaaaactcgtgccatggctgaccggctatacaagactggagatatttacctggaaggttgtgtggatgatgaggacatttctctgaaaaaaaaacggttggaggggcgcttttgctttatcaatcagttcgactcctttaataacatgattgagtatgggcataacaatagtaaactctataagaagcaccaagcgaagttgaataaacgcgaaactcagtatcagaggtttcttttctacaaacatttctacaacccagacgcaccactgctggtgaccgaaggtattaccgacatcatccacattgagtcagcactgatgaagcattacgtgagatatccgcgactgatcaccaaaacagaaaaaggcttcgagttcaatttcaaattcttgaatcggaccgataaactcaagttttttttcgggattagcgaggacggggccgacacaatggtcaacatctacaattattacagcggtacaaactgtacgaacatcgataagatccttgaaaagaaactgccccctaaacaatccatgggaactaggaatccagtaattctcatttttgacaacgagcagcagggcaacaaaaaaccgctgaagaagttccttaactactcacggaagaagttaaatggcaatctctatagtcgcatttgtagcaatctgtactga

SEQ ID NO: 8580 - RNA, 1632 nt, unidentified
  source 1..1632: mol_type = other RNA; note = synthetic construct
atgtatataaacgaggtcaatgaccgtgaaaggttggcaatattgctggacgtgccgttacagaagctgacttacatcttgtatgtcaagaagactgacaattgctacaagcaatttcagatcccaaaaaaagatggtaccatgcggatcatttgtgccccgaatgatgagcttaaagtgattcaacggaagcttgccaatgagctgtggaagtatcacttatactatatggagaagaagaacatcgagtccaatatttcccatggctttgtaaaaggacgcagcattctgactaatgcaaacatacacgtgaacaagaagtacattgtcaacatggacattgaagacttttttcctagtatccatttcggacgtgtccgagggtacttcaataaatccaacgagtttaacctgtcagaaaatgtctctaccattatcgcccagcttacatgttatcaaggcgtcctcccccaaggtgctccaacatcccctatcctcgctaatctcctctgtaacattctggatatgaggctcctgaaagtgtgtgccaaatacaaagttgactacagtcgatatgccgatgatatgacatttagcactaacgacaaatacttcatcgtgaatcagtctaggttcatagacgagattgagaaggaagtggaggaattcgggttcaagatcaataagaaaaagacacgcctggacttctacagcagtcggcaaaatgtgaccggattgatcgtaaatcagaaaataggcgtggacaagaagtttagaaaagacacccgcgcaatggcttattcactctacaaaaacggagagtttaaaatagatggagaaatcggcagcgtttatcagttggagggtagatttgcttttatcgatcagattgacaagtacaacaacaaaagcgacatccagaaaaatatatggggcctcaattccagagagcgcgagtacctaaagttcctgttctataagaatttcttcgccactaacaagcccgtgataatcaccgagggcaaaacagacatttactatttaaaggccgctctccagaagtattacgtgcagtatccaaaactgattacgaagaaagatgagaagttcatctacaacattaacttcttcgaaagaaactccaagacccagtttttcttcaacattaaaaaggatggggcagatacgctcaagaacatctataacttgtacaccgggttaaacaactttcccaatctttacaagtactttcttgaagtttgcaagtatatccctaagaccccagtgatcctgcttttcgataacgaacagaaaactaatcggcctctgaagaatttcctgaagtacatcaactacaaagatgggaaattgattggaaagaaatgcctgattggcaatctgtatatcatgacaaaccccctagtgaaaaatctggaggagtgcgaaattgaagacctgtttgacgatgaggtactgaatgttgagcttgcggggaaaacgtttagcagggacaagaatatcgatctctcaaaaaagtttggcaagtctatttttgcggactatgttctgaaaaactacaagtcgataaacctagaaaacttcaagcccatcctggattctatcaatgaatga

SEQ ID NO: 8581 - RNA, 1686 nt, unidentified
  source 1..1686: mol_type = other RNA; note = synthetic construct
atgaagaacatcaaaacccgaaatgacttcgccaagtttatcggggtgaaattacagactctgacctatctcctatacattaagaagatcgacaactgctacaatactttggaaatccccaagaagaatggggataccagaactatttgtgtcccaaataagaatctgaagaaggttcagaagaagctgtataacaaactgtcgacctattatgatgaaatcaagacacagaacaactttacctcaaaaatttctcatgggttcgagaagaatagaagcattgtaacaaatgctgaagtgcacaaaaataagcgctatgttgtgaatctggatctgctggtctttttccccagtataaattttggtcgcgtgcggtcctatttcatcaagaacaactacttcgagattaatgacgacatagcaacgatactggcccagctcacctgttacaaaggaactctgccacaaggggcgtccacctctccattgatcgcgaatatgatatgcaacatcatggacatacggatcctgaagatcgcaaaaaaatatcgtctagactatacacggtatgctgacgacttgaccttttccacaaacaataaatacttcctcaacgattacgacaagttcctggaggacataaagaatattatccataggagcggctttgagcttaattctaagaagactaggctgcttttctctaatagtcgacaagaggtcaccggtttagtggtgaataaaaaaatttccgtgcctaaggagtattataaaaacacaagggctatggctcactcgttatacaagaatggctatttcctgattgatgatgaggtgggtacaattgagcagttagagggcaggttctctttcatcaatcagatcaatctctacaacatcgataacaagaagaagaatatgtggcacctcaactcaaaggaaaaacaataccagaagttcatgatctacaaaaccttttatgccaacgaaaaacctctgatcattactgaaggaaaaaccgacgtgttgtacattaaagccgcactgaagaaatactacaagtactttcccaacttgatcacaaaaaaagacaacggcaattttgtgtttcacgtgaactttttcaagcggaaacagaagcactcatattacctcaatcttgttaaagacggcgccgacactattaagaacatctacagcaactgttacattaagacgaagaacaacaagaacattacaacggtccatgattttaaaaagctatgcggggaaagagagacaaacccggtcattcttatctttgataacgagatggttagcaataaagaccgccctctgaagaaatttctcaacgagatcaaggtaaatgcctctcagaaagataaactgaaggaaaacctgtacataaacatctgtgataacctgtacttgtgcacttaccaactcaacaataaagaggcctgcgagattgaaatagaagatctttttcccgcagatgtcctggaacatgagattaacggaagaaagttctccaaaaaagatagcacgcacgacaatggcttctatggaaaaaacgaattcagtcagtatgtatacagtaattacgagagcattgacttctccaatttcataagccttctctcagctattaatgagatcatcgaactctatcctaacaacatctga

SEQ ID NO: 8582 - RNA, 1983 nt, unidentified
  source 1..1983: mol_type = other RNA; note = synthetic construct
atgtttttcaaggagattaaagacttgaaccatttgagtagcatcttgggaatcgacaggaatacactcaacaacctgctaaatcagaaatatcgtgagaagctttatgagacatactacattcctaagaaggatggaagtgaccgacaaatctgtgcccctaaagagcctctaaaatcgattcagaaaaagatcgcggagctactctggcagaatcaactgtgggttaatcataagaaggaagagaagtatatccaggacaaaaagatgttgcgagaagagaagtatcgaatacagacgttctctgagacactggaggatataaattccagttacaagctcaccctggagattaaaaaggactacagattccaaaacgacatcattcaggcttttgaaaagggaaaatccatcctgactaacgcggagatccaccggaataaaaagtacatcatcaagatcgaccttgaagacttttttgactctttcaccttttatcgggtgaagggttattttgaaaagaaccgggatttccagctgagcaaagaaatctccatgaccttggctaatctcgtgtgctataaatctaaattgccacaaggggccccctcatccccgatcctgactaatatgatcgggcgcattctggattctcgcattctgaaaatatgtaagcggtataggcttaaatacactagatacgctgacgatatgaccttcagcacaaacgatgatactatcactaagacactggatgacttcctcagcgagctggacaatgtgattgagaattccggattcaaaatcaatgagaagaaaacacgtgtgagctactggaattcaagacagctggtgaccggcttagtggtgaataaacgcgtcaatatcccgcgggagtattacaaggcaactaagggtatggcacaccagttatacctaggcaacgacgtacacataaaaggcaagaagattaagaagcccattaatcagttaaccggccgctttgctttcattaatcaggttgaaaggttcaacaacgaaagaaccaacctggaacaaacggaattctcatctaaggaaaagtcctttcaaaggtttctcttctacaagaatttctacggtgcagaaaaacccgtgcttataacagaagggaaaactgacataagatatatccgcgccgccctgaaaaaattacacgataagcacccatcattgattactctggaggaaggcgggaaagcaaagtataagctgacattcttcaagaaaagtgatgttattgagcagtacctggatctcaataaacatgggggaagtattttcgaaaagatttggaacctctattgcaacaatcagatctttaagaagaagaacttcaacaacgtctacgagtatttcaagaggatcgactcgaaatacaaatcccctgtaatcatgatctttgataacgaactggacgtcaaagactcaccaatccagcagtttataaacaagttcggctctaatgttaagatagtgtggaacaccgagtataaagagaacatccatgtcaaacttcaggagctgaaacaggccggcaagacccggcaacaaatagatagcgagattaagaagtttcagaaagactttacggagaataagaaaacccagcttattaccgaactcaggaagaaggattacgcccatttaaaggacaatttgtacctgatgctgatcccccttgtcaaaccaaatcagtctaagagtgatattgaagccctcctcctgcccgaagacattgagaaaataaaccagaagcttggtaagcaatttaatccttcagagaaggagtttattgaaaaggacaactactccaaagataaactgagcaagcaggtaatctataactaccagaacattagctttgagaactttgatagcctgttcaagaacgtggagaaaatcatccagcacaacttcctcaaaagagtgttcaaaaaatga

SEQ ID NO: 8583 - RNA, 936 nt, unidentified
  source 1..936: mol_type = other RNA; note = synthetic construct
atgattttcaaagagatcaaggatctgaatcatttatcttcccgactgggcatcgaccggaacattttgaacaacttgttgaaacagaagtaccgcgagaagctgtatgatgtgtacaatatcccgaaaaaggatgggagcgatcggcaaatatgtgctcctaaagaaccccttaaatcggtccagaagaagattgctgagctactgtggcaagagcagctgtggatcaatcacgaaaaagaggagaagtacattaaagacaagaaaatgctcagagaagaaaattttcgtacacagaccttttctgaagcaattgaggatatgaactccggctacaagctcactttggagacaaagaagtattaccggtttcagaatgacataattcaggcctttgaaaaagggaagagcattctcacaaacgcacaagttcatagaaacaagaagtatatcgtgagtatagacctgaaggatttcttcgattctttcaccttctaccgcgtgaaagaatacttcgagaagaatagggattttcagctgagtaaggaaatagccatgacccttgccaacctggtctgctacaaatccaaattaccacagggtgccccaagctcacctatcctcacgaacatgattggacgcatccttgactcccggattctgaaaatctgtaaaaagtataggctgaagtacactcgatacgcagacgatatgacgttttcaaccaatgacgacgttatcattaaaaaactcgacgacttcctaagcgaccttaacagcatcatcgataacgcgagttttaaaatcaatgagaagaagaccagggtgtcatattggaattctaggcagctggtaacaggactcgtcgtgaacaagagagtgaatacccccagagagtattataaggctactaactggactttctgcatccactga

SEQ ID NO: 8584 - RNA, 1053 nt, unidentified
  source 1..1053: mol_type = other RNA; note = synthetic construct
atggatctgaaggacttttttgattcctttaccttctacagggtgagaggctacttcgagcaccataaggactttctgttgagtcgcgagatagctatgaccctcgctaatcttgtttgttataaatctaagctgccgcaaggggcacccagctcacccattctcactaatatgatcggcagaatccttgattccagaattcgaaagctgtgcaaaaagttccggcttaaatatacccggtatgcagatgacatgactttctccacgaatgatgatgactgttttgcccgggtaaaggactttctccatgaattgaacatcatagtggaggatgcagggttcactgttaatgataagaaatcacgtatctgctactggtactccaggcagactgtgacaggattaatcgtcaacaaacgaatctctgtgtcgaagaagtactacaaagctacaagggggatggcccaccagctgtatataggtcgcgaagtgtatgtcaataaggagaaggtggacaacccaataaaaattctgtcaggtagatttgccttcattaatcaagtcgaccagtatagcgataatattctgggtctagagaggaatatatttagtacccgggagaagacattccagagattcctgttctacaaatacttctatggcattgaccgtcctatgctggtgacggaaggaaagaccgacattcggtatatccgcgcgtctctgaaaaagctgaataaaaagtttcccgagctcattaacttggagaatgacgggaaagccgaatacagcatcaccttcttaaagaaatctacagttcttgagaagtacctcggcctaaacaagcacggcggaagcatctttgaaaaaatctggaacctgtatctgaacaacaacctcttgaacaacaagaactttggcgacatctataattacttcaagaggatcggaagcccatacaaaagtcctgtaattatgctcttcgataacgaattagacgaaccagatcgccctattaagcagtttctggacaaaatccagaaaaatggatga

SEQ ID NO: 8585 - RNA, 1641 nt, unidentified
  source 1..1641: mol_type = other RNA; note = synthetic construct
atggaatttaaggacattactgacaagagactcttggccaaatttctgggcataaaatacaaggaactgacttacatcctttactccaaacgtaccgaaaatctatatcagaccttcgagatacctaaaaaaaatggaaagatgcgatgcatcaatgcccctcaagaaccactgaaatacgtgcagaggaatctggccaaacagcttatatcgatccaagagaagtactatctggagacgaacaacatcatacaaggctttaccaaaaaacgcgacattatcagcaatggaagctaccaccgtaacaagcgatatatcctgaatttggacctggagaactttttcgactcatttcacttcggcagggttaaaggctatttccagaagaaccagtattttatgctcaactctaatgtcgcgacatgtttggctaatatcgcctgctataaagggaagctgccccagggctccccctcaagtcctgtgattacaaatctgatttgttccatcctggatagacgcctcgcaacaattgctcagaagtatcgcatgacctatacccggtacgctgatgaccttaccttttctactaatcgcagagacttcttagaaaacaaggatgaactcatctccgagctctacgcagtaatcgataaatccggatttaaggtaaacaggaataaaactcgggtgctgttttggaacagcaggcaggaggtgacaggcttagtggtcaataagaagatttctgtcaagagagaattctacaaggagactagggccatgcttgatcatctgtacaagggtctgattgtcgagcacaatgggattgaagtttccttgcagcagattgagggacgactctctttcattaaccagatcgataagtacaacaataagcatgggggggagcgcaagaatgtgcaaaagggaatgaacgggagagagaaagagtaccagcagttcctgttctataagtacttcttttgtccttcaaagccggtgattgttacagaaggaaagaccgatcccgtatatattcgtagtgcgcttcagaaattctatatccaatacccaaagctcatccggaaaaaggaggatggttcattcgagtacctgattacattcctaaagcggactagcagactggagttttttttggggatccagcaagatggcgctaacgccatgaagaacatatataacgaatatgtgggcaacaaccagtatccaaatctatatgaacctcttcggaaatacgggctgaagtctagcaaccccgtgatcctactgtttgacaatgagacagtcaccaagaggcccttgaaggactttctcaatcacatcaataataagtcaggtatggactatcggttgtggctgaacatacatgagaacttatacctcgctaccatcccgctcgtgaaaggacagaaagaatgcgagatagaagacttattcagcgatgaagtccttagtcacgagattgatggcaaatacttcgaccgcaagggcaaagatggtgagaaaagctacagtaaacaaattttcgcatcttacatcgcccagaacatcagttccattgacttcacgaactttgttccactcctggacgcactgaacgaaatcgtgaaaaattga

SEQ ID NO: 8586 - RNA, 1710 nt, unidentified
  source 1..1710: mol_type = other RNA; note = synthetic construct
atgttgagaattaaagaatgtgataacgtgtaccagctggccatgtgcctgaacctgaatacggcagtcatcaccaacatcctctataatatcaaaactgacaactgttaccgccaattcaaaattcccaagaagaatgggaagacaaggactatctgcgcaccaaatgctgaactgaaaagcgttcaaaaacgcctagcgaacgcgctctactatgaactcaaactcatccgggaagagaacaacatcaattccaagatttcacatgctttcgagaagaagaagtcaattatctctaactgcgagatccataagcggaaaagatttatcctcaatgtggacctcaaagacttttttgatcatttccattacggaagagtctatggctatttcctgaagaacaagtacttcttatgcaccgacgagacggctcgcactatcgctaacatcgcatgttttcagggaaagctgcctcagggagctccaacctcacccattatcacgaatctgatatttcaggccgtagacgcaaggattctgcaacttaccaaaaaacaccacttggactatacacggtacgcggacgatcttacatttagtactaatgagcaggatttcatagagacttataacgacttcctaaacaagcttaccagacttatagagaagagcggatttgagattaatcagaacaagatccgaatttcgtgtcacgatagtcgacagaccgttacaggcttaatagtaaatgacaagatcaacgtgtgcaacgactattataaactggtcagggcctacgcccactccttctacaagaccgattcctttgatataaaggataacaacggcaaagtgattaaatctggcaacgccaaccaactggaaggtatgttagcctttacgcacatgatcgataagcacaataaaaccatcaagaagaatcctgctgagctgcagcattctttaaataaacgggaacgcgagtatcagcgcttcctattctataagtacttctaccacaatgaacgtccactgattatcactgaagggaaaacagatcagatttatctgtgctgtgccatgaagaaatattatagggagttccccgaattgattgaacaaagaaagtccggctttcactttaaggtgcagttcatgaaaaaaagtaagaggatgttggagatgttcagctttgtgcaggatggtgccagcgcaatgacaaccctgtatctcaactactacaagaagaattccaagtttcccgattattaccaatacttcagtcagatcacatgcaagtcagcctctaatcctgtcctctttatctacgataatgagctgtgttctaaggacaaaccactttacgagcttatgaagaaggagaagaaatccatggttgacaaaatagaaaaggacgggtgggtgtcaatgagcagcaaaaagaatttgtacattgtcaccaatccgctggtggacagtaaaaaagagtgcgaaatcgaagagttgtttaccactgagacactgcagaaggaaataaacggtaaaactttcagcctcgaaaagaattacgacaccaacgagcattttgggaaagacatcttctccaaaattattgctaaggagtacgagcagattgatttctctcggttcattccttttctggaacgaatacgtgatgccatcgtggactacaacaatacagaggcatga

SEQ ID NO: 8587 - RNA, 1695 nt, unidentified
  source 1..1695: mol_type = other RNA; note = synthetic construct
atgcagatgattaacgaagtcactacaagagatgagctagccgatctggttggaattccatataggaaactgacatatatcctgtacaagaagtacgtggaaaatatgtatacttccttcgagatacccaaaaaaaacggcggcagacggctaatcaattctcccaatgaagaactcaaatacatccagaagaacttagttaaagctctctacagatatgagcagacactgcttgataaggatataaatattcacagctcagtgtcgcatgcattcgagaacgaaaaatctatcttcacaaatgcccgtatccaccgcaacaaacgctttatcatcaatgtagatctggagaactttttcgactctattcactttgggagggtgagaggttactttctaaagaacaactatttccgactgaccgacgaagtagccacagtgatagcgcagcttacatgttataaagggagtctgccccagggagcaccaacttcgcctataatctccaactacatctgcaacatttttgacttgcgaatcatgaaactcgcgaagaagtacagaatgaattacactcgatatgctgacgaccttacgttctccaccaatgataaacactgcattgaatatcaggacgagtttcttttgaagttaaagaaggagattgacagggccggcttcagcatcaaccagactaagacacgcatttcttacaaaaacagccggcaagaagttaccggcgtagtggtcaatcaaaaaatctctatcaagcgtgaatactacaaaatcaccagagcaatggctgataggttgtataagactggggaatttttcatcgatggggagaaaggaagtatccatcagctggagggaaggtttgattttataaatcaggcggagtggtttgacaataaatacttcaagaagaagcggaacttctattccctgaacggccgggagaaagagtacaagaagttcctcttctacaagtacttctttgcaaacgagaaaaccctgatcatcactgaagggaagaccgatgtgatttatatcaaggccgcccttaaaaacctgtacaaagagtatcctgagctcgtcacgaggaacgagaagggtgagtatcaatacaagttcagtttcctgaaaaagagcaaacgcctggactatttcctgaatatcaaaaaagacggtgccgacaccttgaagaacatttatgcttattacagcgggaagtcagaggttaactacccagagtatatgacggaattcgagaatagtcagggaattcgggctcagaatgccgtgattatgctgtatgacaatgaactgcagcagaaaaccaagcccgtggcaaaattttgtaaagtgaacatgtccgacgatcaaataaagaagctcaagaaggaagaatatgtcctcctcaattccaacttatacctgatggtgacccctctgcaaaaaggcaagagcatttcagatattgaggacctctttcatagcgagttattgaaaacaaagcttgacggcaagatttttaccaagaatgacaagtacgataccaaaatctactatggtaaggatcgcttttcaaagtacgtcatgaaaaattacgccaaaattgacttcgaggcttttaagccgttgctgaataacataaagaagatcgtgtacgaatacaaaaagatagaggaatga

SEQ ID NO: 8588 - RNA, 1689 nt, unidentified
  source 1..1689: mol_type = other RNA; note = synthetic construct
atgaaaatgattaacgaagtgaagagcaggaacgagctggcggatctattaggcatcagcaggaaacggttgacatatctgctgtacattaagcacctcgaaaacatgtacacctcattcgagattcccaaaaaatctgggggccagcgtctcattaatgcacctaacaaagaacttaaactgattcaacgacgtctggcgaatgaattgtatgagtatcatactagactcaacaaggataagcagatcaacggggtgtcccaggcctttgaaaaagagaagagtatcttcaccaacgccaagatccaccgcaagaagcggtttatcatcaatgttgacctggagaatttcttcgataatattcacttcgggagagtgcgcggctatttgatcaagaacaaagacttccaactgtccgaggaggtagccacagtgatcgcacagttgacctgtttcaaagggagccttcctcagggcgcacccacttcccccatcatcagcaactacatttgcaacatttttgacctgcggattattaaactggctaagaaatacaagctgaattataccaggtatgccgacgatctaactttctctacaaacgacaagtacttcatggagaattgggaagcttttttaggcaatttggagaaagaagtcgaaagagccggcttccacctcaatgagaaaaagacgcgaataagttatgaagattctaggcaggaagtgaccggagtgatagtaaataagaagatcagcatcaagagagagtactataagaatactagagcaatggccaacaatctgtataagaccggtgaattctacattaacggggagaagggcagtctcaaccagctggaaggtcggttcacattcattaaccaggctgagtgctttggtaagaagattaactttcagcaactaaatggaagggaaaaagagtaccagaagtttctctttttcaagtacttttacgctaacgaaaagccattaatagtgacagaggggaaaactgatgttatttatcttaaggcagctctcaagaaaatgtacagggactatcctgagcttgtgacccgcgatgataaaggaggtttccattacaacctgagctttctgaagaagtcgatgcggctcaaaaattatcttaatatacagtcggacggagccgataccatgaagaatatctacctgtactactccaaacaatcaaataagaactacccgcaatacatcaaaaaatttgagaacatacggggttcacgcccacagaacgttgttataatgctgtttgacaatgagttgaaagaaaaagatcgacctatctctaagttttgtaaaggaacagtcaaggatgagcagaaagtcgagctgcaggacaagctccatatactgctggaaactaatcttttcctgatggtcacccccctcaaagagggaaaagagatttccgacatcgaggaccttttcccagatgaagtgttaaacatcgagattgacggcaagaaatttacgaagaaggacaaatacgacacaaaggagaattatggcaaagatcgctttgccaagtatgtcatgaagaattatgggaaaatcaacttcgacgggtttagaccactgttggataagatcaagttcatcatcatgcagtacaaggaaggagacaagggcgaaaaagagaactga

SEQ ID NO: 8589 - RNA, 1674 nt, unidentified
  source 1..1674: mol_type = other RNA; note = synthetic construct
atgttattgtcagagatacatacaaggtacgagtttgctcagctgctcggaatcgaactgaaggaattgacctatctgctttacattgagaaggttgaaaacctgtataccacatttagtatccctaaaaagagcggtggcgagaggtgcatcaatgccccccaaaagaagctcaaatatatccagaagctcctgaaggtgcttttagaatcatacgaagaggagatatgttgtgccaatcatattaataccggcgtggctcacgcgtttaagaaaagacggagcatcattacaaatgcccagaagcacaagaacaagaagtacatcatcaacattgatctcgagaacttctttgactcttttaatttcggtcgggtgagggggtttttcataaagaacaagtactggaaccttgacccaaacatcgccacgttgattgcccaaatatcatgctataatggggttctgcctcagggagcacctactagccccatcatcacaaacatgatttgtaacatcatggactggcacataactaaaatcgcccagaagtacaaattaatctacactcgctatgctgatgatcttacctttactaccaacgacaagaaaattgtggacaaatacgatgacttcctgctggagctgaatagagagatcgaaaaaagcggtttcaaaataaacaactccaaaacccgctttactaacaatcttaatcgacaggtcgtcactgggttggtcgtgaattccaaagtatctattaacagggagtactataagaagacatatgcaatggcccactccctttaccggtccggcgaattcaccattgatgaaaaaaagggcaccattaatcaactcgagggcagattctccttcatcgaccagattgacaaatataacaaccggatcgattgtaacataaagcacgacatttggcatctgaatcaccgcgaaaagaagtaccaggagttcctgttctacaagtacttctgcgctaacaatcgccctctagtgattactgagggcaaaacagatattatctatctgaagaccgcatacaggatcttgcgtcaggacgacacaaaattatttatcccggaggacaatgaaatagattacggcgtatcttttctgcgtaaatctgaccgactggactattttttcaacctgaaaaaggatggagcaagccccatgaccaatattcttgatagttatctggggaataagacgtttaaaatcagctattacgagcagctaatggcgaaatataaaataacgccaaatgctccagtcattctgttgtacgataacgaactcaataaaaagggagcagtgagagatgttattaactcgaagaagctggacatcgagtcactaaaggagaaaaactacatcagagtcataggtaatctgtatattcaagtggtacccctcgttaaagggaaggaagactgcgaaatcgaggatttgattacagaaaatgtggatgacctcatcatcgaggggcggcactttgaccgaaaaggaaaggccgacaaagaaaagttctacaataaagacgtgctcagtcactatatcgaggaacatgagaacgagttccatttcgattgcttcaaagagctgtttaagacctgggatctcattatcgaagattacaacagtctgaagtga

SEQ ID NO: 8590 - RNA, 1722 nt, unidentified
  source 1..1722: mol_type = other RNA; note = synthetic construct
atgaacttagaggatgtgtgtacacgcaacgacctcgccgattttctgggaattaagagaggcaaactgacctatatcttatacatccagaaagtcgacaccatgtatagtacctttagtatcccaaagaaaagtggcggtgaacgcacaataaatgcccctaatgacgatcttaagcagatccagcgtaaactggcagatgcactgtggaattatcaggtgaaaatatgggagaagaacaagatccagaccaatatttctcatgcgttccagaagagtaagtccattgttaccaattctatgagacacgtcaggaaacgatacgtgctgaacatcgatttaaagaacttctttgactccttccatttcggcagggtgcgggggtttttcatgaaaaatttgttctggggcatgaccgaggaggctgctacagtgattgcacagctgacctgctataagggcgccctgccacaaggtgcaccgacatctcccattatcacgaacatgatctgcaacataatggatatgcatctactgtctattgccaagagatacaagttgaattatactcgatacgccgacgacatgacattctccacgaatgataaacacttcatggaacactatgacgctttctataaggacctctcaaaagaagtattgggagcgggctttcagataaatgaagaaaagacacgcctgctgtacaatgactcccggcaagaggtcaccggactgatcgtaaataacaagatttccatcaaacgcgagtattacaaaaatacccaagctatggcacactcgctgtacacgaacgggttctttactataaacggggaggatggaactatcagccaacttgaaggacgcttttcgtttattgatcagatcgagaagtacaataactcccacgacggggccaaacatagtgccatttcactcaaccacagagaaaagaaataccaagagttcctgttctacaaaaacttctgtatcaaccctaagcccctaatcgtgaccgaagggaagactgatattctgtacataaaaagcgctctgaggaagatgtatctccagtatcctgatctcatagagaagaaagacaaccaatggatctataatctatctttcctgcatcggagctctaaactgagctactttttcgacttcaacgtggacggggcagataccatgcagaacatctataatatgtacaccggcagcggaaggactcacgttaattattacagacattttcgggagaagtacgatttaaatatgcatcagcccgtcatactcttgtttgacaacgaatttgagaattccgaaaagcctattaagaagttcatgaacaacattggtagcgataaaaagggcaagaataaggccaagggcgaatccaaacagcgtgagacatcacttcagaacgagctgtttctgcaccttattggtaatctgtacgtgcaggccgttccacttgctccatccgagacaagcggagaaatcgaagatttgctcgggaaaaatattctcaacatggagattgacggcaggaaatttgaccgaactggtaagaaagataagagccggttctataacaaggacattctctcaaagtacatcctctctcactatgaggagatcgacttttcattgtttatcccccttttcgacacttttaggaaaatcaaaaacgactacagcgatcagaaaaatacttga

SEQ ID NO: 8591 - RNA, 1695 nt, unidentified
  source 1..1695: mol_type = other RNA; note = synthetic construct
atgtcctataatgaggctagaaataatgtggccgaaaaactcggtgtaccaccaaaactgttatcgtatctgtttagacgtgggatcgataagttctacaaagagatagaaatccccaaaaaaacagggggactacggaaaattatgatcccccagaatcagttgaaatctgtgcagaaggagattctgaaaatgctacagaagatttacatcgagaacaacgtggaaaccaccttctcacatggtttcgagaagaacaagagcataatatctaacgcgaggatgcacaagaacaagtatctggttttgaacctggatctggaggacttttttggatcattccacttcggcagaatcaggggctactttgagaagagtaataatttccagctgtcccatgaagaatccgctgtgctcgcaaatcttatttgctacaaaggatttctgcctcaaggggcctccaccagccccattatgacaaacatgatctgtcattttctcgacttgaaactgcactacatagccaagaaaaataagttcacatacacgagatacgcagatgatctgaccttcagtagcaacaatattaagactgagtctgaatgcgaacaattactgttcaacatcgagaagcagatcaagaaagcgggatttaaaattaacaagagcaagactcgcctgcaattccgcaatggctctcaaaaggtgaccggactcgtcgtcaacaaaaaagtgaatgtgaacaacacgtattacaagaccacacgggccatggctaataaactttatagggagggctccttcaatatcaatgggaataaagggaccgttaatcaactcgaaggccgctttagtttcatagatcagctcaatttcgagtcaaacaagaacgacaaatctatgtctaccgtgaaacacgggttttcctggggcagcgacaaccggaaagactatctggtgaacagaagggagaagagttatcaggagttccttttctacaaatacttttacgcaaacgagaagcccatcatcctcacagaaggcaaaactgacatcacttatttaaaggccgccctgaagaacatgtatcaggattatccttctcttattgagaagaaagatggcaagttcaactttaaggttgaattcatgaagcgcagcaagaggttcaactacttttttggttatttcgaagggggaaatggtatgaagaatatctatcggttgtttttccactcaccgtacaagtactatgaaaagttctacaagaagcgccagattgagaatcacaaccctgtcttccttatatttgacaatgagctagtcgacaatcttaaacctttgcggtcgtttattaactttacgaacctcaatacgaacgataatatccggtttctggaagagcagcactacctgaacctggacaaaaacttatatgctattactcatcagctcatgaatgacaagtccatgatggagattgaggatctttttctggaagacgtactgaacgtccgactcaataataagagtttcaaccgaaaggacaatgcagatagggagtccactttcggcaaaagcagatttagcgattacatcgccgaacattacaagaccatcaacttcgaaaactttaaaccaatgttggatatcatccgtaacatttcagacaatgagaaaaacattcgactgtga

SEQ ID NO: 8592 - RNA, 1677 nt, unidentified
  source 1..1677: mol_type = other RNA; note = synthetic construct
atgaactataacgatgctcgcaactctattgccgacaaaattaatgtccccccgaaactgctgagttacatcttcctgactggtatcgataagttttacaccgaaattgagatccctaagaaaaatggaggcgttagaaagatatctatcccacagaatcaactcaagtccgtgcaccaggaagtcctgaagtttctgcaaaagatctacaagaactcagatctggccaccgtattttcccatggtttcgaaaagaataagagcatcataacgaacgcacaggtgcacaaaaataaaaggatcgtgctaaatatggacttggaggatttcttctatagtttccattttggacgtattcgggggttcttcaagaacaataagttcttcaagatgactcacgaagaggccaccgttctttccaacctgatctgctataagggagtactgcctcagggcgcagcaacttccccaattatgactaacatgatctgccactttatggacctgaaattgcagcatgtggcgaagaaacataagtgttcttataccaggtatgctgatgacctcacattttcgaccaataacaagaacacagttgagaactacaaagagctcatcaaggacatcaaaactcaaatcaacaaagccgggtttaagattaatgacgacaagacgagattacagtccaaagagaattcacagcgagtgaccggcctggtggtgaacaaaaaagtgaacgtctctcactactattataagaagactagagccatggcagagagcctatataaaaccggcaagttttacatcaatgaccaggaaggggacattaagcagctggaagggcgctttagcttcatcgatcagctgaattttgccaataacattcaagggaagaaagatggcaccggatatcacggcttctttacaacaggcaatgacggaaagatagctgtcaacaatcgggagaaaagctaccagaagttcttattctacaagtacttttacgccaatgataaacccacaattctcacagaaggcaaaacagacatcaagtacttgaaagctgccttaaaaaaaatgtacctactgttccccaacctcattaaaaaaaaggagacggggtttgaatttaaagttaacttcctggaaaggtcaaggcggttcgatttttttttcggttatgtggagggggctgagggaatgaaaaaaatcttcgagctctatttcaggaagcccttctattactacaacgagtttcaacttaagcgtacctttccaaaccagaagccagtcttcttgatttttgataacgagctgaagaataacaagaaacctattcggaagttcattaacttcactaatggaaatgtggagctgaaagtctcaaaagtggaatctgagaatttcttgcatatagacaagaacctttaccttatcacccaccagcttatgaatgacaaggacgagatggaaatcgaggatctcttcagcacagacgttctcagtgctaaggtagatggtaagatctttgatcgcaatgataatgcggaccgatccaagacttttggcaaagcagtgtttgccgaatatattaccagaaattaccgcaacatagactttagtaacttcatacctatgctgcacagaattagcgaaatcataagcaacacctga

SEQ ID NO: 8593 - RNA, 1911 nt, unidentified
  source 1..1911: mol_type = other RNA; note = synthetic construct
atgaaaaataagaacaaggccaacgatataaagaagttcgtcatggacaatatcaagatcgataccattcggcattccgacgattatcttccctacttctattacttgtatcctcagtgggctcccgaccataccaaaattataaataccctcgcgaatatcagtgcctcttattgcaacgtgagtattcctaagaagataagtggcactagaaatctttctgtaccaaacaagtttctcaaacccttacaggagtttgtgaagcttctgatcacgaatcagttaaagtcgaacaatttctccttttccccaatcgctcagggttttatagaaggtcgaggaatctacactaacgcccacattcaccggaacaagaaatatatacttcacctcgacctcaaagatttctttaccagtattcactttgggcgtgtatcaggcttctttataaaggacaagaactttaagctgcagcctcacattgcttattttttcgcaaacctctgctgccttgatggagttcttcctcaaggctctcccacctccccaatcatttccaatctgatcgcgcaacatctggacaaaaaagtcctgctgctcagcaaaaagtaccatttcaccttttctcgatatgcggatgacctcgtgttcagcaccaatgacacgaagattatagtgaacgaattgccgaatttcctgaattctatcaacagcatcgttaaaaaccaagggttcgaaattaattgggataagctttcactgatggggccagatgtccggcatacagtgactggactgtccaacaacgtaagagttagcgttaccaaaaatttctatctagagacgcgcgctatcagcgagaatctgtatgtgtcaaactcgttcttcgtggacaataaattatttctagggcacagcgacaaatccattactgagaatctgaaaatcgtcgaagggcgcttcgcatttatctacgatatcgagaaaagaaacagacagttttactccaagaaaaccttcgggaaagctctgcagggcaaaaataacaataactaccagccgaatcacaaaattactttcctggagagcaagaacaagaaacagggagcttctgatatcgggcagaatgcctttaacggcaaaatttgggcctatagcaagttcctcttctacaagtactttatatacggcgacaagcttactattttctgtgagggaaaaacagacccaatctacctcaaagctgccatgggcgcactaggctataataacgcagtgacaatgtactccattgaaacatggctcaacgaaaagaacgtcttcgtcaatttatttggactgcccatgggaggttcaggtctgcagaaactgatctattattttttgacacccatcaagaacagtaagagttattacgatttcttcgagaagaagaccttgagcatgaaacctgtggtgctgctggtggactatgaattgaagaaagacaaaccactcaataacatcattaacgccatttgtattgccaagaagctgagcaataatgagaaggtgaaattaaagaacgagattgagagcgatctcgacaagaacggctactacttcttgggtaataatgtttacatcgccgtgacaatagattttaactccaagaaggacacagacagggccatcgaagagtactttcctacaaatactctgctagatattgaaggaaatcaaactcgccacttcggcgatgagaactgtaaagtcatcaataagaacaagcacctgatctctaacaactcacagcccatggagaaaatcgacttcgcaatctggtctttgaaccataggtacaataggaacctgtttatcgggtttatcaatatcctgaacatactgattacctcagaaatgaccatttga

SEQ ID NO: 8594 - RNA, 1983 nt, unidentified
  source 1..1983: mol_type = other RNA; note = synthetic construct
atgaacattaagaaaatcagcctgaaaatctctgacttttctcaccgtgattctttcatcagcaccctggaaaaatataaaaagcattttggcaccttcgatgtgcaatctacaatccagaatgccagcgccctgtactcggaaaaaaagattcccaagaagatatctgggttcagagttatctccattccctctcctgagctgaaaattatccaggtttttgtgaaagagctgatcgagaatcagttggagtactttgattacaagttttcagtcgtgaaccatgctttccaaaaggagaagtcgatttatactaatgcacaggtgcatagaaataagaagtacattttacacgtggatctgaaggatttcttcagcagtatacacttcggccggatatctggatacttgagcaaaaacaagaactttaagctgccatcctatatggcttattttttcgcggacatttgttgtttgaatggcattcttcctcaaggatccccagctagccctgtgatttccaatcttatcgcagaaaatctagataagaaggtcctgtccctgtctaaggaataccactttatctatactcggtatgtagatgacctagtgtttagcaccaacgacacagcgataatcatgaactatatgcaggatttcctgtacaaactgaatgctattgtcgagaatcagggattccacataaattgggaaaaactcaacctcatgggcccagacgtccgccataccgttaccggtttaagcaataataagagggtgtccgttaccaaggacttttaccttaccacccgtagtatcgccaataacttctattgcacaaactcattctactccaaaggcatcttgtacagcggttacgagtcgtccgaccgccagaagaacctgaattttatagccgggctgttttccttcatctatgatattgaggttaggaacaagaactttcacaaagagaagacttatggtgagagcttgcaggggctcaaccacaataattatcagccccgacataaagtgagcatggagacgaacaattctctgagtgaccaaatttttaacgggaagatcttcctttactccaagttcctattcttcaagtatttcctgttcggggacatcatcacagttttcactgaagggattacagatcccctctatctgaacgctgccataaaaagtttggattaccagaacgaagtggaactaattagtattcaggagatgcagaacaaagagatggtgtttcctaaactgtttaacttaagcaggggcggctcagctcttcgcagactcattgactactacaacgacaccgtgaaaaatggcaagacatattacgacttcttcaaaaacaagatggtccctctcaaacccgtagtgctcctgttcgactacgagattaaaaagaataagccgttaggacaggcaatcaatctcctcctgaactacgggcacaactcacagacggtagaggatgagctgcgggaaaatggtttttatttcgtaggagacaatctgtacattgcaactacagtcaattttaacgacaaaaccgacgatgatcgagccatcgaagactatcttccgatccaatttcttggagatgtgaatggagatcatactagacacttcgccgatgagaagtcaaaattctttagggaaaagaagatcgcgatcagtgaactgtccaccccaatgtacaaagaggaactcgcccagactgtcctgaagaagacgagtgacatcgtcatttttaaggacttcagcatgatactttcaatcttttcagagattcgcttaggctacatgaataaagtgatagactgcatcaacgaggatcggattaacacaatctataacatattggactccaaatctgcaagtgaaatcatcgacaaaaacactgagctcaagaaaaagtttgacgaaaagctctcagatctgctgaaaatccatgcctga

SEQ ID NO: 8595 - RNA, 2088 nt, unidentified
  source 1..2088: mol_type = other RNA; note = synthetic construct
atgaagcatttcgagtatcatagacagaagaagatatctgactttcattctagggacagttttatacacgaactccatatcgtctcttggatcacagacgaaaggaaacaattgttcagtaggttgcttaattcccctggcaatttttacaaggagttttcaatccctaagaagtatggagaaggtgaacgtatcatcgacgccccaaatgaggatctcaaatctctgcagatcatcataaagagtctcatagagaatcagctgaaggtgaaagagttcgtattcgggaagtatgaccaggcataccagaagaacaaaggaattttcacaaatgcccagatccacaggaacaaaaaatatcttgtgcacatcgatctggaaggattctttccgtccatacactttgggcgcgtcagcggattttttcagaagtcccggctgttcaaattggagcccccaatggcttttttctttgccaatctgtgctgctacaaagggcatttacctcagggggctccgacctctccactcatagctaaccttataggtgagaaactggaccgggaggttctcctcctgtccaagaagtttagattcacgtacagtaggtatgcggacgatttgacattttccacgaacaacgtcaagagcatcaccaatgactttcgatctttcatggacgcactgaattacatgatcgaaaaaatgggcttcaacatcaattgggacaaggtgggaattgaaggacccgatgttcgacacacagtcaccggacttagtaacaataagagagtgagcagcaccgttgatttctacaaattaaccagggcaatggcaaactcattatatgtcgacaacgagtttttcgatgctaaacggtcctataacgcctacactcagaagagcctcgagaaagcaattcaagtgattgaggggcgctacgccttcattaacgacattgaggataagaacaagaaactgtacgaacggcattccggcggcgaagaatatcagagtattacccccaccgactttagggagcaccactacatatcctccagattgaatggcgtctcaaaggagaatctgccagctatttatagtggcaagaaactgtcctacagccgctttttgttttacaagaaattcttagccggggatgcgatgactgtattcactgaaggcaaaaccgaccctatgtatatttccgcagccatgaaggccttgaccccaaacctaaagatcacctttacgattccccaagtggaaggggagaaccagactcagttcgcaaatctttttgacctcaaccgaggcggtgcctccttacggcgtattctggatatctatttcgggattagcacaggtggccacgccagcatcagccatcccctctacttcgaaaaaaagatcatctcaatcaagccatgtgtcctgcttctcgattttgaattcaacgatggccagcagaaatctgagaaagccaattctaagaagaaaaacagctcttcaccccacccgcttgtggttgttctgaactacatttttcaaaaccgcagaatcgctaagaaaaaggccagcattatcaaggatgaccttatcaaaaatggcttctatttcgtggacgagaatctgtacattgctactacaactgatcggtcaggcgacaaaacaaatcgagccatcgaagattacttccctgctagcttcctgaatgatccttatggagatggtacaaaacacttcgagaatgcgcccatgctgaaaaaagacaacgggttcaaggacagtgattctctgagaaagtacgactttgctaaatatgtgaagacccaaactgagactgtggacctatttaaggatttcaacgtgctgtttgacattttcaataacattcgcaaggactacaatcgtagactactgaagaagatcgcggatgtatcgacaaattataccatactggcaaagaacacgatgtaccgcattctggatagcgatatcctacggaaagagattgcccatgactcagatctgaaccagctcttcttcgacaactataagaaactctttgatgtgtcgtcatactga

SEQ ID NO: 8596 - RNA, 2025 nt, unidentified
  source 1..2025: mol_type = other RNA; note = synthetic construct
atgaccaagttcaagtataatagggagaaaaagatctccgattttaaaactaggctatcgtttgtgcgcgaactgtattctattggtctgaatagcatcgacattttcaaactgtccaagaacataaacaactactacacagagtttactatccctaaaaagtacggcaccggcgtgagaacgatttccgcgccgctgggagacttgaagcaaatccagcagatcattaagaaactcatcgagaatgaactcacctattgcaattacacgtttgggaaatacaatcaggctttccagaagaataaaagcattttcaccaatgctcaaatccatcgtaacaagaagtacattatccatttggacctaaaagacttctttagttccattcacttcggccgcataagcggatacctgcagaaaaactccaaatttcggctgaccaaggacatggcctcattcattgcaaacctttgctgttataatggcatgctccctcaaggcgcaccgacgtcaccaatcataagcaatctgctgggggagtctctggatcgaaaactactgaaaataagcaagacttaccatttgacctactcgcgatacgccgacgatttagtgttttctactaacgacgagaaaattatcgcacaaaagctttcagaactcatagaagttatctctaccagcgtcaagaaaagtggctttcagctgaactgggacaagcttaattttatgggtcccgacgttaggcatttagtaaccggactctctaacaataagcgtgtctcgagcacaattgacttctataagaataccagatccatggcccttaacttctacgtgaagaatagcttttacgccggtaaacatttctacaacgggtatactataagaaaccagcaacggtcaatgcaggtgctggaagggcggtatgcttttattaacaacatagagagccaaaatcgcaggctgtatgagaatcacctgtccggtgcagagtatcacgccatcacaccacaggatttcaaagacagacacaatttgattaaggccaaaaaacacgacgaaccctccttttcaggaaaagagctgagttacagccgcttcattttctttaagaagttcttgttcggcaataacatctccgtgtttactgaggggaaaacagatccacgctatatccaggccgccatgcgggctttaaacagtgatatccagctggaagtgacatcttttcagactgaaagcgaccttaacacccagttttcaaagatgtttaacttaacgcaggggggaacatctctgaagcgaatcatcgatctctataagggcaccaattatcaatacgggaagagggcgctgtctgcctactataactattttgacctcgataacagtaagatcaagtttgttcccatgaaaccatgcatattgttgctggatttcgagcttctggggcctacatcccccttgcagacaattatcaataggttaatgggcgcaagaaaaaacagctacacaatcgactcaaaagagaacattcagaagaatcttaaggagaagggtttttattacatcttcgacaacctctacatagtcacaactattggctcaaatgataccgaaaatcagaagaacagggcgattgaggattacttccctaaggagtttctggccgatatctataaggatggaaccacttgtttcgaaaatgctgaaaacaagtctgataacagtcggaagctcatcagtaagaatgattttagcattctgatcgaatccaatttcttcaacgatcctgagattttcaaaaatttccagatcctctttgacatattcggaaaagtccaattcgactatctgaataaactcctaaaccggattgataacaaccccagtgctcagcacgtaattttcaacatcctcgactctaatttcattcggaacatcatcaacgaaaatcactccctgcgcgagaaatttctgatgatcttcaacaagtacttccttagaaattaccagaaatga

SEQ ID NO: 8597 - RNA, 2010 nt, unidentified
  source 1..2010: mol_type = other RNA; note = synthetic construct
atgagctataaaatctcggacctgaatacaaagaacgacatcattaactatctgatgtccaccaagtcaataagctccccgaagattttttacaagattttgaacgacgtgtccgctcactacagcgacatctacctaaagaaaaagtattcaaacgacgttaggcacataaatgccccagatgagcagctgaagagcatacagcacaagattaagatcttgatcgaaaatcagctttcttacaagaactacaagttcaacaacatcagtcaggcctatcagaatggtaaatcaatctttacgaacgcccaaatccatcggaacaagaagtatgtcttgcacttagatatttgcaacttcttcgacgagattacgtttaaaaggattaatggctttctgcagcacaattcaaaattcatgctgaactacaccgtatccactattatgactaagctttgctgctatgacggccacctgacccaaggttcccctgtctcacctataatcagtaacttgctgggggagaaaattgatctcgtgctagttaaggttgctaagaaataccatttcgtctatacacgatatgccgatgatctggtattctctaccaatgatacgtacaccattaatgaaaagttgaccgagttcataaacaaggtgtccgagataatcaatagccagggctttagtatcaactgggacaaactgagcatagcaggccccgatgtcaggcatacagttacaggactgaccaataataaaaaagtcagtgtccctcttgaattttataaacaaactcgggctattgccaatcatttctacatttacgacgagttctacaataatcagcaaatctaccgcgactgttatgtgaaaaactttaacaagacgccaatgaagattatagaagggagactcaaccacatctacaatatcgaaaaccagaatcggacactctattctgaccacctgtccggatttgagtatcaggccattacacctattgattacaagcgtcatgtgttcagccccaccgaaaacaaggagactcacgaggtgatcaatgaattttccggcaaagagcttgaatactccaagttcatcttctataagttcttcctttacggggattttatcacactgttcaccgaaggcaaaacagatcccctctatatcaagaaggcgaaaaagattttaggcatcgatgatttcgatctgaaaatttatgacgcagatactgagatcaacaagaaaagcattttcagccgcttattcaatctccataccggcgggaaaagcttgattaagatctttgagatctacgttggtagagcgaccgaccagcacttcatcaattactctaaatacttcgaggagaaaacattctctataaaaccaacagtgctgctctatgactttgagctgtatagtcgcaattctcccctaggaaatttcatcagcatcatttgtggaaagaagtataagcattacggatttaagagaaacgtgatcatcaaggagctcaaaactaaaggattttacagggtctataagaacctctacattgcagtgactatggattttaacatgatagggcttaatacccaggaagaggatataaaaagatcgatcgaagactacttcccatcacaactcctgagcaatactaatggtttaaacaccgagcattttgaaggggtgtccgctccgaattctcacagtgtggtgattgataagaaccagtttagtaagcggatccagacctataccgataagaagatcttcaacaactttaacaacctcttcgacatatttctggacattcagaaagactacctgtctgtgctgctctcccgtttggacaaatctaacttagacaatcccgtagaaaaacgcatggtgattaattgtctgtaccgaatccttaattcaaataagactctgcagctcatcgagcaatttaaactaaccaaactgtttatggacgtatacaacaaaaactttctgtga

SEQ ID NO: 8598 - RNA, 1998 nt, unidentified
  source 1..1998: mol_type = other RNA; note = synthetic construct
atggccaagaaattgtcggacattaccaacaagaaccagctcattcaagtgctgatagtagcacatgccattaccaatggaaagactttctataacgtgctgaacaatattgacaaacattataccgagttcagcattccaaagaaatacagtaatgaactgaggacaattaacgcacccgactccgagctgaaaaaaatccagaaacaaatcaaacggcttatcgagaatcagctgttaagcaagaagtattacttcaacatcagttctcaagcataccagaagaataagtccatctttacaaacgcccagattcaccgtaacaaaaaatacatcctccatttcgacatagagaacttctttgacaatatcacattccgaaggattaatggtttcttccagaaaaacaagaggtttaaactgccctacaacatttctaccattcttactcggctgtgttgctgcaaaggccacttggtgcaaggcagtccgatctctcctattatctctaatctcattggcgatggcttggattacaaattacggaagctgtccaataagtaccacttcatatacacacgatatgctgatgatatgatattctcaaccaatgatagcaagataatcacgaataagctgcaggaatttatgaaggacttgcaagatattatcgagcaggagggtttttctctgaaccagagaaaatataccctgatgggcccaaatgtaaggcactatgtcacaggacttaccaacaacaagaaagttgccacaccgattgagttttataagagcactcgggctatggctaatcacctgtataagtacggggagattaatgtcaatggcaaaatctttgactccaattcttaccctagtcctgtgaatattgtggaggggcgccttaaccacatttatcatatcgagcaggagaaccgcaagttatatcaggaacacagcgcgggatttgagtattttccaataacccctctcgactaccagaaacatactaacaagttgaagatcaacaacgatactggctcaatcattaatgaactctcagggaaagaactggagtattctaagttcatcttctacaagaacttcttctatggggactacataaaagtgtttactgagggaaaaacggatcccaggtatataaagaaggcctatagcatgctgcgtcccaacgacaactcaatcagactctccagcgtcgagtcactgctcaatcacaacaatatcctcaccaaggtttttaacctgcaccaaggcggggatggattgaccgatattttcaatatgtacaccgggaatcagtctaacgagaataaatacttcaactacacgcagtacttcaatctaaagactttacccatcagaccaactatcatcctgatggactttgaactgaacaacaagaataagacatcccctctcaacaactttatcaacaatatcgtgaacacactgctcgggggaaaaggtcgcaataaagaaaaggagaggaacaaaatcaagcaggaactgaaggaaaaaggatactatcggatctactcaaatctgtacttagccgtcactacagacttgattgaaataacatcccataccgaaaacaaaacaatagaccgcgatattgaaaattacttcgatattgacctggtgaaagacatgtttcagagaaacatgatccacatcaaagacattagaagtgtctgtaaagtgagcgagttgatcaataagaatgagttctcgaagtccatcaaaaagattaatgatgctaccaagttcacaggttttcagaacctaataaccatcttcagcaatattcatcttgactatcttgaactggttctaaacaaactcctactgacccgagataatccactcatctacacgcagactatcaagaagattaagtccagtaactacatcatacatatgatcaccggcaatcaaaagcttaacaatctctataagcagcttaacctgtga

SEQ ID NO: 8599 - RNA, 1821 nt, unidentified
  source 1..1821: mol_type = other RNA; note = synthetic construct
atgctcaacgaagctaaaaccatcgacgaattggctgcatgtatcgagatgcagccctggcagctgaagaaggtgttgtatagcgggggcggcgccaacacaaaataccgccaattcgaagtgataaagaaaacgggggggataagaaaaatcgatgctcccgagcaaagtctgaaacacgtccagaagcggatcgcggccaagatcaatgaccttctggcacttgagaaaggtgatgcaccgttcgttccccttagtcaggcttaccagaaaggccatggaatttatactaacgcgcttgtgcaccgtaacaagaaactagttctgaatatcgacatctctgacttctttccgagcctgcactttggccggatagctgggttctttatgaaaaataagaacttcctgctgtcaaaggaggttgccgtatcgatcgcccagctaacctgccataatggtgtgctcgctcagggttcagccctgtctcctgtgattagcaacttaattttccaggccgtcgatcaacatatcctgaaggtaactcgcaagtacaagcttacctacacccgctacgctgatgacatgacgttttccactaacaattttggcttcttgaacgagctggaggagttcgtaaaaagcatcgaaagccagattaaagccgatggattttcgatcaattggtcaaaaatgaggctgagtggaccagacgtccgacagacagtgaccggtctatcaataaacaagaaggtgaacgtttcaaaacagtactacaagaatacccgcagtatggccctgtccctgtacacaacgggcttttttcatgtcgatggacagaggtatgaccagaacatgctgagtaaactcgaaggcagattcagctacattaatgacattgtacggaagaacaacctcctgtatgaacagtattcctttgaatatctggcgacacgagctaacaataagtctaggctcctgaacgagaagaagtccaaaccatctttgcaccccgaagcattttcctcttccgagaaagcctacaggaacttcctgttctacaagtacttctataagaacaagaagcctctgatagtgacagagggacatactgacgcgatctatttaaagaccgccataaagaacctgaagatcagcaacttaaatctcgatttcttgaagagatcaaagatgaccaagtatttcttcggctttattaaaggtggcgactccctcaaaaatattgcaaatctgtacctcagctctcagaaaagcaacgtgaatatcagcaacaagatgtataattacggcgtgatcccagaccaacctgttatcttactcctggaccacgaaatgcataagaaagaaaagaaggattctccactccttcctctcgcaaattacttgaagggggtgtccaagttccctgagattgaggatttcttttgcgaactccacaaacacggatttatccacctaacctctaatttgtacattgccgtggtcagtaaaaagggcactaccaaagacgatatctatgagatagagaatctgtttcccaatactctgttaaacgatgtttttggtatggggacatttgagaaagtgtattccggaaaagggagaaaaatcgacaagaatgatttcgcactgattattaggaaacactggaacaacgacatttttcagggattcaaggtgatgttggatgtgattgataaggtctgtctcgactatgagaaaagaaagcaacggatgcttgaaaaacgtcaaaatgacgagaagaaagccgtgaaggtcgggaatacaaacaataaactttga

SEQ ID NO: 8600 - RNA, 1755 nt, unidentified
  source 1..1755: mol_type = other RNA; note = synthetic construct
atgtatctcaatgaagccaaaactatcgacgacctcgcggagtgcttggaaattaagacctggcagctgaaaaaggtgctctatagtcacggcggagccaacaacaagtatttccaattcgagatcacaaagaaatccggaggcacgcggaaaattaatgctcccgagaaaagcttaaaactcgtgcagaagaagcttgctacaaaaatcaatgatcttctgcatgaggagaaaggagaggcgccttttacgccactgagccaggcataccagaaaaaacacggaatctatacaaatgggctcattcacaggaataagaatctggtcctcaacatagatctccttaatttctttccaagcctgcatttcgggagggtggtaggattcttcatgaagaacaagaaattctccctcaccaacgaagtttctgttgcaatcgcacagctgacttgccatgatgggatgctggctcaggggtcaagcctgtccccggtgataagcaatctaatctgtcagtccattgaccagcatattctgaagattagcaaggagtacaaattgacgtataccagatacgccgacgacatgactttctcaaccaacgactttaacttcattaatcgactggaacagttcgttaagctgttggaaacccagatcaaacgggacggctttgatataaactggagcaaaatgcgcttttctggtcctgatgtgaggcagactgtcacaggtctatcagtgaacaagaaggtgaatgtcccctaccaattttacaagaatacccgatcaatggcactgtctctatataccacagggcattttactatcgatggccaagagtatgatcgcgataaattgtacaaactagagggcagattcagtcacataaatgatatcgactggaagaataacctgttatatgaacggtactcctttgaatatcaggctatgcgcccaaataacaagtctcaccttctgaacggtaaaattagtaccccctacctttaccccgaagctttttccagtagagaaaaggcctatcgcaatttcttgttctacaagtacttcttcaagaacaagaagccgcttattgtgacagagggccataccgacatcgtatatctgaaatccgccattaagaatctgcagagaaacgatttgaacgtggactttctgaaaaggtctaagtctaccaagtacttttttgggtttatcaagggaggcgattccctgaagaacattagcaacctctaccacaatagttcattgatgaacatctccaacaagatgtataagtacggtatcaagccagaccagcctgtgatactccttttagatcacgagatgtacaaaaaagttcagaaggatagccctttaatgcccctcgccaactattggaaggatgtatcgaaattccccatcatccagaacttttacgacgaattacatcaacatggcttcatacacctcacttcgaatctgtacattgccgtggttagtaaaaaaggcactacaaaggacaatatcttcgaaattgagaatctgttctcagactatgtcctggataaggtcttcggcctgggaacatttgagaaaaaatacaaagggtctgggcggaaaattaccaagaacgacttttcactgatcatccgtaagcaccaaaaggatagcatttttgagggtttcgacaaaatgcttgacataatccacctggtgtgtgtcgactatgagaagcgttctggacagcaatga

SEQ ID NO: 8601 - RNA, 1833 nt, unidentified
  source 1..1833: mol_type = other RNA; note = synthetic construct
atgaatctgaatgaggttaatgatgtcgtggacctcgccagagtgttacactatcctagcaggaaaataaagaagattctttacagggacagggttgataaccaatacttcgaatttagtctcgccaagaagagcggtggctcccgacttattaatgtccctaacgaagtgctcgccgacctgcagaattgcattttgattgagctgaaacgctatatgaacaatcatgacatcaaattcagccgcgtgtctcaggcttaccaaaaggatcgcgagaaaggaatctacaggaatgctcgaattcaccggggaagaaagtacgtaataaatgttgatctcgaggatttctttccctccattcattttggacgagtggtgggcttctttgaaaagaacaacaagttcaagttcacacacagatgtgctatcttgctcgctcagctggtttgctataaaggctatctgccacagggagcgtccacttcacctctgatcagtaatctgatctgtcatactctggatatccacattttgaagatagcaaagaagtatcaccttagatattcaaggtttgctgacgatcttaccttctccacaaacgacgatgaaattagcacggaagaacaaatgcacaattttataaaggagctgacaaggcagatcgggcgtgatgggtttaaggtgaactggaaaaaaatgcgaattgccgggccggacgtacgccacactgtaaccggtctggtgaataacaagatcgttaaggtgaagaaggagtactacaaaaatacccgcgctatggtgaaccagttgttttatactcaccggttcattattgatggcgtcaagtacaatatcgaaaacgacgagtcaaaaaaaggcgggataaaaaagctggagggaagactcgcattcattgacgatataaaccggaggaataatatcgaatatctggacgatatcaccaagaaagccatgacacgggtgcagaatccaaaacggtacgacaaatttagtgcgttcgagagaatgtacagacagtttctcttctttaagaacttctggcaaagaaacacaccgctgatagtcaccgagggcaaaacggacgtgttacatctgaaagaggcaatcaagaattctgatattctccttcccaacatttcgttttttaaaccttcctcccggttcgacttcttcctgggaattgggtttgacggggccagcaagatggacaagtttatcaacttgtacatcaaggagaattccttcgagaacctatcaatcaaatttcggaagatagatgacatcaagaaagaaaacgatctgtttggactttcgggggaatccaaacccgttattctactcttcgaccatgagtttgcagacttagagtctccaataaacatgttcatcaataacctgagcaaagaccgcacctacaggcatattgagagtaagaagatcgaagaactcgagaaatatgaaagcgagaaacagaattctaacgccattaaaaagttcctaaagaagaagctgaacgaaaatggcttcatccacttggtcgataatctgtacgtcctcgtcatcaagaaagacgtgccatcaatcaacgaaaagtatgccattgaaggtctataccccattgaggtcgtaaataacgtgtttggtctgggcgtgctggaaacctatgccgacaacaattttgagaacgtgcttagcaaaaacgatttcagtaaaatcatccgtcataagcctgcagagatcttccgtggcttccggcccactttatcttgcatcgaggagatcttgaaagattctgagaaccgcaacaattga

SEQ ID NO: 8602 - RNA, 1695 nt, unidentified
  source 1..1695: mol_type = other RNA; note = synthetic construct
atgaagttcaatgaattgagaaacaggaatgacctggcatcgatcctgaaaatacctaaaaaccagttctcataccttctctacaagctaaacgtgaataagcagtatgagaaatttgagatccccaaaaaatctggtgggactcgaacgattcatagcccgaacgataggctaaagtatatacagaaacgcttgaacgaggagattcttaacttcatcgacgatagcgattatccaaagagcaaaatttctcatggatatgagaagggcaagagcatttcaacaaatgcttcagttcacgtcaagaagcggtacgtcttgaatatcgatatcgaggattttttcgggtctatcaactttggtagagtgcgtggattctttaacaagaacaagtttttctccctgcccctggaggtgtccactatcatcgctcaaatctgctgtaaagacggggtgttgcctcagggagcgcctacgtcccctatcattagcaacctaattggacataccctcgattacaggatcagcatcttagccaagaagtacaaaatgaattactcaaggtacgtagacgatctgactttttccacaaatgagaaaaacttcgagttgtatctcgagaattttctgagcgaatttgacgcacacctgaataatgctgggtttaaacgcaacaagaagaagacgcgtctgcaatataagcggagtcggcagagtgtgacaggcgttatagtgaatgaagatctgagtatacccaacgatttctataaaaacacaagagccatgctcaacgagtttattaagaacgagaagttcttcattgacaaaaaggacaactatggcactctcaatcaattagagggccgcctgagctacataaaccacttcgagaagatgaaaaatatgcggaacgccaagaataaggaagttaacaaaaagaaccacactaagttctccaccaaagaaaaggaattcaagaagtttctcttctacaagaacttcatcatcaacgacaagcctctcattattaccgaaggtaaaactgacgtactgtatctcaaagccgcgttgaagaatctgcattctgaatacccaaatctgatcgaaaagaaggataatggcaattacgacttcaaagtgaaattctttcagcgaagtaagaggaaccggtatttttttatcatttccaaagacggagctgatgcaatgaaaaacctcgtagacttattcatcgataagcgcagtaataatgtgaatgagtgcgtcatgaccaaaattaaaaccatgcgcaaaacaaaagccctgaaccccgtgatactgctgttcgataatgaaatggtcaccgatagaccgctcaagaacttcctgaatttcatcaaaatctctccagaagatcgacttaaatttggcctgtccctgaatacctgtattagcgacaacttgtttttactaaccaacgatatccccctgaaaaagaaggacgttggtgaagccgagattgaagaccttcttccagagaatatactgaatcacgtcataaacggcaagatgatgaattatacaaacgggaaggacaaacagtcaatttctaaagactttctgtccaaatacgtggtgtcaaattacgagaagattaacttcgacaagtttagaccccttctcaattcgcttaactctatcatcgagaattactga

SEQ ID NO: 8603 - RNA, 1677 nt, unidentified
  source 1..1677: mol_type = other RNA; note = synthetic construct
atggtgatttccgatattgaaagccgggaacagctcgccttccttctcaacatccccctgagcaaactgacctatctgctatacgtgaaaaaaattgacaactgctacaccagtttcgacattaagaaaaagaataacggagtcagagtaatatccgctccaaacgaagatctcaaagatatccagagaaaacttggatatctgttggagtcacatcataaggctttcctgaaggaaaaaaacattgacaacaagatctcccatggcttcgagaagaacaagtccattattacaaatgctgcggtgcaccgcaataacaagtacattctgaacatcgacattaaggatttctttgactctatccactttggccgggttagagggttcttcaacaagaacatcgagttcaatttaccgctggatatggcaactgttatggcacaactggtttgttacaagggggttctgcctcaaggcgccccaaccagccctatcgtgtcaaatctgatatgcaacattctggacatccgaattctcaacctggtcaagaaatataggatgaattatacccggtatgctgacgatatgactttttcaacaaatgacaggtgtatcgtcgataactacgacggaatcctcgaggagatagccaatgagctggataaatttggcctctacataaacgacaaaaagaccagactaatttacaaggattcgcgccaggaagtgaccggactggtggtcaacaaaattatcaacgtaaaccgggattattgcaaaaaaactagagccatggctgaaaatctctaccgtaaaggttctttttacataggggatgaggaagggtctataaagcagttggaagggaggttcgcctacatcaatcagctcgacttttataacaacaagcgaaaaggcgaaaaaaaagactgctggcacttgaattctcgcgagaagaattatcagaagtttctgtattaccgctattttttcaacaacgagaagcctcttatagtgacggagggtaagacagatatcctttacttgaagtcagcactcaagaaaatgtatgactcttatcccaatctgatctccaaaactaagaatggcttcgaatttaaagtgagctttttgaaacgaagcaagaggctcgaatatttcttcaatatcaatcaggatggtgcagacaccataaagaatgtgttgaacatgtacaccggacagaaaggatttgcgaattactacaagtacttcaaggacaaaagtgagaaagacgggcgtaatcctgtgttactgatcttcgataatgagcagaagacagataggcccctaaaaaagtttaagaaagacgccaagatccaggatgtgaacatcaagaattggattaacatcttagggaacctttacctggtcacaaatccaattgtgaatggcaaagacgagtgtgaaattgaggatcttttctccgagagtactcttaatacgttgatcggtggcaagtcctttagccggaactcaaaaagtgagaacgacaaatactacggcaaggccattttcgccgattatgtcatgaagaactatcagaagatcgactttagtaactttgtacccttcctggacagcatcaatagcgttttagatgactaccaaaagaagaatctgatccaatctcagtga

SEQ ID NO: 8604 - RNA, 1827 nt, unidentified
  source 1..1827: mol_type = other RNA; note = synthetic construct
atgatgtcctataaagagattgactcaaagcgcaaactggcactatatattggagttccagtgaaacagttgacctggcttctttacgttcggaaaatagaaaactgctacaacaactcgtttagcattaaaaagaagaacggggatgaccggattattaatgcacccaacaagtctttaaagtatgtgcaaagaaggctggctcggttactgctcaaacgactgaatgaggtctacgtagaaggtaacatcatcaataacatatcccacggctttttcaaggggaaaagtattaagacaaacgctgtgccacataggaacaagaagtacattctcaatatcgatctaaaggacttcttcgacagtatccattttggcagggtgcaagggttcttcaaaaacaacaaccactttaagttgcctgaagtagccaccatcatcgcacagctgacctgctacgaaggcaagctcccccaaggcgctcctacatcccccgttatcagtaatctgatttgccaaattctggactacaaaatcctgagcctctgtaagaagtaccgacttacttacaccagatacgccgacgatctcaccttctctactaatgacaataacttcaaggacaactattccaactttttaagcgagcttgataaagtggtcgtacggtcaggctttgagatcaatagtaacaagatacgcttccaggagttcaattatcgtcagacagtgaccggcctaactgtcaacaaaaaagttaacgtgcgacaggattactacaagcggaccagatctatggcgcactctctgtacacgactgagaaatatgagatcaatggaagaaatggtacgattaatcagctggaaggaaggttttccttcataaacgatttggtgaagtacaataacaggctggttgaacaaaatagtctgagactcaactcaattgagtataagaaaaaccttctctacacacaagactcagagtttgtgaatcggacaaataagaacccttggaagaccaatttaaacagcttgagcattcgcgagaaggactatcagaaattcctgttctacaagtatttcattgccaatccccagatcactttcattccagaaggaaagactgatgaaaagtacataaaagctgcccttaaacgttactacaaggactatccgaatctggtgaagaaggtcgggaagaagtttgtctacaacattactttcatcgatagaagcaagcgctggaaatacttttttggcgtgctggaaggaggtgggtccgatctctatcagctgctaaattattttaccaacgccgagaataggacttgtcgcaactatctgtctcattttaagtcaatcatcccaaatcccccgaaaaaacccgtcattttcttactggacaatgagttcgataagaaaaagcccctcaaccagtttataaaaaagctcctgattgcaaatggactggattccaataaaatcgagagcacggtgcatgaggagtatctgtataacattgaccttaatgcgtttatcatgacaattccattcgacaacatcaaaaacgaggatgataaagagatagaagacctgctggatatcgaaaccataaataacgaactcatcagcaacgaatttgacggcaaaatcttcgacaagaataagcagcacgatgatcctaaatatatagggaaagagatcttcgccaatacaatcttgaagaaccacaactctaaattgatcgactttacccagttcaaacctcttttggacctcatcaatcagctgtccacaaattacagccagtttcagaacaagtga

SEQ ID NO: 8605 - RNA, 1848 nt, unidentified
  source 1..1848: mol_type = other RNA; note = synthetic construct
atgcagtattccgatattaagtcgatcagaaccctcgcttatgcgttgggcgtgcaaaccaaacaactgacgggactactttacgggatcaaaattgaaaactgctatacctccttcaaaatttccaaaaagaacggggacgaacggaccatcaacgccccaagcaaaagtttaaaatatgttcagaggcgactgactagactgttagtcaagagacaggaggagttcttcttggagagaaacgtcaaaaacaatatttctcatggctttagcaaggggaaaggcatcaagacaaatgccgtgcctcacaggaataagagatacgtgctcaatgtagatcttgagaacttttttgagacgatccatttcggtcgagtccagggcttcttcaagaataacgagtactttaagttgcctgaggttgcaacaattatcgcgcagatagcttgttatgaaggtagcctgcctcagggagcaccatcttcacccattatatccaacttgatttgccaaatcctagattaccggatcgtccatctctgtaagaagtaccgacttacttacacccgttacgccgacgatttgacgttcagtactaatgacaaaaacttcgaggacatgaaagatgaatttgaggatgagctgaaaaaggtgattagtcgtagcgggttcatcgttaattccaataagactcgctttcagaaaaatgactcaaggcaaatcgtaacaggactgtctgtgaataagaaaatcaacgtgacccgcgatttttataaaaagactaggtctatggccgataaactgtatcggaatgggtccttcactattaatgagaagaacggaaccatcgaccaactagagggccgcttttcatttatcaatgatctcgtgaagtacaacaacagactggatgaactgaacagcctcaagagcaatctgatcgaatataagaagaacctgctctatactgaagagcggaaatataagaacgataatgacaacaaccaggtgctcgattgggaacggaatctgggcaatctgaacataagagaaaaagactttcagaagttcctcttctacaagtatttcattgccaatccgaaggtcacagtaataactgaggggaaaacagactcaaggtacattaaggctgccctacgcgagtattacctcgaatatcctaacctgataacaaaggatgaagggggcttcaagtacaatatccactttctcaagccgtctaaacggctgcgctatttttttgattacatgtctgggggaggcggaggttttgtccttattaaccttatggagttctttagcggaaaagattcaaggaccaagcgcaactacattaagtacttcaactcaattctgtcggagaaaacattaccccagaagccaaccctgtttctggttgacaatgagtggcagggttccaaccctttaccaggtgtgatcggcaaattagtgaaggacaaaaatctggagaggaaagatattgaacagaagatcaagagcgactttctctaccacatagacttgaatgctttcgtgataaccctccccgttgaatccgtcgactacaaaacaaacattgagatagagaacctgtttaatcttgaggaaatcaataacgagcttatcgcacccaactatgacggcaagatcttcgatcccaagaagaaaaatggcgacaacaaaaagaagatcggaaaagaaatcttcagcaactacattttgtctaactacgacagtgaagtgatcaattattccaagttcaagccactgttggacctgattaataaactgagtgaagactacaccaaattcaaggacaataaatga

SEQ ID NO: 8606 - RNA, 1833 nt, unidentified
  source 1..1833: mol_type = other RNA; note = synthetic construct
atgaattatgaggatattcatagtcgcgatatgctggcattcgctctgggaatacccattaagcaattgaccggcctgctgtacggggtcaaaatcgaaaactgctacactaccttcacaattagtaagaaaaacggctccgagcgaaccatatcggccccaaataagtcactgaagtatgtgcaaaggaaactggcccggctactccttgagcgctacgaggagtttctcaccgaaaagaacactaataaccgcatctcacatgcttttttcaagggcaaatccataaagacgaatgcattacctcatagaaacaaaaggtatgtgctgaatgtagacttgcaggatttcttcgactctatacatttcggaagagtccacgggttcttcaagaacaatgactttttcaaactccctgacgtggcaactgtgatcgcgcagctgacatgctatgagggcgtgttacctcagggggcgcctaccagcccaatcatcagcaatctcatctgtcagatccttgactacaagataatcgagctttgtcaggaataccacctgacttatactagatatgctgatgatctgaccttctctacaaatgagaagaactttgacaacaactatcaggattttttggataaactcgacaaactggttacccggtccggttttaaaattaatgccgagaaaacccacttccaggaatacaacggtcgccagactgtaacagggcttagtgtcaacaaaaaactgaacgtgaagaagggtttttacaagcatacccggagcatggcccactcactctacaagacgggcaagtttatgattaatggcaaagaagggacactaaatcaactcgagggaagattcagcttcattaacgatttagtgaagtacaacaacaggttggaggagcttccatccctaaaactgaactcaattgagtacaagaagaatttgcagtttaccgatggaaaggaatttgaagttaagaagaacgagcagaagcaaatcctggactggaaaaagaatctatctacactgagtatcagggagaaagactatcagaaattccttttctacaagtacttcattgccaataccaatatcacagttgttactgaggggaaaactgactctaaatacatcaaggccgctctgcgtaagtattatgcagaatatccagaacttgtaacaaaggagaaggacggctttaagtacaagatcaattttctccccaggacgaagcgaatgagatatttctttggtttcctgtctggaggcgggtccgatcagattcagctcttcaactacttcattaaccgtgataatcacatcagccggaattacatcaagtacttcaaagagatcagcgaagacgtgccgctgccgcagaaaccaactgtgtttttgctggacaatgagtgggagacaaaaaagcccctccacaatatcataaaagtgctgtgtagtgctcaaaacctgaacaacaaagacatcattcagaaaatccacactgattatctgtatcacgtggatctgaatgcctttcttatgacactgcccgtcgacaatttaagccctaaatgcgaagtcgaaatcgaaaacttattcgacctggaaaagattaacaccgaactcattgaacccttgcatgacggaaagaagtttgatattaaaaaggagcacgacgatgataaatcaataggcaaagagatctttgccaataccattctcaccaactacgattccgagattatagacttcagcaactttaagcccttgctggacaaactctccgacatctctaaggattttacaaagtatacgtga

SEQ ID NO: 8607 - RNA, 1866 nt, unidentified
  source 1..1866: mol_type = other RNA; note = synthetic construct
atgtgcaagtattcaagtattgatagcaaagaagctctcgcgtccaccattggtgtgagcgtgcgccagattacaggccttgtttacggcatccgaattgacaactgttatcactccttctatattagcaaaaagtcagggaaaaagcgacaaatatcagccccaaataaatcgttaaagtacgtgcaaaggcggctgtgccggctgctaattgagaaattgaacgacttctatctggagtacaacataaagaatcagatcacccatggattcttcaaaggaaagtcgataaaaacgaatgccttgccgcacagaaacaaacggtatgtgcttaatatcgaccttaaggatttttttggcagcattcatttcggaagggtccaagggtttttcctcaagaataactatttcaagctgccaaaggtggctacacttatcgcacagctgacttgttacaatggcaaactacctcagggagccccgactagccccattatcagtaacctgatatgccagatcctggactacaagataatcatcctgtgtaagaagtatcggctgacctatactaggtatgcagatgatctgacattctccaccaataataaggtctttagcgagaactatactctcttcttggaagagttaaaagatatcgtcaccagcagtggttttgacatcaatgccgagaagactcattttcagaaattcaacagcaggcagaccgtcacaggactgagtgtgaataagaagttgaacgtgcaaaacgacttttataagaagacacgcagcatggctaataccttatataagactggtgagtttaccatcgacggaaaagagggcaccataaaaaaactagaagggcggtttagtttcatcaatgaactcgtaaagtacaacaacagacttgtggaagatcggtcactcacctcaaacatcatcgagtataagaagaatcttctgagaacacaggagaaattatttagactgtccgaccgtaaaataaagaccctcgcctgggacgagaacctgcgctcactgtctatgcgtgagaaggactaccagaaattcctattctacaagtacttcatcgctaataagaaaactacactgattacggaagggaagacggatccacgctacattaaagcagccttgaaacattactatagcgattttgcgggtctggttagttccgacgggaacaactttaaatacaacgtaagtttcctctcccgttccaatcgcatgaggtacttttttgggtttaaagaaggcggaggcggcgagctccagaatctgctgcgattctttaccgagggcaacacagttgagaaccttttggagtatttcagaaaaatcatccctctcaaaccctctaagcccgttattttccttgtcgacaatgaattctctaaagatgacccactctactgcgtggcaaagtttctcaagaacaaaatccacacaactgagtacatcgaaaaaaaactccacacagactatttttaccatgtggggttgaatactttcatcatcaccctgcctatctctaacatcgatatggataataaggacaagtctaagttgaagggaacggatattgaaattgaagacctgtacaacctgaacgagattaatgaaaaactcataaagcccaatcacggcgggaagatttttaataagaagaaggaggacaactctaagtacattggcaaagagatattctccaagttcatgatctctaattactccaactcctgtattgactactcaaaattcaggcctttactggatctgattaacgatctgtctgaaaactatcacctgaagaccgatggtgaaagatacaatacaaaatga

SEQ ID NO: 8608 - RNA, 1155 nt, unidentified
  source 1..1155: mol_type = other RNA; note = synthetic construct
atgtattcgtactcttcaatcgatagcaaagaaaatctggcagccaacataggtgtcactgtgaagcagattacggggattctttatgggatcggaatagacaagtattaccacacctttttcattcccaagaaaaacggacagcagcggcagattaatgcgccaaccggctctctgaaatatgtgcaaaggcgcctaaacgtgctgctgctgaagagactggatgaattctatctggagcacaacatcaagaacagaatttcacatgggttctttaagggcaaatccattaagacgaatgcattccagcatcggaataaacggtatgtgctgaatattgacttgaagaacttcttcgactcaatacattttgggcgggtccagggattcttcttgaagaacgattacttcaagctgcccaaagtagctactattatcgcccagctgacctgttacaatggtaagctagcacagggcgctcctacaagcccgatcatctctaatttaatctgccaaatcttggactaccgcatacttaaactctgtaaaaagtaccgactcatgtataccagatatgccgatgatctgacattttccaccaacaataaggcctttagtgaggcttataccctctttttagacgagctcagcaacattgtgaatgatagtgggtttgccattaatactgaaaaaacacacttccaggagtttaacaagagacagaccgttactggcttgtctgtcaacaagaagatcaacgttcaaaatgagttttacaagaagaccaggagtatggctaatacactctacagaacagacaaatttacgatagacggcaaagaaggaactatcaataaactggaaggtcgtttttccttcatcaacgatttagtgaagtacaacaataggcttgaggaagacaatagtctggcgtccaacatcatagaatacaaaaagaacatcctgcgcgccaaagagaagcactttaacaagagcaacaataaccagatcaaaattctcgactggaacgagaatcttaggtgcctcagcattcgtgagaaagattatcaacgattcttgttctacaagtacttcattgccaacaataaaatcactcttatctccgagggcaaaacagaccctcgctacatctga

SEQ ID NO: 8609 - RNA, 1848 nt, unidentified
  source 1..1848: mol_type = other RNA; note = synthetic construct
atgaaatacaccgacatatgtagcagggatgatctggctatcgctctaggaatcggcaaaagacaactcactgggctcctctacggaatcggcatagacaagtgctatagctcttttgagattcctaaaaagaacgggggaaagcgactgattaatgcgcccaataaatctctcaagtatgtccaaaggaagctgaataagctgctcttgaagagactcgacgattataaccgagaaaatggttcaaaacagaacatcgcacacgcatattttaagggcaagggcattaaaactaacgcctttccacatcggaacaagagatttattcttaacatcgacttggacgatttctttggaactattcacttcgggcgggtgcagggtttcttccaaaaaaatgcctatttcaagctgcctgagatcgccacaattcttgcccagctcacatgttatgaggggaagctgcctcaaggagctcctacctcccccgtcatcagcaacttgatctgccagattctcgactacaagatattagacttatgcaagcggtacaaattaacctatactaggtatgccgacgacctgactttcagtacaaatgatcggaagttcttcgaatctagacagcagttcgttgaggaacttgggcgcattattaagaagtccggtttcaatatcaacaacgagaagacgtatttccagagttccgagaataggcaggtggtgacgggcctgtctgtgaataaaaagatcaacgttacagtcgacttttacaaaaaaacccgctctatggcacagcatctttacaagacaggcggatttagcgtggacgggaaagagggtaatttgaatatccttgaaggcagattcagttttatcaatgacctcgtgagatacaacaaccagaccaaaaaaaatgagagcctcgtgagtaacagcccagagtaccagaaatacttgagtctgccgatcgaaaaactgattagcttaaaggggaaacgatttaccggaaaactgacgcgcaacgaaaagctgtacaatctgacaattagggagaaggattaccagaagttcctgttttacaaatactttgtggcgaatcccaagaccatcattataacagagggtaaaacagattcgcggtatattaaagcatccttgaaaaggtactacactgattatcccaatctaatcaagaaagagggcaacaagttctcttataatatcactttcctgccccgctcacagcgtcttaagtatttttttggctttttagacggcggagggagtgatctgataaacctggttagcttctttatagacactaacaactactctttccgcaattacgtcagctatttcaagtcaattatcaccaacaatcctcctaaaccagtaatatttcttctggacaacgaggaaaaatcaggaaaaccgctcggctccttcaagtccttcatctccaagaacactagtgccacctcatctcaaatagatagcgccattaaaagcgatttcttctaccacattgattttaacacgtttttgatgacccttccagtagaacgtacctcaaactccgacattctggatgtcgagatcgagaatctattcgatctagacaagatcaataacgaactgatccgggggatgcatggtggcaagacattttctccaaagaaggctgagggggatgatctccacatcggcaaagaaatcttttccaagacaatcctgaccaactacgaatcagaaataattgacttttcgcagttcaagcccctgctggacaacatctccaacctgagcaataattattccgagtacaccaaggataaaattcagtga

SEQ ID NO: 8610 - RNA, 1842 nt, unidentified
  source 1..1842: mol_type = other RNA; note = synthetic construct
atgaaatattatcaaatcagttccatcgacatgcttgcgttcgcactcagaatccccgtgaaacagattacaggactcttgtatggtgtcaagatcgagaattgctacagcaccaaggaaatccccaaaaaagatggttccaagcgcatactcaacgctccaaacaaaagtttaaagtatgttcagcgtcaaatctgtaagctgctgattaatcgcttggacgagctgacggagaaaaatggggtgaaaaataatatctcccatggcttcttcaagggaaagagcatcaaaaccaatgcacttccgcatagaaataagaagtacgtacttaacgtggacttagaggacttttttgacagtattcactttggaagggttcagggcttctttaagaacaacaagtacttcaaactccctgagatcgccactgtgctcgcgcagctgacctgcttcaatggcaaactgcctcaaggtgcccccacttcaccccttgtctcaaacttgatctgccaaatcctcgatttcaagattctgaaactgtgtaagaagtacaaactaacttacacacggtacgttgacgatttgacattttccactaatgacccatacttcttttacctgtacaactactttctcgacgagcttaacaacctaattaataaggccggcttcaagataaatcttcagaagacccactttcagccttttaataatagacaggttgtgacgggtctaagtgtcaataagatccttaacgtcaaaaaggaattctacaagatcactagatcaatggcaaactcactgtataaaacaggaacttttgagattgacggaaagaaagagacggtggaaaaaattgataagctacatgggaggttcaccttcattaatgatctggtaaagtctaacaacaggttacacgaaatcaattctctgcgcctgaatggcatcgaatataagaagtttctactcactacctatgagaaggaattcgaatataaatcggccaatcagaagagcgagttgaagtggaaaaacaatctggggcacttaaacctccgggaaaaggactttcagaaattcctcttttacaagtacttcattgctaatacctctgtaacaattctgaccgagggaaaaaccgattccagatatctgaaagccgccctgaaaaagacatatagtcagtatccagaactcattaactttgaggattcaaagttcaaggtcaacatcaacttcataaatcggacggctacacagcggtatttctttgggatattggaaggcgggggcggggatctgacacaactcctgaagtattttactgacggcaaaaacgatattgagaggaattaccttagctacttcaaacggattataccagaggccccaaagaaacccgtcatattcttagtggataacgaatctgataacaaatcgcccctggagaacgtggcatcctttctcgctagcaggcagggggtgaaaaagcaagacatcgtgaaaaaactgcagaacgacttctattaccacgttgattttaatgtgttcatcgtgaccctgcctaccaatatcttcaacaataagaccaacatcgagattgaggaccttctgaatctggacgaaataaacaaccagattattcgagaacgatatagcggaaagtccttctctccgaagaaatctcacaacgatataaaccatatcggcaaggagattttcagcaattttatcaaccgtaactactccaaccctctgatcgattttagcggctttcgccagctgttggacttgattgattcactgagccaggactaccattcttacacaaataattga

SEQ ID NO: 8611 - RNA, 1755 nt, unidentified
  source 1..1755: mol_type = other RNA; note = synthetic construct
atgaatctgcagatcaataatttcaccacgcgcactgagttagccaacctgctggaaatagagttacagattctcactcggctgctatactcaccaacccagaatgtgaatacacagtatcatacgtttgaactggaaaagaaacgcggtggagctacccgtacaatagccgcgcctaacgactcacttaagattgttttgaggaagctgaacgaccttctttcccaatattatttgaaagcgtttgcctttagggaggccgagaagcagatttcccatggcttcgttcgaaaaaaaaacattttcaccaacgcctctcagcacaggaacaagaaatatatcctcaacattgacctggaagactacttcgaccactttcactttggtagagtcaggggcttctttgaaaaagataagcgctttaacctgagcaaggaaatggccaccgtgcttgcacagctcacttgctacaagaaagtgctccctcagggtgcacccacaagcccaacgatcgcaaacatgattacggcaattttagatcggcgcatcttatccctgtgccagaagtacaagttgaaatacactaggtacgctgacgacctaactttctccaccaatgataataccttctccgataagtacggagaattccttattgagctcgacagaatagtgaaagcttgtggccacgagataaaccaagacaaaactcacttcctgacatacaacaatcggcaaacaatcacagggctgagcgttaataagatcgtaaacgtgccgagaacctactcaagtaagacgcgagccatggcccataacctgtatactaagggagagtacttcatcggggacaacgtgtataacatcaatgagaatgaaaagacactcgagattctgaccggacgattcaactttagtaattggatcgacaacttaaagctgcagaacaatcagttcgctcaaaacaataaatcactcaggacctatagcaaacgtgagaaggatttcagcaaattcctcttctacaagactttttatgtgaatgccacacctttgctgattaccgaaggcaagactgatttcagctacatcgattctgcgtataaatctctactaccacgggatatcgaagtggtcaacaagtttgattacaagctgttcaagaaaaacaactctatcactacctactttctcaacagcaaatcggacaataagacaggcgagggcggcgacgagattagcaaattgtttttccagtatacctcccaaattaccttcggcaaaggaatagtggaggattgtgaaatcaacattgggctgagcaaagtaagtccccatttttaccactattttcggaaatatgggcacccctttaatcatcatcctgttgtcatcctgctggataatgaaaacagttctaataagccccttaaaaagtttctcaaggcaatctatacaggagggaattaccagccaccgtatgagttgcttcagtctacaaattttctgcacctggtcgggaacctgtacctgacaaccatacctagtccacaaaagaaccccaatgcctttgagatagaagatctgtttacagaggaggacaagaaaagactctccttctcgagagatagaaaagctcccttctccgaggctgtcgaggaaaatcgcgagactatcaatttcgacaactttatcaagctcttcaagatccttgatgacattaagcagcactacttgaccttcgaatcatattga

SEQ ID NO: 8612 - RNA, 1761 nt, unidentified
  source 1..1761: mol_type = other RNA; note = synthetic construct
atgagcgactataatttctcaaacattaagacgaggaaggatctggctagatttctcaaaatacccctaaagaagcttacttttctgttgtacatcgatcaaaacttgtacaccaactttagcatacccaaaaaatctggtggaattcgcaatatctacgcacctaacaaaaatctcaaagaggtgcagagagtcatcaaacataagttggagcagcacattaatgaatatcagaaactcaacgggattaagaataacgtgtctcatggctttgagcgggagaagaatattatcaccaattcagagatccacaagaataagaagatagtcttcaatactgacatcaaagactttttctccacaatccactttgggcgggttcgcggattctttattaagaacaagtacttccgcatggaggaaaacattgccacaatgctcgcgcagctggtgtgttataatggctcattaccccaagggagccccactagcccaataatcggcaatctgatttgcaacacccttgatatcaaaatcttgaagctgtgcaaaaagtttaagcttaactatacccggtatgccgatgatttgacttttagtaccaataacaagctcttctcagacgagttccagcttttttacaataatttggaggaacaggtgaaccaatccggtttcctcataaacaccaacaaaaataggttcctgtgtaaggataatcgacagacagtgacaggactcactgtaaataagaaggttaacgttaacagggacttttatctgaagacacgtgctatggcatattgtctctataatagcggggaattctatatagatggcgaaaaagcaaacatcaatcagctggaaggacgatttagctttattaaccagctggataagcaccagaacatcaagaaattcaatatgctgctgccatctgagaagaaagaaaagtttttcagcaacctgttcctgaattcccgtgagaaagagtaccagaaatttctgttttacaagtacttctggaggaacagtaaacctttaatactgactgaaggaaagactgacattctctatattaaggccgctcttaagaaatactataaggcctatccggaactaatagagaaaatcggggaagacgagttctactataagatctcttttttcaagcggtctgacaagatgaagtttttcttctccttcatttccgacggcgccgacaatctcaccaacatcttcaactactacattgataacttcgacgacaaaaagaataagagtttcaactactgcaactactttaagaacaaactgagcatcccattcaagaatccgatcatcatcttatatgacaacgagagacaaaacaaaccacttcacaaagccattgataatgtaattaccggcctcattaggggaaagtcagaggagaaaaaaaaacagcgcagagaaaaaaaggagagtctgaagaaatctctgaatgactccacgccttttgctgagaatatcctagagaacatctactttctaacaaatcctcaactggaggataagaatacggaaattgaagacttactcaccaacataacaaatcatctggaacttgatggtaaatcgttcaataaagatggcgggaagaacaatttcggcaaaaacattttatcccagtacgtgtataagaactacaagaagctggatctgaactccttgaaacccatcctggacaacatcaaggacgtcaaaagtaaatacttttga

SEQ ID NO: 8613 - RNA, 1728 nt, unidentified
  source 1..1728: mol_type = other RNA; note = synthetic construct
atgaataaactgtccgagatcaaaacacgtagcgaccttgcggccacacttagtgtttcagaaggcgacctggtgaagatcctatattacgagaaggacttataccaaaactttgacattgcaaagaagaacggcacatcccgcaagatcaatgccccaaaagagaatctcaaaaagatcttacagaccttgaatatcttgctgaataagcacgtacatgattattacgacgagaacaattcctcattaaatgtttctcacggttttgaaaagggacgagatatagtgtctaatgccgaggtgcacattaacaagaaatttgtgttcaacactgacatcaaggattttttccccagtattcattttggaagagtgcggggactgtttcataagcatacaatcttccagatggatgagtacgctgcaactatgcttgctcagttgacctgctataatggctccctaccacaaggcgcccctactagcccactgatctctaacctgatttgcagggaattggacattaggatgctgaggatatgtaaaaaattccgactgcactacactagatatgctgacgatctgacctttagcacaaataacaagaactttcagctcaattacgagaacttttataagaagctcaacaacgagatcaacagcgccggattttctttaaaacacaataagtcgaggctgcagcagaagaccgagaggcaggaagtgaccgggctgacagtcaataacaaggtcaacgttaatcgcaaattctatctgaaaactagggccatggcgcacagtttctatgagaacggtagcttctatattaacaacaatatcgggactatgagacaactcgagggacgtctagcatttattaatcgcctcgacaaagagaataatattcggaagtatgagcgcctcaccaatgaaaaggataaaatggggtttttcaagcataaacctctcaatgctcgagagaaagaataccagaagtttctgttctacaaaaacttctgggtgagaacgaaacccctcataataacggaaggcaagactgatcccctgtatatcaaagctgccttgaaaaagtattacaaggaatacccggagctgattgaactcaataacaacaacgacttcgaatttaagatcgatttcttcaatcggaccagtaaactgagatactttttcgaacttgagaaggacggcgcagataccatgaaccggcttattaactactacgtgcacaaaaactacaattccaagcgcaatgataagttcaactactatcacttcttccacagcaagatgggggtaccccctctttatccaattgtctttctcttcgataacgaatatgaaaagaagccactgcataagttcattgacaatgtggccccactgacaaataagcccgtgaaaaccctgaaaaaggaattgaacaaaaccaatcctactccgcagaacctgataggcaatacctacatcttgtcagtccccaaatccacacctaacgtcaatggggagatcgaggacctgttactcaacataaccaaagacctgacgatcaaaggaaaaaagtacaacaaaaacggtggcgatcagtatatcgggaaggacattcttagcaagtatatctaccaagagtacgaatcattgaatcttgattctctcaagcctctgctggaccggattgttaacctaaaaatcatgtacgagaagtga

SEQ ID NO: 8614 - RNA, 1791 nt, unidentified
  source 1..1791: mol_type = other RNA; note = synthetic construct
atgaagtatgcgttcataaacaacaaatacgacttcttcaacgttctcggggtgcctgccacaaaaatgaactacttactgtacaatcgagagagaatgggtactaacaatatgtatcacacctttagcattcctaaaaaatcaggaggaaaacggaccattcatgcaccgaacgatgagttgaaaaacattcagaagaaactggccaaagtcctcgaaaaccactattacgaaagcatccaggacaataagaataaagacgcgttcttgcaaggttttttcaaggatcgcggcatcattaccaatgctaagattcatcggaacaagaagtttattctcaatatcgaccttgaagacttttttcagactattcacttcgggcgtgtcaaaggctttttcgagaaagataacacctttaaggtgccgagcgaagtcgctctgataattgctaatctcgtttgttatcgtggcatccttccacaaggcgcccccacctccccaattatctcaaatttgatcgggcgcataatggatgtaaaactgctgaagctatgcaagagatataaactcaagtacacaaggtatgccgatgatctgacgttctctactaatgacaatagttttctggaactagaggataagctgatctatgagatcaaaaacgaaatcaggaaatgcggatttgaggttaatgaaaaaaagacgcgagtacaggattacagactccggcagagtgtgaccaacatcactgtgaacaagaaactgaatgtgtcaaaaacgtacattaagaacacccgggccatggcccaccatttgtacaagcatcaagaatattacatcgacaatgaagtgggaacaataaatcagctcgaaggccgctttgctttcattaaccaacttgacaagtacaacaataacattgtcaagatcaagagctttgaaaagaattcgattgaggagcagaaaaacctgggtagcgtgttccagactaagaaagagatttcaaagaccttcttcttcaaaaatctcaatagcagggagaaggagtatcagaagttcttgttctacaagtatttctacgcaaatccaaagccaatcatagtgaccgagggcaaaacagacgttagatatctaaaggccgcactgaaaaacttatacaaagagtatcccgatctgatagaaaaaaacgaaaatggctttgacttcaagatttccttcctaaataggttttccaacaggcaccagaagatcagcaagctgcattatttccttaatattgtgcctgacggggcagatactatctacaacatatacggttactatgactctaaaaacagtacatatcccaactttatcgagttctttaagaacatttcccagtcgtctcccgccaatcccgtcattttcctgtttgacaacgagctgaataacaagaataaacccttggctaagttctgcaagaaattaaacatgaaggaacaccaaaaggagaaactctcttccgacaataagatctacttaacagagaacttgtacctcatcacacaccagcttctggaaaattgtgatgaaaatgagctggaggacctgtttagtaagagtactctgagcaaggagatcaacggaaaaaaattcatcaaacgcgattccttcgataataagaagtattatgggaaggagatcttttccaactacatatcctctaattactctgtgcttgactttaacaactttcggcctatacttaacaatatcgtggatgtactgaagaaatacaagtcaatcctgtga

SEQ ID NO: 8615 - RNA, 954 nt, unidentified
  source 1..954: mol_type = other RNA; note = synthetic construct
atggagtatgcattcatcaccgataagaatgactttttccaggcgctaaagatccctacacagaagatgaattaccttttgtacaacaaacaccagatgggcccggaaaacatgtatagcaccttcagcatctccaaaaaatccggtggggaaaggatcatccatgcgccttctgatgaactgaagtcagttcagaagaaacttgcaaaattgctcgaaaaccactactacgaatcgatccgcaataacaaaaacaaggacacatttctgcaaggattcctgcagaatagggggataattacgaatgccaaggtgcaccgcaacaagaaacacattcttaacattgacttggaagactttttccatacgatccatttcggccgggtgaaggggttctttgagaaagacaagacttttaaagtcccctccgaggtcgctctgatcatagccagattgacctgttataaaggcgccttaccacagggcgctcccacatctccaatcattagtaacctgatcggcaaaatcatggatttcagactaattaagctgtgcaagaaatataagctgtcctacactagatacgctgatgacctcactttctcaaccaatgacaatagtttcctgaaactggctgaccgattaattattgagatcaagaatgaggttcggaaaagcggatttaaagtgaatgaaaagaagactagggtgcagaactaccgcctgcggcaagatgtaacaaatataaccgtcaacaagaaactcaatgtgagcaagacatactttaagaacacccgagccatggcacaccatctctataagcaccaagagtattttatagatgacgagattggtaccctcgagcagcttgagggaaggtttgccttcattaaccagatagataagtacaacaacaagctgtctcgtgccgaaacttatgagaaaaatcattga

SEQ ID NO: 8616 - RNA, 1758 nt, unidentified
  source 1..1758: mol_type = other RNA; note = synthetic construct
atgaagtatacgtacattaacaacaagtacgatttctttgcactgcttggagttcctagtaacaagatgaactacctgttgtataatagagtgaatatgggccccgagaatatgtattctacttttaccatccccaaaaaaaacggaggggaaagaactattaacgcgcccaacaaagagcttaagaacatccaaaagaaactcgtggtgctgctggaaaaccattataacgagctggttgagaagaagaaatttcgtgatagcttcctccacgcttttataaaggatcggtccatcattacaaatgctaggatccaccgcaacaaaaattttatcctgaacatcgacctggaaaacttcttcgaaactatacattttgggcgggtgaagggcttcttcgagaaggactttaattttaaggtgcctagcgaagtagccttaattatcgctcagctcacctgctataaaggctcattgcctcagggcgcccctaccagcccgatcatttctaacctgattggcaaaattctagaccttagactgatcaaactgtgcaagaagtacaaactcaactataccaggtacgcagatgatcttacattctctacgaatgattacagctttgtcaagaatttcaacaagatcctagaggatataaagatcgaggtcaataaaagtggcttcaaagtgaatgacaaaaagacaagagtccagaattaccgtttacgccaggatgtaaccaatctgacagtgaacaagaaaatcaacgttcagaagaagtacttcaaaaatactagagccatggccaaccatctgtaccgcaataatgaattctttattgacggggatctgggaacccttaatcagttggaaggtcgattcgcgttcattaaccaaattgacaagtacaacaacaagaacatcatccacaaatacaatagcagtaagaagaaatccaacaaagagtatatccacaacctcaatagtcgggaaaaggagtatcgcaagttcattttttaccggctattttatgccaatccgaatcccatcatagctacagaaggaaaaacagatattaggtacatcaaagccgcactgaaaaatttgtatgacgaatatccagagctgattgagaagaacgacaatcagtttctgttcaagatctcctttctaaacaggttccgaaagaagacagatgagatgaataaacttcaatacttcctgaaccttgccccacatggtgcagactctctcaagaacatcttcaagtattacaaggaaagcgaatcgtcttaccccaattacatggagtactttaaaaaactcggtaacaacatgccaaacaatcctgtgatcatactctttgataacgagctccacaacaagaaaaaaccactctccaagttctgtaccaatctgaaattgaccgatgacgacaagtcaattctgaaattgaacctgaatatctgtctcaaggacaatctgtatttacttaccaatcagctgattggaactagtaaggagaatcagctggaggatttatttcaagaagagactttgtccaagattattaacaacaagtccttctcaacctctgacgaatatgacaaatcaatctactacgggaaagaaatattctcccagtatataagcagcaattatgagacggagaatttcgacaattttaggccattactcgacaacattgtcaagataatcaacgactacaagatgaacaaatgcgaggataataattga

SEQ ID NO: 8617 - RNA, 1788 nt, unidentified
  source 1..1788: mol_type = other RNA; note = synthetic construct
atggagtacaatctaatcgccgacaaatatgattttttcaacatgctgggcatcagcacaaggaaaatgaactacatcctctataatagggaacatatgggtaccgagaatatgtatgagacttttagtattcccaagaaatcaggaggcgaacgaacaattcatgctcctaaagccgaattaagaattatccagaagcgtctggcatctatcctggaaaaccattattatgagagcattgaggataagaagtatagtgacaccttcattcacgcattcatcaagaataagtccatcatcactaatgccaaaattcatcgcaacaaaaagaacatcatgaatatagacctggaggacttcttccacacgattcactttggtcgggtcaaaggattcttcgaaaaagactcaatcttcaaggtgcccagtgaggtggcgctgataatcgcacagcttacctgttttaaaggcgctttgccacagggagctccaacatctcccattatatcaaatatgatagggaagatcctcgatttgcgcctgttacacttgtgcaaaaagtacaatcttgactatactaggtacgccgatgatcttaccttctctactaatgataaagcctttgaaaagaacaccgacacaattctttccgaaatcaaaatggagatcgtaaagtctgggtttaaagtgaacgataagaagacacggattcagaattatcggatccgccaggacgtgacatcgctgactgttaataagaagatcaacactaagaagacctactttaagaatacccgggcaatggccaataacctgtacaagaatcatgagtttttcatcgataacaagctgggtactattgaacaactggaaggccgatttgccttcatcaaccagattgacaagtacaacaacaagatttccaagatcaaatcctttgagagaaatacgctggtccaccagaagtacctcgagagcatgtacctcattaaaaaagagaactccaagacacagtatttcaaaaacctgaacaaacgggaaagggagtaccaaacatttctgttctatagacacttttacgggaactctaaaccaataatagttaccgaaggaaaaaccgatattcgttatatcaaagccgctcttaagaatctgtacaaatattaccctgacctcatcgagaaagatggaaacagcttcatattcaaaatcaacttcctgaagagattcaaaagcaagcctagcaaaatgaataagctccactatttcttgaacattttgcctgatggagcagacgccatgaaaaacatctacaactactataacgagaacgattcctattacccgaactacatcaaaaagtttaagctgttgggcaagaatgtgccctataaccctgtgattttaatgtttgacaacgaactgcaaaacactaaaaaaccgctctcaaatttctgcaagcatgcgaagctgagtaatgacaaaaagaataagctcaagacagactactacatcaacctgattgagaatttatacctacttacccaccagttgatgccaaatagcaatgaaaatgaactcgaggatctatttgaccagcaagctcttagtaagaagattgggggtaaaacctttaagaggggcgacggctttgacacgaatcagtattacgggaaggagatattctctcagtatatcataagcaactacaagcgcattaactttgataatttcagacccctcctggataatctggtcgagatcataaaagactactccaagaaatga

SEQ ID NO: 8618 - RNA, 1788 nt, unidentified
  source 1..1788: mol_type = other RNA; note = synthetic construct
atgaagtatagcttcataaccaacaagaaagacttcttcaatctgctcggcgtgtctgctaagaaaatgaactacatcctgtacaacaagcagttcaagggtccggaaaatatgtatacgacgttccttgttccaaaaaaaaatggcggcgagcgcaagatcagcgcacccaatggggagctgaagattatccaaaaaaagctggcaaccattctcgagaatcactattatgagacgtacaagtcacagaattactgcaataatatcacccatgcctttcagaaaaataaaggcattatcaccaacgccaaggtgcaccgcaacaaaaaaaacatcttgaacatagacctggaggagttttttcactcaatacattttggccgggtaaaaggcttttttgaaaaagactctacgttcaaggtccctaaagatgtcgctctgattattgctcagctgacatgttatcagggatatctgccacagggcgccccaacatcccctatcatctccaatctgattggtaatatcctggatatgaggttgttgaagctatgtaagaaatacaagctgaactatacacggtatgcggacgatctcacattcagcagcaatgacctaagcttcagtaaggtaaaagataagatcatccttgacatagagatggagattgagagatgcggatttaaagttaacaatagcaagactcggattcagaattacaaaattagacaggaggtcactgggttaaccgtgaataaaaagatcaatgtgaagagatcctactacaaaaacactcgcgccatggccaacaatttataccgaaacaaagagttcttcatcgacaataagattggaaccatcaaccagttggaagggcgatttagttttattaaccagctggacaagtataacaacaagatactcaagtacaagtcttttgaaaagaacagtgtgggtcatcaaaagaatctcgaatcactttacaagatcaagaaggaatccagtaacactcaattttttaagcacttgaacgcccgggagaaagagtatcagaaattcctgttctacaaatacttctacaacaatcctcagccgctactggctactgagggaaaaaccgatataaggtatctaaaggcagctctgaaaaatttatacatcgagtatcccgaccttattgaacaacaggatggaaagttcgtgtataaaataggattcctgaatcgtttcaactacaatgcaaaaaagatgaatcgtctccattatttcctcaatattcttcccgacggtgcctcggctctgaagaacatttactcatactacaatgagcaaaactctcattatcctaactatgtgaagttgttcaagaagttagatgacgacaagcccctcaaccctgttatcctgttatacgacaatgaactcgccaataaaaagaagccaattctgaacttttgcaatcacatcgatatgtctgagaatgaaaaggcaagtcttcagtccgggtcctattttcacattagcgagaacctgtatctcttgacccaccagctcatcaattctgcgaaagagaacgaacttgaagacctgtttgataaaaaaacactgagcaagatcatcaacaacaagactttttgcaaaaaggacaaattcgatacctcaaaatactacgggaaagatatcttttccaaattcgtcatttgcaactacaacaacatcaacttcgaaaactttaagcccctcctggataatatagtcagggtggtgaaggattacgaaaacaggtga

SEQ ID NO: 8619 - RNA, 1827 nt, unidentified
  source 1..1827: mol_type = other RNA; note = synthetic construct
atgaattacaattttatcgtagacaagcagtcattctgtaatgaactgggcattagcgtgggtttgctgaattaccttctgtactccaacaaagaaaatggcattgagagcttctatattaacttttcggtacccaaaaagaacggggaagaacgccgtatacacgcacccaatgagcagttgaagtttgtacaaaaaaaggtgcaggagctgctgcagatccgaaatgacgagctttttgcaaagctgaacgtcgaaaataaaatcgtgcatggctttgtccctgggaaaaatatcataacaaacgcgagaaaacacaggaacaaaaagatcgtgatcaacattgatatccaggactttttcgaatctctgcactttggaagggtaaaggggtttttcgaaaaggataaattcttcggcctacctaaggaagtggctctgattatagcccaactgacgtgttacaaaggacacctgccccaaggagccccaacatctcctataatttctaatctcatcgctaagatcctggatattcggatgttgaagatgtgcaaaaaatacaatctggactacacgcgatatgccgacgatatgacgttttctacaaacaagtatctcaccactaagcagttggagaagttactcaaagatctggagaaggtcatcagcaatagtggctttagcatcaacaacaagaaaacaaggattcagcaaaacaatcttcggcaggacgttaccggtattacagttaatgagaagctgaacgtcaacaaggaatatatcaaaaagacccgcgccatggctcataacctgtattgcaacaacgaattctatattgagaacgagaaagggaccttagatcaactggaaggaagattctcattcataaatcagctggacaagttcaacaacaatatcagcaagactaaatcagttgagtacaacctgattaagaaccagaagaatttcagctacatttcaacttaccagaaaaaggttaacacaaaatctgaccaattcttcaaacagctcaattcccgcgaacaggagtaccaaaagtttattttcttcaagctcttctacggcaatccgaagccacttatcattactgaggggaaaaccgacatcaaatatctaaaggctgccttaaaatccttgcacaaggaatatcccggtttggtggagaagcagggagataaatacatctacaaagtgagtttcctggacaaaagttccagaaaaaacaagaagatcagcaaactccagtatttccttaatatttccgagcatggcggggacgtgatgaagaatatcttttcgtactatgatgtgcagaacaactactatccatcctattatgattacttcgacgaattacggaattttaccggtgcgaataagcccgtcattctcttttttgacaatgaagtggatagacggaagaaagatagtcctgtgaaatcctttatcaagcatgccaaaatctcttctaaggtcgacgagtttaagaagaacaagaaaatccacatcactaaaaacctctacctgcttacccacagccttgaagagggggcactcgagggcgaaatagaggacctctttgatgaggatgtgctaaatcacgagataaacggaaagatcttttcacgtaaggacgaggaggaaaccaacaaatatggcaaagagatattcagcaagtacgtttatagtaacttccagaacattaacttccataacttcaagcagattttggatgacatcgtgtacattatagagatctacgagatgtccaagaagaataggaaaaaggtggtcactgagtga

SEQ ID NO: 8620 - RNA, 1713 nt, unidentified
  source 1..1713: mol_type = other RNA; note = synthetic construct
atgaggctgaaagacgtaaaaaatagaaaggatctagcccagctcctagacgtgaaggtgaaagtcctcacttattgtctgtatgtgctcccagaaacaatgcgttattccagcttcgtgatacccaagaaggacggctctgagagacaaatccttgtgccctgcgctcagctcaagaggattcagaagaaactggcggaagtcctgaacgaggattacttggagattaactccaataacgtagcacagggattcatcaagaataaggggatcattacaaacgcccggtatcatcgcaacaaaagagtcatcataaatgtggatatctccgattttttcggcaccatacattttggtcgcgtgaaagggtactttgagaacaacaagttctacaaactgaataacaaggtggctacaatgattgcccagctcacatgttaccaagggaaattgccacagggcgcccccacaagccctgtcattgcaaatatgattggccagattatcgactaccacatcttgaaattgtgcaagcaatacaagctgtattacacccgatatgctgacgacatgacctttagcactaacatcaactacagtttggttgaaatcgagaagtttatctgcgacttgtcagaaaccctgtccagactgggtttcgaaatcaacactaagaagactcgagtctgttttaactcaagcaagcaggaggttacgggagtaatagttaacaagaaactcaatgcggacaaaacctttattaaggaaactagagccatggctcagaatctttacagcaccggcgggtttgtgatagataataaaattggcaccatggaccaactcgaagggcgcttcgcgttcattaaccaattcgacaagtacaataacatcgtgaacaatacgtctaaaggtaaacacctcgagaagctcaatgttcgcgaaaaagcctaccagcagttcttattctacaagctgttcttaggtaatgatcgccctgtgatctatacggagggtaaaacagatagtaggtacattaaagccgctcttaagaagctgtatattcagtacgatgaccttatagagaaaaatgaaaacgggaagttcgaatataagatcctattcggaagtcggaacaaaaagtatgagtacttccttgactttatgcagtacggggcagattctttcaatatcatcgccctgttatacaccggacggaacggctatgctaatctgtgctcgatcctgaagtctaagatgcggcggaaaccgaacgcaccagtcattctgctgatggacaacgaacagactaatggaaaaccattaaacaagttcttgcagtcatatagggatgaacactacaaaaatcttactgatcatgagaaggccttcttcaatgactataattacattaggctggtggagaacctttatctggcaacctttcccctggaacctggagttgaggaaatggagatagaggatctcttttccaaagagtttctagatggcaagatcaatggcaaatcctttaagaggtcccctaagaagggagagacaaatgtaatgagcaaagacgagctgtctcgttatgtgctgagtcactatcgaagcattaatttttctggctttaaggggctcctggatgtcatctcagccattaagaaagactacgagaaatacatcaacatggacgataacaaatggtattga

SEQ ID NO: 8621 - RNA, 1791 nt, unidentified
  source 1..1791: mol_type = other RNA; note = synthetic construct
atgaaatatttgaaagagctgaagagttgccagacccagaaagacttggccaacctactggggtactctgaaaaaaacttcactaggatcctgttctcccaaaatatttctcttaggtatcagagcttcgaaattcctaagaaaaacggggataaacgcaagatattagctccgacatctgaactgaaagtccttcagacccggttgtcaatactgttatccaattgctacgaggaactggagttaaaacggctcagtaccagctcttatattaagtgtatctcttcccacggcttccgaaaaaaacttatcgtgaatatcccggcatcgaaacagaatagaaagataatcgagtacaaggagattaactttggcatatacagtaatgctaagcaacacacagggaagaggctcgtgctgaatatcgacctaaaggacttttttgagagcattaccttttcaagagttgttggattcttcaccaaaaataaactcttcctcctgcccctggacatcgcggtactgatagcccagatcgtcacgtatcgtacaagtaccagccaagaggggtttttgcctcaaggctctccctgctccccaatcatcagcaacctcataggtaatattctggacgttaagatggtcaagttggccaaagagtataaattcacctacacacgttatgtcgatgacctgaccctttcaaccaacctcccccagttctccgaagacattatcgagtttgatggagaaaagtgggtgctgggatcggcacttaaccacaccattaactcttcaaagttcaaaatcaaccctaagaagacacgcctgacagataaatacaacaaacaggaagtgacgggcctgacaatcaataaaaaggttaacatcgaccggacgtattaccgctacaccaggtccatggtacagaaattctgtgccgagggggagttctttaagtctaaagtccatatggataagcagaagatttcccgggaggctctgaatggcatacttagtcacatctaccaaataaagaaccagcaggacattaattttccaaattgcgctcgcaacttttcagagcttaacagcttggaaaagttatatgccaagtttctctttcaccattattttgtgcacccacagcgaatgctcattattggtgagggttatacggacccactgcattttaagctggcgtgtcataagctatataaagagagcctcagctttcttaaattctccagtctcgaagggactaaaagatttagcaagattactggttacggcggaggaactggcctcttaaagatattcctacagaactataagcagttctataaagccagaaacatctgtttgaagccctgtctgattatcgtggatggggatagcgatggcgacgcagtgattagcaaagcatcggctgagttcaagacaacttttaaaaagatctcccatagttccatgacaactgccggactcctggactggtaccacattttcaacaatctctacatcctgcagttgcctaagaataaagtgatcgaagatttctacgatcctctgatcctgactattcccattggatcaaaaactttccattcagacgataagaagaagaataccaagtttgatagcaaaatccactacggcaagaaggtgctgctggagaagataatttatgaacagcaagacactatcgacttttctaagttcgatctgatcttcaatacaatctttcacattcagttctaccattacatctactgcaacatggaatcctga

SEQ ID NO: 8622 - RNA, 1779 nt, unidentified
  source 1..1779: mol_type = other RNA; note = synthetic construct
atgaaatacctcaaacagctgaagtcttgtcagacccagaaagatttggcgatactcctcggctactccgagaagaacttcacacgtatcctgttcagcgaaaatattacgactaggtatcaggactttgagatttctaagaaatcaggcgggaagcggaggatattcgctcctacccctgaacttaaaattctgcaaactcgcctgtcaattctgttatccaactgctaccgcgaactggagcttaaaagactttctacaagctcctatgtgaattgcatatcatcacatggcttcagaaagaagctcaagattaacatcccgacttcgaaacagaaccgtacatcgttggaggccaaggaaatcaattttgggatctatagcaacgcccagaagcatacgggcaaacggctggtcctgaacattgatttgaaggacttcttcgaaagcatcactttttctcggattgtgggtttctttagtaaaaacaagctgtttagccttccatttgacatcgcaatcctgattgcccagatagtgacctatcgggaaagtactagcaaggaaggctttctgccccagggcagtccctgctccccaattatcagcaatctcattggtaacatcctagacgttaaaatggtgaaactggcaaaggagtacaaatttacttatacacgctatgtggatgatttaacattaagcaccaatctcccacagttcagtgaagacattatcgaattcgatggagagaagtgggtactaggatctgctttgaaccataccataaactcatcgaaattcaagatcaatcctaagaaaacacgactcaccgacaagtataataaacaagaggtaaccggcctcacagttaacaagaaagtcaatatcgaccaaaactattacagatacacaagaagcatggtccaaaacttctgtgccgagggagagtttttcaaatctaagtttcacatggacaagcataaaactaatagggaggcactgaacgggatcctgagccacatatatcaaataaagaaccagcaggacatcaaattcccgaattctacccgcaattttaatgagcttaactctctggagaagctgtataccaagttcctgtttcaccactattttatccatcctcaaagggtcttaattatcggcgaaggttacaccgatcctttacacctgaaacttgcttgtcacaaactataccccgattcactaaagtttatcaaattctcctccctctcaggcacaaaacgatttagtaagattatgggacttacgggggggactgggctgattcagaagtttctgaagaattacaacgtcatctacaagtcccaggtgatctcccatctcccatgcattattctggtggatggagattccgatggggaacacgtgatcaaatgtgcgaataaggagttcaatgactttattaagcacatcagcctgactgccctgaacaagtccgccattttggattattaccacgctcatcataatctttacatcatcaagttgcccaaaaatacggttatcgagaatttctacgaccccagtattctgctcaaaaccatatctggaaaaacctacaacagttctaacagcacattcgatttgaccaagttttacggtaagaaggacctcttcgagaaaattattttccaggaccagaacaccatcgacttctccaagtttgacttgatattcaacacaatcttccacatacagttttaccactatatctactgcaatatggaagagtga

SEQ ID NO: 8623 - RNA, 1776 nt, unidentified
  source 1..1776: mol_type = other RNA; note = synthetic construct
atgaattttctacaccaactcaaaacctgccagactcaaaaggacctcgcagcactgcttggttactcagagaagaacttttctcggatcctctttagtcaaaacatcatcactcgctatcgcagctttgaaatacctaagaaaaacgggaataagcggcagattctggctcccacaagcgagttaaaaattctgcagacccgactggctaatctgctgtccaattgctacgaggaactggaagtcaagcggctttcatcgagttcctatgtcaactgtatttcatcccacggatttagacgcaacattactatcaacatccccacaagtaaacagaatagaacacctatcaagtctaagaaggttaactttggcatctactcaaatgccgaaaagcacatcggcaaaagactggttcttaacatagaccttaaggactttttcgagaatataaccttcagtaggatcgtgggttttttcaccaaaaacaaattcttcctgctgccactggacgtggccatattgattgctcaaatcaccacgtataggacctcaatatctcaggaaggatttctcccgcagggcagcccgtgttcgcctatcatctccaatttaatcgggaacattctagatgtgaaaatggtgaagctcgctaaggagtataagtttacgtatactcgttacgtggacgatttgaccctttcaaccaatttacctcaattctcagatgacattgttaaactgaacaatgagaagtgggtaatcggatctattctgaatcatactgttaatagcagtcgcttcactattaatccaacgaagaccaggctgaccaataaatacaataagcaggaagtcacaggcctgacagtgaacaaaaaggtgaatatagaccagacttattacaggtataccagaagcatggtgcaaaagttctgtagcgagggcgagtttttcaaaagtaaagtgcacatggacaaacagaaaatatcccgggaagccttaaatggtatccttagccatatataccagatcaaaaacaagcaggatattaaattccagaacataacccgtaacttcgacgaactaaatagcctcgataagctttatgccaaattcttgtttcaccactatattgtccatcctcagaggatgtttatcatcggcgaaggatacactgatcccttgcacctgaagctcgcatgccataagctgtacaaaaactctctagagtttatcaagttctccagcctccaagagacaaagaaattcagcaaaattatggggtattctggaggcactggcctgttacagaagtttctcaagaactacaagctgatttataaggggagtctcttgtccttgaagccatctgtaattcttattgacggcgacaaagccggagatgatgtgatcaagaccgcgaagaacgagtttaaggattctttccaggaaatcaagaactcttccatgaatgggtcctacatcctggagttcaagcatgtatttaaaaacctctacatcatccagctgcccaaaaacgatgtcattgagaacctgtacgatgtctccgtgattaacacaaaaattggtacccgaacatataatccctcgaacaacaaattcgacctcacaaaatactatgggaagaaagagttgattgaaaaggtgatctttccaaatcagaacacaataaacttcagcaagttcgacctgattttcaatacgatcttccacatccagctgtaccattacatttactgcaatgggaattga

SEQ ID NO: 8624 - RNA, 1791 nt, unidentified
  source 1..1791: mol_type = other RNA; note = synthetic construct
atgaacttcctgaatcaattgaaaacttgccagactcagaaagacttcgcagccctcttgggatattcagagaaaaacttctcaaggatcctgttttcacagaacataaccacccgctatatcagttttgagattccaaagaagaacggcaataagagacagattctggcccctaccagcgagcttaagattctacaaaccaggcttgctaatctgctttccaattgctacgaggagctcgaggtcaagagactgagttccagctcgtacgtgaattgtacatcaagccacggatttcggaggaatatcaccattaacatccccacttcaaaacaaaaccggacacctattggttcaaagaaaatcaacttcggcatctattctaacgctgaaaaacacattgggaaaagactggtcttgaacatcgacctgaaggactttttcgaaaacatcaccttttctcgaatagtgggttttttcacgaagaataagttcttcttgctccctcttgacgtcgctatactcatagcccagatagcaacttacaggacctccacttcgcaggaagggttcctgccgcagggttccccatgtagtccaattatcagcaatctaatcgggaatatacttgacgtaaagatggtaaaactcgccaaggaatataagtttacatacacacgttacgtggacgatttaacactatccacgaatcttccccaattctccgatgacatcgtcaagctgaataatgagaaatgggttgtgggatctattctgaaccatactatcaattcgagccgcttcactattaatcctacaaagacgcgggtcaccaataagtataataagcaggaggtgactgggctgatagttaacaagaaggtaaacatcgacaaaacctactatcgatatacacgttccatggtgcagaaattttgtagcgagggggagtttttcaaatccaaagtgcacatggacaaacagaagatctcaagagaagcgctcaacggaattctcagtcatatctaccaaatcaagaacaagcaagacattaaattccagaactccacccgcaagttcaatgagctgaacagcttagaaaaactctatgcgaagtttctgtttcaccattactttgtctatccccagagaatgctgataatcggcgaaggatatacagatcctctgcactttaaactggcctgccataaactgtataaaaattccctgcacttcttgaaattctcttctctcgagggaaccaagcggttcagtaaaatcacagggtatggcggcgggacaggcttacttaaaatcttcctccagaactataagcagttttacaaggctaagaacatttttctgaagccgtgcttaattattgtggatggcgatagcgatggccaggccgttatatctaccgcacgctctgaattcaagtctacctttaagcaaatcaatcattctagcatgactaccaccggactgttggattggtaccacatcttcaacaacttatacatattgcagctgcccaaaaacgaggtgattgaggacttttacgatcccagtgttctgatgtatagtattggcagcaaggtgttccacagcgatgacaaaaaaaagaataccaagttcgatccaaacattcactacggtaaaaaagtgctccttgaaaagatcatctacgaaaagcaggatatcattgattttacgaagttcgacctgatctttaactccatttttcacattcagctataccattacatctacagcaatctccataattga

SEQ ID NO: 8625 - RNA, 1782 nt, unidentified
  source 1..1782: mol_type = other RNA; note = synthetic construct
atgaataatctttttttgttacgtacctgccaaacgcagaaagactttgctaaagtcctgggatactctgagaaagaatttaccctaattctgttttctcagtccatccaaaataaataccagtcctttgacatccctaagaaaaacggaaataagcgcaagatactcgcacccacaccagatctcaagatcctgcagaccaggtgcctctcaacactgttgactaattgttatgaggagcttgagaaaaagcgattatccaaaagttcatacgtgcagtctatttcaagtcacggcttccgcaaaaagctgctccttgatattccattcaccaaaaagtcgaggacacccttcgagaaaaaggttatcaagctggggatatacagtaacgcaagcaaacatgtaggcaagaatctgatcctgaatatagacctaaaagacttcttccagtccattaccttcagcagaataatcgggttttttagcaagaacaagtatttccagctcaactttgacattgcggtgctgatcgcccagatagccacgtacagacccaatcaatctcaggaaggcttcttgcctcagggctcaccttgtagcccaattatttctaacctgatcggaaacatactcgatatcaagatgcttaaactggggaagaagtacaagtttacatattcgcgatatgtcgatgacttgactttaagcacgaatctgccaaaattcaacgaggaaattgttaagctggttgataatacgtgggttattggctcagaacttaaaaacgtggtgaactcatccaaattcaaggtgaatccccaaaagaccagacttacaaataagtataaccggcaagaggtgacagggctcactgtaaatcggaaagtaaacgtctctaaggagtattacaggtatacacggtccatggttcaaagtttctgcaccgagggcaactttgtcaaatctaaggtgcatatggacaaacagaagatctcccgcgaggcactgaatggcattctcagccatatattccagatcaagaacaaacagcagatcgaattcaataatcaaacccggaattttgacgaactaaactcaatcgaaaagttatacgccaaattcttgtttcaccactacttcattcaccctcagagaatgatcgtgattggggagggatacaccgacccgacacactttaagctagccagccataacctgtacccggatatccttaaatttctcaagttcagtagcctgcaggaaaccaaacgcttttctaagatcatgggctattccggaggtacaggtttgctgaacaaattcctgaagaactacaagctgatctataaagccaacgtgatcagctgtaagccttgtttgatcattgtggatggagataaagctggcaacgatgtgattaagactgctaggagcgaattctctaagacctttaaggctattaacaacgtcagtttgaatctgagcgccaaactggagttttttcacattttcgagaacctgtacatcctgcagcttcccaaggaccaggtgattgaggatttctatgatactactgtcactggtagtctgatcgggacacgaacttataattcctccaacaacaaattcgacctcactaagtactatggtaagaaggaactcctggaaaagattatctttccaaatcaggacaccataaacttctccaaatttaacctcatcttcaataccatcttccatatacagatttaccactacatctattgcaatctcaaaaattga

SEQ ID NO: 8626 - RNA, 1779 nt, unidentified
  source 1..1779: mol_type = other RNA; note = synthetic construct
atggataacctattcctccttaaaacgtgtcagacccagaaggattttgcatcattgctcggttatagcgagaaagagtttactcgcatcctcttttctcagccaatccagaataagtacaaaagcttcaagattccgaaaaagaatggctcccgaagaaatattctcgcgccagtccctgatttgaaaattctgcagactcgtctgtctatactactcacacattgctacgacgagctggagcacaaaagacttagcaaatcctcttatgttcagtgtatatctagccacggcttcagaaaaaagatcctcgtagaaatcccaatcagcaagaaatcccggacatcattcgaatcaaaggtgataaactttggaatctactcaaatgctaagaaacatgtcggtaagaatctagtgttgaacattgacttgaaggacttttttcagtcgataaccttcagtagaatcattgggtttttcaccaagaacaagtactttcaactgaatttcgatatcgcattacttgtcgctcagattgccacataccggcctaaccaggtgcaagaagggtttctccctcaggggagtccttgctccccaatcatttcaaatctgatcggcaatatcttagacatcaagatggtgaaactggcccgaaagtacaagtttacatatacacggtatgtggatgacctgaccctgtccactaatctgccccagttcagcgaggaaattattaagctggatggcaaatcttgggttataggctccacattgaaatacgccatcaacagcagtaaatttgaagtgaacccccagaagactcgcctgaccaacaagtataacaggcaggaggtcaccggattgaccgtcaatcgtaaggtaaacattagcaaggagtactataggtatacgagaagtatggtacaaagcttctgcgccgaaggacacttcttcaaatcaaaagttcatatggacacggacaaaactaccagggaagccctcaatggaattttgagccatatcttccagattcgcaacaaacaacagattgagtttaacaaccaaacccgcaatttcgacgaactgcagagtacagagaaactttacaccaagttcttattccaccactactttgtgcacccccaaaggatgatcctcgtgggggagggctacacagatcctctgcaccttaagctggcttgtcataagctgtatcccaatagtcttaacttcctgaagttctcttcacttcaacaaaccaagcggttttccaaaattatgggctatcagggaggcacaggactgttaaacaagttcctgaaaaactacaaactgatctaccaggctaaaaatatttctctgaagccctgcctcattatagtggatggcgataccgcagggaatgacgttatcaagctcgccaaatctgagttcaaggagactatcaaactgatcaataagagcttactgactactagttccatcttgaaattctttcacgtgtttgagaatctgtatctgatccagcttccagagaataaagtgattgaggacttttacgactcctcgataaccggttcttgtataggtacaaggacctataatccgtccaacaagaagtttgatctagacaagtattacgggaagaaggaactgttcgaaaagatcatctttaccaatcagaacactattaacttctcggaattcgatctgatctttaacacgatattccatatccagctctaccactatatttacaacaacctcaaaacatga

SEQ ID NO: 8627 - RNA, 1779 nt, unidentified
  source 1..1779: mol_type = other RNA; note = synthetic construct
atgaataatctatttctgctcaagagctgccaaacccagcgcgacctggccattctgctcggatacagcgaaaaggactttacccggatactgttttcaaaacccatcagcacgaagtaccagagtttcgatattcttaagaagaacggcaataaaaggaatatcctggctcccacttcggaactgaaaactttgcagacacggctcagcaaactgctcactaattattacgaagaactcgaacagaaacgactatccactagttcctacgtgaaatgtatttcttcccacggctttagaaataagatcagtgtgcagataccaatttctaagaagaacaggacatctttcgaatccaagattatcaacttagggatctactctaatgcacataagcacgtaggcaaaaagctggttctgaacgtggatctgaaagacttcttccagtcaatcacttttagtcgcataattggcttcttcaccaaaaataagcattttcagctgcctttcgatatagcgctgctgatagctcaaattgcaacctacagattaaatcagagtaaagagggatttttgccccagggatccccatgttcacccattatttctaatctcatcggtaacatccttgacattaaaatgttacgactagctaaagagtacaaattcacctataccaggtatgtcgacgaccttacgctgtccactaacctgccccaatttgacaatgagataatcaagctcgaaggcgatacctggattttgggcagcaccttgaaatacacaatccagagttcaaagttcaacatcaatagtcagaaaactcggatcaccaaccgggataacagacaagaggtcactggactgaccgtgaatacaaaggtcaatatcaaccagaactattaccgttacacaaggagcatggttaacaaattttgtacagagggtgaattcttcaagtccaaagtgcacatggacaaagacaagacatctcgtgaggccttgaacggcatactgtcccacatttttctgatcaaaaaccagcagcaaatagagtttccgcataccacaaaaaacttcaacgagctgaatgggatcgaaaagctatacattaagttcctgttccaccactatttcgtgcatccgcagcgcatgctgatcattggcgagggctataccgatcctatccatctcaagttggcctgccataaactttttcccaattctctcaacttcctcaaattttcatctcttcaggaaactaagagattttcgaagatcatgggttattcaggcggaaccgggctgcttaacaagttccttaagaactataagaccatctacaaagccaaaactatttccttaaagccatgcctgatcatcgttgacggggataatgccggtgatggagtcataaagactgcaaggggagagttcaaagagacattcagacctattaacaatccaccattgagctcaagcgggaaattcgagttttttcacatcttcgagaacttatacatcgtgcaattgcctaagaatcaggtcattgaagatctctacgatacaacagtgacgaccagcctgattgggaagcgcacatataattcttccaacaacaagttcgatcttacgaagtattatgggaagaaggagctctttgagaagatcatttttcctaaccaagacaccatagactttagcaagtttgacctcatcttcaatacgattttccacatccaggtatatcactacttttacagcaacctgaataattga

SEQ ID NO: 8628 - RNA, 1776 nt, unidentified
  source 1..1776: mol_type = other RNA; note = synthetic construct
atgaaatacctggaacaactcaaatcttgcaaaacacagaaggagctggccatcctgctgggatattctgaaaagaacttcacaagaatcctgtttagccaaaaaattagtacccggtatcagtcatttgaaattccaaagaagacaggcagcaaaaggattattttcgcgcctaattctgagctcaagatcctgcagacgcgcctgagcattatattgtccaactgctatgaggaactggaaataaaacgactatcaaccagctcctattcacagtgcatcagttcacacggctttaggaagaaattgacattagacattcccattagcaaatctaacagggaatctttagggagtcagataattaacttgggtatatactccaatgcccagaagcacgttggtaagcgcttggtcttgaacatcgatctgaaggacttttttcagtcaatcactttttcgcgcatcgttggcttcttcaataaaaaccagagattcttgcttgagctggacgtgagcatcttaattgcacagatcgccacctatagggagactacagaggagggctttctgccccaaggctccccatgttctcccattatctcaaatcttatcgggaacatattggacgtcaaaatggtgaaacttgccaaagagtataagtttacctacactcgctacgtcgatgatcttacctttagtacaaatctgcctcaattctctgaaaagatcgtgaagctcaacgataataattgggtcataggaagcacgctaaagcacgttattaacagtagcaagtttgaggttaacagtcagaagactcggctcacaaataattacaacagacaggaggtgaccgggctgaccgtaaattcaaaggtgaacattaacaaggagtactatcgatatactcggtctatggtccagatgttttgtgctgaagggaaattcttcaaaagtaaggtgcatatggaccaggataagaatacgaggggagctctgaatggggtgctatcccatatcttccagataaagaacaaacaacagatcgagttcgatccgaagaccaagaactatgacgaactgcagtccattgagaaactgtacactaagtttcttttccacaattacttcgtccatccacaccggatggtagtgatcggagaggggtatacagatccaattcacttaaagttagcatgtcataagctgtacccgaatagcctgaactttctaaagttcagcagcctgcagcagactaagagattttcccaaattatgggttacaatggcggtacaggacttcttaataagtttctcgagaactaccaactgatttatcaggctaaatcgatctccctgaaaccttgtctcattatcgtggacggggataaagcaggagacggcgttatccggactgcccgtagcaaattcaaagatacctttcagtcaatccgttatacacctctgaattccagtagcatcctcaacttcttccacgtattcaagaatctttacatcatacagctccccaaaaccaaagtgatcgaagacctctacgacacctgcgtgacctctactctgataggcaccagatcttacaacccttccaataaagatttcgacctctccaaattttacggcaagaaggaactcttcgagaagattattttccccaaccaaaacacaattaacttcagcgaattcgacctcatcttcaatacgatctttcatatccagctgtaccactatatcttttccaactccaagaattga

SEQ ID NO: 8629 - RNA, 1782 nt, unidentified
  source 1..1782: mol_type = other RNA; note = synthetic construct
atgaacattctcaagtttccgattagcaaacttgcgcttgctagcgataagaaagacctgtccaatctcctcaattacgattataaagacttctgttggatcctctattcacagcccatccacatgaggtacaaactcatcgagattccaaagaaaaatggcaagataaggatcattcacgctccagattcgcacctaaagcaactgcagaaaaatctggccattcaactgaataaaatcttcgaagagaagaatctgtacgagccagctttctcttttgcctttcgcagaaacaacaacaagcagaaatttggcatttacttcaatgctaaacggcatagaaatcgcaaattagtaatcaacatcgaccttaaagactttttccataccatcgagtttaaacgtatcgtcggctactttaagaggaataagtacttcaacttcccaattgacgtggcgattggtattgcccaaatcgcttgctataaggaccctaatacagggaaaaccttcttgcctcagggaagtccagtgtctccgattatttccaacctgattactgaaatcctcgacgcaaagttcactaagttggccaaaaagtataagttctactacagtcgctacgcagacgacctaactttatcgttcgacacaaataacatcccttctgaaatcgtcaaatgcaacgagaataattactccctgggtagggaggtcatcaaggccattaagtcttccgggtttaacataaataaggacaaggtcagctttaggaccaactttgatagacagcaggtaactggcttagtggtgaacaagaagataaacatccctcggaattattatgactttagtaagtccatggcatataactattgccaatacgctacattcaagaaatcaagctatcacacttttgcaaaaaagaactccaatcagggcgaaagcataataggcgtgctaaactacatctacaatatcaagatggagtataagaaccgaacaactgataaacccccttacatttacaccgaattcaaaatcgacaagcccaaaagccctgagcagttgttctggtcaaagaactcatttatccggctgcttttgcaaacttatttccaggagtcttttgtttatcggaagaaaattcatctgctttgcgagggaaagacggatccactccattttaagaattacatctcaacgcttcccattgagattcagtcttattacgactttaccgccttcaaggaagaggatctgacgatatttcagaaagagttgaatatccgatccggaacccccaatctgaaaagattcatcgagatttacagtactctgtacatatccaaaatgatctttgtgaaccccacaatactcatcgttgataacgacaaggcaggaaacgaagtttttcagtgtgccaccgggagatataaaaagacaaccaaaaacggcaaagtcattataaacagcatcgaaatcgaatatgcctatatttgtaagaacctgttcatcatcaagctgcccaaaataaaccctgaaacaacgattgaagatctgtatgataccaccctcacaagcacaatactgaacgggaaaagtttcacaaaggataatgtgtacgatccgaatatccactatggtaaagtggacttcttcaagaatgtgattcgcaagaaccggactaccatcgattacaagaattttgaggccattattgagattatcaaccgtatcttcaacttgaatttctacctgaacctgaccaatataaattga

SEQ ID NO: 8630 - RNA, 1752 nt, unidentified
  source 1..1752: mol_type = other RNA; note = synthetic construct
atgcttgccacggataaaaaggacttggcaaactttctcaactacgattacaagcatttctgctggattctatactctcagcctattcacacccgctacaacataatagaaatcccaaagaagagtggtaaactaagggtgattcatgccccagactcccacttgaagcaactgcaaaaaaacctggccgtgcaactcaccgagctgttcgagcagaagaatactgggaaaccctccttcagctttgcgtatcgtagaaataacaaggaggaaaaattcgggatttattttaacgccaaacggcacagaaatcgcaagctcgttattaacatcgatttgaaagacttcttccacaccatagaattcaagcgcattgttggatattttacgcggaacaaccattttaagtttcccattgatgtggccatcgggatcgcccaaattgcatgctacaaggacccaaaaacaggcaaggtctttctgcctcagggttctcctgtgagtcctattatatccaatctgataacggagatcttagatgcaaagataaccaaactggctatccagtataagttctattatagtcggtatgctgacgaccttacactatcattcgatactaaaaagctgccgcaggagattatacagtcaaacgagaataacttcttcttaggagacaaaatcatcaaagcgatcaaaagctctggttttaacatcaacaacgacaagatttgcttccgtactaatttcgatagacagcaggtcacagggcttgttgtcaataagaagataaatatccccaggaactactataatctgtcgaaaagtatggcatacaatttttgtcagttcgccacatttgagaaatcatccttccacactttctccaagaataatagcgacaagggcaaaagtatcattggaatcatgacctacatctacaacattaagaacgaatacaacaaccggaccattaatgctgagcccaacatctacactgactttaaaatggagaaaccaaagtcacccgaacatttattctggtctaagaactccttcaataggctctttctccacacctattttcaggaattcttcgtgtatcgaaagaagattcacctgctttgtgagggaaagactgatcctttgcactttaagaattacatctctacactggataagaagatccagaactactacgaatttacggctttcaatgaagataagctcaccatctttcaaaaagagttgaatattcgcagcggcacacccaatcttaaaaggttcatcgacatatatagcaccttgtacgtaagcaaattaagctttctcaaccctaccatcattattgtcgataatgacaaagctggcaatgaagtgtttcagtgcggggtaggacgatataacaaaacatcacagcatggcaaaaccactatcaataagctggaagtggaatatgcctacatctgtaagaacctttttatcctgaagctaccgaaaatcctcaaagatactacaattgaggacctgtacgagccatctgtgacctccactctgctgaatggcaaatcgttcacaaaggacaataactatgacagcaatctttactacggcaaggtcgagttgctgaggaacgtgatcaagaaaaacaagctgtccattaactacaaaaacttcgagacaatgctggaggcaatagatagactgtttctcatgaatctgtatctgaatctcaccaattctatcaagtga

SEQ ID NO: 8631 - RNA, 1785 nt, unidentified
  source 1..1785: mol_type = other RNA; note = synthetic construct
atgagtaagcagttaaatgctctcaaacagtgtcagacaagccgggatctggctaagctgctgggatattcttacaaaggattttgctatgtgctatatagcgccccaattcacaccaaatataggatggtaacaatccccaaaaagaatagccccattggcagacaaatactgatccccagcaatcgtctgaaaatcctgcagcaaagacttgcaactttgctgacaaacatttacctcgagattaatcagaacaatccgtcgtgttgctacgcctttattcccgacagcaatactcagaacttcggtattgtggagaacgccaaacagcacatcaataagaatatcgtcctcaacatcgatcttaaagacttctttacaagcataacgttcagtcgcattgtggggtttttcactaagaacatacagttccggttgaattatgacgttgctatcactctggcgcagatagcttgttatagagcaagtcctacttcccacgcataccttccccagggatccccatgttcccccatcatatccaacttcgtgggtcagattatcgattccaagattacgtttcttgccaaaaagtttcactttacatactccaggtacgcggatgacctgaccttatcattcgacaagaaccagattgacagcaagatactggaatatgatcaaaccacaagggaatacaaactgggaaaactgttggagaaagaaatcctcaagacaaatttccaaatcaactatcagaagttgtgtgttaggaccaaacgcgaacgacagcaggtcactggactagtggtgaacaagagtgtgaacgtcaataaggcatactattaccatacgaaaagtatggccttggagtattgcagaaatgggacgttcactcggtcaacatctcacgccaagaagataggccagccgaacttccattcgttgatggggtactttaactacatccactatataaagcgagagaacctcaaaagacatcagcctctccagcctaaaatcatcctgccagaattgacaaataacgacattcagcgcaacaaaaagattcctaaatctctgaactccttcgagaagatgatgatcaaagctatttttcactaccgtttcgtacattccgagaagattaaaatcctatgcgagggtaagactgacccacagtacctcaacctgtaccttaagataaaaaagtccaactgcttccatcctaccgcattttcagaccacacacccaccttttttcaaaatgagctcaatattcggagcggcacccaaaacctcaaaaggttcatttctgccttccagaacctgtatatcagcaagaatgaataccagctgccaaccattatcatggttgaccctgataaagatggcttcgatgtgttcaattatgccaagtcaaagagcaattcatacatcgaaatacagaccaactcttctatcaaggtcgctcatgtgtttcacaacttatacctgatctcacttccacagaattctagtatcaaccaacagcagatcaattccatcgaggatatgtttgacaaaaccctgcagcaacaaaagattgggaataagaccctctgcctggacaataagtgctcaggccaaaaacacaacaatcattatggcaaggttgaatacttcgaacacatcattaaatcccagaacaatcttagcttttctaacttcgatcgcttatatgaggtcattgagaacatctgttacctgcactttttcaagtgctttagtaagaccttccattga

SEQ ID NO: 8632 - RNA, 1698 nt, unidentified
  source 1..1698: mol_type = other RNA; note = synthetic construct
atgagctctaatctgctgctcctccaaaattgtaagaataggcaagatttggctgacttactggacatagattacaaccagttctgttacatcttgtatgcccagcctatatccaagcactacaacaaagcacttatttacaagaagaacggcaaaccgagagagattctagcccccgataatcatttgaaatatatccagcagaggctcgctatattgctcgcaaaaatctacgacgaggttaatttcaggtctacacaactctgctattcttaccgaaaagacagcgagcaaaagttcgatttccatgaaaatgctaagttgcatatcggatccaaactggtgatcaatgttgacctgaaggacttttttaccaacattacattcagccggattgtagggtatttttcgaagaacaagaacctcaagatcaattatgaagtggctgtcacgattgcccagattgcgtgttacaaagaccccattagtaacaagagttatcttcctcagggctccccatgttctcccattatctctaattttatcggcaccatcctcgatgatcgtctgtttaaactagccaaccgaaaaaagtttacatatagccgctatagtgacgatctaaccttctcctttaacacaaactcctttccctccgatatcgtcactaagatcgaaaagaactgggttctgtgcaaaacaattcgcaacactatcaatctgtgccaattcgagattaatgaggagaagatagtgattcgggacaaatataagagacagcaggtgaccggactgactgtgaataaaaaggcaaacatcaacgctaattactacaagtatactcgggccatgatcgacaagtattgcaaaaccggtctttatgaacggtctaaacaccattccatcgggatcgacttcagtgaaaaatcactgattggtattgccaaccacatcaagaatataaagggcattaagtacaaccacacgaacattattgataaaaacctggagccgttacagatttaccagaacctgaagggcttcagtaaaagctacatcgaccttatgttccatatcaactttgtgcaccagtcaaaaattaagattatctgcgagggaaaaaccgatcctcaacatatctataactatttgaggaacaccgatctgttccacaaaaatcagttcgacatcatttcctttgaaaaacaccttagctcatttacacagccattaaatctttcagggggtaccgatcagctgtgtaagttcattaagatgtactcgcacctgtacaagagcatcgataagtcaaagtatcctaccatcatatttgtcgataatgacccagcaggaaattcaaccttcaatacagcgaagagctattctacttacaatgagataaagatcctgagagacagtattcgcgtagccttcgtctgcaaaaacctgtacattatacagtccgccaagcattgtcccggcatagagtacctttatccatctcatgtgctcgaggaaaagttagaaggaaaaacgctgaatttgagcaatgacaaaatcaaagatgacagcgagtacggtaagatcgtgttctttcacaagataatcaagcctctggggaagaaaatatacctgggcaaatttagatacctctgctttgggttctaccagatcgcacagcacctcaaaaacacttga

SEQ ID NO: 8633 - RNA, 951 nt, unidentified
  source 1..951: mol_type = other RNA; note = synthetic construct
atgagttcaaatcttcagctgctaaaacaatgtcagaatcgccaagatctcgctaatctcctgatactggattacaagctgctatgtttcacgttatatagccagcccatccataacaactacaaaaaggctatcatctacaagaagaatgggtcaccccgggagatactcgcccctaacaagcagctgaaatttattcagcagaaactggcgctgttactgaatgatatcttcgacgaaatcaatttcaggaagactcagctgtgctactcctatcgtaaggattctgaccagaaatatggctttcatgagaatgcaaagctccacaccaaatccaagctggtcataaatatcgatttagaggacttcttcactaatatcaccttttctaggatcgttggattcttccacaaaaacaagaatctcaagatcaactatgacatttgcattgcaattgcacaaatcgcttgctaccgggacccgaatactaatgacagttatctcccacaggggtcaccttgtagccccattatttccaactttcttggtaccattttggatgaacgattgttcaaactgtccaagagaaaaaagttcatctacagcagatatagcgacgaccttacattttcctttactacaaattcgatccctcaggacatagcccagaagaacggcaacatatggacactcaataaaaccttgatcaacaccattaacagctgtcaattcaagatcaacaaggacaagatcattattagggatcagtatcagagacaacaggtgacaggattgaccgtgaacaagaaggccaacattaacaagaactattacaagtacacgcgcgctatgattgataaatactgcaaatctggcctgtacgaacggtctgcctaccacagtcttggtatggccctgttgcataaagatctgaaatataaagccccatga

SEQ ID NO: 8634 - RNA, 1806 nt, unidentified
  source 1..1806: mol_type = other RNA; note = synthetic construct
atgtcctctctccaggcccttagaaaatgtgaagatcgtaaagacttagctactatactcggatattctctgaagcaattcactgccattatttatgcccaatctccccagtataagtacaacagctttacgatacctaaaaagacagggggcaatcgcaacatccttgcacctaaaagtgacctcaaacagctgcaacaaaagctcgccaccctattgtccaagtgctatgaggaaattgaatgtaacagattgactaaactgccaaaaccggttagtattctctctttcagcagtcatggctttcgccggaagatcgacaataagctgtcaagcgacaagttcaactttgacatttatagcaatgctaagtctcatacaaacaaaaagtacgtcctcaatctcgacatcaaggattttttcaagtcaattaccttcagtaggatagtgggatattttgtgaaaaatcgggacttcctgcttgacgtggatgtgtcagtcacaatcgctcagatcgcgacctacagggagacagactctactgaaggttatctgccccagggatcaccgctgtcccctattatctcgaattttataggaagtgtcctggacattaaaatcttacgcctcgccaagaaatataaactagattacacgcggtatgctgacgatatcaccctgtcgactaatctgaaagattttccataccagatagctgtacatagacaggatcgctggatcgtagggctgcaattggagaagattattaagtccagcggatttgaggtgaataaaagcaagaccaggctctacacaaacaacgaacggcaagaggtgacctccctgtccgtcaataagaaggtcaatatcagaaaggagtactatagatacactcgatccatggtcaaccagtattgtatgaccggtatgtacttcaaatcaagtgaacataggcgggccaacatcgccaacgataacagcctgaacggcatcctgtccttcatatactatatcaaacgtgatcgcaaccttgttgtcgacgatgggtatattaaatactgcgatatgaaggggctgcagaagctgtataccaagttcttattccactacaactttatctaccagtctcgcacaaccgtgatcggggaaggttttaccgatccaagacacctccgtatcgcctacaaagttatttataatgctcacaacacgtccattaagttcacttatctgggcaataccaaacgatttagccacttcacaggaatgaagggcggcaccggtttaatcaataagttcttgtcagagtaccagcttatagataagagcatcgccatttcgaagtttccctgcataatcctgctggacggcgacaaggcagggaatgacgtgattaaaatggccgaaaagctgtttaacaagacaatccggaaaattaacatcccaaaagtgggcattatgctattctaccatgtgtacaacaatctatacatccttcagctcgacaaagacgtagatgtggagaaactgtacgatagcaacgttcttcagacaaaagtggatcagcgaacgtttaaccctagtaataaaaagacagaccagaccaagttctatgggaagaaggagttcctggagaaagttattgagcccaataggtcttcaatcaattttagcaacttcgagatagtgttcaagacactcaatcacatccagttgtaccacttaattgcatacaggtctgaagcaggcttggcagcgaaaaccaatttgagcctgatctccgcgaagtcctctaacactacttga

SEQ ID NO: 8635 - RNA, 1761 nt, unidentified
  source 1..1761: mol_type = other RNA; note = synthetic construct
atgaacaaattgagtaaccttcggagctgctccgaccggaagggtctagcttccctcttaggcttctctgaaaagcaactcacaaacattctgtattcctccaatatcaacgagaagtactacaagtttagcattcctaagaaatctggcggagataggagaatactggcgccccacgcttcactcaaactgctgcaatcgaacatggcaattctgcttagtcaatgccatgatgaaatcgagaatgagcgggtaactaaaactgcacagcagagcagcatcctaagcttctcatcacatggctttcggaaagctcttaagaccgataactcactggaaccatttagcttcaatatttacagcaatgccaaaaagcacattaacaagaagtacgtgctcaatattgatatagttgacttcttcgagagtatcaccttttctcgcattgtgggctacttccacaagaatcgtcactttttactcgacatcgatgttgccattttaatagcccagatcgcaacgtatagaccctccatcagcgtagaaggttatctccctcaagggagtcccctgagccctatcatcagtaacctcattgggagtattctggacgctagaattctaaggctcagccagcgatataagctggattacagccgctatgcggacgatatcaccctgtcaaccaacatgaagtcctttccaactgagatcgcctatcttaagaacgacgagtgggtcgtcggatcgaaactgaaaaaagctattgagggatctagattcacggtgaataagaaaaagaccaggctgtatactagaaacaagaggcaggaggttacctctctgaccgtcaataagaaggtcaacatcagcaagaagtactatcggtacactcgtagcatggttaatgaatactgtaagactgggtcctattctaaatcctccgagcaccgctatacagaaatagatagtgacaattcactgaatggcattctctcctacatttactacatcaagaaagaccgtaacgatatcgcaatcgaccacaaattcagggaatacgagaaattggtgtctatagaaaagctgtacgtgaaattcctgtttcactactacttcatctaccccgaaaagatgttagtggtgggtgagggcgtgacagacccgctgcatcttaaagtcgcctgtaaccagttatcaaagtcctcgcgaaaatatatcaagttcagttacctgggggagatggcacgcttttctaaatttatgcggttcagtggaggcacaggccatatccataacctcctgacaaactatcacacgatttttaaagctaagtccctgtctctgaaaccttgtataatcttggtggacggggacaaagccggtaatgacgtcgtgaagcatgcgaagtccttgttcaaagaacgccagctggtttttaagggagccaattgcatacgagcctatcacttggatcataatctttacatcatccagctgaataagggaaaagagattgaggatctctatcacccagacattaaaaaaaccaagatcgggatcagagaattttctagcgagaatgactcaaagaagctagacgtgaccaaacattacgggaagaaagaattttacgagaaaattgtcgtggaagagcaggatacaataaacttttctggcttcaacgatgtattggccacattgtatcacattcagatgtatcacttcatcctttggctcttctcagagaggaagatatga

SEQ ID NO: 8636 - RNA, 1779 nt, unidentified
  source 1..1779: mol_type = other RNA; note = synthetic construct
atgaacatactggaacaattgaaatcatgcacagacttaaacagcctggccactcttttaggctactcccccaaggtgttctcttacatcctgttttcgaagtctatcaactatcagtacgagaaattcgaaatcgacaaaaaggacggcagtaaaaggataatccatgcccccaaagagaagttgaaggagcttcaacgcagtctggccaatgtgctcaatgagtgttacaacatcatagagaagaacagattgaaccttaccaataagtatcagtgcgtgctctcacacgggtttcggaacaaactggttctggatctgcctattagcaacaaaaccaacattaagctgaaaagcaaggagttcatttttggaattacttcgaatgcgaaggcgcacattaacaaaaagtacatcctgaacatcgatctgaagaacttcttccattctattacttttgggcgtatagtcggcttctttgagaagaatatcaactttaacctcaccaagaaggtagctatcctaatagcacagattgctacctatcgggattccacaaatatggtgggatttctgccacaaggtagtccttgttctcctataatcagcaacttaatctcaggaattctcgataagagactctatgagttcgccaaagaaaataaatgtacctacacaaggttcgccgatgacattacctttagcacaaacatcaagaactttccaacgaatctagcaatcttgagcaatgaaaaatacactccatccaatcagcttatccgaatcatcgagaaaaccggctttcttattaatcccaccaagactcgactgaatacattcgaggaccgccaggtcgttaccgggctggtcgttaacaagaaagttaacgtctcctctaattactaccggtatactaagtctatggtgaacaaatactgtcaggagggaatatattacaaatccaaactgcacaccaatgagaaaataacaacctccaattcactacaggggatactggacttcattttcaacatcaagaagccagctttcgtcaaccctacgaattacaaggaattttccaaacttgactcaatcgagaaactcagtctgaaactgaacttccataagaacttcattcacaataccgaaactagaattatctgcgaaggggtaagtgaccctatgcactttaaaaatgcttataagagcctctacaagtcaaacaaatacccattctttttcaaggtcttgacttctttcaactctctggtgaaaattaccggcattggaaatggcaccggcaatctcaagcacttcctgtccatgtataagaagatcaacacgagcaaaatcaataatatcaacccctgtattgtgttggtggatggtgataatgagggtgaaaaggtgttaacagcagccaaaaagatctttgacaagaattgctacaaggaactctcatttttttccccgttttataatcttgacgattttcaggtgctccattgcgaaaagaacttatatatcgttatgctgcccacaaatttcacaattgaggatctatacgacccgatttacaagacttttacccttggtacgaggaccctgaaactgagcaatgaagatctcgatcacactaagttctatgggaagacagagttcttcgaatatgtgattaaacccaatagtcatgtgatcgacttcacaaacttcaaaaagattttcgaggtcttgtttcacgtacagctctataacttttttcatagcaacctgtcctga

SEQ ID NO: 8637 - RNA, 1761 nt, unidentified
  source 1..1761: mol_type = other RNA; note = synthetic construct
atgaatgaccttattctgctgaagaactgcaaaaatcttcaagacttggcctatcttctgggctataccccgagaatactgtcatacactctatttaaaaggagcatactacagccctacacaaaattcgaaatacctaagaaatccggcggtaaacgcgtcatcctggcgccaaacaaagacctgaaaaaacttcagtcagctctcgcagagctcctagactcctgttttaatataatcgagaagaaccgcttggagaacacgtcctataccacatgtatcctgagccatgggtttcgttcaaagttcaaaattgacataccgaaatcacacaagaatcgggaagtcctgaaaactatagacctgaaactcgggatttattctaacgccttcaagcataagaataaaaagtacgtgctcaacattgatctcaaggatttctttaccagtataacattcaaccggatcgtgggttacttctgcaaaaacgaaaatttcttgcttgacaagaaggtggctatcctgattgctcagattgcaacctacagagagattagatcttctgaaggatttctgccacagggctctccaagttcccctattattagcaacctgatagcaggaatcttggacaatagactgaacaatttggcccagcggtataaatgtacctacacgaggtatgccgatgatctcaccttttcaacaaatattagcacatttccaacggaattgtatgattacgagaataaggtaatcgggaagaagctgaataagatcataaaggactcgtggttcgagattaatccaagcaagacaaggctgacccataaccaaaatcgacaggaagttactggactgactgtgaacaagaaggtcaacatttccaaaaactattaccgatacagtcggtcgatgatccataacttctgcattaatggcacttttacaaagtccaaactccacaacaagcctcttgttttaaacattaacagcctcactggtatcactaactacatcttcaacatcaagaatcccaattttgagaagtcccgtaccctgcgggacctcgaggatttatcctctatcgagaaactgtacgtttcgttcaattttcacaaatacttcagcaacaacgaacagcctaacatcatttgtgagggaatcaccgaccccttacacctcaagaatagctggaagaacttgaataaagatcaactggagtacaagatcacgtctctcgaggaaattaaaagtcttcatgaagtgatgggacttagcaatggcgtgcccaatatgacaaaattcctgcgccagtatcacaaactgcacaaaagtaagtacaagaatcctcagccttgcatcctcctactggatggggatgatgagggggagaaactgttaacaaatatctcatctagcttcaagcagaaaaagtctttggacttttataacttccgcgatccctccaacagcctgctgagggtgacccacctgatcaataacttatatattatgcagctcccaaacggtaagtgcatcgaagacatttatgaccccagtgtgctgaccctgactcttaaaggcagaacatacaatcccagtaacaattcctttgataccaccacttactacggcaagaaggatttgatcaagaaggtaatcatcccccaaaagaattccattaacttcgactcattcaacatcatctttgacaccattctacacatcaggctctattcttttttttgtagcaaatga

SEQ ID NO: 8638 - RNA, 1872 nt, unidentified
  source 1..1872: mol_type = other RNA; note = synthetic construct
atgaagaatctggaaaatctcaaatcttgccatacagcagaggatttgtctacacttctggacttcccgtataaacggttcttgatcattctgtatcacggccacatttcctccaagtatagcagtttcgagattacgaaaaaagatcagtcccttagatccattaatgcccctcataaagagctcaagatgattcaggagaggctcgccgatctgctcgaacaatgtttgagcgaaattgagaatgaccgtcttaagaaaaatctggaaaagtttcacgagaacagccctaataaatatcccaagtttcatctgacttcacacggcttcaggaaaaaactgtatatagatcccccctacaatatccataccatcacacctggcatctttactaatgcctatgtgcataccaacaagaatcttgtcctcaatattgacattaaggacttcttcacttccatcaagtttaatcggttggtcgggttcttcattcagaacaagtacttcgaactttctgaggaagtggcctttactattgcaagaatagcaacctttcgaaagaatgacgatgagatgggatatttgcctcaaggttccccgtgttctcctgtgataagtaacctgtttactagtatgctggattcacgccttgtgaaattatgtaagaagaacaaatgcgtgtacacaaggtacgctgatgatatcaccatatcaaccaatctaaagaagttcccccaggaaatcctaactatcatcaacgataaggtgaagttaaatgaccggctagagcgccagtttgaagcctttggttttaacatcaacaacaagaagacgcggattagtaataggaaacaacgccaggtagttacgggactcgtcgtgaataagaaagtgaacgttaaccgatcttactataaagccactagagccatggtggacaactattgcaagacaaacacatttgtcaaaagcaaataccacgtttttcatgagttgaagattgaaaactcccagagcctgaatgggatcctgaactacatctacaacattaagaaggtggagccatacaaactgattgaaaaccatgacgactacttaaaacaccacaatgacttcatcgataagaagaattgggagtcacgtctgctctatcaccatataaacactctgaacgggctggacaaaatctatgcgtcctatatattccacaagaaatacgtctacaacgaaaagaaaagcattatttgcgagggggtaaccgatgtcattcatttcaagaaggcagctgataaattaggcatcacgagcatcaaatttagctctttctcccccgattaccagtttgagaaactgatccacttggacggcggaaccgataaccttaagaagtttctaagcaacctgaagctgctctataaatcggaagtgagcttaaatctcctgaatccaaccattatcattgttgacagagatgatgcaggtaaaggcgttatcgctgaggccaagaaactgtttaagaacagttggcacgagcactcatcatctacagtgcctaacatgaagttctacaacttcttcaagaaattctacatcttccatcttccaatcgtaccctatgacccaaacaagaccgtaatagagttcctgtacaataatagtaccctgctcaatgacaccatttctatcaacggaaagacactgatctgtgaagctatcgcgacctcggaacaaataaagaaaaaggaggtctacagtaagatctcattcatcaagacaataatcccaaagcacgagccatccctggactataaatactttaaacaggtgctcgacgtggttgacgagataagcaaactcatgaaaaccgcttga

SEQ ID NO: 8639 - RNA, 1872 nt, unidentified
  source 1..1872: mol_type = other RNA; note = synthetic construct
atgaagaatctggagaatctcaaaaactgtgaaaatgctagagatctggcgactctgctggacataccctataaacgcttttccataattctctaccgaggacacatctcatccaaatactcgagcttcgaaatcaaaaaaaaggaccagagtcttcgtaaaatccatgccccgtatgaatatttgaaaatcctgcagaagaagctagcaaatctactcgagcgctgtttaagcgagattgaaaatgaccggttggctgagaacctgtctaagtttcaggaaaatcgaccgaataagtatcctaagtttcatctcgcaagccacgggttcaggaaaaaactgtacattgactccccatataacgtacatactatcactccttccatttttaccaatgcccacactcatacaaataaaaacctcgtgctgaacattgacattaaggactttttcacctccatcaaattcaatcgcttggtcggtttctttattcagaacaagtacttcgaactcagcgaggaggtggcctttacaatagctcgaatcgctacctttagagagaatgatgacgtcatgggttacttaccacagggctccccttgtagcccaatcattagtaacctgtttacagcaatgcttgatagtaggttggtcaaactctgcaagaagaatcagtgtctttatacccggtatgccgacgacatcacgatcagtactaatctcaaagaattccctcaggagatactgacagtggtaaacgacaaggtgaaactgaatgatcggctgcagaggcaatttgaggcctttggcttcaacattaatcacaaaaagaccagaatcagtgaccgcaaacagaggcaggtcgtcacaggtctggttgtgaacaagaaggttaacattaaccagagctattacaaagccaccagagcgatggtggataattactgcaagacaaatacattcgtcaaatcgaaataccatgtgtttcatgagcatcagatagagaattctcagtccctcaatggcattttgaactacatctacaacatcaagaaggttgaaccttataagctgctgaattcccacgacgattatctggataaccacaacaacctgattaacaaacggaattgggaaaaccggttactgtaccatcacattaatacgctgtctgggcttgatcgcatgtatgcactgtttatattccacaagaagtatgtgtacgaccacaaaatctctatcatctgcgaggggattactgacgtactgcactttaaaaaggcttcagagaagcttgggatcaataacatcaggctatcttcattcaatagcgagtatcagttcgagaaacttcttcacctggacggcggcaccgataacctgaaaaagtttttgagcaacctcaaactcatctataagtcagagattcccttaaaggatctcaatcccactattattatcgtggatcgtgacaaagctggaaaaggagttattgaggaagcaaggaagctattcaagaatagttttaaggagcacaactcttcaagcgtcaaggacatgaaattctacactttgttccaaaagttctacatcttctgcttgcccatagtgtctatcgacagcaacaagaccgtgatcgaattcctatataacaacagagatctccttaacgaaaccatgtctgtgaacggaaagcccttaatatgcgaagccatcgccacaaaggagcaaattgatcaaaagaaggtataccccaagatactgtttatcaagaacatcctgccaaaatacgaatccatcctggattacacctacttccagcaagttttcgatgtgattaacgagatatcaaccttgatgaagacggtgtga

SEQ ID NO: 8640 - RNA, 1872 nt, unidentified
  source 1..1872: mol_type = other RNA; note = synthetic construct
atgaaaaatttggagaatcttaagaactgcgagaatgcccgagatctggctaccctcttggatattccgtacaaaaggttcagtattattctgtatcgccatcacataagtagcaaatactctagtttcgagatcaagaaaaaggaccagtctctgcgtaagatccacgcaccttacgagtacctgaagatattacagaaaaagctggccaatcttctggaacaatgtctgtctgagatcgagaatgatagattaactgaaaacttggccaagtttaatgaaaaccggccaaaaaagtatcctaaatttcatctcaccagccacggctttcggaaaaaaatttatatcgacagcccatatgaggtccacacaattacccccggaatatttaccaacgcttatacccataccaacaaaaatctggtgctcaatatagacatcaaggactttttctccagcataaaatttaaccggttagtggggttctttattcagaataagtatttcgagctcagcgaagaggtggccttcacaatcgttcgcattgcaacatttagggagaatgatgatgagatggggtacctcccacagggctcaccctgtagcccggtcatttccaatttatttgcctctatgcttgactcccgcctagtgaagctctgcaagaagaatcgttgtgtttatactcggtacgctgacgacataaccattagcacgaatttgaaggaatttcctcaagacattctgactatcgtgaatgataaagtgatcctcaatgatcgcctgaaaagacagtttgatgcattcggctttaacgtgaataataagaagactaggctctcttcaaaaaaacagcgacaagttgtgacaggtctggtggtcaacaagaaggtcaacattaacaagaattactacaaggccactagggcaatgaccgactccttctgcaaaaccaacacattcattaaatccaagtaccacactttccatgagtctgaagtatctaacagccatagcctcaatgggatcctgaactatatctacaatatcaagaagatcgagccttataaactgctagagtcccactcggactatttgaaacaccacaacgaactaatcgacaagaaaaattgggaaagcagactgctatatcatcatatcaacacgctgtccggtctggataagatgtacgctctgtttatattccacaaaaagtacgtgtacaacgagaagaactccattatctgtgagggaatcaccgacgtgcttcatttcaaaaaagcagctgttaagctcggtgtagataatctgaagtttagttctttccactccgattaccaattcgaaaagctgttgcacctggacggaggcacagataaccttaaaaaattcctgtccaaccttaaactgctctataaaagtgaagtttcactgaaggacctgaacccaactattatcgtcgtagatagagatgacgcgggcaaaggggtgattgaagaagctaaaaagctcttcaagaactcacttgaagaatatagttcgtcaagcatctccacgttgaagttctactgcatcttcaagaagttttacatattccagctgcccattgtgccctacgattctaagaagacagtgatcgagtatttatacaataacagtaccctcctaaacgaaacaatgactatcaacggaaagacgttgatatgcgaggccatcgcgactgccgagcagatcaagaaaaaagaggtttacagcaagattgccttcatcaaaaacatcattcccaaatatgagtcaacccttgactacacatattttaagcaggtctttgacattgtcgacgaaatttcaacactgatgaagaccgtatga

SEQ ID NO: 8641 - RNA, 1872 nt, unidentified
  source 1..1872: mol_type = other RNA; note = synthetic construct
atgaccaatcttgaaaatctaaagcgatgtgagactgccagagacttagctatcctcctggatataccttacaaacgcttctctataattctttaccggggccacattagttctaaatactccaccttcgagattaaaaagaaggatcaaacatctcggaaaataagcgcaccttacgagtacctgaagattgtgcagaagaagctgagtgtgctattagagcagtgcctctcagaaatagaaaataataggctggctgaaactctgtccaagtttcaagaaaacaggccgaataagtatcccaaattccatttggtgtctcacggatttaggaagaagatctacattgatagcccttataactttcattcaatcacccccggcatatttactaacgcacacattcatacgaacaaaaatctcgttttgaacattgacatcaaggacttctttacctctatcaagttcaacagactcgttggattcttcatccagaacaaatactttgagctgtcagaggaggttgcgctcacgattgcccgcattgcgacttttagggaaaatgacaaagtaattgggtatttaccccagggatccccttgcagcccagtcattagcaacttattcacagccatgctggactcgcgattggtaaagctctgcaagaagaacaaatgtgtttatacccgctacgccgatgacattacaatcagcaccaatctgaaagaattcccagaggcaattctcacgatggatgaaaatttgattgtactgaacgagcgtctcattcggcagtttgaaaccttcggtttccacatcaataacaaaaaaacacgcctggcaaatcgtaaacagagacaggtggtgaccggccttgtggtcaacaaaaaggtcaacatcaaccggcactattataaagccactagagccatggttgactccttttgtaagacaaatacatttgtgaagtccaagtatcatgtgttccatgagccacagatcgaagattcgcagagtcttaatggcatactgaactacatatacaacatcaagaaggtggaaccatataagctgcttgagcagcatgatgactacctgaagcatcacaatgagttcatcgataaaaagaactgggaaagtaggctactgtatcaccacatcaacacactgaatgggttggacaaaatgtatgggtctttcatcttccacaaaaagtacgtatacaacgataaaccctcaattatatgcgagggtattacagacgtgatacactttaagaaagccgctgagaagcttgggatcactaacatcaagtttagttccttcaattccgactaccagttcgagaaattgctacatctggatggtggcacagaaaacctgaaaaaatttctgagcaacctcaagattctctataaatccgaggtccaactgaatttgctcaatcctaccatcatcatcgtcgatagagacggagccgggaaaggcgtgattactgaggctaagaaattgttcaagaattcctggaaggaacactcatctaccactgtccctacaatgaaatttcttgctctgttcaagaagttctacatctttgaattaccggtggtgccctttgaccccgagaagaccgtcattgagttcctgtacaacaatagcaccctcctgaacgagacaatgatgatcaatggaaagcatctgatttgtgaggcaatcgctagcaaagaccaaatcgataagaaaaaggtgtacagcaagatcagtttcatcaagaatatcatcccaaaacacgaaagctcactggactatacctattttaagcaggtttttgatgtgattgaggagatctctacgcttatgaaaactatatga

SEQ ID NO: 8642 - RNA, 1098 nt, unidentified
  source 1..1098: mol_type = other RNA; note = synthetic construct
atgaaaaatctcgagaacctgaagaaatgtgaaacttcaaaagacctggccattcttcttaacgtaccatacaagatattcctgatcacactctacaatggacacattagcagcaagtatagcaacttcgaaatcaagaagaaagataataccctgcgcaagataaaagcgcctatccagaacctaaaggacattcagaagaaattagcagatttgctggaatactgcttgtctgagattgagaatgaacgactgaagaagatacagttaaactttagtgagcattcccccaataaatatcccaaatttcaccttacctctcacggcttccgcaagaagatttacattgagtcaccctataacgtgcatactatcaatctgggtatcttttccaatgccagtgttcacaccaataaaaacttagtcctcaacatcgatatcaaggacttcttttcctccattaagttcaatcgactcgtgggattcctcatccaaaacaaatactttgagcttaacgaagagatcgcactgactattgcacaaatagccacatttcgtgagaatgatgatgaggtcggttatttgccccaggggtcgccttgtagtccggtgatttcaaatctgtttactgctatgctagatagtagactggtgaagctttgtaagaagaacaagtgcatttatacgaggtatgctgacgacatcaccatttccactaacctcaaagaatttccaaaagagatcctaacaatcgacgaagaccggattgtcttgaacgaacggctgatcaggcagtttgagacattcgggttcaatatcaacaataaaaagaccagactggccaaccgcaaacaaaggcaggtggtcaccggcctcgttgtaaataaaaaggtgaacatcaatcggtcatactacaaagccacaagagctatggttgattctttttgcaagaccaatacgttcttcaaaagcaaatatcatgtgttccacgagctgcagattgaaaatagccagagcctgaacggcatcctgaactacatatacaacataaagaaggtggagccatataagttgctctctcctcatgacgactactga

SEQ ID NO: 8643 - RNA, 1833 nt, unidentified
  source 1..1833: mol_type = other RNA; note = synthetic construct
atgaacgccttatccagattgaagaattgcaacagtatcgccgacatcatcagctctttctccttaaacataagccccaaaaacttcagttatatcctctacatcctttccgacaatgacaaatataaggaattcaccatcccgaagtcagattcatcgatccgcactatctcctgtccggagcctaggctgaaatatctccaaaaggagtttagcaagatcattaatgactgcgtgattgaaattcagcacaagaatccatcatatctcatcgggaatcacgcctttgagaaatataaatccattgcaagcaacgcctacaaacatgagaagcagagatacatcttaaacattgacatcgagaacttctttagtagcatacattatgggcgtgtggtcggctttttacagaatgaccggtatttttccctaagcgaaaaaacctctaagatcatcgctaaacttgcaacacacaagggagttctccctcagggctcacccctatctcctatattggcatcactgattggcaatatagtggattctaggctgatgaagctggctagaaaatacaaactcacctacacaagatacgcagacgacattacattttctagtaaccgcaatttcagcactgatctgctgacctttaaggacggtatctgggtagcgaataagaagctgatcagtgccatcaatcattgtggtttcaagatcaaccacaaaaaaacccggtttagtgatcaaaatcataagcgagtcgtgaccggcgtcatcgtcaacgaatttctgaatacggacaaaaagtaccggaagaatactcgcgcaatggtgaattctctactgagcaaaggggagtttaaaatcctggacagggacaataatgaaatacagggcacaattgaacagctgataggtcgccttaatcattccatttctattaagtatcgcgatagggtgttaaatccacggcttccacgagatgtccgcattgaagtgcagaacaagatcaaagagaacctgatcaagataatccaatacaaggagaacacgacattccttccaaaaaatatcggactggacaagatcgaaaaagcgtttaacattgagaaggacgaagctaaatatctcctctcttttgtgcaaaaacgtgatgaccgtctgatcatccctgattgtaacatacgactgcttcggaacgtgctgttctacaaatatttcttgagcatggataagcctgtgattatcacagagggaaagactgacgctctgtacttcaaagccgccatgaaaaaactgctgatttccaatgatttgtacttcgtcaagcacaaaaagaatggcgagctggacaagttgggacttaccgggggtaccgctcccataaatgccttcttcaagtacgtgtacaatgataacaacttcgtggattttcacaagattaatgttaagcccaagtctcccgtcatcttcattctggactatgatgatgggctggataaggtgaaaaacctcctaaaaaagaacttcagcgagggcaaaagattttcccagattaagcggaacatttatatactcctcctgaacaagtttggcgatggggaggatttcaaaaaggacaacaaggtatgcatagaaaacttgattagtttcgatggagagaagattgctgtttcaaatgaaagagtttcctttcagggaaaagaactctcgaagaacgaatttagcaaaattgttttggaggagtacgagaggttcgactttactaatttctcaatcgtattctcggagatcaacaacattattaaccacttcaactacaacagggactga

SEQ ID NO: 8644 - RNA, 1854 nt, unidentified
  source 1..1854: mol_type = other RNA; note = synthetic construct
atgtcgacactaaataaactcaggaaatgcgacagtattgaggacctgatctcatccttttcactgaaaattaccgctagccagttcagttatatagtgtaccgtgtccaagatagcgacaaatatcatcagtttacgatccctaaatctgatgggactacgcggatcataagctcacctcacaagaccttaaaatatcttcagaaggagttttccaagatctttatgcagtgtatcaccgagattcaacagaagcaccctagttacttagccaagaatcacgcatttgagaaatacaaatccattgcctcaaatgcctccctgcacaagcgtcaaaagtacctcctaaacattgacatcaaggacttcttttcttcaatacactacggtcgcattataggcttcctgaagaaagacaaatacttttgcctgtctgaccgaaccgcgaaaatcattgcgaaacttgctacatatgacggggtcctgccacagggaagtcccctgagccccatccttgcatccttgattggcaatatcatcgatacacgcctgagcatgattgctagaaaataccatctcgtatatacacgatatgccgacgatatcactttcagcagtaatagggatttttctaagtacctgctcgacaacaagaataatatttggcatcccaataacaagctgatatcggctattaacaagtgcgggtttagcatcaacatcaaaaagaccagatatatcaacagataccacaaacaggttgtgaccggtataatcgtgaaccattccctaaatgtggataagaagtacaagaaacacagtagagctatggttaataatctgcttaggacatcacaatttcaaattcataagggctacaactacaaatacaccggcaatatcgaccagttgattggacgccttaaccacgcaatctctatcaagtatagggaccgcattctgaacctgaacctcctctcggaaattcggaagtatatccagttcagcattaagcggaacctgatcaacataattaaatacaatgggcgcactgacaaaatcaaaaaacatatcggcattgatcggctggaaaggacctttgatattaacaacgaacaagtgaagaagtacttaacattcatccagaagaaagacgacactctctatccatccgacaatcagatcaagttactcagaaatgtgctgttctacaagtacttcatagggatagagagtacgtatatcttcaccgaagggaaaaccgatcacatttacttgaaatatgcattccaggccttgaacttcaccaagaacgtaaagatcatcaaacacaactctaatttggagaaactgggcctgtccggaggtacagaacctattaaccagtttattggacgggcctatactgataatttttatgtcgacttcgacaagatcaatatcaagccaaagcatcccgttatatttttgcttgactatgatgatggcctcaaaaagatagagagctatatcaaacggtgtttcaagacaggagatcagttcgcccatattaaagagaacatctacatcctactgctggaaaagcttactccgcagcaggacaagtacaattataccgaaaagaacaagcagacttgcatagagaatttgatccactacaatgactccaagataatgatttcttctaacaaccacgattgtgtgattttcgatggtaaggaaatcagcaaaaacgacttttcaattaaggtgcgagagaacaagaactcctttgatttcaacaatttctctagcctgattacagccatcagggatatcgagaatcatttcaaaactaaggtcaaactcgattga

SEQ ID NO: 8645 - RNA, 1842 nt, unidentified
  source 1..1842: mol_type = other RNA; note = synthetic construct
atgaacaccctaagcaagctccaaaaatgcaatagtatcgacgagctgatttctagcttcagcctgaatatcactccaaagaagttttcctacatcctctatgtcttgcaggacaatcagaagtataaggattttacaatccccaaatccggcggcggaatacggacaatttcttgccctgaaccaacgcttaaatatcttcagaaggagttcaacaagatctttatttcctgtatcgacgagatcaaacagataaaccccagctatctgatcagcaatcatgcgtttgagaaatacaagtcaattgcttctaacgcctacaaacacaagaacaagaagtacattctcaatattgacatcaaggacttcttttcaagcatccactacggccgcatcatcgggtttctgcaaaaagaccggtatctgaaactgagtgaaaaaaccgccaaaatcattgccaagttagctacatacaatggcactttgccccaaggcagtcctttatccccaattctggcctcactaatcgggaatataatagatgccagacttttgaagctcgcaaagaagtataaattgacatacacccgatacgccgacgacataactttcagcagtaacttggatttttcctccttcctgcttgaaaaggaaaataatatatgggtcccaaacaaaaaccttattagcgccgtcgaatccctcggttttaagattaacaacaagaagactcgctatacagacaaatatcacaaacagattgtgactggactcgtggttaataaattcgttaacaccgacaagaactataagaagaaaaccagagcgatggtataccagctttttaagatcggcgagtttaaactgactggaaagaataaagacacgattacagggtctattgaccagttaattggccgtctcaatcactctattagtatcaagtacaaggataggatcctaaacccttttctgctgaataacgtaaggtccgaagtcaaaaataaacttcgggataatctgatcaacattattcagtatcggggcgaatccaatctgttgccaaaagatgtgggaatcaataagctggaggaatcgatcttcatagaaattgaggaagctaaaaagctcctgtctttcaacaagaacaagaacgataagctaatcattcccgacgatagtataaagcaactgaggaacgtgctgttctacaaatacttcataagcttcgcaatgaatgggccggtgataattacggaaggtaaaaccgatttcttctactttaaagcagctatgaagagtctgtcaatgaacaacaactttaagttcatccgacagaataatagaagcctggagaagctcggtctgagcggaggcaccgaccctattaacaagttcatcaagaacgtgtatcatgatgagaaattcgtgaacttttctaagctgaaggtgcgcccgaagtaccctgtcatctttatcctggattatgacgatggattggataaagtgtcccacattattaaagagaagttcaaagacgggacccagtttgcacagattaaagagaacatctacatactcctcctgaagaaaattacactcaattcttcagggaaaatggattataccaatgagccctcgaaagtttgtatcgagaatcttatcttactgaacgggaacaagataaatgtaatcaacgatgaggttgattacgagggtaccaggacttcaaaatcttgctttgctaaggaggtgtcaagcaatttagagaagttcgacttctccgaattcaagaatatcttcgacaaaatcgaagacatcgtgacccattttcatacatga

SEQ ID NO: 8646 - RNA, 1845 nt, unidentified
  source 1..1845: mol_type = other RNA; note = synthetic construct
atgaatctgcaaaagctgcgaaactgtcaatccattgaggaccttatttcctcatttagtatcaagactaccccgagaaaatttgcctacgtggtatacaagatcccagataaccagaaatacattgagttcgagatcaaaaaggcaaacgggagcctacgcaaaattgccgctcctaactctactctcaagtatctgcagaagctttttgccgacataattttaaactgcgtgctcgagattcaacagaaggataagaactttctggttactaatcacggttttgaaaagcacaagagcataataagcaacgctcgtattcatcagggaaagaagtatctcctgaatctcgacatcaaagatttcttcgagtctattcatttcggccgcattaaaggatttctttctaacgaccagcactttttactgcacaataagacagctgaaatcatcgcgactttggccacttacggcgaaagaaaaactctgcctcagggatcccctctgtctccaatactcagcgtcctcatcgggtccatccttgatgcaaacctcatgaaaatcgcaaacaagtacaatttgtcctacacccggtatgcagacgacataaccttctcaagcaataaggatttttccaaattcctgctgagaaaagaccagaatggcaattggcagctaaaagggaagttcgagaagtacattaacaaagtggggttccatatcaacaaggaaaaaaccaggtatacgaacatcaataacaaacaaatcgtcacgggtttgatagtgaacaagttcacaaatacagatcagcggtaccggaagcagtctagggccatggtccacaaactgtttcaaactggtaccttcacccccgattcaaaaaatgatggcagactgtacaatgaggattaccttattgggcggatttaccactctatatcagtgaagtacagggaaattgtgatcaatcctaatttgctgaccaatgacatcaatatcatcaacaaggaaatcaacaagaagatttccaacctgattcgctatgataaggtttgtgcccccgactataaacctaattacacagccaatgacatactgaataaattaacaccaccctttacggatggattaattgaaagtctcagcaaatctctagtgaaacgtaatatgccgatagacagtgacaatcagattaaactcctgcgcgatatcctgttcttcaagtacttcgttaatatcaactcccccgtcataattccagaaggtcataccgatagcaaatatctgaaaatcgccatgaagatgttaaacatcaacatcgaccttaagttctacaacattaaccccagtctggataagttgggcctcaatggcggaacagctaaaatcaacagctttatccagaactgctatagcgacaacaattttgtttcgttcaataagctgaagatcaagtctaagcatcccatcatatttattctagactatgacgaggggcttaagtcatgtgacgaaattctgaagtatttcaaagatggcagcaattatgcgaggattaaagaaaacatcttcgtgattctgctgaacaaatacaaaatcctggaggataagaagaagaaggatttcaatatcaaggatcatcaggtatgcattgagaatctcatttcacacaacagtcagcgaatcaacgtggacaaagacaaccatgacaaagtgtcgtttaacaacgagttgatatccaaatccaagtttagcgagttggtcgagaataatacccacctttttcagttcctcaactttagtaccatcttcgacacaatcaagaaaattatccacgagtattga

SEQ ID NO: 8647 - RNA, 1749 nt, unidentified
  source 1..1749: mol_type = other RNA; note = synthetic construct
atggccaagtatatagatcgactaagaaagtgcacatgcattgcggatctggtaagcgagtttaagctgaaagtaactgcaaaggaatttggttacgtggtctatcatctttccgatgatctgaagtacgaggagtttgatattcctaaaaagaacggcaccctgagaaggatccattccccgaagcccacattgaaatacattcagaaggaattcagcctgatcatttttaactgtatcaacgagatcaggctggataatgccaattatttggcttgtaaccacgccttcgaacgtgacaagtccattcttagtaacgcagacctgcataagaacaagaagttcatcctgaacatagacatcaaagactttttcgacagcatccactacggacgcattaaaggttttctggcaaatgactcacacttcaaactgaatgagaaggtgtcccaaataatagccaggttagccacctatcataaaattctccctcaaggctcaccactctctccaatactggctaccctgataggaaatatcatggacgtgcgctttcttaagctagccaagaaatatcgatttacctacagtcgttatgctgatgacattaccctatcatctaataaggccttcgataagaatattgtctactggtgcgaaaacaataaaaaatgggtggcgggcgaaatagtgatcaatattctgactgacagcgggtttactatcaattcagagaagacccgcgtgtcttatagcaacgatagacaaactgtaacagggatagttgtcaacaaacagcgcaatgttacacttgagtatcggcggacaaatcggagcatggtttactctctcttgagcacgggctcctttagattaaacgataatgtcgggaagattactcagttgatgggccggctcaatcacagtatttacattaagtactacgacagcaagttctcaataccattggatatgaacgagcgcatcaagtacaaggaaaaaaagcagaaagagctcatcaagattattaacgacaattggaagagtgacaaaaataacatcacgtgcgcagatcatcagatgaagctgcttcggagtgtgatctacttcaaatatatcatcaacgtggaccagaccaccattttccccgagggctttacagatcctatctatttctcttcggcaaaggagaaattgaacatcaattccaacatcaagttccagaaaatcaacaacggactcaaaaaaattggcctgctcggatgtgcctcttctgtcaataccttcattcacaatgtgaaggaaaagattgacaagttcatctcgtataaacaaatcggtgtcatccctaagcaccccgtgatttttatactcgactatgatgacgggctcgacgattgcaggttcatacttgacaaaattcagatcgaccagcagtatgtgtttattagagacaacatctacgttttactgctggagcccaaaggcaaatctaaaaatcatcacaagacgatagagaacatgtcctgtatcgaaaatctgatctcattcgaagggaaccgaattgaggctgttcagggaaagaaagaatacatcaacttcaagggtattgagtttaagaaaggaagtttcgccaattacgtgaaagaacactccagcgattttgattactccgggtttgataaaatcttcaagaagatcacagagatcgaagaggactacgctaaaaggatgatcactaacgcttga

SEQ ID NO: 8648 - RNA, 1794 nt, unidentified
  source 1..1794: mol_type = other RNA; note = synthetic construct
atggaagtgttcatcagtatgtccagctatttggaaaaattgaaatcttgcacgtcaatttccgacctgataagcgaatttgagcttaacatcactccccagcagttttcttacattgtgtacaaggttgaggacagcaagaaataccagacgttcactatcctaaaaaaatcaggcgacgatcgtatcattcagaagccccataactcacttaaagaaattcagaagtcgatcgccaacattttaatgcactgtgtggacgacatacggaaggataagcctaattacctcaagtgttctcatgcattcgagtggggtaagagcatcgtcagtaactccgagatccacatcaacaaaaagttcgtgctcaatattgacattgcagactttttcgatagcattcactacggtaggattaagggcttttttgtgtctgactactacttttctctgaacgaaaccatcgctcgggtgatagccaaagtggcaacttgtaacgggacactacctcagggaagcccgctgagccccatcatcagttcgctgatagggaacctgatcgacataaaattcctcgaactggcgaaaaaatatcgtttcacttatagccggtatgctgatgacattacattgtccagcaataaagaactgtcagatgagctggtgatttgggacagagaaaataatgtctggaaagtcaccaatacaattgagagcttgttgaacagaaagagtggattcaagataaacgagaaaaagacccgatataataggttttcctccagacagctagttaccggtattgttgtcaacaaggagaaaaatgtcgtgagagagtataagaagcagaaccgctctatggtgaattctctcctgaatacgggagagtttttcatcaaagatatttccgatgagcacatcaaagggactatcgaacaactgattggccgcctcaactactgcatctatgtaaagtactacaagccaaataaccttacaaagctggacttggactcaaagattgacaacaaagaggataaccgcaagaatataaggaaaatggtatcactccggattgataagaatgacgaaaatttcccgttacagaagccagatcaccagatgtatctccttcgaagtgtcctctttttcaaatacttcaccaatatcacacagactaccatataccccgaaggctatacagacccaatgtacttttctatagccaccgagaagctgaacaaaaaagggcttttttacttccaaaagatcaatgattccctgaagaaactcggactgagtggaggggcttcatccgtgaattactttatttccaagttcgttgagcattcctatttcatcaggttctcgtctattgtacctacccacccagctatcttcgtcttagattatgacaacggccttgatggttgccaatatatcctgaattccaaacgctttggcttcattaagaagaagaacattcagttttcccatatcaaggataacgtgtatgtactcttactgagccctatcagtaacgagaaaagttggaagaaaaaggagaactataagtgcatcgagaattttatcacctatcaggggaagatcattcaagtgagcgatgaggagggcgaatacgttagctttaaggacgacaagatcaaaaagtacaattttgcccaatacatcatgaataagcccgatgaattttctttctcagaattctctaacctgttcgatcagatatcactgatcgagagcgactacaaagaacggctggccatgaaatga

SEQ ID NO: 8649 - RNA, 1773 nt, unidentified
  source 1..1773: mol_type = other RNA; note = synthetic construct
atgaataagaccacaattgacagactgcggagctgtacttcgattgcagatcttattagcgaattccagctgaagatcagcccttcaaagttctcatacattgtttactgcctcagagacgaggacaaatacaccaagtttgagatccccaaaaaaagcggtggggtgcgtatcatccacagtcctaaagacagtctgaaatacatacagagggaggtcgctactatcttgttaaactgcattgatgacatcaagctgagtaaccctaattatctccgatgcaatcacgcgttcgaaaaagataagagcattgtgtccaatgctaatctgcacgaacataaaaggtttgtcctaaacatcgacatcaagaacttcttttccagcattcattacggccgcatcaagggcttcctgatatctgacgccaattttctcctgaatgagaaggttggacaaattatcgctaagctcgccacgtataatgggtatctgccccaaggagctccaacttcaccaatactagcctcattgataggcaatatcctcgatatccggcttctcaaattggcgaaggaataccgtttttcatacagtcggtacgccgatgatatcactctctcttctaaccaggaactgcctaatgagcttatctattgggaaaaggaggaaaacatttggatagcaggtaacaagatcacaaaggtcattaagaaatgtgggttcgaactgaacccgctgaagactaggtatattcgcaacaccaaccgacagattgtaactggcattgtggtgaataaaaagcggaatgtggtgagtttataccgaaaaatcaatcgcgccatgacgtatagtttactttccacaggccaatatactattcgggatgtgtctggtctgttgtccaatggaacaattaatcagctgatcggccgcatatcccattgtatttacgtgaagtatcataacccccccatgatccatccgttaaactcccaaagggcagatctgaggaagaaaaattctgagagagtgacaaagattatcagtgataactggaatagagactcaaagtccaacatcaattattattccgaccaccagacgatgttgctcagatcggttctgttctttaaatacttcataagcaacgagcgcaccacaattatacctgaagggttcaccgatccaatttactttaaaaccgccctgtctagccttgagattaacttgaaccttcactttcagaaactgaacagagagctgaaaaaaatcggtatctatggcggggcctcattcgtaaacagcttcttatgtaacatcgaaaccgaaaagaaagggttcatcagctatggaatgattaagcaaaccccacagaaacccgtcatctttattttggactacgattccggcctcgaggactgcaaatacctgctgtccaagatgaaagacggagagcagtatatcaacatcaccgacaatatttacatcctgctactaagggtcaaacacaataaggatcacaagaacataaacaaccatatctacaccgaacggcttattagctaccagggaaataaaatacaggcaaaagatgacaaccacgagtacatcctctttaagaacgaggagtacaagaagtacaatttcgcaaagtatatctctcagcacaaggatgagtttaactttgactctttcaaggacatattcgacaagattaaggaaatagaggatgactatcaggccaaactcgctacaaagaatatcaaactgtga

SEQ ID NO: 8650 - RNA, 1761 nt, unidentified
  source 1..1761: mol_type = other RNA; note = synthetic construct
atgactttatacctggagaaattgaagaagtgcaattctattagtgactttatccgcgagttcaatttgggtctgtcagccaagcagtttggctacattatatacgggcttccggaccacaagaagtacgattccttcgaaatacttaaaagtaacggagatcttcgaactatacacgcacctaagaagagcctgaaattcctgcagaaacaattcgcttctatattcctccagtcaattttggacattcagaaacagaaccatcattatttgcgttgtaaccacgccttcgagaagaataaatcaatcatctcgaatgcccgccatcaccagaaaaagaagttccttctgaacattgacatttccgattttttcggaagtatccattacggtcggatcaagaactttctcatcaacgacaaatactttagtatgactgagaaaggggcctctattatcgccaaactcgcagtgtatcagggtaaactgccacagggcagtcctctcagtcctatattagcaacactgattgggaatctgattgatgttaggctgactcagatcgctaagaagtatcgactgacatataccagatacgctgacgacatcagcttttcttccaattttcccctgcctgagaaactggtttattgggacgactcacaacaaatctgggtagccggtaagatcttagagaaggtgattctgaagaccggctttctaatcaatcccaaaaaaacccgctataccacaattccatttagacagctcgtcaccgggattgtggttaacatccatacaaattctccgtccccatataagaaacaaaatagggcaatggtgaattccctactgaaaaccggcaaattctatatcgagaagaatggcatccagacgaaaggaaccctcaatcagttaattgggcggttgaatcatactatctacgcgaagtatcacaaacccacaaccgacatcaagcttgaccaggaggaaagggagaagtttaaagaggaaaacaggaactacatcatcgagattctcagcaaaaaatggcacaagggcaagtccagctactcagaagccgatcaccaaaccaagctgctaaggaacgtgcttttttacaagtactttaatagcctggacaagacaaagatctttacagagggtgtaaccgatagcatatatttccagatcgccgctgaaaaattcaacctcaaagacgacctttcttttcaaaagacgaacatatcactgaagaaactagggctgaagggcggcgtccccactattaagagcttcttcaagaacataaaggacaacaactttatcaacttgaagcagttcaagactaactccgagtatcccgcgatctttattctggattatgatcagggactcgatggatgtccagagatcattgagaagttctctaacgggcgccagtactgtcacataactagaaacatatacgtgctgttgctcaaaccttacaacggcaaaggggactataagaaaaacaagatctgcatcgaaaacctgattagatatgaaggcggacaaattgaagtcgatggagccaaaaatgaaaatgtgtgctggaataattcgctgattagcaaaatggctttcagcaagtacatttccaatcacaaaacggactttgatttcaccgaattcaagaagatcttcaatctcattcaggatatcgaacgggattacttccgtcggctgacacaggcacaagctcaggatgagtggtga

SEQ ID NO: 8651 - RNA, 1776 nt, unidentified
  source 1..1776: mol_type = other RNA; note = synthetic construct
atgttcaatcatctgattaagctgaagttatgtaacaatgggatcgatgtggtcaacaacttccacaactatcttggtattagcgtgaaagatttttggtatatcgcctattctcttaaccatttcagtcagttcacaagctttactattctgaaggcgtcaggaggcgaacggacaatactaattccgccacaacccctcaaggatctccagaagaaatttgccacaatcctaaacttctgcatcagggaaattcagcaagagaatccaaactacttaatctgcaatcatgcattcgagattaaaaagtcaatcctgactaacgctcagatccataggaacaaaagatacgtcctgaacattgatctcagcgatttcttcggctccattcattatggccgcatctccaatttttttaaggccgataagtacttcagacttaatgacaaggtggctaaaacactggctcaattggcctgttttcgcgacgagaataacaaaacatttctccctcaggggagccctctctcacctatcatagccagtctgattggaaacctgctggacatacgcttggttaagataagtaaggagtataagctgacttactcccgatatgcagacgacttgaccttttcctcaaacaagcccattcctgaagacctggtgcggtggaattccgaaaatttcatttgggaggctggagatagattgcggagagtgatcgaagattcaggctttaaaatcaacgataagaagacccgtttattttccgcaaagaagcggcagacggtgacgggaattaccgtcaataagacgctgaatatatccgaatattaccagaagcacaatcgagctatgctttattccctgttcacctctgggaaattcctgatcggagataaagagggtaccattaaccagttaatcggtagactgaattatgtcgcttctgtaaaatacctcaaacagcatcacgacatgagcattcaagagtgggaggaggagcgaaagaaattcgcctacttgtgcgcgggcaattttgacaacaaagagaactctaataggagcatccgcctcttgaggcaagccatattctacaagtacttcattggcaataacaaaccgatcatttttcccgaaggcatcactgattctatttacttcaagctcgccaataaaatactgaatcccaatgaacacaaggaaaactacatcattcagtctattaacagcgagcttactaaaattagcctaggaggtggcaccgcactgatcaatagttttctactccacgcatacaaagactacttcatcaacctgaaaaatctgaagataaagtcgaaacacccagtcatcttcgttctggactacgaccaggggctcgacgtgaaggacaagaacgagaagtcaaaaaataacatccccgagacacatcatatgaaggacgggcagcagtgggtgcacatcagagagaatatctatctcgtactgttgaggcctttagctcttgaaaacaaaaagccaactttccggaatgcgcttgaaatgacctgtgttgagaacctgctgagtcacgtatcgatagggaaaatcaaggtggatgatgaaaaccacgaaaacatcaaatttcgcaataggagctatccaaagaccgtgtttgccaaatatgttgccaagcgttctacacactttgacttttccgagttcaaaaaaatcttcgagatcattgacgagataaagaagcacttttaccagaacagtatctctatttga

SEQ ID NO: 8652 - RNA, 1860 nt, unidentified
  source 1..1860: mol_type = other RNA; note = synthetic construct
atgaaggagaaactgtccaagttgaagaaatgtaccaccaggatcgacttcttaaacatattatttcctggggaagggagcaaaaacgaatacttgaaggtgatcttctccgtgcctgatgagaagaaatatagcacctttaagatccccaaaaagtctggaggcacccgtgaaattctcgcccccaaagaggacctcaaaaagatccagaagaaactcggggattttttgagcgattgttaccaggaactttacggagacaaaaataattactccaacgcttacctgaaggagaagtctattatcaccaatgccaaaaagcatcgtaacaagcgctacgttctcaacatcgacctggagaatttttttccctcaattacctttggccgggttcggaactacttcatcaagaacaagtattttgagcttacagaggaaatcgcgactctgattgctaagattgcatgctacaaaggcatcctcccacaaggttctccatgctcaccaattatcagcaatttcatttgccaaatcctggacatccgattaggaaagctggcaagcaaaaataagtgtcactattctcggtatgccgacgatataacctttagtacgaacctcatgatgtttcccgaaaacatcgcccactggaatggcgacaagatcatagtgggccaggaactaggctccgaagtgacccgggctggattcaattgccaacattcaaagacaaggatctacggaaaagacaaaaggcaagaggtgacaagtctcactgttaatagaaaagtcaatgtgtcaaggaagtattttgattccactaaagcaatggccagaaagtactatctcacagggacatgtgagataaacgggcaggaggccacttacaagcaaattctgggccgctttaactacattaatcagctggagaagtacaacaacaagatttttttcaagcagaacgaggctaaggaacccgaaaacatttttacccccgccaatgaaaaaccactggaaaccaatcagaaagatagtgtgatcgcaccagtacagctaacttacaattctaagtaccacaccttcgcagtcaatggctccaaagagaaggagttagggaaatatggttacaaggttggatacgattatctctccgcgcgcgaacaggcatactcgaagttcctttattatagtacgttcatagctaaccagaaacctattattttgactgaggggaagacagatatattgtatctgaaagccgcgatcaaaaacctctatttggagttccctaatcttgtggagaaagtgcaggataagttcaacttcaagatcagtttctacaactattccaaacttaacaggtacctgctgaacatcattccgagcggtgggggaatcctgagagtcctgtctccgcagtatttatttccctctgactcactgatcagtaaacatcctacaattctgctgctggacaatgaggaaaagaagggtaagccactggctagacttctgggcaatggaaagcttaagaaggagattgtcaaaaaagatttcgccagcctggacaaaactaaaatcacgctaaaagagtcagatgagctgttcaatcgagtcaagggcgtggataagttttttctcttgactattccgcggatcgagtctgataaggagtccgacattgaaaacctgtttacagaggatttcataaaggagcaggaattcgacaaagaaagcaaaggtgctaaaaacgagctgtcgaaaattgtaagccgcgactataagaagatagacttcaccaatttcaagcctcttctcgaaaatctaacaaacataatccgcgccaacgacaataaatga

SEQ ID NO: 8653 - RNA, 1353 nt, unidentified
  source 1..1353: mol_type = other RNA; note = synthetic construct
atgcctattgcacctcagcttaccatcgtgaaaaacaagacgaaaacaatgagcaagaacaacaagctgtctgagcttaagagcgcaaaaaacattacagacttggccaagatcatcagtgtgccacgacagtctataacatacgtgttgtatggcatcaacaggctcaacctggcaaagtaccacacctttaaaatacccaagaaggacggatcagaaagaaccatcaatgcccccgtcaaagagctaaaagacatacaaaaaaaggtgtctagccttctgcaggagtgtttccgtatcgtctgcattctggaaggtcacaggaaccatctgaaaaagattaattccctgtcacacgggtttatcaaagggaagtcgatcattactaacgccacacctcacaaaaataagcggtttgttctcaatgtcgatttgaaagatttctttggccagatccactacggacgggtctacgggtttttcaaaaataacaagcacttccagctgtccgatgaagtggccaaggtgctggccaacatcacgtgttaccagcagggcttacctcagggcgcgccaacgagtccggtaatcagcaatctgatcgccgggattctcgatatcaaattggctagcctggctaaaaagtacagctgctactatacccgctatgctgacgaccttacattctccacaaatttgaaggagtttcccccccgtatcgcttctatcgaaaatggtgacgtaaggattggcagttctctcgaaggaataattaaaaaatgcggcttcgacatcaaccataaaaagaacagactccaattctgcaatagtcgacaggacgttaccggtatagtggtcaacaagaaagtgaatgttccctatgattatcgcaataaggctagggtgatctggcacaagttaaagaatggcaaggagatatatgcaattaactctcagccagagataaagaaggacatcaactatctgattggaattctctcccacatccataatgtgcggcgcgagcatagagtgactactaaagaggagtacattattccaaagaaaccgaacaagaagacttttgatgacatctttgatgcggattcacgcatgtacagggacgttctgttcttcaagaatttcgtgaagaacaagaaaccagttatagtctgtgaagggaaaaccgatattacctacttacaatgtgccctggaatcacaggccgcaaaacatagatcgctgattatcaagaaagagctccaaattagcttttttcggcctacaaaaactatctccgaactattcaaggtaactgggggaaccggcgatattggaaatcttatctcctga

SEQ ID NO: 8654 - RNA, 1731 nt, unidentified
  source 1..1731: mol_type = other RNA; note = synthetic construct
atgtctaagaataacaagttgtccttacttaagtcagctaacaatacaaaggatctcgcagaagtgctctcggttccatttcaggcgataacttacgctatctatggcatcaataggctgcgcctgcctaaatacacgacttttaccataccaaagaaagatggcaccgcacgccggatcaatgtccctgtgaaggaccttaaggacatccagaagaaagtggccgcgttattgcaagaatgcttcaggattatttgtatcctcgaaggccacagagatcatgacaaagagatcacaagcatttcgcatggcttcatcaagggaaagtctattattaccaatgccatccctcataagaatagccggtatgtgttaaatctcgatctgaaggacttttttggtcaaattcacttcggaagagtctacgggttcttcaagaataacaaacactttgagcttgaggatgaggtggctaaggcactggccaacatttgctgttaccagtctggcctgccacagggggcacctacaagtccgatcgtgtcaaatttgattgccggaatcctggacatccgcttagcaagcttggctaaaaaacacagctgcttttatactcggtacgcggatgacctgacattttctacaaatctgaaagaattccccaaagaactggctattttcgagaacggaaatgtgacgattgggacaagtctgaacaaagtgatagacaagtgtgggtttgaagttaatgtcaaaaagaacaggcttcagttctgtgactcacggcaggacgtgaccgggctaatcgtcaacaagaaggtcaacgttccctcagattaccggaaccgagcccgagtaatctggcacaaaatgaaatccggaaaggagatatatgccataaacgccaaacctgagaagaaagagaacatcaactatgtaaccggcattctgggccatatacataatgttcgtcgcgagcatagaatcactaccgccacggaatacgtaatcccgaaaaagccaaccaaggccctgatggactccatcttcgacgcagattctaggatgtacagagacatgctgttttttaagaacttcgtgtccggcaaaaagcccctgattgtgtgcgaagggaagaccgatatcgtatacctgaaatgcgctcttcacagtcaagctgcgaaacaccgatcactcattctgagtaaagagttgaaggtggattttttcagaccaagtaagaccatcggagagctgttccgtgtgactggtggtactggggacattggcaatctcatttctaattactcaagctactgtgatgagtttaaaaggttcagtctcccccagcccgtcataatactcattgataacgattccggagcaccaagcgttcgcagcctggtttcccagatcacaaaatctaagtttgataacacagacaccttcacccacattatcaagaacctatacattctacagactcctctggtcatgggcggcgatagcgccatcgaagacttctttgacgctaagactttgaacgaaaagcttggaaagaagtccttttcctataagggtaatttcgattcttcaaagcactatggtaaaaatcacttcgccgagtatgtggtcaaagtgaagaaaaacagcatcgagttcaaagggtttaacgtgctcttcgactccataaaagccattatcaaggactataaaagcaagccccattga

SEQ ID NO: 8655 - RNA, 1734 nt, unidentified
  source 1..1734: mol_type = other RNA; note = synthetic construct
atgtccaccaattccaagctgaaagaactgcaggaagcaagatccctcgaagacctagcgtcgatcttgtccactcctctgcagctgctcacttatgtgttacacggcagacaccatcacgggcttgtgaactacaagagcttcaacattataaagaagagtggagggattaggacaatcaatgctcctatcgatgaactcaaatccattcagaagaaacttagtactgtcctgcaggattgccagaaaacaatcaacattctggagggacaccggacacacgataaaaagctcgttactatagcacatgggtttataaagggaaagtccattatcaccaacgctgagccccacagaaaccggaaatttgtgctcaatatcgatcttcaggattttttcgacagtattcattacggtcgcatttatggcttcctggtgaacaataagcacttcaaactgaacgagaatatagctagagctattacgaacctagcctgtcacgacggtaaactgccacaaggagcaccaaccagccccataatcagcaatttaattgcgggcattctggatattcgcctcgcagctttggcctataaacacaaattacattacacccgttacgctgatgacatcactctgtcaactaacctgaacgaatttccctcaagcattgcttacatagataatgcccacgtcgttattggtaataaactcaggacatcaatcgagaaacagggtttctcgatcaaccctcagaagagcaggctccagtttaagaatagccgccaagacgtgaccggcctgatcgttaataagaagattaacgtgaagaacgagtataggaatcgagcccgggtgctgtggaacaagatccaaaatgggaaggaaatatatgccatcggatctgagcccgagaaaaccaagaacataaattacctggtaggcgtgttgagttatatttatcatgtgcgcaactctaatctcgttcgtaatggaattccttccattacacacaagaaaccaacaaaaaaagagatcgactctaccctcgatgccaatgcccgcatgtatcgggacgtccttttcttcaagtatttcatcgccaacaaaaaacccattattatctgtgagggcaagacagacatcatttatataagatctgccttgctgtctcttgcacgaaagcaccggtcattaatcgacaagaaggaagccaagatcgactttctgagggtaagtaagacgattaaggaattgttcaagatctcaggcggcaccggcgacatagggaatctaatttccaattactcaagctactgcgaacattttaaacggttttctcccatggcacctgtcatcatccttatcgacaatgactccggggcagccccattgcgatccctaatcaaggagatcaccaaaaccccgttcaagaaagaagacgactacaaatacataatcaacaacctgtacatcatccagactccatcaattgatgggaaagatagcgctatcgaggaccttttcgataagaagatactgcaaacaaagctggatggcaaatcttttatccataaacagagcacgttcgatatcaagaagcattacggaaaaaaccattttgcggagtatgtcgtgagacaacaccagaaagagattgattttagtaggtttaacctgttgttcgactctatcaagaagattatcaaggactacaaaagcaagccgcattga

SEQ ID NO: 8656 - RNA, 1734 nt, unidentified
  source 1..1734: mol_type = other RNA; note = synthetic construct
atgagtaccaataataagttgaaagagcttcaagacgcgaaaaccctggaggacttggcgaccctactagccatacccctgcagatgctgacatacgtactgcacgggagatacaaattgaagctcgagaattataggagcttcactttaacgaaaaagaacggcggagaacgactcattaatgcccccattaacgaactgaaaactatccagcggaagttaagcattctactgcaggactgccagaggattatctccatcttagagggacacaggacacatcaaaaggagataaagtctattgctcacggattcatcaaaggtaaatccatcatctccaacgctactcctcaccggaataagaagtttgtgctgaatacagacttacaagatttcttcggctccatacactatggccgggtttatggcttcttcctcactaacaaacattttcagctgaacgaggacgtcgctcgggccatcgctaatctggcatgtcacgagggaaaacttccccaaggcgcacctaccagccctgtgatttcaaacctgatagccgggattctcgacatcaaattgtccacgctcgcatacaagcacaaactctattatacacgatatgcggatgatcttactttttctactaaccagaaggaattcccatcaagtatcgcttacgaggaagaggggattgtggtcataggtcacgccctgaatagtatcatccagaaacatggcttcgagattaatgcatcaaagaacaggcttcagtataagaattcccgccaggatgttactgggctgatcgtgaacaccaagattaatgtcaagaatgaataccgcaaccgagtgcgtgtgctttggcacaagatccagaatggcaaagagatccatgccattcaaggagacaaggacgacaaaaagaatattaactatctggtgggtgttctctcttatatctaccaggtgaggaagtccaataaaaccaggacaaacaccattaccaatctggggaaaaaaccacagaaaaaggagatcgattcaattctcgacgctgatgaaagaatgtatagagatgtgctcgtattcaagaatttcattactaacgccaagcctctgattatttgtgagggtaagaccgatataacatacctgcgtagcgcactgctgtctttgagcaacaagcatcggtctttgatagaaaaaaaagagatcaaggtcgatttcttgagaatcacagcaacaattcaggagcttttcaaaatatcgggaggcacaggcgacatcggaaacttaatatcgaattacagctcttactgcgatcattttaagcgctttaccccagcttcaccggtaataatcctgatcgataatgactccggggccgctccactgagaagcctgattaaggagatcacaaagacgccgtttactcgcgaaaccgaatacgcccacatcatcaacaacctttacatcattcagacccccctgatcgacggtaaagatagtgccatcgaggacctcttcgaatctaaaacactgaacaccaaactagaagggaagacgtttgtctacaacaaggcaaattttgataccaagaaacattacgggaaaaaccattttgccgaatatgtgattcgccagagtagaaaggacatcaactttaacggctttaaccccctctttgaaagcgttaaaaagattatcaaggaccacaagaagaagcctcactga

SEQ ID NO: 8657 - RNA, 1737 nt, unidentified
  source 1..1737: mol_type = other RNA; note = synthetic construct
atgtcacattccgataaattgtcgaaattgaagaatgcgaagaccctgcaggacctggcagacgtgattaatgtgccactgcagtcccttacctacgcccttcacggtatgcataggctggggattaataagtacaactcgtttccaatacctaaaaaatctgggggggtcaggatcatcaatagccccgttaaggagctgaaagacgtacagaagaaactgagccaaacactctatgattgttacaacgagatgctgatcgtcagtggttatcgggggctggacaaaaagggaattaccatttcccatgggttcattaagaacaagtccatcataacaaacgcagagtgccacagaaatcggaggttcatacttaaccttgacctcgaagattttttcggctctattcattatggccgcgtctatggattttttaagacgaacaagcacttcggcctgcacgatttaatagctcatgcactcgcaaatcttgtatgttacacccacggactgcctcaaggtgcgccgacttcccccttggcgtctaattttattgctcatatcctggacatccgattggccagcctttctaagaaacacggcctatattatacacggtatgccgacgacctcacatttagcacaaacaagaagatttttccagcagatattgcctatctcgaggctggcaaaacggtgatcggatttgagctgaacaagattatcaacaaacacgggttctctgtgaacagcgccaagactcggctgcagtttaacgattcacgccaggatgtcacaggcctaatcgtgaacaaaaaagtgaatattcggaaagagtacgtaagggccgccaggatactcgcaaataagctcttcaacaacaaggtgatttatcgcatcgagtccaagaagactgaagatgacatctgcgacataaattacttaataggcgtgatggctttcatttacaatgttcgccaatcacagctgattcgtgtgagtggtgacaagagtgccgaactgaaaaatttcactaagaaggacatcgacagcagtctcgacgctaatgcccgactctacagagatctcatcttcttcaaaaagtttatcgtgtcagacgaaccactcattatctgtgagggcaaaacggacgtgatctacctgcgtactgccatgttgtctcttagcgctaagcataggtctttggttaccaaggggcgtgttaacgtcgcttttctgaaccatacccagactatcaaggagttattcaaaatacgaggcggaaccggagatctcggcaacctgatcagcaactactcttcatattgcggaaagttcgccagatttaaacccaaaagccctgtgattatcattatggataacgatagtggtgcccccaaaataagaagtttagtcaaagctatcaccggaaaagtatacgacaagaatgacgggttcagacacctgacaaacaatctgtacctaatccagactcctcctctggcaggaggcgcggattcagctatcgaggatctattcgacaagaagaccttagacgttagattgtccaataagaagttttcctacaaaggtgaattcattaagtccaaacactacgggaagaaccacttcgccgaatatgtcgtgaaaccgcgccggaaagatatcgattttaatggcttcaatcccctgctggatgaaatcaaggcagtgattaagcactacaaaaaaagctga

SEQ ID NO: 8658 - RNA, 1767 nt, unidentified
  source 1..1767: mol_type = other RNA; note = synthetic construct
atgagctcagctgacaagtttctgaaactaaaacaagccacaaccttaagtgagctcgcagagatactgggttacaagcataactccctgagttacatcttatacggaaagtttcgacttggcctatccaattactccacattctccattcccaaaaaaaatggtggctatcggactatctcatcccctgccccagagctgatggagctgcagaggagagtatccgacctgctgcacgattgctttgtgcagatccagattattaacggattccgctatcgaaacaagaatatcaagacgatctcacacggcttcatgcggggaaaatcaatcgtgactaatgctgaaacgcataaaaagaagaagttcgtgttgaacattgatattgagaacttcttcgattctatccattttggccgtatttacggctactttctgagtaataagaacttcgaactgaacccgaccatcgccaaaatcctggccaacatcgtttgccacaacggaagcctaccccagggtgcccctacatcgccaatcatctcaaacttggtcgctcacattttggacattaagctcgcaaagatagcacaagagaattcctgtcagtatacgcgctacgtagacgacctgactttttccactaacaaaaatatcttccccattggcctgggcacaattgatgaaaagcacgactgtaagataaatgaaaaactcatcggcctgattaaacatagcggctttaccatcaacaataaaaaaacacgggtgcagtataaggatagccggcaggaggtcaccgggctgatagtcaataagaaggtcaatgttaagtctgagtacaggaataaagccaggattctggtgaataagttgtattcgaataaggaggtgtataagataaactctaccactaacgaacctgcaacaatagagtacatccagggggtgctcaactacatatatcaagtacgtctgcacaatagtattaagcataccgaaaacattctggagagtcagcgcaaaaaatgtgtttccaaggaacaaatcgataccaccttagatgctgacgccagaatgtacagggacttccttttcttcaagaacttcgtgatcaacaattctccccttataatatgtgaagggaaaaccgacgtgatttatctccgcgctgccattagtgtgttgtctaaagaatttccaaaccttagcaatagtgataatggacaccaactgagcttctttaacaataccaatacaacatcacagctgttcaaaatcaacgggggtactggagacttaagaaacctcattagcaactacaagaagtactttacaaagtttgagagattcacacccgagtctccggtcataattcttatcgacaatgatagcgggtccgcgacaatcagaagcattctcaaagaagttacgaaaaaggagttcaccaaaaaagataacttcattcacatcgagaagaatctgtatgtcatgcagaccccactccagaagaatcagactgagtcagagatggaagacttttttactaaggaaactttgtctctcaagctcaagaataaatctttttgctacaagggagaattcaacaaaaatagccattacgggaagaatcactttgcggagtatgttatcaaacctcagaagaaaaccatcaactttagcaacttcaaggtgatttttgacatcattaaccttatctgcgatgattataagcagaagatcaaaaaccccatcaaaaccaggtga

SEQ ID NO: 8659 - RNA, 1956 nt, unidentified
  source 1..1956: mol_type = other RNA; note = synthetic construct
atgtcttggttttgccagagtattggatcatcctttgttaccttcttctcacagaaactgtttaataagctggaactcttactgcaatcttttcagagcttttctcagctcttgacaggaattaagaacatgagtgaaaatgatctggaaagactgaggaattgtaaggacttacaggattttagcaagcttatcggttacaagaaaacgaagaaccttagctacattatttacaagatcccggagaatctgaggtacaacgagttcaagattaagaagaaaaactccgagtttcggatcatccacgccccagtggagaaactcaagaccgtacaatcacggctttccagtctgttacagaattgttatgacctcataagcgttgatctgaaatccaaggaaatcctttcccacggctttatccgtggaaggagcataatcaccaatgccttgatccacaagaataaacgcttcgtcttcaatattgacattgagaacttctttggaagcataaatttcggcagagtgagagggttctttatcaaaaacaggtatttcaagctgaacgagaatatcgctaccattattgcaaaaattgcctgccataataacagtctgcctcagggttcaccttgctccccaataataagcaatctaatcgcgtctattctggatatctaccttttcaagctctgtaagaaatacaaactctattactcccggtatgtggacgatttgacgatatcgactaatctgaactattttcctgagaacatagcttacaaaaacccaagttcaaaaaacgagtgggtcattggcaatgaattgacgaaaatttttgagcgcgttaacttcaaattcaacttcaagaagactcgaatgcagttaaagaattctcgccaagaagtcactgggttaatagtgaataagaaagtgaacgtgaagtatgagtataaaaagaaggtgcgggctatgatacataacctgttcatgaatgggaagattttcatcaagaaagaggacaaagagaaaaatgtcgaggtcgagaaaaaaattaacagcctccatggaatgattcaatttatcgggcatatcatagagtatcagctggaaacttttaatctgtctaaggtggacaaaaagaacgagaatgcaatttctaacatgaattactggctgaagatgtacgaaaatttcatcatctacaagtacttctacggcatcaaggctcccacaatcatcaccgaaggaaagacagataccatataccttaaatgcgcaatcgagaggttgaactttcaattctgtaccaattctttctccagcctgagtaaagcgatctgtttccacccacacacccaccgaaataacttccagaacaagatcaagaacaaagacaactacaagaaaagctttgataagaagctgaaaagaaagcccgtgtttcttggcgggaatagtggcgccacatttctcatgaagaactatatccccaacaacaaactatttaagaacgcagacaagattctgtctgcccccctcatctatattattgataacgatgaaagcggcaaaaaatcactaaacaacttcctgtccaacaaaaaattcattaaccaccgcctcaatgacaatacctgctttgtgggcctcaacctatatatcattaagttgcctcagataagctcggaaaacaatgattacgaaatcgaagactacttcgacacagatacattgagctctattattgacgggaagtcatttaacaaatcaaacgattccttcgacatcaaagacgtttactttggtaaaatggatttcgccctgaagatcatcaagaacaataagaacaacatcgacttttccaagttcaataaactgctggacgagatcaactttgtaattcaggatttctacaacaacaagcgtcatcagaatagtctcgtatccaattga

SEQ ID NO: 8660 - RNA, 1674 nt, unidentified
  source 1..1674: mol_type = other RNA; note = synthetic construct
atgttcctgattttcgagaatatgtataagaaggaagagattgaacgggccgtcaaaaagttagaggaactggttaactgcaaatctaagaaagacttttcagattggctagatatcagactcaaaaccatctactacatcttactcattaacaaggaacctctctataacgagttcactatcccaaaaaaaaacggaagtatgagaaacatctccgcgcctaatgagcacctgaaacggatccagcacaatcttaagaagaatttggacatgtgttacatagccataactcacaacaatttcaacaaacggctggctcatggctttattaggaagaagagcatcattaccaattcacagtatcacaagaataagcgatacgttctcaacatcgacttaaaagattttttcccctccatcaatttcggaagggtgcgcgggttcttcatcaaaaataaatacttccagctgaacgaagatattgctactttgatcgcacaaattgcctgccataataatcagctcccccaagggtcaccgtgtagcccaatcattagtaatctgctggccctgtctctagataaataccttttctccctgagtaaaaagtaccgctttacatataccaggtatgctgatgatattacaataagcaccaatctgagagaatttcccaagggtattgcatatttcgatgaatatgaggagaaatggtttttgggaaacaagattatcgaggtcattaacaacaaccatttcgacataaacttcgaaaagatccgtatgcaatacaaaacgagcagacaggaggtaactggcctcattaccaataagaaggtgaacatcaaaaggtcttatataagagcaacccgagccatgctagatcaccttgtgttatacccctccagtgacgattatattagcaggcgaaaaatcgtggaagggcgtatagcctttatccaccaaattcggaagatcaatattgaaaacaaccgcgacctgtcccttaagatgcttgagaatttcttttgcttcgacaatttcatcaacaacaacaatatcacgatcctcgtggaagggattacagataagatttacatcaagagcgcattcaagtatttcaagtccgagtataagttcaagctgaaaatcataaccaagaatcctttttctcgcactaattctcagaagaacagtggagagggctccctgaatcagctcttgtctcggtttaaggagacaaaattcctggacagaattaacatgtttcttaaacgcagcaaactcgtcaagcccaagaatccaatcatcattatattcgacagggataacaaaaagttcgtgaatgactttgagcagaagaatgcgcagtacttgtttctggagcctaacgtttattatttccctataccagaactccccgacaagaaatacatcagcatcgagtactacttttcagacgaggtactgaatacaccgtttaaaggccataagctggaattggatattcagaacaaggacaagaagatcttctacaaaattggcgagaaaggtctgtcgaaaaacaaatttgccattcatatagtgcggaaactggctgaatcagagttcatcaatttcaagaagatcttcgacatcataaacgagatcaacattgactacaagaacaaatga

SEQ ID NO: 8661 - RNA, 1692 nt, unidentified
  source 1..1692: mol_type = other RNA; note = synthetic construct
atggacaccttagacaagctcaaaaattgcaaaagtaagtttggcctgtcgaagattattgggatcaaactcaagaaaatcacatacatcctctttgtcaagaaatataacctatacacagagtttcagatccccaaaaataacggaaaattccgaaacattagcgcccctaacaagtacttgaaaatcatccagaagaaactgaaaaaggtgctagaagagtgctacaatgagattcagttaaataagaacgcttcacatggtttcctcaaaaagaaaagcatttacacgaatagcaacttccataagaataaaaggtacgtgctgaatatagatctgaaagacttctttccaagtattaactttggtagggttcggggcttcttcataaagaacaagaatttccagttgaacgaagaggtggccaccctgattgctcagattagttgttataacaatcagttaccccagggcagcccatcctcacccattatttccaatttgatcgctatatctctggacaaaggactgtcaattctctccaagaagtacaagttcaactatactagatacgcggatgacattactatctccaccaacctgaagaatttccctatagcaatcgcatataaagacgatgatggcaattggaagcttggcagcgaaatcattaagatgatcaacaacaaccacttcgacattaattttgacaaagttcggatgcagtataagtcatctcgccaagaggtgacagggctaattgtcaataagaaggtaaacgtgaagaggaattatatacgcaaaacccggctgatgctgtacaatctgatcaaaaatccaaattccgacgattatcagagtattcgtaactgtatagaagggaggatagccttcatataccaaattcgcaagatgaacttcgaaaataacaaacgggatatcgccaagaaaatgaaagacatgttcttctacttcgataagatcattaacaaccagaagataaccatcataacagagggaaaaaccgataaggtctatctgtcttcagcctatagccactttaaggaatactataagcttaacttccagatcatcacaaaaataccgtatacgaagcatgacagcaataatattaacaacacgggtgatcaaactttgatgaatttcgtgaaagaactgaaggagaagaacaatatcaaaccttataagtacctcctggaaaagtctaaaatcaaaaacccgaagaatccagtgatcgttattttcgacagagatagaatcaacatcatcaaagaattcgagaagaatatcaagaacgagaactgtaaattcgtgttctttgaacccaatatctactatttcgtactgcctaaacttatcggaaaggagtatcttagcattgagtactatttccccaataaaatcctgaacaagaaaatcaaaggcaaaaacttgtctctgtgccaagagaagcacaagaaacacatcatttacaagattgacgagaataacgatgggctctctaagaacgagttctccaaatacatcaaaaagcttcgatacaataccaagagagataacattctcaatgagaagaacaagaagtacttcgataatttcaagtccatattcgacatcatcaatgacattcgtaaagactacaagaacaagttgcagaatatcaacaaatga

SEQ ID NO: 8662 - RNA, 1737 nt, unidentified
  source 1..1737: mol_type = other RNA; note = synthetic construct
atgatactggaaaaactgcagaattgccaggataaaaaagacctggcccttctgcttaaatgtgatcttcaaaacctgtcaagaatactcttcaaagacttcaacaacaactactccatcttctttattgacaagaaagacggtggcaaacgagaaattttagctcccaagaaggatttgaagatcatccagaaaaaactctctaagatcctagaggaatgttatattgagatttccgagaagaacaacaagatcaacttcaactcgataaatggatttatcacaggcaaatcaatcatcactaacgcaaaaaagcataccaataaaaggtacgtgttgaatatagatctgaaggacttctttccaagtattacatttaaccggattgtggggtttctgaagaagaataagtactttaagctcgaacatgacgttgcgatgttgattgcccaaattgcctgtcacaaaggtagtctcccgcaagggagcccttctagccccatcatatccaatctgatcatgctgtctcttgacaaagagataaatattctcgcaaagaaacacggcttgacctatagccgttatgctgatgacatcacgctctctactaataagaagaattttcccaacgagatagctagtggaaacggaattgagtggaatatccataaaaaactggaaacgctgatcaacaactacaaattcaacatcaaccacaaaaagatccgaatgcagtacaaaacctcccggcaggaggtgaccggcatcattgtgaataaaaaggtcaatgtcaacaggaagtatattcgcaatgttaaggcaatgctgaataagagcatcatcaatcattctatggagaattatgagtacttcaagttgtcacttcggggaaaaattgatttcatttatcaggtccgcaaactgtacatggaaaacgataagtctaacgaaaaggatctaatcagcaagattttcaacaacttcctgtactttaaccatttcatcaacaacaacaaggtgactattctgactgaaggaaagaccgacaagatttatatagatactgcctttagtcacttcaaaaacgaatacaactaccagataaacatcctcaaacagtccgacatgtttacaaatatcaccaaactgaatgggattaacaatctggtgaatttcatcaagtcctatgattcgaaaaacggcatcatcaataagctgataaacaagtcaaacatccacattccaaaaaagcccgtaatcataatcattgactccgacgaacctactaaatcaaaagccctcgagttacttgataacaaaaacgggttcatctttaaggaacctaacctatattgctttcagttacctgagatcaaagacaagaagttcttcagcattgagtactattttccagagagaataaggaactatgaaaacaatgggaagaaattaggtgagaataccaaaaacaagtacaacaacaaggagacaatatacaagattgaagacggcggcaacaatttgagcaagtcctacttttctaactacattaagacactcaagcacaaggagattagcgataaaaagaacaaaaccaaggaggatattgacaatatcaagagaattaacgaggtcaataagaattcattcgaagagttcaagaagatctttaacaaaatcgacgagatcattaacgattataagaagatctgcaacagcaaaacaagtgaacaatga

SEQ ID NO: 8663 - RNA, 1674 nt, unidentified
  source 1..1674: mol_type = other RNA; note = synthetic construct
atgaatcttgagaaactgaaggagtgcaaatcaaaatatgacttggctaatctcttgaagtattcgctccaaagtctgtcctgtattctctttaaggacatagacagcaattatagcatgttctacatcgacaaaaaggatggcactaaacgcgagatcctcgctcctaacgagaaactgaaaaaggttcagaagaatctcagtaagattctgtgcaagtcatacgaatgcattaataaaaaccccaaagccgtgcacggctttattgagaaaaagtccatcataaccaacgctaagatgcacaaaaacaagagatacgtgttgaacatcgacttgaaggacttttttccatccatcacctttaatcgcatagtcggattctttaagaagaacaaacactttcagctggaacatgaggtggcaatcctgatagcccagatattatgccataagggtaaactgccccaggggagccctagcagccccattatgagtaatctgataatgctgtctctcgataaggaactcaatatcctctctaagaaatatggcctgatttatacacgttatgccgatgatatcacattctcgacaaacaaaaggaaatttcctaaagagatcgcatacagtattaataacgtggattggaatgtcagcaaaatcctggaaaggcttatcaataactaccacttcgaaatcaaccataataaaacccgaatgcagtatcggactagtagacaggagactacagggattgtggttaataaaaaggtcaatgtttccaggacttatattcggaatattagagcgatgctaaataagatgatctgtaattacacgatggatgagtacgatagctttaagtcatctattaaaggacggattgatttcatctatcaggtcagaaaagactatattgatctgaaggacaagaaaaactacgaaaaagacttgattgtgaagctgttcaacaagtacttttacttcgataagttcgtcaacaattctaacgttacgatcctgaccgaaggcaaaaccgacaaggtgtatatagacgtggccttttctcactttaagaacgagtacaactatgacattgatattgtgcgtcattctgacatgtttcttaacatcaccaaactcaacggaatcaagaagttaaaagggttcattgacaattacaaggataagtacaagcaagagatcgtaccactactgaagaagtctaagattgagaattccaagtatccggtggtaattattatagactccgatgaaatcgagtttttaaagcagctgaaactatttgacgacaagtacaaccttaagaacaagtacatcttcaaaaagccaaatctttactgtttccacttaccccagttggacgacaaagaattcttcagcattgagtattacttccaggagaacataaggaacaaatatatcaacggtaagcgcctgcgcgatatcatcgagaaggagaatatatacaagattgatgacaagtcccttactaagtcaaaattctcacaatacatccgaaaactgaggtacgataatgaaaaaaagacagacatcaacagcaacaacaagaagatattctccgaattcaaaaagatcttcgatctgatcgacgaaatcctcaaagattataacacccggatccaaaaatga

SEQ ID NO: 8664 - RNA, 1698 nt, unidentified
  source 1..1698: mol_type = other RNA; note = synthetic construct
atgtacggactgcatggtgggcccaacggccagtataccgactttactatcaaaaagcggaacggcaccgaccgcaacataagcgctccaaccacagctctgaaagctatccaaagatctctggcaattaggctgagcggagtctacgagcctaagaaagcagcctatggatacatcaaaaagtccgacaacaaccaagacaaaactgtgtttggaaacgctttggtgcacagcaaaaaaaggtacgtgttcaacgtcgacctcaaagatttctttccatccatccacttcggtagagtcatggggctgttccgttctaatccttataagctggacaggtccattgccatattaattgcaaagattgcctgctacaatgattttctgccccagggcagtccttgcagtcccatcatctctaacatgatttgcagtcatatggatcgagatctcagcgacctcgccaaaaattacaggtgctactatacaaggtacgtcgatgacatcacattttccacaaacgtgaaagactttcctgaggatattgctttctttgatggcatctggaatccgggagaaggtctggtagagatcattgacgaccacggttttaagattaacggcgaaaaaacctcactcagaacacaaagtgacaggcagatcgtgacggggttgactgttaatgacttccccaacgtgcgcaaacgatccattaatcaggtgcgggcgatgctgcatgactggaaggtgaatggcctagagctggcctatactaaatacattgagaagtacgatacgagaaataaccagcacgaagaggaggacaagactgtttttgggaagataatcaaaggaaaactggaatggattggatcagtaaaggataagcggttcgagataaatgagaagcataagggcaataaagccaagctaaatcgactcgggtatagcaagaatctgctcgagcggcagagctataagaaatacattgagaggcttaagcacctgaccattaacgaatcagacatggtcactgtgcttggggaagggcagacagattggatgcatcttaagaccgcgtacaaacggctctgttccgatccagaattgtcattccctatctacttctaccctcactcccgcaaggagaaagggggcgaggataacttgtggaccttttgttcaacagcaaaagatcactacgtaacttatcgccacccagtcgtgtgtgtttttgattgtgacctagagagaatcaataataagcacaagggcaagaagttcatcgaccatggcaacaacgttttctctatactgctgcagaagccggaaggctcaatctatgaaaagtatgcaatcgagcagatctatgatctccacgacatgctgaagaccgacgaatatgggcgcagattgtatctttctagcgaattcgatggaaactccgtgcataaaatgaaccccaacattttcagcaagaaaaagacctctaatgacgaaaagatcgtcgataacgaggtgttcttacggaaaaaggacggcacggagaaatcgattgctctttccaagacaaattttgccgttagtatcgccagaggaatacaacccttccgtaccatgaatttttctggttttatgccaaccttcttacgcattaaagaaatctaccagctgcacatatcggatagcagtcattga

SEQ ID NO: 8665 - RNA, 1200 nt, unidentified
  source 1..1200: mol_type = other RNA; note = synthetic construct
atgacaagaattaataacctgtcccgatttcagcaaatttccacattgaaccagttagctctgttcctcgggttcaagccaaaggacttttcttacatcctttaccgtctcagtgacggaccaaatgggcagtataccgagttcgccatcaagaagaggaatgggaaagaccgcaccatcgctgcaccacacacagcgctgaagactattcagcggtcactgacatctaaactcgaagggatttatgatcccaaaaaagccgcatacggatatataaaggagactcctcacaataaggataaaactgtcttcggaaacgccctggtgcattcaaagaagcgatacgttttcaatatcgacctgtgtgatttttttcccaccatccatttcggtagagtgatgggcttgttccagtcgaatccgtacaagctcaaacgcaatatcgccatcctgctcgctaaaattgcttgctataatgactgtctcccacagggctctccttgtagtcccatcatttccaacatgatatgctcccacatggacagagaattaagcgacttggcaaaggcttatggttgctattacagccgatatgccgatgatatgaccttttccaccaatataatcgagtttcctagggacatcgcatttagagacgagaactggaagcccggcgaaggcctcatagagatcattgataaaaatgggttcgagatcaactcagaaaaaacgactctgcgcacccaggccgatcggcaaatcgtgacgggcctgattgtgaacgattttcctaacattcggaagaggtctattaatcaggtacgggcaatgctacacgactggaaactgaacggtatggaagccgcttacgagaaattcatcaactaccacgacacacggaatagcgaaaacaaggaagatagcacagaactatttagcatggtggttaggggaaagttggagtggattagaagtgtgaaggataaacgtttcaacatccaggagattcaaaacaaggccaagagtaagcagaatagactgtcatatagctcccgccttcttgagaaacagagctacaaaaagtacttcaaccggtataagcatctgaggataaatgaatctgacatgttaactgtccttggcgagggacaaaccgattggcgccattttaaaaacgcgtacgaggtcctgtacaggtga

SEQ ID NO: 8666 - RNA, 1056 nt, unidentified
  source 1..1056: mol_type = other RNA; note = synthetic construct
atggaactgaaactgaatcggactgacgaagagatattagcgcttttcaagagcctcaactctgttgagacagtggcaaacattttggaggtcagtcccaagattctgaattactacactttcaagagcgaaaactatcagaagttcttcatccggaaaaaaaacggtaaaccacgcaccatttactctcccaataccaacattaagattctccagcagaaactcctgtacattttcaacctgctatacaagcccaaccagtacgcttatggctacatcaaggaaagaaatatagtggacaatgccaacaagcacctgaaaaagaaattcatactgaacgtagacctgagtgactattttccgtccattacttaccggagggtgatcggatacctagtcaaaaacttaaagatcgagaataccgccgcacgaatcatcaccaaacttatctgtgtcgaagatgagaagaatacgttccttccacaaggaggcgtgacatctcctttgatctccaactttatctcagagaatctggataaggatctatcctattatctgaagagattcaggtgcgagtatactaggtatgccgacgatctgacaatttcctcggaagatctcaagtttccagataagattgctgtagaggaccagtttcgtcaagtttggcttcataacgatttcgagcgtataatcaagaaaaatggctttgaggtgaattatgagaaaatacggttaagaaagcctaaccagcgacagactgtgaccggtctgattgttaacggatcaaagcctaatgtgaaacgcagctatattcgcaatttgagaagcatcctgtacaattgggaaaccaaggggtacacacacatccaaacggcatacgaattgaagtataggaaattcgacaacgccgaatttaaacccatccctaagatcgagaacgtgattgatgggaagcttaattttttgagcatggtcaaagggaaggacgacgagatctacctcaaactcaaaaagcgctttctgaagctgaaagctacactcgatgacgtctga

SEQ ID NO: 8667 - RNA, 1044 nt, unidentified
  source 1..1044: mol_type = other RNA; note = synthetic construct
atgaagctcgaactcgttaaaactaacgaggaaatcatcgagtgtttctattcactgagaaccaaatccgacgtggctgatcttctggagatccccatcgaggtgctgaattattatctgtacatctcctcgaactacacaatttttacgattcctaaaagggatggctctcctcgtgtaatatattcacccatcacaccgatcaaaatcttgcagcgtaagttactctatgtgttcaacctgatttatgaaccagatgacaactctttcggattcatcaaaaaccggtccatcgttcagaacgctgccaggcaccagaataaaaagtacgtcctgaacatcgacttgaaggattactttccgaacattacatttgggcggattcttggctacctcaagaagaatctgatgctgggggacgaggccagcgtgataataactaaactggcctgcgttgagacagaggaaaatacctttctcccccccggctcacccctctctccaattctgagcaatatgatttcaagaaagctggacgtggaaataagcaactttgttaagaagtacgactgcacctatagtaggtacgcagacgacattagcatttccactgatcgcatcgtattccctgaacaagtggccatcagagatctatacggagatatctggttgaacgcgaaattcgtcaaggtgatctccgacaacgacttcaatatcaactacagaaaggtgcgcctccggtctaataagcagaggcaagaagtcaccggtctgattgtgaacggggtgcgcccaaatgtaaagcgcgagtatatccgaaatcttcgagctatgattttcgattgggaaaaaaacggacttgagaatgcacagagcaacttcgagattaattattggaagcctaaagacagtgactttaagcagataccaaggattgagaatgtcatagacggcaaactaaattttctgagtatggtccggggtaaggatgatttattgtaccagaagctgaaaaccaaatacgataagttagtgagcatctga

SEQ ID NO: 8668 - RNA, 1716 nt, unidentified
  source 1..1716: mol_type = other RNA; note = synthetic construct
atgaagaataagttcaaacgcctagtagactttgaggatgtggccctcctgctcgagatccctacagagtttctctggaaaattctgatacgggacaagcagattaattataccagcttccctctgggaaagaagtcgggcggctttagaacgatctacagccccagcaagaatctcgcaatactgcaggctaagcttgcatacattctctctctaaatttcaccccccataatcgcgcccacggctttattgaaaaacggagtatcgtgaccaacgctagtgagcacttaaagaaatctttcgtgctgaacattgacctggagaacttcttcgagtcaatatctttcgcgagagtccggaagatgtttatctcctactttaagttgggcgagactgtggcaacgacccttgcaaacatttgtatccacccaggaggttttctgccacagggggccgctaccagtcctatagtcagcaatatcttggccaagtcgctggataaagagctcaagcagctgtctatcgagtccaaaggagttaagtataccaggtatgccgacgatattacattctctaccaacaaacgtgtcttcccgaggtccatcgcctccctgaatgaagatgggcaagtggaactttcagagaggctaatgcagatcatcaagaagaacggattcaacgtgaacggaaagaaagtccgaatgcaagattcaaagaagaatcagagtgttactgggataacagtgaacgagaaactgaacatctccaggacttacattcgcagaattagatctatcctgaattgcatcgaaaaaaacatcgatgacttggacagagccagagaggtttttgagcgcaaatacccgttccgccaacgggccaaggaaaactatcctgaaatgttttccgtgttaagggggatgataaatcacgtggggcatgtcaaagggaaatcagacccagtgtatttgaagctcgctaatcgattcaacgatgtgagccccgagcacaaagtgatcaagtcagttgacaagcaatcatctaagaggaaaatgtacgaggactatacatatgtcattgaacaggaaaatcccgtagttgctttcgcgagcgaacagcggaacgaatttgaacacgtttatcataaccagggaactgggttcctgctgaaaggttttggcctggtgacgaatgctcacgtcttgaaggatctggtggatgctatagaactcgagatggtgatccttgagccatactacgtccgagtgttcaagtccaatgacatcaatgtgcatatgatgcggatcgaatgctatgacatcgaaaaagacatcgcaatacttagaagcaacagtgtcgatcacaacacagaaggctttaactacaacgaactgattcagaaagagcagttaatcgatctggtaggataccctgattaccgccggggccaagagatcagggtcgacaatggttttgttcgtggcattcgaatgcacactgactcctctgacaagacaaccgcccataagcgttatgaaattacccccacaatttacggcggcaatagtggtggccccattgtgaacgagaaaggtgaggtgattgccgtggcggtgaaaggagcaactatgaacggggtagttccaaatgaggtcattcctatctccgaggtaattgagctcgccaaaaggcagttgttcagccatagcctttga

SEQ ID NO: 8669 - RNA, 1656 nt, unidentified
  source 1..1656: mol_type = other RNA; note = synthetic construct
atggaaataccaactgagtttctctggaaaatcctaattcgcgataagtccaataactacacatcattccccatttctaagaaaagcggtggataccggacaatacattctccctcctctaatcttgccatcctccagaaaaagctcgcctacgtcctgtcattgcaattcaatccccacaatcgggctcatggttttatcgagaaaaggtccatcgtcacgaacgcatcagagcacctgaagaaaagtttcgtgctgaacattgatctggagaacttcttcgaaagcatctcttttgccagagttcgcaagatgttcgcaagctattttaagttatcaggggtagtcgccacgaccctggcaaatatttgcagtcacccagaaggctttctaccacagggcgcggcaacaagtcctataatttccaacatcattgcgaagtcactggataaggagcttaaacagctgagcgtggagtccaaaggggtgaagtatactaggtacgccgacgacatcaccttctcgacaaataagaaagatttcccgaggaatatcgcttttttgaacgaggactctcacgtggtattgagtgagaagcttttaaggatcatcgagaataacggcttcaatgtcaacgagcagaagattcgcctgcaggatcggcagtccaaccagagtgtaactggcattgttgtaaacgagaaacttaacgttagccggacctacattcggaggatccgctcaatcctcaactgtatcgagaagaataataatgacctggacgcggcccgagaaatttttatcagacggtatcctttccgccaaagagctaaagttaaccagcccgagatgttttccgtactgagaggaatgattaatcatgtgggccatgttaaagggaagagcgatcctgtctacctcaaactggccaaccgattcaactccgtttctcctgagcagaaagtgatcaagtctgtggaaaagcaaataaacaagaggaagatgtacgaggattatactttcgtgattgaacaggaaaagcccgtcgtggcccttgtcagtaaagaatcgaccgaatttgagcacgtgtatcataatcagggaaccggctttttactaaagggtataggaatggtgacaaatgctcacgtcttgaaggatctggtcagcgctatcgagctggagatgttgattccaatcccttactatgttcgtggttttaactccaaggacttcaacgtgcacatgatgcggattgagtgcttcgacaccgaaaaagacatcgtgatcctgcgaagcaagtccctcgatcacaataaagagggattctcttatagtgaggcaatccaaacagaccaactcatagaactggtggggtacccagattacagaaggggtcaggaaatcagagtcgacaacggctttgtgcgcggaataagaatgcacatcaactcaggcgacaaaaccgtgactcataggcgttatgaaatcactccgacgatttacgggggcaatagcggaggaccaattgtaaatgaggtgagcgaagtgattgctgtggccgtgaagggggctaccatgaatggggtggtccccaacgaagtgatacctatctctgaagttattggcctggccaaacgaaacagcctcatatga

SEQ ID NO: 8670 - RNA, 1749 nt, unidentified
  source 1..1749: mol_type = other RNA; note = synthetic construct
atgaagcctgtactgctctctacagacgaggaaatcaagaataagttcaagaatctgaccgattttggcgacgtggcccttctttttgagatccccaccgagtttctctggaagatcctgattcgtgataaatggatcaattacgtgtcattcccgcttcataagaaaaacggtgggtaccggaccattcactcccccagcaagaacctggccattctgcagaaaaagctggcctacatcctatccttgaatttcacaccgcataatagggcacatggctttattgagaaacgcagcatcattactaacgccagtgaacacttaaaaaaggctttcgttctgaatatcgatcttgagaattttttcgagagcatttcatttgctcgggttcggaagatgttcatctcatattttaagctctccgaaatagttgcaaccaccctagcgaatatctgtacccacccagacggatttctccctcagggtgccgctacaagtccgataatctccaacatcctggccaagacactagacaaggagctgaaacagctttccatcgaatccaagggtgtcaaatacacgaggtatgccgatgatataactttctcgacgaataaaaagctgttccccaagagcatcgctttcttgaacgaggacgggcaaatagtactgagtgagagattcatgaagattatcacgaagaatggattcaacgtgaacaagaaaaaaatccgacttcaagatagtgaagggaaccagtctgttacaggcattaccgtcaatgagaaactcaacgtgtctcgaaactacatcagacggatcaggtccattctgaattgtatcgagaagaacataaacgatctggactacgctcgggaagtattcgaaagaaagtacccctttcgccagcgtgccaataggatccatcctgaaatgttttctgtgctcagggggatggtgaaccatgtcggccacgtcaaagggactagcgatcctgtttatctcaaattggcaagccgattcaataatgtgtcaccagaacacaaagtgattaaaagcgtggaagagcagagtaacaaacggaaactgtacgaagaatatactttcgtcattgaacaggagaacccagtggtggcgttcccattcaaaggttccatggattttgagtacgtctaccacaatcaaggaaccggttttctcctgaagggaatcgggctcattacaaacgtgcacgttttaaaggacttggtcgatgccattgagttagagatgtatattccccagtcgtattatgtgcgcgtatttaacagtattgacttcaaagagcacatgatgaaaatagaatgctatgacatcgagaaggacatcgctatactgcgcagctctagcctggatcataatgcagagggcttctcctacaacgaattgattcagaaagaccagcctatagacctggtgggatatccagattacagaatgggccaagacatcagagtcgataatggctttgttcgcgggatcagaatgcataacgactcatgcgacaataccgttaagcacaagcgttatgaaataacacctactatctacggcggcaactcaggagggcccgtaattaatgtgaactctgaggtgattgcggtcgccgtcaagggcgcaactatgaacggagtggtgcccaacgaggtcattccaatttctgaggtgatcgagttagctaataggaagttgtttgtgtattctgtgtga

SEQ ID NO: 8671 - RNA, 1770 nt, unidentified
  source 1..1770: mol_type = other RNA; note = synthetic construct
atgatatttatttctacacttgtgcgccccctcctgcagtcatctgacgataagatcaagagtaagttcaagacgctgaccgattttgaggacgttgctcttttgttagaaattccagtcgaattcctctggaagattctcatcagagacaagcagattaactataagtcatttccgctggctaagaagaatggcggctatagaaccatttatagtcctagtaagaacctgaccttgctccagaagaagttggcctatatcttgagcctcaattttacaccacacacaagggcctatgggttcatcgagaagcgcagtatcgtgactaatgctagcgaacaccttaaaaaaaactacgtgctgaacattgacctggagaatttctttgagagcattagcttcgcccgggtgcgtaagatgttcatctcctacttcaagttcaacgacactgttagcactacactcgctaatatatgtgtacaccccgacgggatcttacctcaaggggccgcaacctctccgatcatctcgaacattctagccaaatccttagataaggaattactgaggctgagcctggagtcgaaaggcgtgaagtacacaaggtatgcagatgacataaccttctctaccaacaaaaaaactttccccaaagcgatagccctgctgaatgatgacaagcaagtcattctgtcagacaaccttattcagatcatcaaatccaacggctttaacgtcaacgagcggaaaattagactgcaggatagagagggaaatcagagcgtcacaggaatcaccgttaacgagaagctaaatgtgagccgaacctacatacgaagaattcgatccatcctcaactgcatcgagaagaacattaacgatctggactttgcccggtcaatctttgagcgtaaatatccattccggcagcgcgtcaagggaaactaccctgatatgtttctggtcctgcgtgggatgattacgcacgtgggtcacgtgaagggtaaacgggatcctatatacctgaaactcgcgagcaggtttaaccggatctcccctaaaaaaatgataatcaactccgcagagaagcagaacaataagaggaaagcttacgaggactacacatatgtgattgatcaggacgacatcaagtgcgtcttcgatcccaagatggatgatatggtggatctatattacgggcagggaactggggtgttgctaaaaggcattggtgtggtcactaatacgcatgttctcggaaccattattgacgccttggacaacggagccaaacttccctctagttacaggattagagtattcaaacatgactcagaactggcgtgtaccatcacttgttatgatccagagagggacatcgccatactgaccccagatgacattgactgctctgcaataggcctggaatacaatacaagtatcacgaagggacagtccattgatttgatcgggtaccccaattatcgccagggccaagaaattcgcgtagaaaatggatttgtccagggcaaacgaatccataaaggtactaaaggagagtacattcgccatgaaatctcccctaccatctacgctggcaatagcgggggcccagttgtaaacgaaaatgccgaggttatagctatcgcagcaaagggcgcaacagagaatggcgtggtgcccaatgaagtgatcccgatctctgagataatcaaactcgctcaagacaatggtcttctgaatgaaagaatgtcctcagtgcaactttga

SEQ ID NO: 8672 - RNA, 1707 nt, unidentified
  source 1..1707: mol_type = other RNA; note = synthetic construct
atgcgtaccgaattgttggccaacgaggacaagattaaacgcaattttcagaacctgaacacctttaatgacatcgctaaccttctggaaatccccgttgagttcctttggaagatattgatcagagatcgggctcactcctaccgcagattcgagctgcgaaagaaaaatggggacccacgcatcatttattcaccaaacaccaatctatctatcctgcagaagaagttcctttatgtgttggaactcaattttaacagccatcagcgagcccacggctttgttaagaaccgggatataatcactaatgccaatgaacacatcaataagaggttcgtgctgaacttcgacctggagaacttcttcgagagtataaacttcaggagggttaggcacatgttcatcagttactttaagctgaacgagacagtcgcttcaactctagctaatctctgttgccatcctgatggcttcctgcctcaaggagcagccacatcaccgatcatttccaacattctgtcaaaaagcatggacaaggaactcacccgcattgcgattaacgtgcgggggtgcaactacacaagatatgctgatgatattaccttttccagcaataagaggatctttcccacacagatcgcaatccaacattctgatggcaacattgaaatcagcgaggaagtgattaaaatcatcaacaagtatggcttcagcataaaagaatctaaaactaggatgagcgattggaaacaacatcagtctgtaaccgggatagttgtgaactctaagctcaacgtaagccgcaaatatgtgcgtaaggtgcggtccatcttgcattcagccgaaaagaacattgataatctggacgtggcggtcgagctgtttaactccaagtataattttcggcagaaaaacaacaacacgtaccctgacatgttcagtatactgagaggcaagatcgcccacatcggaaatgtaaagggaaaaatcgatccagtttttctgaacttagccaaacgttataaccagattgcacatctgaatgaagagccactaatcatcatcccacccaatgacattcagttttatcaggagaacacattcgtgatggagtgcaatgaattcgagctgtacattgacaaaaacgatgagactggtgaattcatctacgggcagggatctggctttttactcaagggcattggtttaatcactaatgcacacgtggtgaaggaggtgattgatctcatgaagaacgaggtgaagttcataaataagtactacgtcgccatccacagagcatcaccttacgacattatatacaaggcacggattatctgttatagtattgagaaggacctggctatacttgaggtcgagaatctcgacatcgagagcattgggtattccgccaatgaaagtatcaagaaagacatgcagattaatctcgtaggttttccctcctacagagaaggcaatgacatcaaaagccaatctgggtatgtggaagggattcgaatgcacgagaaaataaatgtccgctacgagatttctgccaccatttacgagggaaattccggcggtcccgtctttaacgccagtaatgaggtcatcggagtcgctacaaaaggcaccacgtcgaacggagtttcgcctaatgaaatcataccgatttccgaagtgcttaaactggcgaaagaggtgtga

SEQ ID NO: 8673 - RNA, 1761 nt, unidentified
  source 1..1761: mol_type = other RNA; note = synthetic construct
atgagtgggcatgttaacgtagagttgaagtcctcaccaactgacatccggctcaagttcagaaagttgaatacatttgacgacatagcccaccttttggaaataccagtgcagttcctgtggaagatccttgtcagagataagttagtgaactaccgaacgtttaagttaaggaaaaaaaacggcgacgagcgtactatatatagtcctctctccaatctggcaatcctgcagaaaaagctgtcgtacattctgagcctcaatttcacacatcatgaccgcagccatggtttcatcgagaacaggtctattgtcaccaatgccagcgaacatctgcgaaaaaagtatgtgctgaaccttgacctcgagaatttcttcgagagcatttccttccggcgcattcggcacatgttcatttcctactacaagttcaatgataaggtggcttctactctagccaacatttgttcacatcctgatggattcctaccacagggagcacctaccagtcccgtggtgtctaatatcattgccaaaaccctggataaggagctgaaacgcgtagccatcggcgctaaatggacacaatacacgagatatgctgacgacatcaccttctcaacaagtaaagaacaatttcccaaggagatcgcaaccataaacgaatccggaataatcaccctcaacgagaatatcatcaagatcattgaaaagaacggctttaaggtgaacgataaaaaaacccgccttcaaaaccacaaacaatctcagagtgtcactggcatcactgttaacgagaaactgaacatcgacaggaggtacataagaagaattcgctccatcctgtcttgcatagagaagaacattaacaacctggatgaagcccacaaaatctttgaaatgaaatatcccttccgtcagagaaagaggggatcaaatccagacatgtttctcattttgcgggggatgatcagccatgtgggaaacgtcaagggcaagcaagattctgtctattggaaacttgcgaatagattcaataaggtcacccctcacgagcccatcaagttgcagctgtctcggcgagaatttcacgaggacaatacgtacgttatagactcagattataccgcgaaatactacaaccacaacgagaacatttttgacgaagccctctacggacagggtaccgggttcattctgcggacaatcggcctggtcacaaatgctcacgtgatcgaggggatcattgagggtctggagcagaagttcattttttcgaagaagtactacatcgaagcctataagtctacactgtacagctttcctgaaaatgcaaaggtgctctgctacgatattgaaaaggatattgccattcttagtgtggaaggcctcgaaatccacgaaaaagggtatatgtataacgagagcatcaaggaggagcagcagatcgagttggttggatttcccggttataggaaaggacaggatataaagattcagaaggggtttgtgcagggtgttcgaatgcacctgtcaaaagatggcaccaaacgctataaacgtagggaaatttccgctactatatacggcggcaatagcggggggccgatagtaaacactgacaatgaggtaatcggcttagctgtgaagggagcaacaatgaatggggtgagcccaaatgagatcgttccgatcagcgaggtgattgagctagcgaaaaaacacggcattattaatgaacatgtctccatctccttttga

SEQ ID NO: 8674 - RNA, 1758 nt, unidentified
  source 1..1758: mol_type = other RNA; note = synthetic construct
atggaactcaagtcggacgtaagcgtcatcaacaagagattcaagaagttacagaatttcgatgacatagccctgctgctggagatcccagtggaatttttgtggaaaattctcgtgcgcgacaaacataccaactacagggtctttaaactgaggaaaaagaatggaggggagcgcacaatttacagtccagccagcaatctcgccattttgcagaagaagctcgcatacatacttagtctggagtacaaagtgcattctcgagtgcatggcttcactaagaagagatctatcgtcacgaatgccttcgagcacctggataaacgatacgtgctaaactttgacctggaaaatttcttcgagtctatcgagtttaggcgtgtcaggaagatgtttatctcatatttcggtttcaacgacaaggtagcggccactctggcaaatatttgctgccatcctaacggctttttaccccaaggggccgctacatcccccattgtgtccaacatcatagccaatggactggataaggaattgaccaggattgcgaagaactcaaaatggtgtaaatacacccgctacgctgatgacatcaccttttctacgaataacaagaagtttccacaagagatcgctcacattgtggacgaaaacattgtcctgggagagacaatccttaatgttgtagagaagcacggatttaagattaaccacgagaaaacccggctccagaaccacaaacagaaccaaacagtaaccggcattaccgtgaacaaaatctccaatgtaaaccggacctatattcgtcgtatcagaagcatcctgaactgtatcgaaaagaacaagaacgacattgttaacgccgagaagatcttcaagatgaaatatccttaccggcagaaacgcgaagataacaagcctgatatgttccatattctgaaaggcatgatcgcgcacgtgggcaatgtcaagggcaaaaaagatccactctaccttaaactagcaacccggtttaatggagtggtggagttgagcgacctcactcccttccgcctgcctataactaagaagggttttcaagagaatcacacctacgtgatagacaatcctgacttcgagatgtacttcactgaagatggatatgaagaagtgatgtatgggcaggggactggcttccttttgaaggacatcggtctggtcaccaacgctcacgttattgaagatgttatcaagacagtcgagaaaaaacaggggaaatttcagaaggagttttacatttccttctttagagctgtggactaccacgttaagcattgggccaaactgttatattatgacacggatatggatatcgccattctagacgtcaaggatatcaatatctccaagacaggctacgagtataacgaattcattgagaaaggccagaatgtggagctggtgggtttccccaattatcgcgagggacaggagatacggattcaggaagggacaatacagggggtcagaataaatgaatctagggaccgaagcagaaaatatatacggcatgagatcacaactactatttatggcgggaatagcggaggtcccatcgttaatgaaaacaatgaggtgatcgcagtggcagtgaaaggtgctaccctcaatggcgtcagtccgaacgaggttattccgataagtgatgtgatcaagcttatcaaccaaaacaaacagccagaagaaaagtcagaggcttccatcgaagtggttcagtga

SEQ ID NO: 8675 - RNA, 1776 nt, unidentified
  source 1..1776: mol_type = other RNA; note = synthetic construct
atgagtaatcatacctatgtggagctgaaaagtgacgtcagcgttatcaataaacgctttaagaagctgcagaatttcgaagacatcgcgctgcttctcgaaatccccgtggaattcctctggaaaattttagtcagagacaagcacataaactatcgcgcatttaaactaagaaagaagaatggaggggaacgtactatttactcccccgcctctaacctagctatcctccagaaaaaactcgctcacattttgagtcttcagtataaggtgcatagcagggtccacgggtttacaaagaagaggtctattgttacgaacgcattcgagcacttggataagcggtacgtcttgaattttgaccttgaaaacttcttcgagtcgatcgagtttaggcgagtgcggaagatgttcatttcttacttcggatttaacgacaaagttgctgccaccctggcaaatatctgctgtcacccgaatggttttctgcctcagggtgctgcaaccagccccattgtttccaatattatcgctaacggtctggacagggaattaacgagggtggccaaaaataccaagtggtgcaaatacacccgatacgctgacgatatcaccttttccaccaataataagaagtttccccacgagatagctcacatcgtggatgggaatatcgtcttaggagagacaataataaacatcgttgaaaagcacggctttaaaataaaccatgagaaaacgaggctgcaaaaccataaacagaaccagactgtgacaggcatcaccgtgaataagatcagcaacgtgaatagaacctatatccggaagattagatccattctgaactgtatcgagaagaataaagatgaagtggcccgcgccgaaaaaatcttcgagtctaagtaccagtaccggcaatctcgcaagggggataaaccagatatgtttcgcattctgaagggcatgataagccatgttggtaatgtgaagggtaaaaaagatcctgtctacctgaagctcgccaatagatttaacgaggttgtagagctgggcaacagtacaccatttaaactgccaatgactaggagagcattccatgagaatcacaccttcattatagataacgaagactttgagatgtacttgaacaaggatggaacaggagatgtgctgtcagagcaagggacaggcttcattctaaagggaataggcctgattacaaacgctcacgtgttggaggacttcattaaggtgcttgagacagaagaagggagattcgtgaacgagttctatatcagctttttccggtccgtatccactcatgtcaaacataaggccaagatcctgtattacaacactgacatggatatcgcggtactttctgtgaaggacatggacatatcaaaaattggctacgagtataatgagttcatcgaacgtgaccagaaaatcgaactcgtcggcttccctaattatcgtgacggccaagagatcaagattaaagaaggaactgtggaagggatccggattcagcgaagcaaagacggctcaaaacgctacgaacgatatgagatctcggccactattcacggggggaacagcggcggaccgatagtgaacgaaaacaacgaggtggtcgccgtagccgttaagggcgccaccatggcgggagtatcaccaaatgaagtcatccctatcagtgatgtgatcaagctcattaaccagaagaaacagcccgaggagaagtccgaggcatcaattgaggtcgtgcagtga

SEQ ID NO: 8676 - RNA, 1764 nt, unidentified
  source 1..1764: mol_type = other RNA; note = synthetic construct
atggtttacaagctgaacttcgaacttcagtctaatctcgaggacattaagcagaacttcaaaaacctttcttgctttgaggatgtagccctgttattggaggttccaaaagaattgttgtggaaggtcttgattaagaacaagggagcaaactataaagccttcaagctcaaaaagaagaatggctccgagagagtgatctttagccccaccctgtccttgagcatactgcagaagaaattggcgtatatcctggagtcaaactacaaaaaccacaggcaatcctatggctttgtgaaagggaggggaattgtggacaatgcccagaaacatctgaacaagaaatatgtcctgaactttgatatcgagaactttttcgaatctatcaccttccgacgagtgagaagcatgttcatgacgtactataaattcaacgagaaggtggccacaacccttgctaatatatgctgtcaccccaatggattcctaccacagggcgctgctacatcccccatcattagtaatataatctgcaaccgcatcgacaaggaattcagtaaactcgcaaagaataatcggtgccagtacacccggtacgccgacgatattacttttagtaccagcaggcgtgtctttcctcatgacattgcatacattaaagaaggtagcatcttcctgaactcaaatgtcatctctatagtcgagtatcagggttttaagataaataaggagaagacacgtctccaaaattaccgccaaaaccagacggtaaccgggatcacagtaaatgaaaagctcaacgtgaaaagatcatatgttcgcagaataaggtcaatcctgcattgtattgagaaaaatgtggaagacctgcagaaggccgaacaaatttttgaagaaaagtacccgttcagacagaagaagtacctcgacaacattaatatgtttgccatcctgaaaggtatgatcagccatgtgggccacgttaagggaaaggacgatccattatacctgaagctcgctaaacggttcaacaagatcagttatctgtctgagactatctcgccctttaagctggagtccctaaaaaagtttcacgagacttatacctacatcatcgattatgacgacaaggtgcccttagtctgtttcgagaatgataaaatggaagaaatcctttacggccagggcacaggattcttactgaagggtgttggcctaatcactaacgctcacgtgatagaggatgcgattgaggccatcaaggacaataagaagttcaacaacgagtatggaatttcattcttccgcgggaattatccagatctgaaatacaaggccaaagtatcgaaatacgatctcgataaggacatcgctatccttgacatcaaaggctttaacattgacaatcaaggatacgagtataatatcgacatgaaagatgggcagaaaattgagctcattggctaccctgattataagataggccaggagattaaaattgagactggacaccttaaggggatacggaaacatcgcgatagcaccggcacatttcactctaggcgggaaatttcagcaatcatttacggggggaatagcggggggccgattatcaacgagtccaatgaggtgataggagtggccgtgaagggcgcgactctgcatggtgtcagcccttccgaaatcatccctattgaagacgttattaatctgaacagctccaactctgaagtgagttccaaaatcgcaaccaaacctcactga

SEQ ID NO: 8677 - RNA, 1752 nt, unidentified
  source 1..1752: mol_type = other RNA; note = synthetic construct
atggtctacaagttgaatatacggttgcagtccaatttggaagacatcaagcaaaagtttcagaacctgtcatgtttcgaggatgtcgcactgctgctagaagtgccaaaagaactactgtggaaagtgttgataaaaaacaagggtaacaactacaacgccttcaagattaaaaagaagaacggatcagaacggtttatttttagcccaacatccaatctcagcctgctccagaaaaaacttgcctacgttctcaaatgcaactacaagaatcacaatcagtcttttgggtttgtggaagggagaggcatagtggctaatgcccagaagcatctgaataagaaatacgtcctcaattttgatctcgaaaatttcttcgagtcagttaccttccggcgggttcgtagcatgtttatgacctactacaagttcaatgagaaagtcgccaccattcttgctaatatctgttgccaccctaatgggtttttaccccaaggcgcggccaccagcccaatcatctccaacattatctgtaacaggttggataaagagttcagtcagattgccaagaagaatcgatgccagtataccaggtacgccgacgatattaccttcagtaccaataagagacagttcccctacgacatcgcatatgtgagagagggatccctgtttctgtcaactaatatcatctcgatcgttgagagtcaaggcttcaagattaacaaggaaaaaactaggctgcagaacttcaagcagaatcagacagttactggcattactgtgaacgaaaaactgaacgtcaaacgtagctatgtgaggcgcatcagatctattctgcattgcatcgaaaagaactccaacaacctccacaaggctgaacagatatttaaagagaaattcccgtttcgacaaaagaagctttttgacttcaacaacatcaatatgttcgcaatcctcaaaggcatgatttcgcacgtgggccacgtgaaagggaaggacgacgccgtgtatctcaatctggcaaaacgctttaatgatactgtctatctggaccctacaatcagccctttcaggttagagtctcttgagaaattccacaaatcctatacgtacattatccaggacgatgagaaagtacctctagcacattttgaggatggcatggaagtaattggttatggccaagggactgggtttcttctgaagggtgttggactggtgacaaacgcccatgtgatcgaagacgtgatcaaagctattgaggatggcaagaaattgaacattgagtacggcatctcattcttcaagggtaacgatccaaacattaagtataaggctaaagtggctaagtatgatctggacaaggacatcgcaattctggacatcaaaaatttcaatatcggggagcacggatacgagtacaatattaacatgacaaccggtcagaagatagaactgataggataccccgactactctattggtcaggaaatcaaaatcgagagtggctatctgaaggggatacgcaagcacggagattccacgggaaagtttcatacaagacatgagatctctgccatcatatatgggggaaacagcggcggaccgattataaacgagtctaacgaggtcatcggcgtggcggtcaagggagctacattacgcggggtagcgccctccgaaatcatccccattgaggagattattaatctcaatagcaaccttaccgatgtaagtaagcggatatga

SEQ ID NO: 8678 - RNA, 1761 nt, unidentified
  source 1..1761: mol_type = other RNA; note = synthetic construct
atgtcaaaaaaaatgaatgtgcgcctcctgtcagaggaagatgtgatcaagaaaaacttcaagtccttgaaagacttcgcagacattgcgaacatgctggagatccctaccaagattctacaccagattttggtggaaagcaagaagaacaattatagtacctttgtcatcaagaagaagaacggtaccgataggacaatccatgcccctaaaaagaacctgtcaatcattcagaagaagctctcaaacatcctcgccttggtgtacaacaaccatttaaatagccatgggttcatcaaaaatcggtccatcgtcactaatgcggcgcagcaccttaagcagaagtatgtccttaattttgacctggagaactatttcgagacaatcaatttcggccgcgtgcgggctatgtttatccattactacgggtttaatgagtccgtggccagcacactggctaatatatgctgtcaccatgagggatttcttcctcaaggagccgctaccagtcccattatttcgaacatcatctctttcaagatggataaggagctcaccaaaatcgccaaaaagtaccactgcacgtatacgcggtacgctgatgatatcactttttccacaaaaaagagcgtatttccgaaagaaattgcctttataaaggattccagtgtacaaatttcccacgaagtggtgaagattgttaagggcaatggctttttcataaataaggacaagaccaggttgaaccaccaacaggaaagactgagcgtgacaggtatcactgttaacgagaagctcaacgtcgagcgacggtacatccgtaagatcaggtcaattctgcactgtatcgaaaaaaatagctctgacattgaggttgccaaaagcatcttcaatgaaaagtataccttcaggcagcgacgcgacgaggggaacccagatatgttcgacgtgctgagggggatgatcagttacgtgggtctggtcaaagggaaggaggacgaagtttttctgaaactggcacagaggtacaacaaatgcgtcgatgctatgggcgtcagtgttattaaactaccagtagagagaagacgattccaggagcttaacacattcgtgatagagcaggagtattgctactataagtatgatggagttccagataactctcaatgtgtagtcgtgggacagggtacaggctttctgctgaagggcattggccttataaccaacgctcacgtcataggaaaagattactttgacctatgggagttaagcggagtcgaattcaatggaatatcaatcaatcggtccaaatacgagaaggataaaacttactacgccaaactgctctgttacgactatattaaggatatcgcaattctcgacgtggacggcatcgatatcgacaaagtaggcttcgaatataatgattccatatcgactgacgaagaaatccaattaatagggtatccctcctaccagaaaggaattgggctgtccgttaaagacgggaaagtgttggaacagcgctacaccattgaggacgagctcagtcgttctatcagatatgagatttctgcaactgtgttcgggggtaactctggcggccccgtcgttaatatgaacaatgaggtgattgctctggccgcaaagggcagcagcgaaaagggaaacgtgcctaatgaagtgataccaattaagcaggtgattgaccttgccattaaaaagaaactgatcccctctagagaggaaatctctgtgtga

SEQ ID NO: 8679 - RNA, 1734 nt, unidentified
  source 1..1734: mol_type = other RNA; note = synthetic construct
atgctgaataggatgaagcctgaactggtgtgtgaggatgacgctataaaacggaagttcaagaacctggaaaactttgaagacgtcgctcgcatgctggaaattcctgtgaaaaaactacgagagatcattgtcctgtccaagaagaacaattacattaccttcaagatcaagaagaagaacggaaatgataggacaatccatgcccccaacaaaaatctttcaatccttcagaagaagttctcatacattctgagcttggtctacaataatcaccttagcgcacatgggttcataaaagacagaagtatagtgtccaacgccacccaacacataaagcagagatacgtgctcaattttgaccttgaagactacttcgaaaacattaactttggacgagtacgtgccatgtttatccactatttcgggtttaacgaggcagtggcaagtaccttgagcaacatatgttgtcatcacgatggttttttgccccagggtgcagccacttcgcctgctatctccaacattttatccttcaagttagacaaagacctcactaaactcgcccgcaaacatcactgcatatattcccggtacgcggatgatatcaccttttccacgaaaaagaatcaatttccgaaagacattgcgtttattgagaattccagcgtgcagctctctaatgaggtgatcaagatcgtcaaaggaaatggctttttcattaatgagaacaagacgcgtctgaacaacaataaagagcacctatcagttacaggaattacagtgaacgaaaagctgaacgtggagcgaacatatattagaaagatccgctctatcttgcattgcatcgagaagaatatcgatgatatcgaggttgccaagaccatgtttaatgagaagtacaaattcaggcagagaaaagagaataagaatcccgatatgtttgacgtgctgcggggtatgatctcatacgtggggcaggtcaaaggcaaagaagacgaggtcttcctgaaactcgctaataggtacaaccgcgccattgagttcttcgaccttccactcattaaaataccggtgcccaagaagaagtttcaggaggataatacttacgtcatcgaaagtctgaactacgattataccttcggtggcgaacggcattatagcttggtcagtcaggggaccggctttatcctcaagggaatcgggttaatcacaaacgagcacgtgctcaaggagtatatagaaatgctagaactgggggtgcagtatgattcttcggagaacattgtcattcacaggagcaagtactctcatgagaaacagtacgcgaaacttctgtgctacgataaaattaaagacatagccatcctgagcattaaaggactcgacatcaaaaaggttggcttcgactataacgtatcaatcgagcccgatcaagagattcaactggtaggctatcctaacttcagagagaatatggacatttctatcaagaacggcgtgatcctgggagaacgctatactgacaagaccggcttcgtgagcgaaaaacggttcgaaactagtgctcacatatatggtgggaactctggcggaccagtagttaacatggccaatgaagtaatcgcagttgccgtgaagggggctacagaaaacggcgtggtcccaaatgaggttatcccaattaaggaggttatcgatctggcaaaaaagaataagatcattaccacttga

SEQ ID NO: 8680 - RNA, 1746 nt, unidentified
  source 1..1746: mol_type = other RNA; note = synthetic construct
atgattaaaaagatgagtccagagctgctctgcgaggatgccatcctcaaggaacggttcaaatctctgaatgactttgagggggtcgcacacctcctggaaattcctgtgaaggagctaagaaaggtgctggtgctgaacaaaaagtataactacaccactttcaagatcaaaaagaagaacgggaatgataggactatctacgccccccagaagaatctcagtattatccagaagaagttctcctacatactgagcctcgtatacaacaaccatttgaactcccatggattcatcaaggaaagatctatcgtcaccaatgctgagcagcacatcaaacagaagtttatcttgaacatcgatcttgaaaacttctttgagagcattaactttggccgggttcgcgctatgttcattcactacttcaagttcaatgaactcgtagctaccactctggcaaacatttgttgtcactatgacgggttccttccacagggcgcagctacatcaccaatcatctccaatatcctttctttcaagatggacaaggagctgaccaagctagcaaagaaaaatcactgcatatattcgaggtacgccgacgatattacgttttcaaccaagaaaaaccagttccctaaagacatcgcctacatagagaactcattcataaagatcaacagtgagcttctgaaggttataatggggaacggctttttcatcaacaaaaataagacacggctgaattcacaccgcgaaaaacttagcgttacaggaattaccgttaatgaaaaactgaatgtggagagaaagtatatccggaagattcgatccatcctgcattgcattgagaagaacattaacgatatcgaagtggccaaatccatcttcaatgagaaatacaggtttagacagaggaaggagcacggcaaacccgatatgatagacgtgctccgtggaatgatctcctatgttggccaagtgaagggaaagaatgaccaggtctttttaaaactggccaaacgctacaatttaattgtggagctgatagacatggacttgcccattatcaaattgccaatatcaaagcggaaatttcaagaggataacacattcgtcattgaatctctgtattacccgtactttatcgatggagagagcgcgggggaggcacctatcggacaaggaacagggtttttgctcaaaggcatcggtttaatcaccaatgcccatgtgtttaaaggtgagtacaccgagatgctcgagattggagcgacatttaagaagatcgaaatccatagaagcaagtactccagtgggaaaaagcactacgcaagtcttctgcactacgacaagattaaagatatcgcgatcctgagcgtggacggcctagatatggctaaaatgggtttcgaatataacgagttcattgagccaaatatggaaatacagttgctcggttatcctaattttcgagacaatatggacatctccattaaatcgggaactgtgttaggcgtgcgctataccgacacttataggctgaacagcgaaaagcgttatgagattagcgcccatatatatgggggtaactctggcggccctgtcgtaaatgaaaataacgaggctgttgccgtcgctgtaaaaggcattacggatgatgggagcgtcccctctgaagtgattccgattaaggaagtgatagaactggccaaaaaaaagaacattatccccctgaaaggctga

SEQ ID NO: 8681 - RNA, 1737 nt, unidentified
  source 1..1737: mol_type = other RNA; note = synthetic construct
atgacgtataaattaaacgtggaccttgtgcagaacccagaaattatcaaagagaagttcaaaagcctctccaattttaacgatgtagcaaatatcctggaaatcccttcgagctttctgcgccaaattcttatcgtgtctaagaagtccaactacgggacttttacgatcaaaaagaagtctggagatgaccggaaaattcacgcccctagtaagaacctcctgattatacagaaaaagttgacttcaatcctcaacctagtctacaagaatcacaataattctcatggcttcgttaaggatcggtccatcattacgaacgcaaataaacacattaggaagcaatatgtgctcaactttgacttagaggacttcttcaacaatatcaactttggaagagtgagagctatgttcatctattacttcaagttcaacgagactgtggcaaccatcctagcgaacatttgttgccattacgacggatttttgcctcagggcgccccgacctcaccgattatttcaaatatcctggcgaataagctggataaggaccttactcgccttgctaaacgtcatcgatgtgactacacgaggtacgccgacgatatatcaatcagcaccgacaaaaacaaatttcctaaagccatcgcccatacaaaggataaaaagacctatcttagcagcgaaattatctccatcgtcaaaaataacggctttttcattaacgacaagaaatctaggctcaattctaaattcgaaaacctgtcagtgactggactaacagtcaatgaaggccttaacgtaaagcgctcttatattcgccgagttcgcagcattttgaactgcatagagcaaaatctggataacctggacgaggccaaaaggatattcatcgaaaaatacccctttagacagatttcttatgccacagaacctgacatgtttgccatcctcaaaggaatgattgctcacataggacacatcaaagggaagaccaattcggtgtatagaaagttggccatccggtataatgacattgctgagattgagaacattctgtccataaagctgcccagcacacgtaggcagttccaggagactaacacctttgtcatagagagcagtttcttttacaagagtggggacgatgaagagtttgagccctgcggccaaggcaccggctttttgctcaaggggatcggtctggtaaccaacgcacacctgttcgacatatacttcaagaagagcaatgacggttacaatataaccaacttctcaattgaggtgcaccagtccaaatatagtaccaataagaaatacgcgaagctgttgtggcatgaccggattaaggatatcgctatcctccagttcacaaatggcaatctgacagatcaagggttcgattacaacacctccattaagactgggatggagatagaactcctgggttatccagcccacaccctggataattccatcaagattgagtctggagtcgtgagacaggagcggaataaccctatgcccgataggcagaagcagacacgatttgaaattagtcccctgatctacggtggaaacagcggcggtccagtagttaataaagaaaaccaggtcatcgctatcgcaacaagagggataacctccaatggggtggtgccaagtgaggtggttccaatcggcgatgtcatcacactgttcgaaaagcataatcccatcttaactaaaaacgtttga

SEQ ID NO: 8682 - RNA, 1713 nt, unidentified
  source 1..1713: mol_type = other RNA; note = synthetic construct
atgactaccatctacattaatctgaagtcagatgatgacgtgatcaagaacagatttcggacactggatacgttcgaagacatcgctaatttattggagatcaaacccaaaatgcttcgagatattctcgtcattaacaaaggaaagaactacaagagtttcgtgattaagaagaaaaacggcggagagcgcactatttactctcccgaaaaaaacctttcaatcctgcagaagaagttcttatacatactcaacttggtgtataggaatcacgaaaacgcccacgggtttgttagagacaagagtattaagaccaatgctacaagtcatttaggccaaaactatatcctgaatttcgacctgaaggacttctttgagaacattaatttcggaagggtgagaagcatgttcatgagttactttaagttcaataccatcatcgctaccactctagcgaacctctgctgtcatgaagatgggtttctgcctcagggtgctgcaacctccccagctatcgccaacatcctctcctacaacctggacaagacattttcaaaactggcaaaaaaggagaagtgtgtgtacactcgatatgcagacgacatcacgttcagtactaacagagaaaagtttccgaagaacatcgcttttcaaaagaaaggtcaggtcctgctctcaagctacgttgagaaaatcatcagggaaaatggcttcctgataaacgaaagcaaaacaaggcttcacaataaataccagaatctctctgtgaccggcattacagtcaaccagaaactgaacgtgtctagaaagtatattaggaagattcgcagcatcctccattgcatcgaaaaaaatatttcgaatctcgagctggccgagaaacttttttgcgagaaatataccttccggcaaaggaagaactccaatactccaaatatgttcgatgtgttaaaggggatgatttctcacctgggcaatgtacggggcaaatccgatgacatatacataaagttggcaacacgatataacatcctggtcaacaacattgacaaacctgagatcaagctgcccatctccgcccagaagtttcaggaacgcaatacttttgtcgtagactccctgtattctaaatatagcctctatggcgccgaggatcaggttctaaatggacagggcacaggattcctgctgaagaatgtaggacttatcacaaatgcacacgtgttgtatgataatatcgatcttctagacgacggagccgagtataaaactgaatattacatccgcgttcatcagagcaaatactcaatcgataacaaacagtactacgcgaaaatcgtgtactatgattcttttcgtgacattgctatcctgtccataaaggatataaacttgaataccgagggctattcttacaacgaagagattaaccccaatcaaagcattaagctcatagggtatcctcagtacattgatggtcaggatctgcgtgtattggacgggcatattatgaattcacggatacacaccgacggtacccgcacgcaaaaacggtacgagatcagtgccaccatcttcggtgggaatagcggagggccaattgtgaatgccaacaacgaggtcattgcagtggccgccaaggggatatccgacaagggctcggtgcccttcgaggttatccctattagcgacgtcataaagatttacaactga

SEQ ID NO: 8683 - RNA, 1773 nt, unidentified
  source 1..1773: mol_type = other RNA; note = synthetic construct
atgaacgttgaactcaccaaacccgatactctgctgatatacgagttccagaacttgcacagctttagtgacatcgccaatcttctggagattcctatcgaagtcttatggaagaatgttgttgacaagaaaaagtaccactccctaaagatccccaagaagcagagcgacaaattccgcatcattaacaagccgagtaagaacttgaatatcatccagaagaagttcaactacattcttagcctggtgtataaatcctcacatagcactagtcacgggttcgaaaagcataagtcaatccgtactaatgctatctgccacctcaataggcaattggtgctcaatctagacctcgaggagtttttttcatctatcatcttccctagagtgcgcgcaatgttcatgacttacttcaagttcaacaatgaggtggccaccacattagccaatatttgttgcgacaacaacaacaaactgccacaaggcgcagctacctccccaatcgtctcgaatatcatcgcttataaactcgataaacagctgtcacggcttgctagaaccaatggatgtatatattcccgatatgctgacgatataaccctgagcacgaataacaagaagttccggtttgagattttcaacgggaacgacggggtcaaagaagtaggcgagaaggtaaaacagatcatccaatctaacggctttaagataaactccagcaaaacaaggatttgtgagaacagcaaagcacagtatgtgactggagtgaaggtgaactccaaactgaatgtgaaccgcacctatgtccgacggatcaggtcaatacttcacaccatagagaagaatctggacaatatcgaggaggcagtcaaaattttcaaagaaaagtacccctacagagcgaccctctttaataactacgacatgttcaacatcgtcaggggtatgatttcccacattgggcatattaagggaaagcaggatgccgtgtttcagaaatttgttatacgctacaaccgcattatcagtgagatcaatacaaaagaaggcacaaattatgcgtttctatatcgaccatacacctggacagagtttaggcagcagaatatttatgtgatcgaggaggatgaaatttcttacaggctcggaagcttgaataaaaagatcatctctagtcaagggtcagcctttttactgcaaggaataggtctggtgacaaactggcatgtggtaaagtgctttatcgaaggagtcattaacaatgaactggcgacgtttaattctaactactacatacctgtaaccaagtcaagatattccgacaagatctggttcgccaaaattatcatgttcgacaaaggcagagatattgccgtgttgaaaattgatggcgtggatgagaagctgtatgggttcgactactctcttgatatcaaggaaaatatggaatgctgtctgctcggttaccccgaatacattcgggatcagaccctgcacgaggtggagggcaaaatacaatcccagagaattagtcggtactatccgaatgattacgttcgttatactacgacaatggccattcacgggggcaactctggcggaccagtcgtcaacaaggaaaacaatgttattgcaattgccgtgaaaggctctaacaatactgtggctgaagtaatccctataggtgacctgctggagagcatcaaccagcagcagatgattaaaatcgagcagcataacatcgtgcagacaactgaagtttcgaagagctga

SEQ ID NO: 8684 - RNA, 1728 nt, unidentified
  source 1..1728: mol_type = other RNA; note = synthetic construct
atgcacgtagacctgaaatcagaagataccgctatcctgaataagtttaacagcttgcaaacttttgacgatatagccgacctgctggaaataccacccaaaaaactttgggaggctgtgatccagaacaagacttattccgagttcaccattcctaaaaaaaacagctccaattttagggtcataaacaaaccctcaaagaacttggatatcattcagaagaagatgaactacgtgcttagtctagcatacaagagtaccagcaatgtcagtcatgggttcgagaaaaacaaaagcatcagaaccaatgcccaggtgcacttaagaaaaaagctgatcctgaacatcgaccttgcgaattacttctcttctataaccttcccacgtattcgagcaatgttcctatcctacttccgcttcaacgaggtggtggcgacaaccttggctaacatttgctgcgataataacaatgagttgcctcaaggtgccgcaacttcccctattatctccaacatcataacctataagctggataaagaccttgtcagactggctcggaagcatcgatccaactacacacgctacgccgacgacattactttttctacgaatcggaaagaattccagagtgatatcttcaatatggacgaagacttttatgacgtgggtgacaaagtcattgagctcatctcgaagaatgggttcagcatcaacactagcaaaacacgcatccacgactcatctcagcccaaatatgtaacaggcgttaaggtgaacacaaagctcaacctcaataaacgatacataagacggattaggtcaatcctgcactgtatagagaaaaatatcaatagcctggacgaggccattaccatcttcgaagcaaagtatccctttcggaagactaagtttaagaatcgggatatgttcaacatcgtgcgggggatgatttcacatctgggacacattaagggcaagcaggaccatgtgtaccagaagctggctattaggtacaatttgatcatttccgccgtcaatggctcttctaatgaaaactacccctatattcataggccgctgacgcacagcgagttcagagagcagaatgtttatgttattgaatctgacttcgtcaactataagtttttcgagtccaaaaagaacatcgtgacctatcagggtagcggctttctcctgaaagaggtaggattagtgacaaactatcatgtggtgaaagagtacatcgagatcctggaagaggagaatacgtcttttgaagaagagtattacatccctctctccaaatctcgttactcccaagatatttggtttgcgaagatcataatgtatgataaggctagggatctggccgtgctccacataaatattgtcgaccacttcgagcatggctttaattacaatcaatccattaccgaaggaatggatagcgtcattataggctacccagaatataaggagagttcaagtctccatatcgatcagggaaagattcttggggaacgcatccactactataacgataagaggtttacccgctacagcactagaatgccaatccacgggggtaactcaggagggcccatcgtcaacatgaagaacgaggtgattgccgtggccgtaaaaggcaaggacaatagcgttacagaagttatcccggtgagtgatctcttaaagtcgatcgaggcaaaagaaatgtgtctagtttga

SEQ ID NO: 8685 - RNA, 1746 nt, unidentified
  source 1..1746: mol_type = other RNA; note = synthetic construct
atgtccttccagggttctccgaagttacaggacagcgatgacaacattaccaaaaagtacaagtcactcaacagttttcaggatatagccgggcttctggaaatcccccaggagttgctgtggaagactctcatgaaaaataaggaaaacaactaccggacgttcaccttgaagaaaaagagtgggggcgaccggataatcaatgcacccactaacaacctgtcaatcatccagaagaagctgaactacatcctctccatttcctataagaaatctcacacgaatagccacggctttgtcctcaaaaagagcatcgtgaccaatgcatcacagcatgtggcgaaaaagtttgtgctcaattttgatcttgacaatttcttcgggacaattacctacgctagggtgcgcgcaatgttcatgacgtactacaaattcaacaacagcgtcgctagtaccctggcgaatatctgttgcaacaatgatggcgtcctgcctcaaggggccgccacatctccaattatctccaacattatctcccgcaggatcgacgaagatctgagtaggcttgccaagaagatgaattgtacatattccagatacgccgacgacataaccattagctgcgacagcaactatttcccttctgaaatcgcctactttgaagaatccattaccaaaatcggatcccaagtgaagtcgataatcagcaaaaacggcttcagtattaacatgaaaaagaatcgactgaggtcccagtaccagaatcagagcgtgacaggcatcactgtgaatcagaaaactaatgtagacagacagtatattcggaagatacggtctatcttgaactgcatcgagaaaaatatagacgacattagcatggctgaaaagacttttcgggagaaatatagcttcagacagtctcaaataaagaaacccaagatgttcgatgttctgcgtggcatgataagttatgttgggttggtgaagggaaaagatgaccagctttttctaaagttggccaaaagattcaacaaggtgatcaaaaatcagaacctggcattcatccgagttccaattagtaaggtggaactccgcgaggagaacacttttgttatcgattccctgtacagcatttattctatggacggcgaaaagtcagaggcgtgtaatgggcaaggtactggggtactgatcagaaacatgggattagtcaccaatgcccacgttttatacgagaacatcgaggtgctggagtacggagctgagtttgagcgggaatactatataaggatccataagagcaagtatggctcccaggaatacttcgctaagatcgattactttgattcttttcgcgacattgccattcttacaatcaaagactttgataccagtaagtatggtttcgaatataacgaggagattgagttcaatcaaattatcgagctcatcgggtatccttcgtataaagatggtcaggacctgcgcgtcagctcaggtgtagtgatgggagagcgtacccacgctgatagagtccgtaagcaaaaacgatttgagatttcagctcagatcttcggcggaaactcaggcggacctattgtcaattctgacaacgaagttattgccattgccgcaaaaggatctacagagaaaggctcggtgcccaatgaggtaatcccaatttccgatgtgataaatgtgttcgataacaagacaaggaaattttaccatctagcacactcatga

SEQ ID NO: 8686 - RNA, 1071 nt, unidentified
  source 1..1071: mol_type = other RNA; note = synthetic construct
atggcaaaaggccgggtgacaaccgccctgcttcttatgctcccccggagatgtgagtttatggagattgaaatccggaataccgacgaggacgttaagcgaaacttcgagaacctcataaatttcaaagacgtagcacatttgctcgagataagcgccgaaaccttgtacaaaattctgttcatcaacaagcacttgaactataaagagttcaccctaaataggggaaaggtgcgtaccatttatagccctaagaagaacctgatgattatccagagaaagctggcctatatactgagcctgctgtatagccaccatacgaagtctcacgggtacatcaaggagaaatcaattattagcaacgccaatgaacatgtgcagcagaggtacgtgctgaacttcgatttaaaggacttctttgacagtatctcttttggcaggattagagccatgttcatgacttacttcaagttcaacgataaggtttccacaacattagcaaacatttgttgccacccgaatggctttctcccacaaggagctcccacgtccccaatcattagtaatatcatcagctataggctggataagaatctggattcgatctcccgcaggtacaactgcaaatatactcgatacgtggatgacatcacaatttccacaagtcgcatctattttcctaaggctataggccacggccaaaagggttctgatcaggcggtcgtgtcggaaaaaatcaaatccattgtccacaagaacgggtttaaggtcaatgacaaaaaaactcgtcttaactcaaagtatgagaatctctctgtcaccggtatcactgtcaatgaaactctaaatgtgaaacgcagctacgttcggtacatccgggtgatcttgcattcaatcgaaaagggaatagaggaagataatctcgacaaggctcagaaaaagtttaacgagcagtacaactttagacagcgcaaaaaaggaaatcttcctgacatgtacagtgtaattcgagggcgctctcccatgctggataaactgaaggggagaaaaatcatgtccattatatcatga

SEQ ID NO: 8687 - RNA, 1728 nt, unidentified
  source 1..1728: mol_type = other RNA; note = synthetic construct
atgaacgagaaggttagcgagtttaagaacatcaacggcttcgagtccattgccgagtttcttgaaatcccgaaacccgaactatggttgatgctggtcaagaggaaaaaattcaactacacgcagttcaagatcccaaagaagaatggcgagtttcggattatacacagcccatccgagaaacttgctgagagccaaaagcgcctggcaagtgttatcgggcatctttatgcttcaaatcacaccactcatgggttcgtagccggaaagtctatcaagaccaatgcccaggaacacgtgaggcagagttctctgctgaatctggatctggcagattttttcgagaatatcagctatggtcgcgtgagagctatgttcggcgagtacttcaagttcaattacaaagactcctctaccctcgccaaccttgtgtgccatcccgatggatttttgccccagggcgccgtgacgagccctatgatttcaaacatcatctgctactctcttgataaggaaatcaatcggctggccaagcgaaatggatgcatttatacaaggtacgctgacgacttgacaattagcagtaagaaaatcgtgtttcctagatcgattgctcacaaaaacattaatgagggtgtggttctgaatcggcagctggaaagcatcataaacaaaaatgggttcagtgtcaacgcgtcaaagactagattaaacaccaaatacgagtgtttgtcagttaccggagtgaaagtgaacgacaaactcaatgtgaatcgggtttttgtccgtagggttaggtccatcctcaatagcatcgaaaagtgtgagggggatctcatcagtgcccaaaaaatattcgacgaaaagtatcactcccgtaaccagggctctggaaactcaccaaatatgttcgaagcggtgcgcggcatgattgggcacatcggatttatcaaaggggaagaggatctagtgtttatcaaattggccgacagatacaactctataattaacggcacctctaggtccggcttaataaaggtccctctatctattgagaagtcccgacagacatacactttcgtggtggaatcaaacgacttcatcaagtacaagtatgaagaagacgacggttattttatttgtgagggcggcagcgctttctttctcaagggtataggcctggtcaccaatgctcatctcttcggagagctgaaggacacactgaagtattgcgagaacggcctgattgacttggtgatggatgaggaatattacatcctcactcaccggtcacgatataacgccaagaaaatgaagttcagattagtggcgatagactttatgaaggatatcgcaattctgcaacctgagaataaagatgcgtacaaatatggatttgagtacagctgtgatctgaagaagggagataaagtagtcgtgcttggctaccccgagtataaagcaaaccaggaactcagatccatggtaggggagattctgggggagcggagtcacgagctggaaactaaaccagccgaatacgccgcacgttatgaggtgtccgctactatctactccggaaattcgggtgggccggtagtgaacgaagcaaacgaagtcattggcatcgccacaaaaggtacgacagaacgcgggcaggtccccaatgagtttgttcctattgtcgagattgtagagctccataaagcaatgataacccgcgaatga

SEQ ID NO: 8688 - RNA, 1341 nt, unidentified
  source 1..1341: mol_type = other RNA; note = synthetic construct
atgcatttgcaggagctgaagagcttcacagatatcgcctcttccctggatgtgacagccgggcatcttagacggctgttgttcgaggaaaagaacaacttgtactttgagttcgaaatccccaaaaaaaacggaagtcttcgaaagatctacgcaccaaacgattctctgttattcatccaaaagcggctcagcgcaatactcagctctagcgtgaagctgcacgataaagcgtatggcttcataaacaagcgatccattgtcgacaacgctcagctacatataaggaagaacgtgctcctgaatatcgacctcgaaaacttttttccgagtatcagcttcgggcgggttaggtccatgtttatgaactactttaggctggacaagaatgtcgccaccacacttacaaatatctgctgtcaccccggtggctttctccctcagggctctccaacctcccccgtcatttccaacattttgtgtaagactctggacaaagacctcgaccgtctggctaaaaattcatttggtgctacctactcacgctatgcggatgatatcacttttagtacaaagacttcctgggaggaaattatctcaagcaaagtgactctcttccaaaagctcaacgatatcctatttgaccagaccattgttttggacatcgcttcgagctacaacccttcaatacacaagtatgaggaacgccttttgaaaaaaaagtattactctgcactgcagagtataggcttcatatccaaacacgagctcgacacagatttatctgtgctgcacggagatattggggagtttctgatgcaccatttagtgtccaactacatttcagacaataactctgttaagtacttgtatccaaagctggtgctgaagagcaatcctaagatgcccgcatatgggaatgatggaactatttacgtgccaagcaagaaagaaatcttttaccttgaggccaaattctacaccaatctcaccaaagccattaataaagccgtggatagtctgaaagaacataatgaggtcacgcaggaaaatattgaccacaagaccgagctgtttagaaacatcaaaacgaagagtaatgacgagattattgaaattaccgacgatgtcaatgagaagctagttttattcctgatctgcgacaacattttcaaggaagaggacgtgcttaaatgcctgaaaaagaacaatggcctgatcgagctgaagaaatcattcgaggtaatcatcttcgtactgcctatactttcgaaatctgagttcctcgaatccttcaagaagcagagcatcctaagaggaaatcagtattatgtacaatga

SEQ ID NO: 8689 - RNA, 1641 nt, unidentified
  source 1..1641: mol_type = other RNA; note = synthetic construct
atgaagatgcggcttcaggagcttaagtcttttaatgatatcgctagttcactgaacgtgaccaccggccatctgcgtagattgctattcaaggaaaagaacaacctgtactttgagttcgagatcccaaaaaaaaacggcaccttcagaaagatctatgcccctaatgacagcctcctgtttattcagaaacgcctgtgcaagatactgaatagctccgtgaaactgcataataaggcatatggcttcataaatgagaggagtatcgtagataacgctcaactacatctcaagaaaaatgtcctgctcaacatcgatctcgagaacttttttccttccatctcattcgggcgagtaaggagcatgttcatgaactactttaagctggataagaacgtctcaacaatcctcgccaacatatgttgtcacccaaatggtttcctgcctcaaggctctcccacctccccggtgataagcaacatactgtgtaagacactggataaggatttggaccggttggccaagaactccttcggggctacctactcaagatatgccgacgacataacctttagcactaaaaagagcttcaaagagaacatcgttattgaaaagaacggggaaatcattctgggttctagtcttacagatattattcggcgcaatgggttcaagatcaatccaaataagacgcgcctgcagaaagccatccagcaccaggaagtcacggggataatagtcaatcagaaacttaatgtggacagacgctacatccggaaaatccgtgcgatgctttactctatcgaggagaattctaacaatctgtccattcccctcgaaaaatttgccgaagctggctataaggggaacgacattgagaatattctaagagtgattaagggcatgatcaactatgtctctatggtaaaaggtaagtatgacgccgtgtttgagcaacttgctaacaggtacaataccattctcgaagaactagagattgaaaacctgaaaccaattttcataccgcccaaaatttgcttagaggagagtgtgtgcgtcatcaaggagacagcgattaccttattcagcgataaggagaacatgattacagcatattatggacagggctctggattcctgctgaagaatcatgggattatttcgaattaccacgtgttcgagtacttgatcgaggacctgtcccgaggatttagcactatcaaaaacgagttcttcgttgaagtatttttcggaaaaaggactagtaagttggtcaaggccaaaattgagaaatacaacaaagacaaggacctcgtgctgttagttcctgaagattcctcattgcttgactttggctttgagaaatttgaggacgtgttagagcaaaacactgaagtttatctcctgggttaccctgacttcgcagatggagatcagatgaagtttgaaaagggacactatctcaggacagtgaattccaaaggaatcaagaaatacgaaatctcgcagatcatctttggcgggaatagcggtggacccgtgctcgatcgggaaaatcgcgttatcggcgtggcaactgagggcaaaaggatttcaatcaaccgaatcattcccatcgaatacctgcacgacttgaagtga

SEQ ID NO: 8690 - RNA, 1659 nt, unidentified
  source 1..1659: mol_type = other RNA; note = synthetic construct
atgcgcatacaggagtttgagtctttcaaggatatagccgacgccctgggcattaagtcaggccaccttagaaaacttctattcgaagagaggaacaacctctactcggattttgaaattcccaagaaagacggctccttgcgcaagatctactccccttctaaaaaactgttatttatccagaggcggcttctgctaatactcgaaaactcaattaaggtgcaccctcaggcttatggcttcgtgaaaggaaaggggactgtcagcaacgcctccttgcatcttcggaaaaattacctcctgaatattgacctgaaagacttttttcccaacatcacgagcggccgagtcaggagcatgttcttaaactacttcaagttgaacaacactgtggcttcaacactgacaaacctgtgctgtcacccgaagggtttccttcctcagggagctcctactagtcccattatatccaatattctctgcaaaaccctggatcggaacctggatcgactagccaaaaacagtttcgggtccagctattctcgttacgcggatgatatatcattttccagtaacagaccgttcaaagaaaacatcgttagcgaacagaacggaaatgtgatcctcggctcctctctgttagacatcatctcatccaacggctttaagattaatctggataaggtcagactccaaaagaatcatcaacaccaagaggtgactggtatcgttgtcaatgaccggttgaatctggacaggagatatataagacgcgttcgggcgatgctgcacagcattgaggttaacattgacgatctctcaatcccaaccaagaaattcgaagagtcaaattacaaaggaaacacctttgataacctcctgatggtaataaagggcatgatcgattatattggcatggtaaggggaaaggcagacaatatctacgagaaactcgcagtgaagttcaattatatcctagagctgctcgagctggacaacatcaaaccacttttcattacagagaaaatcgagaacaatgtgtgtgtcattaagttcaagaagatcttcctgttcaaaacggactttagcgagatggttgagctggattatggtcagggaagtggtttcctcctcaagtcttatggcattgtcacaaattatcatgtagtggagggtcttatagaatccggttttctgaacgggtttcctaagtctacaaacgagttttacatcgaaacctttttcggaaaacattcttcgaaaatcgtgaaggcaaagatcaataagtacagtaaggaaaaggatctggtgctactgatcccagaggatttgagccttctggacaaagggttggacatttctaccgatgccttaaatctgaatgaggaaatccgcttattgggataccccgaattctatgagggggacgaactgaaaaacgagctgggcaattatctccgaaccgtcgtagacaatgtggaaggcaacagtattaagaagtacgagttgaataccatgatttttgccgggaattccggggggcccgtgataaatagcgacggcaaagtgatcggggttgcaaccgaaggacgtaagattgaaacaaatcgcgctgtgccaatcgactacatcaaaactctgcagagcttggatatttga

SEQ ID NO: 8691 - RNA, 1629 nt, unidentified
  source 1..1629: mol_type = other RNA; note = synthetic construct
atgaagatccagaatatcaacagttttacggagttatccttcgtgctgggatacaagagcggccacctcagaagaattctgtttaacatcaacagcagcagctatacttccttcgagatacctaagaaaaacggtgaggttcgcaagatatacagtccacagagtcaattactgatcctccagaagaaagtggcagctatactagaaaactcgttcaacccacactacaaatcatttggattcattaaagggaagagcatcgaaaaaaacgccaagctgcatttgaaacggaagtaccttatcaacattgacctcaagaattttttcgagtcaataaccgcgggtagagtttacagcatgtttgtgaactactttaagctggatcggaatatcgccgcaattctcactaatatttgttgccacccagaaggattcttacctcagggggctccgacttctcccatcattacgaatatactgtgcaagactctggataaggagttgaataacctgtcaaagaaatattccgtgacctatagcaggtacgctgatgacatcacctttagttctaacaaggccttcaatagctgttttcttacccgggaagagagcctatcagatgacattaagcgaatcattgaacagaacggctttttcatcaatgacaataagtttcggtactctaagtttaaccagcgtaaggaagtgacaggcattatcgtcaacgagaaactgaatgtggatcgaaggtacatcaggaagatccgcgccatgttgtactccattgagaataatcttgacaatctggaggtaccccgcactaagttcgacaaatcccattacaagggtgactccattgagaacctcctgaacgtaatcaaaggcatgatatcttataccaccatggtgaaaggaaacaacaatattagcacaaaactcgcaatgagattcaacgatatcttggagtgtttagagatcgacagtgtaaagccaataaaggttaaacctctggatattaacgaggaaaaggtctgcgtcatcaagctggagaacgtgttcttttattctaagaacggcgaaccttatgacatagactatgggcaagggacaggctttatcctgaaaaatgtgggaatagtctccaactaccatgtttttgaattcatcatcgaggagattgagaaagaaaagaaaccgctctgcgaagataagtatttcatcaacctgtatttcggaattaactgtaccaaaaaggtgaaggccaaagtgctgaaatatgacatcgacaaagatctggtgattctgcaacccaaagacttgaatatccttgaaatgggcttcgagcttgaagagggcacaatcgagaataactctaaggtcacacttctaggctacccctcatataatgaaggtgatcgcataaaagaggagcaggggaaactcctgcgtaagattaatgacattaagggattcgagaaatacgaaatttcctccgtcatccacgctgggaattctggtggccccgtgctcaataataaaggcaaggtactcggggtcgccacagaaggaagggggaatgatattaacaaagttgtgcctatcaccaatgttctgtcgatgttgaagtga

SEQ ID NO: 8692 - RNA, 1683 nt, unidentified
  source 1..1683: mol_type = other RNA; note = synthetic construct
atgagaattcaggatatcagtacctttgatcaaatcgcgaaggccctcggtatctccaccggatacctgcgcagactactcttcgaggaaagagacaacttctacactgagattgagatacccaaaaaaaatggcgactcccgcaagatttttgtccctagtgatgaactgctgcagctgcagaagaaactcaatacgattctcatcagttctttcaacccctccagccgagcttttgggtttgtgcagggcagatccacagtgcagaatgctagcctgcacttgaagaagaagtacatattaaacatcgacctcctagacttttttccttcaatctcctctggaagggtgcgctcgatgttcatcaattactttaagctttcctctatcgtcgctagcaccctcactaatttatgttgccaccctgacggtttccttccacagggtgcacctaccagtcctaccatttccaacattctttgcaaaacactggacaaagagctgatcaacttagccaggaaactggggaaaatcacctattcacgatatgccgacgacattacattcagcaccaactcaacctttagcagaaaactggtgaggagaaataacggggagatctgcttggggaatgaactgatcgaaattgtcgagaaaaacggctttgaaattaactctagcaaaactcgccttcagaataataaccagcatcaagaggttactggcataaaggtgaatcggaaattgaacatcgacaggcgattcattcgcaagattcgcgctatgcttttttctattgaaagcaacctggacgacttgagcatcccggccacaaaattcgcagagtcagattataagggagattctataggaaggctgatgaaggtcatcaagggcatgatttcatatgtgggcatggtgcgtggtaagaatgatgcattgtttatcggtctggccaagaggttcaacaaactgttactcgttgtggatcaatttaaggacgaaaagcccatagtcattgatagtggcctgtcgcagctaccaaacttagtatgtgtggtcccgcagactaatattcagctgtggaagaaagataatgagatgaacatcttcagcgagattgactacgggcaagggacaggatttttgattaaggggataggaatcgtttccaattaccatgtgttcgaattcgtgatcgattccattaaagatgggtttctgcccagggagacggagtacttcgtgaaccttcggtttggcgccagccaatctaagaagatctctgccaagatcagttttttcagtgaggagctcgatttggtaattctgatccccgaagaccagattatactaaacaacggtttcgagcgggagctgagagagccagaacagaatgagacaatcactctgctcggatatccagacttctctgaaggagatcagctcaaaatggaacgtggcgattacctgcggacaaccttctcaaagaaggttgagatgtatgaaatcagcccaataatcttcgccggcaattcaggcggacctatcattaacaaatccgacaaagtaatcggcatcgcgacagaggggcggcgtatagctctgaatcgggcaatacccattaaatacgttgacgaagaaaagcttaccaccctgacttatacgctcttcaagttttga

SEQ ID NO: 8693 - RNA, 1767 nt, unidentified
  source 1..1767: mol_type = other RNA; note = synthetic construct
atggccggtaaagtggagttaccattttgcttcggcggctttctgttgctgctgaaagagcttaagtctttttcagatatcgccgaagccctgtcagtatctagcggcaacctgaggaatattatcttcgagtacaagaagaattcctacgaaaagtttgacattcctaagaagtctggcggcattcgaacaatttacaagcctaactctcagctggcagctatccagcatgaactgtgcgacatactatataatagctacaaaccgcactacaacgctcatggctttatcaaggacaaatccatactgaccaatgccgagaaccacgtcggtaagaagtacatcctcaatctggatctggaaaacttctttgagtcagtgaaattcccaagagtgagggggatgttcattaactacttcggcctgaaagagaatgtggctacgatcctcgcaaatatctgctgccacccagagggttttctgccacagggcgctgcaacctctcccgtcatcacaaatattctcctgaagacccttgataaggaactgaccagactcgcaaaagaaagtaattgggcgaaatattctcgatacgctgatgatattacctttagctccaacaagaagttcataaagaacattgtggaggagattgatgggcagattgttcttggcaaagagttagtttggctaatccagaaaaacgggttcaaggttaacgaaaaaaaaactcgcctgcaaacgaagtatgatcaccaagaggtgactgggattgttgtgaacaagaagctgaatgtcgatcggcggtatatcagacgtatccgcgccatgctccatagtatcgatatgaacaagaatgatctcaagattcccaaggacaggttcaagaaaaaatattttcccaggaactgtaactgtagtggcgacttgttcctcacactgaaaggaatgatcacccacgtcgggcacgttaaaggaatatacaacctcgtgtacaaaaaccttgccatgaaattcaatcgccttttgcttgagtgtcggctgccatacccagcacccatcaatattttagagaagagcgatgtctattacgacaacgtatttgtgatagactcgagcaaggacatattctttattgacaacaatggcgacatggaatcctacgactacggacaaggaactggattctatttgaaagggtacgggatcattacaaattatcatgtgcttgagtacgtgctcgacgaaatcaattccggcaagaaaccgatctcttcctcaggcaatcagtatttcatcgaattctttagcggtcgggacccgtccactataatgaaggcgaagtatctctatggatccaaggaaaaggacattgtggtcctagagcctagcgactccagcctgatcggtcagggattcgacatattcaaatcaaagatcatcccccaaaatatggaactgaatctgttgggttatcccgattacaacaagaacgatgacttgaaaatcgaatcaggaaagtttctccgtaaaattgtacctgatggtaactctagaattgagatcactcagacaatttttggagggaacagtggggggcccgtattgaacagcgataatgaggtgatagggattgccgtgcgcggcgacggaaaatatcctaataccgctatccctatctatgaggttgagaatctacacgcctcgcatatcgaaagcttacctaacagtagtgtcaaagataataacctgtcaatgcagaggtga

SEQ ID NO: 8694 - RNA, 1728 nt, unidentified
  source 1..1728: mol_type = other RNA; note = synthetic construct
atgtctctaatattccacatttccgacatcaagaactatcaggacctggctgattacttggaggtaacaaccggctatctttcaaaagtgatcaatgaccctaaccgctatcaatgtttcgaaatccccaagaaagataattccctccgatccatatattctcctactaaagatctgctggttattcagctgaaaatcaagaagctcattgaacagaatttcaatccccactacaaggcccatggtttcattaatggaaaggactttatcaccaatgcctataatcatatcgggaagaattttgtgctaaaccttgacctgaataatttcttcgagtcgatcagcattaaacgggtcaacaacatgtttcagcgttactttaaagtgcggcccaatatctccactgtcctggcacatatctgttgccacccagatggctttttaccccagggtgcgccgacgtcacctattatcagcaacgtgatctgtaagtctctggacaaggacttgactgagctggccaagagtttaaaactgacttactacagtaggtatgcggacgacatcacctttagctgcaaaaaaaaagacttcccaaagattctggccgaggacataaacggaaatatcgtgctgtcgaaccatctcaccaacctcattgaaaagcatgggtttaaagtcaacttgaacaaaacccgcttgcagagtaagtacatgcaccaagaggtgacaggtatcactgttaacaaaaagatcaacctgaacagaaggtatataaagcggattagggccattctgtacagcttcaagaaatatgtggatgaaccggatatacctattggcaaattctgcgagttctataatatcaccaacaataacatcgaggagacaaagtaccgcatttttaacatcttaaaggggcacattatccatatcagccacgttaagggatataatgacagtaacttcctggacttcatgcgaaagtttaatgaactccttgaactgtactccttatctattccagcaattaaagttctcgactctagcaacaatttctttaagcgtaatacactagtcatctacccacttaactcactggatgatccccagtactttgtggatagagacttcataaagaatggcaacttcgaaatcgattcagtctgttatgggcaagggtctgggttttaccttaaggacattggcattgtgacaaactatcacgtggtatcactgataattgaagaggtcctcgagaaaaaattgacgttctgcaaagagtattaccttgagtactttaccgagagtaatggcaagcagtacaaataccatgccaaaataatcgcatacgacaaagaaaaggacattgcaatcctcaagcccaaatatccagatctggttgactccggattcaagtacaataagaggttcaacatcaacgattccataacgctgttgggctttcccaatcacacaactggtagcgagtttcggagcgataaaggcaagataatcagaaagatcaagaacaagaacatctctacatacgagattgatgctaagatattcgccggcaattccggagggcctgtcctcaattataaaaacgaagtaatcggaatcgctactaaaggctttaccgatagaggaattgtgccgccagaatttattcctattaagtacgctatcgaggtgtataagaaccacaccgataagaaactctga

SEQ ID NO: 8695 - RNA, 1698 nt, unidentified
  source 1..1698: mol_type = other RNA; note = synthetic construct
atgaataacccctttagtaatttgaccgtgaaactgaagaaatccgacgacgagctgatcaacgcctttggctctctgtccacttttgaggacgttgctagtattctcgaggtgtcgagccatgccttgtggataattctcgtcaaaaacaagccatataactatagagaagcatcaatcccaaagaaagacgggggcgagagaaaggtgtatattccaaacaacaatctgttcatcctccaacaaaagctaaagtatgtgctggagcttatttattcaccccactttacctcacatggttttgtgaacgataggagcatcatatctaatgccgaacgacacgttaataagaagttcgtgatcaacattgacctgaaagacttcttccccactatcaagtacaaccgaatagtgaatatgttcgtcaaggtttttcgctgttcacctaacatcgcaaatacccttgctaatattgtgacacatcatgaaggcttcctgccccagggctcaccaatttctcctctgatttcgaatgtcattgcccggacaatggatgaccagctcttcaagctctgcaaagagataaaagaagtacagtacacccggtacgccgatgatcttaccttctccactaataggaagaaaattccgaattccatagtcaagaactccaataactcctatgagttgagcgacaaactcatcaatatcatcgaaaataacggctttgaaatcaactacaagaagttcagagtgcagagcgaatacgaccaccagagtgtcactggtataaaggtgaacaagaagctaaacatcaacaagagctatatccgcatggttcgggtttacctatacatattcgagaaaaacgaggatatcaatcaggccattaaagagttcaatctgcgaagacccaaaaaaagcaacttgaaacacaggttgataaaaaacgagttccagaatcagatcttccacctgaaagtccttaaaggaatgatcgagtttatcgggtctgtgcgtggtagacgggataggattttcaacaagttcagtaagaggttcaacacaatttgcgaaaccgcggggcttaacaatatacagatcaacatccctcttctcctggaagaagttattgacaacaaaatcttggtcgtgggaaacaatgaccaatacttttataccctggatcaggggattaatacgaaggagatttccttaagtaagagcctggcagtcagtaataatgaacgcggtattatttccactaaagctaattggactacattccgggatgattttgagggaacacactactatgactttcataccattccgttgtacaggaagaacacgacagatgtgttatcttatctgaagattaaccgtgtggctgaaaatgatctgatttactttgaaggcccagaagaactgactaaaaacctccaagagatcaacacagagatcgagagcctgaaaataggaaatgtaatactggtgggactccacaataatacgatcgagatctttgaggggatcttaaccaagcgcatcctctttggagagtctaaattcatctttaagcctatctctaacgaaaatctgcctatcagcttcggctttgtatttaatcaggtaggcaatcttgtggggaccctgtcccgcggcaactctgagttatacgtcaactcaattaagtga

SEQ ID NO: 8696 - RNA, 1701 nt, unidentified
  source 1..1701: mol_type = other RNA; note = synthetic construct
atggcggataaatttacgttactggaggagatcgacgacgtgctgaactttaagttccgaaacttgaacaactttaaggagattgctgacatgctggaggtgtccagtgagttcctgcactccatactgtacaaaaagcgtagctacgaaactttcttcattcagaaaaagagcggaggatatcgcgaaatcaaaacccccaataacaacctcaagctaattcagaaaaagttggcgtacattctctcattgaattataagatgcacaagtctgcatttggcttcataaagaacaagtcaatcatcgacaatgccaatctgcatatcaacaaaaaatgggtgttcaactttgacctcgaagatttttttcaccagttcaatcaggggcgagtcatcggcttactccgtaaatactacaagttcaataacacagtagcaggaatccttgctgagatttgttgctatgaaaatacgctccctcaaggagctccaactagcccgatcttatcaaatatcttggcttttgagctcgacagggagttccaaaaggagtgtaagaaatatcactgtacctacagtagatatgtggatgacatcagcatctccacaaataaatctcacttccctaaaaacctcgcatacaagaactcacaggaggaaatcatcctgggggagatagctcaaacaatacttgacaagaccagttttaaagtcaaccctaagaaggtgtatctgcggcatgagacacaacatcagaatgttacgggacttgtcgtgaacgaaggggttaatgtgtcacggacatacattaagagaattagggccacgctccataatctaagagtgagtaacgaggaggacggtaaaaacaaattcttcctggaactcagcaaacattcaagttcgaggtcgcaacagtttgatatgtatgccatcctgaaaggcaagatccagtttgtgggacaggtgaaggggaaggaaaatcaggtattccggaaactagcgactagctttaatcagctggacctgcctgcatctgtcaagcccatttccattctgtcttccaccgagaagaagcgctgccaaaacacatatatcgtcgaggtcggctacgaaatcggggaggaactgttttattacacaggtaccgccttttatatgaaaggagttggcatagtgtctgccgcacacactttcaaaaactactatgactgcaaagagtacgccgattcccaccacctctaccttattaatgaaaacaagctgaccgagaagatcaacattaccaagaaatacatcgattacgaactggatattgccatattcgacatcgatacacagctgaatacagacgattggggttttgaatacagcaatagcatcattgaaggccagtcttgtgtgcttcttgggtatccacggcatatcgatgggaatactctgaatactgagtttggcaaaattacccagaaaataaaccagaaatgcccaaataggttcaacaagaagaccggcaccttgggagtggaacagactcgcttcaagatttcctctgacatatatagtggcaacagcggtggtcccattttgaacgacgacgatagagtaatcgccattgctgtgaaggggtacggcgataatgccgtagaggttaataccgttgtccccatatccgatattttcacttatatgctgccatga

SEQ ID NO: 8697 - RNA, 1698 nt, unidentified
  source 1..1698: mol_type = other RNA; note = synthetic construct
atgacagaaaagttcacgcttcttaaggagattgatgacgtgctcatatttaagttccgcaacctgaacaattttaaggagatagctgacatgctcgaaatcagtccagaatttctccacagtatcctgtaccagaaaaagtcatacgagacatttttcattcagaagaagtccgggggcagccgggagattaaatcgcctaacaacaatctgaagatcatccagaaaaagcttgcctacatcttaagcctgaattataagatgcacaaaagttctttcggcttcatcaagaataagagtattatcgacaacgctaaacaacatacaaacaaaacttgggtctttaactttgacctgaaagactactttcaccagtttaatcagggtagagttatcggcttcttccgtaagtactacaaattcaataacgtcgtcgctggagtgctcaccgagatatgttgttatgaaaatactcttccgcaaggcgcccctacttctccaattctcagcaatatcttgtcctttgaattagatcgggaatttcagaaggaatgcaaaaagtccaactgcacttactcacgctatgtagacgatgtctcaatttccactaacaagttctacttcccgaaaaagatcgcatacaaagatgcccaggaagagattacgctgggtgagataagcaaaaaaatcctggacaagaccggatttgaggtgaaccagagcaaggtgtgcctaagacataagacacagcaccaatatgttaccggactggtggttaatgaaggcgtgaacgtctctcggaaatacataaaaaggattcgagccgccctcaacaatctcagaaccaataatgaaactaacggcaaggagaaattcttcattgaactgtctaagcattcccggaactcaagccagcagttcgacatgtattctattctgaaggggcagatccacttcgtggggcaagtgaagggtaaggataatcaagtgtttagaaagttagctaccagcttcaatcagcttgacttgcctgtttccattaaacccatcagcatcctgagttccacggagaagaaacgttgtcaaaatacatacattgtcgaggtgggttacgaaaatgatgagggcattcagtgttttaccggatctgcgttttacatgaagggcgtcgggattgtgagcgcagctcacacattccgagattattataggtgcatcaaagaggccgttaacccctatttgtatttgataaacgagaacaagcctacagaaaaaatcgaaatcaccaagaaacacatcgattatgacctggatatcgccatttttgatatcgattcatcagaggacaccgcaaactggggattcgagtactccaattcaatttttgaagggcagagttgcgtgctgttgggatatccaaagcataccgacgggaataacctgaacaccgaggtgggtaggataactcagaagctgaaacagaagcatcccaacaaattcaacaaaaagatgtccgatctaggggtggagcagaccaggtataaaatctccagcgacatttacgcaggcaattctggagggcccgtactaaataatgatgagcgcgttatcgccattgcggtgaaaggattcggcgacaatggcactgaggtgaacacagtcgtaccagtatctgacatcttttcgtacatgatatga

SEQ ID NO: 8698 - RNA, 1737 nt, unidentified
  source 1..1737: mol_type = other RNA; note = synthetic construct
atggataacaaaagcattctgttaaacgccattgatgacgtgcttatctttaagttcagaaacctcaacaacttcaaagagatagctgacatgctcgagatttcgccccagttcctgcattctatcctttacaagcggaaatcatataacgtgtttcagattcagaagaagaatggcggcacccgcgaaattaagagcccagacaacaatctgaagatcgttcagaaaaagctcgcttacattatatccctgaattacaagatgcatcggtcttcattcggcttcattaaaaaaaagtccatcgtggacaacgctaagccccacacaaacaagaaatgggtcttcaatttcgaccttaaagacttctttaaccagttcaatcaagggagggttataggcctgtttaagaagtactacaagttcaacgatagcgtggctggcgtgctggctgaaatctgctgtcacgagaatgtgctgccgcagggtgccccaactagtcctatcctgtctaacatcctgtccttcgaattagacagggagtttcagcacaaatgtaagaagtataactgcatctactccagatatgtagatgatatcacgatcagtacaaacaaggcctattttccgaaaaaaattgcacgacgggacgccgagggcgagatagttctcggtagcgtctcacaggagatcgtcgataaggcagattttcaggtaaatcaatccaaagtgtatctgaggcattcctctcagaatcagcacgtcactggtctgaccgtcaacgagggagtcaacgtgtccagaaaatacataaagaaaatccgggcgaccatccacaatcttaaggtgaacaacgagaaggttgcagaggaaaagttctttaaggaatacttgaagggacccataccaaagaagactgacctgaacatgtacagcatcctaaaggggcgtattcagttcgtcggacaggttaaggggaaggaaaactcattgttcaggaaattggcgaaggagtttaatgatttgaaacttcctaagcaagtcaatcctatctctatcttgacagccctcgaaaagaatcgccgaagatattgctttatcgtggaagttggccacattctcggggaggatatataccattataccggtagcgccttctatctgaaaggaatcggcctagtgtccgccgcccataccttcaaggaatactacgaaaacaaagagtatgctgataaacactacatgtacgtggtaaatgagaataagccagacgagaagatccctattgtgaaaaaacatatcgactacgcgttagacatcgcaatctttgaaatgccaacaaaactaagggataataatgaggggtttctgtatagcacaactgtgaacgtcggccaaaagtgtgtgctccttggatatcccaaacacttcgtggggaacactctgaataccgaatttgggcagattaatcaagagttgaaggtaagactgcccgacaaatataatagcgttacgggagaactcggggtgatccaaaaacgctataaaatttctgccgtgatctacgccgggaattcaggcggccccattattgatgaacgcgagaaagtcattggaatagcagtgaagggacatggtgagaatggcgtcgaggttaacacagtggtacctatttctgacatttttacctacatacaggactatagtctcgaacaccgtacctcgctgagtagtaaatga

SEQ ID NO: 8699 - RNA, 1695 nt, unidentified
  source 1..1695: mol_type = other RNA; note = synthetic construct
atgcaacagattcaattgaaggaaatcgatgaggtccttgtgctgaaatttcgcaacctaaacaactttaaggaggtcgccgatctcctggagatatctccccagttcttgcgcgatatcctctacgagaaacgcaagtactcccacttttatataagcaagaagaacggtggcgagcgcgagatcttttctcccgtcaacaacctgaagatcattcaaaagaagttggcatacatcttcacactggactacactcctttcaaatcttcattcgggtttgtgaagaagaaatcaattatcgacaacgctgccctgcacactaacaaaaaatgggttttcaactttgacctgaaagacttcttccatcagtttaatcagggaagagtgataggcctgttcaggcggtatttcaatttcaataatgtggtggccggcgttctcgccgaaatttgttgccatcagaacattttacctcagggcgcccccacgtcacctattctcagtaatatgctgtgcttcgaagtagaccgtgagctccagaagctatgttccagcaaacagtgcacatactcgcgatatgtcgatgacattaccatttcttcctcgaaggattactttccaagattgttcgcgtttaaagacggggagggaaggatgagactggggagactgctcgaggagatcttgaggaagacaggtttcgatgtgaaccaagagaaaatatatcttcgaactcccaatcagaatcaaaatgtgaccggactgaccgtgaatgaaatcgttaacgtgaatcgaaactatgtgaaaaggatcagggcaagtatacataatcttaaagtcaacacggaggaagcggcccgcgaaaagttttttattgaatacacgaagcggaaagcacacattaacccgaatgcaaatgtgtatagtatccttaagggccagatccagtttgttgcgcaggtaaaaggtcgtgagaaccccgtatttaaaaaactcgcttcccaattcaactccctgaatctgccgagcaacattaatccaatttctcctctgacacgggtggaaaagtttcggcgtcggaattgtttcatagtcgagattagttttgagagagaaggcgaatttttttgtaataccggtagtgccttttaccttaaaaagatcggcctggtatccgctgctcacattttcaaagactacttcgagcactatgatagcgccgttaagcgcgagatatacatcgtgaacgaagtcgacaggaagcacaagatcaagatcaataagaagtacatcgattacgacttagatatagccattttcaatcttgacactaccatcgacaccatgaattggggtttcaacagatcagataccatctatgagaaccagaagtgcattttactagggtacccagaggactgcaatggcaacacactcaatacagaattcggaaaaattactcaggttatcagcaacagctttccaaacaaattcaactcaatagaacaggagctgggactgacccagattcggtataagatcagcgctactatctatggcggaaacagcggcgggcctatcctcgatatccatgaaaacgtgatcgggatcgcagctaaagggacctccgataatggaataactattaacacattcgtgccaatttccgacatcaagttcttgatgaattcttga

SEQ ID NO: 8700 - RNA, 1686 nt, unidentified
  source 1..1686: mol_type = other RNA; note = synthetic construct
atgactaaacgcatagatcagctaaagacagaagacagcaacctcatctcaaactttagaaagcttaactcgttctatgatatcgcaagtctgctggaagtgacacctaagttcctctactatattctgaatgtcgaaaagtcatacactcctttcaaaattcccaaaaagaatggcgacatgcgaacgattatggctccctccaaaaacctgaagatcatccagaagaagctaagctacatcctgactaagtcttcctctctgaataagagcgcccatggattcgtacagggcaagtctattatcaccaacgcagccatgcatgttaacaaaaaatgggtactgaatttcgatctgaaaaactactttgaccagtttaaccagggaaagcttatcgggttctttaagagctactacaaattcaatgacgaggtcatcgggatccttgtgtccatatgctgccacaacaacatactgccacaaggtgctccaaccagtcctatactgaccaatatcctcacctacaatttcgataaacagatgagtcagctgtgtcggaagaataactatatatacacccggtacgtggacgacattacaatttctaccgacaagtacgagttccaaaagaggtttgtgtattataacgagaacaacgatgtgcagatcggaaatgcgatcaacaagattctcgagaaaacaaatttcgagatcaacactaagaagaccagactgaggataaattatcagaatcagaccgtgaccggaattacagtgaatcgtaagttgaacgttagccgcaagtatatccgaaagacgagagccatactacacaaccttaaagtaaataacgacaacgtggcccagaaaaaattcgacgaatactaccccgtccgccactatcgtgactataaggcatccgacaagtacaatgttgtcaaaggaatgattgagcacgtggcacaggttaaaggccgggacgataggatcttcaagaaactggctctgtccttcaatgatctcaacttacctgagcacgtctatgagctgaatttgtacagccctttcgagaaaaacttgcgcaagaactgtttcgtggttgaaatcgagtattcattatatggcgacttttaccccgccactgcttcagcctttctccttaaaggggtcggtgtcattacgtccgcccacacctttaaacagtatctcgagtataaagacgaagtggaggatataaagatctgggcatttcgggaaaatgaaacaactttgaagaggccactggatatcaagaattttgacttcacactcgattttgcgatttgccatgttgccggcatcaatcatactgaatacggctttgagttcagcaaacatatcagtctgggcgaagatatcacccttttggggtttccccagtatcagcacaagaatctgttgaataaagaacacggcgtaatcacgcaagagattaatgagtacttccaagagaagttaaacccaaagacacagagtccaggttacaaccaaaaaagatacgggattagctcacagatttttgaaggtaactcgggagggccggtgctcaactctgactacaaggtgataggcattgccaccaaagggattacttccgatgctgtgaaagtcaatacaattgtgccgatctctgatatttttcaatga

SEQ ID NO: 8701 - RNA, 1746 nt, unidentified
  source 1..1746: mol_type = other RNA; note = synthetic construct
atgtcctacttccgcgctaaaccgaccctgcaagcctctgatgccaaactggtgtcttctttgaagagtctgcagaatttcgatgatgtggcatctctgttggaagtaaccccaaagcacctgcgatacatccttttcgagaaaaaggtcagtggatattataagtgcttcgacatccccaagaagtccgggggttctcgcaagatttgggctcctcaagggtccttaaagatcctccaggaaaaattgaacaagatctttagcctgacatataagcccaacattacttcgcacgggttcgtcaaggataggggcattgtgagcaacgcaactgttcatctccgcaagcgacatgtgctcaactttgacatagaagacttcttccatcggattaattttggaagagtgagaggcgtcctgaagagcttttttggtatgtcctgggacgcggccacagtgatcgcgaatatatgctgctacaataatgtgcttccccaaggagcacctacatcaccaatcattagcaacatgatttgcttcaacatggacatggaaatgcggaaattggcaaagaaacacaactgtcactacacgcgttatgctgatgatcttacattttcaaccaccagacagacttttccttctgccatcgctcacctcgatgaggaaagggtcgtctacctgggatccaaaattcagaagatcctggacaacaatgatttcgccgtcaagaagagtaaaactaggctgaataatcgggatcaaaatttatcggtgacgggcatcaccgttaataagatcacaaatgtggagcggaactatatcaagaaggttcgtgctatcctgaagtgtctagagagccatcccctgtcagaggcccagaagatcttcgagtccaagtattactctaaacctgggaaaaaaaacgcagaaatcatgaacgttgtcaaaggcatgatctcccacatcggatatgtgaaaggaaaacaggacccaatttacgagaaactggcccgccggtacaacagactggcagggattgagacgttaaaagtgggggaggcctttcttaaggactggtcacagaatgtcttcgttattgaagttggctatgacaatagcggcgtattcgatccacagcaacaaggcaccggattttttctaaaggacgtgggcttcgtgacaaaccaccatgtcgtaaaagaatacatcgatgacccggatatttatgaaattcgggtgcaccgttcaaggtacaataaaaaatgcttccaggctaaagtgaagatgtactgtaaggagcgcgacatagctatcctcgagatagatgggtttaacatcacagggtttgactatgatctgataaactatgacggccagtccataaaagtgataggttatccaaggtacgggcatgaggatagtttgtttgtggaccagggtaccattgtgcagtacagaagtgagttcatgcgcaccatctacaataagaaaactcaggaactcggactctaccaggaacgaatcatatgtagtgccaggatcatttatggaaactccggtggccccgtgataaacaccagaggccaggtgattggcattgccactaagggtttcagcaatgtaagcaaaaaggaggaagatgacgactccagcgctgcctcataccttgtaaaaatcggcgacgtttttgacatgattggggagaaggaggagtctgtcccctcacctgttagcgcgatttga

SEQ ID NO: 8702 - RNA, 1737 nt, unidentified
  source 1..1737: mol_type = other RNA; note = synthetic construct
atgtcccactttatggccaaaagccaacttaaagcctccaatgagaaactcttggaaagtttccgcaccctgcagtcctttgatgacgttgcagacatattagaggtcagtccgaagcaccttcactacattctattcaagaaaccaaagtcgcagtactacaggtcattcgctataccaaaaaagaacggtgggtaccgtgaaatcactgcccccactaggtcccttaagattctgcaggaaaagctaaatcggatattcagcctggtgtataaacccaatattactgcacacggttttattaagggccgcgggatcgtgactaatgctacagtacacgtaagaaagaagcatgtgctgaacctggatttagaggacttcttctcaaccataaatttcgggagagtgcgcggaatcttgaaaagcttttttaaaatcggcgatgacgcagctactgtgatcgcgaacatctgttgttacaacaatgttctgcctcagggggctccgacctccccaatcctgtcaaacatgatttgtttcaagctcgataaagaaatgcggaatatcgcaaagctctataattgcgattacacccgctatgccgacgatattactttcagtaccaatcatcagacgtttcctaaggagatcgccctgtttcgggaggaaaatatcgtacacctggggatcaaggtcgagaatattatagagtccaacggtttcaagacaaacaactctaaaacgagactcaacaataggaatcagaagctggccgtgacgggcctcactgtgaataaaatcgtcaatgtgaaccgtggctatgtcaggaagacaagatctattttgcgctgcattgagaaatatagcctcgagaaagcccaagaaatttatgtggagaagttcgccaaaaaccataagggggttaagatcattaacgtggtgcagggcatgataacccatattggacatatcaagggaaaacaggaccaggtttatgagaagctcgcgaggcggtataatcggattcgaggcgaggaggtgctgaaaatcggtgatacatttttgagccagaacatctgcgtcattgaggtggggtactatgacgacgagcagaattttatgcctgaagtccaagggactgggttctttctgaggggtgtgggactgataaccaaccgtcacgtgattaaggaacacttagaacttcccgagatctatagcatcaagatccaccggtctaaatacgactacacatattataatgcggtggtgagaatgtctgacgaggaacgagatatcgccattttggatgtcattggcatcgccccagagggcttcgagtacgataacgacaactacacaggccaaaacattaagctgatcggataccccgactacggccataaagattctctgtacatggaccagggcgtcatcacacagtacagaaaacagtggatgcctaacgtttacaatctcgataccgaagaattgggagtttttcaggaacgaatcgtctgcagtgtgcgcatcgtgatcggcaactctggaggtcccgtcgtaaaccttaacggacaagttattggcatagctaccaaaggattcaaaaagattgacaagtccgagaaagacgacacatcaaccgaggcaagccatctggtaaagatagaagatgtttttgaactcctggctgaacaggagcaaaagcttctaaccaacaccctggagaatgtgtga

SEQ ID NO: 8703 - RNA, 1740 nt, unidentified
  source 1..1740: mol_type = other RNA; note = synthetic construct
atgaattacttcaacgccaaaccagaacttatggccaacgaccagtcactgatatccagctttaagtccttgcagtcattccgcgacgtctgcaatctcctggaagttactcctactcatctgcgctatatactttttgagaaaactccaagccagtactatacctttttcacgatatctaagaagagtggcggtattcgggagatcattgcccccaatggcgctttgaaaatcctgcaggagaagcttaataagatctttaaactggcttacaagcccaacgcctccattcacgggttcacaattgataggagcatagtgacgaatgcgcggatgcacctcgggaaaaaccatttgctgaactttgacctggctgactttttcccctcgatcaacttcggcagggttaggggggtcctaatatccttctttggtatgggatccgaggccgctaccgtaattgctaatatctgttgctacaagaactctctcccccaaggagcaccaacgagcccgatcctttctaatatggtgtgtttcaacttggacaagcagctgcagctagtcgccaggaagaacggttgcacctacaccaggtacgcagacgatattacctttagtacaaccaagcacttatttcctaaatcaatcgcattcgtggagaatgagatcgtgtatatcggacccaaaattctgaagatcctggaggacaactcgttcaaagtaaatcacctgaagacccgtctcaacaatcgcctccagcacctaggggttacaggaatcactgtaaacaagatcttgaacgttaagcgggattatatcaagaagattcgagcgattctgcggtgcctggaaatcaatagccttgaacaggcacaattcatctttgagacaaagtacacaaagattcgcaataaagcacctaacagtgagtatcccagtatactcaacgtggtaaaaggtatgatcgactacgtgggtgcagtcaaaggaacccaagatcctatctacgagaagctcgccttcagatacaatcagatctgtaaattaccagtgtttaagatcggggaggaaaataccgagtcttggaacaaaaaagtgtgggtcgtcgaactctgtatcgaggccgaagacgatggcaagatagaatatataccagtgatacaaggcactggattctttttaaatgatattggcttcgtgacaaacgctcatgtcgtgagagactaccgggaatatgatatcattcgaattagcagatccagatacggcagtgaagtgaagaaagcctctgtcatcaagttggatcgagacagggatatcgcaattctgaagatagacgacttcgaggattggtctggcttcaaccattccttcgttcattatatcggcatggacgtcaaagtgattggatatcctaattttggtggcaatgattcactgtatgtgcacaagggggagatcctgcagtatagagttgaacacttcccggacaagtacaataaagcgactgattcactggggatgaaccagcatcgtaccgtgatttctgcccgcattattgccggaaattccggaggccctgtcgtgaacatgcagggcgaagttgtgggggtggcgacaaagggctttaaagagatcagcccagggaaacacgacgatgatactgccacaagcattatgatcaaaattgaggacgtaattagctttgctaacgagatggaacccaccaaagcttga

SEQ ID NO: 8704 - RNA, 1728 nt, unidentified
  source 1..1728: mol_type = other RNA; note = synthetic construct
atgtcatattttgacgctaagattgaactccaggcgactgatgaggaactcatccacagttttaaagacttggagaactatcgggacgtgtgcagcctactggaagtgaccccgaagcacctccattacatcctatataagaagaagaacctgtactatcagttcgacatcccaaaaaagaatggcggcacccgtgagatttatgctccgtgcgactcacttaaaatcctgcaacagaagctgaattacatcatgagcctcatatacaaacccaaatacacaatccacggctttgtcaaaagcaggggaatcgtatcgaacgcaaagcaacacctgggtaagagctacatcctgaatttcgacctgtacgacttctttccatcaataaatttcggaagggtacgcgggatactccggtcttattttgggttgggcgatcatgcagctacaattattgcgaacatttgttgcttcaacaattctttaccccaaggtgcacctacgtctccaattctctcaaatattgtgtgcttcaacctggataaagagttgcaatttatagccaaacagcattcttgtatctacaccagatacgctgacgatatcacgttcagcacaacgaagaaagatttccctaaaagtgtggccttcaagactgattcccagatttttctcgggaagaagattttgaaggtgatcgagaagaacagcttcaaagtgaacgagaataaaactaggcttcacaaccgctatcagaatctttccgtgacagggattaccgttaacgagaaactgaatgtgccccgaaactacattaagcgcatacgcgccatgctgcgttgtatcgagacaaatacaccagaagatgcccaggttattttcctggagaaatacaagtttcggtatagagccaatatggaacctcctaatattatgaatgtcctgcacgggatgatcaactatgtcgggtttgtcaggggcctggacgacgaaatctttaagaagttagccttgcgatataatctcattgtcggcaacgataaaatcaaggtcaagaaagacaacctcgccctgtgggaatcttacgtttgggtggtcgaggtgggatacaaggatgacgacgatttttacgccgaggaacagggaactggcttcttcttaaagaacgtgggtttcgttactaacgcgcatgtaattgagaaatacgatggtgaatccattaatgcaatctatctgaatcggagtcggtacagtgaggaacagaaattggcctccatcataaccatcgacaaagacagagacatcgctatactgtacgttgagggctttgatattgattatggctttagctacaacatccatcacaacttggggcaggaaatcattttactgggttaccccaatcacggagacggaaattccctttatatcaacaaaggccagctcgtacagtatagatcccactatatgcctaacacccttaataaggagacaggaaagctgggagtgaaacaggagagggtgaccatctcctctcgaatagtgactggcaattcaggaggcccagtcattaacctgcaaaacgaggtgatcgggatagctaccaaggggttcaaggatatcagccccaatctaaaggatgattccaccgcagaaagcatgatcgttaagattaaggacgtgctgtcggtccttagtcagatgtctaaacttcatagagaaaactga

SEQ ID NO: 8705 - RNA, 1743 nt, unidentified
  source 1..1743: mol_type = other RNA; note = synthetic construct
atgtcctacttcgatgctaatatcgagctacaggcaaaagatgaggacctcattgttgccttcaagaaactcaaggattttcgagatgtgtgcgatattctggaagtgacgcctacccatttacactacattctgtacaaaaaaggtccatcaaaactttaccatcccttcaatatccccaaaaaagggggtggcactcggcagatcttagcccctaacgactcactgaggatccttcagcagaagctgaactacattatgagcctaatctataagccaaagtttgccatccatggatacgttaagggccggagtattgtgagcaatgcaaagcagcacctcaacaagaactatatactgaacttcgacatagaagatttcttcccgtccataaattttggccgtgtccgcggagtgctgaagagtttctttggaattggcaaagatgcagcgacaatcatcgctaatatctgttgttacaacaaccttctaccccagggagctccaacttctcctattctcagtaacatgatctgctttcaactcgacaaagagatgcagttgattgcgaaacaacatagctgcgtctacactcggtatgcagacgacctcaccttctccacgactaagaagtccttccctaaggccattgcttatcacggggacgattgcgtccacctggggaagaggatcctggctacgatcgagtctaacggattcaagatcaacaataacaaaacccgcttgcattctaagtatcagcacctgggcgtgaccggggtgacagtgaacgaaaagttaaacgtgaagcgggactacatcaagaaaatacgcgcaatcctgaggtgtttggaaattaactctctcgacgaagcccagaaaatattcgaggacaagtacatccgccgccacaccaaggaggtgaattttccgaatattatgaatgtggtcagaggcatgattaattatgttcggcttgtgaaaggccccgaggattctatctttgagaaactggcaaggagatacaataaaatcgccggtgttgaggtcttcactgtaggtattcagcactccagattttggactagctacgtatgtgtggtcgaggtcggctgcaaggacgaggatgaattctatgcggatgaccaagggaccgggttttttcttcaagggatcggattcgttactaacgctcacgtggtgaaaaagttcaatggcattgaattcaacgccatatatatcaacaagtcaaggtatgaccaaaccaaaattgccgctagcatactgactatggatgaggagagagacttggctattttgaagattgatgggtttgagagcaacatcggattttcatactcgacaaactactatgggggccagcccataacactgctgggttatccgaatcatggtggaacagacagcttgtacacagaaaatggagaaatcaagcagtatcgtccccactatatgcccaataagtacgacgaaaaaaccggcaaactgggcgttcatcaggagcgaattgtgattagtcctagaattgtgaccggtaactcaggaggccctgtagtgaattctcaaaaccaggtcatcggcgttgccacaaaggggtttaatgaaatatccccagggagtaaggatgaaccaaccgccgactccatcatcgtcaaaatcgaagacgtactggccctccacaccgagatgcgaagcgatgagacaccaatagccaatcagtga

SEQ ID NO: 8706 - RNA, 1746 nt, unidentified
  source 1..1746: mol_type = other RNA; note = synthetic construct
atgaacactaatttcaaggccaatttgcagataaagagctcggtagaggacatccaaaaaaagttcaagaacttatccagcttcgacgatgtgagcgatctgttggagatctcccctaaacacctgagatatatcttgttcgagatgaaggacaggtacaagagcttcgaaattccgaaaaagaacggggagacaagatctattgttgcgccctctaaaagtataaagattctgcagcggaagctgaactacatcctgtcattaaactattccaaccgacctacgagtcacggttttattaaagggaaaagcatagtgaccaatgcccagccacacgtgaaacagtccgtagtgctgaatttcgacctgaaggacttttttagtacaatcaactttggcagggtgcggggtgtctttattaagtttttcgacattggcgacgatgctgcaaccgtactagctaacatatgttgcaaggacaatgttctgccacaaggggcacccacctctcccattatctctaatatcgtctgttataagctcgacaaagagcttctaaaattcgccaaaaaacatagctgtgtgtatacccgctatgcagatgacataacactctcaacgaataaaaaacacttccctaacgaaatgatccagctcaacaagcagacatacaccctatcaaagtctctctttaataagatcgagaacaatggcttcaaaataaacgacaataagacacgcatccgctactgctctcagcgtatggaagtgaccggcctcactgtaaatgaaaaacctaacgttacaagacactatattcggaacatcagagctataatcaggtcaattgaaaaatacgggttagaggtggcccaagagatccacgagggcaagtacatcaaaattcatctgaaatctaccccacagattaccaatctgcttatcggaaagctgaactacgtgaagatggttcgagggattgaggactccgtctttaacaagctcgccaagcgcttcaacaaagctatgggtgacgaacttgtggagacgtacaagtctaaaagggaattgcgagagttgcatacttacgtcgtagattgcggctttattgtcgacggcgaattcatcaacgagtcacagggcagtggttttttcctcaaaggagttggatttgtcactaatgcccacgttgtgaagctgtataaagaaaacaattccaacgagcttccatacgagattcgtattcatcggtcgagatacagcgatactgtcctcaaggccattctgactatctacaatcgggacttggatattgcaattctgaacgtggaaggatttaactccgattatggttattcctacaaccttgacaatgaatatggtcaggaaataagagtgatgggctatccgaatcacaacaagagggacagcctggccaccgatagtggagagataaagcaatacagggacaattacctcaaagaaactgttaatcaagagacaggagagctgggagacttccaggaacgctttgtggtgagcgctcggatcgtggatggcaattcagggggccccgtgatcaacaatgacgatgaggtcatcgggatcgcgacaaagggattccgtactcttacagatagtgggtacgatgaagataccgataccagcattgcagtgaagatcgaggatgtcatcaaactgatcgagtccaaggatcagaaggacctgaattatcagcattattga

SEQ ID NO: 8707 - RNA, 1464 nt, unidentified
  source 1..1464: mol_type = other RNA; note = synthetic construct
atggacgagagccaaatcaccaatatttgcacgtttgacgagttggccaatgccctggaaatcgaaccatcgaaactgagatacatcttgtggggaaagaaacctccatcatattatagccgcttcactattcctaaagccaatgggaccaagcgacaaattagcgccccacaggggcctatcaaggtgttacagtaccggctcctgagaatcctgaacgcctattattcacctaaacgggtggtgcacggttttactaagggccggagcattgtgtctaatgccaactcccacattaacaagaattgggtagtcaacattgatatcaaagacttctttccctccattaattttggacgggttcgcggtctgtttctgaaatctttcccagggatgactaaggaatccgcaaccgccatagctcagctcacatccgtcttcaatagccttccccagggagctcccacaagccccatcatctcgaacatgatctgttctagattagatcgagatttaatggactttgctcgccaagataacataaaatattcacgctacgctgacgacatcacactctcaggcgatggcgcagtgaggtccagtatcggcgaatatagtaacggactcttggttttgtccagcaaatgtatcaagatattcaacgacaatggtttccagatcaacagtgataaggtcagagtaagcttcaagtaccgcagacaggaagttacaggccttgtggtgaattctaagattaacgtctctcgcaagtatatccgcaatctgcgggcacttctgcacaacatcgagacactggggttgagtgaggcgcaggagctgtacaccgaaaagtaccatggccggggttcactgcagagttatattcacgggaaactcttattcctaagaatggtgaggggatctagcgacaatctatatgatcggctggttaacagttttaatctcaacatagctgaccggccgggaaatgactccaacacccacctcccgaccagggcagagattaaagctatcctcagcaggctagatccctcctacggcaataggtaccatcgaatatggagggaactttacgacgagacggattcaacaggagagaacctgaaaactgccctgtacttaatgagagaggtgattggcgggctgatacgtaggttcgcgaagaatgagtccgtagaaaactatttgaacctgtcccctaacctgcgtataaccaggttgcagcgttgcaagtatctctcagaaaagtctcttgcaactggggaggaaagactggccaaactttttatgtacatcccaggctactacaatgatctgaacaagctacattctctcgagatcgttgacaaagtcgatgtgaaagtgctggtcgacaaggtcaatgagctgattattgaggtggtgaagagcattgagatgctggaacttttccgactcagttga

SEQ ID NO: 8708 - RNA, 1659 nt, unidentified
  source 1..1659: mol_type = other RNA; note = synthetic construct
atgtcctttgtaagaaacagggtgaattcgaatcggaataggagtgagacgataaaagagttttgcgataacatcggggtgtcaaaagagggcttcctcctgtataacaaggaaaacgagaaagaatacaaggtgtttgatctcataaagaagaatggctctctgcggaaagtgaaagctccatctgcaggactggcgggcctccaacgcaagatctccaagatcctgcagacaatctacaatcagccaaactgtgtgcatggttacgtgcccgaccgaagtgtcgtctccaatgcccagtgccatgtcaacaagaggtatattctgagcatcgacattaacgacttctttggatccattaccagaaatagaatcttggggctttttaggtccatcttttctgatcaaaacctctgcgaggctttgacaaacatatgcgtcgtagacggatgtttgcctactggctctcccgcctctcctgtgttatctaacatgatcatgttcaagatggaccgtaaaatcatgagcatctgtaaaaacaaccacgttttttatacccggtatagcgacgatctgacattctccacaaaaaccaagtcattcccctctgagttcgtatatttagatgcttgtggttccctgactctcgggaaatcaattgtcgcgatattcaaggagaatggattcagtataaacctgaagaagaccaagctgcgcagccgaagtaaccgtcaagttgttaccggggtggttgttaacaagatcaccaatatcccttcgagctatatgtctaatttgcgcgccatcaaaaatagcatatcaaagcacggtgtggacggggcccagaagattttcgacgagaattacaaggaaacacggtacaaaaatagagttaacattggccatcacatttctattaaggacatggtgcgcggcaaaatcgaatacattgggatggttcggggaaagcaggacgccctatacagaaagaacctggattggtacaataagaatttccgatcactgggcgacccagaagaatgtgtgtaccccatctactttatcatcgatatgccagagaaaagtaaacagaaggaccataggattaagaatgactgcggccagggtacttgctttttcctggaagatgtgggcatactaactgcagaccactttcttcctagcgtcgaggatgtggaagcagctggagatcaccttcggctgtattttgagactaaggacggctgcaaacacaacgtcaagattgagaacaggtatccgaagattgacatggcagtactttccttagaggataatctgttcagaagcaaaaagctctacgtgaataccgacttctcacacagcgatcgccttaccgtgtcgttgtatggatttcctgactgcgccgtgggcgaaagtctgcaggtgagagattcagtcattacgggaacacgcaacagagccgatgaaaaagagattataattcgagacggcatcaaagctggtatgtccggcggtcccgtaactgatcaggccaacagggtcgtgggggtcattcataaagggggaatcgatgagagtgggaaatgttactacaaaccgatcaacgatctctatcacatcatcaagccaatgcattccagcaatcggagccgttga

SEQ ID NO: 8709 - RNA, 1707 nt, unidentified
  source 1..1707: mol_type = other RNA; note = synthetic construct
atggtgctgaataagaatttccccgtagacatccctgaggacattagagactgtcggaatatcacagaccttgccaagcttctgaatataaatctgaaagccctgttcttctttgcatataaaaaagaacggctgtacttgtccttcaatattaagaagaagaacggcggcgctcggaacataagcgcgccaattgaagccctgaagaacacaaccaaaaaaatcaactcttacctctcagtggtctatgaggagtataagcctaaatctgtgcacggtttcgtttatgatagagatgtggtcaccaatgctgggaatcatctggataggaagtacatcctcaatatagacctgcttaacttctttgaaactatcaccgcccagcgtatctatggcctattcaaacgctatccgttcattttcggtaacaagttcgcttccatactcaccggaatagttacatataacaattgcctgccccagggttctccctgttccccagtgctcagtaatatggtatgtctgaagatggataaacagctgatcaacctcgctaatgagaacggctggagatatacacgctacgccgacgacatcacatttagtgctaacaagatatcgtccaatttagcaaacttcgcaagtgacggcattaacgtcggggagaagatcgtgaatatcatcaacaagaatgggtttgccatcaatgaaaagaagacccgactgagctcgcacaatcagagcaagtgggtgactggaattaaggtgaacaagaaatgtaacgttagcaggaaatatgtccgtaacgtacgcgcgatgcttcatgtttgggaagcatacgacgaaaaattggcagaaaaaacgtacaatgccaagtataactttggcaagaacaaaaagttccggagtgtcgtaaacgggaaaattgagcacattggccatgtcaagacgaagaaggacctcatctacatcaaactgcacaaccgatactgcgaattagtgggcgagtcacacaagaggctgccggagacaaagaaagatgaatacttgaacaaggtgctaatgatacaaggacagagtggctacggatctggctttttcattacgcagcatctcatcttgacttgcgctcatgtagtcaagggttctaagaaggtgaagtttaccacaagactcaataaactgccagtggagtttaaagaggcctccgtgattgacatcaatattgagaaagattacgcgattctgttttcagagaagaaattcaacgagttcgtttttaagtgcaaccttaataaaggactgaacatgtattcccacaatgacgcctacatcagcgtgggatacgccgggtttcgcactgatggaaatttttgggttgaaccttccattgcagaccaaaaaatcgtccagactaaccagaggaaaaacgtcaatagcttcgatgtgtcaggggctatgtggaaaggcatgagcggtgggccaatcattcttgagcacaccgattacgtggaagggtatatcgtgaacggcgcctcttccttagatacctccgaagacgttaaatcacacagcttttaccccattagcaacattccaaaaaaatactacgagcccaagtttttgaccctcctaatcgatgagatgtatggatctaggtttaccgagactaaggaagtgggaatgcctgatcaattcttcacttga

SEQ ID NO: 8710 - RNA, 1584 nt, unidentified
  source 1..1584: mol_type = other RNA; note = synthetic construct
atgaacctaccagaggctgcttaccatttctttgagatgagcttgtttgctaaagatgataaatccctgctggaagccttttattcggccaaaaattacattgacttggcagatgttttcgaaatcacacccaaacaattcaaatttcacgtcttcatggtacctggggacaagaagtacgtgcagttcactttgcagaaaaaaagcgggggggtcaggaacatttacgccccaaacggtaacctcaagttcatccagaacaagctttcctacattctatacaagatctacaagcctacgtttagcgctaagggctttgtgctgaatgaatcgattgtgagcaacgcccgcctgcattctggcaaaaaggcaatccttaacatcgacattaaggactttttcgaaagcataaacttcggcagagtctacggacttttcaagtccaaaccgttttctttcaatactgaaatcgctgccgagctggctaacatttgctgtttcgataataaactcccgcaaggcgccccaacctcacccatcgtgaccaacatgatctgcgtgggccttgataaaaatctgcagtccttggcaaagaaatataatctgatttactcccggtatgcggatgacattacatttagtaccgatttcaagttcctacctcaggctatcgccctgggcaaattgaatgtggttgaagtcggcgagacagtgaaaagcattctgattaagcacggattcaagataaacgacaaaaaaagcaggatctactaccacttcaatagacaggtagttactgggctgatagttaataagcaggtgaatgtgtctcgaaactatattaggaacctgcggggtatcatacactctattgagaagtttgggctccccgccgcagagatagagtttcagcggaaatatgacaagcagcggttacccggaaagtccgtaccaccctttactttttatttaaagggcaagctgtcctttctggcccaggtcaaggggacagagtcctctgtctatatctctatcgttaagaaactccgatcactcatacctggggagttcgagaagaccctcaccaagttagaagagctgcgcaaagactttgacgacctgaacaaactggtttataaaggtgcaagtatcaccgctcgtcagaggggatttgaattcgaaaaattcctcgccgaactttttagtttctttaagatcgacgtgacggaatcattcaagcgagtgggcgatgagcaaattgatgcggccattaacttcgactcctggcattacctgatcgagtgcaagtggaagtcaacacaatgtgatactagggatgtcgacagcctgaccatgaaactgtcaagaagcggatctcaaacaggcggactttttattagtataaatggatggagcgcaaatgtggtggaaaacttgtcacgcaatccaatcaagaataccatcctgatcaacggtgacgatattaaagacatcttggtggagaaggtagcgctcgatcagctcctcaagttcaagttacagagactgaatctttatagtgagccttatgcacgctgggagtga

SEQ ID NO: 8711 - RNA, 1401 nt, unidentified
  source 1..1401: mol_type = other RNA; note = synthetic construct
atgctgtccatcacaaacaacaccatggaagttgtcacagacacctttaataagaagtacagtaagtacttcaggaatattgacgaatcaactataagcgaggaacaattttctaatcgtctgaagtcgtcctggaagtcttcatcttgggtcaatgataacgagagcttcttcgctaattatctcgtgaatgacgacttcctgctgcaaatcatcaaaaactcaacattacccgatttccagaagcatttggccctagaagagtttaagcggcggtggcagcagtatgaaattgccaaggaaaaattcctgcagattgtctccgggagggatctggccgtcttctttgagctgaaatatcagagtttcctttctaccatcggtcttctcaagttcaacaaccagaaaaagtattccgagttcacaatccccaagaaatctggcggagctaggattatcaattctccaaatcaacagctcctgcaccttcagcgcaagctgaacttcatactaaatctgttttacgatcctccaaaagcggcccacggctttataaacaagatcatcaacaaggagaaggttagcagccgtggtattgtgtcgaatgcaaagtctcactccggcaggaaattaatccttaattttgacctggaggatttttttcctagcataactggaaacagaatcttcagctttttcagggcatcacccttcaattttaacaaagaggttgctggtctgctcaccgagatatgctgtgatccgaatataaaagggctgccacaaggggcagcaacatcccctatattgtctaatatgatcgccagaagattggacatcaaattgattcatctcgcgagtaagcacaaactgatttacaccagatacgctgatgacattacctttagcagcaacaagttggacgtgccctccgacttcctggacgagttctactcagtgattactagcgagaaattcaagatcaaccgagaaaaaacgagacagcatagatactcccagaaacagatcgtaacgggcttaattgtgaataagaaagccaacgtcagccgcaaatatatccgaaatgtacgcgccatccttcacaacattgagaactatgggtacgataagtgcgaagaggtgctgaatgagaagtatgctaaatcaaaaaagggcatgatctccctcgaaaactacctacggggacgaattgaatttatcggcaatgtgcgcggaaagaacaaggagcaggacaagaatgatatttacaacaagctgaagaaccggtttgagaacctcgtggtggggcctagttttgaaccaagtccgattatcgaaaacgaaactagtaaccgcaattccaaaaccctctcagagcggatgaaagagattgataaatga

SEQ ID NO: 8712 - RNA, 1734 nt, unidentified
  source 1..1734: mol_type = other RNA; note = synthetic construct
atgaagataattcggttcctgctgaatatcctggaagaattttatctccttcataccaggaattttgagtatgccctctggaatatcagggaatatggttaccggaccaaaaagataaccaagaaaaatggaacagcacgcgagttgaacatcccaccctcctttgtcaaaacgatgcagaaaaagatcaatgaacttctgcaagaacagtacattgctccaaaaccagtgcacggctttattaaggcggatgagaacaacaaaaagagcataatcagcaatgcaaatatgcacacgaaaaagtacatagtgattaacctggacatcaaagacttctttgactctatcaactttggtcgcgtccgggggttatttctaagtaaaccgttcgagattaacgaaaagattgctaccaggctggcccagcttgttataaatgacaacaagttacctcagggcgcaccgacttcgcccatccttagcaatttcatctgtaaacaaatggaccataacctgatcaaagtggccaagaagttttcgctcacttattccaggtatgccgacgatatcacattttcctcccataaaaagaatctgaacctgaagtacatcataaaagagattaccgaggtagttaagaataatggcttcacggtaaatactaaaaagactcggtttcagatggcccatcatacacaaatcgtgaccgggttgaaagttaaccagaaggtgaacatcaacactaagtataagaagcagattcgaagtatgttatactcatggtttaccgatggactcacaaaggctacacagcttcactttaaggagtacaataaacagaagcgtaaatacctccctgaaaaggagaaatcattcaagaacattgtgatcggaaaaatcaacttcctggggttagtctgcgggaccgataaccccttgtatcaaaagtacagacacacatactttctactgagcgataagttcattctcacaagaaaattggatgagtacgaggagctagatattaacgacatcaaacgcagaaaagctcttagcatcttcattcagatctacaattccatactcattttcactgaaggcgagacagacatactatatattaaaagcgcgctccagtcttttcaaaagaagggtatgtacttggatctcaatctgcgcttttgtaacttgagaggatgggtgaacgtgaaaaacattcacgagatcttctacaagaataccaacaagtctaatgatctcactctgataaaccgacgtaagtgcgtcagtccctttatcccaaagtctttcaagctgtgttttatacttgatgctgacgacgatggcattaggaaatacttcaaacatcagaagcacaaaaactatcacctcatcgatgaagccaatcagggctatattgagaagttcatcgacaagaacatcatcattgacattatcaagaactctggatattcaattgaccctaccaaagccgggaccacaaagcagaaattgattgaccacctgaaggacaataaggaaaaagatgagatcttcagtatcgacaattatattgtctacaagctgctgctgattaaaaagactgagctggcaaatatcatatcaaagaaggacatcgacttcagcaacttcaaagagatgttcgatttcctgaaaaaactggaacctgataatgactacgccgatgaactgtgctgcaactccctgtattga

SEQ ID NO: 8713 - RNA, 1707 nt, unidentified
  source 1..1707: mol_type = other RNA; note = synthetic construct
atgaatgaactcgaagacttttacacgcataataaaaaggtgatcgagtatgcccttttgatcatccgtaaagaaaactataccaagaagtacatctcaaagaagaatggatctctgcgcgaactaaatatccctcctcctttcgttatgcagattcagaagaaattcaacagcttgctgcagaaactgtattccccccctgccccaattcatgggtttatagagaagaaggatgacatagtgaagtccatcgttacaaatgccaatcagcacattcagaaacacattgttatcaatgtggacatcaagaactttttcgctacaattaacttcgggagagtccgcggtctttttttagcagaacccttcaaaactactgagcagatcgccaccagactcactcagctggtaatcacagaaaaccaactcccacagggatcgccaacaagtccgaccattagcaacttaatctccttgaaaatggataaccagctgacgaggctggcaaagcggcacaagatggtatttacaaggtatgcggacgatataaccttttctagctaccgtaaaaacattaacgttcaggaggtgatagaggagattgagaaaattgtcaagattaacggcttttcccttaatccccaaaaaacccgagtgcagtatccacatcagagccagaccgttactgggctcaaagtcaaccagaagattaatctggaccggaaatacgtccgacaaatcaggtctaagctgttcagctggtattcagccggattggataaagctaccgagctgcacttcgagaagtttaacaaacaatccgtgaaatacgcgagcgccgacaagaccagtagctataagaaaatcgtcctcggtaaaatacatttcttaggacaagtgttaggccaggataatagtcactttatcaggttccttcatacctattacttgttggagtctaattttgtccttgaccgggagaaggtggaagagatttacgaaaagttcgatctgaataatcctaatcccaacgatgtgatcaaaacgttttctcagatctatgactccatgctaattattactgaaggcattaccgatgtgatctacatcaaacaggctctcaagtacttccaatctaaagggaaattcattgatcttaagctcagatattgcacaatgggcggatacgtagatgtcatcaagctccataaaattctgcatgacaaagacctctgcaaaagtttttgtgacgtggagaaaagaaatttcatcctcccccttataaacaagaacctgaagacatacttcgtgctggatgctgacgagaagcaaatcctggattacttcaataacaagaaccagctaatgaagaattacttcctactggacgaagtgaaccggggctatatcgaaaagatgatcgacaaggaaatcataatcgactttatcatgtccaagggctacgatattgatccaacacgcgaggagctgggtgataaatcaaagaatggcctgaaagagtacctgaaaagtagcaagtttactgacgaagagatacacgcaccgaagaacacttcatacattgcacacaagaagaagattatagaaaagacccgcctggccaaacacataaagaacaaggaagacgtagattatgggaattttgagtcattgttcctgaaactggacgagatcaaaaaccactga

SEQ ID NO: 8714 - RNA, 1725 nt, unidentified
  source 1..1725: mol_type = other RNA; note = synthetic construct
atgcataaaattgaagaattttaccacagccacaaaaagatttttgaatacgctctgtatcagatccgcaccaaaggatattccgagaagatcatcaccaagaaaaatggcggccaaagaaagttaaatattccacccactttcgctaaagtcgtacaaaagaaactgaacaccttgctgcaggacatctatatcccgccaaaacccgtgcacggatttatcaaaagctacaagttcgacacaaagaatattgtgtctaatgcccttaaacataccaagaagagcatagtgattaatgtagacatcgagaatttcttcaacactgtgaatttcggccgtgtgaggggactctttatttctaagcctttcgaaatagacaaggatattgcaactcgactggcccagcttaccgttttcaataatgaactcccccagggtgcccccacctctccaatcattactaacctcatttgcaagaagatggattttcagctcctgaaagtagcaaaagagaactctcttgtgtttagcagatacgcggatgatatcactttttctacgaacaaacagaacatcaacatagagaacatcatttcagatatcgagcaggttatcgtcgataacggtttcaagattaacacaagcaagacacgcgtgcaattgcagaaccagacacaaacagtgaccggactgaaggttaatcagaaggtcaatctggacagaaaatacattcggcagatacgctcgatgttgttctcctggtatacagatgggcttaaggaagccgcagagaaacactttgagaagtttaataagcagccagataagtacctgacagacttagagagttcctttaagaatatcctgatcggcaagattaactttctgggtcaggtcaaagggagggacaattttctatacattaagtaccggcatacgttttaccttctcgacagtaattttagcttaagcaaaaagctcaacgaattcgaaaaactggatctgaatcacctgaatcagcgatgtgtgactaccatattcacccagatttattctagtatcctggtctttactgagggcatcactgacataatgtacatgaagaaagcactgaagtactttcaagaaaaggggaaatatgaaggcctacacctccggtattgcaacttagaatcctggtccaacgtaagtaacattcataaggttttctacgagaatcaaaaggacctgtccatcattaatatgaggaagtgcatactgccttatgtcaaagacgacttgaagttctgtttcatcctggatgcggacgataggaacatcaagcagtatttcgagagatataagcataccaactatttcctgatcgatgacgaccggagcgggtacatagagaagctcttcgagcaggggatcgtgatcgacaaaattaaaaagttgggctacacgatcgacaccactaaagagggactccagaaatccacgataaaggctcttaaagaatatgtcagctctgaactagtgacagaggaggctattcactccatcccttcaacctcatatatcgcctacaaggacaaaattatcaagaaaaccgatttggccaacttcataacaaaagatgactcagtgacatacgatgatttcgagtcaatttttgtgtacttggacagtatgaaacacaacaaggattacgttaaacctctctgttgcaactcgctgtattga

SEQ ID NO: 8715 - RNA, 1740 nt, unidentified
  source 1..1740: mol_type = other RNA; note = synthetic construct
atgaaaatcttagagcagttctacaacgattacgaaaagctgttcgaactggctttgtatgataaccggaaaaagaagtacaagaggaagaacatatccaaaaaaagtgggggcaaacgtagactcttaataccccctgagactaccgacaaactgcagaaaaaactaaatagaatcctgcagacaatctataatgcacctaatagtgtacatgccttcattaagtcaaaggaaaacgaagagaaaaagtcaatagtcagcaatgccaagcagcacgtgaagaagcagattgtgatcaacatcgacatcaaagactttttcgacacgatcaattttggtcgggttagaggcatttttctcgctaaaccaattagtctggatgagacactggccacgaaatttgcgcagttgatctcgtatgataataaacttcctcaaggcgcctctacatctcccatcatttccaatatcatctgcaagaaaatggaccacaatctgatccagtttagcaaaaagcactcactaacttacagtcgctacgccgatgacattacttttagcacacataagaactcccttgatacggactttattctgaatgagatcgagaagatcatagtcgacaatggtttcgaaattaataccctcaagacccgaattcagctcgccaatcagtctcaagttgtcaccggacttaaagtcaaccagaaagtgaacgtgccccgcaaatatattcggcaagtgagatcaatgctgtacagttggaaaactgagggcattgaagaagcatccaagaaacatttcaaaagcttcaacaaccagaccaagaaatatatcgacagcaaagaggaatctttcaaaaatatcgtactggggaaaatcaacttcataggacaggtgaaagggaccgacgacttgaattacatacgcttttaccatacatactacttgcttgacagctccttcagtctcaaagagaaactagattactttgaacacttcgatttctacaacatgcagcaggatagggccaaactgctgctgacccagatctatgactccttactcgtgtttactgagggcgtgaccgatatcatttatattaaggaggctctcaagttcttcaagaacaagaagatgtttacaagcctcaacctgcgctactcttattttggaggatatgccgatgtgattaagatgcatcggattctgtacgatgaacacattgtgcgaatgtccaagcttaacgagttggatatagctaatatacgtaagtgcatactgccaaatatagataagagcctcaagttttgctttgttcttgacgcagatgaaatcgcaatcgaaaagcacttcgagaaacacgattacaagaaccattttctcttggacttaaagaacaaggggtatattgagaaactcctggacaaggagctgattaaaaagatcatcaagaagtacggtttcaaaattgacgtcaacaggaaggaattctcggagaaaacaaaaaccgagttgaacaaatacatgaagatcaagaacaagtacagcaacatctcagctgtgagcaattatattgcgtatggcgtcaagattatcgagaagactaacctagcaaagtttatctcaaataaggacgatgttgactattctaagttcgaagacctgttctgtgtactggagaagatcaatcacaattttaggtccccgaagcaactttgttgtcaatctctgtattga

SEQ ID NO: 8716 - RNA, 1737 nt, unidentified
  source 1..1737: mol_type = other RNA; note = synthetic construct
atgaacgagctggagaacttctatctcactaataagaagaatgtcgagtatgctctctttctcatcagatcagagggttaccggaataaaacaatctcaaagaagaacggcaatactcgaattctgtctatcccacctgacttcacgaagattattcagagcaagtttaacgagatccttcaggagctgtatatcgcaccaaaacccgtgcatgggttcgtaaagacaaacaatgatatctccaaaggcatcatcacaaatgctagcatgcatattcggaagagctatgtgatcaacgtcgatatcgagaactttttcgacacaattaactttggcagggtgcgcggcgttttcctgagtgagccttttaatactaacgagaagatagctacgaagttagcccagttggtatcttttgagaataaactaccccagggagcgcctagctctcccacaatctctaatatcatctgcaagaaaatggaccatgagctgattaaaatagcaaaagagtactcgctaacctacagccgttacgccgatgatataacattctccacccacaagaagaagatcaacaaaatccgcattctgagagcgatctctaaagtgatcaaaaataacgggtttaccataaacgaaaacaaaacgagagtccaaaaatacattcacacccaaattgtgactggcttgaaagtgaaccagaaggtgaacattaaacgtgagtatattaggcagatacgcagtatgctgttttcctggtataaggacggactcgcttcaagcgcagataaacatttcgaccggtttaataagcaggagtcaaagtacatcgacaaccgggaagaatcctttaagagtatcttgataggcaagattaactttcttggacaggtcaagggtaaggagaataggctgttcattaagttccgacacatatactacttactgagagatgagttcaaactgctagaaaaaaccaacaccaagttttcattcgagcacatagacgtgaataatctgacaagtaatgaagtgcttaagattttcacgcaggtttacgattctcgactgatcttgacagaaggggtgacagatgtaacctacatcaaaagcgccctgaagtactttcaatccaaaggagaatttcagtcactcaaactgcgctattgctgggttgggtccatctccattcttgtcacctttttcaagatcttgtatgcccataaaatgaaagagctcgacattatcaacaaaaggaaatgtgttttgccactcgtcgataagaatatcaagatctctttcgtcatggacagcaatgacgacaaaattaataccttcgttaaggccaagaatttcaacaactactatcttctggacctgagcaacaaaggctatattgaaaaactgctggataagaacaaggtgatcgaatttatcgagagcaatggttacattatagacaccactaggcccgaactcaaaccggactcaaaaagaggactcgaggagtatttactgagttctcagaagagcgatggggaaattcactccgtgcagaaaacctcgtatatagcctacgaaaacaagattattgagaagactaagctgagtaagctattcgaagagagtgaagatatcgaatacgaaaaattccgggagttattcactcaccttgaaaagatcgaatctatatccatccaaaatgagaagctctgtactggctccatttactga

SEQ ID NO: 8717 - RNA, 1725 nt, unidentified
  source 1..1725: mol_type = other RNA; note = synthetic construct
atgaatgaactcgaaaacttttacatcacgaacaagaagaatgtggaatttgccttattgaaagttagggacgagaagtacgtcatcaagaatatctctaagaaaaacggcaagaccagaatattacacattccaccctcctatacgaaaataatccagaagaaattctcccaaatcctgcagaaacaatatattcctctcaaacctattcacggatttgtcaagattgagaataatacatcccggaatataatcaccaatgctagtaaccatatcaacaagagatatgtgatcaatatcgacatcgaaaactttttcgataccatcaactttggccgcgttaggggtctatttatgagcaatcccttcaacattaatgagtccattgctaccaaactcgctcagctggtgacatatgaaaataaactgccccaagggagccctacttctcccatcattagtaacttgatttgtaggaaactggatcaccagctcattaagattgcgaaagactatagcctgacatatacacgttatgccgatgacataaccttctctacctataacaagaagataaactacatccgaatcatacgtgacatagacaagattatcaagaacaacggattcattatcaacaaatctaagaccaggatacagaaattcaatcaaactcagattgtcaccggcctgaaggtgaatcagaagattaatgtgtctcggaaatatatcaagcagattcgctcaatgctgttctcctggtataaaaacggattagagaatgccagcaatttgcacttcgacaagttcaataagcaggagtccaaatatattctggaccgcaatgaaagtttcaagaacattcttatcgggaagataaactttctcggccaggtgaaaggaaaagaggatcgattattcattaagttcacccatacgtactacctcttgagagatgaatatttcttgaaagagaagcagaacaagttcgagatccttgatatcaataatctcaagtactgcgagatcatcaagatctttactcagatttacgatacaaagctggtgctgactgaagggattacagacataatttacatcaagcaagcactgaagtacttcaagaacaataacaagttcaagaaccttaagctgcgcttttgtcaggtaggcagcataagtaacctaatcgaaatctacaaagtcctatttgagaacccaaaagatctgactgtcatcaatcggaaaaaatgtctgctcccgtacatcgataagaaactgaatatgtgctttgtgatggacagcgatgataaacagattgagcttctgaagaaaactctccactttcataactattacctgctcgcagaggacattgggggttatattgaaaagctgttcaacaagaacctgattatcgagataatcaacaagaatgggtacgtgattgatacatcaaatccaaaactgcaggactcatcaaaaaaaggcctggaggaatacttgcggtctacaaaaaagagcgacaatgaatttcatgcagttcctaaaacttcgtacatcgcctatgaaaataaaatccttaagaagaccgagctttccaagttcataattgatagtgagaacgtaaactacgacagatttgagaatttgttcaactacctagagaacatcaagatcatcgactttaaatacgacaaactttgcagcaactcaatcttttga

SEQ ID NO: 8718 - RNA, 1809 nt, unidentified
  source 1..1809: mol_type = other RNA; note = synthetic construct
atgttctttaagaactttttacgcaataccaccaaacacgtcctgaatctgttcaagaagaaaaagaactatgagaacatcctgatcgacgagtttcacaatcgagagagcaagatcttctacaagaacaacaagaaaatcatcgagctttcactgagcaatattcgtaataacaaagcctatttccacaaagagatttctaagaagaacggaggtaaaaggaggctatccattccagattcatataccaaggttgtgcagaagaaaatcaacattctgctcacaaagttctatcacgccccaaagtccgtgtacgcttttgtgaaatcgtcggacaataagaaaaacattgtgactaacgcttacatgcacatcaacaagaaaatcgtcattaatgtcgacatcgagaacttctttaatagcatcaactttggccgggtacgaggtcttttaatgtcctatccctataacattgacaaagacctggcaaccaagatagcacagcttactatattcaataaccagttgcctcagggcgcccctagtagtcccgtgataagtaatatgatctgctacaaactggacaaacagcttatgcatctggccaaggagtataggtgcatgtatacgcggtacgccgacgatattacatttagcacgaacgataagtatctgaatcagaaagctttcttcaaggaactcaacaagaaaatcaacgaaaatgggtttagcctgaattcctctaaaaccagagtgcagaaatactgtcattctcagattgtgactggcctcaaagtgaacgagaaagtaaatctgagtaaaaagtacatccggcaaattaggagcatgttgcactctctccataaggatggcttagcagaggcctctgtcaaacacttcaaactctacaatatcgatgagaagtattcaaaggataaggagaagagctttaaacgcatattgagagggaagattgactttatgggaatggttctggggaaagaggactacaagtataagaaatccatttacctgttctacctagccacaaataattacttgcccctgaactattaccaaaaactcgaaaagatgaacagcgaagacgaagattttttgaaactgtccctccaagagatgtattccagtatcgtagtttttactgaaggcgagacagatataacatatttaaaggccgcacttaacttcttccatagcaaagacaaattcctggaactcaaaattagatttgtcagcctgggagggtttcctgaagttataaagtaccacaaagcgatttttctgactaagaatgacaatgtcacactggaattacgcgagaaactgtctccctacctgaataagagtgtgaactattatttccttctcgatgctgacgacccagatatcaagaactactttaacaagacctatgtgccaaattcattctacctcataatggaaaagacagatggttacatagagaaatgctttcagaaggagttgattaaggacatcatcaataagcatggatacaagattgagccggaaaaatcaaccaaacagaaggtgacgaatcaactgttgaaccatctaagaaacaactcaaaaaaggatgacttcttctccatcgattcctacatcgtgtatgcggagaagcagattttcaagaccattctagctaagtacatctgtgacaataaagaagttgactactctgtcttcaaagatttcttcgactttatcatcaagaacaagaccaacaatcttatccctactaagctctctatagatgatgaatacaagtga

SEQ ID NO: 8719 - RNA, 1572 nt, unidentified
  source 1..1572: mol_type = other RNA; note = synthetic construct
atggcgaaagtacgtaccctgatttgggctttcctgtatcacatgctgaccctagatgagttcgaagagaaaatcggcattagcatcggcaagctcaactatatcggttacattctaaaagaggaggacaagtaccttaatttcgagatttccaaacggaatgggaattcccgacaaatcaattcaccaaactcaatcctgaaacatattcagaatcggataaagcttatcttagaagagaatttccacccttacagtgtcgtccacgggttcgtgaatgacaagtccatattgtccaatgccaaaaagcacctcaatgctaaatggatcctgaacttggatatcgagaacttttttggtaccatcaatttcggtcgcgtgctgggcctcttcctcagtaagccatacaaatttgacaagaagatcgcaacactgatagctcagctggtgacttatcagaatgtgctccctcagggatcacccgcatcaccaatcattagcaacctgatctgcaacaaaatggaccgggatttcatatctttttgcaagtctaagcatctaatctatacaaggtatgccgacgacataacgatctcttcgcaaaagcgcaagtatatgaatttcgatagcaccctggacgaagatctcttagaggatatcaagaagctggtgaacgagaatgggtttaagatcaatagcgacaaggtatcttttagctatgggaaggatggaggcatagtgactgggcttagagttaacgagaaaatcaatatcccacgcaaaacaatccggagtttgaggggtttgtatcatagcatcagatccaacggctaccaggtcgctaacgagatttataaccgcaagtacaaaaaccttaacaggctgcctaaagaaaataaagagctcatcaaccacattaacgggcacctgaacttcatttttatgataaagggccagtttgacgacgtatactcgaactactacaacaaattcaagacccagttgaagcttaatataaaatcaccgatacccaaaagcgtttgggactacatttttatcatggagagtgaatctactcagaaacaaggcacggcctttaagctgaacaagtttgggattatctcctgtgagcacgtgtacgataactatagcaagatctttctcaagaacaatttctccaagaagtttgatcttgaactcatcaagaaagacgaacgtattgacttgattaaatcaagggccctggatcttttcattgaagatggcctcgaaattaatctcgacttccattacaaaatcggaagcaaattaaggctgctgggatttcctaattatcgaatcggcgattctggaatggacaagctgataacaattgtgagtaaaagaactgtgtctggcgttgaaagaatcttagtcgattccggcattgtggcgggaaatagtggaggtcccattttggacctgaacggggccgtggttggaattgcagtcacaggtgccgaagatcacgataagctagacgtcaccgagaaccattccttcattcccattaagtacctgctgcagttctga

SEQ ID NO: 8720 - RNA, 1857 nt, unidentified
  source 1..1857: mol_type = other RNA; note = synthetic construct
atggataacccgttttccgagctggacacgaacgaaataagcgccagctttcgccatatctccaatgtctcagaattagcgtcttttctgggtgtgacccgccaaaaactattttattactgcgccgagcatttgaacaagaagcactatgagctttttgacatccctaagaaaaacgggggcacacgaacaatagaagaacccacaaaaggtctaaagctcatacagaaaaagatcgccttcgctgtgagcatcaattaccatccagccgcttgtgtctcagcattcactgagggaagaagcattagatatggcgcagagcggcacaaaggcgcacggaaagttgtctgctttgacctggagaactttttcccttcctgtccacaatataaggtctttggggtgttctacaagttcttcaaattacccaaagaggtgtctgactgcctcgctaggctgtgctgctataaaaaacatctcgcacagggggggcctagcagtccaatcctctccaacgtgatgctgaatagtatggacaagaagtttctgagtcttgcaaagaaaactaagactgtttatacccgatacgccgatgatatgagcttcagttctaagggcgatatgcccagcttgatttggcagaataacaacatatccagctatattacctctattgtacaggaaagtggttttcacataaagcaggaaaaaactcggattctgggaagatcgtgtaggatgcaagtgaccggtgtggtaatcaacaaattcccaaatgtacctcgaacctactaccgtagagtgcgcgccatgttacataacttcaaaactaccaaggactatgaggagacaaaaaagaactttttgaagtactacggcaagtccgacgactgtaatcccgctaaggtgattcagggaatgatctcgtatatcttccaagtcaggaacgacggcggaacacattcaacgctcgcgagaaacatgatgcaggaattcaataccatccagtggccagggaatgaaaagttcaaagttgaaatggccatgccccactcatataagctgcacaaagcggtgtttgccgtcgaaaccaagatcggcgaggatttcttttatggcacagcttttctctgcaataacaagatcatttcctgttcacacatcttcaaaaaaggacacgagaagaaacttagtgacgagattgaatatgttcacctgatcgagcataatgtggaagacaattctatctacaagaagtacaatgtgacgaggatcgaatattggcccgacttcgatgttgcttaccttcataccgactcttgtatcaataaggcaaagcagaagcagttcagcactcctaattttctgcaccagggcggcaataaggtcttcgttgtgggattccctgccagcctgcagactgggtctagttcgcggatgtacgaagaaaaggagacaattcaggaggaccaccgcgtggagctgcagtacaacgagttcgccgtggggcaaaagcaaaccattattgataaaaggcgcatgacctttatctctaaccagaacgggggaattaacccaggaaactcaggtggccccatcctggatataagcgaaaaaaaggtgataggtattgctctcaaaggagataatgtaaaggattccaagtctttgtccaataaccggtcagagttcttcgatctgtacgagtggcttaacatggacaaaccgaaggccttcacatgggagaagattgtcgggaaactcaaatttgagtttaaacacctgtacttgttcgtctacatccataattccaaaaactgcgatcttctgggccgtctgcacaataagctattttga

SEQ ID NO: 8721 - RNA, 1221 nt, unidentified
  source 1..1221: mol_type = other RNA; note = synthetic construct
atgctgtccaatatcattctctacgcttttgacaaacagatgctggaattggcccgaagaacgaaaacggtgtacaccaggtatgtggatgatattacattttcaagtcagaacaccatgccgcgtctgctgtggcagggagagaactggtcaaccactgttaaaaagatcgtggaagaggcggggttccaactatcagaggagaaaactagaaagtttgggaaggggaatagactttctgtcactggagtcgtggtcaatgaaaaaatgaacgtgcgtcggatgtatgtccggaagattagagcaatgctccataactttaagatcacggaggattacgactccacagtgaagaagttcaacggcttctatttgaaagataagatcgtggatcctgaacgcgtgttgaaaggaatgatttcgtacgtatatcagatacgatccgatccagagcaggaccaggttctcagtcggaggctgatgcaagactataattctatcaattggccagggggctccagattcgagctgaagctggccatcccccagaagttcaaaaggtataacgcaatctttgcagttgaagtagtcacactcttcaaggattttttctttggtaccgccttcctttgcgacgggaaaatctactcctgctgtcacatttttgagaatcgaaacgagcctgacgaccagccaaagagcatcaaactaattgaattcgaccccgagactctggaggtccacaagacatacaaggtggacaaagtggatctctggagtgaggatgatatcagtatgctttacagctctgccctgaacaagacaaagcggaagtcattcaatagccccgcgcaccctctcaaaggacctgccaaagtggacattttaggttatcccgaagcttttcagattggcgaaaaaagcaggatgtacactgccgaggagactacaattataaccataggggacaatatcagccagtcacataagagtgaaaattcccggtccgtagtgttgctgaccaacgacaatggaggcatccaaagcggcaactctggtggtccagtagtttctattggaaacggcaccgtggtcggcatagctatcaggggcgctcaaccgaaggatggcaattacgaagtggttcgctctgagatggttgacttctacaactggcttcatagcaacaaacgcacccccgaaacattacgcctgcgctga

SEQ ID NO: 8722 - RNA, 1743 nt, unidentified
  source 1..1743: mol_type = other RNA; note = synthetic construct
atgaaggatctcttttggacgaaaaataacaccgacattaagcgccaatttcccgacctgaaatcagccagagaactggcctcatttctaagcatcaagtatagccagttaacctattatgtttcgaaaggcaagaagtataagtccttccaggtgaaaaagaagaatggtgaaatcaggatcctggaggccccaatcgtggggctgctgctgatccagaaaaaacttgcatacacccttggattgatttacactccatctccctctgccatgggatttgtaaaggggcgcggcattagaaagaatgcccaggtgcatgtcaatagcagagaggtgttgaacctggacgtcgaaaacttctttccttctatccgttcaaacctagtgttcggggtgttccataagttcttcaggttcaatatcaagcttagtgacacactgacaaagttggtttgcttagacggtgcactgccacaaggggcacctactagccctattttgtccaacatcattatgaactccattgatcgcaaattcactgccctcgccaggtctaatcactgtctgtacactcggtacgtcgacgacataacttttagcagtcgcaataccattccacgaacactgttcaggaacaaggacgtgagtgatctcatcaagcaaatactcaaagaaaagggactcaaggtgaatgagaacaaagtaagactccgaaaacgctttcagcggcaggacgtgacaggcgtgctcatcaataagaagatcaacgtgcagaaaaattacctgcgcttaaccagagcaatcctacacagctttgagttgaatgagtacaaagacgctaagaaagtcttcttatcacattacaggaacgaaaaccatctgggaaagaaaatcgaacccgagcacgtagtcaagggcatgatctcctatatataccagattcgtaaggatcctaaggacgatgaggcagtatcccggaaactcatgcagcggttcaacagaatcaattggccatacaactccaaatttgaccaaaagattagcaatcccgttctttttcagaaactcaatagtaccttccaggtttatgtcagcttcaaaaaggagaacggggactttgatagattcactggtaccgcgttcctctgcaacggcgaaatctattcatgttctcatactttcgtccaaggctccaggaagaatgtgggccccgaattaaacgatgcccagcttgttgagttcgattctttcaagaaaaatcagcggaaatgctacaagattaccaagattgagtacaatacggatctggacttttgtcacatttacaccaaccacaaatttgaggggggctttaggaagccgacgacagctccctatgaaaacgagaaactgcaggtggtgggatttcctagtattctcgatcacaacaacacagtcggtctgtatcagaagtccggccggatcaccagcacattttctgaacccaacccagattatgacaaagagaaaggggaggtggaggacggaaagttgttcatgcctctgaagcaacgactattgataaacaccgatgctacaatcctggaggggaacagtggaggtccgatactgactaaagatcttgttgtcattggcatagtgctgaaaggacagaatcgtgaatcggctacgaataatacagctcttgacttcaattttgcgctgaactcagatttcctgatgaagaaatactatctgaagtga

SEQ ID NO: 8723 - RNA, 1617 nt, unidentified
  source 1..1617: mol_type = other RNA; note = synthetic construct
atgaacgcagaatccaaaaagattaggagccaattcacacaactctttaacgttgatgagctggcaagttttgtgggtactaacgcgcaaactatacagaccatcacaaataagacaacctcctattataagtcgttcgagttgaaaaaacggagcggcggaagcaggacaatcctggctcccaagcaacagctcttgagcatacagaagaaaatagccactacgcttgaaaagatctatcctgtctctatctacagccatggtttcatttataagaaggggattaagaccaacgccgaggagcatttacgcagcacggaacttctgaatttcgacattgacaactttttcgacaatatcccagagtatcgcattttcgggatttttcggtactacttcaatatgaacaactacatctccggcatattgaaagagctcacatgcgtagagcggcacttaccacagggggctccatcttctcccattctgtccaacataatatgctataagatcgacaaggatctgggaaagcttgccaggagaaatcattgcaagtatacaaggtacgtagacgatatcactttttcatctaaacgaaagctgccaagctcaatctacaatcgtattaacaagtcttgtagcaacaacatcgtcaaaatcctctcagactctggattcaccattaaccaccgaaagaccagacttttgaccaagtcacagcggcaagaggtcactggtattaccaccaataagcagctgaatgtgtccaaaacttacattagaagcactagggccatgctgtacaacttcaaaaacagtaaataccaggtggccaacgcgaaatttaagaaatactacaaggcaaagcagaatctgaatccgaattccgagattttacctgaagagattattaaggggcgtattagctacatatatcagattcgcaagtcgagaaaagaacagtccctagacaattctgtgacacacaagttaatgcagagtttcaatatggtgtactggcctaaaggctccaagtttgaccagaaaatcgccaatcccgaaaaattcaagctctataacagcatctttgaaatcgaagttaaggctaaggatgaagacctctgtgagaaagacaatattatgacctacaccgctacagcatttctgtgtgaaggcaaaatttactcatgtttccacatcttcaagaaaccaaagcagatcatcgagcctaaactgaaagagtatgattgctataccaagaaaatccgcgctacgtatgaaattgccagtatcgatttcgatcaaaattttgacgtgagtatcatacaccttaacaacacatgcaagatcaaaaaatccggcttcaagagtcctaaaaaggatgctacagagaatgaacagttgattctggccggctttcccgaattttcccatcaccagggaaacacgctcaatctctacaagaaaaatacccagatcgaggatatctacaaggagaacataactaaactgaacaaaccgccctattcatttagtaacaagatgaaggcagagaaaaatctactgttcttccagtatttctctctgtttaacaagatcatcgccgtttttgtgtga

SEQ ID NO: 8724 - RNA, 1755 nt, unidentified
  source 1..1755: mol_type = other RNA; note = synthetic construct
atggacgaagacaagaagtacaaaacatttacaatcccgaaacgttcaggcggacgcaggcagattctggctccctgtggacccatactgggcctgcagcataaattaagagacttcttggatgcctgctacgaaccaccaccaagcacacatggctatgttcccggcaggagtatccgtacaaacgccgtgcctcatgagaaatgccaatacatgatgaagttggacattgtagacttcttcccaagcatcaccttcgccagggtatatggcctcttcaaggctgctccattccggtttacgaataaggtcgcctccactctagctaacttgctctgttatcgcgaagtgcttcctcagggggctccaacctcacctgtggtaagtaacctcatatgtcagaggcttgatcgggatctcctgaagtttgcacgagagtattcctctcaattcacgcgatacgccgacgacctgacattcagcacaaaagacggtgcccagtggggtttggtggtcctgaatgataagcgtaagtgccctcatcccgagatcgaaaggatcattcaggaaaacgggttccgacttaatgaggcgaagacccggtttctgaacaaatattgccggagaatagtcacgggtgtggtgaccaacgagcggctgaatgttcctcagtcttatcttagaaccaccaatcggatgctgaaactggcgggcactaacgggcttgacaacgtgggacggtggtactgtcaagacaatcacatttttagctcgaccgtcatgaatttcgccgattacgtggtcaaagttctgcagggccgcatcgcttatgctaagatgattcgtgggtcagacgatcccatctgccagaagcactccatttatctagacaacattgtttctgggaggcccctgacttacggagccggtaactacatgaagtttgctaaactaacacctctgcgcgtactccacctctcagacttccattttcgggttgagacatcctggaacgccacccccctgttagaggatttagtgaattgcataggcgaccccgctagaatgagtctcctccctcctgatttggtcgtggtcaccggagatatcgcctttagtgggagaaaagccgagtacgcactggccgccgattttttgtcccagctgtgcgcacgcatatcacttccgatcaacagagtttttatggtgccaggcaaccacgatgttgatagagcggcagtgtctgacgtggccctccgagaacagaaggacttgctgaaactcgacgaacctggcgcaagaatcagtgcaatgtttaaagacgctgacatcaggcgggtcttactccgccgcctagatagctacgtggatttctgtaagaatttctatggttctggactccgagcagagccgtggtggaaggagactgttcaggtgagggatatgaatatcgggatttcgggcctgtgtagttcctggatgtccgtgtcagacggagagcaggggcaactgatgctgggtctgccacaagtcaatgaggtgatgcacagaggctttactcacgatctgactatgactcttctgcaccatcccttaaattggatttccgagaaggacgccgaaagcgtggacgaaattagggcgtggagcgacgtagtgttccatgggcacgtccacaccagcgatatcgcaaccacttacagccagtgcaggggcgatgatgatatcggatctcgctctggagtgagatggtga

SEQ ID NO: 8725 - RNA, 1041 nt, unidentified
  source 1..1041: mol_type = other RNA; note = synthetic construct
atgaaaaagctgtacttggcggacattgaggagcgttcgcgacggttcttagggtgtcgcacaatcgatgatctgtgctgccttggtttcgtgaaaaatgagttgttactccacagcctcaatatatcatactactcctttgagttgcgcaagaagtcaggtaagatgcgccagattgaaagccccaacgagagcctgaaaaaggtgctgcggcaattcaactattatctccaatgcgtctattacattcaccagaccgatgcttcccagggctatataatcacccctaagaaaagtaaggtgtgcaaatcaatcctggaaaacgctagggtccacctcaggaacaggttcatgcttaacattgactttcaggactttttccaccagatctcattcgaacgtctcgccaagcggctttccgagacaccctttaaattcgacaccagtacttctaaactcctggccctgctcttcacatataagggaaggttacctatgggcgccccgactagcccagtgttgtccaatctgtgtgttatgaaactagacatggaaatgtctgaatggagtaagaagaatggggtgacctactctagatttgtagacgatttgaccttcagcagagatgatagcgagtttatcagcgatacctatacagaaatcaaccatatatgtctgaagcattctctgaaagtgaatccagcaaaaatcaagtacttcggagaagggtccctaagaaaagtgactgggctgattctgcgagagacgattgatattgaagacggcttttaccacgagctggacaaagacttcaatcgcatgaagaaccttgtggaggttgtgatcattaaccatggcgtaaagtccaacgacgaagtccaaacgttcaagaaggagatcgagggacagatcaattttataggcatggttgagggatataactctcctatctttaatcagtaccggcagaaactgaaggccgttatgaaccccgcagaggaagtccttagtgtcagatggactaattttaattacgtgtga

SEQ ID NO: 8726 - RNA, 1041 nt, unidentified
  source 1..1041: mol_type = other RNA; note = synthetic construct
atgagaaagctctatcgagatgaggttaaaaatagggcctgccagttcctcgagtgtcaaaatatgattgaccttcacaggctgggctttgatacagcccgtattaaactgctggccctcgccccaccgtactattgctttgatatgcccaaagagtccgggggagtcagacacatagaggcacccgaagagcacttgaaggacgtgcaacggcagttcaacaggtatctgcagtgcgtatactttgaaatccagacgcccccaagttatggttatatcataagaacgaaaggacagactccatggaaaaatgtactggaaaacgctcggcaacatctgggtgcccggtacatgttaaatgtggacttcaaggactttttccatcagtttactctgagacgaatacaccggatgctgcagtgccctccattccagtttgacaataagaccgcccacctcctcgctcggcttttctgttacaaagggcgcttacccatgggagcgccaacttccccggctttgagcaacatcggcaccatcgctttcgataacgacatgtatgcctgggctagcaaccagaaactaacattcacaaggttcgtggatgatatgaccttttcttcacctatcgttcccctgactgacgaacacttggcacatatcaacaccatctgtcagaagcacgcactgctcattaaccctgacaaaacagtgtttttcggcgaagccgataccaagaaagtgaccaaactcctgcttcgcgataccgttgatatcgatcctgacttctacagagagttagacaaggacataattaggctgaagcatctaactgaggtcaatattctgatggagaaccataagcgcgggcagcttctgcgtaagttcaagaaggaagtcgaaggccaagtgaattttattggcatgattgagggattcgactcttcaatcttttacaagtaccgcatgaaaatgaaggaggcattgaaacctgataataaggcgcttagtagccgatggacaaactttaactacttttga

SEQ ID NO: 8727 - RNA, 1041 nt, unidentified
  source 1..1041: mol_type = other RNA; note = synthetic construct
atgaggaagctgtatctgaaagaagtagagcaactggcaaagcagttctgtgcgtgcgaaaacttaaaagatctggagcgccttaatttcgccatcaaccgaattaggttgctgtccctgaaccctcaatacgatgttttcaaagtgccgaaacccaacggtaagactcggctcatagaggccccagaggtcgaactgaaggaagtccaaaaacagttttctaactggttacagtgcgtgtactttctgctccagcctaagtctgtttttggttatattcagagagtgaaggatgttctcccagcaaagaacatcttggagcacgcaagacaacacctgggcgccatctatctgctcaatgtggactttcaagactttttccatcaggtcagccacactgatcttgtgaggcttctgcagcggccccccttcagatggaccaaaaaggctgcagctattctcgcaaagctgttcacccgtaatggccgcttgccaatgggggcccctaccagtcccgtgctctccaattttgcggctatacagctggacctggatatggagaaatgggcccagaagcagggaatcaattacacaaggttcgttgacgatctgtcctttagcactaaggaccaggccctaacaaccgctcacctagaccaagtcaagaccatctgcgccaagcatcagttcgtgattaacccacaaaaaatcaaatggtaccctcccggggtcagcaagaaagtgacaggcttagtaatcaacgagacagtggacattgacccgtcattctatcaggaactaaacagaaatctcaaccggctgcagggcctttcagacgtgaatgctatagtaaatcagagtcgacagaatgacttgtaccaggatttcaaaaaggaggtccagggaatgatcaacttcattgggatgattgaaggatacggctcgcaactgttttttgattaccggcagaagctcaaagaggccttgcatgtgtctcctgaatgtcttagcgtgcgctggacgaattcccagtatttttga

SEQ ID NO: 8728 - RNA, 1020 nt, unidentified
  source 1..1020: mol_type = other RNA; note = synthetic construct
atgaatcggtgtttctcttcattcatggctatgagagagccaggggatatgtgcgcgctgttgcggctgccactcttcaagctgaaactgctttcgctgcgcagcgtctataatactttcgagatcaagaagaatggcggcgcacgcttaattgaaaccccggcccagcctctcatgaaatacctgaagagtctcaaaaacttcttgcaagccgcctattactacctgaaaaccgacgctgcctacggatatatactcaaccccggtcagacaaaaaacccccggaatataatgactaacgccaagatccatctaggaaacccttggatgctgaacatcgatcttgacgacttcttccatcaggtcaaggaaaaacacgtacagcaaatctttggcatgctgccatttcgtttttccggcgagctcgtccagctgctgtgcaaactaagttgctacaagggaagattaccgatgggaagtcccacctccccacctatgtcaaatttcgcaatgattcccgtggacaaccgtctcctgaagtgggctaggtccaacggtattgtctacacgcgctttgtggatgatctgaccttttcttctcagaaacccatcaatagctgtacacttacaaggattgaagagattctatacgagtacagatggaagattaatcaggacaaagtggtgttgtttggcgaatctgacataaaaaaagttactggcctggagcttaggaacagggtgtccgtccctgatacgtattttgaggaggtggccaaggatattgtgcggcttgagaaggctaaggaattagtgatccgagcaccctttcacgaaagcacagcctggatcaagaagttggagcaacacgttaatgggcagatcaatttcctggggatggtttatggttacgggagccctgagtatctcaacaaacgaaccaaggcggacgcagtactccagagagattacgaaccagaatcattgaactggctggacttcccttatcaattcttttga

SEQ ID NO: 8729 - RNA, 1011 nt, unidentified
  source 1..1011: mol_type = other RNA; note = synthetic construct
atgcttggcaagataaagaccaccaaagagctggctttgtacctggggacatcctatgagaaactgaacaagatagaccccgaaaagagcttcgcaagcttctacataaacaagcacggttctactgaaaagaggttgatcgaatacccacgaggtgagctgtttcgcattctcgaccggctaagtgatggactgcaatggctttacctggatcacctgacaacggccgcttatggctttatcaggaagctgaagcctaataaggatcctcggaatatttataccaacgcaaaacgccacttggggaaaaagtaccttctgaacatcgacctcgatgacttcttccatcaagttgatactagaaaattgcagaacctgttcagtgattattccctattttccctcaatcaggagagtgaacagttattggtcaagctggtgtcataccgagggcggttaccaatgggcagcccaacatcaccctctctgtcaaatttcgccacaattggcatcgacaatgacctttcggtgtgggccggacgcaattctttcgactatactaggtacgtggatgatatgtctttttcaagcaacatcaagatcacccagaatcatattaaccagattatcgagattctctttgcacatagatttctcatagatccaaacaagaccaaaatcttcgggcctcaagacaccaaagaagtgacgggactcgtcctgggcaaaacaattactgttcccgacgagtttatcaatgcgttcatgaaagacatcaacagattcagcgagatgcatcacctggcctgccagaatcccgacagtagggtcttcgagtggctggaaaagatgagaaaagtgctacagggtcggatggcctttcttaaaatggtacacggcccgaagaacgaaacctacaagctctttcagctgaaactcgataacatttacaagcctgaactgttagagactagcgtgtcctggcgttatgctggatatgagtactcctga

SEQ ID NO: 8730 - RNA, 1047 nt, unidentified
  source 1..1047: mol_type = other RNA; note = synthetic construct
atggcagtgggctatcgccacatttatagaacagcccgctacctgcggtcttgcagacaactctctgatctcgagggacttataaaagtatccaaggctgacattaccctccacagcctgcatcctaaatactacgaattcagggtcttgaagaagaatggtggctttaggaaaattgaagctccacagccgggtcttatggacctattacggaagctgaactttgttctgcagtgcctttatttctttgagaaacctcccgcgagctacggtttcgttatgtcacataaggggaacaaacaaccacgcaatatccgtaccaatgccgagcggcacatcaattctgcctgtatgctgaatgtggattttgaggacttctttcaccaaatcaaagtagacaaggtgtatgcagtgctcgtgaatccaccattccacttcagtagggaatcggcagatgttctggccaccctatgtactttcaagggcaggttacccatgggatcccctgccagtcccgctttgtcaaatttcgccgtgcgtgacatggattggatgcttgacgcttggtctaaagaacgggggtacagattcactcgcttcgtcgatgacttgagctttagctcagaaaccagcgcgttccatcccacaatgatgccggagattaacgctatactctccaacttcaacatgaagattaaccctacaaagaccaaatggtttggccccggcgaagtgaaagtggttacggggctggaggtcactgatcaggtcagaattccaggaagcttttattatgacttgagtaacgatctgaagcgactgaagtactcaatcgaggcccaggtccaggtaatgggatcccagcacaacgagatggtggagaaactcaagaaacaggtccgaggcaagatcaactttgtggggatgatacaggggaagggagatcggaaatacacagatctgctgagggactacgacaatgcaatccatcccgatatcgacaagctgtccgtgagatgggtggattttccttatcaggacttttga

SEQ ID NO: 8731 - RNA, 1035 nt, unidentified
  source 1..1035: mol_type = other RNA; note = synthetic construct
atggccacgcccatcaagaccatccgcacccggaatcacgctttcaggtccatgagagtgattggggacctttgcaggctcaccggtgaaagtaatctcgtcctgggcttgatggccgataaacctagatacagacagtatttcatgcgcaagaaagatggatcgaagcggccaattgaggatcccgatgccaggctgaaggcggtactgcgggtgattaacgaccatctccaggcagtttactactacttgcgcccaggggcggttcacggctttacgattagcagcacttcagatgaaacagagaggaacatcctatctaacgctcgggcacatatgcaatctcactatatgctgaacctggacctcaaggacttttttcaccagatcacccaaaaatccgtcgttcagctactgagctctcacttcgatcaatgggacgactcattaatccatcttgttgcaggcctgtgttgctttagggggcggttacctatgggttctcccgccagtccggccctttcaaattttgctatgactgacttagaccatgagctcatgacactgtgtaaagtgtatgatgtggtgtatacacgatacgcagacgatcttacttttagctcccgtgaaccaatgtccagtgtcttccgcgacatggtgaacgacgctgtgagacaccgaggatttgagataaatcctaagaaggtccgttattacattatggaagatagcaaggtggtgacaggaataatcgtaaccaaggacgagctgtgcctgcctgaagagtacatgcaccagttgagaaaggaaatagacctctaccgcaacagcgtgatcgttgataccatgtatgagactgggatgtctggcaaaaagctgagtctcttcgagcaggaaatcacaggcaaactgtccttcgccaaaatggtaatgcccgatgacgacgaggtcaaagagctggaagacttgttctacaatgaggtggatgtccattcagtgatgcagtcctggctggatattccatatattttctga

SEQ ID NO: 8732 - RNA, 1053 nt, unidentified
  source 1..1053: mol_type = other RNA; note = synthetic construct
atgcacatgggcagtagttcactgagatttttccggagcaacgctaagaggtttgcatctgttcgctccaaggaacagctcgctcgggagcttgatagctccaaatatactctggagctgttggccgtctcacctccttaccgttcttttaaaatcccgaagaaagatggtacttggaggagcatagaggagcctgaagaggagctgaagctggtgttaaagctgcttgcctttcatcttcaaaccgtgtatttcttcattaaacccccttgtgcctatggctacatcctgagtcacaggtcggatccagacaaacgcaatatagtcaccaacgcacataggcacattcaggctcatactttattgaacgttgatatgcgggacttcttccaccagtgcgacgaagccgaggtcgtgagcgtattgaggccacactttccggaaatggaacaggactgccttgagctgattgcaaatttgaccacctaccacaacagactacccatgggcagcccagcatcccctgttctctccaattatgccgcttttagactcgatcacgctatgctggcctggtcccaggaaagaaacatcgtcttcacgcggtacgtggatgatatgacgttcagcagccgtaccgtgctgcccgtggagtatgtgaagcaactcgaagaggcctgcgcgaaatttggattccccctcaacccagctaagaccaaatattacggacccgaagacgaaaagtatgtgacagggctgatgctcacaaaagaagaggttgtcctcccagggaagtacttctcatttctgcaggacgacctggacagattcgcggctctgtacccagtattcagttgtctatcagacgagcgatcttctgcatgggtgtggcattttgaacaaggcttgacagggcgcatcaatcacattggagcagtgtacggtcggtcttccgccacttttcgacattaccagaagaagcttcaggccgccaaacgccctgtagcggaggagatctatatgaattggctggatttaccctacgagacatga

SEQ ID NO: 8733 - RNA, 1050 nt, unidentified
  source 1..1050: mol_type = other RNA; note = synthetic construct
atgacctttggcgacatccaaaccaaagctagcttggtgagtaagtgtgataccctgactgagctgtgcttcctgcttaagactccacggaaagccttactggcaatcgccgataagcctgactataatgagttctttatgccgaaacctgacgggaaaggacgacggttgatcgaagatcccgtggcggtcctccaatatattcaggagatcctgaacgactatttccaggcagtgtactacctgatccgccccgaagccgcttatggctttcagttgagttttgatgacgatcacgcaggccgcaatataagaacgaacgccgagaggcacttacataaaccatggctgctcaacatggacttcaaggattttttccatcaggtgacatcacagaaggtggaaatgatcttacgtggggacagctttagctttgacaaggagtgcgtcgaggtcctttgttctattctgacttataagggtcgcctacccatgggtgctccaacctcacctgtacttagcaacatggctgtcatggaaatggacaatcaactgggccagatggccaaagaaaagaggctgatttatacgaggtttgcagatgatttgaccttttctggacaccaggagataaatgagttcactataaaggcgatcaaggccgtggtggctcaattcgactacttcttcaatgagaataagactagactgttcacaccagagatggagaaaacagttacaggagttaagcttggcgatcggctggggctagaacccaagtacctggataaagtatctctcgaaattcagaagtacgagcataccaaggagattcagggaataaacgggattgagagttcggaatacctcaccaaatatgaacagcagctctcaggtcacatcgaatttattggcttcatctatggaaaacaggcccctgagtacgttcatctcaaaaaaaggtacgacaaagccgagtcctcctcctacttcgattccagatcttggatggaattcgaccgacactacacattttttaacaagaagtga

SEQ ID NO: 8734 - RNA, 1047 nt, unidentified
  source 1..1047: mol_type = other RNA; note = synthetic construct
atggcccggctgaacaagatcaagaagataaagaagttggcagagtatttcgcttctatccacacgaccgaacagcttgcaacattcgtcggggtgcctgtataccagttgactcttctcgccgagtttccggcttacaactgtttctctattccaaaacagaacggcaagccaagaatgattgaggatcctcataaacctctcaaaaaggtccaacagatactcaatagcgccctccagtgcggttattactgtaataaaacacatgctgcctttggcttcctcctcaatccagaagacgatacggatcccagaaacatcctgaccaatgcacagaggcacatcaaccgactgtggctattaaatgtggactacgtggacttcttccacgccgtttccacacaccgagtggtcgagctgctgctgtctgactacttcagcttcgatgaacccactgcccttctgattgcgcagctgtgcacctataaaggccggctgccaatgggggcacctactagtcctgtgttgtcgaactgggcggcaaggaccctcgatgaggagctgctggcctggagtcatcgccatggatttgtgtatatgagatttgccgatgaccttacatttagtagacaagaacccattttgccccaacacgtgcaggagatcagggcgataagcactgtgaatggattcacttttaacgagcagaagttaaagatctgcgctccaagcgccgaaaaaattgtgaccggtctagtggtcggaaagaacggcgtacagctgccctccggttttttaggggaactggaagccgaaatcctgaaatttcgtaccgtcttggaggttcaagctcgcgcagggcgtgcccaatccgtttgggtggaggaattccggacacagctcgagggccacctttcattcgcttcctttgtccttggagaggaccacgctgactaccggcgcctgtcaaggctgctagaggaagccatgcagccgtctgtagctcatgactcagttagctggctgcacttcaattattttttttga

SEQ ID NO: 8735 - RNA, 1098 nt, unidentified
  source 1..1098: mol_type = other RNA; note = synthetic construct
atggctaaaaaagtctctatctatgaactacggcggagagcgaacagtttcctcgcttgcaaagggaccttagacctggcccgccactggagagtggataatgtgcggttggcagtgctagcaattgagcccgagtatcgggaattcagaatccctaagaaaaagcctggaaccttcagggagatagaggatccccgtccaaagttaaaagctattcttcgcaagctcaaccgcgatctccaagctgtctactattttcagcgcagcccagccgcgtacggctttttaactagcccggccagggacccagatccacgaaatatcctgactaacgctcagcagcacctaggggcaaagtggctgatgaatgttgacatgcgtgacttttttcatcaaatagaaacacacgaggttgcagagctcttccggcagccacctttcagcttcccgaaggcaacggctaagctgctggccggcctgaccacctacaaagggagacttcccatgggtgcgcctacttcaccaatcctctccaactggtacgccatccccctcgacaagactctgaccgaatttgccagacagcgtgaatggacatacacaaggtacgccgatgacattacatttagctcgaagacctctcctattaagtttgaggatgtgggtcgggttaacgtgctggtaagggggagggagctggaactcaaccataacaaaaccgtcatttatcccccagatgccccgggaaaggaagtgacgggactgatcgtaggcgctgaacaggtacaactgagttctgagtttttggccaaggtcaaagacggactcagacgattgaatgacgtggtggatactaagtatctgatgccttccggccgcctggccaaaaccccatgggttgaggagatagcacagcaggtgcgaggccttgtctcattcgcacaaaaagtgctgcctcccgccgaccctttgggcatggaacttgaggaagcttacgccacagccttggctcccccccagaattacggtcccgtgtcctggcttgagttcgggtatctggacttcaggattgatacaaatcctgaccagatcaagtga

SEQ ID NO: 8736 - RNA, 1083 nt, unidentified
  source 1..1083: mol_type = other RNA; note = synthetic construct
atgccaaaaaggcctaccattcggaccttgaggagacacgccgagcagttcagagcctgtcgcggccagacccaattgagttggctgcttcgaacagagcctgtgagactggcaatgctggcagcggaccccaagtacgcgacatatagaatccccaaaaaacggaaggggaccttccgcctcgtggaggacccagagcctagattgaagcgggtgcaaaaacgcttaaattactaccttcaggccgtgtattactttcacaggcctaagaacgccttcggctttatcaccaatcccgtggatgacccagatcaacggacaatcgctactaacgccgccaggcacctgggatgccagtggatgttgaatgtcgacatgaaggactttttccacttagtaaatcgcgaacgagtctatgagctgttccgtgcttcccttctcaagttcccgaaaaatctggctagagtgctagctgatctgtgcacctacagggaaaggctacctatgggggcgccaacttcccccgtcctctctaacctcgcttgtatccccctggatcatgacctggaccatttcgcagagcagcgaggcctcacttattcaagatacgccgacgacctgacctttagctcgagggaacagcccatcaactgggagctgatacctcagattaacgagtggattacggcatatgattttcagctcaacccggctaaatctaagctgtacggccctgcagacccccataaagaagtcacaggccttatcgtcggagtacagcaggttagcttatctccagattacattgccagtctgcggaagggtattcagcaactggatcaggtggtgaatgctaagtacgttatgccatccggacgtctgcgcgccactacctgggttgacgaaatagcccaacagcttcaggggcggctggcatttgccagccagatcctaccagacacggatcctctccgcatagagcttgaaacagctatggatgaagcactggccccacccacagagtatggtcccgtgtcatggttggatttcggatatactctctttaacatgccgcctgcgtga

SEQ ID NO: 8737 - RNA, 1128 nt, unidentified
  source 1..1128: mol_type = other RNA; note = synthetic construct
atgccaggttacagatatgagtccgatggcgaggagatttctatcgcccggggtcataccatcgatatgaaatacacccgtaagagagtgaattggctcgctagacagtttgggcaactcacggaccccgcttctctgtcacagctgttaggagtccagctccatctgctgcaactgcttgcgctgcagccgcggtataacacgttcagagtaccaaagaaaaatggcacttttcgcttaattgaagaccccgaaccccaccttaaacaggtgcagaagcgccttaacacatacttgcagtgcgtctactatttgcggcgcacacctgccacatacgggttccagatatcagtggacggggacaacgatccgaggaacatactgactaatgcaaggcgtcacgtggggaacccttggatgctgaacgctgactttctggactttttccatcaggtgaactacgattgggtgtatcggttgttcacaagagaggttttcaccttcgagcctgatcttgcagagttgctggccaaactaaccacttacgggggacgcctagctatgggcgctcctactagccccgtgttaagtaatctcgctacaatgccagtggacgatgcgctgactgaactggcccgatcctacgattggacctacacccgctttgccgatgatctcacagtcagcgcacaagcctgtatcgcccctgcccaagtccaggaatttctgaatactatcgcgccctttggacttgcattcaatgaagccaagttcgcagtcaggagcccggcgatgcccaagaccgttacaggcctggtggtaaccgcacaagacgtgcagctgccagctagtttcgtgaccgacaccctgacggagatcgagaagctcggacacttactggaaattcattataggtccggccgacctgtcacccgatggttggagcagtatcaacagcaggttgaaggtcagctcgcattcgccgaatttattctagacgatgctgactcccagctgcactctctcagggcagcttttgtacggatccagcagacacccgacttgggcgagccagtttcgtggattaatgccgcctatctcgagccagccagccacactctttactga

SEQ ID NO: 8738 - RNA, 1053 nt, unidentified
  source 1..1053: mol_type = other RNA; note = synthetic construct
atgaaaaaccagaaactgacactcaatcagatcaagcgaaacgatgtactcataaagaaatgcaaaacatccaagcaaatcgcgtccctgctaaattgttcagctaaggagctgacacttcactcctttgaacctatatattaccatttcaaggtgccaaagaaacgcaagggcgcctttaggtacattgaggcacccagccaggaaattaagcacctacagagaaagcttaattactacttgcagtctgtgtattacctcaatcagtctaaagccagttacggatacatcattaaggctattggtcaaaagaacaccaagaacatctacactaatgccttacagcatctgggatccacctatatgctcaacgcagatttcaaggacttttttcatcaaatcgcactgaatgatgtggtccagatctttaaatcgaaactgttcaacttcaacaagaatacggcttataccttagccaagatctgcacttataaggggagactgcccatgggagcgccaacgtctcctgccctgagcaatttatattcaatcgctttggatcacgacctctcaacctgggcaacattgaacaaactaattttcactcggttcgtggatgatctgtcctttagcagcaaaaacaatttgctgaatcaaacccatttcaagcagattaacaatatcgctctcaaatatcaccttaactttaaccccaacaagaccaaatatttctcgaaaaccgacaagaaaatcgtgacggggttggtcctgaataatactgtagacatagacaagagttactataatgaactcgacaaggacataaaccgtctgcagaaggttattgaggttcatcacattactggtaaaacacaggggctcgcctttcttaaagagtttaagcaacagatcatgggcaagatcaatttcattagcactatcgagggcaagaacagcaaacagtacctgacataccttaactctttccacaacgccctggaagtcaacaatgagctggtgaacaggtggaccaaattcagtaattacatttga

SEQ ID NO: 8739 - RNA, 1050 nt, unidentified
  source 1..1050: mol_type = other RNA; note = synthetic construct
atgaagcagcagaagcccaccctgaaccagctcaaatggtacgaaaaccagatatttaactgcaaaacgctcgaggaaatttctgtgctgctcaattgttcaaaaaacgaactgctattgcatagttacaaccccgagtactaccaatttagcatcccaaaaaagtcagggactttccgcattattgaagctccgaatgagtcactcaaacggctccagaggaatctgaatcagtacctgcaggccgtgtactacctgaaccagagcgtgtgctcctacgggtacgtgatatctatcctgggcgagaaacaaacgaaaaatatctacacgaatgccacacagcaccttgctaaaccttttatgctgaataccgatttcaaggatttctttcaccagatcaagatcgatgacgttacacaaatttttaagagcgagttcttcaactttgatatctatacagcaactactctcgccaagctgtgttgctataaggatcgtctgcccatgggaaccccaaccagcccagtcttatccaatctgtatacactgaaattggataacgaactcttgcagtgggctaagaagcataatacttcttatacgcggtttgtagacgaccttacctttagttccgtaaccactagtttttcccctcttcacttcaaacaaattaatgaaatcgccctccgacacaaactgaatttcaacgaggaaaagactaggtatcttaattctgacgacatcaagaccgtgaccggacttgtgctaaataccactgttgacatagacaacgcgtattatttggagctaggtaaggacttaatcagacttaagaacgtcatggaggtctattacatcacaggcaaaacacatatcataaccttcttgaagactttcaagcaggagctgttcgggaagattaacttcattggtaccattgaaggcagaaattcgaaacagtttctgaactatctcaacctgttctataacgcattagagcctgatacagacctggttcaacgctggacaaagtttagcaactacgtgtga

SEQ ID NO: 8740 - RNA, 1044 nt, unidentified
  source 1..1044: mol_type = other RNA; note = synthetic construct
atgaagatcacattcaaaaaactgaagaaggaggcagatctcttctgtaaactgagtacgttaaacgatcttgccgcagtcatatctgtgagcaagaatgaaattttgctgatggccttcgaaccagtatattaccatttcacggtgcctaaatccacaggcggccaaagatatatcgaagctccggacattgagctgaagaaaatccaaaggaggctgaactactttctgcagaaggtttactacctcaatcagtctcgcgcggctcacgggtacattataagtgtgatcggtgagaaaaacccaaagactattctttcccaggcagaaaaacatcttggagctaactatatgctaaacgtagatttttccgacttcttccaccaaataagcattacagacgtcaagaatatctttcagtgttctccctttaagttcaaccagtacgcagcctacacattagccaaaatatgctgctataaggatcgcctgcccatgggtgccccaactagtcctgtgttatccaatttctacacccgttcattggatgaggacctcattaaatggtcaatgccccagaagattacctatactcggttcgtggacgatctatcgtttagttctctggacagccccttcaacattacacactatgaacagatcactgagatcaccaacaattacggactggtcctcaatccaagcaagaccgtctactatgacattaaggatgaaaagattgtcacagggctgatcttgagagaaaccgtggatattctgcctgagttttatgaggagcttgataaagacatcaatcggctgaaggctatcaatgaggttgtttacatcactggaaaaatccagaaacccctcatgctgagcacctttaaacaagaggtgatgggcaagatagcctttatcgcccagatcgaagggaagaattcaccggagtacaaccattatatggaaaaatacgaggacgctgaggcgcctgacgaagagttgtccgtgcgatggaccaagtttggcaactatctcatctga

SEQ ID NO: 8741 - RNA, 1053 nt, unidentified
  source 1..1053: mol_type = other RNA; note = synthetic construct
atgtccaagaagcacactaagaagcagattctgaataaagccgctgagttttctaactgcaaaaacatcaagcaagtttcttttgtgctcaaagtgtcccctatgcaactggcaacaagcgccttactgccgcaatactactacttcaagatgaagaagcttaaggggggatttaggaatattgaagctcccgaaccccccctgaaaaagttgcagcgcaagttaaacacgtacttgcaatattgctactattcagaacagaccaaagccgcttacggtttcataattaatccgcgtaagcaaaaagcgaagaatattgtgagtaacgcacagcagcataaaaacaactcgtacatgcttaacatcgacttcgatgatttctttcaccaaatcagcattaaggaggtgattgctatattcaggaagagcccattcaatttcaacaaaaacacagcagggattctctcaaaaatatgtaccaataagggaagactgccaatgggcgcacctacaagtcctgttctgtctaattttgcctgttcaggcctcgataaagagctgcagcagtgggccgatactcggatcatcacctatactcggtttgtcgacgatcttaccttctccagcaacatgccaattaccaaacagcattacaacgagataaaggaaatcaccgacaagtacgactttcagatcgagactacgaaaaccaaatggtatgggaaagaacaggaaaagactgtgacgggtctgaccgtaggcgagacaatcgcaatccctgaggcgtattatacagagctagacaaggacctgcaccgcttgcagaaaactaccgaggtgcatattattacagggcaggtctataaggccgacgccggaaagaagtttaagcaggaaatcatgggcaaaatcaatttcatcgccgtagtccacggctatgacggaaataaatacgagacatacatgcagaagtatgaggatgctatcaatcccccagataaagacgaactcagtatgcgatggctaagattttccaactacatgcagttctga

SEQ ID NO: 8742 - RNA, 1050 nt, unidentified
  source 1..1050: mol_type = other RNA; note = synthetic construct
atgaagctcaaccagaagctcacaagaaagcagatatacaaaaaagccaagatgctgttttcctgtactactctgaaagacgttgaacagctgattggtgccgagctcaatagcatctctctgcatgcttttgacccaggatactttcacttcacgatgccaaagtcaaatggtgaactcagatacattgaggctcccgaggatgaacttaaacgtctgcagaggaaattaaaccactatctccagtgcgcgtattttgtcgtgcggaccccctcctgctacggctttacaattggggccatctccgagaaaaacccgagaaacattctctcgaatgcacagaagcacttgaactgctcttatcttatcaatgtggatgtggatgactttttccatcaaattagtaccgaacgggttcagtttatattcgagaacgatccgttccgattcgataggtacatttctaagacattagccaagctgtgtacctacaaaggaaggcttcccatgggcgcccctactagccctgtcctcagtaacttctacacaatcgaacccgacacagaattgcagaagtggtcagagaaccagagcattacatatactcgcttcgtggacgatctaacttttagctccaccaaaaatctgaacagccggcatatcgagagcatctctgggatactggatggcttcaatttgccactgaattctggcaaacacaaactgtatggaccagaagaccccaaaacggtgactgggctagtggtaggtaactcagtggagatcgctccttcattctactgtgcactggacgaggaccttgtccgattaaagaaggtcgttgaggtgcaccaaatcaccggcatgacctccggattgagtttcctgaagcgctttaagcaagaggtcatgggcaagatcaatttcgttaagcagataaaagggaccttttccgaagagtatgtgagatacctggatcaattccatgaagctctggaacctgacgagaggtttgtggcacgctggaccagtttcaacaattatgtatga

SEQ ID NO: 8743 - RNA, 1053 nt, unidentified
  source 1..1053: mol_type = other RNA; note = synthetic construct
atgaacaagcggcacaccagcgagtggaggcgattaggtgaggatctgctgcagacaaggaccccagacgacctctcaagactgcttggcattaccactgctagacttgctgacaccgcggaggcaccagcatacgccactttctacgtcgacaaaagaaacggtggaaagcggttaatcgaagacccagcccctcccttgaaggctctacaacgacgcctaaatgatctgttgcagggcttatactggctggaacggtccgaggctgcatacggctttgtcgttaaccctctcgacgatccccacccccggcacattgtgacacatgccgagcgtcacctgggatgcagacgcctcatcaacgtggatcttgagggctttttccatcagatagacaatgatagagtgaggaagacattgctggcccctcctttgcagcttgaggcagaagctgtcgagctcctggtggccctgacgacatggaagggacgcctaccaatgggagcgcccacctctcccgtcctgagcaatctggcttttcgtgacgaggatttgtatctgaccaggtttgcgagagacagggggtggctgtatacgagatacgccgatgacctgacattttcaagccggaaccaggacatggaacctcatcacttacatgagattgttcagcacctcgaggatggcctcaaatataccgtacatccagagaagcggcgttatagtgatgatggcgatatcaaatccgtgactcggctcgtgctcgaagggaatcaggttactctccccgaggagtatttccaccaactggacgaaacccttaatgaccttagttccgcccgccgagtgcatcaccgaatgggagggaggcacactctgtggttggaagactacaatgctagaatcgaaggtctgctgtcgtatgcccgctacgtactggatgaaagggatccggtgtacatggatctcaaaaggcgctatgatgacgcaaaccaagcctctccggacgacttcggggcctacacatggtttgacttcccttacttcgaatga

SEQ ID NO: 8744 - RNA, 1044 nt, unidentified
  source 1..1044: mol_type = other RNA; note = synthetic construct
atgttaagtcttagacagctccagtacaggcgcaatcggttgactaaacttagaaccatgcaagaactgtgtctgctgctcggcaagcccggtcataagttggaattgctgtgtgcacaacccatgtacaacgagttccacatccggaagcgaaatggaggcaagaggcatattgaggatcccaggccccctctgaaaagggtgctaggaatcctgaatgacctcctgcaaggggtctattacttcgaaaaaactgaagcagcctatggtttcatcgcgattgcgcgggatgatccagctcctccaaggcacatagtcacgcacgccgagaggcatttagggtgccggtggctgatgaacatcgacctgacatccttctttcaccaaatctctaccgagatggtcttggatcgcttgaaagatccacccttccattttgatgacgaggtggccgatctgatggctcgcctgtgcacgtataaggggcgccttccgatgggagcccctactagccccgtgctgtccaatctggtatttcagcgagaggatgaagttctcaaagcatgggcagacgaccacgggtggctttacacaagatacgccgacgatttatccttttcttcgcagaaggagattagctcatgggaaatgcagcagaccataaacctgctagagaaccacagctacgctgttcacccagagaagcgccggctttatggcccagacgacgttaaaaacgtgactagattggtactgggagatggagagctcgagctaccgcctgacttcctcgaggagcttcgggactgcattgaggacctgcgccgtacaaccagaacccacctccgaatgggtgtggccaggccacctgcttggctgacaaagtacagacagcgtctgaatggcatgatgggctttgctaagcatgtgctcggcgaatatgacgaagatttcctccagatccagagatcatacgacgaagccgtgaaccccccggatgaagacttcgggacctatagttggttagactttccttattggtga

SEQ ID NO: 8745 - RNA, 1038 nt, unidentified
  source 1..1038: mol_type = other RNA; note = synthetic construct
atggacaacagcatagccgccctcgccggactgcgaaaggcctttttcgctatgaggacagcgggagacttggccgaactcctcgcggtatccccagcgcacttggtggctgttgcctttagaccatggtatcatattttcgagctccctaaaaaagacggcaccatgaggcttatagaggacccagatgaccgcttacagcctctgcaggatgggctgaacgattatctgcaggcagtttattggcaccaacggagcccagctgcttacgggttcctggtcattcctactggggaccctgagcccaggcatatcgagacaaatgcgaggaagcatattggaaagccttggctcctcaattgcgacctagaggactttttccaccaaatcaccgctggccgcgtgcacaagctctttgctgatgccccctttggatttgacgaggaagtgtgcgatctgcttgtgcggctgactacttttcggggaagatgtcccatgggtgctccaacctcaccggttttatctaatttggtgttctctgccacagatgcagatctaaccgatcttgctagacgccgagggtggacttacacacgttacgcagatgacctgtcctttagcagttatgacccactggactgggatgattacacccacatccaacgggccgtcattcgccatgactatgagttcaacccagaaaaagccgctctttttggcccggatgatcccaagatcgtcactggcctgctgttgggcacgcaggatgtagaagtgcctcccgatttcttccctcagctgaccgacgacattcaccagctggccggtgccatgcgtgtgcagttcagagtcaacccccgcggtagtcgtacaacggccagattccggaggtcagtcgaaggcaagttgaggttcgcagagcgcatcatggggagaaagcacccgggcgtggcaaaattatggaaagactaccgaaatgcagtgaaaccccccgcaaagcatatccagcggtcctggtttgacttcgaatactggtga

SEQ ID NO: 8746 - RNA, 1068 nt, unidentified
  source 1..1068: mol_type = other RNA; note = synthetic construct
atggccgataccattactatcaagggaatggagtcccgcgcgaggaggtttctcgacgtgcagacagtcgaacagttggctaaaatccttggaaaagacccaatgaagctggcagttctggccgccctgccacagtaccgggaattcgacatcccaaagaaaaatggagggaagagacatattgaggaccccgcccctccactgaaaaaggtgcaacgcaaactgaacgatttccttcaggccgtgtatttctttcaccgcacagacaatgccttcggcttcattacaaatcctgtggatgaccccagccctagacacatcctgactaatgcacaagcccatctcggttgccgatggctactgaacgttgacatgaaggacttcttccacctggttagccaggagagaacggagcagctattcgaagctccactatttgggttcggcgagcacgtttccaccctgcttgctagcctcgcttgttacaaaggcagattgccgatgggggctccgacaagtcccgtgataagcaacctggtgtcaattcccctggatgaagatcttaatgcatttgcccgggagcggggctggacctatactaggtatgctgacgatatgtcctttagttctcaaacggaaatccctccggatgccgtgcaggagatcgaggcctgggtaaaggcctatgactttgaactgaaccccgcaaaggtgaagctctttgggcccggctctcccaatccaaaagaggtcacagggctgcatgtcggagagactgaaatcggccttggtgcagattacaccggtcaactgactggggccatacagcacttgaacgacatagtggacgcgcagtacctcaccccttcaggtaagtcccagccttctcggtgggtcgaagagctggaagcgatggtacgtggcaaattagagttcgcacgtcagattttgggcgaggcagatcctctctatcaggatctctcgttacgattagaaaacgctctcgagccccccgagacatacggaccactgacctggttggaatttggatacgctacccctaggtga

SEQ ID NO: 8747 - RNA, 1062 nt, unidentified
  source 1..1062: mol_type = other RNA; note = synthetic construct
atggctgacacaattaccattcggggcatgagaggacgcgccgatcgattcctagcttgccagactttcgaccagctcgctcggttacttgggaaacagcctctgcaactcgttggtctggcggcccacccgcaatatcgtgagttctatatcccgaagaaatcaggcggtaaacgcctgatagaagacccagtaccccccttgaagaaagcccagcgtagactgaacgactacctgcaggcggtgtactattttcatcgaaccgctagcgcatatggattcctcaccaatcccgtggacgatccacaacctaggcacatcctcacaaatgcaggccagcacttgggtcgcccatggatgttaaacgtcgacatgaaagacttcttccaccagatcacacaggaaagggcccaggagctgtttaaggcacccattttcggatttaacgacgagatctccactgcccttgccgccctgtgttgctataagggaagactccccatgggcgctcccacttcgccaattctgagtaatctagcctctattccactcgatcaggacatggaggattacgctagagataggggatgggtctacacgaggtacgcggatgatatgacctttagcgccaacgaacctattacagaagcacacttctccgagatagagaactggataaccgcttacgactttatcttgaatcctactaagaagcggttttacgggccaggggacaagaaagaagtaaccggcctggttgtgggagattcagaggttgagcttgctgacgattatcttgatatgctcaccggcgccatccaacattttagtgatatcgtggacgcccagcatctgacacctagcgggaagaatcagccctccccttgggtggccgaattgcaagcacaggtgaagggcaaattagaattcgcaaggcagatcctgggggaaaacgatgagcggttcattgacctggagacgcgcctgatcaaggcagcggagcctccagaatcttacgggcccctgacttggcttgagtttggctatgacgtcaaattgtga

SEQ ID NO: 8748 - RNA, 1065 nt, unidentified
  source 1..1065: mol_type = other RNA; note = synthetic construct
atggctgacacaatcaccatacaaggcatgaggaatagggccaaacgcttcttgtcgtctggaacactggaaggcctggcactctcactgggcaaggcgagtctcaagcttctagcgctggcagagcagccatcctacaatgagttccggatccctaagaagtcaggaggtatgagacgcatcgaagacccaacgccagaattaaagaaggcacaaagaaagctaaatgactatcttcaggcagtttatcacttccagaggactgatgctgcgtatggtttcctggccaacccggtggacgatcctagcccaagacacattcttagtaacgcccgagtacacatgggctgtcgatggctgttgaatgtggacgccaaggacttttttcacatggtgtccgaggagcgtgtcaagcaggtgttccagagcggccctttccattttgaagagcccattgccggtcttctggcctccctatgctgctacaagggacggctccctatgggggctccaacaagcccaattctctcaaacttcgcatctgtgcctatggaccacgcactgatggagctcgccaggaaatacgattggaaatacactcggtacgccgatgatatgaccttcagcgctcaggaagaaatcactgaggctcattttgccgaggtaggcgcgattatacgttcccacgggtttttactcaaccccgaaaagaaaaaacattatggacccgaggatgaggataaggaagtcaccgggctgcttgttcgcgaatctagaatcgatctgcctgagggatatttggagcagcttgagaaggccatcgatcatctcgataaagcaattgacgctaaatactctatggccagtgggcgcgggcaaaaaaccgcctggctggaggagctggagcagcaaatccggggaaaactcgaatatgccaggcagatactcggcgaaggcgacttgctgtatctggatctggtcgtgcagttagacgaagctctgacaccccccgactactacggtccgatggcttggctggactttgggtacgctttgcccaaatga

SEQ ID NO: 8749 - RNA, 1053 nt, unidentified
  source 1..1053: mol_type = other RNA; note = synthetic construct
atggccaatcacccaagccgcctcgagttgagagcacttaaggatgcctttctggccatcagaacacccgccgacctgtgttcactgttagcagaggacatgctcgagctctctgccctggccttgaaggaagacaactacgaggctttcttcgtgcaaaagcgaaacggagaacagagattgatcgaaaatccctctcctcccctgaagcgaatccagcggaagttaaatgactgccttcaggctgtctaccatttccaccgctctagtgcagcctacggctttttatcggcatgttccgacgatcctccctgggcacaccgtgggattgtggcgaatgctaggcagcatcttggccggccgtggatgctgaatatggacgttgaggatttctttcatgcgattttggcagaccgggtcgcgtgggtctttctgaacaaaccattcagttttgacaccgagctgactaatttgctcatgcgcctgtgcatctacaagggcagactacccatgggcgctcctaccagcccgatactgagcaactttgccgccaggctgcttgatacagatctggaactgttggccagatcaaagcaatggctgtatacccgttatgcagacgatatgacaattagctcccggcaggagattacagaggatgatgtgcaacttctccgggattattatagggctcacagctttgaagctaacgaaaaaaaaacgaagcttatgggtcctaaagacgtacacactgtaactgggatagtgctactcgagaacaggctggacttactaccagaattcttcgaggatctcgactctgagattggtaaactgagtgagatcgccggcgttaagggacgcctcggcatcaccctgatggactgggttgatgattatgctgagaaaatacaggggatgatctccttcgccgcgcatgtgctgggtgaatcagacgcaagggtggtgaaagctgaaaaggctctcggaaaggcccagcacgggccaaaagactacggagccgtctcctggctggatttcccttaccattga

SEQ ID NO: 8750 - RNA, 1044 nt, unidentified
  source 1..1044: mol_type = other RNA; note = synthetic construct
atggataagaagactagacagaggcaccagcacaacaaggcagtgttttgctcaatcaggtctatcaggagtctctgcagtctgctcaaaaccgaccagagacgcctactgctgctagctcgccagcctccctataaggtttttactgtgcccaaaaaagacgggggcgagagacaaatagaggcgccaggcgctgaactaaagaaggtactggggcacttgaatcgctaccttcaatccgtgtactattttgagaaatcaagcgccgcttacggcttcatcgtgggagtcctcaatgatgatgatcgtcgaaatgttgtaacgaacgcccggaagcatgcaggtcggccctatttgctgaacatcgacctgatcgacttcttccatgccataactcgggagcaggtcgttgagatattccagagcaagccgtttcagtttaaaaaagaccttcctgagctcctggccgatctggtgacgtaccaagggcggcttcctatgggcacccctacatcccccgtgctcagcaacctggcctgtagagaacttgacgaacagttgagcgcctttgctgaagacatgctgtgggtgtacacaaggtatgcagacgatatgtcctttagttcccgaaagccaattgacgccgacaaaatcgactcggtgcgcgctattattgagaaagccggtttcgaggtgaatcagaggaaactgaagacctacggcccggaggatgataagatcgttaccgggctcctggtgacagacaaggtcacattggcaccagactatctgccacagttagatgaagacattaggcagttgcagaatgtcttactgatccaaaatgaacagggacagctgtctactcgctgggtagaacagttcaaaaagaacatcattggacggttaaacttcgcaggtttcgtccttaagcgttctgatgagagatacattgacctcaaagatgcttactataccgcgattaacccaccccaagaagatttcggagccgtgtcatggcgaggctttccttataatctctga

SEQ ID NO: 8751 - RNA, 1044 nt, unidentified
  source 1..1044: mol_type = other RNA; note = synthetic construct
atggataaaaaaaccattgctcgccatcagcataacagagacgtcttctgctctattaatagcattagatcactttgctccctgctcaaaatggaccagaggcggctcacattattggtccggcagcccccctataaagtgtttaccgtgcccaaaaaggatggaggagagcggatcatagaggccccgggtaccgacctcaagggcgtactgggcagactgaaccgttatcttcaatccgtgtattacttcgagaagtcctctgctgcgtacgggtttatcgtcggcgtgcatgacgacaatgaccgtagaaatgtggtaacaaacgcacgaaagcacgccggacgggcctacctactgaacgtggatcttacggattttttccacgctgtctcgcgggaaaggatcgtggaaatctttcagtcaaaaccattccagttcaaacgcgacctgcctgacctcttggccggcctaacgacttaccagggtcgcctccctatgggtacacctacaagcccagtcctcagcaacttcgcttgtcgcgagctggacgcaaggttgactacctatagtggcaatatgttgtgggtgtatactagatatgcagacgatatgagtttttccagtaataagcctatagatgcagacaaggtggatagcgttagagcaattataagggaagaaggattcgaagtgaacgaacgaaaactgaaggtgtttgggccggaggatgacaagatcgtcaccggtctgttagttactgataaagtaaccctggcccccgactacttatcagggctggctgatgacatccaccagctgcaaaacgttcttttgatccaaaacgagcaaggacagctgtctacaaggtgggttgagcagttcaagaagaacattattggcaggcttaattttgccgggttcgtgctgaagcgaaataacgaatcttacatggagctgaaggatgcgtactatactgccatcaatccaccccaggaggatttcggcgccgttagctggcgcgggtttccatacaatctctga

SEQ ID NO: 8752 - RNA, 1044 nt, unidentified
  source 1..1044: mol_type = other RNA; note = synthetic construct
atgaagaaagacacgcgcgagcgtcaccagcatcgaaaaatggtcttctgttcaatcaatagtgagcacacactgtgccgcctgctccacattgatcagagaagactgcagttgctcgccaagcagccagcctacaagagcttcactgttcccaagaaagatggcggccaacggcagatcgaggcacccaacgcggagcttaagagagtattaggtaggctcaacaggtatctgcagagcgtgtattattttgagaaaagttctgccgctttcgggttcatagtgggagtaaccaatgacgacgatagaagaaatgtgataactaatgccaggaagcatctggggaagccttacctgctgaacatcgatcttcttgatttcttccactcgatctctcgggaccgagtctaccagatatttcgggaaaagccattcaacttccggcggaacgttccagacctgctcgcggatttgactacataccaggaccatctacccatgggcactcctacctcacccgttctgtctaacttcgcgtgccgcgatcttgaccgcgaactgttgattttctcccaaacccacgactggacctacacccgatacgctgatgatatgagctttagcgccgcagagcctatccttcagggtcaagtcgaggctctgggggccatcattcagcaggctggttttgccattaatccgaggaagactcagctctttggaccagaagatgagaaaatcgtgacaggactgctcttaacagacacggtgaccctggcccctgactacttgccactgttgcaagctgagatcgaccagctgcgcaacctcctcctggtgcagaatgaacagggcgagctatccacacggtgggtcgaacaatttaagaaacaacttatgggcaggctaaactttgccggatttgtgctgaggagaaatcaccctgattatatggcactcaaagacgcatactatgctgccattcatcccccgcaggaagaattcggggcaatttcctggcgtggctttccctataatttatga

SEQ ID NO: 8753 - RNA, 1044 nt, unidentified
  source 1..1044: mol_type = other RNA; note = synthetic construct
atggacaagaggactgtggagcggaacctgcacgtcaaaacagtatttttcggagtgcggtctatccgcgctttgtgtggggtgctacagattgaccagcggaggctgttgctgctggctaagcagcctccctaccgctcatttactattcccaagaaagacggaggcgaaagacacatcgaggatccgggcgcagagctgaagaaagtcctggggaaactgaaccgatatcttcagagtgcctacttctttgaacgttccatggctgcttacggattcatattaggcgttcagaacgataacgatcgccggaatgtggtgactaacgccaggaaacacctcaagcggccatatttattgaacacagacttgcgcgacttcttccacactattgcgagggatagggtttacgctatttttgctgggccaccttttcattttcctaaagaaatccccgaaatcctggcagatctgaccacctatcagggcagacttcctatgggtgctcccacaagccctgtcttatccaacttcgcatgcagaaatcttgacctggagctagcagcgttctctgagaatatgctctgggtttatacccgttacgcagatgatatgtcgttcagcagtcatcaaccaattgacgccgataaaatccagtccgtgagaaccataatagagaaagaaggatttgccgtgaatgaaagaaaggtcaaggtatatgggcccaatgacctcaagatcgtgaccggtctgctggttgccgacgacgtgcagttggccccagattaccttcctaatctcgaggccgagatcaaccggcttcaagaggtactggtcgcacagaacgagcaaggacagctgtttacgaactgggtggagcaatataagaagcagatcacggggcgcctcaatttcgccggctttgtgatgaaacgatcaaatccagaatatatgaggctcaaggacgcctactacacagcgattcatccaccgcaggaagagttcggcgccatgagctggcgaggtttcccctacaatctctga

SEQ ID NO: 8754 - RNA, 1041 nt, unidentified
  source 1..1041: mol_type = other RNA; note = synthetic construct
atggacaaaaaaacgcgagaacgccaccagcatcaaaagatgttgttttgcgggatcgggtcggtacgcgcactatgtgggctcctgcagactgaccaacggcgactggctctgctggctcagaaacccccatacaagactttctcagtgcctaagaaagagggcggcgaaagattgattgaggcccctggagaggagctgaaaagaatcttatcccgcttgaatgggttgcttcagtccgcctacttctttgaaaaatctagcgccagttatggatttattgttggagttctgaacgatgatgataggcgtaatgtgcttactaacgcccgcaagcatgctggacggaaatacctgctgaacgtggatctaaaagacttctttcactacgtgagcagggacatggtccttaaaatcttcaccggcgaacccttccggttcaagggagagctcgcagatctgttggccgacctgaccacatttcagggaagactgccaatgggcgctcctacatcacccgtgctgtccaacttcgcatgccacgatctcgatgccgggcttatcacactctctgaaaatctgctgtgggtttacaccaggtatgcggatgacatgtccttttcagcaaaccagccctttaatgcagagaagatcgctagtgtcggggcccttatacataatgccggctttgtggtaaaccagcagaagatcaagatatttggcccaggtgacgagaagatagtcaccggtctgctggtgacagacactgtcgcgttagctccggactttctgcctaggcttgaggcagacattagccacctccaacagattatgaaggcccagaatgaacagggccagctcctaacgaagtgggtggaacaattcaaaaagcaaatcatcggtcgtctcaatttcgccggcttcgtgttaaaaaagagcaacgacgcttatattagactcaaggatgcttattacaccgccattaatccaccggaggatgagttcggtgcagtctcttggcgggcgttcccctataactga

SEQ ID NO: 8755 - RNA, 1047 nt, unidentified
  source 1..1047: mol_type = other RNA; note = synthetic construct
atggataaacaggctctatatcaacaccagcaacagaagacagtgctgtgctcaataaactccctgaatgagttggcgcgccttctgagactcgaccagcggaaactgacattgatggccgaaaggcctaattacaggacatttgagataccaaagaaggatgggggtatgcgagaaatcgaaacaccaggggacgacttaaagcgtaccttggggattcttaatcgctatctgcagagcgtctacctgtttgagaagtcctccgctgcctacggctttgtggtgggcgtcaaaaacgatgatgaccgaagaaatgtactgtccaacgcacggaaacacattggtaagccttatcttctgaacattgacttggccaacttcttccacagtattacccgcgagagagttctgaaggttttcaccgaggcccccttcaggtttaagcgcgaactccccgatgtcctcgctgacatttgtacttaccgtggcagactgcccatgggcgcaccaacaagtcccgttttgagcaacctggcatgtatggatctcgacagggacctcagtatactggcaaattctctgttctggaactttactcggtacgctgacgacatgtcgttctcttcagatacgcctattaccccagagaacatcgtgtctctgagaaagatcatcaccgacgctggtttcaccctgaatgagcaaaaattaaaactctacggccctgcggatccgaagactgtcaccggaattctattggaagctgatgattgcactctggacccttcatatctcgatctgctagacgaagagatcaaaagattacatgaagtgatgagggcccaaaacgaacttggacagcttaatactcggtgggtggagcagctcaaacagcagatccgaggcaggatggccttcgccggatttgtactcaagcggaagaacgagcggttcgtggagcttaaaaacgcatttcatagcgccatcaatccgccaacggaggaattcgggtctatcagctggcgcggatttccctataatttttga

SEQ ID NO: 8756 - RNA, 1044 nt, unidentified
  source 1..1044: mol_type = other RNA; note = synthetic construct
atggataagcggacgcgacaacggcatctgcagctgaaaacacaattctgcagtctcaggtctgtcaccgagttctccatgctcgttaagacagaaaagaggaagctccagctgctggctgcgcaacctgcctacaatacttttaccgtccccaaaaaagatggcggcgaaagactgattgaggccccagcccccgctttaaaaaaagcccaggggtcaatcaatcggtttttacagagcatctactaccttgaaaagactacggctgcacacggctttgtggtgggtgttcgaaatgacgacgataggcgcaacatactcaccaatgccaagaagcatttgaacaaaacttacctgctgaatatcgacttgcaggacttcttccacaccgtaactagagacgaagtgttagacgtcttcatgaagccaccgttcaacttcaaacgccagctgccagatcttctggccgaccttttgacctatagcggtcgtctaccaatgggtgcgcctaccagccccgtactttctaactttgcttgtagggagatggatcggcggctaacagcaatggccgaggatatgttgtgggcctatacccgctatgcggatgacatgagcttctcatccaaccgtaacattgatgaagaaaccgtaaacacagtgattcgaataattagagaggagggatttgttccgaataagcgtaagatcaaagtgtacggccctaaggatcagaaagtggtgacagggctgttgatttccgacaaagtgtctctggaggacaattatctggcacagctggaaactgacatcagacaactcggagacgttctactcgcccagaacgagcaggggcagctcgctacaaggtgggtcgagcagctcaagcagcaagtgcggggccgcctgagtttcgcaggctttgtccttggaagacgccacgaaaggtacaaccagctgaaggatgcttactataacgccgtgaatcctccccaggaggagtttggggcaatctcgtggagaggatttccctataatttctga

SEQ ID NO: 8757 - RNA, 1044 nt, unidentified
  source 1..1044: mol_type = other RNA; note = synthetic construct
atggacaagcgcacacgtcagaggcaccttcagaacaagaaaaaattctgcggcctgaggtctgttagcgagctatgcctcctgctgaagacggataagaggaaattggagctgctggccaatcagccaccctacaagacctttactgtgccaaaaaaggatggcggagaaaggctcattgaggcaccaggaggtcctcttaagaaggtgcagggactgctcaatcgctatttgcagtcagcctacttccttgagaaaagcacagcggcctatgggttcgtggtgggtgtacgtaacgacgaggaccgccgaaacgtgctgacaaatgcaaagaaacatctcggcaagacctatttgctcaatatcgacctgcaggacttttttcattctgtgacacgggatcaggtccttgacatccttttgaagccgccctttaacttcaagcggcggttacccgacctgctggccgatctgctgacctataacggcagattacctatgggggcccctacctcgccagtgctatccaatttcgcctgtagagaattggaccgccgattatcagctatggcggaggatcttctgtggacgtacacccggtacgctgacgatatgtctttctccggcaatagaccgttcgacgaggagaaagtgaacagtgtactcagactcatcagagaagagggttttactccaaaccctcggaaaattaagaggtttgggcctaaagacgagaaagttgtcactggattactcctgactgataaagtccagctcgaaaagggttacctcgatcaactacagcaggacatacagcagctggcagatactctgagggcacaaaacgaacaggggcagctggccacacgatgggtggaacaattcaaacagcaagtcagaggcagattgagctttgctgggtttgttctggggcgccggcacgaacgctatcagcaactgaaggatgctttctacaccgcttccaatcccccccaagaagagtttggcgccgtcagttggaggggattcccctacaatttctga

SEQ ID NO: 8758 - RNA, 1035 nt, unidentified
  source 1..1035: mol_type = other RNA; note = synthetic construct
atgaaaacattatcaaaacggcgcctgaagcaaaggagggacaagtttctgtccatgaggtatgtagacgatctcgcagagctaactagcttcgtccggtataaactgacactcattgcaggagtccctcagtaccatttcttcagtgttccaaaacgaaacggaggcctgcggcacatagaaaaccccgcgcgaaaactgaagaaggtgcagaggactctcaacaattttttgcaggcggtgtactttttcgagaagactgaggccgcttacgggttcatcatccgcgcccgtgatgaagcccctcgagacatagtgtccaatgcccaccagcatctgaacgtcccttggctgatgaatatggacctgacagacttcttccactacgttaagcgcgaagatgtctttcatattttctgccatgtgcccttcaatttttccgaggacttggcggaaattctgacccagctcactacgtataagggccggctgccaatgggagctccgacatctcccgtcctctcaaattttgcaacgatcgacatggatatcgacctactggcctttgcacaggcacggggctggaccttcacaaggtacgccgatgatatgtcttttagcatggatactgcccccatggatagtgagattgaggctatcagacaaattgccggcaaacaccagttcctcttcaacgaaaccaaattaaagatctacgggccagaggacgaaaagttagtgaccgggctgagacttggtgaagaggtaaccctttcgtctgcattcttgcaggagataagagaagagattgatcgcctgcagaaggttgtggaagccagagctatggccggccaaccgccaagcaaatgggtggagaagtatacccagcaagtgcagggtcgcatggcttttgccgagaaggttcttggggagtatgaccccatctatgtggagcttgaaaaagcttttaacagagctttgaaccctccagatcgttttagctccgtgaattggctcgactttccttaccactga

SEQ ID NO: 8759 - RNA, 975 nt, unidentified
  source 1..975: mol_type = other RNA; note = synthetic construct
atggcacggttgttaggtatcgagcataggacactggattacctggcagaacgacctcagtataatgagttcgatgttcccaaaaagaacgggggattccggcatattgaagaccccgataacgaattgaagaatgtactgcgtttgtttaacgattaccttcaagctgtttactatttccgcaagtcagatgccgcctatggattcgtcagagttccagacaacgacaccgcgcctaggaacattctcagcaatgcagagaaacatcgcaatcgtccctggatgctgaatgtggactttctggattttttccaccaaatcaagcagatcgaaatctacgagctctttgtgtgcccgcccttcaattttggggaggaactggctgtcctgttgtcgaagctaaccacctacaaaggaagactcccaatggggagccctactagcccagtactctccaatttcgcgaccctgctcctggatcaggatcttctgggtttcgccacaaagaaagacctggtgtactctcggtttgccgacgaccttactttcagtgccaactcacctctctctgtggaacacttgacaggcatccgccagatttgtgctttctacggcctgaagctcaacgagaacaaaattaacttctttctgccccatcagacgaagatagtcaccggcttaattgtcacaaaccgcgtggacataccgcacacctatttagaggacctacgaaaagagattgacaagcttaggacggtgcttgaaatcaattataggactgggagacaggccagcgagtgggtgcagaggtttcaccagcagatagagggcgccattgaatttatcagacagatcgagacatccaagtctccagactaccagcaaatacggcaatattatgctgagagtcaacagatggcagaaaattaccagcctacttcctggctggatttcggctaccacaaatttatctga

SEQ ID NO: 8760 - RNA, 1071 nt, unidentified
  source 1..1071: mol_type = other RNA; note = synthetic construct
atgaccctgtttgagcagcgcaataacccggcgatggccggaaaaatcaggacacaaggaaacgctgcacggttcatccagctacgtaattgccaagatctcgccgtttccctaagaatcgatgcgtatagactgcagctcttggtgctccaaccaaagtataattgctatagtgtacgcaaaccaaagggaggctttcgcttaattgaagacccccagggacggctgaaatccgtgcagagccgacttaatgatttcctgcagtctgcttatctgccactccggcccgagtgtgcctacggtttcactcgggcaaagagtgaagatgacgacagaacagttgtcgggaacgctcttcaacatctcggatgcagatatcttctgaacatagacctcaaggacttcttccaccaggttagtgatgaaaaaattgatggcgtgtggcagagccatttccgtaggtttgatgctgggctgaggcagctcctgaccggccttgtatgcttccgccagagactgcctatgggagctccaacatcaccggcactgtctaacttcgcctctttggagatggaccaccacctgactgaatacgcgcaccggagctgcatgcactacaccaggtatgccgacgacctgagcttttcaagcacagagcccataggcaagggggaataccatgatctacgcaacatcattggcgagtgtggttttgaggtgaatccttccaaggtgaggtggtttggtgatggtgaagcaaaagagatcacgggcatcgagttgggcgaagaatgtctgagattgcctggcaattatctgggccgcctggccagagagattgaacgatacagggccttttttgagttagaatcgcgataccagactggggcctcagggaaaaagcttaagctctttgagcaggagttgagggggaaactggagttcgcccggcaagtcttgaccgaggacgaccccgtgtggcagaagctggccgagtctttcgagcaggctcagtttgcacttgaagacttcgaatccgtcgattggctcgactgtccttacttatactga

SEQ ID NO: 8761 - RNA, 1038 nt, unidentified
  source 1..1038: mol_type = other RNA; note = synthetic construct
atgagcattaaaactgccattaagatcagggccaaaaggttttccaagatagaaacattgagagacttgtgttccctaattaggaaacatgagcagcaagtggttctgatggctcaccagcctcggtatcatcggtacgaaattccaaagagcaagggggggctacgcctggttgaagatccagagaagaagttgaagatcgtgcagaccttcattaacgagcacttacaggctttctactcgctgattcgacccgagtgcgtctacgggttcgtcatcaaaagagaagcgggcgaggacaggactattaccggaaacgctatgcagcatctcggatgcaactatctgctcaatgtcgacttaaaagattttttccaccaggtgtcacgtgtgagagtagaggagatctttaagatccacttcaatcacttccacgatgagcttatcgatatactcgcccgcctaactacataccacgacagactcccaatgggggcaccctcctctcctgtgcttagtaacatggcctctatcgagatggaccgcgagttaattcaatatagtaaacacaccggattggtgtatagccggtatgctgacgacctgtcattttccacgctggatctgatggaacctgagcatctggacaacatcaagtccattatctcacagtgtggcttcaatgtgaaccctcaaaagataaaatggttcggccatgaggatagaaaggaaataaccggtatccttctggacggtaatcggcttggcctgccggaactctacctggagggactccaaaaagagttgatgcgatacaaaagctacatggaagtagagtctcgttatcgcacaggcgcaagcgccaaaaagctcaagctgtttgagtctgaactcaggggtaagatcaattttgccctgacagttatgcccgaagatcagggcgtggggaaacttttcgatcagtttgaagaggcaaaggaaatcatgcaggattttgagagtgtctcatggctggacctgccctacgaattcttttga

SEQ ID NO: 8762 - RNA, 1035 nt, unidentified
  source 1..1035: mol_type = other RNA; note = synthetic construct
atggccaaccgctctacaattcgatcgaaagccaaaagatttgaaaaactccgcaccgtgtttgaatttgcacattggttaggcagagaagaggcaaaactccagctgctgtctttcaagccgcgttataaagagtatcaaattcctaaacccgggggtgggtggaggcaaatagaggatcctgaacctaagttgaaaagtgtgctccagaagcttaatgagcatttgcaggcctgctactacagcgttcggcccgccagtgcttatggttttgtaatctccgcttccgaagacgaagaccgcaatatcgtaactaacgcaaagaaacacctcggctgtaagcacttactcaacatcgatttgaaggatttcttccatcagattcgggaggacaaagtcgtggccattttctcccgccacttcccacagtttgaggacgctctgatcgatctactggcccggctggtctgctacaaggcgagattaccaatgggggcaccaaccagcccagttctgtctaactacgctgcgatacccctggatgaacagctaatggcttactgtagccagtcaggcatctcctacacccggtacgccgacgacctgtcattctcttcaaaacaggcgatcagtaggattgactatgaacactttctgcactgcgtgcaaacctgcgggttcgaggtgaatcccaagaagattagatgggccaaggagaacaatcccaaggaaataacgggccttttccttaagatgggagaggtttgtcttgaagaaaattacctgaggcagctcgagactgagatcggaaggtatatcacatattacgaggtggaggcccgatatagaacaggcgcctccatgaagaagctcaaactgttcgagcaagagctgcgtggaaaactgagctttgcacagcttgtcgagccggataacgagcggattgactatttgagggaccagatggatcaggctaaggaggctctggaagacttcgaaagcgtgcattggctggatttgccttacggattttga

SEQ ID NO: 8763 - RNA, 1038 nt, unidentified
  source 1..1038: mol_type = other RNA; note = synthetic construct
atggcagcgagtagcactgtaaaactccgcgcccggaagtttagtcagctcaggtctgtgtttgatctcgcacatgtgctgaaggttccccaacataatctggtgcttatgggcagcaagccaagatatcgcgtctacgagattcccaaacctaagggcggaatgagattggttgaggatcctgagaagagtctcaagaaaatccagagccacttaaacgacttcctgcaagctgcttactatctgatccgaccggactgtgcttacgggttcacgatcgcatgccctggagatcagctgcgtaacatcaaaacaaacgccgaaaggcacctgaactgtaagtacctgttgaatattgaccttaaggattttttccaccaggtgaaggacatccacctaatcaacctcttcaataggcattatcccgaatttgactcagagttggtgtcttgcctttcaaatctattttcctaccatggtagactgcctatgggtgccccaacctccccggtgcttagtaattatgccatgttggaacttgaccacggcctgcagaactattgcaagtcaggggggatagtgtattcacgctacgccgatgatctgtcgttttctagcaccaatcagattcaggacttcgactttgtgagcatagacgcgatgattaaagattatggattcgagccaaacccaaagaaaatcaaatggtacgaacctaaagataagaaggaaattacaggcctggttctgggtgatgacggcgtcgagcttcaggacgggtacctacagcacctgtaccaagagattcagcggtacaaaatttacttagaggtcgaaagcaggtatcgaactggagcctccctcaagaaactgaagttgttcgaacaggaactgcggggcaaaatacaattcgcaaccatgatcctgcccgagaatgaggagctcttaaattggatgcagatggtagaggacgctatgtccgtcctcgaaaacttcgaatctgtcgattggctggagctcccctattccatctactga

SEQ ID NO: 8764 - RNA, 1002 nt, unidentified
  source 1..1002: mol_type = other RNA; note = synthetic construct
atgaaatgccggacaacagacgacttggctcaggcatgccagaccgatgccaaccaactggttctctttggactcaaaccacgctataaggagtattatattccgaagaacaagggcgaaatgcgattgattgaagatccaagtaaagaactgaagaagatacagactcaccttaacaagctcttacaggcctggtactatacgcagcgatcagatgcctcgcatggatttggtattgccacctcaaaggacgagcaggccaggggcatcaaaaccaatgcatccgtgcacctgcaatgcaattacttattgaatatcgacctgcttgattttttccatcagattgagttccctaggctgcagaagaccttcgagacgtatctgcctaagcagaaggcggacatcagaaatctgctgctccaagtgtgttgctacaaaaacaggctgccaatgggggctcccacatctcctgtccttagcaatatcgcatgtctcgatctagacgggtcccttcagcaactgtgtaaacacgctaatctgaacttcacacgttacgccgatgacctctctttctccagtttactacccatagagaaggaggtacaggatatgatcaaagatgccattatgcacgaaggcttctccatcaactacaacaaggtgaattactttagcatcgaggacgagaagctggttaccggtcttgtgttgcacccagatggcgtgagactaccgaaagagtacgtgcccctgctcctcaaggagatcgagcggctgaaaattataaacgacgtcgaatacagataccagactggaatgtctcggaagaaactcaatttgttagaacaggagattcaagggaaaattcgcttcgtatctgacgtcctgggcagccatgctatcgaaactctgtcaatcgaaaaagcgtatctgaacgctatacaggcacctgaagactttgaaagcctgagttggttggagctgccctatgagtttctttga

SEQ ID NO: 8765 - RNA, 1026 nt, unidentified
  source 1..1026: mol_type = other RNA; note = synthetic construct
atggccaccgggatcccaatcattagaaagcggcagcgcgcggtgctgaacgtcaagtcaatgtccgatttgtctaagctccttcagtgtcaggaacacgttatggctgcccacgcgctcacaccagaatatgacacgtatttcatacccaagaaaaatggcaaaagactgatcgaggaccccaaccctgttctgaaggaaatgcaagggatactaaacgatcacctgcaggccgtgtacttttatatccgccccgcaggcgtgtttggattttgcattagctcaacaacaggcgaagagaagaatatcgtgagtaatgcaaaaaagcatatcggcaacgactacatgatcaatatcgatctgaaggacttcttccaccagataaaaaccaatagggttgctcaaatcatcaacgatgtcttccttcatagcgaaactgaggttaaggaaatgatgaccgccctgatggtctataaaggtcgactccctatgggtgcccctacctctccgattctttcaaacttcgcactgcagaatctcgatcatgagatcaccaatatttgccaatcctttggagtcaccttcacacgttatgccgatgatctaactttcagcagtatggagtacatgaatgacacttttgaggccatgattaaagatgctatcgtgtacgagggatttgaaataaacccagagaaggtgaagcactacctgccctccagtatcaaaatcgtgaccggaattgtagtcgggagagaggacttaaggctgccagaactgttcttagaccaacttcagaaagaggtgattatctatggcaacgtggtgctcgctgaacataggtaccagactgggatgtctcagaagaagctcgaccagttccggcaggagattagcggtaaaataaacttcgcagcaatggtagactccgaaaaccccaaattgttgaagattacggacacatttaacgccaatgatgagattgagaatttgtcgtttgactggctggatattccttacgcttga

SEQ ID NO: 8766 - RNA, 1035 nt, unidentified
  source 1..1035: mol_type = other RNA; note = synthetic construct
atggccacaaatccccgaataatcaagaaacggaaggacgccatcgacagagtccgaacaaccgcggatatatgtaagattctgggggagaatgaactcagactccagctcatggcaaattctccccggtacaaagtgtatactatccggaagaagaacgggaatctgaggctgatcgaggatccagaaatccagttaaaagaagtgctgaggaccattaacgatcacctacaagcagtctattactaccagcgccctgattgcgtgcatggtttttgtatctctagcactcacgacccagacaggaatgtcgtgtcaaatgctcaagcacatatgatgtccgctacaatgctgaacatcgacctcaaggacttttttcatcaaatctccgtttctcaggtgaaaggcattattaaacgccagttccacagatgggacaactatctggccgccatgattgccagtctatgcacctataaaaagcgtctccctatgggatcaccaactagtccgatcctgagcaactttgcaatgctggaattggatcatgagttaatgcagctctcgagggtcttcgaagtgacctatactcgttatgctgatgaccttacgttcagctcaggcagcgatttgccaaccgattttgttaaaatggtgcgggacgctctgcagcaccacggcttcacagttaatgagaacaaggtaaagtactaccaggcctccgacatcaagattgttacaggtattattgtgaaccctacgggactgagtctccctgatgactacatgacccaactgcgcaccgagattgacttgtataggaactcccgcctggtggacgcgatgtaccagactgggatgtctgagagaaagatgacattgttcgagcaggaaatcataggaaaacttaatttcggctacatggtgatgccggatgatcccgaactgaacgaattaaaccagctttttgaggtcgagatagacgtagagtccatgacccagagctggcttgatatcccctacaatatgatgtga

SEQ ID NO: 8767 - RNA, 1038 nt, unidentified
  source 1..1038: mol_type = other RNA; note = synthetic construct
atgatgtcttcactgaagattaaacagcaggttcagtccctccttcggtccaaaagtgtcgatgacctggccaaagtgttgaaattcacagctgagaacatcacgctgctcagcatcagtaagaagtatgaggtgtacaagatccctaaaaaggacgggagctttagaatgatcgaggacccctacgcacctttaaaggccttgcagaaacgtctcaacgaagttcttcagtgctattatgccactattcggccatccccagtgtacgggttttgcatctctacatcaccggataagcccctcaatattaagactaatgcccaaaggcatgtcggaaacccatggatgatcaacatcgacctgaaagattttttccaccacatctctgaaaagcgcgtccaaaatatctttagcaccaacttcaaacactgggataagaatctagtcaagactatggcggcgatcgccacctataagcatagattacccatgggagcacctacttcccccgtgctgtccaacttggcttgtatcaatctggatcacgagctgcagaatttcaccaagaattcaggcataacctttacacgatttgccgacgatttcacttttagcgctcatcacgaactcaacaagaacgacatcgacattattttctctgctctccaccactacgggttcttagagaaccagaagaaagtggtgatttaccccccagatgatattaaaatagtcacaggattggttgtgggtaatgatgacgtgagtctgccgaaggactatattccacagctgcttattgagatagacaggctgaaaaacattctcagcgtagagaagcgctaccagacgggcatgtcgaacaaaaagctgcaactattcaaacaggaaatcgaaggcaaaatcaatttcgcaaccaccattctgggtaatcaacatgtagacatccagcatatagagcaggcatatatagatgccacagctcctgaagatgactacctgtcaatgaactggcttgagatgccttacagcctgtga

SEQ ID NO: 8768 - RNA, 1026 nt, unidentified
  source 1..1026: mol_type = other RNA; note = synthetic construct
atgaagcgaaagaagcttaacaccatctacaagaagataacttccattaggttcatagagcaactgggatttctgactggtatctcaccccacattatggttctccagtcggttctgcctaaatacgacatgttttacgtcagaaaacgtacaggcggaaaaagactgatagagaaccctaacccaatcctgaagaatattcagcgcaagctcaacaagtatctgcaggtggtgtattatattcattgtcctcaaccatctcatgggtttgtgatcaatgtaaaacggggcaagaaaaaagggataattagcaacgccaaagtccatatcggcaatgactatatgctcaacatagatctgaaggacttcttctactacatcaagtacaacacagtgtacaaaatcttcaactctgacctgttcaatttcaatacgtatctcgtcaagatattggcggacttgtgctgtaaagacgaaaggcttcccatgggagctccaaccagtcccgtgttagccaacttagcatgcatcgatatggatctaaaactcgagagcatttgcaatagtttcgccattaagtacactagatatgctgatgatatgacattttccggcctcaatccgatccccgatcacttgattaagaagatctactctatcattgacgaatatggatttgtggtcaatgagaagaaggtcaaattgcgcgggatcaatgaccagaagaaggtgaccggcattatcgttggtgatggtctgagcctggccgaattcttttttgaggaaacccttatcgagatcagcaaactgaagacactgatggagctaaattacaggtatcgggggaacaaggacaaattagtgaacaaacacaagcagaagattgatgggtacatcaactacgcaacccaaatttatggcaaagacaatgagaaagtgcagcagctgattgatgagcttgacaaagctatgtcaatcgaagacttcatcgaaccaatgtcctgggatgattttccttatgtatga

SEQ ID NO: 8769 - RNA, 1032 nt, unidentified
  source 1..1032: mol_type = other RNA; note = synthetic construct
atgaaaaacagtgggatcacttaccaatctaacctgttccacgccctccagagaactgccgatttggagaaactgctgcatacggacatacccgggctcatccaattgttcagggagaagccatatcagtccttttacattcctaagaagaacggagggcgccggctgattgagaatcccaagccggtgctgaaagagatgctcaaacgcctgaatctgctcctccagtgtagttacctgcagtttcgaccgaagtgcgtgtatggatttaccatcaggaaaggcagcgagaaatcccgcaacattatcagtaacgctagacgacatgtaaggaaaaagtttctgctaaacatcgatctgaaagagttcttccattcagttaaggaaaatagagtgcggcaaatttttgaaagcaaactgggcaagaaagatcctttgctagttctgcttttgtccaagctggtgaccctcaatggtcgcttacctatgggctctcccaccagccctgtcatcagcaacctagctcttctggacaccgactgggaactggaggccctctgctctaacctccagttagagtacacccgtttcgcagatgatttatcattttcatcgaatcagcgtatcacaactaaggatatccagttgcttaagcaggtgataagataccacggcttcgagattaaccgggaaaaggtcaagctttacggacccgaagatacaaagtgggtaacggggcttatagtggaagagacagtcaaactgccaccagactacctcctgctgttggagaaagagatcttccggttcaaagaatttactcttctccaccacaagtataagtctggtgcggacgaggacaagataaagcttattcagagcgagatcaggggaaagtggaatttcgccaatatggtgattcccggcgacgaaaaattgatggaattacagctgcaaatggaatatgcattcaaccctgttgaggaatatgagtccacaaattggctggacatgccatatacctttttttga

SEQ ID NO: 8770 - RNA, 1011 nt, unidentified
  source 1..1011: mol_type = other RNA; note = synthetic construct
atgtacaccttcagcgagcaaaagagtgagctaaacacgacccaagtgacagccctcggcaagcgatttgagaacttgaggtcagtcgccgaattggccggtctgttaggcactacagaaccacttctgagtaggcagatggcaaggcccgtatactataccttctacatacccaagcccgggggacagaagcgactcatccagcatcctgccccggccctgaagatcgtacagcaaagcttgaaccgctatctgcaagctatgtactatggggttaagcctgattgcgcttatgggttcattctgtccccttctgacgaattgcgcccaagaaatatctactccaatgcactcgcccacctgaaaggtgagtggttcctcctgttcgacctgaaagacttttttcatacagtgaccctgacgcacttacgggacctgtttagaaacgtcctcttttttcccccagagttgtgtaacgcgctttgccagctctgtgcctaccagggtcgcctccctatgggagctccaacatcaccggtgttgagtaatctttgctgtctgttctttgactaccagctggagaggctagctgcgggtgcacaagcagtgtatactagatatgctgacgatcttaccttctcctttagaagcgaacctccctcaggcttcgcagatgaagtgcgcatggtcgttctgaggcatggattcgcggtgaatgagtctaaagtccgtctgcagagccggccagagcagccagagattactggcctggttttaggcaaaaatgccctgcccgtgcctggcaagaactggcttaagtcgctgaaacaggaaatcaagatctacacttggcttatgtctgaggccgtgcgagaaaggggactattccacgcttgggtttttgatcggttcagacgttccgtccaggggcagattgagtttctcgggttcatactcgggaaagatcaccgcgaatatcggaagctggcaggaaaagtgcggtggggctga

SEQ ID NO: 8771 - RNA, 1005 nt, unidentified
  source 1..1005: mol_type = other RNA; note = synthetic construct
atgtacactttctctgagcagaagtcagcccttcataccacacagctcgctaccctgggccaacgttttgaggccttgaacgatgtgcaaggactggccaaactgttgtccgtgagcgaggcggttatagcgaagcacgtggataagcctgtatatcacagttttcacattcctaaaccaggaggcaggaaacggctgatccagcaccccaccgctgcactcaaggccatacagcaggttctaaaccactatttgcatgcggtttacttcggagtgaaacctgattctgcttacggtttcatccttagtccggtcgacgaactgcgtccccggaatatttactctaatgccctcgcccatagcaagggagaatggttcctttcgtttgacctgcaggatttttttcacacagtgacgctcacacagctgagagatttattccggcgcgtattcttttttccccccgaattgaccgccgcccttactggcctgtgtacttaccagggccgccttccaatgggtgcaccgtccagtcctgtgctctccaacttgtgttgcctgtttttcgacttccagctcgaacaactggctgcatcagccaaagctgtttatacaaggtatgccgatgacctcaccttctcctgccggcaagctccacccccagaattcggcgaccaggtgcggcaagtcgtgctgagacatggttttgtcgtcaatgagagcaaggtgaggctgcagactagactggagcagcccgagattacgggtctggtcctcgggaagaaggtgctgcctgtcccaggcaaggcctggttaaaaagactaaaacaggagatcaagatgtaccgctggttgatgtcagaggctgttcgcgagagagggctattccatgcatgggtgttcgacaggttcaggcagagcgtggcagggcaggtcgaatttgtaggctttatcctggggaaagaccacggagaatatcgaaagttagcagggatggtgcgatga

SEQ ID NO: 8772 - RNA, 1011 nt, unidentified
  source 1..1011: mol_type = other RNA; note = synthetic construct
atgtacgcttacctccctcctaagagtgatctgaccaccctgcagctgaaagctctggcacagcggtttgaggctctcacagacgtgcccggtctggccaaacttctcgggattaccgaaaatagtctgactaaggctgccgccaagcaggattatttatccttttatgtccccaagccgggaggggagaagcggttgatccagcatccagcatctgcattaaaaatgctgcaacagacactgaatgggtacctgcaagcggtctatcacggaatccgtccagactgtgcctacggcttcatactgagccccgccgatgaactgcagcctcggaatatatacttcaacgcaatgcgacacattaagaatgaatggttcctgttggtagatctgaaggacttctttcacaccgtcacgaagacccatttgaagaacctgttccggcacctcttcttctttccgccagatttgacatctgtactcactgacctttgctcctgtcaaggccgcctacctatgggcgcgccaacttccccagtgcttagcaactttgcttgcctcggcatggaccatcagatggaaaaacttgccgagacgcacagggctgtgtatacaagatacgcggacgatctcacattctcattctctactccccctcccgccgatttcctggagagcgttcgcgccatcgtgctgtttcatggatttgtcgtaaacgacaaaaaagtgaggttgcagtccagactagagcaacctgagattaccggattagttatcgggaagggtagcaaaccagtgcccgggaaagaatggctgaagcaccttcgtcaggagatcaaaatttacaggtggctcatgtcggaagccgtgcgagagagaggcctctttcacgcctttgtctttgacagattcaagaagtcagtgcttggccaggttgaatttgtgggtttcgtgttggggaagggtcataaggagtatcgcaaactagcaggaaaagttaggtggggctga

SEQ ID NO: 8773 - RNA, 1011 nt, unidentified
  source 1..1011: mol_type = other RNA; note = synthetic construct
atgtattacttccagcaatttaaaagcgagctctcgacagcccagctccgaactctgtcaagtagattcgaggctctggaaagcgtaaaggatttaagcgtgcttcttaagaaggagacgcccgcactgatgaaaatggccgagtccccttcttatcaggagttttatattccgaaaccaggcggggaaaagaggttcatacagcacccggcaccaaccttgaaggccgtgcagcaggagctgaatcggtatctccaggccgtttactatggtattagacccccctgcgtgcacggattcgtcgttagtccaggggatgagtcccaaccccgaaacatctatactaatgcgctggcccacacccggggtcattggttcctgaacatcgatctcaaggacttctttcacactgttactgcccagcatgtgttcgacctgtggaggcacattttttggttccctgagcacctgagcacactgctagcctgtctctgctgttatggagggcgtttgcccatgggtgccccaacctcaccagtgcttagtaacttggtattttacgaactcgacgggcagttactccaactagcgcggtcttccgacgctatttacacacggtacgctgatgacttaacattttcttttcccaggcctcctgcagacgattttacggaccgcgtgcgccatctgctccttacccatggcttcaccgtgaatgagaagaaagtccgcctacaggggagattggagcagcctgaaatcactggcctggtcgtcggccatggagctaaaccagtactgtcaaaatcctacctgaagacacttaaaaaggaagttgtgatctaccgctggctgatcagcgaagcagtgcagaagagagggttctttcagcaatggttgtttgaccagttcaggaaatctatcaccggccagatagaatttgcaggtttcgtcctgggaaaaggcgatagagtgtaccaaaggctggctggaaagatgcgttggggctga

SEQ ID NO: 8774 - RNA, 1002 nt, unidentified
  source 1..1002: mol_type = other RNA; note = synthetic construct
atgtatgatatcgctccgccttcacttgaacttaccctagctcaaatggatgccaaggccgcccgcttcctcgctattaagcaccccggggaattagcaggtcttctgaaggctgacgccgcgctccttgccaaattcgcagccaaacctcactacgcagtgttttcaattcccaaacccggcggagctaaacgcataattcataacccacatcctgatctaaagaccatacagcagtctctgaacctctacctgcagtgtgcctattgccaattgatgccaccatgcgcgttcggttttatccctagaccgacagatgagccccggccaaggaacatttataccaatgccctcgtgcacttcggatcccagtgggtgctcaatttggatctgaaggactacttccataccgttacatcgagacacctgacatgggtcttccgggaactctttggattccccgaggccctagctaaccagcttatcgctctggcatcctaccgaggcgtgttaccgatgggagctcctacgtcccctgtactgagcaatctggccgccttgcccctcgatcaggagctgcagcctttcgcgaatttactggacgcagcttatacgcggttcgtcgacgacctcacattttcttttgacactcagcccactcccgaagtaatcgccgcaattcgacagaaggtggaaaagcaccattttatccttaacgagacaaagatacggttgactgcaaaaaaagacaatcctgaggtcaccggcttgatcctcaagagtccacacccagacgtcagtggcagcttcctgaagaagctgaaaaaggacatccgcctgtacagaaggctgaccactccagggatgatgcaaagggggatctttcatgcctctgtgctggataagctgcgtaggagcattgcgggccaggttcaatttgtcaaatttattcgcgggagagtggagaagggtctgaaacgttgggagaaagtggttggctga

SEQ ID NO: 8775 - RNA, 1002 nt, unidentified
  source 1..1002: mol_type = other RNA; note = synthetic construct
atgtacacaatttatcctccctcattagatcttacattggcacagtccgacgcaaaagccgcccggtttctcgccattaaacaccctggcgagctggcttccttgctgaaggccgatgcggccaagctcgccaagttcgttgctaagccatactaccaggtgtttagcattcccaaaccaggcggagcacggcggatcatccataacccccatagtgacctgaagacaattcagcaaaccctgaacatgtatttgcagtgtgcctattaccagcttaagcccccttgcgcctatggattcatccctaggccaaccgacgagcccaaaccaagaaacatttttacaaacgcaatgacccacctgggcagcgaatgggtacttaatctcgacctgaaagattacttccacacagtcacgtccagacatttgacgtgggtgttccgtgagctgttcgggttcccagaagcgctggctaatcagcttttggctctggtgagttatcgtggcgttttacccatgggggctcccacttcgcctgtgctatctaatctggcagctcttcccctcgacgctgacctgcagtcatttgccaatctgctggatgctctgtacacccgctttgttgatgacatgactttcagccttgaacagcagccaactccggaggtgatcgcggccctgaggcaaaccgtcgagaaacaccaattcactctgaatgagactaagatcagactgacagcaaagaaagatcacccggaagtaaccggtttattgctcaaggagccacatcctgacgtgtctgagcactttctaaaacggctaaagaaagacatccgactctaccaaaagctgaccgaacgcagcatgatggagaggggaatatttcatgcaaacgtcctcgataagctccgacgctctatcgccgggcaggtccagtttgtcaaattcatacgcggcagggtggaaagagaactcaaggtgtgggagtgggcccctggttga

SEQ ID NO: 8776 - RNA, 999 nt, unidentified
  source 1..999: mol_type = other RNA; note = synthetic construct
atgtatggggtgattccacaggcccttgaactgacgctggcacaattggacatcaaggcaaataagttccgcgcactgaggcaccctggtgacttagcagggctgctcaaagctgacgccgcccagctggctaagttcgccgctaaaccacactaccaggtcttccatatccccaaacctggcggcgaccgtaggacaatccataatcctcaagctgagttgaagacaattcaacaaaacctcaacgtttttcttcaggccgcgtattacgggatcaaaccgccctgtgcttacggcttcatacctcggccaaccgacgagccacgcccaagaaacatctatacgaatgccttggtccatgaaggaagcgaatgggtgctgaaccttgatatgaaggactatttccatactgtgacctctagacacctcaattggatctttaaggagctctttgaattgcctgaggcactgtcacttcatttaattggtctatgcacatacaagggcgtgctgcccatgggagctcctaccagccctgtattgtcaaatctggccgcactgccactggatgcggaactgcagggaatagctgcacagtataacgccctctacactcgctatgtggacgatctaacctttagtttcgatgccgaacccgacatcctctttaccggcgtggttagggaggctgtcgaacgacacggattcatgctgaacgagtccaaaataaaactcactagaaaacgggaccaccccgagatcacagggctcattctgaagccccccaagccggatgtatccaaaactttcctgaaacacctgaagaaggacatcaagctgtaccgggagctgatttctgccgatatgatgcaccgaggtatttttcacgccagtgttcttgagaagttgaaaaaaagcattgatgggcagctacagtttttagcattcataagaggcaagcaggataaggcttacctcaggtgggccgcgcttgcctga

SEQ ID NO: 8777 - RNA, 1029 nt, unidentified
  source 1..1029: mol_type = other RNA; note = synthetic construct
atgcagtacttcaggcagagcttcaaaaagctgacttcacagcaagttctggccaaggggcaactacttgtcaaagcccgaaccgtgaaagccatcgctgccctgaccatgacagaggagacttggatgagagaacaggctgtgaacccgcaatactatgccttccaggcccctaaagccaatggtactttcaggcttattgagaatccccatcccaagctcaaggagtttcagagggcactggcagacatgctgcagggcgtatactacggaatccgcccaagggcgtcatacgcttttgtaccatctaccgccgatgaaacttctccctgcaacatatatacaaatgccctgaggcattgtaagagcaagtggatattgcagctggacttgaaggattttttccactccatttcggcccatcgtatcaaagagctgtttatgcggattccctttgaatacccagaggatacagctcaggtggttgctcgcttggtgacatccaagaacagactgcctatgggggcaccaaccagtccggtgctctcaaaccttatctgctttgaacttgaccacttacttgacaaactctctagagatcacgggtggacatatacccgatatgcagacgacatgacgtttagtggcgcaaagcggttcagtaacgagagcgtggagatcatcagacagcagatcgagggaaatgacttcgtgctcaattatgaaaagactcagcagcaccgcattgaggacgagcctgaagtctgtggattagcgttaaaagaggacggaaaacccgatctctccaatatgttcgtcaaggatctgaaggctgatataaagacctataaacaactcacgtccgacaagatgatcgctcaggaaattttcagcgctgaggcactgaaccggttccggcaacacattgaaggtgaactggcgtttgttcgctttattaaaggccctaataacgggttgtacctgaaactacgtttcatgctggccgatggcatgctcggcgtcgaatga

SEQ ID NO: 8778 - RNA, 1029 nt, unidentified
  source 1..1029: mol_type = other RNA; note = synthetic construct
atgcagtattttcggcagccgtttaagcagctgactgcacagcaggtgctaaccaaaggacagttcctgcttaaagctcaaactgtgaaagctatcggttctcttctactttgcgaggaagcctggatgagagaacaagccgcaaatccccagtactatgccttccaggcccccaaggctaacggcgctttcaggctgattgaaaatcctcatcctaaactgaaggattgtcaacggctgctcgctgatctcttacagggcgtgtattacggaattaaaccgcgagctagctatgcctttatcccttcaacagcggatgagactagtccctctaacatatacacaaacgccctccgtcattgtcaaagcaagtgggttttgcagctggacttgaaagatttttttcacagcatctccgcccagcgaattaaggaaatgttcctggcgatcccattcaattatcccgaagacacagcccttgtaatggcacgcctcgttacctccaaaaatcgcttacccatgggagctccaagttctcctgtcctgtcaaacttagtctgcatagacatggaccaccaactggataagcttgcgagagatcagggatggacatatacccggtacgcagacgatatcacgttctcgggtgagcgccggtttaccaacgagactgtggagttgattagacagcagatagagggcaatgacttcgtgctcaactacgaaaagacagccctcaacaggaccgaagacgagccagagatctgcggcttggccgtaaaaccaggcggcaaacctgatctgagcgagcgtttcgttaaggacctgaaaacggacatcaagatttacaaggtgctcacctccgataagatgatcgcacaggaggtcttttccgcagaagctattaatcgcttcaggcaacatattgagggggaattgtcatttgtgaggttcatcaaggggccacaccacgggctgtacctgaagctgagatttatgctggccgacggtatgatgggggtcgagtga

SEQ ID NO: 8779 - RNA, 1029 nt, unidentified
  source 1..1029: mol_type = other RNA; note = synthetic construct
atgctgtactttcgacagccctcaaaaaagctgacgacacaggagctgctcaccaaaggacagttccttctgaaggctcgaacactgaaggctatcggcgctttgctgatgtgcgacgattcatggatcagagagcaggctgcatctccgcagtattacagcttccaagcgccaaagagttctggggcttttaggctaatcgaaaacccccatccaaaactgaaagaatgtcagcggctgttggccgacctcttacagggagtgtactatggcattcgccctcgtagcgcctatgcgttcgttcctaccactgcggacgagagctcaccatgcaacatctacacaaacgccttgcgtcactgtcggtccaagtgggtccttcaactggatctgaaagatttctttcacagcataagcgcacacaggattaaaacaatgttttgcgcacttccctttaattaccctgaggacatcgcccaagtgctggccaaactcctcacctcaaagaacaggttaccgatcggggcacccactagccccgtagtgtctaatctggtttgtattgaactcgaccaccagctggataagttggccagagactacggttggacctacacacgctatgccgacgatattactttcagtggggagaaacggtttaagaatgagactgtcgaacatgtgagacaacacatagagtccaacggtttcgtcctgaattttgaaaagaccgctatttcgaggacccaggatgaacccgagatctgcggactagctatacgccctgaggggaaacctgacttgtcctctcggtttattaaggatctgaagatggacatccgcatttataagacgctgtccagtgacaaaatgatcgcacaggatctattcccagccgaagccatcaacagattccggcagcatatagagggcgagttatccttcgtgagattcattaagggccctaatcatggactctatctcaagcttaggtacatgctcgcagatggccttccaagtgccgaatga

SEQ ID NO: 8780 - RNA, 1038 nt, unidentified
  source 1..1038: mol_type = other RNA; note = synthetic construct
atgagcacgccggagtatcatcagttaactccagccaccgtcaagttgagcacgcaccaggttgcagcccgagcacggacattcctgagtcagcctcatctgggccagatggctcacctgctagggctggataagaatcagctcgtgcttctctcgaagtctcctcggtatgactgcttttttatccctaagccaaaggggggaaaacggttgatcgaggcgcccagagagcccctgaagggtacccagcaaagattggccaagtggctccaatgcgtgtactttgtccatagatccgaggcagcttttggctttatgatggtccctgtggacgacgaggatccccgccacatctacacccacgcacaacgtcacagggaagccacatggcttcttaacatcgacttgaaagatttcttccaccaaatcccggctgatcgagtgctgaggcttttccaacaggcgcccttcggcctaactcccaaagctgcagcttgtctgactggcctttgtacattccagggccggctgcctatgggagctccaagcagtccagtactatccaactttgcctgccgtgacctggatgcagaactggaagcgctcgctcgcagagaaggctgggtatataccaggtacgcagacgacttaacattctcaggaccaaaaccgtttactcaggcccattgggagtctatttcaggtttgataggggccgccgggttcaaaatgaataccaagaagatgagactgcgccacagaaaggacaagcccgaagtgaccgggctcattctgaaaaagaatccagatgtgtctcccgatttcctggccggaatcgaggccgatctcctggtgctcgaggctctcgtttcagaacggatgctgcttagggatattttcagtcggcagcctgttaaacgcctccgtaggagcattcagggacagataaactttctgaaagccatccgaggtaaagaccataaatcctgtcgcaaattacagaacaggttggaccagtccgtcattaagctgaagtga

SEQ ID NO: 8781 - RNA, 1023 nt, unidentified
  source 1..1023: mol_type = other RNA; note = synthetic construct
atgtatctgaaaatcagcacacagaccggggacaagccatcggcatacgaacttcaggaaaaaggtaggcagtttatagccgctgacacttttcccgcccttgcagagctcctgaatattaaagaggaaactcttcgggccaagatgtataaccggaaatacacccaattcttcgtgccgaaacccaacggcgagaagcggcttattgagaatccagaggattggttaaagtctcttcaaggacagctgaataagcattttcaggccgcatactatatggtccgaccaccttgcgcatatggggctttactagccgtggcagacgaggtgaaaccaagaaatatttataccaacgcgctcaggcacatcggtcaaaagtggttgttgaacgtggacattcgcaggttttttcccagcatatcctacgagaaggtttacatgacactccgcagaccccccttctcttttaaccccaacgccgctaaatgtctgagtatgctcacgacattcgaacagagactgcctaccggcgctcccacttcccctatactctcaaatatcatatgcctgccgctcgactcaatgctcctgcagctgtctaaaaaacatggttgggcttatacccgctttattgacgatctgtcctttagcggagagaataagttcaagaaaaagcatctgagggccatccagggcatcctgctgagccaagggttccttatcaacgagaagaagctgaagattaaccgagtcagagataagccagaagtaacgggcctgattctgaagaagaaaaaacctgacatttcccctagtttcctaaagcgtctcaaaaagtacatccacctgtaccacattatgacagaacaggatatgttgaatcgtcagctattccctgccgaattgatccagcgctaccggaattttatcaacggccaattagcgttcatcaagttcatcaggggagagggggataaagattacttgagactgttcaaacggtttcagccacgaggatattga

SEQ ID NO: 8782 - RNA, 1035 nt, unidentified
  source 1..1035: mol_type = other RNA; note = synthetic construct
atgaaaagaggaaagactcgggggtaccagaagaacgccgctaattttttggggattcgaacacatatggaattagccaatctgctggggatcagtctgtctcagcttgaagtgctaattaacaagcccacctacaaagagtacactatccggaagaaaagacatggtgtacgaatcatatacgacccttcccctatgttgaaggccgtgctgaaacagttgagcttcttcctgaatgctgtctacagcaccctgcagaatgactgcgtctatggattcatcccacacctcgataagaccggcccccagaagaatatccgggagaacgccatcaagcacgtaggcaaaaatcatctgttcagcctcgaccttaaagattttttccacagcatttccacaaagcgggtgttccaaatttttcaggaagaaccctttaacttctataagtcaatagccgtccctctagcactgcttaccacctatcgcaagagcctgccaatgggtgctaatacatctccaattttgtcaaactttgcctgtttagagctcgatgcggagcttagtaggctggcgagtcgctctgacctcgagtacactcgttatgcagacgacctgacattctcttccgacttgcccttcaccgatcagctcaaatccgatatcagagagatcatacaaaaacacggattccaaattaacgagaaaaaagtgcgggaacgcagcaagaacagaaggcaagtggtgacgggaattaaggtcaacaccaagccgaaccttgaccgtaaatatattaggaatctgagggcattactgtttgattggcgcattaatggtatctataaggctgttatccatcactacaacctagacggaatcccaacgtttcagcagataactcactttctctcatcaacacgaggcagaatctcctttgttggctttgttaggggcaaagaagatcctatataccagaagctccaggtggagttcgagcgcctgactacattccatgggcacaaggaactgtcgggctga

SEQ ID NO: 8783 - RNA, 1089 nt, unidentified
  source 1..1089: mol_type = other RNA; note = synthetic construct
atgaaagatatacagcagacagccattgagtttaactctgaaatatccaatggagcctttgagacaacactagtaaataagaagcagtttaccagaacccaaaagaaggccttagagcttctcagaatcgagtctgatcaggaccttatcctgttcagcggcgtttcagcaaatgctctgctccgaaacattaacgcccctgtctattccgagaaaaacatccggaagaaaaatggcggatttcgctctctggacattcccgagaagtctcttaaactgctgcaggaaaagctgaatgatcatctgcaaagtgtgtacacatacctgaggccccagacaacgcacggatttgtgagatatcctaatcggaagtcctgtaacattttgaaaaacgccagcgtgcacaccagcaaaaactatgtcctgaatatggatctgaaggattttttccacagtgtaaatgctctgcgcgtgaaacatgtgttccagaacagcccattcaagtttaatgaacacctctccaactgtctggctttgcttacaacctacaaagggaggttgccccaaggtgcgcctagctctccagtgctctcgaatttcgccgcactgagcctagactacaaaatatgcaaactgtgcaagacttatgcgatcgactacagccgatacgctgatgacctcaccttcagttcccagtcatttatgccggaagcgttcaagaatgagttaaataacctcatcgaaaaggaggggttccacgtcaatgccgataaaaccagattacggagtaaaaaccgcaagcagctggtgaccggcgttgtggtcaaccacaaagctaacgttgatcggacctatgtgcgtaagctacgcgctatgatcttcgactcggaaatcaacggcctcccctccgcagcagcaaagcatttgaacttgactactaagcctactacggaccatatttcattttttgttcggaggcttaacgggatgctggccttcatgtcacaaattaggggtaaggacgacgccttgactctcaagatgaaaaaccgtttccttaatgtcctgtctatcccactcaatcagtga

SEQ ID NO: 8784 - RNA, 1137 nt, unidentified
  source 1..1137: mol_type = other RNA; note = synthetic construct
atgataactattgaagagattctcaccctatctaagacaaataagtcagagcttcagaaatacttcagtggtggctcctaccacttggacaaaagcatggaatcttttcagaagcatgagctcaacgccctctatttcttgagcattgaggaacccaaggagctcacccggttttttaaaacctccttttttcagcttgaggagatcttgaataatcctctgtacaagaactacaccattaagaaaaagagaggcggggccagacaaatctgtgagcctgaaaagcatctgaaaagtattcaaaaacggctcaactatttcttgcaggcatattatctttggatcaagcctaatgaagtgcacgggtttgttgtaaatccccattatctcggaatccactgtaacattgttgaaaatgccaaggtgcacgtgaacaaaaaggatgtgcttaacattgacctgaaagactttttcccgtcgattagcgcccagcaggtgaagaacatcttttccagcaattacttcaacttcaacgagcagatttcaactgcactgactctgttaactacatacgagggaaagctaccaattggtgctcccacatccccagttatcagcaatttcatttgccaccaactcgataatgatctgataaccttttgcaagcagaacaatctgacatttactcgctacgcggatgacttaaccttcagctctgacaacaccatctctgacgataacaccctgaatatattcgacctgatcaagaagaaccagttcgaaataaacgagaaaaaagtcaggttgaagcgatctcacaggaaacagacggtcacaggcctgacagtgaactcaaaagtgaatgtcgaccgcaagctgctgaagaaaatacgcgctatgctgcatgatctggtaaagaacggaatagaaacgagtgtcaaaaagcatttcaatatcggcaatatcgaacaacgtcacaaggtgatcttcatcaatcggcttaaaggctatatcaactttgtcggacaagtgagggggaagaacgactcattatacctgaaacagaagtccactttcaacaatatcctcatcagctccaaggggaaaagtctagagattgatatgaaacaggcttga

SEQ ID NO: 8785 - RNA, 1305 nt, unidentified
  source 1..1305: mol_type = other RNA; note = synthetic construct
atgagtaatatttacaacatcgcagtggtgttcctccagcctaaatctagttgcaagcaagaaaatatcgcgatctactgtgatgcgcattgtgtgccactgttaatcaactctaaaaagaccaaggataacctgcagcgtctctttctgaacaaaaatcgcatgactgtaccagagattcagcagctggtgcagaggcacaagaaggaatttaaaaagtacttctcggacgacttttatctgacgaatctggcccttcaggatttcaaaaagcatgaattaaacgctctgtgtctgctgagcattgaggaacccttcgaattggccaaattcctgaccactccgatctatcacctggaagagctgcttaataatcccccatacaaacatttcacaatacagaagaagagaggcggaaccaggcaaatcttcgcccctgaaaacagcctcaagggaatacaaaagcggttgaattatttcttgcaggcatattacctctggctgaagccacatcacgtgcacggatttgtcattaatccgcactaccttggcacatcatgcaatatcgtggagaatgctaaggttcatgtctctaagaatttcgttctgaacattgacttgaaagacttttttcactccattaccgctaatcaagtcaaggatatcttttcaagccacttcttcaacttttctgaacccatcgccatcgcactcaccttgctcaccacgtataaggggaaactgcctataggcgcccctacatcccccgtgctatcaaactttatatgccatgagttagatgatgacttactccgctttagtgctgagaatgatcttacattcacacgatacgccgacgacctcacttttagctccaacttcaaaatttcccatgatatcactctggacatcatcaacctcattaagaagaacttcttcgagatcaatagcaaaaaaatccacctcaaaacccaaaaccgaaaacagattgtcactggtctgaccgtgaatcagaaggtcaacgttgacaaaaagctactgaaaaagataagagcaatgctacatgatgtttccattaatggcattgagaaagccgcccagagacactttaaactgaacaagatcgacaaacggtacagctcacagtttatgaaccggctagagggctatatcaactttgtggggcaggtgagggggaaaggtgatacattggtactgaagtttaaggaagagttcaagcttatattcgagattgagattcacaaggaaagtaacaaaaagcttgacgagaacaatatcaagtga

SEQ ID NO: 8786 - RNA, 1131 nt, unidentified
  source 1..1131: mol_type = other RNA; note = synthetic construct
atgccgaccatcgaggagatcgtgaccttttcgaaagcccataagtctaatatccagaagtacttcaacggagggcatccctactccaccctgccaaaacttgtgcagaaaattaagaagcacgaacgaaacgcactgttcctgctgtctacagaaacccccaccgaactgtgcactttcttgaaaactcccttcttccagctggaggagatcataaacaatccaatctacaagcagtatgagattaagaagaagcggggcgggaatcggcagatctacagtcctgagaaaaagctgaaagcaattcagaggcgactgaattatttcttacaggcctactacctctggattagaccgaatgaagtgtttggattcgtggtgaaccctcactatcaagggaccttctgtaatatagttgaaaacgcaaaacctcacactggcaagaagcatatcctgaatatggacctgaaggacttttttcccagcataagcgccagtagaattaaaagtgtgtttgcatcctcctattttaacttctcagagcaaattgccactgcgttagctctcctgaccacgtatgagggaaagctgccaatcggcgctccaacatcccctgtaatcagcaacttcgtttgtttccagctcgacgctgatctaaagaatttttgcgagactaccggactgcagttcacgaggtatgccgatgatctcacctttagcagcaatctgctcatttctaatgagacagtcctcgacattatcaacttgattaagaagaacggtttcgaaattaacgaaaagaagcttcgcttgaaatcttccaataggaaacaaacagttacagggcttaccgtcaatgagcgcgtcaacatcgaccgtaaacttttgaagaaagtccgggccatgctacacgatttaactacaaacggtatagacgtggcggctaagaggcactttaactggtcaggcgagacggatgcaaaacagcgctcaaaatttatccatcggctcgaaggctacatccactttgtgggccaagtcagaggtaagaacgacgctgtatacactaaacttaagcagcccttggataaattttcagccacacagcaaagagccgaacagatgtggtga

SEQ ID NO: 8787 - RNA, 1119 nt, unidentified
  source 1..1119: mol_type = other RNA; note = synthetic construct
atgccaatcgtgaaggaaattcttaccttcagtaaggaccataagtcaaagatccaaaagtatttcaacggcggctacctttattccaaaacaccgaagctactgcaagagaagaagaaacacgaactcaatgcactgttcttgcacacaatcgaaaccccagctgagctatgcaagttcctgaacacatctttctttgagctggaggaactcattaacaatcccgtttacaagaattacaccatccggaaaaaaaaggggggcgagaggcagatttacagccccgaaaaaaaactcaaggctattcaacgccggcttaactacttcttgcaggcctattatctgtgtattaaacctaacgaggtctttggatttgtcgtgaacccccactacttaggtaattattgcaatattgccgagaacgccaagccacatactgggaaaaagcaccttctcaatattgacctgaaggacttttttcctagcatctccgcaagccgaatcaaatccgttttcacctcaagttactttaatttcagtgagcagatcgctactgctctgacattgctgactacctatgagggcaaactcccaattggaacccctactagccctgtgatctctaattttgtctgtttccagctggatgccgacctcaaaaatttttgtaaaactaacggactgcagttcacaaggtacgccgacgatctgacctttagctccgatacccttatctccatagatatcgttctggatatcataaacctgatcaagaagaactcttttgaaatcaacgagaaaaagttgcgtctgaaatcatcgaatagaaaacagactgtcacgggcctcacggtgaatgagaaagtgaacgtagatcgaaagctgctcaaaaagattcgggcgatgctgcatgatttgacgacaaacggtatagacattgccaccaagagacactttaacttaaacggtgaaattgacaccaaacatagggggaagtttatcaatcgcctagaagggtatataaacttcgtgggacaggtgagaggcaagaatgacaccgtgtacataaagttaaaacagcccttcgacaaggtattctctaatactgcaacatgctga

SEQ ID NO: 8788 - RNA, 1101 nt, unidentified
  source 1..1101: mol_type = other RNA; note = synthetic construct
atgacaaataccagtaccatcattgaatttgcacgacgaaataagggcgtgctgcagaaccaccttgctgacggttccttaaggctccccgtggccttagagatcctggagaaacaccaattgaacgcattgtatctcttgtcgatagaaacccccatagatttgtgttccttttttaagtccggtttactgcagctggagtctataatcaacaatccgcagtacacccattatacaattaagaagaagcgcggaggaaacagacacatttatgcccccaacaaaaagttgaaagccattcaaaaacggctaaactacttccttcaggcgtactatctgatgattaagccagaggaagtccatggcttcgtcgtaaacccacattatctcgggagccactgcaatatcgtagagaatgcgaaagcccatacggggaaaaagcaccttctcaatatcgatctgaaggacttcttccctaggatcactgccaaacaagtcctcgatctcttcagcagccctgtttttggatatagcgaccaggttgcaaccgctatcaccctgctttgtacgtacgaagggcgtcttcccgctggagccccttctagtcctgtgatttctaacttcatttgcctgaatctggacgcagatctgaaagccttttgcgctacccacaatctggaatacactagatatgctgatgatctgacatttagctcaaacgccgcgattgagactaacacactactagacatcatcagtctgatccagaagaacaatttcgagatcaattccaacaaactccgcataagaccagccaaccggcgccaaattgtgactggactgaccgtcaatgaaaaagtgaatgtgaaccggaagatgctcaaaaagatccgggctatgctgcacgacctttcaactaacggcgtggagactgccacaagaaagcatttcaaaatatcaggcaaggcaaagccattccaggagggcaagtttctgcagaggctcgagggttacatcaatttcatcgggcaggttagggggaagacagacgcactgtacattggctacaaagaacagtttgaacaggcttttgagaattga

SEQ ID NO: 8789 - RNA, 1071 nt, unidentified
  source 1..1071: mol_type = other RNA; note = synthetic construct
atgatccagaaatatcatttcgagggcttatacctgaataatatcgtgctgcaacagtttacccgacatgagctgaacgcactgttcattctgactgttaaaaagcctctagagctggtaaaaatcttcaacgtgagtttttgtatgctcgaggagcagataaaccacccagcttaccgctattttacgcttcccaaaaagaatggaggttctagggacatctacgccccctccgtgaaactcaagtcgatccagcaatgtctgaactactatttccaggcctactatttgttcattaagccagaggaggtgcacgggttcgtcataaatccccattatcttgggaaacgctgcaacatcgccgaaaatgcgaaagctcacgttaagaagaaatatgtgcttaacattgacctgcaggacttttttcctaatatcaaggctaagcgagttaaggaaacatttctgagtcccgtgttcaattttaatgaacagatcgcaactgccttgacattgctaacaacatacaagggcctgcttcctgccggtgcacctactagcccggtgatctcaaacttcatttgcctgaaactcgacaaagagctcaagtatttctccgaactcaacgatctgacttacacccggtacgccgatgacctgaccttttcaagcaaccatgagatcccaggcgacatgattctcgacattatctgtattatacaccggaacgatttccggatcaacgaaaagaaattaaggctcaaaccatccaacagaaagcagacagtcaccgggataacagtcaatcaaaaggtaaatgtggacagaaaactgctcaagaagactagggcgatgattcacgatctaggcacccatgggctgtatgccgcaacctctagacactttaaagtggctgaagataagaacagctctcttaatgccaagttcattagaaggctgcaaggatacattaattttatcggacaggtccgcggccgtgatgacgctgtctacttgaaattgaagaccacgtacctgagcttattctcctttcagaccgaagatttctgctga

SEQ ID NO: 8790 - RNA, 1116 nt, unidentified
  source 1..1116: mol_type = other RNA; note = synthetic construct
atgaactcacaggaagaaatcctctcgattctaattcccgcaaaggataagatctggaattctttttatgggatacccatccggaagaaatctaagcaacttgagcagttaaagaagcatgaactgaatgcgctgctgctcctgaccattaataaaccgagtcgcttggcacagttcctaagcactcccttctttgaacttgagggcatcatcaataaccctaattacaggcactataccatcccaaagaaaaaaggcggcatgagagagatctacgcgccagcaaactctctcaaaaaaattcaacgaaggctgaactatttcttgcaggcctactacttgtgcattaagccaaaggaggtgcacggattcgtggtaaatcccgcttatttgggaaagaaatgcaatattgtcgccaatgctaggctccacataggcaaaagccatgtcctgaatatcgacgtgaaggattttttcccttctatatcagccaaacaggtcaagggtatcttttctagccacctgtttaacttcaatgaccagatctccaacgccctgacacttctcactacatttgaaggaagattaccagctggcgcccctacttcccctgtcatttccaatttcgtgtgtaccaagttggatagtgatctgattgaattctgttccttaaacagtctttcatactcccggtatgctgatgatctgaccttctcaagcaataacgttatcgataacgacattatccttgacctcataaatatcatcaacgccaacaacttcaagattaacgacaagaaactgcgcctcaaggctagcaataggaaacagacagtgaccgggctgaccgtgaacgagaaggtaaatgttgatcgcaaactgttgaagaaaattcgtgcaatgctgcatgacctcacaacgaacggtatcgataaagccgccaaacaccattttaacattaacaaggacatcgacgagaagctgagaggcaaatttatataccgactagaggggtacattaattttgttggtcaagtgcggggaaaaaaggaccttctgtatgtcgggctgaagtccaagtttgacaacgagttcaaagtgataccgctcagctga

SEQ ID NO: 8791 - RNA, 1107 nt, unidentified
  source 1..1107: mol_type = other RNA; note = synthetic construct
atgaactcccctgaggagctgatctacctagccaggaataagaaatggttagtttggaaggacaacttccttgaactcgccgggaaagacttggcactgcacaagttcaagaaatatgaactggttgctctgcgcctcctgagcatcgaaaccgctagcaacctggtaaaactcgctagcgtgtcactggatacgcttcagaacaaccttaatcatcccgagtacaagcattatcagacaaagaaaaagaagggcggctctcgcctaataaatgccccgacaggcgaactcaagaagatccagaagcggctgaacaattatctgcaggcgtactacctctgtctcaaacctaaagaggtgcacggatttgtcttactggctccattgattcagcaacgctccaatatcgtggccaacgcagaggtgcatgtgggtaaaaagtttgtgctgaatctggacttgaaagattttttcccctctatcaccgccaaaagagtcaaagctttctttatgagccccttgttcaactataacgaacaaattgcaaacgcgctaactcttctttgcaccttccagggaaaacttccaattggggcccctacttccccagtcatatccaactttatttgtttgaagctcgatgctgatctacagaatttttgcgcagccaacgaactcaattatagtaggtacgccgatgacctgagtttcagctcgaattcatctatatccaatgacacaattctcgacctgatcaatctgattaccaagaacgacttcacggtgaactacaagaaactgagactgaagtcaagtaataaacggcagacagtgaccggcattactgtcaatgagaaggttaacgttaaccgagtgttacttaagaagattagggcaatgctgcacgatctgacatctaatgggttggaggtcgccactcacaaacacttcaaatttaacgggttcgtagaccagaagtataaggaacgatttttattccggttgaagggatacatcaattttatcggtcaagtgagaggcaaagaggattttatcttcctgaagtttcgtaatgagctgaaaatgatcctcatagagatcacctga

SEQ ID NO: 8792 - RNA, 1161 nt, unidentified
  source 1..1161: mol_type = other RNA; note = synthetic construct
atgaaaaaccttcctgatatctccattgcactcaaaaatgtccgggagaacttcaatagctactttaactggaatagcctgccacagaataagtcagaaaagtataagctgcatgagattaacgctctcattttactatccattaagattccaacccatctgtgtttagccctatcaaattcaatcagcggcatcgaagtgctgataaataatcccgtgtatacggaattgaaagtcaagaaaaagagcggagaattcagacagatatacgcacccaattatgaattgaagagagtgcagaaacgactgaactattttctgcaagggtactacctgtgcatcaagccaaacgaagtcaatggcttcgtcatcaacccgtttccctttgacgcaaaatgcaacatcgctgagaatgcaaagtaccacgttaataagaaacacgttctgaacatcgacatcaaaaacttctttccttctatatcagcgtatagggtgaagaagatcttcactagtgagttgtttaatttcaacgaacaggtcgcgactgccctgacactcctttgtacctacaagggagtgttgcccatcggtgctcctacctcgccagtaatttccaacttcatatgcttccagctggacagagatctgaagaacttctgcaacgagaaaaacataagttatagccgatatgctgatgacctgacattttcctctaacgagaaaatcacagatgagattatctccgagatcaccctgctgattaacaaatacggattcgagctcaacaaaaataagtttagacttcgcctctctaataggaaacaagttgtgactgggttggtggtgaacgaaaaggttaacattgatcggaagcttctcaagaagattcgggccatgttacatgacatgtctcgtaatgggatcgaagtagccgccaaaaggcactttaaaagtgagaatccgcctattaagacaaatagcctcaccaacaaaaacaccgctattttcgagtccgagcagagtgacaatgagatcaatatcgcctttgcctgtcgcttcaaaaagatcgtgataggctacatcaattttgtgggtcagattaggggcactgatgaccgcctttacaactctttcaaggcagcctacaagaatagctggtga

SEQ ID NO: 8793 - RNA, 1179 nt, unidentified
  source 1..1179: mol_type = other RNA; note = synthetic construct
atgatgacggttgaagagattttaaagttgtccaagacctctaagtccaagcttcagaaatacttttcagggggttcttaccacctgggaaaaagtatggaaaatttcaagaagcacgagctcaacgcattgtattttctgagcatcgataaacctgcagagctgacacgttttctcaaaacttcgtttttccagttggaggagatactgaacaatcccacatacaagaattacaccatcaaaaagaagcgcgggggcactcgacagatttttgctccagaaaaacacctgaaatcgattcaaaagaggctgaactatttcttacaagcgtactatctgtggatcaaacctaacgaggttcatggtttcgtcgtgaacccacactatcttgggactcattgcaatatcgttgaaaatgccaaagtgcatgtgaacaagaagtttgtactcaacatagacttgaaggacttcttcccatccataagtgcccggcaagtgaaagaaattttcagctccacctgtttcaatttcaatgagcagatttctactgcgctcgcccttctgactacctacgagggcaaactcccgatcggcgccccttcttctcccgtgattagcaacttcgtctgccttgagttagatctagccctgaaggaattttgtcagaagatcaacagcgaatatttctacaacgataacaacaaactgctacataagaagaaacagttcgtgtttttcgagacatacgatatcgcctatagcaggtatgctgacgacattacattctccagcaacattcccatttcaaccgagatgctctcaaacatcatcagtatcatacaccagtacggatttgaacttaacgagaaaaaactgcggttcaaactgtcaaatagaaaacagacagtcactggactcaccgttaatgagaaggtgaacatcgatagaaagctgctaaaaaagatccgggcaatgctccatgacctgacgacgaatggaatcgaacaaagcgtccagaggcactttaaagtgaccaatatagagcagagacacaaggctacctttatcaatcgcttggaaggctacattaattttgtgggccaggtccgcgggaagagtgactccctgtatgtgaagcaaaagacagctttcgataatgtatttgaacagcgaaagtga

SEQ ID NO: 8794 - RNA, 1002 nt, unidentified
  source 1..1002: mol_type = other RNA; note = synthetic construct
atgaagcatgagaaaatcatcaatttcgtagagtccaacctcgaaattattcggtccaatatcaattcgagagaaatcattttcggcatcctgcagggtccccagcacaaatttcaacggaatgccgccgtgttcctttccatcacccatgcctatgacctctgcaattttctgcagctgtcatatagcgtcctgcagaatcaaatcaacaatcctgtgtacaagcagttcgagataaaaaaaaagtccggcgggatgcgttccattgaagagccaaacgacatcttaaagggaattcagaaacgccttaactactacctgcaggcctactacttatggatcaaacccgcagaggtacatggcttcattatccgcccacagcagtatgagcacaggtataacatagttgaaaatgcccgggcacatatcggtaagaaacacgtgctgaacttggacatcaaggactttttttctagcataagtgttgcacagatctttgagcttttccagagtgattacttcagattcaacgagaacatgtgtgtggcgttaacactcctcgttacccaccaaaagcacctccccacaggggctccaacttctcctgtgctatcaaattttatctgcttgggactggatagggatttgagagagtttgcggaagccaatcaattgacatatactcgctacgctgacgatctgacgttctcaagtgacgtgcatattcctgaagacgttgtgctcgacgtgatgaatatcctgaaaaaacacgcttttgacattaacccgaagaagatacgaatgtctagtagctttagaaaacaggtggtgactggaattaccgtcaacgataaggtgaacgtcgacaggaagctgctgaagaaggtacgagcaatgctacacgatttcgccgaaaacgggcttaaggaagctaccagcaaacacttcaagattagcgtcgatgaggatagcatttattgtagggtcctgtctatagattga

SEQ ID NO: 8795 - RNA, 1089 nt, unidentified
  source 1..1089: mol_type = other RNA; note = synthetic construct
atgttgactccatttcgcttcgctagccttgtgtttaaaattcgctacgctcctcccaacttcgtgaagaaaatgattcggatagttaataagcgataccatttcctcaaaatcaagaatgccagtgacctgagcaaactcctgttcgtgtctttcgaaaacttacaaatcgagattaaccagccgacttacaagacgtttgaaatctccaaaaaatccggcgggaagaggatcatacaccagccccttgacaatactcttagaatacagaatgaactgctatcaatcttccagaactactatacgaagataaaacctaaccacgttcatggttttgtgtcatatagcaagaaagacggaaagaagagcaacattttagagaatgctaagccccacgtcggaaaaaagcatctccttaacattgatctgaagaactttttcccatcaattacagccaagaaggtgaagcagctgttcgagtcggattttttcaagttcaataccaacattgccacaagtctggctttgttgaccacttttgaaggaaagctgaccatcggcagccctacttcccctgtaatatctaatttcatctgctatcccatggacattattctggccgagttctgtaaaaagaacaacctgacatttacccgatacgcagatgacctctccttttcttcatatgattacatcaagaacgacactctgttggacatcatcaatatcatcaccgagaatggctttgacgtcaactataaaaaactccggtttgccaattccaatgccaagcagacagtaaccggcatcacagtcaatcaaaaaccaaatgttgataggacctttctaaagaagattagagcgattctctacgatataaatcaaaacggtcttgaaatggcagcattcaagcactactctatcagtaaaaaaggggaaaatacactgagcttcttaaacgtcctggagggctacattctgtttgtgcggcagatccgtggggtgaatgatacctattatcagtgcttcaacaacaagctcaaagagattaggttgaagaacctggagatcgagaacaaaaaaatctga

SEQ ID NO: 8796 - RNA, 1095 nt, unidentified
  source 1..1095: mol_type = other RNA; note = synthetic construct
atgaataacataaaaaacaaggcgaagcagtggcgcaataagtacgtctccacggagactaaaagatttacgttcaataagaacgagcgcaaacggtatacatttaacgcccttcatttactgagcctagaaaacgaaacacagctctgcaggatgctcgatatctcactggatactctttccgaggtgattaataaccctgtctaccagactttcgagatcccaaaaaaaaaaggcggcaagcgaactattgatgctcccgaagatattctgaaggacatacagcggaaattgaattacttcctgaatgcatactaccttatgatcaatccggaggtggtgtttggtttcgtcatacaaccccatgaactgggcaaaatctgcgccattgccgaaaatgcgaagccacacgttggtaaacggcaggtgttgaacatcgatatcaaggacttctttccatcaattaagactacccacgtcaaggctctgtttcagtctgaattgtttcagttcgacgagcacctggcatccctgctggctctccttactacatataaaggcaccctgcctattggagcccccacatcacctgcagtggctaacttcatctgttaccaattagacaaagaattgcaggagttttgtaaggaaaatgatctcagcttcagcagatatgccgacgaccttacattctcttcggacaccaagtttcactctgacaccatactggacattgtgagtatgatcaacaagagaggattttccatcaacgagaagaagtttcgtattcaaagtgccaacaagaagcaaaccgtgaccggactcgttgttaacgccaaagtgaatgtagatcgcaaattcatcagaaagctgagggctatcatgcacgacattcgactcaatggggtcaaaattgcagcccagcatcattttaacttaaagcaggagcccgatgagaaactgttggcatacttcatccacaggctggaggggctaatcaacttcgtaggccaggtgagggggaatcatgataagatctatacccggtttaagtatgaattcgacgagatattcaccacaagcctcaatgtttga

SEQ ID NO: 8797 - RNA, 1107 nt, unidentified
  source 1..1107: mol_type = other RNA; note = synthetic construct
atgaataataggaaggagatggcacgtcggtggcggaaaaagtacgtctccgccgacaccaacagattcaaattcaataaaaaggctcgacagaaacacacctttaatgctctgcatctgttgtctttggagaacgagaatcagctctgccggatgctcgatatccagctgggctccttaagcaacgtgataaataaccccatttatcagagtttcgaaatccccaagaagaagggagggaagagaaatatcgacgcgcccgacgatgagcttaagaacatccagcagaaacttaacttcttcctgaacgcctactatttaatgattaagcctaacgccgtgtttggatttgtaattaggccaagtgagtatgggaaaatctgtgccatcgctcagaatgctaaacaacatgtaggaaagtaccaagtgcttaacgtggacataaaagatttctttcccagcatcaatgccgcccaggttcgcgcgctgtttcagagcgaaatcttccagtatgacgaacacttagccaccctcctggccctcctgaccacatacaaggggaaactgccgattggcgcaccttcctctcctgcaatctctaattttatatgccagcagctcgatgatgaactgcaattgctttgtaatgccaaagagatcgcatataccagatacgctgatgatctgacattttcgagctccgtgaaaattgatactgacttcatcctagacattgtctcaatcatcaataagcatcactttcgtatcaacgagaaaaagttcagaattcagtcagaaaaccggaagcaaactgttactggccttgtcgtgaatcagaaagtcaacattgacaggaagtacataagaaacctgagggcaattttgcacgacattcggctcaatggtgtggaggaggctgccaaaaatcactttaagctaaaacagcgaccaaacgacacaacgattaactatttcatcaaccgcctggggggactgattaattttgttggtcaagtgcgcggcaaccaggacttcatatactatcgctttaagggcacattcgatgaactgtttgcgtcaaggctcaagcaaccaaagtacttctga

SEQ ID NO: 8798 - RNA, 1059 nt, unidentified
  source 1..1059: mol_type = other RNA; note = synthetic construct
gcagacacgggacgttttttctttagacgggatgcaccacaacgatatccattcaacgggttgcacctgctgagtgtggagcacgagtcgcagttttgcaaaatgcttgacgtcacactcaaggcgatgagcgcccttattcatcatccggcttatacgactttcgagatatccaagaagaaaggcgggaagagaaccattgaagcgccagatgaagacttgaaggaggtgcagagacggctcaactactatctgaatgcctactacctgatgatcaagcccgcaagtgtgttcggttttgtgattcagcctaaggagaacgggcgatattgtgctattgccgagaatgcaaggccgcatgttggcaagaagcaagtcctgaacatagatatcaaagatttctttcctgctatcaaagccggacgggttaaggccttatttacctccgaaatctttggctacaatgagcatctagccactctgctggccctgcttgtgacacacaaaggagcattaccagttggcgctcctacctcacccgctatcgcaaattttatttgttatcccctggacatggaactcatgcaattctgcagcgaccacggattgacatacactagatacgccgacgatctgacattctctgctgaagaaaccatagacactgacgatatccttgatatcgtctctatcatcaactcccatcacttcgctattaacgagaaaaagttcaggattcgcagtgcgcaccagcagcagatggtgaccggggtagtggttaatagaaaagtgaacatcgaccggcgcctcattcgccgagtacgtgccatcctccacgacatccagcagaatggcctgattgctgccacaatgcgccacttccggatagacgagatgcccgacgatgcagccatttcttattttagccgcaggaccgtgggtctggtgaatttcatcggtcaggtaaaaggccccaaggatcctgtctacttgaggtataagaggatactcgatgatctatttccttcaagcgtctcctcaccaaaaacttacttctga

SEQ ID NO: 8799 - RNA, 1080 nt, unidentified
  source 1..1080: mol_type = other RNA; note = synthetic construct
atgacccttatcaataagattcacacccggctcgccgagtataattcctattattacggcccatttgaggccatcgagtttagatttgaacagacattctttgtctcgaaactcctctccctgatcgaaatctctgatctctgtttgctgcttaaaacaagattgttcgacattgagcatgtgattaatcaaccacagtacgagacttttcagatacccaagaagaggggagggtcacggctgatccagactcctgaatctcaactgatgtttatccagtcacgcctcaacttctatctacaaaactactaccacttgattaggcccgaatgcgtccatggcttcgtgatcaacccgaacaaaaacgagaagaagtgcaacattgtggagaacgccaaaatacacgtacagcagaagtatgtgctgaatctggatctcaaagacttttttcctagtatacaggcataccgagtcaaggaactcttcttgagcgactacttcagatacacagaacatattgcgaccgctttaactctgttagtgacgtatgacggcaaactacccattggggctcctacaagccccgtgatttccaattttatctgtttagagttggacgaagcactgtctgtttattgcaagaagaatgaaatccgctacagtcggtatgcggatgaccttaccttcagcagcaatcatttcatttctaagacgataatcaccgatctggagtacattatcaacagtttccagttcaaactgaacccaaagaaaacccgtatcaagacaaagaatagaaaacagaccgtcactggactggtcgtgaatgaaaaagtgaatgttgaccgcaagatcataaagatggtaagggccatgcttcacgacacactgcagaatgggatttccaaagccgctaaaaagcacttcaaatcaatcaacgagatcaggaacactagcgaggcctattttctgaaccgactggagggttatataaacttcattgcacaagtgcgtggtaatgatgattccatcgttattaagtttcggtactactacaagatgatcttccagcttgcttga

SEQ ID NO: 8800 - RNA, 1080 nt, unidentified
  source 1..1080: mol_type = other RNA; note = synthetic construct
atgatcctgataaataaaattcacgcccggctcgaagagtataattcatactactatggaccatttgaggcaattgacttccgattcgatcagactttctttgtttccaagcttctctccgtagtcaaaattgcggacctatccctcttgtttaaaaccagactgtttgacatagagaaccttatcaatcatccacagtacgaaacgttccaaatccctaaaaaacgcggtggaaaccggctgattcaaacccccgaaagccaactcatgtacatccagtctaggctgaatttctatctccaaaactactaccacttagtgcgcccagaaggcgtgcatggttttgtcattaatcccaacaaaaaggagaaggtttgtaacattttcgaaaacgccaagatccatgtacaacagaagtatgtgctgaacgtcgatctcaaagatttctttccgtctatcaaggcataccgggtgaaggaactgttcctgtccgattatttcagatttaacgagcagattgccacggccctgactctgttggttacttatgaaggcaagttgcctattggctctcccacctcacccgttatctcgaatttcatctgcctggagcttgacagcgccctttccgcatattgcatgaaaaacgagattaggtatagccgctacgccgacgacctgacatttagttcaaatcagagtatctctaaggctcagtacactgagctcaaggagataatcgagcagaaccagtttgaactaaacgtgaagaaaaccaggttaaaaagtaacaatcgaaagcagacagtcaccggcctggtcgtaaatgagaaagtgaacgtggacaggaagataataaaaatggtgcgggcgatgttgcacgacacattacagaaaggaatttcaaaggctgctaagaatcacttcaagagcaaaaatgagatcagaaacaccagcgaaacatactttcttaatcgtttggaggggtacattaatttcatcgctcaggtgagagggcatgatgatcctatcgtgctgaagtttaagtaccactataagatgatcttccagctggcatga

SEQ ID NO: 8801 - RNA, 1092 nt, unidentified
  source 1..1092: mol_type = other RNA; note = synthetic construct
atgaacaacccgcttaaaaccattgataaaatccatacccgcttggaagagtataacgcctattactatggctatcagggcgatgttgtgttcaagttcaatcagacatttttcgtccagcagttgctgtccgtggtcaagctgagcgacctgaaggtgctgttgaagctcaatttttcctggctgggccctttaataaatgcgccccactacgatagctttagtatcccaaagaaaagcggaggtatgcgcaagattgaagcacccgaagttctacttagagccactcaggctcggttcaacttttacttacagcattactatcacctcgtacgtccagagggggttttcgggttcgtgatcaaccctaataagaaagagtccttctgcaacattgttgagaatgccaagctgcatgtgcacaagaaatacgtactgaacctggacctcgaggactttttttcatcgattaaagcatatcgggttaaagccctgtttcagagcgagtattttaggtataccgaagaagtggcgaatgcccttgcactgctggtcacatacaatggaacactacccaccggtgcaccaacctctcctgtgatctctaactttatctgccttcaactggacgctatgctcttggcctactgtaacgaaaacgctctgcactactcacggtacgctgatgacctgacttttagtagtgacagggaaatcactacgctacacctggaagagctcagcaagatcattcactccaaccatttcaccataaattctaaaaagacccgccttaggctccatcacagaaagcagacggtgactgggctgattgtgaatgaaaaggtgaatgtcgaccgaaaaacaataaaaatggtcagggctatgttgtatgatgcactgcagaacggcgtatccaaggctgccaaaaagcatttctcaattactaaggagacaagccaaatgtctgacacatactttttaaaccgacttgagggctacatcaatttcatcgcccaagtcagaggaaaggaggatgccatggtgcaaaagttcaaagaggagttcaaaatggtgcacctcctctcatga

SEQ ID NO: 8802 - RNA, 1125 nt, unidentified
  source 1..1125: mol_type = other RNA; note = synthetic construct
atgaaacacaaactccttctggacaaaatccattctagaatcgaagactacaatcggtacttctactcatccgaaaacgacgtgatttttaggttcgaacagaaattctttgtgactaagctgttgtctatcgtcaccatacctgatttgaagatcttgttcaaagtgcacttatcttacattgagaaagtcattaacgagccgaactacacaagcttcttgatcccaaaaaaaaatggaggcaatcgcctgattcagagcccagagtcagatctgaagaagatacagatgaagctgaacttttatctgcaacagtattatcactggattagacctgacggcatttatgggtttgttataaaccccaataagaaggagaagatatgcaacatcgtggaaaacgctaaagtccatacgaaccaaaaatacgtactcaacttggatctgaaagacttttttccctctatcaaggcataccgtgttaaggagctttttctctccgagtatttcaagtttagcgattgcgtcgcgactgccctggcccttctgactacatacgaggggaagctgcccattggagcccccacaagccctgtgctgtctaattttatatgtctcgagctagatgctgatttagttgccttctgtaacaagaaccagattaattttagccgctatgcagacgaccttacctttagttcaaacaatgaaatcaccgatgagacgatcaacatcatctccgaaatcattaagaagaaccagttcagtatcaatccaaaaaagaccaggctcaaatccagtaatcgaaagcagaccgtgaccggtctagtggtgaacaagaaagtgaatgtagatcggaagacaattaagatggttagagctatgctgtacgacgcctcgaataacggtatcactattgcagcgattaaacatctaaagctggatcggaatgctaatgtggtggacgtcagttatttcctcaacaggctggatgggtatataaatttcatcagccaagtaaaaggcgacgacgaccttctcgtcttaaagttcaagtccgaattcaagaacctggccaaaatgaaaacaaaacacatcaagagcaactcctacaataattcatga

SEQ ID NO: 8803 - RNA, 1203 nt, unidentified
  source 1..1203: mol_type = other RNA; note = synthetic construct
atggttactgccttcacatgcttctgcgtggctcactgtgttccacttctgaaagcggatgaaattcagattatcagtaatggaagcttcttcatgcttacctctgatgaactgatctctactgcaaggcgatacaagcggtggatgaaattaaactatcggcttcgatattcgatgcgcccagccgtcctgaaccatctctccaagaatgaatttgaatctgcccggctcctgatgatcgagaatagtcatgacatgatatgcttctttgaccagattcccaaaagctatctggagaagatactcaacgagcctaattacacagagtacgccctgaacaagaaaaaggggggacagagaaagatccagatacccgaacccgtgcttaagcgtatgcagaagaagatcaatgccgctctgcaggcgtactacctgctgatcggctatgaaaattcatttgggttcgtcaagaagacctcccatgctgcttttacctcaggaattgccaccaatgcttcaaaacacatcgggcagcaggtagtgctcaacctcgatctaaaggatttttttgagtccgtgtccgcagcacgtatttttaccctgttcaaatctccgttgtttaagttcaatgaggacatcgccgcagctctagctctgctgtgcacgtggcagaaaagactgccaaccggcgcgcctacttcacccattctgagcaatttcatatgtctggagctggatcagaacttgcacgagttcagcctcaaaaataagcttaactactccagatatgccgacgacctcacgtttagcacaaacgaaaggattacagaggagatgaagatcgaattgaaagagattatctgtagaaaccagtttgaaatcaacgcaaagaaatggcggattaggacacagaatcaaaagcaattggtaacaggcctagtcgttaacgagaaagtgaatgtggacagaaaattcataaggaagatccgcgcaatgattcacgatcttaagctgaacggattagagaacgccactggcaaccactttcgcaagagcactaaaaataatcacgagttacaattccggttcatcaacaaactccatggttatattgacttcatcggtcaagtcaggggccgcgaagacaccatctacaaaaagtttaaatgggaattggtgcctttcgggatggccgatagttga

SEQ ID NO: 8804 - RNA, 1095 nt, unidentified
  source 1..1095: mol_type = other RNA; note = synthetic construct
atgaccaaaacaaacgatataatacagtacgccagggccaacaaaaagtgggcacagcatagaaaagtctcaattgcaaacgggaccgctggaataaaagacgttatccagcagagggaaatggccgctctgcacttcttgtgtatggacagcgctcatgatttaacccgtctattcaaacgggatatcagcttcgtggaatattgtatgaactacccggtgtacgtggagcacctgattgcaaaaaagacagggagtaaacgcattatcctcgcacctgacaaaaatctgaagcggatgcaaagaggacttaattattaccttcagtgctactacaacctgatcaagcctgatgttgtatttgggttcgtcaaaacaatacggaggcagaagaacccatcagctattgtacagaatgcctctatgcaccagaaaaagaaatatctcctgaacctggacttagagaatttctttccttccatctcagccaagagaattctgactctgttttctggaccccacttccaatttaacagcgagattgccaccgccctcgcgttgctgacgacttaccagggcaaggttcccgttggtgcacccacttctccaatcctcagcaattttatttgcctggagatggatgaacaattgatcgagctggctagtcgtcatcagcttacatattccagatatgctgatgacctgactttctcgagcaatgagttcatcactcctgagatacttaaggagattcgctccgtgatcgaacagaaccagtttaaactaaatgagaagaagctccgctttagaaacgctggcaagcagcagattgtgaccggcttaacagtgaacgaaaaggtgaacgtggaccggaaattcctcaagaaagtcagggcaatggcccatgatctggaaaagaatggcctggaggacgcggcgcaaaagcactttcggcgaaattctccctccgaagagatgaatgccacgttccttaacaccctcgccggatacgtcaattttatcgggcaagtccgaggcaaggaagacggtgtgtatttgcgctataagaggatcttcagtccaatcccatcctga

SEQ ID NO: 8805 - RNA, 1059 nt, unidentified
  source 1..1059: mol_type = other RNA; note = synthetic construct
atgaagctcaagataaacagtaccatgaagtgggaatcaattctggaaaaacgcgactcacacgcagcgaatatcagacggttaatctgcacaagtaatggggtgatcccgtctttttctcactccttaagggaggggcgagtcttgacatttctctccgtcagcaattggatcgaactgagctgctttctgcagctctccccaattaagctcgaacaggtgatcaactgtccgaattaccggcagttcacaatccctaaaaagaagggcgctccaagacttattttccagcccgacccagatctgatgaaaatccagcggaaactgaatcgctatctacaggatgtctactccttccaactccctgaatgcgtgcatggatttgtatgcaagagcaaccaggtatcaagaagcatagtgactaatgcgcaaccccacataaataagcaacgggtcctatctattgacctggagaactatttccccagtatttctgccaagcgtataaaggtgctgttttgtagctggggctttaacgaagaaattgctacagccctgacgctgttatgtaccttcaaaggaggcctgcctgctggagcaccttcctcacccgttctggccaatctgtgtaccatggagttggattccaagctgatcgagttctcaaaaaacaacgagcttacttatacaaggtacgccgatgatctgaccttctcgagcaacgactatatcctagacgacactatactccgtgtgcttgagatcattaagagtacggatttctctattaacatgaagaagaacaggtgcatgggcaggaatagtaagcagaaaatcaccggtattgttgttaacgagaaattgactgccgaccgcaaagtgaaaaaaaaattgcgcgctatgctccacgatttggcaaagaatgggcttgagatcgccacccagagacattactccattgtcggtcagccaactgacctggagcaaaacaggttccttaagcatgttatcggcgtgcagtcttttgtgaatatggtgaataaccaccgatttagctga

SEQ ID NO: 8806 - RNA, 1029 nt, unidentified
  source 1..1029: mol_type = other RNA; note = synthetic construct
atggataagatcgaagtgaacaagattgttaacgctagcaaactgaatcagttccggacgattgagctactggacaaactctcctgctttttgaaagttaataccgaagtcttcagtaatagactgaattatcccgtatatacaactaaccgaatcccaaagaaaaagggcggttggcgggagctgcttgtacctgaaacagagctgatgaggatacagtccaaactgaatgtgtgcctgcagctgtacttcaacaagattaaacccgactgcgtgcacggctttctcatgaatgaacggaccggcgaagagctcagaagcattgtgtcaaacgcccaggcccatgtgggaaagtcatttttgctgaacattgacctcaagaatttctttccgagtatcagcgcaaaacgcattaacgagctgctgcatgataaactgagcctttttcctaatgagaagatggcaaatgcggtcactcttctgtgtacctataagggttttcttccaaccggggctcccacgagtcctgttttgtccaatatcgtgtgtctcccactcgactacgaattgtcgacatactgtgaaaataaccagatcacttatactaggtacgccgatgatctctctttttccagcaaccgctattttagtgagaagtgtataagcgagattagacagatcatcaaggagcaacaattcgccatcaacgagaagaaattcaggataaactcacgcaagtctcaacaacgtgtcactgggttagtggtcaacaacaaagttaacgtggataggacatatattaagaccattagagcttgcttacataattggaagctaaacggattagaacacgccacagctaaacactactttgtgatcgcaccctctaccgaggaacaggcccagttctcaaataagctgaaaggccagatagaattcatcggcatggtgcgagggaagaaggacgagatctacataaagtacaaaggggagttcaaatacttgatcggatcctctgtcttcccttga

SEQ ID NO: 8807 - RNA, 903 nt, unidentified
  source 1..903: mol_type = other RNA; note = synthetic construct
atggtcaatcccaccatatttgaagatcgcttaaattctccagtgtacactaccaaccggatcccgaaaaaaaagggcggatggcgcgagctacttgtgcccgagaaggagcttaagtacatccaaaaaaacctgaacttctatctgcagctctattacaacgacattaagcctgattgtgtgcatggatttttgatgaacgagagaaatggcgataagacgcgtggcattgtcagcaatgcacaggcccacacagggaaagcgttcctcctgaatattgacctcaaagactttttcccaagcatctctgccagacgaataaagcaccaactgtttaacgagctcgatgtctttgccaatgaaaatatcgccaatgccattaccctgttgtgtacatatcaggggtatctgcccacaggcgctcctaccagtcctgtcatatccaatattatctgtttacagctggataaaagcttgatggccttctgcaaggaaagaaatatcacatataccaggtatgcagacgacctgtcatttagcagtgacaactacttttccgatgagtgcattaacgaactgaagaaccttatcgagcagcaccatttcaagatcaacgaaaagaaattccgcataaactcatcgaaatctaaacagacagttactggcctcgttgtgaatactaaggtaaatgtggacagaaaatacatccggaacattcgagcttgcatttacaactggcggatgaacggactggaattcgcaaccgctaaacattaccaggtgatctccccagatatggagaagcagactgaatttgctaataagcttaagggtcaagtggaattcgtaggtatggttagggggaggaaaatgaagttcattagggacacggaggagatctga

SEQ ID NO: 8808 - RNA, 1194 nt, unidentified
  source 1..1194: mol_type = other RNA; note = synthetic construct
atgcatgctttctcgacatcttttcacacccacgctttccaccttaaaatctctaccactgccttgttcctgctgcttacaatgacccactctgataacaaaaggaccgagaagattagagaggccttctttgctcaaattcaatcagaggcgaaggaggagcgtaagcaaaatcggctcaaagccatccagtcacgggaaaagttcgtgggacgctttctgagaatgcagctggcaggtgatctgtgcaaactcgtgaaggaagactataactccctgaatgagatgattaatcgccccaattaccacagtttcagcattcccaagaagagagggggaaagcgagaaatcacggcacctgataaaaggctgttacgggtacagaaaaagcttaacaggtatctacagtttgtgtacctcggagtccgtcctactgcagtgcatggtttcgtgatgcaggtttcagatggaagcgtccaggccaacatagttgagaacgccaaggtccatgtcggcaaaagggcggtgctgagcatcgatctggtggactttttcccaagcattagtgccaaaaaagtaaaggatctgctcatgggcagcccgtttaatttcaacgaacatattgccgttccactggccctgctcatgactgcggagcgcaaattgccacagggcgcacccacctcccctgtgatctccaactttatctgtttgcagttagatgagacactaagaatctgggcattaaaccacaacgctaactataccaggtacgccgatgacttgacatttagcgccgacctcgctttctccgaagagcagcaagcagacttgaggaaactcatagaagcttacgggtttgtgatcaatgtcaagaagttgagacagagactgaagaatcgaaagcagactgtgaccggtctgacggtgaatactaaagtaaacgttgaccgtcggtacctaaaaagaatccgagctatgctccatgacctgaatacaaacgggatagaagaagccacaattcggcactttaaactggttcgccgggcaagtcccgagcaacgcctgcttttcgtcaatcggcttgaggggtctatcgcctttattggccaggtgaggggccagtccgaccctatatatcagcgcatgcgaaaggctttcttcgacatgtcttcaagtaagaaggaaaagtga

SEQ ID NO: 8809 - RNA, 1113 nt, unidentified
  source 1..1113: mol_type = other RNA; note = synthetic construct
atgaacaaaccagccaacgagttccagccctccataagcaacggtaacttcaagcagacccttgctgaaaggcggattgaagtgaagaaaaacaggattaagaactttcagatgcgggagaactattccaatagattcctgcgtatgcagtgcgccaccgacctttgcctactgctgaacgaaccgttctataatctggaattcctgatcaataagcccaattacaataccttctcgattcctaagaaatctggggggaagagagatattagtgcccctgaaaagaacctcctcagagtccaaaaaaagttgaataggtacctccagtttatttacctgcgactgcgcccaacaaatgttcatggctttgtgctccaagttgggaatcatgagatccaagcaaatattgtggagaatgcaaaacaccacgtgggaaaaaaagccgtgttgaacatcgatcttgaagacttttttccatctatcactgcaagaaaagttaaggagctgctgaagagcgccccgtttcagttcaacgaggaccttgcaatcgctattggcctgttgacaacgcataagggaagaatgccccagggagctccaacctcacctgtgatttccaactttatatgtttgcccctagaccacgccatgcagcagtggtcaatcaaaaacaaagtaaactactcccgttacgccgatgacttaacgtttagcgctgatatagtcttcagcccctcacaaatcctggagctgcgggccatcatcgaatctttcggctttagactgaatgagaaaaaactccggcagcgacttaacaaccgaaagcagagtgtcactggaataaccgtcaacactaaggtgaacgtaaatcgcaggttactcaaactagtgcgcgcgatgctccacgacctcagggttaatggcatcgagacagctacacggaatcacttcgtgagccctgaaaacccatatttcgacaggaagaagtttttcctgaatcgcttggagggttccattgcgtttatcgggcaggtccgcggccttgatgatcctctgtacaccaagatgaagacagagttctatctgctgttagatagtaagaatactgactga

SEQ ID NO: 8810 - RNA, 1080 nt, unidentified
  source 1..1080: mol_type = other RNA; note = synthetic construct
atgacagtatacgagttcgtcgaaaaacagcgcccggagcttaagcagtcattaagaactcagaccatgaagatcaagagctcacccgaactgactaaacacacaatctccgccggactgctactctctcttcagaacgcccaggatgtgtgtgcttacttccaactgccaagagcagtgctcgaacaactgattaattcccctaaatatcggtccttttccattgcgaaaaagcgcggggggaaaagactgatccaagcacctgaattaggtctaatgaaggtgcagaggattttgaaccacggactgcaaagtctctacgcctgcaatcctaatccaagtgtcttcgggtttgtgatcaatgacgagcaagccaaccccgcctcacccatcgtccagaatgccgctccgcacgtcggcaaggcatacgtgctgaacatcgacttgaaggattttttcccaagcatccgagcacaccgggttaaagagttgttcatgtctcagcagtttaggtttaacgagcagacagccaccgttctcactctgctcactacatatcagggtaggcttccccaaggagctcccacctcgccaataatcaccaatttcatctgcgctaagatggacgcggagatgcgaaagatagccaacgataagggttggacctacacacgctatgctgatgacttgacgttcagcgccgacctgttcttcgacgcagaagccgtagcggaaatcaggagcatgattgtgtccaaccatttcgtgattaacgaaaagaagatcagacagaagggaaaaggccgcaggaaagaggtcaccggcatagtagtcaacactaagccaaatgttaagcggagttacatcagacaggtgcgcgccatgcttcatgatctggaaaagaatggccgtaccattgcttcagcaaaccatttcaaaaacagccctgttgtgagggagaatgatcactctgtgtttattaatcgactgcgtggctatatttcttttattgggcaggtgcggggcaaagaggaccctatatttctccggtttcaggagaaaatgaaagctctgacgtga

SEQ ID NO: 8811 - RNA, 1122 nt, unidentified
  source 1..1122: mol_type = other RNA; note = synthetic construct
atgaaccagactgagctgctcgcttacaaagccacatataacagcgtgtttcggcagtacctgaactccccaagaaaaacatttaagcctccctttttgctaagcaagtcaattcagtatgcgctttatttcctggccatcgagcgcccattagatatgtgtgcgtttttcaagatccaccaccaagaacttgaagatattatcaaccagccaacttacgtaacccacttcctgctgaagaaaaagcaggggttgagaactattaaggcccctattgggaccttgaagctgcttcagcagaagttaaacagacacctgcaaggcgtgtaccttaatctgaaacctacatgtgccaaaggctttgtcatcaatccccccggaagttccttgaaggctaacattgtggaaaatgccctcccccacgtcgcaaagaaatatgttctgaacatggatatcagggatttcttcactagcataagcgacaagcaaatctaccatttattcaagtcctcacctttcgatttttctccgcaaatcgcagctgcctttacgtatctcgtgaccgttgacgactgcctgccgcagggtgcacccacatctccaattctatctaacttcgcctgccgtagcctagacgaaaagctgatggagtttgctaaccatcatcagttgaattacacgaggtatgcagacgatctcaccttctcctcagacatccctttcactaaggagcagatcgccaccataaaaaagaccctccgggaggaggggttcgaacccaatgagaaaaaatttcggctgaggacaagtaacaaaaagcagctggtgaccggccttgttgtcaatgaaaaagtgaatgtcgacaggaagatgctcaagcgagtccgagcaatactgcatgacctgagactgaatggtgcctcaaaggctgcacagaacttcttcaagtccgagagcaaaccaaatgagacagacattctcctttttttcaaaaaactccgtggaatgatagatttcatcggccaggtacgcggaaaagaggacgtgctgtttgtgaagatgcggcaagattattctagttcgtttgctattgaagaagatcgcatggtgtactaccgctga

SEQ ID NO: 8812 - RNA, 1152 nt, unidentified
  source 1..1152: mol_type = other RNA; note = synthetic construct
atgctgacagccatcctggatggcattaggaaaaactatacgaaggccacattctatacgtacaggcagattgttgtaaataaaaagaaggggggcaagagaatcatttccatacccggattgctgctgcgcaaatcacagcggagcctcctccctttttttcagcagctccggacgcattcatgcgcacatggttttgtcgtcggaaagagtatcatcacccacgctagcctgcatctggctaaagagtcaattctgaccctggatatccaggatttctttggatcaattactagcgagcacctggagaagattttccgatctcatggtgttcagaaaagtgaggacctggagctgctgattaagttgactactataaacgggaagctaccccaaggggctcctaccagcccaatattgagcaacgccgtggtttttgaaatggactttgaactcaacgagtgggccaccaaaaacaatctgatctactcaaggtacgcagacgacatggtgttctcctctgaaactcgcacaatcgaaaaaacctgtatcgatgaggtcagtcaaataactcagaaattcggcttcaaactcaataattccaaaagtcgcatcatgccgcgcgggaagagacaggtggtaaccggactggtggtcaatactaagttgaatgtcaagcgtgagtatttaaggaatacctctgcgatcctccacaacatcagcaacaatccatttagcgccctgtcccaggtgtctcggggatcagtgttcgcaacctaccaaagttatgaaaaagaatacctttcccgcaatctgtcgctttcttcctttcactacctgatccggaatcagaagcaacagcagaaacttataaacccaacaaagatccgattgcacaggaagagccacttctctaactatcccattttccggctattacttctcctccaaggtgtgaatgggaggatttccttcatttcgtccgtgatcggcgaaaaccagattagtgtgcaaaagcttagaaatcagttcaaggagatcgagaaagagctatttggcaactattctatcaactggagcacaaacacaacccgtctttacaagattattctcagagaatgccctcagttacgaacaagaataaagggctga

SEQ ID NO: 8813 - RNA, 960 nt, unidentified
  source 1..960: mol_type = other RNA; note = synthetic construct
atggattacttctacaagaagataaagcggcttattctggcttgggaagacgggacacccaactctgataatattccaagcaattacgactattcccgtttcaagatcattaaaaaagacggaggacaccgcatcatctactcaccttatggccatttaaaaaagatacagcgcggcataagcgagctgctgtacaagaatgtggaattgcatggcgcaagtcacggctacacaatcaacaagtctatcattacgaacgcaaagcagcacctgaaaaagaactgcattatcaacattgatctggagaacttctttcagacaatcaacaccgtgatgctgaataaatccctcaaactttttttcccagacatcaccgatgaacttttgatcaagatcatcgccatttgttcattcgagggctccctaccgcagggtgctcctacttcacccattctgtccaatctcgtgtgttattcgctggacttgaaactctctgaactggccataagccacaatctcgattatacaagatttgcggacgacatgaccttttcaactaacaacaagatagtcgagttgcaactgaagaatgatatcaacgggattatccaaagcgaagggtttagactcaatgagaagaagtacagggtattaaaaaagagacacaggcagagtgttactggtattacggtcaatgagaaaatcaatgtcacccggaagtatattcgagggattcgcgccgccctgtacaattgggagacttacggtaaaaaagaagctagtaggaggtattttgagagcgcaaaaaccaaaatatgccgatctcataactttgaagtttcccttagaggcaaaattgagttcgtgggaaatgtgcggggaaaggaggacgaaatctatagcaagttcaagaacaagttcgagatcatcaacctatttgagaaaatcaaccagttctga

SEQ ID NO: 8814 - RNA, 1893 nt, unidentified
  source 1..1893: mol_type = other RNA; note = synthetic construct
atgaacatcaataccggaatcctgtttttcgtgatgaagaagttcaactaccacaagatcaaatacaagaataccgagctagaggaattcataagcaaggagttaaatagtcatctcattaagaacatcctgaagcacaagagttccttttataagagcttcacagtgctgaagaaaaatggtgcaaagcgcagaatagaccagccccattacaaactgatggacatccaaaagaagattgccaattacctgctagtaaagaggaagaaaaacagtagtagtcacgggttcgaatactacaggtctatagtcaccaacgcggagaaacacatcaataagaacatcgttctgaacttggacttcaaagagttcttcaagaacatatcaaagtcccaagtcctgtccgtgttgaggaacagctttgatataacaaatgagtctgcctacttactcacagaactcgtgacctttaataactgcttgccccagggcgcaccttcttcacccgttatctcaaattatgtttgcaacaatctggataacgatttgaagacgtactgtaaggagtacaatatcatttatacccgatatgccgacgatcttacgtttagctttaatttcaagaagctgcctcgtcagattgtagatgagataatcagtatcattgtgaaacacggcttcaagcttaatgatcagaagtttcgatatttccacaaaaactcaagacagttagtcacggggatcgtcgtcaacgaccatgtgaatattaagagggaattctacaagaaggtgcgggccattctgcataattggaaaacaaaaggatacgtcgtgaccaaacagaaatttgacctcgagtatccaaacaagaactttcgtaagactctgcttggctgggtgaactacattggttatgtaagaggcaaagacaacccaatgtatctgacattgtcgtcttcccttgagcttctgttacgcactaaatatccgaagagtgagtttaaaacagacgaaaaatactgcgacaaatgcaaaactgggattctcattgaaaccaaagaaggaggagtgaagaacaacttcaaaaaatctaacgatgctagctatttcttcgagtgcaacaatgaggaatgtaatttctcagagaacatcgatagcaaatacttctttctcaaatcgaaggcctaccttaaaaataataacctggagaaggtgaaggaacttctcgaaaagtccatcgaacttgatagcaataactacaaggcatataacaatctgggcgtgatcagctacaacaaaaaagagtacaaagtgtctgtcgaacactatagcaattccattaaagcttatcgggaacgcgctaagccatattattgtagggggagagcctatgctaacctccaacagtttgaaaatgccatcctggactatctcaagtatattcagctgtctactcggaaagatgttctcaattccgtctactttcatttagggcaagcatattttaagactcacaaatacgaggaagcactgaactacgtgaatctgcatattgagcgcttcgagatcactaaagcggtgatagccttgaaaaccgcctgtctgaacaatctaaataatctgaacaagcggtttgagttgaagatttacaaagacgcctccaaaatatacgacgtgattgagaaaaacgaaaacatttggtttgagtatcagaccatcgacagcgatgagtctgtgaaagttgctctggtatccctgatacccaagggtatcctcttcaacaaggagatcaattccctatcagttaagggctacaatttgattaacaagaaggaagagacatacctgatcgataacatcgctaatctcattaatgtccctaaggaaatctga

SEQ ID NO: 8815 - RNA, 1329 nt, unidentified
  source 1..1329: mol_type = other RNA; note = synthetic construct
atgggttcctcatttttcaattttatgagtcgcaagttcacgatttcacagtttaggaagctgaacaacgattttttagacgtggagagtccgaataagctagccgaaatcttggggattaagacctcggtgttgattaagaacattaagtatcagcgctacaccagcttcaccagtatccataagggaaaaaaacgtattgtcgctgaacctaatttcgagcttaaacaaatccagcgcagactaaataactacctgcaagcaatctattactttaacaagcacgagaacgtgcacggttttgtgaaatgcgtgacaaacgaaaagattcggtattcaatcctgtccaacgcgctgcctcacgtgggcaaaagttacgtgattaacgcagacatcttcaggtttttcccctctattaccggcaagatggtcaaagatgttttccttggggagccttttttcttcgaggacaatttggctagcgccctcgccctgttatgtatacagaagaattggttgccaactggagcgcccactagcccagtaattagcaaccttgtatgtatggaactagatgaagaactcaatgtactggctaacaagaacaattactcttacacgaggtacgccgacgacatgaccttttccggggaaaataaacccgatgagaagtttaaggacgaactgacatccatcctggaatctttcggattcaaactgcataagaagaagtatcgtgttctcacaaagcacactaggcagactgttactggcatagttgtgaatgagaaattgaacgtgaagcgggagtataaaagaaatcttagagccctgcatcatgacatcaaggtaaatgggattgaaaatgcactccttaagaatagaagcgtccagatccttaccatccagggcatcgaatctttcaaaaatagcacactgtcaaagtcattattcgttgataaggtcgccgagtactctaaagccatctctaacgcaggcaacatagatggtgaggtcgagtatctgctgtttgctgacctcgagctcgatggctttatcatagatgtgttcgacaaccataagcaggccgtgaaaaaaatgcacgaactgtggcacttcattgcttccctgtggacgctcagccacaacgacatcgtcggaaaaatatccgcaatatcccaaaagcgctataggctgactgaagagacacggtatgagacaattggcctcgagggttgcagtaatgggttctacaccgtgggagtggtcaaactgaacaacaaatttacccaggaggagtacgagaaaaaacgagggcgaatccggtga

SEQ ID NO: 8816 - RNA, 1332 nt, unidentified
  source 1..1332: mol_type = other RNA; note = synthetic construct
atggctaagcattacttaagagaactgcaacacatttacaatctcaagatcctgagccaatacctcggaaaagatgagtacgagctgcagaatctcctgtaccgaaaaacatattctagtttcctgatccctagaaaaaatggcaaacaccgttctatcaatgccccttcggacgaacttaagtacgtgttacagaaccttaataggttcttgagcgccatttataacgaaatgcagggccaggagcatcccgcccatggatttactcttggtaagggaatcttatcaaacgccaaaatacattccggcaaggcgtttgtgttaaacctcgacctaaaagatttcttcccctctataagccgaaaccgcatcaaagaggtgttttccagtgaaccattcatgctgaaaacggaaattgctgattatctatcggagctcgtgacctattatgatacacttccccaggggagccccgcatccccaatcatttctaatctcgtgtgttggaacctggacaaaactctgagcgactttgccaaaaagaaccttctcgtctataccaggtacgcagatgacttgagcttcagcagtaaccagaagatcgacaccgagataatcaaacaaatcgaggactatatccagaaggagggtttccagctgaacactgataagaccagaatccagaacaggacagagcgccaggtcgtgacaggggtaacggttaatgtcaaacctaatgtttcacggaagtttatacggaggattagggctattctgcactcctgggagacactggggtatgaggaagctgacaccatcttccagtcatcctataaaaggcgcaagggagtttttaaagcaccgtcactgaaatactatctgataggtaacattgcgtatattggacacatcagagggcaagatgacagtatctacaacaatttctgcatcaagctattccggctgtccgatcgcaaggtattcaagggccagattgaacgttttattcagagcttgcaatccgacatcgataatcagcaatttagtgaaaccaatttggagaatcggattttcaatctggcaaagaaggcctttgagcctcaccagatacgctataataacatcctcagaaagtactacacactgcgaaagaaaactaagatcaacataaccaaggggaaaaattactctagcctgtttttggcttctctggaaacttcaccagagttcaaggaactcctgtacgagtccggccggtttggcgacaaggagtactactctcagtacattaaagaagccaagagattgattcggaacaccaaccttatttga

SEQ ID NO: 8817 - RNA, 1029 nt, unidentified
  source 1..1029: mol_type = other RNA; note = synthetic construct
atggccattaagacaatcgctcagttatgttccatgctgcaggtcacagcaaaagagtttcagcatatactggccctgcccgaatacgttagctactccatcccgaagaagtcaggaggaattagagctgtcgaggccccacagggtttactgcgtgagctccagggccgactcgcaaagtatatgcagccattttacacccaacacaagctgccgtgcgtccacggctttgttaaggctttcaataacgaacccaaatatggggtactcactaatgctaaacctcacctgaacaagccttgtgtgctgaacatggacatcaagaacttctttgacagtatatccgctaagcatgtgaagcaggccctgcagcagtaccccttcatggtgtcagatgaagtctctacagccattgccctgctttgcacacacaacaagaaactgcctactggggttaccacttctcctttacttagcaatatcgtgttctatagggttgataaggcacttatcgatctcgttaacgagatcaacagcacgaagtgcaaagacgacgtggcgatctattacactagatacgcggatgacctcactttttcgggggaggtaaaactcgtcaatgagatacaagcaagaattgtggagattctggccagctacggcttcgaagtcaacacaaaaaagactcgactgcagaagacgtacgctgcacaatgggtcaccggcatcaaagtgaataacaaaccaaatgtgagtaggctgtatgtaaggaatctacgggcgaccattcataacctacaaaacaacaccgctaccgatgccgtgaagaaacatttgggtaccacacccaataaggaaatcgacctctcagatgtacacacgatgttggcctctatccggtccaagattgcatgggtgggattggtgcgcggcaagaccgacgacgtgtatctgaagttgaaacggaatttcaaagaggccgaacagaaaatacttcttcacgaagtgccagagaaaaaacgcaattga

SEQ ID NO: 8818 - RNA, 1002 nt, unidentified
  source 1..1002: mol_type = other RNA; note = synthetic construct
atgcgcagcctcgaggagctgcttaaaatcctggcgatttcaagtgagctgctccagcagcttctggccgctccagagtatacaatctaccacatttctaagaagtccggagggacccgaactatccaggcccctcaggggttgttacgccagactcaggtgctgctggcaaagtacctccagactgtgtacagccggcaccacctcccctgcatccatggattcgttccgtccgccggtcttttgaagtatggggttttgagtaacgccgtgccacatctcaataagcccttcgtgctgaacatggacatcaaaaacttcttcgagagcatcactgccaaaaaggtcaagaagtccctgtgcgagtttccatattattttaacgaagaagtggcaaccgccatagctctcctttgtacgtaccaaaaacaactaccgaccggtgctcctacaagtcctgtcttgtcaaatatggttttttacattcccgatgtggccttgctacagtggatcacggacgtaaatgagactaaacaaattgatgagacaggaataagctataccaggtacgccgatgacttaacattttctggctctgccaacctggtgctgtcactacaggctcgtataatttcctttttcgcaacagaaggctttgaaattaacgcaaagaagacccgggctcaaacccctcacggcccacagtgggtaaccgggattaaagtgaatgagcgactgaatatctccagatactatattcgcaatcttcgggcagtcatccatcaaatgagggttcatgctgcagaagcggtggtttgtagatacctgaagctgcccgcgaccactcagatcaatacggcccacgtcaaaaagatgctgagctctgtccagtcgaaaatcgcttgggtgggcatggtgaggggcaaagccgaccccatatatctcagattacagacacagttcaacgtggctagggaagtaatgctggtcaaggaaagctga

SEQ ID NO: 8819 - RNA, 1047 nt, unidentified
  source 1..1047: mol_type = other RNA; note = synthetic construct
atgaacacaatcattctggacaacaataaccactgggattcccttctgttcattaatgcaaatacgctggataaaatggccttctcactgagctgccacctcagctttctgcagcgccaggtggaaagccccaagtatttccaattcaaagttagcaagaagagtggaggattccgtgaaattaatgctcctaacgctgagctgaagtacctccagcgaaacttgagctggaagtttaacaagatttattcttcacccgatggggtccatggcttcgttaagggcacctttttggagactaggcacatcgtcagtaatgctaaactccatatcgggaagaagtgggtatggaacttagacatagagtcctttttcagttccatcactacacaaatggtcattaaccgacttatggaggccccctttaacttcgacgaaaataaagccaagtacatctctctgctgataatctataagcggcaactgccgatgggctccccatgctcaccagtggtaagcaatcttgtttgtgaaaacatggacgcccagattaatcagtgggtcgcgaaccagaacaaatttcaacctgagatcaatcttgtgtactctcggtatgcggatgatattaccttttccactgacctcgcaatctctgatgagcacaaactcgagatctatgacatcctgaatcagtacgggtttgaggtgaatcgcaaaaaggaaagaatccaatccaacaagcagtcacagtgggtgaccggtattaagataaacgagaaacctaatgtcgacaggtcttacatcaggaacatcagagcagccctccatcagataagggctaagggattgcaggaggctgcaaccaatttcttcaatttgaaggagttagccaacacaacagagattgatagattcctacggatactacagggacgcatctcgcacgtgggctttgtgaaaggtaaagacgacagtgcctacctgaaatactggagagaactgggcgaagtgatggccccaattcagaaagaacccctgatttattga

SEQ ID NO: 8820 - RNA, 1002 nt, unidentified
  source 1..1002: mol_type = other RNA; note = synthetic construct
atgaaaagcaaatacaagttcttagactcccagctggccatcgaagacattagcagtatattaaacatccgctttaccgaactcatcaagaacatcgaaaagcccaattatacgacatttcgaattccaaagaagtctggagggcatcgtgtagtgttcgccccgtgtagcgatcttatgaaaatccacaacatcgtcaacaataagctcagatctacctaccacatgatgcagccaaaggttgtgcatggattcacatataaaaccgccaaagagaaataccttgacatcggcattaaggcgaatgctaaaatgcacctcaataagaagtgcatcttgaacattgacatcaaagacttcttcccttccatttcaatcagtagagtgcgggcaatgtttgaatgcccccccttcaactacgaccataatctggcaactggcctggccctgctgttttgttataaagggcaactgcccgcaggggcacctacttcaccactcatctccaatttttattgcctgaaattggacgccgatgtcctggagctatccaactcagagaatatcacctacagtaggtatgccgatgatcttaccttttctagcaatgccattattgatacaaagttcgtcgtgaaggtgtccgaaatcctaaagaacttcggctttgagataaaccggaagaaacttaggaaggcctctaatttccaggctcaatatgtgactgggataaaggttaaccagacactgaatctgaatagaacctactatcgcaacctcagggcggtgctgcactcgatcgaacagattggtgtcagcgcttcaatgttgaaatacaaaggcaagaaacgctacattctgggagaggagcacaagtttttaagcagtgtacgaggaagaatagagtacctcggctatattcggggtaacaatgacgttctgtacaaggagctcaaaaacaagttcaacgctttgatagatagggctcctattaattactga

SEQ ID NO: 8821 - RNA, 993 nt, unidentified
  source 1..993: mol_type = other RNA; note = synthetic construct
atgaaagagattacaaaaaaccggttcctgtcactgcagtttgttgatgaactgtcaatgattctgggaatgtccctgggcgattttacgagcgccatcgagaatgcgaactacaaaagctttgaaatcccaaagaaatcagggggaactcgcttaatctcctctcctgactcactcaccaggaagttacaaagcaaactatatgtgtacctgaagagctactatcactcagtccaccctaaatgtgtccatggtttcattccaaaattcaaggccaaggcgagtcaccatatcaaagccaacgcacaggtgcatctcgggatgccctacctcttgaatatagacatcaaggacttttttcacagtatcagtacaactagagtgaggtccctgtttgcaaactcccccttttactttagccacgaagtatccactgcacttgctctgctctgctgctacgaacggaaattgccgatgggcgcttgtaccagccccgtgatttctaatcttatctgtttgcagatggacgccctgttcatcaagtggagtaatgagcagaagataaagtacaccagatatgccgatgacatttccttctctagcatgatggctttcagccataagcagattgaggatatacgtaccattatccagaacgagcgcttcgagatcaacgaaaaaaagctcaggattcaatcgagatatacgtccatgtgggtaacagggatcaaggtgaatcagaagcttaacgttaaccggacctatattcgaaatctgcgagccatcctttacgacataaaaacaaatggctgggaaaaggcttgcaagaaacacttccatctcaacgagaacactaaaaacgaggaagagctgaagtctaagttttacttcaaaatcaagggcaagatccaacacattggatatgtgaagggttattctgatgaggtctactctaaattgaataatcagttcctgggcctacagatactgtga

SEQ ID NO: 8822 - RNA, 1029 nt, unidentified
  source 1..1029: mol_type = other RNA; note = synthetic construct
atggagattaaaccatttcatcggaagatcacagatctccagatacagcagtttctgcacttcaattccgtgcatgacctcagtcacctcataaatatcgacacagacattatcgagcatgttttggacgaacctaagaggtaccacgagtttcctataccgaagagaaaagggggaaagcgccttattcactctccctcaagacccctcaaagacatccaaaaacgtttatccatttacttgacgcgcatctaccacgaatatgctccagcttacgtccacgggttcattagaagcaacaaaaagactagtagcaggaacatcctcacaaacgcgacccagcatctcgatcgtccatacgtgctaaacatagacatcgagaacttttttccctcaatcaacgccgaactgatcaagtcagcattcaacaaactgccgtttcagatgtattccgatgaaggtgcatctattatttctctgctgctgactaggaattggattctacccgccggctcgcctgctagtccaatcgtatccaatataatcttctacgagacagatattgccttacacaagtactgcatcaagaataagctggtttacactagatatgcagacgatctgaccttctctggagagctgatcaatgatcacatgaccgaagcgataaagaagataattatctaccacggcttcatgatcaacgataaaaaagtgcgacttcagagcaagcagagtgcccaatatgtgacgggaattaaggtgaacaacaagttgaacgtcaatcggaaatatattcggcagcttaggagcatcctgcatgactgggagtccaatgggatcgacattgcttcaacccgctattatgccggtaaactccatcggtaccaaaatcgcctggatatgtatactagctttaaggcaagcgtgcatggcaagttagccttcttgcaacagattaaacaggaggaacctgtccttcagggcctgtacaagcgattcatcgccctgaaaaatacctatatgtga

SEQ ID NO: 8823 - RNA, 1002 nt, unidentified
  source 1..1002: mol_type = other RNA; note = synthetic construct
atgaatacacataggattgaaaagttcatcgctgcaaaatctatgcggcagctagaactgtcacttctcgcatcgaggaatgagttgaaacagtgggttcagaatccagattatcggacctttgagatccctaaaaagaagggaggcacgagacagctgcatgcacctgctccaccgttgaaacgcatccagcagagtataaacgagctgttacaaatcctgtatgtacctactcaaaatgcttatggtttcatgctgaaacaggctggtgaaattaaccggaatactctccaaaacgcgaactgccacctgcagcgcaattttgtctggaacctcgatattcaaaacttctttccaagtatcagcaccaagcgagtgaaggccatttttatggaaggacccttttacatgacagatgaaatagcaagctacgtagccctgttatgctgttaccagaagcagatacctgcaggggccccctcttcacccatgctttcccacttcgcctgtcttcagatggacaatagcttacagaagtttatagcccaggcggcctttaagccgtaccagatttcctacacgcgttatgctgatgatctgactttcagcttggacctactcccatctgacgagattaaaaatggcattgagtccattatcctggagcacggattcgtgttgaataccagtaaaaacaggatccaacataaacaccaagggcagtgggtgacaggaatcaaagttaaccagaagcccaacctggacaggaagtatatcagaaagcttcgagcgattatccatcacgtcgaagctaaggggatcattgccgccactgcccgctacctgacactcgcagaggaacagatcaaacagaaggagatatccttcttcctgaactcagtgagagggaaaatcaactacgtcggcgctgtgagaggcaaggaggacgtggtttttaagaaactcatcaccaccttcaattctgccatcaacggcatttga

SEQ ID NO: 8824 - RNA, 1131 nt, unidentified
  source 1..1131: mol_type = other RNA; note = synthetic construct
atgtacttacagtcgtctgaaaacgtagccgacacgaaccctgactttccaagcgagaatcctgaagaagagaaaaggaaatttgcatgtctgttcctcatcatcaagcagttcaagatctacatgaacaaaaactacgacaacctggaacaactggcaaacattaaaacacccgatgagctgcttaacctgttagaagtgagcccctctagtctgattgctatggtggagaatcctcagtatgagacattccacatccccaagaaggccgggggttatcggtgcattgatgcaccctctgaagatctgaaaagagttcagcagaagctggcaagtcacctctcttaccttttcattaacttccagaccaggagtgtcatgggattcgttccccattataagggcataaataatccagcgggtattgtggagaacgctaaaaggcatattggacagccgatagtgttgaacattgacgtggcggactttttcccttccataaaaatctccagcatcaagaaaatgttcatgcaaaagccttttagcttcaacgatgagctcgcccacctgctcgctttgcttacctgctataaaggcaagctgccacagggagccccgacctcacctatcctgtccaatttttttctcctacgagctgatctcaagatcgagcgcattatgaagaaacgggaactaaattacacaagatacgccgatgacatcaccctgtccgggttcctttttccacaagataagttacccgacatcgtgcaggaaatcttgacaccatttgggctgcgtttgaacgagaaaaagataaggtaccaaacttttgtgggcagacaggaagtgaccgggatcaaagttaatgtcaaactgaatctcgacagacggtatattcgccgtataagggctattctgcactgttgggatgttaaaggaatcgaacatgctgccactgtatttcataagcgcaagatcaataacgccctagagtttacttcaacgatacgcggcatgattgcacacgtgggcaatgtccggggtaaggaggacgtgatcttccttcgatttcacgagaagttcaatagcttgtcaattttcgaggagatgaaggtcgtcgccatgtga

SEQ ID NO: 8825 - RNA, 1653 nt, unidentified
  source 1..1653: mol_type = other RNA; note = synthetic construct
atggtcgacaacaaacatggagcactgctcgatattgagtcgaaagaagatttcgcctactacctggagaggcccattaaagatctgacaatgctcgcttatgccaagaatgggatccggtacaagaccttcgagatcggcaagaagcgtagcggggaaaaaagaacaatcgaagcccctgttgggtatttaaaggcagtgcagaggcaactgttggagctgtttaacgaggcctacagaccaccacagtgtgtgcacggcttcgtttctagctgttctattgctagcaacgccatgtcacacgtgaaaaaaagcgcagtggtaaacctcgatttgcgggatttttttcccagcatcaccggagataggatccacggactgtttagaaaggaccccttctcattccctgaagatgtcgcgaatctgcttaccgagttagtttgctataagggcagcttaccgcagggggccccaacttctcctatcctttccaacatgatttgctaccggcttgacaagcagctagtgtcctatgctgctaaaaataagcttgtctataccagatacgcggacgacattacgttttccagtactagccgatccgcaataaacaagctcttcaatgagtctgagttgggcattaacagtgtatccccggaggtgcggaacattataggatccaaccgcttcgagatcaatgagacgaaaattcatatagcccggaaatccagccggcagcaagtcactgggatcatcgtcaacgagaaatgcaacttcccccgtaaggaatacagaagtctaagggtgctgtttaataactgggctctcgtaggctttgaatacgctggcgcagagtacgctaaacgcaatcacagttacagctcaaagctcttcaacgaagccggtctgatatccgaaacactcctgaagaagcacattcgcgggagactggagtactacacaatgattaccggtcctaataagaaagcctcacagccactggccaagctgtggaatatgtatcatgacgtgaccggggagaaggtgccaatctcaacccccgagcgaactgtctgccagactgagatctgttattctcgacaaaatgatcagggcgacccaattcctttatgtgaaaatggcacttccttcctgacagacaagggttatcttttcacctgcgcccattgtttgtgcgacatacatcacgaatacaagaaaatcggtgacgaaaggtgttcttttcctacactgaaggtgttgtatgagcccgaattgagcgatttcctgatcgacaagaccctggacgtagcagcaatcaaagcccccccattcatgaaaaacgaggcctttgccctgaccaacggcaattatttcccccaaataggtgaatcagttaaggcatacggcttcgcggggggagactccagtattaggtgcatcgaggctgctgtggctgagacgctgaaagccggcagagtgcgcgtggatcgcccttttatccacggcatgtcaggtggacccgttttcaatactcgcggagaagcaatcggactactcacaggaggctctgcccctgatgactattcgcacgatggggaatttgtcctttttagtgctatttctgaacagctcccgaatgcgtttaggtga

SEQ ID NO: 8826 - RNA, 1650 nt, unidentified
  source 1..1650: mol_type = other RNA; note = synthetic construct
atgcgcacacgggctgacgttgctgccttcctcggcgtgactccgcagcagctgggatttctggctttcagtagcgtaccaaaatacaccgtgttcaatatcaacaagaaacgtcctggtgagaaacgagaaatcaaggcacccatcctggtattaaagagggtccagaggagactcgctgatgtgatcgcctccatctatgagtccaacaacccacccaattctgtgcatggttttaggttgaacagatcaatcgcgaccaatgccaagtgccatgtccaccgggaagctgttttgaacattgatctggagaacttttttcccagtattaacggtggacgcattagggggctcttcctacacgagccctttaatttccctgaagaggttgcggatacacttacaaatctatgctgtgacgccggtggccttccacaaggtgctcctagcagccccgtgctctccaattgtatatgcaaaaggatggacaagcgcctgctgagctttgcgcgagaaaacgacctggtctacacgcggtacgccgacgacattactttctctgcctttaacaagaggagactgcggcacgcttgtttgagtgatggcagcccgtcccttcagctgtcctccgagctgctcaagattatcgaggggaatgggttctctgtcaacaccactaaaacccacttatcaacaaggtcttcacggcaggaggtcaccggcgtaatcgtgaacgaaaagtgcaattttaagcggagcgattacagagagttgcgcgtgctattacataattggttggacgtcggctacaaacatgctggcaaagagtacattaagcacaaacctgaaatagcactggccattgtagatgacgacgacacgatatctgagagaaaactgcgctcgcatatccgtggacggctggctttttacactatgctcgccaaccagaaccctgggatttctaagcccctgcgtagactttggaccatgtatgcaggggctacgaaagagattgtgcccaccgtggacccagagagcgcaatctggcaaattgtgacatattacgattatgtcagctcgaaggatggctcagtgaaaaatttctccaaggtgggcactgtcttcaaagcggacggcgaatgcttgataacagccgcccactgtgttgccgacctggatgaggtgaatgtgtgctccgaggccgtgtgtgaaatcgcatatgggcctgtgcctcagttctgcgagctcgggaacgtcgactggaatccaaagagcgattatgccgttctccacgagatgcccgaaatgctgaacaacatcacaggactgacttgtgatgggacctatagggcacaggttggggaaaccgtgtgggcttacggctatagcgatgccaagcctcaactccggtgcattgaagcacgcgttagtgaagttcatagtgatggtcgattctaccgagtagaccgcccgttcatcgagggcatgtccggaggaccaattataaattcaagaggatcagtgataggcatcgcagtgcacggctctgccccaagagaatatgtctacgacggagagtttctttcaatcgcccacgtgaatcttggaactaactaccagaccaatgaaagttgttctgcatcctga

SEQ ID NO: 8827 - RNA, 1650 nt, unidentified
  source 1..1650: mol_type = other RNA; note = synthetic construct
atggcatcccaggaaataagttttaccagcattgctacaaacgcacaactagccgagtactgtggggtgtcctgggacgagctcaagatgttagcatatgccaacagaatcaagcggtataccgaatggctggtaccaaaacggaacggagaagggttccgcagaatatccagcccaatggccaacctgcgacgggtgcagcgagcgatcgctaacggactctcagagttctattcgcctttgaagtgcgtctatgggtttgtttgtgagaggaacgtggccatgaatgcattgcagcacgctaggaagagaacagtactcaccctggacttgaaagatttcttcccgagcatcagcgctcccagagtcagggggctgttcatgaaggccatggatttcccccaggatgtggctgacaccctgacaaatttagtgtgttacgagggcagcttgccgcaaggggctcctacatctcccgttatcagcaacatgatttgctttaagatggacagggccctgcttaactttgccgccaattcaggctttacgtatactcgatatgcagacgatctcgtgttttcatctacaagtgcctatagcgctcgaaagatggtggatcaaggcaaaaatgtcgttgacggcattaaccggttcataatcgataccatcgagtccaatggcttcgagatcaatgagagaaaggtacatgtggcaaacagaggatccaggcagatcgtcaacggaatcattgtcaatcagaaatgcaacattcgaaggagccagtacagagaattccgcgcgttgttccatcggtggattcgcgaaggatgttcaagcgcagcggcggcctattttgggaataaaaagaaccactgctacaaggcaaaactgtgtgacggcgatgaactctgcgatgaaaagagtttcgtacgccacattcgcggtcggctagattacttctccatggttgtcggcgtgaatgggcacccaacggagcctatggctaagctctggacactgtttcatcaggccgcccatgagagagtgccatacctcacttttgagaaaagtgctgttcagttaagttacgtgtttgactctaaggagaagaatgacgcagttgccgctgaatcttctggtgtgatcgtccgtgacattctgctgacttgtgctcacggacttccagaagaatcaactgatgctaatggcgatgcggtccctatcgagattcgtactgcctttgatgagaggttctatatcaaggcctcttctttccggaaatgcagcggttttgacttcgccttcgtgctgctcgacgccaaactgggcaatatgggagtgcgctccatcaataccgcatacctgcctcaggccggcgaaaccatctacgcctctggctacgctggtgggaagatgccctcacattgcgtgcaagcctccgtcctgcccaatcggtacggaaacggtagtattgttgtggatcgtgcctttattaagggcatgtccggaggcccagtgtttaacacccgccacgaagtgataggtatagtacttaaagggtcagacgagtccagttactcgagggacggagagtttcttcctttcagcgctatcgcagacctggagcccttcgcattgcttaaaaaatga

SEQ ID NO: 8828 - RNA, 1677 nt, unidentified
  source 1..1677: mol_type = other RNA; note = synthetic construct
atggctctcaatttcggaaaggaaacgttcagtgacaatgtcaatattacaaacagtttcctcgaaattcagactcccgaggatctagctgcacacattgaggaaaatgtcaaagttctgaaaaagtatgcctatcccggaaaacgcatcttttacagcatcctgatcatccccaagaaagatcactccccacgactaattgaggctccctgcaatgacctgaagagaattctgcggaagatcacagatcaactgacatatatctaccaacctcctgcctgcgtgcatggttttgtatgctccaagagcgtggctacgaacgcccactcacatgtcaataaatactttgtgagcagctttgacataaagaacttctttcctagcatttctgccaagagagtgcgcggactcttcaagaacatctttttttacgctaacgacaatttgatcgacctgttaaccaatctggtgaccttgcataaacacttgccccagggctacccaacctcacccattatctccaatatgatttgtctgcaaatggataagcagatcactaagtactgtaaggaaaagcatttgttctactctaggtacgccgacgacatcacaatctctgggaattctaagcggctcatctccaatattttcatcagcagcaaagcagaggatttaacgttgtgtccagatttcagtaatatcattgagtccaacggcttttccctcaactctcagaagacacacattagctttaagtcggaccggcagaccgtgacccagataatcgtcaacaaaaagtgcaacattcctcgagaggtctacagatcacttagggttctgttctataattggcagaaaaacggttggcaatatgcagcgaacgagtatgcaaaattcatatccgaccatcattacatttctttcagaaacgacgtgaattcgcctatgctcacagatgaacagctgtttaagaaacacattcgcgggaggcttgcctattacaccatgatcgacgcgcagaacagtattccgtccaccccacttaccaagctgtgggaaatgtacctgcagtgcactaaagagcacgttcctatgagcctcatagagaataacgtgttccagctagaaatcacttatgactacgaaatcgatggtaagagcaataatttcactagttcctctaccgggtttttaactgagaaaggccttttcacctgcgttcacggcttaaaggagctcaaccagaaatatgatatcccggagaacaccaacgtggaggtagcctgcctcaacaaatcactgtctcgtaaattcccaagccaaataccaatcaaggattttctgctttgtgaagaagatgacatagccttctatcggtataagaacattaaacccctgtcaaacctggtcatcaactttaattacctaccgcagataagtgaacacgtcactgggtatggcatccccggaggagagactgatgtgtaccctattgaagcaatagttgacagcttcaagcttgacaaatcatgtgtacgcatcacaccaacattctacaagggaatgtccggcggccctgtgctgaatgctcgtcaggaggtgattgggatcatactggagggctcttcatttgacgatctgagtaggtgtgggttgtttattaggctcctgtcctga

SEQ ID NO: 8829 - RNA, 1626 nt, unidentified
  source 1..1626: mol_type = other RNA; note = synthetic construct
atgctcaatgggtttcagtccaaagccgacctggcagggttcctggacctgagtctggagaagctggatctgttcgtgaatcctacctctatgtatcagctctacagaagtaggctcgttccaaaacgctgtgggggctacagggagttgctcattccccggtctgacctgaaaaaagcccaaagaattattgcctgtgaattagagaagtcttatagtcctctcccatgtgtgcacggtttcgtgaaagggagaagcataaagaccaacgctgaaacacacgtgggcagtcaggtgatcgtcggcctggacataaaggattttttcccctcaatatctagcaagcgggtgtacggactcctgattagcaaacggctgggtttaactcccgaggtcgccttctgtatatcacgactggttgctacaccaaaggggcttcctcaaggggctccaagttcaccggtgatctcgaatatgatctgtctgggaatggacaaacagctcatgcatctcttccatgagtaccattatcagtacagccgatacgccgacgaccttactttttctttcagatcctccttctttttctatcgccacttctatagtggaggcaagttgcgtcttcccaacaagctacgaaatgctattacaaactttcacggaatcgccagcttcgagctaaatgaggacaaaagtttctacagcttttccttttcaagacagctggtgaccggcgtagtctgcaacaaaaagacgaatatcaaaagggagcagtaccgccgcttgcggtcaacactgcatcgcctctccgtgggagattgcaatggggcaatgggatgctactatggtaagtctgtcggcgaaatcaccgatgctgaaattaggatgtttgaaccatcactcagaggtagccttgactattataagtcgctgatcaaggacccttggacaagtggccccttaatgcgtttgggtagcctctacaacaacagcaagcccgaggatgccccagtcttccctgtagcgctgcaccaggattctattctttatctggagggagtcgactgtgagcaaaatccttttgaaggtctggggttctacttaaccggatacgggttggtgactgcatggcacgtcatatgcgacgcagtgagccgggacatggaatctggagagattaggatcttttcgagcaataagactcctctagccagattcatctactccaacgatctgcttcaggaaaacaaaagggatgcagcgatccttaaggatgtaccctccgaaatgattaagaacaccccgcagttatcccccaatattgatctgcctaccaagggcgagaaaattactgcctaccaacatcacttctccgaatccggattttcatttgagctgcacggcggcgaattgctacgcctcggggatcccaacgaggaaggcactctgtgctataccaactgctcatttatgcacggcatgagcggcggcccggtttttaacgggatcggccaggttatcggaatcgtgcattctgctacagagcagggcaagctgggttcctttcttccattgcgggattgcttcaggtctacggacgtttatgggaaatggatcatcttctga

SEQ ID NO: 8830 - RNA, 1626 nt, unidentified
  source 1..1626: mol_type = other RNA; note = synthetic construct
atggtggacgagcttcaaaccaagaaggagctggctgacttcttaaatctctcccttgataagctggactactttgtctcagctgacagtttttatagtctgtaccggcaccgactagtcccgaaaaggaacggcgggtttagagagctcctgatacctaggagtgacctgaagcgggttcagcgaataattgctaagcagttggagaaacactacaagccattgccttgtgtccatggttttgtgcgaggtcgttctattagaacgaatgcagatattcatgtgggaagtcaggtcatcgtgggccttgacatcaaagacttctttccctctatttcctccaagcgcgtgtatggtctgttaaagtcgaaaaaactgggcctgtcttcagaagttgcgttctgcttaagtcgcctcattagcactccaaagggattgccacagggcgcccctagcagtcccattatctctaatatgatctgtcttggtatggataaacagctcatgcacctctcccgggagtatcattaccagtattcccggtatgctgatgaccttactttctccttcgaatcaagttattggttttaccgtcacttttattctgacagaaagcttcgcattcccaacaagattagggtggctatcaccgaattccacggcaacaagtccttcgagatcaatgaaaacaaatctttctacagctgcaactacagccgccaggtggtgaccggcgttgtatgcaacaagaagacaaacattaaacgggaacagtacagacgcctgaggtccactctgcacagactgagcataggagatgaggaaggagccatgggatgttactacggcaagtccagttccgacctgtctgaagaggaaaagggaacattccgagcctctctccgtgggtccctcgatttttacaagtcactgttaaagaacccgtggagctctggaccgcttatgagattgggcagcctgtacaatcagtccaaagtggaaggagattcagtatttcctatcgcgttgcaccaagactcaatcctgtacctggagggaattaacagcaaagacgagccctttgagggcctaggcttttatttgccctcgtatgggctgctgaccgcctggcatgtgatctctgatgccgtattcgacgatagggagaagcggaacattggcgtgaaaagcagtgccaaaatctctctggggattttctcattcggaaaatcaacagtacaaacgggtaggcacgatgcagcaatcttaaatgatgtgccaccagagatcatccagtccttccctagggtgagcgtctccacagatctccctagcaaaggtgacaaagtttttgcataccaactgcatcatagcgaaaacggctttcgcttcgacctgttggatggagaactgctcgagatcgggtcaccctcggaggaagggaccctctgttataccaattgtctattccagcatgggatgagcgggggccccgtctttaatgggatggggaaggttgtcggcatagttcacagcgccactgaggacggtaagtgcgggagcttcctaccactcagagattgcatcaattctactgaggtgtatggcatatggaaaacattctga

SEQ ID NO: 8831 - RNA, 1713 nt, unidentified
  source 1..1713: mol_type = other RNA; note = synthetic construct
atgtgttgcttgcacatcatcttttgttatgtcagcatcaaatacgactcaacggaagagcccgccataaacttcaaggagaatctgatgctcaatgagcttcagagtaaaaccgatctggccggcttcctgggtctgtcaattgagaaactcgactttttcgttaattcctcatccatgtatgacctctacaggaataagctgatccctaaacgaaacggcggttatcgggagctcttaatacctcgtagtgacctgaagaaagtgcagagaatcatcgctaaggaacttgagaagagttacaatcccctgccctgcgtgcacgggttcgtcaagggacgctctatccagaccaatgctgagacacacattggatcccaggtgatagccggaatcgatatcaaagatttcttcccgtcaattagctcaaagagagtgtatggactactggtgagtaagaaactgggtcttacccctgaggtcgctttctgtattagccgcctggttgctactcccaaaggcttaccacaaggtgcaccctcttccccactgatttccaacatggtttgtctggggatggataagcagcttatgcacctgagccacgagtaccattaccaatacaagagatatgcagacgacttaacgttttccttcaagtcaagcttctatttttaccggcacttctgctccgaggagaaactcaggctgcctaacaaaatacggaatgccatcaccgacttccacgggaccgaaagctttgagatcaacgaagacaaatctttctacagctgttctttctcacggcagctcgtgactggcgttgtatgcaaccagaagaccaacataaaacgagagcagtacaggcgtctgcgctctactctgcatcgtctctcaaacagtgatatcgaaggagccatgggatgttattatggcaaatctatcgccaagctaacagatgccgagagggggattttccaggcagcgttgcgagggagcctgaacttttacaagtcccttattaagaacccctggacaagcggacctctcctcagactcggcagcctatacaataagacaaaacctgaggacacacctgtatttcctgtggctttgcagcaagattcgctgctgtacttagaaggcgaggatgataaagaaactccatttgaaggacttggcttttacctcactggctacggcctggtgacagcatggcatgtcatatgcgacgctgtgtctcatgatatggaacgcagggagattaaggtgtcctccagtgacaagaccccattggcaaaatttaagttcagcaagtccattgtgcaagacaataagcgggacgccgttattctgcgggaagtcccgcaggaaattctaaagaagatcccgaagcttcccgcggtcatggatttgccagtaaagggagataaaatcagtgcgtatcagcaacacttttctgagtctagatttagcctggaattgcattctggggacttgctgcgcgtgggagatccatcggaagaggggactctttgctatacaaattgctctttccagcatgggatgagcggtgggcccgtgtttaacgacttgggccaagtaattggcattgtccacacggccaccgaacagggcaaactggggagtttcctcccactgagggattgcatcagatcctcggacgtgtatggtgagtggcaggttttttga

SEQ ID NO: 8832 - RNA, 1713 nt, unidentified
  source 1..1713: mol_type = other RNA; note = synthetic construct
atgaagtttaaaaaaatcacagccaacagacggaactttatcaagtttatttcgccgagcgacaatgaagtgtatgacttcgacacggtgaaaaagcttagccagaacagacacaactactacaaaaaggtgaagattcccaaaaagaatggcggattccgagaaattctgattgtcaacggcgaaatcaaacggatacaggagaaaattcttgagttgctgcaatctgtgtacaacgattcatctactccaaaatgcgtaaacggctttgtcaaggggagatctatatatgataatgccgcaatacacaccaacaagaagcacgtcatcaacttcgatatcaaagacttcttcaaaagtgtgacattggagaaaatcaatacatacctgtcctataagcctataagtcttccaaggaaccaatatccaaacgtattaatctcctacttgtgcacgtatgatcgctatttgccccaaggggcccccacctcccctatactgtccaacatcgtgctgaagaactttgattacgccatgatcatgctcgccaagaaacataaactcgtgtacagccgctatgctgacgatctgacatttagtggtaatgaagacattgacttcttcagtttcaagaatacagttgctcaaaagcttaacaagcatggcttcgagatgaatatgaataaatcccgcatccagtacagctggcagcgccagattgtgactggactggtggtgaataacaaggtgaacattaagtcagagttcgttgctaccactaagtctatgatttacaactgggagaattatgggatcgatattgcgaaggaaaagtttaaccagcacaggaagcattctgatgggattcattttgagaatgtgctcagaggacgtattgacttcatcggatcaatacttaatcgatcaggggaatataagaaccctgtctttgcgcagctaaatctgaagtattggatcctgctgaattgtatcgactatagctttgtctcggagaagtctgtccgagacaaactctttaatcggaattacgaatctgagaaaatcgcatacgactctagcctgtatgagtcccaggaatatcggtttatcagctattgtttcaaggtatacactcagatggagataatttacaagtactacttctacctcaggtttaatggcgatttcatgaaaataggaatgttcatgtacgataactccaagaacattcgtaagcaatttaagcgcatgtttagtgagtgcgaagacgaggacaagaaaattaaattggctaaacagcgaatcagcggcatcaagaacctcaaagaaatttccaccttcaatatcgaaagcctgttcatggatcagttatacaggaaaaggaatagatcactgcccaaattctttaacttcatacgggagattcgcaattatcatgcccacgcaggtgaaaaaatcgttaagcagacattcgaagaggtgcagtcagacgtcaagtccatcatcgagagcaaaaatctgtcagaggtgactctcgaaagtaaaaccttcaccggtgttagccacgaggaactgcggaagattaatcactaccagttttacttatggttccagtccagtccttttgacgatgttagggagattctaaaagagctagcatttgaggtaaagctcatcgaaaacagaatcaaaaagaacgcccacaatacctga

SEQ ID NO: 8833 - RNA, 1032 nt, unidentified
  source 1..1032: mol_type = other RNA; note = synthetic construct
atgatcaccgagaaccacattcaggctctcaaagcttcaaccgatgcggacagctttgtccaagctatgatgccaggcgttgattatctgatagatagcaagaggtccaaactcgagcattcggaaatcgtcaaggtggtgaagaacttcgagttattcactagcagcgcatccatacgccgctataggaccttcgagatcccaaagaaatcaggaggttcacggaagatcgaagcgccggtcttgccccttaagacccttcagcgattaatcctgctatttctggagtccgtgtatgacgccccagcccaggtgcatggctttgtaaaggaccggtccatcataacaaatgcaatgtcacatagcaacaaagcccacgtgctcaatatcgacattgaacagttcttcaattccgttagacagactagagtgagagcacttttcaataagcatctgggcttttcgcagtatagttctcttatgctgtccaaactcatgtgtcacagagggtgcttgcctatgggcgcccctacaagccctctggtcacaaatctgatttttcaaagggcagacaagcgcattttcgccgctagtaagaagatgaacgtgacatacactagatacgcagatgacttgtctttctcttgtgattctgttgagagtctgcaccgtaccaagcgactgatcgctgtaatcattcggcaggaaggtttcaaggtcaaccccaagaaaacgcggctcttgcacagggccgattgccagtcagtgacggggttagttgtgaatgataaagtgaacgtgctgcgcacctaccggaggactactcgagctatcaatcacaggctggagatcagcattaaagagcacagcggggacaccaatatggccctcattgccgcttctgaataccatgccatgaaaacaggccaaaacgacgcccgtccccctataagtcacctgaactttattaaaggacgccaggcatttgagtacggagtactaaaaagttctcaatcccccgaagaatcctga

SEQ ID NO: 8834 - RNA, 2367 nt, unidentified
  source 1..2367: mol_type = other RNA; note = synthetic construct
atgaagtccctcctcaccccctgctccaagaaggatactccgcctgaagatttttccagtcagctgcaacgctggctgatcttccgcccggagttcgacattaaagtgttgcaaaagcagaactgttggccaatcacagggcaacattacaagtcctttaatgttcaaaagcggaacggaagcactagacagctggtgaccgtggataagaaattgaaaagcgttcagaggaacttgcttcactatttcgagcagtactacgatgtgagtaaacatgcatacggattcgtcggcgagacagctaacttcaaggtgaacaagaaaaacctgcggactcggggcgtgataacgaatgccctggcccacaccaacaagaaagtcgtgatttctctagacctggagaacttttttccaagtattacctttccccgagtcatgggcttactgaagagcaagccattcaacttctcaaacaaagaggctgccatcttagcatctttagtttgcctccctaaagccatcgatgataagcgtggcttgccacaaggtgccccaacgagccctattatcagtaacctaatttgcaagaagcttgattaccaggttggcaaaatggcccagaagtatgatttgatctataccagatacgcagacgacctcactataagtacaaataacctcaagaggatcaatgcaaataagatcatctcactggtaagggattgtgtggagcggaatgggtttagaattaataaggaaaagaccaaggtgatgtaccgtaatcagagacagatggtgacggggatcgtcgtaaatgaaggtctgaatcttcccaaaaagaacgtggacgcgctgaaggctaccctgcacaacctggaacatgtttacaaaaacattgacgaggcagttgatggatccaacaaaaataactacgattcattcacccctctcgtgtactgtggtgtcttctacaaaggcaggtatattcgaaccatttcacgcggtcagaaatctactaaacccacatctgataaggaattcaactatatctactccagacacatattggggcgagtcctatggtatggtcaggtggtcaccactggaatcaataccccctatgatttgtccaatagaaagcatatttcccccaagcagtacagtcgcattgttaagtttgaggaaatgcttagctccctatatcggatcagcatcaaattcaactggcccattgagcatattatcttccgactgtcgaataaactgagccacctgcagtctatcgtgaaaaccaatccggagctgtccttagagagtaccgaacctaataaagacgaaattgaactaaagcaccgctttagcaatcttaaaaacactaaagaggaccgcaaacagttttttgacgactctccttcgacactcaagcgggctctcattgtggagaacaggtcccacagcctcttttcatttaaaagcatcaaaaagcacgtcgaggacggctggtatataccaaccgtacagcaggaggtgttcaaggagctcgacaccggacaactctctgacctttttcatagatctgccaatgctcaaggacacaacgtgcttaatttgattctggagatcgtcaaggttgtcaagccacgtagcaggtacctgtctgaagaagtgaaggacaaaatagtgatggtacataaggaactgttgaaactgatccggtctgaaggggagggcgtgtgtatcgaatatagcaaagaatcaacatcaacaaagcttgctattcaggctatcaacgacctgaaactgagcactcgcttgtacgaggacgatacagacaatttttacaacaggatagtcctggatgcggtgaagcagagtggcactgaacatctggtgaatatcgatagacaaggtatggagactcggctggtgaccgatataaaggcatggagagactcaatcgtgcatattctgttctctataaagcagcacgccgataaatccgaagtcggaatcggcagtcctcagcctaagccatatacaataaaattcagggaggaaaaccccattacgaatatccctcgggccgtagagatttaccgactgaatgttgacctccccttcaacaaaaagctgaatattgcgtccaacatagagtatggactgatcgataaatggcttacggggagggacttattacttgccattaaacgctttatgcccatcggggacatcttcactcacgggaactatctcgactgcgacaactttacagtaaatctcacagagcactcattcaagaaggagaataacattacacacaaaagctatggcaagctgttcatctcgctccaggagataaacaattga

SEQ ID NO: 8835 - RNA, 2361 nt, unidentified
  source 1..2361: mol_type = other RNA; note = synthetic construct
atgcggaatctgctgaccccactatctaaaaagacatccccgcaggaagacttcttcagtctcctacagctttggctgacttcccgacccgaattcgacatcaaagtattacagaaacagaactgctggccgatcacagagcagcattataagctctttaccgtcgagaaaagaaacggaaaaacaaggactttggttacagtggacaaacaactgaaatctgttcagcgaaacctgctacagtatttcgagaagaagtacgaagtctcacaatacgcctacgggtttgttgggggaacatctaatttccaagctaacacaaaacacctgaggaccaggggcgttgtgactaatgctctggtgcacaccaacaagaagctggtcatatctttagatctggaggacttttttccaagcattaccttcccacgcgtgatgggactactcaaaagcaaaccctttgacttcagcaacaaacagagcgctatactcgctagcctgatctgcctcccaaaggggatcgatgataaaagaggtcttccccaaggcgcacccacttccccaattattagcaaccttatctgcaagaaactggactaccagctgggcaagatggccaagaagtacgacctgagttactcacggtatgctgatgaccttacgatctcgactaacaatctgaagaagataaacgcgaacaaggtaatatctattgttaaatcccacgtggagagaaatggcttccgtattaattccgagaagacgaaggtaatgtattgtaatcagaggcagatggtgacagggatactggtgaatgaaggtttaaatctgcccaagaagcaggtggactcgttaaaggctactctccataaccttgagaatgtgtacaagaacgtgaacgagtccgtgaagggagcaaacaagaacaaatatgattctttctcccctgtgggattttataagggcggctaccgcggtaggtatatccggtcaattggaaagggcaagaaaagtaacaagcctacctccgataaagagtttaactacatctactctaggcatatcctgggccgggtcctgtggtacggtcaagtggtgactacaggtattaacaccccttacgacttgagtaaacggaagtacattagtcccaagcaatatagcagaattatcaagtttgaggagatgctgtcaagcttgtataggatatcgatcaagttcaattggtcaatggaacacatcatatttcgcttctctaatagactctctcatctgcagagctccgttaaaatgaacccggaactgcttattgaacccattgagtttaacacagaagaagtcgagcttaacaaccgattctccaagttgaaaaaaaataacgaggagtgcaaggtgttttttgacaattgtccagcctctctccagcgcgcactaattgtcgaaaataggagccggtcacggttcttatacgggtccatagagaagtatatcgaaagtggatggtacatccctgccatgcaacaggaggtgtttaaagatctcgacaacggccagctgtcagatctttttcacaagtcttcgaatgaaaaagggcacaatgtccaccgtctactgctggacatggtcaagttggtcaaaccccgcatcagatatcttagcgaggaaatgaaggacaaaatcctgattgtccacaaggagttactgaagctgatgcgctcagagggcgagtccgtgtgtattgagttcgggaaggatagcgaaaagtctaagctcgcactgcaggccatatccgatctcaagctctcaactagactgtatgaggacgacaccgacaatttctataatagaattgtgctcgatgccgttaaacaaagtggtacagagaacttggtaaatattgatcgattgggaatggaggcccgtatcgtcacagacatcaaagcatggcgggacagcatcgttcatgtattgatctccattaaacagcactccgaaaaaaccgaattgaatttggggagcagtcagcagaaaccatatacgatcaagctgcgagatgaaaatcccataactcatgaacctcgcgccattgaaatttacaggctgaatgtgagtctgcctttcaaaaaagagctgaacatcaataccgagagcggcctcattagtaaatggctgacgggcagagacttgctccttgcgaccaaaaagttcatgcctatcggagatgtgttttcacatggcaacttcattgattgtgaagattttgtagtgaacctcaccacccacaattacatcaagaaggagaatatcatcagcgacgattacgggaaacttttcatctctctcgaggaaatcaagaactga

SEQ ID NO: 8836 - RNA, 2361 nt, unidentified
  source 1..2361: mol_type = other RNA; note = synthetic construct
atgaaatcacttcagacccccctcagcaaaaaggccgtgtccagcactgatctgtcaagcttgtttcagaggcttttaactactcggcctgaatttgacacaaagagcctgcgggaacagaattgctggcccatcaccggccgtcactataaagagttcaccgtgcagaaaaggaatgggtccaccaggagactcgtcaccgtagataaacgcctcaaatctattcaacgcaatctgcagcagtacctagaacagaacttcgaggtaagtcagtacgcttatggttttattggggaagccacccagtctcataaaggtagacaggatttacgagcccggggagtggtgtcgaacgccttagcacataccaataaaaaggtggtgattagcatcgacctcgaggactttttcccgtcaattacatttcctcgcgttctcggattactcaaaagtcagccctacagcttcagtaacaaacaggccgccgtcctcgcatccctgatatgcctccctaaatccattgatgataaacgagggcttccacagggagctcccaccagcccacttatatcaaacctcatctgcaaaaagttggactaccaagtaggactgcttgccaaaaagtatgacctagtgtacactcggtatgcagatgatctgacaatcagtaccaataatgtcaacaaggtgccgcccatcaagatcctctccttagtgaaatcgtgtattgaaagaaacggtttcaaggtgaatagcaaaaagacaaaggtgatgtaccccaatcagcgacaaatggtgacggggctcgtagtcaacgaggggcttaatttaccaaagaagcaggttagttcactgaaagccacactgcataatttggagttcaagtataagaacgtcgacgatgcggtaaaggattccaataagaacaactacgattcctttaaccccgtcggctactattctggactgcatagagggcggtatattaagtctgtggcaaaaggacgtaagtccacaaaacctacaagtgagaaagagttcaactacatctactcgagacacatccttggcagggtgttgtggtatggccaagtcgttactaccggcatcaataccccttatgacctgtccaaacggcagcacatttctccaaaacagtacgttcgaatcatcaagtttgaagagatgctgagtagtctgtaccgcatctctatcaaatacgactggtctattgagcacatcatcctgaggttttccaacaagctgtcacacctaaagtcaagcctccgtctgatgcccaattacagcctcaacaccatcgagcctccacaggaagaagttgaattgaaagagcgtctgctcaacttgaagaatactcaggaggaaaggaagaaattcttcgataacgctcccacttctcttcagaggacacttacagtcgacaacaagtccagaaaggagataagttttgtgagcattaagaatcgcatcgacaatgggtggtataagccagatttccaacaagagctgttcaaggagcttgaccatggccggctgtcggatctcttccacagaagctcaaacgacaagggccacagcgtgcaggagctgctagtcgaaatcgtgaacgtcgtacgcccacgccttcggtatttatccaaagagatgcgcgagaggatcgtcaccgtgcaccgcgaattgctgaaactaatgttgtctgagggagagggggcctatatagagtatggcaaggacagctcagctaagcctattatccaggctatttcttctctcaaactggcaaccaggctgtatgaggatgataccgacaatttctacaacaagattgttctggacgccgttaagcagtctggtacggagaactatataaatatcgatagaagcgacatggagctaaggttggttacggacatcaaggcatggcgagattctctcgtgcacattctgttcagtataaagcaacatctggacaagacagagctggacatcgactcactgagtcataaaccctacactattgtgttcagagatgaaaatccaatttcaagcgaacctcgggctgtcgaaatataccggtccaatgaatctctgccgtataagaaaaagctggaaattcctctgaacagcgattccggctttctggataaatgggtgacgggcagagatttgctgctggcgattgagaagtttatgagcgtgggcgacgtgtttgtgcatggaaattttaaagactgtgacaagtacaaggtcaacctgactgaacactcctacataaaggaagacaatgctacttccaaggtttacggtaagctgttctttacattgcaagagaacaaatga

SEQ ID NO: 8837 - RNA, 2361 nt, unidentified
  source 1..2361: mol_type = other RNA; note = synthetic construct
atgaagtctctgcaaaccccccctccctccaagaacattagccatgtggatttatccagtttgtttcagaggtggctgataagtcgtcccgaatttgataccaaagcactgcagcaacaaaactgctggcccataactggccgccattacaaagagtttgttgtacagaaaaggaatgggaatacccgccggttagttaccgtagacaaaaaactcaagtccattcagcagaatctgctgcagtacttcgagaagaagtacgaggtatctcagtacgcatacggtttcgtgggcgaagtccctcgcgtgcagacaaataagcagaatgtgcggaccagaggagtcgtttctaacgccctcgcccacgccaataagaaagtagtcattagtttggatctcgaggatttcttccccagtatcacttttcctagggtgatcgggcttcttaaaagccaaccctatggattctctaataagcaaagtgtggtactcgcctcttgtctgtgcctccctaaatcaatcgacgagaatagaggactacctcagggcagccccacaagcccgattattagcaacctaatatgtaagaagctcgactaccaggtgggccgactcgctaagaaatacgattttgtctacactcgttatgcagacgaccttaccattagcaccaataacattaacaagatctctgctaaggaaatcatctcaatcattaagtcatgtatcgaaaggaatggctttaggttaaacaaggaaaagacaaagatcatgtacagaaaccagagacagatggtgaccggaatcatagtcaatgagggtctaaatctcccaaaaaagcaagtcgacgctcttaaagccaccttacacaatttggagtacaaatataagagcgtggacgaggcggtgaaagggagtaacaagcataactacgatagctttaatccagtgggatactatcgagggctgaataaaggccggtatatcaaaagcattagcaagggtcgcaaatctacgaagccgacttccgacaaggaattcaataagatttattcccgacacatcctaggacgtgtgctgtggtatgggcaggtcgttacaacggggattaacacaccctatgacctgtcaaaccgtaaacacatttcgcctaagcagtactctagaataatcaagttcgaggaaatgctctcctcactgtacaaaatatcttccaagttccactggaagatggaacacatcattcatagattctctaataagctcagccatctgaaaagctcgctgcgcttgatacccgatttctccctgtcatccctcgagctgaacagtgaggatatggacctgaagactaggctccctacactgaagtctactttagaagagaggaaggacttcttcgatctgtgcccaaaaagcttgcaaaggacacttgtcattgacaacaagtcccgaaagaaattcaagatctcctcccttgaaaacagaatcaacaatgggtggtataagccagaagtgcagaaggagctgtttaaggagctggacaacgggcggctgagcgatctgtttcatagatcatccaacgaacagggacactcagtgcaggatttgttgtttgaaatcattgactcggtccgcccccgactgaggtatctgagcgaggaggttaaagagaaaatcgtggtagttcatcgcgaactgcttaaactcatgttgctggaaggcgagaattcccacattgagtatggtaaagacagttcaacaaaaccagctattcaggcaatcaatgatctgaagctgagtaccagactgtacgaggacgacactgataatgtgtacaataaaatcgtgcaggctgctgtcaaacaaagcggcactgagaatctaattaacattgatcggtccgacatggaaacccggcttgtgacggatatcaaggcctggcgggacagtctcgttcacattttgtttagcattgaacagcacgccgacaaaaccgagcttgatagcgccgccctgcaccagaagccgtatacagttgtgttcagagacgagaaccctattacccaagagccacgcgcaatcgaaatataccggttgaacaaagacctcccatttaagaaaaacctgaacatcgcgcctaattcatcctctggcttcatcgataggtggcttacaggccgggatatcctcttagcgacagagaagttcataagtatcggtgacgtgtttgtgcacggaaacttccgcgattgcgagtgttatacggtcaacctaactgaacattcttacatcaaggaacagaaaccaaactcctcaaactatggcaaactgtttatctctctgcaggagataaaatga

SEQ ID NO: 8838 - RNA, 2406 nt, unidentified
  source 1..2406: mol_type = other RNA; note = synthetic construct
atgaagaacctcagcataccttcccccaagataaaccctacacaggactcattcctgtccatgttttttaggcagtttgatagtaatcccgaattcgacaccactgttctgaagaagcagaaatgctggccaatcaccactgagcactatcgaccctttacaatcaggaaacgtaatgggaccctgagagaactcgtcacagtcgacaagaacctgaagaaaatccagtccaacctgttgatatacttctctaagaactacgaggtcagcaaatacgcccacggctttgtggcaaaagagattgaaaatcagtttcccaacaacaaagaagaatatttggtggggggcagactgagggcgaaaggagttatcaccaatgctctcagccatactaacaaaaaagtggtgatctcactggacttaaaagacttctttccctcaatcacttttccgcgtgtaatgggccttctaaaatccaagtcattcgactatagcaacaaacaggctgctattctggccacactcacctgtctgccgtcatccgtagacacgaagcggggtttgccacaaggcgcgccaacctcccctatcattagcaacctcatctgcaaaaagctcgattatcagctgggaaaaatagccagtaagtatgatctcacatatagtcggtacgcggacgaccttacctttagcaccaataatctgaaacggatttccgccaataagattatctcccgcgtcacagagtgcgtgaagcgaaacggcttcgtgattaacaatccgaagacgaaaataatgtacaacaaccaacgccagatggtcactggtattatagtgaatgacggactcaatttacccaaaaaggaggtggatgctattcgcgcaactatccacaacctggagaataaatataaatccgtggatgacgctgtaaaagggtttggaaagctaaagaacaagaatccttacgatagcttcgtcccactggggtattacacggggggctataaaggaaggtacattaggaatgcccgcaagggcaagaaagcaaataagccaacaaccaataaggagttcgactcgatatatgctcttcacattttaggacgtatcctttggtatggccaggtggtgacaactggagtgtctactccatacgacctctcaaagcgaaagaatattagccctaaacagtattcccggattaacaaatacgaggagatactggcctctttttatagagtttctatgcgcttcaactggcctgtggagcatatcatcttgcgactggccaataatctgcctcatcttcagagtctggtgaagatgagtccacagttcctgctagagccaatctttttaaatagcgaagagacataccttaagaattcgatcagcaagctcaagaaagagaaatctgactacatcaagtttttcgagtctgccccagagagtcttcaacgagtcttagtggtagagaattgttctcatgacaacttcatcttcaacaccattaaaaagtgtgtggaaaaaggttgggaggttcccagcattcagcaggagctgtttaaagacctgaacaccggtgatttgtcagatctgttccacaagagttacgacagtaccggccattccgtgaaaaagcttattatcgacctggttagagtcgttaaacctagactcagatacctgagtagttccatccagaataagatcatcctggtacacaaggaactgctcgatttgatgcggtctgaaggcgaggacgtgcggatagagtatgggaacgaatccacaaagaccaagcaagctttgcaagccattagagatcttaggcttgccgttcgcctgcacgacgatgacacctataacttttacaacaaggttgtgctagaagccgtcaatcggagcggcacgtctgatctcgtgaatattgatagggatgatatggagtgtagaatggtgtcagacatcaacgcttggagagatagcctgactaaagtgttgatgtctatcaaacagcacgcagatacaacggaaaaagagctatcgccctcacagcataagccctacactatcaaattcaaagatgagaaccccatcaatggtgagtctcggagggtagaaatttaccgcctggaagtcaccctgcctttcaaggagaagctcgaaatcgataccgattttaacgaaggaatcatttctaagtggaaagtggggggagattttaactcagcaattaagcgctttctcgcaattggggacatcttcgttcatgggaacttcatagactgcgaaaattgcacagtcaacttcactgagcacagctacaagttagaaaagaatatcgtcaggaagaaccacggcaagttgttcatttccttccaagaaataaagagcaagtga

SEQ ID NO: 8839 - RNA, 2388 nt, unidentified
  source 1..2388: mol_type = other RNA; note = synthetic construct
atgacgaccaagttttctcacccacagaagagaaacttcaattctttcattaggctcaacttcttctcaactaacgcccctgagttctcaactaccgaactaaaaaagaataagtgttggccgattacagaaaaacactacaagagtttcacgatcactaaacgaaataaaacagagcgcgagctggtgactgtggacaagaacctgaaggttatccagagcaatttatacgacttcttcaaacagaagtacaacatcagcaaatacgcccatgggttcgtagctaaagatcctttaatcttgtctctcctgaaagagcaagataagccactgcgcagtaagggcgtgataactaatgcactgtcacacacaaataagaaagtggtgattagtcttgacctgaaggatttttttcccagcatcactctgcctagagtgatcggccttttaaagacgcagccttataacttcagtaacaagcaggcggcgatcctggcatcgcttatttgcctccccaaaaacatcgacaaaaaacaaggtcttcctcagggtgcccccacatccccgatcatcagcaatttaatatgcaagaaactggactatcagctcggcctgatttctaagaagtacgatatcacgtataccaggtacgccgatgaccttaccttttcaacaaataatctgaagaggatatccgcaaccagaatagttgagaaggtcgctgagtgtgtgaaacggaacgggttcaagattaacgacagtaaaaccaagattatgttctccaaccaaaagcagatggttaccggtatcctggttaatgaaggcctgaacctgcccaagaaggacgttgacgctctccgcgccaccctctataacctggacaaagtgtatacttctactgacgatgcagtaaaggggttctggaagttgaaaggcaagaacccttacgacacctttaccccagttgggttttacctaggtgggtttaaaggaaggtacataaaatctccctcaaaaggcattaaaagcactaagcccacaatcgagaaagagttcgaaaaaatatacgcccagcaccttttaggccggatcacctggtatggacaggtggtgacaacagcaattaacaaaccttatgacttggtgaagaaacagcacataagcccaaagcagttttcgcggattaagaaatacgaagagatgctcgcaaccttctatcgaatctccatcaagcgaaagtggccaattgaacacattgtgctgaggagagcctacaatctcccacacctccagtctctgatgaagatgaatcccatttatcttctagatgcaactttcctcgatgagaataaggaaatcgagcagttgaaaaacaaggtgtctgagctcaaaaccgacaaggaaaaatataccgaattctttcgttccgctcccaggagcctgcagcgcgtactcagacatgagaaccggagccacaacaatttttctctggagagcattaagaagttcaccaattttgggtggcaggatcccattaagcagaaaaaagtctttaatgccatcgacaacggcgagctgagtgatatctttcatcaatcaatcaacagagatggggataatatcaaggagactatcatcaagttcgtcacagtggttggaccacagctaatttacttgtccaaggacgtgaagaataagctcatcaatgtccataaggaattgctggccctgttaattagtgaaggagagtccttcaacatagatttttacaaagagaacccaaagacagagcaagccttgcaggccgtgcgcgacctgaaatcagctattcggctttatgaaggcaactccgaaaacttttacactaagattgtactggaagctcttaaaataaccgagactatcgatatggtcgctattgacaagagagacatggcccctcgtatggtgacagacattaatgcttggaggaatgctctgattaaagtgttgatgtccataaagcaacataccgacgaaacagaaaaacacagcaacgcccagaaacaaaaacccttcaccataatgtttcgcgagcacgatgacgatgaaaacatcacaacggcgatcgagatctatcggctgaattccgagctcccgttcaaaaaggagctaaaaatagatactgaggtcaagaatggcaatgtaaaaaaatggaagacgggaggagatcttaagtccgcggtcagcaactttctgagcatcggagacatttttatccatggtaagttcaacgattgcaaggatatcacctttaatctgacagagcatgtctataaagtcaataaggagatcaaggaaaacgaatacgggaaattgtttattacactcgaagagctgaataactga

SEQ ID NO: 8840 - RNA, 2397 nt, unidentified
  source 1..2397: mol_type = other RNA; note = synthetic construct
atgaacaagacatctatctcaagcccaaaggcaaagacggtggacctaaaatcaattttcatggccttcgagaaatggagatctaatagacctgagttcgacaccgccgctctgcgcaaaaggaaatgctggcctgttaccgctaagcattataagaaattcaccctcaagaaacgcaatggaagcatgagacaactcgtagtggtcgacaaaaatttgaaggagattcagagctctctggccatccatttcagccaaaactataaagcaagtgagtacgcatacggattcgtggccaaggagagtgagcttacggccgccaagacccagccagagctttctctcgataaactaaggccaaaaggtgtcatcaccaacgctctcgctcataccaataaaaagctggtcatatcgatggatctgaaggagtttttcccaaccataactttccctcgcgtgatgggattgttgaaaagcgaaccctataaatttagcaataaggaagcgtctatcttggcctccatgatctgtctgccaaaggaaattgatgacaagcggggccttcctcaaggggcgcctacatcccccattatatccaacctgctgtgtaagaaacttgactttcagttaggccgcatagcccagaagtacgatttgaattacactcgttacgcagacgatctgacattctccactaataacctgaaacggatttccgctaacaagatcattcatgaagcgacgaaatgtgtggagcgtaacggctttcacgtgaatgtcgacaagactaaagttatgtacagcaatcagagacagatggttacaggaattctggtgaacgaaggcctaaatctgcctaagaaacaggtggatgcgattcgggccacactccataatctggaaaagaagtataagaccgttgatgagagcattacatctttctggaagattggcaaaaagaactcctacgattccttcgtcccactgggctactacgccgggggatacaaggggaggtttatcaaatccgcctctaaaggttataagggaaataagccaactaccgaaagggagtttaactacatttactcaatgcacttactggggcggatcctttggtacgggcaggttgtcacaacatcgatcaatgagccctatgaccttaagaagagaaaattcatttcccctaaacagcactcacgcataatcaagtttgaagaaatgctcgtgagctattaccgcatctccattaaatacaagtggccggtggagcatataattctgcgcctcgctaacaaattgccccacctgcagtcattaatcaagatgaaccccggctttctgctggactcattactgctgtctgtggaggagcacgagcttatagaacggtttcgaaagttagggcgagataaggaagagtataccaggtttttcaagagctccccccctgatctgcagagggtgctacgggtcgcaaatagatcccataacaatttctcacactcaactatcaaagagtgcgtcgagaatgggtggcaatttcccaacaagcagcaattcctttttaacgagctgaacactggcaacttgagtgacctgtttcacaaatctctagacaagaagggacacaacgtggagaagctgctctccgatctcgtccttgtttgcagaccccggctgcgatatctgagccccaacattaagagcaaaatagtggctgtgcacagggaactgttggatctcatccgaaccgagggtggagatgtgtttatcgatctcgagaacgaaactaaaaaaaccgaactggcactccaagctatcagggaccttaaaagtgaaatccgtctgtatgacggtgattctgacaacttctaccagaaaattgtgcgagtagcactgaaccggagtggcgactctaacatctttgccatcgacatggatggcatggcaagtcgcatggtaacagacattaaagcttggcaggatgccctcacaaaggttctcatcagtattgtacagcacacgaagtcacttgacgataaggcccagggtcaggccctctatactattaagttcagggatcgtaatcccatcaattgcaagccgagagctatcgaaatctaccggctcaattatgaactgccattcaagcagaaactggacatcgacgccaatagcaattgtgggcaggtgatgaagtggctaaccggaggtgacctgaccctcgcaattaagagctttttaagtgttggcgacatcttcgtgcatgggaaatttttggattgcgacgatgtaactgtcaacttgacggagcaccagtatatcagagaaaaacacgaaccgatagacaaactgggcaagttattcatcacattgcaagagatatcggagtga

SEQ ID NO: 8841 - RNA, 1239 nt, unidentified
  source 1..1239: mol_type = other RNA; note = synthetic construct
atgaacaatgccagtatcagctctcataagccaagcaatagggacctggattcaattttcatggcgttcgaaaagtggctcaagaataggcccgaattcgacacggccatcttgcgaaagcgtaaatgctggccaatcaccgccaagcactacaagaaattcaccataaagaaacggaatgggtccaatcgtgaactcgttgtggtggacaagaaccttaaagagctgcagtccaatctggcagcctactttgcacagaactatgaggttagcgactatgcctacggctttgtaccgaaagagcctgagcggagaattggcggaaaggaacagtccgagcttctggtggagaagttaaggcccaaaggtgtaataacaaacgcactgtctcatactaacaagaaactcgtgattagcatggatctaaaggatttttttcccactataacgtttcctagggtgatgggtctgctgaaaagccaaccctacaacttcacaaacaagcaggcttcaatccttgcttccatggtgtgtctcccaaaagatgtggacgataagagaggactccctcaaggcgctccaacctcgccgatgatcagtaacctgatctgtaaaaaactggacttccagttggggaaaatggctaagaagtatgacgtgtcttacactagatatgcagacgatctgacctttagtaccaataatctgaaacgcgtgagtgcgaacaaaattgttcacgaagccaccaagtgcgtggagagaaatggatttcgggtcaatgtagataagacaaaggtcatgtactcaaaccagcgccagatggtgactggtatcctggtcaacgaggggctcaacctgcctaaaaagcacgtagactcgattcgagccacccttaataacctggaacacaaatataagtctgtcgatgaagccgttgtcggcttctggaaaattgggaagaagaattcctatgactcattcgttccactcgggtattatatcggcggctacaaggggaggtacataaaggccgtgaacaaaggctttaagggaaacaagcccacaagcgataaagaattcaataaagtctacgcactacaccttttgggccgcatcttatggtacggacaggtcgtgacaacttctatcggagagccttacgctttgacaaaacggaaatatatttctcccaagcaacattcccgcatcattaagttcgaggagatgttagctagctga

SEQ ID NO: 8842 - RNA, 2424 nt, unidentified
  source 1..2424: mol_type = other RNA; note = synthetic construct
atggctcagctgctgaacatgaacaatatccaaaaggatcctagtcaggataagaacacaactgtggactcttttctggagatgtttgaacgatggcttctgacacgcccagagtttgatatagccgccctgggtaaacgtaagtgttggccaattacatctgggcattatcacaggttttccatcaagaagcgcaacgggtccaaaagagagctggttagcgtggacaagaaccttaaggccttacaagccaacctcgccacttactttgaagaaaccttcgagatctctaagtacgcacacgcttttgtgccaaaggaaagtgcagataaggctacctttaagcagcaggaaggactgctcgtgaataaattgaggcccaagggggtcgtctcaaatgctcttgcccataagaacaaaaaagtggtgatcagcatcgatttgaaggagttcttccctaccattaccttcccccggattatggggatgttgaaaagtaaaccctacaacttctccaataagcaggcggcagtgttggcatcgttaatctgcttacctaaagacatcgacgacaaaaggggtcttcctcaaggggccccaacgagcccaatcatgtccaatcttatctgtaaaaagctcgactatcagctcgcgaagatggccagcaagtatgatattacgtatacccggtacgcggacgatctgacatttagcaccaataacctaaagagaattcccgccaaagagatagtgtcaatcgttaccaaatatgtggagagaaacggcttccaggtgaacacaaccaagacgaagatcatgtttaaaaatcaacggcagatggtgacaggcatacttgttaatgagggtctgaaccttcctaaaaagcaaatcgatgccctgcgagctaccttatacaatctggagcatgagcacaattccgttgaagattcagtgattgaattctgggggctcaaaaacaaacagccgtacgactctttcatccctgtcggattttataacggaggctaccgcggaagatttattaagagcaacaagaagggcgtcaaggcccacaagccaacctccaagaaagagttcgataaaatttatgccctacacttgttgggccggattctctggtacggacaggtagtcacgaccactatagacgccccttatgatttgtccaaacgccagtacattagccccaagcagtttagcagaatcaacaagtacgaagagatgctcgctagcttttaccgtatttcaatcaagttcagttggcctgtgcagcacattatcctaagactggctaataaactgccgcatctgcagagccttgttaaaatgaagagtatatctgagctggatccaaccattctcgacgaagtggggatcgaattacacggtcaggtcctgaaattgcggacagagaaagagaaatacaccgaattcttcaattccgctcccctgagcctgcaacgggttctccgagtccacaaccagtcacatatcaatttcgacctggacattataaagaaatgcataagcagtggctgggaggaaccctttaagcagcagaaggtgttcaaagaaatcaacaacgcggacctgtctgacctgttccacaagagttctaatcgtaaaggccacaacgctaaaaaactgctgaacgagatcgtgcgcgtggtgcagccacaaactaggtacttgtcagataacgttaggatcaagattactaaggtgtattctgagttactcacactcattagacttgaaggcgattcagtatgcatagacctggaaaacgagaatacaaaaaccgaacaggcccttcaggccatccgcgatctgaagtcagagatcaggctgtatgacaatcataccgacaatttttatcagcgggtggtgctgcccgcagttaagaattcggagacatccagtctggtagccattgacaaaaaagatatgaatcccagcatagtgactgatattaatgcatggcgggtagcactgacaaaggtcctaattagcatcaaacagcactgcgacaagacggagctgatggaggatacctcttcccatcgaccgttcactatcacttttcgagacgataatccagttactggagctcctcgcgtcatcgaaatccataggctcaacctagacttgcccttcaagaagaagctcgaagtagatacaactatggtggaggggaaggtcatgagatggcttactaacggagatctctcctccgcagtcagggagttcctacccattggtgacatatttgtccacggcaacttcaaagactgtgagaacgcaaccgtaaatctcacagagcatttctacaagattaatgacgaactgaaggtgtcggactacggcaaactctttttctctctgcaagagatcaaagaatga

SEQ ID NO: 8843 - RNA, 2424 nt, unidentified
  source 1..2424: mol_type = other RNA; note = synthetic construct
atggctcagctgtttaatatgcagaacatccaggccggcagcagcaaaccaaagaacacaaatttctctagtttcctgaaactgttcgaacactggttgaaaactagaccagagtttgacattaagacactcaaggagaggaaatgctggcctatcaccgcaggtcactaccatcggttcagtataaagaaaaggaatggctccaagagggagctggtgagcgtcgataagaacttgaaagagatgcagagcaatctcgcaacctattttgagaaaacgttcgagattagcaaatacgcttacgccttcgtgcccaaggagtccgaaaagaaggcgactattaagcagcaagagacactccttctcgacaagctccgaccaaagggggttgtctctaacgccttagcccaccagaacaagaaagtcgtaatttccatcgatttgaaagacttcttcccaacgatcacttttccgagaatcatgggcatgctgaagaccaccccctacgatttttccaataaacaatctgccgtgttggcctcccttatctgcctgcccaaagacatcgatgagaagcgcggtcttcctcaaggagcaccaacttccccaatcatttctaaccttatctgcaagaagctggattatcagctggctaaaatggcacggaagtacgacattacttacacacgttatgctgacgatctgacctttagcaccaacaacctgaaaaggatcagtgcagaagagatagtgtcgtccgtgacacagtatgtcgaaagaaatggcttcaaagtgaacgagactaagacaaagatcatgttcaagaaccagaggcaaatggtgacttccatactggtgaacgaaggcttaaatttgccaaaaaagcaaatcgatgccctgagagctacactacataaccttgagcatgagtacaatagtgttgaagaggctgtcaatgagttctggagtctgaaaaataagcaaccgtttgatagtttcatccctgtggcgttctatcccggaggctaccgcgggagattcatcaagtctaataagaaggggttgaaggccaacaaaccaacccccaagaaagaatttgacaagatctacgccctgcacttgctcggccggattttgtggtacggtcaggtcgtatcaaccactatttctgtcccgtacgacttgtctaagcgacagtacatctctcccaagcaatattcacgtatcaagaagtatgagcagatgctggcgtccttttaccgcatttcgattaaatttaactggtccgttgagcatatagtgtttagactggctaataaactgcctcatctccagtctctgattaaggtgaagtcaaaatcagagctcgaccctacaatcctggacaaaattggcaaggagctgcagggaaaggtgagccggctccgctctgagaaggaagagtataccgaatttttcaattctgcccctcgttcgctgcagcgagtgctacgggtacaaaaccagtcacacattagttttgacctcgacaccctaaaaaaatgtgtggaattcggatggaacgaaccccttaaacagaagaagctgttcaaggagataaatacgagcatgcttagcgacttatttcacaagtcctcaaacgggaaaggccacaatgcggagaagctcctcaatgagatcgttagagttgtcaagcctcaggtacgctacctgagcgataacgtcagggttaaactgactaaagtgcacagcgaattactcaccctagtgcagctggaagggaaaaacgtgtgcatcgacttagagaacgaaaatattaagaccgagaaagcccttcaggctatccgggactttaaatcagaggttcggctctatgataacgacacggataatttttatcagaaagtggtccttcctgcagtgaaatcaagcgaaacttctggtctagtaacaatcgataaaaaagacatggacccctcaattgtgacagatatcaacgcatggagagaagctctaaccaaagttctgataagcattaagcagcattgtgataagaccgagctgatggaagacgcatccagtcacatgccctttacaataaaattccgcgacgaaaatcccgtgaacggggccccaaggacagtagaaatttacaggctcaacagtaagctgccttttaagaagaaactcgaggtcgatacagccatagtcgagggaaaggttatgcgatggctgttcaatggggatcttagctccgccgtgcgcgaattcttacctgtaggagatattttcgtgcacggaaagttcaaggattgtgaagacgtgaccgtcaatctgactgagcatttttataaagtggacaaaaccttgaaggttaatccgtatggcaaactgtttttcacgctgcaggaaatgaaggaatga

SEQ ID NO: 8844 - RNA, 2376 nt, unidentified
  source 1..2376: mol_type = other RNA; note = synthetic construct
atgaacaataagcgcaccgcaaagaataataacttcctcgcatattggctgggcattaaatctcccgagctggatatcaaggtcctaaagaacatcaagtgctggcccattactgccaaccactacaaccgattcaccattaaaaaacgtaatggctccaagcgcgagctggtcagcgttaacaaaagcctgaaaactgtgcagtccgatcttgccgagtacttcgccgtgacctatggcatctcaaagtatgcccacgcgtttatctctaaggaacctgagacactcagcgtgttttcacaggaggcaatcctggttgacaaactgaggcccaaaggaatagttagtaatgctctcccacataccaacaaacgtgtcgtcatatcactggatcttaaggattttttccccacaataacgtttcccagagtgatgggaatgctcaaaggtgaaccatataacttttccaacaaacaagccgcagtcattagtagcctgatatgcctcccgaaagatattgatgaaaatcaggggcttccccaaggcgctccaacatcgcctgtgatcagcaatctcatttgcaacaagttagactaccagttgggaaagatgtccaagaagtatgacattacctacactcggtatgctgacgacctgaccttctccacaaataacctcaaaagaatttcagctgaagaaatcgtaagccttgccactcaatacgtggatcgaaatggctttaaggtcaatgaggctaagacaaagatcatgtttaaaaaccagcgccagatggtgacttcaatcttggtaaacgaaggtttgaacctacctaaaaaacaggtcgacgctctgagggcaacactctataatctggagaacacgtataacaacgtggaggatgctgtggacaagttctggaatatgaagaataaaaaggcgtacgactccctggttcctgtggggttctataaaggcggttatcgcggtcgctttatcaaatccaagaataagggcttaaagggaaacaaacccgtgtctaagaaagaatttgacaagatttacgccctgcatcttctcgggagaattttgtggtacgggcagattacgaccacagcaatcaataccccctacgacctttcgaagaggcaatacatttcaccgaagcaacacagtaggattaacaagtacgaggagatgctcgcagctttctaccgcatctcgatgaaattcaattggagtgtagagcatatcgttctacggctggccaacaaactgcctcacttgcagtctctggtcaagatgaacccaaactttctcctggaacacatcctgttggacgacctcgagttagaattgcgagataaggtttcaaagctgaggattgagaaggaaaagtatacggagtttttcgatagtgctcctagaagtctgcagagggtcctcagggtctttaatagaagccacaatagtttcgccctgaataagatcaagtcctgtgtggaatcaggctggccagttccgttaaagcaacagatcctgttcgagaagcttgctacagaagaactcagcgacttattccataagagcactaacattaaagggcacaacgtaaaaacactgctggaagacatcgttaaagtggtaagacctgagttgatttacctcagcgacaatgtccgggtgaaaatcacccgggtgcatagagaattactctccctgatgcgcacagagggagatggagtgtgtattgatttcgaaaatgaaaccgcgaagactgagcaggccgttcaggcgatccgggatctgaagtctgaggtgcgactgtacgagagcgatatcgacaacttttatctgaagattgttctaccagccgtaaaaaactctagaaccctgaatatagtggatatcgacaaagatgacatgaatccatcaatcgtgaccgacatatatgcctggcgggaagcccttaccaaagtgctcatctccattaaacagcatatagacaaatccgaaagcattggcaatagctccgggaagaagcctttcctgatcaagttgcgtgacgagcaccccacaagctctctgcctcgggccattgagatctaccggagggacgtggagcttccctttaacaaaaagttggatatcgacgtgaattctgcagagggcaaagtcatgaagtggcttactgggggtgatttgtcttctgccgtgaaagcatttcttccaataggcgatatatttgtgcacggaaatttcaaggattgtgagaacgtgactgtcaacctgaccgaacatttctacaaggtagaggacaatctggagatcagtgggaacggaaaactattcttctctctacaggagataaaagaatga

SEQ ID NO: 8845 - RNA, 2376 nt, unidentified
  source 1..2376: mol_type = other RNA; note = synthetic construct
atgaacaacaagcgcaatgtgaagaatatcaacttcttctccttttggctcggcatcaaagaccctgagttcgacattaagaagttaaaagacatcaagtgctggcccattaccaagaaccattataatccgtttacgatcaaaaagaggaacggctcaaaacgcaacctcgtgagtgtcaacaagaacttgaaaacagtgcagtccgacctcgcagagtatttcaccaaaaactacaagagctctaagtacgcacatgcttttatctgtaaggaaccagagtctctgagcattctgaagcaggaagcgttactgatcgacaaactaagaccaaaaggcataatcagcaacgccctcgctcacaccaacaagcaagttgttataagcctggatctgaaggactttttcccttctattacatttcccagggtcatgggaatgcttaaagggcagccttataatttctccaataagcaggctgccattattgcctccttgatatgtctcccaaaagggatagacgaaaatcagggactccctcagggtgctcccacttcaccagttataagcaatctgatctgcaacaagctagattatcagctgggtaaaatgtccaagaagtatgacatcacctatactcgatacgccgacgatctgaccttctctacaaacaacttaaaacggatctcagccgataagatagtttccctggcgactcagtacgtagatagaaacgggtttaagatcaatgaggccaagacaaaaatcatgtataagaaccaatgccagatggtcactggaattctggtgaatgaaggcctcaacctgccaaaaaaacaaaacgatgcgctccgtgcaacgctgtacaacctggaaaacaaaaacaacaaagtggaggaggctgttgcaaaattctggggaataaagtcaaagcaggcctacgatagtctcgtgccagttggtttttataaatggggctatcggggcaggttcattaagtctaagaacaagggcctgaagaccaccaaacctgcactaaaaaacgagttcgataaaatctacgcactgcacttgcttggtcgcatcctgtggtacggtcaggtggctacaaccggcattaatactccatacgatctttctaagaagcagtatatttcccccaagcaacatagcaggatcaataagtatgaagaaatgcttgccgctttttaccgtatcagcatgaaattcaactggtcagtagaacatatagttctgcgccttgccaataagcttccccatctgcaatctcttgtaaagatgaatccgaatttcagcctggaacatatccttttagacaagctggaattggatctccgggataaggtcagcaaactgcgcaacgagaaagagaagtataccgaattctttttcagtgcccctcggtccctgcagagagtgctcaaggtgagcaacagatcacaccacaatttcacactgatcaagatcaaaagctacgttgaaagtgggtggcctgtgcccctgaagcagaaagcagtctttgatgagattgccaccggagacttatcgaatctctttcacaagtccactaacataaacggccacagcgtgaaaaatctgctgaaagatattgtgaggatcgtccggcccgagctgatctatctgagtgataatttccgaacaaaaatcacacgtgtgcaccgagaacttttgaacttaatgagaaccgagggcgacggggtatacattgacatcgagaatgtgacaccaaagactgaacaggccgtgcaggctatcgtcgacctaaaatcggacatccggttgtttgagaatgacattgacaacttctacttgaagatcgtcctcccagccgtgaaaaattccggaactctgaacatggtcgacattgataaggatgatatgaatcccaacatcgtgacggatatttacgcgtggcgcgaggccctgacaaaggtcctcatttcaattaaacaacactctgacaagtccgagagtatagggaacatacaggggaaaaggccttttattattaagttcatcgacgagaacccggtgaatggctcacccagagctatcgagatttacagaaggaatattcaacttccctttaacaagaagctcgagattgacatcaatagttcggaaggaaaagtggataaatggctcaccgggggagacttgtcttttgccgtaaaggagttcctacctattggtgatatatttgcacacgggaattttaatgactgtaataatgctaccgtgaatttgacggagaatttgtacaaaatcgatggcaagttgaaactgaatgacagtggaaagctgttcttctctctacaggagatcaaagaatga

SEQ ID NO: 8846 - RNA, 2391 nt, unidentified
  source 1..2391: mol_type = other RNA; note = synthetic construct
atgaagaccactccgattttgagttctaaagttgactctgacgacaagtttccattcttctccatattggaatcgtggggggtcaattctccagagttcgatacagttgtgctgaaaaaactcaagtgttggcccgtcagcaaaaagcattacaaaccattcaccattgaaaagagaaacggtactgagagacacctcgtggctgtagataagaacctcaagctgatgcagcagagactcgccgtttactttgaacgcgcctatccagtatctaaatacgcccacgcattcatacctaagaggagtaaatttgcctacgagctcaattcatccccccagattaggcccacaggcgtcataactaacgccctggcgcacaccaataaaaaggtggtgatcagtatagacatcaaagacttctttccgaacattaccttcccacgcgtcctggggcttctaaaaagcaaaccctacgatctgagcaataggcaagcagctattcttgcgtccttaatctgcttgcctaagggaatcgatgaaaacaggggccttccacagggtgctcccacctcacccatcatcagcaatctgctgtgcaagaagctggataatcaattgggtgccttctccaaaaagaatggcatcacttacactagatacgctgatgatctcacgttctccacgaataacttaaagcacataagtacgtccaagattgtcgagcacgtgacaaatttcgtggaacggaacggatttaacattaacaccctcaaaaccaaggtgatgtataagaatcagaggcagatggttactggcattgttgtgaacgatggattgaacctgccaaagaagcaggtcgacgcaatccgagccacacttcataatctggagcacaattataagagcgtaagcgaggccgtatacgacttttggctcgtgaagggcaaaaatgcttatgatcagttcgtgcccctggacttttaccctgggggttacaagggtcggtacatcaagtcaaagaataatggcgaaaagcgtaataaacccacttccgacattgagtttaacaagatctacgccctgcatatcctggggagaattctgtggtacggacaggtggtgaccactgcggtcaacgaaccttatgatctcagcaaacggaagtacatttcccctaagcaacacttgcggatcaataaatatgaagagatgttggccactttctatcgcatcagcatgaaattcaactggcctattgagcatatcatcctaagactcgccaataaatttccgaatctgcagagcttggtaaagatgaaccccatgttcttacttgagccagtgactttagacgctaacgagctggccatcaaggacaaagtcaactctcttcgttctgataaacttgagtacacggcattttttgaatcagcccctgattcgctgaaacgggtgctgcgcgttgagaacaggtcccataccaactttgaccttaagaacattaagcagtgtgtggaatacggatgggagacaccaaccaaattgagggaagttttcaatgaattcgataacgggaagcttgctgatctctttcacaaatcaagtgatagaaaggggcacaaagtcgtggacctgcttaaagagttggtgtctttcgtgaaaccacggatccgctactttcccgcaagagtcaaacgtaaaattatcgtggtccagaaggaattactccacctaatccgggccgagggagaggaggtatatattgacctggagaacgaaaccacggttaccaaaaaagcatctcaggctatcagggacctgaaattcgcaattcggctatatgacagtgacacagataacctgtataatagagtggtcctggaagccatcaaaagctccgataccctcgagctgatcaacatagacaaggacaatatgaatccccgaatttataccgatatagacgcatggagggagtcactgacaaaagtgctgatctctataaaacaacacacacatgatgatgaacgcgtgatagaccagaagcaactaaagcccttcactatctgttttcgagaagagaaccctctgacaggaagcccgattgcgattgagatttataaggccaatagtaagatccctttcaaaaagaagctgaacatttcggaaaaatctaactcagggctcgtgaataagtggatcaccgggggcgacttacagcgagctgtgcgagattttatgcctgttggcgacatctttgttcatggcgactttatagactgcaagaacatcaccgtgaatctgacagagcacagctataagaaggagaagacagtctatcataacaagtacggcacactcttcatttccctgcaagagcttcgcgcttga

SEQ ID NO: 8847 - RNA, 2409 nt, unidentified
  source 1..2409: mol_type = other RNA; note = synthetic construct
atgaagaagaacaatcagaagaaagtgaaagaagagtcagctacagatttctttgactttatcaaggacttgctggcgcgcagaccagagttcgatacaaaaaaactggccgataaaggttgttggcctattagtaaatctcactatcaccacttcagtattaagaagcgaaatggttcttaccggcagctcgtgaccgtcgactatcgtctgaaagagtttcagtcaaatctgaggaggtacttcgagaaatacttcactatttcgaagcacgctcacgggttcgtgtctacatccacaagccaggtgggcgccactgacctggaaaaggagtttttgtctgaacttaaccggcctaaaggggtggttacgaacgcccttgctcacacgggtaagaaggtggtcattagcatcgaccttaaggactttttcccaagtattacatttccacgcgtattgggaatgctgcgaaagtcaccttacgatctgagcaataaacaggcagcagtgattgcctccctggtttgtcttccgaaagatatggatgaagatcgcggacttccccaaggtgctccgacctcccccatcatctctaatctcatttgcaacaaactggactaccagctgggccggttcgctaagaaatatgacttgaagtatactcgctacgcggacgatctaactctaagcacaaacaatcttaagcgtataacccccaaaaagattattgacgaagtgacccgacacgtagagcgcaacggatttcaaattaatgacgcaaagacgaaggtcatgtaccagaactccagacaaatggttactggtatcctggtcaatgatgggctcaacctccacaagaaacatgtggatgcattgagggcaacattgcataatctcgaaaacaagtacgattcagtagagagggccataaatgagttctggaccttaaaagataagcagccgtttgacgccttcgtgcctttggggtattacaattccggaattagaggcagatacatttcttcctcgaagaagggtattaaacggcccatgcccatcaccaaacaggagatgcacaagatctatgccttacatctcctggggcgcatcctgtggtatggccaagtggtaaccactgctgtgcaaagcccctatgacctgtataagaggccccacatatctcccaaacagtactccaggatcaaaaactatgaagaaatgctggctagcttttatcgggtgtccatcaagttcaagtggccagtagagcacataatccttaggctttcgaatcgtttcaaacacctgcagagtctggtggcaatgcagccaaatctgctcgtagagccaattgtgctgaacgacgccgaacagaagctgaaagttgatgttctgaagttgagaaagaaggaggactatctcgaatttttccgcacgtctcccgagagcttaaagagagccatctggagcatctcatccagccctagtaaccatagcctggaggacataaagcagtatgtgaatcatggctggcctgtcccagagatccagcgagaggtcttcaaacagctcgataccggcacactgtctaatttgtttcacaagagctacgagagcggcggacactccgtgaacgaactcctagaggaaatcgtgaaagtcgtgaagacaaggttaagatacctgagtccagtcgtgaggcgcaagattctgtccgtccataaagagctgctggccatctttagactggaaggaaatgacgtgcggatcgatctcgaaaagaaggtcaaatcacatgaatcagccctccaagcgattagagatctaaaagccgccgttaggttatacgaggatgacaccgagaatttctacaacaagatagtgctgccagccgtgaaggagtctgggatgagtaacttcgtgaaaatcgataacaatgacatggaggtccgcctgatcaccgacatcgccgcttggaagaacgcactcattaaagtgctggactctgtcaaggaacatatggaatcaagtgagcgggtcagaaaggctagcgagcagttcccttttactctcaagtttcgagaagctaaccctgagactgaggagcctatggcactggagctctaccggaccaacgccgagattgggttcaagaaaatacccgatttggagacaaacaaatcccatggccttgtgaaaaagcggctgactggaggcgacttatcactagcggttaaagaatttcttccgataggagatatctatgttctcggcaaatttgaacgtaagggggaatgcatcaaggacatctctataaacctaaccgactttagtttcgttaagtgcaagagcgttaaacattccaaatacggccagcttatgttcagcttggtagaaaaagaatcctga

SEQ ID NO: 8848 - RNA, 2181 nt, unidentified
  source 1..2181: mol_type = other RNA; note = synthetic construct
atggtcagcgttgactccaagctcaagtctattcagacttctatcaaagaagagcttgaggagaagtatccaactagtaagttcgcccacgcctttatctccaacaatctggataccctcgatgatattgtgcgtccgaaaggagttattagcaatgcactcgcccacaccaacaaaaaagtcgtaattagcattgacttgaaggacttctttcctacgatctcctttcccagggtgctggggatgttcaagcagcagccttacttcttttcaaataagcaggcgagtatcctggctagcctcgtgtgtctccctaaaggtgttgatgcgaacaggggtctaccacaaggagcccccagttcgccattgatctcgaatttaatctgcaacaagatcgacaagcaactgggccagctcgccaaaaagctcgattgcatttacactagatacgctgacgacataacgttctcaaccaacaatatcaacagggtgaaaccctctgcgttggtgaatgagatccggaagcacgtggtccgtaatggtttcgaggtcaatgaggaaaagaccaagattatgttctcaaatcaacgacagatggtaacaggcatagtcgttaacgatggactgaatctccataaaagacacgtcgatgcacttagggcaaccctttataacctggaattcaagtataagaccacttctcaggggattaaggccttctggaagcttggatctctgagaagctttgattcgctggtcccagtagggtttattaagggggaaacacccattcgcttcgtgaaaagtgcttcaaaagaggatggaaaaaagcggttaatcaagacaacaggcaagtaccaggtgaaaacatatgctttgcatatcctgggccgaatcttgtggtacgggcaggtggtgactaccgccatcagtgatccctactcactctcaaagaattcttacataagccctaagcaagagcgcaggatcaaaaaatttgaagagatgctcgccgcctattatcggattgccgataagttgaactggccggtgaagcatatcatactcaggctggctaataagtatcctcacctgcagagtttaatacattttgacccgcggtacaccttaaagaatatcgctctattggtggctgagtctgaccttattacaaaggtgaacaagctgggtaaggataatcaagagtatctggacttttacaaagagtcacctgagacgttccagcgtcaccttctactgcgctccagattcaagcaatcctttaagatccatgacatacgcaccctggccgagaatgggtgggttgacccaaagttgcagaacgagttgttcgaagagctgaacactagaaaactggccgacctgttccacaaaagcgatgatggcaaggggcataaagtcgaggagatcctcttagaacttgttaaagtggttgctcccaaactgcgctacctctccagtaatgtccgaactaaagtgctgcaggtccacaaggagtttgtgggcctgatcggggcagaaggcaaagacgtgaaactagacctggagattgagactgacctgacaaagagcgctattcaggctattcgagacttgaaaaacgcgaccagactgtacgaacataataacgacaccttttatagtaggatagtactgcctagcattaatgattctgatacaacaaagctggtggatattaacacttccggtatggcaccccggctgatcacagaaattggcgcatggaagaaagcactgaccaaggtcctgcagagcataaaagaatccgcctccaaagtgaacttagactccaagcagaaaccctttaagatcaaattcaaagacgccaacccagtgaccggagaacccgttacgctcgaaattttcaaagttggccacgacaatccattcggcaagaatctgaaccttccagaaaactcctcttcaggatttatccagaagaaccttcttggtcgggatctgacaaacgcaatagaacagtttctccctgtaggcgatatctatgtacaaggaaactttaaagacgtggacaacgccaagatcaatctaacccgccacaagtttgaaagaatcgaggagatgtctaaagacaacaaagaaagcctgttcttcgtgctcaaagagtaccagagcaagtga

SEQ ID NO: 8849 - RNA, 2697 nt, unidentified
  source 1..2697: mol_type = other RNA; note = synthetic construct
atgtccgacaccaccgaacctaaagagcccgcagctctcaccttagccgcactgattgaccgggacgaacagagcgccgcaggagacgaacagagaaagattgacagccggcgcgatctggcaagatacatcgggatccccctgcgacatcttgccgatgtactgtacgaggccgacaggtccagattctacacagtaaagactattccaaaggcctcgggaggtaccagaacactccacgccgtttccggaaagctaaaagatgtgcagcggaaagcgctggacaaacttcagcggaaattccctccatctgaccgtgcacatggcttcgtcccgggcaggagtatcatcactaatgctatcccccaccgacgaaaaaagcttgtggtgaaactggatattgtcgatttttttcccagcatacgggtggcaagagttttcgggatgtttcaggctccgcccttccgtttcggcagagaagctgccatgacccttgcgcaattggcctgtgtccctgagcacaatggtcctctcccacagggcggggtgctttctccatatgtggcaaacgtgatttgtcgcagaatggaccaacgcctggcgtcaattgcccggcaacatagatgtaatttcacacgctatgccgatgatcttacattttctaccaatgatgccaatcgcttagatgctgacagactgatcgctaaggttcgggaagttgtggagggagagggctttgcgatcaatgacgccaaaacacgtgtgctgcggcagagtgaccgtcagatcgtcactggcatcgtggtcaatgacgggctgaacgttacaaggcgatatttgcggagcctgagggctatcttgcacaacatggagaaagagggcatcgaggctcaactcattaagggctctggtttaaaggatagacgggcgtcccgcttagaactcgtgcccgacggggatggctatagattaggcaaccacaaactgacaaaggagcaggccgtagaacgctttctgcagcatttggtgggtcgatttgctttcgtgggccaagtcgtcaacgctgaagggcaggataatcagcagattaggtacagacgggtggtgctgtataagaggctgctcaacagatttagacgcagtgtcaggtctgcagttcatgcaggactgggcgacggacccaaacattgcgagagggccatacggtctttgatggaacgttatgccagcgtggagcaggagtccgagtggtataggagagcgaaggagaggcgagaaagcgagctggagcgctggagggaaagtaaagagggccggaggatctcagctgccttggccagaacaacgaacgccagtgagctatgcagattcgtgcaaaaggaggctaagagcgacgttcgatactggccggtgaactgtggcgataatcccgaggccctgagggttcgagtggaggagaacgctcgctacccttccctgaaccggggaaccaccaggcaagtggtgaatgggtttaaggatactagcgatctgggagggcttactcacaggggcgatgcaacacctgcgagcttgcttcagattctactcgaccgctacgagcctcactactatgagctgccgaacgccctccggaaactggtggaccccatgtcagcagcactccgggatatagtcttgcaagacggagaggacgtaagcctggatctctttaaagaccctagactggatcgtcacgtcaagcagctaaaggagggaacgcgcctcatcgcccctggttcaaagaaggacgagggcaaacctatcaccgaactgttgaccgatgcctacgaaaaagggctggaaagggccgagaagaagcccggaacctccgtgccatggaaggaccggtttataagcccacatcaggctatctacacggtcgtacctgccctttggattagtctagtggacatctttcactcaatcggaattcatagtgaacatagggaaatcgaggtggaaacttacataaccgaacagggctgcttccagatccgcatttctgacgctaatagttcagggctcgaaattccaccagccagggacttcgctcacgggaagatacgacacgccgcgttcgaacttttcgctatagccggctattggatttttacgcggtttgaagacggtgcagtgcaccgtgtggatatgctcaccggtaagactgcacgcgcaactgatgctagatatcccggatttactcatctgattgttctgcccaatgaaaaaggcttcatcgaggaaccatcggttggggatgccgcaactgggtctgattccgccgctacaccgagaaggaccgttcgagtactgataattgacaataacgagcagagaaggaacgataacgtacagtgctggtcatctctcccagatgtggagttagatgcagtcgctcagattgaccgcgagtcctaccgctgccgtgagctggacctcgtgctagtacacgagtccaacccagagtcagaatggatccatcaggacgttgaagaccggtggcctgtcgtcttcttctctggtaacaatacactggattgcgaagtccacgagggcaggtggttcgtgtcccccgtgtttttgcgcgaacacttcgggaagctcgtggataagatcgtccacgagggagggaaagactgtgtcggtctgagctga

SEQ ID NO: 8850 - RNA, 2634 nt, unidentified
  source 1..2634: mol_type = other RNA; note = synthetic construct
atggaaaagatgactaccagaaccaaaatctactggaggagagacttagcccagtatattggcgtccctctccaggacctgctggaaatcctttataaggagaatagacgagattactatcgaatccgctcaatccctaaagcatcaggggggacacgaaccatccatgcggtatccggaaagctgaaagatattcagagaaaagtcctggacaagctgcaagcagactttccaccgagctctagggcacatggctttgtacctaagaggagcataattaccaatgccattccacatcgcaggaaaaaggtgctggtgaagctggacattcgagacttcttccccagtatcagatttgcccgtgtcatggggctctttcaatccgcgccattccattttggtcgcgaggctgctattaccctggcgcaaattatatgtgtcccaggtgataacggacctcttcctcagggtggcgtgctctccccctatgtggcaaatgtcatttgtcggaggctagatcagaaactggccgccatagctcgggagcacagatgccattttacccggtatgccgatgatttgacatttagtacaaacgacgtcaaatgtctcaaccgcgagcagtttatcgccagagtggaagcggcggtggcaaacgaggggttcacgataaacagtaagaaaacacgcgtcttaaggcagagcgatcgtcagatcgtgaccgggatcgtggtgaatgacggtctgaatgtgacaagaaagtacattcgcaatctcagggcgattctccacaatattgaaaaaaacgggctagaaacccagttgattaaggacggaggcttccacgataggcgggcctcaaggctggagctcaaacgcgacggggacgggtacaggctaggcacacgccagctgaccaaggaggaatcgatcgagagattcctgcaacaccttgtcggccgcttcgcttttgtcggccaggttgttaatgcagagggccaggagaatagacagatcagataccgcagggtggtgctgtacaaaaggcttctgaagcgcttttacatttgcatatgccgcatagagaagaatgagaatcttgggaaaggacccgaaaaatgcaagtcaacactggagaagctgatgaaaaaatacagctcatttgaccagcagagcgagtggtataatcgtgccaaggaatgtaggcaatctaaattggagcagtggcaaaacagcaaggaagctcagactatcagagacgagctggcctgcattacgacattagaagacgcacggaggtttctcaccgctcaggcttgttctgatgtgagatattggattgagtgcagcggaaacttcgaggatatcaaaattaagttggcaaagttcgctcagtatcccgcctttaattttttcgacacacggcaggtgttgcatggtttcaaggacactcaggatttgggtgcactgacccaccacggatccactcccgctcacctcctgaatatcctacttaagagatacgagcctcactattataagcttcccgattacgaaccgccctactccctgcggggactggtggatcccatgtcagatgctctgcgaaacatagttctggaggatggagaagatgtgtttctggatttcaacgaccctcggatcgagtccaaggttgccaagttgaaacaggggacaagattatcagcccgccaaggccaagcacacatcgggaccatgattgaggaaatgctccagagtgcctacgaggagggacttaagagggctaaccagactccgaagaaatccgtcccatggaagggccggttgcagaacccacgggaagatatttatactgtcatccccgccctccaaggcagtttagtggacatcttcgagtctatgtacagaaaccgaaagtccggccaaatcgaggtcgagacgtccgtgactgagtctggctgcttccagatccgtatagccgacgtcgatggcgcttccctgcgcgtaccacctggtagagacttcgcccatgggaaactcagaagggccacccggagcctgttcgtgatcgctggatactggatattcgcccggttcaacgacggcagcgttcaccgagtgaacatgcttaccggagaaacggtaaaggtggctgatgaccggtactctgggttcacccacgtcctcgtgctgccaaataacgagggcaggatcgatccgccttctgttggaaaaagctccctcgacgtgtcggtggccaagacaagccggcgtactctgcgggtactggttatagacaacaatgatcaggaacggtatgataacgaactgcggtggcagactttgccagacctcgaactgaaaaccgtagcagccattgaccgtgagacttgtgccagttacgcacctgatatcgttttcgttcatttcaacaatgacgaacgaaaatggattacgcaagaaaacactaatctttgccccatcgtgctattcagcggcgaatttatgtctgaatgtatgatccacgagggttgctggtgtgttagtcgtacatttctcaaggaacgatttggagacttaatcgatcagatcgtgaggaaagagcgcaaggactgcgtaggcttgtcttga

SEQ ID NO: 8851 - RNA, 2646 nt, unidentified
  source 1..2646: mol_type = other RNA; note = synthetic construct
atggaattcacaactaccccgtcatctctgaacagcaggaaagatttggcggactacatcgggcttccactgggtgagcttaacaatatactgtacgctggcaatagatcccgattctacaaagtgaagatgataccgaaagctagcggcggagaacgcaagctgcacgccatttcaggcgaactgaagtcactgcaaaggatggccctggacaaactgcagacagattatccccccagtcctagagcacacggattcgtaccagagagatctattattaccaatgccaggcatcacaccaacaagaagttggtgatcaagctggatttactggatttcttccctactattcattatggaagagttgtaggaatgtttcagaaaccccccttctctttcgggtacgaggtggcaaaaaccctcgctcaaattagctgcctctcacaggaagaggccggcatcttaccccaaggcggagccatgggtccatacattgctaacgtcatatgcagacgaatggacaagagattggcaagcgtggcaagaaaccaccggtgtaatttcaccaggtacgccgacgatctcacattcagtaccaacgacgtgcgccggcttgagattcctcagcttattacagaggtgtccggaattgtggagtcagaaggattcaaggtgaacagcgaaaagacacgggtgctcaggccatccgatcgccaaatcgtgacgggtatcgtcgttaatgatggtttgaatgtacctaggaagtacattaactcgctgcgggcgattctgcacaacatggagaaagaaggcattgaaaagcagctagtgaaaggtaagctgttcggggccaataatcctaagattagccgcctggaatttgaactagttggtgaagggtacagactcggctcacgcgcctattctaaagacgaggccgtggatctctttcttcggcatctgctcgggcggttcgccttcgtagggcaggtcgtgaacgctaatggccaacaggaacgtcagattaagtttaagcgcgttattctctataagcgactcctcaagcgcttccactcttgtgtcattgacccacgtaataacggtctgggcaatgggcccaagaagtgcgccagggcaattgttcgaatgatgaagcagtactcttcctttgaccaggagtccaaatgggacaggcggatcaaagaagtgcgtaagtctaaactggagtcctggcaacagagtggcgacgggcgaaaagtttgtaaggctttggatcgcatcaacaacttgtccgacttgaaagttttcctagagaacgagtcgaaaagggatatacggtattggtgggtgtgcggacgcgactttgttaccgacaaagaacaagctctgaaatacgcatcttatccgcctgtagactatcgttggacgcggcaagtcctgtgcggcatcaaaaacactcagggaaagaatctagggattctgactcactatggggacgatggccacgcaaatactcccgcgaagctgctagaagtgttagccgagaattatgagccctactattattggttgcccattaggcttcgtaaaatcatcgaccccgtgtcagatgcactgcgcaatatagtcctgcaggacggcgagaatgcttccttggataattttggtgatatcaggttagagccagtaattaagacattcaaactagagacacgactctccaacagcgacagagcagccgatggaacatacatctttcaactgttaaaagatgcacatgaggctgggcagagacaggccaacagaaaggaaatcaagagtcttagcctcgtgatgcaccagaagatgcctagcaaacagtacaccgtggttccttcacttcgcatcgctctgatcgacatattccacagcatgtatgtgaactcagagtctgatggtatcagcgtggatactaggataacccatagaaggtgttttcagatccgggtcaccggcccgctgcatcatccactgctgtgtagaccaagcagaaactttgcgcatgggaagctgtccagggctgcccgtgaactttttgggatagccggctactggatctgctccacatttgaagacggccgggagtacagaatagacatgttgactggcaaggctgccctgatctctaacgagcataaactgagtttcagccacatcatcgtgtttccaaatgacaacgatgagatcgatgagagtatacacggcgttgaggtcatagactctgtccctgaaaacgcacctcagcagaaaattcgggtcctcttaatcgataacaatgaccgccggcgcgatgaaaacgtgaagaggtggcgagccctcaaaaatgttgacatcaaggctgtcgcccgaattgatcgggcgagttatgagaagctcgacctggacctcgtgctgatccacgagtccaaccccgaggtggaaaccaatgagcttgtgtttgacgatcagacgcggatcattgtgtttagtagcggaaataagactgaagattgtgtgacggacgagggactcttttacgtctccagtatcttcttacagaaaaatctggccaagcttatcgacaagatcgtcgtcgagggacagaaagattgcgtagacttgtcgtga

SEQ ID NO: 8852 - RNA, 1905 nt, unidentified
  source 1..1905: mol_type = other RNA; note = synthetic construct
atggagattcccctgaaacgtctcacatactgcctgtataaaacttccagagagagtgcttatacaaggaaggatcttcctaaaagcaacgggggcgttaggacgattcatgccgttagcggcccaataaaagggctgcagagaaccgctctggacaaattacaggaagatttcaagccgaccgcatacgcacacggattcactcctgaaaagtctattctcaccaacgcttatgtgcaccaggggtccaaaatcatactgagaatagatctgaaggactttttccccagcatcaactttggccgggtgcgaggcatgtttatgagcccccccttcaagttcggcgaacaagccgcgacggcaatggcccagatgtcttgccttgcaggaagcgaagacgtgctacctcagggcggcgtgctgtctccttatatagcaaatatgctctgtcgccgcttggatgctcgcctagccggtctgtcaaggacatggaaatgtagatttaccagatacgccgacgattgtgtattcagcactaatgacaccaaaagactgaatgccgaaaaatttgtggcccaggtggaagaaattattcgggaggaggggtttcaaatcaacccagacaaaacacgggtgatgtacccgcacgagagacaaatggtcacgggtgtcgttgtcaacgacgggatcaacatcaacagacggtactatcgatcactgcgggctctcctgcacaactggaagaagtacggaatctcaagtcagttggtgaaaagtggaggttttaaagatgaacgcaatcccggaccaagatttgaaagagatggggacatctttaggctgaatggttgggagtttagtaaagagcaggctgaagagaagtttgcaagacatgttctgggccgcattttgttcttgcttcaggcgaccaatttcgtaccaccttctactgagggatacctggagggagaaaaggacgagactgctaagaaaatggtggccaaacgaaaggaagcactggctgagaaaccgcgttctcaagccgcacagaagctccttttaaaatatttccacctcgtgagcaagcggaagcatctggatgacttgaagaacgccgcttaccgacagcttcagcggtatcctattagggaactcgtcgcgaggcacccccacttgaaaatagagctcaggagtggcatctcacgctaccaaatccgagctcaggccttgcaggaatatcagaagcgacctgagacaaggaagtgcgtggaacgcatccatgaatgcgacgatctggccgaggccgggggattacttgacgagctggcgaataccgacgtgcgcttcgcaggtttgccacgcggggaccttcgggtcctcctgaaggagatgaccaagtttgcttcgtaccctgccttcggagcgaaccacgcacgttccttcttcgcatcactaagggattccgagacaggtttaggccagattcttcaccacccagagcacagcatgtccgatctgaatgaatccatgggcaagttcgtggaccccgttttctggtggttacccttcgggctcagggaggacattgataagattgatgacctcttggagggcgtgtcgcggcaactaggggacgatgctaaaatcgactggctggcccatgagctcactgaaaaggagacactcaagctgaagaaggatacaagatttcatcggaaggaaggcacccggctgcatgaggccgtaaatgaggtagtgaaaagggtcgccaaaacctacgaccgtgagctgccagagatttgtaacgagctgtccgataagtccactgcctatacccatgttaggtctgtccgcctggccctggacgaaatcatcctttctatgatcactcacagcgataagtga

SEQ ID NO: 8853 - RNA, 2751 nt, unidentified
  source 1..2751: mol_type = other RNA; note = synthetic construct
atgcccaagatcttcttaaaaaaacaccagacagagtatatcatcaagaaccgagcaaccaatcgcaagagtatcgtcgcgataatggcaggcaaaaagatgaagaatatgttgagtggcgacaagattaagaaagcgtataagaagttcactatcgccaaagctaagaagggtacccggactttgcacgctccctcgactgagctcaaggacctgcaaaggacaatcctggataaactgcagaaacctttcagacctagtatatacgcccacggcttcgtgaaatcaacaagcaataaagccaggtccatcataacaaacgcctcctaccataagtctaagaagtacataatcaagaccgacatcaaaaacttctttccttccatcaaaaaggagcaaattacacaaatgcttgtgaacgaaccattcgagtttacgatcaaaaccgctgaaaaaattagctctctggcatgcttagatggtaagaagaaggttttgccccagggtggagtcctctctccatatctgtctaatatgctttgctgcaacctggatgacaaactctcgggattggctaccaaaaatcactgcaacttcactcgatacgccgacgacattacctttagcacaaatgataagaagatcaagttcaagcccctaattcagcaaatttacaagatcgtggaatcctatgggttcgtggtgaaccgcgggaaaacaaaggtgttgacccctgcagaccggcaagttgtaaccggcatcattactaatgacggcattaatgtcaatcggaagtattaccgaaacctgcgggccattatacacaactgcgaggacgagtctctgaacatctttaacatagatactatcgccggacagattgggcggttcatcaagtacaagatacagaaaagaaacaagaacaacgccatagaactcaaatactcctggtcttttaaagattctcgctgtagcagaccaaacattttttcagacagcgtcatgcgttccgaatacatactgttgaacaaaaaagttggagtccaggatgtaaaacttatgagagactatggcggagtcaaccttcaggttccatttctgaaaggcgagtttctcaaccagctgtttggcaccgacaaattcaaaaacaatgagaagtacgcgatgaggctttacaagtataattcagatatcgagtctctgagtactggaaggctctaccttaaaaacaaaaagtatgccgagattctactcgacggcaaatggattggttgtgagaaatataccgaaaagaatccgaaaatctacaacatactcgaaaacaagttcaaggttctgcaagaaaagcataaggacaacgaccgattcttctataagtccgtgatctacaacaagggtttcgaagagaaagaatacatgctcgagaattttgccctcacaaaaatcaacacccagcagcagacaattcagtacgagaactacaataaagtcgataagaaccatacaggcgattatcacatcgctgtgaaaaagaattatgccgtgcattcttttttcaagcatttactgggaagattcgtattttatggctccgtggtcctgtccaacaatcaggacaagaattatgatagatacaagcgtgtgggcgcatacgaaaaactgctgtatcggttctacaagttggtggaaaagcattgtaacaaaagcctgcagaaacagaccttaaatcttatcaagaagacgccgaaactgaaggatgactttaacgtcttgaagaaaatgaccgatgattacaagaaacagaaagagaaatctctcgaaaagtttcactatgactcaaagtatgccactgaaattgataacactgagagtattgaggctctcgatgatattgctaagaagctaagcaagaaggacgtgagatttttccgtattgacaaataccacaaagacgagcccaaggactatcaaaattacctcatggcaattttgaagaagcccgcaattgatctgaaaaaaaccatgggtgtgcttctcagttttaagggcagccaggatggcctcggggttatcactcacgacactgagaaactgaactcaaagcagatatttgagacggtgaataagtgtttcacgcagtactactattatttacctcagggaattagggaagaattcgacaattacatagatgccctgaataatcaagacgggcggcagtcacagcgctttcaaagccaggccgaaaaactgaaaaagaataccaggtttgggaataattcagatgaggaatttctgctgaaagacagtgtcgatgaggctatcctaaacgctaagaaagaggttaagaagtccgatatcaagattcacaatgagattaaaagggcaagcttttatactcatgtaccaaccattaagcaggtgttcgagaaaatcatccacagcctgtataagaattccaaaggttccgagattacaattagctgtgaccataaggacgatgagaaaaagtaccaagtaatcatcacagacaacagcgacgctaacatcaccaataatgggcgcgaattcgtgaacggaaagcttagttcagtgatggggttaacatttgggctgtgcgattacttcatcgaaacggagttcaataaaaagcgcaaaaccatcaatatgcacaacggagaattcctgaagacgctacctactcataagaaagggttcacccacatactgcagtttgcgacaaagatctga

SEQ ID NO: 8854 - RNA, 1473 nt, unidentified
  source 1..1473: mol_type = other RNA; note = synthetic construct
atgactaatgatattatccaggagatcctccgtaagagaaagatcaaccgatctactccactgatgcagaagatcaacaataaaaaggacctactatcctttttcggagacgagatcgggcaagagaacttcgacaacgtgctgtacggagaggaaaaggagcagtacaaaaagttcgtaattaataaggccacaggtaagcctcggaccctccacgctgtgcccccaaaattgaaacacattcagagaatcgccttagataagttgcagagtgtcaaacagtaccagccttcaagctatgctcatgggttcgtgttgaagagatccatcattactaatgccatcccccacaggagaaagaagaggatcataaagatggacctgaaggattttttcccgtctatccatgaggacagggtgcgcgatatgtttatggggaagccgtttagcttcggaaaagaggcagctactattatggcccatttgagttgcctcaacgacggttcaggaattctgcctcaggggggcgtacttagcccatatgtagcaaatatgctttgtctgaaactcgacaaaaaattagcgaaggtcgcaataaagaatcattgcaactttacccggtatgcagacgacattaccttctccacgaatgatgtgagcgaggacagtatatccaatctgattaaagagacgtccaacataattgagagtgaaggttttgtggtgaacaccgagaagaccaaggtgctgacccccaatcgaaggcaggtggtgaccggcattatcgtgaacgatggggtcaacgtgaaccgcaggtacattagaaaccttcgtgccgctataaaaaactgtgaagaacagggcataggatcacaaatgcagcggttcgtctttaaggaccaccgctgctctggccctgataagttcgatgggacaaatggcgaaatccggaattattttctccaccacctgtttggcaaaattacattctttggcaatgttgtcctgtctaataaccaagacctgaaaaacaagaagaattcggatacatacagaagggtacaaacctacgaggaaatcctctatcggttctatgaccttatcaagaacgtcaaaacttctcggcgattcaagaaaagtgttgtggcggctgtcaacaacaggccaaacctctccaaacgtctgagcttcgcgcaacagggagtctccattcgcggcaaagccctcaagaaataccgctcaacttacaaagccaaaaagttaaaggatgatctggagctggttaccaatatcaatcagcttagaagcttcatcggggacgttgctgagacaaacccatcttttttcaatacagccatccctgttgatctagatgaagcaaaagaaaaactgggtacacgcctgagctttccccccgtgaatctggacatcgccacgggagtgctgcagtcattggttgaagacgaaggctga

SEQ ID NO: 8855 - RNA, 2493 nt, unidentified
  source 1..2493: mol_type = other RNA; note = synthetic construct
atgcccaaagagagcaagaacaacaaaatgaccgtgtcttctagatctgacttggcagattttttcggggtgaagaacaagtatattaattgggtgctctacgcggataaatctgccagcggttacaagaaattcactattaacaaggctagtggcaagatccgcactctgcatgcggtgacaaaaaaactaaagaagcttcagcggattgccctggatcacttgcaagctgataaacgatttcaacctacagcctacagtcatggcttcacacaacaaaagagcattatcacgaatgcagcctaccacaagcggagtaagcgcatcattaagatggatatcaaagacttcttccccactatccactttgggcgcgtgcagggtatgttcatggctccaccctttaaattcggtaaggaagccgcaacagtgatggctcagatgagctgtctggatgatggttccggcgcactacctcagggaggcgtgttgtccccttacatcgccaatatgatgtgccgtcgcatggacaaacgactggctgcggtagcacggaaccacagctgcagattcactcgctatgcagacgatctgacattctccactaattgcatcagcgatgagaatattggtaagttggttcaggaggcctcggctattgtggaagcagaacactttattgtcaataaggagaaaaccaaagtccttaccccgaaagaccgccaagttgtgacaggcattgttgtcaatgacgggctcaatgtgaatcggaagtacatcagaaacctgcgagccatcattaggaattgtgaacagtttggaatcaaatcacagattgtcaagctcggcggatttaaggacaaccgcaactcaagaatttcaatcaaaggcgaagagaacctttccgaggaacggtttctgaggcacatcctgggcaaactaaattttatgggcgacgtagtgttcgctaacttaaacgacaaagacgggaagaagatagatgacaatagtgtgaacatgaatcggatggtaagaattaaaacccacgctgacctgctcactcggttttacaagctggtggctaacgaatctggggtggacggcgtatatgacaagatcgagatcagcattgttaataacggcaagaaaaatccatactgtaagattatggacctcatatccgagataaataatcaggctaggaagtacctggatgagtttgaaaggctcgaaggggttaccaggattgtggatgaaaaaaagtatccactggtagacaaaaaacagacacgggtgttccttgattcttttaggaattctatcaacggaatgggagcattcacccatgcacacggtgaggagttcacgatccacaaagccatgggcattttattaaagaagtgtcatccggccatatactatctccctgaggccttcaagaaggaaatctactcatatattcactacatcaccaatatcggaataaagaacggcgctaactatagttggaatgtcatgagcgacactaagtcagttgcgttgaagcgggccactaggttcgattctatggagaactccctgtccagcaccgtcgacagctgcataagatatgtcaagaaacagaacaacatctcctctgaccttaacgttatcaactgcataaagaacaaccagctgttacagatctatacctttgtacccggcatcgagtccgccctgaacaatataatccattccatgttgaagaacacggaagcccagataaataagtatatcctaatcgacgtgaaccaggccactgatctgatcgagataattgtcagatcggaggatattatgatctcatcgttcgtgcccgaagacaagcatggaaaactcacactggcaactaaaagcacaaaagggctttgtgactactgggtggaagttgattcagtgagtctcgatctgaccaacaaacgagtctgcttcgacatgcatacaggaaaaatcatcgacggaattattcctagtttctccagtggatttgtgcacaagctccgattcgatacggccgataaaataagggataccgatgtcgagaacagagagatctcagctatcaccccaatcgagaataagatcgattacctgtacaaggtcctcttactcgaccataatattgacgataggcgtgagattaagcgcaatcttctggaaattgacggtgtgtctgagcagtcactgactattttgaagaatataagccaagtggactttgaatctatgaagcttgacatcgcctttatccacaaaaataacaaagagacatccaacattgcactgtgggagacaagtgggatcaaagtcatttttttttccggggagatacgtcagaattccaccataaacgccgagaagagccagttcatggttaaggaagaaaccatgaagagcgccgcgagactgaaatcttatttcgagaagaaactgagcgggaaaattaccacgtga

SEQ ID NO: 8856 - RNA, 2193 nt, unidentified
  source 1..2193: mol_type = other RNA; note = synthetic construct
atggagataatttttggctcgaagacacctgggccgactactgttctagctaaacagattggatttcctgcaaataagctgcgggacatattgtatggaccaaacaatcgctctgcgcactataagcgaattgccatacccaagaattcctctacccccgctaatcctaagatcagggtgttacacgcagtatccaaagacttaaaaaacctgcagcgcgccacgtatgattacctggccgccatttattcccccactaaatatgccaaaggatttgtcatcggagagtctatacttaccaacgcatggccacacaggcgacaggccgtcctcctgaagtttgatatcaaagactttttcccaagcatcaacttttaccgggtaagggggatgtttatggcgtggccattcaatttctcccctgccactgcgactatctatgcacagatatgttgcatggacaacggccccatagcccagggtgcggttacgtcaccctacataagtaatatgatttgcaggcgcttggacaaacggctgtcacagttcgcccagaaacatcacctggtttttacccgatatgctgatgatattaccctgagtagcaatagcaagcatctggctatcaagaaggtccaacaggaagttgtggagatgatcgagtcagagaagttcattgtcaataaagagaagagcaaggtgttattccctagccagcgccagatggtgacaggcatagttgtcaatgacggggtgaacgtgcccaggaagtacatcaagcaggttagagccatcctgtataaatgtgaaaccctgggcgtggccagagtagtgagcgagcatttgacccatgtgaagccaggtcaaccctgcgcacctatccatagggaactgaaacctacaggcgagtacctggacgtcgatgtccctattaacagagatgtgtacatgagaaacggtaccgataaggaaatttccttctaccaggttactctcatctttctcagccatcttcgcgggaggattctctacatcggccaggtggcaaaggccaatcatgaatctatttgggaggtgagttacgctagcgccaacagccctaggggatatccggaacgtacagtttacctcaagcgctacaaaatttatcgggaactgctggaccggtacaactccattgtgaacttcgaggactatggcaaagagcttagtattaaggtgaagtctctggagtctagatacatggaggaggaagagatagatttctttatggctagagatatcgaacagattaagtcagacatgtcagagcgagccgaaaccgaggctcggttcttctattccatctcacccgcaatgctggagaacgacatcaaggacaaattgttaatcatgctgaataggtttcccccggatatcatcaccactcgcgctgtgctacagagcgcgcaggacactgggagcatgatcatgagattgcttcacaatgaagtgatccaaagagaggagttcgacgattactttaatgagtatctgacggtgaaggaaaaattgccatacagactcgaaaaggagattacggcttttcttaaagaagcttcctatctcttcagacgagagaacatcgatgagtataacttctacctagacgagcaattcaatcgggatcgcgtgatcccatttaagaataactctaggttcgtgttgaacccacgaaaaacaagcggcggtactgatgcctacgagatgatcaagggaattgtccattctcgtgccgtgcgggacaaaatgaatgagaactccgtacggattatgattcccgaagaccaaaatgagtggcgtatcgacctctacacccacgtgtctagtgtaaagtggtcacttcacagaatcatcgaaagtatggtcgtaaactcgcaagataccatcatacacatcacctttgaattccagcgcgaaggcttttccacactcagggtttacaatgaggatgtcacagaaattgctaataccccatcccgggcacttgctcacgggaaactgaaaaaagcaatggagtacctggacggcctggcagaatattatatagaggccaactttgccggaacagggtggagttcagtcaacatgtacacaaaccaatctcaggaaattgaaagtctcattggtttcacacaccgtatcgtgttctga

SEQ ID NO: 8857 - RNA, 2040 nt, unidentified
  source 1..2040: mol_type = other RNA; note = synthetic construct
atgaaagcacacatatttgaagttgctcaggagttaaatgttaaaccaggtgtgattcgaactgctttgtacgtaggcaataggggggactactacactcttaacgaaattcctaagagaaatggaggagtgaggaccatccatgcggtgaatggacgcttgagggtcctgcagaaggtcgcgtacaattggctgtccaataattatagcccccgccatgaagccaaagggttcgtgatcggaggcggcattattgagaacgctaagattcatcggaacaaaaagctggttatatgttacgatctcaaagactttttccctagtatcacatttgcaagggtccaggggatgtttatgtcttttcctttcgagtttgccaagcccaaggctacgttgttcgcccagatttgttgcctcccagacgagaacggacctattccacaaggcggcgttacctcccccttcgtaagtaacatgatttgccgaagattagacactcgcctgcataagctcgccattaagaaacggatgcactactcaagatacgccgatgatcttacattctccacagatgataatgtgggctatgaaaagtttaccaagattgttcgggaaattatcgaggacgagcacttcgaactaaatgaagagaagtctagaattcggaccaagtctacgaggcaggtggtgaccggtatcgtcgtgaatgaaggactgaatgtaaaccggaaatatattcgcagcctgagagctgcacttcacaattgctatgtgcacggcgtgctgagtcagattgacaagaaaacgaaatataaggatccctggaacacctgcccacccataaagaagatcgccaacaaaaattatgtgctgtacaagaatggtgccagtatcgagatcaaggatgcaaaatataagtttctggagcacttatttgggcgaatacagtttataggtcacgtcgccaaaagcaatgagcatctcaaccctgtgcaccacaacaaacgcgtggagatctacaacaatctgctcgagatgttcgaaaaggtccgggagaacgagaagataactggcaagctcaaaatccaagcaaagaaggccctataccagcagcaggataacgcgttgcttgagtcaattaaacgatacactctcgatgaattgaacgaatttgtagatgagcaaaaacagactgatccaaggtatttcacatatagcttctctgagggagatatcatggagtacagggacgaagtgggtaatctcgctcagtatccgagccccacaaacgaaatggtaatgcaatacctaaactccctgaaggactcagaaaataagatcctgggcaagcttgtccatgacactactatctcattcggagaattcaacaacttccgcatgcagtttgaaaaagataaaatcgagctcccgaaactgctgagagatcgtttggatgggttcatcaataccgacatcatgaattttatcaaggataaagacgtgaacttcaacatatttagcgacataacattcgtcgaaaagtccatcaacaagctgaaaaaggcaacaagattcttcaacgggacagggaatatcggcgacgacgaaactgatctcgtcaagatgatcgagtccgtttttaaaaacgcccgtaaccccaacaatctgaacttgaaaatcgacaggctgaatacctttggtgcttataccgacgttcagtccgtgaagtacgccctgtcactgattattgacagtatgatcgacaacagcaacggatctacggtgttttgtaaaaccgacaaacagaacaaggtgattgagttattcgacgacaactctgagccactggacattctccctaatcgtgattttgtgaatgggaaacttcggaagaccatattcacactaaccgcactgtgtgagtacagcatcatcgctaacttcaagaaagggggctggaaaaatatcaatatgatgaagggcgaggtcattgagtcggaagagtatccgggctttacccatcaacttacattcagatga

SEQ ID NO: 8858 - RNA, 1149 nt, unidentified
  source 1..1149: mol_type = other RNA; note = synthetic construct
atgaaagacttaaatttgaacctgatcaccattatcatcatctttatcgtcatcatcatcacgatttttaaggggaaactgagtgtctttaacaaaaagaaacggaacttcaacctgaaattccttaacaagattcccattctgaaccctgattacaatacattctatatacccaaacgggatggtagcgaaaggcaaattgacgctccgaatacccagcttaaaaacatccagaaaaacattcttcgggaactcaacaaaacttatctgtttccatctttcgtaagtggctttaagaagaacgccagcattaagaataatgcgagcaagcatactaacaagaagatcatcatcaatatcgacatagaggacttctttcactctataactgagaataagatccgcaagactctcagggcctacaaagaactgcagaatgaggaaatcgagaagttgataaacctagttacatacaggggccgtttagcacaaggagccccaacctcgccttttattgctaatctcgtgttcctgggcatcgacaacatcataatcaaactcttgaagaagtacgacaagaaggtgtcctacacacgctatgctgatgatataactttctccagtaacaacaccaaaattaagaacgctattcgcataatagtcgatagcatcttgcctaaatatgggtacgtggccaaaaaaaagaaaacgaccatttacagagcccatacaaagcagattgtgaccgggctagtagtgaataaacgggtttcatatcccaggaacaaatatatgaaactgagagcaatggtgttcaatttcctgtccaagggagatggaaatattaacatcattaagggccacctgtctttccttaaatcagtcgaccgaaagaaatacctgaagctgaagttctattacagacgaaattttaaggagaacaacaactacaaggtgctcttcaacaagcagaaaaaaaaacacaagaaggcctcctttacaaatccacataccggcaaaagagaagttaagtttgattactcaggtaagaagatcgagaaaaacgactataagtatgagtccgcatttgagaacatcaagaaaagcaagaagaacaatgacgatgataaaaacgacctcattatttga

SEQ ID NO: 8859 - RNA, 1026 nt, unidentified
  source 1..1026: mol_type = other RNA; note = synthetic construct
atgctaatcacaatcatcgttattatcagcatcatcgttttcttcatcacgagcaaaatatggatcggcgcaaaaaagaagtggattatgaagatgtctgatttgttcaaacgggtcctggaatttgacgctcctgatctgtcctataccacatttacaatccctaagaaagattggacttctagacagatcgaagcacctaacgcccagcttaaaaagactcagcagactcttctccatttgctctcaaataacattattctcccatggtatgtgactgggtttcggaagaaattctccatcaaaacaaacgctaagaaacacgtgggtagggaggtcgtaattaacctggacataaaggacttcttcaccaatgtaaccacgcaaaagctgaggcagcgcttagagtacctcaaagtggataatgaaatcatatcccgctttgaaaagctatgctttaacaattggcatttgccccaatgggcccccacaagcccatttcttgctaatttcattttcgtgccgatcgatgaggcaatcattaaaaccgccaagaagtatgacaagaacattatttactccaggtacgccgataacattaccttaagtagtaacgtgaagaacataagtaacctcatcaggataatctcagagtggattatgccaaagttcggatacaccattaatagcaaggttaatctgtcgcgcaaacacaccagacagaccgtcacctggatcacagtgaatgagaagatatctatgccccgtcataaatatatgttactcagagcccaagtgcacgcttatcttactaaatggacgtggaatactctggagattgcctggcgattggcgtttctgtatctgctggacaaaaagaagtactggaaactgcagaagtactacaagaaaaagttctgggagactcaggaactgtcagcggtgtttagacgaaaccctaagaaagtcaaactggacatctacaagaagtggtttattaatccccggacatggcagaaattctga

SEQ ID NO: 8860 - RNA, 1338 nt, unidentified
  source 1..1338: mol_type = other RNA; note = synthetic construct
atgaagaaagattttacgaacatctcgacatatcaggagtttatcgagtatatcaaaagctttagcgaatatcagtacttaactcgtactctaagcaaagactttctccaaagaataaatgaaacgcagaatatgggcgacttctatacgaccaagatgatttccaaaaaagcaggtggcaacagggaattagcaatacctattgaagagcttaagcacttgcagaaagctctgctcggcgtgctgaagaaataccagagactgtccattagaaaaagcaaatggtctagcaattacgactatatatccccagcctttaaatccatcaaaatcggttcccacaacaagttctatgtgaataagctagaccttaagaatcggcatactaaggggataccttcacacgtcgtacatgcttctcatcacaccaacaagaaactggtgatcaccttcgactttgagaatttcttcactacaattaggccaaatcgcattaggggcattttcaagggatacttcaaattctcagatttcgtgtgcacccttctgacatctattactactcactttaaggtaggccttcctcaaggagctcccaccagtccgtacctctcaaatctggccacctatgagtttgacaaagcgtttcacaaagaatgtaagaagctggggatctattacagtcgctatgccgatgacgtcgccctgagtaccaacaattattccgttttgtacaacaacagcattttttctgagaagccaaagaatggaaagcggctgcaattttgcgattatctcaacaatctattggagcagaatcacctcaccatcaaaggttctaagacaagggttatgagctactggaatcgacaggtcgtgacaggcatcgttgtgaataagaaaatcagtattgggaaggatgagctggtccgcgcacgttcggtcctgatcaatattggaaaaaccctcactatcctcgactaccggatggggataatagccgtggataagcagattaagaaattctacgacgagtaccaattgcggaactcccatgaggaagagcttcagaccataagagatgataatgaacgctcactctgtatgctgtgcatcgctttgctcacaattcattccctgatcgagtactacagtcaggtgatgcccacaaacagcaaactgatcaagattaaggaactttacaactctatccagtacaacctgttttacaacaagaactatcgacacatcattatcaagaacaaccacttgttcaagttcaacctgcattcattccccatcttcttaattgaaaagctgaacttccagtctcattga

SEQ ID NO: 8861 - RNA, 963 nt, unidentified
  source 1..963: mol_type = other RNA; note = synthetic construct
atgtctaaactcagcagcattaacaatgttgcttctttggtcaaggtgatcaatcacaagttgtacatcaaaaagtacgaacccatcaccattgacttcctgaaaaagaacatacataagtatgtggacagaaacattcctaaaaagaggggcgggtttagaacactgaacatccctaacgaccaattactacacgttcaggagatccttctagagttgttctatgaaagtcaggatagaatcgtccgagaaaataaatggatcagccagatcgaccgctccgcacccgcctataagccatctaactattacttgaacaagccagcacattggattcacgcccagaaccatgtgaacaaagccataattgtctcgttcgactttcatgatttttttggatccctctattccggccgtatttacagcgtgttcataaagtacttcaaatgcaataaggcagtagctactattctcactaatctcactaccttcaatcattctctccctcagggggcgcccacaagtccatttctgagtaacctggttatgtactatttcgacaaaacgatgatcaagataagccgggagaacagcgtccggtattccaggtatgctgacgacgtgattctgtcaagtaacgattcacagttccttgataataccaactttttcgagaagtcctttaataatggccagaatatcgaattttccgagcaaatcagcaaactccttctgggttaccacctgtcacttaatccgaataaaacacgggtgtacaattactggaatcaacagaagatcacaggaattgtagtcaatcaccacaccaacatttctaggcgcaagttagtggtgcaccgatcaatcctgatcaacctgattaaagccatagataccaaagatttcgataacatcaagggttacgagcagctgaagattaacataaataaggccctgtcgtga

SEQ ID NO: 8862 - RNA, 2514 nt, unidentified
  source 1..2514: mol_type = other RNA; note = synthetic construct
atgaatctcttcaaaatcacaagttctgagtttctgaacttcatattcgctaatttagagtcctctaaaggcattgacaaggatttcatcaccctggtgaagaacatcattaactaccagtacaagttctaccagatctttttgattcgaaaagcaaatggaaagctccggcccatcgccgctccgtatcctgaactgaagagcatacagaaatctatcgtcaagtacctggacctgaattttattccccatcctaacagttttggattccagaaaaacaaggacattaaaggtaacgcgaagatgcaccttaataataagtttgtcttcaacgctgacatcaaggattttttcgtgtcaattaagttctctcacttccgaaaaaagatgctgccaaacgagaatatattcagcgacgattccaatcccctgtcaattcttcgtgtgttctgttttatctctgacgctgaaaataaacaactgagcaaggaggacactcactacttccttccccaaggggctcctacaagccccatcctatccaacatatacttctacgacctcgatgaaaaaattttcgacctgtgcaagcagctcaacattaattattctcggtatgtggatgacctgacattttccagcaacgaaaactacttcgaaaacaactccgattttaggaataagctggtgtcaatcctcaactctgatggtttgagcctgaatgagtccaagaacaagctctattacaaatacaacacacagatcgtcacaggactgattgtgaaccaaaagttaaacgttcatcagcgggtgatcaaagacctgcgaaaatggatctatatttacgaaaggtacggcatcgagaagcttaatctaattttcgagaacgactatcactctaaaaatagaaactccaggaacttcaagataaatacattttcagccctcgagagtaaggtggcctacgtcggctatattaaaggctatagagacagtacgtacctcatcttgaaagagaagatcgggaatatcctcaaacacaaagtaatcgagtcaaatgaggaaaagtcattaataatcctggacagcagtttcttcattcacgggaaaaaaagctacaggctgaaattctacgatggccttaatataccaattgacgagataacagtgaccaagaactattttaagaagaacaagtggaagttcaagaagatactgagtgactggggaatctcgaaccagagcgtctattttcggatcgtgatcaataacccaatcaacatagacttgaataccgccttagtcgttaagaagggtgacaccatctattatgaatatgaggataccgaattcaacaactctagcaagcggaccgacgacaactttgagatccaggttgtggcttataacattactgacgagaacggctacatcactattgtaagcatcgatactcccaacgcaattaagtcagtagtcgctacgatcccaactgtgaatgtgaatcaaacctcggaacaacagaaacacttgaaggatttaagagcgagattcctcaaggataaaacctttatcccagtcaaagtgagtaatacgtcctccattaccgattataggtatggccttttttccgaggaaaaatccacccatcgtcaagtaactgaagaggatctgttgaacccgaaggccattgtgggtattttgagcaccccatggaatagcgagaaaggcgagcaggccactgtctttatcaaaaaggaacaggttcagctcccataccctgcccccattgcacagacagggtcagttgtgctgctcattgataatcagatccatgtgctgcataccaagaagattaaagatgtacccgtgaagtacaaacaactgaccaaactgttgaagcagtttgcctcggaagcgaatgcagatgtgcgcaacgggatttggaagcaactaatcggaagagggagtaccgatggaatagtgatctatagaacagaaaacagcaatattgacgtagagcggcagggagaggtcgtgaataatcgcggcattggtcctcagttgttttacaatcctgacactaatacgatcatctacgaggggaaacgctacaatgtgaatgaggaaaacatcaacgacattatcgacgacctcgctgagcgccgcgttcacattgaagaagcccttgtcgaaacttcaaaagattacaagaaggatatcgtggagtacctaactactgacctggctgagctgaacacaaagactggaacatatcagatagcacctacaatttataccgaaataggcaatgtggaggttcaggataatacgaagacggaggtcaaacttacaccacaggaagagcaggccgccctgtttgattttcttccgtccgttgcaaaggaaaccaaagaagttgtcaaccccaaaaccgaggaggcctctgaaacaaccatcgcaaaaaggatactgcctaaagccgatggggaggatatgtctgacatcctgtga

SEQ ID NO: 8863 - RNA, 1269 nt, unidentified
  source 1..1269: mol_type = other RNA; note = synthetic construct
atgaaaaatctcatgattaaggataaggagaacatactcatccagcctggcatctttttctacactcatggctactatagcgcaacccacgcccttgacttcattcattctgcggactcctataagaagattagtatccctaaacggaacggcaaaattcggactgtgtatcagccccacccgaagctgcacgccatgcagagcacaatcaagccgttcttacacaaggtgtactttaagatctgtcagaaacacgggatgatttcctacgagaagcggagtcatatgtcaaaacaggcttggaacaggcatatcgaattacggcgaaggttcccaaccatagaggactttgccgatcacatcgatgagttgttcgacgagtattctgatgaggccgataagcgctatggcaaagaaaaccccaatgataaactccatatgtcctctatgcttcttgatttcgactacgattttttttgctacaagggcatcgaccctgagctcagctacaagaaaaccttcaaatactacggtagtgtggtgcagcatgccagaaacgctgttcgcaaaccttacctgttcaagtgtgatatcaaggatttctacccctccatcacggataagaagctatatcgcatcctgtcaagcgaaccatataacacctacatcagccccgagattgccgcactgatcgtgtctgtatgtacacacagatcgagactagttcagggggcatgcacatccccaatcctggcgaacatgtttatgattcatgccgacaactttttctccaagaacttgaaaaagagctgcacatataatcgttatagtcgatacgtggacgatctcattttcgcgtcagaccagccaatagacgctgccgagatatctaagcagatttctggatacttgagttcaatgggactgcagttgcaccccaaaaaaactcgctacctgctgccacatcaaaaaaaaatcgtgaccggtgtcgtcgttaatcagaagataaatatcgacaggcgatatattcggtgtatcagagccatgctgcacgacgctgaagcccaagggatagagcacgcagcacttagacacgcttccggaaagcatggaaaaattgaagctattgacccccagtactttctgaagcgtctgcaagggatgattagctgggtccagtatgtaaggagccctcacgaaaataattgccaacagctgatcaataggtttaacaatctccagaagaaatgggaacaatcaaaatattga

SEQ ID NO: 8864 - RNA, 1635 nt, unidentified
  source 1..1635: mol_type = other RNA; note = synthetic construct
atgaaaaaagaacgcatcaatacagtgaatgattggaacaagctcaacaaattgtctggcaacaaggagatacttagtcacctctataagatcttatctcggttcgccgacacattgaagaatgagattattgcagaaatcgagaagaagaataagcctaaggccgaacagattaaactctcgaaatggtctatttcaatcgatcgactgctttacctgtcaggccaggataacctcaagaagcagtatcataaagtggagatccccaaaaaacggggtggagtgcgcatcctgaacatcccatccaagaagctgcgttttgtgcaaagactccttctagactttctgtccgaaaatttcgaaacacacaaatgcgcctacggctttgtgaaagggaaaagcattgttgataatgccaagctgcatgtgaataaaaaacacgtcgtgtgctatgatatcaaggatttctttccatccattaccggccgtcggatttacggtatgttgcaacagtatccatttaatgcaaataaggacgtagctaggattatcgctaatattgcaacgtattacgatgatgagaaaagcgagaaaattctgccacagggctcccctacatctccctacctcgctaacatgatatgtaggaaaatggacagcagaattttcaacttcttcaaggagaagaacatacattatactagatacgcggacgatctcaccttttctactaatgactccaagaaaatagagctgattctgaagaacgtgcctcgcttcataaaggaggaagggttcgagctaaataattcaaagacccgggtgcagaattattataagcgacagatagtgacggggattatcgtaaataagaaaatatccctgcctcgcgagtacattagaggcctgagggccctcctacacaacgtcgagaagtacggatgggaaagtcaagtgaacagaaaaattatctccttcgagagtgacgattacctcaaattcatcaacttccagaaagagacaaataacgaagaggagaacaaaaagttacaaaagctgaccaagagcaagtttgacgaatataataaaacccagaacaacgagcacaaattgatccatggaaagaactacatagatctgaggttaaaatctcagaagtacccgagccagaggtacactcaggtcgacatgatgaaagagatcataaagggaaagatcgaattttggggtatggttcgcaatatcagggataaagaggggaaaattatcaaaaccgataacacctacaagaatctgaaagacgaatttgaacttctgaacctgatgcaaagaaaggaagacgtccagtacatcaaggttagtcggaagttcgagaacatcattaagagctatgagaacaataagtcaatcgacgagaagactaagaaggagatcattgacaacattaatagcttgaagaagcttaagaacgaaaatctgagcgaaatcgttaaaaacatggtatcacccatccttcacaatcccaaacgaaccagtgaaatcttgatcaaatttcacaaggacgataatgtcctgaagtatacaaaccatgactgggataaagaagacgacaacatgaaatttctgactaactga

SEQ ID NO: 8865 - RNA, 2151 nt, unidentified
  source 1..2151: mol_type = other RNA; note = synthetic construct
atgcgcttgcccgactgggataaggcgaccgtgaaggcatacgaaactaggtggagtgccttgaaagccagcgggcccactgatgtgtattcagccgtcgccacacttctgagcacacaatccgataaccctgtgccagaagacttaatacgtcatctggtgggatccaagaacaggaaaagacactaccacaccgtggagattcctaaaagaagggggggtgttcgaactctgaccgtcccctctgacacaatgaagtgggttcagagaggcctcttgcaagtgcttacccatttattcccccggcaccggtgtgccgtaggtttcgagcggggagagtcccccctaacccatgctagacaccatgtgcgaaaaagattcgtgtatgtggtggacatcgaggacttctttccaagcatcacctgggctaggatctacggcatgttacaggcatatcccttcgaactgcctccacacgccgctcgcgttctggctaacttagccacttacgatggagccttgccccagggagctccctcaagtcccatactggctaatttgctctgtcggaaactggacagccgcctctttaagtgggccagaacgaatggttaccagtacagtaggtatgctgacgacctcgcattttctaccaacaagaatgagttcccggtgagtgataggaaattcatcgaacaggtaattcaagaggaaggattcagcattaacgccgaaaagtcaaggctgatgccttacagccgccgacagatggtcacaggcctgattgtgaacaagaagcctaacctcccacggtcctatgtcaggggccttagagcactgttgcacaatgtggagaggcacggctgggaaagtcaggtcgggcgtactccggtgtttaaaagggcgtatgagtggacgctgtaccgggataagaaaatgagccctgaaaaactccttggcatccagctcgaccagatcttctatgatcatctggttcatccaacagcagtcctgcacaaggcccgagatgtggcctcacttcagcgggtggtccagggaaggatcgcatacctgggcttggtacgcgggaaggattgtccaatctaccagagaatgcgggatcaatatttagccctcgtccgtcaagagtcagaaatggcccgagggagagcaatttatcaggaaaaggctcgcgaggtagaatccacccctgatgagcctaaaggccccaatagatatgccgagataaaaaaatacgagcagctgcccgaaccggagtaccgctccaagctccaggaactgggagtgcggacgcttgaatatctcttcctactgagaacaaaccagagttttgaggacctaaaaaaggtggctgctcgtattgcatactctacaactacatcccctgaggaaaccgcccgcttctttgccgaatttgacgacgataagaccttccgcgggttgctccacgaaccgatcgggctggagctctctccgggtgaactggtaggagcctgcgaagaggcactttccaggtataagctgccaaataagctgcgtaagcggactgaggagttactggaggagtgccgggtactgctgcacgctaaccccgacgtttatccatggaagaatgacaatcttcgggacaaagtcctgttgccatacaaaaaggacacgcggtttgatgtcgcgcatggccttacactgaaggagagactcgaggagcatatacagatcctggaaaagcgctacgacaagttttttgaggtggatgcagatctaatgctccgaacatttgtgccagacgtcctcaacgctatcaagatcctgttgatctcaatggcgcagcacacatcggccggaaagattcacattcaggttccagaggttctggggcaagggccaatagagatccacatttttgatgaggacagcgtgatgcaatgcgctcctgatctgctgaaaggtgttctaaaaggcgaatctgccggcgcactccgcagacttaggggctacgcatattggaccattaccgctccttttagcgacggctcgtcttacactttcaacgttatgaccaatgagaaattcaaagcgcccgaacccgcctctggtgtccgacataccctgactttccctcaggtgtga

SEQ ID NO: 8866 - RNA, 1083 nt, unidentified
  source 1..1083: mol_type = other RNA; note = synthetic construct
atggtaactctcggaagacgtatcaccagccggcaccggaacattaaacccgtttttacgctaaaacatctgtctgccctgtccggtgtggactacgggttcctgaggcacacagttgggagaaatacagatgcctacaccgagtttaagataaaaaagcgctcttcatctgatgtcaagaaaaattaccgtacaatttgtgtccctagccccgccctcatgaaggttcagagatggatcgccggcaacatcctgtcccatgtttccgcccacccatgctcagtggcattctccgtcggagacaggcttttcgacgcggtcgcaccccactgcccttccaagtggttagttaagctggacgtaaggaacttctttgagtctattaaggaagtgtcagtgtaccatgtgtttctgcagctggggttcgaaccgcttatcgccttcgagatgacacgcctgtgtacctacgtcgcttcgaatgcaagcaataacaacgacagatggcatgatagctttttcctccctgaacatgtgattactctgtatcaatatccagagcaaggtcacttgccgcagggagcacctacgagtccaatgcttgccaacctcgcttcgcgaagcctggatgagcgattggccgcgcttgctgacgagaatttggtacgctatacccgatacgctgacgacatgacattttctagcgacgacgtggatttcggccggaaaagagctggcctactcataaaacgggtgtaccaacagctggatcggcagagcctgtcacccaataccgctaaaactaccgtcattccacctggtgcacgtaagttagtgctgggactcagtgtggaggaaaccgtccctaggctgactcgccagttcaagaacagtttcaggcagcacatccactatttattgcgcgatgatgtggggcccaccaaacacgccgcagctagaaagtttgcctccactacaggcctccgccatcacctggagggccttctagcgtttgccgctcagatcgaacccatgtgggcagccgctcagcggaataggttgcaagccgtgagttggccatattga

SEQ ID NO: 8867 - RNA, 1152 nt, unidentified
  source 1..1152: mol_type = other RNA; note = synthetic construct
atggagcactggaatccacaactctttagaaaccaggctgcaggggttcctcccgagctggttgcacatatggtcacggtaggcaggaggattaccagctgccaccgggctgtgcagcctgtgtttaccttgaagcatctcgcagttctgtccggggtggattacggcttcctccgccatacagtcggcagacggacggatgtttacaccgaattcaggatccggaagaggcctagcgcaaacgggcaaaatagatacaggactatatgtgtgcccagtcctgccctgatgaaagtgcaacgatggatcgcccgcaacatactgagccatgtccccgcacacccatgttccgtggcattcagcgctggcgacagcctgtttaaggccgtcgctcctcattgtccctccaaatggctcgtaaagttggacatccgcaattttttcgaatctattgaggaaacctcagtatacaatgtgtttcatcagttggggttcgagccactcattgcgtttgagatgacacgcctatgcacctatgctaggtctgaccctagtttgggaccaaaccatcggaccgacggactgttcttacccgagcggatcatcacactgtatcagcacccagcccagggttacctcccgcaaggtgctcccacttcccctatgctggcaaacctagtttgccggactttagatgatagactctcaacccttgcggacgagcactcagtccgatatactcgctatgccgacgatatgaccttcagcactgacaaggtagacttcggacgtgagtctgccggcgtgctaatcaagctggtctaccagcagcttgcccgtcaggccctgagtccgaatacagccaaaacaaccgtggtgccgccaggagcgcgaaaactggtccttgggttaggcgtggaagaggctgctcccagactgacacgccagttcaaagatttgctgagacagcacattcactatctgctccatgatgacgtgggacctattaaacacgctgccgccaggaagtttgcctcgacaacgggtctgcgacaccaccttgaaggccttctggccttcgctgcccagatcgaaccatcttgggcagcgactcagagatcacgttttaacactgtgtcctggccctactga

SEQ ID NO: 8868 - RNA, 1152 nt, unidentified
  source 1..1152: mol_type = other RNA; note = synthetic construct
atggaacggtggaatagccagatcttcaggaataatgcagtcggcgtccctccagaattggtggttcatatgaccgctgttggaaaaagaatcacctcatataatcgcgaagtccagcccgtattcactctgaagcatctcgccgtgttgtcaggcgtagactacggtttcctgcgccacacagtgtctagggatactaacgcgtacacagagtttcggatcagaaagaggtcctctgtgcacgggcagacccactatcggactatttgcgtgccaagcccttccttaatgaaggtgcaacgctggatcgctcgcaacatactgtctcacgtgcccgctcatccttgctccgttgccttctctacaggagatagtctgtttaaagcagtcgctccccactgcccgtctaaatggctcgttaagctcgatatacgatcattttttgagtcgattgacgagatctccgtctaccatgtgtttaagcaactgggctttgagtcccttatcgccttcgagatggcccgtttatgtacgcatgtaggggcggaacccagccacgaaccagatatgggccacgactcgcacgtgctgcccgaaagaatcataaagctttatcagcacagtagacaagggcacctgccccaaggggctccaacctcacctatgctagcaaacctggtgtgtagaagtctggatgagcgacttagcacgattgccgacaaacatagtgtacgttatactcggtacgccgacgacatgactttcagcagtaacgaggttgactttggaagagagagggctggacgtttaattcagctcgtgtaccagcagcttaaccgccaggccctgaggcctaatactgctaagaccacagtcgttagccctggtgcgcgcaaactggtgcttggtttgagcgtggaggaggatgtcccacggctcacccgacagttcaaggaatcactgaggcagcacatctactatctcctccacgacgatatagggcccgccaagcatgcagcaacaaggaaattcgcctccaccattggcctgagaaaccatattgagggcttgctggctttcgcctctcagattgaaccgacctgggccgcactacaaatctcccggtttcagacagtgagctggccacattga

SEQ ID NO: 8869 - RNA, 1149 nt, unidentified
  source 1..1149: mol_type = other RNA; note = synthetic construct
atgcagcgttggaatccacagttattcaggaaacaggcgtccggcgtgaaacccgaacttcttgcccatctggtgaaggtgggacgcagaattactcaagcacatcgcgatgtgcagcctgtctttaccctgagacacctggccgctctgtctgaagttgattatggcttccttcgacagacggtggcccggagaactgaggcatacgctgaatttaagatcaaaaagcgggggagcgagcaccttagcccccagtaccgcacaatctgcgcgccttcaccttccctaatgaaggtgcagaggtggatcacacagaacatcttggctcacgttccagctcacaattgctccgtggccttctcaaaaggtgacagtctctacaaggcggtagagccccattgcctagccaaatggcttgtgaagatagacgtgcagtcattttttgagtctatttcagagagtacagtttaccggttgtttaacaatctgggttttgaaccactcgttgcattcgagatggcccggctctgtacgagggatcagcacgatgcccaacacaagaaggagcagtggaaagattattcccctgctagcctgtatgtcattgagcagtatatgcatagcgtacaaggccatctgccgcaaggggctccgacctctccaatgctcgccaacctcgtgtgtcgggcactggatgaacgcctggcggccattgccgaggaacagaacctgaattacacccgatatgcagacgacatcacatttagctctctggaccccaacttcgagagggaaatggcaaaggctctcatccagagagtctacagggaattggcccgtcagggactgaaacctaatactgccaaaaccactgtcgtgcccccctcggccagaaagatcgtcctcgggctatccgtagaggaggaaacacctaggttagcaagacacttcaaggacttgctgcgtcaacacattcactacctgacccacccagaggtgggcccaataaagcatgctactgctcgaaagttcgcaagtgtcgtggggctccgccatcatgttggcggattattgacctatgccgcccagatagagccggactgggctgctaaacaacggatgcgcttcctggaagtcaaatggccctga

SEQ ID NO: 8870 - RNA, 1155 nt, unidentified
  source 1..1155: mol_type = other RNA; note = synthetic construct
atggagcgttggaacccgcagctgttccgaaagcaagctagtgttgtcgcgccagatgtgctcgcacaatgcatcgcagtggggaggagaatcactgccctccaccgcgatgtgcagcccgtgtttaccctcaaacacctggcagtgttgtcagaggtagactttgggttcattcgacagacagtcgctcgcaggaccgacgcgtatacagaattccgggtgaagaaacggtctactcaaaatggtgacccacgatacaggaccatatgcgtccccagccctggcctgatgaaggtccagagatggattgctcagaatatactggcccacgttccagcacatgcctgttcagtagccttctccaagggagatagcttgtataaggccgtggagcctcactgtagcgctaagtggcttgtcaagctggatattcggaacttttttgaaagcatctccgaggcctccatttacctgacactccagagtttaggctttgaacctttgattgcattcgagatcgcgaggctgtgcacccgagtggtggatgacggcatgcaccggaacgacaggtggctcaataacttcaagcatctgagtccctatgtcatcgcgcaatatacacagacacagcaagggcaccttccccagggcgctcctacttctcccatgcttgctaaccttgtttgccgcgcactggatgagcgtctacttgccgtagccgaaagagctgacgtccgttacacgagatacgcagatgacatgaccttttcctctgacgatgcctccttcggaagagacagagctcaaaaactgattcaggccgtgtacaaacagctcgcttgtcagagtctgtcgcctaatatggcaaaaactaccatcgtgccacctgccgctcggaaagttgttctgggcttgagcgtggaagaggcagagccgcgcctgacgagacagtttaaggccctgttgcggcagcacatatactacctgtcaaggcgggacgtaggagtgatcaagcatgcctcagcccgcggattcacttctgtgaccgggttaaggcatcacctcgagggtttactagcgttcgccgcccagattgaaccaaaatgggctgccatccagcgcagccattttcaggcaatcaaatggccctattga

SEQ ID NO: 8871 - RNA, 1152 nt, unidentified
  source 1..1152: mol_type = other RNA; note = synthetic construct
atggagaggtggagccctaggcagtttcgcaaagaggcaaaagacgtcgaccccgacgtcctccaaagagccattgccgtgggaaacaggattgttgagctaaatcgtgaagtccagcccgtgtttactctgaagcatctctctgttctctcaggtgtaggctacggctttctacgccagactgtggcgagacgcaccgaatcctatacggcattccgtatccagaagcgacccacccctgacggagaaaggcggtaccgtactatttgcgtgccaactcccgcactgatgaaggtgcagcgctggatcgcgcaaaacatactgaagcacgtgccagcgcacgatgcctctgtagctttcagtaaggatgatacactgtataaggctgtggagcctcattgtagtgccaagtggctggtgaagctggatatcagaaaattcttcgagtcgatttctgaagcttcagtgtatcttgtgtttaggagcttgggctttgagccactcatctcattcgagctggcacgactgtgtaccagggtcgtggacgcaccgatgtaccgcagcgatgcctggctcaatgcccattggaatgatgaatatgtcatcgagcagtaccgccaagtatggcagggtcacttaccgcaaggggccccaacctcacctatgcttgctaacctggtgtgccgcaagcttgacgagagactggctagcattagcgaatcgttcagcgtgcagtacacacggtacgccgacgacatgacgttctctagtgtagatcgatcctttgatagagcccgggccatgaaacttatcggcaaagcttacgagcagctgagcttacagggtctggggcccaataaaaccaagacatccgttacaccaccagggggaaggaaggtggtcctcggattgttggtggaggaggaaaaaccccggctgacacgggaattcaaagccatgctgcggcaacatttctattacatgctccgagaagacgttggagtcgttagacacgcttcctccagaggcttcataagtatcaccgggctgaggaaccaccttcaggggttattgggctttgccgcacagatagagcctgagtatgcagctagacagcgggaaaaattttctcgggtttcctggcctttgtga

SEQ ID NO: 8872 - RNA, 1161 nt, unidentified
  source 1..1161: mol_type = other RNA; note = synthetic construct
atggagcgttggagcagccatcaatacaagaaggtggctcatgagagaggcgtgccatctgccgttgttgagaacgcggtcgctattggaagagagatagtaagaaagaaccctaacgtgcagcccgtgttcacactgaggcacttggccgagctctgtgaagtggactacgccctgctgagacagtacgtttcacgagggtttgacccctacgagagtttcagagtcaggaagaggcccggccctaatggtgagcgccggtacaggatcatatgcgtacccaacccgcctctaatgaaggcacagcgctggatcacacagaatgtgctgcagtatggggtggttcacaacgcttccgtggccttcgctcctaagtctaaactcttacatgcaacagagccccactgcaatgcccggtggctgatcaaattggacatcaaacggttttttgagagtattcccgaaaggtttgtgtatcgggtctttagggacttcggttaccaggcgctcgtcgcgttcgagatggctaggctgtgtacaagactttatcctggccccctgtttgattcccgcaaatggactagcagcggactgcgggaaagcccgtataagattcacgcttacgatcaatcttggcaaggacacttacctcagggagccccaacctccccgatgctagctaacctggtctgctacaagctcgatgagctcctcgcagatttggcagattcagacggcctgcagtacaccagatatgccgacgatctgaccttcagcaccaattctaaggaatttagtcgcgaacaggcagcagcagtggtaggtaaagttttccagcatctcgctcagatgggcttctcccctaatagatctaaaacttcagtgatcccaccacggggacggaaagttgtgcttgggctacttgtggatggctcccgcccacgattgtcaagggaattcaaagccagtctgcgtcaacatttgtactatctgacgcttgacgggtggggaccagtcaagcacgccaaagtccgaggctttgcctcgctcgtaggtttacgtgaccacgtgctggggctgattggctatgccgggcagatcgagccagcctatgcccttgctcgccgacgcgaattcgaaactattaagtggcccatctga

SEQ ID NO: 8873 - RNA, 1188 nt, unidentified
  source 1..1188: mol_type = other RNA; note = synthetic construct
atgtcagattggaggccccaacattaccgcaagaatgcaccggcagggagcccagcaagcactatcgatgccgcactggaagttgcaagtattacctccacggccaatagcaggttaccccccattttctctttgagacacctggcccattatacatccattaactacaacattctgcgcgctgctatctctcgtagtggacccgaaccttatcgatctttccgaatccggaaacgtacagagaaatcctctgagcggtaccggcacatatccgtaccttcccacgccttgatgtgtgttcaaagatggattaaccagcggatccttcaacagtgccaggtcgacgacgccagtactgcgtttgcgaaagactcaaagctcatcgaggccgccaccatccactgcaaaagcaggtggctggtcaaaattgacgtgaggaactttttcgactcgataaacgagataagcatctatcgggtgttcaatagtctggggtaccagcctttagtggcttttgaactggcaaggttatgcactcggaaaagcgcacgacattccaagaattggctgaattttagaccggaaaccagggatgtctgggccgccccagatgacgaggggaaagcttggtctagcgatatggtcatcaagtcatatgacgctctacaccagggttacctcccacagggagccccaacctccccaatgctgagtaacctagccatgcgttcgtttgatgagaaggtgcgcgacttggcactcaagcgcggcttcttttacacccgatatgctgacgatatttcactgagcacggagcgcacatcttcacgcgtgacctgtgtcgaactgattagagatgtgcaccagctgcttcacgaggagggactgagtccgaacttcgctaagactaaaatcgttcctccaggcgcgaagaagattgtgcttggccttttggtgaacggagaaaaaccccggctcacaagagaattccgcctcagactgagacaacatttgcactttcttgagaagcctaatggtcccgtagagcatgccgctaagcggaagttcgcgtccgtgtctggcctgagacaccatctgctaggcctcgccgcttatgctgcccagatagaacccgagtacgggcaggacatccagcagaggctcaggaatatcccttggcctagctga

SEQ ID NO: 8874 - RNA, 1191 nt, unidentified
  source 1..1191: mol_type = other RNA; note = synthetic construct
atgagcgactggaggccgcagcattacaggaagcatgctccatgcggactggggagcggagtactggacgctgcaattaaggtagcagctggcacccgacaagcaaatgccaagctcccccccatcttctctttgcggcacttagcacattatagcggaatcaactattatgtcctgcgggccgctgtgagcagatctggggtcgagccatacagatcctttcgcatccacaagcgacctccgtcacatgtgagacgttaccggcacatttcaatccccagcccggcactcatgcaagtgcagaggtggatcaaccagcgcattcttcagcagtgcgaggtcgatgaggcctctgtggccttcgccgaaaattgtaaaatctttgacgcggcaaagctgcactcccagtcgaggtggctgattaaaatcgatgtgagggattttttcgactccattaacgaaatttccgtgttccacgtctttaataggcttggctaccagcctctggttgccttcgagctcgcccgattgtgcactcgggaaagtcaccatcgtaaggggaagaactggaagaactttcgactgaaggataacgagatacccagtctgtgggatgagtccgagcctagatggaaatccaacatggtgataaaatcatacgactctcagcaccagggctatcttcctcaaggcgcccccacgagtccaatgttgagcaatctagtgatgaaagactttgacgagaaagttggggcgctcgctagtgaaaatggctttttttacaccagatacgcggatgatataactctgtccacagctgatcagtctagtcggacagactgtgtccaactcatgagggcggtgtatcaactgttacacgaaaagggtctgagcccaaacgtcgccaaggctaagatcgtgcctcctggggccaaaaagattgtgctgggactgctagtaaatggtgacaaaccacgcttgacacgcgaattcagactgcggcttcgccagcatttattcttcttggagaaagagaatggtccagttgaacacgcaaaacgtcggaaattcgcctctgttagcggcctcagacatcacctcatgggactggccgcctatgctgctcagatcgaacccgcatacggccttaagatacagcagcgcctaatgaccatctcatggccctcatga

SEQ ID NO: 8875 - RNA, 1191 nt, unidentified
  source 1..1191: mol_type = other RNA; note = synthetic construct
atgagcgattggcactcccagcggtaccgaaaagcagcgcctgctggacagagttccgcagtgattgacgcagctattcagactgctagtatcaccaagcaggtaaacgctaaattacctcctatttttagtcttcgccatttgagccactacactagcatcaattataatatcctccgggccgtggtttcgcgttccagaagagagagctaccgctctttccagattcaaaagcgatcaggacggggcgcctcccgatttcgcagtatttctgtgcccagcccagccctgatgcaggtgcaacgctggatcaatcaacgtattctgcagcagtgtaaggtcgacgaggcctcagtggccttcgccaaacacgccacactgacagaggccgccaaaatccactgccaatctcgttggctgataaagatagacgtccgaaatttcttccattctatcaacgagatctccgtgtaccgggttttcaaatcactcggctaccaacccctggtagcatttgagctagctaggctgtgcactagacagtcactcattggccccgggaaacaatgggaaaatttcaggagcacgaaggacgacatccaggctgccctggacgataagccagtgatgtggagttctgatatggtgataaagagctacgattctccgagacagggatatctcccccagggtgcaccgacctcccctatgctgagcaaccttgtcatgaggagctttgatcagaagctgcgcgacctggcttccgaaagtcagttttactatacgaggtatgcggatgacattactttatcaaccaccgaaccctcctctagggcaacctgtctcgccctcatgaggaaggtatatcagttattgcacgatgaaggcctgtcgccaaacgccgctaaagtccagatcgtgccacccggagcaaaaaaaatcgttctagggcttttggtgaacggtgatacacctagactgacacgcgaattccggttgagactccggcatcacctgtactatctggagaagcccaacggccctgttgagcatgccgccaagagggacttcgcttctgtctccggtcttagacatcacttgtttgggcttgcagcctatgcgtcacagatcgagccggcgtacggggctcaaatacagcagcggctgaggagcattccatggccagcatga

SEQ ID NO: 8876 - RNA, 1194 nt, unidentified
  source 1..1194: mol_type = other RNA; note = synthetic construct
atgacaagatggaggccccagcgctatagggctggagcagtagcgaaaggcattagccctcagatagtggagcacgcactccgtaccgcagagatcacccacgccgtgaacggtaagctgccacccatactgacactccgccatctggctgagtatacgggcgtcgactacgggactctccggagtgtggcccgtcgaagcgatgaagtcagttatcgggtcttcaggatccgtaaacgccctgcacataagggggagagacggtttcgagtcattgctgtgccgtcagcacccctaatgcagatccaacgctggataaacaagagggtgcttatgcacgccgatgtacatcccgctagcgtggccttcgccgaagacgacaatattagggaggcggctgcggttcactgccagtgtaagtggcttattaagttggacgtgttaaacttctttgagtccatcagcgagatcagtatctataaagtctttagaagcctcggctatcaaccgctcatctctttcgaattatcccgcatctgcacgcgcatatctaaatccaccgccaatcggtcctctgaacggtggattaatttcagacctggatccgccgttgataccgatggcgtgtcatctattagtggtatgaccatccgggcctacgacgaataccgcatcgggcaccttcctcaaggagcccccactagcccaatgctggccaacctggctatgagggaactggaccagaatctcacagaagttgccaaggtgcacggacttttctatacccgatacgcagacgatctgactttctcgacaagggaggactcggatagacgtaaatgccaacacattattggccagatttatagagcactcgctaacgtgggtctgtccccaaatcgatgtaagacaagaatcatccccccaggtggccggaaaatcgtgttgggattgctggttactggacctgaaccaagactaatgcgagattttaaggctaggttgagacagcatttttactacctggagaggccgaatttcgggccttctcagcatgcgcggaagctgggctttagctcagtcatcgggtttagacaccatctggccggcttagtatcatacgccgctcagattgagccagagtacgggcagaggatgcggaaccgcctgaagaacataaaatggcccatttga

SEQ ID NO: 8877 - RNA, 1179 nt, unidentified
  source 1..1179: mol_type = other RNA; note = synthetic construct
atgactacctggcgtcctcaacactttaggtctgccgcaacagccgccggacgagatcccagtaccatcagaaatgccctagccgtggctgagaatataagacgtcataaccccgccctccctcccatctttagcctgaaacacatggccgaattaacagggaacgactatggtgtgctccggtcgattgttaagcgggacgagcccgacccttacagaatcttcacaattcggaagcgacctagcttcgacggagagaggcggttccgcctgattacagtgccacggccagccctgcttcggactcaaaagtggatctgtcagcagatccttgctaaggcaaccccccacgggtcctcagtggccttctccaaagggaatacgctctttgacgctgctaggccacattgcgaatccagatggcttatcaagatggacgtgcgcaacttctttgagtcaatcaatgaaatagccgtctacagagtattccgcagcctgggatatcagcccctggtgtccttcgagctggctcgagtttgcacgcgattgggtggccctactccgttgcggagtactccgagatggcactacgatcccaagaattggccaagcatctctgcataccaggtctaccgatacgggtatggccctagaatgggccatcttccacagggagcaccaacctcacccatgttggctaatctggctatgcgtgaatttgatcatgctgtggatgaaattgcggcgcgccacggcctcagatatacacgctatgctgacgacctcaccttctctacagattctgacgatttcgatcgcggaaaagcggggcacttcatcggtctggtttacaaggagatgggcaaggtgggcctgtcaccaaacataaccaaaactcgcgtcgcaagtcccggcgccaggaaagtggtgttaggtctgttagttgatgggaagaggcctaaactgcctagggagtttaaacaaaacatgcgccggcacattttttgtcttacccatgagggactggggccagtacggcatgcccaggaacgtggatttagctccgtcaggggcttcaggaggcacattcagggcctcctggcctttgcaaaccagattgagccggaatatgcggcaggttgcaggcagcaactaagaggcgtagtctggcctttgtga

SEQ ID NO: 8878 - RNA, 1179 nt, unidentified
  source 1..1179: mol_type = other RNA; note = synthetic construct
atgacctcttggcgcccccagcattttcgaagtgcagctgcggcagccggaagggacccatcaacaatccagaacgccctggcaatcgcgcaggggattaggcagcataatgccatcctgccacccatcttcacactcaaacatctggcagagcttaccggcaccgagtatgctgcactcaggtccatcgtcaaacgagatgagcccgacccttataggatctttactatccgaaaacggccgtcctacgatggggaaaggaggttcagactcattactgttccaagaccttctctcctgcgtacccagaagtggatttgccagcagatcttggccaacattgtgccacactctagctcagtagcattctcgaagggcgatacggtttacgatgctgctaatcctcactgtgaatcacgctggctgataaaaatggatgtccggaattttttcgagagtatcaacgagatatccgtgtatcggatcttccgcagcgtgggttatcaaccccttctgagctttgagttagcacgaatttgcacaagactagggggcgcaacaccactgagaatgaccccccggtggaattacaacagccggcaatggagtgccatcagctcttaccaagtgtacagatacggacacggtcctcgtgtggggcaccttcctcagggagcgccaacttccccgatgcttgctaatctcgccatgagagaatttgaccgcagagtagaccacctggccactcatcacgggttgagatataccagatatgctgacgacttgaccttctcgactgtgtctgacgatttcgaccgcggcctggccagccacttcattggcttagtctacgccgagatgggcaaggttggactgtcccccaatgttaccaaaacacgggtggctagtcccggtgcccgcaagattgtgctcggccttctcgtggacggcaaagctcctaagttaactcgagagtttaagcagaacatgcggaggcacattttttgcctgacacacgaggggctaggtccaacgcggcatgccgaagaacgtggattcagctccgtcaggggactgcgccgccatatacagggcctgctggcctacgctaagcaaatagaacccgattatgccgcgaactgtaggcggcagttgcagtcagtggtctggcctttgtga

SEQ ID NO: 8879 - RNA, 1173 nt, unidentified
  source 1..1173: mol_type = other RNA; note = synthetic construct
atgactagctggtcacctcaacacttccagacagtagctgacagcgctgaaagagatcccaaggtgattcagaacgcccttaccgccgcaagagtcattcgtagcaccaatccagccctgcctcctgtgttcacgctgggccaccttgcacacctgaccggaagcgaattttttcagctccggagcgtggcccggagagatgaaccggacccataccggctgtttcggatccggaaacgaccgagctttgagggcgagcggcgatttcgaattatcaccgtgcctcaaccacacctacttagggtccagcgctggataacacaggcaatcctggcgaacgctttaccccatcaggcttccgttgcattctctaagggtaataggttgagggacgccgccgctgttcattgtaattcatcttggctcatcaaactggatgtcacgaacttcttcgagtctatttcagaaatttcagtgtacaggatctttcgtagtctgggatatcagccactgataagtttcgagatggccagaatatgtactcgcctcggcggccccacaaccaggaaacgaggggaaagatggagagtgcactttaaacctcgggagattaagtcctacgatgtatatagaccctttggaggcgcccgtgtggggcatctaccccaaggtgcccccacctctcctatgctcgctaatctggccatgagaagttttgacactgaggtggataagctcgccgttgagcatgggctgaggtatacacgctatgcggacgacttaactttctcgacaaagggggaattctcccgcgatcaggccgcacacgtaatcggcctcgcttacaaggccatggggagagtcggcctgtcgccaaacgccactaaatcccgagttgctccacctggatcccgcaaaatggtgttgggtctgctggtcgatggcgctgaaccgcgccttccacgggagttcaaggaatctatgcggaggcacttatattacttgtgccgcacagacatagggcctgtggcacatgcgagggctcgtggtttcgccagtaccatcggaatgaggcatcacattgagggattgctcagcttcgcgaagcagatcgagccctcctacgcagcagagtgcaagcgcaaatttgcaaacatcgactggcccatctga

SEQ ID NO: 8880 - RNA, 1119 nt, unidentified
  source 1..1119: mol_type = other RNA; note = synthetic construct
atggcaaatgctttggccactgccagccagctcaagatcccttcacttcctccagtgtttacccttgcccaccttgctcagcaggcaggagtggactacggcgtgctgcgacgtgttgctcagaggagcccaaacgaaggttaccgcgtgttccggataaggaaacgcccagcttatactggcgagcggagataccggcagatagcggtgcccagtccacagctaatgaaggtccagcggtggatcacccaagcgattctcagcaaagctgccgcccactcagcatcagtagccttttccaagggagataagttagcagacgcggcagcccctcattgcggttgtaagtggttaataaagatggacgtgagaaatttcttcgagagcatcaacgaaattgcagcatatcgcgtttttagatctttaggctaccagcccctcgtgagtttggagatggcccgcatctccacgaggctagccggatggagtccaagacgagccaccaacaggtggcgcgtagaagactggcggcacatggagcgccgatggtccgaaatcgaggcctaccaagcatatcgagacgatagcggaccccttctcggccacttgccccaaggagccccaacctctcctatgctggccaatctggctatgcgggaatttgatgctcaggccgccgcaatcgctgagcagaatgggatgatctataccagatacgctgacgatctgtcattctctacggatcagcccatcactaaagctgattgcaggcgtcttattgggacaatttacaatctgatgggcactattgggctgtcgcccaacgtgacaaagacaagagtttcccccccgggagccagaaaaattgtcttggggctgctggtagacggtaagaaacctcggctctcccgagagtttcgtgcgctgatgaggcagcacctgcattatctcatgaaggatggggttggccctgtgaggcatgccagggctaggggtttcgtctctgtggctgggttccggaaccatctgagaggcctcgcgacatatgcacgccaaattgacgtcgtctacggcgatggactgctgagagagctggacaaagtgagctggccggtctga

SEQ ID NO: 8881 - RNA, 1152 nt, unidentified
  source 1..1152: mol_type = other RNA; note = synthetic construct
atgtcccggtggagcccccagcaataccgaagtaatgcccagaatatcgacccagacatagtggcgcacgccatagaaacggcccgcctcattcacgaagtgaacgccgagattacacctgtcttcactctcaggcacctcgcctatgcgaccgacgtagattatggcttactgagggcaatcgcctccagagctcatggagagccataccgcctgttcgtgatcaaaaaacggcctagcaggtcaggggagaagagatttcgggtgattgcggttccttctccagggttaatgaaagttcagcgttggatcacccaccggatcctgggccatatacgcccccaccccgctagtgtggctttttctaagggcgataagattgtgtctgcagtccgccctcactgtggagcacgatgggtaatcaaaatggatgtccgaaacttctttgagagcataaacgagatctccatttaccgtgtgttccgcagtctgggattccaaagactaataagcctggagatggcaagaatttgcacgagactgggcacacctactatctcaagactgcatcagcgttggaagagcaattatcagagggagactatccacgtgtatggcgctgggagaatggggcatctaccccagggcgctccaacctctcccatgctcgccaacttggcggtccggaaactggacgagcttattgaagaaattgcaaccaagtgcggcatgatctataccagatacgctgacgatttgacactctctacaaaggatatgacctttaatcgggaccaggcagggatcgttatcggcaagatctacgccgctatgggactttacgggctgagcccgaatatcactaagacaaacattttgagtccgggaagccgaaaaatcgtcctgggtcttctggtggacggtgaaaagcctaggctttcccgggatttcaggaatctcatgaggcagcatctgcactacctcggatcattaaagcatgggccagccgagcatgcctccaagaggggattttcctcaatacgcggtatgaaacaccacatttatggtctggcaacttacgcccgccaaatcgaagaatcgtatggcattgaatgtattgccgctttgaacaaaattgagtggcccatctga

SEQ ID NO: 8882 - RNA, 1152 nt, unidentified
  source 1..1152: mol_type = other RNA; note = synthetic construct
atgagtaggtggagccctcaacaatataggcgctccgcgaaggacacagaccctgggattgttgcaaacgccatagagacagcaaaactgatccatgccgtcaatgccgatgtggccccagtgttcacactgagacacctggctcacgccgcggatgtggactatggactgctgagagctattactagtcgggccgacggcgagccataccgattgttcctgatcagaaagcggcccagccacactggcgaaaagcggtttagagttattgctgtcccctcgccggcactgatgaaagtacagcggtggatcacgcaccgcatcctgggacatgtgaggccccactcagcaagtgtcgcctttagcaaaggggataccctagtggcagctgctgaaccacactgtggcgccagatggattgtgaaaatggacgtgcggaatttctttgagtccattaacgaaatttccgtgtatagggtgttccagtccctgggcttccagcgcctgatatctctcgagttagcacgtatctgtacccgcctgggctctcttacaacgtctcgaaaaaatcctagatggtggtctaatagagagcgtgaaacaattaaggtttatggtgctaggcgcatgggacatctcccgcagggtgctcctacttccccaatgctcgctaacctcgctgtaaggaaattggacgagttgatcgaagagatcgcggcaaaacacgggatgatctatacccgatacgccgatgatttgacagtctcaaccaaggacaagaccttcaaccgggataaatgccgagctgtgatcggagaaatatacgcagccatggccaagcacggcctttcaccaaacaccgccaagactatcattctgagccccggcagtcgcaagatcgttttaggactcctcgtagacggagaggaaccccgcctacagagggactttcgtattttaatgcgacagcatctctactacctgactagccctaagcacgggcctgccgatcatgccaggatcaggggcttttcctctatacggggtatgcggcatcacatacatgggctggcgacctttgccagacaggtcgagaagccatacggggaagagtgccttagcgcacttaataaagtgaactggcccgtctga

SEQ ID NO: 8883 - RNA, 1158 nt, unidentified
  source 1..1158: mol_type = other RNA; note = synthetic construct
atgacgagatggaacccccagcaatttaagcgggacgctgaaagggccggacttgaccctgctgttacagctaatgccattagaacggcccgtctcgtgacttccgtagatccagatcttcccccagtcttgacactgcgccatctggccgcccttacccgaagtgactacctgatgatgcgcggcatcgccatgcgaagccagaacgagcattacaggctctttcgtattagaaagaaacctgcgcatgacggagagaagcgcttccgcgtgattgcagtccccgaaccggggttgatgagagcacagcggtggattgcccagaggatcttggcacgaattcggccacacggggcctctgtagcctttagtaagggagacaagctggtggaagcggctagaccacactgcggtgcccgatggctgataaagctggacgtgagcaacttttttgagtcgattaatgaaactgccgtgtatcgggtgtttcgcagcctgggctatcaacctttagtgtgcatggaaatggcgaggctatgtacccggctcggcacaaccactcattaccggagtcgccctcggtggctgttaacccgtgaaagatccactatagaggtgtattcacgcaggagaatgggccatctcccccaaggggctcccacatcaccaatgcttgccaatctcgcggttaggctgttcgatgaggccatacaggaattagcagatgcaaatgacctggccttcacaaggtacgctgacgacatcgcactgagctctcaggacgcaaaatttggtcgggacagatgtgccgctgtgatcggaaaggtctacgctaagatgggcgagttcggtctgtcacccaatgccaccaaaaccagggttgcatccccgggcgctcggaaagtggtcttgggactcctggtcgatggcgacgagcctcgactgcctagagatttccgtgcaaacatgcggagacacctacactatctctgtgtacccggggccgatatcgcagttcacgcggctgccagggggttcgattctatctctggcatgaaaaaccacgtgttcggacttgcaatgttcgctaggcagatcgagcgcgattacggggatgagtgcttgtccaaactgaacgctgtcgcctggccacgctga

SEQ ID NO: 8884 - RNA, 1155 nt, unidentified
  source 1..1155: mol_type = other RNA; note = synthetic construct
atggaagattggcttcctcaattgtaccaaaaacagggcactgaagccgggattgcccccagggtcctggcaaatgctaacttgacagcgaagagtatccgagccgttaacagacacgtaccaattcttttttcacttaaccacttggccgtgcgttgtggcgtgccttacagctttctgagggccgtggtggagaggcatgattttcaattctaccggtccttcaggatccggaaacgcccactgaagggcagagtgagattccggctgattagcgcccctgtccccttcctgatgcgcgttcagaggtggatagcacaggagatcctatctaatggctacccgcacgaaacctcaaccgcctatgcgaagcggtcctctcctttgaaggctgccgctttacattgcgacgcacgatggctcatcaagatagacgtgatgaatttcttcgaatcaatcaccgaagtcagtgcctatcgagctttccggaggctcggatatcagccactattgtcatttgaaatggcgcgccttagcacaagggttcggagcgccttacgacagctgccgtctccctactggcacactcaggctcatcgctggccaaagatcgaaagttatcagtgttggagaaagggcgggctgccccaaggtgctcctacttccccgatgttagcaaacctggccagtattgctctcgacgaatgcctggcagaggtggcacgcaaatatcggctgacctattcccgctacgcagatgatctgtgcttttccacaagcggcgatttctccaggaaagattgtgctggtgttatttccgaggtgtacgccggactgcgcaaatttgggctcagaccccagaccatgaaaacaacggtgtctccacctggtgcccgaaaggtggtgctggggctcctggtcgacaggaatactccccacctaacgcgggagtttaaggcacgtctgaggcagcacctgcactacctcagaaaagccgacgtaggaccagctagacatgcagagcgccgtggattttcgtctgtcatcgggcttcggcatcacgttgagggactcgtcgagtatgctagctctgtagacgcggtgtacggcgagagcagaagacgtgagctcgccgaggtcagctggcccttctga

SEQ ID NO: 8885 - RNA, 1152 nt, unidentified
  source 1..1152: mol_type = other RNA; note = synthetic construct
atggagaattggttgagtcaacggtatagaatggatgctaacaagcagggtgtggacccagaggttgtagagcacgcagtggcaacagcagagaatatcagaagtattaacccgaacgtgcctctcctgttttctctgaaacatctcgccttgcgggcgggcgtcccatatgagtttctgcgcgccgtggttgaacgccaggagagacatttctaccggacattccggattcgaaagaggccgctggagggcagaatccgcttcaggttgattgcggctcctgtaccccctttgatgtccgtccagaggtggatcgccactcagattctgagcgaggggcacccccatgaagctagcgttgcctacgctcgtcactcatctcccctgaaggctgcttcattccactgcaacgccaggtggcttatcaagatcgacgtgatgaatttctttgaatccattaccgaagtggctgcatatagggcttttcgcagattcggttaccaacctctgctctcctttgaaatggggcgtctatgcacaagggtgcgaagctggcgaagacaggcacccccttactggcaaagtaaatcttggcgctggggaaagatagattcatacaagttctctaccaagggcgcactcccacaaggtgcgccaacgagcccaatgctcgcgaacctgaccgcgctagagcttgacgctctggttacaaggcttgccaataagcacggattagtgtacactcgctatgcagatgacctgtgcttttccactccaggcgaattttctagagcccagtgttcgcagctggtcggcgaggtatataaagccctgcgtcgctttggcttacggccgcagaccatgaaaaccgtgatcgccccacccggagcccgaaaagtcgtgctagggttgcttgtggatggacagaaacctcggctgcccagggagttcaaggccagactgcggcagcatcttcacttcctcacgcaccctagcgtcggacctgcattacacgccgccaggagaggttttgctagtataatagggctccggcatcatgtcagcgggctgatcgaatacgctgcctccgttgaacccgcctatggcgcacgatgtcgctcacagttcgccaatgtgcagtggcccttctga

SEQ ID NO: 8886 - RNA, 1158 nt, unidentified
  source 1..1158: mol_type = other RNA; note = synthetic construct
atgactcattggtccccacagcgatacagaagtttggggcaacgccggggaatcgacccatcggtactggagaatgcagttcgcactggtaatatcacctgcgcagcaaacccccatgtccccaccctcttctcactgaaacacctcgcatatcgatctggagtggattactccctcctcagagcgattgtagagcggagggaccctgagccataccgaacgtttaaggtcaggaaaagaagcagttcaccgcagcatgctcggtaccgggtgattgccgtgccgtctccagctcttatgcgggtgcagaagtggatcgcccagagaattctcgcagtggcccctgcccattctgcttctaccgcttacggcaagaactgtaacatcagcgacgccgtcttgccccactgttcttccagatggctcatcaagcttgacgtgaggagcttcttcgaaagcataagtgaatccgccgcatatggcgtcttcagaaagcttggatatcaacccctgatctcctttgagctagcaaggatttgcacacgtgtatatagcaaaacacgcctgcgctcgtataaatactgggatgtcgaacctgcccgctggtccgcaattcctagttatcagtactttcgaaaaggttccctgccacagggggcccctacaagccctatgttggccaacctggctgtgcgtcaattcgatgccaatatcaccgctatagctgagaagtacggcctgatctacactcggtacgcggatgaccttgcgcttagtacttcaggcgaattcagcaggcaaaaatgccactcagtgattcagaaggtttatggagaaatgagagctttcggtctgtctcccaacgcaacgaaaaccgctatatcaccaccgggcgccagaaagctcttactggggctgctggttgataccgaccggcccaaactgacaagggagttcagggcgaagctgcgtcagcacgtgttttttttacagagcccaaaagctggacccgttaagcatgcccgccacctggggttccagtccttgattgggtttaggcaccacatacacggcctagtgaattatgcctatgagatcgagcctgcctttggcgagcgctacaaggaagccttgaaggccgtggaatggcccttatga

SEQ ID NO: 8887 - RNA, 1152 nt, unidentified
  source 1..1152: mol_type = other RNA; note = synthetic construct
atgactatgtggcggcctcagtcttaccaacggcgcggcaaggagctgggcatagaggaaactctcctagctcgagcatgcgctattgggtcagcagtaatcgccgttaaccctgctctgccacctgtctttacacttcgccatctcgcctatcaggtggatgccgattacggtcttctcagggctatcatttcccgctctttaagggatccttataaggtgttcagaatccgtaagcggcccagcaccgtgggagaaaagagattccgagtgatctgtgtgccagaccccgagctgatgcgcgtacaaagatggatttctcagcgaatcctcagccacgccaatccccatagcgcgtccgtcgcctacgccaaaggttccactatacttgccggggcagagcctcattgtgggtgcagatggctaatcaaacttgacgttcggaatttctttgaaactatctcagagatagctgtgtatcgcgtctttcgaagcctggggtatcaggccttagtggccttcgagctgacacggttgtgcacccggctcggcacgaaaaccccgctgagaattgggcagagatggcaggttcatttcggtaggcacatggtgatcggcgattattcggcctctcgtatgggccatctgccacagggagcacccaccagcccaatgctggcaaatttggctgtgctggcttttgacggcgaagtcaacgaaattgcgaacaagcacggtctgatctacacacgatatgcagacgatatcgctctaagtacaaccgacaagacgttctcccgcaccgtagccgccaaggtcattggggaggtgtacgccgcgatgggccgttacggactcagtcccaacgtcaccaagactagggtgagttccccagcatcaagaaaggttgtcctcggactgctggtggatggaaacgctccgaggttgacacgcgagttcaaagcaaatctccggagacacctgcactacttggggcggcctgacgtaggcccagccaaacacgcagctgctaggggctttgcagccattgcgggcttaaggcaccacgttgagggactggtggcgtttgccaggcaaatagaacccgaatacggagagaggtcagccaaattgcttgtggacagactgtga

SEQ ID NO: 8888 - RNA, 1167 nt, unidentified
  source 1..1167: mol_type = other RNA; note = synthetic construct
atgaaggattggacaccccagcactataggagggcacccggtgcggccaatttgcctgcttccgtaatggaagctgcaatcgctgcctccggcaagaccgttgcggtccactcttctcttccgccgatcctgacccttaatcacctggcacacctgacacaagtgccttataagcaccttcgcgattacgtgactcgagagatagaaagctacaagatcttcagagtccgaaaacgagctcgtccaggcaaacctaccacgtttcgagtgatctgtgtacctcccccatcattggcaacggctcaacgatggatcgcccagcatgtactctctaaagccaggcctaacgccgctagcacagccttcgctccaggaagtaaactggtggacgctaccgctccgcattgcgcatcccggtggttaataaaagtggacgttcagagattcttcgagtctatcagcgaggttgattgctatcgggtgttccggtccctgggttatcagcctctcgtcgccttcgaattgtctaggctctgtactagaacggggaacttttccaggcttcatcgggcgattaaatggcggcgcaaaatttcactgagcaagtcgaagataccagggtacgcaagtcgcgacattggacacgtcccacagggcgctgctacttccccaatgctggccaatttggttatgcgggaggccgacacattgatgacaagcctcgcagatcgcctgggcctaacttacaccaggtatgccgacgatctgacattctcaacttcagatcccaaatttgatcggcagactgcaattaagaccgtgaatgaagcctacgcgatactgagacgctttggtttcacccccaacattgcaaagaccacaattgccagtcctagaagccgtaaaattgtgctgggccttcaggtggaccaggacaagccccgcctaacccgtgcctttaagatgaagatgagaatgcatatgtactatctggaaaggagagacatcggcccattagtgcatgccgaacgccggggatttagtgccgtcgccgggatgagaaaccacctgatgggactggcggcctatgcaatccaaatcgagcccgagtacgggaggaacttaagagagaggctcgaggctctcgactggcccgtgctctactga

SEQ ID NO: 8889 - RNA, 1167 nt, unidentified
  source 1..1167: mol_type = other RNA; note = synthetic construct
atgaaagactggacccctcagcattaccgtcgagctcaaggcgcctcctctatagcaccgctggtgatggacgctgcaatcgtaacgagtcagaaaactgtcgccgtgcaccccagccttccaccaatactaaccttgaagcacctggcccacttaactcaagtgccatataagcacctgcgagattatgttacccgggaggtggagagttacaaagtgtttcgtgtgcgtaagagaggtcggctgggtcagccaacatcgtttagagtgatttgcgttccccctcccagcctcagtgtcgctcaacagtggatcgcccaacatgtcctcgccaaggccaaaccacacgctgctagcaccgcttttgccccaaactgccgcttgatcgacgcagcatccccgcactgtacctccaggtggctgattaaggtagatgtgaagcgctttttcgaatctattagcgaaatcgattgttacagagtatttcgatctctgggatatcagcctctcgtctccttcgaactctcaaggctttgcacgcggaccggcaacttcagccgaatcagacgcacagttaagtggcggaggaaagttagcctgtccaagtctaagatccctaattatgcttcaagagacattggacatctgccgcagggcgccgcaacaagtcccatgctggcgaatttggctatgcgcgaggcagatattttgctcactgagctggccgagcggctcggactcacgtacactaggtacgccgatgatctgacactatcaaccaccgacgtcaccttcgaccgcgagcaggcgagacggacagtgaatgaggtttaccgaatcctgcagcggttcgggttgaatcccaacttagctaaaactacaatcgcctcccctaggtctaggaaaattgtgctcggactgcatgtgcaccaggaaacaccccgcctgactcgggcattcagaatgaaaatacgcatgcatcttcattacctggaaagaaaggacgtaggcccccttaaacacgcggagaggaggggtttttcagccgtcgccgggatgagaaaccacctaatgggcttagcagcttacgccatccagattgagcctgactatgggcgcgaagtgaaggcgaggcttgaagccgtggagtggcctgtcctgtattga

SEQ ID NO: 8890 - RNA, 1167 nt, unidentified
  source 1..1167: mol_type = other RNA; note = synthetic construct
atgaaggattggaccccacagcactaccggcggtctaaaggagctagtaatgttccaacagcagtgatgaacgcggcgatcgcaacatcccagaaaactgtggccatcaatcctagcctacctccgattcttactttgaatcacctggcacatatgactcaggtcccttataaacatctgagggactatgtcgccagggacgtggaatcctacaagacttttagagtacgcaaacgggccaggccgggtcgaccaacatcattccgcgtgatctgtgtgcccccacctagtttggccgtcgctcagagatggatagctcagcacgtgctcgccaaagctagaccccatgcagcctctacagcgtttgcacccaagtgcaagctgatcgaggccgcagcccctcactgtagctctaggtggttaatcaaggttgacgttcagcgattcttcgagagtatttcagagatagactgctatagggtcttccggtctttaggctatcaaccccttgtgtcacttgagctcagccgactgtgcaccagggttggccatttctccagaatgaggcgcgctattaagtggcgtcgtaaagccccactggctaagtcgaagatactcaagtacgcgtccagagccctaggacatctgcctcaaggcgccgctacctcacccatgcttgctaatctggtgatgcgggaagctgataccttgctgaccagcctcgccgatcggtttgggctgacatacaccaggtatgccgacgatctgaccttttctaccgcagatactgcatttgaccgcaaaagtgcacggaacgccgtgaacgaggtctatgggatcctgcggcgattcgggctcacgcctaacctgttcaaaacaaacattgtttccccccgaagcagaaagatcgtattgggtctgcaggtaggccaagatgtgccccgcctaacgagagcattcaagatgaagatgcgcatgcacctctactacctggagagagaagacgtgggaccattagcccacgccgagagaaggggatttagcgctgtcgccggcatgcgcaatcaccttatggggctcgccgcttatgctattcagattgaaccagagtacggcatgggtgtgaaagcgcgtctggaagcagtccagtggcccatcttgtactga

SEQ ID NO: 8891 - RNA, 1167 nt, unidentified
  source 1..1167: mol_type = other RNA; note = synthetic construct
atgaaggattggaagccacaacattacagaagagctcccggagcatccaaagttagcgtacccgtgctagccgcggccatcgctacaagcgaaaaaacggtcgccgtacacccgtcattgcctccaatacttactctgaaacatttagcccacctgaccggcgtgccctataaacacttgcgggactatgtcagcagggacacagaggcctacaagatattccgagtgcgaaaaagggctaggcccgggaccctgaccagttttcgggttatttgtgttcccccacctagtctagcaattgcgcagaaatggatagcacagcatgtgctggccaaggcaaaaccgcactccgcatctaccgctttcgcccccaattgtcgcctggttgacgcagcaaagccacattgcgctagccgttggctgattaaggtggatgtgcagagattctttgagtccatctccgaaatcgattgctaccgggtgttccgctccttggggtatcaacctctcgtctcgctggagctctctaggctctgcactagggtcgggcggttcaatggcatgcgccatggcatcaaatggagacgcaaagctagtatcaagaagagcaagattgtacgatacgccctgctgcggcttggacacttgccacagggtgccgcgacttcaccaatgcttgctaatttggttatgagagatgctgacgaactgctcactagcatggctgaccagcttggcatgacctacaccaggtatgccgacgacctgacgttttcaaccgcgtctcccgtgttcgagcggcaaacagccaggcgcgtgattaacgagatctaccaggtgctcagaagatatggtctgacacctaacttagccaaaaccacaattgtccctccacgcagtagaaaaatcgtgctgggtctgcaggtggatcaggacgaacctcggctcactagggcctttaagatgaagatgaggatgcatttacactacctagagcgagaggatgtcggaccccttaagcacgccgaacgacgtgggttttcagcagtggcaggcatgcggaaccacctgatgggactggccgcttatgcctctcagatcgaacctacatacggccgtgatctgaaggaccgcttggagaagctcgattggccggtcctctattga

SEQ ID NO: 8892 - RNA, 1167 nt, unidentified
  source 1..1167: mol_type = other RNA; note = synthetic construct
atgaaggactggaaacctcagcactatcgcagggctcctggtgcagccgacgttccagccagcgttatggctgccgcaatcgccaccggcgctaaaatcgtcgccgtgcaaagaagtcttccgcccatcttcacactgaagcacctggctctgttgacgcaggttccataccctcacttgcgcgactatattactcgcaagaccgatgcgtacaagatttttagagtgaggaagcgagctaggcccggccagcctacctcgttcagagtgatttgtgttcctccccactcacttgctgtggcgcagcattggatagccaaacacgtcctcgccaaaggggtgccacattccgccagcacagcctttgcacccgactgccggctcattgatgccgccgcaccgcactgcgcttctagatggttaataaaggtcgatgtgcagcgtttctttgagtcaattagcgaggtcgactgttatagggtgttccgatcattgggataccagcccctcgtatcccttgaactgagtcggatctgcaccagaatcggccccttgaatagccttcgtcgctctgccaaatggttcagaaaagcacctctcgctaaatccaagatccggagctatgcagtgccgaggatcgggcatctgccacaaggagcagctacttctcctatgctggccaacctggccatgaaggaagctgatgtactgctcactgccttagcaaatagatattctctgaattacacccgatacgcagacgatttgacgtttagtactgcagaccacagcttcaagcgcaacgatgcccgaatggctgtgcatgagatttacggtgtcctgaggcggtttggacttgcacccaacctcacaaagaccgctatcgtaagtccacggtccagaaagatcgtcctgggactgcaggtgaaccaggatgtgccacgcctaacacgggactttaagatgaaaatcagaatgcacctgcattatctcgagcgcgaagacgtcgggccattaaagcatgccgagaggcgtgggttctccgctgttgcgggcatgcggaatcacctaatgggtctggccgcctacgccgctcagatagaacctgcatatggccaagccattaaagcgaggttcgagcggatagcgtggcccgtgctgtactga

SEQ ID NO: 8893 - RNA, 1167 nt, unidentified
  source 1..1167: mol_type = other RNA; note = synthetic construct
atgaaggactggaaacctcaacactaccgtagagccgctggcgcagtcggagttccagcaccagtgatggccgcagcaatagcaaccggccagaagacagttgctattcacccctccctgcctccaatcctcactctcaaacatctagctcatctcacacaggtcccgtatttacacttgcgggattacattgctagagagatcgacgcctacaaaattttcagagtacgcaagagggcccgacccggacagcctacaagtttcagggtgatatgcgtgccgcctcactcactcgctgttgcacaacagtggattagccagaatgtgctggccaagggcaaaccacatcatgccagcaccgcctttgcccccaattgtcggctggtggatgccactgcccctcattgcagcagcaggtggctgattaaggtcgacgtacaacggtttttcgaatccatctccgaagtcgactgctatagggtctttaggtccttaggctatcagcctctggtttccctggaactttctaggctctgtactagagtcggaccattcaacgggctacggcgatcaagaaagtggtttcggaaagcccctatcgagaaatctaagataagaccctatgcggtgagtcgactgggccacctgccacaaggggcctctactagtccgatgttggctaacctggccatgcgggaggtggatgggcttatgacggcgatggctgaccgttacggtctgacatatacccgctacgcagacgatttaacattgagcacctcggatcccgaattccagcggaaggacgcacgaaaagctatttacgagatctatggcatcttgcgcagatttgggctgaatcccaacctgaccaagaccgccatcgtgtcacccaggtctaggaagatcgttctcgggctgcaggtggatcgtgatgagccccgccttacgcgcgcgttcaagatgaaattgcgcatgcacctccactacctagagcacgaagacattggtcctctcaagcatgcggagcggcgcggattttctgctgtggtgggtatgaggaaccaccttatgggcctggccgcttacgcaatccagatagagcccgattatggaaaggacatcaaaatgagactggaacgagtgaaatggccagtactttactga

SEQ ID NO: 8894 - RNA, 1167 nt, unidentified
  source 1..1167: mol_type = other RNA; note = synthetic construct
atgaaggactggaagcctcaacactatagaaggtcccctggtgctagcgctgtgagttcctccgtaatggccgctgccatcgccactgcgcaaaaaaccgtggccgtgcacagtagtctacctcccattctgacgctgaagcatctcgcacacctgacccaggtgccatacctgcatttaagggactacgtgtctcgggaagtggaagcctacaaaatctttagggtccgcaagcgggcaaggcctgatcagcccacctcttttcgtgtcatatgcgttccaccccagagtctcgcagtcgcccagcgatggattgcgcagcatgtgctggctaaagggaagacgcacccggcttccacagccttcgcacctaattgtcgactggtcgatgccgccgctccccattgtgcctccagatggctgataaaagtggatgtacagaggttctttgagagcatcagcgaggtggactgctatagggtcttccgctcactgggataccagcccctgatgtcacttgagttatctaggctatgcactcgggtcggacctttcaatggcatgcggaggtcccgtaagtggtttagaaaaccgccactgtcgcgatctaaaatcaagagctacgcggtgtggcgcttgggacacctcccacagggtgctgcaacatcacctatgctggctaacttggccatgagagacgtggatgtccttatgacaggcctcgcggatcggtacgggctcacttacactcggtatgctgatgaccttacattctcaaccgcagatccgggctttgagagagaggacgcccgcaaagccatttacgaggtttatggagtactgcgacgattcgggttgaccccaaacctggcaaaaactacagtggcgagcccccgttctcggaagatcgttttaggcctccaagtggatcaagacgctcccagactcccccgcgccttcaagcttaagatgcggatgcatctatattatttggagagagacgacgttggccctctgaagcacgcagaacgcagggggtttagcgccgtgaccggtatgcgcaaccacttgatggggctcgctgcatacgccattcagattgaaccagcctacggcaaggacatcaaagcaagactggaaagagttaagtggccagtactttattga

SEQ ID NO: 8895 - RNA, 1170 nt, unidentified
  source 1..1170: mol_type = other RNA; note = synthetic construct
atgaccgactggaagcctcagccataccggcgggcagcagaggatctgggcatttctaaggccgtgctcgatgcttccatagcagcttctctcgccgtggtggacgtcaatccaagcttgcctccgatcctaacattgaaacatctttctcacctcagtggggtgccttatcaggacctgcgcttgatagtaagcagagagaacgccgacccatacaaaattttcagaatccggaaaagacccagacgagatggactgacacagtttcgcgtgatttgcatccctgaggtgaagctggctgaggttcagcagtggatcgcaaggaaggtgctagcccatggcagaccccactcagcctcgaccgcattcgctcctggctcacgcctcgtcgatgccgtccaaccccactgtgggtcacgctggataattaaggtcgacgtaaggcggttcttcgaatccgtaagcgaaattgctgcatatcgggtgtttagacgactgggttaccaaccattaatgagcctggaactggcgaggttgtgcacgagggtaggaccaattaccaaacttcgacggactcgacactggacacgggtggctccattggatgccgccactatccgatcctacgccgtcaggcacctaggtcacctgccccaaggagcgtccacttcacccatgttagctaatctggttatgtgtgacgccgacgccgagctcaccaaagcagctgaatcctttcatctgatttacacaagatacgctgacgatctgacctttagcacgcggaacgccgcctttgatagaagtgcggcagtgaccctcatcaagcaggtttatcgtgttcttggcaggtttggattggagcccaatcttgcgaaaacacaggtcgtgcctccgagggcgcggaaaatcgtgctgggcttactggctgaccaggatgttccccgccttactcgcgaattcaagaagaagatgagaatgcacctgtactatctggagcgtgctgacgtgggccctgtgaggcatgctcaacagcgcggattcagcgccgttgcagggcttcgcaaccatctcctcggtctggccgcctatgccagtcaggtcgaaccaatgtatggggccgagctgcgtaagaggctcatggcagtctcttggcccatcgtgtactga

SEQ ID NO: 8896 - RNA, 1170 nt, unidentified
  source 1..1170: mol_type = other RNA; note = synthetic construct
atgacggattggaaaccccagccctacaggagagcagcccagagcctgggcatctctgaagcagtgcttgacgctagcgtagcagcctcccaagccgtggtggcaatcaatccttcactcccgcccatcctcacactaaagcacctgagttatttaactggaactccctaccagtacctccggcaggtggttagtcgcgatgagctcaatccatatagagtcttccgagtgagaaagcgcccgactccttgcggccgtgtgcagtttagggttatttgcgtgccagatatcaaactggcgattgttcaacgatggattgctcgaaaggttctggcgctgggtcggccccattctgctaacaccgcgtttgcccctggaagcagacttgtggacgctgtggagccccattgtggttcccgatggatcgttaaggtggacgtacgtagattttttgagagcatttctgagataagcgcctatcacgcattcaggcttctggggtaccaacctctgatgtcattggagctggccagactgtgtacaagggtcggcaactttagtaaactgcgacggcagagacgttggattcgcttggctccacgccatgtcgctaaaataagtagctatgccgtcccaaggctcggacacctcccacagggagcacctacatccccaatgctggctaaccttacgatgtgcgaagcagacgccgtgctgaccaaagccgccgaatcattcgggatggtatacacccggtacgccgatgatctgaccttctctacctcgaaggattccttcgacaggaaggacgccaaggtgctaataaagcagatttaccagatcctaggccggtttggcctcgtccccaatcttgccaaaactcaggtcgtgcctcctcgggcacggaaaattgttctcggacttctggtagatcagtcaacccctcgcctgacacgcgagttcaaaaacaagatgcggatgcatttgtattacttggagagggcggacatcggtcccatccaacacgcccaaaagagggggttctccgctgtcgtgggcttacgcaatcacctgatggggctggctgcctatgcttgtcaggtggaaccgaaatacggggacgaattgaagaagagattaaaggcagtcccctggccagtggtctattga

SEQ ID NO: 8897 - RNA, 1170 nt, unidentified
  source 1..1170: mol_type = other RNA; note = synthetic construct
atggatgactggaagccccagccatatatccggcaagcccagcagttgggtgtggcccagtccattctggacgccgcagtcgccgcatcagaggctgttgtagccgcacaccctagcctccccccgatactgaccctgcgacacctcgcccacctgacggacaccagctaccttaaactgcgggattgggttagccgcgaaatagaagatccctacagagtcttccggatcaagaaacgtccggtcgcccctaattgcactgcctttcgaactatttgtgtgccagacgtggaactagcttttctccagaggtggctgtctcgcaatgtgttgagctggggaagacctcattctgcatccacagcgtttgccccaggcagcaccttgcttgcggctgtagagccacattgcggatcgaggtggctggtgaagttggacgtgcgtaggtttttcgagtcaattagcgaagtgtccgtctataaagcgtttcgccggttgggataccaacccttagttagtctcgagttagcacggctttgtacacgcgtcgggcctgcaagtcggctgtatgccaatgcccgctggactaggcgagccccaagatacgtagcagctattagaaagtacgctgttgtccggttcggccacttaccccaaggcgcaccaacatcacctatgcttgccaacctagtgatgagggatgtggatgaggagctgacgaaggttgctaagctgcacggcatgacctatactcgctacgccgacgatctgaccttctctaccccccggagggattttgggagagaaatcgccgtggagctgatccagaaggtgtatcgatccctgggcagattcggactgcagccgaatctggcgaagacacaggtcgttcctcccagaagtcgcaaagtcgtgttgggactgctcgtggacgggaaggagcccaggctgactagagaattcaaaaacaaaatgcggcagcacctctactacctcgaaagacctgacgtaggtgccgtgcgtcatgcccaagctcgagggttctctgcggttgcaggtcttaggaaccatcttctggggctagctgcttacgcttcccaggtggagcctcagtatggcgctgagctcgcaaggcgcctcaacgctgtgtcatggccagtggtctattga

SEQ ID NO: 8898 - RNA, 1173 nt, unidentified
  source 1..1173: mol_type = other RNA; note = synthetic construct
atgaacgattggaagcctcagccctatcgtcgggaggcacaacggaggggggtatctcccgaggtgttagccgctgccatcgccgcttcagaagccgtcgtggccgtgaaccctagtctgccgcccatattgtccctacgacacctctcgcatcttaccggcgtcccttaccagttgattagagcttgggtaactcgtgaaggcgccggcgagtctccctacaagactttttccatccgcaaaagacctaaaaaggatggcaccaaacagttccggttcatctgtgtaccacagcatgacctgggactgacgcagaggtggattgcaagtaaggtcttagccctcggtagacctcattctgcatcaacagcctttgcacccaagtcaaagctgttcgaagcagtggaaccgcactgcgagtgtaaatggctcattaaggttgacgtccaacgcttcttcgaaagtatcaccgagattgctgtgtaccaagtgtttagaaagctcggataccaacccctggtgagcttagagctcgcccggatttgcactcgtctgggtccaccaggccggtataggcctccagcacgatggagaagacacgccccattggacgcgcacattataaattcttattccactcgagccctgggacatctacctcagggcgcttccaccagcccaatgctaagcaatctcgttatggtggatctggacgaaaaactgagcaagctcgcttctagtgtcaacatgacctatacacggtacgcggatgatttcacttttagctcacacgcaacggacttcaacagggaggctgcagaacgctttataaaggacatctatcacgcgttgggacagtttgggctcaaagctaatctggccaaaacacagatcatcccaccgagggcccgcaaagttgtgctgggtctgcttgtggatggaaagacacctcggctgacaaggaagttcaaggccaaaatgcgaatgcacctttactacttgaagcatgcagaggttgggccccttaggcatgctgagcgcaggggttttagctccatagcgggcctgagaaatcaccttttggggctggccgcctatgctatccagatcgaaatggagtacgggctggagctcaaaacccgcctggaggctattcagtggccccttctgtga

SEQ ID NO: 8899 - RNA, 1170 nt, unidentified
  source 1..1170: mol_type = other RNA; note = synthetic construct
atgacggactggaaacctcagccctataggcgggccgctgaggaattgggcgtgtctgaagctgtgctggaggccgcaattgcagctagcgaggctgttgtagctgtccacacatccctcccgcctattctgaccctcgggcacctgagccatctatccggggtgagttatcaggacctgaggtcctttgtcagccgtgacgagccggacccatacaaggtgttccgagtgcgtaagcgaccccagcctgatggtcgccttaggtttcgggtgatctgcgtccctgacgctcggctgggagatgcacagcgatggattgcgcgacatgtcttagttcacgggcggcctcacagtgccagtactgccttcgcccctaaagctagattaatcgacgcagtgcgcccacactgtgggtcgagatggctgatcaagattgatgtgagacgtttcttcgagtctatcagcgagatctcagtatacaaggtgttcaggcgcctgggataccagccactggtttcactggaattagccaggctatgcacccgagtaggtcccaacacatggctcactagaacacagagatggtggagacgcgccccattgcacgtctctacgatcaggaactatgcactccctcgccttggccatcttccccaaggcgccccaacctcccccatgttggctaatctcgtcatgcgggaggctgacatagaactcagcaagatagctaagagctatggcctgaatttcactagatacgcagatgacctgactttttccaccacaaaacccaaatttgatagggccgcagccggtagtctcattcaacaagtttaccaggtcctgggccgctttgggctagagcccaacctggccaagacacaagtagtgccaccccgcgcccggaagattgtgcttggattgctcgcggaccgggatgcaccatgtctgaccagggaatttaagaataaaatgcgcatgcatctgcactacttggaacacgaggatatcggccctgtgaggcatgctcagcatagaggcttctctgcggttgcaggactgcggaaccacctcctgggacttgccgcctatgcgtcacagatagagccagtgtatggtgccgaaatcaaaaccagattgatggccgtgccctggccgattatctactga

SEQ ID NO: 8900 - RNA, 1173 nt, unidentified
  source 1..1173: mol_type = other RNA; note = synthetic construct
atgaaggattggaagccccaaccttacaggagaatagcgcaggaactgggagtctctgatgctgtcctgcgctcagctctggcagcaagcgaagccgtcgtggccgtacaccccaagctacctcctgttctgacattgaagcacctgagccggctctctggggtgggatatatggacctccgcagatacgtttcccgagaagacccccacacatacaaagtgttctgcattcgtaagcgaccccagccggacggtaggattagattccgggaaatatgtgtgccagagcatagcttatgcgacgtgcagcagtggattgtgaggcacattctcgttcacggacgtccccactcagcatcaaccgcctttgcaccgggcgccaagctcatcgatgctgtgcagccccactgtggtagtcgttggatcatcaagcttgacgtccgaaggttctttgagtctatatccgagattagtgtgtataacgtattcagatccctgggataccaacccctagtgagttttgagctggcgaggatttgcaccagaatcggctcagacaaaacttggctctccaagactcgaagatggcggaggaaagctcctttgcatgtagcagccattcgaaattacagcgcgaaacagctgggttatctggcccagggggcccctacttctccgatgatcgctaatttggtcatgcgcgctgctgatgccgagatcagcgccctctcggagccatttggtatcacgtacacccggtatgcggacgatctgacttttagcaccaatagtgcccatttcgatcggaccaccgccagcgccctcatcaggaaagtctaccagacactgggccgcttcgggctgcaaccaaaccttgcaaaaacacaggtggtatctccacgggctcgcaaagtggttctcggccttctggctgatggagtctcccctcgcttgacgcgcgaattcaaaggaaagcttagaatgcatctgcattacttagagcatgtggacgttggccctatcaagcacgctcagagacggggcttttccgctgttgcagggctaaggaaccacttactggggttggccgcatatgccatacaaattgaaccagagtacggctatgcagtgaaggcccggcttatggccgtgcattggccaatcatctattga

SEQ ID NO: 8901 - RNA, 1170 nt, unidentified
  source 1..1170: mol_type = other RNA; note = synthetic construct
atggagaattggaggagccaacactaccaatcagtgggacggtcacagggaatcgcacccgagatcctgaacgctgcaactcagaccgggactgccattgttaggacgaacgcaaggctgcagccagtccttaccctccgtcacctcgcctacttggctgactgtgattatggcttccttcgggctgtcgtgggtcgagccatcgagaatccgtaccgcgtgttcgcaattcacaaaagacctgcaccatctggcaatgccaggttccgcacaatctgcgcccctgatccccgcttactgggagtccagagatggctggtgaccaatgtgctgaaccacgcccccacagtacatccagcctctaaagcctttgccccggaatgcacattggtcaaggccgcagagcctcactgtggggctcgatggctcgtgaaggtggatgtgcggaacttcttcgaatcaatcagcgagatagctgcctaccgggcttttagagcgctgggctatcaggccctcgttgcctttgaactcgcccggttatgcactcgcttgggcaggttcacacctcgaaggagccatccacagtggctacggaagcgtaatagaatctataggatcgcctcgtacaaccatgctgagggaagaatagggcatttacctcagggcgcacccacttcccctatgctcgctaatattgcaatgcaagctgctgacgctgaatttgacatgcttgcgtcctccgcgggtatggtgtataccaggtatgccgatgacattgtgtttagcacgaaggataaagatttcacaagggacctggccgcagggctggttggatctgcctatagaattctgggaaagtacgggtttagtccaaacgtcgcaaagacagaaatcatacccccccgcgcccgtaaagtcgtacttggcctgctagttgatgacctgaccccccggctgccaagagagtttaaggagaaaatgagaatgcacctgtactaccttaagcgagatgacattggccctgtgagacatgcaaaaaagcgaggcttcatcgcggtggcgagtctccgcaacgtactgtatgggttggcagctttcgccacccagatagagcccacttacggttcccgtatccgccgggacttggacgctattgaatggccaacctga

SEQ ID NO: 8902 - RNA, 1176 nt, unidentified
  source 1..1176: mol_type = other RNA; note = synthetic construct
atggagaactggcatccacaacactaccaggccgtcgggcattcccaaggcattagtccggacgtgctggccgcagccatgcagacagccaaagtgatcttgcgagtaaaccctcgattacagcccgtgcttactctgaggcacctcgcctatctgacggactgtgattatggctatcttagggccgtgattggacggggcatcgaaaatccgtaccgggttttcaccatccacaagcggccaggtccttctggaaatgcgcgtttccgcacaatttgcgctcccgacagccagctgctgaaagtccaacggtggttagtgaccaacattttgaatcatgccactgctgctgtgcactcaactagcaaggccttcgcccccggatgtactctcatgaaggctgcagaagcacactgtggcgcccgctggctaatcaaggtggatgtgcagaacttttttgagtccgtgagtgaaattgcggcctatcgagccttccgtaatttgggttaccaagctttagtttcatttgagctggctcgtctgtgcacccgcctgggtcacaacacacctcgaagaggacacgcacagtggctcaggaaaaaagcaggggtggcctataagatatctaaatacaaccactcgatggggaggatcggacatctgccacagggcgctcctaccagtcccatgcttgcaaatttggctatgagagccgcggacgcggagttcgataatctggcccggatcgacggcatgacgtacacacgctacgccgacgacctagtattttctacctgcgattctggatttacacgggataaggcgtccgcaatcgttggctccgtttatcgcatactcgggaagtacggcttcagcccaaatgtggctaagaccgaaatcgtccccccgagagctaggaagatagtactcgggcttcttgtcgacgagccctcccctagactgcctagagagttcaaagagaaaatgcgcatgcatctgtactatctcaagaaggatggcatcggcccagctaggcatgcatcaaaaagaggattcatttcagtcgctgggatgagaaacgtcctgtacggtctggcagcctttgcaactcaggtggaaccaacatacgggagcagcttgaggcaggatctcgacgccattccttggcccacctga

SEQ ID NO: 8903 - RNA, 1173 nt, unidentified
  source 1..1173: mol_type = other RNA; note = synthetic construct
atggaaaactggagaagtcagcactatcggaactttggcacccgcaagggagttagccctgaaatcctggaggctgccgtgcagactggcgaagcaatcgtgcgtactaacgcaagactgcagcccgtgttcacccttcgtcatctcgcctatctgacagactgcgattacggactgctgagggccatagttggaagatctctgcagaacccctacagagtcttcaggattcataagcgcccacggtccgatgggctaaaccgttatcgaacaatttgcgtccccgatccacaactgctagccgtgcaacgctggctggcatccaatatccttaatcacgccgctagtagcattcacgccgcgtcaacagctttcgccccagggtgtactctgttgcgagctgccgaaccacactgcggtgctaaatggcttataaaggttgacgtgcaaaacttcttcgagtcagtgtcagaaatcgcagcctatcgcgcgttccgcaggttaggatatcaggccctcctggcttttgagtttgcccgcttgtgtaccagattgggaaatagaacgcttagacggtcgcaccagcagtggagaagggatccttggcgccgctacgagattgcggcttacaatcactctcagggcaggatcggtcatctccctcaaggggcgccgacctcacctatgctggctaatatcgcgatgcacactaccgacgttgacctggatgcactggcactttcttttaggctgacatacacaaggtacgcagacgacttggtgtttagtactactgacccagctttcacacggaagctcgcatccagcttcgtgggcagcgtgtatggcatcctcggcaaatacgggtttagcccgaatgtcgccaaaacccagattgtccctccccgggctcgaaaggtcgtgctaggcctgttagtagatgagccatcccccaggctgccccgggaatttcgagagaaaatgaggatgcatttgtactatctcaagaaggacggggtagggcctgctcgacatgccgtaaaacggggttttaccgcagtcgcctccctccggaatgtgttatacggtctggccgctttcgccacgcagatcgagccgcagtacggagcaggcattagagccgagctcgattctataaactggcccacctga

SEQ ID NO: 8904 - RNA, 1173 nt, unidentified
  source 1..1173: mol_type = other RNA; note = synthetic construct
atgggaaactggcggcctcagcactaccgtactatagggtccgagaagggtgtgccacgcgacgtactggacgctgccgtgcaaacaggtaaggccatcgtgcgcacagacgctcagttagagccggtgttcacgttgaggcacctggcctatctgacggattgtgattatggcttactcagggctatcgtagggaggagtatccaaaatccttatagagtattccgggtgcataaaagacccgggcccgacggccagaaacggtacagaacaatttgtgctccggacccccagctccttaccgtccaacgatggttatccaccaacgtcctgaatcatgcctcatctagcattcacgctgcctccactgcatttgctcctggctgcacactgctgaacgcagccgagcctcattgcggagcacgctggctgataaaggtggatgtccagaacttcttcgagtcaatcagcgaaatagccgcataccgcgcctttcggggtcttggctatcagcccctggtggcgttcgagtttgcgcgcctgtgcactaggctaggtcggaagacttctaggcggtcacacgcccagtggagaagagctccatggagacgatataagattgcggcgtacaatcacgaccagtatcgaatcgggcatcttccacagggcgcccctacctcgccaatgcttgctaatattgccatgcacggcgcagacgaagctttgcacgcactagcccgtagtagcggactgacctacacaaggtacgccgatgatcttacatttagcaccaccgcactggactttaacagggaactcgctagcattgtcgttcgctccgtctacagaatcctgggcgaatatgggttctctccaaacgttgcaaaaacccagattatccctccccgagccaggaagattgtgctcggcctcctggttgacgaaccaaatcccagactgcccagagagtttagggaaaagatgcgcatgcatttgtactacatcaaaaaagatggagttgggcctgcccggcacgctgctaatcgtggattcactgcagtggccagtctgcgaaacgtgttgtacggactcgccgcattcgcgacccaaatcgagccacagtatggcttgtctatacggaaagagctcgatgccgtggcatggcccacttga

SEQ ID NO: 8905 - RNA, 1170 nt, unidentified
  source 1..1170: mol_type = other RNA; note = synthetic construct
atggcggattggaaaccccagccatatagggccaaagctcagtctctcgaagtcgaccccacaatcctggacgctgctgtagctgccggaaacgaggtggttgccattcacccctccctgccccctatcttcaccctcaaacacctggcttatcttaccgacaccaaatactcggtgcttcgcatgatggtcggtagacacattgaggagccttacagggtgttcaagatccgcaaacggcccggtcctgatggagcagccagatttagggttatttgcgcaccatcacccaccctgctggccgttcagagctggcttgctcgcaaggtgctcgttcacgcgaggactaaggtacattcagcttccacggcctatgcacccggatgcagtattcttgaggccgcctccccacactgtggatgtcgctggctcatcaaggtcgatataaagaattttttcgagagcgtgtctgaaattagcgcctaccacgccttccgatccttaggctaccagcctttagtgtctttcgaattggcacgtctgtgcacccgagtcgggagccagacacggcacagagctcatcgtcaatggcagaggcatctcccctcaacgaaaagcaagatacacgactacgtgtattggaggttggggcatttgcctcagggagctccaactagtcctatgctggcaaacatcgccatgtataaggcagatggcgaactcacagcatggggcctcaaacatggcttggtgtatactcgctatgctgacgacatgacattttctatctcagatgagggctttaatagaaacaaagccgccgcggtaatacgagggatctaccggatcatcggcaaatacgggtttgctccaaacgtcacaaagactcaggttgtccctccacgggcaagaaaggtggtactgggcctgctggttgatcaaaatgaaccgcggctgcctcgggagttcaagatgggggtgcgcatgcatctgcactacttaaagagtccaaaatttggaccggcggtgcatgccgccaataggggtttcaccgcggtcgctgggctaagaaaccacctgttcggcctagtggcctacgcagcccaagtggagccggcatacggtactagaattaagtccgagctggaagccgtgaagtggcccatttga

SEQ ID NO: 8906 - RNA, 1161 nt, unidentified
  source 1..1161: mol_type = other RNA; note = synthetic construct
atgttgaccaaacggcctcaacattatagatccctaggtagatgtgcagggatcgacgatgtcattatagagcgcgccctggccactgccgccattcaagacagggtgggaggtagaattcctactattctgactctgcgccatcttgctgagcttgccggggtgccttacggcttcttacgcggcgtagcggcccgtagatttcccgacccctatacaacatttcaggtgcgaaaaatcgctcgtcctggtgaagagggatatcgaacaatcaccgtgccaccaccgctgctcatgtcagtccagaggtggatctccgggaacatactggtacacggacgcccacatgccgcctctaccgcttatgctcccggcagttcagtagtcaaagctgctgaacggcactgcggttgtagatggctaatcaaactggatgctaggcgtttcttcgagtctatttccgagatcgcagcatacagggtttttaccactgatttcgcattccaaccactggtggcgctggagttggcaagaatctgcactcggctcccggaaaacgcacggaccaacagggcccgacgatggttagccaaagtgagcgggtacggagccatcctggactaccacgctgcgcagctcggccatttgcctcagggagctccatccagccccatgcttgccaacctggcggttcgcgagttcgatgacgagatggctaggaccgctcagcagcaccgaatgacgtacacaagatacgcagatgacattgcactgtcgaccagcgaccccgcattcacgcggtctagggccagcgacgtggttctggcggcctatgcagccatgggcaggcatggcctctcaccgaatacaaccaagactaatgtggtccctcccggcgcacggaagttggtgcttggactattggttgatggcgaccgccccagactcacacgggaatttaaggattctctccgcatgcactttcactactgccttatgcctgatgttgggcccgtcgcccatgccgaaaagcggaattttgtgtcagtgattgggctgaggcaccacctggggggattagtcgccttcgccagtcagatagaaccagagtatggcgctagcctcagtgaacagatgaagaagatcgtgtggccactgtga

SEQ ID NO: 8907 - RNA, 924 nt, unidentified
  source 1..924: mol_type = other RNA; note = synthetic construct
atgcttgcaaaaggaggcaccccctctcgaggctatcgtatgatcagtgttccacggcctgatctcaaacacgtccagcgctggatttgtgataatattctggcgttggagaagcctcacagcgcaagtaaggcctataccccaaagagtacactggttgaagctgtggaaccgcatttaggatgccgctggcttataaagctggacctgcacgccttcttcgactcaattcccgagacttctgtgtacaaggttttcgagggcatcgggtaccaacccttggtggctatagaattagctcgcatctgcacaaggctatccccagattcacgatggcgcgcgcatagcagatggcaatccaggaggccagaaagatattctaatgtgaaaggctatgctgtgaagcgccttgggtacctcccacagggagctcccacatcccccatgctctcaaacctggtaatgagggtgtttgacgctgatctgacggccgccgcagtgaagcgaggcttccagtacactagatatgcagacgacttagccttcagcactaaggagatgtcttcgcggaacctgtgtggtgccctgatcaccgacgtatacaagctgattgccaaatatgggctggcccccaatctgtccaaaacagcggtcacccctcctgggggtaggaaactgttgctaggtctgttgatcgatggagagaagcctagactcacgaaagaatttcgggaggagctcaacaggcatctctactttatagataaatacggcgtccagagccacgcagaccacagaaagtttgagagcatctacggcctccgtcatcacctttttgggttggcctactacgcccggcagattgacccgacctatggacaggctgtgctggcacggcttaacgcagtcccttggccaatctga

SEQ ID NO: 8908 - RNA, 1161 nt, unidentified
  source 1..1161: mol_type = other RNA; note = synthetic construct
atgtgtagttggtgcccccagcaattccggaaggaagccttaaaaaacaatatcgacctcaacatcatcgagcacgcgattaaaaacgccgagctggtatccgctgtgtctagcgagctccctcccctgttctctctccggcacctgtcacaccttaccggcgtggactatgtcgttctgcgcccagtggtggaacgcaactactcaaatccctacaagatctttcgactgaaaaagggcgttaaaggtcaccagaacagggggtttcggataatctgtgtaccagacgcatctattatgaaagcgcagcgctggattgcaaagaatatcctgagctgcggcgaagcatcatctgcatcctttgcttacgccaaaagttcaaaaattatcgacgcagccaaactgcactgcggctgcaggtggatgctgaaactagatgtgagaaatttcttcgagtctttctctgagattgcggcctatcgtgtgttcaggagttttgggtaccaacctctaatcagttttgaactgtcgcgcatctgtactcgattagggaaccagacaaagactcattcccaccctaaatggatggctaccaacaagaactacaccgtgatcaataaatatatcagccgtagaatagggcactttccgcagggcgctcctaccagcccaatgttaagcaatctcgctatgaagctgtttgataatgaggtgatcggtattgcaacaaagcatggtttggtctattccagatattccgatgatctgtgtctcagcacagctgacaagaagttcaaccgggagaaagccaagacgatcataaacgctatttacaaggaaatgatgaagattggactcgcgccaaatattaccaaaacacagataattccgcccggtgcacggaagatcgttttgggacttttggtcgatggggaagcccccaagctttccagggccttccgatccaagttgagaatgcatttctattacctcaagcatgttgatattggcccacccctgcacgccaaaaataggggatttgagagcgtcatgggcctgaagaaccatatccagggactgatagcctatgccagacaaattgaccctgcctacgctagttcatgcactgaccagatgaatggaatagactggcctctttga

SEQ ID NO: 8909 - RNA, 1164 nt, unidentified
  source 1..1164: mol_type = other RNA; note = synthetic construct
atgcatatctggtgtcctcagcaattccgtaaggccggcgaggccaacaatgttgaccctaaggtgattgagaacgccatccaggttgccagtgcggtccaggcagtcgataagcggctgccacctatcttttccctgcgccatatttcccaccttaccggggtcgactattttgtgcttaggtcgctggtagaaagaaactacattgagccctacaaggtgtttaaactggataagaagaacaaacgctcaggaaacaggggataccggatcatcagtattccctccccacaattgatgatcgtgcaaaagtggattgctaagaatatcctgaaatttggcgaagtgcacaccgcctcttttgcctatgcagagaacagtaagatcattcaggccgctaccctacattgcaattgcacttggatgattaaactcgatgtgagcaacttcttcgaatccttctccgagattgctgcttatcgagtgttccgcaccctgggctaccagcctcttataagctttgaaatgagccggctgtgcaccaaactcggcacggagactcgcttgcgtcgacacccggcttggcaatcttctagcttcagtaaataccacaaaattagccgctataggaatagagccattggccacctgccacagggtgctcctacatctcctatgttgtccaacttagctatgaaaaactttgactcagccgtgtcaaaaatcgcactagacaacaatctcgtctattcacgatatgcagacgacctctgtctgagtacaaacgataagagcttcgatcgtacaatagctaggaaggtaataatctcgatctacgagaagatgaatgcgatagggcttaagccaaacctgactaagacgcagattgttcccccaggcgcacggaagatcgtgctgggtttactcgttgacggaaattcacccaaattgtctagagaatttagagccaaactgaggatgcacttccatttcctctgtcggtccgatatcgggccggcaaagcatgcggagagaagagggtttgaaagcgtcatgggtctgaaaaatcacatacagggattaatcgcatacgccaggcagatcgatcccacatacgcctctagctgcgacgagcacatggacaatattaattggcccttctga

SEQ ID NO: 8910 - RNA, 1161 nt, unidentified
  source 1..1161: mol_type = other RNA; note = synthetic construct
atgcacagctggtgtcctcagcagttcaagaagaacggaattaaacagggagttaacccagaagtgattgaacatgcagtacagaacgcggccctcgtcaaggcagtgtccaataacctgcctcctatttttagcctacggcacctctctaatcttgtcggcgtggaatattccctgctgagggctgtcgtagagcgtcagcagttggacccttataaagtctttaaactgaaaaagcggtctaaaaggacctcatcacaccccttcaggataatatgtgtgcccgacgagttcatcatgaagacacaaaaatggatcgcacaacatattctaagtcagggcagcgttcatcacgcctccaaggcgtatgctaagaatagtaatatcgtggatgctgccaatttgcatgtggaatgccggtgggttatcaagctggacgtcaacaatttctttgagagcttcagcgagatctccgcctacaggattttccgatctttcgggtatcagccactgattagtttcgaattatccagactgtgcactaggttgggaccccacactaagctgcggagcaattcgtactggactgccacacgacacaagtacaagatcattaagcgttacaaaaaccataggatcggacatcttccccaaggcgcaccgacctctccgatgctcagtaatttagctatgaagggctttgacaaggaggtgagtgtgatagccgagaatgccggccttatctacacacgctatgcggatgacctgtgtctctctaccacctccgaagacttctctaagtccaaagcacagatcgtcattaacaacatatacgagaaaatgcgcaacatcgggcttagaccaaacataacgaaaacccagattctgcctcccggggctagaaaaatcgtgctcgggttgctcgttgacggtgataagccccggctctcaagagattttcgctcaaaaatgcgcatgcacctgtactatatgatgagagaggatatcggtccagtgctgcacgctaagaatcgcggttttgaaagcgtgatcggcctgcgaaaccacatccagggactgattgcctatgccaaacaagtagatgagtcatacgggttagtttgcgcctgcaagtttgagacaattaaatggccaatgtga

SEQ ID NO: 8911 - RNA, 1155 nt, unidentified
  source 1..1155: mol_type = other RNA; note = synthetic construct
atgcaccggtggaaccctcagcaattccgaaaggccgcagaggaacagggagtggctccaaaggtcgtggaaaatgcaattagctgcgctgagattacacggtcagtggaccctaggctgccacccctgtttagtctgaggcaccttgcgcactacgtggaagctgactatagcctattgcgcaaagccgtggccagatccggcgacgagccctataccacttttaaactgaagaaaaacggcaagagagcctatagaatcatttgcgtccctgatatcttcctgctggaggtccagaggtggatcgcccagaatatcctggcctttggtaccccacaccattcatccgtggcctacgctaaaaattgtaacattgtcgacgccgctagcgtacattgcggctgcaggtggctgatcaaactggacgtcgccaactttttcgagtctttttcagagatcgccgtgtatcgcgtgttccgatctttgggctatcaggcactcataagcttcgagatggcccgcctctgtacacgtttaggagcccatacaaagaccagatcgggcaatcgatgggaggttcgagatgatcggatttacaaaatcgatggctacaagaactgtaggatcggccatgtgccgcaaggggcacctacttccccaatgttaaccaatctggctcttcgcgaattcgataaggatatcggtgatatcgctgcagagtatggcatgtactacacccggtacgctgacgacatgttctttagcactaaagacctcagtttcaatcgcgaaataggaaagaagctcatatctcgtctttacgggagaatgaaagcggagggcttccggcccaacatttccaagacacgcattcaccctccaggggcaaggaagctagttctcggactgttggtggatggagctgtgccgaagctcacgcgggaatttagaagtaaaattcggatgcacctttactacatgaacaagcagcacatagggcccgcgctgcatgcccaaaacaggggattcgactctgtaatgggtttaaaaaatcacgttgaagggttgatcaattatgcacatcaggttcagcccgacctcggtgcaaggctgagagccgaatttaaaaagattgcgtggggggcttccgtatga

SEQ ID NO: 8912 - RNA, 1104 nt, unidentified
  source 1..1104: mol_type = other RNA; note = synthetic construct
atgtccagaaagcattcacagctgctgcccctgcaaggactccagcctgcaagtgcttcaacaggtgcatgtttcccggtcatcaattctctgaaacagctggcggacatgactgagacggactacgcaatcctgcgccagttcgtggcaaggcagcaacccgagccctataaaacttttcgaatcaggaaaaagagcggggggtttaggatcattgcgatcccagacgagaacctgttaaaggtgcaacagtggatttaccgtcagatactgactctcgtaaggcctagtccagtgtcttatgcattccagaagggtaagtcaattcaaaacgctgccagtgtgcactgtggctgccgctggttgatcaagctggacctgtacaactttttttcagcgatctctgagatcgatgtctaccgggtctttagaagcttaggctatcagccactgatcgccttcgaattggctaggctctgcacacggctaggctctctcacagctttccgacgccgaaaccggtggcagatagcagaccactatgccgtgatttcgcagtaccacggccaacgcatgggccatctgccacaaggagccccgacgagtccagcattgtccaatctagtgatggtcaactttgatagaaaggtcctctgccttgctgccgaggaacagctcacctattccaggtacgctgatgacctttgttttagcacacctttacgcgatttctccagagccagagcccgtgccttcattcaccagatctacaggctgatgcggtcccatggacagagccctaatatgtccaagaccgttatagtgccccccggtgcccggaaaatagtactagggctgcttgttgatggggaacagccacggctccagaagcaggtgcgcaataaaatccgacagcacattttccatcttaatcatgctgacattggccctgagaaacacgcccagaagcgtgggtttcacagcaccgccggcttcaaaaaatacctcgatggattgctgtcttatgttagcgacattgaccccgatctggaacagacctatagacaccaacttgctggagtgagatggcctttggaaacctga

SEQ ID NO: 8913 - RNA, 1095 nt, unidentified
  source 1..1095: mol_type = other RNA; note = synthetic construct
atggggagaaagcactcgcaattgttctttacacacgactctcaagagattagtgccagctccaattgccttccaccgattaagagcttaaaacatctcgcagatttgactgaaaccagctatcgggatcttaggaaaataatcacccgtcagtcccccgaaccctataaggtctttaggatcaggaagaagagcggcggattccggattatcgctatcccagacgaatcattacttaaggtccagcagtggatatatcgtcacatcctgagtcaagcacaaccctcccctgtttcatacgcgtttcaaaaaggaaagtcaatccgagacgcagcttctgtgcactgcggctgtcgctggttgattaagttggatctgtacaatttcttcggcgccatcagcgagattgatgtgtacagagtcttttactcactgggatatcagccgctcatagccttcgaactggccagactatgtactcgcctgggctcactgactgcgttccgacataggcatcgatgggagatcgagggcaacagcaccatcatcagccagtatcagggccagcggatgggtcatctgcctcaaggggcccctacttccccagcactgtctaacctcgccatggtggctttcgatcggaagatcatgaacctggctgccgaggagcagctgacatacagtcgctacgccgacgacctgtcttttagtacacccttgacgagtttttctcgcgagctcgctaaggcctttattcacagagtgttccggttaatgcgcacctacgggcagagccccaacatgacgaaaaccaaaataataacaccaggagctaggaaaattgtacttggtctactagttgatggagaagagcctagactccagaaatctgtgaggaaccacattcgccagcacattttctatctgaatcattccgacgtcgggctgcagaaacatgcccagaagcggggttttctttccaccgacggcttcaaagctcatctggatggggtactctcctatgttcacgacatcgatccttcgctcgcgcagaattacagacaccagctggcagacgtgtaccgtctcgtgtga

SEQ ID NO: 8914 - RNA, 1203 nt, unidentified
  source 1..1203: mol_type = other RNA; note = synthetic construct
atgaagacgtggtcaccacaaaatttccagagccgagccaaagagaagagcggtcaggctgttatcggcaacgcccagaagatagccaagcagattcagactattaacccgaagctgccagtgatcttcacattaaagcatctgagtgtgagagcccggatttcatacggctttgtgcgcagcgtcgtctctaggaatccttcagaaccctataggagtttttccatacgcaaacgtattagcgcgccccgtggcaaaacatccaaaaggaaagcgatgggggtgaaacacgaggtcggggagcactcttttagaaggatatgtgtacctacaccccgcttaatgcagttgcagcggtggatagataaaaatattctgagcgtcgctcctcctcacaccgcaagcgttgcttattctcagggcaagaagctgatcgacgctgcccaactgcattgtggttcgacatggctcgtcaagttggacgtgaagaacttcttcgagtctattaccgaaatcgatgtctaccgcgttttcctgagtctgggttatcccgccctgttgtccttcgagctcgcccgaatctgcaccaggctcggcatcgattccaagtacgcccggaaggatgtttttgcagtgcggcggctggcacggagaaaaggccacgtggcagcttactttgggtcgcgcatggggagactgcctcaaggagcgcctacctctccaaagctctcaaacctagtgatgcgctccttcgacgaagatatgaccaatcttgcccagaaagaaggaatgacatacactcgctatgccgacgacctctgctttagtacccggtccagaacttatacccgtgataaagcaacgaaattgatcaggagtgtgtatgacgctcttggagctactgggctaggcccaaatcggacaaagacggtggttgtgccacccggagcccgaaaggtggtacttgggcttacagtgaacgacgtaaggcccagactgccggccgagctgaagtccagaatgagggtccatctccactacctgaaattgttcggtcccaccgagcacgccaaacgatctggattcagctcaactttaggcatgtacagacatcttgcaggaatctgcgcatttgctcaacagattgaaccagatgtagctaaggactggctcactaagctgcagggcatcagctggatctga

SEQ ID NO: 8915 - RNA, 1158 nt, unidentified
  source 1..1158: mol_type = other RNA; note = synthetic construct
atgactccttggcgatcccaagcttttcgagctgaggcgatagcaggtggcggcagtgcaggcgtgattactaatgcggtcgcaacagccgctgccctgcataaacacacccccgacgctcctcctgtgttcacattaggacacctggcccatttgaccgatgtgcactaccgtttcctgaggcaagtagtggagcgacaggatcctgaacgctaccgcaggtttagaattctcaaaagaactagtggtgccggcggagcgcctcgctatagaatcatttgtgtgcccgacccccgccttatgagggttcagagatggattaacgctaatgtactggcactcgggcacgtgcacaaggccagcaccgcatttaaagcaggcgataatattgtcgccgctgctggggtacactgcgacgctaagtggatgatcaagatcgatatcctgaacttcttcgagtccgtgtccgaacagtctgtctaccatgtttttcgaggcctcggatatcagccactcatcagctttgaactggcccggctttgcacacggagaggggaatccagtaacgctcgtcgcggcaaaaggtgggcccactctgtcggccatgcaaagcggataacaaattatcattcctcggtgctgggacatctaccccagggtgcccctacctcaccgatgctggctaaccttgcgatgaaaggctttgacgaggccgtgagccggcttgccgatacctacgacctgtcatatactaggtatgccgacgacttaacattgagcagcttgggcctattcgacaggagccgtgcccagaccatcgtctctgaggtttacgaccagctgcgctgttgggggttcagacccaatctcgccaagacgctgattgtgccaccaggggccagaaaggtggttctgggactgcttgttgacagacaggtgccacggttgacgaaggccttcagggcaaggatgcggcgccacctctacttcttgtcacacccacagcatgggcccgtcaaacacgcagctgccttaggttttgcctcagtatatgggctccggaaccatgtgtctggactgatcgcctacgcgcaacaagtggatgctaactttgctgcagatgcatggggaaagttcgatgccatagtctggccgtga

SEQ ID NO: 8916 - RNA, 1161 nt, unidentified
  source 1..1161: mol_type = other RNA; note = synthetic construct
atgacaccatggcgatcacggtcttacgttgacagcggatctaccgctggctgcgatgaaacaattgtgaaaaacgccgcagaaacgggcaaaatgctcctggaacgaacacccggcgcacctccaatcttcacactcaagcacctgtcccagctcactggagttaattatagcttcctgaggcggtgtgtggaaagggtcgagagcgagccttaccggagatttcgaatccgcaaacgccagaaccctaatgagaagaaacagcgctatcgcattatctgcgtcccagatcctaggttgatggcagtccatcgctggatcaatactaacatcttgcaactagtacctccccacgctgcctctgtggcctttggcaaagggaataatatcgcagaggccgccgctaaccactgcgcttctaagtggctcattaagcttgacattgtgaacttcttcgaaagcatttcagagcagagcgtataccatgtgttttccagaatcggataccagccgctgatagcattcgaattagccagactgtgtaccaggttgggacaaccaagctatgctcgctggtcaaggagatggagtgctcggagttatcggtttgagaaaatttcctcctaccaaaaggaacagttgggtcacttaccccaaggggcccccaccagtcctatgctcgccaatctatccatgaccgctttcgatgcgtcgattagacaggtcgccaatgactttgacctggcgtatacacggtacgcagatgatctgactttttctaccacgtcagtggaattcaacagaaataagagtcagactgttattcccaaaatttacgcagagcttctgaagtacggcttcaaaccgaacctcactaagaccaagatctcctccccgggcagccgtaaagtcgtgctggggttactggtggacggagccgagccaaggcttaccaaaaagttcagggacaacatacgtcagcatctgtatttcatcaaccaccccaatatcggtcccgtgcaacatgcgaacaagaaggggtttaagtctatatatgggcttagaaaccacgtgcagggtctgatcgctcacgccagtcagatagataaggagtacgctaacgccgcctgggagcagtttaatcatgttctgtggccatga

SEQ ID NO: 8917 - RNA, 1176 nt, unidentified
  source 1..1176: mol_type = other RNA; note = synthetic construct
atggaaccttggcgcagccagcacttcaaaaaattcgctatttccaaaggttccgacctcgcaaccgtcgatgccgccatagccatcgggaaggccctgcaggtgaagtcacccaattgccagccaattttctctctaaagcatttggcctacagcgctgacgtgaaatacaaatttttgcgtgaggtggttgaacgctccactgaggataagtatagggtcttcaagattcataaacggggaatacccggtcagacttccaagcgatttcggattatttgcgcccctgacccgcaacttatgaaaatgcagaaatggatcgcacgcaatatccttgcacatgggcgaacacacgacgcgtcagttgcataccaggcaggatccaatattgtggatgcagcttcgctgcattgtggctgtaggtggctgattaagctcgacatcatcaacttctttgagagcgttaccgaacagaacgtcttccgcgtgttcagtgacatgggttatcagcccctcgtcgcctttgagttagcccggatctgcacgagaaaagggtcggccacatggagaagaaacagagcttataagaagtggaggacgcggaaccacatttacaccagcatccatgcttatagcgccgtggatatccttgggcacctgcctcaaggcgcccctaccagtccaatgctggcaaatcttgctatggtggactttgataagagtgtggaggatgtagctaatagttttggcctaacctacacacggtacgccgacgatctgacatttagcactaagtcagacgcattctctagggaggtagctcagaaagtgatctctgaagtgtacaaagtcatcaggcggttctcttttgaacccaatctcaccaagacacaggttgtgcctccaggagctcgtagagttgtcttgggcctgctggtggatggaccaactccgcaactcagcaaaaagtttcgcaaccagctgagaaggcatctgcaccacgtttccgcggattggcccggcgtcgtggaacatgcagaaaaaaaccactttcaatctgtattcgggctgcgaaaccacatagagggcttaatagcgttcgctcactcagtggacccagagtatgccaagaaggcctgggagaagttcgccaagatcgactggccccaggcgtga

SEQ ID NO: 8918 - RNA, 1143 nt, unidentified
  source 1..1143: mol_type = other RNA; note = synthetic construct
atgtggcacccacattccttcaaatatcagggaaagaaagaagctgttgacgacggtatcgtgcagaccgctatcgagattgccgataaaacaagttcagtccatcctgagctccccccaatcttttcattgcgacacctggcgcatctgaccaacgtgagctacgggttcctgcgtcacattgtgtgcaggaacatcgatgaaccctatgaagtgttccagatacggaaaagaatctatagcaagaagaaagcctaccggattgtttgcgtaccctctccagatctaatgtgtgtgcagcgctggatagcccacaagattctgcgcttaggggacacccaccctgctagcatggcctatgctccagatagtaagatttaccgggcagcgctgcagcattgtgagtgtaaatggttagtcaaaatcgacgtaaagcggttttttgaatctatcagcgaaatgaagatctatcacgtgttcctccaattcggctaccacccgctggtggcttttgagatggcaagaatttgcacgagagtaggtaagggctccactttttggaggaaacctcagtggatccctcagagacacgtgtactacaagattactgattatatgagcgatcgacttggccatctcccacaaggagccccatcatcccctatgctggcaaacctcgcaatgaagtccctggaccaaaaactccagcgcattgcagacaagtttcaggtttcttacacccggtacgccgacgacctcactttctctaccaaagataaggtcttcgggaagcacaatagcagaaaaatcgtgcgtaaagtctatgacgtgcttcgcgcccatggcctcttgcccaacacactgaagactacaatatcacaccctggagccaggaaggttgtcctaggtcttctggttgacgggcccaagcccagactgtcccgccaatttaggtctaggatcaggcagcacctgtactacctgcagaaagatcccatagctcatgcccgagcgcgtggatttatctcggtctggggcttgcggaatcacattcagggccttttggcccataccaaggagatagatacggatttctatgacaagacaagtagtgagttcaatctggtggactggccgttatga

SEQ ID NO: 8919 - RNA, 1278 nt, unidentified
  source 1..1278: mol_type = other RNA; note = synthetic construct
atggcatggaacagtcagcggttcgtgagggcaggagaactggccggagtggacgctgacattctcaacaacgccgtgatcatcgctgaacaaacactccgagtccagtcatccggccctccaatactaaccctggggcacctcgcgcacttgtcaggtcagtccgtaaaatatctgagaagtctcgtctcccgcgagggcgaggatccgtacagacagttcaccattagaaagcgcccagtccccaaccaatctccacggctccgcttcatcgctgtacccgagcctcagctgatgtcccttcttcgttggattctgtccgaaatcttggaaaaggctccctgccatcccgccagctctgcctttgccccagaaagcaaactctttaatgccgctttcaaacaccggggggcccagtggctgattaaggtggacgtgagagactttttcgagtccatcacggaaattgatgtgtacagggtctttcttgagcgcggctatcagccattaacagcgcttgagttggcacggatctgtactagactgagggatgtgcatcgggaaaaagggagcattgctacaaggaatcgacgatcaagtatgaggaccccaaacgggataggcgagtataatagccgcatcatgggaacactcgcccagggagctcctacctcacccatgcttgccaatctggcagtgagggccttggacgagaagctccagggagtctctgagaagttcggtgtgcggtacacaagatacgccgatgacatcattctttctactaccgacaaaactttcggtagacaacgctcaattcagttagtcggagagatatatgcagccctagggctgtatgggctcgcccctaataccagcaagacgctgatcgttcctccaggtgcgaggaaggtggttctagggttgctggtagatggcagtaagcccaagctgactcgggaattcagggcaaaaatgcgcatgcatctgcactttttgctccacgagggagtgggaccgagggcacatgcagctaatcggggcttcagctcggttgagggcctccgacagcacttgctggggctgatcgcttttgctggccaggttgatctgccctacgcccttaggtacaagaacttatttcgctccatagacctggaacgtcgaagacatctaacctcttctcaaagcgagagccctctgcggctgggctggaaacacctgttagaacccgcgggcgccactctgggttcgatcagacgtagtcaccctacatga

SEQ ID NO: 8920 - RNA, 1164 nt, unidentified
  source 1..1164: mol_type = other RNA; note = synthetic construct
atggcctggaactcgcagagatttgttagagctggtgagctggccgggatcgaggctgaaattttggagaacgctgtcgcggtggcagagcatacgcttggagtgcgaagccctggacccccgatcctgacactcggacacctagggcacctcacgggccttagcgtcaaatacttaagaagtctggtggcaagggacggcgacgatccttaccggcagttcaccataaggaagcgtcctgtaccgggccaaccaccaaggttccgattcattgcagttcctgagccccagctgatgggcctgcagcgatggattttgtctgaaattttggagcgcgcaccatgccatcctgccagcgttgcctatgtgcctggatcccggctgtttaaggctgccaaccaacatagacgagcgcagtggctgataaagatcgatgttagggattttttcgagagtattaccgagatcgatgtgtatagagtgttccttgggcggggttatcagcccctcacagcgctcgaatttgcccggatctgtactagactgcgggataatctcagagaaagtggtgcccccgcacctaggaagaggcgaacaaagatgcgcggcagcgaatcagtcgctgcttactactccgctgtgatgggaacactaccccagggggccccaacctctccaatgttggccaacttggccgtgcagggcctggatgaaaagctgcaggcgatcgcagataaagtcggcttacgctacactagatacgctgacgacctcatctttagcacctctgacaagtccttcggaagggagcgctctatccaattcattggggaagcttatagtgccctgggggagcacggtctgaccccaaatacctctaaaactctcatcgtgccacccggcgcccgtaaagtggtacttggtcttctggtcgacggagctaagccccgcctcactcgtgactttcgggccaaaatgcggatgcatctccacttcttactgcacaaaaacatcgggcccaaggcccatgcatccaatcggggcttttcctcaatagaaggacttcgccaacacctactgggcctgatttcattcgcagcacagatagacaggagcttcgccaatgagtgcaggcgccagtttagactggtagagtggtcatga

SEQ ID NO: 8921 - RNA, 1164 nt, unidentified
  source 1..1164: mol_type = other RNA; note = synthetic construct
atggtgtggaatagccagagatttgtaaaggctggggtgctagccggcgtctctacagaaattctggacaatgccgttacgatagcagagcatactctctcctttagaagccccggacctcctatccttactctgggacatctggggcacctgaccggccttagcgtcaagtatttacgtggcctcgttgctcgggatggagaagatccgtacaggcagttcaccatccggaaaaggccaatacccgggcaacctccccgatttcgtttcatagcggtaccagagcctcagttgatggatctacagagatggatcctgagcgagattctgcagcacgctgattgtcacccggcctccgtggcattcgctcctggttctcgcctgagaacggcggcctatgaacatcgcagggcccaatggttggttaagattgatgtgagggatttcttcgagagcatcacagaaatcgatgtgtaccgtgtgttcctggcaagagggtaccaacctctgaccgcgttggagctcgccagaatttgcactcgactacgcgacgtgcacagagagaagggctcccccgcaccaaggaattggcgcacccgaatgcgcgctcccaacagtgttggcgcatactacagtgcagtcatgggcactctgccgcagggagcacccacatctccaatgttggcgaaccttgccgtgaaggacctcgacgacaaacttcaggccatcgccaacaaggtgggtttgcggtatacacggtacgccgacgacctcaccttctcaacaacggacaagacattcggacgagagaggagtgtgcagctggtcggcgaggtgtataccacattgggcctccatggtttagccccaaacacctccaaaactctgatcgtccctccaggcgcccggaaagtagtcctgggtcttctcgttgatggatcgaagccccggctgactagggactttagggcaaaaatgcggatgcacctgcactttctccttcacgaagatgtgggcccaaccgctcatgctattcatagagggttctcatccgtcgaagggctgcgccaacacctgttaggactcattgcctttgccgggcagatcgaccgctcttttgctgaagagtgcaaagtgaagctgcggtcagctaattggccctga

SEQ ID NO: 8922 - RNA, 1179 nt, unidentified
  source 1..1179: mol_type = other RNA; note = synthetic construct
atgaggacttggaacagccagcggtactttgccgagggccttgctgcaggcgtggatgagtctatactcaacaacgccattgcaaccgcagaacacaccctgagacagccttccccaggaccgcctattctcaccctcggccacttgggtcatttagcgggggtggatgtggggatactgaaaacgtacgcatcacgccaggatgccgacccatatcgcgagttctccatcagaaaacggcctattcctggacagccgcctcgttaccgcactatcgctgtcccagaacctcccctgctgcgagtccagacctggattgcatcggaggtactcaggcacgcgccatgccatagtgccagcacggcttttgcacccggaagtcgcttagcacaggctgccgcgagacattgtcgagccgtgtggatggtgaagatcgaccttcgaaatttcttcgagtcactgaccgaaatcgatgtacaccgtgtgttcctggagcgaggctaccagccactggttgccttcgaacttgccagactatgtacaagactgcgcgacaagcaccgaaatgacactgccgtgctgccccaaagaaggacccccaaattccggcattcctccttgacaagcctttaccccagggacttattgggagttctcccccaaggcgcccccacatccccaatgctcgctaacctcgcagtgagggacttggacgagcgcctcactgctattgccaagacctttggtgttcgttatagcagatatgctgatgacctgacattctctaccacacggaagtcatttggaaggtctagggcccacgatctggttggccgcgtgtatgaaacactggctgcccggggcctagctcctaatcagtccaagactacaatcgtcagcccaggcgcccggaaagtggtattggggttgctggtcgacggggacacgcccaagctaactagagattttcggtctaggcttagaaagcacctgtaccacataagcgcccctgatcaaggtccggtgcaacatgcagctaggcgcggatttgcctcagtcgaggggctgcggcagcatctgcttgggctgatcgctttcgccggtcagattgatcccgtctatgcagcgaaatgccgggcgatcctcgactctagtgattggagtcagaccaggcgttga

SEQ ID NO: 8923 - RNA, 1173 nt, unidentified
  source 1..1173: mol_type = other RNA; note = synthetic construct
atgaacgattggcacagccaacactatcttgacgctggtcgccaggcagggattgatgaagaattactgcagagggctgtggccgctgcggagtacacgcttacaagacccaaccacggtcctcctgtgcttaccattggacatctagcacaattgtgcggagtggaaactgggctgcttcacgcctacgtcgctcgggaaggggacgatccgtaccgcgagttcactatcagaaaaagacccataccaggggaggctcccaggtacagattcattgccgtgccagagcctcgtctgctgcaggttcagacctggatcgcaacggagatcctgcggcaggccccatgtcatggtgcatctaaggcctttgctcctggtaatcggttgataacagcagcaggagtccattgtcgggcccagtggatgattaaaatcgatgtaagggacttcttcgagtcgatcaccgagatcgatgttcaccgggtgttccgtgaaagggggtaccagccgctcgttgcatttgagctggcccggatttgcacccgtctgagagacgatcatcgacacccaacaagcttcctcccacagagacgcaagccaaagtattatggcgggtcaggctactctgtctaccctcgcaccctaattggcgtgttgcctcaaggagctcccacatcccccatgctagctaacctcgccgtgcgggacttggacgaagtcttaacttcattggcgtcacagttcggcctgagatattccagatatgccgacgacctcactttcagcacccgacgaaaaagttttggccgcgcacgtgccaaggatgccatcggacagatatatcaggccctgataaatcgcggcctgagcccgaatagagcgaagaccgctattgtgtcccctggggctaggaagatcgtcctgggactcttagtagatggcacacggcccaggctcagtcgcgagtttaggtcccgactgaggatgcacctgtactttgtggcccacccagatcatggccccgcgcaacacgctaaaatgcgcggctttgcgtctgttgagggccttaggcagcatctcctgggtctgatcgccttcgccggacaaatcgacgcactgtttgccgactggtgccgggcagaaatgaggcgagccaactggcccctcacttga

SEQ ID NO: 8924 - RNA, 1218 nt, unidentified
  source 1..1218: mol_type = other RNA; note = synthetic construct
atggatcgagcagttccacggtgcgctgcatttcttcacggcgctattcgtactactctggctgagagcaaacagatgaccctgtggcggtcccagccttttctcacagccgcgaaaaaagatggcagagaagatcaggtggtcaagaacgctaccaagatcgctacccatctaattcggaagtctccaggggttgagcccatcctgtccctcaggcacttggggcacctgaccggcactccatataacatgctgaggtccgtggtgcgcagggacgaacccgaaccctacaggatctttagaattcggaagcgtcctctggccaatgagaagttgcgtttccgaacgatcgccgtaccagccccctggttaatggagctgcaaagatggctgaatgtgtgcattctagaacacatttcaccgcactctgccagcatggctttcagccggggtaattctatccgagatgcagcggcaccacattgtggcgcgaggtggcttatcaagatggacattatgaactttttcgagtcagtcacagaacgccaggtcttccgggtttttgaggatataggttacgaaccactggtggcctttgagcttgcacggctctgtactaggttgggcaccagatcgacacatgccggacaccccagatatagatccagtctgaaccggatggagatcaaggactattctgaccccttaatgggacagcttccccagggggcacctacgagtcctcgactggccaatctcgtgagcagggacctggacaaggctctgacaaaactcgctgatgagagaggattcgtgtacactcggtacgccgacgacctaaccttctccagtagggaagctcttaacagaacagcaattaaacctatcatcggcgccattagtggtataatcggcgataatggattctcaccgaacgtggcaaaaacaaccgtctcaagccctggagcccgcaagattgtgctgggcttactcatagacggggatgaacccaggctgagccgcgagtttaaacaaaaactgcgccagcatctctactatttgcgcgaacacgggcctgttatacatgccggacgaaacggtaatgccaccacttttgggcttagacgccacgtattcggcttgctgcagcatgcgcgccaaatcgagccagtctacgggaattcttgcctcgaggagttcgccaagatccagtggtga

SEQ ID NO: 8925 - RNA, 1143 nt, unidentified
  source 1..1143: mol_type = other RNA; note = synthetic construct
atgactgcgtggaggcctcagcggtttaaagccgccgctggtaaggccggctgtgaacagaacgttgtgtcacatgccgtcacagtggcaagtcacgtacttatacgatcaccaggtgtcgagcccatcttaagccttcgccatctggggcatctcactgacaccccttactacagactgaggcgccttgtgagaagggaagatcccgagccgtactccgtatttcggatcagaaaacggccattgcccaacgaaaaattgcgattccgtacgattgttgtgccatctccgtggctcatggacctgcagaggtggctcaatgtcaacgtgttagagcatgtcccacctcacccagcctctgtggcttttagccgtggcaactctgtgctcgaagcagctgcacctcactgcggggccagatggctgattaagatggatattaagaacttcttcgagtccatcactgaacgacaggtgtaccgggtcttcgacgacatcggatatgagccccttgtcgccttcgaactagcacgcctatgtacaagagttggtaatcggacctcgcgcaagtaccatcagcggtatcactctccttggcaggcgagagagatctcagagtatacgaacgccttcatggggcacctgcctcaaggcgctcctaccagtccccgcgttgctaatctggctgctagagatttagataaggcattgtccaacctggcagatgcgcgaaggtttacctatacacggtacgccgacgacctgactttctccaccagcaagaaaatagatcgcgccgacgtgaggcccatcctgggagaaatttccaagattgtatcagaaaacggtttcagccctaatgtggcaaaaaccacagtgagcagccccggcgccagaaaggtcgtgcttggactcctggtagatggcgaggagccccgcctgactagggagtttaaacagcgtctgagacaacacctctatcatctccggaagcatggcccagccattcactgcctgcacaatggaaatgccacaccgtttggcataaggaatcacgttttggggctggtgatgcacgctaggcaaatcgagcgaccatacggggacgcttgcttgcaggagtttaatagtatcggatggtga

SEQ ID NO: 8926 - RNA, 1176 nt, unidentified
  source 1..1176: mol_type = other RNA; note = synthetic construct
atgaggcgcgaccccccacatcagaggtggagcaaacaaatgactagttggcggccgcagcccttctctacaatggctcgggctcaaggccgagactctgcaaccattcaaaattctatcgatgcggcacagagattagctgaaataactcctaatgctgaacctattttcaccctgaagcacttggctcacttgacaggggcaccatacgtattgctccgcggaattgtttctcgacacgaaccagacccttatcgcgtgttcaaaatacacaagaggcccctccctggcgaggtgaccagattcaggaccatcgtgattcctaaccagtcccttatggatgtccagcgctggatcaacgtccacattctggaacacgtcaagccacaccgtgcatcagccgcttttaccagaggagatagcatcaagagagcggctgagaggcattgcggtgcacgctggctaattaagatggatcttcggaactttttcgaatcggtgactgagcggcaggtctacagggtgtacctctcaatcggctaccagcccttggttgcctttgagcttgcacggctgtgcacgcgagttgcctcctcccacgcgagactgagtagatatcacgccccgtggggatggaaaacaatcgagggatacagacatccgacgatgggccatctgcctcaaggtgcgccaaccagccccaagttagccaatctggttgcccgggagttagacgagaatctggaacagctcgcccggtctaacggatttgtgtatacacggtatgccgatgacttgacattcagtacactgggggcctcctccaggtgtgcagtgaggtcatttataggggatgtgtccgagagtattgcccaggctggcttcactccaaaccaagccaaaactcaggtgagcccccctgggagcagaaaggtcgtgctgggtctgctcgtagaccgtgacgagccccgacttagtcgcgagtttaagtctcagctgaggcagcatcttttttacctgaaacgacatggcgcctcagctcatgcctcccgtcaagggtcagcaaccatcttcggtctgagacgccatatactgggcctaatccagcacgcccgccagatcgaagaacagtatggaaatagccagctcaaaagcttcaaggagctccactggtga

SEQ ID NO: 8927 - RNA, 1017 nt, unidentified
  source 1..1017: mol_type = other RNA; note = synthetic construct
atgaggcatttgtccgtgagggctggtgtgccatatgcctatctgcgggaaatcgtggagagaaatgctacaagggattatcggttgtttcgcatacgaaaacgtcctgtgcggaatcaacgccttcggtacagaatcattactgttccagaagctagattgaagaaggtgcaacagtggatagatcggcacgtgctctgcgctgccgagcctgatgaggcctcagtggcattcaccaaaagatcttctgtgtatgcagccgcctcaattcactgcggcgctcgctggatgatcaagatagacatccgcgcctttttcgaaagtatttctgagcgccaggtctaccacgtctttcacgaaattgggtaccagcctcttgtagctttcgaactggcacgcctgtgtacccggttaaggaggcgagccccgccattgaagagatggagcctcggcttcgatcgtagatatgagatttccgcttacatcaacggccaggttggacacgtcccccaaggtgccccaacgagtcctagactctccaacctggtagttcgggaactcgacgaggacatccgtaccatcgccgcttcggcagggctaacatatactcgctacgcggatgacctgacactcagcaaaaccactgatgacttcagcagggctgccgccgtcaaagtgattcggaaaatctacagggtactgggggcccatggctttgcgcccaatctagccaaaacccagatcgtgcccccgcgcgcacgtaagattgttctgggccttcttgtcgacggagacagaccccgactgcagagggagtttaaggcgaggattagacagcatctgcactacctgatgcatcctaagttcggacccgcgaagcatgcaaaggcccagggcaacgctacaatatatgggctgcgaaatcacatcaagggattactggccttcgcacacggtgtcgaccccgagtacgcacggaaacagacggagctctttaaccgagtgcattggccatga

SEQ ID NO: 8928 - RNA, 1122 nt, unidentified
  source 1..1122: mol_type = other RNA; note = synthetic construct
atgatcagtagctctaagcgtaatccctggcacccgtcagagtttctagaggcctgccagcgaaagggagctatctccactgtcgccggtccagctctcgaaatagctcaacgcataaaagcacagggacctaacttgcccgttctgttgtccttggctcacctggctgctacggtggacgtgccgatcggcctactactgtcctacgtagagagagacaaggatccctaccgggtgttttcagtgagcaagctcggccctaatggcgagacaagtaataggagaaccatttgtgtacccgagcctcttttgagcaaaacacagtcttggatcgcagttcaactgctgaataactgcaccccacatgccgcttccacagcctacgcgcccggatcatctctttacaaagccgtcagacagcattgtggggcacgatggttgctgaaaatcgacctgaaaaacttcttcgagtccataaacgaaatgatggtgttcgatacttttatcagcctggggtatccccgcccaatctgtttccagctcgcacggctgtgcaccagggtctttggtgccgcccaggacgacttcgccagaatgaggttaggggtgcttccacaaggagcaccctcttctcctatgctggccaatctggctgtttataagctcgacgttagcctttctgaaatagccgctaaaaatgggtggatttacacaagatatgcagacgatttagccttttccacccgtagcgtgtctagtcgccacgagactaaggaactgatgtggtcgatcctcgaccagattcgatcctttggcctgacgcctaataagagaaagacttccattagtccaccaggcgcacggaagatcctcctcgggcttaacgtcgataccgatcggcctaggctgactcggagcttcaaaaacaacgtggagacacacgtgtacgcgatcaccaaccctgcaatcggattcaataagcacttagaagctcgcggcttcgaatcgggcccctcaatgattcggcatattgcgggtctgattgcctatgccaggagtattgagccagattatgccgatagcctctacaaaaggctgaccacagaagcggtccgctcatga

SEQ ID NO: 8929 - RNA, 1122 nt, unidentified
  source 1..1122: mol_type = other RNA; note = synthetic construct
atgacctccagtagcaatcgcaacccctggcacccatccgaatttatagatgcctgccaaagggagggggccgtgtccaatgttgctggacccgctctggatatcgctcaacggattaaagctcagggccaggacttgccggtacttttctcactggagcatctcgctgcaaccgtcgacgtgcccatcggtttactgctgagctacgtgcagagagggaaagatccatatagggtgtttagcgtgtccaagcaaggctctaagggactcaggtctaaccggcgcaccatttgcgtcccagaacctctccttagtaaaacgcagagctggatcgcagcccagctgctaaacaattgtacgcctcaccctgcttcaacagcatacgcgccgggcagctctcttgcaaaagccgtaagaccacattgtgaggcccgatggctgttgaaagttgacctgaaaaacttctttgagagcattgacgaactgaaagtgtttgatacatttgtcagtatggggtaccctcgcccaatctgctttcagatggcacgcctgtgtactagagtgttcggagccgagcgtggagataacgcttcaacccgtttaggtgtattgccccagggcgctccgtcatcccctatgctggccaatctcagtgtttatagattagacgtctccttgtccgaaattgcgtcgcggtcgggatggaattatagtcgctacgccgacgacctggcattctctactaggctcgagtcaagccggcacgccaccaaggatctaatgtggtctattttcgacgaaatcaggtcattcggcctgactaccaataagcgcaagactatcatttctcccccaggcacaagaaaggtgctgctgggcctgaacgtggatacagataggcctcgattgacaaggtcttttaagaataacgtcgagacacacgtgtacgccatcactaatcccgagatcggtttcaacaagcatcttgaagcaagagggttccgaagtgggcctagcatgattagacacatagccggtcttatcgcgtatgcccgttccatagagcccgactacgctgagaagctctataagcggctcaccaccgaagccgttcggagctga

SEQ ID NO: 8930 - RNA, 1125 nt, unidentified
  source 1..1125: mol_type = other RNA; note = synthetic construct
atgaccggctggtcccgacgcaatccttggtcccccaccgcatttatgcaggcctgccgcagggaaggcgaggttgaaaccatcgccgaaccggctctgggtattgctagacggataaaagcccaaggtccagatctgcctgtgctcttttccctcgagcatctcgcagctacggtggatgtgcctatcggactgttactcagttacgtggaccgggagaaagatccctaccgcgtattttccatctcgaagaagaggggccccaagtccgaagcaagtaacagaaggacgatctgcgttccagaacctcttctaagcaaaacacagtgctggatagcggcacagatactgaacaattgtaagccgcacagtagcagcacagcgtatgccccggggagctctctggtcaatgccgttaaagaacattgtggagcccggtggcttctgaaggttgatgtgaagaatttcttcgagagtatcaacgagcttatggtgttcgaaaccttttcctctttaggctacccaagacctctgtgcttccagatggcacgcatctgtactcgtgtcttcggaactgctcagtttgaggtgtctaaagctcgcttgggggtattaccccagggtgcccccagttcccctatgctcgcgaatctcgcggtgaacgagctggatgaggccataagcgagatcgctatccggcgtgggtggatttatactagatatgccgacgacctagctttttcaactaagcgcgagtcttcaaggcacgaggccaaggagctgattttctcaattgtcgacgaaattaggtcttttgggttgtcaccaaataacaggaagacaacaattagcccacctggcgcccggaaggtccttttgggcctgaacgtggacaccagcagaccacgactgacacgacgtttcaaaaataacttggagactcacgtctacgccatcaccaacccctccatcggaatcaaaaaacattcggaggcaagacagttccgaagcgaacaatctatgattaagcacattgcagggctgattgcctatgccaggtctatagaacccgagtacgcagacaaactgtacagacggctcacagctgatgctatctcaacctga

SEQ ID NO: 8931 - RNA, 1158 nt, unidentified
  source 1..1158: mol_type = other RNA; note = synthetic construct
atgcggtcttggcgtcctcagaacttcgtacgagaggggcagctacggggggtcgacgatgacgtcattaataatgctgttttaactgccgcaagacttaggcagcgcagtccagtgttgcctcccatattttcactgggacatctcgcctggctcgttggcgcaagttacgaactgttgcgggacgtcgtgtccagatatactgtggacccctaccggtcctttcagatacgcaaaaggcctctaccaggacaaggcaagaggtttcggaggatctgcgtgcccgatacatttctgatgttaacccaaaagtggattgcctccaacctgctggtgagggtcccagctcactccgcgtcagtcgccttctctaagggagatcgcatcgttgacgccgtgcagccacactgtgagagtacctggctgatcaaaatggatgtggtgaacttcttcgagtcaattgacgaacgtgtggtgtaccgcgtattccgcaggatgggttaccagccgctggtgagcttcgagttggcgcgattgtgcacaagaatcggtgctccaaccgcagcaagacgcggtcggagatggaatcctattaggaattcagagtccaagattagctcgtatgaagctccgcgactcggacacctccctcaaggagcaccaacgtcgcctatgttagcaaacctcgcagttatcgagatggatgagcgactgagcgaagtggcaggcaaggctggatttgtgtactcccgttatgccgacgatcttgctttttctagcaggcggcagctggacaggaaatcttgtcgtgaagtcatcgcgagtgctagcgcgatcctggacgtcttcggctttagcgtaaactctgccaaaaccagcgtacggccacctgggagcagaaaagtgctgttgggcctcaatgccaactctgtgcagccccgcctgagtcgagaacttagagatcgcctgctccggcatagatatttcctgctgcacccccaaattggtcccgccaagcatgccaagagactggggtttgactcaacaataggctttaagaatcacctattcggccttgttgcttacgccgcccaggttgagcccgggttcgctatggtccttaaagaggatctcgcccagatctcctggcccctttga

SEQ ID NO: 8932 - RNA, 1155 nt, unidentified
  source 1..1155: mol_type = other RNA; note = synthetic construct
atgtcttcttggcgcccccacctgtacaagagcaatgggatagcccaagggagagcgcgggtgacactgctgaatgctattgtacaagcccagaaagtgcaggcccgggggttgcctgccattctcaccctgggacaccttagcaagcatgttggcgtcccctatctgctcctgcgggaagtggtaagaaggaaacgcgatactgcttacagagagtttcccgtcgcgaagagatctggcggttggcgtcgaatctatgtgcccgagccactgctgttgaggacccagagatggataagccggtatgtactcgccaatttgacaccgcattccgccagtgtcgcatatgtgagagagtccagtgtattcaaagctgcagaaatgcattgtcgatgccagtggctgatcaaggtggatatccaggacttctttgagtccatttcggaaagacaggtttacctggtctatctgcaggcagggtaccagccgttggtcgctttcgagttggcccgcctatgtacttgggtttttgacgagcagtcactcaggtacaggcggaagcggtggcgaacctcccctgaaaggcgcagcgttccaggcgagatcggaggataccgagacagtaggatcggccaccttcctcagggtgccccgacatcacccatgctgtcaaacttagttatggccaagttcgatgcggcagctgaagccattgccctctcagaagggtgcgtgtatactcgctactccgacgatctttccatcagtagcgatgccagcgactttggacgttcaagagctgagaacgtggtgcgcgagctatttgcacttatgaggggatctggcttcgagccaaaccccgagaaaacggtgatcgctccacctggcgcacggaaaattgtgctcggtctattagtggattctgacaggcctcggttacggcgcgaattcaagtctaggctcgaagctcacgtccacggactggtcaagtttggcccagtgcagcatgcgcgtcaacgcgactttaaaagtatattcggcatgaagagacacctgtacgggctgctgacctatgcagaacaaattgattccgctttcgccgagcctcttcgaaagaaactcgacagcgtggtttggccaggtgtggagccctga

SEQ ID NO: 8933 - RNA, 1167 nt, unidentified
  source 1..1167: mol_type = other RNA; note = synthetic construct
atgtcccggtggagcagccagccctacctcaaggctggaaggaaggcgggcgtacctggggatgttctcaagaatgcggtgaagacagcaaaacaagtgaagcagggctgccctcctatactgactttaaatcatctaagccaccttactggggtcccacactctttcctccacaggatggtgagccggacatacagaaccgaagcctataacgtctttaaactgcggaagcccaatgtcgggcactctgcggaccggttcaggtggatctgcgcaccttcagaagagctgctcagagtgcagcgttggattaacacacatattctcagtaaggttgagccccacgaagcctcctatgcttacgacaatcgccacggtgtacttgacgccgccgagttacattgcggagcccagtggctgattaagctggatctgacgaactttttcgagtccgtgctggagccccgggtgtatgagcttttcaggtcgttcggctaccagccacttgtggccttcgagctggccaggttgtgtaccagagtgcgcgcatctggcaaccctgaccgacgatttgggaatagagaactgcccgccggactcccatatccagctgaccctcgcatcggccatcttccgcaaggggctgccacctctccccgtatcgccaatttggtgatgcagagcctcgacgaaagcctgcacgactacgcctgtgacaacgagcttgtttactcaaggtacgcagatgatctggtctttagtagtaagaatgcgtttgatcgccaggaagcaattcagcacatcaaactgattggcaagtgtctaatcgaagagggcttctggctaaacgaggctaaaaccaagatcgtaccacccggagcaagaaaaatcgtgttgggtctgttggtggatggggatgagccccgcctgagtaagtcttacaaaaaatatgtctccgaccaactctactatttgtcccatccaaaaatcgcaccaatggcccacgctaagcgacatggctttcagtcactgcaaggcttaattaaccatgtctctggaaagatagcttatggtttctcaattgaaccggattgggctaaaaaacaggggaaacagctcaagggaatctccggtaaactggagctggaccacgttatatttccttga

SEQ ID NO: 8934 - RNA, 1167 nt, unidentified
  source 1..1167: mol_type = other RNA; note = synthetic construct
atgaaccgctggtcaagccagctgtacctgaaaaccggtagagaggtgtctgtccccgatgatacgcttcagaacgccgtcaagaccgctaaacagatgaagcacggatgtcctcctatctttacactaaagcatctggcacacgtggctaacgtgccctaccctttcctgcataggaccataagcaggacataccgcactgaagcctacaatgtattcaagttgcgtaaaccgaatgtcggacatagccctgacagattccgatggatatgcgccccctccgaggacctcttacgcgttcagagatggatcaataccaatatactttcccgagtggagccacacgaagctagttacgcttatgacaagcgtcacggcgttctggaggcggccgaactccattgcggagctgagtggctgatcaagctggatctaacaaatttcttcgaaagcatactagagccccgcgtctacgatctgtttagatcctttggttatcagcccctcgtggcttttgaactggcacggctgtgtactcgggttaggtcatccggaaaccctgaccgacggttcggcaatggagagcttccagctgggcttccataccctgccgacccaaggattggccatgtaccccagggggcagcgacaagtcctaggattgccaatctggtgatgcaatctctcgacgagtctctccaagattacgctctcgaaaaagacttggtctatagcagatatgccgatgatctggtgttttctagtaagaaggcattcgaccggtcccacgcccaccagcacattaaatcaattaacgcccgcctgatcgagggggggttttggttgaacgaagccaagacgaagatcattgccccaggggccagaaagatcgtgttagggttgctggtggatggtgacaccccacggctgccgaaatcatataaaaagttcgtgtctgaccatctgtattacctctcgcatccggcaatcgatgcgaaaactcatgcaaagcaccggggctttcaaagccttcaaggcctgattaaccacgtaagtggcaaaatcgcgtatggctacagcattgaacaggactgggcaaaaaagcagggtgataggttgaaggagatctgctccaaaaacgagttagaccacgttctcttcccctga

SEQ ID NO: 8935 - RNA, 1167 nt, unidentified
  source 1..1167: mol_type = other RNA; note = synthetic construct
atgtcccgatggagcagccagctctacctaacaacaggccgtaaagcaggcgtgccgggcgacatcttacagaatgccgtgcaaacagccaaacagatggaacacggctgtccaccgatcctgactctcaatcatctagcccatctggcaggcgtgccttatcctttcctgcatcgcacgatctcaaggacttaccgcaccgaggcgtataacgtgttcaagttgagaaaggcaaatgtgggccactctccagatcggtttaggtggatctgtgcgccatctgaggacctactgcgcgtgcagcgttggattaacgttcatattcttagtaaggttgacccccatgaggcttcatatgcatatgacaaacgacatggtgtactggaggccgccgttctgcactgcggagctgagtggctcatcaagctggacctgaccaattttttcgaaagcatactcgagccacgggtctacaaactgtttcggagctttgggtaccagcccctggtcgctttcgaattggcgcgtctttgtaccagagtacggaagtcggggaaccctgacaggaggttcggaaacactaccctgccagtcgggcttccctactccggtgaccccaggattgggcacctgcctcagggagctgctaccagccccagagtcgccaatcttgtcatgcagtcactggatgagaaccttcaggaatatgctcgggaaaacgagctcgtgtactcacgctacgctgatgacctcgtgttcagctccaaaaatgctttcgacagatctcaagtagccttgcacatcaaaatgatcaacgcatgcttgattaaggagggtttctggttaaacgaagccaagactaagatcatacctcccggggcaagaaaaattgtgctgggactcctcgttgatggcgatcggccgagactcacgaagtcctacaaaaagtacgtgacagaccatctgtattatcttgcccaccccaatattgatgccatgacccacgcccgacaccgcggttttcaatccttgcaaggattaataaaccacgtgagtggaaagatcgcgtacgggttttctgtggaaccagattgggcccgcgtcaatggcgcaaggctgaaagagatatgcagtaagattcaggttgattatgtcctgtttccttga

SEQ ID NO: 8936 - RNA, 1167 nt, unidentified
  source 1..1167: mol_type = other RNA; note = synthetic construct
atgacccgatggtctagccagccttatttaaaagaggggagagggctcggcgtcccgcaagatattctgcaaaatgctgttaaaactgcgaagcgcatgaaacatggctatcccccaattctgacactgaatcaccttgcacacctcacaggtgtcccgtacccttttttgcaccggaccgtgtctaggacacatgagaaggaagcgtacaacctcttcgccctgaaaaagccaaacgttggtcattcacccgatagactacgctggatcagtgcaccatgcgaggacttgcttagggtgcaacgatggatcaatgctaatatcctcagccatgcagagtcacacgaagcatcttatgcttacgataaacgtcacggcgtcctggaggccgcagaactgcattgcggcgccgaatggttaataaagctcgacctgaccaattttttcgagagtatactcgagcccagagtctataaactgttccggagcttcggctaccagcgtctggtggcatttgagctggccagattatgcacgaggatacgcgtatcaggtaaccccgaccgaaggttcgaccaccggactctaccagctgggtttccatatcccgctgatcctagaatcggacacctgccacagggagcagccacgtcccctaagatcgccaacctggtgatgtacagcctggacgaacagctacaggcctacgcgacaaagaatgaacttgcctacagccgctatgctgatgacctcgttttttcctccagtaatccattcgatcgcccccaggccatcgaacatgtgaaagcgatcaacgagtgtttgatcaaggccggattttggctcaacaaggccaaaaccaagattatcccgcctggtgctaggaaggtagtgttgggactgctcatcgacggggagcagcctagactgactaaagcttacaggaagtacatatcagatcacctgtacttcttgtctcaccccgacatcgatgccattacccacgctgaacaccggggatttaagtcccttcagggccttattaaccatatttccgggaagattgcctatgggtattcgattgaccctgactgggccaaggagcatggcaaccggcttaaaatgatttgtcgggcactggaggtggatcacgtgatcttcccctga

SEQ ID NO: 8937 - RNA, 1167 nt, unidentified
  source 1..1167: mol_type = other RNA; note = synthetic construct
atgaacagatggtcgtcacagccgtatctgaaagcagggaggaagagcggcgtgccggaagacattctgaaaaacgcagtcaagactgcaaatcagatgaaacacggctgccctccgctactgaccctgaatcatctgagtcatctcacaggtgttccttaccccttcctgcatagaacaatttctcgtacttataagaccgaggcatacaacgtgttcaaactgcgcaaacctaacgctggccactctctagatcggttcagatggatctgtgcgccttccgaggatctcttaaggatccagcgatggatcaatgtgcacatcctcagcaaggtggagcctcacgaagccagctacgcctacgacaatcggcatggcgtgcttgaggcagcggctttgcattgtcgcgccgagtggctgatcaagctggatctcacaaactttttcgagtctatccttgaaccacgagtttacgagttattcagaagcttcggataccagccactcgtcgcctttgaattgagtcggctctgcactagaattcgcgccagtggcaaccccgatcgcaggtttggaaataaaaccctaccagctgggctgccatatcatgcggacgccaggattggccacctgccccaaggagctgcaacctcaccacggatagccaacctggtcatgcaaagcctggacgaaaacctccaggcctatgccactgaaaacgaattagtgtacagcagatatgccgacgaccttgttttttcatcccgaaatgccttcgacaggagtgaggcgatacaacacatacaatccatcaatgagtgtttggtcgaagagggattttggctgaacaaggctaagacgcggatcaccccccctggtgctaggaaggtggtgcttgggctcttggttgacggtgaaaagccccgcctgcctaaaatttacaaaaagtacgtatccgaccacctgtactatcttgcacaccccgagatcgatgccatgacacacgccaagcatcgtgggtttcagtcattgcagggccttattaatcacgtctctggaaaaattgcttatggtttttccatcgagcccgattgggctaagaagcagggggcacagctgaaggctgtgtgcaaaacgatagaggtggatcatgtagtattcccatga

SEQ ID NO: 8938 - RNA, 1167 nt, unidentified
  source 1..1167: mol_type = other RNA; note = synthetic construct
atgaacagatggagtccccaacgctatcttaaagccggccgacaagagggagttagtgaggccacgctccagaatgctatcgatactgctaaacagatgaagcatggctgccctccgatattcagcctgaatcatctgtctcacctcatagggactacgtacccttttctccacgaaaccgtctctcgggagaatgaggaggaagcctacaaggtgttccggctgaaaaagccaaacgtaggtcatagccccgatcgctttcggtacatatgtgcaccatgcgaagacttgttgagggtccaacggtggatcaacaaccatatactgagccgcattgaaccccatgaggcttcctatgcgtacgacaatcgacacggggttctggatgcagccgcccttcactgtggtgctcggtggctgatcaaactagacctgactaacttcttcgagtccatcctggagcctcaggtttacgagctcttcaagtcattgggataccagcccctggtggccttcgaattagcacgcctatgcacacggctaagagttagcggcaacccagaccgacgctataagaacaaaaccccaccagaagggctcccttacaccggagatacccgtatcggacacttgccccaaggagcagcctcatcccctcgtattgccaatctggtgatgaggtccctcgatgaatcccttcagtattttgctagtgagaatgacctcacctattcaaggtatgcggacgaccttgtgtttagttccagagccgaatttgatagatctcaggcaacacagcacattaaagccatcaacaatagactggtcgacgaaggtttctggttgaacaaagcaaagaccaagattgtgactccgggcacaaggaaaattgtccttggcctgctggtggatggaaagaagccacgcctgcccaagtcatataagaagtacgtgagcgaccacctgtactacctcagccatcccacaatcgacgccatggcgcacgctgagtctagggggtttcagtcggtgcagggtctgatcaatcacgtcagcggcaagattgcttatgggttttctatcgagcctgtgtgggggaaagaacagggcgatagattacgtggcgtgtgtagggagttagacctggatcatgtaattttcccgtga

SEQ ID NO: 8939 - RNA, 1167 nt, unidentified
  source 1..1167: mol_type = other RNA; note = synthetic construct
atgactcgttggtcgtctcaaccttacctaaaggccgggcgtcaggctggagttagcgagtccatcctccagaacgccgttcagactgcaaaacagatgaaacacagctgccccccaattttcacgttaaaacatctggctcacctcaccgatgtcccctaccctttcctgcacagaacaatctctcgcaagtacagagccgaagcttataacgtgtttaagctgaaaaagcagaatgctggccacagtccagataggtttaggtggatctgtgcccctaccgaagacctgcttcgcgtgcaaagatggataaacacccacatcctgagtaaaattcagccccacgaggcgagcttcgcgtacgacaatcgcaacggagtgctagaaacagcacagctccactgtggtgcaacctggttgatcaagcttgatctgacgaactttttcgaaagcattctcgaacctcaagtatatgagctgttccggtcatttggttatcagccgctggtcgcctttgagcttagtcgcctctgcacaagggtgcgagcaagcggcaacccagatcagcgacatggcaataagccactacctcccgggctcccgtacagtggtgacaccaggatcggacacctgccccaaggcgcagctacctctcccagaattgctaatctggttatgcagtccctcgacgagacattgcagacctatgccactgagaatgatcttatgtattcaagatacgctgacgacctggtcttttcctctaagggcgtcttcgacaggccccaagccactcagcacattaaggccattaacaagtgcattgcagaggaggggttctggttgaatactgccaaaactaaaatcgtgacaccaggggcccgaaagatagtgctgggcctgttaatagacgggggcaccccgcggttgtcaaaagcctataagaagcacgtgtcagatcacctgtactacttagcccatcctaagatcgacgctatggcccatgctacacggcggggatttcatagcctccagggcctgattaaccacatctccggtaaaatcgcgtatggattctccatcgaacctgattgggccaatgagcatggaaaacggcttaaagggatatgtgcaaagttgcatgtagatcatgtgctgttcccatga

SEQ ID NO: 8940 - RNA, 1116 nt, unidentified
  source 1..1116: mol_type = other RNA; note = synthetic construct
atgccagaggatgttttacagaacgccgtcaagaccgcaaaacagatgaaacacggctgtcctcccattttgactcttaaccatctcgcgcatctcacaggggtcccctacccgttcctgcataggacgatctctcgaacgtacaggaaagaggcctacaatgtttttacactgaggaagcccaactcaggccattctcccgatcgagtgagatggatatgtgctccatccgaagatcttctgcgattgcagagatggataaataccaacatcttatccaaagtggagccacacgaagcgtcatatgcctatgattcgcggcacggtgtgcgcgaagctgctgaactccactgcgaagctcagtggctgattaagctcgacctaactaactttttcgaaagcatactggagccgcgtgtgtacgagctatttcgctccttcggctaccagcctcttgttgccttcgagctggcacgtctgtgcacacgcattagagccagacggaatcctgaccagcgccacggaaataagagcctgcctcccggtctgccatattcacgggactctagaatcggacacttgccacagggggctgcgaccagtcctaagattagtaatcttgtcatgcagtcactcgacgaaactctgcaggcctacgcagaggataatgagctcgtgtactctaggtatgccgatgacctggtgtttagcagtaggaaacctttcgacaggtcccaagccctgcaacatgtgaagtccatcaaccaatgtctggtcgaggaaggtttttggctaaacaaggcaaagaccaaggtaatcacacctggcgcacggaaggtcgtactgggactccttattaatggcaagaaaccccggctgactaaagcatacaagaaatatgtgagcgatcacctgtatttcttggcccatccggacatcgatgccatcacccacgcagagcaccgggggttcaaatccttgcaggggttaatcaaccatatcagcggaaaaatcgcttatggctacagcattgaacccgactgggctcgcgagcaagggaatagactcaaggtgatatgcgccgctcatgaggtggaccacgttatttttccatga

SEQ ID NO: 8941 - RNA, 1164 nt, unidentified
  source 1..1164: mol_type = other RNA; note = synthetic construct
atgaagcgttggagtcctcaggcgtatttaaaggccggacgggcagccgggatacctgaagacgtgctgcagtctgccgtaaaaatcgccgctcagatgcatgaaggctgtccccccattttttccctcaaacacctggccaacttaaccggagtgccctacccatttctccaccgcaccatctctcgaacttataagactgaggcttatactgtgttcatggtgcacaagacaaacgtcggacattcaccagatcgcttcagaacgatttgtgctccctcacctgagctcttgaaggctcagcgatggatcaataaatacatcctctcgaatatcccgtcacaccacgcatcttacgcctatgagggccgcaacggtgtactggaggccgctaatgtccattgccaggcaacttggctgatcaaacttgatctgactaacttttttgagagtattctggagcctaaagtgtttacccttttccgcagcctgggttaccaacccctggtggcattcgagctggccagattgtgcaccagaacaaggaagaccggcaaccccagagtcatgtctcgggctggtggtggctcccctgcactaccatataagaatagcctaattggacatctcccccaaggggcggcaaccagccctaagattgcgaatcttgttatgcggtcccttgatgaaaaactgtttaagttcgcccaagataacgacctgatctacacacggtacgctgacgatttaatcttctccagccgccagccgtttgataggaccgtcccttctgcttacatcttggctattaaccagctgctgcgggccgaaggctattggccaaatagagccaaaacgaaagtggtgacacctggcactaggaaggtggtgttggggctgctagtagacgggagtgagccccgactgacaaaaacatacaaaaagtacgttagggaccatctgtattacctctcacatccggaaatcagcccagagctgcacgccaaacgtaagggattcaggagtcttcagggattgataaatcacgtttccgggaaaattgcatatggcattagcatagaaccagaatgggggaccgcccaaggcgaaaagctcaaggagatatgccagaagtggcaggtcgaccacgttctcttcccatga

SEQ ID NO: 8942 - RNA, 1164 nt, unidentified
  source 1..1164: mol_type = other RNA; note = synthetic construct
atgaagcgctggtccccacagtcgtaccttaaagcaggccacgcagccggcatacccgaggatgtgttacaaaacgccgtgaagatagccggacagatgctcgacggatgcccgccaatttttagcctgaaacacctcgctacactgaccggtgtcccgtatcctttcctgcaccgcacaatcgaccggacttatcagactgaggcatacacggtgtttcgtttgcagaaagcttcagtgggccactccccagaccgttttcgttacatctgtgcgccatgtccagaattattgagagcccaacggctgattaataagtacattctgagcaatctcaccccccaccacgcgagttatgcatacgatgggcgaaatggggtactggaagctgcttccgtacattgccaagccacatggctgatcaagctcgacctgacgaactttttcgaatctattctggagccccaggttttcaagcttttccggagtatcggctaccagcctttggttgccttcgagctgagtcgcttgtgtacccgggtcagagtgcgggggaaccctgacactaaattttggagcggggagttgtcatcttctttcccctataaagatagcaggatcggccaccttcctcagggagcagcgacaagcccgaaaatcgccaatctcgtgatgcgctcccttgatgagaagctatatgacctggcctcgaagaatgagctgatatacaccaggtatgctgatgatctgatattctcatctaggcagacctttgacagggccctggcatcccgccatattcgggctgtgaatcaggtcttgcgcgaagaggggtattggcttaaccgagctaaaactaagatcgtgcctccaggaacaagaaaggtcgttctgggtttactagtggatggtcccgttcctaggctgaccaaatcttacaagaaatacgtcagtgaccatctctactacctctctcaccctgaagtaagcgcagaggcgcatgccgctagaagaggatttaactccctccagggtctgatcaaccatattagcggcaagatcgcctatggaatctcaattgaacccctttggggcgccgaacaggggcaacgactcagacagatttgcggcaggctgctagtggaccatgtgatgttcccctga

SEQ ID NO: 8943 - RNA, 1164 nt, unidentified
  source 1..1164: mol_type = other RNA; note = synthetic construct
atgaaccgctggagtccacagcactaccttaaagctggacgcgccgctgggattccagaggatgtactgcaaaatgccgtgagcatagctgcgcagatgcacgagggttgccctcctatttttagcctcaaacacctcgcaaacctgacctcagtgccctacccttttctgcatcgcaccatctcccggacttatcagacagaggcttatactgtcttcagactgcagaaagccaacattggccacagcccagaccggtaccgttacgtctgtgccccctcacccgaaatgctgaggacacaaaggtggatccacaagcatatcttggcctccctgaaaccacaccattcaagctacgcatatgaaaagagaaatggagtattcgaggccgcaagtctgcattgtcagtgcatctggctcatcaagctcgatctgaccaatttctttgaaaccatcctggaaccgcgggtgtataaactgtttcgatctctgggctaccaacccctggtggctttcgaactaacacgactttgcacccgtatcagacccagaggcaaccctgagaatcggttgtggaggggcgagctgacagaaaatcttccttacataggttctgcagttggacacttgccacagggggcagcgacttctccaaaaattgccaatctggtgatgaaatcccttgacgaaaagttatatgagttcgcgtcactcaacgagctcacatatacgcgctatgccgatgaccttattttcagttccaccaagagcttcgaccgagcactggcaagcaaacacattgagactatcaacaagttactgcgggatgaggggttttggattaatagggccaagaccaaagtggtcacgcctggagcgagaaaggttgttttgggcttattggtggacggcgccgaaccgcggctgactaaggactacaagaagtacgtctctgatcatctttatttcctctcccgcctagacatcgatgctgaggcccacgccaagaggaaacgttttgactctgtgcagggcctgctcaaccatctgtcgggaaagatcgcttacggtatcagtatagagcccaagtggggggctgaaagggggacaaaactccgccagatatgtgatagattgtccctagaccatattttatttccctga

SEQ ID NO: 8944 - RNA, 1149 nt, unidentified
  source 1..1149: mol_type = other RNA; note = synthetic construct
atgaatcgttggagcccccagcgctacaagtcagaggggctcaaccagggcgtggatcaaaacaccctctccaatgcattgtcgacagccgaactgcttcgtgcaaactcccctaaactgccaccgatttttactctgagacacttagctcacgaagcaggtgtgccctatgccctgttgcgggctgtcgtggccaggtctgaaagggcagaagcttacaaggtattcaagttgaaaaaagcggtagcctcatttggcgcgaatagattccgatatatctgtgttccacatccatccctactgaaggtccagcgatggattcacaagcacattctcatgcaggtggacgctcatcctgccagttacgcgtataaggagaaaaccagcccctgtgacgccgctacaatgcatgcgggatgcacgtggatgatcaagctggacgccaccaattttttcgagtccatcctggagccagacgtgtatttcgtttttcgcgatatgggttaccaagccctcgtcgcattcgagctggccaggctctgcaccagggttaggcctaccggtaaccccgtcaaagctaacagagtgaaagagggacaaggcaacctgccataccgcaccatcaaaatcgggcaccttccacagggagctgcaacgtcacctcttttgagcaaccttgtggctcggaaactggactgcgccctcacaggtctggcaaacgataggggattgacttatacccggtacgctgacgatttaactttcagctctttcggggactttgatcgcgacattagtacaaatctggtcagagagatttacgagatcatgagaactcatggcctgtggccaaataagtctaagaccaagatcatacctcccggagcaagaaaagtggtgctgggccttctggtggatggccctgtaccccgtctcactaaggagtttaaagccgaagtccgaacgcatattcacttcatgttacggcccgatgttggggtgcggaagcacctccgcgccagaaaattcgatacaccctgggggatgcagaattatctgtttggcaagctggcttacgcccagccgatagaacctcgatggactgcccgcatgagggacctactacggaagatagactggacaagttga

SEQ ID NO: 8945 - RNA, 1149 nt, unidentified
  source 1..1149: mol_type = other RNA; note = synthetic construct
atgaaccgatggtcaccgcaaaggtacaagtccgcaggattgaaccagaatgttgataagggcgtgctgaacaatgcactgcggaccgcgcagcttcttcacgccaacttccccttgttatcccccatcctcaccttgcggcatctggctcacgaggccggagtatcttatgggttcctgcgcggagtagctgcgagatctgagcgggtcgagccctacaaagtgttcaagctcaagaaaaacgtggtgtcttttggagctaacaggttccggtacatatgcgccccacatccctccctgctgaaaatgcagcgctggatccacaagaacattttgatgcacgttcacagtcatccagcaagctatgcctataaggaaaaaacatcccctcgtgatgctgcggcaatgcacgccggttgtaaatggatgataaagctagatgcgacgaattttttcgagtccattctggaaccagacgtatatcgcgtcttccgggagatgggctatcaggccctcgtggccttcgaactcgctagaatctgcactcgcgtgaggcctagtggtaatccagttaagacggaccgtttcaaggatgggatggggaatttaccttataaaaacgtcgccattggccatttgccacaaggagctgctacatcgcctcttctgtctaatctggtcgcacgcacactggatcatagcctggccgagtttgctaattcaaaggacctcgcctacacacgttacgccgacgatctgactttttcaagctttggtacctttaacagagatggggctgagaatatcgtgagggagatctacgaaataatgagagcccatgggctttggccgaacaagagcaaaactaagattattcctcccggggctcggaaagttgtcctaggcctcctcgtggacggtcacgtccccaagctgagcaaggaatttaaagcagaagtgaggacccacatccattttatgctgcgacctgacgtgggcgtgtcaaaccacagaaaagcacgaaaatttgacaattcctggggcttaaaaaatttcatcttcggcaagctggcatacgcccaggccattgagccaatctggaccagtagaatgagggaccttttcatgaagattgactgggatagctga

SEQ ID NO: 8946 - RNA, 1149 nt, unidentified
  source 1..1149: mol_type = other RNA; note = synthetic construct
atgaatagatggtcttcacagcactatattcgcattggtaatgaccaaggagtcgctccggctatcttgaagaccgctgccgaaaccgccaagcacctgcataaatgcaatccaaactttccacccgtcttcaccctgaggcatctggctcattacactggcgtcccttacggcttcctccggatggtggtggcgcgcaataagcaggttgagccgtacagggtgtttaaactgaagaaacaagtgcgtagttttggacgcgaacggttccgatttgtctgtgccccccatccctacctgttaaaggcccagcgctggataaaccgagagattttggccaaaattcctggtcacgaggcctcgtacgcatattcacccgggagctccgtctacgacgcagcaagcatgcacgccgggtgtcggtggcttatcaagttggacgcgactaacttcttcgagagcatacttgagcccaaaatctatgagatttttaggacgatcggataccagcctttggtggcattcgagcttgctcgtgtttgcacaagaacccgacctagtgggaaccctgtatactccaacagggctgaccccaataagaaaggcctgccatataacactgtacagatcgggcatctgccacaaggggccgccacaagtccccatctctccaacctggctgcacgcgatctggatgaaagcctcaagaacttcgctctccttaaccagttaatatatacgcggtacgccgacgatctgaccttttcttcaaccgaagaatttgtcagagaagacgttgtgaagaagatccacgaaatatatgggtttatgagagcaaatggactctggccaaataagtcaaaaactcagatcgtgcctcctggtgccagaaagatcgtactgggcttgctggtggatggcgcccaaccaaggcttacaaaagaattcaaacaggagattaggacacacctccactttctacagcgttctgatatcggtgtgcggaaacacctaaaagcgcggggcttcgattccttctggggactgcgcaatttcttagtgggcaagctgtcctatgcaaaatctgttgagcccgagtgggagagcaagatgaatagactctttgtgaagattaactgggacacatga

SEQ ID NO: 8947 - RNA, 1128 nt, unidentified
  source 1..1128: mol_type = other RNA; note = synthetic construct
atgacacggtggagttctcagttgtacattaaggaaggtagatcaaaggatgtcccaagagacatcttgcgggatgctgccagaaccgccgagcttttgatttcaccagacctgccccctgtttttaccttgcgacatatcgctcatctgacaggagtcccttacaatttcctgcgggaggtcgttagtaggagctccgatccctatcgagtattcaagctgaagaagaacagcccaaatctggtcggtaggtaccggtatatatgcgccccacacccaaaactgctcaaggtgcagcgctggatcaaccgtgagatactcgaaagtcttcagccccatgaagcctcatacgcttatacaaaaggcgccggcgtgctgaaggctgcagaagtccacagtgggtgcaggtggatgattaagctcgacgtaactaacttttttgagtctatcctcgagccccgcatttacaagattttccggggactcgggtaccagcccctcgtttccctggagctggcgagactgtgtacgcgagtccgcccgtacggaaacccagtgtacaggaataaacaggacgcaaaccttcccggcctcccttatatggtggccgagatcggacacctccctcaaggcgcagcaactagccctctgctgtccaatctggcggtgtacgagttagataaggaactttcctcttattccatcgaacacgaacttacctattctagatatgccgatgacatggtgtttagcagcgaagctaaatttagccgttcggctgttctggtgatggtacacgagctttacgacattgttaggaaacatgggttatggcccaatagggtgaagaccaagatagtgtcccctggggcgagaaaagtggtgttgggtctgttggtagacggcaaaaaaccgagattgacatctgagtacaagcaggaagtgcgcactcacctgcatttcctgctaagggaagacatcggggtcgagaaacacctagtgaagcgcggtttcgattcacgctttggcttacgtaatttcctgctgggcaagatcgcctatgcccaacacattgagcccaaatgggcaggagagatgcggaacatgctccatctagtgaaatggtga

SEQ ID NO: 8948 - RNA, 1167 nt, unidentified
  source 1..1167: mol_type = other RNA; note = synthetic construct
atgaactcgtggaatagtcaattgtttaagactgagggccgggctcgggggattcctaatgagatcctcgacaatgctacgaagatcgctaaacagctgaaatatgccggcctgccccctatctttactcttaaccacctgagtcacctctgcggagtgaagtacagcactctgaggtatattgtcgaacggaaacataacgatgacgcctataaggtttttaagctgaagaaatccggggtcgggttttccgacgaaagagtccgttttgtatctgtgcctaatagtgaactgttcaaggtgcagcggtggatacataacaatatcctcaagctgatccccgcccacgaaaacagctttgcctttcatagcaatggcggcatactaaaggctgcatacccccactgcaataagaaatggatgattaagctggacgtgtcaaattacttcgagtctattctcgagcccacagtgtataatgccttcttaaaaatgggctatgagccattggtcagtttcgaactggcacgcatatgcaccagggtaaaaccacatcataacccagtgaaaaaaaacaggatcaactggctcttaaacaccgatcttccgtacaagactatcgagattggacacctacctcagggtgcgcccacctctccactactgagcaacgtctgttctatcaaattggatgagctgttgtctgacttcgccggcgttaataacctcacctacacacgctatgccgatgacattgtgttcagctccgcagacttttttaatcgtgacctttgtaatgggtacataaagtccgtgtactcaattatgagagagaataacctgtggcctaaccgaacgaagacaaaaattatccctccgggagctcgaaagatcgttctcggtctgttagtggacacagatagaccaaggctgaccaaggagtacaaaaaggaaattctgacccacctgtactatattttcaacgagtccataggactcgaaaagcactgcaaagccagagggttcgattcagtgtatggtttcttgaacttcatcaacggaaaacttacatacgcgaatttcatcgatcccgaatggagcaaaccactgatctacaagcttaagtgtgttgcacgcccctatatcgatcttgactcctcatgttga

SEQ ID NO: 8949 - RNA, 1158 nt, unidentified
  source 1..1158: mol_type = other RNA; note = synthetic construct
atgaagatttggtcaccgcacttatatatttcccagggaatagccgacggggttagccctgacgtattgaatagtgcagtggcaacagccaaaaaattgagatatctcgacctgcctccggtgttcaccctgaagcacctgtccgttttatcaggcgtctcatatagctcgctaaggttcattgtacagcgccgggacccatcctctaattacaaaaccttcaagctcaagaaatccaacgccggctttcacccagatcgagtcagattcatctcggtgcccgaaccatctctgctgatcgtgcagaaatggatccacgagcacatcctcaagaagattccccactctaaatccaccatggcttttcatgccgatggcggcatcttgaaggcagccatcccacattgtggtaataactggatgatcaagattgacatcaaaaactacttcgagagcattagtgaggtcaaagtgtacgatgcgtttgtccaagccgggtaccagcctcttatctcatttgaaatggctcggctctgtactcgagtcaggaataaaagtaatcccatcaagatgtatcgtcatgacgataccttaggaactcaacttccctataccacggtggagataggacacctgccacagggtgctcctacgtctcccctgctgtctaacatttgcacaaagaagctcgatgcgagcttctttgaatttagcattgcccatggcattaactatacaaggtacgctgacgacataattttcagctccagatccttcttctcaagggacatttgcgtgtcccttataaaggagatcaagtatatcctgaacaaaaatggcttttggccaaacgaggctaaaactaaaatcgttacacccggcgcacgcaaaatcgtgctcggactgttggtagatggtcctgtgcctaaacttacaagcgaatacaaaaaggagatcctgatgcatctacattttgcatctcggaaggatattgggataatttctcactgcaatagacgcgggtttaagagcgttaccgggtttctgaattacctggagggaaagataagtttcgctagtagcatcgaacccctctgggcccggaaggtgaatgccactttcgtgtacatcaagaacaagtacaacaacactatctga

SEQ ID NO: 8950 - RNA, 1149 nt, unidentified
  source 1..1149: mol_type = other RNA; note = synthetic construct
atgacgaattggtcacctcaacattatgtggagactggcgaacaacatcacgtgtccgccgcggtgctaaacgcagcacttaaaacagcctcggtcattcgcagcagaaacaaggatgttcccataatttttaccctcggacatcttgccgcgctgacaggagtccctcatagtttcctgcgggctgttatcaccagggatgacttcgccccctataaggtctttaaactccggaagaggtccgccggatttgccaaagataggttccgttttatttgcgctccccaccctaaactgctccgcgtgcagcggtggataaacgagagaatcctgaagcacatcccaatcgacatcgcgagctacgcgtaccgagaaaacacttctatccaggacgcagctatacagcactgtgagtgcaactggttgatcaagctggacatgtctaatttttttgagtctatcttggagcccaagatctacagagtctttagagagctgggttacaaccggctcctttctctggagctcgcccgcctgtgtactaggattcgtcatttcggtaatcccagcatgccaaaggagaagaagttactgaaaaagttcccataccgcaaaagtcgcttcattggacacgtcccccagggcgctgctacttcaccactgctagctaatattgtgtcaaggggcctagacgcctctattagagaattctcccggacaatgaatattacctacacccgttatgccgacgatttaatcttctcctccaaaagcaagtttgatcgacagggtgcacacagcctggtgaaggatctgtacgaacttataaaagctcacgggtattggccgaatctgaccaaaaccaaagtgagtccaccgggcgccagaaagatcgtattggggttactggttgatgggcgaacacctcggctcacgaaggaatttaagagtgagattaaaacacacatccacttcatcaccagaccagacgtgggcattgcaaagcatatgcttaatagggggtttgactccactgctgggttgaggaacttcctctatggcaaattgtcattcgccgcacatgtagaacctctgtgggccgcaaagatgcgaagcaaactcgaccaggtgaactggcctaagcgctga

SEQ ID NO: 8951 - RNA, 1149 nt, unidentified
  source 1..1149: mol_type = other RNA; note = synthetic construct
atgactaactggagtccacagcgctttctggaaaccggcaaacaacgcctcgcatcgcctttggtgttggaagccgccctgcagtccgctaagctgatcaaaagcaggaataagaacgttcccgtgattttcacactcgggcacattagcgcgcataccaaagttccttaccatttcttaagggaagtgatcacccgcgaaaatctcaagtactacaaggttttcaaacttcagaaaaggaatgccggttttaccaagaagcaggtgaggttcatttgtgcaccccatccctatctgctgcgtgtgcagagatggattaatgaacggatcctgaagcacatccccatcgatgattccagctacgcttaccgggccaataccagcatagcggatgctgcctttcagcattgcgagtgccgatggctgattaaactggaccttagtaacttttttgagagtatcctggaaccaaaggtctataaggtgtttcgtgagcttggctataaccgcctactcagcttggagctggcccggctttgcacccgtacaaggaattacggcaatcctagcatcagtagagaaaagatctcacaaaaaaagctgccctatataaagaacaagtatattggccacgtcccgcagggagctgctacgtctcctctgttagcaaatattatctctagagacttggacgtctccctaaagcagttctccaagaacttgggactggtctatacgcgatacgcagacgaccttatattctctacaaaaactgacctgactcgggcacagctgaaccaacacattaacgagctctataagatcatcaaatcacacggttactggccaaacttcacaaaaactaaaatatcccccccaggcgcccggaagatcgtgttagggctgctcgtaaacggggtaacaccaaggctgcctaaagagtttaaagccgagataaagactcacattcacttcatttctagatcagacatcggagtcgctcaacatatggcgaatagaggattcgaatctgctgagggcttcagaaactttctttacggtaagctctcatttgccaatcacatcgagccggattgggccgcacggcgaaaatgtgagctcgatcgcgtggattgggccgggctatga

SEQ ID NO: 8952 - RNA, 1167 nt, unidentified
  source 1..1167: mol_type = other RNA; note = synthetic construct
atggttaattggcggtcacagcatttcattaatgagggacgtcagcagggcatcgctgagcctctgctgcgcaacgcaactcttatcgcaaggcgcatccaggccgtgaatgccgatttaccacccctttttacccttagacacctctctcatgaggtgggcgtgccgtacctggcactgcgatcaatcgtgagccggaagtttacctgtgaaccctatcgtgtattctcgctgaggaaaaaaaatgtcggccacggctctaggcgattccgcgtgatttgcgtgcctgatcccgccctgctgaagacccaacgctggatacattcaaggatcctcaagttcggcagatgccacgaggctagcggggcttatagtaaaggaagtggcatttatgacgtggctagtacacactgtaatgcccggtggctggtgaagctggatgtcacaaatttcttcgatgctatcttggaaccgaaagtttaccaggtattcgctcggttaggataccaacctctaatggcatttgaattggcaagactctgcaccagactgagacacgacggcaacccaaaacggaagtccaaaacagggtatagaaaaatttggacatacggaagctccgtggtgggacatcttccccagggagctcctactagcccgctcctggcgaacttggtggcctacgacctagattcagaattgtttgccttagccgaaaacgcaaacgttcgctataccaggtacgccgacgacatcgtcttttcttcttccgagaaggccttcacgcggtccgatgcggaggggttgatccgtggggcttacgcctgtctcgaacgacacgggctttgggccaatcgggccaagactcacgtggtaagcccagcggcccgcaagatagttctgggtctgctcgtcgacggtccagtcccaaaactgcagagagagtttaaagacaagcttaggatgcatattcactatctgcatcacccccaaattggtcccgttgagcacgcaaggcgacgcggattcgacaacgtcctggggctgcaacggcatctcctcggcctagctgcctttgctatggggatcgagcctgcgtggggcagacagcagatggatgaaattaagagggcaaactggcccataggtataccaccttttaagtga

SEQ ID NO: 8953 - RNA, 1167 nt, unidentified
  source 1..1167: mol_type = other RNA; note = synthetic construct
atggtaaactggcgggcccaacagtttataaacgagggaagacagagaggagtgagtgctccaatactgcagaatgctgtccagatcgctagacagatccagagcgtgtccaatgacctgcccccattgttcactctgaggcatctggcccacgaagttggagtgccttatctggcgcttagagggattgtgagtcgtcaatttattgatgaggcataccgcgttttcaccctgagaaagcggaatgtcggccatgactctaggagattccgagtgatctgtgtacccaacccagccctcttaaagacacagcggtggattcattcaaaaatactcaaacttgggcgctgccacgaagcatccggtgcctatagcaaagaatcccgcatttacgatgtggcatctattcattgcaacgcccggtggctggttaagctggatgtgaaagatttctttgacagcatcctcgaacccaaagtctatcaggtcttcatcaagctggggtatcaaccactggtggcctttgaattagcgaggctctgtactcgaacgcggtataccggaaatccgaagcgccgctccaagcgccaataccccaaaatccagggctaccggaaccctgtcgtagggcacttaccgcagggcgcacctacgtcgccactgcttgccaatctggtggcttatgatctagactcagagctgctagccctggctgggaagaccaatgttagatacacccgttacgctgacgacattgtcttctcaagcgcggacaaggcttttactagggccgatgccgagaagcttatagatgagacatacgcttgcctcaagcagcatgggttgtaccccaacagggccaagacaaatatcgtgagtccatctgcccgcaagattgtgctcggtttgttggtggatggccctacccctcgactgcagcgtgagtttaaagacagactgcggatgcacatccactatctgcatcaccctcagttcggccccgttgagcacgctaaacgaaggggatttgacaacgtgctaggacttcaaaggcacctcctcggcttggcagcattcgccatcggtattgagcccgtctggggccggcagcagatggaagagatcaaaagggcaacatggcccattggcatccctccattcaagtga

SEQ ID NO: 8954 - RNA, 1173 nt, unidentified
  source 1..1173: mol_type = other RNA; note = synthetic construct
atgaatcattggaactcgcagaggtacctggcatctggccgcagtcagaagagggcagctaatgtgttggctaatgcggcatcaacagccgagctcatcagaaaagccgcccctggtgccgccatcctctttaccctcaatcatcttgccagggaaaccggcgtcccctatcattacttacggtcggtgacagagcgcggcggactgaatagcaacactttctacagagtcttttccttgaagaagcacaacggcgggttcaggggtaagcgtactcgaactatttgcgcacccgaaccattgttaatgaaaacacagcgttggattcacgaacacattctgaccaagggatgtccccactccgcgtcctccgcctacagaccagggagcaggataagagacgcagctgagcagcataggaatgcacgctggctcgtcaagatggatgtgactaacttttttgagagcatcctggagcccaaagtctatgaagtgttcaggagcttcggttaccagcctctcatggctttcgagctcacccggctgtgcacccgcattcgaaagggtgggccgaaacggcacaaagtgaacgatacggctcgcattggccgctattcaagtggaagcctcggtcacttgccccagggagcaccaacctctccgttgctagccaatctggccgcctttgacctggattgtgagctcaacagtttagcaacatctaacggaatggtgtacacaagatacgccgacgacatcgtgctatcctcaagcgcggaggactggagtaagtctaaggccgtgacccttctgaagcagggccatgacatcctgaaagcacacgggtttcaacctaaccttgccaaagctacgatagcgggccctggcgggcgaaaactagttctcggactgtcagtatctggagccgaacctcgactgactcgggattttaagaataagctgagagcccacatccattacctgcaaaagtatcagagccaaggaatccctccccatgagaagctgaaattcgattctcggcttgggctgcagcggcacgtattcggcctggcttattatgctatcgggatagaaagagcttggggcgctgcgcgtcttgccgagttgaaagctctgccatggccagttgaacacgggatttccttcgtttga

SEQ ID NO: 8955 - RNA, 1170 nt, unidentified
  source 1..1170: mol_type = other RNA; note = synthetic construct
atgaatcattggcagtcccagcgttatcttaaagaggggctggcgactaataaaaacatcgggctgctgaatagagccatcgctaccgcagaagctatcagggctgttaacccgcacgcccctcctattcttactctcaatcacttggcccacgagacaggcgtcccttacgattttttgcggggcgttgtgacacgcgggggttcttctgatcactccttttatcacgtgttcactgtgaaaaagaataacgtgggtcatgcccacggacgcacccgaacaatctgtgtgccccaccccatgctcattaaggcgcagcgttggattcacgagaatattctacagtttggcaggtttcatgaggcggcatgcgcttacaggcccggtagcaaaattgtggacactgcttcccttcattgcgaagcccggtggatggtgaagatggatgtaactaacttctttgagagtattctggagacaaaggtttacaaggtgttccggagcttcggctatcagcccttggtcgcttttgagctgaccaggatctgtacccgaataagaaaagaatcacctcggcgcatccagccttctaaagccggtatcagcagctacgccaacaactacgtcggccatctcccccagggagcaccaacgtcacctctactggccaatctggctgtgtacgatctggataaggaattatctttgctggccagacaaaacggaatgatatatacccgctacgccgacgacatcacgttctcgtcagtgacctccacttggtcacgggcgaaagctgttcagttgctctgcgacggccacgccaagcttaaatctcatggattctggccaaatcacgccaaggcacatattgtcagtccaggaagtagaaagattgtacttgggttaaccgtagatgggaccgcaccacggctgacaaaacaattcaagaacacactgcgagcccatatccactacctggaaagattccaactgagcaaccgcccaccccaccaagtgctcggcttcgactccatcctcggcctgcagaggcatgtctttggactcgcctattatgcaatggggatagagagggggtggggagcagctagactggctgagttaaagagtatcagctggccggcagaacacggcatagcctttgactga

SEQ ID NO: 8956 - RNA, 1152 nt, unidentified
  source 1..1152: mol_type = other RNA; note = synthetic construct
atgacttcatgggatagccagcactacctctcctctggccttgtggccggtattgatgcaggcctgctcgcgagggtagacgctacagcaagacggatgctggccgtgaacccaaccgctactgtgatcgtatccctcggacacctggccagcctgtgtgacgtcccttacggctacctccggcgagtgataagaagagacgcaacactggaaccatatcgcgtgttcgctctggctagaggaggtcacgggcctacccgaaggccacgaaccatctgcgcgcctgagcctttgctattgcgtgctcaaagatggatccacgctaacgtgctgcagcacgccaaggcacatgcggcctccacagcttatgcaaagggatgctcagttgtggaagccgcccgggttcattgcggggcttcatggctcataaaactggacgtcagtaacttctttgacagcattttagaacccaagatctaccaggtgttcctcgcccaggggtatcagccacttgttgcatttgagctagcgcggttgtgtacaagggtcagaagcaaggggaatgtagcacgctctacgggttctggcgttcccggaccctatgtctacccgtctatcggacatctgccccaaggggctcccaccagcccattgctggctaacctcgttagttttgccttcgacgaggaagtctcgcaattggcaaggagattctgtcttaggtacactagatacgccgatgatatgaccctgagttttcgcggcaccggttttgatcggactaaagcgcgggaggtcatcggcgcatgctatcgcatcatgcttgatcactccctttggccgaatcgcacgaaaacccaggtgattccccccggcgcccgtaaactggtgttagggctgctggtggacggaaataggcctgccctaactagggaattcagggagcaaatgcgcatgcatcttcacttcctcgagacacagggacctgtctcacatgcccagcaccgcgggtttggatccgtaattggcctgcagaatcacctctttggcctggcagcccatgccatgggcgtgaacaaggccattggtcgtgactggatgtatcggttacagcgactgccttggccggctgccttcgagatgccagtgtga

SEQ ID NO: 8957 - RNA, 1209 nt, unidentified
  source 1..1209: mol_type = other RNA; note = synthetic construct
atgacacactggcagagccagctgtttgaggttgacgctccccccgatgcaccagtggatgctgccctggcaattgctaatgctatacgcagtatcaaccctcttcttccacccctgtttacactgtctcacttggcccatgagacaggagtgccttataagtacctcaggaataccgttgcccgcgggaaggtggacgaacagtattccgtatttcgaatccagaaaagagcccccagcgcaacaatacaatatagatggatcgccgctccgcacccgctgttgcttaaaacccagagatggatcaacactaacatcctcaagaatattgccgtgcataacgccgcattcgcatacatcaaggagggaagcgcttataaggcggcctgcttacacaatcaagcaaagtggctggtcaaagtggacattaggaacttcttcgagtccattctggagactaagatctgcaaggtcttcgagacagcagggtaccagccacttctggcctttgagctatctcgcatatgtaccaggatcgccaccccagagatggaaagagcgctggcccccaacggacgtgtgcctaattcactgaaaggcctaaaatatagcatctctgcctacaactcctttgctctcggccatctgccccaaggcgctcctacgtcccctatgctggctaacattgtagcgaaagaaatcgacgacgagatcagcagtctcgcagaaaaatataagttgcgatactcaaggtactcagatgatatagttctgagtactcccagcactcagttcggcaaagagatgtgcaaagaagtcgtcggtaagttataccgcattctgctttctgctgggtaccagccgaatgtcgaaaagactaagatttctggtcctggttccaagatgattgtgctggggttactcgtggacggcaaaacgccacggctgaccagtgaatttaaaagtaagctgaggatgcacctcttctactgtcggacccggtcacctcaacagcacgcagttaagcgtaaattcgcgagcctcctcggactaaagaatcatttgattggcttgatttcctacgccggaacaatcgacgccgcctttgcctccaaatgttatgccgagcttaatgcttgctcttggccaatattcgatagcgcagacttcgattcaatcatcgaatcgaccgtgaagattctccggtga

SEQ ID NO: 8958 - RNA, 1200 nt, unidentified
  source 1..1200: mol_type = other RNA; note = synthetic construct
atgtccaactggcaatcccagctttttaagcaagatgcacctcctggggctcctgtgagtgctgccatagccatcgccagcgagatccgctccactaacccctttctaccaccccttttcaccctggcacacctcgcccatgaaaccggagttccatataaattcctcagatccgtggtcgcaaggacgggggccactgaacactacaccgttttcaaaattaagaagcgcagccagaatgccattaagcagtatcggtggatagccgcaccccacccatttctgcttagagtacagcgctggattaatgataacatcctgaagaagctgccagttaatgaagccgcctttgcttatctggaagatcgaagtgcctacaaggctgctatcgtgcacaaaaacgcaaaatggctgatgaaagtagacatcgaaaatttcttcgagacagtgctggaaacacgtatttacaaaattttcctggacgccggctaccagcctctattgagctttgaactgagcagaatctgtactcggatcgccaatccggaactcgagcgtgcatattccataaacggatttgcaaaagtgaagacaaaggggacaaaatacgtcatcgaggcttacgcttcttcggctttgggtcatcttcctcagggcgcaccaacctcgcccatgctggcaaatttaatagccaaagacattgacgagaaaatcgcggagctggcagatagatttgatctcaggtatacccgatatagcgacgacatcgtgctgagctcaaaatcaaatgactttggcaaggccaacgccgctaaggctatcggccaattatacgctatactgcgcagggccggcttccagcccaacatggagaaaacgaaagtcagcggtccagggtccaagatgatcgcgcttggtctgctggtcgacggaaacaaaccgaggctgactagtgagttcaaggataagttaaagatgcacttgtacttttgccggacaagatcacctcaggcgcatgcggtggctcggaagttcgactctgtgattggcctcaagaatcatctcttggggctgatttcttatgcaaggatggtcgactcttctttcgccgatgagtgcctagcccagatgaactcttgtcactggcccatcaccggacccattgatctctcattgattctcgagagtcttaaggcgtga

SEQ ID NO: 8959 - RNA, 918 nt, unidentified
  source 1..918: mol_type = other RNA; note = synthetic construct
atggccgccccacacccgctcttactcagggtccagagatggatcaacaccgagattttatctaagctgcagcaacatccagctagctacgcctatcgtagcggacgctgcgcctttgatgctgcccgtaggcatcagagagctaggtggctcgtgaaagcagacgtgactaattttttcgaatcaatcttagagccagacgtctactcgattttcaggtctgccgggtaccagcctctcatcgccttcgagttggcccggatttgcaccagagttcgaaccgtggacgaaataaatcccaaggaccttcgcacatccagaacgaagagcgccgcatacaaaattcaggcctatcgctccgcatacataggacacctgccacagggcgccgcaacaagccctttgctggctaacctggtggctaatcccctggacgttacactgtctcaggtcgcaactcggactggcttcaggtatacccggtatacagatgacatcgcattttcaagtgcatcacttgataccacacgagcggatgcagtatctgtcgccggcgctatccattccgcgctatataaacatggattcagtcctaacctcgctaagtccgtaattcgcggtcccggccacagacgcattgtcctgggcctgctggttgatggagatcggccccgactgacgagtgagtttaaagacactctgaccctgcacctgagacacttggaaatgtcaggtcctattgaacacgctaaggccaggggcttccactccatcgtggggttgaaacaccatatagatggtctgatcgcctacgctaaaggggtggacgaggcgtttgcagcgaagtgtgcccaaaagctagggcgggtgagctggccgcttctcactcctcttgacctcgatgctatcgtgccctga

SEQ ID NO: 8960 - RNA, 1092 nt, unidentified
  source 1..1092: mol_type = other RNA; note = synthetic construct
atggagtccaaaggcgttgctgtcgtcctgtccctgtcccatctcagcaagcttacaggagccagctattggtcactccgccaggtgataagtagacacggagacatgccatacagaccttttaggatccctaagcgttccggtggcgctaggctgattttcgagccgcaccctatgctgcgccatgttcagcgatggattcttgatagcattctctctaaagtccgccccaacgataacgcctatgcattcgtgcaggggagaaatgccatcgatgctgcccgaaaacattgcggggcaaaatggttggtgaaggccgacattgtaaatttcttcgagagtatccaggagtttaagatctttaaagtctttgccgacatcggctacggtccactggtggggtttgaactgtcgcggctttgcacttatccatatagggtgggccacccccggtatgaacagccagagtggacccaccgtttaggccaggagcacggagagaacggctacataggctcttatttcggatcttactttgacagcagaatcgggcacttaccacagggagcgcctacctcacccgcactctcaaatttcacatgcaagtggctcgaccaaaagttggcccggtatgcagaaatgcacgaatgggagtacacccggtacgccgatgacatcgtgctcagtaaggtggctgctaaccgcgcagaagcaattgaggccctaaattacgtgagatgggtagcggcacggtctggcttcatgcttaactccaagaaaactaagattgtaccccctggggctcgaaagattgtgctggggctgttggttgatggtgacaggccccgcctgacgaagaaattccaaaacgatctggatatgcattgtcactacggtctaaagctgggcgccaaaagacattctgaacgccgtcactttcggagtgtcttgtcatttctcgaccatgttcagggcaagataagcttcgccttccaagtggatccgctgagggcggagggatgggcttcgaaatttctgatcatcaggagcgaatacttagctagcgtggggtccgacgtctgtaatggatga

SEQ ID NO: 8961 - RNA, 1164 nt, unidentified
  source 1..1164: mol_type = other RNA; note = synthetic construct
atgtccgctccctcgcctcagcggtatgcctctggtgccagcaggcagggaatcgatgctgtgactctggagaacgcactcgctactcttgcgcggatacgggctacagacccacgtatcaccccagtgctgaccttgcggcatttttctgtcttgacagagctgccttatcttttcctgcgtaggactgtggcaagaagagggcacgccgaataccgattcgtcctcttgaaaaaacgcatccctggtcgaagtgcaaaacgcatgatctccattccccccaaaagtctagccgtggcccagcggtggttagtggatcatgtactgagatacgccccggttcacccagtgtccttcgctttccatcccgagagcagccctgtccaagcagcggaacagcaccctaataccaagtggttgctgaaggtcgacatcgaagacttttttcactctgttagtgaggggaccgtgtctgccattttcacccgcctcggcttcccaaagctgctggcatttgaatttgccagactctgtacaattggactcgatagaggtccaggaaagaatcccgctccccacgctggaccaataagcttctatgctcttgggtatgagggcttcttgccgcagggagcgccgacatcccctatgctagcaaacctggcaatgttacgaattgacaccctgctcgcatcactggctgaggagcggggactgcggtatagcagatacgccgacgacctcactttttctacagatacggacaggacgctggtggaaatgaggcgcttacagcgcgacgtctgcgggattctgaacgatagtgggtttaggcataatcagcggaagactggcataaggggcccaggcacaaggaggatcgttcttggcatgttggtagatgggcctatgcctcgactccagcgagcctacaaggacatgattcgcctgcacctgcactacctttcatcacccgcctacggtccagctaagcatgccctagcacgcaaaaccggcgttagctccctttaccatcacgtgagaggcctgatttcctgggcgcagcaagtggagcctgcctttggccagcaagccctggagcagttcgcctcagccgattggccccccatccaaccccgtcagatcgaaggaagactcgggtga

SEQ ID NO: 8962 - RNA, 1167 nt, unidentified
  source 1..1167: mol_type = other RNA; note = synthetic construct
atgagcacacctagtcctcaacgttacgcgtcaggcgcacggcagagaggagtggaccctgcaaccctcaaaaacgcgttggctactttcgcccgcatccgcacgacagacccacggatcactcctgtcctgacactgcgccacttttctgtgctcaccgagctgccctatcgctttctccggggaacagtagcaaggagtgggctagtggaatatcgaactgtctacctgaagaagaggattcccggacggtctgctaagcgaatgatttctatacccccgccatccttagcctccgcccagagatggatcgtggatcatattctcagatacgcccgggtgcaccccgcctcatttgctttccaccccgactcctcaccagtacatgccgctgagcagcatccaaacactaagtggctcctcaaagtggatattgaggatttctttcattcagtgagcgagggaaccgtgagcgcaatattcttcaggctcggcttccctaagctgctggccttcgagtttgcaagactgtgtacgatctccattgacagaggcagatcgcgcaatccggctccgcatgccggacctataactgcgtatgcgtacggttatgaagggtttcttcctcaaggcgcaccaaccagtccaatgttggccaacctggctatgttgcgtgtcgatgctcttctggccgatctggcagaggagcgcgggttacgctactctcgatacgccgatgacctggcctttagcgctgataacaatcgaagccttgcagaaatgcataggctacagagagacgtctgccagatcctgaatgacgcaggttttcagcataataggcgcaaaacagttatccgaggccctgggacacggaggattatcctagggatgctggttgacggacccaccccacgtcttcagagggcgtacaaggatattatcaggttacacctccactatttggcaagccctgcctacgggccagctaaacacgctcttgcccggaaaaccggtatctcttccctgtatcaccacgttcggggcctgatagcctgggcccaacacgtggaacccgccttcggcaggcaggctttggagaagttcacctccgtcaattggcccaccatccagcccagatgggttgaaagaggcagtaacgactga

SEQ ID NO: 8963 - RNA, 1170 nt, unidentified
  source 1..1170: mol_type = other RNA; note = synthetic construct
atggccgccccttctccccaacgctacttgtcaggtggcaggcgtcaaggcgtggcaaccgtcacccttgacaatgcactggctgctttcgcacgcctgagggagacagatccgagaatcacccccgtcctcactttacggcacttcagtgtggtaactggcttgccgtacttcttcctgcgaagaagtgtcgcccggagggcgcacatcggctataggtttgtgtacttaaggaagagaatcccaggtagatcttctatgcgtatgatctctattccacctcccagcttggcagctgctcagcgatggctggttgacaacgtgcttaggtatgttgaaccacaccctgccagttttgccttccatcctgacagctcacccgtcttggccgccgagcaacaccctgatactcagtggctgctgaaagtggacattgaagatttcttccattccgtcagcgagagacacgtctccgcgatttttgcaagtctcggattccctaagctgctggcttttgaatttgcaaggctctgcactattggcctggatcgcgggcccggaagaaatcctgcccctcaccccagccccatcgctctttatcagtccaacttcgaaggatttctgccacagggagctcccaccagcccgatggtagccaacctggccatggttcgcacagacgagtttctatctatgcttgcggaagctcgcgggttccgctattctcgctacgcagacgatttagctttctcgtccgacaagtcgcggacaatcgctgagatgcgagggctgcagcgagaagtgtgtcggatactgaacgaggccgggttccggcccaatcatcgcaaaacagttataagagggccaggtacccgaagagtagtgcttgggctcctcgtgaatggccccacgccaaggctatcccgggcatttaaagacaacatccggctgcacctccactacttgacgagcccagatcatggaccggccaagcatgctctggcaaggaagaccggcacctcaagcctgtaccatcacgtgcgtggcctcattgcctgggccacacaggtggagccagcctttggagctgccgcgctacggacttttagatcagcctcctggccactcatacagcctcaggaggtgggtgaggaagatgactggctgtga

SEQ ID NO: 8964 - RNA, 1185 nt, unidentified
  source 1..1185: mol_type = other RNA; note = synthetic construct
atgcccgtgccatctccccagaggtatgcctccggtggaaggcgccagggaatcgactcacagaccctagacaatgccattgcggcaatcacacggataagggcaactgatccacgcatcacgccagtccttacactcagacaccttagtgtgttaaccgagctgccttttttgtttttacgacgaaaagtcgctcggcaggaacgtgtgggctatcggacaatattcctgaagaagcgaattccaggtagatcatccatgcgccgcatcagtatcccgcccaagagcctggcacatgtccagaactggctggttcagaacgtactgcaatacacaagtgctcaccccgcaagtttcgcttttcaccctgactcttcgcccatcttggctgcggagcagcacccaaataccaagtggcttctgaaagtagatattcaggatttcttccactcaataagcgaggggactgttgcctccatcttttctaggttgggttttccgaagctccttgcattcgagctggggaggttgtgcactattccctgtaaccggggcccctctagaaatcctaaaccacatccatcccccatcgagttttaccgttccgacttcgaggggtatctgcctcaaggcgccgccacaagtcccatgctggccaatctcgctatgtccatgaccgatcaaagactgtcggccctggcagaaaaattcggattccgctacagccgttacgctgacgatctcgctttctcaagcccaaacgatcacgccttagccgacctccagaagcttaaacgcaacgtgtttcacattctcaacagctccggattcaggcctaatttgagaaaaaccgtcattcgcggccctggggcacgaaggattgtgctcggcatgctggtggatggtaaggaacccaggctgagcaaggagtttaaggacaacatccggctgcatctgtattaccttaccagccctcagcatgggcctcagaagcacgccctatctagaaagacgggcgtgtcatccatgtaccatcatgttagaggcctgattgcctgggcccggcaagtcgaaaaaacttatggagaggaagcgctggctaagtttaaaagcgtgaattggccacctatccagccgcggatggtgcactgctctctcgacgatctaagagataaagacgactga

SEQ ID NO: 8965 - RNA, 1035 nt, unidentified
  source 1..1035: mol_type = other RNA; note = synthetic construct
atgcgacacctgtccgcactcactggccttccatttctgtttttgaggcgcaccgtggcccgaaaggagcacgtgaactaccggaaggtgtacctgaaaaagagaattcctggacggtctaccaaacggctgatcctgatccctccgaaatcactagcggtagcacaaggttggctggtccaaaacgtcctcagatatacagtcgctcatccagcaagctttgcgttccatccagaaagcagtcccgtgcaagccgcagaacagcacccttctacgaagtggctgctcaaggttgacatacaggatttctttcatagtgtctcagagggacgtgtctctgctatctttgccggtctaggcttccctaaattgttggccttcgagttagccaggctttgcacagttgctgccgaccgtggcgcgggaaggaatcctcaaccgttcgcgggacccattaactattatgacaatcccttcgaagggtttctgcctcagggtgctgccacaagtcccatgttagctaacctcgccatgctgtccgtggacgaagccctttccgggatcgccaaacgcaccgggttccgctactcccgctacgctgacgatctggctttcagcaccaagaaagactccagcgtagctcagatgaatcgactcaaaagggaggtgattgcagtgctgaacgataatggctttcgccctaatctgaggaagaccgtgataagagggcccggcagcaggagaatcattcttggaatgcttgttgatgggcccgaccccagactcagcaaggagtacaaggataacatacggctgcacttatacttcctgacttcacagaagcacggcccacagaagcatgctctatcaagaaaaacaggtgtgtcgtctttgtatcaccatgttcggggcctgatcagttgggccaaacaggtggagccagcatatgggcagttggcactcgagaagtttcagactgccgattggccaccaattcagccccgtcggatttttaagatcgaggccgaattctga

SEQ ID NO: 8966 - RNA, 1167 nt, unidentified
  source 1..1167: mol_type = other RNA; note = synthetic construct
atgcccgccccaaacccgcaacgctacaggagccaaggcagactagaaggagtagatgacactgtgctggatcacgcggtcgaaaccttcgagagaattcgcgcagtggacccacgcattacgcctgtgttaacgcttaggcacctgagccacctgaccgacatcccgtttctgcatttgcgagatctcgtcggacgtagggcccatcgcccctacaaattcttttatctcaagaaacggatcccaggccggaatagagtccggatgatctccgttcccaatggcactctgatgtccctgcagaggtggatcgtggataacatactgcagttcacacggcctcacgccgccagttttgctttccatcccgattgtcggccgtatgaagccgccgccgaacattgcggctgtgcatggctgctaaaaattgacttggaggagttctttcacaccgtctctgaggggagagtcgccgcggtgtttgagaacctgggtttccctcggctgttgtcctttgagttcgcaaggttgactacagtggcatgtgaacgaccaggatcaagacctgatcccggtgagcgatggccagctattccctactatcagtgcgagcatgagggcatgcttcctcagggtgcccccacatcacctatgctggccaacctggctatgctcaaggtcgacgaaatcctctcggctctggctgaggaatacgggatgacctttactaggtacgctgacgacttggcttttagttgcggggaggaatacgacttcgctcacgtacagagattcaagagactcgtgctcgagaagcttaataagtctggcttcaggcccaaccacaggaagactgtaatacgtggccctggcacaaggcggattgtgctaggtatgctggtggatagtgagcggccacgcctccccagagaatacaaagataatatacgaatgcaccttcactatctcaccagcgaatcccatgggcctagcgttcatgcagcatcacgacagacctctgtgtctggaatcttccaccacgttcgcgggttaatcgcatgggcggagacagttgaacctgactatggagcccgtgccttagagaactttgaaagcgtggactggcccccacttgagccaaatcgcctgctggggcatagaggatga

SEQ ID NO: 8967 - RNA, 1173 nt, unidentified
  source 1..1173: mol_type = other RNA; note = synthetic construct
atgtctctcccaagctcacagaggtatcgatcccagggaaggagggagggcgtggatgacgcagtactcaacaacgcattagcagctatgagacgcattcgagctgtggatcctcggattacacccgttctaaccctgcgacacctgtcccacctgatcgatgttccctttttacatctgagagagatagtcgcgaggcgggcccgaagaccttataaattcttctacctgaagaaacggatccccggacgcagtagaatgagaatgatttctgcccctaacgccacgttgcttaagattcagcgctggattgtggaaaatatcttgcaatacaccacggcgcatgaagcgtcctatgcgtttcaccctggttcacgtccctttgacgccgcccaggagcattgtggctgcgagtggctgcttaaaattgacctcgaggatttcttccattccatcagcgagggtcgcatcgctgctgtgttcgcccacctcggcttctctaagcttctgagctttgaactcgctcgcctcgttaccgtggggtgcgaacggcctggaacaagaactgaccccgcaatccggtggccggccattccttactaccagagcaagcacgaaggaatggtaccacagggcgccccgacctcacctatgctgagcaacttagtgatgttcaagacagatgagattttggctcgcttggctgacgcccacggaatgaaatataccaggtatgccgacgatttggccttcagttgtggccccgggaaaaacgaaatccatgttcgtaggttcatgaggctggtgcttgaccaactaaatcacgccggttttcgtccaaatcacaggaagactgcaatacgggggccaggaagccggagaatagtgctcggcatgctggtcgactcagataggccaagactgactcgcgaatacaaggacatgatccgactgcaccttcattatctcacaagtccatcttacgggcctgcactgcatgcactagcccggaaaacttccgtcagtggcatatttcatcacgtgagaggtctgatcgcctggtcgcagatcgtggagcccgattttggggctggggctctgacccgctttgaaggcgtcgattggccccccgtccaaccagacccgtacgatgaggaggcaaatgacacatga

SEQ ID NO: 8968 - RNA, 1170 nt, unidentified
  source 1..1170: mol_type = other RNA; note = synthetic construct
atgccgcccggccctcagagatacagagctcagggtcgtagggagggcgtggatgaaaccgtccttgctaacgcattgtccgttatcgaccgaattcgcgccgccgacccacggataactcctgtgttgactttgcggcacctcagcgagctggtaggggtaccctatccccacctcagggaccttgtagctcggcgcgttccacgatcttataagttcttctatctgaagaaacgcattcccggacgtacttcaactaggatgataagtgtccctaataaaaccttgctcagtatccagcaatggattgtctctgacatcctgaggtttacaagtgcgcatgaagcatcctatgcattccaccccggtggacggcctctagaagctgcagaggagcattgcggctgcgcctggctgcttaaggtggacctgcaggacttttttcacaccatttctgaggggcgagtggccgggatattcgccgaactcggattcaataggctcctggcctttgagctggcccgccttgtgacagttgcgtgtgagcgcgccaaaccatcagatcctgcagctcgatggcctacaatcccttactaccagtgtgcgcacgaagggatgttacctcagggagcacctacatcacccatgctaagcaacctggttatgcataggacagatggagtccttgcacgtctcgctcgggctcacggcatgaggtacagcagatacgcagatgacctagcgttcagctgcggcgccgatcgggatgcagctcatgtgcggagatttaaaaggctggtgctgaagagcttaaatgaggctggctttagaccaaacctgcgcaaaactaccatcagggggcccggtagccggagaattgtccttgggatgttagtggacggtgatagaccacgactgccaaaaggctacaaggacatgattcgcttgcatctccactacctcacgtcgccggattatggaccggccgctcatgcccaggccagaaagacgtccgtgtctggcatcttccaccacgtgagaggcctgatctcctgggccgaaaccgttgagcccgcctacggaaagcaactgctggctcgcttctggagtgccgattggccacccctggagccaacctatctcgatgacctgtccgaagacggggactga

SEQ ID NO: 8969 - RNA, 1176 nt, unidentified
  source 1..1176: mol_type = other RNA; note = synthetic construct
atgccggcacccgccccacagcgatatagaagcgagggacggagaaaaggtgtgcctcccgatgtactcgctaacgccctcgccagcatctcacggataagagacacagacccacggatcgaaccagtcctgaccctgcggcacctggccttcttaacggatgtaccttacaggtacctgcggcaagttgtggctcgcagtgccgccactgggtaccgtacctttagactcaagaaacgagtgccgggccgcagcagaatgaggaccatatcagtgccgcccccatcccttaaggaggtgcagcggtggatcgtggagaatgtcattcagcatgtggccccacacgaggcaagttacgcgtttcaccctggctcctccccttacctagcagccgaggagcattgcgaatgctcttttctgttgaaggtcgatgttcaagacttttttcactcgattggggagggatccgtggctgccgtattcgaagcgatcggatttcagaagttaatttccttcgagatggcgaggcttgtgacaaggcctatccccagttctaaacctgcaccagatcccgccgctaggtgggtcgctataccatattataattatccccatgaaggggtcctgccacagggtgcacctacgagccccatgcttgcgaacctagttatgcgtcacgcggatcagcgactggcaaacctggctactcggatgggcatgagatatactaggtatgccgacgaccttgccttcagcgcacctcatggatctgctattgccttggccgacatgcgccgctgtaggacccaggtgctgcgaattctcaacgagtacggattctcacctaacctcaggaagacagtgatccgcggtcccggctctagacgtatcgtcttagggatgctggttgacggcgatcgccccaggttggcacgggaattcaaggataatctgcgcctgcacctgcactacctcacagccccatctcatggcccggctgcccatgcaatggctagaaaaaccggcgtgagtagcatgtatcaccacgtgcgaggtctgatttcatgggcccagtgtgtcgatcctgaatacgctgcagacgccttggctttgttccgcactgcaaattggcccctcgttcaacccagatggtccggggctagcgacgatgactga

SEQ ID NO: 8970 - RNA, 1164 nt, unidentified
  source 1..1164: mol_type = other RNA; note = synthetic construct
atgaatctacccaatccacagcggtatcgctctgaagggcgaagtctcggagtggatgagattacattggataatgccatagccacaatcaagcgcctgcaggcttcttcgccctcactgcctgcggtcttcacactgagacaccttgcccacctgacccaagtgaaatatgggtacctccgatacattgtgcgccgcaaggtgaattatagacacttccgcatctcaaaaaagctccctggccggaatcggtaccggctcatatcaatcccacctgctaatctgagtaagctgcagagatggatttccaacaacatcctgcgacatctgagcccctcttccgctagctatgcctatcatcccggatctaacccccggtttgcagctgagcagcattgtggctgcgaatggctgatcaaaattgacgttcaagacttcttccatgccatctccgagggacgtattgccgagatcttttataaggcgggctaccccagacttctgagctttgagctggccagaatagtcacgtgtgtgcttccaggcactattaaaagggctgcttcttacagcgccagatggccagttattagtcagtaccagcacgatagggagggtgttctgcctcagggcgctcccacctccccaatgctgagtaacttagccatgcgtgcattagacgaacgacttattgcgctcgccgcaaagaacggtatgatctatacccggtacgcagacgatttagtgttctcttgcaagaacagaaccaaacctactatcgacaaagtgaaacggagcattttgagggagctaagccgcgagggctttcaacctaatctgcgaaaaaccgccgtcaggggacccggttcaaggcgtatcgtattgggtgtgttggtcaatggcaaggaaccgaggctcacgcgcgattttaaggagaatctgagaatgcactttcatttcctaactagtgaaaaacatggaccacacaaccacgccaacaaccgggggacatccatttcagggatataccatcacgtgagggggcttatcgcatgggcaaaggtcatcgaaccggcatacggagctaacttgatggtaaggttccacagcataaactggccatccctccagcctcactccatcttcgaagacatggagaagtga

SEQ ID NO: 8971 - RNA, 1161 nt, unidentified
  source 1..1161: mol_type = other RNA; note = synthetic construct
atgagcctgctatcatcacagagatatcgctctaggggaagaagactaggcatagaccccaccactctggagcgagccgttgccacaattgagaggatccagaggtccgacccacggctgaccccgatcctgactctgcgccatctctccgaattgacaggagcacagtacggctatctgagacgtgtggtagggcgcatactcggcgggtaccggcacgtacattttaagaagagaattcctggcaggtcaaggaggcgggtgatttctatccctcctaggagactgctcgaggttcagcagtggatcgctcaaaacgttttgcggttcgccgagcctagcagggcgagtttcgcttaccacccttcttccagcccagtgctcgccgcagaggaacactgcggctgcgagtggttgcttaaagtggacatcgtcgacttctttcattctatcactgagggccgcgtcagtgccgtcttctaccgactcggatatcccaggctagtggcttttgaactggctcgcctgactacgatgcaactgattcgaggcgctttgcagcgtgacgccgagcgttggtcagctataccttactatcagagcgagtatgaaggtgtgttgccccagggggcgccaacaagtccgatgctgtctaatcttgtgatgaaggatctcgacgaacggcttatcgaattatccaagcagcacgggatgcgctacacccgttatgccgatgatcttgctttttcctgtgggaaaggcagggaccggagccatgtggagcgattcaaaaggttagtcctggcagaactgtcccgggaggggttcaatcccaacctgagaaaaaccgtcattagaggtccaggtacccggcgcattgtgctcggaatgcttgtggatggtccctcgcccaggctcccgagagaattcaaggatatgctgagactgcaccttcattttctgaaatctgagggacatggcccaagcgcacacgcgcaaaagcgacggaagagcatctccggactctaccaccacgtacgcgggttaatcggctgggccatgagtgtggaaccagattacggagcccggattttggccgagtttgagagagttgcatggccccccgttcaacctcgctggtcggaacgaccagacagatga

SEQ ID NO: 8972 - RNA, 1251 nt, unidentified
  source 1..1251: mol_type = other RNA; note = synthetic construct
atgctcgtcagccggtccgacattttcatgcttagaaacggaacctctttgagcaggcgtcgtcttggcggggcatcatgccactatcctcccaatggggtgaaggtgatgcaatcttggagccctcaacagtacaggtatgacggcgctcagcatggtgtaagtgatgaaacaattgagtccgtcattgctagagtggagctgatagcagccgtgaaccccagtatcacccccgtgcttactctgcgccacctgagcgagctctgcggagtggaatacggctttttaagacggattgtgagccggagcactgtaccgtatagagtcttttccttgcgcaagaggatccccgggaggactcgacatagattgatctgtgttcctagaaacgaactgaaggcagcacaggactggatcgtcaggaacattctgaggcacaccaaagcccacggcgcctcattcgcttaccacccaaaatctcggcctgagctgggtgcccatcgccattgcgggtgtgactacctactgaagatcgatataacagacttcttccacagtgtaagtgaaggtaggatttttcgcatcttcgccgaactcggcttttcagagctcgttgccttcgagctggcccgcctgaccacgataatcgcacagggaacggaacggcccgattggatcgccgcagctaggtggccggctataccagcgtatcagacatcatatgagggatttctccctcagggggcgtcaacatccccaatgctatccaacttggccatgttagccttagatgccagaatcgcgggcatggctagcgacgcaggtctggtctacacaaggtacgccgacgatctgaccttttctggacgtaaaccccacgacctcaagtcgatgaagcggttcaaacgaaaggtgtttgatgcactgaatgaagccggcttccggccaaatctgcgcaaaagttctatccgcggacccggggcacgacggattgtcttaggcatgctggttgacggcccacgacctagactcgctaaggagtttaaggacgatctgcgaaagcatcttcattacctgcgcagcaaagattatggaccagctaaacacgcggccgccaataagacctccatttccgctatgttccacatggtgcgtggtcttatcgggtgggctactagggttgagccgcagtacggcagatcttgtctcgtggagttccggaaagtggtgtggccacccttgattccttga

SEQ ID NO: 8973 - RNA, 1287 nt, unidentified
  source 1..1287: mol_type = other RNA; note = synthetic construct
atgggcattcttgacgtgcagtccattggattttccatgctggttagcagatcggatatcttcatgctccgcaacggcacatctctgtcaaggagacggcttgggggtgcatcctgccactacccaccttacggcgtgaaggttatgcaaagttggaacccgcagcaatacagatccgatggtgcacagaagggggtggcctcagagacgattgagtccgccatcgcccggatcaagcttataggagctgccaacgcaaatgtaaccccggttctaactcttcgccatttgagcgagctaactggcgtcgactatggatttttgaggagggtggtgtctcgctcgattgtgccatatagggcattcagcctgcaaaagcgagtgcccggtcgcactcgacacagactgatctgtatccctcgggatgaactgaaaagcgtccaggactggatcctccgtaatatactgacacacaccaaggctcatgaggcctcattcgcatatcatcctcgatcacgcccagagttagccgcccagagccattgcggatgccattaccttctcaagattgatgtgcaggacttcttccatagtgtctcagaggggcgtatttaccagatatttgtggacctgggctttagcgaactcgtaagtctggagctggcaaggctcacgaccattatcgccccaggaactggcaggcctgattgggtggccgctgtcagatggcccaatatccccgcgtatcagacaccatacgaaggctttctccctcagggagcccctaccagtcccatgctgagtaacctagcaatggtagcgctggatgctcggattagcgcaatggcttctaaggctgggatcgtatacacccggtacgctgacgacttgacattttccgcacgcgctccccacgacgctatatctctgaaacggtttaagagggagatttttgccgtgctcaacgaagcgggtttccgacctaatttgaggaaaacctctatccgagggccgggagcccggagaatcgtgttagggatgctggttgacggccccagaccacggttagccaaggaattcaaagatgacctgagaaaacacctgcactatttgaagtctcccgatttcggcccagccaaacacgctgctgccaataaaacctccgtttccgcgatgttccacatggtccgcggcctcatcggttgggccacaagggtcgagcccgaatatgggagaagctgtctggtggaattccgtaaagtcgtgtggccacctctgactccctga

SEQ ID NO: 8974 - RNA, 1152 nt, unidentified
  source 1..1152: mol_type = other RNA; note = synthetic construct
atgcaatcatggtcaccccagcactataggttccacggaacgacagaaaacgtgcccgaaagcatccttgaatccgcgatcagcagaatcgagctgattcgggctcgcaaccccaatatcacgccagtgctcactctgaggcacctgagcttattggccgacgttgactacgtgtttctccggcgggtggcaagtcgtagtacacatccctatagagcttttatgttgaagaagaacgtgcccggccgaacccgactgaggctcatttgcgtaccgaacaaaaatcttaagaagatccaggactggatcgtgcgaaacatactgcgccatacccgcgctcatcgcaagtcctttgcctatcatccctattccagaccggaatttgccgcccaagcccactgcgactgcgattatctgctgaaagtcgatattgaggatttttttcaccgggtgagtgaggggagagtatacaaaatcttctgtgatcttggctactcagaactagtctccctggagttggcgaggataactacaacagtcgccgagggtactgaacgacccatcgagagcattcatttccggtggcctgccattcctgcatacgtttctccttacgagggtttcctcccacagggcgcaccaacatctccaatgctgtctaatctggccatgctcggcttggacgagcagctagattcgatggctagagaagaaggaatagtttatacccggtatgcagacgacctgaccttctccgccagaagacctcacaatgctgcaaccatcaaacgattcaagcgcagggttttagctctgttgaacgacactggcttcaggcctaatcatcgcaagaccatgattcgggggcctggtgccaggcgcattgtgttagggatgctcgtcgatgggccgaaacctcgtcttccaaatgagttcaaggatgaaatccgtaagcatctgtactacctgcagagcgagaaatttgggcccgcccaccactcagcagctaacaaggtcagtatttctactctctaccacatcgtgagaggactgattggctgggctgcgagggtggagccagagtacggaagacggtgtcttcagcagttcaaattaatcgagtggccacctatagacaggggaagctcttga

SEQ ID NO: 8975 - RNA, 1341 nt, unidentified
  source 1..1341: mol_type = other RNA; note = synthetic construct
atgggcacgaccggtgtacagagcattggctttagcatgctggcttctcgatcactgttcttcatgctgcgcacaggtacctccctatacagaaggaggctacggtatgcctcccgtcagtaccctccaaatggagtcaaggtgatgcaggcatggagcccccagcactacaggtatgaagccgaacgccatggagtacaagatgagacaattgacaatgccatcgccaggatcgaactgattgtggccaacaatgctaacgtgacccctgtcttgactttgcgtcacctttctgctatgtccggcgtcgagtacgggttcctccgttcagtgatcagtcgcagcatgatgcgaaaaaagtatcgggtgttctctttgcgcaagaatgttcccggaaggacaaggtacagactgatctgcgtcccaaatgaggagctgaagactgttcaagactggattgtgaggaatatcctgaggcacacgcgaagccatcctgcgtcttacgcctatcaccccaaatccagacccgaattcgccgccaaggcccactgtggctgtgattacttactgaaggtggatatccaggatttttttaacagggtcaccgaaggcaagattactagaatttttagggacttagggtttagtgacctggtgagttttgagctcgcacggctcacaaccgtgacagcgcaaggtatggagctccctgagggactgagcgaaagacggtggccggccatccctgcttaccagagccggtatgagggcttcctgccacagggggctccgacatcccccatgttgtccaaccttgcaatgctcgccctcgatgaaaagctgcaggagttagcaagtagtgagggtatctcatacactcggtatgcggacgacctgaccttttctgcccgaaaaccacacgactttgagtcaataaaacggttcaaacgcaaggttcttactgagctgaacgcggcagggttccgccccaaccttcggaagacccatatacgtggcccaggaatgagacgcattgtacttggcatgctggttgatggacaaagacctcgcctcactaaggagttcaaggacgatttgcgacagcacctccattacctgacctccgacgaccatgggcccgctacccatgctcaggcaaacaagacgtcgataggcgggatgtttcacattgtgagaggtaaaatcgggtgggcaacaagagtggaacccgaatatggaagaaaatgcctaattcagttccggaccatcaaatggccacctatcgagcgcgctaaatcaggcactatctctctggacttcgatatgatagatgaaccatga

SEQ ID NO: 8976 - RNA, 1182 nt, unidentified
  source 1..1182: mol_type = other RNA; note = synthetic construct
atgtcaagttggaacccgcagcactataggttcgatggagaacgccagggcgtgcctggagctgtcattgactctgccctcgcgattatggagcgaatccgaagagtcgatccccggatgacccccgtgttcacccttcgccatctaagcgaaatgactggaacacggtacgggcttctccggtccgtagttgctcgccgcacacatccgtacaaggtttttaccctgaagaaggctattccgggaaggactcgcgtcagactcatctgtactccaaatagagagctcaaaaccacccaggactggattgtgagaaacatcttgcaacacacacgtgcacaccccgcctcctacgcttatcatcctgggagccgaccagagtttgccgctcgcatgcattgtggctgcgattttctgctgaaggtggacattgaggacttcttcactagggtcacagaaggtaagatctgcgaagtgttcgagggcttagggtatcccgaccttatagctttcgaactggctcggttgacgaccgtggtggcaagtggtggcaagagccctagcgttgaccctgccgttcggtggcccacgataaaagcctaccaacacgcagccgagggttttctaccacagggcgcccccacctccccaatgctttcaaatctcgtgatgcggcacctggatgatcgctttgcggctatggccgctgcggcgaacatgaaatataccagatacgctgacgatttggccttttctgcaaggaagccccacactagggcaacagtggccgccttcaagcggaaagtcctgagggagctgagcgaggctgggtacagacctaatctgcggaaaactgcaatcaggggcccaggagccaggaggattgtgctcggaatgctggtcgacggccccgaacctcgactgagtcgtgaattcaaggatgatctgcgacagcatcttcactatctggcatcagaggatttcggcccatcgagacacgccgagcgtcagaagctgtctgtgtccacactctaccatcgggtaagagggttaatcgggtgggccatgcgcgtggagcccaaatttggtgctaaatgcttagcccagtttgaagccgtagcctggccacctatcgacatcagatctcctattaacgcaatagactgggacgagttggcatga

SEQ ID NO: 8977 - RNA, 1155 nt, unidentified
  source 1..1155: mol_type = other RNA; note = synthetic construct
atgagtttttggagccctcagcgttaccaattcgaaggggagaaacacgggatcgatgacgacgcaattgcggctagcgtggaggttataaaacggattcagaacatcaacgcacgcctacctattgtgctgactctcagacatttgagttggctgaccgatactaactacggttaccttagaaaagtagtgtctcgggagtctggcaaatataagcgggttttgttcaagaagaaggtacctggccgctcccgctatcgggaaatccacattcccgaggcctccctgcttgcggtgcagaagtggatcacggccaaaattctgtccaatacgtcagcccacccaagttcttttgcatatcacccagacagccagccgatctttgctgcctctaggcattgtggatgcaaatggctgctaaagatcgacattgagaacttctttcatagcatctcagaacgcatggtctataaggtctttcgagatctcgggtatactaagctcttgagcttcgaattggctcgtatcactaccacaaccggcctgtccaataaaaagtctgaggatatctttaggtcagacagctcccgttggccctctatacccaattattactgttcggatgaggggttcctgccgcaaggtgctccctcaagccccatgctcagtaacctcgtgatgaaggctatcgacaaggacttagaatacctcgccaactgcaatggtttcacatacacccgatatgcagacgaccttgccttctcaacagaaaagaacgccacaatagctgatataaataggttcaagaaggaggttaatcggctgttaatcgaggctggctttaatccaaataggcggaaaaccgccattcgcggacctggagcaaggagaattattctgggcatcctggtcgatagcaaaaaccctagactgtctaaggagtacaaggaccagcttaggcagcacctgtactacttgagatcgcaggagcatggcccttccaaacacgccgaagcgagaaagctgagcgtcagtaccctttttcaccatgtgcgaggaaaaattgcctgggcagaaaaagtggagccagagttcggagccctctgcttagaaaaattcgaatccatctcctggcccccactggataactggtga

SEQ ID NO: 8978 - RNA, 1143 nt, unidentified
  source 1..1143: mol_type = other RNA; note = synthetic construct
atgtcctcttggtcctcgcagagatataagtttgagggtgaaacacagggcattgatgactctgtcctggattcctccatctctgctattggacgaatccagaaagttgatgagcggctgccaattattttaacactgaggcacttcagcctcctgaccgactgtcactttgggtatctacggagggtggtatcacgcgagagcagagagtataagcggatcttgttcaagaagaaggttcctgggcgctcacgttaccgcgagatacacgtccccgaacaggagctcctcgaggtgcagcaatgggtgaccgccaaaatcttatccaatactaaagcccatcattctagcttcgcataccaccctaactcccaacctatttttgccgccagccagcactgtggttgtaagtggctgctgaagattgacattgaagacttcttccatagcatcagtgaaagaatggtgtataaggttttcaaagacctgggctataacaaactcttgtcttttgagcttgctaggattacaaccattgtaaaagcgcgcgataagtcacaggctagcagtgatctgacaaagtggccggccatacccacgtactgcaagaactccgagggatttctcccccaaggcgcaccaagtagtcccatgctgtctaatctcgtgatgaagagcgtggacgagaaactcgctactcttgctaagacgaacggattcatctactctagatatgccgacgacctggccttttccactaaactcaacgtgggaatggtcagtatgagacagctgtctaagttggtgtcatgcctgctaagcgcagaaggctttaatctgaataagcggaagactgtcatacgtgggcccggcacccggaccatcatcttgggtatactagtggattccaaaaagccaaggttaagcaaagaatacaaagatgatctgcgacagcacctttattacctgtgcagtcaggaccatgggccatcgaaacacgccgagatacgaaaaatctcagtctcaacccttttccatcacatcagggggaagatcgcatgggcggagaaagttgaacctgaattcggagcatactgcttggaacaatttaatggcatcaagtggccgcctcttggctactga

SEQ ID NO: 8979 - RNA, 1167 nt, unidentified
  source 1..1167: mol_type = other RNA; note = synthetic construct
atgcctgcctggaacccacagcgctaccagcatgaaggaaaaattagggacatcgaccaggggattctcgatagcgtggtccggataataaatcgtattagagccgtggacgcacgacttccagtgatcctgacactgcggcatctgtccgtgcttactgacgtgccgtataagtacctccgtgatgttgtctctagacaggcaggcgattataaacgcgtgctgctaaagaaaagggttcccggtagaacacgacacagagaaatcagcattccaaatcccgtcctggccggcgtacagaaatggatcaacgagaatatactgcagttcacaagtgcacatcccctttcttacgcgtaccaccccgaatcgcaggccgtgtttgcggccactcctcactgtggttgcaggtggctacttaaggtagacctgacggacttcttccactcaatttccgagtccgatgtgtacgctgtgttcaagtctctgggatatagtcctctgttggcttttgagttagctaggctcactaccatgctgtcagcatcttctcggcccgctcccgccgactttactgaaaggtggagcagcatccctgcctacgcctgtgaaaaacagggcgtgttaccccaaggtgcccccaccagcccaatgctgtcgaacctcgtcatgcgggacctcgatgagggattggcccaattggccgaggcagccggttatacctacaccaggtacgctgacgatcttgcttttagcacggccaaggacgtcggactcgagcatgtgcagcggttgagaaagagtgtcctcctgaaattggccaaatccggattttctgggaatctgagaaaaaccgttattcgaggcccaggcgcgcgcaggatggttttagggatcctcgtagatgggcacgaaccacgacttgctcgggaatacaaggatgccctgcggcaacatctgtattatctgttgtcacctgcacacggcccagctaagcacgcaggagctcgtaacctctccgtgagcacactgttctatcacgtgaggggcaagatcgcttgggcagagcgcgttgagccttcattcgggtccgcctgcctagaagagtttgagaaggtcgattggcctccggtagatgtggcaagacaacgcagtcgcgacgcgtga

SEQ ID NO: 8980 - RNA, 1188 nt, unidentified
  source 1..1188: mol_type = other RNA; note = synthetic construct
atgcggatcaccagccctcagcactatgtggcagccggccaaggactagcaattgacccacttgtgctggaaaacgcctcaagagcgataagccaaatctggagtcgcaacatcaacttgtttccgcttcttacactcaatcacctttctgtagcaacaggtctgaactacggttttctcagaagggttgtggcacgcaaaggaggtccgtacttatactcacacttctacatgcggaaacgcgtacctgggagacggaaggtcaggatgatatccattcccgctcctaaattggctcagtgccaaagttggattgtccgccacattttaaagcatgtcccccctcacagcggcagctatgcctaccatccacactccaatccggtgttcgcggcacgacgccacacggaagccgtttggctgattaaagtagacatccaggacttttttcacgccattaatgagcacgctgtttatcgggttttccgtagcctgggctatgcttctattctgtccctggaactcgccaggctgtgcacaatgaccgccgagcgtcccaggcaggcaaaggatccttccgcccgctacgtctcacccgcagtggagtattatcagaccccatacgtgggagtcctaccacaaggggcacccacatccccaatgctatctaacctggtgatgagagatgtagatcagggcctgtccgatctcgcgaaggagtctgccatgcggtttactcgatacgctgatgacatcgtcttctcttgtgccgacaaaaggctcggaagctcagtgagattggtgaggaataagatcctcgagatactgaaccaggccggcttccggccaaatcttagaaaaaccgtcatcagaggacctggggaccgcaaagttgtgttggggatgctggtggattcggctcatccccgattaatgaaggaatttaaggatgagctgcgtctgcatatacactatctgagacatccaaaattcggccctgcccaccatgctttggctcgaaagaccagtgtgactagtatttaccatcatgtgctcggcctcatcttctgggcccggactgtggaacccacctatggggcccggctgctgaaggagttcaagctgatccagtggcctcccatcacgaggcgagactactacgctactgttaggcaggcgggtgactga

SEQ ID NO: 8981 - RNA, 1188 nt, unidentified
  source 1..1188: mol_type = other RNA; note = synthetic construct
atgagaatcacatccccccagcactatgtggcagctgggcacgaacttgcggtggaccccctcgttcttgagaatgcatccaaggtaatttcccgaatctggagtgtcaatcctaacctgtttcccctcttaactcttaatcatctgtccgtcgcctctggagtcgattatgggttcctgcgcaacgtcgtggcgcgcaagacaggtaactaccggcagtttctgatgaggaaacgcgtccctggtcgaaggcgggtaagagttataagcatgcctgtgcccaaactgatgcattgtcagcattggattgtggagaatatcttaaagcacgccaagccgagcccagacagctacgcttatcatccgaactctaatcccgtgttcgcagcccgacgccacacaaattcagtttggctgatcaaggtggatattgaggatttttttgactctgtccacgaacacgatgtgtatagggtatttagatcactggggtacgccggaatactgagcctcgagcttgctcgtatctgtacgatggctgccaaatggaggcccgacactgatgagaggtgggcacgctacaagggccacggtgtcgcttattaccggaaccagtggatcggagtgttgcctcagggcgccccaacctctccaatgctgagcaacctcgtaatgcgcgatgtggatcagaaactggcacggctggcttcgtcaagctgcatgcgattcacacggtacgccgatgacattgtgttcagttgcagcgacaggagaacagccgagactgtgcggtctgtgcgcagtcaaatcctcaccattttgaacgaagccgggttcaggccgaatagaagaaagaccgtgataagaggaccaggcgataggaaactggtcttgggcttgttagttgacggcaagaagccacggctggccaaagaatttaacgacgagataaggatgcacctccattatcttgggcaccctgactttggccctgcccgtcacgccactgcaagaaaaacctcaattgcagctatttaccatcatgttctgggcctaatcttctgggcgcgtgctgtggacaagaccttcggaagtgaactcctacgacagttcaattccatcgcttggcccccagtttccgaaagacattacttcgccaccatggagcaacaagagaaccaccggtga

SEQ ID NO: 8982 - RNA, 1158 nt, unidentified
  source 1..1158: mol_type = other RNA; note = synthetic construct
atgcggcagacttctcctcaacagtataaagctgctggccacgagttagagatagcaccagcagtacttaataacgccgctgcagccatgcagcgtattgctagcataaattcacaattattcccactgctcacactcaaacacctgtccattgagagtgacgttagctatgggttcctgagaaagacagtggctcgggaagcgggtcgctacagacatatatatctacggaagaaggtgccgggacgaaaaaacgtgaggatgatctctatccccgaaggaagattactgcgatgccagaaatggattagtgagaacatcctgcgcttcggcgctccccaccaagctagttacgcctaccaccctggcagcaatccggtgttcgcggcaagagcacacactgaagccaagtggctgatcaaagtggacatacaggacttctttcatgccattagcgagcatcaagtctacagggtgttcaggtcccttggttacgcacgcctcatgtcctttgagcttgcacgactttgcacgatgccatgtgaaagattggaaccagacacagcggatgtcaaatatctggaggctactatcacccattactacagcccttacgttgggatcctccctcagggcgccccaacctcacctatgctgtcaaacctggtgatgaaagagctcgatgccaagttggccaagctggctgacgacaacgccatgaatttctctcgatatgcagatgatattgtgttctcttgcaaagatgcccgtccctcccagagcgtcaaccgcgttaaaaggctgatcctgaaggcgctgaatgatgaggggtttcgcccaaatcttagaaagaccaaggttaggggccccggaacccgcaaggtggtattgggaatcctagtagacgggaagcagccccggttgccccgtgaatacaaagacaagattaggcagcacctccattacctgacccaccctgattttggtcccgccggacatgcttcggccagaaagacaagcgtctcacggatttatcaccacgtctttgggttgatttgttgggccaaggcagtggaaccttcctttggcgaggaagccctccggtcctttaatgccatcaactggcccccaatcagtaggccgaaattctattcttga

SEQ ID NO: 8983 - RNA, 972 nt, unidentified
  source 1..972: mol_type = other RNA; note = synthetic construct
atggctaggtggaacccccagaggtatcaggacgagggcgagaagcaggggatcgatccaggggttcttgacgctgccagcaaagccatcgcaaatatacaagcagtcaacccatctctcccccctatcctgacgcttatgcatctctccaaggtgacagaagtgaattacccttatctccgggagatagtcgggaggaagattgacccctacaagtccttcgccctgcgaaaacgaaccccaggcttgcaccggacccgtactatccatgtgcccgaggactaccttttaacagtgcagcggtggatttcgcgcgccattttgagacaggctgcccctcattccgccagcttcggctatcaccccgggtcaagccctgtaactgcagcacggcggcacagaaatgcgaaatggctgataaagattgacctgaaagacttctttgataatatccgcgaaccagctgtgttcgacgtctttagaagcctggggtacggctccctcatcagttttgagatggctcgcattgtgaccagagccccagatgcaaagcgggcccaaattgccatcgatgaacacagaatccccttctactctgtggacagtaatggttttctgcctcagggtgcaccgacaagccctatgctgtctaacctggtaatgaggggcctggatgctaaattgcaggagctcgccaacgaacacgatttccgctactcacgctatgccgacgatctagtcttttcttgccgtgaccagaagtcacgaagtgctgcgcagaccctgcgtgatgccgcacttcaagcgttgagggctggaggctttacgccaaacatgaggaagacaactattgtggctccgggcggtagaaaaatcgttctgggactcttaggggccgtcgaagttcaaggatttttctggggactattcgtgatccaggcagccgacggtaccatatgtgcggatggatga

SEQ ID NO: 8984 - RNA, 1128 nt, unidentified
  source 1..1128: mol_type = other RNA; note = synthetic construct
atgaggttccctagtctccagcagtataaagcgaagttggtaagctttgccgtggcccagcctctattcagcagacttgtcagggttttactcagaatccgttcaacctccgatagtatataccctatatttaccctccgccacttctgtcaaatcgtgggggcagacttcaagtttctgcgcctggtcattggtcggaaatttccctatacttacactacgttctacctgaaaaagaactccccatctaggggttttcgggaaattaacgtgccctgtaacgagctgagactggtgcagaggtggctggtggaaaacatcatctctcacgtgcacccatcagaacactcctttgcttttcaccctggtagctctccatatgccgccgccgcagagcatcggaacaccaagtggttgctgaaagtagatatcaaggacttcttccattcggtgtctgagcatgaggtttatgatattttctatggcatcggcttccaaaaattactcgcctttgagcttgctcgcatttgtacaattcccagtacagactcagctagtttggtgagtaaggagcgaaaaatcgaggattaccaaagcaatcgaataggcagacttccacagggagccccttccagccccatgttggcaaatctggccatgagaaaagtcgaccatgagattgcctcgtgctgcgctgaatacgacctgaggtttacaaggtacgccgacgatattgcaatctccagcgacgatgactgcgggctcgacaccttaatccagatacgacgacaggtctttcggattctacgggctcacgggttcgatccaaatcctaggaagtcagttatccggaaacccggcgacagaaagatcgtgctcggactgctggtagatactgaacgtccccgccttacgtcagaattcaagaacaatctgcgcatgcatctctattacctgatgaagccgtccggaccatctgctcacgcaaaagcacgcaattcctctatcaccacagtccacgctcacgtgttggggctgattcattgggcccgttacgtggatagcacctatggaaatgcgagacttgcggagttcaagagcgttaactggccgaagggcacttggtga

SEQ ID NO: 8985 - RNA, 1155 nt, unidentified
  source 1..1155: mol_type = other RNA; note = synthetic construct
atggcccacccctgggatcctcagacgtttattgcaggcgccagactagctggcaggtcagaggtcaccatacaagcatgccaagctgctgccatcgctattaagagaacacatccagacctgccagtaatcctgacactgaaccatctcgctcacctggccgacgtaaacgctgacttcctgcaggaagtggcacaccggaagatcgatccatacagagtgttccgagttaagaaaaggggcgtcgcaaatcttgtgcctgcccagccacgccgctataggacgatctgcgttccggagccacgactcatgagggtccagcgttggatcgcccagaacatactgcaggttacaccctctcacacagccagcttcgcatttataaagaacagggacttgaaaggggccgccgagatgcacgtgaatgccaagtgggtggtcaagatggatgtgcggcaattctttgagagcattcctgaagccgcggtctacagagtttttcgaacattcgggtacggggctttactgtcattccagatggctcggatttgtactcggaggccggatcatcaccgacgggacactagagcactccttggacgcgggggtcagaggccttatagattgcaccccatgggccatcttcctcaaggagcccccagctcgcccatgcttgccaatcgcgcggtagaagcactcgaccgtcggttggagaggctcgccatttcagctggctggacatacacgcgctatgcggacgatctggctttttccagaaccaccgacgctacccggtccgaggctatgaagctggtgaagttggcagaactctccttgcagatccatggactggtggtccatagacagaagacctctatcctaagtcccggtagccggaagatcttactgggaatgctagtggacactggaaaacctaaactgaccaaggcctttcgaaacaatatcgagactcacctgtacgccttaacccataaaaaaatcggggccgaaaaacaccgcactaaacgcggcttctcttccctgataggcatgcgtagacatattcttggtctgattgcatatgcacaccaggtggatgaggcgtatgcggccactctctacgcaaaagccaatagtgtggattggaccaggtga

SEQ ID NO: 8986 - RNA, 1155 nt, unidentified
  source 1..1155: mol_type = other RNA; note = synthetic construct
atggcccatcggtgggacccccaaacctttatagggggggccagggtcgctggtagagacgaatacactatcgaagcctgtaaggctgccgctaccgctgtcaaacgtattcacccagatctgcctgtgatattcacactgaatcactttgcgcacttagtagacgtggatgccgactttttggccgaggttgcacataggaagatcgacgcctatcgcgtctttcgagtgaaaaagcggggcgtggctaacctggttagcgcaccatccagacggtaccggaccatttgcgtgcctgaaccacgtctcatgcgcgcccaacgatggattgcgcagaatatcctccaggtcacgccgagtcacagggccagcttcgcattcacaaagggccgcgatctaagaggcgccgctaccagccatgccaacgctaagtggctcgtgaaaatggatgtgcgccagttctttgaatctatctcagaggccgctgtctaccgagtgtttcgggcattcggctacggagccttgctctcattccagatggcgaggatctgcacaagattgcctgaccatcatcactctgataatcgcgatcgattaggtcgcggcggccgtggaccatatagagcacaggctgtgggccaccttccgcaaggtgctccctcaagccctatgcttgcaaacagagctgtggaggccctggaccgaaaggtggagcgcatcgcaaacaaatcaggctggacgtatactaggtatgctgatgacctggccttctcgaggtccgatgacgcccggagaggggatagcatgaaactcgtaaaacttattgagatgagtctgatgtccaatgggctggttgtccaccggcagaaaacttctattaccgcgtccggaggacggaagatcttgcttggcatgctgattgataggggggagcccaagctacccaagtccttcaggaacaacatcgaaacccatttatacgcactcagtcacgctaatatcggggcagagaagcatagggccactagaggatttgcatctctgataggaatgcggcgccatattatgggtctgatcgcacacgcccaccaggtagacaagacatatgccgcgaaactgtacgcccaggttaatctggtggactggaacagatga

SEQ ID NO: 8987 - RNA, 1155 nt, unidentified
  source 1..1155: mol_type = other RNA; note = synthetic construct
atgccatacagatgggattcccaagcatttattgtgggagcaaggtcagagggtaggtccgagagtactatccaagcctgcttagccgcggccacagctgtgaagcgaaaacacccagaccttcctataattttcacgctgaatcacttggcccacctggcagacgtgaacgcggacttccttcaggaggttgctcatcggaaaattgatccctatcgcgtgttcagggttaagaagaggggagtcgctaatgcagtacccgcccccccaagacgctatcggaccatttgcgttcctgaccccaagctcatgcgtgtgcagcgctggattgcccaaaacatcctgcaggcaactccatcccaccatgcctcgttcgccttcaccagagatagggatttggtcgatgccgccaaaaagcatgctggagcaaagtgggtggttaagatggacgtgcgacacttctttgaaagcatattcgaagacagcgtgtaccaggtgtttagaagcttcggctacggcgcactgatcagttttcagatggctcggatctgtactcggctggccgaccataaccgaaacgatgcacgcgctctcttagggagaggcgggagacgcccatatcggcagcatagcaaaggacacttgcctcagggggcacctacttccccgatgcttgctaatcgagtggtagagactctcgatcagaagctggacctgatcgccataaccgcggattgggcgtattctcgatatgctgatgacttagcctttagtcgtattacaacaaccacaagacggcaagccatgtctctcgtcaagaaggtcgaagctgagctcgccaagtttggcctggagactcacagacagaagacaacaatcgtgtctcctgggggtcggaaagtgctgctgggtgtcctgatagatacagacaaaccccgtctgaccaagaacttcaggaataacatcgaaacgcatctatacgcactgacctcacagaaaattggcccggagcagcaccgcctcaaacgcaattttgtttcactaatcgggatgaggaggcatatcctgggccttatcgccttcgctcaccaggtagacgaaacctacgctgccaaactctacacgttgtttaataccgtcaattggaaccggtga

SEQ ID NO: 8988 - RNA, 1158 nt, unidentified
  source 1..1158: mol_type = other RNA; note = synthetic construct
atgagacatccgtggagtagccagcagttccgactgggagccttagcagccgggagatcggaagccattatcgctgcagccgaatctattgctcgggacataaaaagacgaaatgagaatctgcctgtagtgctcacattgcatcacttagctcatctagtggacgtgcccatagaacctcttcagaagatcattttccggcaaatcgacccttaccgggtttatagagtgaagaagcgaggcactcctaatggcgctgctgcgcctccacggaaatacaggacaatttgcgtacctcacccgcagcttatgcggctccagcgctggatcgcccagaatatactcaacgaggtggctccacacgacgcatcctttgcctttacccccaagcgtaacctggttggcgctgcatggagacacaccgaggcgcgatggctgctgaaaatggacgtgaggcacttttttgagtcaatctccgaaaggcaggcctactgggtcttcagaacactggggtatacggctttgctttccttccagatggcccggctgtgtacccgcctgacacagcatggagtcgctgatccacgtagagcagcaggccgcggtcacactggtctgccatactggcaacacccccaagggcatcttccgcaaggtgcgcccaccagtcccatgctggcgaatctcgtgatgaggtctttcgatcgcagggtggaggcacttgcccagtccactggatggggatattcccggtatgctgacgatctggcgttcagccggcgcgatgggagctctagaggagctgcaatgcatttggccaaagcagtggagcacgagctggccttgctgggtctagtgtcacaccgagccaagacatctgttgtccccccaggggccaggaaggttctgttgggcgtcctggtagacagcactaggcccgccctcactagagccttccgtaacaacgtggaaacgcacctatacgctctcaccagcccaaagattggagccgcagcacaccgggctaaaaggggctttgccagttcaatcggcatgaggcgccatatcgaggggttaattgcattcgcccatcaggtcgaccgcgcttatggcgccaaactctacgcccagtttaacgatatcgattggacccgctga

SEQ ID NO: 8989 - RNA, 1170 nt, unidentified
  source 1..1170: mol_type = other RNA; note = synthetic construct
atgaccttcacttgggatcctcagcaatttgaagcaggggctctgggtgctggcttggaccgaagatcagtggaggcagccttggctgcaggagcagccattaaagcttctcatcctgatttaccagtggttctctccctagggcacctggcccacctcactgatgtgtccgcaggcgtgctggacaaaatcgtgcgaagaagacttgacccatacaaggtgtttcgcgtccagaaacggggtacgcccaaagctggtaatgcccccgcgaggcgttacagaaccatctgcgtgcctacaccaggattaatgagggtgcagcggtggattgctcagaatatactcaatgtgataaccccccacgcggcctcctatgctttcactcccaacgtgaagatgtcggatgccatcaagcggcatgccaacgccacctggcttgtcaaagtggacgtccgccatttttttgagagtattagcgagactcaggtgtattggtttttccggcgactgggttacccagccctgctgtgctttgagttagggcgcctctgtacaaggctggctcccgatcaccgcgtatacgccaccgatccacctgttactcctggctctaggccatcagctggccacgacctcccttatccgcccagacttcagggatggctgccgcaaggagcccctacatccccgatgctcgcaaaccatatagttgagcccctggacgtcaagctgtctgctatggccagaagtggggggtggcgctatacacgatacgcagacgacctgcacttcagccggacatctaagttcacgcggaaggcggccgtagattggagtcacgaagtcgagagggaactggtccgcttgggccttagggcgaacagacagaagaccactatcacgcctcccggagcccgtaagctggtattgggcgccctagttgacagctcaacaccacggcttaataggggcttccgcaataacgtagaaacccacctcttcgctctaacccacccagatatcggcgtggacaaacatcaggcaaagcggggattcgctagcacaatcggaatgcgtcgacatgtccaagggctgattgccttcgcaagacaaattgacaggccctacggcgataaattgctggttcagtttgaaagcatcaagtggtga

SEQ ID NO: 8990 - RNA, 1137 nt, unidentified
  source 1..1137: mol_type = other RNA; note = synthetic construct
atgctgcacccttgggatagccaggcttttgcagagggtgcgaaaaagattggccgtagtgacgctacaattgccaatgccttagcagtggccgacgccattaaaaagagtaatgtgaacctacccgtgatcctctccctgggccaccttgcccatttgacagacgtgggcctgccagttctgcggaactataccgagcggagcgatgacccctaccgagtcttccaggttaagaagaaccacgtagggaaagcccccaggcgtcacaggaccatctgcgtcccggagccctccctgatgagagtgcagcggtggattgctcaaaatatcttgaacgcccagaagccacatccaaggtcctatgcgttcgcgccttgtagatctctagtgcaagccgcagagcgccatgcaggatgcagatggctcatcaagatggactttaaagacttcttcgagagcatagacgaacggagggtgtatctggtgttcaggtcaatggggtacggcgccctcttgtctttcgagatggcaagactgtgcacacgtcttcccggtgcctattcagcaaaaccacaggaggcggctgcactctcgactggatacaaatttcagcaaccaggatttctgccacagggggctcccacgtctccgatgttagccaatctcgtcgtacgcgctcttgatcgacggttggaacgcatcgggctgaaatacggttgggtgtacagcagatatgcagatgatttagcgttctccaccaaagacatatcagggagaggcgccgccattgctctcgtgaagcaggttgaacgggaggttcgcgattttgggctgagggaaaacccggctaagactagtatcaccccccctggacaccgcaaagtgcttctgggtctactcgtcgaccgagatcagcctcgcctcaccaagagctttaggaacaatgtagaaacacatctgtttgcccttggccatcctaaggttggcgccatggctcactgtgcagccagaggattcagatctgtcactggcctgcgaaggcacctggctggactgatcgcattcgctcacgccgtggacaagccttacgctgcacgcttgtacgccgattttgacaaggtcgattggtcccggtga

SEQ ID NO: 8991 - RNA, 1137 nt, unidentified
  source 1..1137: mol_type = other RNA; note = synthetic construct
atgaagcatccttgggattcgcagaactttgttcggggggccagagctagtgggagggatctcgacaccatatctgcagccgtgagcattgctaaggcgattaagcaggtcagtccaaacctgcctgttatcttttcgttgagccatctcgcccacttagtggacgtcagtccaaaagacctgcggcccatagttgacaggatgagtgatccttaccgtcacttccggctccggaaaaagtctggtggaaacggaagcaaagcacctaaaagaagattccgcgatatctatgctccacagccccatattcttagaacacaacgttggatcgcacagaacatactgaatctcatccaaccacatccgtcttcctttggcttcgcaccaggctccgatatgctggctgccgcaacccttcactgtgggtgcgcctggctcctgaagatggatgtttcaaattttttcgagtccataacggaacgtcaggcatatcaggtcttcagggaatgcgggtacactgctttattgagcttccaattggcgaggctgtgtacacgatccattgataagaaacactactcccacctcagggagactgagttccctcaccccagcgctacagaaggctttctaccccaaggcgcccccacctctcccatgttggccaacttggctgtgtatagcctggatgtgaagctcaaacagatcgccgacgaactgggctggaaatatagcaggtacgccgacgatattgccttcagcaccgaacagtcagtgtccagaaccgacgcgctgaaactgcgggggattgtcgagggtactctgaagtctttcggactgtcagaaaatagtaataagacccgaatctccccacctggtgcccgcaagatccttcttggcgtactggtggacagagagcgcccgcgactgacgagacggtataaagacaacatcgagacacatctatacgcacttaatcacgagaaaatcggtgtgctcgcccatcaggctaatcgcaagttttcatcagtgactggcatgaggcatcacgtgctaggactgatttcttttgcgtatcacgtagaccgcaagtacggaaacaagttatactccgagtacaatcgcgtcaagtggtga

SEQ ID NO: 8992 - RNA, 1137 nt, unidentified
  source 1..1137: mol_type = other RNA; note = synthetic construct
atgaagcatccttgggatagccagacattccgacggggtgcaagggaaaacggacttgacgcagtttccatagaggcagccctgagcattgccaaggccatcaagtctactgcccccgacctgccagtcatcttttccctgtcccatttggctcatctagtcgatgttagccccaagcacctgcgcccaatcgtggatagaatgtctgatccatatcggcacttccggctccgaaagaaaagtgggagaaaggggagtaaagctcctcgcagaagatatcgtgatatttatgctcctcagccccacttgctgcgcactcaacgttggatcgctcagaatattctcaacgtccttaaaccccattcctcttcgtttgctttcgctcccgatagcgatatgttggacgccgctacccagcactgcggatgcacttggctgctcaaaatggacgtgtcaaacttctttgaaagtattacagagaggcaggcatatcaggtgtacaggggttgtggctacaccgccctgctctcttttgaactcgcccgcctgagtacgcggagcgttgaccagaagcattatttccaccttcaagagtcagaatttccgcatcctgaagcagtggagggatacttacctcaaggggcccccacctcaccaatgctggccaatcttgcagtgcgtcccctagatatgaaattgaagaggatcgctgccgagctgggctggaagtacacgaggtatgcagatgacatggccttcagcaccgaccgcgtaagaacccggaaggaagcgctgcagctgaaggccatagtggagacagccttaaccaggttcggcttaagcgtcaatcaatccaagactcgcatctcacctccaggagctcgcaaagtgctgctcggcctgctaattgatcgggagcggccgaggctcacacgacagttcaaagacaacatcgagacacatctgtacgcgttgaatcacgcaaagatcggtgcgcaggctcacagggacaaaagagggttttcttccatcactggcatgagacatcacattagaggccttatagcgttcgcccaccacgtagacccagactacgcccagaaactctacaaggactttaaccgaattaaatggtga

SEQ ID NO: 8993 - RNA, 1143 nt, unidentified
  source 1..1143: mol_type = other RNA; note = synthetic construct
atgagtcacccttgggactcacagaccttcacagccgcagcacgtgctgcaggtcgcagtgatgcagtgattgatgcctccttaagggcggcgacgtatatcaaagacaggcaccctgacttgcccgttattttaaccctagcccacctcgcacacctgactgatgtctcaggggagtttttacgcggagtagtggatcgcgagacagatccctatcgtgtctttcagctgaataaaagatccagacccaacgcgccccaacgcgctcatcgaaccatttgtgtgcctcacccactgctgatgagaactcagagatggatagcacagaacatcctgaatgtcatcgatccgcacagagcctcattcgccttcgcaccgaaacgcgacattgtgcaggctgctaagagacacgccggctgccgatggctggtgaagctggacgtcactgatttcttcacctccatcagggaagatgctgtgtacagggtgtttcgcgcattgggatacggggccctcattagctttgagctcgcccgtctttgcacaagggccccaggaagcagccggaggaagcatagagctagccatgaccaacgactcccataccatcggaagcactgcggatttctcccccagggagcccctactagccccatgctggcaaacctggcttcttaccagctcgacgaggactttgaagcactcgctacatcccgcaactggatctattcgcgctacgccgatgacctagccttttccacaaagcacccgagtaacaggtcagaagccctgcacgtctctcggaaagccgaggcattgctggaacggcatgggttcgccgcgaatcgatctaaaacctgtattgcgcctccaggtgctcggcgtctggttctggggcttttggttgaccgaggcgctcctagacttccacgggcattccgggataatatcgaaacgcatctctacgccctggctcatgccgacataggccctcttagacacctaaataaaaggggcttcgcttctttgataggcatgcggaggcacatcgagggcctgatcgcttttgctcatcaggtggagcccacctatgccgccaggctttatgctcggttcaagaaggtagcctggccagcccaatga
